United States Patent 10,058,623 (COMPOSITIONS AND METHODS FOR MODULATING UTRN EXPRESSION) - sequence listing, part 12

SEQ ID NO: 431088 - DNA, 15 bp, Homo sapiens
cacattattctggac

SEQ ID NO: 431089 - DNA, 15 bp, Homo sapiens
acattattctggact

SEQ ID NO: 431090 - DNA, 15 bp, Homo sapiens
cattattctggactc

SEQ ID NO: 431091 - DNA, 15 bp, Homo sapiens
attattctggactct

SEQ ID NO: 431092 - DNA, 15 bp, Homo sapiens
ttattctggactctt

SEQ ID NO: 431093 - DNA, 15 bp, Homo sapiens
tattctggactcttc

SEQ ID NO: 431094 - DNA, 15 bp, Homo sapiens
attctggactcttct

SEQ ID NO: 431095 - DNA, 15 bp, Homo sapiens
ttctggactcttctc

SEQ ID NO: 431096 - DNA, 15 bp, Homo sapiens
tctggactcttctca

SEQ ID NO: 431097 - DNA, 15 bp, Homo sapiens
ctggactcttctcag

SEQ ID NO: 431098 - DNA, 15 bp, Homo sapiens
tggactcttctcagt

SEQ ID NO: 431099 - DNA, 15 bp, Homo sapiens
ggactcttctcagtg

SEQ ID NO: 431100 - DNA, 15 bp, Homo sapiens
gactcttctcagtgg

SEQ ID NO: 431101 - DNA, 15 bp, Homo sapiens
actcttctcagtggt

SEQ ID NO: 431102 - DNA, 15 bp, Homo sapiens
ctcttctcagtggtc

SEQ ID NO: 431103 - DNA, 15 bp, Homo sapiens
tcttctcagtggtca

SEQ ID NO: 431104 - DNA, 15 bp, Homo sapiens
cttctcagtggtcag

SEQ ID NO: 431105 - DNA, 15 bp, Homo sapiens
ttctcagtggtcagt

SEQ ID NO: 431106 - DNA, 15 bp, Homo sapiens
tctcagtggtcagtc

SEQ ID NO: 431107 - DNA, 15 bp, Homo sapiens
ctcagtggtcagtca

SEQ ID NO: 431108 - DNA, 15 bp, Homo sapiens
tcagtggtcagtcat

SEQ ID NO: 431109 - DNA, 15 bp, Homo sapiens
cagtggtcagtcatt

SEQ ID NO: 431110 - DNA, 15 bp, Homo sapiens
agtggtcagtcattt

SEQ ID NO: 431111 - DNA, 15 bp, Homo sapiens
gtggtcagtcattta

SEQ ID NO: 431112 - DNA, 15 bp, Homo sapiens
tggtcagtcatttaa

SEQ ID NO: 431113 - DNA, 15 bp, Homo sapiens
ggtcagtcatttaag

SEQ ID NO: 431114 - DNA, 15 bp, Homo sapiens
gtcagtcatttaagg

SEQ ID NO: 431115 - DNA, 15 bp, Homo sapiens
tcagtcatttaaggg

SEQ ID NO: 431116 - DNA, 15 bp, Homo sapiens
cagtcatttaagggt

SEQ ID NO: 431117 - DNA, 15 bp, Homo sapiens
agtcatttaagggtt

SEQ ID NO: 431118 - DNA, 15 bp, Homo sapiens
gtcatttaagggtta

SEQ ID NO: 431119 - DNA, 15 bp, Homo sapiens
tcatttaagggttaa

SEQ ID NO: 431120 - DNA, 15 bp, Homo sapiens
catttaagggttaaa

SEQ ID NO: 431121 - DNA, 15 bp, Homo sapiens
atttaagggttaaaa

SEQ ID NO: 431122 - DNA, 15 bp, Homo sapiens
tttaagggttaaaac

SEQ ID NO: 431123 - DNA, 15 bp, Homo sapiens
ttaagggttaaaacg

SEQ ID NO: 431124 - DNA, 15 bp, Homo sapiens
taagggttaaaacga

SEQ ID NO: 431125 - DNA, 15 bp, Homo sapiens
aagggttaaaacgat

SEQ ID NO: 431126 - DNA, 15 bp, Homo sapiens
agggttaaaacgata

SEQ ID NO: 431127 - DNA, 15 bp, Homo sapiens
gggttaaaacgatat

SEQ ID NO: 431128 - DNA, 15 bp, Homo sapiens
ggttaaaacgatatt

SEQ ID NO: 431129 - DNA, 15 bp, Homo sapiens
gttaaaacgatattg

SEQ ID NO: 431130 - DNA, 15 bp, Homo sapiens
ttaaaacgatattgt

SEQ ID NO: 431131 - DNA, 15 bp, Homo sapiens
taaaacgatattgta

SEQ ID NO: 431132 - DNA, 15 bp, Homo sapiens
aaaacgatattgtat

SEQ ID NO: 431133 - DNA, 15 bp, Homo sapiens
aaacgatattgtata

SEQ ID NO: 431134 - DNA, 15 bp, Homo sapiens
aacgatattgtataa

SEQ ID NO: 431135 - DNA, 15 bp, Homo sapiens
acgatattgtataat

SEQ ID NO: 431136 - DNA, 15 bp, Homo sapiens
cgatattgtataatt

SEQ ID NO: 431137 - DNA, 15 bp, Homo sapiens
gatattgtataattt

SEQ ID NO: 431138 - DNA, 15 bp, Homo sapiens
atattgtataattta

SEQ ID NO: 431139 - DNA, 15 bp, Homo sapiens
tattgtataatttaa

SEQ ID NO: 431140 - DNA, 15 bp, Homo sapiens
attgtataatttaaa

SEQ ID NO: 431141 - DNA, 15 bp, Homo sapiens
ttgtataatttaaaa

SEQ ID NO: 431142 - DNA, 15 bp, Homo sapiens
tgtataatttaaaaa

SEQ ID NO: 431143 - DNA, 15 bp, Homo sapiens
gtataatttaaaaaa

SEQ ID NO: 431144 - DNA, 15 bp, Homo sapiens
tataatttaaaaaaa

SEQ ID NO: 431145 - DNA, 15 bp, Homo sapiens
ataatttaaaaaaaa

SEQ ID NO: 431146 - DNA, 15 bp, Homo sapiens
taatttaaaaaaaag

SEQ ID NO: 431147 - DNA, 15 bp, Homo sapiens
aatttaaaaaaaagt

SEQ ID NO: 431148 - DNA, 15 bp, Homo sapiens
atttaaaaaaaagtt

SEQ ID NO: 431149 - DNA, 15 bp, Homo sapiens
tttaaaaaaaagttt

SEQ ID NO: 431150 - DNA, 15 bp, Homo sapiens
ttaaaaaaaagtttc

SEQ ID NO: 431151 - DNA, 15 bp, Homo sapiens
taaaaaaaagtttca

SEQ ID NO: 431152 - DNA, 15 bp, Homo sapiens
aaaaaaaagtttcat

SEQ ID NO: 431153 - DNA, 15 bp, Homo sapiens
aaaaaaagtttcatg

SEQ ID NO: 431154 - DNA, 15 bp, Homo sapiens
aaaaaagtttcatga

SEQ ID NO: 431155 - DNA, 15 bp, Homo sapiens
aaaaagtttcatgaa

SEQ ID NO: 431156 - DNA, 15 bp, Homo sapiens
aaaagtttcatgaac

SEQ ID NO: 431157 - DNA, 15 bp, Homo sapiens
aaagtttcatgaaca

SEQ ID NO: 431158 - DNA, 15 bp, Homo sapiens
aagtttcatgaacat

SEQ ID NO: 431159 - DNA, 15 bp, Homo sapiens
agtttcatgaacatt

SEQ ID NO: 431160 - DNA, 15 bp, Homo sapiens
gtttcatgaacattc

SEQ ID NO: 431161 - DNA, 15 bp, Homo sapiens
tttcatgaacattct

SEQ ID NO: 431162 - DNA, 15 bp, Homo sapiens
ttcatgaacattcta

SEQ ID NO: 431163 - DNA, 15 bp, Homo sapiens
tcatgaacattctag

SEQ ID NO: 431164 - DNA, 15 bp, Homo sapiens
catgaacattctagt

SEQ ID NO: 431165 - DNA, 15 bp, Homo sapiens
atgaacattctagtc

SEQ ID NO: 431166 - DNA, 15 bp, Homo sapiens
tgaacattctagtca

SEQ ID NO: 431167 - DNA, 15 bp, Homo sapiens
gaacattctagtcat

SEQ ID NO: 431168 - DNA, 15 bp, Homo sapiens
aacattctagtcatg

SEQ ID NO: 431169 - DNA, 15 bp, Homo sapiens
acattctagtcatgc

SEQ ID NO: 431170 - DNA, 15 bp, Homo sapiens
cattctagtcatgcg

SEQ ID NO: 431171 - DNA, 15 bp, Homo sapiens
attctagtcatgcgt

SEQ ID NO: 431172 - DNA, 15 bp, Homo sapiens
ttctagtcatgcgtc

SEQ ID NO: 431173 - DNA, 15 bp, Homo sapiens
tctagtcatgcgtca

SEQ ID NO: 431174 - DNA, 15 bp, Homo sapiens
ctagtcatgcgtcat

SEQ ID NO: 431175 - DNA, 15 bp, Homo sapiens
tagtcatgcgtcatt

SEQ ID NO: 431176 - DNA, 15 bp, Homo sapiens
agtcatgcgtcattc

SEQ ID NO: 431177 - DNA, 15 bp, Homo sapiens
gtcatgcgtcattca

SEQ ID NO: 431178 - DNA, 15 bp, Homo sapiens
tcatgcgtcattcat

SEQ ID NO: 431179 - DNA, 15 bp, Homo sapiens
catgcgtcattcata

SEQ ID NO: 431180 - DNA, 15 bp, Homo sapiens
atgcgtcattcatag

SEQ ID NO: 431181 - DNA, 15 bp, Homo sapiens
tgcgtcattcatagt

SEQ ID NO: 431182 - DNA, 15 bp, Homo sapiens
gcgtcattcatagtg

SEQ ID NO: 431183 - DNA, 15 bp, Homo sapiens
cgtcattcatagtgt

SEQ ID NO: 431184 - DNA, 15 bp, Homo sapiens
gtcattcatagtgtt

SEQ ID NO: 431185 - DNA, 15 bp, Homo sapiens
tcattcatagtgttg

SEQ ID NO: 431186 - DNA, 15 bp, Homo sapiens
cattcatagtgttgg

SEQ ID NO: 431187 - DNA, 15 bp, Homo sapiens
attcatagtgttggt

SEQ ID NO: 431188 - DNA, 15 bp, Homo sapiens
ttcatagtgttggtg

SEQ ID NO: 431189 - DNA, 15 bp, Homo sapiens
tcatagtgttggtga

SEQ ID NO: 431190 - DNA, 15 bp, Homo sapiens
catagtgttggtgag

SEQ ID NO: 431191 - DNA, 15 bp, Homo sapiens
atagtgttggtgagg

SEQ ID NO: 431192 - DNA, 15 bp, Homo sapiens
tagtgttggtgagga

SEQ ID NO: 431193 - DNA, 15 bp, Homo sapiens
agtgttggtgaggaa

SEQ ID NO: 431194 - DNA, 15 bp, Homo sapiens
gtgttggtgaggaag

SEQ ID NO: 431195 - DNA, 15 bp, Homo sapiens
tgttggtgaggaagt

SEQ ID NO: 431196 - DNA, 15 bp, Homo sapiens
gttggtgaggaagtc

SEQ ID NO: 431197 - DNA, 15 bp, Homo sapiens
ttggtgaggaagtca

SEQ ID NO: 431198 - DNA, 15 bp, Homo sapiens
tggtgaggaagtcat

SEQ ID NO: 431199 - DNA, 15 bp, Homo sapiens
ggtgaggaagtcatt

SEQ ID NO: 431200 - DNA, 15 bp, Homo sapiens
gtgaggaagtcattt

SEQ ID NO: 431201 - DNA, 15 bp, Homo sapiens
tgaggaagtcatttg

SEQ ID NO: 431202 - DNA, 15 bp, Homo sapiens
gaggaagtcatttgg

SEQ ID NO: 431203 - DNA, 15 bp, Homo sapiens
aggaagtcatttggg

SEQ ID NO: 431204 - DNA, 15 bp, Homo sapiens
ggaagtcatttgggc

SEQ ID NO: 431205 - DNA, 15 bp, Homo sapiens
gaagtcatttgggca

SEQ ID NO: 431206 - DNA, 15 bp, Homo sapiens
aagtcatttgggcac

SEQ ID NO: 431207 - DNA, 15 bp, Homo sapiens
agtcatttgggcaca

SEQ ID NO: 431208 - DNA, 15 bp, Homo sapiens
gtcatttgggcacac

SEQ ID NO: 431209 - DNA, 15 bp, Homo sapiens
tcatttgggcacaca

SEQ ID NO: 431210 - DNA, 15 bp, Homo sapiens
catttgggcacacat

SEQ ID NO: 431211 - DNA, 15 bp, Homo sapiens
atttgggcacacatg

SEQ ID NO: 431212 - DNA, 15 bp, Homo sapiens
tttgggcacacatgt

SEQ ID NO: 431213 - DNA, 15 bp, Homo sapiens
ttgggcacacatgtt

SEQ ID NO: 431214 - DNA, 15 bp, Homo sapiens
tgggcacacatgttt

SEQ ID NO: 431215 - DNA, 15 bp, Homo sapiens
gggcacacatgtttc

SEQ ID NO: 431216 - DNA, 15 bp, Homo sapiens
ggcacacatgtttca

SEQ ID NO: 431217 - DNA, 15 bp, Homo sapiens
gcacacatgtttcaa

SEQ ID NO: 431218 - DNA, 15 bp, Homo sapiens
cacacatgtttcaaa

SEQ ID NO: 431219 - DNA, 15 bp, Homo sapiens
acacatgtttcaaat

SEQ ID NO: 431220 - DNA, 15 bp, Homo sapiens
cacatgtttcaaatc

SEQ ID NO: 431221 - DNA, 15 bp, Homo sapiens
acatgtttcaaatcc

SEQ ID NO: 431222 - DNA, 15 bp, Homo sapiens
catgtttcaaatccc

SEQ ID NO: 431223 - DNA, 15 bp, Homo sapiens
atgtttcaaatccct

SEQ ID NO: 431224 - DNA, 15 bp, Homo sapiens
tgtttcaaatcccta

SEQ ID NO: 431225 - DNA, 15 bp, Homo sapiens
gtttcaaatccctaa

SEQ ID NO: 431226 - DNA, 15 bp, Homo sapiens
tttcaaatccctaat

SEQ ID NO: 431227 - DNA, 15 bp, Homo sapiens
ttcaaatccctaata

SEQ ID NO: 431228 - DNA, 15 bp, Homo sapiens
tcaaatccctaataa

SEQ ID NO: 431229 - DNA, 15 bp, Homo sapiens
caaatccctaataaa

SEQ ID NO: 431230 - DNA, 15 bp, Homo sapiens
aaatccctaataaaa

SEQ ID NO: 431231 - DNA, 15 bp, Homo sapiens
aatccctaataaaat

SEQ ID NO: 431232 - DNA, 15 bp, Homo sapiens
atccctaataaaatg

SEQ ID NO: 431233 - DNA, 15 bp, Homo sapiens
tccctaataaaatgt

SEQ ID NO: 431234 - DNA, 15 bp, Homo sapiens
ccctaataaaatgtc

SEQ ID NO: 431235 - DNA, 15 bp, Homo sapiens
cctaataaaatgtct

SEQ ID NO: 431236 - DNA, 15 bp, Homo sapiens
ctaataaaatgtcta

SEQ ID NO: 431237 - DNA, 15 bp, Homo sapiens
taataaaatgtctag

SEQ ID NO: 431238 - DNA, 15 bp, Homo sapiens
aataaaatgtctaga

SEQ ID NO: 431239 - DNA, 15 bp, Homo sapiens
ataaaatgtctagaa

SEQ ID NO: 431240 - DNA, 15 bp, Homo sapiens
taaaatgtctagaaa

SEQ ID NO: 431241 - DNA, 15 bp, Homo sapiens
aaaatgtctagaaag

SEQ ID NO: 431242 - DNA, 15 bp, Homo sapiens
aaatgtctagaaaga

SEQ ID NO: 431243 - DNA, 15 bp, Homo sapiens
aatgtctagaaagat

SEQ ID NO: 431244 - DNA, 15 bp, Homo sapiens
atgtctagaaagata

SEQ ID NO: 431245 - DNA, 15 bp, Homo sapiens
tgtctagaaagatac

SEQ ID NO: 431246 - DNA, 15 bp, Homo sapiens
gtctagaaagataca

SEQ ID NO: 431247 - DNA, 15 bp, Homo sapiens
tctagaaagatacac

SEQ ID NO: 431248 - DNA, 15 bp, Homo sapiens
ctagaaagatacaca

SEQ ID NO: 431249 - DNA, 15 bp, Homo sapiens
tagaaagatacacag

SEQ ID NO: 431250 - DNA, 15 bp, Homo sapiens
agaaagatacacaga

SEQ ID NO: 431251 - DNA, 15 bp, Homo sapiens
gaaagatacacagaa

SEQ ID NO: 431252 - DNA, 15 bp, Homo sapiens
aaagatacacagaaa

SEQ ID NO: 431253 - DNA, 15 bp, Homo sapiens
aagatacacagaaaa

SEQ ID NO: 431254 - DNA, 15 bp, Homo sapiens
agatacacagaaaaa

SEQ ID NO: 431255 - DNA, 15 bp, Homo sapiens
gatacacagaaaaaa

SEQ ID NO: 431256 - DNA, 15 bp, Homo sapiens
atacacagaaaaaaa

SEQ ID NO: 431257 - DNA, 15 bp, Homo sapiens
tacacagaaaaaaaa

SEQ ID NO: 431258 - DNA, 15 bp, Homo sapiens
acacagaaaaaaaaa

SEQ ID NO: 431259 - DNA, 15 bp, Homo sapiens
cacagaaaaaaaaaa

SEQ ID NO: 431260 - DNA, 15 bp, Homo sapiens
acagaaaaaaaaaat

SEQ ID NO: 431261 - DNA, 15 bp, Homo sapiens
cagaaaaaaaaaata

SEQ ID NO: 431262 - DNA, 15 bp, Homo sapiens
agaaaaaaaaaatac

SEQ ID NO: 431263 - DNA, 15 bp, Homo sapiens
gaaaaaaaaaatact

SEQ ID NO: 431264 - DNA, 15 bp, Homo sapiens
aaaaaaaaaatactg

SEQ ID NO: 431265 - DNA, 15 bp, Homo sapiens
aaaaaaaaatactgg

SEQ ID NO: 431266 - DNA, 15 bp, Homo sapiens
aaaaaaaatactggt

SEQ ID NO: 431267 - DNA, 15 bp, Homo sapiens
aaaaaaatactggtt

SEQ ID NO: 431268 - DNA, 15 bp, Homo sapiens
aaaaaatactggttt

SEQ ID NO: 431269 - DNA, 15 bp, Homo sapiens
aaaaatactggtttt

SEQ ID NO: 431270 - DNA, 15 bp, Homo sapiens
aaaatactggttttt

SEQ ID NO: 431271 - DNA, 15 bp, Homo sapiens
aaatactggtttttg

SEQ ID NO: 431272 - DNA, 15 bp, Homo sapiens
aatactggtttttga

SEQ ID NO: 431273 - DNA, 15 bp, Homo sapiens
atactggtttttgag

SEQ ID NO: 431274 - DNA, 15 bp, Homo sapiens
tactggtttttgagt

SEQ ID NO: 431275 - DNA, 15 bp, Homo sapiens
actggtttttgagtt

SEQ ID NO: 431276 - DNA, 15 bp, Homo sapiens
ctggtttttgagttc

SEQ ID NO: 431277 - DNA, 15 bp, Homo sapiens
tggtttttgagttct

SEQ ID NO: 431278 - DNA, 15 bp, Homo sapiens
ggtttttgagttctt

SEQ ID NO: 431279 - DNA, 15 bp, Homo sapiens
gtttttgagttctta

SEQ ID NO: 431280 - DNA, 15 bp, Homo sapiens
tttttgagttcttat

SEQ ID NO: 431281 - DNA, 15 bp, Homo sapiens
ttttgagttcttatt

SEQ ID NO: 431282 - DNA, 15 bp, Homo sapiens
tttgagttcttattt

SEQ ID NO: 431283 - DNA, 15 bp, Homo sapiens
ttgagttcttatttt

SEQ ID NO: 431284 - DNA, 15 bp, Homo sapiens
tgagttcttatttta

SEQ ID NO: 431285 - DNA, 15 bp, Homo sapiens
gagttcttattttac

SEQ ID NO: 431286 - DNA, 15 bp, Homo sapiens
agttcttattttact

SEQ ID NO: 431287 - DNA, 15 bp, Homo sapiens
gttcttattttactg

SEQ ID NO: 431288 - DNA, 15 bp, Homo sapiens
ttcttattttactgt

SEQ ID NO: 431289 - DNA, 15 bp, Homo sapiens
tcttattttactgtg

SEQ ID NO: 431290 - DNA, 15 bp, Homo sapiens
cttattttactgtga

SEQ ID NO: 431291 - DNA, 15 bp, Homo sapiens
ttattttactgtgac

SEQ ID NO: 431292 - DNA, 15 bp, Homo sapiens
tattttactgtgaca

SEQ ID NO: 431293 - DNA, 15 bp, Homo sapiens
attttactgtgacat

SEQ ID NO: 431294 - DNA, 15 bp, Homo sapiens
ttttactgtgacatt

SEQ ID NO: 431295 - DNA, 15 bp, Homo sapiens
tttactgtgacattc

SEQ ID NO: 431296 - DNA, 15 bp, Homo sapiens
ttactgtgacattca

SEQ ID NO: 431297 - DNA, 15 bp, Homo sapiens
tactgtgacattcag

SEQ ID NO: 431298 - DNA, 15 bp, Homo sapiens
actgtgacattcagg

SEQ ID NO: 431299 - DNA, 15 bp, Homo sapiens
ctgtgacattcagga

SEQ ID NO: 431300 - DNA, 15 bp, Homo sapiens
tgtgacattcaggat

SEQ ID NO: 431301 - DNA, 15 bp, Homo sapiens
gtgacattcaggatg

SEQ ID NO: 431302 - DNA, 15 bp, Homo sapiens
tgacattcaggatgt

SEQ ID NO: 431303 - DNA, 15 bp, Homo sapiens
gacattcaggatgtt

SEQ ID NO: 431304 - DNA, 15 bp, Homo sapiens
acattcaggatgttt

SEQ ID NO: 431305 - DNA, 15 bp, Homo sapiens
cattcaggatgtttt

SEQ ID NO: 431306 - DNA, 15 bp, Homo sapiens
attcaggatgtttta

SEQ ID NO: 431307 - DNA, 15 bp, Homo sapiens
ttcaggatgttttaa

SEQ ID NO: 431308 - DNA, 15 bp, Homo sapiens
tcaggatgttttaag

SEQ ID NO: 431309 - DNA, 15 bp, Homo sapiens
caggatgttttaagc

SEQ ID NO: 431310 - DNA, 15 bp, Homo sapiens
aggatgttttaagct

SEQ ID NO: 431311 - DNA, 15 bp, Homo sapiens
ggatgttttaagctc

SEQ ID NO: 431312 - DNA, 15 bp, Homo sapiens
gatgttttaagctcc

SEQ ID NO: 431313 - DNA, 15 bp, Homo sapiens
atgttttaagctcca

SEQ ID NO: 431314 - DNA, 15 bp, Homo sapiens
tgttttaagctccat

SEQ ID NO: 431315 - DNA, 15 bp, Homo sapiens
gttttaagctccatg

SEQ ID NO: 431316 - DNA, 15 bp, Homo sapiens
ttttaagctccatgt

SEQ ID NO: 431317 - DNA, 15 bp, Homo sapiens
tttaagctccatgtt

SEQ ID NO: 431318 - DNA, 15 bp, Homo sapiens
ttaagctccatgttt

SEQ ID NO: 431319 - DNA, 15 bp, Homo sapiens
taagctccatgtttt

SEQ ID NO: 431320 - DNA, 15 bp, Homo sapiens
aagctccatgttttt

SEQ ID NO: 431321 - DNA, 15 bp, Homo sapiens
agctccatgttttta

SEQ ID NO: 431322 - DNA, 15 bp, Homo sapiens
gctccatgtttttaa

SEQ ID NO: 431323 - DNA, 15 bp, Homo sapiens
ctccatgtttttaat

SEQ ID NO: 431324 - DNA, 15 bp, Homo sapiens
tccatgtttttaata

SEQ ID NO: 431325 - DNA, 15 bp, Homo sapiens
ccatgtttttaatac

SEQ ID NO: 431326 - DNA, 15 bp, Homo sapiens
catgtttttaatact

SEQ ID NO: 431327 - DNA, 15 bp, Homo sapiens
atgtttttaatacta

SEQ ID NO: 431328 - DNA, 15 bp, Homo sapiens
tgtttttaatactac

SEQ ID NO: 431329 - DNA, 15 bp, Homo sapiens
gtttttaatactaca

SEQ ID NO: 431330 - DNA, 15 bp, Homo sapiens
tttttaatactacat

SEQ ID NO: 431331 - DNA, 15 bp, Homo sapiens
ttttaatactacatt

SEQ ID NO: 431332 - DNA, 15 bp, Homo sapiens
tttaatactacattt

SEQ ID NO: 431333 - DNA, 15 bp, Homo sapiens
ttaatactacatttg

SEQ ID NO: 431334 - DNA, 15 bp, Homo sapiens
taatactacatttgg

SEQ ID NO: 431335 - DNA, 15 bp, Homo sapiens
aatactacatttggg

SEQ ID NO: 431336 - DNA, 15 bp, Homo sapiens
atactacatttgggg

SEQ ID NO: 431337 - DNA, 15 bp, Homo sapiens
tactacatttggggg

SEQ ID NO: 431338 - DNA, 15 bp, Homo sapiens
actacatttgggggg

SEQ ID NO: 431339 - DNA, 15 bp, Homo sapiens
ctacatttgggggga

SEQ ID NO: 431340 - DNA, 15 bp, Homo sapiens
tacatttggggggac

SEQ ID NO: 431341 - DNA, 15 bp, Homo sapiens
acatttggggggaca

SEQ ID NO: 431342 - DNA, 15 bp, Homo sapiens
catttggggggacaa

SEQ ID NO: 431343 - DNA, 15 bp, Homo sapiens
atttggggggacaag

SEQ ID NO: 431344 - DNA, 15 bp, Homo sapiens
tttggggggacaaga

SEQ ID NO: 431345 - DNA, 15 bp, Homo sapiens
ttggggggacaagaa

SEQ ID NO: 431346 - DNA, 15 bp, Homo sapiens
tggggggacaagaaa

SEQ ID NO: 431347 - DNA, 15 bp, Homo sapiens
ggggggacaagaaaa

SEQ ID NO: 431348 - DNA, 15 bp, Homo sapiens
gggggacaagaaaaa

SEQ ID NO: 431349 - DNA, 15 bp, Homo sapiens
ggggacaagaaaaaa

SEQ ID NO: 431350 - DNA, 15 bp, Homo sapiens
gggacaagaaaaaaa

SEQ ID NO: 431351 - DNA, 15 bp, Homo sapiens
ggacaagaaaaaaag

SEQ ID NO: 431352 - DNA, 15 bp, Homo sapiens
gacaagaaaaaaaga

SEQ ID NO: 431353 - DNA, 15 bp, Homo sapiens
acaagaaaaaaagaa

SEQ ID NO: 431354 - DNA, 15 bp, Homo sapiens
caagaaaaaaagaag

SEQ ID NO: 431355 - DNA, 15 bp, Homo sapiens
aagaaaaaaagaagt

SEQ ID NO: 431356 - DNA, 15 bp, Homo sapiens
agaaaaaaagaagtc

SEQ ID NO: 431357 - DNA, 15 bp, Homo sapiens
gaaaaaaagaagtca

SEQ ID NO: 431358 - DNA, 15 bp, Homo sapiens
aaaaaaagaagtcat

SEQ ID NO: 431359 - DNA, 15 bp, Homo sapiens
aaaaaagaagtcatg

SEQ ID NO: 431360 - DNA, 15 bp, Homo sapiens
aaaaagaagtcatgt

SEQ ID NO: 431361 - DNA, 15 bp, Homo sapiens
aaaagaagtcatgtc

SEQ ID NO: 431362 - DNA, 15 bp, Homo sapiens
aaagaagtcatgtca

SEQ ID NO: 431363 - DNA, 15 bp, Homo sapiens
aagaagtcatgtcaa

SEQ ID NO: 431364 - DNA, 15 bp, Homo sapiens
agaagtcatgtcaat

SEQ ID NO: 431365 - DNA, 15 bp, Homo sapiens
gaagtcatgtcaatt

SEQ ID NO: 431366 - DNA, 15 bp, Homo sapiens
aagtcatgtcaattt

SEQ ID NO: 431367 - DNA, 15 bp, Homo sapiens
agtcatgtcaattta

SEQ ID NO: 431368 - DNA, 15 bp, Homo sapiens
gtcatgtcaatttaa

SEQ ID NO: 431369 - DNA, 15 bp, Homo sapiens
tcatgtcaatttaac

SEQ ID NO: 431370 - DNA, 15 bp, Homo sapiens
catgtcaatttaact

SEQ ID NO: 431371 - DNA, 15 bp, Homo sapiens
atgtcaatttaactt

SEQ ID NO: 431372 - DNA, 15 bp, Homo sapiens
tgtcaatttaacttt

SEQ ID NO: 431373 - DNA, 15 bp, Homo sapiens
gtcaatttaacttta

SEQ ID NO: 431374 - DNA, 15 bp, Homo sapiens
tcaatttaactttat

SEQ ID NO: 431375 - DNA, 15 bp, Homo sapiens
caatttaactttatg

SEQ ID NO: 431376 - DNA, 15 bp, Homo sapiens
aatttaactttatgg

SEQ ID NO: 431377 - DNA, 15 bp, Homo sapiens
atttaactttatggt

SEQ ID NO: 431378 - DNA, 15 bp, Homo sapiens
tttaactttatggtt

SEQ ID NO: 431379 - DNA, 15 bp, Homo sapiens
ttaactttatggttt

SEQ ID NO: 431380 - DNA, 15 bp, Homo sapiens
taactttatggtttt

SEQ ID NO: 431381 - DNA, 15 bp, Homo sapiens
aactttatggttttt

SEQ ID NO: 431382 - DNA, 15 bp, Homo sapiens
actttatggtttttt

SEQ ID NO: 431383 - DNA, 15 bp, Homo sapiens
ctttatggttttttt

SEQ ID NO: 431384 - DNA, 15 bp, Homo sapiens
tttatggtttttttt

SEQ ID NO: 431385 - DNA, 15 bp, Homo sapiens
ttatggttttttttg

SEQ ID NO: 431386 - DNA, 15 bp, Homo sapiens
tatggttttttttgt

SEQ ID NO: 431387 - DNA, 15 bp, Homo sapiens
atggttttttttgtt

SEQ ID NO: 431388 - DNA, 15 bp, Homo sapiens
gttgttgtttgttta

SEQ ID NO: 431389 - DNA, 15 bp, Homo sapiens
ttgttgtttgtttat

SEQ ID NO: 431390 - DNA, 15 bp, Homo sapiens
tgttgtttgtttatg

SEQ ID NO: 431391 - DNA, 15 bp, Homo sapiens
gttgtttgtttatga

SEQ ID NO: 431392 - DNA, 15 bp, Homo sapiens
ttgtttgtttatgat

SEQ ID NO: 431393 - DNA, 15 bp, Homo sapiens
tgtttgtttatgatt

SEQ ID NO: 431394 - DNA, 15 bp, Homo sapiens
gtttgtttatgatta

SEQ ID NO: 431395 - DNA, 15 bp, Homo sapiens
tttgtttatgattag

SEQ ID NO: 431396 - DNA, 15 bp, Homo sapiens
ttgtttatgattagc

SEQ ID NO: 431397 - DNA, 15 bp, Homo sapiens
tgtttatgattagca

SEQ ID NO: 431398 - DNA, 15 bp, Homo sapiens
gtttatgattagcaa

SEQ ID NO: 431399 - DNA, 15 bp, Homo sapiens
tttatgattagcaat

SEQ ID NO: 431400 - DNA, 15 bp, Homo sapiens
ttatgattagcaatt

SEQ ID NO: 431401 - DNA, 15 bp, Homo sapiens
tatgattagcaattt

SEQ ID NO: 431402 - DNA, 15 bp, Homo sapiens
atgattagcaatttt

SEQ ID NO: 431403 - DNA, 15 bp, Homo sapiens
tgattagcaattttc

SEQ ID NO: 431404 - DNA, 15 bp, Homo sapiens
gattagcaattttca

SEQ ID NO: 431405 - DNA, 15 bp, Homo sapiens
attagcaattttcat

SEQ ID NO: 431406 - DNA, 15 bp, Homo sapiens
ttagcaattttcata

SEQ ID NO: 431407 - DNA, 15 bp, Homo sapiens
tagcaattttcatac

SEQ ID NO: 431408 - DNA, 15 bp, Homo sapiens
agcaattttcatact

SEQ ID NO: 431409 - DNA, 15 bp, Homo sapiens
gcaattttcatactg

SEQ ID NO: 431410 - DNA, 15 bp, Homo sapiens
caattttcatactgc

SEQ ID NO: 431411 - DNA, 15 bp, Homo sapiens
aattttcatactgcc

SEQ ID NO: 431412 - DNA, 15 bp, Homo sapiens
attttcatactgcct

SEQ ID NO: 431413 - DNA, 15 bp, Homo sapiens
ttttcatactgcctc

SEQ ID NO: 431414 - DNA, 15 bp, Homo sapiens
tttcatactgcctcc

SEQ ID NO: 431415 - DNA, 15 bp, Homo sapiens
ttcatactgcctcct

SEQ ID NO: 431416 - DNA, 15 bp, Homo sapiens
tcatactgcctcctt

SEQ ID NO: 431417 - DNA, 15 bp, Homo sapiens
catactgcctccttt

SEQ ID NO: 431418 - DNA, 15 bp, Homo sapiens
atactgcctcctttc

SEQ ID NO: 431419 - DNA, 15 bp, Homo sapiens
tactgcctcctttcc

SEQ ID NO: 431420 - DNA, 15 bp, Homo sapiens
actgcctcctttcct

SEQ ID NO: 431421 - DNA, 15 bp, Homo sapiens
ctgcctcctttcctg

SEQ ID NO: 431422 - DNA, 15 bp, Homo sapiens
tgcctcctttcctga

SEQ ID NO: 431423 - DNA, 15 bp, Homo sapiens
gcctcctttcctgat

SEQ ID NO: 431424 - DNA, 15 bp, Homo sapiens
cctcctttcctgata

SEQ ID NO: 431425 - DNA, 15 bp, Homo sapiens
ctcctttcctgatac

SEQ ID NO: 431426 - DNA, 15 bp, Homo sapiens
tcctttcctgatact

SEQ ID NO: 431427 - DNA, 15 bp, Homo sapiens
cctttcctgatacta

SEQ ID NO: 431428 - DNA, 15 bp, Homo sapiens
ctttcctgatactat

SEQ ID NO: 431429 - DNA, 15 bp, Homo sapiens
tttcctgatactatt

SEQ ID NO: 431430 - DNA, 15 bp, Homo sapiens
ttcctgatactattt

SEQ ID NO: 431431 - DNA, 15 bp, Homo sapiens
tcctgatactatttt

SEQ ID NO: 431432 - DNA, 15 bp, Homo sapiens
cctgatactattttc

SEQ ID NO: 431433 - DNA, 15 bp, Homo sapiens
ctgatactattttct

SEQ ID NO: 431434 - DNA, 15 bp, Homo sapiens
tgatactattttcta

SEQ ID NO: 431435 - DNA, 15 bp, Homo sapiens
gatactattttctat

SEQ ID NO: 431436 - DNA, 15 bp, Homo sapiens
atactattttctata

SEQ ID NO: 431437 - DNA, 15 bp, Homo sapiens
tactattttctataa

SEQ ID NO: 431438 - DNA, 15 bp, Homo sapiens
actattttctataac

SEQ ID NO: 431439 - DNA, 15 bp, Homo sapiens
ctattttctataaca

SEQ ID NO: 431440 - DNA, 15 bp, Homo sapiens
tattttctataacaa

SEQ ID NO: 431441 - DNA, 15 bp, Homo sapiens
attttctataacaat

SEQ ID NO: 431442 - DNA, 15 bp, Homo sapiens
ttttctataacaatg

SEQ ID NO: 431443 - DNA, 15 bp, Homo sapiens
tttctataacaatgg

SEQ ID NO: 431444 - DNA, 15 bp, Homo sapiens
ttctataacaatggc

SEQ ID NO: 431445 - DNA, 15 bp, Homo sapiens
tctataacaatggct

SEQ ID NO: 431446 - DNA, 15 bp, Homo sapiens
ctataacaatggctg

SEQ ID NO: 431447 - DNA, 15 bp, Homo sapiens
tataacaatggctgg

SEQ ID NO: 431448 - DNA, 15 bp, Homo sapiens
ataacaatggctggt

SEQ ID NO: 431449 - DNA, 15 bp, Homo sapiens
taacaatggctggtt

SEQ ID NO: 431450 - DNA, 15 bp, Homo sapiens
aacaatggctggttt

SEQ ID NO: 431451 - DNA, 15 bp, Homo sapiens
acaatggctggtttt

SEQ ID NO: 431452 - DNA, 15 bp, Homo sapiens
caatggctggtttta

SEQ ID NO: 431453 - DNA, 15 bp, Homo sapiens
aatggctggttttac

SEQ ID NO: 431454 - DNA, 15 bp, Homo sapiens
atggctggttttact

SEQ ID NO: 431455 - DNA, 15 bp, Homo sapiens
tggctggttttactt

SEQ ID NO: 431456 - DNA, 15 bp, Homo sapiens
ggctggttttacttg

SEQ ID NO: 431457 - DNA, 15 bp, Homo sapiens
gctggttttacttgt

SEQ ID NO: 431458 - DNA, 15 bp, Homo sapiens
ctggttttacttgtt

SEQ ID NO: 431459 - DNA, 15 bp, Homo sapiens
tggttttacttgtta

SEQ ID NO: 431460 - DNA, 15 bp, Homo sapiens
ggttttacttgttaa

SEQ ID NO: 431461 - DNA, 15 bp, Homo sapiens
gttttacttgttaaa

SEQ ID NO: 431462 - DNA, 15 bp, Homo sapiens
ttttacttgttaaaa

SEQ ID NO: 431463 - DNA, 15 bp, Homo sapiens
tttacttgttaaaaa

SEQ ID NO: 431464 - DNA, 15 bp, Homo sapiens
ttacttgttaaaaat

SEQ ID NO: 431465 - DNA, 15 bp, Homo sapiens
tacttgttaaaaata

SEQ ID NO: 431466 - DNA, 15 bp, Homo sapiens
acttgttaaaaataa

SEQ ID NO: 431467 - DNA, 15 bp, Homo sapiens
cttgttaaaaataaa

SEQ ID NO: 431468 - DNA, 15 bp, Homo sapiens
ttgttaaaaataaat

SEQ ID NO: 431469 - DNA, 15 bp, Homo sapiens
tgttaaaaataaatc

SEQ ID NO: 431470 - DNA, 15 bp, Homo sapiens
gttaaaaataaatcg

SEQ ID NO: 431471 - DNA, 15 bp, Homo sapiens
ttaaaaataaatcga

SEQ ID NO: 431472 - DNA, 15 bp, Homo sapiens
taaaaataaatcgaa

SEQ ID NO: 431473 - DNA, 15 bp, Homo sapiens
aaaaataaatcgaag

SEQ ID NO: 431474 - DNA, 15 bp, Homo sapiens
aaaataaatcgaaga

SEQ ID NO: 431475 - DNA, 15 bp, Homo sapiens
aaataaatcgaagaa

SEQ ID NO: 431476 - DNA, 15 bp, Homo sapiens
aataaatcgaagaaa

SEQ ID NO: 431477 - DNA, 15 bp, Homo sapiens
ataaatcgaagaaaa

SEQ ID NO: 431478 - DNA, 15 bp, Homo sapiens
taaatcgaagaaaac

SEQ ID NO: 431479 - DNA, 15 bp, Homo sapiens
aaatcgaagaaaact

SEQ ID NO: 431480 - DNA, 15 bp, Homo sapiens
aatcgaagaaaacta

SEQ ID NO: 431481 - DNA, 15 bp, Homo sapiens
atcgaagaaaactat

SEQ ID NO: 431482 - DNA, 15 bp, Homo sapiens
tcgaagaaaactatc

SEQ ID NO: 431483 - DNA, 15 bp, Homo sapiens
cgaagaaaactatcc

SEQ ID NO: 431484 - DNA, 15 bp, Homo sapiens
gaagaaaactatcca

SEQ ID NO: 431485 - DNA, 15 bp, Homo sapiens
aagaaaactatccat

SEQ ID NO: 431486 - DNA, 15 bp, Homo sapiens
agaaaactatccata

SEQ ID NO: 431487 - DNA, 15 bp, Homo sapiens
gaaaactatccataa

SEQ ID NO: 431488 - DNA, 15 bp, Homo sapiens
aaaactatccataat

SEQ ID NO: 431489 - DNA, 15 bp, Homo sapiens
aaactatccataata

SEQ ID NO: 431490 - DNA, 15 bp, Homo sapiens
aactatccataatag

SEQ ID NO: 431491 - DNA, 15 bp, Homo sapiens
actatccataatagc

SEQ ID NO: 431492 - DNA, 15 bp, Homo sapiens
ctatccataatagct

SEQ ID NO: 431493 - DNA, 15 bp, Homo sapiens
tatccataatagctt

SEQ ID NO: 431494 - DNA, 15 bp, Homo sapiens
atccataatagcttt

SEQ ID NO: 431495 - DNA, 15 bp, Homo sapiens
tccataatagctttt

SEQ ID NO: 431496 - DNA, 15 bp, Homo sapiens
ccataatagctttta

SEQ ID NO: 431497 - DNA, 15 bp, Homo sapiens
cataatagcttttat

SEQ ID NO: 431498 - DNA, 15 bp, Homo sapiens
ataatagcttttata

SEQ ID NO: 431499 - DNA, 15 bp, Homo sapiens
taatagcttttatac

SEQ ID NO: 431500 - DNA, 15 bp, Homo sapiens
atagcttttatactt

SEQ ID NO: 431501 - DNA, 15 bp, Homo sapiens
tagcttttatacttt

SEQ ID NO: 431502 - DNA, 15 bp, Homo sapiens
agcttttatactttt

SEQ ID NO: 431503 - DNA, 15 bp, Homo sapiens
gcttttatacttttg

SEQ ID NO: 431504 - DNA, 15 bp, Homo sapiens
cttttatacttttgt

SEQ ID NO: 431505 - DNA, 15 bp, Homo sapiens
ttttatacttttgtt

SEQ ID NO: 431506 - DNA, 15 bp, Homo sapiens
tttatacttttgttg

SEQ ID NO: 431507 - DNA, 15 bp, Homo sapiens
ttatacttttgttgt

SEQ ID NO: 431508 - DNA, 15 bp, Homo sapiens
tatacttttgttgtt

SEQ ID NO: 431509 - DNA, 15 bp, Homo sapiens
atacttttgttgttt

SEQ ID NO: 431510 - DNA, 15 bp, Homo sapiens
tacttttgttgttta

SEQ ID NO: 431511 - DNA, 15 bp, Homo sapiens
acttttgttgtttac

SEQ ID NO: 431512 - DNA, 15 bp, Homo sapiens
cttttgttgtttacc

SEQ ID NO: 431513 - DNA, 15 bp, Homo sapiens
ttttgttgtttacca

SEQ ID NO: 431514 - DNA, 15 bp, Homo sapiens
tttgttgtttaccat

SEQ ID NO: 431515 - DNA, 15 bp, Homo sapiens
ttgttgtttaccatg

SEQ ID NO: 431516 - DNA, 15 bp, Homo sapiens
tgttgtttaccatga

SEQ ID NO: 431517 - DNA, 15 bp, Homo sapiens
gttgtttaccatgac

SEQ ID NO: 431518 - DNA, 15 bp, Homo sapiens
ttgtttaccatgact

SEQ ID NO: 431519 - DNA, 15 bp, Homo sapiens
tgtttaccatgactt

SEQ ID NO: 431520 - DNA, 15 bp, Homo sapiens
gtttaccatgactta

SEQ ID NO: 431521 - DNA, 15 bp, Homo sapiens
tttaccatgacttat

SEQ ID NO: 431522 - DNA, 15 bp, Homo sapiens
ttaccatgacttatg

SEQ ID NO: 431523 - DNA, 15 bp, Homo sapiens
taccatgacttatgt

SEQ ID NO: 431524 - DNA, 15 bp, Homo sapiens
accatgacttatgta

SEQ ID NO: 431525 - DNA, 15 bp, Homo sapiens
ccatgacttatgtac

SEQ ID NO: 431526 - DNA, 15 bp, Homo sapiens
catgacttatgtaca

SEQ ID NO: 431527 - DNA, 15 bp, Homo sapiens
atgacttatgtacat

SEQ ID NO: 431528 - DNA, 15 bp, Homo sapiens
tgacttatgtacatc

SEQ ID NO: 431529 - DNA, 15 bp, Homo sapiens
gacttatgtacatct

SEQ ID NO: 431530 - DNA, 15 bp, Homo sapiens
acttatgtacatctg

SEQ ID NO: 431531 - DNA, 15 bp, Homo sapiens
cttatgtacatctgc

SEQ ID NO: 431532 - DNA, 15 bp, Homo sapiens
ttatgtacatctgct

SEQ ID NO: 431533 - DNA, 15 bp, Homo sapiens
tatgtacatctgcta

SEQ ID NO: 431534 - DNA, 15 bp, Homo sapiens
atgtacatctgctat

SEQ ID NO: 431535 - DNA, 15 bp, Homo sapiens
tgtacatctgctatt

SEQ ID NO: 431536 - DNA, 15 bp, Homo sapiens
gtacatctgctatta

SEQ ID NO: 431537 - DNA, 15 bp, Homo sapiens
tacatctgctattag

SEQ ID NO: 431538 - DNA, 15 bp, Homo sapiens
acatctgctattaga

SEQ ID NO: 431539 - DNA, 15 bp, Homo sapiens
catctgctattagaa

SEQ ID NO: 431540 - DNA, 15 bp, Homo sapiens
atctgctattagaag

SEQ ID NO: 431541 - DNA, 15 bp, Homo sapiens
tctgctattagaagt

SEQ ID NO: 431542 - DNA, 15 bp, Homo sapiens
ctgctattagaagta

SEQ ID NO: 431543 - DNA, 15 bp, Homo sapiens
tgctattagaagtag

SEQ ID NO: 431544 - DNA, 15 bp, Homo sapiens
gctattagaagtagc

SEQ ID NO: 431545 - DNA, 15 bp, Homo sapiens
ctattagaagtagca

SEQ ID NO: 431546 - DNA, 15 bp, Homo sapiens
tattagaagtagcaa

SEQ ID NO: 431547 - DNA, 15 bp, Homo sapiens
attagaagtagcaag

SEQ ID NO: 431548 - DNA, 15 bp, Homo sapiens
ttagaagtagcaagc

SEQ ID NO: 431549 - DNA, 15 bp, Homo sapiens
tagaagtagcaagca

SEQ ID NO: 431550 - DNA, 15 bp, Homo sapiens
agaagtagcaagcat

SEQ ID NO: 431551 - DNA, 15 bp, Homo sapiens
gaagtagcaagcatt

SEQ ID NO: 431552 - DNA, 15 bp, Homo sapiens
aagtagcaagcattt

SEQ ID NO: 431553 - DNA, 15 bp, Homo sapiens
agtagcaagcatttg

SEQ ID NO: 431554 - DNA, 15 bp, Homo sapiens
gtagcaagcatttga

SEQ ID NO: 431555 - DNA, 15 bp, Homo sapiens
tagcaagcatttgaa

SEQ ID NO: 431556 - DNA, 15 bp, Homo sapiens
agcaagcatttgaac

SEQ ID NO: 431557 - DNA, 15 bp, Homo sapiens
gcaagcatttgaaca

SEQ ID NO: 431558 - DNA, 15 bp, Homo sapiens
caagcatttgaacat

SEQ ID NO: 431559 - DNA, 15 bp, Homo sapiens
aagcatttgaacatt

SEQ ID NO: 431560 - DNA, 15 bp, Homo sapiens
agcatttgaacatta

SEQ ID NO: 431561 - DNA, 15 bp, Homo sapiens
gcatttgaacattag

SEQ ID NO: 431562 - DNA, 15 bp, Homo sapiens
catttgaacattagt

SEQ ID NO: 431563 - DNA, 15 bp, Homo sapiens
atttgaacattagtt

SEQ ID NO: 431564 - DNA, 15 bp, Homo sapiens
tttgaacattagtta

SEQ ID NO: 431565 - DNA, 15 bp, Homo sapiens
ttgaacattagttat

SEQ ID NO: 431566 - DNA, 15 bp, Homo sapiens
tgaacattagttatc

SEQ ID NO: 431567 - DNA, 15 bp, Homo sapiens
gaacattagttatcc

SEQ ID NO: 431568 - DNA, 15 bp, Homo sapiens
aacattagttatcct

SEQ ID NO: 431569 - DNA, 15 bp, Homo sapiens
acattagttatcctg

SEQ ID NO: 431570 - DNA, 15 bp, Homo sapiens
cattagttatcctgt

SEQ ID NO: 431571 - DNA, 15 bp, Homo sapiens
attagttatcctgtt

SEQ ID NO: 431572 - DNA, 15 bp, Homo sapiens
ttagttatcctgttt

SEQ ID NO: 431573 - DNA, 15 bp, Homo sapiens
tagttatcctgtttg

SEQ ID NO: 431574 - DNA, 15 bp, Homo sapiens
agttatcctgtttga

SEQ ID NO: 431575 - DNA, 15 bp, Homo sapiens
gttatcctgtttgat

SEQ ID NO: 431576 - DNA, 15 bp, Homo sapiens
ttatcctgtttgatg

SEQ ID NO: 431577 - DNA, 15 bp, Homo sapiens
tatcctgtttgatgc

SEQ ID NO: 431578 - DNA, 15 bp, Homo sapiens
atcctgtttgatgcc

SEQ ID NO: 431579 - DNA, 15 bp, Homo sapiens
tcctgtttgatgccg

SEQ ID NO: 431580 - DNA, 15 bp, Homo sapiens
cctgtttgatgccga

SEQ ID NO: 431581 - DNA, 15 bp, Homo sapiens
ctgtttgatgccgaa

SEQ ID NO: 431582 - DNA, 15 bp, Homo sapiens
tgtttgatgccgaag

SEQ ID NO: 431583 - DNA, 15 bp, Homo sapiens
gtttgatgccgaagt

SEQ ID NO: 431584 - DNA, 15 bp, Homo sapiens
tttgatgccgaagta

SEQ ID NO: 431585 - DNA, 15 bp, Homo sapiens
ttgatgccgaagtac

SEQ ID NO: 431586 - DNA, 15 bp, Homo sapiens
tgatgccgaagtact

SEQ ID NO: 431587 - DNA, 15 bp, Homo sapiens
gatgccgaagtactc

SEQ ID NO: 431588 - DNA, 15 bp, Homo sapiens
atgccgaagtactca

SEQ ID NO: 431589 - DNA, 15 bp, Homo sapiens
tgccgaagtactcaa

SEQ ID NO: 431590 - DNA, 15 bp, Homo sapiens
gccgaagtactcaat

SEQ ID NO: 431591 - DNA, 15 bp, Homo sapiens
ccgaagtactcaatg

SEQ ID NO: 431592 - DNA, 15 bp, Homo sapiens
cgaagtactcaatgt

SEQ ID NO: 431593 - DNA, 15 bp, Homo sapiens
gaagtactcaatgtt

SEQ ID NO: 431594 - DNA, 15 bp, Homo sapiens
aagtactcaatgttg

SEQ ID NO: 431595 - DNA, 15 bp, Homo sapiens
agtactcaatgttgg

SEQ ID NO: 431596 - DNA, 15 bp, Homo sapiens
gtactcaatgttgga

SEQ ID NO: 431597 - DNA, 15 bp, Homo sapiens
tactcaatgttggag

SEQ ID NO: 431598 - DNA, 15 bp, Homo sapiens
actcaatgttggaga

SEQ ID NO: 431599 - DNA, 15 bp, Homo sapiens
ctcaatgttggagag

SEQ ID NO: 431600 - DNA, 15 bp, Homo sapiens
tcaatgttggagagg

SEQ ID NO: 431601 - DNA, 15 bp, Homo sapiens
caatgttggagaggt

SEQ ID NO: 431602 - DNA, 15 bp, Homo sapiens
aatgttggagaggtt

SEQ ID NO: 431603 - DNA, 15 bp, Homo sapiens
atgttggagaggtta

SEQ ID NO: 431604 - DNA, 15 bp, Homo sapiens
tgttggagaggttag

SEQ ID NO: 431605 - DNA, 15 bp, Homo sapiens
gttggagaggttaga

SEQ ID NO: 431606 - DNA, 15 bp, Homo sapiens
ttggagaggttagat

SEQ ID NO: 431607 - DNA, 15 bp, Homo sapiens
tggagaggttagatc

SEQ ID NO: 431608 - DNA, 15 bp, Homo sapiens
ggagaggttagatca

SEQ ID NO: 431609 - DNA, 15 bp, Homo sapiens
gagaggttagatcag

SEQ ID NO: 431610 - DNA, 15 bp, Homo sapiens
agaggttagatcagg

SEQ ID NO: 431611 - DNA, 15 bp, Homo sapiens
gaggttagatcagga

SEQ ID NO: 431612 - DNA, 15 bp, Homo sapiens
aggttagatcaggaa

SEQ ID NO: 431613 - DNA, 15 bp, Homo sapiens
ggttagatcaggaag

SEQ ID NO: 431614 - DNA, 15 bp, Homo sapiens
gttagatcaggaaga

SEQ ID NO: 431615 - DNA, 15 bp, Homo sapiens
ttagatcaggaagaa

SEQ ID NO: 431616 - DNA, 15 bp, Homo sapiens
tagatcaggaagaaa

SEQ ID NO: 431617 - DNA, 15 bp, Homo sapiens
agatcaggaagaaat

SEQ ID NO: 431618 - DNA, 15 bp, Homo sapiens
gatcaggaagaaatc

SEQ ID NO: 431619 - DNA, 15 bp, Homo sapiens
atcaggaagaaatca

SEQ ID NO: 431620 - DNA, 15 bp, Homo sapiens
tcaggaagaaatcaa

SEQ ID NO: 431621 - DNA, 15 bp, Homo sapiens
caggaagaaatcaag

SEQ ID NO: 431622 - DNA, 15 bp, Homo sapiens
aggaagaaatcaagt

SEQ ID NO: 431623 - DNA, 15 bp, Homo sapiens
ggaagaaatcaagtg

SEQ ID NO: 431624 - DNA, 15 bp, Homo sapiens
gaagaaatcaagtga

SEQ ID NO: 431625 - DNA, 15 bp, Homo sapiens
aagaaatcaagtgat

SEQ ID NO: 431626 - DNA, 15 bp, Homo sapiens
agaaatcaagtgatt

SEQ ID NO: 431627 - DNA, 15 bp, Homo sapiens
gaaatcaagtgattt

SEQ ID NO: 431628 - DNA, 15 bp, Homo sapiens
aaatcaagtgatttt

SEQ ID NO: 431629 - DNA, 15 bp, Homo sapiens
aatcaagtgattttt

SEQ ID NO: 431630 - DNA, 15 bp, Homo sapiens
atcaagtgatttttt

SEQ ID NO: 431631 - DNA, 15 bp, Homo sapiens
tcaagtgattttttt

SEQ ID NO: 431632 - DNA, 15 bp, Homo sapiens
caagtgatttttttc

SEQ ID NO: 431633 - DNA, 15 bp, Homo sapiens
aagtgatttttttcg

SEQ ID NO: 431634 - DNA, 15 bp, Homo sapiens
agtgatttttttcgg

SEQ ID NO: 431635 - DNA, 15 bp, Homo sapiens
gtgatttttttcggt

SEQ ID NO: 431636 - DNA, 15 bp, Homo sapiens
tgatttttttcggtt

SEQ ID NO: 431637 - DNA, 15 bp, Homo sapiens
gatttttttcggttc

SEQ ID NO: 431638 - DNA, 15 bp, Homo sapiens
atttttttcggttct

SEQ ID NO: 431639 - DNA, 15 bp, Homo sapiens
tttttttcggttcta

SEQ ID NO: 431640 - DNA, 15 bp, Homo sapiens
ttttttcggttctat

SEQ ID NO: 431641 - DNA, 15 bp, Homo sapiens
tttttcggttctatt

SEQ ID NO: 431642 - DNA, 15 bp, Homo sapiens
ttttcggttctattt

SEQ ID NO: 431643 - DNA, 15 bp, Homo sapiens
tttcggttctattta

SEQ ID NO: 431644 - DNA, 15 bp, Homo sapiens
ttcggttctatttaa

SEQ ID NO: 431645 - DNA, 15 bp, Homo sapiens
tcggttctatttaat

SEQ ID NO: 431646 - DNA, 15 bp, Homo sapiens
cggttctatttaata

SEQ ID NO: 431647 - DNA, 15 bp, Homo sapiens
ggttctatttaataa

SEQ ID NO: 431648 - DNA, 15 bp, Homo sapiens
gttctatttaataag

SEQ ID NO: 431649 - DNA, 15 bp, Homo sapiens
ttctatttaataagc

SEQ ID NO: 431650 - DNA, 15 bp, Homo sapiens
tctatttaataagca

SEQ ID NO: 431651 - DNA, 15 bp, Homo sapiens
ctatttaataagcat

SEQ ID NO: 431652 - DNA, 15 bp, Homo sapiens
tatttaataagcatt

SEQ ID NO: 431653 - DNA, 15 bp, Homo sapiens
atttaataagcattt

SEQ ID NO: 431654 - DNA, 15 bp, Homo sapiens
tttaataagcatttt

SEQ ID NO: 431655 - DNA, 15 bp, Homo sapiens
ttaataagcattttg

SEQ ID NO: 431656 - DNA, 15 bp, Homo sapiens
taataagcattttgt

SEQ ID NO: 431657 - DNA, 15 bp, Homo sapiens
aataagcattttgtg

SEQ ID NO: 431658 - DNA, 15 bp, Homo sapiens
ataagcattttgtga

SEQ ID NO: 431659 - DNA, 15 bp, Homo sapiens
taagcattttgtgag

SEQ ID NO: 431660 - DNA, 15 bp, Homo sapiens
aagcattttgtgagt

SEQ ID NO: 431661 - DNA, 15 bp, Homo sapiens
agcattttgtgagta

SEQ ID NO: 431662 - DNA, 15 bp, Homo sapiens
gcattttgtgagtat

SEQ ID NO: 431663 - DNA, 15 bp, Homo sapiens
cattttgtgagtatg

SEQ ID NO: 431664 - DNA, 15 bp, Homo sapiens
attttgtgagtatgt

SEQ ID NO: 431665 - DNA, 15 bp, Homo sapiens
ttttgtgagtatgtg

SEQ ID NO: 431666 - DNA, 15 bp, Homo sapiens
tttgtgagtatgtga

SEQ ID NO: 431667 - DNA, 15 bp, Homo sapiens
ttgtgagtatgtgat

SEQ ID NO: 431668 - DNA, 15 bp, Homo sapiens
tgtgagtatgtgatg

SEQ ID NO: 431669 - DNA, 15 bp, Homo sapiens
gtgagtatgtgatgt

SEQ ID NO: 431670 - DNA, 15 bp, Homo sapiens
tgagtatgtgatgtg

SEQ ID NO: 431671 - DNA, 15 bp, Homo sapiens
gagtatgtgatgtgt

SEQ ID NO: 431672 - DNA, 15 bp, Homo sapiens
agtatgtgatgtgta

SEQ ID NO: 431673 - DNA, 15 bp, Homo sapiens
gtatgtgatgtgtac

SEQ ID NO: 431674 - DNA, 15 bp, Homo sapiens
tatgtgatgtgtacc

SEQ ID NO: 431675 - DNA, 15 bp, Homo sapiens
atgtgatgtgtacca

SEQ ID NO: 431676 - DNA, 15 bp, Homo sapiens
tgtgatgtgtaccat

SEQ ID NO: 431677 - DNA, 15 bp, Homo sapiens
gtgatgtgtaccatg

SEQ ID NO: 431678 - DNA, 15 bp, Homo sapiens
tgatgtgtaccatgc

SEQ ID NO: 431679 - DNA, 15 bp, Homo sapiens
gatgtgtaccatgct

SEQ ID NO: 431680 - DNA, 15 bp, Homo sapiens
atgtgtaccatgcta

SEQ ID NO: 431681 - DNA, 15 bp, Homo sapiens
tgtgtaccatgctat

SEQ ID NO: 431682 - DNA, 15 bp, Homo sapiens
gtgtaccatgctata

SEQ ID NO: 431683 - DNA, 15 bp, Homo sapiens
tgtaccatgctataa

SEQ ID NO: 431684 - DNA, 15 bp, Homo sapiens
gtaccatgctataag

SEQ ID NO: 431685 - DNA, 15 bp, Homo sapiens
taccatgctataagg

SEQ ID NO: 431686 - DNA, 15 bp, Homo sapiens
accatgctataagga

SEQ ID NO: 431687 - DNA, 15 bp, Homo sapiens
ccatgctataaggac

SEQ ID NO: 431688 - DNA, 15 bp, Homo sapiens
catgctataaggaca

SEQ ID NO: 431689 - DNA, 15 bp, Homo sapiens
atgctataaggacat

SEQ ID NO: 431690 - DNA, 15 bp, Homo sapiens
tgctataaggacata

SEQ ID NO: 431691 - DNA, 15 bp, Homo sapiens
gctataaggacatac

SEQ ID NO: 431692 - DNA, 15 bp, Homo sapiens
ctataaggacatacc

SEQ ID NO: 431693 - DNA, 15 bp, Homo sapiens
tataaggacatacca

SEQ ID NO: 431694 - DNA, 15 bp, Homo sapiens
ataaggacataccaa

SEQ ID NO: 431695 - DNA, 15 bp, Homo sapiens
taaggacataccaag

SEQ ID NO: 431696 - DNA, 15 bp, Homo sapiens
aaggacataccaaga

SEQ ID NO: 431697 - DNA, 15 bp, Homo sapiens
aggacataccaagat

SEQ ID NO: 431698 - DNA, 15 bp, Homo sapiens
ggacataccaagatg

SEQ ID NO: 431699 - DNA, 15 bp, Homo sapiens
gacataccaagatgg

SEQ ID NO: 431700 - DNA, 15 bp, Homo sapiens
acataccaagatgga

SEQ ID NO: 431701 - DNA, 15 bp, Homo sapiens
cataccaagatggag

SEQ ID NO: 431702 - DNA, 15 bp, Homo sapiens
ataccaagatggagt

SEQ ID NO: 431703 - DNA, 15 bp, Homo sapiens
taccaagatggagtc

SEQ ID NO: 431704 - DNA, 15 bp, Homo sapiens
accaagatggagtca

SEQ ID NO: 431705 - DNA, 15 bp, Homo sapiens
ccaagatggagtcac

SEQ ID NO: 431706 - DNA, 15 bp, Homo sapiens
caagatggagtcacc

SEQ ID NO: 431707 - DNA, 15 bp, Homo sapiens
aagatggagtcacct

SEQ ID NO: 431708 - DNA, 15 bp, Homo sapiens
agatggagtcacctc

SEQ ID NO: 431709 - DNA, 15 bp, Homo sapiens
gatggagtcacctct

SEQ ID NO: 431710 - DNA, 15 bp, Homo sapiens
atggagtcacctctt

SEQ ID NO: 431711 - DNA, 15 bp, Homo sapiens
tggagtcacctcttt

SEQ ID NO: 431712 - DNA, 15 bp, Homo sapiens
ggagtcacctctttt

SEQ ID NO: 431713 - DNA, 15 bp, Homo sapiens
gagtcacctcttttc

SEQ ID NO: 431714 - DNA, 15 bp, Homo sapiens
agtcacctcttttct

SEQ ID NO: 431715 - DNA, 15 bp, Homo sapiens
gtcacctcttttctt

SEQ ID NO: 431716 - DNA, 15 bp, Homo sapiens
tcacctcttttcttt

SEQ ID NO: 431717 - DNA, 15 bp, Homo sapiens
cacctcttttctttt

SEQ ID NO: 431718 - DNA, 15 bp, Homo sapiens
cctcttttcttttag

SEQ ID NO: 431719 - DNA, 15 bp, Homo sapiens
ctcttttcttttagg

SEQ ID NO: 431720 - DNA, 15 bp, Homo sapiens
tcttttcttttaggt

SEQ ID NO: 431721 - DNA, 15 bp, Homo sapiens
cttttcttttaggta

SEQ ID NO: 431722 - DNA, 15 bp, Homo sapiens
ttttcttttaggtaa

SEQ ID NO: 431723 - DNA, 15 bp, Homo sapiens
tttcttttaggtaac

SEQ ID NO: 431724 - DNA, 15 bp, Homo sapiens
ttcttttaggtaacc

SEQ ID NO: 431725 - DNA, 15 bp, Homo sapiens
tcttttaggtaacca

SEQ ID NO: 431726 - DNA, 15 bp, Homo sapiens
cttttaggtaaccat

SEQ ID NO: 431727 - DNA, 15 bp, Homo sapiens
ttttaggtaaccatt

SEQ ID NO: 431728 - DNA, 15 bp, Homo sapiens
tttaggtaaccattc

SEQ ID NO: 431729 - DNA, 15 bp, Homo sapiens
ttaggtaaccattct

SEQ ID NO: 431730 - DNA, 15 bp, Homo sapiens
taggtaaccattcta

SEQ ID NO: 431731 - DNA, 15 bp, Homo sapiens
aggtaaccattctag

SEQ ID NO: 431732 - DNA, 15 bp, Homo sapiens
ggtaaccattctaga

SEQ ID NO: 431733 - DNA, 15 bp, Homo sapiens
gtaaccattctagaa

SEQ ID NO: 431734 - DNA, 15 bp, Homo sapiens
taaccattctagaaa

SEQ ID NO: 431735 - DNA, 15 bp, Homo sapiens
aaccattctagaaaa

SEQ ID NO: 431736 - DNA, 15 bp, Homo sapiens
accattctagaaaac

SEQ ID NO: 431737 - DNA, 15 bp, Homo sapiens
ccattctagaaaaca

SEQ ID NO: 431738 - DNA, 15 bp, Homo sapiens
cattctagaaaacac

SEQ ID NO: 431739 - DNA, 15 bp, Homo sapiens
attctagaaaacact

SEQ ID NO: 431740 - DNA, 15 bp, Homo sapiens
ttctagaaaacactt

SEQ ID NO: 431741 - DNA, 15 bp, Homo sapiens
tctagaaaacacttt

SEQ ID NO: 431742 - DNA, 15 bp, Homo sapiens
ctagaaaacactttc

SEQ ID NO: 431743 - DNA, 15 bp, Homo sapiens
tagaaaacactttcc

SEQ ID NO: 431744 - DNA, 15 bp, Homo sapiens
agaaaacactttcct

SEQ ID NO: 431745 - DNA, 15 bp, Homo sapiens
gaaaacactttcctc

SEQ ID NO: 431746 - DNA, 15 bp, Homo sapiens
aaaacactttcctcc

SEQ ID NO: 431747 - DNA, 15 bp, Homo sapiens
aaacactttcctcca

SEQ ID NO: 431748 - DNA, 15 bp, Homo sapiens
aacactttcctccat

SEQ ID NO: 431749 - DNA, 15 bp, Homo sapiens
acactttcctccatg

SEQ ID NO: 431750 - DNA, 15 bp, Homo sapiens
cactttcctccatga

SEQ ID NO: 431751 - DNA, 15 bp, Homo sapiens
actttcctccatgat

SEQ ID NO: 431752 - DNA, 15 bp, Homo sapiens
ctttcctccatgatt

SEQ ID NO: 431753 - DNA, 15 bp, Homo sapiens
tttcctccatgattt

SEQ ID NO: 431754 - DNA, 15 bp, Homo sapiens
ttcctccatgatttt

SEQ ID NO: 431755 - DNA, 15 bp, Homo sapiens
tcctccatgattttt

SEQ ID NO: 431756 - DNA, 15 bp, Homo sapiens
cctccatgattttta

SEQ ID NO: 431757 - DNA, 15 bp, Homo sapiens
ctccatgatttttat

SEQ ID NO: 431758 - DNA, 15 bp, Homo sapiens
tccatgatttttatc

SEQ ID NO: 431759 - DNA, 15 bp, Homo sapiens
ccatgatttttatct

SEQ ID NO: 431760 - DNA, 15 bp, Homo sapiens
catgatttttatctc

SEQ ID NO: 431761 - DNA, 15 bp, Homo sapiens
atgatttttatctcc

SEQ ID NO: 431762 - DNA, 15 bp, Homo sapiens
tgatttttatctcca

SEQ ID NO: 431763 - DNA, 15 bp, Homo sapiens
gatttttatctccaa

SEQ ID NO: 431764 - DNA, 15 bp, Homo sapiens
atttttatctccaat

SEQ ID NO: 431765 - DNA, 15 bp, Homo sapiens
tttttatctccaatg

SEQ ID NO: 431766 - DNA, 15 bp, Homo sapiens
ttttatctccaatgc

SEQ ID NO: 431767 - DNA, 15 bp, Homo sapiens
tttatctccaatgcc

SEQ ID NO: 431768 - DNA, 15 bp, Homo sapiens
ttatctccaatgcct

SEQ ID NO: 431769 - DNA, 15 bp, Homo sapiens
tatctccaatgcctt

SEQ ID NO: 431770 - DNA, 15 bp, Homo sapiens
atctccaatgccttt

SEQ ID NO: 431771 - DNA, 15 bp, Homo sapiens
tctccaatgcctttt

SEQ ID NO: 431772 - DNA, 15 bp, Homo sapiens
ctccaatgccttttt

SEQ ID NO: 431773 - DNA, 15 bp, Homo sapiens
tccaatgcctttttt

SEQ ID NO: 431774 - DNA, 15 bp, Homo sapiens
ccaatgccttttttt

SEQ ID NO: 431775 - DNA, 15 bp, Homo sapiens
caatgcctttttttc

SEQ ID NO: 431776 - DNA, 15 bp, Homo sapiens
aatgcctttttttct

SEQ ID NO: 431777 - DNA, 15 bp, Homo sapiens
atgcctttttttctt

SEQ ID NO: 431778 - DNA, 15 bp, Homo sapiens
tgcctttttttcttc

SEQ ID NO: 431779 - DNA, 15 bp, Homo sapiens
gcctttttttcttcc

SEQ ID NO: 431780 - DNA, 15 bp, Homo sapiens
cctttttttcttcca

SEQ ID NO: 431781 - DNA, 15 bp, Homo sapiens
ctttttttcttccag

SEQ ID NO: 431782 - DNA, 15 bp, Homo sapiens
tttttttcttccagt

SEQ ID NO: 431783 - DNA, 15 bp, Homo sapiens
ttttttcttccagtt

SEQ ID NO: 431784 - DNA, 15 bp, Homo sapiens
tttttcttccagttc

SEQ ID NO: 431785 - DNA, 15 bp, Homo sapiens
ttttcttccagttcc

SEQ ID NO: 431786 - DNA, 15 bp, Homo sapiens
tttcttccagttcct

SEQ ID NO: 431787 - DNA, 15 bp, Homo sapiens
ttcttccagttcctt

SEQ ID NO: 431788 - DNA, 15 bp, Homo sapiens
tcttccagttccttt

SEQ ID NO: 431789 - DNA, 15 bp, Homo sapiens
cttccagttccttta

SEQ ID NO: 431790 - DNA, 15 bp, Homo sapiens
ttccagttcctttaa

SEQ ID NO: 431791 - DNA, 15 bp, Homo sapiens
tccagttcctttaaa

SEQ ID NO: 431792 - DNA, 15 bp, Homo sapiens
ccagttcctttaaat

SEQ ID NO: 431793 - DNA, 15 bp, Homo sapiens
cagttcctttaaatt

SEQ ID NO: 431794 - DNA, 15 bp, Homo sapiens
agttcctttaaattt

SEQ ID NO: 431795 - DNA, 15 bp, Homo sapiens
gttcctttaaatttt

SEQ ID NO: 431796 - DNA, 15 bp, Homo sapiens
ttcctttaaattttt

SEQ ID NO: 431797 - DNA, 15 bp, Homo sapiens
tcctttaaatttttt

SEQ ID NO: 431798 - DNA, 15 bp, Homo sapiens
cctttaaattttttc

SEQ ID NO: 431799 - DNA, 15 bp, Homo sapiens
ctttaaattttttcc

SEQ ID NO: 431800 - DNA, 15 bp, Homo sapiens
tttaaattttttcca

SEQ ID NO: 431801 - DNA, 15 bp, Homo sapiens
ttaaattttttccat

SEQ ID NO: 431802 - DNA, 15 bp, Homo sapiens
taaattttttccatt

SEQ ID NO: 431803 - DNA, 15 bp, Homo sapiens
aaattttttccatta

SEQ ID NO: 431804 - DNA, 15 bp, Homo sapiens
aattttttccattac

SEQ ID NO: 431805 - DNA, 15 bp, Homo sapiens
attttttccattact

SEQ ID NO: 431806 - DNA, 15 bp, Homo sapiens
ttttttccattacta

SEQ ID NO: 431807 - DNA, 15 bp, Homo sapiens
tttttccattactaa

SEQ ID NO: 431808 - DNA, 15 bp, Homo sapiens
ttttccattactaat

SEQ ID NO: 431809 - DNA, 15 bp, Homo sapiens
tttccattactaatt

SEQ ID NO: 431810 - DNA, 15 bp, Homo sapiens
ttccattactaatta

SEQ ID NO: 431811 - DNA, 15 bp, Homo sapiens
tccattactaattat

SEQ ID NO: 431812 - DNA, 15 bp, Homo sapiens
ccattactaattatc

SEQ ID NO: 431813 - DNA, 15 bp, Homo sapiens
cattactaattatct

SEQ ID NO: 431814 - DNA, 15 bp, Homo sapiens
attactaattatctt

SEQ ID NO: 431815 - DNA, 15 bp, Homo sapiens
ttactaattatctta

SEQ ID NO: 431816 - DNA, 15 bp, Homo sapiens
tactaattatcttat

SEQ ID NO: 431817 - DNA, 15 bp, Homo sapiens
actaattatcttata

SEQ ID NO: 431818 - DNA, 15 bp, Homo sapiens
ctaattatcttatac

SEQ ID NO: 431819 - DNA, 15 bp, Homo sapiens
taattatcttatact

SEQ ID NO: 431820 - DNA, 15 bp, Homo sapiens
aattatcttatactg

SEQ ID NO: 431821 - DNA, 15 bp, Homo sapiens
attatcttatactgt

SEQ ID NO: 431822 - DNA, 15 bp, Homo sapiens
ttatcttatactgtt

SEQ ID NO: 431823 - DNA, 15 bp, Homo sapiens
tatcttatactgttg

SEQ ID NO: 431824 - DNA, 15 bp, Homo sapiens
atcttatactgttgt

SEQ ID NO: 431825 - DNA, 15 bp, Homo sapiens
tcttatactgttgta

SEQ ID NO: 431826 - DNA, 15 bp, Homo sapiens
cttatactgttgtat

SEQ ID NO: 431827 - DNA, 15 bp, Homo sapiens
ttatactgttgtatg

SEQ ID NO: 431828 - DNA, 15 bp, Homo sapiens
tatactgttgtatgt

SEQ ID NO: 431829 - DNA, 15 bp, Homo sapiens
atactgttgtatgta

SEQ ID NO: 431830 - DNA, 15 bp, Homo sapiens
tactgttgtatgtat

SEQ ID NO: 431831 - DNA, 15 bp, Homo sapiens
actgttgtatgtatt

SEQ ID NO: 431832 - DNA, 15 bp, Homo sapiens
ctgttgtatgtattt

SEQ ID NO: 431833 - DNA, 15 bp, Homo sapiens
tgttgtatgtatttt

SEQ ID NO: 431834 - DNA, 15 bp, Homo sapiens
gttgtatgtattttt

SEQ ID NO: 431835 - DNA, 15 bp, Homo sapiens
ttgtatgtattttta

SEQ ID NO: 431836 - DNA, 15 bp, Homo sapiens
tgtatgtatttttaa

SEQ ID NO: 431837 - DNA, 15 bp, Homo sapiens
gtatgtatttttaag

SEQ ID NO: 431838 - DNA, 15 bp, Homo sapiens
tatgtatttttaagt

SEQ ID NO: 431839 - DNA, 15 bp, Homo sapiens
atgtatttttaagta

SEQ ID NO: 431840 - DNA, 15 bp, Homo sapiens
tgtatttttaagtat

SEQ ID NO: 431841 - DNA, 15 bp, Homo sapiens
gtatttttaagtatt

SEQ ID NO: 431842 - DNA, 15 bp, Homo sapiens
tatttttaagtattt

SEQ ID NO: 431843 - DNA, 15 bp, Homo sapiens
atttttaagtattta

SEQ ID NO: 431844 - DNA, 15 bp, Homo sapiens
tttttaagtatttaa

SEQ ID NO: 431845 - DNA, 15 bp, Homo sapiens
ttttaagtatttaaa

SEQ ID NO: 431846 - DNA, 15 bp, Homo sapiens
tttaagtatttaaaa

SEQ ID NO: 431847 - DNA, 15 bp, Homo sapiens
ttaagtatttaaaaa

SEQ ID NO: 431848 - DNA, 15 bp, Homo sapiens
taagtatttaaaaat

SEQ ID NO: 431849 - DNA, 15 bp, Homo sapiens
aagtatttaaaaatc

SEQ ID NO: 431850 - DNA, 15 bp, Homo sapiens
agtatttaaaaatca

SEQ ID NO: 431851 - DNA, 15 bp, Homo sapiens
gtatttaaaaatcac

SEQ ID NO: 431852 - DNA, 15 bp, Homo sapiens
tatttaaaaatcact

SEQ ID NO: 431853 - DNA, 15 bp, Homo sapiens
atttaaaaatcacta

SEQ ID NO: 431854 - DNA, 15 bp, Homo sapiens
tttaaaaatcactat

SEQ ID NO: 431855 - DNA, 15 bp, Homo sapiens
ttaaaaatcactatt

SEQ ID NO: 431856 - DNA, 15 bp, Homo sapiens
taaaaatcactatta

SEQ ID NO: 431857 - DNA, 15 bp, Homo sapiens
aaaaatcactattaa

SEQ ID NO: 431858 - DNA, 15 bp, Homo sapiens
aaaatcactattaat

SEQ ID NO: 431859 - DNA, 15 bp, Homo sapiens
aaatcactattaatt

SEQ ID NO: 431860 - DNA, 15 bp, Homo sapiens
aatcactattaattg

SEQ ID NO: 431861 - DNA, 15 bp, Homo sapiens
atcactattaattga

SEQ ID NO: 431862 - DNA, 15 bp, Homo sapiens
tcactattaattgac

SEQ ID NO: 431863 - DNA, 15 bp, Homo sapiens
cactattaattgacc

SEQ ID NO: 431864 - DNA, 15 bp, Homo sapiens
actattaattgacca

SEQ ID NO: 431865 - DNA, 15 bp, Homo sapiens
ctattaattgaccat

SEQ ID NO: 431866 - DNA, 15 bp, Homo sapiens
tattaattgaccatt

SEQ ID NO: 431867 - DNA, 15 bp, Homo sapiens
attaattgaccattc

SEQ ID NO: 431868 - DNA, 15 bp, Homo sapiens
ttaattgaccattcc

SEQ ID NO: 431869 - DNA, 15 bp, Homo sapiens
taattgaccattcca

SEQ ID NO: 431870 - DNA, 15 bp, Homo sapiens
aattgaccattccac

SEQ ID NO: 431871 - DNA, 15 bp, Homo sapiens
attgaccattccaca

SEQ ID NO: 431872 - DNA, 15 bp, Homo sapiens
ttgaccattccacat

SEQ ID NO: 431873 - DNA, 15 bp, Homo sapiens
tgaccattccacatt

SEQ ID NO: 431874 - DNA, 15 bp, Homo sapiens
gaccattccacatta

SEQ ID NO: 431875 - DNA, 15 bp, Homo sapiens
accattccacattag

SEQ ID NO: 431876 - DNA, 15 bp, Homo sapiens
ccattccacattagt

SEQ ID NO: 431877 - DNA, 15 bp, Homo sapiens
cattccacattagtt

SEQ ID NO: 431878 - DNA, 15 bp, Homo sapiens
attccacattagttt

SEQ ID NO: 431879 - DNA, 15 bp, Homo sapiens
ttccacattagtttc

SEQ ID NO: 431880 - DNA, 15 bp, Homo sapiens
tccacattagtttcc

SEQ ID NO: 431881 - DNA, 15 bp, Homo sapiens
ccacattagtttcct

SEQ ID NO: 431882 - DNA, 15 bp, Homo sapiens
cacattagtttcctc

SEQ ID NO: 431883 - DNA, 15 bp, Homo sapiens
acattagtttcctcc

SEQ ID NO: 431884 - DNA, 15 bp, Homo sapiens
cattagtttcctcca

SEQ ID NO: 431885 - DNA, 15 bp, Homo sapiens
attagtttcctccat

SEQ ID NO: 431886 - DNA, 15 bp, Homo sapiens
ttagtttcctccata

SEQ ID NO: 431887 - DNA, 15 bp, Homo sapiens
tagtttcctccatac

SEQ ID NO: 431888 - DNA, 15 bp, Homo sapiens
agtttcctccatacc

SEQ ID NO: 431889 - DNA, 15 bp, Homo sapiens
gtttcctccatacca

SEQ ID NO: 431890 - DNA, 15 bp, Homo sapiens
tttcctccataccaa

SEQ ID NO: 431891 - DNA, 15 bp, Homo sapiens
ttcctccataccaat

SEQ ID NO: 431892 - DNA, 15 bp, Homo sapiens
tcctccataccaatc

SEQ ID NO: 431893 - DNA, 15 bp, Homo sapiens
cctccataccaatct

SEQ ID NO: 431894 - DNA, 15 bp, Homo sapiens
ctccataccaatctt

SEQ ID NO: 431895 - DNA, 15 bp, Homo sapiens
tccataccaatctta

SEQ ID NO: 431896 - DNA, 15 bp, Homo sapiens
ccataccaatcttat

SEQ ID NO: 431897 - DNA, 15 bp, Homo sapiens
cataccaatcttatg

SEQ ID NO: 431898 - DNA, 15 bp, Homo sapiens
ataccaatcttatgc

SEQ ID NO: 431899 - DNA, 15 bp, Homo sapiens
taccaatcttatgct

SEQ ID NO: 431900 - DNA, 15 bp, Homo sapiens
accaatcttatgcta

SEQ ID NO: 431901 - DNA, 15 bp, Homo sapiens
ccaatcttatgctag

SEQ ID NO: 431902 - DNA, 15 bp, Homo sapiens
caatcttatgctagg

SEQ ID NO: 431903 - DNA, 15 bp, Homo sapiens
aatcttatgctaggc

SEQ ID NO: 431904 - DNA, 15 bp, Homo sapiens
atcttatgctaggcc

SEQ ID NO: 431905 - DNA, 15 bp, Homo sapiens
tcttatgctaggcct

SEQ ID NO: 431906 - DNA, 15 bp, Homo sapiens
cttatgctaggccta

SEQ ID NO: 431907 - DNA, 15 bp, Homo sapiens
ttatgctaggcctat

SEQ ID NO: 431908 - DNA, 15 bp, Homo sapiens
tatgctaggcctatt

SEQ ID NO: 431909 - DNA, 15 bp, Homo sapiens
atgctaggcctattt

SEQ ID NO: 431910 - DNA, 15 bp, Homo sapiens
tgctaggcctatttc

SEQ ID NO: 431911 - DNA, 15 bp, Homo sapiens
gctaggcctatttca

SEQ ID NO: 431912 - DNA, 15 bp, Homo sapiens
ctaggcctatttcaa

SEQ ID NO: 431913 - DNA, 15 bp, Homo sapiens
taggcctatttcaat

SEQ ID NO: 431914 - DNA, 15 bp, Homo sapiens
aggcctatttcaata

SEQ ID NO: 431915 - DNA, 15 bp, Homo sapiens
ggcctatttcaatat

SEQ ID NO: 431916 - DNA, 15 bp, Homo sapiens
gcctatttcaatata

SEQ ID NO: 431917 - DNA, 15 bp, Homo sapiens
cctatttcaatatat

SEQ ID NO: 431918 - DNA, 15 bp, Homo sapiens
ctatttcaatatatt

SEQ ID NO: 431919 - DNA, 15 bp, Homo sapiens
tatttcaatatattc

SEQ ID NO: 431920 - DNA, 15 bp, Homo sapiens
atttcaatatattct

SEQ ID NO: 431921 - DNA, 15 bp, Homo sapiens
tttcaatatattctt

SEQ ID NO: 431922 - DNA, 15 bp, Homo sapiens
ttcaatatattctta

SEQ ID NO: 431923 - DNA, 15 bp, Homo sapiens
tcaatatattcttaa

SEQ ID NO: 431924 - DNA, 15 bp, Homo sapiens
caatatattcttaat

SEQ ID NO: 431925 - DNA, 15 bp, Homo sapiens
aatatattcttaatt

SEQ ID NO: 431926 - DNA, 15 bp, Homo sapiens
atatattcttaattg

SEQ ID NO: 431927 - DNA, 15 bp, Homo sapiens
attcttaattggcat

SEQ ID NO: 431928 - DNA, 15 bp, Homo sapiens
ttcttaattggcatt

SEQ ID NO: 431929 - DNA, 15 bp, Homo sapiens
tcttaattggcattt

SEQ ID NO: 431930 - DNA, 15 bp, Homo sapiens
cttaattggcatttc

SEQ ID NO: 431931 - DNA, 15 bp, Homo sapiens
ttaattggcatttct

SEQ ID NO: 431932 - DNA, 15 bp, Homo sapiens
taattggcatttctc

SEQ ID NO: 431933 - DNA, 15 bp, Homo sapiens
aattggcatttctcc

SEQ ID NO: 431934 - DNA, 15 bp, Homo sapiens
attggcatttctcca

SEQ ID NO: 431935 - DNA, 15 bp, Homo sapiens
ttggcatttctccat

SEQ ID NO: 431936 - DNA, 15 bp, Homo sapiens
tggcatttctccatt

SEQ ID NO: 431937 - DNA, 15 bp, Homo sapiens
ggcatttctccatta

SEQ ID NO: 431938 - DNA, 15 bp, Homo sapiens
gcatttctccattaa

SEQ ID NO: 431939 - DNA, 15 bp, Homo sapiens
catttctccattaac

SEQ ID NO: 431940 - DNA, 15 bp, Homo sapiens
atttctccattaaca

SEQ ID NO: 431941 - DNA, 15 bp, Homo sapiens
tttctccattaacat

SEQ ID NO: 431942 - DNA, 15 bp, Homo sapiens
ttctccattaacata

SEQ ID NO: 431943 - DNA, 15 bp, Homo sapiens
tctccattaacataa

SEQ ID NO: 431944 - DNA, 15 bp, Homo sapiens
ctccattaacataaa

SEQ ID NO: 431945 - DNA, 15 bp, Homo sapiens
tccattaacataaat

SEQ ID NO: 431946 - DNA, 15 bp, Homo sapiens
ccattaacataaatc

SEQ ID NO: 431947 - DNA, 15 bp, Homo sapiens
cattaacataaatcc

SEQ ID NO: 431948 - DNA, 15 bp, Homo sapiens
attaacataaatcct

SEQ ID NO: 431949 - DNA, 15 bp, Homo sapiens
ttaacataaatccta

SEQ ID NO: 431950 - DNA, 15 bp, Homo sapiens
taacataaatcctaa

SEQ ID NO: 431951 - DNA, 15 bp, Homo sapiens
aacataaatcctaaa

SEQ ID NO: 431952 - DNA, 15 bp, Homo sapiens
acataaatcctaaaa

SEQ ID NO: 431953 - DNA, 15 bp, Homo sapiens
cataaatcctaaaat

SEQ ID NO: 431954 - DNA, 15 bp, Homo sapiens
ataaatcctaaaatg

SEQ ID NO: 431955 - DNA, 15 bp, Homo sapiens
taaatcctaaaatga

SEQ ID NO: 431956 - DNA, 15 bp, Homo sapiens
aaatcctaaaatgat

SEQ ID NO: 431957 - DNA, 15 bp, Homo sapiens
aatcctaaaatgata

SEQ ID NO: 431958 - DNA, 15 bp, Homo sapiens
atcctaaaatgataa

SEQ ID NO: 431959 - DNA, 15 bp, Homo sapiens
tcctaaaatgataaa

SEQ ID NO: 431960 - DNA, 15 bp, Homo sapiens
cctaaaatgataaac

SEQ ID NO: 431961 - DNA, 15 bp, Homo sapiens
ctaaaatgataaacc

SEQ ID NO: 431962 - DNA, 15 bp, Homo sapiens
taaaatgataaacct

SEQ ID NO: 431963 - DNA, 15 bp, Homo sapiens
aaaatgataaaccta

SEQ ID NO: 431964 - DNA, 15 bp, Homo sapiens
aaatgataaacctaa

SEQ ID NO: 431965 - DNA, 15 bp, Homo sapiens
aatgataaacctaaa

SEQ ID NO: 431966 - DNA, 15 bp, Homo sapiens
atgataaacctaaag

SEQ ID NO: 431967 - DNA, 15 bp, Homo sapiens
tgataaacctaaagc

SEQ ID NO: 431968 - DNA, 15 bp, Homo sapiens
gataaacctaaagca

SEQ ID NO: 431969 - DNA, 15 bp, Homo sapiens
ataaacctaaagcac

SEQ ID NO: 431970 - DNA, 15 bp, Homo sapiens
aaacctaaagcacaa

SEQ ID NO: 431971 - DNA, 15 bp, Homo sapiens
aacctaaagcacaaa

SEQ ID NO: 431972 - DNA, 15 bp, Homo sapiens
acctaaagcacaaac

SEQ ID NO: 431973 - DNA, 15 bp, Homo sapiens
cctaaagcacaaacc

SEQ ID NO: 431974 - DNA, 15 bp, Homo sapiens
ctaaagcacaaacct

SEQ ID NO: 431975 - DNA, 15 bp, Homo sapiens
taaagcacaaacctg

SEQ ID NO: 431976 - DNA, 15 bp, Homo sapiens
aaagcacaaacctgg

SEQ ID NO: 431977 - DNA, 15 bp, Homo sapiens
aagcacaaacctggc

SEQ ID NO: 431978 - DNA, 15 bp, Homo sapiens
agcacaaacctggca

SEQ ID NO: 431979 - DNA, 15 bp, Homo sapiens
gcacaaacctggcat

SEQ ID NO: 431980 - DNA, 15 bp, Homo sapiens
cacaaacctggcatg

SEQ ID NO: 431981 - DNA, 15 bp, Homo sapiens
acaaacctggcatga

SEQ ID NO: 431982 - DNA, 15 bp, Homo sapiens
caaacctggcatgag

SEQ ID NO: 431983 - DNA, 15 bp, Homo sapiens
aaacctggcatgagg

SEQ ID NO: 431984 - DNA, 15 bp, Homo sapiens
aacctggcatgaggt

SEQ ID NO: 431985 - DNA, 15 bp, Homo sapiens
acctggcatgaggtt

SEQ ID NO: 431986 - DNA, 15 bp, Homo sapiens
cctggcatgaggttt

SEQ ID NO: 431987 - DNA, 15 bp, Homo sapiens
ctggcatgaggtttc

SEQ ID NO: 431988 - DNA, 15 bp, Homo sapiens
tggcatgaggtttcc

SEQ ID NO: 431989 - DNA, 15 bp, Homo sapiens
ggcatgaggtttcct

SEQ ID NO: 431990 - DNA, 15 bp, Homo sapiens
gcatgaggtttcctg

SEQ ID NO: 431991 - DNA, 15 bp, Homo sapiens
catgaggtttcctgg

SEQ ID NO: 431992 - DNA, 15 bp, Homo sapiens
atgaggtttcctgga

SEQ ID NO: 431993 - DNA, 15 bp, Homo sapiens
tgaggtttcctggag

SEQ ID NO: 431994 - DNA, 15 bp, Homo sapiens
gaggtttcctggaga

SEQ ID NO: 431995 - DNA, 15 bp, Homo sapiens
aggtttcctggagat

SEQ ID NO: 431996 - DNA, 15 bp, Homo sapiens
ggtttcctggagata

SEQ ID NO: 431997 - DNA, 15 bp, Homo sapiens
gtttcctggagataa

SEQ ID NO: 431998 - DNA, 15 bp, Homo sapiens
tttcctggagataaa

SEQ ID NO: 431999 - DNA, 15 bp, Homo sapiens
ttcctggagataaaa

SEQ ID NO: 432000 - DNA, 15 bp, Homo sapiens
tcctggagataaaaa

SEQ ID NO: 432001 - DNA, 15 bp, Homo sapiens
cctggagataaaaac

SEQ ID NO: 432002 - DNA, 15 bp, Homo sapiens
ctggagataaaaact

SEQ ID NO: 432003 - DNA, 15 bp, Homo sapiens
tggagataaaaactg

SEQ ID NO: 432004 - DNA, 15 bp, Homo sapiens
ggagataaaaactgc

SEQ ID NO: 432005 - DNA, 15 bp, Homo sapiens
gagataaaaactgcc

SEQ ID NO: 432006 - DNA, 15 bp, Homo sapiens
agataaaaactgccc

SEQ ID NO: 432007 - DNA, 15 bp, Homo sapiens
gataaaaactgcccg

SEQ ID NO: 432008 - DNA, 15 bp, Homo sapiens
ataaaaactgcccgt

SEQ ID NO: 432009 - DNA, 15 bp, Homo sapiens
taaaaactgcccgta

SEQ ID NO: 432010 - DNA, 15 bp, Homo sapiens
aaaaactgcccgtag

SEQ ID NO: 432011 - DNA, 15 bp, Homo sapiens
aaaactgcccgtagt

SEQ ID NO: 432012 - DNA, 15 bp, Homo sapiens
aaactgcccgtagtg

SEQ ID NO: 432013 - DNA, 15 bp, Homo sapiens
aactgcccgtagtgc

SEQ ID NO: 432014 - DNA, 15 bp, Homo sapiens
actgcccgtagtgca

SEQ ID NO: 432015 - DNA, 15 bp, Homo sapiens
ctgcccgtagtgcat

SEQ ID NO: 432016 - DNA, 15 bp, Homo sapiens
tgcccgtagtgcatg

SEQ ID NO: 432017 - DNA, 15 bp, Homo sapiens
gcccgtagtgcatgc

SEQ ID NO: 432018 - DNA, 15 bp, Homo sapiens
cccgtagtgcatgcc

SEQ ID NO: 432019 - DNA, 15 bp, Homo sapiens
ccgtagtgcatgcca

SEQ ID NO: 432020 - DNA, 15 bp, Homo sapiens
cgtagtgcatgccat

SEQ ID NO: 432021 - DNA, 15 bp, Homo sapiens
gtagtgcatgccatg

SEQ ID NO: 432022 - DNA, 15 bp, Homo sapiens
tagtgcatgccatgg

SEQ ID NO: 432023 - DNA, 15 bp, Homo sapiens
agtgcatgccatggg

SEQ ID NO: 432024 - DNA, 15 bp, Homo sapiens
gtgcatgccatggga

SEQ ID NO: 432025 - DNA, 15 bp, Homo sapiens
tgcatgccatgggat

SEQ ID NO: 432026 - DNA, 15 bp, Homo sapiens
gcatgccatgggatc

SEQ ID NO: 432027 - DNA, 15 bp, Homo sapiens
catgccatgggatct

SEQ ID NO: 432028 - DNA, 15 bp, Homo sapiens
atgccatgggatctg

SEQ ID NO: 432029 - DNA, 15 bp, Homo sapiens
tgccatgggatctga

SEQ ID NO: 432030 - DNA, 15 bp, Homo sapiens
gccatgggatctgag

SEQ ID NO: 432031 - DNA, 15 bp, Homo sapiens
ccatgggatctgagc

SEQ ID NO: 432032 - DNA, 15 bp, Homo sapiens
catgggatctgagct

SEQ ID NO: 432033 - DNA, 15 bp, Homo sapiens
atgggatctgagctc

SEQ ID NO: 432034 - DNA, 15 bp, Homo sapiens
tgggatctgagctcc

SEQ ID NO: 432035 - DNA, 15 bp, Homo sapiens
gggatctgagctcct

SEQ ID NO: 432036 - DNA, 15 bp, Homo sapiens
ggatctgagctcctc

SEQ ID NO: 432037 - DNA, 15 bp, Homo sapiens
gatctgagctcctcc

SEQ ID NO: 432038 - DNA, 15 bp, Homo sapiens
atctgagctcctcca

SEQ ID NO: 432039 - DNA, 15 bp, Homo sapiens
tctgagctcctccac

SEQ ID NO: 432040 - DNA, 15 bp, Homo sapiens
ctgagctcctccacc

SEQ ID NO: 432041 - DNA, 15 bp, Homo sapiens
tgagctcctccacct

SEQ ID NO: 432042 - DNA, 15 bp, Homo sapiens
gagctcctccacctg

SEQ ID NO: 432043 - DNA, 15 bp, Homo sapiens
agctcctccacctgg

SEQ ID NO: 432044 - DNA, 15 bp, Homo sapiens
gctcctccacctggc

SEQ ID NO: 432045 - DNA, 15 bp, Homo sapiens
ctcctccacctggca

SEQ ID NO: 432046 - DNA, 15 bp, Homo sapiens
tcctccacctggcac

SEQ ID NO: 432047 - DNA, 15 bp, Homo sapiens
cctccacctggcaca

SEQ ID NO: 432048 - DNA, 15 bp, Homo sapiens
ctccacctggcacag

SEQ ID NO: 432049 - DNA, 15 bp, Homo sapiens
tccacctggcacaga

SEQ ID NO: 432050 - DNA, 15 bp, Homo sapiens
ccacctggcacagaa

SEQ ID NO: 432051 - DNA, 15 bp, Homo sapiens
cacctggcacagaag

SEQ ID NO: 432052 - DNA, 15 bp, Homo sapiens
acctggcacagaagg

SEQ ID NO: 432053 - DNA, 15 bp, Homo sapiens
cctggcacagaaggc

SEQ ID NO: 432054 - DNA, 15 bp, Homo sapiens
ctggcacagaaggct

SEQ ID NO: 432055 - DNA, 15 bp, Homo sapiens
tggcacagaaggctg

SEQ ID NO: 432056 - DNA, 15 bp, Homo sapiens
ggcacagaaggctgc

SEQ ID NO: 432057 - DNA, 15 bp, Homo sapiens
gcacagaaggctgca

SEQ ID NO: 432058 - DNA, 15 bp, Homo sapiens
cacagaaggctgcac

SEQ ID NO: 432059 - DNA, 15 bp, Homo sapiens
acagaaggctgcaca

SEQ ID NO: 432060 - DNA, 15 bp, Homo sapiens
cagaaggctgcacag

SEQ ID NO: 432061 - DNA, 15 bp, Homo sapiens
agaaggctgcacagc

SEQ ID NO: 432062 - DNA, 15 bp, Homo sapiens
gaaggctgcacagca

SEQ ID NO: 432063 - DNA, 15 bp, Homo sapiens
aaggctgcacagcaa

SEQ ID NO: 432064 - DNA, 15 bp, Homo sapiens
aggctgcacagcaat

SEQ ID NO: 432065 - DNA, 15 bp, Homo sapiens
ggctgcacagcaatt

SEQ ID NO: 432066 - DNA, 15 bp, Homo sapiens
gctgcacagcaattt

SEQ ID NO: 432067 - DNA, 15 bp, Homo sapiens
ctgcacagcaatttg

SEQ ID NO: 432068 - DNA, 15 bp, Homo sapiens
tgcacagcaatttgt

SEQ ID NO: 432069 - DNA, 15 bp, Homo sapiens
gcacagcaatttgtc

SEQ ID NO: 432070 - DNA, 15 bp, Homo sapiens
cacagcaatttgtcc

SEQ ID NO: 432071 - DNA, 15 bp, Homo sapiens
acagcaatttgtcct

SEQ ID NO: 432072 - DNA, 15 bp, Homo sapiens
cagcaatttgtcctc

SEQ ID NO: 432073 - DNA, 15 bp, Homo sapiens
agcaatttgtcctca

SEQ ID NO: 432074 - DNA, 15 bp, Homo sapiens
gcaatttgtcctcag

SEQ ID NO: 432075 - DNA, 15 bp, Homo sapiens
caatttgtcctcagc

SEQ ID NO: 432076 - DNA, 15 bp, Homo sapiens
aatttgtcctcagct

SEQ ID NO: 432077 - DNA, 15 bp, Homo sapiens
atttgtcctcagctt

SEQ ID NO: 432078 - DNA, 15 bp, Homo sapiens
tttgtcctcagcttt

SEQ ID NO: 432079 - DNA, 15 bp, Homo sapiens
ttgtcctcagctttt

SEQ ID NO: 432080 - DNA, 15 bp, Homo sapiens
tgtcctcagcttttc

SEQ ID NO: 432081 - DNA, 15 bp, Homo sapiens
gtcctcagcttttcc

SEQ ID NO: 432082 - DNA, 15 bp, Homo sapiens
tcctcagcttttcca

SEQ ID NO: 432083 - DNA, 15 bp, Homo sapiens
cctcagcttttccat

SEQ ID NO: 432084 - DNA, 15 bp, Homo sapiens
ctcagcttttccatc

SEQ ID NO: 432085 - DNA, 15 bp, Homo sapiens
tcagcttttccatcc

SEQ ID NO: 432086 - DNA, 15 bp, Homo sapiens
cagcttttccatccg

SEQ ID NO: 432087 - DNA, 15 bp, Homo sapiens
agcttttccatccgg

SEQ ID NO: 432088 - DNA, 15 bp, Homo sapiens
gcttttccatccggc

SEQ ID NO: 432089 - DNA, 15 bp, Homo sapiens
cttttccatccggcc

SEQ ID NO: 432090 - DNA, 15 bp, Homo sapiens
ttttccatccggccc

SEQ ID NO: 432091 - DNA, 15 bp, Homo sapiens
tttccatccggcccc

SEQ ID NO: 432092 - DNA, 15 bp, Homo sapiens
ttccatccggcccca

SEQ ID NO: 432093 - DNA, 15 bp, Homo sapiens
tccatccggccccac

SEQ ID NO: 432094 - DNA, 15 bp, Homo sapiens
ccatccggccccacc

SEQ ID NO: 432095 - DNA, 15 bp, Homo sapiens
catccggccccacct

SEQ ID NO: 432096 - DNA, 15 bp, Homo sapiens
atccggccccacctt

SEQ ID NO: 432097 - DNA, 15 bp, Homo sapiens
tccggccccaccttg

SEQ ID NO: 432098 - DNA, 15 bp, Homo sapiens
ccggccccaccttgt

SEQ ID NO: 432099 - DNA, 15 bp, Homo sapiens
cggccccaccttgtg

SEQ ID NO: 432100 - DNA, 15 bp, Homo sapiens
ggccccaccttgtgc

SEQ ID NO: 432101 - DNA, 15 bp, Homo sapiens
gccccaccttgtgcc

SEQ ID NO: 432102 - DNA, 15 bp, Homo sapiens
ccccaccttgtgcct

SEQ ID NO: 432103 - DNA, 15 bp, Homo sapiens
cccaccttgtgcctc

SEQ ID NO: 432104 - DNA, 15 bp, Homo sapiens
ccaccttgtgcctct

SEQ ID NO: 432105 - DNA, 15 bp, Homo sapiens
caccttgtgcctctc

SEQ ID NO: 432106 - DNA, 15 bp, Homo sapiens
accttgtgcctctct

SEQ ID NO: 432107 - DNA, 15 bp, Homo sapiens
ccttgtgcctctctt

SEQ ID NO: 432108 - DNA, 15 bp, Homo sapiens
cttgtgcctctcttc

SEQ ID NO: 432109 - DNA, 15 bp, Homo sapiens
ttgtgcctctcttca

SEQ ID NO: 432110 - DNA, 15 bp, Homo sapiens
tgtgcctctcttcac

SEQ ID NO: 432111 - DNA, 15 bp, Homo sapiens
gtgcctctcttcact

SEQ ID NO: 432112 - DNA, 15 bp, Homo sapiens
tgcctctcttcactc

SEQ ID NO: 432113 - DNA, 15 bp, Homo sapiens
gcctctcttcactcc

SEQ ID NO: 432114 - DNA, 15 bp, Homo sapiens
cctctcttcactcca

SEQ ID NO: 432115 - DNA, 15 bp, Homo sapiens
ctctcttcactccac

SEQ ID NO: 432116 - DNA, 15 bp, Homo sapiens
tctcttcactccact

SEQ ID NO: 432117 - DNA, 15 bp, Homo sapiens
ctcttcactccactc

SEQ ID NO: 432118 - DNA, 15 bp, Homo sapiens
tcttcactccactct

SEQ ID NO: 432119 - DNA, 15 bp, Homo sapiens
cttcactccactctt

SEQ ID NO: 432120 - DNA, 15 bp, Homo sapiens
ttcactccactcttg

SEQ ID NO: 432121 - DNA, 15 bp, Homo sapiens
tcactccactcttga

SEQ ID NO: 432122 - DNA, 15 bp, Homo sapiens
cactccactcttgag

SEQ ID NO: 432123 - DNA, 15 bp, Homo sapiens
actccactcttgagg

SEQ ID NO: 432124 - DNA, 15 bp, Homo sapiens
ctccactcttgaggt

SEQ ID NO: 432125 - DNA, 15 bp, Homo sapiens
tccactcttgaggtt

SEQ ID NO: 432126 - DNA, 15 bp, Homo sapiens
ccactcttgaggttt

SEQ ID NO: 432127 - DNA, 15 bp, Homo sapiens
cactcttgaggtttg

SEQ ID NO: 432128 - DNA, 15 bp, Homo sapiens
actcttgaggtttgc

SEQ ID NO: 432129 - DNA, 15 bp, Homo sapiens
ctcttgaggtttgct

SEQ ID NO: 432130 - DNA, 15 bp, Homo sapiens
tcttgaggtttgctg

SEQ ID NO: 432131 - DNA, 15 bp, Homo sapiens
cttgaggtttgctgg

SEQ ID NO: 432132 - DNA, 15 bp, Homo sapiens
ttgaggtttgctggg

SEQ ID NO: 432133 - DNA, 15 bp, Homo sapiens
tgaggtttgctggga

SEQ ID NO: 432134 - DNA, 15 bp, Homo sapiens
gaggtttgctgggag

SEQ ID NO: 432135 - DNA, 15 bp, Homo sapiens
aggtttgctgggagc

SEQ ID NO: 432136 - DNA, 15 bp, Homo sapiens
ggtttgctgggagcc

SEQ ID NO: 432137 - DNA, 15 bp, Homo sapiens
gtttgctgggagcca

SEQ ID NO: 432138 - DNA, 15 bp, Homo sapiens
tttgctgggagccag

SEQ ID NO: 432139 - DNA, 15 bp, Homo sapiens
ttgctgggagccagg

SEQ ID NO: 432140 - DNA, 15 bp, Homo sapiens
tgctgggagccaggc

SEQ ID NO: 432141 - DNA, 15 bp, Homo sapiens
gctgggagccaggct

SEQ ID NO: 432142 - DNA, 15 bp, Homo sapiens
ctgggagccaggctc

SEQ ID NO: 432143 - DNA, 15 bp, Homo sapiens
tgggagccaggctcc

SEQ ID NO: 432144 - DNA, 15 bp, Homo sapiens
gggagccaggctcct

SEQ ID NO: 432145 - DNA, 15 bp, Homo sapiens
ggagccaggctcctc

SEQ ID NO: 432146 - DNA, 15 bp, Homo sapiens
gagccaggctcctca

SEQ ID NO: 432147 - DNA, 15 bp, Homo sapiens
agccaggctcctcac

SEQ ID NO: 432148 - DNA, 15 bp, Homo sapiens
gccaggctcctcact

SEQ ID NO: 432149 - DNA, 15 bp, Homo sapiens
ccaggctcctcacta

SEQ ID NO: 432150 - DNA, 15 bp, Homo sapiens
caggctcctcactac

SEQ ID NO: 432151 - DNA, 15 bp, Homo sapiens
aggctcctcactaca

SEQ ID NO: 432152 - DNA, 15 bp, Homo sapiens
ggctcctcactacat

SEQ ID NO: 432153 - DNA, 15 bp, Homo sapiens
gctcctcactacatt

SEQ ID NO: 432154 - DNA, 15 bp, Homo sapiens
ctcctcactacattc

SEQ ID NO: 432155 - DNA, 15 bp, Homo sapiens
tcctcactacattct

SEQ ID NO: 432156 - DNA, 15 bp, Homo sapiens
cctcactacattctg

SEQ ID NO: 432157 - DNA, 15 bp, Homo sapiens
ctcactacattctgc

SEQ ID NO: 432158 - DNA, 15 bp, Homo sapiens
tcactacattctgca

SEQ ID NO: 432159 - DNA, 15 bp, Homo sapiens
cactacattctgcag

SEQ ID NO: 432160 - DNA, 15 bp, Homo sapiens
actacattctgcagg

SEQ ID NO: 432161 - DNA, 15 bp, Homo sapiens
ctacattctgcaggt

SEQ ID NO: 432162 - DNA, 15 bp, Homo sapiens
tacattctgcaggta

SEQ ID NO: 432163 - DNA, 15 bp, Homo sapiens
acattctgcaggtag

SEQ ID NO: 432164 - DNA, 15 bp, Homo sapiens
cattctgcaggtagt

SEQ ID NO: 432165 - DNA, 15 bp, Homo sapiens
attctgcaggtagtg

SEQ ID NO: 432166 - DNA, 15 bp, Homo sapiens
ttctgcaggtagtgg

SEQ ID NO: 432167 - DNA, 15 bp, Homo sapiens
tctgcaggtagtggt

SEQ ID NO: 432168 - DNA, 15 bp, Homo sapiens
ctgcaggtagtggtc

SEQ ID NO: 432169 - DNA, 15 bp, Homo sapiens
tgcaggtagtggtct

SEQ ID NO: 432170 - DNA, 15 bp, Homo sapiens
gcaggtagtggtctt

SEQ ID NO: 432171 - DNA, 15 bp, Homo sapiens
caggtagtggtcttc

SEQ ID NO: 432172 - DNA, 15 bp, Homo sapiens
aggtagtggtcttcc

SEQ ID NO: 432173 - DNA, 15 bp, Homo sapiens
ggtagtggtcttcct

SEQ ID NO: 432174 - DNA, 15 bp, Homo sapiens
gtagtggtcttcctt

SEQ ID NO: 432175 - DNA, 15 bp, Homo sapiens
tagtggtcttccttg

SEQ ID NO: 432176 - DNA, 15 bp, Homo sapiens
agtggtcttccttgc

SEQ ID NO: 432177 - DNA, 15 bp, Homo sapiens
gtggtcttccttgcc

SEQ ID NO: 432178 - DNA, 15 bp, Homo sapiens
tggtcttccttgcct

SEQ ID NO: 432179 - DNA, 15 bp, Homo sapiens
ggtcttccttgcctt

SEQ ID NO: 432180 - DNA, 15 bp, Homo sapiens
gtcttccttgccttt

SEQ ID NO: 432181 - DNA, 15 bp, Homo sapiens
tcttccttgcctttg

SEQ ID NO: 432182 - DNA, 15 bp, Homo sapiens
cttccttgcctttgc

SEQ ID NO: 432183 - DNA, 15 bp, Homo sapiens
ttccttgcctttgcc

SEQ ID NO: 432184 - DNA, 15 bp, Homo sapiens
tccttgcctttgccc

SEQ ID NO: 432185 - DNA, 15 bp, Homo sapiens
ccttgcctttgcccc

SEQ ID NO: 432186 - DNA, 15 bp, Homo sapiens
cttgcctttgcccca

SEQ ID NO: 432187 - DNA, 15 bp, Homo sapiens
ttgcctttgccccat

SEQ ID NO: 432188 - DNA, 15 bp, Homo sapiens
tgcctttgccccatt

SEQ ID NO: 432189 - DNA, 15 bp, Homo sapiens
gcctttgccccattg

SEQ ID NO: 432190 - DNA, 15 bp, Homo sapiens
cctttgccccattgc

SEQ ID NO: 432191 - DNA, 15 bp, Homo sapiens
ctttgccccattgcc

SEQ ID NO: 432192 - DNA, 15 bp, Homo sapiens
tttgccccattgccc

SEQ ID NO: 432193 - DNA, 15 bp, Homo sapiens
ttgccccattgccca

SEQ ID NO: 432194 - DNA, 15 bp, Homo sapiens
tgccccattgcccat

SEQ ID NO: 432195 - DNA, 15 bp, Homo sapiens
gccccattgcccatc

SEQ ID NO: 432196 - DNA, 15 bp, Homo sapiens
ccccattgcccatcc

SEQ ID NO: 432197 - DNA, 15 bp, Homo sapiens
cccattgcccatccc

SEQ ID NO: 432198 - DNA, 15 bp, Homo sapiens
ccattgcccatccca

SEQ ID NO: 432199 - DNA, 15 bp, Homo sapiens
cattgcccatcccag

SEQ ID NO: 432200 - DNA, 15 bp, Homo sapiens
attgcccatcccagt

SEQ ID NO: 432201 - DNA, 15 bp, Homo sapiens
ttgcccatcccagtt

SEQ ID NO: 432202 - DNA, 15 bp, Homo sapiens
tgcccatcccagttt

SEQ ID NO: 432203 - DNA, 15 bp, Homo sapiens
gcccatcccagtttt

SEQ ID NO: 432204 - DNA, 15 bp, Homo sapiens
cccatcccagttttc

SEQ ID NO: 432205 - DNA, 15 bp, Homo sapiens
ccatcccagttttct

SEQ ID NO: 432206 - DNA, 15 bp, Homo sapiens
catcccagttttctg

SEQ ID NO: 432207 - DNA, 15 bp, Homo sapiens
atcccagttttctgc

SEQ ID NO: 432208 - DNA, 15 bp, Homo sapiens
tcccagttttctgcc

SEQ ID NO: 432209 - DNA, 15 bp, Homo sapiens
cccagttttctgcct

SEQ ID NO: 432210 - DNA, 15 bp, Homo sapiens
ccagttttctgcctg

SEQ ID NO: 432211 - DNA, 15 bp, Homo sapiens
cagttttctgcctgt

SEQ ID NO: 432212 - DNA, 15 bp, Homo sapiens
agttttctgcctgta

SEQ ID NO: 432213 - DNA, 15 bp, Homo sapiens
gttttctgcctgtag

SEQ ID NO: 432214 - DNA, 15 bp, Homo sapiens
ttttctgcctgtagg

SEQ ID NO: 432215 - DNA, 15 bp, Homo sapiens
tttctgcctgtaggt

SEQ ID NO: 432216 - DNA, 15 bp, Homo sapiens
ttctgcctgtaggtc

SEQ ID NO: 432217 - DNA, 15 bp, Homo sapiens
tctgcctgtaggtcc

SEQ ID NO: 432218 - DNA, 15 bp, Homo sapiens
ctgcctgtaggtcct

SEQ ID NO: 432219 - DNA, 15 bp, Homo sapiens
tgcctgtaggtcctc

SEQ ID NO: 432220 - DNA, 15 bp, Homo sapiens
gcctgtaggtcctct

SEQ ID NO: 432221 - DNA, 15 bp, Homo sapiens
cctgtaggtcctctg

SEQ ID NO: 432222 - DNA, 15 bp, Homo sapiens
ctgtaggtcctctga

SEQ ID NO: 432223 - DNA, 15 bp, Homo sapiens
tgtaggtcctctgac

SEQ ID NO: 432224 - DNA, 15 bp, Homo sapiens
gtaggtcctctgacc

SEQ ID NO: 432225 - DNA, 15 bp, Homo sapiens
taggtcctctgacct

SEQ ID NO: 432226 - DNA, 15 bp, Homo sapiens
aggtcctctgacctg

SEQ ID NO: 432227 - DNA, 15 bp, Homo sapiens
ggtcctctgacctga

SEQ ID NO: 432228 - DNA, 15 bp, Homo sapiens
gtcctctgacctgat

SEQ ID NO: 432229 - DNA, 15 bp, Homo sapiens
tcctctgacctgatt

SEQ ID NO: 432230 - DNA, 15 bp, Homo sapiens
cctctgacctgattt

SEQ ID NO: 432231 - DNA, 15 bp, Homo sapiens
ctctgacctgatttc

SEQ ID NO: 432232 - DNA, 15 bp, Homo sapiens
tctgacctgatttcc

SEQ ID NO: 432233 - DNA, 15 bp, Homo sapiens
ctgacctgatttcca

SEQ ID NO: 432234 - DNA, 15 bp, Homo sapiens
tgacctgatttccaa

SEQ ID NO: 432235 - DNA, 15 bp, Homo sapiens
gacctgatttccaac

SEQ ID NO: 432236 - DNA, 15 bp, Homo sapiens
acctgatttccaacg

SEQ ID NO: 432237 - DNA, 15 bp, Homo sapiens
cctgatttccaacgc

SEQ ID NO: 432238 - DNA, 15 bp, Homo sapiens
ctgatttccaacgct

SEQ ID NO: 432239 - DNA, 15 bp, Homo sapiens
tgatttccaacgctt

SEQ ID NO: 432240 - DNA, 15 bp, Homo sapiens
gatttccaacgcttg

SEQ ID NO: 432241 - DNA, 15 bp, Homo sapiens
atttccaacgcttgc

SEQ ID NO: 432242 - DNA, 15 bp, Homo sapiens
tttccaacgcttgcc

SEQ ID NO: 432243 - DNA, 15 bp, Homo sapiens
ttccaacgcttgcct

SEQ ID NO: 432244 - DNA, 15 bp, Homo sapiens
tccaacgcttgcctc

SEQ ID NO: 432245 - DNA, 15 bp, Homo sapiens
ccaacgcttgcctca

SEQ ID NO: 432246 - DNA, 15 bp, Homo sapiens
caacgcttgcctcat

SEQ ID NO: 432247 - DNA, 15 bp, Homo sapiens
aacgcttgcctcatt

SEQ ID NO: 432248 - DNA, 15 bp, Homo sapiens
acgcttgcctcattt

SEQ ID NO: 432249 - DNA, 15 bp, Homo sapiens
cgcttgcctcatttg

SEQ ID NO: 432250 - DNA, 15 bp, Homo sapiens
gcttgcctcatttgc

SEQ ID NO: 432251 - DNA, 15 bp, Homo sapiens
cttgcctcatttgcc

SEQ ID NO: 432252 - DNA, 15 bp, Homo sapiens
ttgcctcatttgccc

SEQ ID NO: 432253 - DNA, 15 bp, Homo sapiens
tgcctcatttgccca

SEQ ID NO: 432254 - DNA, 15 bp, Homo sapiens
gcctcatttgcccac

SEQ ID NO: 432255 - DNA, 15 bp, Homo sapiens
cctcatttgcccacg

SEQ ID NO: 432256 - DNA, 15 bp, Homo sapiens
ctcatttgcccacgc

SEQ ID NO: 432257 - DNA, 15 bp, Homo sapiens
tcatttgcccacgca

SEQ ID NO: 432258 - DNA, 15 bp, Homo sapiens
catttgcccacgcag

SEQ ID NO: 432259 - DNA, 15 bp, Homo sapiens
atttgcccacgcagc

SEQ ID NO: 432260 - DNA, 15 bp, Homo sapiens
tttgcccacgcagct

SEQ ID NO: 432261 - DNA, 15 bp, Homo sapiens
ttgcccacgcagctg

SEQ ID NO: 432262 - DNA, 15 bp, Homo sapiens
tgcccacgcagctgc

SEQ ID NO: 432263 - DNA, 15 bp, Homo sapiens
gcccacgcagctgct

SEQ ID NO: 432264 - DNA, 15 bp, Homo sapiens
cccacgcagctgctg

SEQ ID NO: 432265 - DNA, 15 bp, Homo sapiens
ccacgcagctgctgg

SEQ ID NO: 432266 - DNA, 15 bp, Homo sapiens
cacgcagctgctggt

SEQ ID NO: 432267 - DNA, 15 bp, Homo sapiens
acgcagctgctggtc

SEQ ID NO: 432268 - DNA, 15 bp, Homo sapiens
cgcagctgctggtca

SEQ ID NO: 432269 - DNA, 15 bp, Homo sapiens
gcagctgctggtcat

SEQ ID NO: 432270 - DNA, 15 bp, Homo sapiens
cagctgctggtcatc

SEQ ID NO: 432271 - DNA, 15 bp, Homo sapiens
agctgctggtcatcc

SEQ ID NO: 432272 - DNA, 15 bp, Homo sapiens
gctgctggtcatcct

SEQ ID NO: 432273 - DNA, 15 bp, Homo sapiens
ctgctggtcatcctg

SEQ ID NO: 432274 - DNA, 15 bp, Homo sapiens
tgctggtcatcctgc

SEQ ID NO: 432275 - DNA, 15 bp, Homo sapiens
gctggtcatcctgcc

SEQ ID NO: 432276 - DNA, 15 bp, Homo sapiens
ctggtcatcctgccg

SEQ ID NO: 432277 - DNA, 15 bp, Homo sapiens
tggtcatcctgccgg

SEQ ID NO: 432278 - DNA, 15 bp, Homo sapiens
ggtcatcctgccggc

SEQ ID NO: 432279 - DNA, 15 bp, Homo sapiens
gtcatcctgccggct

SEQ ID NO: 432280 - DNA, 15 bp, Homo sapiens
tcatcctgccggctc

SEQ ID NO: 432281 - DNA, 15 bp, Homo sapiens
catcctgccggctct

SEQ ID NO: 432282 - DNA, 15 bp, Homo sapiens
atcctgccggctctg

SEQ ID NO: 432283 - DNA, 15 bp, Homo sapiens
tcctgccggctctgc

SEQ ID NO: 432284 - DNA, 15 bp, Homo sapiens
cctgccggctctgct

SEQ ID NO: 432285 - DNA, 15 bp, Homo sapiens
ctgccggctctgctg

SEQ ID NO: 432286 - DNA, 15 bp, Homo sapiens
tgccggctctgctgg

SEQ ID NO: 432287 - DNA, 15 bp, Homo sapiens
gccggctctgctggg

SEQ ID NO: 432288 - DNA, 15 bp, Homo sapiens
ccggctctgctgggg

SEQ ID NO: 432289 - DNA, 15 bp, Homo sapiens
cggctctgctggggc

SEQ ID NO: 432290 - DNA, 15 bp, Homo sapiens
ggctctgctggggct

SEQ ID NO: 432291 - DNA, 15 bp, Homo sapiens
gctctgctggggctt

SEQ ID NO: 432292 - DNA, 15 bp, Homo sapiens
ctctgctggggcttt

SEQ ID NO: 432293 - DNA, 15 bp, Homo sapiens
tctgctggggctttg

SEQ ID NO: 432294 - DNA, 15 bp, Homo sapiens
ctgctggggctttgt

SEQ ID NO: 432295 - DNA, 15 bp, Homo sapiens
tgctggggctttgtg

SEQ ID NO: 432296 - DNA, 15 bp, Homo sapiens
gctggggctttgtgt

SEQ ID NO: 432297 - DNA, 15 bp, Homo sapiens
ctggggctttgtgtc

SEQ ID NO: 432298 - DNA, 15 bp, Homo sapiens
tggggctttgtgtct

SEQ ID NO: 432299 - DNA, 15 bp, Homo sapiens
ggggctttgtgtctt

SEQ ID NO: 432300 - DNA, 15 bp, Homo sapiens
gggctttgtgtcttc

SEQ ID NO: 432301 - DNA, 15 bp, Homo sapiens
ggctttgtgtcttcc

SEQ ID NO: 432302 - DNA, 15 bp, Homo sapiens
gctttgtgtcttcct

SEQ ID NO: 432303 - DNA, 15 bp, Homo sapiens
ctttgtgtcttcctg

SEQ ID NO: 432304 - DNA, 15 bp, Homo sapiens
tttgtgtcttcctgg

SEQ ID NO: 432305 - DNA, 15 bp, Homo sapiens
ttgtgtcttcctgga

SEQ ID NO: 432306 - DNA, 15 bp, Homo sapiens
tgtgtcttcctggac

SEQ ID NO: 432307 - DNA, 15 bp, Homo sapiens
gtgtcttcctggacg

SEQ ID NO: 432308 - DNA, 15 bp, Homo sapiens
tgtcttcctggacgc

SEQ ID NO: 432309 - DNA, 15 bp, Homo sapiens
gtcttcctggacgct

SEQ ID NO: 432310 - DNA, 15 bp, Homo sapiens
tcttcctggacgctt

SEQ ID NO: 432311 - DNA, 15 bp, Homo sapiens
cttcctggacgcttt

SEQ ID NO: 432312 - DNA, 15 bp, Homo sapiens
ttcctggacgctttc

SEQ ID NO: 432313 - DNA, 15 bp, Homo sapiens
tcctggacgctttcc

SEQ ID NO: 432314 - DNA, 15 bp, Homo sapiens
cctggacgctttccc

SEQ ID NO: 432315 - DNA, 15 bp, Homo sapiens
ctggacgctttccct

SEQ ID NO: 432316 - DNA, 15 bp, Homo sapiens
tggacgctttccctt

SEQ ID NO: 432317 - DNA, 15 bp, Homo sapiens
ggacgctttcccttc

SEQ ID NO: 432318 - DNA, 15 bp, Homo sapiens
gacgctttcccttcc

SEQ ID NO: 432319 - DNA, 15 bp, Homo sapiens
acgctttcccttccc

SEQ ID NO: 432320 - DNA, 15 bp, Homo sapiens
cgctttcccttcccg

SEQ ID NO: 432321 - DNA, 15 bp, Homo sapiens
gctttcccttcccga

SEQ ID NO: 432322 - DNA, 15 bp, Homo sapiens
ctttcccttcccgag

SEQ ID NO: 432323 - DNA, 15 bp, Homo sapiens
tttcccttcccgagc

SEQ ID NO: 432324 - DNA, 15 bp, Homo sapiens
ttcccttcccgagct

SEQ ID NO: 432325 - DNA, 15 bp, Homo sapiens
tcccttcccgagctc

SEQ ID NO: 432326 - DNA, 15 bp, Homo sapiens
cccttcccgagctct

SEQ ID NO: 432327 - DNA, 15 bp, Homo sapiens
ccttcccgagctctc

SEQ ID NO: 432328 - DNA, 15 bp, Homo sapiens
cttcccgagctctct

SEQ ID NO: 432329 - DNA, 15 bp, Homo sapiens
ttcccgagctctctg

SEQ ID NO: 432330 - DNA, 15 bp, Homo sapiens
tcccgagctctctgc

SEQ ID NO: 432331 - DNA, 15 bp, Homo sapiens
cccgagctctctgcc

SEQ ID NO: 432332 - DNA, 15 bp, Homo sapiens
ccgagctctctgcca

SEQ ID NO: 432333 - DNA, 15 bp, Homo sapiens
cgagctctctgccat

SEQ ID NO: 432334 - DNA, 15 bp, Homo sapiens
gagctctctgccatg

SEQ ID NO: 432335 - DNA, 15 bp, Homo sapiens
agctctctgccatga

SEQ ID NO: 432336 - DNA, 15 bp, Homo sapiens
gctctctgccatgat

SEQ ID NO: 432337 - DNA, 15 bp, Homo sapiens
ctctctgccatgatt

SEQ ID NO: 432338 - DNA, 15 bp, Homo sapiens
tctctgccatgattc

SEQ ID NO: 432339 - DNA, 15 bp, Homo sapiens
ctctgccatgattcc

SEQ ID NO: 432340 - DNA, 15 bp, Homo sapiens
tctgccatgattccc

SEQ ID NO: 432341 - DNA, 15 bp, Homo sapiens
ctgccatgattccct

SEQ ID NO: 432342 - DNA, 15 bp, Homo sapiens
tgccatgattccctg

SEQ ID NO: 432343 - DNA, 15 bp, Homo sapiens
gccatgattccctgg

SEQ ID NO: 432344 - DNA, 15 bp, Homo sapiens
ccatgattccctggc

SEQ ID NO: 432345 - DNA, 15 bp, Homo sapiens
catgattccctggca

SEQ ID NO: 432346 - DNA, 15 bp, Homo sapiens
atgattccctggcac

SEQ ID NO: 432347 - DNA, 15 bp, Homo sapiens
tgattccctggcacc

SEQ ID NO: 432348 - DNA, 15 bp, Homo sapiens
gattccctggcaccc

SEQ ID NO: 432349 - DNA, 15 bp, Homo sapiens
attccctggcaccct

SEQ ID NO: 432350 - DNA, 15 bp, Homo sapiens
ttccctggcaccctg

SEQ ID NO: 432351 - DNA, 15 bp, Homo sapiens
tccctggcaccctgt

SEQ ID NO: 432352 - DNA, 15 bp, Homo sapiens
ccctggcaccctgtg

SEQ ID NO: 432353 - DNA, 15 bp, Homo sapiens
cctggcaccctgtgg

SEQ ID NO: 432354 - DNA, 15 bp, Homo sapiens
ctggcaccctgtggt

SEQ ID NO: 432355 - DNA, 15 bp, Homo sapiens
tggcaccctgtggtc

SEQ ID NO: 432356 - DNA, 15 bp, Homo sapiens
ggcaccctgtggtct

SEQ ID NO: 432357 - DNA, 15 bp, Homo sapiens
gcaccctgtggtctc

SEQ ID NO: 432358 - DNA, 15 bp, Homo sapiens
caccctgtggtctct

SEQ ID NO: 432359 - DNA, 15 bp, Homo sapiens
accctgtggtctctc

SEQ ID NO: 432360 - DNA, 15 bp, Homo sapiens
ccctgtggtctctct

SEQ ID NO: 432361 - DNA, 15 bp, Homo sapiens
cctgtggtctctctc

SEQ ID NO: 432362 - DNA, 15 bp, Homo sapiens
ctgtggtctctctca

SEQ ID NO: 432363 - DNA, 15 bp, Homo sapiens
tgtggtctctctcac

SEQ ID NO: 432364 - DNA, 15 bp, Homo sapiens
gtggtctctctcact

SEQ ID NO: 432365 - DNA, 15 bp, Homo sapiens
tggtctctctcactg

SEQ ID NO: 432366 - DNA, 15 bp, Homo sapiens
ggtctctctcactgt

SEQ ID NO: 432367 - DNA, 15 bp, Homo sapiens
gtctctctcactgtg

SEQ ID NO: 432368 - DNA, 15 bp, Homo sapiens
tctctctcactgtgt

SEQ ID NO: 432369 - DNA, 15 bp, Homo sapiens
ctctctcactgtgtt

SEQ ID NO: 432370 - DNA, 15 bp, Homo sapiens
tctctcactgtgttt

SEQ ID NO: 432371 - DNA, 15 bp, Homo sapiens
ctctcactgtgtttt

SEQ ID NO: 432372 - DNA, 15 bp, Homo sapiens
tctcactgtgttttc

SEQ ID NO: 432373 - DNA, 15 bp, Homo sapiens
ctcactgtgttttcc

SEQ ID NO: 432374 - DNA, 15 bp, Homo sapiens
tcactgtgttttcca

SEQ ID NO: 432375 - DNA, 15 bp, Homo sapiens
cactgtgttttccaa

SEQ ID NO: 432376 - DNA, 15 bp, Homo sapiens
actgtgttttccaat

SEQ ID NO: 432377 - DNA, 15 bp, Homo sapiens
ctgtgttttccaatg

SEQ ID NO: 432378 - DNA, 15 bp, Homo sapiens
tgtgttttccaatgt

SEQ ID NO: 432379 - DNA, 15 bp, Homo sapiens
gtgttttccaatgtc

SEQ ID NO: 432380 - DNA, 15 bp, Homo sapiens
tgttttccaatgtct

SEQ ID NO: 432381 - DNA, 15 bp, Homo sapiens
gttttccaatgtctg

SEQ ID NO: 432382 - DNA, 15 bp, Homo sapiens
ttttccaatgtctgt

SEQ ID NO: 432383 - DNA, 15 bp, Homo sapiens
tttccaatgtctgtg

SEQ ID NO: 432384 - DNA, 15 bp, Homo sapiens
ttccaatgtctgtgt

SEQ ID NO: 432385 - DNA, 15 bp, Homo sapiens
tccaatgtctgtgtc

SEQ ID NO: 432386 - DNA, 15 bp, Homo sapiens
ccaatgtctgtgtct

SEQ ID NO: 432387 - DNA, 15 bp, Homo sapiens
caatgtctgtgtctg

SEQ ID NO: 432388 - DNA, 15 bp, Homo sapiens
aatgtctgtgtctga

SEQ ID NO: 432389 - DNA, 15 bp, Homo sapiens
atgtctgtgtctgaa

SEQ ID NO: 432390 - DNA, 15 bp, Homo sapiens
tgtctgtgtctgaag

SEQ ID NO: 432391 - DNA, 15 bp, Homo sapiens
gtctgtgtctgaagc

SEQ ID NO: 432392 - DNA, 15 bp, Homo sapiens
tctgtgtctgaagct

SEQ ID NO: 432393 - DNA, 15 bp, Homo sapiens
ctgtgtctgaagctt

SEQ ID NO: 432394 - DNA, 15 bp, Homo sapiens
tgtgtctgaagcttg

SEQ ID NO: 432395 - DNA, 15 bp, Homo sapiens
gtgtctgaagcttgg

SEQ ID NO: 432396 - DNA, 15 bp, Homo sapiens
tgtctgaagcttggc

SEQ ID NO: 432397 - DNA, 15 bp, Homo sapiens
gtctgaagcttggcc

SEQ ID NO: 432398 - DNA, 15 bp, Homo sapiens
tctgaagcttggccc

SEQ ID NO: 432399 - DNA, 15 bp, Homo sapiens
ctgaagcttggccct

SEQ ID NO: 432400 - DNA, 15 bp, Homo sapiens
tgaagcttggccctt

SEQ ID NO: 432401 - DNA, 15 bp, Homo sapiens
gaagcttggcccttc

SEQ ID NO: 432402 - DNA, 15 bp, Homo sapiens
aagcttggcccttcc

SEQ ID NO: 432403 - DNA, 15 bp, Homo sapiens
agcttggcccttccc

SEQ ID NO: 432404 - DNA, 15 bp, Homo sapiens
gcttggcccttccct

SEQ ID NO: 432405 - DNA, 15 bp, Homo sapiens
cttggcccttccctc

SEQ ID NO: 432406 - DNA, 15 bp, Homo sapiens
ttggcccttccctct

SEQ ID NO: 432407 - DNA, 15 bp, Homo sapiens
tggcccttccctctt

SEQ ID NO: 432408 - DNA, 15 bp, Homo sapiens
ggcccttccctcttt

SEQ ID NO: 432409 - DNA, 15 bp, Homo sapiens
gcccttccctctttt

SEQ ID NO: 432410 - DNA, 15 bp, Homo sapiens
cccttccctcttttt

SEQ ID NO: 432411 - DNA, 15 bp, Homo sapiens
ccttccctctttttt

SEQ ID NO: 432412 - DNA, 15 bp, Homo sapiens
cttccctcttttttt

SEQ ID NO: 432413 - DNA, 15 bp, Homo sapiens
ttccctcttttttta

SEQ ID NO: 432414 - DNA, 15 bp, Homo sapiens
tccctctttttttag

SEQ ID NO: 432415 - DNA, 15 bp, Homo sapiens
ccctctttttttagt

SEQ ID NO: 432416 - DNA, 15 bp, Homo sapiens
cctctttttttagtg

SEQ ID NO: 432417 - DNA, 15 bp, Homo sapiens
ctctttttttagtga

SEQ ID NO: 432418 - DNA, 15 bp, Homo sapiens
tctttttttagtgat

SEQ ID NO: 432419 - DNA, 15 bp, Homo sapiens
ctttttttagtgatt

SEQ ID NO: 432420 - DNA, 15 bp, Homo sapiens
tttttttagtgatta

SEQ ID NO: 432421 - DNA, 15 bp, Homo sapiens
ttttttagtgattac

SEQ ID NO: 432422 - DNA, 15 bp, Homo sapiens
tttttagtgattacc

SEQ ID NO: 432423 - DNA, 15 bp, Homo sapiens
ttttagtgattaccc

SEQ ID NO: 432424 - DNA, 15 bp, Homo sapiens
tttagtgattaccct

SEQ ID NO: 432425 - DNA, 15 bp, Homo sapiens
ttagtgattaccctc

SEQ ID NO: 432426 - DNA, 15 bp, Homo sapiens
tagtgattaccctca

SEQ ID NO: 432427 - DNA, 15 bp, Homo sapiens
agtgattaccctcat

SEQ ID NO: 432428 - DNA, 15 bp, Homo sapiens
gtgattaccctcatt

SEQ ID NO: 432429 - DNA, 15 bp, Homo sapiens
tgattaccctcattg

SEQ ID NO: 432430 - DNA, 15 bp, Homo sapiens
gattaccctcattga

SEQ ID NO: 432431 - DNA, 15 bp, Homo sapiens
attaccctcattgat

SEQ ID NO: 432432 - DNA, 15 bp, Homo sapiens
ttaccctcattgatg

SEQ ID NO: 432433 - DNA, 15 bp, Homo sapiens
taccctcattgatgg

SEQ ID NO: 432434 - DNA, 15 bp, Homo sapiens
accctcattgatgga

SEQ ID NO: 432435 - DNA, 15 bp, Homo sapiens
ccctcattgatggag

SEQ ID NO: 432436 - DNA, 15 bp, Homo sapiens
cctcattgatggaga

SEQ ID NO: 432437 - DNA, 15 bp, Homo sapiens
ctcattgatggagag

SEQ ID NO: 432438 - DNA, 15 bp, Homo sapiens
tcattgatggagagt

SEQ ID NO: 432439 - DNA, 15 bp, Homo sapiens
cattgatggagagtc

SEQ ID NO: 432440 - DNA, 15 bp, Homo sapiens
attgatggagagtct

SEQ ID NO: 432441 - DNA, 15 bp, Homo sapiens
ttgatggagagtctg

SEQ ID NO: 432442 - DNA, 15 bp, Homo sapiens
tgatggagagtctga

SEQ ID NO: 432443 - DNA, 15 bp, Homo sapiens
gatggagagtctgaa

SEQ ID NO: 432444 - DNA, 15 bp, Homo sapiens
atggagagtctgaaa

SEQ ID NO: 432445 - DNA, 15 bp, Homo sapiens
tggagagtctgaaag

SEQ ID NO: 432446 - DNA, 15 bp, Homo sapiens
ggagagtctgaaaga

SEQ ID NO: 432447 - DNA, 15 bp, Homo sapiens
gagagtctgaaagag

SEQ ID NO: 432448 - DNA, 15 bp, Homo sapiens
agagtctgaaagagt

SEQ ID NO: 432449 - DNA, 15 bp, Homo sapiens
gagtctgaaagagtg

SEQ ID NO: 432450 - DNA, 15 bp, Homo sapiens
agtctgaaagagtgt

SEQ ID NO: 432451 - DNA, 15 bp, Homo sapiens
gtctgaaagagtgta

SEQ ID NO: 432452 - DNA, 15 bp, Homo sapiens
tctgaaagagtgtaa

SEQ ID NO: 432453 - DNA, 15 bp, Homo sapiens
ctgaaagagtgtaaa

SEQ ID NO: 432454 - DNA, 15 bp, Homo sapiens
tgaaagagtgtaaaa

SEQ ID NO: 432455 - DNA, 15 bp, Homo sapiens
gaaagagtgtaaaaa

SEQ ID NO: 432456 - DNA, 15 bp, Homo sapiens
aaagagtgtaaaaaa

SEQ ID NO: 432457 - DNA, 15 bp, Homo sapiens
aagagtgtaaaaaaa

SEQ ID NO: 432458 - DNA, 15 bp, Homo sapiens
agagtgtaaaaaaat

SEQ ID NO: 432459 - DNA, 15 bp, Homo sapiens
gagtgtaaaaaaatg

SEQ ID NO: 432460 - DNA, 15 bp, Homo sapiens
agtgtaaaaaaatga

SEQ ID NO: 432461 - DNA, 15 bp, Homo sapiens
gtgtaaaaaaatgat

SEQ ID NO: 432462 - DNA, 15 bp, Homo sapiens
tgtaaaaaaatgatc

SEQ ID NO: 432463 - DNA, 15 bp, Homo sapiens
gtaaaaaaatgatct

SEQ ID NO: 432464 - DNA, 15 bp, Homo sapiens
taaaaaaatgatctg

SEQ ID NO: 432465 - DNA, 15 bp, Homo sapiens
aaaaaaatgatctga

SEQ ID NO: 432466 - DNA, 15 bp, Homo sapiens
aaaaaatgatctgag

SEQ ID NO: 432467 - DNA, 15 bp, Homo sapiens
aaaaatgatctgagc

SEQ ID NO: 432468 - DNA, 15 bp, Homo sapiens
aaaatgatctgagca

SEQ ID NO: 432469 - DNA, 15 bp, Homo sapiens
aaatgatctgagcag

SEQ ID NO: 432470 - DNA, 15 bp, Homo sapiens
aatgatctgagcagc

SEQ ID NO: 432471 - DNA, 15 bp, Homo sapiens
atgatctgagcagcc

SEQ ID NO: 432472 - DNA, 15 bp, Homo sapiens
tgatctgagcagcca

SEQ ID NO: 432473 - DNA, 15 bp, Homo sapiens
gatctgagcagccag

SEQ ID NO: 432474 - DNA, 15 bp, Homo sapiens
atctgagcagccagg

SEQ ID NO: 432475 - DNA, 15 bp, Homo sapiens
tctgagcagccagga

SEQ ID NO: 432476 - DNA, 15 bp, Homo sapiens
ctgagcagccaggat

SEQ ID NO: 432477 - DNA, 15 bp, Homo sapiens
tgagcagccaggata

SEQ ID NO: 432478 - DNA, 15 bp, Homo sapiens
gagcagccaggatag

SEQ ID NO: 432479 - DNA, 15 bp, Homo sapiens
agcagccaggataga

SEQ ID NO: 432480 - DNA, 15 bp, Homo sapiens
gcagccaggatagag

SEQ ID NO: 432481 - DNA, 15 bp, Homo sapiens
cagccaggatagaga

SEQ ID NO: 432482 - DNA, 15 bp, Homo sapiens
agccaggatagagat

SEQ ID NO: 432483 - DNA, 15 bp, Homo sapiens
gccaggatagagatt

SEQ ID NO: 432484 - DNA, 15 bp, Homo sapiens
ccaggatagagattg

SEQ ID NO: 432485 - DNA, 15 bp, Homo sapiens
caggatagagattgt

SEQ ID NO: 432486 - DNA, 15 bp, Homo sapiens
aggatagagattgta

SEQ ID NO: 432487 - DNA, 15 bp, Homo sapiens
ggatagagattgtat

SEQ ID NO: 432488 - DNA, 15 bp, Homo sapiens
gatagagattgtatg

SEQ ID NO: 432489 - DNA, 15 bp, Homo sapiens
atagagattgtatgg

SEQ ID NO: 432490 - DNA, 15 bp, Homo sapiens
tagagattgtatgga

SEQ ID NO: 432491 - DNA, 15 bp, Homo sapiens
agagattgtatggaa

SEQ ID NO: 432492 - DNA, 15 bp, Homo sapiens
gagattgtatggaaa

SEQ ID NO: 432493 - DNA, 15 bp, Homo sapiens
agattgtatggaaaa

SEQ ID NO: 432494 - DNA, 15 bp, Homo sapiens
gattgtatggaaaac

SEQ ID NO: 432495 - DNA, 15 bp, Homo sapiens
attgtatggaaaaca

SEQ ID NO: 432496 - DNA, 15 bp, Homo sapiens
ttgtatggaaaacat

SEQ ID NO: 432497 - DNA, 15 bp, Homo sapiens
tgtatggaaaacata

SEQ ID NO: 432498 - DNA, 15 bp, Homo sapiens
gtatggaaaacatag

SEQ ID NO: 432499 - DNA, 15 bp, Homo sapiens
tatggaaaacatagt

SEQ ID NO: 432500 - DNA, 15 bp, Homo sapiens
atggaaaacatagtg

SEQ ID NO: 432501 - DNA, 15 bp, Homo sapiens
tggaaaacatagtgc

SEQ ID NO: 432502 - DNA, 15 bp, Homo sapiens
ggaaaacatagtgca

SEQ ID NO: 432503 - DNA, 15 bp, Homo sapiens
gaaaacatagtgcag

SEQ ID NO: 432504 - DNA, 15 bp, Homo sapiens
aaaacatagtgcaga

SEQ ID NO: 432505 - DNA, 15 bp, Homo sapiens
aaacatagtgcagat

SEQ ID NO: 432506 - DNA, 15 bp, Homo sapiens
aacatagtgcagatc

SEQ ID NO: 432507 - DNA, 15 bp, Homo sapiens
acatagtgcagatcc

SEQ ID NO: 432508 - DNA, 15 bp, Homo sapiens
catagtgcagatcct

SEQ ID NO: 432509 - DNA, 15 bp, Homo sapiens
atagtgcagatcctt

SEQ ID NO: 432510 - DNA, 15 bp, Homo sapiens
tagtgcagatccttt

SEQ ID NO: 432511 - DNA, 15 bp, Homo sapiens
agtgcagatcctttt

SEQ ID NO: 432512 - DNA, 15 bp, Homo sapiens
gtgcagatccttttc

SEQ ID NO: 432513 - DNA, 15 bp, Homo sapiens
tgcagatccttttct

SEQ ID NO: 432514 - DNA, 15 bp, Homo sapiens
gcagatccttttctt

SEQ ID NO: 432515 - DNA, 15 bp, Homo sapiens
cagatccttttctta

SEQ ID NO: 432516 - DNA, 15 bp, Homo sapiens
agatccttttcttag

SEQ ID NO: 432517 - DNA, 15 bp, Homo sapiens
gatccttttcttaga

SEQ ID NO: 432518 - DNA, 15 bp, Homo sapiens
atccttttcttagat

SEQ ID NO: 432519 - DNA, 15 bp, Homo sapiens
tccttttcttagatc

SEQ ID NO: 432520 - DNA, 15 bp, Homo sapiens
ccttttcttagatca

SEQ ID NO: 432521 - DNA, 15 bp, Homo sapiens
cttttcttagatcat

SEQ ID NO: 432522 - DNA, 15 bp, Homo sapiens
ttttcttagatcatg

SEQ ID NO: 432523 - DNA, 15 bp, Homo sapiens
tttcttagatcatgg

SEQ ID NO: 432524 - DNA, 15 bp, Homo sapiens
ttcttagatcatggg

SEQ ID NO: 432525 - DNA, 15 bp, Homo sapiens
tcttagatcatggga

SEQ ID NO: 432526 - DNA, 15 bp, Homo sapiens
cttagatcatgggaa

SEQ ID NO: 432527 - DNA, 15 bp, Homo sapiens
ttagatcatgggaaa

SEQ ID NO: 432528 - DNA, 15 bp, Homo sapiens
tagatcatgggaaag

SEQ ID NO: 432529 - DNA, 15 bp, Homo sapiens
agatcatgggaaagc

SEQ ID NO: 432530 - DNA, 15 bp, Homo sapiens
gatcatgggaaagcc

SEQ ID NO: 432531 - DNA, 15 bp, Homo sapiens
atcatgggaaagcca

SEQ ID NO: 432532 - DNA, 15 bp, Homo sapiens
tcatgggaaagccac

SEQ ID NO: 432533 - DNA, 15 bp, Homo sapiens
catgggaaagccact

SEQ ID NO: 432534 - DNA, 15 bp, Homo sapiens
atgggaaagccactg

SEQ ID NO: 432535 - DNA, 15 bp, Homo sapiens
tgggaaagccactga

SEQ ID NO: 432536 - DNA, 15 bp, Homo sapiens
gggaaagccactgaa

SEQ ID NO: 432537 - DNA, 15 bp, Homo sapiens
ggaaagccactgaag

SEQ ID NO: 432538 - DNA, 15 bp, Homo sapiens
gaaagccactgaagt

SEQ ID NO: 432539 - DNA, 15 bp, Homo sapiens
aaagccactgaagta

SEQ ID NO: 432540 - DNA, 15 bp, Homo sapiens
aagccactgaagtac

SEQ ID NO: 432541 - DNA, 15 bp, Homo sapiens
agccactgaagtact

SEQ ID NO: 432542 - DNA, 15 bp, Homo sapiens
gccactgaagtactt

SEQ ID NO: 432543 - DNA, 15 bp, Homo sapiens
ccactgaagtacttc

SEQ ID NO: 432544 - DNA, 15 bp, Homo sapiens
cactgaagtacttct

SEQ ID NO: 432545 - DNA, 15 bp, Homo sapiens
actgaagtacttctc

SEQ ID NO: 432546 - DNA, 15 bp, Homo sapiens
ctgaagtacttctca

SEQ ID NO: 432547 - DNA, 15 bp, Homo sapiens
tgaagtacttctcag

SEQ ID NO: 432548 - DNA, 15 bp, Homo sapiens
gaagtacttctcaga

SEQ ID NO: 432549 - DNA, 15 bp, Homo sapiens
aagtacttctcagag

SEQ ID NO: 432550 - DNA, 15 bp, Homo sapiens
agtacttctcagagg

SEQ ID NO: 432551 - DNA, 15 bp, Homo sapiens
gtacttctcagaggt

SEQ ID NO: 432552 - DNA, 15 bp, Homo sapiens
tacttctcagaggta

SEQ ID NO: 432553 - DNA, 15 bp, Homo sapiens
acttctcagaggtat

SEQ ID NO: 432554 - DNA, 15 bp, Homo sapiens
cttctcagaggtatt

SEQ ID NO: 432555 - DNA, 15 bp, Homo sapiens
ttctcagaggtatta

SEQ ID NO: 432556 - DNA, 15 bp, Homo sapiens
tctcagaggtattaa

SEQ ID NO: 432557 - DNA, 15 bp, Homo sapiens
ctcagaggtattaac

SEQ ID NO: 432558 - DNA, 15 bp, Homo sapiens
tcagaggtattaact

SEQ ID NO: 432559 - DNA, 15 bp, Homo sapiens
cagaggtattaactt

SEQ ID NO: 432560 - DNA, 15 bp, Homo sapiens
agaggtattaacttc

SEQ ID NO: 432561 - DNA, 15 bp, Homo sapiens
gaggtattaacttct

SEQ ID NO: 432562 - DNA, 15 bp, Homo sapiens
aggtattaacttctg

SEQ ID NO: 432563 - DNA, 15 bp, Homo sapiens
ggtattaacttctgc

SEQ ID NO: 432564 - DNA, 15 bp, Homo sapiens
gtattaacttctgct

SEQ ID NO: 432565 - DNA, 15 bp, Homo sapiens
tattaacttctgctg

SEQ ID NO: 432566 - DNA, 15 bp, Homo sapiens
attaacttctgctgt

SEQ ID NO: 432567 - DNA, 15 bp, Homo sapiens
ttaacttctgctgta

SEQ ID NO: 432568 - DNA, 15 bp, Homo sapiens
taacttctgctgtag

SEQ ID NO: 432569 - DNA, 15 bp, Homo sapiens
aacttctgctgtaga

SEQ ID NO: 432570 - DNA, 15 bp, Homo sapiens
acttctgctgtagac

SEQ ID NO: 432571 - DNA, 15 bp, Homo sapiens
cttctgctgtagaca

SEQ ID NO: 432572 - DNA, 15 bp, Homo sapiens
ttctgctgtagacac

SEQ ID NO: 432573 - DNA, 15 bp, Homo sapiens
tctgctgtagacact

SEQ ID NO: 432574 - DNA, 15 bp, Homo sapiens
ctgctgtagacactg

SEQ ID NO: 432575 - DNA, 15 bp, Homo sapiens
tgctgtagacactgg

SEQ ID NO: 432576 - DNA, 15 bp, Homo sapiens
gctgtagacactggt

SEQ ID NO: 432577 - DNA, 15 bp, Homo sapiens
ctgtagacactggtg

SEQ ID NO: 432578 - DNA, 15 bp, Homo sapiens
tgtagacactggtgc

SEQ ID NO: 432579 - DNA, 15 bp, Homo sapiens
gtagacactggtgcg

SEQ ID NO: 432580 - DNA, 15 bp, Homo sapiens
tagacactggtgcga

SEQ ID NO: 432581 - DNA, 15 bp, Homo sapiens
agacactggtgcgac

SEQ ID NO: 432582 - DNA, 15 bp, Homo sapiens
gacactggtgcgact

SEQ ID NO: 432583 - DNA, 15 bp, Homo sapiens
acactggtgcgactg

SEQ ID NO: 432584 - DNA, 15 bp, Homo sapiens
cactggtgcgactgt

SEQ ID NO: 432585 - DNA, 15 bp, Homo sapiens
actggtgcgactgta

SEQ ID NO: 432586 - DNA, 15 bp, Homo sapiens
ctggtgcgactgtat

SEQ ID NO: 432587 - DNA, 15 bp, Homo sapiens
tggtgcgactgtatg

SEQ ID NO: 432588 - DNA, 15 bp, Homo sapiens
ggtgcgactgtatga

SEQ ID NO: 432589 - DNA, 15 bp, Homo sapiens
gtgcgactgtatgaa

SEQ ID NO: 432590 - DNA, 15 bp, Homo sapiens
tgcgactgtatgaac

SEQ ID NO: 432591 - DNA, 15 bp, Homo sapiens
gcgactgtatgaact

SEQ ID NO: 432592 - DNA, 15 bp, Homo sapiens
cgactgtatgaactt

SEQ ID NO: 432593 - DNA, 15 bp, Homo sapiens
gactgtatgaacttg

SEQ ID NO: 432594 - DNA, 15 bp, Homo sapiens
actgtatgaacttga

SEQ ID NO: 432595 - DNA, 15 bp, Homo sapiens
ctgtatgaacttgat

SEQ ID NO: 432596 - DNA, 15 bp, Homo sapiens
tgtatgaacttgatg

SEQ ID NO: 432597 - DNA, 15 bp, Homo sapiens
gtatgaacttgatgt

SEQ ID NO: 432598 - DNA, 15 bp, Homo sapiens
tatgaacttgatgtc

SEQ ID NO: 432599 - DNA, 15 bp, Homo sapiens
atgaacttgatgtcc

SEQ ID NO: 432600 - DNA, 15 bp, Homo sapiens
tgaacttgatgtccg

SEQ ID NO: 432601 - DNA, 15 bp, Homo sapiens
gaacttgatgtccgg

SEQ ID NO: 432602 - DNA, 15 bp, Homo sapiens
aacttgatgtccggt

SEQ ID NO: 432603 - DNA, 15 bp, Homo sapiens
acttgatgtccggtg

SEQ ID NO: 432604 - DNA, 15 bp, Homo sapiens
cttgatgtccggtga

SEQ ID NO: 432605 - DNA, 15 bp, Homo sapiens
ttgatgtccggtgag

SEQ ID NO: 432606 - DNA, 15 bp, Homo sapiens
tgatgtccggtgagt

SEQ ID NO: 432607 - DNA, 15 bp, Homo sapiens
gatgtccggtgagtg

SEQ ID NO: 432608 - DNA, 15 bp, Homo sapiens
atgtccggtgagtga

SEQ ID NO: 432609 - DNA, 15 bp, Homo sapiens
tgtccggtgagtgat

SEQ ID NO: 432610 - DNA, 15 bp, Homo sapiens
gtccggtgagtgatg

SEQ ID NO: 432611 - DNA, 15 bp, Homo sapiens
tccggtgagtgatgg

SEQ ID NO: 432612 - DNA, 15 bp, Homo sapiens
ccggtgagtgatggg

SEQ ID NO: 432613 - DNA, 15 bp, Homo sapiens
cggtgagtgatgggt

SEQ ID NO: 432614 - DNA, 15 bp, Homo sapiens
ggtgagtgatgggta

SEQ ID NO: 432615 - DNA, 15 bp, Homo sapiens
gtgagtgatgggtaa

SEQ ID NO: 432616 - DNA, 15 bp, Homo sapiens
tgagtgatgggtaag

SEQ ID NO: 432617 - DNA, 15 bp, Homo sapiens
gagtgatgggtaagt

SEQ ID NO: 432618 - DNA, 15 bp, Homo sapiens
agtgatgggtaagta

SEQ ID NO: 432619 - DNA, 15 bp, Homo sapiens
gtgatgggtaagtag

SEQ ID NO: 432620 - DNA, 15 bp, Homo sapiens
tgatgggtaagtagc

SEQ ID NO: 432621 - DNA, 15 bp, Homo sapiens
gatgggtaagtagca

SEQ ID NO: 432622 - DNA, 15 bp, Homo sapiens
atgggtaagtagcaa

SEQ ID NO: 432623 - DNA, 15 bp, Homo sapiens
tgggtaagtagcaaa

SEQ ID NO: 432624 - DNA, 15 bp, Homo sapiens
gggtaagtagcaaaa

SEQ ID NO: 432625 - DNA, 15 bp, Homo sapiens
ggtaagtagcaaaat

SEQ ID NO: 432626 - DNA, 15 bp, Homo sapiens
gtaagtagcaaaatg

SEQ ID NO: 432627 - DNA, 15 bp, Homo sapiens
taagtagcaaaatga

SEQ ID NO: 432628 - DNA, 15 bp, Homo sapiens
aagtagcaaaatgaa

SEQ ID NO: 432629 - DNA, 15 bp, Homo sapiens
agtagcaaaatgaag

SEQ ID NO: 432630 - DNA, 15 bp, Homo sapiens
gtagcaaaatgaagt

SEQ ID NO: 432631 - DNA, 15 bp, Homo sapiens
tagcaaaatgaagtg

SEQ ID NO: 432632 - DNA, 15 bp, Homo sapiens
agcaaaatgaagtga

SEQ ID NO: 432633 - DNA, 15 bp, Homo sapiens
gcaaaatgaagtgac

SEQ ID NO: 432634 - DNA, 15 bp, Homo sapiens
caaaatgaagtgaca

SEQ ID NO: 432635 - DNA, 15 bp, Homo sapiens
aaaatgaagtgacag

SEQ ID NO: 432636 - DNA, 15 bp, Homo sapiens
aaatgaagtgacagg

SEQ ID NO: 432637 - DNA, 15 bp, Homo sapiens
aatgaagtgacagga

SEQ ID NO: 432638 - DNA, 15 bp, Homo sapiens
atgaagtgacaggac

SEQ ID NO: 432639 - DNA, 15 bp, Homo sapiens
tgaagtgacaggaca

SEQ ID NO: 432640 - DNA, 15 bp, Homo sapiens
gaagtgacaggacag

SEQ ID NO: 432641 - DNA, 15 bp, Homo sapiens
aagtgacaggacagg

SEQ ID NO: 432642 - DNA, 15 bp, Homo sapiens
agtgacaggacaggg

SEQ ID NO: 432643 - DNA, 15 bp, Homo sapiens
gtgacaggacaggga

SEQ ID NO: 432644 - DNA, 15 bp, Homo sapiens
tgacaggacagggac

SEQ ID NO: 432645 - DNA, 15 bp, Homo sapiens
gacaggacagggaca

SEQ ID NO: 432646 - DNA, 15 bp, Homo sapiens
acaggacagggacaa

SEQ ID NO: 432647 - DNA, 15 bp, Homo sapiens
caggacagggacaaa

SEQ ID NO: 432648 - DNA, 15 bp, Homo sapiens
aggacagggacaaag

SEQ ID NO: 432649 - DNA, 15 bp, Homo sapiens
ggacagggacaaaga

SEQ ID NO: 432650 - DNA, 15 bp, Homo sapiens
gacagggacaaagat

SEQ ID NO: 432651 - DNA, 15 bp, Homo sapiens
acagggacaaagatt

SEQ ID NO: 432652 - DNA, 15 bp, Homo sapiens
cagggacaaagatta

SEQ ID NO: 432653 - DNA, 15 bp, Homo sapiens
agggacaaagattaa

SEQ ID NO: 432654 - DNA, 15 bp, Homo sapiens
gggacaaagattaat

SEQ ID NO: 432655 - DNA, 15 bp, Homo sapiens
ggacaaagattaatg

SEQ ID NO: 432656 - DNA, 15 bp, Homo sapiens
gacaaagattaatgg

SEQ ID NO: 432657 - DNA, 15 bp, Homo sapiens
acaaagattaatggt

SEQ ID NO: 432658 - DNA, 15 bp, Homo sapiens
caaagattaatggta

SEQ ID NO: 432659 - DNA, 15 bp, Homo sapiens
aaagattaatggtaa

SEQ ID NO: 432660 - DNA, 15 bp, Homo sapiens
aagattaatggtaag

SEQ ID NO: 432661 - DNA, 15 bp, Homo sapiens
agattaatggtaaga

SEQ ID NO: 432662 - DNA, 15 bp, Homo sapiens
gattaatggtaagaa

SEQ ID NO: 432663 - DNA, 15 bp, Homo sapiens
attaatggtaagaaa

SEQ ID NO: 432664 - DNA, 15 bp, Homo sapiens
ttaatggtaagaaat

SEQ ID NO: 432665 - DNA, 15 bp, Homo sapiens
taatggtaagaaatg

SEQ ID NO: 432666 - DNA, 15 bp, Homo sapiens
aatggtaagaaatga

SEQ ID NO: 432667 - DNA, 15 bp, Homo sapiens
atggtaagaaatgac

SEQ ID NO: 432668 - DNA, 15 bp, Homo sapiens
tggtaagaaatgact

SEQ ID NO: 432669 - DNA, 15 bp, Homo sapiens
ggtaagaaatgactc

SEQ ID NO: 432670 - DNA, 15 bp, Homo sapiens
gtaagaaatgactcc

SEQ ID NO: 432671 - DNA, 15 bp, Homo sapiens
taagaaatgactcca

SEQ ID NO: 432672 - DNA, 15 bp, Homo sapiens
aagaaatgactccag

SEQ ID NO: 432673 - DNA, 15 bp, Homo sapiens
agaaatgactccagc

SEQ ID NO: 432674 - DNA, 15 bp, Homo sapiens
gaaatgactccagct

SEQ ID NO: 432675 - DNA, 15 bp, Homo sapiens
aaatgactccagctg

SEQ ID NO: 432676 - DNA, 15 bp, Homo sapiens
aatgactccagctgt

SEQ ID NO: 432677 - DNA, 15 bp, Homo sapiens
atgactccagctgtc

SEQ ID NO: 432678 - DNA, 15 bp, Homo sapiens
tgactccagctgtct

SEQ ID NO: 432679 - DNA, 15 bp, Homo sapiens
gactccagctgtctg

SEQ ID NO: 432680 - DNA, 15 bp, Homo sapiens
actccagctgtctga

SEQ ID NO: 432681 - DNA, 15 bp, Homo sapiens
ctccagctgtctgac

SEQ ID NO: 432682 - DNA, 15 bp, Homo sapiens
tccagctgtctgaca

SEQ ID NO: 432683 - DNA, 15 bp, Homo sapiens
ccagctgtctgacag

SEQ ID NO: 432684 - DNA, 15 bp, Homo sapiens
cagctgtctgacagc

SEQ ID NO: 432685 - DNA, 15 bp, Homo sapiens
agctgtctgacagca

SEQ ID NO: 432686 - DNA, 15 bp, Homo sapiens
gctgtctgacagcaa

SEQ ID NO: 432687 - DNA, 15 bp, Homo sapiens
ctgtctgacagcaat

SEQ ID NO: 432688 - DNA, 15 bp, Homo sapiens
tgtctgacagcaatg

SEQ ID NO: 432689 - DNA, 15 bp, Homo sapiens
gtctgacagcaatga

SEQ ID NO: 432690 - DNA, 15 bp, Homo sapiens
tctgacagcaatgag

SEQ ID NO: 432691 - DNA, 15 bp, Homo sapiens
ctgacagcaatgagg

SEQ ID NO: 432692 - DNA, 15 bp, Homo sapiens
tgacagcaatgagga

SEQ ID NO: 432693 - DNA, 15 bp, Homo sapiens
gacagcaatgaggag

SEQ ID NO: 432694 - DNA, 15 bp, Homo sapiens
acagcaatgaggaga

SEQ ID NO: 432695 - DNA, 15 bp, Homo sapiens
cagcaatgaggagaa

SEQ ID NO: 432696 - DNA, 15 bp, Homo sapiens
agcaatgaggagaaa

SEQ ID NO: 432697 - DNA, 15 bp, Homo sapiens
gcaatgaggagaaag

SEQ ID NO: 432698 - DNA, 15 bp, Homo sapiens
caatgaggagaaaga

SEQ ID NO: 432699 - DNA, 15 bp, Homo sapiens
aatgaggagaaagaa

SEQ ID NO: 432700 - DNA, 15 bp, Homo sapiens
atgaggagaaagaaa

SEQ ID NO: 432701 - DNA, 15 bp, Homo sapiens
tgaggagaaagaaat

SEQ ID NO: 432702 - DNA, 15 bp, Homo sapiens
gaggagaaagaaatg

SEQ ID NO: 432703 - DNA, 15 bp, Homo sapiens
aggagaaagaaatga

SEQ ID NO: 432704 - DNA, 15 bp, Homo sapiens
ggagaaagaaatgat

SEQ ID NO: 432705 - DNA, 15 bp, Homo sapiens
gagaaagaaatgata

SEQ ID NO: 432706 - DNA, 15 bp, Homo sapiens
agaaagaaatgataa

SEQ ID NO: 432707 - DNA, 15 bp, Homo sapiens
gaaagaaatgataaa

SEQ ID NO: 432708 - DNA, 15 bp, Homo sapiens
aaagaaatgataaaa

SEQ ID NO: 432709 - DNA, 15 bp, Homo sapiens
aagaaatgataaaaa

SEQ ID NO: 432710 - DNA, 15 bp, Homo sapiens
gaaatgataaaaaga

SEQ ID NO: 432711 - DNA, 15 bp, Homo sapiens
aaatgataaaaagat

SEQ ID NO: 432712 - DNA, 15 bp, Homo sapiens
aatgataaaaagata

SEQ ID NO: 432713 - DNA, 15 bp, Homo sapiens
atgataaaaagatat

SEQ ID NO: 432714 - DNA, 15 bp, Homo sapiens
tgataaaaagatatg

SEQ ID NO: 432715 - DNA, 15 bp, Homo sapiens
gataaaaagatatgc

SEQ ID NO: 432716 - DNA, 15 bp, Homo sapiens
ataaaaagatatgca

SEQ ID NO: 432717 - DNA, 15 bp, Homo sapiens
taaaaagatatgcaa

SEQ ID NO: 432718 - DNA, 15 bp, Homo sapiens
aaaaagatatgcaag

SEQ ID NO: 432719 - DNA, 15 bp, Homo sapiens
aaaagatatgcaaga

SEQ ID NO: 432720 - DNA, 15 bp, Homo sapiens
aaagatatgcaagaa

SEQ ID NO: 432721 - DNA, 15 bp, Homo sapiens
aagatatgcaagaat

SEQ ID NO: 432722 - DNA, 15 bp, Homo sapiens
agatatgcaagaatc

SEQ ID NO: 432723 - DNA, 15 bp, Homo sapiens
gatatgcaagaatcc

SEQ ID NO: 432724 - DNA, 15 bp, Homo sapiens
atatgcaagaatcct

SEQ ID NO: 432725 - DNA, 15 bp, Homo sapiens
tatgcaagaatccta

SEQ ID NO: 432726 - DNA, 15 bp, Homo sapiens
atgcaagaatcctaa

SEQ ID NO: 432727 - DNA, 15 bp, Homo sapiens
tgcaagaatcctaaa

SEQ ID NO: 432728 - DNA, 15 bp, Homo sapiens
gcaagaatcctaaaa

SEQ ID NO: 432729 - DNA, 15 bp, Homo sapiens
caagaatcctaaaat

SEQ ID NO: 432730 - DNA, 15 bp, Homo sapiens
aagaatcctaaaata

SEQ ID NO: 432731 - DNA, 15 bp, Homo sapiens
agaatcctaaaataa

SEQ ID NO: 432732 - DNA, 15 bp, Homo sapiens
gaatcctaaaataaa

SEQ ID NO: 432733 - DNA, 15 bp, Homo sapiens
aatcctaaaataaaa

SEQ ID NO: 432734 - DNA, 15 bp, Homo sapiens
atcctaaaataaaac

SEQ ID NO: 432735 - DNA, 15 bp, Homo sapiens
tcctaaaataaaaca

SEQ ID NO: 432736 - DNA, 15 bp, Homo sapiens
cctaaaataaaacaa

SEQ ID NO: 432737 - DNA, 15 bp, Homo sapiens
ctaaaataaaacaaa

SEQ ID NO: 432738 - DNA, 15 bp, Homo sapiens
taaaataaaacaaaa

SEQ ID NO: 432739 - DNA, 15 bp, Homo sapiens
aaaataaaacaaaac

SEQ ID NO: 432740 - DNA, 15 bp, Homo sapiens
aaataaaacaaaacg

SEQ ID NO: 432741 - DNA, 15 bp, Homo sapiens
aataaaacaaaacga

SEQ ID NO: 432742 - DNA, 15 bp, Homo sapiens
ataaaacaaaacgag

SEQ ID NO: 432743 - DNA, 15 bp, Homo sapiens
taaaacaaaacgagg

SEQ ID NO: 432744 - DNA, 15 bp, Homo sapiens
aaaacaaaacgaggt

SEQ ID NO: 432745 - DNA, 15 bp, Homo sapiens
aaacaaaacgaggta

SEQ ID NO: 432746 - DNA, 15 bp, Homo sapiens
aacaaaacgaggtag

SEQ ID NO: 432747 - DNA, 15 bp, Homo sapiens
acaaaacgaggtagt

SEQ ID NO: 432748 - DNA, 15 bp, Homo sapiens
caaaacgaggtagtc

SEQ ID NO: 432749 - DNA, 15 bp, Homo sapiens
aaaacgaggtagtct

SEQ ID NO: 432750 - DNA, 15 bp, Homo sapiens
aaacgaggtagtctt

SEQ ID NO: 432751 - DNA, 15 bp, Homo sapiens
aacgaggtagtcttt

SEQ ID NO: 432752 - DNA, 15 bp, Homo sapiens
acgaggtagtctttg

SEQ ID NO: 432753 - DNA, 15 bp, Homo sapiens
cgaggtagtctttgg

SEQ ID NO: 432754 - DNA, 15 bp, Homo sapiens
gaggtagtctttggg

SEQ ID NO: 432755 - DNA, 15 bp, Homo sapiens
aggtagtctttggga

SEQ ID NO: 432756 - DNA, 15 bp, Homo sapiens
ggtagtctttgggac

SEQ ID NO: 432757 - DNA, 15 bp, Homo sapiens
gtagtctttgggact

SEQ ID NO: 432758 - DNA, 15 bp, Homo sapiens
tagtctttgggactt

SEQ ID NO: 432759 - DNA, 15 bp, Homo sapiens
agtctttgggacttt

SEQ ID NO: 432760 - DNA, 15 bp, Homo sapiens
gtctttgggactttc

SEQ ID NO: 432761 - DNA, 15 bp, Homo sapiens
tctttgggactttca

SEQ ID NO: 432762 - DNA, 15 bp, Homo sapiens
ctttgggactttcaa

SEQ ID NO: 432763 - DNA, 15 bp, Homo sapiens
tttgggactttcaac

SEQ ID NO: 432764 - DNA, 15 bp, Homo sapiens
ttgggactttcaaca

SEQ ID NO: 432765 - DNA, 15 bp, Homo sapiens
tgggactttcaacag

SEQ ID NO: 432766 - DNA, 15 bp, Homo sapiens
gggactttcaacagt

SEQ ID NO: 432767 - DNA, 15 bp, Homo sapiens
ggactttcaacagta

SEQ ID NO: 432768 - DNA, 15 bp, Homo sapiens
gactttcaacagtaa

SEQ ID NO: 432769 - DNA, 15 bp, Homo sapiens
actttcaacagtaaa

SEQ ID NO: 432770 - DNA, 15 bp, Homo sapiens
ctttcaacagtaaaa

SEQ ID NO: 432771 - DNA, 15 bp, Homo sapiens
tttcaacagtaaaag

SEQ ID NO: 432772 - DNA, 15 bp, Homo sapiens
ttcaacagtaaaaga

SEQ ID NO: 432773 - DNA, 15 bp, Homo sapiens
tcaacagtaaaagaa

SEQ ID NO: 432774 - DNA, 15 bp, Homo sapiens
caacagtaaaagaaa

SEQ ID NO: 432775 - DNA, 15 bp, Homo sapiens
aacagtaaaagaaaa

SEQ ID NO: 432776 - DNA, 15 bp, Homo sapiens
cagtaaaagaaaact

SEQ ID NO: 432777 - DNA, 15 bp, Homo sapiens
agtaaaagaaaactg

SEQ ID NO: 432778 - DNA, 15 bp, Homo sapiens
gtaaaagaaaactga

SEQ ID NO: 432779 - DNA, 15 bp, Homo sapiens
taaaagaaaactgaa

SEQ ID NO: 432780 - DNA, 15 bp, Homo sapiens
aaaagaaaactgaag

SEQ ID NO: 432781 - DNA, 15 bp, Homo sapiens
aaagaaaactgaagc

SEQ ID NO: 432782 - DNA, 15 bp, Homo sapiens
aagaaaactgaagct

SEQ ID NO: 432783 - DNA, 15 bp, Homo sapiens
agaaaactgaagctg

SEQ ID NO: 432784 - DNA, 15 bp, Homo sapiens
gaaaactgaagctgt

SEQ ID NO: 432785 - DNA, 15 bp, Homo sapiens
aaaactgaagctgtg

SEQ ID NO: 432786 - DNA, 15 bp, Homo sapiens
aaactgaagctgtga

SEQ ID NO: 432787 - DNA, 15 bp, Homo sapiens
aactgaagctgtgaa

SEQ ID NO: 432788 - DNA, 15 bp, Homo sapiens
actgaagctgtgaat

SEQ ID NO: 432789 - DNA, 15 bp, Homo sapiens
ctgaagctgtgaatt

SEQ ID NO: 432790 - DNA, 15 bp, Homo sapiens
tgaagctgtgaatta

SEQ ID NO: 432791 - DNA, 15 bp, Homo sapiens
gaagctgtgaattat

SEQ ID NO: 432792 - DNA, 15 bp, Homo sapiens
aagctgtgaattatg

SEQ ID NO: 432793 - DNA, 15 bp, Homo sapiens
agctgtgaattatgg

SEQ ID NO: 432794 - DNA, 15 bp, Homo sapiens
gctgtgaattatggt

SEQ ID NO: 432795 - DNA, 15 bp, Homo sapiens
ctgtgaattatggtg

SEQ ID NO: 432796 - DNA, 15 bp, Homo sapiens
tgtgaattatggtgt

SEQ ID NO: 432797 - DNA, 15 bp, Homo sapiens
gtgaattatggtgtg

SEQ ID NO: 432798 - DNA, 15 bp, Homo sapiens
tgaattatggtgtgt

SEQ ID NO: 432799 - DNA, 15 bp, Homo sapiens
gaattatggtgtgtg

SEQ ID NO: 432800 - DNA, 15 bp, Homo sapiens
aattatggtgtgtgt

SEQ ID NO: 432801 - DNA, 15 bp, Homo sapiens
attatggtgtgtgta

SEQ ID NO: 432802 - DNA, 15 bp, Homo sapiens
ttatggtgtgtgtat

SEQ ID NO: 432803 - DNA, 15 bp, Homo sapiens
tatggtgtgtgtatt

SEQ ID NO: 432804 - DNA, 15 bp, Homo sapiens
atggtgtgtgtattt

SEQ ID NO: 432805 - DNA, 15 bp, Homo sapiens
tggtgtgtgtatttc

SEQ ID NO: 432806 - DNA, 15 bp, Homo sapiens
ggtgtgtgtatttct

SEQ ID NO: 432807 - DNA, 15 bp, Homo sapiens
gtgtgtgtatttctg

SEQ ID NO: 432808 - DNA, 15 bp, Homo sapiens
tgtgtgtatttctga

SEQ ID NO: 432809 - DNA, 15 bp, Homo sapiens
gtgtgtatttctgaa

SEQ ID NO: 432810 - DNA, 15 bp, Homo sapiens
tgtgtatttctgaag

SEQ ID NO: 432811 - DNA, 15 bp, Homo sapiens
gtgtatttctgaaga

SEQ ID NO: 432812 - DNA, 15 bp, Homo sapiens
tgtatttctgaagac

SEQ ID NO: 432813 - DNA, 15 bp, Homo sapiens
gtatttctgaagaca

SEQ ID NO: 432814 - DNA, 15 bp, Homo sapiens
tatttctgaagacag

SEQ ID NO: 432815 - DNA, 15 bp, Homo sapiens
atttctgaagacaga

SEQ ID NO: 432816 - DNA, 15 bp, Homo sapiens
tttctgaagacagaa

SEQ ID NO: 432817 - DNA, 15 bp, Homo sapiens
ttctgaagacagaat

SEQ ID NO: 432818 - DNA, 15 bp, Homo sapiens
tctgaagacagaata

SEQ ID NO: 432819 - DNA, 15 bp, Homo sapiens
ctgaagacagaatat

SEQ ID NO: 432820 - DNA, 15 bp, Homo sapiens
tgaagacagaatata

SEQ ID NO: 432821 - DNA, 15 bp, Homo sapiens
gaagacagaatataa

SEQ ID NO: 432822 - DNA, 15 bp, Homo sapiens
aagacagaatataaa

SEQ ID NO: 432823 - DNA, 15 bp, Homo sapiens
agacagaatataaat

SEQ ID NO: 432824 - DNA, 15 bp, Homo sapiens
gacagaatataaatc

SEQ ID NO: 432825 - DNA, 15 bp, Homo sapiens
acagaatataaatca

SEQ ID NO: 432826 - DNA, 15 bp, Homo sapiens
cagaatataaatcag

SEQ ID NO: 432827 - DNA, 15 bp, Homo sapiens
agaatataaatcagt

SEQ ID NO: 432828 - DNA, 15 bp, Homo sapiens
gaatataaatcagtt

SEQ ID NO: 432829 - DNA, 15 bp, Homo sapiens
aatataaatcagtta

SEQ ID NO: 432830 - DNA, 15 bp, Homo sapiens
atataaatcagttaa

SEQ ID NO: 432831 - DNA, 15 bp, Homo sapiens
tataaatcagttaag

SEQ ID NO: 432832 - DNA, 15 bp, Homo sapiens
ataaatcagttaaga

SEQ ID NO: 432833 - DNA, 15 bp, Homo sapiens
taaatcagttaagag

SEQ ID NO: 432834 - DNA, 15 bp, Homo sapiens
aaatcagttaagaga

SEQ ID NO: 432835 - DNA, 15 bp, Homo sapiens
aatcagttaagagaa

SEQ ID NO: 432836 - DNA, 15 bp, Homo sapiens
atcagttaagagaag

SEQ ID NO: 432837 - DNA, 15 bp, Homo sapiens
tcagttaagagaagg

SEQ ID NO: 432838 - DNA, 15 bp, Homo sapiens
cagttaagagaaggc

SEQ ID NO: 432839 - DNA, 15 bp, Homo sapiens
agttaagagaaggca

SEQ ID NO: 432840 - DNA, 15 bp, Homo sapiens
gttaagagaaggcat

SEQ ID NO: 432841 - DNA, 15 bp, Homo sapiens
ttaagagaaggcata

SEQ ID NO: 432842 - DNA, 15 bp, Homo sapiens
taagagaaggcatag

SEQ ID NO: 432843 - DNA, 15 bp, Homo sapiens
aagagaaggcatagg

SEQ ID NO: 432844 - DNA, 15 bp, Homo sapiens
agagaaggcatagga

SEQ ID NO: 432845 - DNA, 15 bp, Homo sapiens
gagaaggcataggaa

SEQ ID NO: 432846 - DNA, 15 bp, Homo sapiens
agaaggcataggaat

SEQ ID NO: 432847 - DNA, 15 bp, Homo sapiens
gaaggcataggaatt

SEQ ID NO: 432848 - DNA, 15 bp, Homo sapiens
aaggcataggaattt

SEQ ID NO: 432849 - DNA, 15 bp, Homo sapiens
aggcataggaattta

SEQ ID NO: 432850 - DNA, 15 bp, Homo sapiens
ggcataggaatttat

SEQ ID NO: 432851 - DNA, 15 bp, Homo sapiens
gcataggaatttata

SEQ ID NO: 432852 - DNA, 15 bp, Homo sapiens
cataggaatttatat

SEQ ID NO: 432853 - DNA, 15 bp, Homo sapiens
ataggaatttatatt

SEQ ID NO: 432854 - DNA, 15 bp, Homo sapiens
taggaatttatatta

SEQ ID NO: 432855 - DNA, 15 bp, Homo sapiens
aggaatttatattat

SEQ ID NO: 432856 - DNA, 15 bp, Homo sapiens
ggaatttatattata

SEQ ID NO: 432857 - DNA, 15 bp, Homo sapiens
gaatttatattatat

SEQ ID NO: 432858 - DNA, 15 bp, Homo sapiens
tttatattatatttt

SEQ ID NO: 432859 - DNA, 15 bp, Homo sapiens
ttatattatatttta

SEQ ID NO: 432860 - DNA, 15 bp, Homo sapiens
tatattatattttag

SEQ ID NO: 432861 - DNA, 15 bp, Homo sapiens
atattatattttagt

SEQ ID NO: 432862 - DNA, 15 bp, Homo sapiens
tattatattttagta

SEQ ID NO: 432863 - DNA, 15 bp, Homo sapiens
attatattttagtaa

SEQ ID NO: 432864 - DNA, 15 bp, Homo sapiens
ttatattttagtaaa

SEQ ID NO: 432865 - DNA, 15 bp, Homo sapiens
tatattttagtaaat

SEQ ID NO: 432866 - DNA, 15 bp, Homo sapiens
atattttagtaaatt

SEQ ID NO: 432867 - DNA, 15 bp, Homo sapiens
tattttagtaaattt

SEQ ID NO: 432868 - DNA, 15 bp, Homo sapiens
attttagtaaatttt

SEQ ID NO: 432869 - DNA, 15 bp, Homo sapiens
ttttagtaaattttc

SEQ ID NO: 432870 - DNA, 15 bp, Homo sapiens
tttagtaaattttct

SEQ ID NO: 432871 - DNA, 15 bp, Homo sapiens
ttagtaaattttctt

SEQ ID NO: 432872 - DNA, 15 bp, Homo sapiens
tagtaaattttcttc

SEQ ID NO: 432873 - DNA, 15 bp, Homo sapiens
agtaaattttcttcc

SEQ ID NO: 432874 - DNA, 15 bp, Homo sapiens
gtaaattttcttcca

SEQ ID NO: 432875 - DNA, 15 bp, Homo sapiens
aaattttcttccaaa

SEQ ID NO: 432876 - DNA, 15 bp, Homo sapiens
aattttcttccaaaa

SEQ ID NO: 432877 - DNA, 15 bp, Homo sapiens
attttcttccaaaat

SEQ ID NO: 432878 - DNA, 15 bp, Homo sapiens
ttttcttccaaaatg

SEQ ID NO: 432879 - DNA, 15 bp, Homo sapiens
tttcttccaaaatgg

SEQ ID NO: 432880 - DNA, 15 bp, Homo sapiens
ttcttccaaaatggt

SEQ ID NO: 432881 - DNA, 15 bp, Homo sapiens
tcttccaaaatggta

SEQ ID NO: 432882 - DNA, 15 bp, Homo sapiens
cttccaaaatggtaa

SEQ ID NO: 432883 - DNA, 15 bp, Homo sapiens
ttccaaaatggtaac

SEQ ID NO: 432884 - DNA, 15 bp, Homo sapiens
tccaaaatggtaacc

SEQ ID NO: 432885 - DNA, 15 bp, Homo sapiens
ccaaaatggtaacca

SEQ ID NO: 432886 - DNA, 15 bp, Homo sapiens
caaaatggtaaccat

SEQ ID NO: 432887 - DNA, 15 bp, Homo sapiens
aaaatggtaaccata

SEQ ID NO: 432888 - DNA, 15 bp, Homo sapiens
aaatggtaaccataa

SEQ ID NO: 432889 - DNA, 15 bp, Homo sapiens
aatggtaaccataaa

SEQ ID NO: 432890 - DNA, 15 bp, Homo sapiens
atggtaaccataaaa

SEQ ID NO: 432891 - DNA, 15 bp, Homo sapiens
tggtaaccataaaaa

SEQ ID NO: 432892 - DNA, 15 bp, Homo sapiens
ggtaaccataaaaaa

SEQ ID NO: 432893 - DNA, 15 bp, Homo sapiens
gtaaccataaaaaaa

SEQ ID NO: 432894 - DNA, 15 bp, Homo sapiens
taaccataaaaaaat

SEQ ID NO: 432895 - DNA, 15 bp, Homo sapiens
aaccataaaaaaata

SEQ ID NO: 432896 - DNA, 15 bp, Homo sapiens
accataaaaaaatag

SEQ ID NO: 432897 - DNA, 15 bp, Homo sapiens
ccataaaaaaatagg

SEQ ID NO: 432898 - DNA, 15 bp, Homo sapiens
cataaaaaaataggg

SEQ ID NO: 432899 - DNA, 15 bp, Homo sapiens
ataaaaaaatagggc

SEQ ID NO: 432900 - DNA, 15 bp, Homo sapiens
taaaaaaatagggct

SEQ ID NO: 432901 - DNA, 15 bp, Homo sapiens
aaaaaaatagggcta

SEQ ID NO: 432902 - DNA, 15 bp, Homo sapiens
aaaaaatagggctaa

SEQ ID NO: 432903 - DNA, 15 bp, Homo sapiens
aaaaatagggctaaa

SEQ ID NO: 432904 - DNA, 15 bp, Homo sapiens
aaaatagggctaaat

SEQ ID NO: 432905 - DNA, 15 bp, Homo sapiens
aaatagggctaaatg

SEQ ID NO: 432906 - DNA, 15 bp, Homo sapiens
aatagggctaaatgg

SEQ ID NO: 432907 - DNA, 15 bp, Homo sapiens
atagggctaaatggg

SEQ ID NO: 432908 - DNA, 15 bp, Homo sapiens
tagggctaaatgggt

SEQ ID NO: 432909 - DNA, 15 bp, Homo sapiens
agggctaaatgggta

SEQ ID NO: 432910 - DNA, 15 bp, Homo sapiens
gggctaaatgggtaa

SEQ ID NO: 432911 - DNA, 15 bp, Homo sapiens
ggctaaatgggtaaa

SEQ ID NO: 432912 - DNA, 15 bp, Homo sapiens
gctaaatgggtaaaa

SEQ ID NO: 432913 - DNA, 15 bp, Homo sapiens
ctaaatgggtaaaat

SEQ ID NO: 432914 - DNA, 15 bp, Homo sapiens
taaatgggtaaaatg

SEQ ID NO: 432915 - DNA, 15 bp, Homo sapiens
aaatgggtaaaatgt

SEQ ID NO: 432916 - DNA, 15 bp, Homo sapiens
aatgggtaaaatgta

SEQ ID NO: 432917 - DNA, 15 bp, Homo sapiens
atgggtaaaatgtag

SEQ ID NO: 432918 - DNA, 15 bp, Homo sapiens
tgggtaaaatgtagc

SEQ ID NO: 432919 - DNA, 15 bp, Homo sapiens
gggtaaaatgtagct

SEQ ID NO: 432920 - DNA, 15 bp, Homo sapiens
ggtaaaatgtagctc

SEQ ID NO: 432921 - DNA, 15 bp, Homo sapiens
gtaaaatgtagctct

SEQ ID NO: 432922 - DNA, 15 bp, Homo sapiens
taaaatgtagctctt

SEQ ID NO: 432923 - DNA, 15 bp, Homo sapiens
aaaatgtagctcttt

SEQ ID NO: 432924 - DNA, 15 bp, Homo sapiens
aaatgtagctctttg

SEQ ID NO: 432925 - DNA, 15 bp, Homo sapiens
aatgtagctctttgg

SEQ ID NO: 432926 - DNA, 15 bp, Homo sapiens
atgtagctctttgga

SEQ ID NO: 432927 - DNA, 15 bp, Homo sapiens
tgtagctctttggaa

SEQ ID NO: 432928 - DNA, 15 bp, Homo sapiens
gtagctctttggaaa

SEQ ID NO: 432929 - DNA, 15 bp, Homo sapiens
tagctctttggaaaa

SEQ ID NO: 432930 - DNA, 15 bp, Homo sapiens
agctctttggaaaac

SEQ ID NO: 432931 - DNA, 15 bp, Homo sapiens
gctctttggaaaact

SEQ ID NO: 432932 - DNA, 15 bp, Homo sapiens
ctctttggaaaactc

SEQ ID NO: 432933 - DNA, 15 bp, Homo sapiens
tctttggaaaactca

SEQ ID NO: 432934 - DNA, 15 bp, Homo sapiens
ctttggaaaactcaa

SEQ ID NO: 432935 - DNA, 15 bp, Homo sapiens
tttggaaaactcaac

SEQ ID NO: 432936 - DNA, 15 bp, Homo sapiens
ttggaaaactcaact

SEQ ID NO: 432937 - DNA, 15 bp, Homo sapiens
tggaaaactcaacta

SEQ ID NO: 432938 - DNA, 15 bp, Homo sapiens
ggaaaactcaactac

SEQ ID NO: 432939 - DNA, 15 bp, Homo sapiens
gaaaactcaactact

SEQ ID NO: 432940 - DNA, 15 bp, Homo sapiens
aaaactcaactactc

SEQ ID NO: 432941 - DNA, 15 bp, Homo sapiens
aaactcaactactca

SEQ ID NO: 432942 - DNA, 15 bp, Homo sapiens
aactcaactactcag

SEQ ID NO: 432943 - DNA, 15 bp, Homo sapiens
actcaactactcaga

SEQ ID NO: 432944 - DNA, 15 bp, Homo sapiens
ctcaactactcagat

SEQ ID NO: 432945 - DNA, 15 bp, Homo sapiens
tcaactactcagatt

SEQ ID NO: 432946 - DNA, 15 bp, Homo sapiens
caactactcagattt

SEQ ID NO: 432947 - DNA, 15 bp, Homo sapiens
aactactcagatttc

SEQ ID NO: 432948 - DNA, 15 bp, Homo sapiens
actactcagatttct

SEQ ID NO: 432949 - DNA, 15 bp, Homo sapiens
ctactcagatttctg

SEQ ID NO: 432950 - DNA, 15 bp, Homo sapiens
tactcagatttctgc

SEQ ID NO: 432951 - DNA, 15 bp, Homo sapiens
actcagatttctgct

SEQ ID NO: 432952 - DNA, 15 bp, Homo sapiens
ctcagatttctgctt

SEQ ID NO: 432953 - DNA, 15 bp, Homo sapiens
tcagatttctgctta

SEQ ID NO: 432954 - DNA, 15 bp, Homo sapiens
cagatttctgcttat

SEQ ID NO: 432955 - DNA, 15 bp, Homo sapiens
agatttctgcttata

SEQ ID NO: 432956 - DNA, 15 bp, Homo sapiens
gatttctgcttataa

SEQ ID NO: 432957 - DNA, 15 bp, Homo sapiens
atttctgcttataaa

SEQ ID NO: 432958 - DNA, 15 bp, Homo sapiens
tttctgcttataaat

SEQ ID NO: 432959 - DNA, 15 bp, Homo sapiens
ttctgcttataaatg

SEQ ID NO: 432960 - DNA, 15 bp, Homo sapiens
tctgcttataaatgg

SEQ ID NO: 432961 - DNA, 15 bp, Homo sapiens
ctgcttataaatggc

SEQ ID NO: 432962 - DNA, 15 bp, Homo sapiens
tgcttataaatggct

SEQ ID NO: 432963 - DNA, 15 bp, Homo sapiens
gcttataaatggcta

SEQ ID NO: 432964 - DNA, 15 bp, Homo sapiens
cttataaatggctat

SEQ ID NO: 432965 - DNA, 15 bp, Homo sapiens
ttataaatggctatt

SEQ ID NO: 432966 - DNA, 15 bp, Homo sapiens
tataaatggctatta

SEQ ID NO: 432967 - DNA, 15 bp, Homo sapiens
ataaatggctattaa

SEQ ID NO: 432968 - DNA, 15 bp, Homo sapiens
taaatggctattaag

SEQ ID NO: 432969 - DNA, 15 bp, Homo sapiens
aaatggctattaagt

SEQ ID NO: 432970 - DNA, 15 bp, Homo sapiens
aatggctattaagta

SEQ ID NO: 432971 - DNA, 15 bp, Homo sapiens
atggctattaagtaa

SEQ ID NO: 432972 - DNA, 15 bp, Homo sapiens
tggctattaagtaaa

SEQ ID NO: 432973 - DNA, 15 bp, Homo sapiens
ggctattaagtaaat

SEQ ID NO: 432974 - DNA, 15 bp, Homo sapiens
gctattaagtaaata

SEQ ID NO: 432975 - DNA, 15 bp, Homo sapiens
ctattaagtaaatat

SEQ ID NO: 432976 - DNA, 15 bp, Homo sapiens
tattaagtaaatatg

SEQ ID NO: 432977 - DNA, 15 bp, Homo sapiens
attaagtaaatatga

SEQ ID NO: 432978 - DNA, 15 bp, Homo sapiens
ttaagtaaatatgat

SEQ ID NO: 432979 - DNA, 15 bp, Homo sapiens
taagtaaatatgatt

SEQ ID NO: 432980 - DNA, 15 bp, Homo sapiens
aagtaaatatgattt

SEQ ID NO: 432981 - DNA, 15 bp, Homo sapiens
agtaaatatgatttt

SEQ ID NO: 432982 - DNA, 15 bp, Homo sapiens
gtaaatatgattttt

SEQ ID NO: 432983 - DNA, 15 bp, Homo sapiens
taaatatgattttta

SEQ ID NO: 432984 - DNA, 15 bp, Homo sapiens
aaatatgatttttag

SEQ ID NO: 432985 - DNA, 15 bp, Homo sapiens
aatatgatttttagc

SEQ ID NO: 432986 - DNA, 15 bp, Homo sapiens
atatgatttttagct

SEQ ID NO: 432987 - DNA, 15 bp, Homo sapiens
tatgatttttagctg

SEQ ID NO: 432988 - DNA, 15 bp, Homo sapiens
atgatttttagctga

SEQ ID NO: 432989 - DNA, 15 bp, Homo sapiens
tgatttttagctgaa

SEQ ID NO: 432990 - DNA, 15 bp, Homo sapiens
gatttttagctgaac

SEQ ID NO: 432991 - DNA, 15 bp, Homo sapiens
atttttagctgaact

SEQ ID NO: 432992 - DNA, 15 bp, Homo sapiens
tttttagctgaacta

SEQ ID NO: 432993 - DNA, 15 bp, Homo sapiens
ttttagctgaactaa

SEQ ID NO: 432994 - DNA, 15 bp, Homo sapiens
tttagctgaactaaa

SEQ ID NO: 432995 - DNA, 15 bp, Homo sapiens
ttagctgaactaaaa

SEQ ID NO: 432996 - DNA, 15 bp, Homo sapiens
tagctgaactaaaat

SEQ ID NO: 432997 - DNA, 15 bp, Homo sapiens
agctgaactaaaatt

SEQ ID NO: 432998 - DNA, 15 bp, Homo sapiens
gctgaactaaaatta

SEQ ID NO: 432999 - DNA, 15 bp, Homo sapiens
ctgaactaaaattat

SEQ ID NO: 433000 - DNA, 15 bp, Homo sapiens
tgaactaaaattatc

SEQ ID NO: 433001 - DNA, 15 bp, Homo sapiens
gaactaaaattatct

SEQ ID NO: 433002 - DNA, 15 bp, Homo sapiens
aactaaaattatctg

SEQ ID NO: 433003 - DNA, 15 bp, Homo sapiens
actaaaattatctga

SEQ ID NO: 433004 - DNA, 15 bp, Homo sapiens
ctaaaattatctgaa

SEQ ID NO: 433005 - DNA, 15 bp, Homo sapiens
taaaattatctgaat

SEQ ID NO: 433006 - DNA, 15 bp, Homo sapiens
aaaattatctgaatc

SEQ ID NO: 433007 - DNA, 15 bp, Homo sapiens
aaattatctgaatcc

SEQ ID NO: 433008 - DNA, 15 bp, Homo sapiens
aattatctgaatcct

SEQ ID NO: 433009 - DNA, 15 bp, Homo sapiens
attatctgaatcctt

SEQ ID NO: 433010 - DNA, 15 bp, Homo sapiens
ttatctgaatccttg

SEQ ID NO: 433011 - DNA, 15 bp, Homo sapiens
tatctgaatccttgt

SEQ ID NO: 433012 - DNA, 15 bp, Homo sapiens
atctgaatccttgta

SEQ ID NO: 433013 - DNA, 15 bp, Homo sapiens
tctgaatccttgtag

SEQ ID NO: 433014 - DNA, 15 bp, Homo sapiens
ctgaatccttgtaga

SEQ ID NO: 433015 - DNA, 15 bp, Homo sapiens
tgaatccttgtagaa

SEQ ID NO: 433016 - DNA, 15 bp, Homo sapiens
gaatccttgtagaaa

SEQ ID NO: 433017 - DNA, 15 bp, Homo sapiens
aatccttgtagaaat

SEQ ID NO: 433018 - DNA, 15 bp, Homo sapiens
atccttgtagaaatt

SEQ ID NO: 433019 - DNA, 15 bp, Homo sapiens
tccttgtagaaattt

SEQ ID NO: 433020 - DNA, 15 bp, Homo sapiens
ccttgtagaaatttt

SEQ ID NO: 433021 - DNA, 15 bp, Homo sapiens
cttgtagaaatttta

SEQ ID NO: 433022 - DNA, 15 bp, Homo sapiens
ttgtagaaattttac

SEQ ID NO: 433023 - DNA, 15 bp, Homo sapiens
tgtagaaattttacc

SEQ ID NO: 433024 - DNA, 15 bp, Homo sapiens
gtagaaattttacca

SEQ ID NO: 433025 - DNA, 15 bp, Homo sapiens
tagaaattttaccaa

SEQ ID NO: 433026 - DNA, 15 bp, Homo sapiens
agaaattttaccaag

SEQ ID NO: 433027 - DNA, 15 bp, Homo sapiens
gaaattttaccaagt

SEQ ID NO: 433028 - DNA, 15 bp, Homo sapiens
aaattttaccaagtt

SEQ ID NO: 433029 - DNA, 15 bp, Homo sapiens
aattttaccaagttc

SEQ ID NO: 433030 - DNA, 15 bp, Homo sapiens
attttaccaagttca

SEQ ID NO: 433031 - DNA, 15 bp, Homo sapiens
ttttaccaagttcac

SEQ ID NO: 433032 - DNA, 15 bp, Homo sapiens
tttaccaagttcaca

SEQ ID NO: 433033 - DNA, 15 bp, Homo sapiens
ttaccaagttcacaa

SEQ ID NO: 433034 - DNA, 15 bp, Homo sapiens
taccaagttcacaac

SEQ ID NO: 433035 - DNA, 15 bp, Homo sapiens
accaagttcacaact

SEQ ID NO: 433036 - DNA, 15 bp, Homo sapiens
ccaagttcacaactt

SEQ ID NO: 433037 - DNA, 15 bp, Homo sapiens
caagttcacaacttt

SEQ ID NO: 433038 - DNA, 15 bp, Homo sapiens
aagttcacaactttg

SEQ ID NO: 433039 - DNA, 15 bp, Homo sapiens
agttcacaactttgt

SEQ ID NO: 433040 - DNA, 15 bp, Homo sapiens
gttcacaactttgtc

SEQ ID NO: 433041 - DNA, 15 bp, Homo sapiens
ttcacaactttgtca

SEQ ID NO: 433042 - DNA, 15 bp, Homo sapiens
tcacaactttgtcag

SEQ ID NO: 433043 - DNA, 15 bp, Homo sapiens
cacaactttgtcagt

SEQ ID NO: 433044 - DNA, 15 bp, Homo sapiens
acaactttgtcagta

SEQ ID NO: 433045 - DNA, 15 bp, Homo sapiens
caactttgtcagtag

SEQ ID NO: 433046 - DNA, 15 bp, Homo sapiens
aactttgtcagtagt

SEQ ID NO: 433047 - DNA, 15 bp, Homo sapiens
actttgtcagtagtc

SEQ ID NO: 433048 - DNA, 15 bp, Homo sapiens
ctttgtcagtagtcc

SEQ ID NO: 433049 - DNA, 15 bp, Homo sapiens
tttgtcagtagtccc

SEQ ID NO: 433050 - DNA, 15 bp, Homo sapiens
ttgtcagtagtccct

SEQ ID NO: 433051 - DNA, 15 bp, Homo sapiens
tgtcagtagtccctg

SEQ ID NO: 433052 - DNA, 15 bp, Homo sapiens
gtcagtagtccctga

SEQ ID NO: 433053 - DNA, 15 bp, Homo sapiens
tcagtagtccctgac

SEQ ID NO: 433054 - DNA, 15 bp, Homo sapiens
cagtagtccctgact

SEQ ID NO: 433055 - DNA, 15 bp, Homo sapiens
agtagtccctgactt

SEQ ID NO: 433056 - DNA, 15 bp, Homo sapiens
gtagtccctgacttt

SEQ ID NO: 433057 - DNA, 15 bp, Homo sapiens
tagtccctgactttt

SEQ ID NO: 433058 - DNA, 15 bp, Homo sapiens
agtccctgacttttg

SEQ ID NO: 433059 - DNA, 15 bp, Homo sapiens
gtccctgacttttgt

SEQ ID NO: 433060 - DNA, 15 bp, Homo sapiens
tccctgacttttgtt

SEQ ID NO: 433061 - DNA, 15 bp, Homo sapiens
ccctgacttttgttt

SEQ ID NO: 433062 - DNA, 15 bp, Homo sapiens
cctgacttttgtttg

SEQ ID NO: 433063 - DNA, 15 bp, Homo sapiens
ctgacttttgtttga

SEQ ID NO: 433064 - DNA, 15 bp, Homo sapiens
tgacttttgtttgag

SEQ ID NO: 433065 - DNA, 15 bp, Homo sapiens
gacttttgtttgagc

SEQ ID NO: 433066 - DNA, 15 bp, Homo sapiens
acttttgtttgagca

SEQ ID NO: 433067 - DNA, 15 bp, Homo sapiens
cttttgtttgagcaa

SEQ ID NO: 433068 - DNA, 15 bp, Homo sapiens
ttttgtttgagcaat

SEQ ID NO: 433069 - DNA, 15 bp, Homo sapiens
tttgtttgagcaata

SEQ ID NO: 433070 - DNA, 15 bp, Homo sapiens
ttgtttgagcaatat

SEQ ID NO: 433071 - DNA, 15 bp, Homo sapiens
tgtttgagcaatatg

SEQ ID NO: 433072 - DNA, 15 bp, Homo sapiens
gtttgagcaatatgg

SEQ ID NO: 433073 - DNA, 15 bp, Homo sapiens
tttgagcaatatgga

SEQ ID NO: 433074 - DNA, 15 bp, Homo sapiens
ttgagcaatatggaa

SEQ ID NO: 433075 - DNA, 15 bp, Homo sapiens
tgagcaatatggaaa

SEQ ID NO: 433076 - DNA, 15 bp, Homo sapiens
gagcaatatggaaat

SEQ ID NO: 433077 - DNA, 15 bp, Homo sapiens
agcaatatggaaata

SEQ ID NO: 433078 - DNA, 15 bp, Homo sapiens
gcaatatggaaatac

SEQ ID NO: 433079 - DNA, 15 bp, Homo sapiens
caatatggaaatact

SEQ ID NO: 433080 - DNA, 15 bp, Homo sapiens
aatatggaaatactt

SEQ ID NO: 433081 - DNA, 15 bp, Homo sapiens
atatggaaatactta

SEQ ID NO: 433082 - DNA, 15 bp, Homo sapiens
tatggaaatacttaa

SEQ ID NO: 433083 - DNA, 15 bp, Homo sapiens
atggaaatacttaat

SEQ ID NO: 433084 - DNA, 15 bp, Homo sapiens
tggaaatacttaatt

SEQ ID NO: 433085 - DNA, 15 bp, Homo sapiens
ggaaatacttaattt

SEQ ID NO: 433086 - DNA, 15 bp, Homo sapiens
gaaatacttaatttc

SEQ ID NO: 433087 - DNA, 15 bp, Homo sapiens
aaatacttaatttca

SEQ ID NO: 433088 - DNA, 15 bp, Homo sapiens
aatacttaatttcat

SEQ ID NO: 433089 - DNA, 15 bp, Homo sapiens
atacttaatttcatt

SEQ ID NO: 433090 - DNA, 15 bp, Homo sapiens
tacttaatttcattt

SEQ ID NO: 433091 - DNA, 15 bp, Homo sapiens
acttaatttcattta

SEQ ID NO: 433092 - DNA, 15 bp, Homo sapiens
cttaatttcatttaa

SEQ ID NO: 433093 - DNA, 15 bp, Homo sapiens
ttaatttcatttaat

SEQ ID NO: 433094 - DNA, 15 bp, Homo sapiens
taatttcatttaatt

SEQ ID NO: 433095 - DNA, 15 bp, Homo sapiens
aatttcatttaattt

SEQ ID NO: 433096 - DNA, 15 bp, Homo sapiens
atttcatttaatttg

SEQ ID NO: 433097 - DNA, 15 bp, Homo sapiens
tttcatttaatttgt

SEQ ID NO: 433098 - DNA, 15 bp, Homo sapiens
ttcatttaatttgta

SEQ ID NO: 433099 - DNA, 15 bp, Homo sapiens
tcatttaatttgtat

SEQ ID NO: 433100 - DNA, 15 bp, Homo sapiens
catttaatttgtatc

SEQ ID NO: 433101 - DNA, 15 bp, Homo sapiens
atttaatttgtatca

SEQ ID NO: 433102 - DNA, 15 bp, Homo sapiens
tttaatttgtatcat

SEQ ID NO: 433103 - DNA, 15 bp, Homo sapiens
ttaatttgtatcatg

SEQ ID NO: 433104 - DNA, 15 bp, Homo sapiens
taatttgtatcatgt

SEQ ID NO: 433105 - DNA, 15 bp, Homo sapiens
aatttgtatcatgtc

SEQ ID NO: 433106 - DNA, 15 bp, Homo sapiens
atttgtatcatgtca

SEQ ID NO: 433107 - DNA, 15 bp, Homo sapiens
tttgtatcatgtcaa

SEQ ID NO: 433108 - DNA, 15 bp, Homo sapiens
ttgtatcatgtcaat

SEQ ID NO: 433109 - DNA, 15 bp, Homo sapiens
tgtatcatgtcaatg

SEQ ID NO: 433110 - DNA, 15 bp, Homo sapiens
gtatcatgtcaatgt

SEQ ID NO: 433111 - DNA, 15 bp, Homo sapiens
tatcatgtcaatgta

SEQ ID NO: 433112 - DNA, 15 bp, Homo sapiens
atcatgtcaatgtat

SEQ ID NO: 433113 - DNA, 15 bp, Homo sapiens
tcatgtcaatgtata

SEQ ID NO: 433114 - DNA, 15 bp, Homo sapiens
catgtcaatgtatac

SEQ ID NO: 433115 - DNA, 15 bp, Homo sapiens
atgtcaatgtatact

SEQ ID NO: 433116 - DNA, 15 bp, Homo sapiens
tgtcaatgtatactt

SEQ ID NO: 433117 - DNA, 15 bp, Homo sapiens
gtcaatgtatacttt

SEQ ID NO: 433118 - DNA, 15 bp, Homo sapiens
tcaatgtatactttt

SEQ ID NO: 433119 - DNA, 15 bp, Homo sapiens
caatgtatacttttt

SEQ ID NO: 433120 - DNA, 15 bp, Homo sapiens
aatgtatactttttc

SEQ ID NO: 433121 - DNA, 15 bp, Homo sapiens
atgtatactttttcc

SEQ ID NO: 433122 - DNA, 15 bp, Homo sapiens
tgtatactttttcct

SEQ ID NO: 433123 - DNA, 15 bp, Homo sapiens
gtatactttttcctt

SEQ ID NO: 433124 - DNA, 15 bp, Homo sapiens
tatactttttccttt

SEQ ID NO: 433125 - DNA, 15 bp, Homo sapiens
atactttttcctttt

SEQ ID NO: 433126 - DNA, 15 bp, Homo sapiens
tactttttcctttta

SEQ ID NO: 433127 - DNA, 15 bp, Homo sapiens
actttttccttttaa

SEQ ID NO: 433128 - DNA, 15 bp, Homo sapiens
ctttttccttttaat

SEQ ID NO: 433129 - DNA, 15 bp, Homo sapiens
tttttccttttaatg

SEQ ID NO: 433130 - DNA, 15 bp, Homo sapiens
ttttccttttaatgc

SEQ ID NO: 433131 - DNA, 15 bp, Homo sapiens
tttccttttaatgca

SEQ ID NO: 433132 - DNA, 15 bp, Homo sapiens
ttccttttaatgcaa

SEQ ID NO: 433133 - DNA, 15 bp, Homo sapiens
tccttttaatgcaat

SEQ ID NO: 433134 - DNA, 15 bp, Homo sapiens
ccttttaatgcaatt

SEQ ID NO: 433135 - DNA, 15 bp, Homo sapiens
cttttaatgcaattg

SEQ ID NO: 433136 - DNA, 15 bp, Homo sapiens
ttttaatgcaattga

SEQ ID NO: 433137 - DNA, 15 bp, Homo sapiens
tttaatgcaattgaa

SEQ ID NO: 433138 - DNA, 15 bp, Homo sapiens
ttaatgcaattgaac

SEQ ID NO: 433139 - DNA, 15 bp, Homo sapiens
taatgcaattgaact

SEQ ID NO: 433140 - DNA, 15 bp, Homo sapiens
aatgcaattgaactg

SEQ ID NO: 433141 - DNA, 15 bp, Homo sapiens
atgcaattgaactgt

SEQ ID NO: 433142 - DNA, 15 bp, Homo sapiens
tgcaattgaactgtt

SEQ ID NO: 433143 - DNA, 15 bp, Homo sapiens
gcaattgaactgttt

SEQ ID NO: 433144 - DNA, 15 bp, Homo sapiens
caattgaactgtttt

SEQ ID NO: 433145 - DNA, 15 bp, Homo sapiens
aattgaactgttttt

SEQ ID NO: 433146 - DNA, 15 bp, Homo sapiens
attgaactgtttttt

SEQ ID NO: 433147 - DNA, 15 bp, Homo sapiens
ttgaactgttttttt

SEQ ID NO: 433148 - DNA, 15 bp, Homo sapiens
tgaactgtttttttt

SEQ ID NO: 433149 - DNA, 15 bp, Homo sapiens
gaactgttttttttt

SEQ ID NO: 433150 - DNA, 15 bp, Homo sapiens
aactgtttttttttt

SEQ ID NO: 433151 - DNA, 15 bp, Homo sapiens
actgttttttttttt

SEQ ID NO: 433152 - DNA, 15 bp, Homo sapiens
gttttttttttttat

SEQ ID NO: 433153 - DNA, 15 bp, Homo sapiens
ttttttttttttatt

SEQ ID NO: 433154 - DNA, 15 bp, Homo sapiens
tttttttttatttta

SEQ ID NO: 433155 - DNA, 15 bp, Homo sapiens
ttttttttattttaa

SEQ ID NO: 433156 - DNA, 15 bp, Homo sapiens
tttttttattttaat

SEQ ID NO: 433157 - DNA, 15 bp, Homo sapiens
ttttttattttaatc

SEQ ID NO: 433158 - DNA, 15 bp, Homo sapiens
tttttattttaatcc

SEQ ID NO: 433159 - DNA, 15 bp, Homo sapiens
ttttattttaatccc

SEQ ID NO: 433160 - DNA, 15 bp, Homo sapiens
tttattttaatccct

SEQ ID NO: 433161 - DNA, 15 bp, Homo sapiens
ttattttaatcccta

SEQ ID NO: 433162 - DNA, 15 bp, Homo sapiens
tattttaatccctag

SEQ ID NO: 433163 - DNA, 15 bp, Homo sapiens
attttaatccctagt

SEQ ID NO: 433164 - DNA, 15 bp, Homo sapiens
ttttaatccctagtt

SEQ ID NO: 433165 - DNA, 15 bp, Homo sapiens
tttaatccctagttt

SEQ ID NO: 433166 - DNA, 15 bp, Homo sapiens
ttaatccctagtttg

SEQ ID NO: 433167 - DNA, 15 bp, Homo sapiens
taatccctagtttgt

SEQ ID NO: 433168 - DNA, 15 bp, Homo sapiens
aatccctagtttgta

SEQ ID NO: 433169 - DNA, 15 bp, Homo sapiens
atccctagtttgtat

SEQ ID NO: 433170 - DNA, 15 bp, Homo sapiens
tccctagtttgtatg

SEQ ID NO: 433171 - DNA, 15 bp, Homo sapiens
ccctagtttgtatgt

SEQ ID NO: 433172 - DNA, 15 bp, Homo sapiens
cctagtttgtatgtg

SEQ ID NO: 433173 - DNA, 15 bp, Homo sapiens
ctagtttgtatgtgt

SEQ ID NO: 433174 - DNA, 15 bp, Homo sapiens
tagtttgtatgtgtt

SEQ ID NO: 433175 - DNA, 15 bp, Homo sapiens
agtttgtatgtgtta

SEQ ID NO: 433176 - DNA, 15 bp, Homo sapiens
gtttgtatgtgttag

SEQ ID NO: 433177 - DNA, 15 bp, Homo sapiens
tttgtatgtgttaga

SEQ ID NO: 433178 - DNA, 15 bp, Homo sapiens
ttgtatgtgttagaa

SEQ ID NO: 433179 - DNA, 15 bp, Homo sapiens
tgtatgtgttagaaa

SEQ ID NO: 433180 - DNA, 15 bp, Homo sapiens
gtatgtgttagaaag

SEQ ID NO: 433181 - DNA, 15 bp, Homo sapiens
tatgtgttagaaagt

SEQ ID NO: 433182 - DNA, 15 bp, Homo sapiens
atgtgttagaaagta

SEQ ID NO: 433183 - DNA, 15 bp, Homo sapiens
tgtgttagaaagtat

SEQ ID NO: 433184 - DNA, 15 bp, Homo sapiens
gtgttagaaagtatc

SEQ ID NO: 433185 - DNA, 15 bp, Homo sapiens
tgttagaaagtatca

SEQ ID NO: 433186 - DNA, 15 bp, Homo sapiens
gttagaaagtatcac

SEQ ID NO: 433187 - DNA, 15 bp, Homo sapiens
ttagaaagtatcaca

SEQ ID NO: 433188 - DNA, 15 bp, Homo sapiens
tagaaagtatcacag

SEQ ID NO: 433189 - DNA, 15 bp, Homo sapiens
agaaagtatcacagt

SEQ ID NO: 433190 - DNA, 15 bp, Homo sapiens
gaaagtatcacagta

SEQ ID NO: 433191 - DNA, 15 bp, Homo sapiens
aaagtatcacagtac

SEQ ID NO: 433192 - DNA, 15 bp, Homo sapiens
aagtatcacagtaca

SEQ ID NO: 433193 - DNA, 15 bp, Homo sapiens
agtatcacagtacaa

SEQ ID NO: 433194 - DNA, 15 bp, Homo sapiens
gtatcacagtacaac

SEQ ID NO: 433195 - DNA, 15 bp, Homo sapiens
tatcacagtacaaca

SEQ ID NO: 433196 - DNA, 15 bp, Homo sapiens
atcacagtacaacaa

SEQ ID NO: 433197 - DNA, 15 bp, Homo sapiens
tcacagtacaacaat

SEQ ID NO: 433198 - DNA, 15 bp, Homo sapiens
cacagtacaacaatc

SEQ ID NO: 433199 - DNA, 15 bp, Homo sapiens
acagtacaacaatct

SEQ ID NO: 433200 - DNA, 15 bp, Homo sapiens
cagtacaacaatctc

SEQ ID NO: 433201 - DNA, 15 bp, Homo sapiens
agtacaacaatctct

SEQ ID NO: 433202 - DNA, 15 bp, Homo sapiens
gtacaacaatctctc

SEQ ID NO: 433203 - DNA, 15 bp, Homo sapiens
tacaacaatctctca

SEQ ID NO: 433204 - DNA, 15 bp, Homo sapiens
acaacaatctctcat

SEQ ID NO: 433205 - DNA, 15 bp, Homo sapiens
caacaatctctcatc

SEQ ID NO: 433206 - DNA, 15 bp, Homo sapiens
aacaatctctcatcc

SEQ ID NO: 433207 - DNA, 15 bp, Homo sapiens
acaatctctcatcct

SEQ ID NO: 433208 - DNA, 15 bp, Homo sapiens
caatctctcatcctt

SEQ ID NO: 433209 - DNA, 15 bp, Homo sapiens
aatctctcatccttt

SEQ ID NO: 433210 - DNA, 15 bp, Homo sapiens
atctctcatcctttg

SEQ ID NO: 433211 - DNA, 15 bp, Homo sapiens
tctctcatcctttgc

SEQ ID NO: 433212 - DNA, 15 bp, Homo sapiens
ctctcatcctttgca

SEQ ID NO: 433213 - DNA, 15 bp, Homo sapiens
tctcatcctttgcat

SEQ ID NO: 433214 - DNA, 15 bp, Homo sapiens
ctcatcctttgcatt

SEQ ID NO: 433215 - DNA, 15 bp, Homo sapiens
tcatcctttgcattg

SEQ ID NO: 433216 - DNA, 15 bp, Homo sapiens
catcctttgcattgt

SEQ ID NO: 433217 - DNA, 15 bp, Homo sapiens
atcctttgcattgtt

SEQ ID NO: 433218 - DNA, 15 bp, Homo sapiens
tcctttgcattgttc

SEQ ID NO: 433219 - DNA, 15 bp, Homo sapiens
cctttgcattgttct

SEQ ID NO: 433220 - DNA, 15 bp, Homo sapiens
ctttgcattgttctt

SEQ ID NO: 433221 - DNA, 15 bp, Homo sapiens
tttgcattgttcttt

SEQ ID NO: 433222 - DNA, 15 bp, Homo sapiens
tgcattgttctttgt

SEQ ID NO: 433223 - DNA, 15 bp, Homo sapiens
gcattgttctttgta

SEQ ID NO: 433224 - DNA, 15 bp, Homo sapiens
cattgttctttgtac

SEQ ID NO: 433225 - DNA, 15 bp, Homo sapiens
attgttctttgtact

SEQ ID NO: 433226 - DNA, 15 bp, Homo sapiens
ttgttctttgtactt

SEQ ID NO: 433227 - DNA, 15 bp, Homo sapiens
tgttctttgtacttt

SEQ ID NO: 433228 - DNA, 15 bp, Homo sapiens
gttctttgtactttc

SEQ ID NO: 433229 - DNA, 15 bp, Homo sapiens
ttctttgtactttcc

SEQ ID NO: 433230 - DNA, 15 bp, Homo sapiens
tctttgtactttcca

SEQ ID NO: 433231 - DNA, 15 bp, Homo sapiens
ctttgtactttccaa

SEQ ID NO: 433232 - DNA, 15 bp, Homo sapiens
tttgtactttccaag

SEQ ID NO: 433233 - DNA, 15 bp, Homo sapiens
ttgtactttccaagc

SEQ ID NO: 433234 - DNA, 15 bp, Homo sapiens
tgtactttccaagca

SEQ ID NO: 433235 - DNA, 15 bp, Homo sapiens
gtactttccaagcaa

SEQ ID NO: 433236 - DNA, 15 bp, Homo sapiens
tactttccaagcaac

SEQ ID NO: 433237 - DNA, 15 bp, Homo sapiens
actttccaagcaact

SEQ ID NO: 433238 - DNA, 15 bp, Homo sapiens
ctttccaagcaactt

SEQ ID NO: 433239 - DNA, 15 bp, Homo sapiens
tttccaagcaacttt

SEQ ID NO: 433240 - DNA, 15 bp, Homo sapiens
ttccaagcaactttc

SEQ ID NO: 433241 - DNA, 15 bp, Homo sapiens
tccaagcaactttca

SEQ ID NO: 433242 - DNA, 15 bp, Homo sapiens
ccaagcaactttcat

SEQ ID NO: 433243 - DNA, 15 bp, Homo sapiens
caagcaactttcata

SEQ ID NO: 433244 - DNA, 15 bp, Homo sapiens
aagcaactttcatat

SEQ ID NO: 433245 - DNA, 15 bp, Homo sapiens
agcaactttcatatt

SEQ ID NO: 433246 - DNA, 15 bp, Homo sapiens
gcaactttcatattc

SEQ ID NO: 433247 - DNA, 15 bp, Homo sapiens
caactttcatattca

SEQ ID NO: 433248 - DNA, 15 bp, Homo sapiens
aactttcatattcat

SEQ ID NO: 433249 - DNA, 15 bp, Homo sapiens
actttcatattcatt

SEQ ID NO: 433250 - DNA, 15 bp, Homo sapiens
ctttcatattcattc

SEQ ID NO: 433251 - DNA, 15 bp, Homo sapiens
tttcatattcattct

SEQ ID NO: 433252 - DNA, 15 bp, Homo sapiens
ttcatattcattctc

SEQ ID NO: 433253 - DNA, 15 bp, Homo sapiens
tcatattcattctcc

SEQ ID NO: 433254 - DNA, 15 bp, Homo sapiens
catattcattctcct

SEQ ID NO: 433255 - DNA, 15 bp, Homo sapiens
atattcattctcctg

SEQ ID NO: 433256 - DNA, 15 bp, Homo sapiens
tattcattctcctgt

SEQ ID NO: 433257 - DNA, 15 bp, Homo sapiens
attcattctcctgtc

SEQ ID NO: 433258 - DNA, 15 bp, Homo sapiens
ttcattctcctgtct

SEQ ID NO: 433259 - DNA, 15 bp, Homo sapiens
tcattctcctgtcta

SEQ ID NO: 433260 - DNA, 15 bp, Homo sapiens
cattctcctgtctat

SEQ ID NO: 433261 - DNA, 15 bp, Homo sapiens
attctcctgtctatc

SEQ ID NO: 433262 - DNA, 15 bp, Homo sapiens
ttctcctgtctatcc

SEQ ID NO: 433263 - DNA, 15 bp, Homo sapiens
tctcctgtctatccc

SEQ ID NO: 433264 - DNA, 15 bp, Homo sapiens
ctcctgtctatccca

SEQ ID NO: 433265 - DNA, 15 bp, Homo sapiens
tcctgtctatcccaa

SEQ ID NO: 433266 - DNA, 15 bp, Homo sapiens
cctgtctatcccaat

SEQ ID NO: 433267 - DNA, 15 bp, Homo sapiens
ctgtctatcccaatg

SEQ ID NO: 433268 - DNA, 15 bp, Homo sapiens
tgtctatcccaatga

SEQ ID NO: 433269 - DNA, 15 bp, Homo sapiens
gtctatcccaatgag

SEQ ID NO: 433270 - DNA, 15 bp, Homo sapiens
tctatcccaatgagt

SEQ ID NO: 433271 - DNA, 15 bp, Homo sapiens
ctatcccaatgagtt

SEQ ID NO: 433272 - DNA, 15 bp, Homo sapiens
tatcccaatgagttg

SEQ ID NO: 433273 - DNA, 15 bp, Homo sapiens
atcccaatgagttga

SEQ ID NO: 433274 - DNA, 15 bp, Homo sapiens
tcccaatgagttgag

SEQ ID NO: 433275 - DNA, 15 bp, Homo sapiens
cccaatgagttgagc

SEQ ID NO: 433276 - DNA, 15 bp, Homo sapiens
ccaatgagttgagcc

SEQ ID NO: 433277 - DNA, 15 bp, Homo sapiens
caatgagttgagccg

SEQ ID NO: 433278 - DNA, 15 bp, Homo sapiens
aatgagttgagccga

SEQ ID NO: 433279 - DNA, 15 bp, Homo sapiens
atgagttgagccgat

SEQ ID NO: 433280 - DNA, 15 bp, Homo sapiens
tgagttgagccgatc

SEQ ID NO: 433281 - DNA, 15 bp, Homo sapiens
gagttgagccgatca

SEQ ID NO: 433282 - DNA, 15 bp, Homo sapiens
agttgagccgatcat

SEQ ID NO: 433283 - DNA, 15 bp, Homo sapiens
gttgagccgatcata

SEQ ID NO: 433284 - DNA, 15 bp, Homo sapiens
ttgagccgatcatac

SEQ ID NO: 433285 - DNA, 15 bp, Homo sapiens
tgagccgatcataca

SEQ ID NO: 433286 - DNA, 15 bp, Homo sapiens
gagccgatcatacag

SEQ ID NO: 433287 - DNA, 15 bp, Homo sapiens
agccgatcatacagt

SEQ ID NO: 433288 - DNA, 15 bp, Homo sapiens
gccgatcatacagta

SEQ ID NO: 433289 - DNA, 15 bp, Homo sapiens
ccgatcatacagtat

SEQ ID NO: 433290 - DNA, 15 bp, Homo sapiens
cgatcatacagtatg

SEQ ID NO: 433291 - DNA, 15 bp, Homo sapiens
gatcatacagtatga

SEQ ID NO: 433292 - DNA, 15 bp, Homo sapiens
atcatacagtatgat

SEQ ID NO: 433293 - DNA, 15 bp, Homo sapiens
tcatacagtatgatt

SEQ ID NO: 433294 - DNA, 15 bp, Homo sapiens
catacagtatgattt

SEQ ID NO: 433295 - DNA, 15 bp, Homo sapiens
atacagtatgatttt

SEQ ID NO: 433296 - DNA, 15 bp, Homo sapiens
tacagtatgattttt

SEQ ID NO: 433297 - DNA, 15 bp, Homo sapiens
acagtatgatttttt

SEQ ID NO: 433298 - DNA, 15 bp, Homo sapiens
cagtatgattttttt

SEQ ID NO: 433299 - DNA, 15 bp, Homo sapiens
agtatgatttttttt

SEQ ID NO: 433300 - DNA, 15 bp, Homo sapiens
gtatgatttttttta

SEQ ID NO: 433301 - DNA, 15 bp, Homo sapiens
tatgattttttttaa

SEQ ID NO: 433302 - DNA, 15 bp, Homo sapiens
atgattttttttaaa

SEQ ID NO: 433303 - DNA, 15 bp, Homo sapiens
tgattttttttaaaa

SEQ ID NO: 433304 - DNA, 15 bp, Homo sapiens
gattttttttaaaaa

SEQ ID NO: 433305 - DNA, 15 bp, Homo sapiens
attttttttaaaaat

SEQ ID NO: 433306 - DNA, 15 bp, Homo sapiens
ttttttttaaaaata

SEQ ID NO: 433307 - DNA, 15 bp, Homo sapiens
tttttttaaaaataa

SEQ ID NO: 433308 - DNA, 15 bp, Homo sapiens
ttttttaaaaataaa

SEQ ID NO: 433309 - DNA, 15 bp, Homo sapiens
tttttaaaaataaaa

SEQ ID NO: 433310 - DNA, 15 bp, Homo sapiens
ttttaaaaataaaaa

SEQ ID NO: 433311 - DNA, 15 bp, Homo sapiens
tttaaaaataaaaac

SEQ ID NO: 433312 - DNA, 15 bp, Homo sapiens
ttaaaaataaaaaca

SEQ ID NO: 433313 - DNA, 15 bp, Homo sapiens
taaaaataaaaacac

SEQ ID NO: 433314 - DNA, 15 bp, Homo sapiens
aaaaataaaaacaca

SEQ ID NO: 433315 - DNA, 15 bp, Homo sapiens
aaaataaaaacacaa

SEQ ID NO: 433316 - DNA, 15 bp, Homo sapiens
aaataaaaacacaaa

SEQ ID NO: 433317 - DNA, 15 bp, Homo sapiens
aataaaaacacaaag

SEQ ID NO: 433318 - DNA, 15 bp, Homo sapiens
ataaaaacacaaagg

SEQ ID NO: 433319 - DNA, 15 bp, Homo sapiens
taaaaacacaaaggc

SEQ ID NO: 433320 - DNA, 15 bp, Homo sapiens
aaaaacacaaaggcc

SEQ ID NO: 433321 - DNA, 15 bp, Homo sapiens
aaaacacaaaggcca

SEQ ID NO: 433322 - DNA, 15 bp, Homo sapiens
aaacacaaaggccaa

SEQ ID NO: 433323 - DNA, 15 bp, Homo sapiens
aacacaaaggccaag

SEQ ID NO: 433324 - DNA, 15 bp, Homo sapiens
acacaaaggccaaga

SEQ ID NO: 433325 - DNA, 15 bp, Homo sapiens
cacaaaggccaagaa

SEQ ID NO: 433326 - DNA, 15 bp, Homo sapiens
acaaaggccaagaag

SEQ ID NO: 433327 - DNA, 15 bp, Homo sapiens
caaaggccaagaaga

SEQ ID NO: 433328 - DNA, 15 bp, Homo sapiens
aaaggccaagaagat

SEQ ID NO: 433329 - DNA, 15 bp, Homo sapiens
aaggccaagaagata

SEQ ID NO: 433330 - DNA, 15 bp, Homo sapiens
aggccaagaagatat

SEQ ID NO: 433331 - DNA, 15 bp, Homo sapiens
ggccaagaagatatt

SEQ ID NO: 433332 - DNA, 15 bp, Homo sapiens
gccaagaagatatta

SEQ ID NO: 433333 - DNA, 15 bp, Homo sapiens
ccaagaagatattat

SEQ ID NO: 433334 - DNA, 15 bp, Homo sapiens
caagaagatattatg

SEQ ID NO: 433335 - DNA, 15 bp, Homo sapiens
aagaagatattatgg

SEQ ID NO: 433336 - DNA, 15 bp, Homo sapiens
agaagatattatggt

SEQ ID NO: 433337 - DNA, 15 bp, Homo sapiens
gaagatattatggtg

SEQ ID NO: 433338 - DNA, 15 bp, Homo sapiens
aagatattatggtgc

SEQ ID NO: 433339 - DNA, 15 bp, Homo sapiens
agatattatggtgct

SEQ ID NO: 433340 - DNA, 15 bp, Homo sapiens
gatattatggtgctg

SEQ ID NO: 433341 - DNA, 15 bp, Homo sapiens
atattatggtgctga

SEQ ID NO: 433342 - DNA, 15 bp, Homo sapiens
tattatggtgctgac

SEQ ID NO: 433343 - DNA, 15 bp, Homo sapiens
attatggtgctgacc

SEQ ID NO: 433344 - DNA, 15 bp, Homo sapiens
ttatggtgctgacca

SEQ ID NO: 433345 - DNA, 15 bp, Homo sapiens
tatggtgctgaccaa

SEQ ID NO: 433346 - DNA, 15 bp, Homo sapiens
atggtgctgaccaaa

SEQ ID NO: 433347 - DNA, 15 bp, Homo sapiens
tggtgctgaccaaag

SEQ ID NO: 433348 - DNA, 15 bp, Homo sapiens
ggtgctgaccaaagt

SEQ ID NO: 433349 - DNA, 15 bp, Homo sapiens
gtgctgaccaaagtc

SEQ ID NO: 433350 - DNA, 15 bp, Homo sapiens
tgctgaccaaagtca

SEQ ID NO: 433351 - DNA, 15 bp, Homo sapiens
gctgaccaaagtcat

SEQ ID NO: 433352 - DNA, 15 bp, Homo sapiens
ctgaccaaagtcatc

SEQ ID NO: 433353 - DNA, 15 bp, Homo sapiens
tgaccaaagtcatcc

SEQ ID NO: 433354 - DNA, 15 bp, Homo sapiens
gaccaaagtcatcca

SEQ ID NO: 433355 - DNA, 15 bp, Homo sapiens
accaaagtcatccag

SEQ ID NO: 433356 - DNA, 15 bp, Homo sapiens
ccaaagtcatccagc

SEQ ID NO: 433357 - DNA, 15 bp, Homo sapiens
caaagtcatccagct

SEQ ID NO: 433358 - DNA, 15 bp, Homo sapiens
aaagtcatccagcta

SEQ ID NO: 433359 - DNA, 15 bp, Homo sapiens
aagtcatccagctaa

SEQ ID NO: 433360 - DNA, 15 bp, Homo sapiens
agtcatccagctaac

SEQ ID NO: 433361 - DNA, 15 bp, Homo sapiens
gtcatccagctaacg

SEQ ID NO: 433362 - DNA, 15 bp, Homo sapiens
tcatccagctaacga

SEQ ID NO: 433363 - DNA, 15 bp, Homo sapiens
catccagctaacgaa

SEQ ID NO: 433364 - DNA, 15 bp, Homo sapiens
atccagctaacgaaa

SEQ ID NO: 433365 - DNA, 15 bp, Homo sapiens
tccagctaacgaaag

SEQ ID NO: 433366 - DNA, 15 bp, Homo sapiens
ccagctaacgaaagg

SEQ ID NO: 433367 - DNA, 15 bp, Homo sapiens
cagctaacgaaaggt

SEQ ID NO: 433368 - DNA, 15 bp, Homo sapiens
agctaacgaaaggta

SEQ ID NO: 433369 - DNA, 15 bp, Homo sapiens
gctaacgaaaggtag

SEQ ID NO: 433370 - DNA, 15 bp, Homo sapiens
ctaacgaaaggtaga

SEQ ID NO: 433371 - DNA, 15 bp, Homo sapiens
taacgaaaggtagat

SEQ ID NO: 433372 - DNA, 15 bp, Homo sapiens
aacgaaaggtagatg

SEQ ID NO: 433373 - DNA, 15 bp, Homo sapiens
acgaaaggtagatgc

SEQ ID NO: 433374 - DNA, 15 bp, Homo sapiens
cgaaaggtagatgca

SEQ ID NO: 433375 - DNA, 15 bp, Homo sapiens
gaaaggtagatgcaa

SEQ ID NO: 433376 - DNA, 15 bp, Homo sapiens
aaaggtagatgcaag

SEQ ID NO: 433377 - DNA, 15 bp, Homo sapiens
aaggtagatgcaaga

SEQ ID NO: 433378 - DNA, 15 bp, Homo sapiens
aggtagatgcaagaa

SEQ ID NO: 433379 - DNA, 15 bp, Homo sapiens
ggtagatgcaagaac

SEQ ID NO: 433380 - DNA, 15 bp, Homo sapiens
gtagatgcaagaaca

SEQ ID NO: 433381 - DNA, 15 bp, Homo sapiens
tagatgcaagaacag

SEQ ID NO: 433382 - DNA, 15 bp, Homo sapiens
agatgcaagaacaga

SEQ ID NO: 433383 - DNA, 15 bp, Homo sapiens
gatgcaagaacagag

SEQ ID NO: 433384 - DNA, 15 bp, Homo sapiens
atgcaagaacagagc

SEQ ID NO: 433385 - DNA, 15 bp, Homo sapiens
tgcaagaacagagcc

SEQ ID NO: 433386 - DNA, 15 bp, Homo sapiens
gcaagaacagagccc

SEQ ID NO: 433387 - DNA, 15 bp, Homo sapiens
caagaacagagccct

SEQ ID NO: 433388 - DNA, 15 bp, Homo sapiens
aagaacagagcccta

SEQ ID NO: 433389 - DNA, 15 bp, Homo sapiens
agaacagagccctat

SEQ ID NO: 433390 - DNA, 15 bp, Homo sapiens
gaacagagccctatg

SEQ ID NO: 433391 - DNA, 15 bp, Homo sapiens
aacagagccctatgc

SEQ ID NO: 433392 - DNA, 15 bp, Homo sapiens
acagagccctatgcg

SEQ ID NO: 433393 - DNA, 15 bp, Homo sapiens
cagagccctatgcgt

SEQ ID NO: 433394 - DNA, 15 bp, Homo sapiens
agagccctatgcgtc

SEQ ID NO: 433395 - DNA, 15 bp, Homo sapiens
gagccctatgcgtct

SEQ ID NO: 433396 - DNA, 15 bp, Homo sapiens
agccctatgcgtcta

SEQ ID NO: 433397 - DNA, 15 bp, Homo sapiens
gccctatgcgtctat

SEQ ID NO: 433398 - DNA, 15 bp, Homo sapiens
ccctatgcgtctatg

SEQ ID NO: 433399 - DNA, 15 bp, Homo sapiens
cctatgcgtctatga

SEQ ID NO: 433400 - DNA, 15 bp, Homo sapiens
ctatgcgtctatgac

SEQ ID NO: 433401 - DNA, 15 bp, Homo sapiens
tatgcgtctatgaca

SEQ ID NO: 433402 - DNA, 15 bp, Homo sapiens
atgcgtctatgacaa

SEQ ID NO: 433403 - DNA, 15 bp, Homo sapiens
tgcgtctatgacaat

SEQ ID NO: 433404 - DNA, 15 bp, Homo sapiens
gcgtctatgacaatg

SEQ ID NO: 433405 - DNA, 15 bp, Homo sapiens
cgtctatgacaatga

SEQ ID NO: 433406 - DNA, 15 bp, Homo sapiens
gtctatgacaatgac

SEQ ID NO: 433407 - DNA, 15 bp, Homo sapiens
tctatgacaatgact

SEQ ID NO: 433408 - DNA, 15 bp, Homo sapiens
ctatgacaatgactt

SEQ ID NO: 433409 - DNA, 15 bp, Homo sapiens
tatgacaatgacttc

SEQ ID NO: 433410 - DNA, 15 bp, Homo sapiens
atgacaatgacttcc

SEQ ID NO: 433411 - DNA, 15 bp, Homo sapiens
tgacaatgacttcct

SEQ ID NO: 433412 - DNA, 15 bp, Homo sapiens
gacaatgacttcctt

SEQ ID NO: 433413 - DNA, 15 bp, Homo sapiens
acaatgacttcctta

SEQ ID NO: 433414 - DNA, 15 bp, Homo sapiens
caatgacttccttaa

SEQ ID NO: 433415 - DNA, 15 bp, Homo sapiens
aatgacttccttaac

SEQ ID NO: 433416 - DNA, 15 bp, Homo sapiens
atgacttccttaacc

SEQ ID NO: 433417 - DNA, 15 bp, Homo sapiens
tgacttccttaacct

SEQ ID NO: 433418 - DNA, 15 bp, Homo sapiens
gacttccttaacctc

SEQ ID NO: 433419 - DNA, 15 bp, Homo sapiens
acttccttaacctct

SEQ ID NO: 433420 - DNA, 15 bp, Homo sapiens
cttccttaacctctg

SEQ ID NO: 433421 - DNA, 15 bp, Homo sapiens
ttccttaacctctgg

SEQ ID NO: 433422 - DNA, 15 bp, Homo sapiens
tccttaacctctgga

SEQ ID NO: 433423 - DNA, 15 bp, Homo sapiens
ccttaacctctggat

SEQ ID NO: 433424 - DNA, 15 bp, Homo sapiens
cttaacctctggatt

SEQ ID NO: 433425 - DNA, 15 bp, Homo sapiens
ttaacctctggattt

SEQ ID NO: 433426 - DNA, 15 bp, Homo sapiens
taacctctggatttt

SEQ ID NO: 433427 - DNA, 15 bp, Homo sapiens
aacctctggattttg

SEQ ID NO: 433428 - DNA, 15 bp, Homo sapiens
acctctggattttgg

SEQ ID NO: 433429 - DNA, 15 bp, Homo sapiens
cctctggattttggc

SEQ ID NO: 433430 - DNA, 15 bp, Homo sapiens
ctctggattttggct

SEQ ID NO: 433431 - DNA, 15 bp, Homo sapiens
tctggattttggctg

SEQ ID NO: 433432 - DNA, 15 bp, Homo sapiens
ctggattttggctgg

SEQ ID NO: 433433 - DNA, 15 bp, Homo sapiens
tggattttggctggc

SEQ ID NO: 433434 - DNA, 15 bp, Homo sapiens
ggattttggctggct

SEQ ID NO: 433435 - DNA, 15 bp, Homo sapiens
gattttggctggctt

SEQ ID NO: 433436 - DNA, 15 bp, Homo sapiens
attttggctggcttt

SEQ ID NO: 433437 - DNA, 15 bp, Homo sapiens
ttttggctggctttt

SEQ ID NO: 433438 - DNA, 15 bp, Homo sapiens
tttggctggcttttg

SEQ ID NO: 433439 - DNA, 15 bp, Homo sapiens
ttggctggcttttga

SEQ ID NO: 433440 - DNA, 15 bp, Homo sapiens
tggctggcttttgac

SEQ ID NO: 433441 - DNA, 15 bp, Homo sapiens
ggctggcttttgact

SEQ ID NO: 433442 - DNA, 15 bp, Homo sapiens
gctggcttttgactc

SEQ ID NO: 433443 - DNA, 15 bp, Homo sapiens
ctggcttttgactca

SEQ ID NO: 433444 - DNA, 15 bp, Homo sapiens
tggcttttgactcat

SEQ ID NO: 433445 - DNA, 15 bp, Homo sapiens
ggcttttgactcatc

SEQ ID NO: 433446 - DNA, 15 bp, Homo sapiens
gcttttgactcatcc

SEQ ID NO: 433447 - DNA, 15 bp, Homo sapiens
cttttgactcatccc

SEQ ID NO: 433448 - DNA, 15 bp, Homo sapiens
ttttgactcatccct

SEQ ID NO: 433449 - DNA, 15 bp, Homo sapiens
tttgactcatccctt

SEQ ID NO: 433450 - DNA, 15 bp, Homo sapiens
ttgactcatcccttc

SEQ ID NO: 433451 - DNA, 15 bp, Homo sapiens
tgactcatcccttcg

SEQ ID NO: 433452 - DNA, 15 bp, Homo sapiens
gactcatcccttcga

SEQ ID NO: 433453 - DNA, 15 bp, Homo sapiens
actcatcccttcgat

SEQ ID NO: 433454 - DNA, 15 bp, Homo sapiens
ctcatcccttcgatt

SEQ ID NO: 433455 - DNA, 15 bp, Homo sapiens
tcatcccttcgattt

SEQ ID NO: 433456 - DNA, 15 bp, Homo sapiens
catcccttcgatttt

SEQ ID NO: 433457 - DNA, 15 bp, Homo sapiens
atcccttcgatttta

SEQ ID NO: 433458 - DNA, 15 bp, Homo sapiens
tcccttcgattttat

SEQ ID NO: 433459 - DNA, 15 bp, Homo sapiens
cccttcgattttatc

SEQ ID NO: 433460 - DNA, 15 bp, Homo sapiens
ccttcgattttatct

SEQ ID NO: 433461 - DNA, 15 bp, Homo sapiens
cttcgattttatctc

SEQ ID NO: 433462 - DNA, 15 bp, Homo sapiens
ttcgattttatctcc

SEQ ID NO: 433463 - DNA, 15 bp, Homo sapiens
tcgattttatctcct

SEQ ID NO: 433464 - DNA, 15 bp, Homo sapiens
cgattttatctcctc

SEQ ID NO: 433465 - DNA, 15 bp, Homo sapiens
gattttatctcctct

SEQ ID NO: 433466 - DNA, 15 bp, Homo sapiens
attttatctcctcta

SEQ ID NO: 433467 - DNA, 15 bp, Homo sapiens
ttttatctcctctat

SEQ ID NO: 433468 - DNA, 15 bp, Homo sapiens
tttatctcctctatc

SEQ ID NO: 433469 - DNA, 15 bp, Homo sapiens
ttatctcctctatct

SEQ ID NO: 433470 - DNA, 15 bp, Homo sapiens
tatctcctctatctg

SEQ ID NO: 433471 - DNA, 15 bp, Homo sapiens
atctcctctatctgt

SEQ ID NO: 433472 - DNA, 15 bp, Homo sapiens
tctcctctatctgtg

SEQ ID NO: 433473 - DNA, 15 bp, Homo sapiens
ctcctctatctgtgt

SEQ ID NO: 433474 - DNA, 15 bp, Homo sapiens
tcctctatctgtgtt

SEQ ID NO: 433475 - DNA, 15 bp, Homo sapiens
cctctatctgtgttc

SEQ ID NO: 433476 - DNA, 15 bp, Homo sapiens
ctctatctgtgttca

SEQ ID NO: 433477 - DNA, 15 bp, Homo sapiens
tctatctgtgttcac

SEQ ID NO: 433478 - DNA, 15 bp, Homo sapiens
ctatctgtgttcact

SEQ ID NO: 433479 - DNA, 15 bp, Homo sapiens
tatctgtgttcactg

SEQ ID NO: 433480 - DNA, 15 bp, Homo sapiens
atctgtgttcactga

SEQ ID NO: 433481 - DNA, 15 bp, Homo sapiens
tctgtgttcactgac

SEQ ID NO: 433482 - DNA, 15 bp, Homo sapiens
ctgtgttcactgacg

SEQ ID NO: 433483 - DNA, 15 bp, Homo sapiens
tgtgttcactgacgg

SEQ ID NO: 433484 - DNA, 15 bp, Homo sapiens
gtgttcactgacggc

SEQ ID NO: 433485 - DNA, 15 bp, Homo sapiens
tgttcactgacggcc

SEQ ID NO: 433486 - DNA, 15 bp, Homo sapiens
gttcactgacggcca

SEQ ID NO: 433487 - DNA, 15 bp, Homo sapiens
ttcactgacggccat

SEQ ID NO: 433488 - DNA, 15 bp, Homo sapiens
tcactgacggccatc

SEQ ID NO: 433489 - DNA, 15 bp, Homo sapiens
cactgacggccatct

SEQ ID NO: 433490 - DNA, 15 bp, Homo sapiens
actgacggccatctg

SEQ ID NO: 433491 - DNA, 15 bp, Homo sapiens
ctgacggccatctgg

SEQ ID NO: 433492 - DNA, 15 bp, Homo sapiens
tgacggccatctggc

SEQ ID NO: 433493 - DNA, 15 bp, Homo sapiens
gacggccatctggcc

SEQ ID NO: 433494 - DNA, 15 bp, Homo sapiens
acggccatctggccc

SEQ ID NO: 433495 - DNA, 15 bp, Homo sapiens
cggccatctggcccc

SEQ ID NO: 433496 - DNA, 15 bp, Homo sapiens
ggccatctggcccct

SEQ ID NO: 433497 - DNA, 15 bp, Homo sapiens
gccatctggccccta

SEQ ID NO: 433498 - DNA, 15 bp, Homo sapiens
ccatctggcccctaa

SEQ ID NO: 433499 - DNA, 15 bp, Homo sapiens
catctggcccctaac

SEQ ID NO: 433500 - DNA, 15 bp, Homo sapiens
atctggcccctaact

SEQ ID NO: 433501 - DNA, 15 bp, Homo sapiens
tctggcccctaactt

SEQ ID NO: 433502 - DNA, 15 bp, Homo sapiens
ctggcccctaacttc

SEQ ID NO: 433503 - DNA, 15 bp, Homo sapiens
tggcccctaacttcc

SEQ ID NO: 433504 - DNA, 15 bp, Homo sapiens
ggcccctaacttcct

SEQ ID NO: 433505 - DNA, 15 bp, Homo sapiens
gcccctaacttccta

SEQ ID NO: 433506 - DNA, 15 bp, Homo sapiens
cccctaacttcctag

SEQ ID NO: 433507 - DNA, 15 bp, Homo sapiens
ccctaacttcctagc

SEQ ID NO: 433508 - DNA, 15 bp, Homo sapiens
cctaacttcctagct

SEQ ID NO: 433509 - DNA, 15 bp, Homo sapiens
ctaacttcctagctc

SEQ ID NO: 433510 - DNA, 15 bp, Homo sapiens
taacttcctagctcc

SEQ ID NO: 433511 - DNA, 15 bp, Homo sapiens
aacttcctagctcct

SEQ ID NO: 433512 - DNA, 15 bp, Homo sapiens
acttcctagctcctc

SEQ ID NO: 433513 - DNA, 15 bp, Homo sapiens
cttcctagctcctcc

SEQ ID NO: 433514 - DNA, 15 bp, Homo sapiens
ttcctagctcctcct

SEQ ID NO: 433515 - DNA, 15 bp, Homo sapiens
tcctagctcctcctt

SEQ ID NO: 433516 - DNA, 15 bp, Homo sapiens
cctagctcctccttg

SEQ ID NO: 433517 - DNA, 15 bp, Homo sapiens
ctagctcctccttga

SEQ ID NO: 433518 - DNA, 15 bp, Homo sapiens
tagctcctccttgat

SEQ ID NO: 433519 - DNA, 15 bp, Homo sapiens
agctcctccttgatc

SEQ ID NO: 433520 - DNA, 15 bp, Homo sapiens
gctcctccttgatct

SEQ ID NO: 433521 - DNA, 15 bp, Homo sapiens
ctcctccttgatctc

SEQ ID NO: 433522 - DNA, 15 bp, Homo sapiens
tcctccttgatctca

SEQ ID NO: 433523 - DNA, 15 bp, Homo sapiens
cctccttgatctcaa

SEQ ID NO: 433524 - DNA, 15 bp, Homo sapiens
ctccttgatctcaat

SEQ ID NO: 433525 - DNA, 15 bp, Homo sapiens
tccttgatctcaatg

SEQ ID NO: 433526 - DNA, 15 bp, Homo sapiens
ccttgatctcaatgt

SEQ ID NO: 433527 - DNA, 15 bp, Homo sapiens
cttgatctcaatgtc

SEQ ID NO: 433528 - DNA, 15 bp, Homo sapiens
ttgatctcaatgtct

SEQ ID NO: 433529 - DNA, 15 bp, Homo sapiens
tgatctcaatgtcta

SEQ ID NO: 433530 - DNA, 15 bp, Homo sapiens
gatctcaatgtctag

SEQ ID NO: 433531 - DNA, 15 bp, Homo sapiens
atctcaatgtctaga

SEQ ID NO: 433532 - DNA, 15 bp, Homo sapiens
tctcaatgtctagag

SEQ ID NO: 433533 - DNA, 15 bp, Homo sapiens
ctcaatgtctagagc

SEQ ID NO: 433534 - DNA, 15 bp, Homo sapiens
tcaatgtctagagcc

SEQ ID NO: 433535 - DNA, 15 bp, Homo sapiens
caatgtctagagcct

SEQ ID NO: 433536 - DNA, 15 bp, Homo sapiens
aatgtctagagcctc

SEQ ID NO: 433537 - DNA, 15 bp, Homo sapiens
atgtctagagcctct

SEQ ID NO: 433538 - DNA, 15 bp, Homo sapiens
tgtctagagcctctt

SEQ ID NO: 433539 - DNA, 15 bp, Homo sapiens
gtctagagcctctta

SEQ ID NO: 433540 - DNA, 15 bp, Homo sapiens
tctagagcctcttaa

SEQ ID NO: 433541 - DNA, 15 bp, Homo sapiens
ctagagcctcttaaa

SEQ ID NO: 433542 - DNA, 15 bp, Homo sapiens
tagagcctcttaaac

SEQ ID NO: 433543 - DNA, 15 bp, Homo sapiens
agagcctcttaaact

SEQ ID NO: 433544 - DNA, 15 bp, Homo sapiens
gagcctcttaaactt

SEQ ID NO: 433545 - DNA, 15 bp, Homo sapiens
agcctcttaaacttg

SEQ ID NO: 433546 - DNA, 15 bp, Homo sapiens
gcctcttaaacttgc

SEQ ID NO: 433547 - DNA, 15 bp, Homo sapiens
cctcttaaacttgca

SEQ ID NO: 433548 - DNA, 15 bp, Homo sapiens
ctcttaaacttgcat

SEQ ID NO: 433549 - DNA, 15 bp, Homo sapiens
tcttaaacttgcatc

SEQ ID NO: 433550 - DNA, 15 bp, Homo sapiens
cttaaacttgcatcc

SEQ ID NO: 433551 - DNA, 15 bp, Homo sapiens
ttaaacttgcatcca

SEQ ID NO: 433552 - DNA, 15 bp, Homo sapiens
taaacttgcatccat

SEQ ID NO: 433553 - DNA, 15 bp, Homo sapiens
aaacttgcatccatg

SEQ ID NO: 433554 - DNA, 15 bp, Homo sapiens
aacttgcatccatgt

SEQ ID NO: 433555 - DNA, 15 bp, Homo sapiens
acttgcatccatgtt

SEQ ID NO: 433556 - DNA, 15 bp, Homo sapiens
cttgcatccatgttt

SEQ ID NO: 433557 - DNA, 15 bp, Homo sapiens
ttgcatccatgtttt

SEQ ID NO: 433558 - DNA, 15 bp, Homo sapiens
tgcatccatgttttc

SEQ ID NO: 433559 - DNA, 15 bp, Homo sapiens
gcatccatgttttct

SEQ ID NO: 433560 - DNA, 15 bp, Homo sapiens
catccatgttttctg

SEQ ID NO: 433561 - DNA, 15 bp, Homo sapiens
atccatgttttctgg

SEQ ID NO: 433562 - DNA, 15 bp, Homo sapiens
tccatgttttctggt

SEQ ID NO: 433563 - DNA, 15 bp, Homo sapiens
ccatgttttctggtc

SEQ ID NO: 433564 - DNA, 15 bp, Homo sapiens
catgttttctggtct

SEQ ID NO: 433565 - DNA, 15 bp, Homo sapiens
atgttttctggtctc

SEQ ID NO: 433566 - DNA, 15 bp, Homo sapiens
tgttttctggtctct

SEQ ID NO: 433567 - DNA, 15 bp, Homo sapiens
gttttctggtctctc

SEQ ID NO: 433568 - DNA, 15 bp, Homo sapiens
ttttctggtctctcc

SEQ ID NO: 433569 - DNA, 15 bp, Homo sapiens
tttctggtctctccc

SEQ ID NO: 433570 - DNA, 15 bp, Homo sapiens
ttctggtctctccct

SEQ ID NO: 433571 - DNA, 15 bp, Homo sapiens
tctggtctctccctt

SEQ ID NO: 433572 - DNA, 15 bp, Homo sapiens
tggtctctcccttgt

SEQ ID NO: 433573 - DNA, 15 bp, Homo sapiens
ggtctctcccttgtg

SEQ ID NO: 433574 - DNA, 15 bp, Homo sapiens
gtctctcccttgtgc

SEQ ID NO: 433575 - DNA, 15 bp, Homo sapiens
tctctcccttgtgct

SEQ ID NO: 433576 - DNA, 15 bp, Homo sapiens
ctctcccttgtgctg

SEQ ID NO: 433577 - DNA, 15 bp, Homo sapiens
tctcccttgtgctgc

SEQ ID NO: 433578 - DNA, 15 bp, Homo sapiens
ctcccttgtgctgcc

SEQ ID NO: 433579 - DNA, 15 bp, Homo sapiens
tcccttgtgctgcca

SEQ ID NO: 433580 - DNA, 15 bp, Homo sapiens
cccttgtgctgccag

SEQ ID NO: 433581 - DNA, 15 bp, Homo sapiens
ccttgtgctgccagc

SEQ ID NO: 433582 - DNA, 15 bp, Homo sapiens
cttgtgctgccagcc

SEQ ID NO: 433583 - DNA, 15 bp, Homo sapiens
ttgtgctgccagcct

SEQ ID NO: 433584 - DNA, 15 bp, Homo sapiens
tgtgctgccagcctc

SEQ ID NO: 433585 - DNA, 15 bp, Homo sapiens
gtgctgccagcctcc

SEQ ID NO: 433586 - DNA, 15 bp, Homo sapiens
tgctgccagcctccc

SEQ ID NO: 433587 - DNA, 15 bp, Homo sapiens
gctgccagcctcccc

SEQ ID NO: 433588 - DNA, 15 bp, Homo sapiens
ctgccagcctcccct

SEQ ID NO: 433589 - DNA, 15 bp, Homo sapiens
tgccagcctcccctg

SEQ ID NO: 433590 - DNA, 15 bp, Homo sapiens
gccagcctcccctgg

SEQ ID NO: 433591 - DNA, 15 bp, Homo sapiens
ccagcctcccctggc

SEQ ID NO: 433592 - DNA, 15 bp, Homo sapiens
cagcctcccctggct

SEQ ID NO: 433593 - DNA, 15 bp, Homo sapiens
agcctcccctggctg

SEQ ID NO: 433594 - DNA, 15 bp, Homo sapiens
gcctcccctggctgt

SEQ ID NO: 433595 - DNA, 15 bp, Homo sapiens
cctcccctggctgtt

SEQ ID NO: 433596 - DNA, 15 bp, Homo sapiens
ctcccctggctgttc

SEQ ID NO: 433597 - DNA, 15 bp, Homo sapiens
tcccctggctgttct

SEQ ID NO: 433598 - DNA, 15 bp, Homo sapiens
cccctggctgttctc

SEQ ID NO: 433599 - DNA, 15 bp, Homo sapiens
ccctggctgttctca

SEQ ID NO: 433600 - DNA, 15 bp, Homo sapiens
cctggctgttctcag

SEQ ID NO: 433601 - DNA, 15 bp, Homo sapiens
ctggctgttctcagt

SEQ ID NO: 433602 - DNA, 15 bp, Homo sapiens
tggctgttctcagta

SEQ ID NO: 433603 - DNA, 15 bp, Homo sapiens
ggctgttctcagtac

SEQ ID NO: 433604 - DNA, 15 bp, Homo sapiens
gctgttctcagtacc

SEQ ID NO: 433605 - DNA, 15 bp, Homo sapiens
ctgttctcagtacca

SEQ ID NO: 433606 - DNA, 15 bp, Homo sapiens
tgttctcagtaccag

SEQ ID NO: 433607 - DNA, 15 bp, Homo sapiens
gttctcagtaccaga

SEQ ID NO: 433608 - DNA, 15 bp, Homo sapiens
ttctcagtaccagat

SEQ ID NO: 433609 - DNA, 15 bp, Homo sapiens
tctcagtaccagatc

SEQ ID NO: 433610 - DNA, 15 bp, Homo sapiens
ctcagtaccagatca

SEQ ID NO: 433611 - DNA, 15 bp, Homo sapiens
tcagtaccagatcag

SEQ ID NO: 433612 - DNA, 15 bp, Homo sapiens
cagtaccagatcaga

SEQ ID NO: 433613 - DNA, 15 bp, Homo sapiens
agtaccagatcagaa

SEQ ID NO: 433614 - DNA, 15 bp, Homo sapiens
gtaccagatcagaat

SEQ ID NO: 433615 - DNA, 15 bp, Homo sapiens
taccagatcagaatt

SEQ ID NO: 433616 - DNA, 15 bp, Homo sapiens
accagatcagaattc

SEQ ID NO: 433617 - DNA, 15 bp, Homo sapiens
ccagatcagaattcc

SEQ ID NO: 433618 - DNA, 15 bp, Homo sapiens
cagatcagaattcct

SEQ ID NO: 433619 - DNA, 15 bp, Homo sapiens
agatcagaattcctg

SEQ ID NO: 433620 - DNA, 15 bp, Homo sapiens
gatcagaattcctgt

SEQ ID NO: 433621 - DNA, 15 bp, Homo sapiens
atcagaattcctgtg

SEQ ID NO: 433622 - DNA, 15 bp, Homo sapiens
tcagaattcctgtgt

SEQ ID NO: 433623 - DNA, 15 bp, Homo sapiens
cagaattcctgtgtg

SEQ ID NO: 433624 - DNA, 15 bp, Homo sapiens
agaattcctgtgtga

SEQ ID NO: 433625 - DNA, 15 bp, Homo sapiens
gaattcctgtgtgaa

SEQ ID NO: 433626 - DNA, 15 bp, Homo sapiens
aattcctgtgtgaac

SEQ ID NO: 433627 - DNA, 15 bp, Homo sapiens
attcctgtgtgaacc

SEQ ID NO: 433628 - DNA, 15 bp, Homo sapiens
ttcctgtgtgaacca

SEQ ID NO: 433629 - DNA, 15 bp, Homo sapiens
tcctgtgtgaaccac

SEQ ID NO: 433630 - DNA, 15 bp, Homo sapiens
cctgtgtgaaccaca

SEQ ID NO: 433631 - DNA, 15 bp, Homo sapiens
ctgtgtgaaccacac

SEQ ID NO: 433632 - DNA, 15 bp, Homo sapiens
tgtgtgaaccacact

SEQ ID NO: 433633 - DNA, 15 bp, Homo sapiens
gtgtgaaccacactg

SEQ ID NO: 433634 - DNA, 15 bp, Homo sapiens
tgtgaaccacactgc

SEQ ID NO: 433635 - DNA, 15 bp, Homo sapiens
gtgaaccacactgct

SEQ ID NO: 433636 - DNA, 15 bp, Homo sapiens
tgaaccacactgctg

SEQ ID NO: 433637 - DNA, 15 bp, Homo sapiens
gaaccacactgctgc

SEQ ID NO: 433638 - DNA, 15 bp, Homo sapiens
aaccacactgctgca

SEQ ID NO: 433639 - DNA, 15 bp, Homo sapiens
accacactgctgcac

SEQ ID NO: 433640 - DNA, 15 bp, Homo sapiens
ccacactgctgcaca

SEQ ID NO: 433641 - DNA, 15 bp, Homo sapiens
cacactgctgcacag

SEQ ID NO: 433642 - DNA, 15 bp, Homo sapiens
acactgctgcacagt

SEQ ID NO: 433643 - DNA, 15 bp, Homo sapiens
cactgctgcacagtg

SEQ ID NO: 433644 - DNA, 15 bp, Homo sapiens
actgctgcacagtga

SEQ ID NO: 433645 - DNA, 15 bp, Homo sapiens
ctgctgcacagtgaa

SEQ ID NO: 433646 - DNA, 15 bp, Homo sapiens
tgctgcacagtgaag

SEQ ID NO: 433647 - DNA, 15 bp, Homo sapiens
gctgcacagtgaagc

SEQ ID NO: 433648 - DNA, 15 bp, Homo sapiens
ctgcacagtgaagct

SEQ ID NO: 433649 - DNA, 15 bp, Homo sapiens
tgcacagtgaagctg

SEQ ID NO: 433650 - DNA, 15 bp, Homo sapiens
gcacagtgaagctgt

SEQ ID NO: 433651 - DNA, 15 bp, Homo sapiens
cacagtgaagctgtg

SEQ ID NO: 433652 - DNA, 15 bp, Homo sapiens
acagtgaagctgtgc

SEQ ID NO: 433653 - DNA, 15 bp, Homo sapiens
cagtgaagctgtgca

SEQ ID NO: 433654 - DNA, 15 bp, Homo sapiens
agtgaagctgtgcaa

SEQ ID NO: 433655 - DNA, 15 bp, Homo sapiens
gtgaagctgtgcaag

SEQ ID NO: 433656 - DNA, 15 bp, Homo sapiens
tgaagctgtgcaaga

SEQ ID NO: 433657 - DNA, 15 bp, Homo sapiens
gaagctgtgcaagac

SEQ ID NO: 433658 - DNA, 15 bp, Homo sapiens
aagctgtgcaagaca

SEQ ID NO: 433659 - DNA, 15 bp, Homo sapiens
agctgtgcaagacaa

SEQ ID NO: 433660 - DNA, 15 bp, Homo sapiens
gctgtgcaagacaac

SEQ ID NO: 433661 - DNA, 15 bp, Homo sapiens
ctgtgcaagacaaca

SEQ ID NO: 433662 - DNA, 15 bp, Homo sapiens
tgtgcaagacaacag

SEQ ID NO: 433663 - DNA, 15 bp, Homo sapiens
gtgcaagacaacagc

SEQ ID NO: 433664 - DNA, 15 bp, Homo sapiens
tgcaagacaacagcc

SEQ ID NO: 433665 - DNA, 15 bp, Homo sapiens
gcaagacaacagcct

SEQ ID NO: 433666 - DNA, 15 bp, Homo sapiens
caagacaacagcctt

SEQ ID NO: 433667 - DNA, 15 bp, Homo sapiens
aagacaacagccttc

SEQ ID NO: 433668 - DNA, 15 bp, Homo sapiens
agacaacagccttca

SEQ ID NO: 433669 - DNA, 15 bp, Homo sapiens
gacaacagccttcac

SEQ ID NO: 433670 - DNA, 15 bp, Homo sapiens
acaacagccttcacc

SEQ ID NO: 433671 - DNA, 15 bp, Homo sapiens
caacagccttcaccc

SEQ ID NO: 433672 - DNA, 15 bp, Homo sapiens
aacagccttcaccca

SEQ ID NO: 433673 - DNA, 15 bp, Homo sapiens
acagccttcacccac

SEQ ID NO: 433674 - DNA, 15 bp, Homo sapiens
cagccttcacccacc

SEQ ID NO: 433675 - DNA, 15 bp, Homo sapiens
agccttcacccaccc

SEQ ID NO: 433676 - DNA, 15 bp, Homo sapiens
gccttcacccacccc

SEQ ID NO: 433677 - DNA, 15 bp, Homo sapiens
ccttcacccacccct

SEQ ID NO: 433678 - DNA, 15 bp, Homo sapiens
cttcacccaccccta

SEQ ID NO: 433679 - DNA, 15 bp, Homo sapiens
ttcacccacccctac

SEQ ID NO: 433680 - DNA, 15 bp, Homo sapiens
tcacccacccctacc

SEQ ID NO: 433681 - DNA, 15 bp, Homo sapiens
cacccacccctaccc

SEQ ID NO: 433682 - DNA, 15 bp, Homo sapiens
acccacccctacccc

SEQ ID NO: 433683 - DNA, 15 bp, Homo sapiens
cccacccctaccccc

SEQ ID NO: 433684 - DNA, 15 bp, Homo sapiens
ccacccctaccccca

SEQ ID NO: 433685 - DNA, 15 bp, Homo sapiens
cacccctacccccaa

SEQ ID NO: 433686 - DNA, 15 bp, Homo sapiens
acccctacccccaaa

SEQ ID NO: 433687 - DNA, 15 bp, Homo sapiens
cccctacccccaaac

SEQ ID NO: 433688 - DNA, 15 bp, Homo sapiens
ccctacccccaaacc

SEQ ID NO: 433689 - DNA, 15 bp, Homo sapiens
cctacccccaaacct

SEQ ID NO: 433690 - DNA, 15 bp, Homo sapiens
ctacccccaaacctc

SEQ ID NO: 433691 - DNA, 15 bp, Homo sapiens
tacccccaaacctcc

SEQ ID NO: 433692 - DNA, 15 bp, Homo sapiens
acccccaaacctcca

SEQ ID NO: 433693 - DNA, 15 bp, Homo sapiens
cccccaaacctccag

SEQ ID NO: 433694 - DNA, 15 bp, Homo sapiens
ccccaaacctccaga

SEQ ID NO: 433695 - DNA, 15 bp, Homo sapiens
cccaaacctccagag

SEQ ID NO: 433696 - DNA, 15 bp, Homo sapiens
ccaaacctccagagg

SEQ ID NO: 433697 - DNA, 15 bp, Homo sapiens
caaacctccagaggg

SEQ ID NO: 433698 - DNA, 15 bp, Homo sapiens
aaacctccagaggga

SEQ ID NO: 433699 - DNA, 15 bp, Homo sapiens
aacctccagagggaa

SEQ ID NO: 433700 - DNA, 15 bp, Homo sapiens
acctccagagggaat

SEQ ID NO: 433701 - DNA, 15 bp, Homo sapiens
cctccagagggaatt

SEQ ID NO: 433702 - DNA, 15 bp, Homo sapiens
ctccagagggaatta

SEQ ID NO: 433703 - DNA, 15 bp, Homo sapiens
tccagagggaattag

SEQ ID NO: 433704 - DNA, 15 bp, Homo sapiens
ccagagggaattagg

SEQ ID NO: 433705 - DNA, 15 bp, Homo sapiens
cagagggaattaggg

SEQ ID NO: 433706 - DNA, 15 bp, Homo sapiens
agagggaattaggga

SEQ ID NO: 433707 - DNA, 15 bp, Homo sapiens
gagggaattagggaa

SEQ ID NO: 433708 - DNA, 15 bp, Homo sapiens
agggaattagggaat

SEQ ID NO: 433709 - DNA, 15 bp, Homo sapiens
gggaattagggaata

SEQ ID NO: 433710 - DNA, 15 bp, Homo sapiens
ggaattagggaatat

SEQ ID NO: 433711 - DNA, 15 bp, Homo sapiens
gaattagggaatatt

SEQ ID NO: 433712 - DNA, 15 bp, Homo sapiens
aattagggaatattt

SEQ ID NO: 433713 - DNA, 15 bp, Homo sapiens
attagggaatatttg

SEQ ID NO: 433714 - DNA, 15 bp, Homo sapiens
ttagggaatatttgt

SEQ ID NO: 433715 - DNA, 15 bp, Homo sapiens
tagggaatatttgtg

SEQ ID NO: 433716 - DNA, 15 bp, Homo sapiens
agggaatatttgtgc

SEQ ID NO: 433717 - DNA, 15 bp, Homo sapiens
gggaatatttgtgcc

SEQ ID NO: 433718 - DNA, 15 bp, Homo sapiens
ggaatatttgtgcct

SEQ ID NO: 433719 - DNA, 15 bp, Homo sapiens
gaatatttgtgcctt

SEQ ID NO: 433720 - DNA, 15 bp, Homo sapiens
aatatttgtgccttc

SEQ ID NO: 433721 - DNA, 15 bp, Homo sapiens
atatttgtgccttct

SEQ ID NO: 433722 - DNA, 15 bp, Homo sapiens
tatttgtgccttctc

SEQ ID NO: 433723 - DNA, 15 bp, Homo sapiens
atttgtgccttctct

SEQ ID NO: 433724 - DNA, 15 bp, Homo sapiens
tttgtgccttctctc

SEQ ID NO: 433725 - DNA, 15 bp, Homo sapiens
ttgtgccttctctcc

SEQ ID NO: 433726 - DNA, 15 bp, Homo sapiens
tgtgccttctctcct

SEQ ID NO: 433727 - DNA, 15 bp, Homo sapiens
gtgccttctctcctg

SEQ ID NO: 433728 - DNA, 15 bp, Homo sapiens
tgccttctctcctgt

SEQ ID NO: 433729 - DNA, 15 bp, Homo sapiens
gccttctctcctgtt

SEQ ID NO: 433730 - DNA, 15 bp, Homo sapiens
ccttctctcctgttc

SEQ ID NO: 433731 - DNA, 15 bp, Homo sapiens
cttctctcctgttca

SEQ ID NO: 433732 - DNA, 15 bp, Homo sapiens
ttctctcctgttcat

SEQ ID NO: 433733 - DNA, 15 bp, Homo sapiens
tctctcctgttcatt

SEQ ID NO: 433734 - DNA, 15 bp, Homo sapiens
ctctcctgttcatta

SEQ ID NO: 433735 - DNA, 15 bp, Homo sapiens
tctcctgttcattac

SEQ ID NO: 433736 - DNA, 15 bp, Homo sapiens
ctcctgttcattacc

SEQ ID NO: 433737 - DNA, 15 bp, Homo sapiens
tcctgttcattacct

SEQ ID NO: 433738 - DNA, 15 bp, Homo sapiens
cctgttcattacctt

SEQ ID NO: 433739 - DNA, 15 bp, Homo sapiens
ctgttcattaccttc

SEQ ID NO: 433740 - DNA, 15 bp, Homo sapiens
tgttcattaccttca

SEQ ID NO: 433741 - DNA, 15 bp, Homo sapiens
gttcattaccttcag

SEQ ID NO: 433742 - DNA, 15 bp, Homo sapiens
ttcattaccttcagt

SEQ ID NO: 433743 - DNA, 15 bp, Homo sapiens
tcattaccttcagtt

SEQ ID NO: 433744 - DNA, 15 bp, Homo sapiens
cattaccttcagttc

SEQ ID NO: 433745 - DNA, 15 bp, Homo sapiens
attaccttcagttca

SEQ ID NO: 433746 - DNA, 15 bp, Homo sapiens
ttaccttcagttcag

SEQ ID NO: 433747 - DNA, 15 bp, Homo sapiens
taccttcagttcagt

SEQ ID NO: 433748 - DNA, 15 bp, Homo sapiens
accttcagttcagtt

SEQ ID NO: 433749 - DNA, 15 bp, Homo sapiens
ccttcagttcagttt

SEQ ID NO: 433750 - DNA, 15 bp, Homo sapiens
cttcagttcagttta

SEQ ID NO: 433751 - DNA, 15 bp, Homo sapiens
ttcagttcagtttaa

SEQ ID NO: 433752 - DNA, 15 bp, Homo sapiens
tcagttcagtttaaa

SEQ ID NO: 433753 - DNA, 15 bp, Homo sapiens
cagttcagtttaaaa

SEQ ID NO: 433754 - DNA, 15 bp, Homo sapiens
agttcagtttaaaag

SEQ ID NO: 433755 - DNA, 15 bp, Homo sapiens
gttcagtttaaaagt

SEQ ID NO: 433756 - DNA, 15 bp, Homo sapiens
ttcagtttaaaagtc

SEQ ID NO: 433757 - DNA, 15 bp, Homo sapiens
tcagtttaaaagtca

SEQ ID NO: 433758 - DNA, 15 bp, Homo sapiens
cagtttaaaagtcag

SEQ ID NO: 433759 - DNA, 15 bp, Homo sapiens
agtttaaaagtcaga

SEQ ID NO: 433760 - DNA, 15 bp, Homo sapiens
gtttaaaagtcagat

SEQ ID NO: 433761 - DNA, 15 bp, Homo sapiens
tttaaaagtcagatc

SEQ ID NO: 433762 - DNA, 15 bp, Homo sapiens
ttaaaagtcagatct

SEQ ID NO: 433763 - DNA, 15 bp, Homo sapiens
taaaagtcagatctg

SEQ ID NO: 433764 - DNA, 15 bp, Homo sapiens
aaaagtcagatctgc

SEQ ID NO: 433765 - DNA, 15 bp, Homo sapiens
aaagtcagatctgca

SEQ ID NO: 433766 - DNA, 15 bp, Homo sapiens
aagtcagatctgcac

SEQ ID NO: 433767 - DNA, 15 bp, Homo sapiens
agtcagatctgcaca

SEQ ID NO: 433768 - DNA, 15 bp, Homo sapiens
gtcagatctgcacag

SEQ ID NO: 433769 - DNA, 15 bp, Homo sapiens
tcagatctgcacagg

SEQ ID NO: 433770 - DNA, 15 bp, Homo sapiens
cagatctgcacaggg

SEQ ID NO: 433771 - DNA, 15 bp, Homo sapiens
agatctgcacagggg

SEQ ID NO: 433772 - DNA, 15 bp, Homo sapiens
gatctgcacagggga

SEQ ID NO: 433773 - DNA, 15 bp, Homo sapiens
atctgcacaggggag

SEQ ID NO: 433774 - DNA, 15 bp, Homo sapiens
tctgcacaggggagt

SEQ ID NO: 433775 - DNA, 15 bp, Homo sapiens
ctgcacaggggagtt

SEQ ID NO: 433776 - DNA, 15 bp, Homo sapiens
tgcacaggggagttg

SEQ ID NO: 433777 - DNA, 15 bp, Homo sapiens
gcacaggggagttgg

SEQ ID NO: 433778 - DNA, 15 bp, Homo sapiens
cacaggggagttgga

SEQ ID NO: 433779 - DNA, 15 bp, Homo sapiens
acaggggagttggag

SEQ ID NO: 433780 - DNA, 15 bp, Homo sapiens
caggggagttggagc

SEQ ID NO: 433781 - DNA, 15 bp, Homo sapiens
aggggagttggagcc

SEQ ID NO: 433782 - DNA, 15 bp, Homo sapiens
ggggagttggagcct

SEQ ID NO: 433783 - DNA, 15 bp, Homo sapiens
gggagttggagcctt

SEQ ID NO: 433784 - DNA, 15 bp, Homo sapiens
ggagttggagccttc

SEQ ID NO: 433785 - DNA, 15 bp, Homo sapiens
gagttggagccttct

SEQ ID NO: 433786 - DNA, 15 bp, Homo sapiens
agttggagccttctg

SEQ ID NO: 433787 - DNA, 15 bp, Homo sapiens
gttggagccttctgt

SEQ ID NO: 433788 - DNA, 15 bp, Homo sapiens
ttggagccttctgtc

SEQ ID NO: 433789 - DNA, 15 bp, Homo sapiens
tggagccttctgtcg

SEQ ID NO: 433790 - DNA, 15 bp, Homo sapiens
ggagccttctgtcgg

SEQ ID NO: 433791 - DNA, 15 bp, Homo sapiens
gagccttctgtcggt

SEQ ID NO: 433792 - DNA, 15 bp, Homo sapiens
agccttctgtcggtc

SEQ ID NO: 433793 - DNA, 15 bp, Homo sapiens
gccttctgtcggtct

SEQ ID NO: 433794 - DNA, 15 bp, Homo sapiens
ccttctgtcggtctt

SEQ ID NO: 433795 - DNA, 15 bp, Homo sapiens
cttctgtcggtcttc

SEQ ID NO: 433796 - DNA, 15 bp, Homo sapiens
ttctgtcggtcttcc

SEQ ID NO: 433797 - DNA, 15 bp, Homo sapiens
tctgtcggtcttcct

SEQ ID NO: 433798 - DNA, 15 bp, Homo sapiens
ctgtcggtcttcctc

SEQ ID NO: 433799 - DNA, 15 bp, Homo sapiens
tgtcggtcttcctct

SEQ ID NO: 433800 - DNA, 15 bp, Homo sapiens
gtcggtcttcctctc

SEQ ID NO: 433801 - DNA, 15 bp, Homo sapiens
tcggtcttcctctct

SEQ ID NO: 433802 - DNA, 15 bp, Homo sapiens
cggtcttcctctctc

SEQ ID NO: 433803 - DNA, 15 bp, Homo sapiens
ggtcttcctctctcc

SEQ ID NO: 433804 - DNA, 15 bp, Homo sapiens
gtcttcctctctcca

SEQ ID NO: 433805 - DNA, 15 bp, Homo sapiens
tcttcctctctccat

SEQ ID NO: 433806 - DNA, 15 bp, Homo sapiens
cttcctctctccata

SEQ ID NO: 433807 - DNA, 15 bp, Homo sapiens
ttcctctctccatac

SEQ ID NO: 433808 - DNA, 15 bp, Homo sapiens
tcctctctccatacc

SEQ ID NO: 433809 - DNA, 15 bp, Homo sapiens
cctctctccatacca

SEQ ID NO: 433810 - DNA, 15 bp, Homo sapiens
ctctctccataccac

SEQ ID NO: 433811 - DNA, 15 bp, Homo sapiens
tctctccataccaca

SEQ ID NO: 433812 - DNA, 15 bp, Homo sapiens
ctctccataccacat

SEQ ID NO: 433813 - DNA, 15 bp, Homo sapiens
tctccataccacata

SEQ ID NO: 433814 - DNA, 15 bp, Homo sapiens
ctccataccacatac

SEQ ID NO: 433815 - DNA, 15 bp, Homo sapiens
tccataccacataca

SEQ ID NO: 433816 - DNA, 15 bp, Homo sapiens
ccataccacatacag

SEQ ID NO: 433817 - DNA, 15 bp, Homo sapiens
cataccacatacaga

SEQ ID NO: 433818 - DNA, 15 bp, Homo sapiens
ataccacatacagat

SEQ ID NO: 433819 - DNA, 15 bp, Homo sapiens
taccacatacagatg

SEQ ID NO: 433820 - DNA, 15 bp, Homo sapiens
accacatacagatgc

SEQ ID NO: 433821 - DNA, 15 bp, Homo sapiens
ccacatacagatgca

SEQ ID NO: 433822 - DNA, 15 bp, Homo sapiens
cacatacagatgcag

SEQ ID NO: 433823 - DNA, 15 bp, Homo sapiens
acatacagatgcagg

SEQ ID NO: 433824 - DNA, 15 bp, Homo sapiens
catacagatgcaggc

SEQ ID NO: 433825 - DNA, 15 bp, Homo sapiens
atacagatgcaggca

SEQ ID NO: 433826 - DNA, 15 bp, Homo sapiens
tacagatgcaggcag

SEQ ID NO: 433827 - DNA, 15 bp, Homo sapiens
acagatgcaggcagg

SEQ ID NO: 433828 - DNA, 15 bp, Homo sapiens
cagatgcaggcaggc

SEQ ID NO: 433829 - DNA, 15 bp, Homo sapiens
agatgcaggcaggca

SEQ ID NO: 433830 - DNA, 15 bp, Homo sapiens
gatgcaggcaggcag

SEQ ID NO: 433831 - DNA, 15 bp, Homo sapiens
atgcaggcaggcagg

SEQ ID NO: 433832 - DNA, 15 bp, Homo sapiens
tgcaggcaggcaggc

SEQ ID NO: 433833 - DNA, 15 bp, Homo sapiens
gcaggcaggcaggca

SEQ ID NO: 433834 - DNA, 15 bp, Homo sapiens
caggcaggcaggcac

SEQ ID NO: 433835 - DNA, 15 bp, Homo sapiens
aggcaggcaggcacg

SEQ ID NO: 433836 - DNA, 15 bp, Homo sapiens
ggcaggcaggcacgc

SEQ ID NO: 433837 - DNA, 15 bp, Homo sapiens
gcaggcaggcacgca

SEQ ID NO: 433838 - DNA, 15 bp, Homo sapiens
caggcaggcacgcac

SEQ ID NO: 433839 - DNA, 15 bp, Homo sapiens
aggcaggcacgcaca

SEQ ID NO: 433840 - DNA, 15 bp, Homo sapiens
ggcaggcacgcacat

SEQ ID NO: 433841 - DNA, 15 bp, Homo sapiens
gcaggcacgcacatg

SEQ ID NO: 433842 - DNA, 15 bp, Homo sapiens
caggcacgcacatgc

SEQ ID NO: 433843 - DNA, 15 bp, Homo sapiens
aggcacgcacatgca

SEQ ID NO: 433844 - DNA, 15 bp, Homo sapiens
ggcacgcacatgcac

SEQ ID NO: 433845 - DNA, 15 bp, Homo sapiens
gcacgcacatgcaca

SEQ ID NO: 433846 - DNA, 15 bp, Homo sapiens
cacgcacatgcacaa

SEQ ID NO: 433847 - DNA, 15 bp, Homo sapiens
acgcacatgcacaag

SEQ ID NO: 433848 - DNA, 15 bp, Homo sapiens
cgcacatgcacaagc

SEQ ID NO: 433849 - DNA, 15 bp, Homo sapiens
gcacatgcacaagca

SEQ ID NO: 433850 - DNA, 15 bp, Homo sapiens
cacatgcacaagcac

SEQ ID NO: 433851 - DNA, 15 bp, Homo sapiens
acatgcacaagcacc

SEQ ID NO: 433852 - DNA, 15 bp, Homo sapiens
catgcacaagcaccc

SEQ ID NO: 433853 - DNA, 15 bp, Homo sapiens
atgcacaagcacccc

SEQ ID NO: 433854 - DNA, 15 bp, Homo sapiens
tgcacaagcaccccc

SEQ ID NO: 433855 - DNA, 15 bp, Homo sapiens
gcacaagcacccccc

SEQ ID NO: 433856 - DNA, 15 bp, Homo sapiens
cacaagcacccccca

SEQ ID NO: 433857 - DNA, 15 bp, Homo sapiens
acaagcaccccccac

SEQ ID NO: 433858 - DNA, 15 bp, Homo sapiens
caagcaccccccacc

SEQ ID NO: 433859 - DNA, 15 bp, Homo sapiens
aagcaccccccacca

SEQ ID NO: 433860 - DNA, 15 bp, Homo sapiens
agcaccccccaccaa

SEQ ID NO: 433861 - DNA, 15 bp, Homo sapiens
gcaccccccaccaaa

SEQ ID NO: 433862 - DNA, 15 bp, Homo sapiens
caccccccaccaaac

SEQ ID NO: 433863 - DNA, 15 bp, Homo sapiens
accccccaccaaaca

SEQ ID NO: 433864 - DNA, 15 bp, Homo sapiens
ccccccaccaaacat

SEQ ID NO: 433865 - DNA, 15 bp, Homo sapiens
cccccaccaaacata

SEQ ID NO: 433866 - DNA, 15 bp, Homo sapiens
ccccaccaaacatac

SEQ ID NO: 433867 - DNA, 15 bp, Homo sapiens
cccaccaaacatact

SEQ ID NO: 433868 - DNA, 15 bp, Homo sapiens
ccaccaaacatactt

SEQ ID NO: 433869 - DNA, 15 bp, Homo sapiens
caccaaacatacttt

SEQ ID NO: 433870 - DNA, 15 bp, Homo sapiens
accaaacatacttta

SEQ ID NO: 433871 - DNA, 15 bp, Homo sapiens
ccaaacatactttat

SEQ ID NO: 433872 - DNA, 15 bp, Homo sapiens
caaacatactttatg

SEQ ID NO: 433873 - DNA, 15 bp, Homo sapiens
aaacatactttatga

SEQ ID NO: 433874 - DNA, 15 bp, Homo sapiens
aacatactttatgat

SEQ ID NO: 433875 - DNA, 15 bp, Homo sapiens
acatactttatgatt

SEQ ID NO: 433876 - DNA, 15 bp, Homo sapiens
catactttatgattt

SEQ ID NO: 433877 - DNA, 15 bp, Homo sapiens
atactttatgattta

SEQ ID NO: 433878 - DNA, 15 bp, Homo sapiens
tactttatgatttaa

SEQ ID NO: 433879 - DNA, 15 bp, Homo sapiens
actttatgatttaaa

SEQ ID NO: 433880 - DNA, 15 bp, Homo sapiens
ctttatgatttaaag

SEQ ID NO: 433881 - DNA, 15 bp, Homo sapiens
tttatgatttaaagc

SEQ ID NO: 433882 - DNA, 15 bp, Homo sapiens
ttatgatttaaagct

SEQ ID NO: 433883 - DNA, 15 bp, Homo sapiens
tatgatttaaagcta

SEQ ID NO: 433884 - DNA, 15 bp, Homo sapiens
atgatttaaagctaa

SEQ ID NO: 433885 - DNA, 15 bp, Homo sapiens
tgatttaaagctaag

SEQ ID NO: 433886 - DNA, 15 bp, Homo sapiens
gatttaaagctaagg

SEQ ID NO: 433887 - DNA, 15 bp, Homo sapiens
atttaaagctaaggt

SEQ ID NO: 433888 - DNA, 15 bp, Homo sapiens
tttaaagctaaggta

SEQ ID NO: 433889 - DNA, 15 bp, Homo sapiens
ttaaagctaaggtat

SEQ ID NO: 433890 - DNA, 15 bp, Homo sapiens
taaagctaaggtatc

SEQ ID NO: 433891 - DNA, 15 bp, Homo sapiens
aaagctaaggtatca

SEQ ID NO: 433892 - DNA, 15 bp, Homo sapiens
aagctaaggtatcaa

SEQ ID NO: 433893 - DNA, 15 bp, Homo sapiens
agctaaggtatcaat

SEQ ID NO: 433894 - DNA, 15 bp, Homo sapiens
gctaaggtatcaatc

SEQ ID NO: 433895 - DNA, 15 bp, Homo sapiens
ctaaggtatcaatca

SEQ ID NO: 433896 - DNA, 15 bp, Homo sapiens
taaggtatcaatcac

SEQ ID NO: 433897 - DNA, 15 bp, Homo sapiens
aaggtatcaatcact

SEQ ID NO: 433898 - DNA, 15 bp, Homo sapiens
aggtatcaatcacta

SEQ ID NO: 433899 - DNA, 15 bp, Homo sapiens
ggtatcaatcactaa

SEQ ID NO: 433900 - DNA, 15 bp, Homo sapiens
gtatcaatcactaaa

SEQ ID NO: 433901 - DNA, 15 bp, Homo sapiens
tatcaatcactaaat

SEQ ID NO: 433902 - DNA, 15 bp, Homo sapiens
atcaatcactaaata

SEQ ID NO: 433903 - DNA, 15 bp, Homo sapiens
tcaatcactaaataa

SEQ ID NO: 433904 - DNA, 15 bp, Homo sapiens
caatcactaaataaa

SEQ ID NO: 433905 - DNA, 15 bp, Homo sapiens
aatcactaaataaaa

SEQ ID NO: 433906 - DNA, 15 bp, Homo sapiens
atcactaaataaaac

SEQ ID NO: 433907 - DNA, 15 bp, Homo sapiens
tcactaaataaaact

SEQ ID NO: 433908 - DNA, 15 bp, Homo sapiens
cactaaataaaactg

SEQ ID NO: 433909 - DNA, 15 bp, Homo sapiens
actaaataaaactgc

SEQ ID NO: 433910 - DNA, 15 bp, Homo sapiens
ctaaataaaactgct

SEQ ID NO: 433911 - DNA, 15 bp, Homo sapiens
taaataaaactgcta

SEQ ID NO: 433912 - DNA, 15 bp, Homo sapiens
aaataaaactgctaa

SEQ ID NO: 433913 - DNA, 15 bp, Homo sapiens
aataaaactgctaac

SEQ ID NO: 433914 - DNA, 15 bp, Homo sapiens
ataaaactgctaaca

SEQ ID NO: 433915 - DNA, 15 bp, Homo sapiens
taaaactgctaacaa

SEQ ID NO: 433916 - DNA, 15 bp, Homo sapiens
aaaactgctaacaat

SEQ ID NO: 433917 - DNA, 15 bp, Homo sapiens
aaactgctaacaatt

SEQ ID NO: 433918 - DNA, 15 bp, Homo sapiens
aactgctaacaattt

SEQ ID NO: 433919 - DNA, 15 bp, Homo sapiens
actgctaacaatttt

SEQ ID NO: 433920 - DNA, 15 bp, Homo sapiens
ctgctaacaatttta

SEQ ID NO: 433921 - DNA, 15 bp, Homo sapiens
tgctaacaattttat

SEQ ID NO: 433922 - DNA, 15 bp, Homo sapiens
gctaacaattttata

SEQ ID NO: 433923 - DNA, 15 bp, Homo sapiens
ctaacaattttatag

SEQ ID NO: 433924 - DNA, 15 bp, Homo sapiens
taacaattttatagg

SEQ ID NO: 433925 - DNA, 15 bp, Homo sapiens
aacaattttataggc

SEQ ID NO: 433926 - DNA, 15 bp, Homo sapiens
acaattttataggct

SEQ ID NO: 433927 - DNA, 15 bp, Homo sapiens
caattttataggcta

SEQ ID NO: 433928 - DNA, 15 bp, Homo sapiens
aattttataggctat

SEQ ID NO: 433929 - DNA, 15 bp, Homo sapiens
attttataggctatc

SEQ ID NO: 433930 - DNA, 15 bp, Homo sapiens
ttttataggctatct

SEQ ID NO: 433931 - DNA, 15 bp, Homo sapiens
tttataggctatctc

SEQ ID NO: 433932 - DNA, 15 bp, Homo sapiens
ttataggctatctca

SEQ ID NO: 433933 - DNA, 15 bp, Homo sapiens
tataggctatctcac

SEQ ID NO: 433934 - DNA, 15 bp, Homo sapiens
ataggctatctcacc

SEQ ID NO: 433935 - DNA, 15 bp, Homo sapiens
taggctatctcacct

SEQ ID NO: 433936 - DNA, 15 bp, Homo sapiens
aggctatctcacctc

SEQ ID NO: 433937 - DNA, 15 bp, Homo sapiens
ggctatctcacctct

SEQ ID NO: 433938 - DNA, 15 bp, Homo sapiens
gctatctcacctcta

SEQ ID NO: 433939 - DNA, 15 bp, Homo sapiens
ctatctcacctctaa

SEQ ID NO: 433940 - DNA, 15 bp, Homo sapiens
tatctcacctctaaa

SEQ ID NO: 433941 - DNA, 15 bp, Homo sapiens
atctcacctctaaat

SEQ ID NO: 433942 - DNA, 15 bp, Homo sapiens
tctcacctctaaatg

SEQ ID NO: 433943 - DNA, 15 bp, Homo sapiens
ctcacctctaaatgt

SEQ ID NO: 433944 - DNA, 15 bp, Homo sapiens
tcacctctaaatgtg

SEQ ID NO: 433945 - DNA, 15 bp, Homo sapiens
cacctctaaatgtgt

SEQ ID NO: 433946 - DNA, 15 bp, Homo sapiens
acctctaaatgtgtt

SEQ ID NO: 433947 - DNA, 15 bp, Homo sapiens
cctctaaatgtgttt

SEQ ID NO: 433948 - DNA, 15 bp, Homo sapiens
ctctaaatgtgttta

SEQ ID NO: 433949 - DNA, 15 bp, Homo sapiens
tctaaatgtgtttag

SEQ ID NO: 433950 - DNA, 15 bp, Homo sapiens
ctaaatgtgtttaga

SEQ ID NO: 433951 - DNA, 15 bp, Homo sapiens
taaatgtgtttagaa

SEQ ID NO: 433952 - DNA, 15 bp, Homo sapiens
aaatgtgtttagaaa

SEQ ID NO: 433953 - DNA, 15 bp, Homo sapiens
aatgtgtttagaaaa

SEQ ID NO: 433954 - DNA, 15 bp, Homo sapiens
atgtgtttagaaaat

SEQ ID NO: 433955 - DNA, 15 bp, Homo sapiens
tgtgtttagaaaatt

SEQ ID NO: 433956 - DNA, 15 bp, Homo sapiens
gtgtttagaaaatta

SEQ ID NO: 433957 - DNA, 15 bp, Homo sapiens
tgtttagaaaattac

SEQ ID NO: 433958 - DNA, 15 bp, Homo sapiens
gtttagaaaattaca

SEQ ID NO: 433959 - DNA, 15 bp, Homo sapiens
tttagaaaattacac

SEQ ID NO: 433960 - DNA, 15 bp, Homo sapiens
ttagaaaattacaca

SEQ ID NO: 433961 - DNA, 15 bp, Homo sapiens
tagaaaattacacaa

SEQ ID NO: 433962 - DNA, 15 bp, Homo sapiens
agaaaattacacaat

SEQ ID NO: 433963 - DNA, 15 bp, Homo sapiens
gaaaattacacaatt

SEQ ID NO: 433964 - DNA, 15 bp, Homo sapiens
aaaattacacaattc

SEQ ID NO: 433965 - DNA, 15 bp, Homo sapiens
aaattacacaattca

SEQ ID NO: 433966 - DNA, 15 bp, Homo sapiens
aattacacaattcat

SEQ ID NO: 433967 - DNA, 15 bp, Homo sapiens
attacacaattcatt

SEQ ID NO: 433968 - DNA, 15 bp, Homo sapiens
ttacacaattcattg

SEQ ID NO: 433969 - DNA, 15 bp, Homo sapiens
tacacaattcattgt

SEQ ID NO: 433970 - DNA, 15 bp, Homo sapiens
acacaattcattgta

SEQ ID NO: 433971 - DNA, 15 bp, Homo sapiens
cacaattcattgtat

SEQ ID NO: 433972 - DNA, 15 bp, Homo sapiens
acaattcattgtata

SEQ ID NO: 433973 - DNA, 15 bp, Homo sapiens
caattcattgtatac

SEQ ID NO: 433974 - DNA, 15 bp, Homo sapiens
aattcattgtataca

SEQ ID NO: 433975 - DNA, 15 bp, Homo sapiens
attcattgtatacat

SEQ ID NO: 433976 - DNA, 15 bp, Homo sapiens
ttcattgtatacata

SEQ ID NO: 433977 - DNA, 15 bp, Homo sapiens
tcattgtatacatat

SEQ ID NO: 433978 - DNA, 15 bp, Homo sapiens
cattgtatacatatg

SEQ ID NO: 433979 - DNA, 15 bp, Homo sapiens
attgtatacatatgt

SEQ ID NO: 433980 - DNA, 15 bp, Homo sapiens
ttgtatacatatgta

SEQ ID NO: 433981 - DNA, 15 bp, Homo sapiens
gtatacatatgtatg

SEQ ID NO: 433982 - DNA, 15 bp, Homo sapiens
tatacatatgtatgg

SEQ ID NO: 433983 - DNA, 15 bp, Homo sapiens
atacatatgtatgga

SEQ ID NO: 433984 - DNA, 15 bp, Homo sapiens
tacatatgtatggag

SEQ ID NO: 433985 - DNA, 15 bp, Homo sapiens
acatatgtatggaga

SEQ ID NO: 433986 - DNA, 15 bp, Homo sapiens
catatgtatggagaa

SEQ ID NO: 433987 - DNA, 15 bp, Homo sapiens
atatgtatggagaaa

SEQ ID NO: 433988 - DNA, 15 bp, Homo sapiens
tatgtatggagaaaa

SEQ ID NO: 433989 - DNA, 15 bp, Homo sapiens
atgtatggagaaaac

SEQ ID NO: 433990 - DNA, 15 bp, Homo sapiens
tgtatggagaaaaca

SEQ ID NO: 433991 - DNA, 15 bp, Homo sapiens
gtatggagaaaacac

SEQ ID NO: 433992 - DNA, 15 bp, Homo sapiens
tatggagaaaacacc

SEQ ID NO: 433993 - DNA, 15 bp, Homo sapiens
atggagaaaacacct

SEQ ID NO: 433994 - DNA, 15 bp, Homo sapiens
tggagaaaacacctg

SEQ ID NO: 433995 - DNA, 15 bp, Homo sapiens
ggagaaaacacctgt

SEQ ID NO: 433996 - DNA, 15 bp, Homo sapiens
gagaaaacacctgtc

SEQ ID NO: 433997 - DNA, 15 bp, Homo sapiens
agaaaacacctgtcc

SEQ ID NO: 433998 - DNA, 15 bp, Homo sapiens
gaaaacacctgtcct

SEQ ID NO: 433999 - DNA, 15 bp, Homo sapiens
aaaacacctgtcctc

SEQ ID NO: 434000 - DNA, 15 bp, Homo sapiens
aaacacctgtcctct

SEQ ID NO: 434001 - DNA, 15 bp, Homo sapiens
aacacctgtcctctt

SEQ ID NO: 434002 - DNA, 15 bp, Homo sapiens
acacctgtcctcttc

SEQ ID NO: 434003 - DNA, 15 bp, Homo sapiens
cacctgtcctcttct

SEQ ID NO: 434004 - DNA, 15 bp, Homo sapiens
acctgtcctcttctt

SEQ ID NO: 434005 - DNA, 15 bp, Homo sapiens
cctgtcctcttcttg

SEQ ID NO: 434006 - DNA, 15 bp, Homo sapiens
ctgtcctcttcttgt

SEQ ID NO: 434007 - DNA, 15 bp, Homo sapiens
tgtcctcttcttgtg

SEQ ID NO: 434008 - DNA, 15 bp, Homo sapiens
gtcctcttcttgtga

SEQ ID NO: 434009 - DNA, 15 bp, Homo sapiens
tcctcttcttgtgat

SEQ ID NO: 434010 - DNA, 15 bp, Homo sapiens
cctcttcttgtgata

SEQ ID NO: 434011 - DNA, 15 bp, Homo sapiens
ctcttcttgtgatat

SEQ ID NO: 434012 - DNA, 15 bp, Homo sapiens
tcttcttgtgatatt

SEQ ID NO: 434013 - DNA, 15 bp, Homo sapiens
cttcttgtgatattt

SEQ ID NO: 434014 - DNA, 15 bp, Homo sapiens
ttcttgtgatatttt

SEQ ID NO: 434015 - DNA, 15 bp, Homo sapiens
tcttgtgatattttt

SEQ ID NO: 434016 - DNA, 15 bp, Homo sapiens
cttgtgatattttta

SEQ ID NO: 434017 - DNA, 15 bp, Homo sapiens
ttgtgatatttttag

SEQ ID NO: 434018 - DNA, 15 bp, Homo sapiens
tgtgatatttttaga

SEQ ID NO: 434019 - DNA, 15 bp, Homo sapiens
gtgatatttttagat

SEQ ID NO: 434020 - DNA, 15 bp, Homo sapiens
tgatatttttagatt

SEQ ID NO: 434021 - DNA, 15 bp, Homo sapiens
gatatttttagatta

SEQ ID NO: 434022 - DNA, 15 bp, Homo sapiens
atatttttagattaa

SEQ ID NO: 434023 - DNA, 15 bp, Homo sapiens
tatttttagattaaa

SEQ ID NO: 434024 - DNA, 15 bp, Homo sapiens
atttttagattaaaa

SEQ ID NO: 434025 - DNA, 15 bp, Homo sapiens
tttttagattaaaaa

SEQ ID NO: 434026 - DNA, 15 bp, Homo sapiens
ttttagattaaaaaa

SEQ ID NO: 434027 - DNA, 15 bp, Homo sapiens
tttagattaaaaaag

SEQ ID NO: 434028 - DNA, 15 bp, Homo sapiens
ttagattaaaaaaga

SEQ ID NO: 434029 - DNA, 15 bp, Homo sapiens
tagattaaaaaagag

SEQ ID NO: 434030 - DNA, 15 bp, Homo sapiens
agattaaaaaagaga

SEQ ID NO: 434031 - DNA, 15 bp, Homo sapiens
gattaaaaaagagat

SEQ ID NO: 434032 - DNA, 15 bp, Homo sapiens
attaaaaaagagatt

SEQ ID NO: 434033 - DNA, 15 bp, Homo sapiens
ttaaaaaagagattg

SEQ ID NO: 434034 - DNA, 15 bp, Homo sapiens
taaaaaagagattgc

SEQ ID NO: 434035 - DNA, 15 bp, Homo sapiens
aaaaaagagattgca

SEQ ID NO: 434036 - DNA, 15 bp, Homo sapiens
aaaaagagattgcat

SEQ ID NO: 434037 - DNA, 15 bp, Homo sapiens
aaaagagattgcatt

SEQ ID NO: 434038 - DNA, 15 bp, Homo sapiens
aaagagattgcatta

SEQ ID NO: 434039 - DNA, 15 bp, Homo sapiens
aagagattgcattat

SEQ ID NO: 434040 - DNA, 15 bp, Homo sapiens
agagattgcattatt

SEQ ID NO: 434041 - DNA, 15 bp, Homo sapiens
gagattgcattattt

SEQ ID NO: 434042 - DNA, 15 bp, Homo sapiens
agattgcattattta

SEQ ID NO: 434043 - DNA, 15 bp, Homo sapiens
gattgcattatttat

SEQ ID NO: 434044 - DNA, 15 bp, Homo sapiens
attgcattatttatc

SEQ ID NO: 434045 - DNA, 15 bp, Homo sapiens
ttgcattatttatcc

SEQ ID NO: 434046 - DNA, 15 bp, Homo sapiens
tgcattatttatcca

SEQ ID NO: 434047 - DNA, 15 bp, Homo sapiens
gcattatttatccac

SEQ ID NO: 434048 - DNA, 15 bp, Homo sapiens
cattatttatccacc

SEQ ID NO: 434049 - DNA, 15 bp, Homo sapiens
attatttatccacca

SEQ ID NO: 434050 - DNA, 15 bp, Homo sapiens
ttatttatccaccag

SEQ ID NO: 434051 - DNA, 15 bp, Homo sapiens
tatttatccaccagt

SEQ ID NO: 434052 - DNA, 15 bp, Homo sapiens
atttatccaccagtt

SEQ ID NO: 434053 - DNA, 15 bp, Homo sapiens
tttatccaccagttt

SEQ ID NO: 434054 - DNA, 15 bp, Homo sapiens
ttatccaccagtttc

SEQ ID NO: 434055 - DNA, 15 bp, Homo sapiens
tatccaccagtttcc

SEQ ID NO: 434056 - DNA, 15 bp, Homo sapiens
atccaccagtttcct

SEQ ID NO: 434057 - DNA, 15 bp, Homo sapiens
tccaccagtttcctc

SEQ ID NO: 434058 - DNA, 15 bp, Homo sapiens
ccaccagtttcctca

SEQ ID NO: 434059 - DNA, 15 bp, Homo sapiens
caccagtttcctcag

SEQ ID NO: 434060 - DNA, 15 bp, Homo sapiens
accagtttcctcagg

SEQ ID NO: 434061 - DNA, 15 bp, Homo sapiens
ccagtttcctcagga

SEQ ID NO: 434062 - DNA, 15 bp, Homo sapiens
cagtttcctcaggaa

SEQ ID NO: 434063 - DNA, 15 bp, Homo sapiens
agtttcctcaggaat

SEQ ID NO: 434064 - DNA, 15 bp, Homo sapiens
gtttcctcaggaatc

SEQ ID NO: 434065 - DNA, 15 bp, Homo sapiens
tttcctcaggaatca

SEQ ID NO: 434066 - DNA, 15 bp, Homo sapiens
ttcctcaggaatcat

SEQ ID NO: 434067 - DNA, 15 bp, Homo sapiens
tcctcaggaatcatc

SEQ ID NO: 434068 - DNA, 15 bp, Homo sapiens
cctcaggaatcatct

SEQ ID NO: 434069 - DNA, 15 bp, Homo sapiens
ctcaggaatcatctt

SEQ ID NO: 434070 - DNA, 15 bp, Homo sapiens
tcaggaatcatcttt

SEQ ID NO: 434071 - DNA, 15 bp, Homo sapiens
caggaatcatcttta

SEQ ID NO: 434072 - DNA, 15 bp, Homo sapiens
aggaatcatctttaa

SEQ ID NO: 434073 - DNA, 15 bp, Homo sapiens
ggaatcatctttaaa

SEQ ID NO: 434074 - DNA, 15 bp, Homo sapiens
gaatcatctttaaaa

SEQ ID NO: 434075 - DNA, 15 bp, Homo sapiens
aatcatctttaaaaa

SEQ ID NO: 434076 - DNA, 15 bp, Homo sapiens
atcatctttaaaaat

SEQ ID NO: 434077 - DNA, 15 bp, Homo sapiens
tcatctttaaaaatt

SEQ ID NO: 434078 - DNA, 15 bp, Homo sapiens
catctttaaaaatta

SEQ ID NO: 434079 - DNA, 15 bp, Homo sapiens
atctttaaaaattat

SEQ ID NO: 434080 - DNA, 15 bp, Homo sapiens
tctttaaaaattatt

SEQ ID NO: 434081 - DNA, 15 bp, Homo sapiens
ctttaaaaattattc

SEQ ID NO: 434082 - DNA, 15 bp, Homo sapiens
tttaaaaattattcc

SEQ ID NO: 434083 - DNA, 15 bp, Homo sapiens
ttaaaaattattcca

SEQ ID NO: 434084 - DNA, 15 bp, Homo sapiens
taaaaattattccag

SEQ ID NO: 434085 - DNA, 15 bp, Homo sapiens
aaaaattattccagt

SEQ ID NO: 434086 - DNA, 15 bp, Homo sapiens
aaaattattccagtt

SEQ ID NO: 434087 - DNA, 15 bp, Homo sapiens
aaattattccagtta

SEQ ID NO: 434088 - DNA, 15 bp, Homo sapiens
aattattccagttaa

SEQ ID NO: 434089 - DNA, 15 bp, Homo sapiens
attattccagttaaa

SEQ ID NO: 434090 - DNA, 15 bp, Homo sapiens
ttattccagttaaag

SEQ ID NO: 434091 - DNA, 15 bp, Homo sapiens
tattccagttaaaga

SEQ ID NO: 434092 - DNA, 15 bp, Homo sapiens
attccagttaaagaa

SEQ ID NO: 434093 - DNA, 15 bp, Homo sapiens
ttccagttaaagaat

SEQ ID NO: 434094 - DNA, 15 bp, Homo sapiens
tccagttaaagaatt

SEQ ID NO: 434095 - DNA, 15 bp, Homo sapiens
ccagttaaagaatta

SEQ ID NO: 434096 - DNA, 15 bp, Homo sapiens
cagttaaagaattac

SEQ ID NO: 434097 - DNA, 15 bp, Homo sapiens
agttaaagaattact

SEQ ID NO: 434098 - DNA, 15 bp, Homo sapiens
gttaaagaattactg

SEQ ID NO: 434099 - DNA, 15 bp, Homo sapiens
ttaaagaattactgt

SEQ ID NO: 434100 - DNA, 15 bp, Homo sapiens
taaagaattactgtt

SEQ ID NO: 434101 - DNA, 15 bp, Homo sapiens
aaagaattactgtta

SEQ ID NO: 434102 - DNA, 15 bp, Homo sapiens
aagaattactgttac

SEQ ID NO: 434103 - DNA, 15 bp, Homo sapiens
agaattactgttact

SEQ ID NO: 434104 - DNA, 15 bp, Homo sapiens
gaattactgttacta

SEQ ID NO: 434105 - DNA, 15 bp, Homo sapiens
aattactgttactac

SEQ ID NO: 434106 - DNA, 15 bp, Homo sapiens
attactgttactaca

SEQ ID NO: 434107 - DNA, 15 bp, Homo sapiens
ttactgttactacaa

SEQ ID NO: 434108 - DNA, 15 bp, Homo sapiens
tactgttactacaac

SEQ ID NO: 434109 - DNA, 15 bp, Homo sapiens
actgttactacaact

SEQ ID NO: 434110 - DNA, 15 bp, Homo sapiens
ctgttactacaacta

SEQ ID NO: 434111 - DNA, 15 bp, Homo sapiens
tgttactacaactac

SEQ ID NO: 434112 - DNA, 15 bp, Homo sapiens
gttactacaactact

SEQ ID NO: 434113 - DNA, 15 bp, Homo sapiens
ttactacaactacta

SEQ ID NO: 434114 - DNA, 15 bp, Homo sapiens
tactacaactactat

SEQ ID NO: 434115 - DNA, 15 bp, Homo sapiens
actacaactactatt

SEQ ID NO: 434116 - DNA, 15 bp, Homo sapiens
ctacaactactattt

SEQ ID NO: 434117 - DNA, 15 bp, Homo sapiens
tacaactactatttt

SEQ ID NO: 434118 - DNA, 15 bp, Homo sapiens
acaactactatttta

SEQ ID NO: 434119 - DNA, 15 bp, Homo sapiens
caactactattttat

SEQ ID NO: 434120 - DNA, 15 bp, Homo sapiens
aactactattttatt

SEQ ID NO: 434121 - DNA, 15 bp, Homo sapiens
actactattttattt

SEQ ID NO: 434122 - DNA, 15 bp, Homo sapiens
ctactattttattta

SEQ ID NO: 434123 - DNA, 15 bp, Homo sapiens
tactattttatttaa

SEQ ID NO: 434124 - DNA, 15 bp, Homo sapiens
actattttatttaag

SEQ ID NO: 434125 - DNA, 15 bp, Homo sapiens
ctattttatttaagc

SEQ ID NO: 434126 - DNA, 15 bp, Homo sapiens
tattttatttaagct

SEQ ID NO: 434127 - DNA, 15 bp, Homo sapiens
attttatttaagctg

SEQ ID NO: 434128 - DNA, 15 bp, Homo sapiens
ttttatttaagctgc

SEQ ID NO: 434129 - DNA, 15 bp, Homo sapiens
tttatttaagctgcc

SEQ ID NO: 434130 - DNA, 15 bp, Homo sapiens
ttatttaagctgcct

SEQ ID NO: 434131 - DNA, 15 bp, Homo sapiens
tatttaagctgcctg

SEQ ID NO: 434132 - DNA, 15 bp, Homo sapiens
atttaagctgcctga

SEQ ID NO: 434133 - DNA, 15 bp, Homo sapiens
tttaagctgcctgaa

SEQ ID NO: 434134 - DNA, 15 bp, Homo sapiens
ttaagctgcctgaat

SEQ ID NO: 434135 - DNA, 15 bp, Homo sapiens
taagctgcctgaata

SEQ ID NO: 434136 - DNA, 15 bp, Homo sapiens
aagctgcctgaatat

SEQ ID NO: 434137 - DNA, 15 bp, Homo sapiens
agctgcctgaatatc

SEQ ID NO: 434138 - DNA, 15 bp, Homo sapiens
gctgcctgaatatca

SEQ ID NO: 434139 - DNA, 15 bp, Homo sapiens
ctgcctgaatatcat

SEQ ID NO: 434140 - DNA, 15 bp, Homo sapiens
tgcctgaatatcatt

SEQ ID NO: 434141 - DNA, 15 bp, Homo sapiens
gcctgaatatcattt

SEQ ID NO: 434142 - DNA, 15 bp, Homo sapiens
cctgaatatcatttc

SEQ ID NO: 434143 - DNA, 15 bp, Homo sapiens
ctgaatatcatttct

SEQ ID NO: 434144 - DNA, 15 bp, Homo sapiens
tgaatatcatttctg

SEQ ID NO: 434145 - DNA, 15 bp, Homo sapiens
gaatatcatttctgt

SEQ ID NO: 434146 - DNA, 15 bp, Homo sapiens
aatatcatttctgtt

SEQ ID NO: 434147 - DNA, 15 bp, Homo sapiens
atatcatttctgttt

SEQ ID NO: 434148 - DNA, 15 bp, Homo sapiens
tatcatttctgtttc

SEQ ID NO: 434149 - DNA, 15 bp, Homo sapiens
atcatttctgtttca

SEQ ID NO: 434150 - DNA, 15 bp, Homo sapiens
tcatttctgtttcag

SEQ ID NO: 434151 - DNA, 15 bp, Homo sapiens
catttctgtttcagc

SEQ ID NO: 434152 - DNA, 15 bp, Homo sapiens
atttctgtttcagcc

SEQ ID NO: 434153 - DNA, 15 bp, Homo sapiens
tttctgtttcagcct

SEQ ID NO: 434154 - DNA, 15 bp, Homo sapiens
ttctgtttcagcctg

SEQ ID NO: 434155 - DNA, 15 bp, Homo sapiens
tctgtttcagcctgg

SEQ ID NO: 434156 - DNA, 15 bp, Homo sapiens
ctgtttcagcctgga

SEQ ID NO: 434157 - DNA, 15 bp, Homo sapiens
tgtttcagcctggag

SEQ ID NO: 434158 - DNA, 15 bp, Homo sapiens
gtttcagcctggagc

SEQ ID NO: 434159 - DNA, 15 bp, Homo sapiens
tttcagcctggagca

SEQ ID NO: 434160 - DNA, 15 bp, Homo sapiens
ttcagcctggagcag

SEQ ID NO: 434161 - DNA, 15 bp, Homo sapiens
tcagcctggagcagt

SEQ ID NO: 434162 - DNA, 15 bp, Homo sapiens
cagcctggagcagtc

SEQ ID NO: 434163 - DNA, 15 bp, Homo sapiens
agcctggagcagtca

SEQ ID NO: 434164 - DNA, 15 bp, Homo sapiens
gcctggagcagtcaa

SEQ ID NO: 434165 - DNA, 15 bp, Homo sapiens
cctggagcagtcaat

SEQ ID NO: 434166 - DNA, 15 bp, Homo sapiens
ctggagcagtcaatt

SEQ ID NO: 434167 - DNA, 15 bp, Homo sapiens
tggagcagtcaattt

SEQ ID NO: 434168 - DNA, 15 bp, Homo sapiens
ggagcagtcaatttt

SEQ ID NO: 434169 - DNA, 15 bp, Homo sapiens
gagcagtcaattttg

SEQ ID NO: 434170 - DNA, 15 bp, Homo sapiens
agcagtcaattttgc

SEQ ID NO: 434171 - DNA, 15 bp, Homo sapiens
gcagtcaattttgct

SEQ ID NO: 434172 - DNA, 15 bp, Homo sapiens
cagtcaattttgctt

SEQ ID NO: 434173 - DNA, 15 bp, Homo sapiens
agtcaattttgctta

SEQ ID NO: 434174 - DNA, 15 bp, Homo sapiens
gtcaattttgcttaa

SEQ ID NO: 434175 - DNA, 15 bp, Homo sapiens
tcaattttgcttaat

SEQ ID NO: 434176 - DNA, 15 bp, Homo sapiens
caattttgcttaatt

SEQ ID NO: 434177 - DNA, 15 bp, Homo sapiens
aattttgcttaattt

SEQ ID NO: 434178 - DNA, 15 bp, Homo sapiens
attttgcttaattta

SEQ ID NO: 434179 - DNA, 15 bp, Homo sapiens
ttttgcttaatttaa

SEQ ID NO: 434180 - DNA, 15 bp, Homo sapiens
tttgcttaatttaaa

SEQ ID NO: 434181 - DNA, 15 bp, Homo sapiens
ttgcttaatttaaat

SEQ ID NO: 434182 - DNA, 15 bp, Homo sapiens
tgcttaatttaaata

SEQ ID NO: 434183 - DNA, 15 bp, Homo sapiens
gcttaatttaaatat

SEQ ID NO: 434184 - DNA, 15 bp, Homo sapiens
cttaatttaaatatt

SEQ ID NO: 434185 - DNA, 15 bp, Homo sapiens
ttaatttaaatattt

SEQ ID NO: 434186 - DNA, 15 bp, Homo sapiens
taatttaaatatttt

SEQ ID NO: 434187 - DNA, 15 bp, Homo sapiens
aatttaaatatttta

SEQ ID NO: 434188 - DNA, 15 bp, Homo sapiens
tttaaatattttatt

SEQ ID NO: 434189 - DNA, 15 bp, Homo sapiens
ttaaatattttatta

SEQ ID NO: 434190 - DNA, 15 bp, Homo sapiens
taaatattttattaa

SEQ ID NO: 434191 - DNA, 15 bp, Homo sapiens
aaatattttattaat

SEQ ID NO: 434192 - DNA, 15 bp, Homo sapiens
aatattttattaata

SEQ ID NO: 434193 - DNA, 15 bp, Homo sapiens
atattttattaataa

SEQ ID NO: 434194 - DNA, 15 bp, Homo sapiens
tattttattaataat

SEQ ID NO: 434195 - DNA, 15 bp, Homo sapiens
attttattaataatc

SEQ ID NO: 434196 - DNA, 15 bp, Homo sapiens
ttttattaataatca

SEQ ID NO: 434197 - DNA, 15 bp, Homo sapiens
tttattaataatcat

SEQ ID NO: 434198 - DNA, 15 bp, Homo sapiens
ttattaataatcata

SEQ ID NO: 434199 - DNA, 15 bp, Homo sapiens
tattaataatcatag

SEQ ID NO: 434200 - DNA, 15 bp, Homo sapiens
attaataatcataga

SEQ ID NO: 434201 - DNA, 15 bp, Homo sapiens
ttaataatcatagaa

SEQ ID NO: 434202 - DNA, 15 bp, Homo sapiens
taataatcatagaaa

SEQ ID NO: 434203 - DNA, 15 bp, Homo sapiens
aataatcatagaaaa

SEQ ID NO: 434204 - DNA, 15 bp, Homo sapiens
ataatcatagaaaaa

SEQ ID NO: 434205 - DNA, 15 bp, Homo sapiens
taatcatagaaaaac

SEQ ID NO: 434206 - DNA, 15 bp, Homo sapiens
aatcatagaaaaacc

SEQ ID NO: 434207 - DNA, 15 bp, Homo sapiens
atcatagaaaaaccc

SEQ ID NO: 434208 - DNA, 15 bp, Homo sapiens
tcatagaaaaaccca

SEQ ID NO: 434209 - DNA, 15 bp, Homo sapiens
catagaaaaacccag

SEQ ID NO: 434210 - DNA, 15 bp, Homo sapiens
atagaaaaacccagc

SEQ ID NO: 434211 - DNA, 15 bp, Homo sapiens
tagaaaaacccagct

SEQ ID NO: 434212 - DNA, 15 bp, Homo sapiens
agaaaaacccagcta

SEQ ID NO: 434213 - DNA, 15 bp, Homo sapiens
gaaaaacccagctat

SEQ ID NO: 434214 - DNA, 15 bp, Homo sapiens
aaaaacccagctatt

SEQ ID NO: 434215 - DNA, 15 bp, Homo sapiens
aaaacccagctatta

SEQ ID NO: 434216 - DNA, 15 bp, Homo sapiens
aaacccagctattac

SEQ ID NO: 434217 - DNA, 15 bp, Homo sapiens
aacccagctattact

SEQ ID NO: 434218 - DNA, 15 bp, Homo sapiens
acccagctattactt

SEQ ID NO: 434219 - DNA, 15 bp, Homo sapiens
cccagctattactta

SEQ ID NO: 434220 - DNA, 15 bp, Homo sapiens
ccagctattacttaa

SEQ ID NO: 434221 - DNA, 15 bp, Homo sapiens
cagctattacttaat

SEQ ID NO: 434222 - DNA, 15 bp, Homo sapiens
agctattacttaatt

SEQ ID NO: 434223 - DNA, 15 bp, Homo sapiens
gctattacttaattt

SEQ ID NO: 434224 - DNA, 15 bp, Homo sapiens
ctattacttaattta

SEQ ID NO: 434225 - DNA, 15 bp, Homo sapiens
tattacttaatttag

SEQ ID NO: 434226 - DNA, 15 bp, Homo sapiens
attacttaatttagt

SEQ ID NO: 434227 - DNA, 15 bp, Homo sapiens
ttacttaatttagtc

SEQ ID NO: 434228 - DNA, 15 bp, Homo sapiens
tacttaatttagtct

SEQ ID NO: 434229 - DNA, 15 bp, Homo sapiens
acttaatttagtcta

SEQ ID NO: 434230 - DNA, 15 bp, Homo sapiens
cttaatttagtctat

SEQ ID NO: 434231 - DNA, 15 bp, Homo sapiens
ttaatttagtctatt

SEQ ID NO: 434232 - DNA, 15 bp, Homo sapiens
taatttagtctattt

SEQ ID NO: 434233 - DNA, 15 bp, Homo sapiens
aatttagtctatttg

SEQ ID NO: 434234 - DNA, 15 bp, Homo sapiens
atttagtctatttgt

SEQ ID NO: 434235 - DNA, 15 bp, Homo sapiens
tttagtctatttgtg

SEQ ID NO: 434236 - DNA, 15 bp, Homo sapiens
ttagtctatttgtgc

SEQ ID NO: 434237 - DNA, 15 bp, Homo sapiens
tagtctatttgtgca

SEQ ID NO: 434238 - DNA, 15 bp, Homo sapiens
agtctatttgtgcat

SEQ ID NO: 434239 - DNA, 15 bp, Homo sapiens
gtctatttgtgcatg

SEQ ID NO: 434240 - DNA, 15 bp, Homo sapiens
tctatttgtgcatgt

SEQ ID NO: 434241 - DNA, 15 bp, Homo sapiens
ctatttgtgcatgta

SEQ ID NO: 434242 - DNA, 15 bp, Homo sapiens
tatttgtgcatgtat

SEQ ID NO: 434243 - DNA, 15 bp, Homo sapiens
atttgtgcatgtata

SEQ ID NO: 434244 - DNA, 15 bp, Homo sapiens
tttgtgcatgtatag

SEQ ID NO: 434245 - DNA, 15 bp, Homo sapiens
ttgtgcatgtatagt

SEQ ID NO: 434246 - DNA, 15 bp, Homo sapiens
tgtgcatgtatagtt

SEQ ID NO: 434247 - DNA, 15 bp, Homo sapiens
gtgcatgtatagttg

SEQ ID NO: 434248 - DNA, 15 bp, Homo sapiens
tgcatgtatagttga

SEQ ID NO: 434249 - DNA, 15 bp, Homo sapiens
gcatgtatagttgag

SEQ ID NO: 434250 - DNA, 15 bp, Homo sapiens
catgtatagttgagt

SEQ ID NO: 434251 - DNA, 15 bp, Homo sapiens
atgtatagttgagta

SEQ ID NO: 434252 - DNA, 15 bp, Homo sapiens
tgtatagttgagtat

SEQ ID NO: 434253 - DNA, 15 bp, Homo sapiens
gtatagttgagtata

SEQ ID NO: 434254 - DNA, 15 bp, Homo sapiens
tatagttgagtatag

SEQ ID NO: 434255 - DNA, 15 bp, Homo sapiens
atagttgagtatagt

SEQ ID NO: 434256 - DNA, 15 bp, Homo sapiens
tagttgagtatagtg

SEQ ID NO: 434257 - DNA, 15 bp, Homo sapiens
agttgagtatagtgg

SEQ ID NO: 434258 - DNA, 15 bp, Homo sapiens
gttgagtatagtggg

SEQ ID NO: 434259 - DNA, 15 bp, Homo sapiens
ttgagtatagtgggt

SEQ ID NO: 434260 - DNA, 15 bp, Homo sapiens
tgagtatagtgggta

SEQ ID NO: 434261 - DNA, 15 bp, Homo sapiens
gagtatagtgggtat

SEQ ID NO: 434262 - DNA, 15 bp, Homo sapiens
agtatagtgggtata

SEQ ID NO: 434263 - DNA, 15 bp, Homo sapiens
gtatagtgggtatag

SEQ ID NO: 434264 - DNA, 15 bp, Homo sapiens
tatagtgggtatagt

SEQ ID NO: 434265 - DNA, 15 bp, Homo sapiens
atagtgggtatagtt

SEQ ID NO: 434266 - DNA, 15 bp, Homo sapiens
tagtgggtatagttg

SEQ ID NO: 434267 - DNA, 15 bp, Homo sapiens
agtgggtatagttgt

SEQ ID NO: 434268 - DNA, 15 bp, Homo sapiens
gtgggtatagttgtg

SEQ ID NO: 434269 - DNA, 15 bp, Homo sapiens
tgggtatagttgtgt

SEQ ID NO: 434270 - DNA, 15 bp, Homo sapiens
gggtatagttgtgta

SEQ ID NO: 434271 - DNA, 15 bp, Homo sapiens
ggtatagttgtgtat

SEQ ID NO: 434272 - DNA, 15 bp, Homo sapiens
gtatagttgtgtatg

SEQ ID NO: 434273 - DNA, 15 bp, Homo sapiens
tatagttgtgtatgt

SEQ ID NO: 434274 - DNA, 15 bp, Homo sapiens
atagttgtgtatgtg

SEQ ID NO: 434275 - DNA, 15 bp, Homo sapiens
tagttgtgtatgtgt

SEQ ID NO: 434276 - DNA, 15 bp, Homo sapiens
agttgtgtatgtgtg

SEQ ID NO: 434277 - DNA, 15 bp, Homo sapiens
gttgtgtatgtgtgt

SEQ ID NO: 434278 - DNA, 15 bp, Homo sapiens
ttgtgtatgtgtgta

SEQ ID NO: 434279 - DNA, 15 bp, Homo sapiens
tgtgtatgtgtgtat

SEQ ID NO: 434280 - DNA, 15 bp, Homo sapiens
gtgtatgtgtgtatg

SEQ ID NO: 434281 - DNA, 15 bp, Homo sapiens
tgtatgtgtgtatgt

SEQ ID NO: 434282 - DNA, 15 bp, Homo sapiens
gtatgtgtgtatgtg

SEQ ID NO: 434283 - DNA, 15 bp, Homo sapiens
tatgtgtgtatgtgc

SEQ ID NO: 434284 - DNA, 15 bp, Homo sapiens
atgtgtgtatgtgca

SEQ ID NO: 434285 - DNA, 15 bp, Homo sapiens
tgtgtgtatgtgcat

SEQ ID NO: 434286 - DNA, 15 bp, Homo sapiens
gtgtgtatgtgcata

SEQ ID NO: 434287 - DNA, 15 bp, Homo sapiens
tgtgtatgtgcatat

SEQ ID NO: 434288 - DNA, 15 bp, Homo sapiens
gtgtatgtgcatata

SEQ ID NO: 434289 - DNA, 15 bp, Homo sapiens
tgtatgtgcatatac

SEQ ID NO: 434290 - DNA, 15 bp, Homo sapiens
gtatgtgcatataca

SEQ ID NO: 434291 - DNA, 15 bp, Homo sapiens
tatgtgcatatacaa

SEQ ID NO: 434292 - DNA, 15 bp, Homo sapiens
atgtgcatatacaac

SEQ ID NO: 434293 - DNA, 15 bp, Homo sapiens
tgtgcatatacaact

SEQ ID NO: 434294 - DNA, 15 bp, Homo sapiens
gtgcatatacaactt

SEQ ID NO: 434295 - DNA, 15 bp, Homo sapiens
tgcatatacaacttt

SEQ ID NO: 434296 - DNA, 15 bp, Homo sapiens
gcatatacaacttta

SEQ ID NO: 434297 - DNA, 15 bp, Homo sapiens
catatacaactttat

SEQ ID NO: 434298 - DNA, 15 bp, Homo sapiens
atatacaactttata

SEQ ID NO: 434299 - DNA, 15 bp, Homo sapiens
tatacaactttatat

SEQ ID NO: 434300 - DNA, 15 bp, Homo sapiens
atacaactttatata

SEQ ID NO: 434301 - DNA, 15 bp, Homo sapiens
tacaactttatatag

SEQ ID NO: 434302 - DNA, 15 bp, Homo sapiens
acaactttatatagt

SEQ ID NO: 434303 - DNA, 15 bp, Homo sapiens
caactttatatagtt

SEQ ID NO: 434304 - DNA, 15 bp, Homo sapiens
aactttatatagttg

SEQ ID NO: 434305 - DNA, 15 bp, Homo sapiens
actttatatagttgt

SEQ ID NO: 434306 - DNA, 15 bp, Homo sapiens
ctttatatagttgtg

SEQ ID NO: 434307 - DNA, 15 bp, Homo sapiens
tttatatagttgtgt

SEQ ID NO: 434308 - DNA, 15 bp, Homo sapiens
ttatatagttgtgta

SEQ ID NO: 434309 - DNA, 15 bp, Homo sapiens
tatatagttgtgtat

SEQ ID NO: 434310 - DNA, 15 bp, Homo sapiens
atatagttgtgtatg

SEQ ID NO: 434311 - DNA, 15 bp, Homo sapiens
tatagttgtgtatga

SEQ ID NO: 434312 - DNA, 15 bp, Homo sapiens
atagttgtgtatgaa

SEQ ID NO: 434313 - DNA, 15 bp, Homo sapiens
tagttgtgtatgaat

SEQ ID NO: 434314 - DNA, 15 bp, Homo sapiens
agttgtgtatgaatg

SEQ ID NO: 434315 - DNA, 15 bp, Homo sapiens
gttgtgtatgaatgt

SEQ ID NO: 434316 - DNA, 15 bp, Homo sapiens
ttgtgtatgaatgta

SEQ ID NO: 434317 - DNA, 15 bp, Homo sapiens
tgtgtatgaatgtat

SEQ ID NO: 434318 - DNA, 15 bp, Homo sapiens
gtgtatgaatgtata

SEQ ID NO: 434319 - DNA, 15 bp, Homo sapiens
tgtatgaatgtatat

SEQ ID NO: 434320 - DNA, 15 bp, Homo sapiens
gtatgaatgtatatg

SEQ ID NO: 434321 - DNA, 15 bp, Homo sapiens
tatgaatgtatatgt

SEQ ID NO: 434322 - DNA, 15 bp, Homo sapiens
atgaatgtatatgtg

SEQ ID NO: 434323 - DNA, 15 bp, Homo sapiens
tgaatgtatatgtga

SEQ ID NO: 434324 - DNA, 15 bp, Homo sapiens
gaatgtatatgtgat

SEQ ID NO: 434325 - DNA, 15 bp, Homo sapiens
aatgtatatgtgatg

SEQ ID NO: 434326 - DNA, 15 bp, Homo sapiens
atgtatatgtgatga

SEQ ID NO: 434327 - DNA, 15 bp, Homo sapiens
tgtatatgtgatgaa

SEQ ID NO: 434328 - DNA, 15 bp, Homo sapiens
gtatatgtgatgaat

SEQ ID NO: 434329 - DNA, 15 bp, Homo sapiens
tatatgtgatgaata

SEQ ID NO: 434330 - DNA, 15 bp, Homo sapiens
atatgtgatgaatag

SEQ ID NO: 434331 - DNA, 15 bp, Homo sapiens
tatgtgatgaatagt

SEQ ID NO: 434332 - DNA, 15 bp, Homo sapiens
atgtgatgaatagtt

SEQ ID NO: 434333 - DNA, 15 bp, Homo sapiens
tgtgatgaatagtta

SEQ ID NO: 434334 - DNA, 15 bp, Homo sapiens
gtgatgaatagttaa

SEQ ID NO: 434335 - DNA, 15 bp, Homo sapiens
tgatgaatagttaat

SEQ ID NO: 434336 - DNA, 15 bp, Homo sapiens
gatgaatagttaata

SEQ ID NO: 434337 - DNA, 15 bp, Homo sapiens
atgaatagttaataa

SEQ ID NO: 434338 - DNA, 15 bp, Homo sapiens
tgaatagttaataat

SEQ ID NO: 434339 - DNA, 15 bp, Homo sapiens
gaatagttaataata

SEQ ID NO: 434340 - DNA, 15 bp, Homo sapiens
aatagttaataataa

SEQ ID NO: 434341 - DNA, 15 bp, Homo sapiens
atagttaataataat

SEQ ID NO: 434342 - DNA, 15 bp, Homo sapiens
tagttaataataatt

SEQ ID NO: 434343 - DNA, 15 bp, Homo sapiens
agttaataataattt

SEQ ID NO: 434344 - DNA, 15 bp, Homo sapiens
gttaataataatttt

SEQ ID NO: 434345 - DNA, 15 bp, Homo sapiens
ttaataataattttt

SEQ ID NO: 434346 - DNA, 15 bp, Homo sapiens
taataataatttttc

SEQ ID NO: 434347 - DNA, 15 bp, Homo sapiens
aataataatttttca

SEQ ID NO: 434348 - DNA, 15 bp, Homo sapiens
ataataatttttcag

SEQ ID NO: 434349 - DNA, 15 bp, Homo sapiens
taataatttttcaga

SEQ ID NO: 434350 - DNA, 15 bp, Homo sapiens
aataatttttcagat

SEQ ID NO: 434351 - DNA, 15 bp, Homo sapiens
ataatttttcagatg

SEQ ID NO: 434352 - DNA, 15 bp, Homo sapiens
taatttttcagatga

SEQ ID NO: 434353 - DNA, 15 bp, Homo sapiens
aatttttcagatgaa

SEQ ID NO: 434354 - DNA, 15 bp, Homo sapiens
atttttcagatgaaa

SEQ ID NO: 434355 - DNA, 15 bp, Homo sapiens
tttttcagatgaaaa

SEQ ID NO: 434356 - DNA, 15 bp, Homo sapiens
ttttcagatgaaaaa

SEQ ID NO: 434357 - DNA, 15 bp, Homo sapiens
tttcagatgaaaaag

SEQ ID NO: 434358 - DNA, 15 bp, Homo sapiens
ttcagatgaaaaagt

SEQ ID NO: 434359 - DNA, 15 bp, Homo sapiens
tcagatgaaaaagta

SEQ ID NO: 434360 - DNA, 15 bp, Homo sapiens
cagatgaaaaagtat

SEQ ID NO: 434361 - DNA, 15 bp, Homo sapiens
agatgaaaaagtatg

SEQ ID NO: 434362 - DNA, 15 bp, Homo sapiens
gatgaaaaagtatgt

SEQ ID NO: 434363 - DNA, 15 bp, Homo sapiens
atgaaaaagtatgta

SEQ ID NO: 434364 - DNA, 15 bp, Homo sapiens
tgaaaaagtatgtat

SEQ ID NO: 434365 - DNA, 15 bp, Homo sapiens
gaaaaagtatgtatg

SEQ ID NO: 434366 - DNA, 15 bp, Homo sapiens
aaaaagtatgtatgg

SEQ ID NO: 434367 - DNA, 15 bp, Homo sapiens
aaaagtatgtatggg

SEQ ID NO: 434368 - DNA, 15 bp, Homo sapiens
aaagtatgtatgggt

SEQ ID NO: 434369 - DNA, 15 bp, Homo sapiens
aagtatgtatgggtt

SEQ ID NO: 434370 - DNA, 15 bp, Homo sapiens
agtatgtatgggtta

SEQ ID NO: 434371 - DNA, 15 bp, Homo sapiens
gtatgtatgggttaa

SEQ ID NO: 434372 - DNA, 15 bp, Homo sapiens
tatgtatgggttaat

SEQ ID NO: 434373 - DNA, 15 bp, Homo sapiens
atgtatgggttaatg

SEQ ID NO: 434374 - DNA, 15 bp, Homo sapiens
tgtatgggttaatgt

SEQ ID NO: 434375 - DNA, 15 bp, Homo sapiens
gtatgggttaatgtt

SEQ ID NO: 434376 - DNA, 15 bp, Homo sapiens
tatgggttaatgttt

SEQ ID NO: 434377 - DNA, 15 bp, Homo sapiens
atgggttaatgtttt

SEQ ID NO: 434378 - DNA, 15 bp, Homo sapiens
tgggttaatgttttc

SEQ ID NO: 434379 - DNA, 15 bp, Homo sapiens
gggttaatgttttcc

SEQ ID NO: 434380 - DNA, 15 bp, Homo sapiens
ggttaatgttttcct

SEQ ID NO: 434381 - DNA, 15 bp, Homo sapiens
gttaatgttttcctc

SEQ ID NO: 434382 - DNA, 15 bp, Homo sapiens
ttaatgttttcctct

SEQ ID NO: 434383 - DNA, 15 bp, Homo sapiens
taatgttttcctctt

SEQ ID NO: 434384 - DNA, 15 bp, Homo sapiens
aatgttttcctcttt

SEQ ID NO: 434385 - DNA, 15 bp, Homo sapiens
atgttttcctctttg

SEQ ID NO: 434386 - DNA, 15 bp, Homo sapiens
tgttttcctctttgg

SEQ ID NO: 434387 - DNA, 15 bp, Homo sapiens
gttttcctctttggt

SEQ ID NO: 434388 - DNA, 15 bp, Homo sapiens
ttttcctctttggtc

SEQ ID NO: 434389 - DNA, 15 bp, Homo sapiens
tttcctctttggtcc

SEQ ID NO: 434390 - DNA, 15 bp, Homo sapiens
ttcctctttggtcct

SEQ ID NO: 434391 - DNA, 15 bp, Homo sapiens
tcctctttggtcctt

SEQ ID NO: 434392 - DNA, 15 bp, Homo sapiens
cctctttggtccttt

SEQ ID NO: 434393 - DNA, 15 bp, Homo sapiens
ctctttggtcctttg

SEQ ID NO: 434394 - DNA, 15 bp, Homo sapiens
tctttggtcctttga

SEQ ID NO: 434395 - DNA, 15 bp, Homo sapiens
ctttggtcctttgac

SEQ ID NO: 434396 - DNA, 15 bp, Homo sapiens
tttggtcctttgaca

SEQ ID NO: 434397 - DNA, 15 bp, Homo sapiens
ttggtcctttgacag

SEQ ID NO: 434398 - DNA, 15 bp, Homo sapiens
tggtcctttgacaga

SEQ ID NO: 434399 - DNA, 15 bp, Homo sapiens
ggtcctttgacagat

SEQ ID NO: 434400 - DNA, 15 bp, Homo sapiens
gtcctttgacagatg

SEQ ID NO: 434401 - DNA, 15 bp, Homo sapiens
tcctttgacagatgg

SEQ ID NO: 434402 - DNA, 15 bp, Homo sapiens
cctttgacagatggc

SEQ ID NO: 434403 - DNA, 15 bp, Homo sapiens
ctttgacagatggct

SEQ ID NO: 434404 - DNA, 15 bp, Homo sapiens
tttgacagatggcta

SEQ ID NO: 434405 - DNA, 15 bp, Homo sapiens
ttgacagatggctat

SEQ ID NO: 434406 - DNA, 15 bp, Homo sapiens
tgacagatggctatg

SEQ ID NO: 434407 - DNA, 15 bp, Homo sapiens
gacagatggctatgt

SEQ ID NO: 434408 - DNA, 15 bp, Homo sapiens
acagatggctatgta

SEQ ID NO: 434409 - DNA, 15 bp, Homo sapiens
cagatggctatgtat

SEQ ID NO: 434410 - DNA, 15 bp, Homo sapiens
agatggctatgtata

SEQ ID NO: 434411 - DNA, 15 bp, Homo sapiens
gatggctatgtatat

SEQ ID NO: 434412 - DNA, 15 bp, Homo sapiens
atggctatgtatatt

SEQ ID NO: 434413 - DNA, 15 bp, Homo sapiens
tggctatgtatattt

SEQ ID NO: 434414 - DNA, 15 bp, Homo sapiens
ggctatgtatattta

SEQ ID NO: 434415 - DNA, 15 bp, Homo sapiens
gctatgtatatttag

SEQ ID NO: 434416 - DNA, 15 bp, Homo sapiens
ctatgtatatttagt

SEQ ID NO: 434417 - DNA, 15 bp, Homo sapiens
tatgtatatttagta

SEQ ID NO: 434418 - DNA, 15 bp, Homo sapiens
atgtatatttagtac

SEQ ID NO: 434419 - DNA, 15 bp, Homo sapiens
tgtatatttagtaca

SEQ ID NO: 434420 - DNA, 15 bp, Homo sapiens
gtatatttagtacat

SEQ ID NO: 434421 - DNA, 15 bp, Homo sapiens
tatatttagtacata

SEQ ID NO: 434422 - DNA, 15 bp, Homo sapiens
atatttagtacataa

SEQ ID NO: 434423 - DNA, 15 bp, Homo sapiens
tatttagtacataat

SEQ ID NO: 434424 - DNA, 15 bp, Homo sapiens
atttagtacataata

SEQ ID NO: 434425 - DNA, 15 bp, Homo sapiens
tttagtacataatat

SEQ ID NO: 434426 - DNA, 15 bp, Homo sapiens
ttagtacataatatg

SEQ ID NO: 434427 - DNA, 15 bp, Homo sapiens
tagtacataatatgg

SEQ ID NO: 434428 - DNA, 15 bp, Homo sapiens
agtacataatatggt

SEQ ID NO: 434429 - DNA, 15 bp, Homo sapiens
gtacataatatggta

SEQ ID NO: 434430 - DNA, 15 bp, Homo sapiens
tacataatatggtat

SEQ ID NO: 434431 - DNA, 15 bp, Homo sapiens
acataatatggtatg

SEQ ID NO: 434432 - DNA, 15 bp, Homo sapiens
cataatatggtatgt

SEQ ID NO: 434433 - DNA, 15 bp, Homo sapiens
ataatatggtatgta

SEQ ID NO: 434434 - DNA, 15 bp, Homo sapiens
taatatggtatgtaa

SEQ ID NO: 434435 - DNA, 15 bp, Homo sapiens
aatatggtatgtaat

SEQ ID NO: 434436 - DNA, 15 bp, Homo sapiens
atatggtatgtaata

SEQ ID NO: 434437 - DNA, 15 bp, Homo sapiens
tatggtatgtaatat

SEQ ID NO: 434438 - DNA, 15 bp, Homo sapiens
atggtatgtaatatt

SEQ ID NO: 434439 - DNA, 15 bp, Homo sapiens
tggtatgtaatattt

SEQ ID NO: 434440 - DNA, 15 bp, Homo sapiens
ggtatgtaatattta

SEQ ID NO: 434441 - DNA, 15 bp, Homo sapiens
gtatgtaatatttaa

SEQ ID NO: 434442 - DNA, 15 bp, Homo sapiens
tatgtaatatttaac

SEQ ID NO: 434443 - DNA, 15 bp, Homo sapiens
atgtaatatttaact

SEQ ID NO: 434444 - DNA, 15 bp, Homo sapiens
tgtaatatttaactc

SEQ ID NO: 434445 - DNA, 15 bp, Homo sapiens
gtaatatttaactca

SEQ ID NO: 434446 - DNA, 15 bp, Homo sapiens
taatatttaactcag

SEQ ID NO: 434447 - DNA, 15 bp, Homo sapiens
aatatttaactcagg

SEQ ID NO: 434448 - DNA, 15 bp, Homo sapiens
atatttaactcaggg

SEQ ID NO: 434449 - DNA, 15 bp, Homo sapiens
tatttaactcagggt

SEQ ID NO: 434450 - DNA, 15 bp, Homo sapiens
atttaactcagggta

SEQ ID NO: 434451 - DNA, 15 bp, Homo sapiens
tttaactcagggtat

SEQ ID NO: 434452 - DNA, 15 bp, Homo sapiens
ttaactcagggtata

SEQ ID NO: 434453 - DNA, 15 bp, Homo sapiens
taactcagggtatac

SEQ ID NO: 434454 - DNA, 15 bp, Homo sapiens
aactcagggtatact

SEQ ID NO: 434455 - DNA, 15 bp, Homo sapiens
actcagggtatactg

SEQ ID NO: 434456 - DNA, 15 bp, Homo sapiens
ctcagggtatactgt

SEQ ID NO: 434457 - DNA, 15 bp, Homo sapiens
tcagggtatactgtt

SEQ ID NO: 434458 - DNA, 15 bp, Homo sapiens
cagggtatactgttt

SEQ ID NO: 434459 - DNA, 15 bp, Homo sapiens
agggtatactgttta

SEQ ID NO: 434460 - DNA, 15 bp, Homo sapiens
gggtatactgtttaa

SEQ ID NO: 434461 - DNA, 15 bp, Homo sapiens
ggtatactgtttaat

SEQ ID NO: 434462 - DNA, 15 bp, Homo sapiens
gtatactgtttaatt

SEQ ID NO: 434463 - DNA, 15 bp, Homo sapiens
tatactgtttaattt

SEQ ID NO: 434464 - DNA, 15 bp, Homo sapiens
atactgtttaatttt

SEQ ID NO: 434465 - DNA, 15 bp, Homo sapiens
tactgtttaattttt

SEQ ID NO: 434466 - DNA, 15 bp, Homo sapiens
actgtttaattttta

SEQ ID NO: 434467 - DNA, 15 bp, Homo sapiens
ctgtttaatttttaa

SEQ ID NO: 434468 - DNA, 15 bp, Homo sapiens
tgtttaatttttaaa

SEQ ID NO: 434469 - DNA, 15 bp, Homo sapiens
gtttaatttttaaat

SEQ ID NO: 434470 - DNA, 15 bp, Homo sapiens
tttaatttttaaata

SEQ ID NO: 434471 - DNA, 15 bp, Homo sapiens
ttaatttttaaatat

SEQ ID NO: 434472 - DNA, 15 bp, Homo sapiens
taatttttaaatatt

SEQ ID NO: 434473 - DNA, 15 bp, Homo sapiens
aatttttaaatattt

SEQ ID NO: 434474 - DNA, 15 bp, Homo sapiens
atttttaaatatttc

SEQ ID NO: 434475 - DNA, 15 bp, Homo sapiens
tttttaaatatttcc

SEQ ID NO: 434476 - DNA, 15 bp, Homo sapiens
ttttaaatatttcct

SEQ ID NO: 434477 - DNA, 15 bp, Homo sapiens
tttaaatatttcctg

SEQ ID NO: 434478 - DNA, 15 bp, Homo sapiens
ttaaatatttcctga

SEQ ID NO: 434479 - DNA, 15 bp, Homo sapiens
taaatatttcctgat

SEQ ID NO: 434480 - DNA, 15 bp, Homo sapiens
aaatatttcctgata

SEQ ID NO: 434481 - DNA, 15 bp, Homo sapiens
aatatttcctgatat

SEQ ID NO: 434482 - DNA, 15 bp, Homo sapiens
atatttcctgatatt

SEQ ID NO: 434483 - DNA, 15 bp, Homo sapiens
tatttcctgatattt

SEQ ID NO: 434484 - DNA, 15 bp, Homo sapiens
atttcctgatatttt

SEQ ID NO: 434485 - DNA, 15 bp, Homo sapiens
tttcctgatatttta

SEQ ID NO: 434486 - DNA, 15 bp, Homo sapiens
ttcctgatattttag

SEQ ID NO: 434487 - DNA, 15 bp, Homo sapiens
tcctgatattttaga

SEQ ID NO: 434488 - DNA, 15 bp, Homo sapiens
cctgatattttagaa

SEQ ID NO: 434489 - DNA, 15 bp, Homo sapiens
ctgatattttagaaa

SEQ ID NO: 434490 - DNA, 15 bp, Homo sapiens
tgatattttagaaag

SEQ ID NO: 434491 - DNA, 15 bp, Homo sapiens
gatattttagaaagc

SEQ ID NO: 434492 - DNA, 15 bp, Homo sapiens
atattttagaaagcc

SEQ ID NO: 434493 - DNA, 15 bp, Homo sapiens
tattttagaaagcca

SEQ ID NO: 434494 - DNA, 15 bp, Homo sapiens
attttagaaagccaa

SEQ ID NO: 434495 - DNA, 15 bp, Homo sapiens
ttttagaaagccaag

SEQ ID NO: 434496 - DNA, 15 bp, Homo sapiens
tttagaaagccaagt

SEQ ID NO: 434497 - DNA, 15 bp, Homo sapiens
ttagaaagccaagta

SEQ ID NO: 434498 - DNA, 15 bp, Homo sapiens
tagaaagccaagtat

SEQ ID NO: 434499 - DNA, 15 bp, Homo sapiens
agaaagccaagtatt

SEQ ID NO: 434500 - DNA, 15 bp, Homo sapiens
gaaagccaagtatta

SEQ ID NO: 434501 - DNA, 15 bp, Homo sapiens
aaagccaagtattaa

SEQ ID NO: 434502 - DNA, 15 bp, Homo sapiens
aagccaagtattaag

SEQ ID NO: 434503 - DNA, 15 bp, Homo sapiens
agccaagtattaaga

SEQ ID NO: 434504 - DNA, 15 bp, Homo sapiens
gccaagtattaagac

SEQ ID NO: 434505 - DNA, 15 bp, Homo sapiens
ccaagtattaagact

SEQ ID NO: 434506 - DNA, 15 bp, Homo sapiens
caagtattaagacta

SEQ ID NO: 434507 - DNA, 15 bp, Homo sapiens
aagtattaagactat

SEQ ID NO: 434508 - DNA, 15 bp, Homo sapiens
agtattaagactatt

SEQ ID NO: 434509 - DNA, 15 bp, Homo sapiens
gtattaagactattt

SEQ ID NO: 434510 - DNA, 15 bp, Homo sapiens
tattaagactatttt

SEQ ID NO: 434511 - DNA, 15 bp, Homo sapiens
attaagactattttt

SEQ ID NO: 434512 - DNA, 15 bp, Homo sapiens
ttaagactatttttc

SEQ ID NO: 434513 - DNA, 15 bp, Homo sapiens
taagactatttttct

SEQ ID NO: 434514 - DNA, 15 bp, Homo sapiens
aagactatttttctt

SEQ ID NO: 434515 - DNA, 15 bp, Homo sapiens
agactatttttcttc

SEQ ID NO: 434516 - DNA, 15 bp, Homo sapiens
gactatttttcttcc

SEQ ID NO: 434517 - DNA, 15 bp, Homo sapiens
actatttttcttccc

SEQ ID NO: 434518 - DNA, 15 bp, Homo sapiens
ctatttttcttccct

SEQ ID NO: 434519 - DNA, 15 bp, Homo sapiens
tatttttcttccctg

SEQ ID NO: 434520 - DNA, 15 bp, Homo sapiens
atttttcttccctgt

SEQ ID NO: 434521 - DNA, 15 bp, Homo sapiens
tttttcttccctgta

SEQ ID NO: 434522 - DNA, 15 bp, Homo sapiens
ttttcttccctgtaa

SEQ ID NO: 434523 - DNA, 15 bp, Homo sapiens
ttcttccctgtaaaa

SEQ ID NO: 434524 - DNA, 15 bp, Homo sapiens
tcttccctgtaaaat

SEQ ID NO: 434525 - DNA, 15 bp, Homo sapiens
cttccctgtaaaatc

SEQ ID NO: 434526 - DNA, 15 bp, Homo sapiens
ttccctgtaaaatct

SEQ ID NO: 434527 - DNA, 15 bp, Homo sapiens
tccctgtaaaatctc

SEQ ID NO: 434528 - DNA, 15 bp, Homo sapiens
ccctgtaaaatctca

SEQ ID NO: 434529 - DNA, 15 bp, Homo sapiens
cctgtaaaatctcat

SEQ ID NO: 434530 - DNA, 15 bp, Homo sapiens
ctgtaaaatctcata

SEQ ID NO: 434531 - DNA, 15 bp, Homo sapiens
tgtaaaatctcatat

SEQ ID NO: 434532 - DNA, 15 bp, Homo sapiens
gtaaaatctcatata

SEQ ID NO: 434533 - DNA, 15 bp, Homo sapiens
taaaatctcatatat

SEQ ID NO: 434534 - DNA, 15 bp, Homo sapiens
aaaatctcatatatt

SEQ ID NO: 434535 - DNA, 15 bp, Homo sapiens
aaatctcatatattt

SEQ ID NO: 434536 - DNA, 15 bp, Homo sapiens
aatctcatatatttt

SEQ ID NO: 434537 - DNA, 15 bp, Homo sapiens
atctcatatattttg

SEQ ID NO: 434538 - DNA, 15 bp, Homo sapiens
tctcatatattttgt

SEQ ID NO: 434539 - DNA, 15 bp, Homo sapiens
ctcatatattttgtg

SEQ ID NO: 434540 - DNA, 15 bp, Homo sapiens
tcatatattttgtga

SEQ ID NO: 434541 - DNA, 15 bp, Homo sapiens
catatattttgtgat

SEQ ID NO: 434542 - DNA, 15 bp, Homo sapiens
atatattttgtgata

SEQ ID NO: 434543 - DNA, 15 bp, Homo sapiens
tatattttgtgatac

SEQ ID NO: 434544 - DNA, 15 bp, Homo sapiens
atattttgtgataca

SEQ ID NO: 434545 - DNA, 15 bp, Homo sapiens
tattttgtgatacaa

SEQ ID NO: 434546 - DNA, 15 bp, Homo sapiens
attttgtgatacaac

SEQ ID NO: 434547 - DNA, 15 bp, Homo sapiens
ttttgtgatacaacg

SEQ ID NO: 434548 - DNA, 15 bp, Homo sapiens
tttgtgatacaacga

SEQ ID NO: 434549 - DNA, 15 bp, Homo sapiens
ttgtgatacaacgaa

SEQ ID NO: 434550 - DNA, 15 bp, Homo sapiens
tgtgatacaacgaag

SEQ ID NO: 434551 - DNA, 15 bp, Homo sapiens
gtgatacaacgaaga

SEQ ID NO: 434552 - DNA, 15 bp, Homo sapiens
tgatacaacgaagaa

SEQ ID NO: 434553 - DNA, 15 bp, Homo sapiens
gatacaacgaagaat

SEQ ID NO: 434554 - DNA, 15 bp, Homo sapiens
atacaacgaagaatt

SEQ ID NO: 434555 - DNA, 15 bp, Homo sapiens
tacaacgaagaattt

SEQ ID NO: 434556 - DNA, 15 bp, Homo sapiens
acaacgaagaattta

SEQ ID NO: 434557 - DNA, 15 bp, Homo sapiens
caacgaagaatttat

SEQ ID NO: 434558 - DNA, 15 bp, Homo sapiens
aacgaagaatttata

SEQ ID NO: 434559 - DNA, 15 bp, Homo sapiens
acgaagaatttataa

SEQ ID NO: 434560 - DNA, 15 bp, Homo sapiens
cgaagaatttataag

SEQ ID NO: 434561 - DNA, 15 bp, Homo sapiens
gaagaatttataagt

SEQ ID NO: 434562 - DNA, 15 bp, Homo sapiens
aagaatttataagtg

SEQ ID NO: 434563 - DNA, 15 bp, Homo sapiens
agaatttataagtga

SEQ ID NO: 434564 - DNA, 15 bp, Homo sapiens
gaatttataagtgac

SEQ ID NO: 434565 - DNA, 15 bp, Homo sapiens
aatttataagtgaca

SEQ ID NO: 434566 - DNA, 15 bp, Homo sapiens
atttataagtgacat

SEQ ID NO: 434567 - DNA, 15 bp, Homo sapiens
tttataagtgacata

SEQ ID NO: 434568 - DNA, 15 bp, Homo sapiens
ttataagtgacatat

SEQ ID NO: 434569 - DNA, 15 bp, Homo sapiens
tataagtgacatatt

SEQ ID NO: 434570 - DNA, 15 bp, Homo sapiens
ataagtgacatattc

SEQ ID NO: 434571 - DNA, 15 bp, Homo sapiens
taagtgacatattca

SEQ ID NO: 434572 - DNA, 15 bp, Homo sapiens
aagtgacatattcag

SEQ ID NO: 434573 - DNA, 15 bp, Homo sapiens
agtgacatattcagt

SEQ ID NO: 434574 - DNA, 15 bp, Homo sapiens
gtgacatattcagtc

SEQ ID NO: 434575 - DNA, 15 bp, Homo sapiens
tgacatattcagtcc

SEQ ID NO: 434576 - DNA, 15 bp, Homo sapiens
gacatattcagtcca

SEQ ID NO: 434577 - DNA, 15 bp, Homo sapiens
acatattcagtccac

SEQ ID NO: 434578 - DNA, 15 bp, Homo sapiens
catattcagtccact

SEQ ID NO: 434579 - DNA, 15 bp, Homo sapiens
atattcagtccacta

SEQ ID NO: 434580 - DNA, 15 bp, Homo sapiens
tattcagtccactat

SEQ ID NO: 434581 - DNA, 15 bp, Homo sapiens
attcagtccactatg

SEQ ID NO: 434582 - DNA, 15 bp, Homo sapiens
ttcagtccactatgt

SEQ ID NO: 434583 - DNA, 15 bp, Homo sapiens
tcagtccactatgtc

SEQ ID NO: 434584 - DNA, 15 bp, Homo sapiens
cagtccactatgtca

SEQ ID NO: 434585 - DNA, 15 bp, Homo sapiens
agtccactatgtcag

SEQ ID NO: 434586 - DNA, 15 bp, Homo sapiens
gtccactatgtcagt

SEQ ID NO: 434587 - DNA, 15 bp, Homo sapiens
tccactatgtcagtc

SEQ ID NO: 434588 - DNA, 15 bp, Homo sapiens
ccactatgtcagtcc

SEQ ID NO: 434589 - DNA, 15 bp, Homo sapiens
cactatgtcagtcca

SEQ ID NO: 434590 - DNA, 15 bp, Homo sapiens
actatgtcagtccac

SEQ ID NO: 434591 - DNA, 15 bp, Homo sapiens
ctatgtcagtccact

SEQ ID NO: 434592 - DNA, 15 bp, Homo sapiens
tatgtcagtccactt

SEQ ID NO: 434593 - DNA, 15 bp, Homo sapiens
atgtcagtccacttt

SEQ ID NO: 434594 - DNA, 15 bp, Homo sapiens
tgtcagtccacttta

SEQ ID NO: 434595 - DNA, 15 bp, Homo sapiens
gtcagtccactttat

SEQ ID NO: 434596 - DNA, 15 bp, Homo sapiens
tcagtccactttatg

SEQ ID NO: 434597 - DNA, 15 bp, Homo sapiens
cagtccactttatgc

SEQ ID NO: 434598 - DNA, 15 bp, Homo sapiens
agtccactttatgcc

SEQ ID NO: 434599 - DNA, 15 bp, Homo sapiens
gtccactttatgcca

SEQ ID NO: 434600 - DNA, 15 bp, Homo sapiens
tccactttatgccag

SEQ ID NO: 434601 - DNA, 15 bp, Homo sapiens
ccactttatgccagt

SEQ ID NO: 434602 - DNA, 15 bp, Homo sapiens
cactttatgccagta

SEQ ID NO: 434603 - DNA, 15 bp, Homo sapiens
actttatgccagtat

SEQ ID NO: 434604 - DNA, 15 bp, Homo sapiens
ctttatgccagtatt

SEQ ID NO: 434605 - DNA, 15 bp, Homo sapiens
tttatgccagtatta

SEQ ID NO: 434606 - DNA, 15 bp, Homo sapiens
ttatgccagtattag

SEQ ID NO: 434607 - DNA, 15 bp, Homo sapiens
tatgccagtattagc

SEQ ID NO: 434608 - DNA, 15 bp, Homo sapiens
atgccagtattagca

SEQ ID NO: 434609 - DNA, 15 bp, Homo sapiens
tgccagtattagcaa

SEQ ID NO: 434610 - DNA, 15 bp, Homo sapiens
gccagtattagcaaa

SEQ ID NO: 434611 - DNA, 15 bp, Homo sapiens
ccagtattagcaaac

SEQ ID NO: 434612 - DNA, 15 bp, Homo sapiens
cagtattagcaaact

SEQ ID NO: 434613 - DNA, 15 bp, Homo sapiens
agtattagcaaactt

SEQ ID NO: 434614 - DNA, 15 bp, Homo sapiens
gtattagcaaactta

SEQ ID NO: 434615 - DNA, 15 bp, Homo sapiens
tattagcaaacttat

SEQ ID NO: 434616 - DNA, 15 bp, Homo sapiens
attagcaaacttatg

SEQ ID NO: 434617 - DNA, 15 bp, Homo sapiens
ttagcaaacttatgc

SEQ ID NO: 434618 - DNA, 15 bp, Homo sapiens
tagcaaacttatgca

SEQ ID NO: 434619 - DNA, 15 bp, Homo sapiens
agcaaacttatgcaa

SEQ ID NO: 434620 - DNA, 15 bp, Homo sapiens
gcaaacttatgcaaa

SEQ ID NO: 434621 - DNA, 15 bp, Homo sapiens
caaacttatgcaaat

SEQ ID NO: 434622 - DNA, 15 bp, Homo sapiens
aaacttatgcaaata

SEQ ID NO: 434623 - DNA, 15 bp, Homo sapiens
aacttatgcaaatac

SEQ ID NO: 434624 - DNA, 15 bp, Homo sapiens
acttatgcaaataca

SEQ ID NO: 434625 - DNA, 15 bp, Homo sapiens
cttatgcaaatacaa

SEQ ID NO: 434626 - DNA, 15 bp, Homo sapiens
ttatgcaaatacaat

SEQ ID NO: 434627 - DNA, 15 bp, Homo sapiens
tatgcaaatacaatt

SEQ ID NO: 434628 - DNA, 15 bp, Homo sapiens
atgcaaatacaattt

SEQ ID NO: 434629 - DNA, 15 bp, Homo sapiens
tgcaaatacaatttc

SEQ ID NO: 434630 - DNA, 15 bp, Homo sapiens
gcaaatacaatttca

SEQ ID NO: 434631 - DNA, 15 bp, Homo sapiens
caaatacaatttcat

SEQ ID NO: 434632 - DNA, 15 bp, Homo sapiens
aaatacaatttcata

SEQ ID NO: 434633 - DNA, 15 bp, Homo sapiens
aatacaatttcatag

SEQ ID NO: 434634 - DNA, 15 bp, Homo sapiens
atacaatttcatagt

SEQ ID NO: 434635 - DNA, 15 bp, Homo sapiens
tacaatttcatagtt

SEQ ID NO: 434636 - DNA, 15 bp, Homo sapiens
acaatttcatagtta

SEQ ID NO: 434637 - DNA, 15 bp, Homo sapiens
caatttcatagttat

SEQ ID NO: 434638 - DNA, 15 bp, Homo sapiens
aatttcatagttatt

SEQ ID NO: 434639 - DNA, 15 bp, Homo sapiens
atttcatagttatta

SEQ ID NO: 434640 - DNA, 15 bp, Homo sapiens
tttcatagttattaa

SEQ ID NO: 434641 - DNA, 15 bp, Homo sapiens
ttcatagttattaaa

SEQ ID NO: 434642 - DNA, 15 bp, Homo sapiens
tcatagttattaaat

SEQ ID NO: 434643 - DNA, 15 bp, Homo sapiens
catagttattaaatg

SEQ ID NO: 434644 - DNA, 15 bp, Homo sapiens
atagttattaaatga

SEQ ID NO: 434645 - DNA, 15 bp, Homo sapiens
tagttattaaatgag

SEQ ID NO: 434646 - DNA, 15 bp, Homo sapiens
agttattaaatgagt

SEQ ID NO: 434647 - DNA, 15 bp, Homo sapiens
gttattaaatgagtg

SEQ ID NO: 434648 - DNA, 15 bp, Homo sapiens
ttattaaatgagtga

SEQ ID NO: 434649 - DNA, 15 bp, Homo sapiens
tattaaatgagtgaa

SEQ ID NO: 434650 - DNA, 15 bp, Homo sapiens
attaaatgagtgaag

SEQ ID NO: 434651 - DNA, 15 bp, Homo sapiens
ttaaatgagtgaaga

SEQ ID NO: 434652 - DNA, 15 bp, Homo sapiens
taaatgagtgaagat

SEQ ID NO: 434653 - DNA, 15 bp, Homo sapiens
aaatgagtgaagatt

SEQ ID NO: 434654 - DNA, 15 bp, Homo sapiens
aatgagtgaagattt

SEQ ID NO: 434655 - DNA, 15 bp, Homo sapiens
atgagtgaagatttg

SEQ ID NO: 434656 - DNA, 15 bp, Homo sapiens
tgagtgaagatttga

SEQ ID NO: 434657 - DNA, 15 bp, Homo sapiens
gagtgaagatttgaa

SEQ ID NO: 434658 - DNA, 15 bp, Homo sapiens
agtgaagatttgaaa

SEQ ID NO: 434659 - DNA, 15 bp, Homo sapiens
gtgaagatttgaaat

SEQ ID NO: 434660 - DNA, 15 bp, Homo sapiens
tgaagatttgaaatt

SEQ ID NO: 434661 - DNA, 15 bp, Homo sapiens
gaagatttgaaatta

SEQ ID NO: 434662 - DNA, 15 bp, Homo sapiens
aagatttgaaattat

SEQ ID NO: 434663 - DNA, 15 bp, Homo sapiens
agatttgaaattatt

SEQ ID NO: 434664 - DNA, 15 bp, Homo sapiens
gatttgaaattatta

SEQ ID NO: 434665 - DNA, 15 bp, Homo sapiens
atttgaaattattat

SEQ ID NO: 434666 - DNA, 15 bp, Homo sapiens
tttgaaattattata

SEQ ID NO: 434667 - DNA, 15 bp, Homo sapiens
ttgaaattattatat

SEQ ID NO: 434668 - DNA, 15 bp, Homo sapiens
tgaaattattatata

SEQ ID NO: 434669 - DNA, 15 bp, Homo sapiens
gaaattattatatag

SEQ ID NO: 434670 - DNA, 15 bp, Homo sapiens
aaattattatatagt

SEQ ID NO: 434671 - DNA, 15 bp, Homo sapiens
aattattatatagtt

SEQ ID NO: 434672 - DNA, 15 bp, Homo sapiens
attattatatagttt

SEQ ID NO: 434673 - DNA, 15 bp, Homo sapiens
ttattatatagttta

SEQ ID NO: 434674 - DNA, 15 bp, Homo sapiens
tattatatagtttag

SEQ ID NO: 434675 - DNA, 15 bp, Homo sapiens
attatatagtttagt

SEQ ID NO: 434676 - DNA, 15 bp, Homo sapiens
ttatatagtttagta

SEQ ID NO: 434677 - DNA, 15 bp, Homo sapiens
tatatagtttagtag

SEQ ID NO: 434678 - DNA, 15 bp, Homo sapiens
atatagtttagtaga

SEQ ID NO: 434679 - DNA, 15 bp, Homo sapiens
tatagtttagtagaa

SEQ ID NO: 434680 - DNA, 15 bp, Homo sapiens
atagtttagtagaag

SEQ ID NO: 434681 - DNA, 15 bp, Homo sapiens
tagtttagtagaagt

SEQ ID NO: 434682 - DNA, 15 bp, Homo sapiens
agtttagtagaagtt

SEQ ID NO: 434683 - DNA, 15 bp, Homo sapiens
gtttagtagaagtta

SEQ ID NO: 434684 - DNA, 15 bp, Homo sapiens
tttagtagaagttac

SEQ ID NO: 434685 - DNA, 15 bp, Homo sapiens
ttagtagaagttact

SEQ ID NO: 434686 - DNA, 15 bp, Homo sapiens
tagtagaagttactt

SEQ ID NO: 434687 - DNA, 15 bp, Homo sapiens
agtagaagttacttt

SEQ ID NO: 434688 - DNA, 15 bp, Homo sapiens
gtagaagttactttt

SEQ ID NO: 434689 - DNA, 15 bp, Homo sapiens
tagaagttactttta

SEQ ID NO: 434690 - DNA, 15 bp, Homo sapiens
agaagttacttttat

SEQ ID NO: 434691 - DNA, 15 bp, Homo sapiens
gaagttacttttata

SEQ ID NO: 434692 - DNA, 15 bp, Homo sapiens
aagttacttttatat

SEQ ID NO: 434693 - DNA, 15 bp, Homo sapiens
agttacttttatatt

SEQ ID NO: 434694 - DNA, 15 bp, Homo sapiens
gttacttttatattc

SEQ ID NO: 434695 - DNA, 15 bp, Homo sapiens
ttacttttatattct

SEQ ID NO: 434696 - DNA, 15 bp, Homo sapiens
tacttttatattctc

SEQ ID NO: 434697 - DNA, 15 bp, Homo sapiens
acttttatattctcc

SEQ ID NO: 434698 - DNA, 15 bp, Homo sapiens
cttttatattctcca

SEQ ID NO: 434699 - DNA, 15 bp, Homo sapiens
ttttatattctccat

SEQ ID NO: 434700 - DNA, 15 bp, Homo sapiens
tttatattctccata

SEQ ID NO: 434701 - DNA, 15 bp, Homo sapiens
ttatattctccatat

SEQ ID NO: 434702 - DNA, 15 bp, Homo sapiens
tatattctccatata

SEQ ID NO: 434703 - DNA, 15 bp, Homo sapiens
atattctccatataa

SEQ ID NO: 434704 - DNA, 15 bp, Homo sapiens
tattctccatataac

SEQ ID NO: 434705 - DNA, 15 bp, Homo sapiens
attctccatataact

SEQ ID NO: 434706 - DNA, 15 bp, Homo sapiens
ttctccatataactt

SEQ ID NO: 434707 - DNA, 15 bp, Homo sapiens
tctccatataactta

SEQ ID NO: 434708 - DNA, 15 bp, Homo sapiens
ctccatataacttaa

SEQ ID NO: 434709 - DNA, 15 bp, Homo sapiens
tccatataacttaag

SEQ ID NO: 434710 - DNA, 15 bp, Homo sapiens
ccatataacttaagg

SEQ ID NO: 434711 - DNA, 15 bp, Homo sapiens
catataacttaaggt

SEQ ID NO: 434712 - DNA, 15 bp, Homo sapiens
atataacttaaggtt

SEQ ID NO: 434713 - DNA, 15 bp, Homo sapiens
tataacttaaggtta

SEQ ID NO: 434714 - DNA, 15 bp, Homo sapiens
ataacttaaggttac

SEQ ID NO: 434715 - DNA, 15 bp, Homo sapiens
taacttaaggttaca

SEQ ID NO: 434716 - DNA, 15 bp, Homo sapiens
aacttaaggttacaa

SEQ ID NO: 434717 - DNA, 15 bp, Homo sapiens
acttaaggttacaac

SEQ ID NO: 434718 - DNA, 15 bp, Homo sapiens
cttaaggttacaaca

SEQ ID NO: 434719 - DNA, 15 bp, Homo sapiens
ttaaggttacaacat

SEQ ID NO: 434720 - DNA, 15 bp, Homo sapiens
taaggttacaacatt

SEQ ID NO: 434721 - DNA, 15 bp, Homo sapiens
aaggttacaacatta

SEQ ID NO: 434722 - DNA, 15 bp, Homo sapiens
aggttacaacattat

SEQ ID NO: 434723 - DNA, 15 bp, Homo sapiens
ggttacaacattatt

SEQ ID NO: 434724 - DNA, 15 bp, Homo sapiens
gttacaacattattt

SEQ ID NO: 434725 - DNA, 15 bp, Homo sapiens
ttacaacattatttt

SEQ ID NO: 434726 - DNA, 15 bp, Homo sapiens
tacaacattattttc

SEQ ID NO: 434727 - DNA, 15 bp, Homo sapiens
acaacattattttct

SEQ ID NO: 434728 - DNA, 15 bp, Homo sapiens
caacattattttctt

SEQ ID NO: 434729 - DNA, 15 bp, Homo sapiens
aacattattttcttg

SEQ ID NO: 434730 - DNA, 15 bp, Homo sapiens
acattattttcttgt

SEQ ID NO: 434731 - DNA, 15 bp, Homo sapiens
cattattttcttgta

SEQ ID NO: 434732 - DNA, 15 bp, Homo sapiens
attattttcttgtat

SEQ ID NO: 434733 - DNA, 15 bp, Homo sapiens
ttattttcttgtatg

SEQ ID NO: 434734 - DNA, 15 bp, Homo sapiens
tattttcttgtatgt

SEQ ID NO: 434735 - DNA, 15 bp, Homo sapiens
attttcttgtatgta

SEQ ID NO: 434736 - DNA, 15 bp, Homo sapiens
ttttcttgtatgtaa

SEQ ID NO: 434737 - DNA, 15 bp, Homo sapiens
tttcttgtatgtaat

SEQ ID NO: 434738 - DNA, 15 bp, Homo sapiens
ttcttgtatgtaata

SEQ ID NO: 434739 - DNA, 15 bp, Homo sapiens
tcttgtatgtaataa

SEQ ID NO: 434740 - DNA, 15 bp, Homo sapiens
cttgtatgtaataaa

SEQ ID NO: 434741 - DNA, 15 bp, Homo sapiens
ttgtatgtaataaaa

SEQ ID NO: 434742 - DNA, 15 bp, Homo sapiens
tgtatgtaataaaat

SEQ ID NO: 434743 - DNA, 15 bp, Homo sapiens
gtatgtaataaaatg

SEQ ID NO: 434744 - DNA, 15 bp, Homo sapiens
tatgtaataaaatga

SEQ ID NO: 434745 - DNA, 15 bp, Homo sapiens
atgtaataaaatgag

SEQ ID NO: 434746 - DNA, 15 bp, Homo sapiens
tgtaataaaatgagg

SEQ ID NO: 434747 - DNA, 15 bp, Homo sapiens
gtaataaaatgagga

SEQ ID NO: 434748 - DNA, 15 bp, Homo sapiens
taataaaatgaggac

SEQ ID NO: 434749 - DNA, 15 bp, Homo sapiens
aataaaatgaggaca

SEQ ID NO: 434750 - DNA, 15 bp, Homo sapiens
ataaaatgaggacaa

SEQ ID NO: 434751 - DNA, 15 bp, Homo sapiens
taaaatgaggacaaa

SEQ ID NO: 434752 - DNA, 15 bp, Homo sapiens
aaaatgaggacaaat

SEQ ID NO: 434753 - DNA, 15 bp, Homo sapiens
aaatgaggacaaatt

SEQ ID NO: 434754 - DNA, 15 bp, Homo sapiens
aatgaggacaaatta

SEQ ID NO: 434755 - DNA, 15 bp, Homo sapiens
atgaggacaaattac

SEQ ID NO: 434756 - DNA, 15 bp, Homo sapiens
tgaggacaaattaca

SEQ ID NO: 434757 - DNA, 15 bp, Homo sapiens
gaggacaaattacac

SEQ ID NO: 434758 - DNA, 15 bp, Homo sapiens
aggacaaattacaca

SEQ ID NO: 434759 - DNA, 15 bp, Homo sapiens
ggacaaattacacat

SEQ ID NO: 434760 - DNA, 15 bp, Homo sapiens
gacaaattacacatt

SEQ ID NO: 434761 - DNA, 15 bp, Homo sapiens
acaaattacacatta

SEQ ID NO: 434762 - DNA, 15 bp, Homo sapiens
caaattacacattag

SEQ ID NO: 434763 - DNA, 15 bp, Homo sapiens
aaattacacattagt

SEQ ID NO: 434764 - DNA, 15 bp, Homo sapiens
aattacacattagtt

SEQ ID NO: 434765 - DNA, 15 bp, Homo sapiens
attacacattagtta

SEQ ID NO: 434766 - DNA, 15 bp, Homo sapiens
ttacacattagttaa

SEQ ID NO: 434767 - DNA, 15 bp, Homo sapiens
tacacattagttaat

SEQ ID NO: 434768 - DNA, 15 bp, Homo sapiens
acacattagttaata

SEQ ID NO: 434769 - DNA, 15 bp, Homo sapiens
cacattagttaatag

SEQ ID NO: 434770 - DNA, 15 bp, Homo sapiens
acattagttaataga

SEQ ID NO: 434771 - DNA, 15 bp, Homo sapiens
cattagttaatagaa

SEQ ID NO: 434772 - DNA, 15 bp, Homo sapiens
attagttaatagaag

SEQ ID NO: 434773 - DNA, 15 bp, Homo sapiens
ttagttaatagaagt

SEQ ID NO: 434774 - DNA, 15 bp, Homo sapiens
tagttaatagaagta

SEQ ID NO: 434775 - DNA, 15 bp, Homo sapiens
agttaatagaagtaa

SEQ ID NO: 434776 - DNA, 15 bp, Homo sapiens
gttaatagaagtaac

SEQ ID NO: 434777 - DNA, 15 bp, Homo sapiens
ttaatagaagtaact

SEQ ID NO: 434778 - DNA, 15 bp, Homo sapiens
taatagaagtaactg

SEQ ID NO: 434779 - DNA, 15 bp, Homo sapiens
aatagaagtaactgg

SEQ ID NO: 434780 - DNA, 15 bp, Homo sapiens
atagaagtaactggg

SEQ ID NO: 434781 - DNA, 15 bp, Homo sapiens
tagaagtaactgggc

SEQ ID NO: 434782 - DNA, 15 bp, Homo sapiens
agaagtaactgggct

SEQ ID NO: 434783 - DNA, 15 bp, Homo sapiens
gaagtaactgggcta

SEQ ID NO: 434784 - DNA, 15 bp, Homo sapiens
aagtaactgggctag

SEQ ID NO: 434785 - DNA, 15 bp, Homo sapiens
agtaactgggctagt

SEQ ID NO: 434786 - DNA, 15 bp, Homo sapiens
gtaactgggctagta

SEQ ID NO: 434787 - DNA, 15 bp, Homo sapiens
taactgggctagtaa

SEQ ID NO: 434788 - DNA, 15 bp, Homo sapiens
aactgggctagtaaa

SEQ ID NO: 434789 - DNA, 15 bp, Homo sapiens
actgggctagtaaaa

SEQ ID NO: 434790 - DNA, 15 bp, Homo sapiens
ctgggctagtaaaac

SEQ ID NO: 434791 - DNA, 15 bp, Homo sapiens
tgggctagtaaaact

SEQ ID NO: 434792 - DNA, 15 bp, Homo sapiens
gggctagtaaaacta

SEQ ID NO: 434793 - DNA, 15 bp, Homo sapiens
ggctagtaaaactaa

SEQ ID NO: 434794 - DNA, 15 bp, Homo sapiens
gctagtaaaactaat

SEQ ID NO: 434795 - DNA, 15 bp, Homo sapiens
ctagtaaaactaatg

SEQ ID NO: 434796 - DNA, 15 bp, Homo sapiens
tagtaaaactaatgg

SEQ ID NO: 434797 - DNA, 15 bp, Homo sapiens
agtaaaactaatggg

SEQ ID NO: 434798 - DNA, 15 bp, Homo sapiens
gtaaaactaatgggt

SEQ ID NO: 434799 - DNA, 15 bp, Homo sapiens
taaaactaatgggtg

SEQ ID NO: 434800 - DNA, 15 bp, Homo sapiens
aaaactaatgggtgt

SEQ ID NO: 434801 - DNA, 15 bp, Homo sapiens
aaactaatgggtgtt

SEQ ID NO: 434802 - DNA, 15 bp, Homo sapiens
aactaatgggtgttt

SEQ ID NO: 434803 - DNA, 15 bp, Homo sapiens
actaatgggtgtttt

SEQ ID NO: 434804 - DNA, 15 bp, Homo sapiens
ctaatgggtgttttc

SEQ ID NO: 434805 - DNA, 15 bp, Homo sapiens
taatgggtgttttct

SEQ ID NO: 434806 - DNA, 15 bp, Homo sapiens
aatgggtgttttctc

SEQ ID NO: 434807 - DNA, 15 bp, Homo sapiens
atgggtgttttctcc

SEQ ID NO: 434808 - DNA, 15 bp, Homo sapiens
tgggtgttttctccc

SEQ ID NO: 434809 - DNA, 15 bp, Homo sapiens
gggtgttttctccca

SEQ ID NO: 434810 - DNA, 15 bp, Homo sapiens
ggtgttttctcccag

SEQ ID NO: 434811 - DNA, 15 bp, Homo sapiens
gtgttttctcccagg

SEQ ID NO: 434812 - DNA, 15 bp, Homo sapiens
tgttttctcccaggg

SEQ ID NO: 434813 - DNA, 15 bp, Homo sapiens
gttttctcccagggc

SEQ ID NO: 434814 - DNA, 15 bp, Homo sapiens
ttttctcccagggct

SEQ ID NO: 434815 - DNA, 15 bp, Homo sapiens
tttctcccagggctt

SEQ ID NO: 434816 - DNA, 15 bp, Homo sapiens
ttctcccagggcttt

SEQ ID NO: 434817 - DNA, 15 bp, Homo sapiens
tctcccagggctttt

SEQ ID NO: 434818 - DNA, 15 bp, Homo sapiens
ctcccagggcttttg

SEQ ID NO: 434819 - DNA, 15 bp, Homo sapiens
tcccagggcttttgt

SEQ ID NO: 434820 - DNA, 15 bp, Homo sapiens
cccagggcttttgtt

SEQ ID NO: 434821 - DNA, 15 bp, Homo sapiens
ccagggcttttgttt

SEQ ID NO: 434822 - DNA, 15 bp, Homo sapiens
cagggcttttgtttt

SEQ ID NO: 434823 - DNA, 15 bp, Homo sapiens
agggcttttgttttc

SEQ ID NO: 434824 - DNA, 15 bp, Homo sapiens
gggcttttgttttcc

SEQ ID NO: 434825 - DNA, 15 bp, Homo sapiens
ggcttttgttttcct

SEQ ID NO: 434826 - DNA, 15 bp, Homo sapiens
gcttttgttttcctc

SEQ ID NO: 434827 - DNA, 15 bp, Homo sapiens
cttttgttttcctca

SEQ ID NO: 434828 - DNA, 15 bp, Homo sapiens
ttttgttttcctcac

SEQ ID NO: 434829 - DNA, 15 bp, Homo sapiens
tttgttttcctcact

SEQ ID NO: 434830 - DNA, 15 bp, Homo sapiens
ttgttttcctcacta

SEQ ID NO: 434831 - DNA, 15 bp, Homo sapiens
tgttttcctcactaa

SEQ ID NO: 434832 - DNA, 15 bp, Homo sapiens
gttttcctcactaac

SEQ ID NO: 434833 - DNA, 15 bp, Homo sapiens
ttttcctcactaaca

SEQ ID NO: 434834 - DNA, 15 bp, Homo sapiens
tttcctcactaacaa

SEQ ID NO: 434835 - DNA, 15 bp, Homo sapiens
ttcctcactaacaac

SEQ ID NO: 434836 - DNA, 15 bp, Homo sapiens
tcctcactaacaact

SEQ ID NO: 434837 - DNA, 15 bp, Homo sapiens
cctcactaacaactt

SEQ ID NO: 434838 - DNA, 15 bp, Homo sapiens
ctcactaacaacttt

SEQ ID NO: 434839 - DNA, 15 bp, Homo sapiens
tcactaacaacttta

SEQ ID NO: 434840 - DNA, 15 bp, Homo sapiens
cactaacaactttat

SEQ ID NO: 434841 - DNA, 15 bp, Homo sapiens
actaacaactttatt

SEQ ID NO: 434842 - DNA, 15 bp, Homo sapiens
ctaacaactttatta

SEQ ID NO: 434843 - DNA, 15 bp, Homo sapiens
taacaactttattaa

SEQ ID NO: 434844 - DNA, 15 bp, Homo sapiens
aacaactttattaat

SEQ ID NO: 434845 - DNA, 15 bp, Homo sapiens
acaactttattaatt

SEQ ID NO: 434846 - DNA, 15 bp, Homo sapiens
caactttattaattg

SEQ ID NO: 434847 - DNA, 15 bp, Homo sapiens
aactttattaattgg

SEQ ID NO: 434848 - DNA, 15 bp, Homo sapiens
actttattaattgga

SEQ ID NO: 434849 - DNA, 15 bp, Homo sapiens
ctttattaattggag

SEQ ID NO: 434850 - DNA, 15 bp, Homo sapiens
tttattaattggagc

SEQ ID NO: 434851 - DNA, 15 bp, Homo sapiens
ttattaattggagcc

SEQ ID NO: 434852 - DNA, 15 bp, Homo sapiens
tattaattggagcct

SEQ ID NO: 434853 - DNA, 15 bp, Homo sapiens
attaattggagcctc

SEQ ID NO: 434854 - DNA, 15 bp, Homo sapiens
ttaattggagcctca

SEQ ID NO: 434855 - DNA, 15 bp, Homo sapiens
taattggagcctcat

SEQ ID NO: 434856 - DNA, 15 bp, Homo sapiens
aattggagcctcatt

SEQ ID NO: 434857 - DNA, 15 bp, Homo sapiens
attggagcctcattc

SEQ ID NO: 434858 - DNA, 15 bp, Homo sapiens
ttggagcctcattca

SEQ ID NO: 434859 - DNA, 15 bp, Homo sapiens
tggagcctcattcat

SEQ ID NO: 434860 - DNA, 15 bp, Homo sapiens
ggagcctcattcatt

SEQ ID NO: 434861 - DNA, 15 bp, Homo sapiens
gagcctcattcattg

SEQ ID NO: 434862 - DNA, 15 bp, Homo sapiens
agcctcattcattgt

SEQ ID NO: 434863 - DNA, 15 bp, Homo sapiens
gcctcattcattgta

SEQ ID NO: 434864 - DNA, 15 bp, Homo sapiens
cctcattcattgtaa

SEQ ID NO: 434865 - DNA, 15 bp, Homo sapiens
ctcattcattgtaaa

SEQ ID NO: 434866 - DNA, 15 bp, Homo sapiens
tcattcattgtaaat

SEQ ID NO: 434867 - DNA, 15 bp, Homo sapiens
cattcattgtaaatg

SEQ ID NO: 434868 - DNA, 15 bp, Homo sapiens
attcattgtaaatga

SEQ ID NO: 434869 - DNA, 15 bp, Homo sapiens
ttcattgtaaatgac

SEQ ID NO: 434870 - DNA, 15 bp, Homo sapiens
tcattgtaaatgaca

SEQ ID NO: 434871 - DNA, 15 bp, Homo sapiens
cattgtaaatgacag

SEQ ID NO: 434872 - DNA, 15 bp, Homo sapiens
attgtaaatgacagg

SEQ ID NO: 434873 - DNA, 15 bp, Homo sapiens
ttgtaaatgacaggc

SEQ ID NO: 434874 - DNA, 15 bp, Homo sapiens
tgtaaatgacaggca

SEQ ID NO: 434875 - DNA, 15 bp, Homo sapiens
gtaaatgacaggcac

SEQ ID NO: 434876 - DNA, 15 bp, Homo sapiens
taaatgacaggcaca

SEQ ID NO: 434877 - DNA, 15 bp, Homo sapiens
aaatgacaggcacac

SEQ ID NO: 434878 - DNA, 15 bp, Homo sapiens
aatgacaggcacaca

SEQ ID NO: 434879 - DNA, 15 bp, Homo sapiens
atgacaggcacacag

SEQ ID NO: 434880 - DNA, 15 bp, Homo sapiens
tgacaggcacacagc

SEQ ID NO: 434881 - DNA, 15 bp, Homo sapiens
gacaggcacacagct

SEQ ID NO: 434882 - DNA, 15 bp, Homo sapiens
acaggcacacagctt

SEQ ID NO: 434883 - DNA, 15 bp, Homo sapiens
caggcacacagcttc

SEQ ID NO: 434884 - DNA, 15 bp, Homo sapiens
aggcacacagcttcc

SEQ ID NO: 434885 - DNA, 15 bp, Homo sapiens
ggcacacagcttccc

SEQ ID NO: 434886 - DNA, 15 bp, Homo sapiens
gcacacagcttccct

SEQ ID NO: 434887 - DNA, 15 bp, Homo sapiens
cacacagcttcccta

SEQ ID NO: 434888 - DNA, 15 bp, Homo sapiens
acacagcttccctaa

SEQ ID NO: 434889 - DNA, 15 bp, Homo sapiens
cacagcttccctaag

SEQ ID NO: 434890 - DNA, 15 bp, Homo sapiens
acagcttccctaagt

SEQ ID NO: 434891 - DNA, 15 bp, Homo sapiens
cagcttccctaagtg

SEQ ID NO: 434892 - DNA, 15 bp, Homo sapiens
agcttccctaagtgt

SEQ ID NO: 434893 - DNA, 15 bp, Homo sapiens
gcttccctaagtgta

SEQ ID NO: 434894 - DNA, 15 bp, Homo sapiens
cttccctaagtgtag

SEQ ID NO: 434895 - DNA, 15 bp, Homo sapiens
ttccctaagtgtagg

SEQ ID NO: 434896 - DNA, 15 bp, Homo sapiens
tccctaagtgtaggc

SEQ ID NO: 434897 - DNA, 15 bp, Homo sapiens
ccctaagtgtaggca

SEQ ID NO: 434898 - DNA, 15 bp, Homo sapiens
cctaagtgtaggcat

SEQ ID NO: 434899 - DNA, 15 bp, Homo sapiens
ctaagtgtaggcatg

SEQ ID NO: 434900 - DNA, 15 bp, Homo sapiens
taagtgtaggcatga

SEQ ID NO: 434901 - DNA, 15 bp, Homo sapiens
aagtgtaggcatgaa

SEQ ID NO: 434902 - DNA, 15 bp, Homo sapiens
agtgtaggcatgaag

SEQ ID NO: 434903 - DNA, 15 bp, Homo sapiens
gtgtaggcatgaagg

SEQ ID NO: 434904 - DNA, 15 bp, Homo sapiens
tgtaggcatgaaggg

SEQ ID NO: 434905 - DNA, 15 bp, Homo sapiens
gtaggcatgaagggg

SEQ ID NO: 434906 - DNA, 15 bp, Homo sapiens
taggcatgaagggga

SEQ ID NO: 434907 - DNA, 15 bp, Homo sapiens
aggcatgaaggggaa

SEQ ID NO: 434908 - DNA, 15 bp, Homo sapiens
ggcatgaaggggaag

SEQ ID NO: 434909 - DNA, 15 bp, Homo sapiens
gcatgaaggggaagg

SEQ ID NO: 434910 - DNA, 15 bp, Homo sapiens
catgaaggggaaggc

SEQ ID NO: 434911 - DNA, 15 bp, Homo sapiens
atgaaggggaaggca

SEQ ID NO: 434912 - DNA, 15 bp, Homo sapiens
tgaaggggaaggcat

SEQ ID NO: 434913 - DNA, 15 bp, Homo sapiens
gaaggggaaggcatt

SEQ ID NO: 434914 - DNA, 15 bp, Homo sapiens
aaggggaaggcattg

SEQ ID NO: 434915 - DNA, 15 bp, Homo sapiens
aggggaaggcattgg

SEQ ID NO: 434916 - DNA, 15 bp, Homo sapiens
ggggaaggcattggc

SEQ ID NO: 434917 - DNA, 15 bp, Homo sapiens
gggaaggcattggcc

SEQ ID NO: 434918 - DNA, 15 bp, Homo sapiens
ggaaggcattggcct

SEQ ID NO: 434919 - DNA, 15 bp, Homo sapiens
gaaggcattggcctc

SEQ ID NO: 434920 - DNA, 15 bp, Homo sapiens
aaggcattggcctcc

SEQ ID NO: 434921 - DNA, 15 bp, Homo sapiens
aggcattggcctcca

SEQ ID NO: 434922 - DNA, 15 bp, Homo sapiens
ggcattggcctccat

SEQ ID NO: 434923 - DNA, 15 bp, Homo sapiens
gcattggcctccata

SEQ ID NO: 434924 - DNA, 15 bp, Homo sapiens
cattggcctccataa

SEQ ID NO: 434925 - DNA, 15 bp, Homo sapiens
attggcctccataac

SEQ ID NO: 434926 - DNA, 15 bp, Homo sapiens
ttggcctccataacc

SEQ ID NO: 434927 - DNA, 15 bp, Homo sapiens
tggcctccataaccg

SEQ ID NO: 434928 - DNA, 15 bp, Homo sapiens
ggcctccataaccga

SEQ ID NO: 434929 - DNA, 15 bp, Homo sapiens
gcctccataaccgag

SEQ ID NO: 434930 - DNA, 15 bp, Homo sapiens
cctccataaccgagc

SEQ ID NO: 434931 - DNA, 15 bp, Homo sapiens
ctccataaccgagcc

SEQ ID NO: 434932 - DNA, 15 bp, Homo sapiens
tccataaccgagcca

SEQ ID NO: 434933 - DNA, 15 bp, Homo sapiens
ccataaccgagccac

SEQ ID NO: 434934 - DNA, 15 bp, Homo sapiens
cataaccgagccacg

SEQ ID NO: 434935 - DNA, 15 bp, Homo sapiens
ataaccgagccacgg

SEQ ID NO: 434936 - DNA, 15 bp, Homo sapiens
taaccgagccacggt

SEQ ID NO: 434937 - DNA, 15 bp, Homo sapiens
aaccgagccacggta

SEQ ID NO: 434938 - DNA, 15 bp, Homo sapiens
accgagccacggtag

SEQ ID NO: 434939 - DNA, 15 bp, Homo sapiens
ccgagccacggtaga

SEQ ID NO: 434940 - DNA, 15 bp, Homo sapiens
cgagccacggtagag

SEQ ID NO: 434941 - DNA, 15 bp, Homo sapiens
gagccacggtagaga

SEQ ID NO: 434942 - DNA, 15 bp, Homo sapiens
agccacggtagagac

SEQ ID NO: 434943 - DNA, 15 bp, Homo sapiens
gccacggtagagacg

SEQ ID NO: 434944 - DNA, 15 bp, Homo sapiens
ccacggtagagacgt

SEQ ID NO: 434945 - DNA, 15 bp, Homo sapiens
cacggtagagacgta

SEQ ID NO: 434946 - DNA, 15 bp, Homo sapiens
acggtagagacgtag

SEQ ID NO: 434947 - DNA, 15 bp, Homo sapiens
cggtagagacgtagc

SEQ ID NO: 434948 - DNA, 15 bp, Homo sapiens
ggtagagacgtagct

SEQ ID NO: 434949 - DNA, 15 bp, Homo sapiens
gtagagacgtagctg

SEQ ID NO: 434950 - DNA, 15 bp, Homo sapiens
tagagacgtagctga

SEQ ID NO: 434951 - DNA, 15 bp, Homo sapiens
agagacgtagctgac

SEQ ID NO: 434952 - DNA, 15 bp, Homo sapiens
gagacgtagctgacc

SEQ ID NO: 434953 - DNA, 15 bp, Homo sapiens
agacgtagctgacca

SEQ ID NO: 434954 - DNA, 15 bp, Homo sapiens
gacgtagctgaccac

SEQ ID NO: 434955 - DNA, 15 bp, Homo sapiens
acgtagctgaccaca

SEQ ID NO: 434956 - DNA, 15 bp, Homo sapiens
cgtagctgaccacag

SEQ ID NO: 434957 - DNA, 15 bp, Homo sapiens
gtagctgaccacagg

SEQ ID NO: 434958 - DNA, 15 bp, Homo sapiens
tagctgaccacaggg

SEQ ID NO: 434959 - DNA, 15 bp, Homo sapiens
agctgaccacaggga

SEQ ID NO: 434960 - DNA, 15 bp, Homo sapiens
gctgaccacagggac

SEQ ID NO: 434961 - DNA, 15 bp, Homo sapiens
ctgaccacagggact

SEQ ID NO: 434962 - DNA, 15 bp, Homo sapiens
tgaccacagggactg

SEQ ID NO: 434963 - DNA, 15 bp, Homo sapiens
gaccacagggactgg

SEQ ID NO: 434964 - DNA, 15 bp, Homo sapiens
accacagggactgga

SEQ ID NO: 434965 - DNA, 15 bp, Homo sapiens
ccacagggactggaa

SEQ ID NO: 434966 - DNA, 15 bp, Homo sapiens
cacagggactggaat

SEQ ID NO: 434967 - DNA, 15 bp, Homo sapiens
acagggactggaata

SEQ ID NO: 434968 - DNA, 15 bp, Homo sapiens
cagggactggaatac

SEQ ID NO: 434969 - DNA, 15 bp, Homo sapiens
agggactggaatacc

SEQ ID NO: 434970 - DNA, 15 bp, Homo sapiens
gggactggaatacca

SEQ ID NO: 434971 - DNA, 15 bp, Homo sapiens
ggactggaataccac

SEQ ID NO: 434972 - DNA, 15 bp, Homo sapiens
gactggaataccacc

SEQ ID NO: 434973 - DNA, 15 bp, Homo sapiens
actggaataccaccc

SEQ ID NO: 434974 - DNA, 15 bp, Homo sapiens
ctggaataccaccca

SEQ ID NO: 434975 - DNA, 15 bp, Homo sapiens
tggaataccacccag

SEQ ID NO: 434976 - DNA, 15 bp, Homo sapiens
ggaataccacccaga

SEQ ID NO: 434977 - DNA, 15 bp, Homo sapiens
gaataccacccagaa

SEQ ID NO: 434978 - DNA, 15 bp, Homo sapiens
aataccacccagaag

SEQ ID NO: 434979 - DNA, 15 bp, Homo sapiens
ataccacccagaagg

SEQ ID NO: 434980 - DNA, 15 bp, Homo sapiens
taccacccagaaggc

SEQ ID NO: 434981 - DNA, 15 bp, Homo sapiens
accacccagaaggct

SEQ ID NO: 434982 - DNA, 15 bp, Homo sapiens
ccacccagaaggctt

SEQ ID NO: 434983 - DNA, 15 bp, Homo sapiens
cacccagaaggcttt

SEQ ID NO: 434984 - DNA, 15 bp, Homo sapiens
acccagaaggctttt

SEQ ID NO: 434985 - DNA, 15 bp, Homo sapiens
cccagaaggcttttc

SEQ ID NO: 434986 - DNA, 15 bp, Homo sapiens
ccagaaggcttttct

SEQ ID NO: 434987 - DNA, 15 bp, Homo sapiens
cagaaggcttttctc

SEQ ID NO: 434988 - DNA, 15 bp, Homo sapiens
agaaggcttttctcc

SEQ ID NO: 434989 - DNA, 15 bp, Homo sapiens
gaaggcttttctcca

SEQ ID NO: 434990 - DNA, 15 bp, Homo sapiens
aaggcttttctccat

SEQ ID NO: 434991 - DNA, 15 bp, Homo sapiens
aggcttttctccatg

SEQ ID NO: 434992 - DNA, 15 bp, Homo sapiens
ggcttttctccatgt

SEQ ID NO: 434993 - DNA, 15 bp, Homo sapiens
gcttttctccatgtc

SEQ ID NO: 434994 - DNA, 15 bp, Homo sapiens
cttttctccatgtct

SEQ ID NO: 434995 - DNA, 15 bp, Homo sapiens
ttttctccatgtctt

SEQ ID NO: 434996 - DNA, 15 bp, Homo sapiens
tttctccatgtcttc

SEQ ID NO: 434997 - DNA, 15 bp, Homo sapiens
ttctccatgtcttct

SEQ ID NO: 434998 - DNA, 15 bp, Homo sapiens
tctccatgtcttctt

SEQ ID NO: 434999 - DNA, 15 bp, Homo sapiens
ctccatgtcttcttc

SEQ ID NO: 435000 - DNA, 15 bp, Homo sapiens
tccatgtcttcttct

SEQ ID NO: 435001 - DNA, 15 bp, Homo sapiens
ccatgtcttcttctc

SEQ ID NO: 435002 - DNA, 15 bp, Homo sapiens
catgtcttcttctct

SEQ ID NO: 435003 - DNA, 15 bp, Homo sapiens
atgtcttcttctctg

SEQ ID NO: 435004 - DNA, 15 bp, Homo sapiens
tgtcttcttctctgc

SEQ ID NO: 435005 - DNA, 15 bp, Homo sapiens
gtcttcttctctgct

SEQ ID NO: 435006 - DNA, 15 bp, Homo sapiens
tcttcttctctgctt

SEQ ID NO: 435007 - DNA, 15 bp, Homo sapiens
cttcttctctgcttc

SEQ ID NO: 435008 - DNA, 15 bp, Homo sapiens
ttcttctctgcttct

SEQ ID NO: 435009 - DNA, 15 bp, Homo sapiens
tcttctctgcttctc

SEQ ID NO: 435010 - DNA, 15 bp, Homo sapiens
cttctctgcttctct

SEQ ID NO: 435011 - DNA, 15 bp, Homo sapiens
ttctctgcttctctg

SEQ ID NO: 435012 - DNA, 15 bp, Homo sapiens
tctctgcttctctgt

SEQ ID NO: 435013 - DNA, 15 bp, Homo sapiens
ctctgcttctctgta

SEQ ID NO: 435014 - DNA, 15 bp, Homo sapiens
tctgcttctctgtac

SEQ ID NO: 435015 - DNA, 15 bp, Homo sapiens
ctgcttctctgtaca

SEQ ID NO: 435016 - DNA, 15 bp, Homo sapiens
tgcttctctgtacag

SEQ ID NO: 435017 - DNA, 15 bp, Homo sapiens
gcttctctgtacagg

SEQ ID NO: 435018 - DNA, 15 bp, Homo sapiens
cttctctgtacaggt

SEQ ID NO: 435019 - DNA, 15 bp, Homo sapiens
ttctctgtacaggtt

SEQ ID NO: 435020 - DNA, 15 bp, Homo sapiens
tctctgtacaggttt

SEQ ID NO: 435021 - DNA, 15 bp, Homo sapiens
ctctgtacaggtttt

SEQ ID NO: 435022 - DNA, 15 bp, Homo sapiens
tctgtacaggttttc

SEQ ID NO: 435023 - DNA, 15 bp, Homo sapiens
ctgtacaggttttca

SEQ ID NO: 435024 - DNA, 15 bp, Homo sapiens
tgtacaggttttcat

SEQ ID NO: 435025 - DNA, 15 bp, Homo sapiens
gtacaggttttcatt

SEQ ID NO: 435026 - DNA, 15 bp, Homo sapiens
tacaggttttcattt

SEQ ID NO: 435027 - DNA, 15 bp, Homo sapiens
acaggttttcatttt

SEQ ID NO: 435028 - DNA, 15 bp, Homo sapiens
caggttttcattttc

SEQ ID NO: 435029 - DNA, 15 bp, Homo sapiens
aggttttcattttct

SEQ ID NO: 435030 - DNA, 15 bp, Homo sapiens
ggttttcattttctt

SEQ ID NO: 435031 - DNA, 15 bp, Homo sapiens
gttttcattttctta

SEQ ID NO: 435032 - DNA, 15 bp, Homo sapiens
ttttcattttcttag

SEQ ID NO: 435033 - DNA, 15 bp, Homo sapiens
tttcattttcttagc

SEQ ID NO: 435034 - DNA, 15 bp, Homo sapiens
ttcattttcttagct

SEQ ID NO: 435035 - DNA, 15 bp, Homo sapiens
tcattttcttagctt

SEQ ID NO: 435036 - DNA, 15 bp, Homo sapiens
cattttcttagcttt

SEQ ID NO: 435037 - DNA, 15 bp, Homo sapiens
attttcttagctttc

SEQ ID NO: 435038 - DNA, 15 bp, Homo sapiens
ttttcttagctttcc

SEQ ID NO: 435039 - DNA, 15 bp, Homo sapiens
tttcttagctttcct

SEQ ID NO: 435040 - DNA, 15 bp, Homo sapiens
ttcttagctttccta

SEQ ID NO: 435041 - DNA, 15 bp, Homo sapiens
tcttagctttcctat

SEQ ID NO: 435042 - DNA, 15 bp, Homo sapiens
cttagctttcctatg

SEQ ID NO: 435043 - DNA, 15 bp, Homo sapiens
ttagctttcctatga

SEQ ID NO: 435044 - DNA, 15 bp, Homo sapiens
tagctttcctatgac

SEQ ID NO: 435045 - DNA, 15 bp, Homo sapiens
agctttcctatgact

SEQ ID NO: 435046 - DNA, 15 bp, Homo sapiens
gctttcctatgactg

SEQ ID NO: 435047 - DNA, 15 bp, Homo sapiens
ctttcctatgactgt

SEQ ID NO: 435048 - DNA, 15 bp, Homo sapiens
tttcctatgactgta

SEQ ID NO: 435049 - DNA, 15 bp, Homo sapiens
ttcctatgactgtat

SEQ ID NO: 435050 - DNA, 15 bp, Homo sapiens
tcctatgactgtata

SEQ ID NO: 435051 - DNA, 15 bp, Homo sapiens
cctatgactgtatag

SEQ ID NO: 435052 - DNA, 15 bp, Homo sapiens
ctatgactgtatagc

SEQ ID NO: 435053 - DNA, 15 bp, Homo sapiens
tatgactgtatagct

SEQ ID NO: 435054 - DNA, 15 bp, Homo sapiens
atgactgtatagctc

SEQ ID NO: 435055 - DNA, 15 bp, Homo sapiens
tgactgtatagctca

SEQ ID NO: 435056 - DNA, 15 bp, Homo sapiens
gactgtatagctcac

SEQ ID NO: 435057 - DNA, 15 bp, Homo sapiens
actgtatagctcaca

SEQ ID NO: 435058 - DNA, 15 bp, Homo sapiens
ctgtatagctcacaa

SEQ ID NO: 435059 - DNA, 15 bp, Homo sapiens
tgtatagctcacaac

SEQ ID NO: 435060 - DNA, 15 bp, Homo sapiens
gtatagctcacaacc

SEQ ID NO: 435061 - DNA, 15 bp, Homo sapiens
tatagctcacaacct

SEQ ID NO: 435062 - DNA, 15 bp, Homo sapiens
atagctcacaacctc

SEQ ID NO: 435063 - DNA, 15 bp, Homo sapiens
tagctcacaacctca

SEQ ID NO: 435064 - DNA, 15 bp, Homo sapiens
agctcacaacctcat

SEQ ID NO: 435065 - DNA, 15 bp, Homo sapiens
gctcacaacctcata

SEQ ID NO: 435066 - DNA, 15 bp, Homo sapiens
ctcacaacctcatac

SEQ ID NO: 435067 - DNA, 15 bp, Homo sapiens
tcacaacctcatacc

SEQ ID NO: 435068 - DNA, 15 bp, Homo sapiens
cacaacctcatacca

SEQ ID NO: 435069 - DNA, 15 bp, Homo sapiens
acaacctcataccag

SEQ ID NO: 435070 - DNA, 15 bp, Homo sapiens
caacctcataccagg

SEQ ID NO: 435071 - DNA, 15 bp, Homo sapiens
aacctcataccagga

SEQ ID NO: 435072 - DNA, 15 bp, Homo sapiens
acctcataccaggaa

SEQ ID NO: 435073 - DNA, 15 bp, Homo sapiens
cctcataccaggaag

SEQ ID NO: 435074 - DNA, 15 bp, Homo sapiens
ctcataccaggaagg

SEQ ID NO: 435075 - DNA, 15 bp, Homo sapiens
tcataccaggaaggg

SEQ ID NO: 435076 - DNA, 15 bp, Homo sapiens
cataccaggaagggc

SEQ ID NO: 435077 - DNA, 15 bp, Homo sapiens
ataccaggaagggct

SEQ ID NO: 435078 - DNA, 15 bp, Homo sapiens
taccaggaagggctc

SEQ ID NO: 435079 - DNA, 15 bp, Homo sapiens
accaggaagggctca

SEQ ID NO: 435080 - DNA, 15 bp, Homo sapiens
ccaggaagggctcac

SEQ ID NO: 435081 - DNA, 15 bp, Homo sapiens
caggaagggctcacc

SEQ ID NO: 435082 - DNA, 15 bp, Homo sapiens
aggaagggctcaccc

SEQ ID NO: 435083 - DNA, 15 bp, Homo sapiens
ggaagggctcaccct

SEQ ID NO: 435084 - DNA, 15 bp, Homo sapiens
gaagggctcaccctt

SEQ ID NO: 435085 - DNA, 15 bp, Homo sapiens
aagggctcacccttc

SEQ ID NO: 435086 - DNA, 15 bp, Homo sapiens
agggctcacccttct

SEQ ID NO: 435087 - DNA, 15 bp, Homo sapiens
gggctcacccttctt

SEQ ID NO: 435088 - DNA, 15 bp, Homo sapiens
ggctcacccttcttt

SEQ ID NO: 435089 - DNA, 15 bp, Homo sapiens
gctcacccttcttta

SEQ ID NO: 435090 - DNA, 15 bp, Homo sapiens
ctcacccttctttag

SEQ ID NO: 435091 - DNA, 15 bp, Homo sapiens
tcacccttctttaga

SEQ ID NO: 435092 - DNA, 15 bp, Homo sapiens
cacccttctttagat

SEQ ID NO: 435093 - DNA, 15 bp, Homo sapiens
acccttctttagatc

SEQ ID NO: 435094 - DNA, 15 bp, Homo sapiens
cccttctttagatcc

SEQ ID NO: 435095 - DNA, 15 bp, Homo sapiens
ccttctttagatcca

SEQ ID NO: 435096 - DNA, 15 bp, Homo sapiens
cttctttagatccag

SEQ ID NO: 435097 - DNA, 15 bp, Homo sapiens
ttctttagatccaga

SEQ ID NO: 435098 - DNA, 15 bp, Homo sapiens
tctttagatccagaa

SEQ ID NO: 435099 - DNA, 15 bp, Homo sapiens
ctttagatccagaat

SEQ ID NO: 435100 - DNA, 15 bp, Homo sapiens
tttagatccagaata

SEQ ID NO: 435101 - DNA, 15 bp, Homo sapiens
ttagatccagaatat

SEQ ID NO: 435102 - DNA, 15 bp, Homo sapiens
tagatccagaatatt

SEQ ID NO: 435103 - DNA, 15 bp, Homo sapiens
agatccagaatattc

SEQ ID NO: 435104 - DNA, 15 bp, Homo sapiens
gatccagaatattcc

SEQ ID NO: 435105 - DNA, 15 bp, Homo sapiens
atccagaatattcca

SEQ ID NO: 435106 - DNA, 15 bp, Homo sapiens
tccagaatattccag

SEQ ID NO: 435107 - DNA, 15 bp, Homo sapiens
ccagaatattccagg

SEQ ID NO: 435108 - DNA, 15 bp, Homo sapiens
cagaatattccagga

SEQ ID NO: 435109 - DNA, 15 bp, Homo sapiens
agaatattccaggag

SEQ ID NO: 435110 - DNA, 15 bp, Homo sapiens
gaatattccaggaga

SEQ ID NO: 435111 - DNA, 15 bp, Homo sapiens
aatattccaggagag

SEQ ID NO: 435112 - DNA, 15 bp, Homo sapiens
atattccaggagagg

SEQ ID NO: 435113 - DNA, 15 bp, Homo sapiens
tattccaggagaggg

SEQ ID NO: 435114 - DNA, 15 bp, Homo sapiens
attccaggagagggc

SEQ ID NO: 435115 - DNA, 15 bp, Homo sapiens
ttccaggagagggct

SEQ ID NO: 435116 - DNA, 15 bp, Homo sapiens
tccaggagagggctc

SEQ ID NO: 435117 - DNA, 15 bp, Homo sapiens
ccaggagagggctct

SEQ ID NO: 435118 - DNA, 15 bp, Homo sapiens
caggagagggctctg

SEQ ID NO: 435119 - DNA, 15 bp, Homo sapiens
aggagagggctctgg

SEQ ID NO: 435120 - DNA, 15 bp, Homo sapiens
ggagagggctctggt

SEQ ID NO: 435121 - DNA, 15 bp, Homo sapiens
gagagggctctggtt

SEQ ID NO: 435122 - DNA, 15 bp, Homo sapiens
agagggctctggttg

SEQ ID NO: 435123 - DNA, 15 bp, Homo sapiens
gagggctctggttga

SEQ ID NO: 435124 - DNA, 15 bp, Homo sapiens
agggctctggttgac

SEQ ID NO: 435125 - DNA, 15 bp, Homo sapiens
gggctctggttgact

SEQ ID NO: 435126 - DNA, 15 bp, Homo sapiens
ggctctggttgactt

SEQ ID NO: 435127 - DNA, 15 bp, Homo sapiens
gctctggttgacttg

SEQ ID NO: 435128 - DNA, 15 bp, Homo sapiens
ctctggttgacttgg

SEQ ID NO: 435129 - DNA, 15 bp, Homo sapiens
tctggttgacttggc

SEQ ID NO: 435130 - DNA, 15 bp, Homo sapiens
ctggttgacttggcc

SEQ ID NO: 435131 - DNA, 15 bp, Homo sapiens
tggttgacttggccc

SEQ ID NO: 435132 - DNA, 15 bp, Homo sapiens
ggttgacttggcccg

SEQ ID NO: 435133 - DNA, 15 bp, Homo sapiens
gttgacttggcccga

SEQ ID NO: 435134 - DNA, 15 bp, Homo sapiens
ttgacttggcccgag

SEQ ID NO: 435135 - DNA, 15 bp, Homo sapiens
tgacttggcccgagt

SEQ ID NO: 435136 - DNA, 15 bp, Homo sapiens
gacttggcccgagta

SEQ ID NO: 435137 - DNA, 15 bp, Homo sapiens
acttggcccgagtaa

SEQ ID NO: 435138 - DNA, 15 bp, Homo sapiens
cttggcccgagtaac

SEQ ID NO: 435139 - DNA, 15 bp, Homo sapiens
ttggcccgagtaaca

SEQ ID NO: 435140 - DNA, 15 bp, Homo sapiens
tggcccgagtaacat

SEQ ID NO: 435141 - DNA, 15 bp, Homo sapiens
ggcccgagtaacatg

SEQ ID NO: 435142 - DNA, 15 bp, Homo sapiens
gcccgagtaacatgg

SEQ ID NO: 435143 - DNA, 15 bp, Homo sapiens
cccgagtaacatggg

SEQ ID NO: 435144 - DNA, 15 bp, Homo sapiens
ccgagtaacatggga

SEQ ID NO: 435145 - DNA, 15 bp, Homo sapiens
cgagtaacatgggac

SEQ ID NO: 435146 - DNA, 15 bp, Homo sapiens
gagtaacatgggact

SEQ ID NO: 435147 - DNA, 15 bp, Homo sapiens
agtaacatgggactc

SEQ ID NO: 435148 - DNA, 15 bp, Homo sapiens
gtaacatgggactca

SEQ ID NO: 435149 - DNA, 15 bp, Homo sapiens
taacatgggactcag

SEQ ID NO: 435150 - DNA, 15 bp, Homo sapiens
aacatgggactcagg

SEQ ID NO: 435151 - DNA, 15 bp, Homo sapiens
acatgggactcaggg

SEQ ID NO: 435152 - DNA, 15 bp, Homo sapiens
catgggactcaggga

SEQ ID NO: 435153 - DNA, 15 bp, Homo sapiens
atgggactcagggac

SEQ ID NO: 435154 - DNA, 15 bp, Homo sapiens
tgggactcagggact

SEQ ID NO: 435155 - DNA, 15 bp, Homo sapiens
gggactcagggactg

SEQ ID NO: 435156 - DNA, 15 bp, Homo sapiens
ggactcagggactgc

SEQ ID NO: 435157 - DNA, 15 bp, Homo sapiens
gactcagggactgct

SEQ ID NO: 435158 - DNA, 15 bp, Homo sapiens
actcagggactgcta

SEQ ID NO: 435159 - DNA, 15 bp, Homo sapiens
ctcagggactgctag

SEQ ID NO: 435160 - DNA, 15 bp, Homo sapiens
tcagggactgctagg

SEQ ID NO: 435161 - DNA, 15 bp, Homo sapiens
cagggactgctagga

SEQ ID NO: 435162 - DNA, 15 bp, Homo sapiens
agggactgctaggat

SEQ ID NO: 435163 - DNA, 15 bp, Homo sapiens
gggactgctaggatt

SEQ ID NO: 435164 - DNA, 15 bp, Homo sapiens
ggactgctaggattg

SEQ ID NO: 435165 - DNA, 15 bp, Homo sapiens
gactgctaggattgg

SEQ ID NO: 435166 - DNA, 15 bp, Homo sapiens
actgctaggattggc

SEQ ID NO: 435167 - DNA, 15 bp, Homo sapiens
ctgctaggattggca

SEQ ID NO: 435168 - DNA, 15 bp, Homo sapiens
tgctaggattggcag

SEQ ID NO: 435169 - DNA, 15 bp, Homo sapiens
gctaggattggcaga

SEQ ID NO: 435170 - DNA, 15 bp, Homo sapiens
ctaggattggcagac

SEQ ID NO: 435171 - DNA, 15 bp, Homo sapiens
taggattggcagacc

SEQ ID NO: 435172 - DNA, 15 bp, Homo sapiens
aggattggcagacct

SEQ ID NO: 435173 - DNA, 15 bp, Homo sapiens
ggattggcagacctt

SEQ ID NO: 435174 - DNA, 15 bp, Homo sapiens
gattggcagaccttc

SEQ ID NO: 435175 - DNA, 15 bp, Homo sapiens
attggcagaccttct

SEQ ID NO: 435176 - DNA, 15 bp, Homo sapiens
ttggcagaccttctt

SEQ ID NO: 435177 - DNA, 15 bp, Homo sapiens
tggcagaccttcttc

SEQ ID NO: 435178 - DNA, 15 bp, Homo sapiens
ggcagaccttcttca

SEQ ID NO: 435179 - DNA, 15 bp, Homo sapiens
gcagaccttcttcat

SEQ ID NO: 435180 - DNA, 15 bp, Homo sapiens
cagaccttcttcata

SEQ ID NO: 435181 - DNA, 15 bp, Homo sapiens
agaccttcttcataa

SEQ ID NO: 435182 - DNA, 15 bp, Homo sapiens
gaccttcttcataat

SEQ ID NO: 435183 - DNA, 15 bp, Homo sapiens
accttcttcataata

SEQ ID NO: 435184 - DNA, 15 bp, Homo sapiens
ccttcttcataatat

SEQ ID NO: 435185 - DNA, 15 bp, Homo sapiens
cttcttcataatatc

SEQ ID NO: 435186 - DNA, 15 bp, Homo sapiens
ttcttcataatatca

SEQ ID NO: 435187 - DNA, 15 bp, Homo sapiens
tcttcataatatcat

SEQ ID NO: 435188 - DNA, 15 bp, Homo sapiens
cttcataatatcatg

SEQ ID NO: 435189 - DNA, 15 bp, Homo sapiens
ttcataatatcatgc

SEQ ID NO: 435190 - DNA, 15 bp, Homo sapiens
tcataatatcatgct

SEQ ID NO: 435191 - DNA, 15 bp, Homo sapiens
cataatatcatgcta

SEQ ID NO: 435192 - DNA, 15 bp, Homo sapiens
ataatatcatgctaa

SEQ ID NO: 435193 - DNA, 15 bp, Homo sapiens
taatatcatgctaaa

SEQ ID NO: 435194 - DNA, 15 bp, Homo sapiens
aatatcatgctaaat

SEQ ID NO: 435195 - DNA, 15 bp, Homo sapiens
atatcatgctaaatg

SEQ ID NO: 435196 - DNA, 15 bp, Homo sapiens
tatcatgctaaatgg

SEQ ID NO: 435197 - DNA, 15 bp, Homo sapiens
atcatgctaaatgga

SEQ ID NO: 435198 - DNA, 15 bp, Homo sapiens
tcatgctaaatggag

SEQ ID NO: 435199 - DNA, 15 bp, Homo sapiens
catgctaaatggagg

SEQ ID NO: 435200 - DNA, 15 bp, Homo sapiens
atgctaaatggagga

SEQ ID NO: 435201 - DNA, 15 bp, Homo sapiens
tgctaaatggaggaa

SEQ ID NO: 435202 - DNA, 15 bp, Homo sapiens
gctaaatggaggaag

SEQ ID NO: 435203 - DNA, 15 bp, Homo sapiens
ctaaatggaggaaga

SEQ ID NO: 435204 - DNA, 15 bp, Homo sapiens
taaatggaggaagaa

SEQ ID NO: 435205 - DNA, 15 bp, Homo sapiens
aaatggaggaagaat

SEQ ID NO: 435206 - DNA, 15 bp, Homo sapiens
aatggaggaagaatc

SEQ ID NO: 435207 - DNA, 15 bp, Homo sapiens
atggaggaagaatcc

SEQ ID NO: 435208 - DNA, 15 bp, Homo sapiens
tggaggaagaatcca

SEQ ID NO: 435209 - DNA, 15 bp, Homo sapiens
ggaggaagaatccaa

SEQ ID NO: 435210 - DNA, 15 bp, Homo sapiens
gaggaagaatccaat

SEQ ID NO: 435211 - DNA, 15 bp, Homo sapiens
aggaagaatccaatc

SEQ ID NO: 435212 - DNA, 15 bp, Homo sapiens
ggaagaatccaatcc

SEQ ID NO: 435213 - DNA, 15 bp, Homo sapiens
gaagaatccaatccc

SEQ ID NO: 435214 - DNA, 15 bp, Homo sapiens
aagaatccaatccca

SEQ ID NO: 435215 - DNA, 15 bp, Homo sapiens
agaatccaatcccat

SEQ ID NO: 435216 - DNA, 15 bp, Homo sapiens
gaatccaatcccata

SEQ ID NO: 435217 - DNA, 15 bp, Homo sapiens
aatccaatcccataa

SEQ ID NO: 435218 - DNA, 15 bp, Homo sapiens
atccaatcccataaa

SEQ ID NO: 435219 - DNA, 15 bp, Homo sapiens
tccaatcccataaag

SEQ ID NO: 435220 - DNA, 15 bp, Homo sapiens
ccaatcccataaagg

SEQ ID NO: 435221 - DNA, 15 bp, Homo sapiens
caatcccataaagga

SEQ ID NO: 435222 - DNA, 15 bp, Homo sapiens
aatcccataaaggaa

SEQ ID NO: 435223 - DNA, 15 bp, Homo sapiens
atcccataaaggaag

SEQ ID NO: 435224 - DNA, 15 bp, Homo sapiens
tcccataaaggaagg

SEQ ID NO: 435225 - DNA, 15 bp, Homo sapiens
cccataaaggaaggg

SEQ ID NO: 435226 - DNA, 15 bp, Homo sapiens
ccataaaggaagggg

SEQ ID NO: 435227 - DNA, 15 bp, Homo sapiens
cataaaggaagggga

SEQ ID NO: 435228 - DNA, 15 bp, Homo sapiens
ataaaggaaggggaa

SEQ ID NO: 435229 - DNA, 15 bp, Homo sapiens
taaaggaaggggaaa

SEQ ID NO: 435230 - DNA, 15 bp, Homo sapiens
aaaggaaggggaaag

SEQ ID NO: 435231 - DNA, 15 bp, Homo sapiens
aaggaaggggaaagt

SEQ ID NO: 435232 - DNA, 15 bp, Homo sapiens
aggaaggggaaagtg

SEQ ID NO: 435233 - DNA, 15 bp, Homo sapiens
ggaaggggaaagtga

SEQ ID NO: 435234 - DNA, 15 bp, Homo sapiens
gaaggggaaagtgaa

SEQ ID NO: 435235 - DNA, 15 bp, Homo sapiens
aggggaaagtgaaaa

SEQ ID NO: 435236 - DNA, 15 bp, Homo sapiens
ggggaaagtgaaaaa

SEQ ID NO: 435237 - DNA, 15 bp, Homo sapiens
gggaaagtgaaaaat

SEQ ID NO: 435238 - DNA, 15 bp, Homo sapiens
ggaaagtgaaaaatg

SEQ ID NO: 435239 - DNA, 15 bp, Homo sapiens
agtgaaaaatggtag

SEQ ID NO: 435240 - DNA, 15 bp, Homo sapiens
gtgaaaaatggtagt

SEQ ID NO: 435241 - DNA, 15 bp, Homo sapiens
tgaaaaatggtagta

SEQ ID NO: 435242 - DNA, 15 bp, Homo sapiens
gaaaaatggtagtaa

SEQ ID NO: 435243 - DNA, 15 bp, Homo sapiens
aaaaatggtagtaaa

SEQ ID NO: 435244 - DNA, 15 bp, Homo sapiens
aaaatggtagtaaat

SEQ ID NO: 435245 - DNA, 15 bp, Homo sapiens
aaatggtagtaaatg

SEQ ID NO: 435246 - DNA, 15 bp, Homo sapiens
aatggtagtaaatgc

SEQ ID NO: 435247 - DNA, 15 bp, Homo sapiens
atggtagtaaatgca

SEQ ID NO: 435248 - DNA, 15 bp, Homo sapiens
tggtagtaaatgcag

SEQ ID NO: 435249 - DNA, 15 bp, Homo sapiens
ggtagtaaatgcaga

SEQ ID NO: 435250 - DNA, 15 bp, Homo sapiens
gtagtaaatgcagac

SEQ ID NO: 435251 - DNA, 15 bp, Homo sapiens
tagtaaatgcagaca

SEQ ID NO: 435252 - DNA, 15 bp, Homo sapiens
agtaaatgcagacat

SEQ ID NO: 435253 - DNA, 15 bp, Homo sapiens
gtaaatgcagacatt

SEQ ID NO: 435254 - DNA, 15 bp, Homo sapiens
taaatgcagacattc

SEQ ID NO: 435255 - DNA, 15 bp, Homo sapiens
aaatgcagacattcc

SEQ ID NO: 435256 - DNA, 15 bp, Homo sapiens
aatgcagacattccc

SEQ ID NO: 435257 - DNA, 15 bp, Homo sapiens
atgcagacattccca

SEQ ID NO: 435258 - DNA, 15 bp, Homo sapiens
tgcagacattcccaa

SEQ ID NO: 435259 - DNA, 15 bp, Homo sapiens
gcagacattcccaac

SEQ ID NO: 435260 - DNA, 15 bp, Homo sapiens
cagacattcccaaca

SEQ ID NO: 435261 - DNA, 15 bp, Homo sapiens
agacattcccaacaa

SEQ ID NO: 435262 - DNA, 15 bp, Homo sapiens
gacattcccaacaag

SEQ ID NO: 435263 - DNA, 15 bp, Homo sapiens
acattcccaacaagc

SEQ ID NO: 435264 - DNA, 15 bp, Homo sapiens
cattcccaacaagcc

SEQ ID NO: 435265 - DNA, 15 bp, Homo sapiens
attcccaacaagcca

SEQ ID NO: 435266 - DNA, 15 bp, Homo sapiens
ttcccaacaagccag

SEQ ID NO: 435267 - DNA, 15 bp, Homo sapiens
tcccaacaagccaga

SEQ ID NO: 435268 - DNA, 15 bp, Homo sapiens
cccaacaagccagaa

SEQ ID NO: 435269 - DNA, 15 bp, Homo sapiens
ccaacaagccagaat

SEQ ID NO: 435270 - DNA, 15 bp, Homo sapiens
caacaagccagaatt

SEQ ID NO: 435271 - DNA, 15 bp, Homo sapiens
aacaagccagaattt

SEQ ID NO: 435272 - DNA, 15 bp, Homo sapiens
acaagccagaatttc

SEQ ID NO: 435273 - DNA, 15 bp, Homo sapiens
caagccagaatttca

SEQ ID NO: 435274 - DNA, 15 bp, Homo sapiens
aagccagaatttcac

SEQ ID NO: 435275 - DNA, 15 bp, Homo sapiens
agccagaatttcaca

SEQ ID NO: 435276 - DNA, 15 bp, Homo sapiens
gccagaatttcacag

SEQ ID NO: 435277 - DNA, 15 bp, Homo sapiens
ccagaatttcacagg

SEQ ID NO: 435278 - DNA, 15 bp, Homo sapiens
cagaatttcacaggt

SEQ ID NO: 435279 - DNA, 15 bp, Homo sapiens
agaatttcacaggtg

SEQ ID NO: 435280 - DNA, 15 bp, Homo sapiens
gaatttcacaggtgc

SEQ ID NO: 435281 - DNA, 15 bp, Homo sapiens
aatttcacaggtgct

SEQ ID NO: 435282 - DNA, 15 bp, Homo sapiens
atttcacaggtgctg

SEQ ID NO: 435283 - DNA, 15 bp, Homo sapiens
tttcacaggtgctga

SEQ ID NO: 435284 - DNA, 15 bp, Homo sapiens
ttcacaggtgctgac

SEQ ID NO: 435285 - DNA, 15 bp, Homo sapiens
tcacaggtgctgacc

SEQ ID NO: 435286 - DNA, 15 bp, Homo sapiens
cacaggtgctgacca

SEQ ID NO: 435287 - DNA, 15 bp, Homo sapiens
acaggtgctgaccat

SEQ ID NO: 435288 - DNA, 15 bp, Homo sapiens
caggtgctgaccatg

SEQ ID NO: 435289 - DNA, 15 bp, Homo sapiens
aggtgctgaccatgt

SEQ ID NO: 435290 - DNA, 15 bp, Homo sapiens
ggtgctgaccatgtg

SEQ ID NO: 435291 - DNA, 15 bp, Homo sapiens
gtgctgaccatgtgc

SEQ ID NO: 435292 - DNA, 15 bp, Homo sapiens
tgctgaccatgtgcc

SEQ ID NO: 435293 - DNA, 15 bp, Homo sapiens
gctgaccatgtgcca

SEQ ID NO: 435294 - DNA, 15 bp, Homo sapiens
ctgaccatgtgccac

SEQ ID NO: 435295 - DNA, 15 bp, Homo sapiens
tgaccatgtgccaca

SEQ ID NO: 435296 - DNA, 15 bp, Homo sapiens
gaccatgtgccacac

SEQ ID NO: 435297 - DNA, 15 bp, Homo sapiens
accatgtgccacaca

SEQ ID NO: 435298 - DNA, 15 bp, Homo sapiens
ccatgtgccacacac

SEQ ID NO: 435299 - DNA, 15 bp, Homo sapiens
catgtgccacacact

SEQ ID NO: 435300 - DNA, 15 bp, Homo sapiens
atgtgccacacactg

SEQ ID NO: 435301 - DNA, 15 bp, Homo sapiens
tgtgccacacactgt

SEQ ID NO: 435302 - DNA, 15 bp, Homo sapiens
gtgccacacactgtg

SEQ ID NO: 435303 - DNA, 15 bp, Homo sapiens
tgccacacactgtgc

SEQ ID NO: 435304 - DNA, 15 bp, Homo sapiens
gccacacactgtgcc

SEQ ID NO: 435305 - DNA, 15 bp, Homo sapiens
ccacacactgtgcca

SEQ ID NO: 435306 - DNA, 15 bp, Homo sapiens
cacacactgtgccaa

SEQ ID NO: 435307 - DNA, 15 bp, Homo sapiens
acacactgtgccaag

SEQ ID NO: 435308 - DNA, 15 bp, Homo sapiens
cacactgtgccaaga

SEQ ID NO: 435309 - DNA, 15 bp, Homo sapiens
acactgtgccaagaa

SEQ ID NO: 435310 - DNA, 15 bp, Homo sapiens
cactgtgccaagaaa

SEQ ID NO: 435311 - DNA, 15 bp, Homo sapiens
actgtgccaagaaac

SEQ ID NO: 435312 - DNA, 15 bp, Homo sapiens
ctgtgccaagaaact

SEQ ID NO: 435313 - DNA, 15 bp, Homo sapiens
tgtgccaagaaactt

SEQ ID NO: 435314 - DNA, 15 bp, Homo sapiens
gtgccaagaaactta

SEQ ID NO: 435315 - DNA, 15 bp, Homo sapiens
tgccaagaaacttac

SEQ ID NO: 435316 - DNA, 15 bp, Homo sapiens
gccaagaaacttacc

SEQ ID NO: 435317 - DNA, 15 bp, Homo sapiens
ccaagaaacttacct

SEQ ID NO: 435318 - DNA, 15 bp, Homo sapiens
caagaaacttaccta

SEQ ID NO: 435319 - DNA, 15 bp, Homo sapiens
aagaaacttacctac

SEQ ID NO: 435320 - DNA, 15 bp, Homo sapiens
agaaacttacctacc

SEQ ID NO: 435321 - DNA, 15 bp, Homo sapiens
gaaacttacctacct

SEQ ID NO: 435322 - DNA, 15 bp, Homo sapiens
aaacttacctacctt

SEQ ID NO: 435323 - DNA, 15 bp, Homo sapiens
aacttacctaccttg

SEQ ID NO: 435324 - DNA, 15 bp, Homo sapiens
acttacctaccttgt

SEQ ID NO: 435325 - DNA, 15 bp, Homo sapiens
cttacctaccttgtt

SEQ ID NO: 435326 - DNA, 15 bp, Homo sapiens
ttacctaccttgttt

SEQ ID NO: 435327 - DNA, 15 bp, Homo sapiens
tacctaccttgttta

SEQ ID NO: 435328 - DNA, 15 bp, Homo sapiens
acctaccttgtttaa

SEQ ID NO: 435329 - DNA, 15 bp, Homo sapiens
cctaccttgtttaat

SEQ ID NO: 435330 - DNA, 15 bp, Homo sapiens
ctaccttgtttaatt

SEQ ID NO: 435331 - DNA, 15 bp, Homo sapiens
taccttgtttaattg

SEQ ID NO: 435332 - DNA, 15 bp, Homo sapiens
accttgtttaattgc

SEQ ID NO: 435333 - DNA, 15 bp, Homo sapiens
ccttgtttaattgca

SEQ ID NO: 435334 - DNA, 15 bp, Homo sapiens
cttgtttaattgcat

SEQ ID NO: 435335 - DNA, 15 bp, Homo sapiens
ttgtttaattgcatt

SEQ ID NO: 435336 - DNA, 15 bp, Homo sapiens
tgtttaattgcattc

SEQ ID NO: 435337 - DNA, 15 bp, Homo sapiens
gtttaattgcattct

SEQ ID NO: 435338 - DNA, 15 bp, Homo sapiens
tttaattgcattctc

SEQ ID NO: 435339 - DNA, 15 bp, Homo sapiens
ttaattgcattctca

SEQ ID NO: 435340 - DNA, 15 bp, Homo sapiens
taattgcattctcat

SEQ ID NO: 435341 - DNA, 15 bp, Homo sapiens
aattgcattctcata

SEQ ID NO: 435342 - DNA, 15 bp, Homo sapiens
attgcattctcataa

SEQ ID NO: 435343 - DNA, 15 bp, Homo sapiens
ttgcattctcataat

SEQ ID NO: 435344 - DNA, 15 bp, Homo sapiens
tgcattctcataata

SEQ ID NO: 435345 - DNA, 15 bp, Homo sapiens
gcattctcataataa

SEQ ID NO: 435346 - DNA, 15 bp, Homo sapiens
cattctcataataat

SEQ ID NO: 435347 - DNA, 15 bp, Homo sapiens
attctcataataatt

SEQ ID NO: 435348 - DNA, 15 bp, Homo sapiens
ttctcataataattc

SEQ ID NO: 435349 - DNA, 15 bp, Homo sapiens
tctcataataattcc

SEQ ID NO: 435350 - DNA, 15 bp, Homo sapiens
ctcataataattcct

SEQ ID NO: 435351 - DNA, 15 bp, Homo sapiens
tcataataattcctt

SEQ ID NO: 435352 - DNA, 15 bp, Homo sapiens
cataataattccttg

SEQ ID NO: 435353 - DNA, 15 bp, Homo sapiens
ataataattccttga

SEQ ID NO: 435354 - DNA, 15 bp, Homo sapiens
taataattccttgaa

SEQ ID NO: 435355 - DNA, 15 bp, Homo sapiens
aataattccttgaag

SEQ ID NO: 435356 - DNA, 15 bp, Homo sapiens
ataattccttgaagg

SEQ ID NO: 435357 - DNA, 15 bp, Homo sapiens
taattccttgaaggg

SEQ ID NO: 435358 - DNA, 15 bp, Homo sapiens
aattccttgaagggt

SEQ ID NO: 435359 - DNA, 15 bp, Homo sapiens
attccttgaagggtg

SEQ ID NO: 435360 - DNA, 15 bp, Homo sapiens
ttccttgaagggtga

SEQ ID NO: 435361 - DNA, 15 bp, Homo sapiens
tccttgaagggtgaa

SEQ ID NO: 435362 - DNA, 15 bp, Homo sapiens
ccttgaagggtgaat

SEQ ID NO: 435363 - DNA, 15 bp, Homo sapiens
cttgaagggtgaata

SEQ ID NO: 435364 - DNA, 15 bp, Homo sapiens
ttgaagggtgaatac

SEQ ID NO: 435365 - DNA, 15 bp, Homo sapiens
tgaagggtgaatact

SEQ ID NO: 435366 - DNA, 15 bp, Homo sapiens
gaagggtgaatactt

SEQ ID NO: 435367 - DNA, 15 bp, Homo sapiens
aagggtgaatactta

SEQ ID NO: 435368 - DNA, 15 bp, Homo sapiens
agggtgaatacttac

SEQ ID NO: 435369 - DNA, 15 bp, Homo sapiens
gggtgaatacttacc

SEQ ID NO: 435370 - DNA, 15 bp, Homo sapiens
ggtgaatacttacca

SEQ ID NO: 435371 - DNA, 15 bp, Homo sapiens
gtgaatacttaccac

SEQ ID NO: 435372 - DNA, 15 bp, Homo sapiens
tgaatacttaccacc

SEQ ID NO: 435373 - DNA, 15 bp, Homo sapiens
gaatacttaccaccc

SEQ ID NO: 435374 - DNA, 15 bp, Homo sapiens
aatacttaccaccca

SEQ ID NO: 435375 - DNA, 15 bp, Homo sapiens
atacttaccacccat

SEQ ID NO: 435376 - DNA, 15 bp, Homo sapiens
tacttaccacccatt

SEQ ID NO: 435377 - DNA, 15 bp, Homo sapiens
acttaccacccattc

SEQ ID NO: 435378 - DNA, 15 bp, Homo sapiens
cttaccacccattct

SEQ ID NO: 435379 - DNA, 15 bp, Homo sapiens
ttaccacccattcta

SEQ ID NO: 435380 - DNA, 15 bp, Homo sapiens
taccacccattctac

SEQ ID NO: 435381 - DNA, 15 bp, Homo sapiens
accacccattctaca

SEQ ID NO: 435382 - DNA, 15 bp, Homo sapiens
ccacccattctacag

SEQ ID NO: 435383 - DNA, 15 bp, Homo sapiens
cacccattctacaga

SEQ ID NO: 435384 - DNA, 15 bp, Homo sapiens
acccattctacagat

SEQ ID NO: 435385 - DNA, 15 bp, Homo sapiens
cccattctacagatg

SEQ ID NO: 435386 - DNA, 15 bp, Homo sapiens
ccattctacagatga

SEQ ID NO: 435387 - DNA, 15 bp, Homo sapiens
cattctacagatgag

SEQ ID NO: 435388 - DNA, 15 bp, Homo sapiens
attctacagatgagg

SEQ ID NO: 435389 - DNA, 15 bp, Homo sapiens
ttctacagatgagga

SEQ ID NO: 435390 - DNA, 15 bp, Homo sapiens
tctacagatgaggaa

SEQ ID NO: 435391 - DNA, 15 bp, Homo sapiens
ctacagatgaggaaa

SEQ ID NO: 435392 - DNA, 15 bp, Homo sapiens
tacagatgaggaaac

SEQ ID NO: 435393 - DNA, 15 bp, Homo sapiens
acagatgaggaaact

SEQ ID NO: 435394 - DNA, 15 bp, Homo sapiens
cagatgaggaaactg

SEQ ID NO: 435395 - DNA, 15 bp, Homo sapiens
agatgaggaaactga

SEQ ID NO: 435396 - DNA, 15 bp, Homo sapiens
gatgaggaaactgag

SEQ ID NO: 435397 - DNA, 15 bp, Homo sapiens
tgaggaaactgagag

SEQ ID NO: 435398 - DNA, 15 bp, Homo sapiens
gaggaaactgagagt

SEQ ID NO: 435399 - DNA, 15 bp, Homo sapiens
aggaaactgagagtc

SEQ ID NO: 435400 - DNA, 15 bp, Homo sapiens
ggaaactgagagtct

SEQ ID NO: 435401 - DNA, 15 bp, Homo sapiens
gaaactgagagtctg

SEQ ID NO: 435402 - DNA, 15 bp, Homo sapiens
aaactgagagtctga

SEQ ID NO: 435403 - DNA, 15 bp, Homo sapiens
aactgagagtctgag

SEQ ID NO: 435404 - DNA, 15 bp, Homo sapiens
actgagagtctgaga

SEQ ID NO: 435405 - DNA, 15 bp, Homo sapiens
ctgagagtctgagag

SEQ ID NO: 435406 - DNA, 15 bp, Homo sapiens
tgagagtctgagagg

SEQ ID NO: 435407 - DNA, 15 bp, Homo sapiens
gagagtctgagaggc

SEQ ID NO: 435408 - DNA, 15 bp, Homo sapiens
agagtctgagaggct

SEQ ID NO: 435409 - DNA, 15 bp, Homo sapiens
gagtctgagaggctt

SEQ ID NO: 435410 - DNA, 15 bp, Homo sapiens
agtctgagaggctta

SEQ ID NO: 435411 - DNA, 15 bp, Homo sapiens
gtctgagaggcttag

SEQ ID NO: 435412 - DNA, 15 bp, Homo sapiens
tctgagaggcttaga

SEQ ID NO: 435413 - DNA, 15 bp, Homo sapiens
ctgagaggcttagag

SEQ ID NO: 435414 - DNA, 15 bp, Homo sapiens
tgagaggcttagagg

SEQ ID NO: 435415 - DNA, 15 bp, Homo sapiens
gagaggcttagaggc

SEQ ID NO: 435416 - DNA, 15 bp, Homo sapiens
agaggcttagaggca

SEQ ID NO: 435417 - DNA, 15 bp, Homo sapiens
gaggcttagaggcat

SEQ ID NO: 435418 - DNA, 15 bp, Homo sapiens
aggcttagaggcata

SEQ ID NO: 435419 - DNA, 15 bp, Homo sapiens
ggcttagaggcatac

SEQ ID NO: 435420 - DNA, 15 bp, Homo sapiens
gcttagaggcatact

SEQ ID NO: 435421 - DNA, 15 bp, Homo sapiens
cttagaggcatactg

SEQ ID NO: 435422 - DNA, 15 bp, Homo sapiens
ttagaggcatactgt

SEQ ID NO: 435423 - DNA, 15 bp, Homo sapiens
tagaggcatactgtc

SEQ ID NO: 435424 - DNA, 15 bp, Homo sapiens
agaggcatactgtct

SEQ ID NO: 435425 - DNA, 15 bp, Homo sapiens
gaggcatactgtctt

SEQ ID NO: 435426 - DNA, 15 bp, Homo sapiens
aggcatactgtcttc

SEQ ID NO: 435427 - DNA, 15 bp, Homo sapiens
ggcatactgtcttct

SEQ ID NO: 435428 - DNA, 15 bp, Homo sapiens
gcatactgtcttcta

SEQ ID NO: 435429 - DNA, 15 bp, Homo sapiens
catactgtcttctat

SEQ ID NO: 435430 - DNA, 15 bp, Homo sapiens
atactgtcttctatg

SEQ ID NO: 435431 - DNA, 15 bp, Homo sapiens
tactgtcttctatgt

SEQ ID NO: 435432 - DNA, 15 bp, Homo sapiens
actgtcttctatgtg

SEQ ID NO: 435433 - DNA, 15 bp, Homo sapiens
ctgtcttctatgtga

SEQ ID NO: 435434 - DNA, 15 bp, Homo sapiens
tgtcttctatgtgac

SEQ ID NO: 435435 - DNA, 15 bp, Homo sapiens
gtcttctatgtgaca

SEQ ID NO: 435436 - DNA, 15 bp, Homo sapiens
tcttctatgtgacag

SEQ ID NO: 435437 - DNA, 15 bp, Homo sapiens
cttctatgtgacaga

SEQ ID NO: 435438 - DNA, 15 bp, Homo sapiens
ttctatgtgacagag

SEQ ID NO: 435439 - DNA, 15 bp, Homo sapiens
tctatgtgacagagc

SEQ ID NO: 435440 - DNA, 15 bp, Homo sapiens
ctatgtgacagagcc

SEQ ID NO: 435441 - DNA, 15 bp, Homo sapiens
tatgtgacagagcca

SEQ ID NO: 435442 - DNA, 15 bp, Homo sapiens
atgtgacagagccaa

SEQ ID NO: 435443 - DNA, 15 bp, Homo sapiens
tgtgacagagccaaa

SEQ ID NO: 435444 - DNA, 15 bp, Homo sapiens
gtgacagagccaaaa

SEQ ID NO: 435445 - DNA, 15 bp, Homo sapiens
tgacagagccaaaat

SEQ ID NO: 435446 - DNA, 15 bp, Homo sapiens
gacagagccaaaata

SEQ ID NO: 435447 - DNA, 15 bp, Homo sapiens
acagagccaaaatac

SEQ ID NO: 435448 - DNA, 15 bp, Homo sapiens
cagagccaaaataca

SEQ ID NO: 435449 - DNA, 15 bp, Homo sapiens
agagccaaaatacaa

SEQ ID NO: 435450 - DNA, 15 bp, Homo sapiens
gagccaaaatacaaa

SEQ ID NO: 435451 - DNA, 15 bp, Homo sapiens
agccaaaatacaaac

SEQ ID NO: 435452 - DNA, 15 bp, Homo sapiens
gccaaaatacaaact

SEQ ID NO: 435453 - DNA, 15 bp, Homo sapiens
ccaaaatacaaacta

SEQ ID NO: 435454 - DNA, 15 bp, Homo sapiens
caaaatacaaactaa

SEQ ID NO: 435455 - DNA, 15 bp, Homo sapiens
aaaatacaaactaag

SEQ ID NO: 435456 - DNA, 15 bp, Homo sapiens
aaatacaaactaagg

SEQ ID NO: 435457 - DNA, 15 bp, Homo sapiens
aatacaaactaaggc

SEQ ID NO: 435458 - DNA, 15 bp, Homo sapiens
atacaaactaaggct

SEQ ID NO: 435459 - DNA, 15 bp, Homo sapiens
tacaaactaaggctt

SEQ ID NO: 435460 - DNA, 15 bp, Homo sapiens
acaaactaaggctta

SEQ ID NO: 435461 - DNA, 15 bp, Homo sapiens
caaactaaggcttat

SEQ ID NO: 435462 - DNA, 15 bp, Homo sapiens
aaactaaggcttatg

SEQ ID NO: 435463 - DNA, 15 bp, Homo sapiens
aactaaggcttatgt

SEQ ID NO: 435464 - DNA, 15 bp, Homo sapiens
actaaggcttatgtc

SEQ ID NO: 435465 - DNA, 15 bp, Homo sapiens
ctaaggcttatgtca

SEQ ID NO: 435466 - DNA, 15 bp, Homo sapiens
taaggcttatgtcac

SEQ ID NO: 435467 - DNA, 15 bp, Homo sapiens
aaggcttatgtcaca

SEQ ID NO: 435468 - DNA, 15 bp, Homo sapiens
aggcttatgtcacaa

SEQ ID NO: 435469 - DNA, 15 bp, Homo sapiens
ggcttatgtcacaaa

SEQ ID NO: 435470 - DNA, 15 bp, Homo sapiens
gcttatgtcacaaaa

SEQ ID NO: 435471 - DNA, 15 bp, Homo sapiens
cttatgtcacaaaac

SEQ ID NO: 435472 - DNA, 15 bp, Homo sapiens
ttatgtcacaaaact

SEQ ID NO: 435473 - DNA, 15 bp, Homo sapiens
tatgtcacaaaactt

SEQ ID NO: 435474 - DNA, 15 bp, Homo sapiens
atgtcacaaaacttg

SEQ ID NO: 435475 - DNA, 15 bp, Homo sapiens
tgtcacaaaacttga

SEQ ID NO: 435476 - DNA, 15 bp, Homo sapiens
gtcacaaaacttgat

SEQ ID NO: 435477 - DNA, 15 bp, Homo sapiens
tcacaaaacttgatg

SEQ ID NO: 435478 - DNA, 15 bp, Homo sapiens
cacaaaacttgatgc

SEQ ID NO: 435479 - DNA, 15 bp, Homo sapiens
acaaaacttgatgct

SEQ ID NO: 435480 - DNA, 15 bp, Homo sapiens
caaaacttgatgctc

SEQ ID NO: 435481 - DNA, 15 bp, Homo sapiens
aaaacttgatgctct

SEQ ID NO: 435482 - DNA, 15 bp, Homo sapiens
aaacttgatgctctt

SEQ ID NO: 435483 - DNA, 15 bp, Homo sapiens
aacttgatgctctta

SEQ ID NO: 435484 - DNA, 15 bp, Homo sapiens
acttgatgctcttaa

SEQ ID NO: 435485 - DNA, 15 bp, Homo sapiens
cttgatgctcttaac

SEQ ID NO: 435486 - DNA, 15 bp, Homo sapiens
ttgatgctcttaact

SEQ ID NO: 435487 - DNA, 15 bp, Homo sapiens
tgatgctcttaactg

SEQ ID NO: 435488 - DNA, 15 bp, Homo sapiens
gatgctcttaactgc

SEQ ID NO: 435489 - DNA, 15 bp, Homo sapiens
atgctcttaactgcc

SEQ ID NO: 435490 - DNA, 15 bp, Homo sapiens
tgctcttaactgcca

SEQ ID NO: 435491 - DNA, 15 bp, Homo sapiens
gctcttaactgccat

SEQ ID NO: 435492 - DNA, 15 bp, Homo sapiens
ctcttaactgccata

SEQ ID NO: 435493 - DNA, 15 bp, Homo sapiens
tcttaactgccatag

SEQ ID NO: 435494 - DNA, 15 bp, Homo sapiens
cttaactgccatagt

SEQ ID NO: 435495 - DNA, 15 bp, Homo sapiens
ttaactgccatagtg

SEQ ID NO: 435496 - DNA, 15 bp, Homo sapiens
taactgccatagtgt

SEQ ID NO: 435497 - DNA, 15 bp, Homo sapiens
aactgccatagtgta

SEQ ID NO: 435498 - DNA, 15 bp, Homo sapiens
actgccatagtgtac

SEQ ID NO: 435499 - DNA, 15 bp, Homo sapiens
ctgccatagtgtact

SEQ ID NO: 435500 - DNA, 15 bp, Homo sapiens
tgccatagtgtacta

SEQ ID NO: 435501 - DNA, 15 bp, Homo sapiens
gccatagtgtactat

SEQ ID NO: 435502 - DNA, 15 bp, Homo sapiens
ccatagtgtactatc

SEQ ID NO: 435503 - DNA, 15 bp, Homo sapiens
catagtgtactatct

SEQ ID NO: 435504 - DNA, 15 bp, Homo sapiens
atagtgtactatctt

SEQ ID NO: 435505 - DNA, 15 bp, Homo sapiens
tagtgtactatctta

SEQ ID NO: 435506 - DNA, 15 bp, Homo sapiens
agtgtactatcttaa

SEQ ID NO: 435507 - DNA, 15 bp, Homo sapiens
gtgtactatcttaaa

SEQ ID NO: 435508 - DNA, 15 bp, Homo sapiens
tgtactatcttaaac

SEQ ID NO: 435509 - DNA, 15 bp, Homo sapiens
gtactatcttaaact

SEQ ID NO: 435510 - DNA, 15 bp, Homo sapiens
tactatcttaaacta

SEQ ID NO: 435511 - DNA, 15 bp, Homo sapiens
actatcttaaactac

SEQ ID NO: 435512 - DNA, 15 bp, Homo sapiens
ctatcttaaactact

SEQ ID NO: 435513 - DNA, 15 bp, Homo sapiens
tatcttaaactactt

SEQ ID NO: 435514 - DNA, 15 bp, Homo sapiens
atcttaaactacttc

SEQ ID NO: 435515 - DNA, 15 bp, Homo sapiens
tcttaaactacttcc

SEQ ID NO: 435516 - DNA, 15 bp, Homo sapiens
cttaaactacttccg

SEQ ID NO: 435517 - DNA, 15 bp, Homo sapiens
ttaaactacttccgt

SEQ ID NO: 435518 - DNA, 15 bp, Homo sapiens
taaactacttccgta

SEQ ID NO: 435519 - DNA, 15 bp, Homo sapiens
aaactacttccgtaa

SEQ ID NO: 435520 - DNA, 15 bp, Homo sapiens
aactacttccgtaat

SEQ ID NO: 435521 - DNA, 15 bp, Homo sapiens
actacttccgtaata

SEQ ID NO: 435522 - DNA, 15 bp, Homo sapiens
ctacttccgtaataa

SEQ ID NO: 435523 - DNA, 15 bp, Homo sapiens
tacttccgtaataat

SEQ ID NO: 435524 - DNA, 15 bp, Homo sapiens
acttccgtaataatt

SEQ ID NO: 435525 - DNA, 15 bp, Homo sapiens
cttccgtaataatta

SEQ ID NO: 435526 - DNA, 15 bp, Homo sapiens
ttccgtaataattag

SEQ ID NO: 435527 - DNA, 15 bp, Homo sapiens
tccgtaataattagt

SEQ ID NO: 435528 - DNA, 15 bp, Homo sapiens
ccgtaataattagta

SEQ ID NO: 435529 - DNA, 15 bp, Homo sapiens
cgtaataattagtat

SEQ ID NO: 435530 - DNA, 15 bp, Homo sapiens
gtaataattagtatt

SEQ ID NO: 435531 - DNA, 15 bp, Homo sapiens
ataattagtatttgt

SEQ ID NO: 435532 - DNA, 15 bp, Homo sapiens
taattagtatttgta

SEQ ID NO: 435533 - DNA, 15 bp, Homo sapiens
aattagtatttgtag

SEQ ID NO: 435534 - DNA, 15 bp, Homo sapiens
attagtatttgtagc

SEQ ID NO: 435535 - DNA, 15 bp, Homo sapiens
ttagtatttgtagct

SEQ ID NO: 435536 - DNA, 15 bp, Homo sapiens
tagtatttgtagcta

SEQ ID NO: 435537 - DNA, 15 bp, Homo sapiens
agtatttgtagctat

SEQ ID NO: 435538 - DNA, 15 bp, Homo sapiens
gtatttgtagctatt

SEQ ID NO: 435539 - DNA, 15 bp, Homo sapiens
tatttgtagctattc

SEQ ID NO: 435540 - DNA, 15 bp, Homo sapiens
atttgtagctattca

SEQ ID NO: 435541 - DNA, 15 bp, Homo sapiens
tttgtagctattcaa

SEQ ID NO: 435542 - DNA, 15 bp, Homo sapiens
ttgtagctattcaat

SEQ ID NO: 435543 - DNA, 15 bp, Homo sapiens
tgtagctattcaata

SEQ ID NO: 435544 - DNA, 15 bp, Homo sapiens
gtagctattcaatag

SEQ ID NO: 435545 - DNA, 15 bp, Homo sapiens
tagctattcaataga

SEQ ID NO: 435546 - DNA, 15 bp, Homo sapiens
agctattcaatagaa

SEQ ID NO: 435547 - DNA, 15 bp, Homo sapiens
gctattcaatagaaa

SEQ ID NO: 435548 - DNA, 15 bp, Homo sapiens
ctattcaatagaaac

SEQ ID NO: 435549 - DNA, 15 bp, Homo sapiens
tattcaatagaaaca

SEQ ID NO: 435550 - DNA, 15 bp, Homo sapiens
attcaatagaaacaa

SEQ ID NO: 435551 - DNA, 15 bp, Homo sapiens
ttcaatagaaacaac

SEQ ID NO: 435552 - DNA, 15 bp, Homo sapiens
tcaatagaaacaaca

SEQ ID NO: 435553 - DNA, 15 bp, Homo sapiens
caatagaaacaacat

SEQ ID NO: 435554 - DNA, 15 bp, Homo sapiens
aatagaaacaacatt

SEQ ID NO: 435555 - DNA, 15 bp, Homo sapiens
atagaaacaacattt

SEQ ID NO: 435556 - DNA, 15 bp, Homo sapiens
tagaaacaacatttt

SEQ ID NO: 435557 - DNA, 15 bp, Homo sapiens
agaaacaacatttta

SEQ ID NO: 435558 - DNA, 15 bp, Homo sapiens
gaaacaacattttat

SEQ ID NO: 435559 - DNA, 15 bp, Homo sapiens
aaacaacattttatt

SEQ ID NO: 435560 - DNA, 15 bp, Homo sapiens
aacaacattttattt

SEQ ID NO: 435561 - DNA, 15 bp, Homo sapiens
acaacattttatttt

SEQ ID NO: 435562 - DNA, 15 bp, Homo sapiens
caacattttattttc

SEQ ID NO: 435563 - DNA, 15 bp, Homo sapiens
aacattttattttca

SEQ ID NO: 435564 - DNA, 15 bp, Homo sapiens
acattttattttcat

SEQ ID NO: 435565 - DNA, 15 bp, Homo sapiens
cattttattttcatt

SEQ ID NO: 435566 - DNA, 15 bp, Homo sapiens
attttcattttcttc

SEQ ID NO: 435567 - DNA, 15 bp, Homo sapiens
ttttcattttcttcg

SEQ ID NO: 435568 - DNA, 15 bp, Homo sapiens
tttcattttcttcga

SEQ ID NO: 435569 - DNA, 15 bp, Homo sapiens
ttcattttcttcgat

SEQ ID NO: 435570 - DNA, 15 bp, Homo sapiens
tcattttcttcgatt

SEQ ID NO: 435571 - DNA, 15 bp, Homo sapiens
cattttcttcgattt

SEQ ID NO: 435572 - DNA, 15 bp, Homo sapiens
attttcttcgatttt

SEQ ID NO: 435573 - DNA, 15 bp, Homo sapiens
ttttcttcgatttta

SEQ ID NO: 435574 - DNA, 15 bp, Homo sapiens
tttcttcgattttaa

SEQ ID NO: 435575 - DNA, 15 bp, Homo sapiens
ttcttcgattttaaa

SEQ ID NO: 435576 - DNA, 15 bp, Homo sapiens
tcttcgattttaaaa

SEQ ID NO: 435577 - DNA, 15 bp, Homo sapiens
cttcgattttaaaat

SEQ ID NO: 435578 - DNA, 15 bp, Homo sapiens
ttcgattttaaaata

SEQ ID NO: 435579 - DNA, 15 bp, Homo sapiens
tcgattttaaaataa

SEQ ID NO: 435580 - DNA, 15 bp, Homo sapiens
cgattttaaaataat

SEQ ID NO: 435581 - DNA, 15 bp, Homo sapiens
gattttaaaataatt

SEQ ID NO: 435582 - DNA, 15 bp, Homo sapiens
attttaaaataattc

SEQ ID NO: 435583 - DNA, 15 bp, Homo sapiens
ttttaaaataattca

SEQ ID NO: 435584 - DNA, 15 bp, Homo sapiens
tttaaaataattcac

SEQ ID NO: 435585 - DNA, 15 bp, Homo sapiens
ttaaaataattcaca

SEQ ID NO: 435586 - DNA, 15 bp, Homo sapiens
taaaataattcacac

SEQ ID NO: 435587 - DNA, 15 bp, Homo sapiens
aaaataattcacaca

SEQ ID NO: 435588 - DNA, 15 bp, Homo sapiens
ataattcacacagta

SEQ ID NO: 435589 - DNA, 15 bp, Homo sapiens
taattcacacagtaa

SEQ ID NO: 435590 - DNA, 15 bp, Homo sapiens
aattcacacagtaat

SEQ ID NO: 435591 - DNA, 15 bp, Homo sapiens
attcacacagtaatt

SEQ ID NO: 435592 - DNA, 15 bp, Homo sapiens
ttcacacagtaattg

SEQ ID NO: 435593 - DNA, 15 bp, Homo sapiens
tcacacagtaattga

SEQ ID NO: 435594 - DNA, 15 bp, Homo sapiens
cacacagtaattgaa

SEQ ID NO: 435595 - DNA, 15 bp, Homo sapiens
acacagtaattgaat

SEQ ID NO: 435596 - DNA, 15 bp, Homo sapiens
cacagtaattgaata

SEQ ID NO: 435597 - DNA, 15 bp, Homo sapiens
acagtaattgaatat

SEQ ID NO: 435598 - DNA, 15 bp, Homo sapiens
cagtaattgaatatg

SEQ ID NO: 435599 - DNA, 15 bp, Homo sapiens
agtaattgaatatgt

SEQ ID NO: 435600 - DNA, 15 bp, Homo sapiens
gtaattgaatatgtt

SEQ ID NO: 435601 - DNA, 15 bp, Homo sapiens
taattgaatatgttt

SEQ ID NO: 435602 - DNA, 15 bp, Homo sapiens
aattgaatatgttta

SEQ ID NO: 435603 - DNA, 15 bp, Homo sapiens
attgaatatgtttat

SEQ ID NO: 435604 - DNA, 15 bp, Homo sapiens
ttgaatatgtttata

SEQ ID NO: 435605 - DNA, 15 bp, Homo sapiens
tgaatatgtttataa

SEQ ID NO: 435606 - DNA, 15 bp, Homo sapiens
gaatatgtttataac

SEQ ID NO: 435607 - DNA, 15 bp, Homo sapiens
aatatgtttataact

SEQ ID NO: 435608 - DNA, 15 bp, Homo sapiens
atatgtttataactc

SEQ ID NO: 435609 - DNA, 15 bp, Homo sapiens
tatgtttataactct

SEQ ID NO: 435610 - DNA, 15 bp, Homo sapiens
atgtttataactctt

SEQ ID NO: 435611 - DNA, 15 bp, Homo sapiens
tgtttataactcttt

SEQ ID NO: 435612 - DNA, 15 bp, Homo sapiens
gtttataactctttg

SEQ ID NO: 435613 - DNA, 15 bp, Homo sapiens
tttataactctttgc

SEQ ID NO: 435614 - DNA, 15 bp, Homo sapiens
ttataactctttgct

SEQ ID NO: 435615 - DNA, 15 bp, Homo sapiens
tataactctttgctt

SEQ ID NO: 435616 - DNA, 15 bp, Homo sapiens
ataactctttgcttt

SEQ ID NO: 435617 - DNA, 15 bp, Homo sapiens
taactctttgctttt

SEQ ID NO: 435618 - DNA, 15 bp, Homo sapiens
aactctttgcttttt

SEQ ID NO: 435619 - DNA, 15 bp, Homo sapiens
actctttgctttttt

SEQ ID NO: 435620 - DNA, 15 bp, Homo sapiens
ctctttgcttttttc

SEQ ID NO: 435621 - DNA, 15 bp, Homo sapiens
tctttgcttttttct

SEQ ID NO: 435622 - DNA, 15 bp, Homo sapiens
ctttgcttttttctt

SEQ ID NO: 435623 - DNA, 15 bp, Homo sapiens
tttgcttttttcttt

SEQ ID NO: 435624 - DNA, 15 bp, Homo sapiens
ttgcttttttcttta

SEQ ID NO: 435625 - DNA, 15 bp, Homo sapiens
tgcttttttctttat

SEQ ID NO: 435626 - DNA, 15 bp, Homo sapiens
gcttttttctttatt

SEQ ID NO: 435627 - DNA, 15 bp, Homo sapiens
cttttttctttattg

SEQ ID NO: 435628 - DNA, 15 bp, Homo sapiens
ttttttctttattgt

SEQ ID NO: 435629 - DNA, 15 bp, Homo sapiens
tttttctttattgtt

SEQ ID NO: 435630 - DNA, 15 bp, Homo sapiens
ttttctttattgttg

SEQ ID NO: 435631 - DNA, 15 bp, Homo sapiens
tttctttattgttgc

SEQ ID NO: 435632 - DNA, 15 bp, Homo sapiens
ttctttattgttgct

SEQ ID NO: 435633 - DNA, 15 bp, Homo sapiens
tctttattgttgctc

SEQ ID NO: 435634 - DNA, 15 bp, Homo sapiens
ctttattgttgctct

SEQ ID NO: 435635 - DNA, 15 bp, Homo sapiens
tttattgttgctctt

SEQ ID NO: 435636 - DNA, 15 bp, Homo sapiens
ttattgttgctcttt

SEQ ID NO: 435637 - DNA, 15 bp, Homo sapiens
tattgttgctctttc

SEQ ID NO: 435638 - DNA, 15 bp, Homo sapiens
attgttgctctttct

SEQ ID NO: 435639 - DNA, 15 bp, Homo sapiens
ttgttgctctttctt

SEQ ID NO: 435640 - DNA, 15 bp, Homo sapiens
tgttgctctttcttc

SEQ ID NO: 435641 - DNA, 15 bp, Homo sapiens
gttgctctttcttca

SEQ ID NO: 435642 - DNA, 15 bp, Homo sapiens
ttgctctttcttcac

SEQ ID NO: 435643 - DNA, 15 bp, Homo sapiens
tgctctttcttcact

SEQ ID NO: 435644 - DNA, 15 bp, Homo sapiens
gctctttcttcactg

SEQ ID NO: 435645 - DNA, 15 bp, Homo sapiens
ctctttcttcactga

SEQ ID NO: 435646 - DNA, 15 bp, Homo sapiens
tctttcttcactgaa

SEQ ID NO: 435647 - DNA, 15 bp, Homo sapiens
ctttcttcactgaaa

SEQ ID NO: 435648 - DNA, 15 bp, Homo sapiens
tttcttcactgaaat

SEQ ID NO: 435649 - DNA, 15 bp, Homo sapiens
ttcttcactgaaata

SEQ ID NO: 435650 - DNA, 15 bp, Homo sapiens
tcttcactgaaatac

SEQ ID NO: 435651 - DNA, 15 bp, Homo sapiens
cttcactgaaatacc

SEQ ID NO: 435652 - DNA, 15 bp, Homo sapiens
ttcactgaaatacca

SEQ ID NO: 435653 - DNA, 15 bp, Homo sapiens
tcactgaaataccac

SEQ ID NO: 435654 - DNA, 15 bp, Homo sapiens
cactgaaataccacg

SEQ ID NO: 435655 - DNA, 15 bp, Homo sapiens
actgaaataccacgc

SEQ ID NO: 435656 - DNA, 15 bp, Homo sapiens
ctgaaataccacgct

SEQ ID NO: 435657 - DNA, 15 bp, Homo sapiens
tgaaataccacgctg

SEQ ID NO: 435658 - DNA, 15 bp, Homo sapiens
gaaataccacgctgc

SEQ ID NO: 435659 - DNA, 15 bp, Homo sapiens
aaataccacgctgca

SEQ ID NO: 435660 - DNA, 15 bp, Homo sapiens
aataccacgctgcat

SEQ ID NO: 435661 - DNA, 15 bp, Homo sapiens
ataccacgctgcata

SEQ ID NO: 435662 - DNA, 15 bp, Homo sapiens
taccacgctgcataa

SEQ ID NO: 435663 - DNA, 15 bp, Homo sapiens
accacgctgcataat

SEQ ID NO: 435664 - DNA, 15 bp, Homo sapiens
ccacgctgcataatg

SEQ ID NO: 435665 - DNA, 15 bp, Homo sapiens
cacgctgcataatgg

SEQ ID NO: 435666 - DNA, 15 bp, Homo sapiens
acgctgcataatgga

SEQ ID NO: 435667 - DNA, 15 bp, Homo sapiens
cgctgcataatggaa

SEQ ID NO: 435668 - DNA, 15 bp, Homo sapiens
gctgcataatggaat

SEQ ID NO: 435669 - DNA, 15 bp, Homo sapiens
ctgcataatggaatc

SEQ ID NO: 435670 - DNA, 15 bp, Homo sapiens
tgcataatggaatca

SEQ ID NO: 435671 - DNA, 15 bp, Homo sapiens
gcataatggaatcat

SEQ ID NO: 435672 - DNA, 15 bp, Homo sapiens
cataatggaatcata

SEQ ID NO: 435673 - DNA, 15 bp, Homo sapiens
taatggaatcataaa

SEQ ID NO: 435674 - DNA, 15 bp, Homo sapiens
aatggaatcataaac

SEQ ID NO: 435675 - DNA, 15 bp, Homo sapiens
atggaatcataaaca

SEQ ID NO: 435676 - DNA, 15 bp, Homo sapiens
tggaatcataaacag

SEQ ID NO: 435677 - DNA, 15 bp, Homo sapiens
ggaatcataaacagt

SEQ ID NO: 435678 - DNA, 15 bp, Homo sapiens
gaatcataaacagtt

SEQ ID NO: 435679 - DNA, 15 bp, Homo sapiens
aatcataaacagttc

SEQ ID NO: 435680 - DNA, 15 bp, Homo sapiens
atcataaacagttca

SEQ ID NO: 435681 - DNA, 15 bp, Homo sapiens
tcataaacagttcac

SEQ ID NO: 435682 - DNA, 15 bp, Homo sapiens
cataaacagttcact

SEQ ID NO: 435683 - DNA, 15 bp, Homo sapiens
ataaacagttcactg

SEQ ID NO: 435684 - DNA, 15 bp, Homo sapiens
taaacagttcactga

SEQ ID NO: 435685 - DNA, 15 bp, Homo sapiens
aaacagttcactgat

SEQ ID NO: 435686 - DNA, 15 bp, Homo sapiens
aacagttcactgatt

SEQ ID NO: 435687 - DNA, 15 bp, Homo sapiens
acagttcactgattt

SEQ ID NO: 435688 - DNA, 15 bp, Homo sapiens
cagttcactgatttc

SEQ ID NO: 435689 - DNA, 15 bp, Homo sapiens
agttcactgatttcc

SEQ ID NO: 435690 - DNA, 15 bp, Homo sapiens
gttcactgatttcct

SEQ ID NO: 435691 - DNA, 15 bp, Homo sapiens
ttcactgatttccta

SEQ ID NO: 435692 - DNA, 15 bp, Homo sapiens
tcactgatttcctaa

SEQ ID NO: 435693 - DNA, 15 bp, Homo sapiens
cactgatttcctaac

SEQ ID NO: 435694 - DNA, 15 bp, Homo sapiens
actgatttcctaaca

SEQ ID NO: 435695 - DNA, 15 bp, Homo sapiens
ctgatttcctaacac

SEQ ID NO: 435696 - DNA, 15 bp, Homo sapiens
tgatttcctaacacc

SEQ ID NO: 435697 - DNA, 15 bp, Homo sapiens
gatttcctaacaccg

SEQ ID NO: 435698 - DNA, 15 bp, Homo sapiens
atttcctaacaccga

SEQ ID NO: 435699 - DNA, 15 bp, Homo sapiens
tttcctaacaccgag

SEQ ID NO: 435700 - DNA, 15 bp, Homo sapiens
ttcctaacaccgagg

SEQ ID NO: 435701 - DNA, 15 bp, Homo sapiens
tcctaacaccgaggg

SEQ ID NO: 435702 - DNA, 15 bp, Homo sapiens
cctaacaccgaggga

SEQ ID NO: 435703 - DNA, 15 bp, Homo sapiens
ctaacaccgagggag

SEQ ID NO: 435704 - DNA, 15 bp, Homo sapiens
taacaccgagggaga

SEQ ID NO: 435705 - DNA, 15 bp, Homo sapiens
aacaccgagggagaa

SEQ ID NO: 435706 - DNA, 15 bp, Homo sapiens
acaccgagggagaag

SEQ ID NO: 435707 - DNA, 15 bp, Homo sapiens
caccgagggagaagg

SEQ ID NO: 435708 - DNA, 15 bp, Homo sapiens
accgagggagaaggt

SEQ ID NO: 435709 - DNA, 15 bp, Homo sapiens
ccgagggagaaggtg

SEQ ID NO: 435710 - DNA, 15 bp, Homo sapiens
cgagggagaaggtgt

SEQ ID NO: 435711 - DNA, 15 bp, Homo sapiens
gagggagaaggtgtc

SEQ ID NO: 435712 - DNA, 15 bp, Homo sapiens
agggagaaggtgtct

SEQ ID NO: 435713 - DNA, 15 bp, Homo sapiens
gggagaaggtgtcta

SEQ ID NO: 435714 - DNA, 15 bp, Homo sapiens
ggagaaggtgtctag

SEQ ID NO: 435715 - DNA, 15 bp, Homo sapiens
gagaaggtgtctagg

SEQ ID NO: 435716 - DNA, 15 bp, Homo sapiens
agaaggtgtctaggc

SEQ ID NO: 435717 - DNA, 15 bp, Homo sapiens
gaaggtgtctaggca

SEQ ID NO: 435718 - DNA, 15 bp, Homo sapiens
aaggtgtctaggcaa

SEQ ID NO: 435719 - DNA, 15 bp, Homo sapiens
aggtgtctaggcaat

SEQ ID NO: 435720 - DNA, 15 bp, Homo sapiens
ggtgtctaggcaata

SEQ ID NO: 435721 - DNA, 15 bp, Homo sapiens
gtgtctaggcaatat

SEQ ID NO: 435722 - DNA, 15 bp, Homo sapiens
tgtctaggcaatatt

SEQ ID NO: 435723 - DNA, 15 bp, Homo sapiens
gtctaggcaatatta

SEQ ID NO: 435724 - DNA, 15 bp, Homo sapiens
tctaggcaatattag

SEQ ID NO: 435725 - DNA, 15 bp, Homo sapiens
ctaggcaatattaga

SEQ ID NO: 435726 - DNA, 15 bp, Homo sapiens
taggcaatattagac

SEQ ID NO: 435727 - DNA, 15 bp, Homo sapiens
aggcaatattagact

SEQ ID NO: 435728 - DNA, 15 bp, Homo sapiens
ggcaatattagactt

SEQ ID NO: 435729 - DNA, 15 bp, Homo sapiens
gcaatattagacttt

SEQ ID NO: 435730 - DNA, 15 bp, Homo sapiens
caatattagactttg

SEQ ID NO: 435731 - DNA, 15 bp, Homo sapiens
aatattagactttgt

SEQ ID NO: 435732 - DNA, 15 bp, Homo sapiens
atattagactttgtc

SEQ ID NO: 435733 - DNA, 15 bp, Homo sapiens
tattagactttgtct

SEQ ID NO: 435734 - DNA, 15 bp, Homo sapiens
attagactttgtctt

SEQ ID NO: 435735 - DNA, 15 bp, Homo sapiens
ttagactttgtcttt

SEQ ID NO: 435736 - DNA, 15 bp, Homo sapiens
tagactttgtctttt

SEQ ID NO: 435737 - DNA, 15 bp, Homo sapiens
agactttgtcttttt

SEQ ID NO: 435738 - DNA, 15 bp, Homo sapiens
gactttgtcttttta

SEQ ID NO: 435739 - DNA, 15 bp, Homo sapiens
actttgtctttttaa

SEQ ID NO: 435740 - DNA, 15 bp, Homo sapiens
ctttgtctttttaat

SEQ ID NO: 435741 - DNA, 15 bp, Homo sapiens
tttgtctttttaatt

SEQ ID NO: 435742 - DNA, 15 bp, Homo sapiens
ttgtctttttaattt

SEQ ID NO: 435743 - DNA, 15 bp, Homo sapiens
tgtctttttaatttt

SEQ ID NO: 435744 - DNA, 15 bp, Homo sapiens
gtctttttaattttc

SEQ ID NO: 435745 - DNA, 15 bp, Homo sapiens
tctttttaattttca

SEQ ID NO: 435746 - DNA, 15 bp, Homo sapiens
ctttttaattttcat

SEQ ID NO: 435747 - DNA, 15 bp, Homo sapiens
ttttaattttcatat

SEQ ID NO: 435748 - DNA, 15 bp, Homo sapiens
tttaattttcatata

SEQ ID NO: 435749 - DNA, 15 bp, Homo sapiens
ttaattttcatataa

SEQ ID NO: 435750 - DNA, 15 bp, Homo sapiens
taattttcatataaa

SEQ ID NO: 435751 - DNA, 15 bp, Homo sapiens
aattttcatataaaa

SEQ ID NO: 435752 - DNA, 15 bp, Homo sapiens
attttcatataaaaa

SEQ ID NO: 435753 - DNA, 15 bp, Homo sapiens
ttttcatataaaaat

SEQ ID NO: 435754 - DNA, 15 bp, Homo sapiens
tttcatataaaaatt

SEQ ID NO: 435755 - DNA, 15 bp, Homo sapiens
ttcatataaaaattt

SEQ ID NO: 435756 - DNA, 15 bp, Homo sapiens
tcatataaaaatttg

SEQ ID NO: 435757 - DNA, 15 bp, Homo sapiens
catataaaaatttga

SEQ ID NO: 435758 - DNA, 15 bp, Homo sapiens
atataaaaatttgaa

SEQ ID NO: 435759 - DNA, 15 bp, Homo sapiens
tataaaaatttgaag

SEQ ID NO: 435760 - DNA, 15 bp, Homo sapiens
ataaaaatttgaagt

SEQ ID NO: 435761 - DNA, 15 bp, Homo sapiens
taaaaatttgaagta

SEQ ID NO: 435762 - DNA, 15 bp, Homo sapiens
aaaaatttgaagtat

SEQ ID NO: 435763 - DNA, 15 bp, Homo sapiens
aaaatttgaagtata

SEQ ID NO: 435764 - DNA, 15 bp, Homo sapiens
aaatttgaagtataa

SEQ ID NO: 435765 - DNA, 15 bp, Homo sapiens
aatttgaagtataag

SEQ ID NO: 435766 - DNA, 15 bp, Homo sapiens
atttgaagtataagt

SEQ ID NO: 435767 - DNA, 15 bp, Homo sapiens
tttgaagtataagta

SEQ ID NO: 435768 - DNA, 15 bp, Homo sapiens
ttgaagtataagtaa

SEQ ID NO: 435769 - DNA, 15 bp, Homo sapiens
tgaagtataagtaat

SEQ ID NO: 435770 - DNA, 15 bp, Homo sapiens
gaagtataagtaatt

SEQ ID NO: 435771 - DNA, 15 bp, Homo sapiens
aagtataagtaattg

SEQ ID NO: 435772 - DNA, 15 bp, Homo sapiens
agtataagtaattgc

SEQ ID NO: 435773 - DNA, 15 bp, Homo sapiens
gtataagtaattgct

SEQ ID NO: 435774 - DNA, 15 bp, Homo sapiens
tataagtaattgctt

SEQ ID NO: 435775 - DNA, 15 bp, Homo sapiens
ataagtaattgcttt

SEQ ID NO: 435776 - DNA, 15 bp, Homo sapiens
taagtaattgctttc

SEQ ID NO: 435777 - DNA, 15 bp, Homo sapiens
aagtaattgctttca

SEQ ID NO: 435778 - DNA, 15 bp, Homo sapiens
agtaattgctttcag

SEQ ID NO: 435779 - DNA, 15 bp, Homo sapiens
gtaattgctttcagg

SEQ ID NO: 435780 - DNA, 15 bp, Homo sapiens
taattgctttcaggc

SEQ ID NO: 435781 - DNA, 15 bp, Homo sapiens
aattgctttcaggcc

SEQ ID NO: 435782 - DNA, 15 bp, Homo sapiens
attgctttcaggcct

SEQ ID NO: 435783 - DNA, 15 bp, Homo sapiens
ttgctttcaggccta

SEQ ID NO: 435784 - DNA, 15 bp, Homo sapiens
tgctttcaggcctat

SEQ ID NO: 435785 - DNA, 15 bp, Homo sapiens
gctttcaggcctata

SEQ ID NO: 435786 - DNA, 15 bp, Homo sapiens
ctttcaggcctatag

SEQ ID NO: 435787 - DNA, 15 bp, Homo sapiens
tttcaggcctataga

SEQ ID NO: 435788 - DNA, 15 bp, Homo sapiens
ttcaggcctatagac

SEQ ID NO: 435789 - DNA, 15 bp, Homo sapiens
tcaggcctatagacc

SEQ ID NO: 435790 - DNA, 15 bp, Homo sapiens
caggcctatagacca

SEQ ID NO: 435791 - DNA, 15 bp, Homo sapiens
aggcctatagaccac

SEQ ID NO: 435792 - DNA, 15 bp, Homo sapiens
ggcctatagaccacg

SEQ ID NO: 435793 - DNA, 15 bp, Homo sapiens
gcctatagaccacga

SEQ ID NO: 435794 - DNA, 15 bp, Homo sapiens
cctatagaccacgac

SEQ ID NO: 435795 - DNA, 15 bp, Homo sapiens
ctatagaccacgaca

SEQ ID NO: 435796 - DNA, 15 bp, Homo sapiens
tatagaccacgacaa

SEQ ID NO: 435797 - DNA, 15 bp, Homo sapiens
atagaccacgacaat

SEQ ID NO: 435798 - DNA, 15 bp, Homo sapiens
tagaccacgacaata

SEQ ID NO: 435799 - DNA, 15 bp, Homo sapiens
agaccacgacaataa

SEQ ID NO: 435800 - DNA, 15 bp, Homo sapiens
gaccacgacaataat

SEQ ID NO: 435801 - DNA, 15 bp, Homo sapiens
accacgacaataatt

SEQ ID NO: 435802 - DNA, 15 bp, Homo sapiens
ccacgacaataattt

SEQ ID NO: 435803 - DNA, 15 bp, Homo sapiens
cacgacaataatttc

SEQ ID NO: 435804 - DNA, 15 bp, Homo sapiens
acgacaataatttca

SEQ ID NO: 435805 - DNA, 15 bp, Homo sapiens
cgacaataatttcat

SEQ ID NO: 435806 - DNA, 15 bp, Homo sapiens
gacaataatttcatt

SEQ ID NO: 435807 - DNA, 15 bp, Homo sapiens
acaataatttcatta

SEQ ID NO: 435808 - DNA, 15 bp, Homo sapiens
caataatttcattag

SEQ ID NO: 435809 - DNA, 15 bp, Homo sapiens
aataatttcattagc

SEQ ID NO: 435810 - DNA, 15 bp, Homo sapiens
ataatttcattagct

SEQ ID NO: 435811 - DNA, 15 bp, Homo sapiens
taatttcattagctt

SEQ ID NO: 435812 - DNA, 15 bp, Homo sapiens
aatttcattagcttc

SEQ ID NO: 435813 - DNA, 15 bp, Homo sapiens
atttcattagcttct

SEQ ID NO: 435814 - DNA, 15 bp, Homo sapiens
tttcattagcttctc

SEQ ID NO: 435815 - DNA, 15 bp, Homo sapiens
ttcattagcttctca

SEQ ID NO: 435816 - DNA, 15 bp, Homo sapiens
tcattagcttctcaa

SEQ ID NO: 435817 - DNA, 15 bp, Homo sapiens
cattagcttctcaag

SEQ ID NO: 435818 - DNA, 15 bp, Homo sapiens
attagcttctcaagt

SEQ ID NO: 435819 - DNA, 15 bp, Homo sapiens
ttagcttctcaagtc

SEQ ID NO: 435820 - DNA, 15 bp, Homo sapiens
tagcttctcaagtcc

SEQ ID NO: 435821 - DNA, 15 bp, Homo sapiens
agcttctcaagtcca

SEQ ID NO: 435822 - DNA, 15 bp, Homo sapiens
gcttctcaagtccaa

SEQ ID NO: 435823 - DNA, 15 bp, Homo sapiens
cttctcaagtccaaa

SEQ ID NO: 435824 - DNA, 15 bp, Homo sapiens
ttctcaagtccaaat

SEQ ID NO: 435825 - DNA, 15 bp, Homo sapiens
tctcaagtccaaatt

SEQ ID NO: 435826 - DNA, 15 bp, Homo sapiens
ctcaagtccaaatta

SEQ ID NO: 435827 - DNA, 15 bp, Homo sapiens
tcaagtccaaattag

SEQ ID NO: 435828 - DNA, 15 bp, Homo sapiens
caagtccaaattaga

SEQ ID NO: 435829 - DNA, 15 bp, Homo sapiens
aagtccaaattagat

SEQ ID NO: 435830 - DNA, 15 bp, Homo sapiens
agtccaaattagatt

SEQ ID NO: 435831 - DNA, 15 bp, Homo sapiens
gtccaaattagatta

SEQ ID NO: 435832 - DNA, 15 bp, Homo sapiens
tccaaattagattag

SEQ ID NO: 435833 - DNA, 15 bp, Homo sapiens
ccaaattagattagt

SEQ ID NO: 435834 - DNA, 15 bp, Homo sapiens
caaattagattagta

SEQ ID NO: 435835 - DNA, 15 bp, Homo sapiens
aaattagattagtaa

SEQ ID NO: 435836 - DNA, 15 bp, Homo sapiens
aattagattagtaaa

SEQ ID NO: 435837 - DNA, 15 bp, Homo sapiens
attagattagtaaag

SEQ ID NO: 435838 - DNA, 15 bp, Homo sapiens
ttagattagtaaagt

SEQ ID NO: 435839 - DNA, 15 bp, Homo sapiens
tagattagtaaagtt

SEQ ID NO: 435840 - DNA, 15 bp, Homo sapiens
agattagtaaagttg

SEQ ID NO: 435841 - DNA, 15 bp, Homo sapiens
gattagtaaagttgt

SEQ ID NO: 435842 - DNA, 15 bp, Homo sapiens
attagtaaagttgta

SEQ ID NO: 435843 - DNA, 15 bp, Homo sapiens
ttagtaaagttgtaa

SEQ ID NO: 435844 - DNA, 15 bp, Homo sapiens
tagtaaagttgtaat

SEQ ID NO: 435845 - DNA, 15 bp, Homo sapiens
agtaaagttgtaatg

SEQ ID NO: 435846 - DNA, 15 bp, Homo sapiens
gtaaagttgtaatgc

SEQ ID NO: 435847 - DNA, 15 bp, Homo sapiens
taaagttgtaatgca

SEQ ID NO: 435848 - DNA, 15 bp, Homo sapiens
aaagttgtaatgcat

SEQ ID NO: 435849 - DNA, 15 bp, Homo sapiens
aagttgtaatgcatg

SEQ ID NO: 435850 - DNA, 15 bp, Homo sapiens
agttgtaatgcatga

SEQ ID NO: 435851 - DNA, 15 bp, Homo sapiens
gttgtaatgcatgaa

SEQ ID NO: 435852 - DNA, 15 bp, Homo sapiens
ttgtaatgcatgaaa

SEQ ID NO: 435853 - DNA, 15 bp, Homo sapiens
tgtaatgcatgaaaa

SEQ ID NO: 435854 - DNA, 15 bp, Homo sapiens
gtaatgcatgaaaaa

SEQ ID NO: 435855 - DNA, 15 bp, Homo sapiens
taatgcatgaaaaag

SEQ ID NO: 435856 - DNA, 15 bp, Homo sapiens
aatgcatgaaaaagc

SEQ ID NO: 435857 - DNA, 15 bp, Homo sapiens
atgcatgaaaaagcg

SEQ ID NO: 435858 - DNA, 15 bp, Homo sapiens
tgcatgaaaaagcgc

SEQ ID NO: 435859 - DNA, 15 bp, Homo sapiens
gcatgaaaaagcgca

SEQ ID NO: 435860 - DNA, 15 bp, Homo sapiens
catgaaaaagcgcag

SEQ ID NO: 435861 - DNA, 15 bp, Homo sapiens
atgaaaaagcgcaga

SEQ ID NO: 435862 - DNA, 15 bp, Homo sapiens
tgaaaaagcgcagaa

SEQ ID NO: 435863 - DNA, 15 bp, Homo sapiens
gaaaaagcgcagaaa

SEQ ID NO: 435864 - DNA, 15 bp, Homo sapiens
aaaaagcgcagaaaa

SEQ ID NO: 435865 - DNA, 15 bp, Homo sapiens
aaaagcgcagaaaaa

SEQ ID NO: 435866 - DNA, 15 bp, Homo sapiens
aaagcgcagaaaaat

SEQ ID NO: 435867 - DNA, 15 bp, Homo sapiens
aagcgcagaaaaata

SEQ ID NO: 435868 - DNA, 15 bp, Homo sapiens
agcgcagaaaaatat

SEQ ID NO: 435869 - DNA, 15 bp, Homo sapiens
gcgcagaaaaatata

SEQ ID NO: 435870 - DNA, 15 bp, Homo sapiens
cgcagaaaaatataa

SEQ ID NO: 435871 - DNA, 15 bp, Homo sapiens
gcagaaaaatataat

SEQ ID NO: 435872 - DNA, 15 bp, Homo sapiens
cagaaaaatataatg

SEQ ID NO: 435873 - DNA, 15 bp, Homo sapiens
agaaaaatataatgt

SEQ ID NO: 435874 - DNA, 15 bp, Homo sapiens
gaaaaatataatgtt

SEQ ID NO: 435875 - DNA, 15 bp, Homo sapiens
aaaaatataatgtta

SEQ ID NO: 435876 - DNA, 15 bp, Homo sapiens
aaaatataatgttac

SEQ ID NO: 435877 - DNA, 15 bp, Homo sapiens
aaatataatgttact

SEQ ID NO: 435878 - DNA, 15 bp, Homo sapiens
aatataatgttactt

SEQ ID NO: 435879 - DNA, 15 bp, Homo sapiens
atataatgttacttt

SEQ ID NO: 435880 - DNA, 15 bp, Homo sapiens
tataatgttactttc

SEQ ID NO: 435881 - DNA, 15 bp, Homo sapiens
ataatgttactttct

SEQ ID NO: 435882 - DNA, 15 bp, Homo sapiens
taatgttactttctt

SEQ ID NO: 435883 - DNA, 15 bp, Homo sapiens
aatgttactttcttt

SEQ ID NO: 435884 - DNA, 15 bp, Homo sapiens
atgttactttctttt

SEQ ID NO: 435885 - DNA, 15 bp, Homo sapiens
tgttactttcttttc

SEQ ID NO: 435886 - DNA, 15 bp, Homo sapiens
gttactttcttttcc

SEQ ID NO: 435887 - DNA, 15 bp, Homo sapiens
ttactttcttttccg

SEQ ID NO: 435888 - DNA, 15 bp, Homo sapiens
tactttcttttccgg

SEQ ID NO: 435889 - DNA, 15 bp, Homo sapiens
actttcttttccggt

SEQ ID NO: 435890 - DNA, 15 bp, Homo sapiens
ctttcttttccggtg

SEQ ID NO: 435891 - DNA, 15 bp, Homo sapiens
tttcttttccggtgt

SEQ ID NO: 435892 - DNA, 15 bp, Homo sapiens
ttcttttccggtgtt

SEQ ID NO: 435893 - DNA, 15 bp, Homo sapiens
tcttttccggtgttc

SEQ ID NO: 435894 - DNA, 15 bp, Homo sapiens
cttttccggtgttct

SEQ ID NO: 435895 - DNA, 15 bp, Homo sapiens
ttttccggtgttctt

SEQ ID NO: 435896 - DNA, 15 bp, Homo sapiens
tttccggtgttctta

SEQ ID NO: 435897 - DNA, 15 bp, Homo sapiens
ttccggtgttcttaa

SEQ ID NO: 435898 - DNA, 15 bp, Homo sapiens
tccggtgttcttaac

SEQ ID NO: 435899 - DNA, 15 bp, Homo sapiens
ccggtgttcttaact

SEQ ID NO: 435900 - DNA, 15 bp, Homo sapiens
cggtgttcttaacta

SEQ ID NO: 435901 - DNA, 15 bp, Homo sapiens
ggtgttcttaactac

SEQ ID NO: 435902 - DNA, 15 bp, Homo sapiens
gtgttcttaactaca

SEQ ID NO: 435903 - DNA, 15 bp, Homo sapiens
tgttcttaactacag

SEQ ID NO: 435904 - DNA, 15 bp, Homo sapiens
gttcttaactacaga

SEQ ID NO: 435905 - DNA, 15 bp, Homo sapiens
ttcttaactacagag

SEQ ID NO: 435906 - DNA, 15 bp, Homo sapiens
tcttaactacagagc

SEQ ID NO: 435907 - DNA, 15 bp, Homo sapiens
cttaactacagagca

SEQ ID NO: 435908 - DNA, 15 bp, Homo sapiens
ttaactacagagcag

SEQ ID NO: 435909 - DNA, 15 bp, Homo sapiens
taactacagagcagt

SEQ ID NO: 435910 - DNA, 15 bp, Homo sapiens
aactacagagcagta

SEQ ID NO: 435911 - DNA, 15 bp, Homo sapiens
actacagagcagtaa

SEQ ID NO: 435912 - DNA, 15 bp, Homo sapiens
ctacagagcagtaat

SEQ ID NO: 435913 - DNA, 15 bp, Homo sapiens
tacagagcagtaatg

SEQ ID NO: 435914 - DNA, 15 bp, Homo sapiens
acagagcagtaatgt

SEQ ID NO: 435915 - DNA, 15 bp, Homo sapiens
cagagcagtaatgtg

SEQ ID NO: 435916 - DNA, 15 bp, Homo sapiens
agagcagtaatgtga

SEQ ID NO: 435917 - DNA, 15 bp, Homo sapiens
gagcagtaatgtgat

SEQ ID NO: 435918 - DNA, 15 bp, Homo sapiens
agcagtaatgtgatt

SEQ ID NO: 435919 - DNA, 15 bp, Homo sapiens
gcagtaatgtgattt

SEQ ID NO: 435920 - DNA, 15 bp, Homo sapiens
cagtaatgtgatttt

SEQ ID NO: 435921 - DNA, 15 bp, Homo sapiens
agtaatgtgattttt

SEQ ID NO: 435922 - DNA, 15 bp, Homo sapiens
gtaatgtgatttttc

SEQ ID NO: 435923 - DNA, 15 bp, Homo sapiens
taatgtgatttttca

SEQ ID NO: 435924 - DNA, 15 bp, Homo sapiens
aatgtgatttttcac

SEQ ID NO: 435925 - DNA, 15 bp, Homo sapiens
atgtgatttttcaca

SEQ ID NO: 435926 - DNA, 15 bp, Homo sapiens
tgtgatttttcacaa

SEQ ID NO: 435927 - DNA, 15 bp, Homo sapiens
gtgatttttcacaaa

SEQ ID NO: 435928 - DNA, 15 bp, Homo sapiens
tgatttttcacaaat

SEQ ID NO: 435929 - DNA, 15 bp, Homo sapiens
gatttttcacaaatt

SEQ ID NO: 435930 - DNA, 15 bp, Homo sapiens
atttttcacaaatta

SEQ ID NO: 435931 - DNA, 15 bp, Homo sapiens
tttttcacaaattaa

SEQ ID NO: 435932 - DNA, 15 bp, Homo sapiens
ttttcacaaattaaa

SEQ ID NO: 435933 - DNA, 15 bp, Homo sapiens
tttcacaaattaaag

SEQ ID NO: 435934 - DNA, 15 bp, Homo sapiens
ttcacaaattaaagt

SEQ ID NO: 435935 - DNA, 15 bp, Homo sapiens
tcacaaattaaagtt

SEQ ID NO: 435936 - DNA, 15 bp, Homo sapiens
cacaaattaaagttc

SEQ ID NO: 435937 - DNA, 15 bp, Homo sapiens
acaaattaaagttct

SEQ ID NO: 435938 - DNA, 15 bp, Homo sapiens
caaattaaagttcta

SEQ ID NO: 435939 - DNA, 15 bp, Homo sapiens
aaattaaagttctat

SEQ ID NO: 435940 - DNA, 15 bp, Homo sapiens
aattaaagttctata

SEQ ID NO: 435941 - DNA, 15 bp, Homo sapiens
attaaagttctataa

SEQ ID NO: 435942 - DNA, 15 bp, Homo sapiens
ttaaagttctataat

SEQ ID NO: 435943 - DNA, 15 bp, Homo sapiens
taaagttctataata

SEQ ID NO: 435944 - DNA, 15 bp, Homo sapiens
aaagttctataatat

SEQ ID NO: 435945 - DNA, 15 bp, Homo sapiens
aagttctataatatc

SEQ ID NO: 435946 - DNA, 15 bp, Homo sapiens
agttctataatatct

SEQ ID NO: 435947 - DNA, 15 bp, Homo sapiens
gttctataatatctg

SEQ ID NO: 435948 - DNA, 15 bp, Homo sapiens
ttctataatatctgt

SEQ ID NO: 435949 - DNA, 15 bp, Homo sapiens
tctataatatctgta

SEQ ID NO: 435950 - DNA, 15 bp, Homo sapiens
ctataatatctgtat

SEQ ID NO: 435951 - DNA, 15 bp, Homo sapiens
tataatatctgtatg

SEQ ID NO: 435952 - DNA, 15 bp, Homo sapiens
ataatatctgtatga

SEQ ID NO: 435953 - DNA, 15 bp, Homo sapiens
taatatctgtatgaa

SEQ ID NO: 435954 - DNA, 15 bp, Homo sapiens
aatatctgtatgaat

SEQ ID NO: 435955 - DNA, 15 bp, Homo sapiens
atatctgtatgaata

SEQ ID NO: 435956 - DNA, 15 bp, Homo sapiens
tatctgtatgaatat

SEQ ID NO: 435957 - DNA, 15 bp, Homo sapiens
tctgtatgaatataa

SEQ ID NO: 435958 - DNA, 15 bp, Homo sapiens
ctgtatgaatataat

SEQ ID NO: 435959 - DNA, 15 bp, Homo sapiens
tgtatgaatataatg

SEQ ID NO: 435960 - DNA, 15 bp, Homo sapiens
gtatgaatataatgc

SEQ ID NO: 435961 - DNA, 15 bp, Homo sapiens
tatgaatataatgca

SEQ ID NO: 435962 - DNA, 15 bp, Homo sapiens
atgaatataatgcat

SEQ ID NO: 435963 - DNA, 15 bp, Homo sapiens
tgaatataatgcatc

SEQ ID NO: 435964 - DNA, 15 bp, Homo sapiens
gaatataatgcatct

SEQ ID NO: 435965 - DNA, 15 bp, Homo sapiens
aatataatgcatcta

SEQ ID NO: 435966 - DNA, 15 bp, Homo sapiens
atataatgcatctag

SEQ ID NO: 435967 - DNA, 15 bp, Homo sapiens
tataatgcatctagt

SEQ ID NO: 435968 - DNA, 15 bp, Homo sapiens
ataatgcatctagtc

SEQ ID NO: 435969 - DNA, 15 bp, Homo sapiens
taatgcatctagtct

SEQ ID NO: 435970 - DNA, 15 bp, Homo sapiens
aatgcatctagtctt

SEQ ID NO: 435971 - DNA, 15 bp, Homo sapiens
atgcatctagtcttc

SEQ ID NO: 435972 - DNA, 15 bp, Homo sapiens
tgcatctagtcttca

SEQ ID NO: 435973 - DNA, 15 bp, Homo sapiens
gcatctagtcttcaa

SEQ ID NO: 435974 - DNA, 15 bp, Homo sapiens
catctagtcttcaac

SEQ ID NO: 435975 - DNA, 15 bp, Homo sapiens
atctagtcttcaact

SEQ ID NO: 435976 - DNA, 15 bp, Homo sapiens
tctagtcttcaactt

SEQ ID NO: 435977 - DNA, 15 bp, Homo sapiens
ctagtcttcaacttt

SEQ ID NO: 435978 - DNA, 15 bp, Homo sapiens
tagtcttcaactttt

SEQ ID NO: 435979 - DNA, 15 bp, Homo sapiens
agtcttcaacttttc

SEQ ID NO: 435980 - DNA, 15 bp, Homo sapiens
gtcttcaacttttct

SEQ ID NO: 435981 - DNA, 15 bp, Homo sapiens
tcttcaacttttcta

SEQ ID NO: 435982 - DNA, 15 bp, Homo sapiens
cttcaacttttctaa

SEQ ID NO: 435983 - DNA, 15 bp, Homo sapiens
ttcaacttttctaaa

SEQ ID NO: 435984 - DNA, 15 bp, Homo sapiens
tcaacttttctaaaa

SEQ ID NO: 435985 - DNA, 15 bp, Homo sapiens
caacttttctaaaat

SEQ ID NO: 435986 - DNA, 15 bp, Homo sapiens
aacttttctaaaata

SEQ ID NO: 435987 - DNA, 15 bp, Homo sapiens
acttttctaaaatac

SEQ ID NO: 435988 - DNA, 15 bp, Homo sapiens
cttttctaaaataca

SEQ ID NO: 435989 - DNA, 15 bp, Homo sapiens
ttttctaaaatacaa

SEQ ID NO: 435990 - DNA, 15 bp, Homo sapiens
tttctaaaatacaac

SEQ ID NO: 435991 - DNA, 15 bp, Homo sapiens
ttctaaaatacaacg

SEQ ID NO: 435992 - DNA, 15 bp, Homo sapiens
tctaaaatacaacga

SEQ ID NO: 435993 - DNA, 15 bp, Homo sapiens
ctaaaatacaacgag

SEQ ID NO: 435994 - DNA, 15 bp, Homo sapiens
taaaatacaacgagc

SEQ ID NO: 435995 - DNA, 15 bp, Homo sapiens
aaaatacaacgagcc

SEQ ID NO: 435996 - DNA, 15 bp, Homo sapiens
aaatacaacgagcca

SEQ ID NO: 435997 - DNA, 15 bp, Homo sapiens
aatacaacgagccag

SEQ ID NO: 435998 - DNA, 15 bp, Homo sapiens
atacaacgagccagc

SEQ ID NO: 435999 - DNA, 15 bp, Homo sapiens
tacaacgagccagct

SEQ ID NO: 436000 - DNA, 15 bp, Homo sapiens
acaacgagccagctg

SEQ ID NO: 436001 - DNA, 15 bp, Homo sapiens
caacgagccagctga

SEQ ID NO: 436002 - DNA, 15 bp, Homo sapiens
aacgagccagctgag

SEQ ID NO: 436003 - DNA, 15 bp, Homo sapiens
acgagccagctgagt

SEQ ID NO: 436004 - DNA, 15 bp, Homo sapiens
cgagccagctgagta

SEQ ID NO: 436005 - DNA, 15 bp, Homo sapiens
gagccagctgagtaa

SEQ ID NO: 436006 - DNA, 15 bp, Homo sapiens
agccagctgagtaag

SEQ ID NO: 436007 - DNA, 15 bp, Homo sapiens
gccagctgagtaagc

SEQ ID NO: 436008 - DNA, 15 bp, Homo sapiens
ccagctgagtaagcc

SEQ ID NO: 436009 - DNA, 15 bp, Homo sapiens
cagctgagtaagccc

SEQ ID NO: 436010 - DNA, 15 bp, Homo sapiens
agctgagtaagccca

SEQ ID NO: 436011 - DNA, 15 bp, Homo sapiens
gctgagtaagcccat

SEQ ID NO: 436012 - DNA, 15 bp, Homo sapiens
ctgagtaagcccatc

SEQ ID NO: 436013 - DNA, 15 bp, Homo sapiens
tgagtaagcccatcg

SEQ ID NO: 436014 - DNA, 15 bp, Homo sapiens
gagtaagcccatcga

SEQ ID NO: 436015 - DNA, 15 bp, Homo sapiens
agtaagcccatcgat

SEQ ID NO: 436016 - DNA, 15 bp, Homo sapiens
gtaagcccatcgatt

SEQ ID NO: 436017 - DNA, 15 bp, Homo sapiens
taagcccatcgattg

SEQ ID NO: 436018 - DNA, 15 bp, Homo sapiens
aagcccatcgattgg

SEQ ID NO: 436019 - DNA, 15 bp, Homo sapiens
agcccatcgattggg

SEQ ID NO: 436020 - DNA, 15 bp, Homo sapiens
gcccatcgattgggt

SEQ ID NO: 436021 - DNA, 15 bp, Homo sapiens
cccatcgattgggta

SEQ ID NO: 436022 - DNA, 15 bp, Homo sapiens
ccatcgattgggtaa

SEQ ID NO: 436023 - DNA, 15 bp, Homo sapiens
catcgattgggtaaa

SEQ ID NO: 436024 - DNA, 15 bp, Homo sapiens
atcgattgggtaaaa

SEQ ID NO: 436025 - DNA, 15 bp, Homo sapiens
tcgattgggtaaaaa

SEQ ID NO: 436026 - DNA, 15 bp, Homo sapiens
cgattgggtaaaaat

SEQ ID NO: 436027 - DNA, 15 bp, Homo sapiens
gattgggtaaaaatt

SEQ ID NO: 436028 - DNA, 15 bp, Homo sapiens
attgggtaaaaattt

SEQ ID NO: 436029 - DNA, 15 bp, Homo sapiens
ttgggtaaaaatttg

SEQ ID NO: 436030 - DNA, 15 bp, Homo sapiens
tgggtaaaaatttgg

SEQ ID NO: 436031 - DNA, 15 bp, Homo sapiens
gggtaaaaatttgga

SEQ ID NO: 436032 - DNA, 15 bp, Homo sapiens
ggtaaaaatttggaa

SEQ ID NO: 436033 - DNA, 15 bp, Homo sapiens
gtaaaaatttggaaa

SEQ ID NO: 436034 - DNA, 15 bp, Homo sapiens
taaaaatttggaaaa

SEQ ID NO: 436035 - DNA, 15 bp, Homo sapiens
aaaaatttggaaaat

SEQ ID NO: 436036 - DNA, 15 bp, Homo sapiens
aaaatttggaaaatg

SEQ ID NO: 436037 - DNA, 15 bp, Homo sapiens
aaatttggaaaatgt

SEQ ID NO: 436038 - DNA, 15 bp, Homo sapiens
aatttggaaaatgtt

SEQ ID NO: 436039 - DNA, 15 bp, Homo sapiens
atttggaaaatgttt

SEQ ID NO: 436040 - DNA, 15 bp, Homo sapiens
tttggaaaatgtttt

SEQ ID NO: 436041 - DNA, 15 bp, Homo sapiens
ttggaaaatgttttt

SEQ ID NO: 436042 - DNA, 15 bp, Homo sapiens
tggaaaatgtttttc

SEQ ID NO: 436043 - DNA, 15 bp, Homo sapiens
ggaaaatgtttttca

SEQ ID NO: 436044 - DNA, 15 bp, Homo sapiens
gaaaatgtttttcat

SEQ ID NO: 436045 - DNA, 15 bp, Homo sapiens
aaaatgtttttcatg

SEQ ID NO: 436046 - DNA, 15 bp, Homo sapiens
aaatgtttttcatgc

SEQ ID NO: 436047 - DNA, 15 bp, Homo sapiens
aatgtttttcatgct

SEQ ID NO: 436048 - DNA, 15 bp, Homo sapiens
atgtttttcatgcta

SEQ ID NO: 436049 - DNA, 15 bp, Homo sapiens
tgtttttcatgctaa

SEQ ID NO: 436050 - DNA, 15 bp, Homo sapiens
gtttttcatgctaac

SEQ ID NO: 436051 - DNA, 15 bp, Homo sapiens
tttttcatgctaact

SEQ ID NO: 436052 - DNA, 15 bp, Homo sapiens
ttttcatgctaactc

SEQ ID NO: 436053 - DNA, 15 bp, Homo sapiens
tttcatgctaactcc

SEQ ID NO: 436054 - DNA, 15 bp, Homo sapiens
ttcatgctaactcct

SEQ ID NO: 436055 - DNA, 15 bp, Homo sapiens
tcatgctaactccta

SEQ ID NO: 436056 - DNA, 15 bp, Homo sapiens
catgctaactcctac

SEQ ID NO: 436057 - DNA, 15 bp, Homo sapiens
atgctaactcctact

SEQ ID NO: 436058 - DNA, 15 bp, Homo sapiens
tgctaactcctactg

SEQ ID NO: 436059 - DNA, 15 bp, Homo sapiens
gctaactcctactgt

SEQ ID NO: 436060 - DNA, 15 bp, Homo sapiens
ctaactcctactgta

SEQ ID NO: 436061 - DNA, 15 bp, Homo sapiens
taactcctactgtag

SEQ ID NO: 436062 - DNA, 15 bp, Homo sapiens
aactcctactgtagt

SEQ ID NO: 436063 - DNA, 15 bp, Homo sapiens
actcctactgtagta

SEQ ID NO: 436064 - DNA, 15 bp, Homo sapiens
ctcctactgtagtaa

SEQ ID NO: 436065 - DNA, 15 bp, Homo sapiens
tcctactgtagtaat

SEQ ID NO: 436066 - DNA, 15 bp, Homo sapiens
cctactgtagtaata

SEQ ID NO: 436067 - DNA, 15 bp, Homo sapiens
ctactgtagtaataa

SEQ ID NO: 436068 - DNA, 15 bp, Homo sapiens
tactgtagtaataaa

SEQ ID NO: 436069 - DNA, 15 bp, Homo sapiens
actgtagtaataaaa

SEQ ID NO: 436070 - DNA, 15 bp, Homo sapiens
ctgtagtaataaaat

SEQ ID NO: 436071 - DNA, 15 bp, Homo sapiens
tgtagtaataaaatc

SEQ ID NO: 436072 - DNA, 15 bp, Homo sapiens
gtagtaataaaatct

SEQ ID NO: 436073 - DNA, 15 bp, Homo sapiens
tagtaataaaatctc

SEQ ID NO: 436074 - DNA, 15 bp, Homo sapiens
agtaataaaatctca

SEQ ID NO: 436075 - DNA, 15 bp, Homo sapiens
gtaataaaatctcat

SEQ ID NO: 436076 - DNA, 15 bp, Homo sapiens
taataaaatctcatt

SEQ ID NO: 436077 - DNA, 15 bp, Homo sapiens
aataaaatctcattt

SEQ ID NO: 436078 - DNA, 15 bp, Homo sapiens
ataaaatctcattta

SEQ ID NO: 436079 - DNA, 15 bp, Homo sapiens
taaaatctcatttaa

SEQ ID NO: 436080 - DNA, 15 bp, Homo sapiens
aaaatctcatttaaa

SEQ ID NO: 436081 - DNA, 15 bp, Homo sapiens
aaatctcatttaaat

SEQ ID NO: 436082 - DNA, 15 bp, Homo sapiens
aatctcatttaaata

SEQ ID NO: 436083 - DNA, 15 bp, Homo sapiens
atctcatttaaataa

SEQ ID NO: 436084 - DNA, 15 bp, Homo sapiens
tctcatttaaataaa

SEQ ID NO: 436085 - DNA, 15 bp, Homo sapiens
ctcatttaaataaac

SEQ ID NO: 436086 - DNA, 15 bp, Homo sapiens
tcatttaaataaaca

SEQ ID NO: 436087 - DNA, 15 bp, Homo sapiens
catttaaataaacaa

SEQ ID NO: 436088 - DNA, 15 bp, Homo sapiens
atttaaataaacaat

SEQ ID NO: 436089 - DNA, 15 bp, Homo sapiens
tttaaataaacaata

SEQ ID NO: 436090 - DNA, 15 bp, Homo sapiens
ttaaataaacaatag

SEQ ID NO: 436091 - DNA, 15 bp, Homo sapiens
taaataaacaatagt

SEQ ID NO: 436092 - DNA, 15 bp, Homo sapiens
aaataaacaatagtc

SEQ ID NO: 436093 - DNA, 15 bp, Homo sapiens
aataaacaatagtct

SEQ ID NO: 436094 - DNA, 15 bp, Homo sapiens
ataaacaatagtctt

SEQ ID NO: 436095 - DNA, 15 bp, Homo sapiens
taaacaatagtcttc

SEQ ID NO: 436096 - DNA, 15 bp, Homo sapiens
aaacaatagtcttca

SEQ ID NO: 436097 - DNA, 15 bp, Homo sapiens
aacaatagtcttcat

SEQ ID NO: 436098 - DNA, 15 bp, Homo sapiens
acaatagtcttcatg

SEQ ID NO: 436099 - DNA, 15 bp, Homo sapiens
caatagtcttcatga

SEQ ID NO: 436100 - DNA, 15 bp, Homo sapiens
aatagtcttcatgaa

SEQ ID NO: 436101 - DNA, 15 bp, Homo sapiens
atagtcttcatgaag

SEQ ID NO: 436102 - DNA, 15 bp, Homo sapiens
tagtcttcatgaaga

SEQ ID NO: 436103 - DNA, 15 bp, Homo sapiens
agtcttcatgaagaa

SEQ ID NO: 436104 - DNA, 15 bp, Homo sapiens
gtcttcatgaagaat

SEQ ID NO: 436105 - DNA, 15 bp, Homo sapiens
tcttcatgaagaatt

SEQ ID NO: 436106 - DNA, 15 bp, Homo sapiens
cttcatgaagaatta

SEQ ID NO: 436107 - DNA, 15 bp, Homo sapiens
ttcatgaagaattat

SEQ ID NO: 436108 - DNA, 15 bp, Homo sapiens
tcatgaagaattata

SEQ ID NO: 436109 - DNA, 15 bp, Homo sapiens
catgaagaattatat

SEQ ID NO: 436110 - DNA, 15 bp, Homo sapiens
atgaagaattatatg

SEQ ID NO: 436111 - DNA, 15 bp, Homo sapiens
tgaagaattatatga

SEQ ID NO: 436112 - DNA, 15 bp, Homo sapiens
gaagaattatatgat

SEQ ID NO: 436113 - DNA, 15 bp, Homo sapiens
aagaattatatgata

SEQ ID NO: 436114 - DNA, 15 bp, Homo sapiens
agaattatatgataa

SEQ ID NO: 436115 - DNA, 15 bp, Homo sapiens
gaattatatgataaa

SEQ ID NO: 436116 - DNA, 15 bp, Homo sapiens
aattatatgataaag

SEQ ID NO: 436117 - DNA, 15 bp, Homo sapiens
attatatgataaaga

SEQ ID NO: 436118 - DNA, 15 bp, Homo sapiens
ttatatgataaagat

SEQ ID NO: 436119 - DNA, 15 bp, Homo sapiens
tatatgataaagatt

SEQ ID NO: 436120 - DNA, 15 bp, Homo sapiens
atatgataaagattt

SEQ ID NO: 436121 - DNA, 15 bp, Homo sapiens
tatgataaagatttg

SEQ ID NO: 436122 - DNA, 15 bp, Homo sapiens
atgataaagatttgt

SEQ ID NO: 436123 - DNA, 15 bp, Homo sapiens
tgataaagatttgtt

SEQ ID NO: 436124 - DNA, 15 bp, Homo sapiens
gataaagatttgttt

SEQ ID NO: 436125 - DNA, 15 bp, Homo sapiens
ataaagatttgtttg

SEQ ID NO: 436126 - DNA, 15 bp, Homo sapiens
taaagatttgtttga

SEQ ID NO: 436127 - DNA, 15 bp, Homo sapiens
aaagatttgtttgat

SEQ ID NO: 436128 - DNA, 15 bp, Homo sapiens
aagatttgtttgata

SEQ ID NO: 436129 - DNA, 15 bp, Homo sapiens
agatttgtttgatag

SEQ ID NO: 436130 - DNA, 15 bp, Homo sapiens
gatttgtttgataga

SEQ ID NO: 436131 - DNA, 15 bp, Homo sapiens
atttgtttgatagac

SEQ ID NO: 436132 - DNA, 15 bp, Homo sapiens
tttgtttgatagaca

SEQ ID NO: 436133 - DNA, 15 bp, Homo sapiens
ttgtttgatagacat

SEQ ID NO: 436134 - DNA, 15 bp, Homo sapiens
tgtttgatagacata

SEQ ID NO: 436135 - DNA, 15 bp, Homo sapiens
gtttgatagacatag

SEQ ID NO: 436136 - DNA, 15 bp, Homo sapiens
tttgatagacatagc

SEQ ID NO: 436137 - DNA, 15 bp, Homo sapiens
ttgatagacatagca

SEQ ID NO: 436138 - DNA, 15 bp, Homo sapiens
tgatagacatagcat

SEQ ID NO: 436139 - DNA, 15 bp, Homo sapiens
gatagacatagcatt

SEQ ID NO: 436140 - DNA, 15 bp, Homo sapiens
atagacatagcattt

SEQ ID NO: 436141 - DNA, 15 bp, Homo sapiens
tagacatagcatttt

SEQ ID NO: 436142 - DNA, 15 bp, Homo sapiens
agacatagcattttc

SEQ ID NO: 436143 - DNA, 15 bp, Homo sapiens
gacatagcattttca

SEQ ID NO: 436144 - DNA, 15 bp, Homo sapiens
acatagcattttcaa

SEQ ID NO: 436145 - DNA, 15 bp, Homo sapiens
catagcattttcaat

SEQ ID NO: 436146 - DNA, 15 bp, Homo sapiens
atagcattttcaatt

SEQ ID NO: 436147 - DNA, 15 bp, Homo sapiens
tagcattttcaatta

SEQ ID NO: 436148 - DNA, 15 bp, Homo sapiens
agcattttcaattaa

SEQ ID NO: 436149 - DNA, 15 bp, Homo sapiens
gcattttcaattaat

SEQ ID NO: 436150 - DNA, 15 bp, Homo sapiens
cattttcaattaatt

SEQ ID NO: 436151 - DNA, 15 bp, Homo sapiens
attttcaattaattg

SEQ ID NO: 436152 - DNA, 15 bp, Homo sapiens
ttttcaattaattgt

SEQ ID NO: 436153 - DNA, 15 bp, Homo sapiens
tttcaattaattgtt

SEQ ID NO: 436154 - DNA, 15 bp, Homo sapiens
ttcaattaattgttt

SEQ ID NO: 436155 - DNA, 15 bp, Homo sapiens
tcaattaattgttta

SEQ ID NO: 436156 - DNA, 15 bp, Homo sapiens
caattaattgtttac

SEQ ID NO: 436157 - DNA, 15 bp, Homo sapiens
aattaattgtttacc

SEQ ID NO: 436158 - DNA, 15 bp, Homo sapiens
attaattgtttacca

SEQ ID NO: 436159 - DNA, 15 bp, Homo sapiens
ttaattgtttaccat

SEQ ID NO: 436160 - DNA, 15 bp, Homo sapiens
taattgtttaccatc

SEQ ID NO: 436161 - DNA, 15 bp, Homo sapiens
aattgtttaccatct

SEQ ID NO: 436162 - DNA, 15 bp, Homo sapiens
attgtttaccatctg

SEQ ID NO: 436163 - DNA, 15 bp, Homo sapiens
ttgtttaccatctgt

SEQ ID NO: 436164 - DNA, 15 bp, Homo sapiens
tgtttaccatctgtt

SEQ ID NO: 436165 - DNA, 15 bp, Homo sapiens
gtttaccatctgtta

SEQ ID NO: 436166 - DNA, 15 bp, Homo sapiens
tttaccatctgttat

SEQ ID NO: 436167 - DNA, 15 bp, Homo sapiens
ttaccatctgttatg

SEQ ID NO: 436168 - DNA, 15 bp, Homo sapiens
taccatctgttatgt

SEQ ID NO: 436169 - DNA, 15 bp, Homo sapiens
accatctgttatgtt

SEQ ID NO: 436170 - DNA, 15 bp, Homo sapiens
ccatctgttatgttc

SEQ ID NO: 436171 - DNA, 15 bp, Homo sapiens
catctgttatgttct

SEQ ID NO: 436172 - DNA, 15 bp, Homo sapiens
atctgttatgttctc

SEQ ID NO: 436173 - DNA, 15 bp, Homo sapiens
tctgttatgttctct

SEQ ID NO: 436174 - DNA, 15 bp, Homo sapiens
ctgttatgttctcta

SEQ ID NO: 436175 - DNA, 15 bp, Homo sapiens
tgttatgttctctaa

SEQ ID NO: 436176 - DNA, 15 bp, Homo sapiens
gttatgttctctaat

SEQ ID NO: 436177 - DNA, 15 bp, Homo sapiens
ttatgttctctaatc

SEQ ID NO: 436178 - DNA, 15 bp, Homo sapiens
tatgttctctaatca

SEQ ID NO: 436179 - DNA, 15 bp, Homo sapiens
atgttctctaatcag

SEQ ID NO: 436180 - DNA, 15 bp, Homo sapiens
tgttctctaatcagt

SEQ ID NO: 436181 - DNA, 15 bp, Homo sapiens
gttctctaatcagtg

SEQ ID NO: 436182 - DNA, 15 bp, Homo sapiens
ttctctaatcagtgt

SEQ ID NO: 436183 - DNA, 15 bp, Homo sapiens
tctctaatcagtgtt

SEQ ID NO: 436184 - DNA, 15 bp, Homo sapiens
ctctaatcagtgtta

SEQ ID NO: 436185 - DNA, 15 bp, Homo sapiens
tctaatcagtgttac

SEQ ID NO: 436186 - DNA, 15 bp, Homo sapiens
ctaatcagtgttaca

SEQ ID NO: 436187 - DNA, 15 bp, Homo sapiens
taatcagtgttacag

SEQ ID NO: 436188 - DNA, 15 bp, Homo sapiens
aatcagtgttacagc

SEQ ID NO: 436189 - DNA, 15 bp, Homo sapiens
atcagtgttacagcc

SEQ ID NO: 436190 - DNA, 15 bp, Homo sapiens
tcagtgttacagcca

SEQ ID NO: 436191 - DNA, 15 bp, Homo sapiens
cagtgttacagccat

SEQ ID NO: 436192 - DNA, 15 bp, Homo sapiens
agtgttacagccatt

SEQ ID NO: 436193 - DNA, 15 bp, Homo sapiens
gtgttacagccattc

SEQ ID NO: 436194 - DNA, 15 bp, Homo sapiens
tgttacagccattca

SEQ ID NO: 436195 - DNA, 15 bp, Homo sapiens
gttacagccattcat

SEQ ID NO: 436196 - DNA, 15 bp, Homo sapiens
ttacagccattcata

SEQ ID NO: 436197 - DNA, 15 bp, Homo sapiens
tacagccattcataa

SEQ ID NO: 436198 - DNA, 15 bp, Homo sapiens
acagccattcataaa

SEQ ID NO: 436199 - DNA, 15 bp, Homo sapiens
cagccattcataaat

SEQ ID NO: 436200 - DNA, 15 bp, Homo sapiens
agccattcataaatc

SEQ ID NO: 436201 - DNA, 15 bp, Homo sapiens
gccattcataaatca

SEQ ID NO: 436202 - DNA, 15 bp, Homo sapiens
ccattcataaatcac

SEQ ID NO: 436203 - DNA, 15 bp, Homo sapiens
cattcataaatcaca

SEQ ID NO: 436204 - DNA, 15 bp, Homo sapiens
attcataaatcacat

SEQ ID NO: 436205 - DNA, 15 bp, Homo sapiens
ttcataaatcacatt

SEQ ID NO: 436206 - DNA, 15 bp, Homo sapiens
tcataaatcacattt

SEQ ID NO: 436207 - DNA, 15 bp, Homo sapiens
cataaatcacatttg

SEQ ID NO: 436208 - DNA, 15 bp, Homo sapiens
ataaatcacatttgc

SEQ ID NO: 436209 - DNA, 15 bp, Homo sapiens
taaatcacatttgcc

SEQ ID NO: 436210 - DNA, 15 bp, Homo sapiens
aatcacatttgcctc

SEQ ID NO: 436211 - DNA, 15 bp, Homo sapiens
atcacatttgcctca

SEQ ID NO: 436212 - DNA, 15 bp, Homo sapiens
tcacatttgcctcat

SEQ ID NO: 436213 - DNA, 15 bp, Homo sapiens
cacatttgcctcata

SEQ ID NO: 436214 - DNA, 15 bp, Homo sapiens
acatttgcctcataa

SEQ ID NO: 436215 - DNA, 15 bp, Homo sapiens
catttgcctcataaa

SEQ ID NO: 436216 - DNA, 15 bp, Homo sapiens
atttgcctcataaaa

SEQ ID NO: 436217 - DNA, 15 bp, Homo sapiens
tttgcctcataaaaa

SEQ ID NO: 436218 - DNA, 15 bp, Homo sapiens
ttgcctcataaaaag

SEQ ID NO: 436219 - DNA, 15 bp, Homo sapiens
tgcctcataaaaaga

SEQ ID NO: 436220 - DNA, 15 bp, Homo sapiens
gcctcataaaaagat

SEQ ID NO: 436221 - DNA, 15 bp, Homo sapiens
cctcataaaaagatg

SEQ ID NO: 436222 - DNA, 15 bp, Homo sapiens
ctcataaaaagatgg

SEQ ID NO: 436223 - DNA, 15 bp, Homo sapiens
tcataaaaagatggc

SEQ ID NO: 436224 - DNA, 15 bp, Homo sapiens
cataaaaagatggca

SEQ ID NO: 436225 - DNA, 15 bp, Homo sapiens
ataaaaagatggcaa

SEQ ID NO: 436226 - DNA, 15 bp, Homo sapiens
taaaaagatggcaat

SEQ ID NO: 436227 - DNA, 15 bp, Homo sapiens
aaaaagatggcaatc

SEQ ID NO: 436228 - DNA, 15 bp, Homo sapiens
aaaagatggcaatcg

SEQ ID NO: 436229 - DNA, 15 bp, Homo sapiens
aaagatggcaatcgt

SEQ ID NO: 436230 - DNA, 15 bp, Homo sapiens
aagatggcaatcgtt

SEQ ID NO: 436231 - DNA, 15 bp, Homo sapiens
agatggcaatcgttt

SEQ ID NO: 436232 - DNA, 15 bp, Homo sapiens
gatggcaatcgttta

SEQ ID NO: 436233 - DNA, 15 bp, Homo sapiens
atggcaatcgtttac

SEQ ID NO: 436234 - DNA, 15 bp, Homo sapiens
tggcaatcgtttaca

SEQ ID NO: 436235 - DNA, 15 bp, Homo sapiens
ggcaatcgtttacac

SEQ ID NO: 436236 - DNA, 15 bp, Homo sapiens
gcaatcgtttacacg

SEQ ID NO: 436237 - DNA, 15 bp, Homo sapiens
caatcgtttacacgt

SEQ ID NO: 436238 - DNA, 15 bp, Homo sapiens
aatcgtttacacgtg

SEQ ID NO: 436239 - DNA, 15 bp, Homo sapiens
atcgtttacacgtgt

SEQ ID NO: 436240 - DNA, 15 bp, Homo sapiens
tcgtttacacgtgtg

SEQ ID NO: 436241 - DNA, 15 bp, Homo sapiens
cgtttacacgtgtgt

SEQ ID NO: 436242 - DNA, 15 bp, Homo sapiens
gtttacacgtgtgta

SEQ ID NO: 436243 - DNA, 15 bp, Homo sapiens
tttacacgtgtgtat

SEQ ID NO: 436244 - DNA, 15 bp, Homo sapiens
ttacacgtgtgtatt

SEQ ID NO: 436245 - DNA, 15 bp, Homo sapiens
tacacgtgtgtattt

SEQ ID NO: 436246 - DNA, 15 bp, Homo sapiens
acacgtgtgtatttt

SEQ ID NO: 436247 - DNA, 15 bp, Homo sapiens
cacgtgtgtatttta

SEQ ID NO: 436248 - DNA, 15 bp, Homo sapiens
acgtgtgtattttat

SEQ ID NO: 436249 - DNA, 15 bp, Homo sapiens
cgtgtgtattttatt

SEQ ID NO: 436250 - DNA, 15 bp, Homo sapiens
gtgtgtattttatta

SEQ ID NO: 436251 - DNA, 15 bp, Homo sapiens
tgtgtattttattat

SEQ ID NO: 436252 - DNA, 15 bp, Homo sapiens
tgtattttattataa

SEQ ID NO: 436253 - DNA, 15 bp, Homo sapiens
gtattttattataat

SEQ ID NO: 436254 - DNA, 15 bp, Homo sapiens
tattttattataatc

SEQ ID NO: 436255 - DNA, 15 bp, Homo sapiens
attttattataatca

SEQ ID NO: 436256 - DNA, 15 bp, Homo sapiens
ttttattataatcag

SEQ ID NO: 436257 - DNA, 15 bp, Homo sapiens
tttattataatcagc

SEQ ID NO: 436258 - DNA, 15 bp, Homo sapiens
ttattataatcagca

SEQ ID NO: 436259 - DNA, 15 bp, Homo sapiens
tattataatcagcat

SEQ ID NO: 436260 - DNA, 15 bp, Homo sapiens
attataatcagcatc

SEQ ID NO: 436261 - DNA, 15 bp, Homo sapiens
ttataatcagcatct

SEQ ID NO: 436262 - DNA, 15 bp, Homo sapiens
tataatcagcatctg

SEQ ID NO: 436263 - DNA, 15 bp, Homo sapiens
ataatcagcatctga

SEQ ID NO: 436264 - DNA, 15 bp, Homo sapiens
taatcagcatctgag

SEQ ID NO: 436265 - DNA, 15 bp, Homo sapiens
aatcagcatctgaga

SEQ ID NO: 436266 - DNA, 15 bp, Homo sapiens
atcagcatctgagac

SEQ ID NO: 436267 - DNA, 15 bp, Homo sapiens
tcagcatctgagaca

SEQ ID NO: 436268 - DNA, 15 bp, Homo sapiens
cagcatctgagacat

SEQ ID NO: 436269 - DNA, 15 bp, Homo sapiens
agcatctgagacatt

SEQ ID NO: 436270 - DNA, 15 bp, Homo sapiens
gcatctgagacatta

SEQ ID NO: 436271 - DNA, 15 bp, Homo sapiens
catctgagacattac

SEQ ID NO: 436272 - DNA, 15 bp, Homo sapiens
atctgagacattact

SEQ ID NO: 436273 - DNA, 15 bp, Homo sapiens
tctgagacattactt

SEQ ID NO: 436274 - DNA, 15 bp, Homo sapiens
ctgagacattacttt

SEQ ID NO: 436275 - DNA, 15 bp, Homo sapiens
tgagacattactttc

SEQ ID NO: 436276 - DNA, 15 bp, Homo sapiens
gagacattactttct

SEQ ID NO: 436277 - DNA, 15 bp, Homo sapiens
agacattactttctg

SEQ ID NO: 436278 - DNA, 15 bp, Homo sapiens
gacattactttctga

SEQ ID NO: 436279 - DNA, 15 bp, Homo sapiens
acattactttctgat

SEQ ID NO: 436280 - DNA, 15 bp, Homo sapiens
cattactttctgatt

SEQ ID NO: 436281 - DNA, 15 bp, Homo sapiens
attactttctgattt

SEQ ID NO: 436282 - DNA, 15 bp, Homo sapiens
ttactttctgattta

SEQ ID NO: 436283 - DNA, 15 bp, Homo sapiens
tactttctgatttaa

SEQ ID NO: 436284 - DNA, 15 bp, Homo sapiens
actttctgatttaaa

SEQ ID NO: 436285 - DNA, 15 bp, Homo sapiens
ctttctgatttaaac

SEQ ID NO: 436286 - DNA, 15 bp, Homo sapiens
tttctgatttaaaca

SEQ ID NO: 436287 - DNA, 15 bp, Homo sapiens
ttctgatttaaacat

SEQ ID NO: 436288 - DNA, 15 bp, Homo sapiens
tctgatttaaacata

SEQ ID NO: 436289 - DNA, 15 bp, Homo sapiens
ctgatttaaacataa

SEQ ID NO: 436290 - DNA, 15 bp, Homo sapiens
tgatttaaacataaa

SEQ ID NO: 436291 - DNA, 15 bp, Homo sapiens
gatttaaacataaag

SEQ ID NO: 436292 - DNA, 15 bp, Homo sapiens
atttaaacataaagg

SEQ ID NO: 436293 - DNA, 15 bp, Homo sapiens
tttaaacataaagga

SEQ ID NO: 436294 - DNA, 15 bp, Homo sapiens
ttaaacataaaggac

SEQ ID NO: 436295 - DNA, 15 bp, Homo sapiens
taaacataaaggacc

SEQ ID NO: 436296 - DNA, 15 bp, Homo sapiens
aaacataaaggaccg

SEQ ID NO: 436297 - DNA, 15 bp, Homo sapiens
aacataaaggaccgg

SEQ ID NO: 436298 - DNA, 15 bp, Homo sapiens
acataaaggaccgga

SEQ ID NO: 436299 - DNA, 15 bp, Homo sapiens
cataaaggaccggag

SEQ ID NO: 436300 - DNA, 15 bp, Homo sapiens
ataaaggaccggagg

SEQ ID NO: 436301 - DNA, 15 bp, Homo sapiens
taaaggaccggagga

SEQ ID NO: 436302 - DNA, 15 bp, Homo sapiens
aaaggaccggaggat

SEQ ID NO: 436303 - DNA, 15 bp, Homo sapiens
aaggaccggaggata

SEQ ID NO: 436304 - DNA, 15 bp, Homo sapiens
aggaccggaggatac

SEQ ID NO: 436305 - DNA, 15 bp, Homo sapiens
ggaccggaggataca

SEQ ID NO: 436306 - DNA, 15 bp, Homo sapiens
gaccggaggatacaa

SEQ ID NO: 436307 - DNA, 15 bp, Homo sapiens
accggaggatacaag

SEQ ID NO: 436308 - DNA, 15 bp, Homo sapiens
ccggaggatacaaga

SEQ ID NO: 436309 - DNA, 15 bp, Homo sapiens
cggaggatacaagac

SEQ ID NO: 436310 - DNA, 15 bp, Homo sapiens
ggaggatacaagact

SEQ ID NO: 436311 - DNA, 15 bp, Homo sapiens
gaggatacaagactc

SEQ ID NO: 436312 - DNA, 15 bp, Homo sapiens
aggatacaagactct

SEQ ID NO: 436313 - DNA, 15 bp, Homo sapiens
ggatacaagactctt

SEQ ID NO: 436314 - DNA, 15 bp, Homo sapiens
gatacaagactcttt

SEQ ID NO: 436315 - DNA, 15 bp, Homo sapiens
atacaagactctttg

SEQ ID NO: 436316 - DNA, 15 bp, Homo sapiens
tacaagactctttga

SEQ ID NO: 436317 - DNA, 15 bp, Homo sapiens
acaagactctttgag

SEQ ID NO: 436318 - DNA, 15 bp, Homo sapiens
caagactctttgagc

SEQ ID NO: 436319 - DNA, 15 bp, Homo sapiens
aagactctttgagcg

SEQ ID NO: 436320 - DNA, 15 bp, Homo sapiens
agactctttgagcgt

SEQ ID NO: 436321 - DNA, 15 bp, Homo sapiens
gactctttgagcgtg

SEQ ID NO: 436322 - DNA, 15 bp, Homo sapiens
actctttgagcgtgg

SEQ ID NO: 436323 - DNA, 15 bp, Homo sapiens
ctctttgagcgtggt

SEQ ID NO: 436324 - DNA, 15 bp, Homo sapiens
tctttgagcgtggta

SEQ ID NO: 436325 - DNA, 15 bp, Homo sapiens
ctttgagcgtggtat

SEQ ID NO: 436326 - DNA, 15 bp, Homo sapiens
tttgagcgtggtata

SEQ ID NO: 436327 - DNA, 15 bp, Homo sapiens
ttgagcgtggtataa

SEQ ID NO: 436328 - DNA, 15 bp, Homo sapiens
tgagcgtggtataat

SEQ ID NO: 436329 - DNA, 15 bp, Homo sapiens
gagcgtggtataatg

SEQ ID NO: 436330 - DNA, 15 bp, Homo sapiens
agcgtggtataatgt

SEQ ID NO: 436331 - DNA, 15 bp, Homo sapiens
gcgtggtataatgta

SEQ ID NO: 436332 - DNA, 15 bp, Homo sapiens
cgtggtataatgtac

SEQ ID NO: 436333 - DNA, 15 bp, Homo sapiens
gtggtataatgtact

SEQ ID NO: 436334 - DNA, 15 bp, Homo sapiens
tggtataatgtactt

SEQ ID NO: 436335 - DNA, 15 bp, Homo sapiens
ggtataatgtactta

SEQ ID NO: 436336 - DNA, 15 bp, Homo sapiens
gtataatgtacttat

SEQ ID NO: 436337 - DNA, 15 bp, Homo sapiens
tataatgtacttatg

SEQ ID NO: 436338 - DNA, 15 bp, Homo sapiens
ataatgtacttatgt

SEQ ID NO: 436339 - DNA, 15 bp, Homo sapiens
taatgtacttatgtt

SEQ ID NO: 436340 - DNA, 15 bp, Homo sapiens
aatgtacttatgttt

SEQ ID NO: 436341 - DNA, 15 bp, Homo sapiens
atgtacttatgtttt

SEQ ID NO: 436342 - DNA, 15 bp, Homo sapiens
tgtacttatgttttg

SEQ ID NO: 436343 - DNA, 15 bp, Homo sapiens
gtacttatgttttgt

SEQ ID NO: 436344 - DNA, 15 bp, Homo sapiens
tacttatgttttgtg

SEQ ID NO: 436345 - DNA, 15 bp, Homo sapiens
acttatgttttgtga

SEQ ID NO: 436346 - DNA, 15 bp, Homo sapiens
cttatgttttgtgat

SEQ ID NO: 436347 - DNA, 15 bp, Homo sapiens
ttatgttttgtgatt

SEQ ID NO: 436348 - DNA, 15 bp, Homo sapiens
tatgttttgtgattg

SEQ ID NO: 436349 - DNA, 15 bp, Homo sapiens
atgttttgtgattgt

SEQ ID NO: 436350 - DNA, 15 bp, Homo sapiens
tgttttgtgattgtt

SEQ ID NO: 436351 - DNA, 15 bp, Homo sapiens
gttttgtgattgttg

SEQ ID NO: 436352 - DNA, 15 bp, Homo sapiens
ttttgtgattgttgt

SEQ ID NO: 436353 - DNA, 15 bp, Homo sapiens
tttgtgattgttgtt

SEQ ID NO: 436354 - DNA, 15 bp, Homo sapiens
ttgtgattgttgttg

SEQ ID NO: 436355 - DNA, 15 bp, Homo sapiens
tgtgattgttgttgt

SEQ ID NO: 436356 - DNA, 15 bp, Homo sapiens
gtgattgttgttgtt

SEQ ID NO: 436357 - DNA, 15 bp, Homo sapiens
tgattgttgttgttc

SEQ ID NO: 436358 - DNA, 15 bp, Homo sapiens
gattgttgttgttct

SEQ ID NO: 436359 - DNA, 15 bp, Homo sapiens
attgttgttgttctt

SEQ ID NO: 436360 - DNA, 15 bp, Homo sapiens
ttgttgttgttctta

SEQ ID NO: 436361 - DNA, 15 bp, Homo sapiens
tgttgttgttcttag

SEQ ID NO: 436362 - DNA, 15 bp, Homo sapiens
gttgttgttcttagt

SEQ ID NO: 436363 - DNA, 15 bp, Homo sapiens
ttgttgttcttagta

SEQ ID NO: 436364 - DNA, 15 bp, Homo sapiens
tgttgttcttagtag

SEQ ID NO: 436365 - DNA, 15 bp, Homo sapiens
gttgttcttagtaga

SEQ ID NO: 436366 - DNA, 15 bp, Homo sapiens
ttgttcttagtagaa

SEQ ID NO: 436367 - DNA, 15 bp, Homo sapiens
tgttcttagtagaaa

SEQ ID NO: 436368 - DNA, 15 bp, Homo sapiens
gttcttagtagaaaa

SEQ ID NO: 436369 - DNA, 15 bp, Homo sapiens
ttcttagtagaaaac

SEQ ID NO: 436370 - DNA, 15 bp, Homo sapiens
tcttagtagaaaact

SEQ ID NO: 436371 - DNA, 15 bp, Homo sapiens
cttagtagaaaactg

SEQ ID NO: 436372 - DNA, 15 bp, Homo sapiens
ttagtagaaaactgg

SEQ ID NO: 436373 - DNA, 15 bp, Homo sapiens
tagtagaaaactgga

SEQ ID NO: 436374 - DNA, 15 bp, Homo sapiens
agtagaaaactggaa

SEQ ID NO: 436375 - DNA, 15 bp, Homo sapiens
gtagaaaactggaat

SEQ ID NO: 436376 - DNA, 15 bp, Homo sapiens
tagaaaactggaatc

SEQ ID NO: 436377 - DNA, 15 bp, Homo sapiens
agaaaactggaatct

SEQ ID NO: 436378 - DNA, 15 bp, Homo sapiens
gaaaactggaatctt

SEQ ID NO: 436379 - DNA, 15 bp, Homo sapiens
aaaactggaatcttc

SEQ ID NO: 436380 - DNA, 15 bp, Homo sapiens
aaactggaatcttcc

SEQ ID NO: 436381 - DNA, 15 bp, Homo sapiens
aactggaatcttcca

SEQ ID NO: 436382 - DNA, 15 bp, Homo sapiens
actggaatcttccaa

SEQ ID NO: 436383 - DNA, 15 bp, Homo sapiens
ctggaatcttccaag

SEQ ID NO: 436384 - DNA, 15 bp, Homo sapiens
tggaatcttccaaga

SEQ ID NO: 436385 - DNA, 15 bp, Homo sapiens
ggaatcttccaagaa

SEQ ID NO: 436386 - DNA, 15 bp, Homo sapiens
gaatcttccaagaat

SEQ ID NO: 436387 - DNA, 15 bp, Homo sapiens
aatcttccaagaatt

SEQ ID NO: 436388 - DNA, 15 bp, Homo sapiens
atcttccaagaatta

SEQ ID NO: 436389 - DNA, 15 bp, Homo sapiens
tcttccaagaattag

SEQ ID NO: 436390 - DNA, 15 bp, Homo sapiens
cttccaagaattaga

SEQ ID NO: 436391 - DNA, 15 bp, Homo sapiens
ttccaagaattagag

SEQ ID NO: 436392 - DNA, 15 bp, Homo sapiens
tccaagaattagagg

SEQ ID NO: 436393 - DNA, 15 bp, Homo sapiens
ccaagaattagaggt

SEQ ID NO: 436394 - DNA, 15 bp, Homo sapiens
caagaattagaggtt

SEQ ID NO: 436395 - DNA, 15 bp, Homo sapiens
aagaattagaggttt

SEQ ID NO: 436396 - DNA, 15 bp, Homo sapiens
agaattagaggtttt

SEQ ID NO: 436397 - DNA, 15 bp, Homo sapiens
gaattagaggttttg

SEQ ID NO: 436398 - DNA, 15 bp, Homo sapiens
aattagaggttttgc

SEQ ID NO: 436399 - DNA, 15 bp, Homo sapiens
attagaggttttgcc

SEQ ID NO: 436400 - DNA, 15 bp, Homo sapiens
ttagaggttttgcca

SEQ ID NO: 436401 - DNA, 15 bp, Homo sapiens
tagaggttttgccat

SEQ ID NO: 436402 - DNA, 15 bp, Homo sapiens
agaggttttgccatt

SEQ ID NO: 436403 - DNA, 15 bp, Homo sapiens
gaggttttgccattt

SEQ ID NO: 436404 - DNA, 15 bp, Homo sapiens
aggttttgccatttt

SEQ ID NO: 436405 - DNA, 15 bp, Homo sapiens
ggttttgccattttt

SEQ ID NO: 436406 - DNA, 15 bp, Homo sapiens
gttttgccatttttt

SEQ ID NO: 436407 - DNA, 15 bp, Homo sapiens
ttttgccatttttta

SEQ ID NO: 436408 - DNA, 15 bp, Homo sapiens
tttgccattttttaa

SEQ ID NO: 436409 - DNA, 15 bp, Homo sapiens
ttgccattttttaag

SEQ ID NO: 436410 - DNA, 15 bp, Homo sapiens
tgccattttttaaga

SEQ ID NO: 436411 - DNA, 15 bp, Homo sapiens
gccattttttaagaa

SEQ ID NO: 436412 - DNA, 15 bp, Homo sapiens
ccattttttaagaag

SEQ ID NO: 436413 - DNA, 15 bp, Homo sapiens
cattttttaagaagt

SEQ ID NO: 436414 - DNA, 15 bp, Homo sapiens
attttttaagaagta

SEQ ID NO: 436415 - DNA, 15 bp, Homo sapiens
ttttttaagaagtat

SEQ ID NO: 436416 - DNA, 15 bp, Homo sapiens
tttttaagaagtata

SEQ ID NO: 436417 - DNA, 15 bp, Homo sapiens
ttttaagaagtataa

SEQ ID NO: 436418 - DNA, 15 bp, Homo sapiens
tttaagaagtataat

SEQ ID NO: 436419 - DNA, 15 bp, Homo sapiens
ttaagaagtataatc

SEQ ID NO: 436420 - DNA, 15 bp, Homo sapiens
taagaagtataatcc

SEQ ID NO: 436421 - DNA, 15 bp, Homo sapiens
aagaagtataatcct

SEQ ID NO: 436422 - DNA, 15 bp, Homo sapiens
agaagtataatccta

SEQ ID NO: 436423 - DNA, 15 bp, Homo sapiens
gaagtataatcctag

SEQ ID NO: 436424 - DNA, 15 bp, Homo sapiens
aagtataatcctagc

SEQ ID NO: 436425 - DNA, 15 bp, Homo sapiens
agtataatcctagca

SEQ ID NO: 436426 - DNA, 15 bp, Homo sapiens
gtataatcctagcaa

SEQ ID NO: 436427 - DNA, 15 bp, Homo sapiens
tataatcctagcaaa

SEQ ID NO: 436428 - DNA, 15 bp, Homo sapiens
ataatcctagcaaag

SEQ ID NO: 436429 - DNA, 15 bp, Homo sapiens
taatcctagcaaagg

SEQ ID NO: 436430 - DNA, 15 bp, Homo sapiens
aatcctagcaaaggc

SEQ ID NO: 436431 - DNA, 15 bp, Homo sapiens
atcctagcaaaggca

SEQ ID NO: 436432 - DNA, 15 bp, Homo sapiens
tcctagcaaaggcat

SEQ ID NO: 436433 - DNA, 15 bp, Homo sapiens
cctagcaaaggcatg

SEQ ID NO: 436434 - DNA, 15 bp, Homo sapiens
ctagcaaaggcatga

SEQ ID NO: 436435 - DNA, 15 bp, Homo sapiens
tagcaaaggcatgaa

SEQ ID NO: 436436 - DNA, 15 bp, Homo sapiens
agcaaaggcatgaat

SEQ ID NO: 436437 - DNA, 15 bp, Homo sapiens
gcaaaggcatgaatt

SEQ ID NO: 436438 - DNA, 15 bp, Homo sapiens
caaaggcatgaattc

SEQ ID NO: 436439 - DNA, 15 bp, Homo sapiens
aaaggcatgaattct

SEQ ID NO: 436440 - DNA, 15 bp, Homo sapiens
aaggcatgaattctc

SEQ ID NO: 436441 - DNA, 15 bp, Homo sapiens
aggcatgaattctcc

SEQ ID NO: 436442 - DNA, 15 bp, Homo sapiens
ggcatgaattctcct

SEQ ID NO: 436443 - DNA, 15 bp, Homo sapiens
gcatgaattctcctc

SEQ ID NO: 436444 - DNA, 15 bp, Homo sapiens
catgaattctcctct

SEQ ID NO: 436445 - DNA, 15 bp, Homo sapiens
atgaattctcctctt

SEQ ID NO: 436446 - DNA, 15 bp, Homo sapiens
tgaattctcctcttc

SEQ ID NO: 436447 - DNA, 15 bp, Homo sapiens
gaattctcctcttca

SEQ ID NO: 436448 - DNA, 15 bp, Homo sapiens
aattctcctcttcaa

SEQ ID NO: 436449 - DNA, 15 bp, Homo sapiens
attctcctcttcaat

SEQ ID NO: 436450 - DNA, 15 bp, Homo sapiens
ttctcctcttcaatt

SEQ ID NO: 436451 - DNA, 15 bp, Homo sapiens
tctcctcttcaatta

SEQ ID NO: 436452 - DNA, 15 bp, Homo sapiens
ctcctcttcaattaa

SEQ ID NO: 436453 - DNA, 15 bp, Homo sapiens
tcctcttcaattaaa

SEQ ID NO: 436454 - DNA, 15 bp, Homo sapiens
cctcttcaattaaac

SEQ ID NO: 436455 - DNA, 15 bp, Homo sapiens
ctcttcaattaaact

SEQ ID NO: 436456 - DNA, 15 bp, Homo sapiens
tcttcaattaaactc

SEQ ID NO: 436457 - DNA, 15 bp, Homo sapiens
cttcaattaaactca

SEQ ID NO: 436458 - DNA, 15 bp, Homo sapiens
ttcaattaaactcat

SEQ ID NO: 436459 - DNA, 15 bp, Homo sapiens
tcaattaaactcatc

SEQ ID NO: 436460 - DNA, 15 bp, Homo sapiens
caattaaactcatca

SEQ ID NO: 436461 - DNA, 15 bp, Homo sapiens
aattaaactcatcac

SEQ ID NO: 436462 - DNA, 15 bp, Homo sapiens
attaaactcatcact

SEQ ID NO: 436463 - DNA, 15 bp, Homo sapiens
ttaaactcatcactt

SEQ ID NO: 436464 - DNA, 15 bp, Homo sapiens
taaactcatcactta

SEQ ID NO: 436465 - DNA, 15 bp, Homo sapiens
aaactcatcacttat

SEQ ID NO: 436466 - DNA, 15 bp, Homo sapiens
aactcatcacttatt

SEQ ID NO: 436467 - DNA, 15 bp, Homo sapiens
actcatcacttattt

SEQ ID NO: 436468 - DNA, 15 bp, Homo sapiens
ctcatcacttatttt

SEQ ID NO: 436469 - DNA, 15 bp, Homo sapiens
tcatcacttattttg

SEQ ID NO: 436470 - DNA, 15 bp, Homo sapiens
catcacttattttgg

SEQ ID NO: 436471 - DNA, 15 bp, Homo sapiens
atcacttattttggc

SEQ ID NO: 436472 - DNA, 15 bp, Homo sapiens
tcacttattttggca

SEQ ID NO: 436473 - DNA, 15 bp, Homo sapiens
cacttattttggcag

SEQ ID NO: 436474 - DNA, 15 bp, Homo sapiens
acttattttggcagt

SEQ ID NO: 436475 - DNA, 15 bp, Homo sapiens
cttattttggcagta

SEQ ID NO: 436476 - DNA, 15 bp, Homo sapiens
ttattttggcagtac

SEQ ID NO: 436477 - DNA, 15 bp, Homo sapiens
tattttggcagtaca

SEQ ID NO: 436478 - DNA, 15 bp, Homo sapiens
attttggcagtacat

SEQ ID NO: 436479 - DNA, 15 bp, Homo sapiens
ttttggcagtacata

SEQ ID NO: 436480 - DNA, 15 bp, Homo sapiens
tttggcagtacataa

SEQ ID NO: 436481 - DNA, 15 bp, Homo sapiens
ttggcagtacataaa

SEQ ID NO: 436482 - DNA, 15 bp, Homo sapiens
tggcagtacataaac

SEQ ID NO: 436483 - DNA, 15 bp, Homo sapiens
ggcagtacataaaca

SEQ ID NO: 436484 - DNA, 15 bp, Homo sapiens
gcagtacataaacat

SEQ ID NO: 436485 - DNA, 15 bp, Homo sapiens
cagtacataaacata

SEQ ID NO: 436486 - DNA, 15 bp, Homo sapiens
agtacataaacataa

SEQ ID NO: 436487 - DNA, 15 bp, Homo sapiens
gtacataaacataag

SEQ ID NO: 436488 - DNA, 15 bp, Homo sapiens
tacataaacataagc

SEQ ID NO: 436489 - DNA, 15 bp, Homo sapiens
acataaacataagcc

SEQ ID NO: 436490 - DNA, 15 bp, Homo sapiens
cataaacataagcca

SEQ ID NO: 436491 - DNA, 15 bp, Homo sapiens
ataaacataagccat

SEQ ID NO: 436492 - DNA, 15 bp, Homo sapiens
taaacataagccata

SEQ ID NO: 436493 - DNA, 15 bp, Homo sapiens
aaacataagccatat

SEQ ID NO: 436494 - DNA, 15 bp, Homo sapiens
aacataagccatatt

SEQ ID NO: 436495 - DNA, 15 bp, Homo sapiens
acataagccatattt

SEQ ID NO: 436496 - DNA, 15 bp, Homo sapiens
cataagccatattta

SEQ ID NO: 436497 - DNA, 15 bp, Homo sapiens
ataagccatatttaa

SEQ ID NO: 436498 - DNA, 15 bp, Homo sapiens
taagccatatttaac

SEQ ID NO: 436499 - DNA, 15 bp, Homo sapiens
aagccatatttaact

SEQ ID NO: 436500 - DNA, 15 bp, Homo sapiens
agccatatttaactt

SEQ ID NO: 436501 - DNA, 15 bp, Homo sapiens
gccatatttaactta

SEQ ID NO: 436502 - DNA, 15 bp, Homo sapiens
ccatatttaacttat

SEQ ID NO: 436503 - DNA, 15 bp, Homo sapiens
catatttaacttata

SEQ ID NO: 436504 - DNA, 15 bp, Homo sapiens
atatttaacttataa

SEQ ID NO: 436505 - DNA, 15 bp, Homo sapiens
tatttaacttataag

SEQ ID NO: 436506 - DNA, 15 bp, Homo sapiens
atttaacttataaga

SEQ ID NO: 436507 - DNA, 15 bp, Homo sapiens
tttaacttataagaa

SEQ ID NO: 436508 - DNA, 15 bp, Homo sapiens
ttaacttataagaat

SEQ ID NO: 436509 - DNA, 15 bp, Homo sapiens
taacttataagaatg

SEQ ID NO: 436510 - DNA, 15 bp, Homo sapiens
aacttataagaatgg

SEQ ID NO: 436511 - DNA, 15 bp, Homo sapiens
acttataagaatggc

SEQ ID NO: 436512 - DNA, 15 bp, Homo sapiens
cttataagaatggca

SEQ ID NO: 436513 - DNA, 15 bp, Homo sapiens
ttataagaatggcag

SEQ ID NO: 436514 - DNA, 15 bp, Homo sapiens
tataagaatggcaga

SEQ ID NO: 436515 - DNA, 15 bp, Homo sapiens
ataagaatggcagag

SEQ ID NO: 436516 - DNA, 15 bp, Homo sapiens
taagaatggcagagc

SEQ ID NO: 436517 - DNA, 15 bp, Homo sapiens
aagaatggcagagca

SEQ ID NO: 436518 - DNA, 15 bp, Homo sapiens
agaatggcagagcat

SEQ ID NO: 436519 - DNA, 15 bp, Homo sapiens
gaatggcagagcatg

SEQ ID NO: 436520 - DNA, 15 bp, Homo sapiens
aatggcagagcatgg

SEQ ID NO: 436521 - DNA, 15 bp, Homo sapiens
atggcagagcatggg

SEQ ID NO: 436522 - DNA, 15 bp, Homo sapiens
tggcagagcatgggt

SEQ ID NO: 436523 - DNA, 15 bp, Homo sapiens
ggcagagcatgggta

SEQ ID NO: 436524 - DNA, 15 bp, Homo sapiens
gcagagcatgggtag

SEQ ID NO: 436525 - DNA, 15 bp, Homo sapiens
cagagcatgggtaga

SEQ ID NO: 436526 - DNA, 15 bp, Homo sapiens
agagcatgggtagaa

SEQ ID NO: 436527 - DNA, 15 bp, Homo sapiens
gagcatgggtagaaa

SEQ ID NO: 436528 - DNA, 15 bp, Homo sapiens
agcatgggtagaaag

SEQ ID NO: 436529 - DNA, 15 bp, Homo sapiens
gcatgggtagaaagc

SEQ ID NO: 436530 - DNA, 15 bp, Homo sapiens
catgggtagaaagct

SEQ ID NO: 436531 - DNA, 15 bp, Homo sapiens
atgggtagaaagctc

SEQ ID NO: 436532 - DNA, 15 bp, Homo sapiens
tgggtagaaagctcc

SEQ ID NO: 436533 - DNA, 15 bp, Homo sapiens
gggtagaaagctcca

SEQ ID NO: 436534 - DNA, 15 bp, Homo sapiens
ggtagaaagctccag

SEQ ID NO: 436535 - DNA, 15 bp, Homo sapiens
gtagaaagctccaga

SEQ ID NO: 436536 - DNA, 15 bp, Homo sapiens
tagaaagctccagac

SEQ ID NO: 436537 - DNA, 15 bp, Homo sapiens
agaaagctccagact

SEQ ID NO: 436538 - DNA, 15 bp, Homo sapiens
gaaagctccagactt

SEQ ID NO: 436539 - DNA, 15 bp, Homo sapiens
aaagctccagacttc

SEQ ID NO: 436540 - DNA, 15 bp, Homo sapiens
aagctccagacttct

SEQ ID NO: 436541 - DNA, 15 bp, Homo sapiens
agctccagacttctc

SEQ ID NO: 436542 - DNA, 15 bp, Homo sapiens
gctccagacttctct

SEQ ID NO: 436543 - DNA, 15 bp, Homo sapiens
ctccagacttctctg

SEQ ID NO: 436544 - DNA, 15 bp, Homo sapiens
tccagacttctctgt

SEQ ID NO: 436545 - DNA, 15 bp, Homo sapiens
ccagacttctctgta

SEQ ID NO: 436546 - DNA, 15 bp, Homo sapiens
cagacttctctgtag

SEQ ID NO: 436547 - DNA, 15 bp, Homo sapiens
agacttctctgtagc

SEQ ID NO: 436548 - DNA, 15 bp, Homo sapiens
gacttctctgtagct

SEQ ID NO: 436549 - DNA, 15 bp, Homo sapiens
acttctctgtagctc

SEQ ID NO: 436550 - DNA, 15 bp, Homo sapiens
cttctctgtagctcg

SEQ ID NO: 436551 - DNA, 15 bp, Homo sapiens
ttctctgtagctcga

SEQ ID NO: 436552 - DNA, 15 bp, Homo sapiens
tctctgtagctcgat

SEQ ID NO: 436553 - DNA, 15 bp, Homo sapiens
ctctgtagctcgatc

SEQ ID NO: 436554 - DNA, 15 bp, Homo sapiens
tctgtagctcgatca

SEQ ID NO: 436555 - DNA, 15 bp, Homo sapiens
ctgtagctcgatcaa

SEQ ID NO: 436556 - DNA, 15 bp, Homo sapiens
tgtagctcgatcaat

SEQ ID NO: 436557 - DNA, 15 bp, Homo sapiens
gtagctcgatcaatc

SEQ ID NO: 436558 - DNA, 15 bp, Homo sapiens
tagctcgatcaatca

SEQ ID NO: 436559 - DNA, 15 bp, Homo sapiens
agctcgatcaatcac

SEQ ID NO: 436560 - DNA, 15 bp, Homo sapiens
gctcgatcaatcact

SEQ ID NO: 436561 - DNA, 15 bp, Homo sapiens
ctcgatcaatcacta

SEQ ID NO: 436562 - DNA, 15 bp, Homo sapiens
tcgatcaatcactag

SEQ ID NO: 436563 - DNA, 15 bp, Homo sapiens
cgatcaatcactagg

SEQ ID NO: 436564 - DNA, 15 bp, Homo sapiens
gatcaatcactaggg

SEQ ID NO: 436565 - DNA, 15 bp, Homo sapiens
atcaatcactagggg

SEQ ID NO: 436566 - DNA, 15 bp, Homo sapiens
tcaatcactaggggc

SEQ ID NO: 436567 - DNA, 15 bp, Homo sapiens
caatcactaggggct

SEQ ID NO: 436568 - DNA, 15 bp, Homo sapiens
aatcactaggggctg

SEQ ID NO: 436569 - DNA, 15 bp, Homo sapiens
atcactaggggctgt

SEQ ID NO: 436570 - DNA, 15 bp, Homo sapiens
tcactaggggctgtg

SEQ ID NO: 436571 - DNA, 15 bp, Homo sapiens
cactaggggctgtgt

SEQ ID NO: 436572 - DNA, 15 bp, Homo sapiens
actaggggctgtgtt

SEQ ID NO: 436573 - DNA, 15 bp, Homo sapiens
ctaggggctgtgttt

SEQ ID NO: 436574 - DNA, 15 bp, Homo sapiens
taggggctgtgttta

SEQ ID NO: 436575 - DNA, 15 bp, Homo sapiens
aggggctgtgtttag

SEQ ID NO: 436576 - DNA, 15 bp, Homo sapiens
ggggctgtgtttagc

SEQ ID NO: 436577 - DNA, 15 bp, Homo sapiens
gggctgtgtttagct

SEQ ID NO: 436578 - DNA, 15 bp, Homo sapiens
ggctgtgtttagctg

SEQ ID NO: 436579 - DNA, 15 bp, Homo sapiens
gctgtgtttagctgg

SEQ ID NO: 436580 - DNA, 15 bp, Homo sapiens
ctgtgtttagctggg

SEQ ID NO: 436581 - DNA, 15 bp, Homo sapiens
tgtgtttagctggga

SEQ ID NO: 436582 - DNA, 15 bp, Homo sapiens
gtgtttagctgggaa

SEQ ID NO: 436583 - DNA, 15 bp, Homo sapiens
tgtttagctgggaag

SEQ ID NO: 436584 - DNA, 15 bp, Homo sapiens
gtttagctgggaagc

SEQ ID NO: 436585 - DNA, 15 bp, Homo sapiens
tttagctgggaagca

SEQ ID NO: 436586 - DNA, 15 bp, Homo sapiens
ttagctgggaagcag

SEQ ID NO: 436587 - DNA, 15 bp, Homo sapiens
tagctgggaagcagc

SEQ ID NO: 436588 - DNA, 15 bp, Homo sapiens
agctgggaagcagcc

SEQ ID NO: 436589 - DNA, 15 bp, Homo sapiens
gctgggaagcagcct

SEQ ID NO: 436590 - DNA, 15 bp, Homo sapiens
ctgggaagcagcctg

SEQ ID NO: 436591 - DNA, 15 bp, Homo sapiens
tgggaagcagcctgg

SEQ ID NO: 436592 - DNA, 15 bp, Homo sapiens
gggaagcagcctggg

SEQ ID NO: 436593 - DNA, 15 bp, Homo sapiens
ggaagcagcctgggg

SEQ ID NO: 436594 - DNA, 15 bp, Homo sapiens
gaagcagcctgggga

SEQ ID NO: 436595 - DNA, 15 bp, Homo sapiens
aagcagcctggggag

SEQ ID NO: 436596 - DNA, 15 bp, Homo sapiens
agcagcctggggaga

SEQ ID NO: 436597 - DNA, 15 bp, Homo sapiens
gcagcctggggagag

SEQ ID NO: 436598 - DNA, 15 bp, Homo sapiens
cagcctggggagaga

SEQ ID NO: 436599 - DNA, 15 bp, Homo sapiens
agcctggggagagat

SEQ ID NO: 436600 - DNA, 15 bp, Homo sapiens
gcctggggagagatg

SEQ ID NO: 436601 - DNA, 15 bp, Homo sapiens
cctggggagagatgg

SEQ ID NO: 436602 - DNA, 15 bp, Homo sapiens
ctggggagagatggg

SEQ ID NO: 436603 - DNA, 15 bp, Homo sapiens
tggggagagatgggc

SEQ ID NO: 436604 - DNA, 15 bp, Homo sapiens
ggggagagatgggca

SEQ ID NO: 436605 - DNA, 15 bp, Homo sapiens
gggagagatgggcag

SEQ ID NO: 436606 - DNA, 15 bp, Homo sapiens
ggagagatgggcagt

SEQ ID NO: 436607 - DNA, 15 bp, Homo sapiens
gagagatgggcagtc

SEQ ID NO: 436608 - DNA, 15 bp, Homo sapiens
agagatgggcagtca

SEQ ID NO: 436609 - DNA, 15 bp, Homo sapiens
gagatgggcagtcat

SEQ ID NO: 436610 - DNA, 15 bp, Homo sapiens
agatgggcagtcatg

SEQ ID NO: 436611 - DNA, 15 bp, Homo sapiens
gatgggcagtcatgt

SEQ ID NO: 436612 - DNA, 15 bp, Homo sapiens
atgggcagtcatgtg

SEQ ID NO: 436613 - DNA, 15 bp, Homo sapiens
tgggcagtcatgtgg

SEQ ID NO: 436614 - DNA, 15 bp, Homo sapiens
gggcagtcatgtggc

SEQ ID NO: 436615 - DNA, 15 bp, Homo sapiens
ggcagtcatgtggca

SEQ ID NO: 436616 - DNA, 15 bp, Homo sapiens
gcagtcatgtggcaa

SEQ ID NO: 436617 - DNA, 15 bp, Homo sapiens
cagtcatgtggcaag

SEQ ID NO: 436618 - DNA, 15 bp, Homo sapiens
agtcatgtggcaaga

SEQ ID NO: 436619 - DNA, 15 bp, Homo sapiens
gtcatgtggcaagaa

SEQ ID NO: 436620 - DNA, 15 bp, Homo sapiens
tcatgtggcaagaaa

SEQ ID NO: 436621 - DNA, 15 bp, Homo sapiens
catgtggcaagaaat

SEQ ID NO: 436622 - DNA, 15 bp, Homo sapiens
atgtggcaagaaata

SEQ ID NO: 436623 - DNA, 15 bp, Homo sapiens
tgtggcaagaaataa

SEQ ID NO: 436624 - DNA, 15 bp, Homo sapiens
gtggcaagaaataaa

SEQ ID NO: 436625 - DNA, 15 bp, Homo sapiens
tggcaagaaataaaa

SEQ ID NO: 436626 - DNA, 15 bp, Homo sapiens
ggcaagaaataaaag

SEQ ID NO: 436627 - DNA, 15 bp, Homo sapiens
gcaagaaataaaaga

SEQ ID NO: 436628 - DNA, 15 bp, Homo sapiens
caagaaataaaagac

SEQ ID NO: 436629 - DNA, 15 bp, Homo sapiens
aagaaataaaagact

SEQ ID NO: 436630 - DNA, 15 bp, Homo sapiens
agaaataaaagactt

SEQ ID NO: 436631 - DNA, 15 bp, Homo sapiens
gaaataaaagacttt

SEQ ID NO: 436632 - DNA, 15 bp, Homo sapiens
aaataaaagactttg

SEQ ID NO: 436633 - DNA, 15 bp, Homo sapiens
aataaaagactttga

SEQ ID NO: 436634 - DNA, 15 bp, Homo sapiens
ataaaagactttgaa

SEQ ID NO: 436635 - DNA, 15 bp, Homo sapiens
taaaagactttgaat

SEQ ID NO: 436636 - DNA, 15 bp, Homo sapiens
aaaagactttgaatc

SEQ ID NO: 436637 - DNA, 15 bp, Homo sapiens
aaagactttgaatct

SEQ ID NO: 436638 - DNA, 15 bp, Homo sapiens
aagactttgaatcta

SEQ ID NO: 436639 - DNA, 15 bp, Homo sapiens
agactttgaatctaa

SEQ ID NO: 436640 - DNA, 15 bp, Homo sapiens
gactttgaatctaaa

SEQ ID NO: 436641 - DNA, 15 bp, Homo sapiens
actttgaatctaaaa

SEQ ID NO: 436642 - DNA, 15 bp, Homo sapiens
ctttgaatctaaaac

SEQ ID NO: 436643 - DNA, 15 bp, Homo sapiens
tttgaatctaaaact

SEQ ID NO: 436644 - DNA, 15 bp, Homo sapiens
ttgaatctaaaactc

SEQ ID NO: 436645 - DNA, 15 bp, Homo sapiens
tgaatctaaaactcc

SEQ ID NO: 436646 - DNA, 15 bp, Homo sapiens
gaatctaaaactcct

SEQ ID NO: 436647 - DNA, 15 bp, Homo sapiens
aatctaaaactcctg

SEQ ID NO: 436648 - DNA, 15 bp, Homo sapiens
atctaaaactcctgt

SEQ ID NO: 436649 - DNA, 15 bp, Homo sapiens
tctaaaactcctgtc

SEQ ID NO: 436650 - DNA, 15 bp, Homo sapiens
ctaaaactcctgtcc

SEQ ID NO: 436651 - DNA, 15 bp, Homo sapiens
taaaactcctgtcct

SEQ ID NO: 436652 - DNA, 15 bp, Homo sapiens
aaaactcctgtcctt

SEQ ID NO: 436653 - DNA, 15 bp, Homo sapiens
aaactcctgtccttt

SEQ ID NO: 436654 - DNA, 15 bp, Homo sapiens
aactcctgtcctttg

SEQ ID NO: 436655 - DNA, 15 bp, Homo sapiens
actcctgtcctttga

SEQ ID NO: 436656 - DNA, 15 bp, Homo sapiens
ctcctgtcctttgat

SEQ ID NO: 436657 - DNA, 15 bp, Homo sapiens
tcctgtcctttgatt

SEQ ID NO: 436658 - DNA, 15 bp, Homo sapiens
cctgtcctttgattc

SEQ ID NO: 436659 - DNA, 15 bp, Homo sapiens
ctgtcctttgattct

SEQ ID NO: 436660 - DNA, 15 bp, Homo sapiens
tgtcctttgattctt

SEQ ID NO: 436661 - DNA, 15 bp, Homo sapiens
gtcctttgattcttg

SEQ ID NO: 436662 - DNA, 15 bp, Homo sapiens
tcctttgattcttga

SEQ ID NO: 436663 - DNA, 15 bp, Homo sapiens
cctttgattcttgaa

SEQ ID NO: 436664 - DNA, 15 bp, Homo sapiens
ctttgattcttgaaa

SEQ ID NO: 436665 - DNA, 15 bp, Homo sapiens
tttgattcttgaaag

SEQ ID NO: 436666 - DNA, 15 bp, Homo sapiens
ttgattcttgaaaga

SEQ ID NO: 436667 - DNA, 15 bp, Homo sapiens
tgattcttgaaagag

SEQ ID NO: 436668 - DNA, 15 bp, Homo sapiens
gattcttgaaagaga

SEQ ID NO: 436669 - DNA, 15 bp, Homo sapiens
attcttgaaagagaa

SEQ ID NO: 436670 - DNA, 15 bp, Homo sapiens
ttcttgaaagagaaa

SEQ ID NO: 436671 - DNA, 15 bp, Homo sapiens
tcttgaaagagaaag

SEQ ID NO: 436672 - DNA, 15 bp, Homo sapiens
cttgaaagagaaagg

SEQ ID NO: 436673 - DNA, 15 bp, Homo sapiens
ttgaaagagaaaggg

SEQ ID NO: 436674 - DNA, 15 bp, Homo sapiens
tgaaagagaaagggg

SEQ ID NO: 436675 - DNA, 15 bp, Homo sapiens
gaaagagaaagggga

SEQ ID NO: 436676 - DNA, 15 bp, Homo sapiens
aaagagaaaggggag

SEQ ID NO: 436677 - DNA, 15 bp, Homo sapiens
aagagaaaggggaga

SEQ ID NO: 436678 - DNA, 15 bp, Homo sapiens
agagaaaggggagaa

SEQ ID NO: 436679 - DNA, 15 bp, Homo sapiens
agaaaggggagaatt

SEQ ID NO: 436680 - DNA, 15 bp, Homo sapiens
gaaaggggagaattt

SEQ ID NO: 436681 - DNA, 15 bp, Homo sapiens
aaaggggagaatttt

SEQ ID NO: 436682 - DNA, 15 bp, Homo sapiens
aaggggagaattttc

SEQ ID NO: 436683 - DNA, 15 bp, Homo sapiens
aggggagaattttct

SEQ ID NO: 436684 - DNA, 15 bp, Homo sapiens
ggggagaattttctt

SEQ ID NO: 436685 - DNA, 15 bp, Homo sapiens
gggagaattttcttc

SEQ ID NO: 436686 - DNA, 15 bp, Homo sapiens
ggagaattttcttct

SEQ ID NO: 436687 - DNA, 15 bp, Homo sapiens
gagaattttcttctt

SEQ ID NO: 436688 - DNA, 15 bp, Homo sapiens
agaattttcttcttt

SEQ ID NO: 436689 - DNA, 15 bp, Homo sapiens
gaattttcttcttta

SEQ ID NO: 436690 - DNA, 15 bp, Homo sapiens
aattttcttctttat

SEQ ID NO: 436691 - DNA, 15 bp, Homo sapiens
attttcttctttatt

SEQ ID NO: 436692 - DNA, 15 bp, Homo sapiens
ttttcttctttattt

SEQ ID NO: 436693 - DNA, 15 bp, Homo sapiens
tttcttctttatttt

SEQ ID NO: 436694 - DNA, 15 bp, Homo sapiens
ttcttctttattttc

SEQ ID NO: 436695 - DNA, 15 bp, Homo sapiens
tcttctttattttct

SEQ ID NO: 436696 - DNA, 15 bp, Homo sapiens
cttctttattttctt

SEQ ID NO: 436697 - DNA, 15 bp, Homo sapiens
ttctttattttcttt

SEQ ID NO: 436698 - DNA, 15 bp, Homo sapiens
tctttattttctttt

SEQ ID NO: 436699 - DNA, 15 bp, Homo sapiens
ctttattttcttttt

SEQ ID NO: 436700 - DNA, 15 bp, Homo sapiens
tttattttctttttc

SEQ ID NO: 436701 - DNA, 15 bp, Homo sapiens
ttattttctttttct

SEQ ID NO: 436702 - DNA, 15 bp, Homo sapiens
tattttctttttcta

SEQ ID NO: 436703 - DNA, 15 bp, Homo sapiens
attttctttttctag

SEQ ID NO: 436704 - DNA, 15 bp, Homo sapiens
ttttctttttctagt

SEQ ID NO: 436705 - DNA, 15 bp, Homo sapiens
tttctttttctagtt

SEQ ID NO: 436706 - DNA, 15 bp, Homo sapiens
ttctttttctagtta

SEQ ID NO: 436707 - DNA, 15 bp, Homo sapiens
tctttttctagttaa

SEQ ID NO: 436708 - DNA, 15 bp, Homo sapiens
ctttttctagttaaa

SEQ ID NO: 436709 - DNA, 15 bp, Homo sapiens
tttttctagttaaag

SEQ ID NO: 436710 - DNA, 15 bp, Homo sapiens
ttttctagttaaaga

SEQ ID NO: 436711 - DNA, 15 bp, Homo sapiens
tttctagttaaagat

SEQ ID NO: 436712 - DNA, 15 bp, Homo sapiens
ttctagttaaagata

SEQ ID NO: 436713 - DNA, 15 bp, Homo sapiens
tctagttaaagatat

SEQ ID NO: 436714 - DNA, 15 bp, Homo sapiens
ctagttaaagatatt

SEQ ID NO: 436715 - DNA, 15 bp, Homo sapiens
tagttaaagatattg

SEQ ID NO: 436716 - DNA, 15 bp, Homo sapiens
agttaaagatattgt

SEQ ID NO: 436717 - DNA, 15 bp, Homo sapiens
gttaaagatattgta

SEQ ID NO: 436718 - DNA, 15 bp, Homo sapiens
ttaaagatattgtac

SEQ ID NO: 436719 - DNA, 15 bp, Homo sapiens
taaagatattgtaca

SEQ ID NO: 436720 - DNA, 15 bp, Homo sapiens
aaagatattgtacag

SEQ ID NO: 436721 - DNA, 15 bp, Homo sapiens
aagatattgtacaga

SEQ ID NO: 436722 - DNA, 15 bp, Homo sapiens
agatattgtacagag

SEQ ID NO: 436723 - DNA, 15 bp, Homo sapiens
gatattgtacagaga

SEQ ID NO: 436724 - DNA, 15 bp, Homo sapiens
atattgtacagagat

SEQ ID NO: 436725 - DNA, 15 bp, Homo sapiens
tattgtacagagatt

SEQ ID NO: 436726 - DNA, 15 bp, Homo sapiens
attgtacagagattg

SEQ ID NO: 436727 - DNA, 15 bp, Homo sapiens
ttgtacagagattga

SEQ ID NO: 436728 - DNA, 15 bp, Homo sapiens
tgtacagagattgat

SEQ ID NO: 436729 - DNA, 15 bp, Homo sapiens
gtacagagattgatt

SEQ ID NO: 436730 - DNA, 15 bp, Homo sapiens
tacagagattgattt

SEQ ID NO: 436731 - DNA, 15 bp, Homo sapiens
acagagattgattta

SEQ ID NO: 436732 - DNA, 15 bp, Homo sapiens
cagagattgatttat

SEQ ID NO: 436733 - DNA, 15 bp, Homo sapiens
agagattgatttatg

SEQ ID NO: 436734 - DNA, 15 bp, Homo sapiens
gagattgatttatgc

SEQ ID NO: 436735 - DNA, 15 bp, Homo sapiens
agattgatttatgca

SEQ ID NO: 436736 - DNA, 15 bp, Homo sapiens
gattgatttatgcat

SEQ ID NO: 436737 - DNA, 15 bp, Homo sapiens
attgatttatgcatt

SEQ ID NO: 436738 - DNA, 15 bp, Homo sapiens
tgatttatgcattta

SEQ ID NO: 436739 - DNA, 15 bp, Homo sapiens
gatttatgcatttaa

SEQ ID NO: 436740 - DNA, 15 bp, Homo sapiens
atttatgcatttaac

SEQ ID NO: 436741 - DNA, 15 bp, Homo sapiens
tttatgcatttaaca

SEQ ID NO: 436742 - DNA, 15 bp, Homo sapiens
ttatgcatttaacaa

SEQ ID NO: 436743 - DNA, 15 bp, Homo sapiens
tatgcatttaacaag

SEQ ID NO: 436744 - DNA, 15 bp, Homo sapiens
atgcatttaacaagt

SEQ ID NO: 436745 - DNA, 15 bp, Homo sapiens
tgcatttaacaagta

SEQ ID NO: 436746 - DNA, 15 bp, Homo sapiens
gcatttaacaagtac

SEQ ID NO: 436747 - DNA, 15 bp, Homo sapiens
catttaacaagtacg

SEQ ID NO: 436748 - DNA, 15 bp, Homo sapiens
atttaacaagtacgt

SEQ ID NO: 436749 - DNA, 15 bp, Homo sapiens
tttaacaagtacgtt

SEQ ID NO: 436750 - DNA, 15 bp, Homo sapiens
ttaacaagtacgttt

SEQ ID NO: 436751 - DNA, 15 bp, Homo sapiens
taacaagtacgtttt

SEQ ID NO: 436752 - DNA, 15 bp, Homo sapiens
aacaagtacgttttg

SEQ ID NO: 436753 - DNA, 15 bp, Homo sapiens
acaagtacgttttga

SEQ ID NO: 436754 - DNA, 15 bp, Homo sapiens
caagtacgttttgag

SEQ ID NO: 436755 - DNA, 15 bp, Homo sapiens
aagtacgttttgagt

SEQ ID NO: 436756 - DNA, 15 bp, Homo sapiens
agtacgttttgagtg

SEQ ID NO: 436757 - DNA, 15 bp, Homo sapiens
gtacgttttgagtgc

SEQ ID NO: 436758 - DNA, 15 bp, Homo sapiens
tacgttttgagtgcc

SEQ ID NO: 436759 - DNA, 15 bp, Homo sapiens
acgttttgagtgcct

SEQ ID NO: 436760 - DNA, 15 bp, Homo sapiens
cgttttgagtgccta

SEQ ID NO: 436761 - DNA, 15 bp, Homo sapiens
gttttgagtgcctac

SEQ ID NO: 436762 - DNA, 15 bp, Homo sapiens
ttttgagtgcctacc

SEQ ID NO: 436763 - DNA, 15 bp, Homo sapiens
tttgagtgcctacca

SEQ ID NO: 436764 - DNA, 15 bp, Homo sapiens
ttgagtgcctaccat

SEQ ID NO: 436765 - DNA, 15 bp, Homo sapiens
tgagtgcctaccatt

SEQ ID NO: 436766 - DNA, 15 bp, Homo sapiens
gagtgcctaccattt

SEQ ID NO: 436767 - DNA, 15 bp, Homo sapiens
agtgcctaccattta

SEQ ID NO: 436768 - DNA, 15 bp, Homo sapiens
gtgcctaccatttac

SEQ ID NO: 436769 - DNA, 15 bp, Homo sapiens
tgcctaccatttaca

SEQ ID NO: 436770 - DNA, 15 bp, Homo sapiens
gcctaccatttacaa

SEQ ID NO: 436771 - DNA, 15 bp, Homo sapiens
cctaccatttacaag

SEQ ID NO: 436772 - DNA, 15 bp, Homo sapiens
ctaccatttacaagg

SEQ ID NO: 436773 - DNA, 15 bp, Homo sapiens
taccatttacaaggg

SEQ ID NO: 436774 - DNA, 15 bp, Homo sapiens
accatttacaagggg

SEQ ID NO: 436775 - DNA, 15 bp, Homo sapiens
ccatttacaaggggg

SEQ ID NO: 436776 - DNA, 15 bp, Homo sapiens
catttacaagggggg

SEQ ID NO: 436777 - DNA, 15 bp, Homo sapiens
atttacaaggggggt

SEQ ID NO: 436778 - DNA, 15 bp, Homo sapiens
tttacaaggggggtg

SEQ ID NO: 436779 - DNA, 15 bp, Homo sapiens
ttacaaggggggtgt

SEQ ID NO: 436780 - DNA, 15 bp, Homo sapiens
tacaaggggggtgtt

SEQ ID NO: 436781 - DNA, 15 bp, Homo sapiens
acaaggggggtgttc

SEQ ID NO: 436782 - DNA, 15 bp, Homo sapiens
caaggggggtgttct

SEQ ID NO: 436783 - DNA, 15 bp, Homo sapiens
aaggggggtgttcta

SEQ ID NO: 436784 - DNA, 15 bp, Homo sapiens
aggggggtgttctag

SEQ ID NO: 436785 - DNA, 15 bp, Homo sapiens
ggggggtgttctaga

SEQ ID NO: 436786 - DNA, 15 bp, Homo sapiens
gggggtgttctagat

SEQ ID NO: 436787 - DNA, 15 bp, Homo sapiens
ggggtgttctagata

SEQ ID NO: 436788 - DNA, 15 bp, Homo sapiens
gggtgttctagatac

SEQ ID NO: 436789 - DNA, 15 bp, Homo sapiens
ggtgttctagatact

SEQ ID NO: 436790 - DNA, 15 bp, Homo sapiens
gtgttctagatactc

SEQ ID NO: 436791 - DNA, 15 bp, Homo sapiens
tgttctagatactcg

SEQ ID NO: 436792 - DNA, 15 bp, Homo sapiens
gttctagatactcgg

SEQ ID NO: 436793 - DNA, 15 bp, Homo sapiens
ttctagatactcggg

SEQ ID NO: 436794 - DNA, 15 bp, Homo sapiens
tctagatactcggga

SEQ ID NO: 436795 - DNA, 15 bp, Homo sapiens
ctagatactcgggat

SEQ ID NO: 436796 - DNA, 15 bp, Homo sapiens
tagatactcgggata

SEQ ID NO: 436797 - DNA, 15 bp, Homo sapiens
agatactcgggatac

SEQ ID NO: 436798 - DNA, 15 bp, Homo sapiens
gatactcgggataca

SEQ ID NO: 436799 - DNA, 15 bp, Homo sapiens
atactcgggatacag

SEQ ID NO: 436800 - DNA, 15 bp, Homo sapiens
tactcgggatacagt

SEQ ID NO: 436801 - DNA, 15 bp, Homo sapiens
actcgggatacagta

SEQ ID NO: 436802 - DNA, 15 bp, Homo sapiens
ctcgggatacagtag

SEQ ID NO: 436803 - DNA, 15 bp, Homo sapiens
tcgggatacagtagt

SEQ ID NO: 436804 - DNA, 15 bp, Homo sapiens
cgggatacagtagta

SEQ ID NO: 436805 - DNA, 15 bp, Homo sapiens
gggatacagtagtag

SEQ ID NO: 436806 - DNA, 15 bp, Homo sapiens
ggatacagtagtagg

SEQ ID NO: 436807 - DNA, 15 bp, Homo sapiens
gatacagtagtaggc

SEQ ID NO: 436808 - DNA, 15 bp, Homo sapiens
atacagtagtaggca

SEQ ID NO: 436809 - DNA, 15 bp, Homo sapiens
tacagtagtaggcaa

SEQ ID NO: 436810 - DNA, 15 bp, Homo sapiens
acagtagtaggcaaa

SEQ ID NO: 436811 - DNA, 15 bp, Homo sapiens
cagtagtaggcaaaa

SEQ ID NO: 436812 - DNA, 15 bp, Homo sapiens
agtagtaggcaaaac

SEQ ID NO: 436813 - DNA, 15 bp, Homo sapiens
gtagtaggcaaaaca

SEQ ID NO: 436814 - DNA, 15 bp, Homo sapiens
tagtaggcaaaacag

SEQ ID NO: 436815 - DNA, 15 bp, Homo sapiens
agtaggcaaaacaga

SEQ ID NO: 436816 - DNA, 15 bp, Homo sapiens
gtaggcaaaacagat

SEQ ID NO: 436817 - DNA, 15 bp, Homo sapiens
taggcaaaacagatg

SEQ ID NO: 436818 - DNA, 15 bp, Homo sapiens
aggcaaaacagatgt

SEQ ID NO: 436819 - DNA, 15 bp, Homo sapiens
ggcaaaacagatgtt

SEQ ID NO: 436820 - DNA, 15 bp, Homo sapiens
gcaaaacagatgttt

SEQ ID NO: 436821 - DNA, 15 bp, Homo sapiens
caaaacagatgtttt

SEQ ID NO: 436822 - DNA, 15 bp, Homo sapiens
aaaacagatgttttt

SEQ ID NO: 436823 - DNA, 15 bp, Homo sapiens
aaacagatgtttttt

SEQ ID NO: 436824 - DNA, 15 bp, Homo sapiens
aacagatgttttttt

SEQ ID NO: 436825 - DNA, 15 bp, Homo sapiens
acagatgtttttttc

SEQ ID NO: 436826 - DNA, 15 bp, Homo sapiens
cagatgtttttttcc

SEQ ID NO: 436827 - DNA, 15 bp, Homo sapiens
agatgtttttttcct

SEQ ID NO: 436828 - DNA, 15 bp, Homo sapiens
gatgtttttttcctc

SEQ ID NO: 436829 - DNA, 15 bp, Homo sapiens
atgtttttttcctcc

SEQ ID NO: 436830 - DNA, 15 bp, Homo sapiens
tgtttttttcctcct

SEQ ID NO: 436831 - DNA, 15 bp, Homo sapiens
gtttttttcctcctg

SEQ ID NO: 436832 - DNA, 15 bp, Homo sapiens
tttttttcctcctga

SEQ ID NO: 436833 - DNA, 15 bp, Homo sapiens
ttttttcctcctgaa

SEQ ID NO: 436834 - DNA, 15 bp, Homo sapiens
tttttcctcctgaaa

SEQ ID NO: 436835 - DNA, 15 bp, Homo sapiens
ttttcctcctgaaac

SEQ ID NO: 436836 - DNA, 15 bp, Homo sapiens
tttcctcctgaaaca

SEQ ID NO: 436837 - DNA, 15 bp, Homo sapiens
ttcctcctgaaacat

SEQ ID NO: 436838 - DNA, 15 bp, Homo sapiens
tcctcctgaaacatt

SEQ ID NO: 436839 - DNA, 15 bp, Homo sapiens
cctcctgaaacattc

SEQ ID NO: 436840 - DNA, 15 bp, Homo sapiens
ctcctgaaacattct

SEQ ID NO: 436841 - DNA, 15 bp, Homo sapiens
tcctgaaacattctc

SEQ ID NO: 436842 - DNA, 15 bp, Homo sapiens
cctgaaacattctca

SEQ ID NO: 436843 - DNA, 15 bp, Homo sapiens
ctgaaacattctcag

SEQ ID NO: 436844 - DNA, 15 bp, Homo sapiens
tgaaacattctcagc

SEQ ID NO: 436845 - DNA, 15 bp, Homo sapiens
gaaacattctcagct

SEQ ID NO: 436846 - DNA, 15 bp, Homo sapiens
aaacattctcagctt

SEQ ID NO: 436847 - DNA, 15 bp, Homo sapiens
aacattctcagcttt

SEQ ID NO: 436848 - DNA, 15 bp, Homo sapiens
acattctcagctttt

SEQ ID NO: 436849 - DNA, 15 bp, Homo sapiens
cattctcagcttttc

SEQ ID NO: 436850 - DNA, 15 bp, Homo sapiens
attctcagcttttcc

SEQ ID NO: 436851 - DNA, 15 bp, Homo sapiens
ttctcagcttttcct

SEQ ID NO: 436852 - DNA, 15 bp, Homo sapiens
tctcagcttttcctc

SEQ ID NO: 436853 - DNA, 15 bp, Homo sapiens
ctcagcttttcctct

SEQ ID NO: 436854 - DNA, 15 bp, Homo sapiens
tcagcttttcctctt

SEQ ID NO: 436855 - DNA, 15 bp, Homo sapiens
cagcttttcctcttt

SEQ ID NO: 436856 - DNA, 15 bp, Homo sapiens
agcttttcctctttc

SEQ ID NO: 436857 - DNA, 15 bp, Homo sapiens
gcttttcctctttcc

SEQ ID NO: 436858 - DNA, 15 bp, Homo sapiens
cttttcctctttcct

SEQ ID NO: 436859 - DNA, 15 bp, Homo sapiens
ttttcctctttcctt

SEQ ID NO: 436860 - DNA, 15 bp, Homo sapiens
tttcctctttccttt

SEQ ID NO: 436861 - DNA, 15 bp, Homo sapiens
ttcctctttcctttt

SEQ ID NO: 436862 - DNA, 15 bp, Homo sapiens
tcctctttcctttta

SEQ ID NO: 436863 - DNA, 15 bp, Homo sapiens
cctctttccttttat

SEQ ID NO: 436864 - DNA, 15 bp, Homo sapiens
ctctttccttttatt

SEQ ID NO: 436865 - DNA, 15 bp, Homo sapiens
tctttccttttattg

SEQ ID NO: 436866 - DNA, 15 bp, Homo sapiens
ctttccttttattgc

SEQ ID NO: 436867 - DNA, 15 bp, Homo sapiens
tttccttttattgcc

SEQ ID NO: 436868 - DNA, 15 bp, Homo sapiens
ttccttttattgcca

SEQ ID NO: 436869 - DNA, 15 bp, Homo sapiens
tccttttattgccac

SEQ ID NO: 436870 - DNA, 15 bp, Homo sapiens
ccttttattgccacc

SEQ ID NO: 436871 - DNA, 15 bp, Homo sapiens
cttttattgccacct

SEQ ID NO: 436872 - DNA, 15 bp, Homo sapiens
ttttattgccacctg

SEQ ID NO: 436873 - DNA, 15 bp, Homo sapiens
tttattgccacctgc

SEQ ID NO: 436874 - DNA, 15 bp, Homo sapiens
ttattgccacctgcc

SEQ ID NO: 436875 - DNA, 15 bp, Homo sapiens
tattgccacctgcct

SEQ ID NO: 436876 - DNA, 15 bp, Homo sapiens
attgccacctgcctg

SEQ ID NO: 436877 - DNA, 15 bp, Homo sapiens
ttgccacctgcctgc

SEQ ID NO: 436878 - DNA, 15 bp, Homo sapiens
tgccacctgcctgcc

SEQ ID NO: 436879 - DNA, 15 bp, Homo sapiens
gccacctgcctgccc

SEQ ID NO: 436880 - DNA, 15 bp, Homo sapiens
ccacctgcctgcccc

SEQ ID NO: 436881 - DNA, 15 bp, Homo sapiens
cacctgcctgccccc

SEQ ID NO: 436882 - DNA, 15 bp, Homo sapiens
acctgcctgccccca

SEQ ID NO: 436883 - DNA, 15 bp, Homo sapiens
cctgcctgcccccag

SEQ ID NO: 436884 - DNA, 15 bp, Homo sapiens
ctgcctgcccccagt

SEQ ID NO: 436885 - DNA, 15 bp, Homo sapiens
tgcctgcccccagtg

SEQ ID NO: 436886 - DNA, 15 bp, Homo sapiens
gcctgcccccagtga

SEQ ID NO: 436887 - DNA, 15 bp, Homo sapiens
cctgcccccagtgac

SEQ ID NO: 436888 - DNA, 15 bp, Homo sapiens
ctgcccccagtgacc

SEQ ID NO: 436889 - DNA, 15 bp, Homo sapiens
tgcccccagtgaccc

SEQ ID NO: 436890 - DNA, 15 bp, Homo sapiens
gcccccagtgaccca

SEQ ID NO: 436891 - DNA, 15 bp, Homo sapiens
cccccagtgacccat

SEQ ID NO: 436892 - DNA, 15 bp, Homo sapiens
ccccagtgacccatc

SEQ ID NO: 436893 - DNA, 15 bp, Homo sapiens
cccagtgacccatct

SEQ ID NO: 436894 - DNA, 15 bp, Homo sapiens
ccagtgacccatctg

SEQ ID NO: 436895 - DNA, 15 bp, Homo sapiens
cagtgacccatctgt

SEQ ID NO: 436896 - DNA, 15 bp, Homo sapiens
agtgacccatctgtt

SEQ ID NO: 436897 - DNA, 15 bp, Homo sapiens
gtgacccatctgttg

SEQ ID NO: 436898 - DNA, 15 bp, Homo sapiens
tgacccatctgttga

SEQ ID NO: 436899 - DNA, 15 bp, Homo sapiens
gacccatctgttgat

SEQ ID NO: 436900 - DNA, 15 bp, Homo sapiens
acccatctgttgatg

SEQ ID NO: 436901 - DNA, 15 bp, Homo sapiens
cccatctgttgatgt

SEQ ID NO: 436902 - DNA, 15 bp, Homo sapiens
ccatctgttgatgtc

SEQ ID NO: 436903 - DNA, 15 bp, Homo sapiens
catctgttgatgtcc

SEQ ID NO: 436904 - DNA, 15 bp, Homo sapiens
atctgttgatgtcca

SEQ ID NO: 436905 - DNA, 15 bp, Homo sapiens
tctgttgatgtccag

SEQ ID NO: 436906 - DNA, 15 bp, Homo sapiens
ctgttgatgtccagc

SEQ ID NO: 436907 - DNA, 15 bp, Homo sapiens
tgttgatgtccagcc

SEQ ID NO: 436908 - DNA, 15 bp, Homo sapiens
gttgatgtccagccc

SEQ ID NO: 436909 - DNA, 15 bp, Homo sapiens
ttgatgtccagccca

SEQ ID NO: 436910 - DNA, 15 bp, Homo sapiens
tgatgtccagcccaa

SEQ ID NO: 436911 - DNA, 15 bp, Homo sapiens
gatgtccagcccaaa

SEQ ID NO: 436912 - DNA, 15 bp, Homo sapiens
atgtccagcccaaag

SEQ ID NO: 436913 - DNA, 15 bp, Homo sapiens
tgtccagcccaaagg

SEQ ID NO: 436914 - DNA, 15 bp, Homo sapiens
gtccagcccaaagga

SEQ ID NO: 436915 - DNA, 15 bp, Homo sapiens
tccagcccaaaggaa

SEQ ID NO: 436916 - DNA, 15 bp, Homo sapiens
ccagcccaaaggaat

SEQ ID NO: 436917 - DNA, 15 bp, Homo sapiens
cagcccaaaggaatt

SEQ ID NO: 436918 - DNA, 15 bp, Homo sapiens
agcccaaaggaattc

SEQ ID NO: 436919 - DNA, 15 bp, Homo sapiens
gcccaaaggaattca

SEQ ID NO: 436920 - DNA, 15 bp, Homo sapiens
cccaaaggaattcac

SEQ ID NO: 436921 - DNA, 15 bp, Homo sapiens
ccaaaggaattcact

SEQ ID NO: 436922 - DNA, 15 bp, Homo sapiens
caaaggaattcactt

SEQ ID NO: 436923 - DNA, 15 bp, Homo sapiens
aaaggaattcacttg

SEQ ID NO: 436924 - DNA, 15 bp, Homo sapiens
aaggaattcacttga

SEQ ID NO: 436925 - DNA, 15 bp, Homo sapiens
aggaattcacttgaa

SEQ ID NO: 436926 - DNA, 15 bp, Homo sapiens
ggaattcacttgaat

SEQ ID NO: 436927 - DNA, 15 bp, Homo sapiens
gaattcacttgaata

SEQ ID NO: 436928 - DNA, 15 bp, Homo sapiens
aattcacttgaataa

SEQ ID NO: 436929 - DNA, 15 bp, Homo sapiens
attcacttgaataaa

SEQ ID NO: 436930 - DNA, 15 bp, Homo sapiens
ttcacttgaataaat

SEQ ID NO: 436931 - DNA, 15 bp, Homo sapiens
tcacttgaataaatc

SEQ ID NO: 436932 - DNA, 15 bp, Homo sapiens
cacttgaataaatcg

SEQ ID NO: 436933 - DNA, 15 bp, Homo sapiens
acttgaataaatcgc

SEQ ID NO: 436934 - DNA, 15 bp, Homo sapiens
cttgaataaatcgca

SEQ ID NO: 436935 - DNA, 15 bp, Homo sapiens
ttgaataaatcgcaa

SEQ ID NO: 436936 - DNA, 15 bp, Homo sapiens
tgaataaatcgcaaa

SEQ ID NO: 436937 - DNA, 15 bp, Homo sapiens
gaataaatcgcaaaa

SEQ ID NO: 436938 - DNA, 15 bp, Homo sapiens
aataaatcgcaaaac

SEQ ID NO: 436939 - DNA, 15 bp, Homo sapiens
ataaatcgcaaaact

SEQ ID NO: 436940 - DNA, 15 bp, Homo sapiens
taaatcgcaaaactg

SEQ ID NO: 436941 - DNA, 15 bp, Homo sapiens
aaatcgcaaaactgc

SEQ ID NO: 436942 - DNA, 15 bp, Homo sapiens
aatcgcaaaactgcc

SEQ ID NO: 436943 - DNA, 15 bp, Homo sapiens
atcgcaaaactgcca

SEQ ID NO: 436944 - DNA, 15 bp, Homo sapiens
tcgcaaaactgccac

SEQ ID NO: 436945 - DNA, 15 bp, Homo sapiens
cgcaaaactgccact

SEQ ID NO: 436946 - DNA, 15 bp, Homo sapiens
gcaaaactgccacta

SEQ ID NO: 436947 - DNA, 15 bp, Homo sapiens
caaaactgccactac

SEQ ID NO: 436948 - DNA, 15 bp, Homo sapiens
aaaactgccactact

SEQ ID NO: 436949 - DNA, 15 bp, Homo sapiens
aaactgccactactt

SEQ ID NO: 436950 - DNA, 15 bp, Homo sapiens
aactgccactacttg

SEQ ID NO: 436951 - DNA, 15 bp, Homo sapiens
actgccactacttgg

SEQ ID NO: 436952 - DNA, 15 bp, Homo sapiens
ctgccactacttgga

SEQ ID NO: 436953 - DNA, 15 bp, Homo sapiens
tgccactacttggag

SEQ ID NO: 436954 - DNA, 15 bp, Homo sapiens
gccactacttggagg

SEQ ID NO: 436955 - DNA, 15 bp, Homo sapiens
ccactacttggagga

SEQ ID NO: 436956 - DNA, 15 bp, Homo sapiens
cactacttggaggaa

SEQ ID NO: 436957 - DNA, 15 bp, Homo sapiens
actacttggaggaaa

SEQ ID NO: 436958 - DNA, 15 bp, Homo sapiens
ctacttggaggaaat

SEQ ID NO: 436959 - DNA, 15 bp, Homo sapiens
tacttggaggaaatt

SEQ ID NO: 436960 - DNA, 15 bp, Homo sapiens
acttggaggaaattc

SEQ ID NO: 436961 - DNA, 15 bp, Homo sapiens
cttggaggaaattca

SEQ ID NO: 436962 - DNA, 15 bp, Homo sapiens
ttggaggaaattcag

SEQ ID NO: 436963 - DNA, 15 bp, Homo sapiens
tggaggaaattcagg

SEQ ID NO: 436964 - DNA, 15 bp, Homo sapiens
ggaggaaattcaggg

SEQ ID NO: 436965 - DNA, 15 bp, Homo sapiens
gaggaaattcaggga

SEQ ID NO: 436966 - DNA, 15 bp, Homo sapiens
aggaaattcagggat

SEQ ID NO: 436967 - DNA, 15 bp, Homo sapiens
ggaaattcagggatt

SEQ ID NO: 436968 - DNA, 15 bp, Homo sapiens
gaaattcagggatta

SEQ ID NO: 436969 - DNA, 15 bp, Homo sapiens
aaattcagggattat

SEQ ID NO: 436970 - DNA, 15 bp, Homo sapiens
aattcagggattatt

SEQ ID NO: 436971 - DNA, 15 bp, Homo sapiens
attcagggattattc

SEQ ID NO: 436972 - DNA, 15 bp, Homo sapiens
ttcagggattattcc

SEQ ID NO: 436973 - DNA, 15 bp, Homo sapiens
tcagggattattcct

SEQ ID NO: 436974 - DNA, 15 bp, Homo sapiens
cagggattattcctg

SEQ ID NO: 436975 - DNA, 15 bp, Homo sapiens
agggattattcctga

SEQ ID NO: 436976 - DNA, 15 bp, Homo sapiens
gggattattcctgaa

SEQ ID NO: 436977 - DNA, 15 bp, Homo sapiens
ggattattcctgaat

SEQ ID NO: 436978 - DNA, 15 bp, Homo sapiens
gattattcctgaatg

SEQ ID NO: 436979 - DNA, 15 bp, Homo sapiens
attattcctgaatga

SEQ ID NO: 436980 - DNA, 15 bp, Homo sapiens
ttattcctgaatgaa

SEQ ID NO: 436981 - DNA, 15 bp, Homo sapiens
tattcctgaatgaag

SEQ ID NO: 436982 - DNA, 15 bp, Homo sapiens
attcctgaatgaaga

SEQ ID NO: 436983 - DNA, 15 bp, Homo sapiens
ttcctgaatgaagaa

SEQ ID NO: 436984 - DNA, 15 bp, Homo sapiens
tcctgaatgaagaaa

SEQ ID NO: 436985 - DNA, 15 bp, Homo sapiens
cctgaatgaagaaaa

SEQ ID NO: 436986 - DNA, 15 bp, Homo sapiens
ctgaatgaagaaaat

SEQ ID NO: 436987 - DNA, 15 bp, Homo sapiens
tgaatgaagaaaatg

SEQ ID NO: 436988 - DNA, 15 bp, Homo sapiens
gaatgaagaaaatgg

SEQ ID NO: 436989 - DNA, 15 bp, Homo sapiens
aatgaagaaaatgga

SEQ ID NO: 436990 - DNA, 15 bp, Homo sapiens
atgaagaaaatggaa

SEQ ID NO: 436991 - DNA, 15 bp, Homo sapiens
tgaagaaaatggaaa

SEQ ID NO: 436992 - DNA, 15 bp, Homo sapiens
gaagaaaatggaaag

SEQ ID NO: 436993 - DNA, 15 bp, Homo sapiens
aagaaaatggaaaga

SEQ ID NO: 436994 - DNA, 15 bp, Homo sapiens
agaaaatggaaagat

SEQ ID NO: 436995 - DNA, 15 bp, Homo sapiens
gaaaatggaaagatc

SEQ ID NO: 436996 - DNA, 15 bp, Homo sapiens
aaaatggaaagatct

SEQ ID NO: 436997 - DNA, 15 bp, Homo sapiens
aaatggaaagatctc

SEQ ID NO: 436998 - DNA, 15 bp, Homo sapiens
aatggaaagatctca

SEQ ID NO: 436999 - DNA, 15 bp, Homo sapiens
atggaaagatctcag

SEQ ID NO: 437000 - DNA, 15 bp, Homo sapiens
tggaaagatctcagg

SEQ ID NO: 437001 - DNA, 15 bp, Homo sapiens
ggaaagatctcaggt

SEQ ID NO: 437002 - DNA, 15 bp, Homo sapiens
gaaagatctcaggtt

SEQ ID NO: 437003 - DNA, 15 bp, Homo sapiens
aaagatctcaggttg

SEQ ID NO: 437004 - DNA, 15 bp, Homo sapiens
aagatctcaggttgc

SEQ ID NO: 437005 - DNA, 15 bp, Homo sapiens
agatctcaggttgct

SEQ ID NO: 437006 - DNA, 15 bp, Homo sapiens
gatctcaggttgctt

SEQ ID NO: 437007 - DNA, 15 bp, Homo sapiens
atctcaggttgctta

SEQ ID NO: 437008 - DNA, 15 bp, Homo sapiens
tctcaggttgcttag

SEQ ID NO: 437009 - DNA, 15 bp, Homo sapiens
ctcaggttgcttagc

SEQ ID NO: 437010 - DNA, 15 bp, Homo sapiens
tcaggttgcttagcg

SEQ ID NO: 437011 - DNA, 15 bp, Homo sapiens
caggttgcttagcga

SEQ ID NO: 437012 - DNA, 15 bp, Homo sapiens
aggttgcttagcgag

SEQ ID NO: 437013 - DNA, 15 bp, Homo sapiens
ggttgcttagcgagg

SEQ ID NO: 437014 - DNA, 15 bp, Homo sapiens
gttgcttagcgaggc

SEQ ID NO: 437015 - DNA, 15 bp, Homo sapiens
ttgcttagcgaggcc

SEQ ID NO: 437016 - DNA, 15 bp, Homo sapiens
tgcttagcgaggccc

SEQ ID NO: 437017 - DNA, 15 bp, Homo sapiens
gcttagcgaggccct

SEQ ID NO: 437018 - DNA, 15 bp, Homo sapiens
cttagcgaggccctg

SEQ ID NO: 437019 - DNA, 15 bp, Homo sapiens
ttagcgaggccctgg

SEQ ID NO: 437020 - DNA, 15 bp, Homo sapiens
tagcgaggccctggt

SEQ ID NO: 437021 - DNA, 15 bp, Homo sapiens
agcgaggccctggtt

SEQ ID NO: 437022 - DNA, 15 bp, Homo sapiens
gcgaggccctggttg

SEQ ID NO: 437023 - DNA, 15 bp, Homo sapiens
cgaggccctggttgt

SEQ ID NO: 437024 - DNA, 15 bp, Homo sapiens
gaggccctggttgtc

SEQ ID NO: 437025 - DNA, 15 bp, Homo sapiens
aggccctggttgtct

SEQ ID NO: 437026 - DNA, 15 bp, Homo sapiens
ggccctggttgtctg

SEQ ID NO: 437027 - DNA, 15 bp, Homo sapiens
gccctggttgtctgt

SEQ ID NO: 437028 - DNA, 15 bp, Homo sapiens
ccctggttgtctgtt

SEQ ID NO: 437029 - DNA, 15 bp, Homo sapiens
cctggttgtctgttc

SEQ ID NO: 437030 - DNA, 15 bp, Homo sapiens
ctggttgtctgttcc

SEQ ID NO: 437031 - DNA, 15 bp, Homo sapiens
tggttgtctgttcca

SEQ ID NO: 437032 - DNA, 15 bp, Homo sapiens
ggttgtctgttccag

SEQ ID NO: 437033 - DNA, 15 bp, Homo sapiens
gttgtctgttccagg

SEQ ID NO: 437034 - DNA, 15 bp, Homo sapiens
ttgtctgttccaggg

SEQ ID NO: 437035 - DNA, 15 bp, Homo sapiens
tgtctgttccagggt

SEQ ID NO: 437036 - DNA, 15 bp, Homo sapiens
gtctgttccagggtc

SEQ ID NO: 437037 - DNA, 15 bp, Homo sapiens
tctgttccagggtct

SEQ ID NO: 437038 - DNA, 15 bp, Homo sapiens
ctgttccagggtctc

SEQ ID NO: 437039 - DNA, 15 bp, Homo sapiens
tgttccagggtctct

SEQ ID NO: 437040 - DNA, 15 bp, Homo sapiens
gttccagggtctctt

SEQ ID NO: 437041 - DNA, 15 bp, Homo sapiens
ttccagggtctcttt

SEQ ID NO: 437042 - DNA, 15 bp, Homo sapiens
tccagggtctctttg

SEQ ID NO: 437043 - DNA, 15 bp, Homo sapiens
ccagggtctctttgc

SEQ ID NO: 437044 - DNA, 15 bp, Homo sapiens
cagggtctctttgct

SEQ ID NO: 437045 - DNA, 15 bp, Homo sapiens
agggtctctttgctc

SEQ ID NO: 437046 - DNA, 15 bp, Homo sapiens
gggtctctttgctct

SEQ ID NO: 437047 - DNA, 15 bp, Homo sapiens
ggtctctttgctctt

SEQ ID NO: 437048 - DNA, 15 bp, Homo sapiens
gtctctttgctcttc

SEQ ID NO: 437049 - DNA, 15 bp, Homo sapiens
tctctttgctcttcc

SEQ ID NO: 437050 - DNA, 15 bp, Homo sapiens
ctctttgctcttcct

SEQ ID NO: 437051 - DNA, 15 bp, Homo sapiens
tctttgctcttcctg

SEQ ID NO: 437052 - DNA, 15 bp, Homo sapiens
ctttgctcttcctgc

SEQ ID NO: 437053 - DNA, 15 bp, Homo sapiens
tttgctcttcctgct

SEQ ID NO: 437054 - DNA, 15 bp, Homo sapiens
ttgctcttcctgctt

SEQ ID NO: 437055 - DNA, 15 bp, Homo sapiens
tgctcttcctgcttc

SEQ ID NO: 437056 - DNA, 15 bp, Homo sapiens
gctcttcctgcttct

SEQ ID NO: 437057 - DNA, 15 bp, Homo sapiens
ctcttcctgcttctt

SEQ ID NO: 437058 - DNA, 15 bp, Homo sapiens
tcttcctgcttcttt

SEQ ID NO: 437059 - DNA, 15 bp, Homo sapiens
cttcctgcttctttc

SEQ ID NO: 437060 - DNA, 15 bp, Homo sapiens
ttcctgcttctttcc

SEQ ID NO: 437061 - DNA, 15 bp, Homo sapiens
tcctgcttctttcct

SEQ ID NO: 437062 - DNA, 15 bp, Homo sapiens
cctgcttctttcctt

SEQ ID NO: 437063 - DNA, 15 bp, Homo sapiens
ctgcttctttccttg

SEQ ID NO: 437064 - DNA, 15 bp, Homo sapiens
tgcttctttccttgg

SEQ ID NO: 437065 - DNA, 15 bp, Homo sapiens
gcttctttccttgga

SEQ ID NO: 437066 - DNA, 15 bp, Homo sapiens
cttctttccttggag

SEQ ID NO: 437067 - DNA, 15 bp, Homo sapiens
ttctttccttggagt

SEQ ID NO: 437068 - DNA, 15 bp, Homo sapiens
tctttccttggagtt

SEQ ID NO: 437069 - DNA, 15 bp, Homo sapiens
ctttccttggagttg

SEQ ID NO: 437070 - DNA, 15 bp, Homo sapiens
tttccttggagttgc

SEQ ID NO: 437071 - DNA, 15 bp, Homo sapiens
ttccttggagttgcg

SEQ ID NO: 437072 - DNA, 15 bp, Homo sapiens
tccttggagttgcgt

SEQ ID NO: 437073 - DNA, 15 bp, Homo sapiens
ccttggagttgcgtc

SEQ ID NO: 437074 - DNA, 15 bp, Homo sapiens
cttggagttgcgtct

SEQ ID NO: 437075 - DNA, 15 bp, Homo sapiens
ttggagttgcgtctg

SEQ ID NO: 437076 - DNA, 15 bp, Homo sapiens
tggagttgcgtctgt

SEQ ID NO: 437077 - DNA, 15 bp, Homo sapiens
ggagttgcgtctgtc

SEQ ID NO: 437078 - DNA, 15 bp, Homo sapiens
gagttgcgtctgtct

SEQ ID NO: 437079 - DNA, 15 bp, Homo sapiens
agttgcgtctgtcta

SEQ ID NO: 437080 - DNA, 15 bp, Homo sapiens
gttgcgtctgtctag

SEQ ID NO: 437081 - DNA, 15 bp, Homo sapiens
ttgcgtctgtctagt

SEQ ID NO: 437082 - DNA, 15 bp, Homo sapiens
tgcgtctgtctagtg

SEQ ID NO: 437083 - DNA, 15 bp, Homo sapiens
gcgtctgtctagtgg

SEQ ID NO: 437084 - DNA, 15 bp, Homo sapiens
cgtctgtctagtggt

SEQ ID NO: 437085 - DNA, 15 bp, Homo sapiens
gtctgtctagtggtt

SEQ ID NO: 437086 - DNA, 15 bp, Homo sapiens
tctgtctagtggttg

SEQ ID NO: 437087 - DNA, 15 bp, Homo sapiens
ctgtctagtggttgg

SEQ ID NO: 437088 - DNA, 15 bp, Homo sapiens
tgtctagtggttggc

SEQ ID NO: 437089 - DNA, 15 bp, Homo sapiens
gtctagtggttggcc

SEQ ID NO: 437090 - DNA, 15 bp, Homo sapiens
tctagtggttggccc

SEQ ID NO: 437091 - DNA, 15 bp, Homo sapiens
ctagtggttggcccc

SEQ ID NO: 437092 - DNA, 15 bp, Homo sapiens
tagtggttggcccct

SEQ ID NO: 437093 - DNA, 15 bp, Homo sapiens
agtggttggcccctg

SEQ ID NO: 437094 - DNA, 15 bp, Homo sapiens
gtggttggcccctgc

SEQ ID NO: 437095 - DNA, 15 bp, Homo sapiens
tggttggcccctgct

SEQ ID NO: 437096 - DNA, 15 bp, Homo sapiens
ggttggcccctgctt

SEQ ID NO: 437097 - DNA, 15 bp, Homo sapiens
gttggcccctgcttc

SEQ ID NO: 437098 - DNA, 15 bp, Homo sapiens
ttggcccctgcttct

SEQ ID NO: 437099 - DNA, 15 bp, Homo sapiens
tggcccctgcttctt

SEQ ID NO: 437100 - DNA, 15 bp, Homo sapiens
ggcccctgcttcttc

SEQ ID NO: 437101 - DNA, 15 bp, Homo sapiens
gcccctgcttcttcc

SEQ ID NO: 437102 - DNA, 15 bp, Homo sapiens
ccctgcttcttcctc

SEQ ID NO: 437103 - DNA, 15 bp, Homo sapiens
cctgcttcttcctcc

SEQ ID NO: 437104 - DNA, 15 bp, Homo sapiens
ctgcttcttcctcca

SEQ ID NO: 437105 - DNA, 15 bp, Homo sapiens
tgcttcttcctccac

SEQ ID NO: 437106 - DNA, 15 bp, Homo sapiens
gcttcttcctccact

SEQ ID NO: 437107 - DNA, 15 bp, Homo sapiens
cttcttcctccactc

SEQ ID NO: 437108 - DNA, 15 bp, Homo sapiens
ttcttcctccactca

SEQ ID NO: 437109 - DNA, 15 bp, Homo sapiens
tcttcctccactcaa

SEQ ID NO: 437110 - DNA, 15 bp, Homo sapiens
cttcctccactcaac

SEQ ID NO: 437111 - DNA, 15 bp, Homo sapiens
ttcctccactcaact

SEQ ID NO: 437112 - DNA, 15 bp, Homo sapiens
tcctccactcaactc

SEQ ID NO: 437113 - DNA, 15 bp, Homo sapiens
cctccactcaactct

SEQ ID NO: 437114 - DNA, 15 bp, Homo sapiens
ctccactcaactctg

SEQ ID NO: 437115 - DNA, 15 bp, Homo sapiens
tccactcaactctgg

SEQ ID NO: 437116 - DNA, 15 bp, Homo sapiens
ccactcaactctggg

SEQ ID NO: 437117 - DNA, 15 bp, Homo sapiens
cactcaactctgggc

SEQ ID NO: 437118 - DNA, 15 bp, Homo sapiens
actcaactctgggct

SEQ ID NO: 437119 - DNA, 15 bp, Homo sapiens
ctcaactctgggctt

SEQ ID NO: 437120 - DNA, 15 bp, Homo sapiens
tcaactctgggctta

SEQ ID NO: 437121 - DNA, 15 bp, Homo sapiens
caactctgggcttat

SEQ ID NO: 437122 - DNA, 15 bp, Homo sapiens
aactctgggcttatt

SEQ ID NO: 437123 - DNA, 15 bp, Homo sapiens
actctgggcttattt

SEQ ID NO: 437124 - DNA, 15 bp, Homo sapiens
ctctgggcttattta

SEQ ID NO: 437125 - DNA, 15 bp, Homo sapiens
tctgggcttatttac

SEQ ID NO: 437126 - DNA, 15 bp, Homo sapiens
ctgggcttatttact

SEQ ID NO: 437127 - DNA, 15 bp, Homo sapiens
tgggcttatttactt

SEQ ID NO: 437128 - DNA, 15 bp, Homo sapiens
gggcttatttacttt

SEQ ID NO: 437129 - DNA, 15 bp, Homo sapiens
ggcttatttactttg

SEQ ID NO: 437130 - DNA, 15 bp, Homo sapiens
gcttatttactttgg

SEQ ID NO: 437131 - DNA, 15 bp, Homo sapiens
cttatttactttggc

SEQ ID NO: 437132 - DNA, 15 bp, Homo sapiens
ttatttactttggcc

SEQ ID NO: 437133 - DNA, 15 bp, Homo sapiens
tatttactttggcca

SEQ ID NO: 437134 - DNA, 15 bp, Homo sapiens
atttactttggccac

SEQ ID NO: 437135 - DNA, 15 bp, Homo sapiens
tttactttggccact

SEQ ID NO: 437136 - DNA, 15 bp, Homo sapiens
ttactttggccactt

SEQ ID NO: 437137 - DNA, 15 bp, Homo sapiens
tactttggccacttc

SEQ ID NO: 437138 - DNA, 15 bp, Homo sapiens
actttggccacttca

SEQ ID NO: 437139 - DNA, 15 bp, Homo sapiens
ctttggccacttcac

SEQ ID NO: 437140 - DNA, 15 bp, Homo sapiens
tttggccacttcaca

SEQ ID NO: 437141 - DNA, 15 bp, Homo sapiens
ttggccacttcacaa

SEQ ID NO: 437142 - DNA, 15 bp, Homo sapiens
tggccacttcacaag

SEQ ID NO: 437143 - DNA, 15 bp, Homo sapiens
ggccacttcacaaga

SEQ ID NO: 437144 - DNA, 15 bp, Homo sapiens
gccacttcacaagaa

SEQ ID NO: 437145 - DNA, 15 bp, Homo sapiens
ccacttcacaagaag

SEQ ID NO: 437146 - DNA, 15 bp, Homo sapiens
cacttcacaagaaga

SEQ ID NO: 437147 - DNA, 15 bp, Homo sapiens
acttcacaagaagag

SEQ ID NO: 437148 - DNA, 15 bp, Homo sapiens
cttcacaagaagagt

SEQ ID NO: 437149 - DNA, 15 bp, Homo sapiens
ttcacaagaagagta

SEQ ID NO: 437150 - DNA, 15 bp, Homo sapiens
tcacaagaagagtaa

SEQ ID NO: 437151 - DNA, 15 bp, Homo sapiens
cacaagaagagtaaa

SEQ ID NO: 437152 - DNA, 15 bp, Homo sapiens
acaagaagagtaaac

SEQ ID NO: 437153 - DNA, 15 bp, Homo sapiens
caagaagagtaaacc

SEQ ID NO: 437154 - DNA, 15 bp, Homo sapiens
aagaagagtaaacct

SEQ ID NO: 437155 - DNA, 15 bp, Homo sapiens
agaagagtaaacctt

SEQ ID NO: 437156 - DNA, 15 bp, Homo sapiens
gaagagtaaaccttg

SEQ ID NO: 437157 - DNA, 15 bp, Homo sapiens
aagagtaaaccttga

SEQ ID NO: 437158 - DNA, 15 bp, Homo sapiens
agagtaaaccttgaa

SEQ ID NO: 437159 - DNA, 15 bp, Homo sapiens
gagtaaaccttgaat

SEQ ID NO: 437160 - DNA, 15 bp, Homo sapiens
agtaaaccttgaatg

SEQ ID NO: 437161 - DNA, 15 bp, Homo sapiens
gtaaaccttgaatgt

SEQ ID NO: 437162 - DNA, 15 bp, Homo sapiens
taaaccttgaatgta

SEQ ID NO: 437163 - DNA, 15 bp, Homo sapiens
aaaccttgaatgtat

SEQ ID NO: 437164 - DNA, 15 bp, Homo sapiens
aaccttgaatgtatt

SEQ ID NO: 437165 - DNA, 15 bp, Homo sapiens
accttgaatgtattt

SEQ ID NO: 437166 - DNA, 15 bp, Homo sapiens
ccttgaatgtattta

SEQ ID NO: 437167 - DNA, 15 bp, Homo sapiens
cttgaatgtatttag

SEQ ID NO: 437168 - DNA, 15 bp, Homo sapiens
ttgaatgtatttaga

SEQ ID NO: 437169 - DNA, 15 bp, Homo sapiens
tgaatgtatttagac

SEQ ID NO: 437170 - DNA, 15 bp, Homo sapiens
gaatgtatttagact

SEQ ID NO: 437171 - DNA, 15 bp, Homo sapiens
aatgtatttagactc

SEQ ID NO: 437172 - DNA, 15 bp, Homo sapiens
atgtatttagactcc

SEQ ID NO: 437173 - DNA, 15 bp, Homo sapiens
tgtatttagactcca

SEQ ID NO: 437174 - DNA, 15 bp, Homo sapiens
gtatttagactccag

SEQ ID NO: 437175 - DNA, 15 bp, Homo sapiens
tatttagactccagt

SEQ ID NO: 437176 - DNA, 15 bp, Homo sapiens
atttagactccagtt

SEQ ID NO: 437177 - DNA, 15 bp, Homo sapiens
tttagactccagttc

SEQ ID NO: 437178 - DNA, 15 bp, Homo sapiens
ttagactccagttct

SEQ ID NO: 437179 - DNA, 15 bp, Homo sapiens
tagactccagttctg

SEQ ID NO: 437180 - DNA, 15 bp, Homo sapiens
agactccagttctgc

SEQ ID NO: 437181 - DNA, 15 bp, Homo sapiens
gactccagttctgcc

SEQ ID NO: 437182 - DNA, 15 bp, Homo sapiens
actccagttctgcct

SEQ ID NO: 437183 - DNA, 15 bp, Homo sapiens
ctccagttctgcctc

SEQ ID NO: 437184 - DNA, 15 bp, Homo sapiens
tccagttctgcctct

SEQ ID NO: 437185 - DNA, 15 bp, Homo sapiens
ccagttctgcctcta

SEQ ID NO: 437186 - DNA, 15 bp, Homo sapiens
cagttctgcctctat

SEQ ID NO: 437187 - DNA, 15 bp, Homo sapiens
agttctgcctctatt

SEQ ID NO: 437188 - DNA, 15 bp, Homo sapiens
gttctgcctctattg

SEQ ID NO: 437189 - DNA, 15 bp, Homo sapiens
ttctgcctctattga

SEQ ID NO: 437190 - DNA, 15 bp, Homo sapiens
tctgcctctattgac

SEQ ID NO: 437191 - DNA, 15 bp, Homo sapiens
ctgcctctattgact

SEQ ID NO: 437192 - DNA, 15 bp, Homo sapiens
tgcctctattgactt

SEQ ID NO: 437193 - DNA, 15 bp, Homo sapiens
gcctctattgacttc

SEQ ID NO: 437194 - DNA, 15 bp, Homo sapiens
cctctattgacttca

SEQ ID NO: 437195 - DNA, 15 bp, Homo sapiens
ctctattgacttcag

SEQ ID NO: 437196 - DNA, 15 bp, Homo sapiens
tctattgacttcagg

SEQ ID NO: 437197 - DNA, 15 bp, Homo sapiens
ctattgacttcaggt

SEQ ID NO: 437198 - DNA, 15 bp, Homo sapiens
tattgacttcaggtc

SEQ ID NO: 437199 - DNA, 15 bp, Homo sapiens
attgacttcaggtca

SEQ ID NO: 437200 - DNA, 15 bp, Homo sapiens
ttgacttcaggtcag

SEQ ID NO: 437201 - DNA, 15 bp, Homo sapiens
tgacttcaggtcagt

SEQ ID NO: 437202 - DNA, 15 bp, Homo sapiens
gacttcaggtcagtg

SEQ ID NO: 437203 - DNA, 15 bp, Homo sapiens
acttcaggtcagtgg

SEQ ID NO: 437204 - DNA, 15 bp, Homo sapiens
cttcaggtcagtggt

SEQ ID NO: 437205 - DNA, 15 bp, Homo sapiens
ttcaggtcagtggtg

SEQ ID NO: 437206 - DNA, 15 bp, Homo sapiens
tcaggtcagtggtgc

SEQ ID NO: 437207 - DNA, 15 bp, Homo sapiens
caggtcagtggtgcc

SEQ ID NO: 437208 - DNA, 15 bp, Homo sapiens
aggtcagtggtgcca

SEQ ID NO: 437209 - DNA, 15 bp, Homo sapiens
ggtcagtggtgccat

SEQ ID NO: 437210 - DNA, 15 bp, Homo sapiens
gtcagtggtgccatg

SEQ ID NO: 437211 - DNA, 15 bp, Homo sapiens
tcagtggtgccatgt

SEQ ID NO: 437212 - DNA, 15 bp, Homo sapiens
cagtggtgccatgta

SEQ ID NO: 437213 - DNA, 15 bp, Homo sapiens
agtggtgccatgtag

SEQ ID NO: 437214 - DNA, 15 bp, Homo sapiens
gtggtgccatgtagc

SEQ ID NO: 437215 - DNA, 15 bp, Homo sapiens
tggtgccatgtagct

SEQ ID NO: 437216 - DNA, 15 bp, Homo sapiens
ggtgccatgtagctc

SEQ ID NO: 437217 - DNA, 15 bp, Homo sapiens
gtgccatgtagctcc

SEQ ID NO: 437218 - DNA, 15 bp, Homo sapiens
tgccatgtagctccc

SEQ ID NO: 437219 - DNA, 15 bp, Homo sapiens
gccatgtagctccct

SEQ ID NO: 437220 - DNA, 15 bp, Homo sapiens
ccatgtagctccctc

SEQ ID NO: 437221 - DNA, 15 bp, Homo sapiens
catgtagctccctcc

SEQ ID NO: 437222 - DNA, 15 bp, Homo sapiens
atgtagctccctcca

SEQ ID NO: 437223 - DNA, 15 bp, Homo sapiens
tgtagctccctccaa

SEQ ID NO: 437224 - DNA, 15 bp, Homo sapiens
gtagctccctccaaa

SEQ ID NO: 437225 - DNA, 15 bp, Homo sapiens
tagctccctccaaag

SEQ ID NO: 437226 - DNA, 15 bp, Homo sapiens
agctccctccaaagc

SEQ ID NO: 437227 - DNA, 15 bp, Homo sapiens
gctccctccaaagcg

SEQ ID NO: 437228 - DNA, 15 bp, Homo sapiens
ctccctccaaagcgt

SEQ ID NO: 437229 - DNA, 15 bp, Homo sapiens
tccctccaaagcgtg

SEQ ID NO: 437230 - DNA, 15 bp, Homo sapiens
ccctccaaagcgtgt

SEQ ID NO: 437231 - DNA, 15 bp, Homo sapiens
cctccaaagcgtgtt

SEQ ID NO: 437232 - DNA, 15 bp, Homo sapiens
ctccaaagcgtgttt

SEQ ID NO: 437233 - DNA, 15 bp, Homo sapiens
tccaaagcgtgtttt

SEQ ID NO: 437234 - DNA, 15 bp, Homo sapiens
ccaaagcgtgttttg

SEQ ID NO: 437235 - DNA, 15 bp, Homo sapiens
caaagcgtgttttgt

SEQ ID NO: 437236 - DNA, 15 bp, Homo sapiens
aaagcgtgttttgta

SEQ ID NO: 437237 - DNA, 15 bp, Homo sapiens
aagcgtgttttgtat

SEQ ID NO: 437238 - DNA, 15 bp, Homo sapiens
agcgtgttttgtatt

SEQ ID NO: 437239 - DNA, 15 bp, Homo sapiens
gcgtgttttgtattc

SEQ ID NO: 437240 - DNA, 15 bp, Homo sapiens
cgtgttttgtattct

SEQ ID NO: 437241 - DNA, 15 bp, Homo sapiens
gtgttttgtattctg

SEQ ID NO: 437242 - DNA, 15 bp, Homo sapiens
tgttttgtattctga

SEQ ID NO: 437243 - DNA, 15 bp, Homo sapiens
gttttgtattctgag

SEQ ID NO: 437244 - DNA, 15 bp, Homo sapiens
ttttgtattctgagt

SEQ ID NO: 437245 - DNA, 15 bp, Homo sapiens
tttgtattctgagtt

SEQ ID NO: 437246 - DNA, 15 bp, Homo sapiens
ttgtattctgagttc

SEQ ID NO: 437247 - DNA, 15 bp, Homo sapiens
tgtattctgagttcc

SEQ ID NO: 437248 - DNA, 15 bp, Homo sapiens
gtattctgagttccc

SEQ ID NO: 437249 - DNA, 15 bp, Homo sapiens
tattctgagttcccc

SEQ ID NO: 437250 - DNA, 15 bp, Homo sapiens
attctgagttcccct

SEQ ID NO: 437251 - DNA, 15 bp, Homo sapiens
ttctgagttcccctt

SEQ ID NO: 437252 - DNA, 15 bp, Homo sapiens
tctgagttccccttc

SEQ ID NO: 437253 - DNA, 15 bp, Homo sapiens
ctgagttccccttca

SEQ ID NO: 437254 - DNA, 15 bp, Homo sapiens
tgagttccccttcat

SEQ ID NO: 437255 - DNA, 15 bp, Homo sapiens
gagttccccttcatt

SEQ ID NO: 437256 - DNA, 15 bp, Homo sapiens
agttccccttcattt

SEQ ID NO: 437257 - DNA, 15 bp, Homo sapiens
gttccccttcatttg

SEQ ID NO: 437258 - DNA, 15 bp, Homo sapiens
ttccccttcatttgt

SEQ ID NO: 437259 - DNA, 15 bp, Homo sapiens
tccccttcatttgtg

SEQ ID NO: 437260 - DNA, 15 bp, Homo sapiens
ccccttcatttgtgt

SEQ ID NO: 437261 - DNA, 15 bp, Homo sapiens
cccttcatttgtgtc

SEQ ID NO: 437262 - DNA, 15 bp, Homo sapiens
ccttcatttgtgtcc

SEQ ID NO: 437263 - DNA, 15 bp, Homo sapiens
cttcatttgtgtccc

SEQ ID NO: 437264 - DNA, 15 bp, Homo sapiens
ttcatttgtgtcccc

SEQ ID NO: 437265 - DNA, 15 bp, Homo sapiens
tcatttgtgtcccct

SEQ ID NO: 437266 - DNA, 15 bp, Homo sapiens
catttgtgtcccctc

SEQ ID NO: 437267 - DNA, 15 bp, Homo sapiens
atttgtgtcccctct

SEQ ID NO: 437268 - DNA, 15 bp, Homo sapiens
tttgtgtcccctctc

SEQ ID NO: 437269 - DNA, 15 bp, Homo sapiens
ttgtgtcccctctct

SEQ ID NO: 437270 - DNA, 15 bp, Homo sapiens
tgtgtcccctctctt

SEQ ID NO: 437271 - DNA, 15 bp, Homo sapiens
gtgtcccctctctta

SEQ ID NO: 437272 - DNA, 15 bp, Homo sapiens
tgtcccctctcttaa

SEQ ID NO: 437273 - DNA, 15 bp, Homo sapiens
gtcccctctcttaat

SEQ ID NO: 437274 - DNA, 15 bp, Homo sapiens
tcccctctcttaata

SEQ ID NO: 437275 - DNA, 15 bp, Homo sapiens
cccctctcttaataa

SEQ ID NO: 437276 - DNA, 15 bp, Homo sapiens
ccctctcttaataac

SEQ ID NO: 437277 - DNA, 15 bp, Homo sapiens
cctctcttaataact

SEQ ID NO: 437278 - DNA, 15 bp, Homo sapiens
ctctcttaataactt

SEQ ID NO: 437279 - DNA, 15 bp, Homo sapiens
tctcttaataacttg

SEQ ID NO: 437280 - DNA, 15 bp, Homo sapiens
ctcttaataacttgc

SEQ ID NO: 437281 - DNA, 15 bp, Homo sapiens
tcttaataacttgca

SEQ ID NO: 437282 - DNA, 15 bp, Homo sapiens
cttaataacttgcat

SEQ ID NO: 437283 - DNA, 15 bp, Homo sapiens
ttaataacttgcatt

SEQ ID NO: 437284 - DNA, 15 bp, Homo sapiens
taataacttgcattt

SEQ ID NO: 437285 - DNA, 15 bp, Homo sapiens
aataacttgcattta

SEQ ID NO: 437286 - DNA, 15 bp, Homo sapiens
ataacttgcatttac

SEQ ID NO: 437287 - DNA, 15 bp, Homo sapiens
taacttgcatttact

SEQ ID NO: 437288 - DNA, 15 bp, Homo sapiens
aacttgcatttacta

SEQ ID NO: 437289 - DNA, 15 bp, Homo sapiens
acttgcatttactat

SEQ ID NO: 437290 - DNA, 15 bp, Homo sapiens
cttgcatttactatt

SEQ ID NO: 437291 - DNA, 15 bp, Homo sapiens
ttgcatttactattt

SEQ ID NO: 437292 - DNA, 15 bp, Homo sapiens
tgcatttactatttg

SEQ ID NO: 437293 - DNA, 15 bp, Homo sapiens
gcatttactatttgt

SEQ ID NO: 437294 - DNA, 15 bp, Homo sapiens
catttactatttgtg

SEQ ID NO: 437295 - DNA, 15 bp, Homo sapiens
atttactatttgtgg

SEQ ID NO: 437296 - DNA, 15 bp, Homo sapiens
tttactatttgtgga

SEQ ID NO: 437297 - DNA, 15 bp, Homo sapiens
ttactatttgtggaa

SEQ ID NO: 437298 - DNA, 15 bp, Homo sapiens
tactatttgtggaag

SEQ ID NO: 437299 - DNA, 15 bp, Homo sapiens
actatttgtggaagg

SEQ ID NO: 437300 - DNA, 15 bp, Homo sapiens
ctatttgtggaaggt

SEQ ID NO: 437301 - DNA, 15 bp, Homo sapiens
tatttgtggaaggta

SEQ ID NO: 437302 - DNA, 15 bp, Homo sapiens
atttgtggaaggtag

SEQ ID NO: 437303 - DNA, 15 bp, Homo sapiens
tttgtggaaggtagt

SEQ ID NO: 437304 - DNA, 15 bp, Homo sapiens
ttgtggaaggtagtc

SEQ ID NO: 437305 - DNA, 15 bp, Homo sapiens
tgtggaaggtagtcc

SEQ ID NO: 437306 - DNA, 15 bp, Homo sapiens
gtggaaggtagtccc

SEQ ID NO: 437307 - DNA, 15 bp, Homo sapiens
tggaaggtagtccct

SEQ ID NO: 437308 - DNA, 15 bp, Homo sapiens
ggaaggtagtcccta

SEQ ID NO: 437309 - DNA, 15 bp, Homo sapiens
gaaggtagtccctaa

SEQ ID NO: 437310 - DNA, 15 bp, Homo sapiens
aaggtagtccctaaa

SEQ ID NO: 437311 - DNA, 15 bp, Homo sapiens
aggtagtccctaaat

SEQ ID NO: 437312 - DNA, 15 bp, Homo sapiens
ggtagtccctaaatc

SEQ ID NO: 437313 - DNA, 15 bp, Homo sapiens
gtagtccctaaatct

SEQ ID NO: 437314 - DNA, 15 bp, Homo sapiens
tagtccctaaatctg

SEQ ID NO: 437315 - DNA, 15 bp, Homo sapiens
agtccctaaatctgt

SEQ ID NO: 437316 - DNA, 15 bp, Homo sapiens
gtccctaaatctgtt

SEQ ID NO: 437317 - DNA, 15 bp, Homo sapiens
tccctaaatctgttt

SEQ ID NO: 437318 - DNA, 15 bp, Homo sapiens
ccctaaatctgttta

SEQ ID NO: 437319 - DNA, 15 bp, Homo sapiens
cctaaatctgtttac

SEQ ID NO: 437320 - DNA, 15 bp, Homo sapiens
ctaaatctgtttact

SEQ ID NO: 437321 - DNA, 15 bp, Homo sapiens
taaatctgtttactt

SEQ ID NO: 437322 - DNA, 15 bp, Homo sapiens
aaatctgtttacttt

SEQ ID NO: 437323 - DNA, 15 bp, Homo sapiens
aatctgtttactttt

SEQ ID NO: 437324 - DNA, 15 bp, Homo sapiens
atctgtttacttttg

SEQ ID NO: 437325 - DNA, 15 bp, Homo sapiens
tctgtttacttttga

SEQ ID NO: 437326 - DNA, 15 bp, Homo sapiens
ctgtttacttttgag

SEQ ID NO: 437327 - DNA, 15 bp, Homo sapiens
tgtttacttttgagg

SEQ ID NO: 437328 - DNA, 15 bp, Homo sapiens
gtttacttttgaggt

SEQ ID NO: 437329 - DNA, 15 bp, Homo sapiens
tttacttttgaggtc

SEQ ID NO: 437330 - DNA, 15 bp, Homo sapiens
ttacttttgaggtct

SEQ ID NO: 437331 - DNA, 15 bp, Homo sapiens
tacttttgaggtctt

SEQ ID NO: 437332 - DNA, 15 bp, Homo sapiens
acttttgaggtcttg

SEQ ID NO: 437333 - DNA, 15 bp, Homo sapiens
cttttgaggtcttga

SEQ ID NO: 437334 - DNA, 15 bp, Homo sapiens
ttttgaggtcttgat

SEQ ID NO: 437335 - DNA, 15 bp, Homo sapiens
tttgaggtcttgatg

SEQ ID NO: 437336 - DNA, 15 bp, Homo sapiens
ttgaggtcttgatgt

SEQ ID NO: 437337 - DNA, 15 bp, Homo sapiens
tgaggtcttgatgtt

SEQ ID NO: 437338 - DNA, 15 bp, Homo sapiens
gaggtcttgatgttc

SEQ ID NO: 437339 - DNA, 15 bp, Homo sapiens
aggtcttgatgttcc

SEQ ID NO: 437340 - DNA, 15 bp, Homo sapiens
ggtcttgatgttccc

SEQ ID NO: 437341 - DNA, 15 bp, Homo sapiens
gtcttgatgttccct

SEQ ID NO: 437342 - DNA, 15 bp, Homo sapiens
tcttgatgttcccta

SEQ ID NO: 437343 - DNA, 15 bp, Homo sapiens
cttgatgttccctaa

SEQ ID NO: 437344 - DNA, 15 bp, Homo sapiens
ttgatgttccctaaa

SEQ ID NO: 437345 - DNA, 15 bp, Homo sapiens
tgatgttccctaaat

SEQ ID NO: 437346 - DNA, 15 bp, Homo sapiens
gatgttccctaaata

SEQ ID NO: 437347 - DNA, 15 bp, Homo sapiens
atgttccctaaatat

SEQ ID NO: 437348 - DNA, 15 bp, Homo sapiens
tgttccctaaatata

SEQ ID NO: 437349 - DNA, 15 bp, Homo sapiens
gttccctaaatatat

SEQ ID NO: 437350 - DNA, 15 bp, Homo sapiens
ttccctaaatatatc

SEQ ID NO: 437351 - DNA, 15 bp, Homo sapiens
tccctaaatatatct

SEQ ID NO: 437352 - DNA, 15 bp, Homo sapiens
ccctaaatatatcta

SEQ ID NO: 437353 - DNA, 15 bp, Homo sapiens
cctaaatatatctag

SEQ ID NO: 437354 - DNA, 15 bp, Homo sapiens
ctaaatatatctagg

SEQ ID NO: 437355 - DNA, 15 bp, Homo sapiens
taaatatatctaggt

SEQ ID NO: 437356 - DNA, 15 bp, Homo sapiens
aaatatatctaggtt

SEQ ID NO: 437357 - DNA, 15 bp, Homo sapiens
aatatatctaggttc

SEQ ID NO: 437358 - DNA, 15 bp, Homo sapiens
atatatctaggttct

SEQ ID NO: 437359 - DNA, 15 bp, Homo sapiens
tatatctaggttctc

SEQ ID NO: 437360 - DNA, 15 bp, Homo sapiens
atatctaggttctct

SEQ ID NO: 437361 - DNA, 15 bp, Homo sapiens
tatctaggttctctt

SEQ ID NO: 437362 - DNA, 15 bp, Homo sapiens
atctaggttctcttt

SEQ ID NO: 437363 - DNA, 15 bp, Homo sapiens
tctaggttctctttt

SEQ ID NO: 437364 - DNA, 15 bp, Homo sapiens
ctaggttctcttttc

SEQ ID NO: 437365 - DNA, 15 bp, Homo sapiens
taggttctcttttct

SEQ ID NO: 437366 - DNA, 15 bp, Homo sapiens
aggttctcttttctt

SEQ ID NO: 437367 - DNA, 15 bp, Homo sapiens
ggttctcttttctta

SEQ ID NO: 437368 - DNA, 15 bp, Homo sapiens
gttctcttttcttaa

SEQ ID NO: 437369 - DNA, 15 bp, Homo sapiens
ttctcttttcttaaa

SEQ ID NO: 437370 - DNA, 15 bp, Homo sapiens
tctcttttcttaaaa

SEQ ID NO: 437371 - DNA, 15 bp, Homo sapiens
ctcttttcttaaaaa

SEQ ID NO: 437372 - DNA, 15 bp, Homo sapiens
cttttcttaaaaaaa

SEQ ID NO: 437373 - DNA, 15 bp, Homo sapiens
ttttcttaaaaaaag

SEQ ID NO: 437374 - DNA, 15 bp, Homo sapiens
tttcttaaaaaaaga

SEQ ID NO: 437375 - DNA, 15 bp, Homo sapiens
ttcttaaaaaaagaa

SEQ ID NO: 437376 - DNA, 15 bp, Homo sapiens
tcttaaaaaaagaaa

SEQ ID NO: 437377 - DNA, 15 bp, Homo sapiens
cttaaaaaaagaaaa

SEQ ID NO: 437378 - DNA, 15 bp, Homo sapiens
ttaaaaaaagaaaaa

SEQ ID NO: 437379 - DNA, 15 bp, Homo sapiens
taaaaaaagaaaaaa

SEQ ID NO: 437380 - DNA, 15 bp, Homo sapiens
aaagaaaaaaaaaga

SEQ ID NO: 437381 - DNA, 15 bp, Homo sapiens
gaaaaaaaaagaatt

SEQ ID NO: 437382 - DNA, 15 bp, Homo sapiens
aaaaaaaaagaattt

SEQ ID NO: 437383 - DNA, 15 bp, Homo sapiens
aaaaaaaagaatttg

SEQ ID NO: 437384 - DNA, 15 bp, Homo sapiens
aaaaaaagaatttga

SEQ ID NO: 437385 - DNA, 15 bp, Homo sapiens
aaaaaagaatttgag

SEQ ID NO: 437386 - DNA, 15 bp, Homo sapiens
aaaaagaatttgaga

SEQ ID NO: 437387 - DNA, 15 bp, Homo sapiens
aaaagaatttgagaa

SEQ ID NO: 437388 - DNA, 15 bp, Homo sapiens
aaagaatttgagaag

SEQ ID NO: 437389 - DNA, 15 bp, Homo sapiens
aagaatttgagaagt

SEQ ID NO: 437390 - DNA, 15 bp, Homo sapiens
agaatttgagaagtc

SEQ ID NO: 437391 - DNA, 15 bp, Homo sapiens
gaatttgagaagtcc

SEQ ID NO: 437392 - DNA, 15 bp, Homo sapiens
aatttgagaagtcca

SEQ ID NO: 437393 - DNA, 15 bp, Homo sapiens
atttgagaagtccac

SEQ ID NO: 437394 - DNA, 15 bp, Homo sapiens
tttgagaagtccact

SEQ ID NO: 437395 - DNA, 15 bp, Homo sapiens
ttgagaagtccactg

SEQ ID NO: 437396 - DNA, 15 bp, Homo sapiens
tgagaagtccactgg

SEQ ID NO: 437397 - DNA, 15 bp, Homo sapiens
gagaagtccactggc

SEQ ID NO: 437398 - DNA, 15 bp, Homo sapiens
agaagtccactggca

SEQ ID NO: 437399 - DNA, 15 bp, Homo sapiens
gaagtccactggcag

SEQ ID NO: 437400 - DNA, 15 bp, Homo sapiens
aagtccactggcagc

SEQ ID NO: 437401 - DNA, 15 bp, Homo sapiens
agtccactggcagca

SEQ ID NO: 437402 - DNA, 15 bp, Homo sapiens
gtccactggcagcat

SEQ ID NO: 437403 - DNA, 15 bp, Homo sapiens
tccactggcagcatg

SEQ ID NO: 437404 - DNA, 15 bp, Homo sapiens
ccactggcagcatgg

SEQ ID NO: 437405 - DNA, 15 bp, Homo sapiens
cactggcagcatgga

SEQ ID NO: 437406 - DNA, 15 bp, Homo sapiens
actggcagcatggat

SEQ ID NO: 437407 - DNA, 15 bp, Homo sapiens
ctggcagcatggatg

SEQ ID NO: 437408 - DNA, 15 bp, Homo sapiens
tggcagcatggatga

SEQ ID NO: 437409 - DNA, 15 bp, Homo sapiens
ggcagcatggatgaa

SEQ ID NO: 437410 - DNA, 15 bp, Homo sapiens
gcagcatggatgaat

SEQ ID NO: 437411 - DNA, 15 bp, Homo sapiens
cagcatggatgaatc

SEQ ID NO: 437412 - DNA, 15 bp, Homo sapiens
agcatggatgaatct

SEQ ID NO: 437413 - DNA, 15 bp, Homo sapiens
gcatggatgaatcta

SEQ ID NO: 437414 - DNA, 15 bp, Homo sapiens
catggatgaatctat

SEQ ID NO: 437415 - DNA, 15 bp, Homo sapiens
atggatgaatctatg

SEQ ID NO: 437416 - DNA, 15 bp, Homo sapiens
tggatgaatctatgc

SEQ ID NO: 437417 - DNA, 15 bp, Homo sapiens
ggatgaatctatgcc

SEQ ID NO: 437418 - DNA, 15 bp, Homo sapiens
gatgaatctatgcca

SEQ ID NO: 437419 - DNA, 15 bp, Homo sapiens
atgaatctatgccat

SEQ ID NO: 437420 - DNA, 15 bp, Homo sapiens
tgaatctatgccatc

SEQ ID NO: 437421 - DNA, 15 bp, Homo sapiens
gaatctatgccatct

SEQ ID NO: 437422 - DNA, 15 bp, Homo sapiens
aatctatgccatctt

SEQ ID NO: 437423 - DNA, 15 bp, Homo sapiens
atctatgccatcttt

SEQ ID NO: 437424 - DNA, 15 bp, Homo sapiens
tctatgccatcttta

SEQ ID NO: 437425 - DNA, 15 bp, Homo sapiens
ctatgccatctttat

SEQ ID NO: 437426 - DNA, 15 bp, Homo sapiens
tatgccatctttatc

SEQ ID NO: 437427 - DNA, 15 bp, Homo sapiens
atgccatctttatca

SEQ ID NO: 437428 - DNA, 15 bp, Homo sapiens
tgccatctttatcat

SEQ ID NO: 437429 - DNA, 15 bp, Homo sapiens
gccatctttatcata

SEQ ID NO: 437430 - DNA, 15 bp, Homo sapiens
ccatctttatcatat

SEQ ID NO: 437431 - DNA, 15 bp, Homo sapiens
catctttatcatatc

SEQ ID NO: 437432 - DNA, 15 bp, Homo sapiens
atctttatcatatct

SEQ ID NO: 437433 - DNA, 15 bp, Homo sapiens
tctttatcatatctg

SEQ ID NO: 437434 - DNA, 15 bp, Homo sapiens
ctttatcatatctgt

SEQ ID NO: 437435 - DNA, 15 bp, Homo sapiens
tttatcatatctgta

SEQ ID NO: 437436 - DNA, 15 bp, Homo sapiens
ttatcatatctgtat

SEQ ID NO: 437437 - DNA, 15 bp, Homo sapiens
tatcatatctgtatt

SEQ ID NO: 437438 - DNA, 15 bp, Homo sapiens
atcatatctgtattg

SEQ ID NO: 437439 - DNA, 15 bp, Homo sapiens
tcatatctgtattga

SEQ ID NO: 437440 - DNA, 15 bp, Homo sapiens
catatctgtattgaa

SEQ ID NO: 437441 - DNA, 15 bp, Homo sapiens
atatctgtattgaaa

SEQ ID NO: 437442 - DNA, 15 bp, Homo sapiens
tatctgtattgaaag

SEQ ID NO: 437443 - DNA, 15 bp, Homo sapiens
atctgtattgaaaga

SEQ ID NO: 437444 - DNA, 15 bp, Homo sapiens
tctgtattgaaagat

SEQ ID NO: 437445 - DNA, 15 bp, Homo sapiens
ctgtattgaaagatt

SEQ ID NO: 437446 - DNA, 15 bp, Homo sapiens
tgtattgaaagattt

SEQ ID NO: 437447 - DNA, 15 bp, Homo sapiens
gtattgaaagattta

SEQ ID NO: 437448 - DNA, 15 bp, Homo sapiens
tattgaaagatttag

SEQ ID NO: 437449 - DNA, 15 bp, Homo sapiens
attgaaagatttagg

SEQ ID NO: 437450 - DNA, 15 bp, Homo sapiens
ttgaaagatttaggc

SEQ ID NO: 437451 - DNA, 15 bp, Homo sapiens
tgaaagatttaggct

SEQ ID NO: 437452 - DNA, 15 bp, Homo sapiens
gaaagatttaggcta

SEQ ID NO: 437453 - DNA, 15 bp, Homo sapiens
aaagatttaggctac

SEQ ID NO: 437454 - DNA, 15 bp, Homo sapiens
aagatttaggctaca

SEQ ID NO: 437455 - DNA, 15 bp, Homo sapiens
agatttaggctacat

SEQ ID NO: 437456 - DNA, 15 bp, Homo sapiens
gatttaggctacata

SEQ ID NO: 437457 - DNA, 15 bp, Homo sapiens
atttaggctacatat

SEQ ID NO: 437458 - DNA, 15 bp, Homo sapiens
tttaggctacatatt

SEQ ID NO: 437459 - DNA, 15 bp, Homo sapiens
ttaggctacatatta

SEQ ID NO: 437460 - DNA, 15 bp, Homo sapiens
taggctacatattaa

SEQ ID NO: 437461 - DNA, 15 bp, Homo sapiens
aggctacatattaac

SEQ ID NO: 437462 - DNA, 15 bp, Homo sapiens
ggctacatattaaca

SEQ ID NO: 437463 - DNA, 15 bp, Homo sapiens
gctacatattaacag

SEQ ID NO: 437464 - DNA, 15 bp, Homo sapiens
ctacatattaacagg

SEQ ID NO: 437465 - DNA, 15 bp, Homo sapiens
tacatattaacaggt

SEQ ID NO: 437466 - DNA, 15 bp, Homo sapiens
acatattaacaggtg

SEQ ID NO: 437467 - DNA, 15 bp, Homo sapiens
catattaacaggtga

SEQ ID NO: 437468 - DNA, 15 bp, Homo sapiens
atattaacaggtgaa

SEQ ID NO: 437469 - DNA, 15 bp, Homo sapiens
tattaacaggtgaat

SEQ ID NO: 437470 - DNA, 15 bp, Homo sapiens
attaacaggtgaatc

SEQ ID NO: 437471 - DNA, 15 bp, Homo sapiens
ttaacaggtgaatct

SEQ ID NO: 437472 - DNA, 15 bp, Homo sapiens
taacaggtgaatctg

SEQ ID NO: 437473 - DNA, 15 bp, Homo sapiens
aacaggtgaatctgc

SEQ ID NO: 437474 - DNA, 15 bp, Homo sapiens
acaggtgaatctgct

SEQ ID NO: 437475 - DNA, 15 bp, Homo sapiens
caggtgaatctgctc

SEQ ID NO: 437476 - DNA, 15 bp, Homo sapiens
aggtgaatctgctct

SEQ ID NO: 437477 - DNA, 15 bp, Homo sapiens
ggtgaatctgctctg

SEQ ID NO: 437478 - DNA, 15 bp, Homo sapiens
gtgaatctgctctga

SEQ ID NO: 437479 - DNA, 15 bp, Homo sapiens
tgaatctgctctgag

SEQ ID NO: 437480 - DNA, 15 bp, Homo sapiens
gaatctgctctgagt

SEQ ID NO: 437481 - DNA, 15 bp, Homo sapiens
aatctgctctgagta

SEQ ID NO: 437482 - DNA, 15 bp, Homo sapiens
atctgctctgagtag

SEQ ID NO: 437483 - DNA, 15 bp, Homo sapiens
tctgctctgagtagc

SEQ ID NO: 437484 - DNA, 15 bp, Homo sapiens
ctgctctgagtagcc

SEQ ID NO: 437485 - DNA, 15 bp, Homo sapiens
tgctctgagtagcct

SEQ ID NO: 437486 - DNA, 15 bp, Homo sapiens
gctctgagtagcctc

SEQ ID NO: 437487 - DNA, 15 bp, Homo sapiens
ctctgagtagcctct

SEQ ID NO: 437488 - DNA, 15 bp, Homo sapiens
tctgagtagcctctt

SEQ ID NO: 437489 - DNA, 15 bp, Homo sapiens
ctgagtagcctcttg

SEQ ID NO: 437490 - DNA, 15 bp, Homo sapiens
tgagtagcctcttgt

SEQ ID NO: 437491 - DNA, 15 bp, Homo sapiens
gagtagcctcttgtt

SEQ ID NO: 437492 - DNA, 15 bp, Homo sapiens
agtagcctcttgtta

SEQ ID NO: 437493 - DNA, 15 bp, Homo sapiens
gtagcctcttgttat

SEQ ID NO: 437494 - DNA, 15 bp, Homo sapiens
tagcctcttgttatt

SEQ ID NO: 437495 - DNA, 15 bp, Homo sapiens
agcctcttgttattg

SEQ ID NO: 437496 - DNA, 15 bp, Homo sapiens
gcctcttgttattgt

SEQ ID NO: 437497 - DNA, 15 bp, Homo sapiens
cctcttgttattgtc

SEQ ID NO: 437498 - DNA, 15 bp, Homo sapiens
ctcttgttattgtca

SEQ ID NO: 437499 - DNA, 15 bp, Homo sapiens
tcttgttattgtcat

SEQ ID NO: 437500 - DNA, 15 bp, Homo sapiens
cttgttattgtcatc

SEQ ID NO: 437501 - DNA, 15 bp, Homo sapiens
ttgttattgtcatcc

SEQ ID NO: 437502 - DNA, 15 bp, Homo sapiens
tgttattgtcatcct

SEQ ID NO: 437503 - DNA, 15 bp, Homo sapiens
gttattgtcatcctt

SEQ ID NO: 437504 - DNA, 15 bp, Homo sapiens
ttattgtcatcctta

SEQ ID NO: 437505 - DNA, 15 bp, Homo sapiens
tattgtcatccttat

SEQ ID NO: 437506 - DNA, 15 bp, Homo sapiens
attgtcatccttata

SEQ ID NO: 437507 - DNA, 15 bp, Homo sapiens
ttgtcatccttataa

SEQ ID NO: 437508 - DNA, 15 bp, Homo sapiens
tgtcatccttataat

SEQ ID NO: 437509 - DNA, 15 bp, Homo sapiens
gtcatccttataatt

SEQ ID NO: 437510 - DNA, 15 bp, Homo sapiens
tcatccttataattt

SEQ ID NO: 437511 - DNA, 15 bp, Homo sapiens
catccttataattta

SEQ ID NO: 437512 - DNA, 15 bp, Homo sapiens
atccttataatttat

SEQ ID NO: 437513 - DNA, 15 bp, Homo sapiens
tccttataatttatt

SEQ ID NO: 437514 - DNA, 15 bp, Homo sapiens
ccttataatttatta

SEQ ID NO: 437515 - DNA, 15 bp, Homo sapiens
cttataatttattaa

SEQ ID NO: 437516 - DNA, 15 bp, Homo sapiens
ttataatttattaaa

SEQ ID NO: 437517 - DNA, 15 bp, Homo sapiens
tataatttattaaat

SEQ ID NO: 437518 - DNA, 15 bp, Homo sapiens
ataatttattaaatg

SEQ ID NO: 437519 - DNA, 15 bp, Homo sapiens
taatttattaaatgg

SEQ ID NO: 437520 - DNA, 15 bp, Homo sapiens
aatttattaaatgga

SEQ ID NO: 437521 - DNA, 15 bp, Homo sapiens
atttattaaatggac

SEQ ID NO: 437522 - DNA, 15 bp, Homo sapiens
tttattaaatggaca

SEQ ID NO: 437523 - DNA, 15 bp, Homo sapiens
ttattaaatggacat

SEQ ID NO: 437524 - DNA, 15 bp, Homo sapiens
tattaaatggacata

SEQ ID NO: 437525 - DNA, 15 bp, Homo sapiens
attaaatggacataa

SEQ ID NO: 437526 - DNA, 15 bp, Homo sapiens
ttaaatggacataat

SEQ ID NO: 437527 - DNA, 15 bp, Homo sapiens
taaatggacataatt

SEQ ID NO: 437528 - DNA, 15 bp, Homo sapiens
aaatggacataatta

SEQ ID NO: 437529 - DNA, 15 bp, Homo sapiens
aatggacataattag

SEQ ID NO: 437530 - DNA, 15 bp, Homo sapiens
atggacataattaga

SEQ ID NO: 437531 - DNA, 15 bp, Homo sapiens
tggacataattagaa

SEQ ID NO: 437532 - DNA, 15 bp, Homo sapiens
ggacataattagaag

SEQ ID NO: 437533 - DNA, 15 bp, Homo sapiens
gacataattagaagc

SEQ ID NO: 437534 - DNA, 15 bp, Homo sapiens
acataattagaagca

SEQ ID NO: 437535 - DNA, 15 bp, Homo sapiens
cataattagaagcac

SEQ ID NO: 437536 - DNA, 15 bp, Homo sapiens
ataattagaagcact

SEQ ID NO: 437537 - DNA, 15 bp, Homo sapiens
taattagaagcacta

SEQ ID NO: 437538 - DNA, 15 bp, Homo sapiens
aattagaagcactaa

SEQ ID NO: 437539 - DNA, 15 bp, Homo sapiens
attagaagcactaat

SEQ ID NO: 437540 - DNA, 15 bp, Homo sapiens
ttagaagcactaatc

SEQ ID NO: 437541 - DNA, 15 bp, Homo sapiens
tagaagcactaatca

SEQ ID NO: 437542 - DNA, 15 bp, Homo sapiens
agaagcactaatcag

SEQ ID NO: 437543 - DNA, 15 bp, Homo sapiens
gaagcactaatcagc

SEQ ID NO: 437544 - DNA, 15 bp, Homo sapiens
aagcactaatcagcc

SEQ ID NO: 437545 - DNA, 15 bp, Homo sapiens
agcactaatcagccg

SEQ ID NO: 437546 - DNA, 15 bp, Homo sapiens
gcactaatcagccgt

SEQ ID NO: 437547 - DNA, 15 bp, Homo sapiens
cactaatcagccgtg

SEQ ID NO: 437548 - DNA, 15 bp, Homo sapiens
actaatcagccgtgg

SEQ ID NO: 437549 - DNA, 15 bp, Homo sapiens
ctaatcagccgtggc

SEQ ID NO: 437550 - DNA, 15 bp, Homo sapiens
taatcagccgtggca

SEQ ID NO: 437551 - DNA, 15 bp, Homo sapiens
aatcagccgtggcac

SEQ ID NO: 437552 - DNA, 15 bp, Homo sapiens
atcagccgtggcact

SEQ ID NO: 437553 - DNA, 15 bp, Homo sapiens
tcagccgtggcactt

SEQ ID NO: 437554 - DNA, 15 bp, Homo sapiens
cagccgtggcacttg

SEQ ID NO: 437555 - DNA, 15 bp, Homo sapiens
agccgtggcacttga

SEQ ID NO: 437556 - DNA, 15 bp, Homo sapiens
gccgtggcacttgat

SEQ ID NO: 437557 - DNA, 15 bp, Homo sapiens
ccgtggcacttgatg

SEQ ID NO: 437558 - DNA, 15 bp, Homo sapiens
cgtggcacttgatga

SEQ ID NO: 437559 - DNA, 15 bp, Homo sapiens
gtggcacttgatgat

SEQ ID NO: 437560 - DNA, 15 bp, Homo sapiens
tggcacttgatgatg

SEQ ID NO: 437561 - DNA, 15 bp, Homo sapiens
ggcacttgatgatgt

SEQ ID NO: 437562 - DNA, 15 bp, Homo sapiens
gcacttgatgatgta

SEQ ID NO: 437563 - DNA, 15 bp, Homo sapiens
cacttgatgatgtac

SEQ ID NO: 437564 - DNA, 15 bp, Homo sapiens
acttgatgatgtact

SEQ ID NO: 437565 - DNA, 15 bp, Homo sapiens
cttgatgatgtactt

SEQ ID NO: 437566 - DNA, 15 bp, Homo sapiens
ttgatgatgtacttg

SEQ ID NO: 437567 - DNA, 15 bp, Homo sapiens
tgatgatgtacttgt

SEQ ID NO: 437568 - DNA, 15 bp, Homo sapiens
gatgatgtacttgta

SEQ ID NO: 437569 - DNA, 15 bp, Homo sapiens
atgatgtacttgtaa

SEQ ID NO: 437570 - DNA, 15 bp, Homo sapiens
tgatgtacttgtaat

SEQ ID NO: 437571 - DNA, 15 bp, Homo sapiens
gatgtacttgtaatc

SEQ ID NO: 437572 - DNA, 15 bp, Homo sapiens
atgtacttgtaatct

SEQ ID NO: 437573 - DNA, 15 bp, Homo sapiens
tgtacttgtaatctg

SEQ ID NO: 437574 - DNA, 15 bp, Homo sapiens
gtacttgtaatctgg

SEQ ID NO: 437575 - DNA, 15 bp, Homo sapiens
tacttgtaatctggc

SEQ ID NO: 437576 - DNA, 15 bp, Homo sapiens
acttgtaatctggct

SEQ ID NO: 437577 - DNA, 15 bp, Homo sapiens
cttgtaatctggctc

SEQ ID NO: 437578 - DNA, 15 bp, Homo sapiens
ttgtaatctggctca

SEQ ID NO: 437579 - DNA, 15 bp, Homo sapiens
tgtaatctggctcat

SEQ ID NO: 437580 - DNA, 15 bp, Homo sapiens
gtaatctggctcata

SEQ ID NO: 437581 - DNA, 15 bp, Homo sapiens
taatctggctcataa

SEQ ID NO: 437582 - DNA, 15 bp, Homo sapiens
aatctggctcataat

SEQ ID NO: 437583 - DNA, 15 bp, Homo sapiens
atctggctcataatg

SEQ ID NO: 437584 - DNA, 15 bp, Homo sapiens
tctggctcataatga

SEQ ID NO: 437585 - DNA, 15 bp, Homo sapiens
ctggctcataatgag

SEQ ID NO: 437586 - DNA, 15 bp, Homo sapiens
tggctcataatgagt

SEQ ID NO: 437587 - DNA, 15 bp, Homo sapiens
ggctcataatgagtg

SEQ ID NO: 437588 - DNA, 15 bp, Homo sapiens
gctcataatgagtgg

SEQ ID NO: 437589 - DNA, 15 bp, Homo sapiens
ctcataatgagtggt

SEQ ID NO: 437590 - DNA, 15 bp, Homo sapiens
tcataatgagtggtt

SEQ ID NO: 437591 - DNA, 15 bp, Homo sapiens
cataatgagtggttg

SEQ ID NO: 437592 - DNA, 15 bp, Homo sapiens
ataatgagtggttgt

SEQ ID NO: 437593 - DNA, 15 bp, Homo sapiens
taatgagtggttgtc

SEQ ID NO: 437594 - DNA, 15 bp, Homo sapiens
aatgagtggttgtca

SEQ ID NO: 437595 - DNA, 15 bp, Homo sapiens
atgagtggttgtcat

SEQ ID NO: 437596 - DNA, 15 bp, Homo sapiens
tgagtggttgtcatc

SEQ ID NO: 437597 - DNA, 15 bp, Homo sapiens
gagtggttgtcatca

SEQ ID NO: 437598 - DNA, 15 bp, Homo sapiens
agtggttgtcatcag

SEQ ID NO: 437599 - DNA, 15 bp, Homo sapiens
gtggttgtcatcagt

SEQ ID NO: 437600 - DNA, 15 bp, Homo sapiens
tggttgtcatcagtt

SEQ ID NO: 437601 - DNA, 15 bp, Homo sapiens
ggttgtcatcagtta

SEQ ID NO: 437602 - DNA, 15 bp, Homo sapiens
gttgtcatcagttat

SEQ ID NO: 437603 - DNA, 15 bp, Homo sapiens
ttgtcatcagttatt

SEQ ID NO: 437604 - DNA, 15 bp, Homo sapiens
tgtcatcagttattg

SEQ ID NO: 437605 - DNA, 15 bp, Homo sapiens
gtcatcagttattgt

SEQ ID NO: 437606 - DNA, 15 bp, Homo sapiens
tcatcagttattgta

SEQ ID NO: 437607 - DNA, 15 bp, Homo sapiens
catcagttattgtac

SEQ ID NO: 437608 - DNA, 15 bp, Homo sapiens
atcagttattgtaca

SEQ ID NO: 437609 - DNA, 15 bp, Homo sapiens
tcagttattgtacag

SEQ ID NO: 437610 - DNA, 15 bp, Homo sapiens
cagttattgtacaga

SEQ ID NO: 437611 - DNA, 15 bp, Homo sapiens
agttattgtacagag

SEQ ID NO: 437612 - DNA, 15 bp, Homo sapiens
gttattgtacagagt

SEQ ID NO: 437613 - DNA, 15 bp, Homo sapiens
ttattgtacagagta

SEQ ID NO: 437614 - DNA, 15 bp, Homo sapiens
tattgtacagagtag

SEQ ID NO: 437615 - DNA, 15 bp, Homo sapiens
attgtacagagtagg

SEQ ID NO: 437616 - DNA, 15 bp, Homo sapiens
ttgtacagagtagga

SEQ ID NO: 437617 - DNA, 15 bp, Homo sapiens
tgtacagagtaggaa

SEQ ID NO: 437618 - DNA, 15 bp, Homo sapiens
gtacagagtaggaaa

SEQ ID NO: 437619 - DNA, 15 bp, Homo sapiens
tacagagtaggaaat

SEQ ID NO: 437620 - DNA, 15 bp, Homo sapiens
acagagtaggaaatg

SEQ ID NO: 437621 - DNA, 15 bp, Homo sapiens
cagagtaggaaatgg

SEQ ID NO: 437622 - DNA, 15 bp, Homo sapiens
agagtaggaaatggt

SEQ ID NO: 437623 - DNA, 15 bp, Homo sapiens
gagtaggaaatggtc

SEQ ID NO: 437624 - DNA, 15 bp, Homo sapiens
agtaggaaatggtca

SEQ ID NO: 437625 - DNA, 15 bp, Homo sapiens
gtaggaaatggtcag

SEQ ID NO: 437626 - DNA, 15 bp, Homo sapiens
taggaaatggtcagg

SEQ ID NO: 437627 - DNA, 15 bp, Homo sapiens
aggaaatggtcaggg

SEQ ID NO: 437628 - DNA, 15 bp, Homo sapiens
ggaaatggtcagggc

SEQ ID NO: 437629 - DNA, 15 bp, Homo sapiens
gaaatggtcagggcc

SEQ ID NO: 437630 - DNA, 15 bp, Homo sapiens
aaatggtcagggccc

SEQ ID NO: 437631 - DNA, 15 bp, Homo sapiens
aatggtcagggccct

SEQ ID NO: 437632 - DNA, 15 bp, Homo sapiens
atggtcagggccctc

SEQ ID NO: 437633 - DNA, 15 bp, Homo sapiens
tggtcagggccctct

SEQ ID NO: 437634 - DNA, 15 bp, Homo sapiens
ggtcagggccctctc

SEQ ID NO: 437635 - DNA, 15 bp, Homo sapiens
gtcagggccctctca

SEQ ID NO: 437636 - DNA, 15 bp, Homo sapiens
tcagggccctctcaa

SEQ ID NO: 437637 - DNA, 15 bp, Homo sapiens
cagggccctctcaaa

SEQ ID NO: 437638 - DNA, 15 bp, Homo sapiens
agggccctctcaaac

SEQ ID NO: 437639 - DNA, 15 bp, Homo sapiens
gggccctctcaaaca

SEQ ID NO: 437640 - DNA, 15 bp, Homo sapiens
ggccctctcaaacac

SEQ ID NO: 437641 - DNA, 15 bp, Homo sapiens
gccctctcaaacact

SEQ ID NO: 437642 - DNA, 15 bp, Homo sapiens
ccctctcaaacactg

SEQ ID NO: 437643 - DNA, 15 bp, Homo sapiens
cctctcaaacactga

SEQ ID NO: 437644 - DNA, 15 bp, Homo sapiens
ctctcaaacactgat

SEQ ID NO: 437645 - DNA, 15 bp, Homo sapiens
tctcaaacactgatt

SEQ ID NO: 437646 - DNA, 15 bp, Homo sapiens
ctcaaacactgattg

SEQ ID NO: 437647 - DNA, 15 bp, Homo sapiens
tcaaacactgattga

SEQ ID NO: 437648 - DNA, 15 bp, Homo sapiens
caaacactgattgaa

SEQ ID NO: 437649 - DNA, 15 bp, Homo sapiens
aaacactgattgaac

SEQ ID NO: 437650 - DNA, 15 bp, Homo sapiens
aacactgattgaaca

SEQ ID NO: 437651 - DNA, 15 bp, Homo sapiens
acactgattgaacat

SEQ ID NO: 437652 - DNA, 15 bp, Homo sapiens
cactgattgaacatt

SEQ ID NO: 437653 - DNA, 15 bp, Homo sapiens
actgattgaacattt

SEQ ID NO: 437654 - DNA, 15 bp, Homo sapiens
ctgattgaacatttc

SEQ ID NO: 437655 - DNA, 15 bp, Homo sapiens
tgattgaacatttca

SEQ ID NO: 437656 - DNA, 15 bp, Homo sapiens
gattgaacatttcag

SEQ ID NO: 437657 - DNA, 15 bp, Homo sapiens
attgaacatttcaga

SEQ ID NO: 437658 - DNA, 15 bp, Homo sapiens
ttgaacatttcagag

SEQ ID NO: 437659 - DNA, 15 bp, Homo sapiens
tgaacatttcagagt

SEQ ID NO: 437660 - DNA, 15 bp, Homo sapiens
gaacatttcagagtt

SEQ ID NO: 437661 - DNA, 15 bp, Homo sapiens
aacatttcagagtta

SEQ ID NO: 437662 - DNA, 15 bp, Homo sapiens
acatttcagagttat

SEQ ID NO: 437663 - DNA, 15 bp, Homo sapiens
catttcagagttatt

SEQ ID NO: 437664 - DNA, 15 bp, Homo sapiens
atttcagagttatta

SEQ ID NO: 437665 - DNA, 15 bp, Homo sapiens
tttcagagttattaa

SEQ ID NO: 437666 - DNA, 15 bp, Homo sapiens
ttcagagttattaaa

SEQ ID NO: 437667 - DNA, 15 bp, Homo sapiens
tcagagttattaaat

SEQ ID NO: 437668 - DNA, 15 bp, Homo sapiens
cagagttattaaatg

SEQ ID NO: 437669 - DNA, 15 bp, Homo sapiens
agagttattaaatgg

SEQ ID NO: 437670 - DNA, 15 bp, Homo sapiens
gagttattaaatgga

SEQ ID NO: 437671 - DNA, 15 bp, Homo sapiens
agttattaaatggat

SEQ ID NO: 437672 - DNA, 15 bp, Homo sapiens
gttattaaatggatc

SEQ ID NO: 437673 - DNA, 15 bp, Homo sapiens
ttattaaatggatct

SEQ ID NO: 437674 - DNA, 15 bp, Homo sapiens
tattaaatggatctt

SEQ ID NO: 437675 - DNA, 15 bp, Homo sapiens
attaaatggatctta

SEQ ID NO: 437676 - DNA, 15 bp, Homo sapiens
ttaaatggatcttaa

SEQ ID NO: 437677 - DNA, 15 bp, Homo sapiens
taaatggatcttaat

SEQ ID NO: 437678 - DNA, 15 bp, Homo sapiens
aaatggatcttaatc

SEQ ID NO: 437679 - DNA, 15 bp, Homo sapiens
aatggatcttaatca

SEQ ID NO: 437680 - DNA, 15 bp, Homo sapiens
atggatcttaatcac

SEQ ID NO: 437681 - DNA, 15 bp, Homo sapiens
tggatcttaatcact

SEQ ID NO: 437682 - DNA, 15 bp, Homo sapiens
ggatcttaatcactt

SEQ ID NO: 437683 - DNA, 15 bp, Homo sapiens
gatcttaatcacttt

SEQ ID NO: 437684 - DNA, 15 bp, Homo sapiens
atcttaatcacttta

SEQ ID NO: 437685 - DNA, 15 bp, Homo sapiens
tcttaatcactttat

SEQ ID NO: 437686 - DNA, 15 bp, Homo sapiens
cttaatcactttatc

SEQ ID NO: 437687 - DNA, 15 bp, Homo sapiens
ttaatcactttatca

SEQ ID NO: 437688 - DNA, 15 bp, Homo sapiens
taatcactttatcag

SEQ ID NO: 437689 - DNA, 15 bp, Homo sapiens
aatcactttatcaga

SEQ ID NO: 437690 - DNA, 15 bp, Homo sapiens
atcactttatcagaa

SEQ ID NO: 437691 - DNA, 15 bp, Homo sapiens
tcactttatcagaaa

SEQ ID NO: 437692 - DNA, 15 bp, Homo sapiens
cactttatcagaaaa

SEQ ID NO: 437693 - DNA, 15 bp, Homo sapiens
actttatcagaaaat

SEQ ID NO: 437694 - DNA, 15 bp, Homo sapiens
ctttatcagaaaatt

SEQ ID NO: 437695 - DNA, 15 bp, Homo sapiens
tttatcagaaaatta

SEQ ID NO: 437696 - DNA, 15 bp, Homo sapiens
ttatcagaaaattag

SEQ ID NO: 437697 - DNA, 15 bp, Homo sapiens
tatcagaaaattagg

SEQ ID NO: 437698 - DNA, 15 bp, Homo sapiens
atcagaaaattagga

SEQ ID NO: 437699 - DNA, 15 bp, Homo sapiens
tcagaaaattaggaa

SEQ ID NO: 437700 - DNA, 15 bp, Homo sapiens
cagaaaattaggaaa

SEQ ID NO: 437701 - DNA, 15 bp, Homo sapiens
agaaaattaggaaat

SEQ ID NO: 437702 - DNA, 15 bp, Homo sapiens
gaaaattaggaaata

SEQ ID NO: 437703 - DNA, 15 bp, Homo sapiens
aaaattaggaaataa

SEQ ID NO: 437704 - DNA, 15 bp, Homo sapiens
aaattaggaaataat

SEQ ID NO: 437705 - DNA, 15 bp, Homo sapiens
aattaggaaataatg

SEQ ID NO: 437706 - DNA, 15 bp, Homo sapiens
attaggaaataatgt

SEQ ID NO: 437707 - DNA, 15 bp, Homo sapiens
ttaggaaataatgta

SEQ ID NO: 437708 - DNA, 15 bp, Homo sapiens
taggaaataatgtat

SEQ ID NO: 437709 - DNA, 15 bp, Homo sapiens
aggaaataatgtatt

SEQ ID NO: 437710 - DNA, 15 bp, Homo sapiens
ggaaataatgtattt

SEQ ID NO: 437711 - DNA, 15 bp, Homo sapiens
gaaataatgtatttc

SEQ ID NO: 437712 - DNA, 15 bp, Homo sapiens
aaataatgtatttcc

SEQ ID NO: 437713 - DNA, 15 bp, Homo sapiens
aataatgtatttccc

SEQ ID NO: 437714 - DNA, 15 bp, Homo sapiens
ataatgtatttccca

SEQ ID NO: 437715 - DNA, 15 bp, Homo sapiens
taatgtatttcccaa

SEQ ID NO: 437716 - DNA, 15 bp, Homo sapiens
aatgtatttcccaat

SEQ ID NO: 437717 - DNA, 15 bp, Homo sapiens
atgtatttcccaata

SEQ ID NO: 437718 - DNA, 15 bp, Homo sapiens
tgtatttcccaatat

SEQ ID NO: 437719 - DNA, 15 bp, Homo sapiens
gtatttcccaatatt

SEQ ID NO: 437720 - DNA, 15 bp, Homo sapiens
tatttcccaatattt

SEQ ID NO: 437721 - DNA, 15 bp, Homo sapiens
atttcccaatatttt

SEQ ID NO: 437722 - DNA, 15 bp, Homo sapiens
tttcccaatatttta

SEQ ID NO: 437723 - DNA, 15 bp, Homo sapiens
ttcccaatattttaa

SEQ ID NO: 437724 - DNA, 15 bp, Homo sapiens
tcccaatattttaat

SEQ ID NO: 437725 - DNA, 15 bp, Homo sapiens
cccaatattttaatc

SEQ ID NO: 437726 - DNA, 15 bp, Homo sapiens
ccaatattttaatca

SEQ ID NO: 437727 - DNA, 15 bp, Homo sapiens
caatattttaatcag

SEQ ID NO: 437728 - DNA, 15 bp, Homo sapiens
aatattttaatcaga

SEQ ID NO: 437729 - DNA, 15 bp, Homo sapiens
atattttaatcagaa

SEQ ID NO: 437730 - DNA, 15 bp, Homo sapiens
tattttaatcagaaa

SEQ ID NO: 437731 - DNA, 15 bp, Homo sapiens
attttaatcagaaac

SEQ ID NO: 437732 - DNA, 15 bp, Homo sapiens
ttttaatcagaaaca

SEQ ID NO: 437733 - DNA, 15 bp, Homo sapiens
tttaatcagaaacat

SEQ ID NO: 437734 - DNA, 15 bp, Homo sapiens
ttaatcagaaacatc

SEQ ID NO: 437735 - DNA, 15 bp, Homo sapiens
taatcagaaacatct

SEQ ID NO: 437736 - DNA, 15 bp, Homo sapiens
aatcagaaacatctt

SEQ ID NO: 437737 - DNA, 15 bp, Homo sapiens
atcagaaacatcttt

SEQ ID NO: 437738 - DNA, 15 bp, Homo sapiens
tcagaaacatctttt

SEQ ID NO: 437739 - DNA, 15 bp, Homo sapiens
cagaaacatcttttg

SEQ ID NO: 437740 - DNA, 15 bp, Homo sapiens
agaaacatcttttgg

SEQ ID NO: 437741 - DNA, 15 bp, Homo sapiens
gaaacatcttttggt

SEQ ID NO: 437742 - DNA, 15 bp, Homo sapiens
aaacatcttttggtc

SEQ ID NO: 437743 - DNA, 15 bp, Homo sapiens
aacatcttttggtca

SEQ ID NO: 437744 - DNA, 15 bp, Homo sapiens
acatcttttggtcat

SEQ ID NO: 437745 - DNA, 15 bp, Homo sapiens
catcttttggtcatg

SEQ ID NO: 437746 - DNA, 15 bp, Homo sapiens
atcttttggtcatga

SEQ ID NO: 437747 - DNA, 15 bp, Homo sapiens
tcttttggtcatgag

SEQ ID NO: 437748 - DNA, 15 bp, Homo sapiens
cttttggtcatgagg

SEQ ID NO: 437749 - DNA, 15 bp, Homo sapiens
ttttggtcatgagga

SEQ ID NO: 437750 - DNA, 15 bp, Homo sapiens
tttggtcatgaggaa

SEQ ID NO: 437751 - DNA, 15 bp, Homo sapiens
ttggtcatgaggaaa

SEQ ID NO: 437752 - DNA, 15 bp, Homo sapiens
tggtcatgaggaaag

SEQ ID NO: 437753 - DNA, 15 bp, Homo sapiens
ggtcatgaggaaaga

SEQ ID NO: 437754 - DNA, 15 bp, Homo sapiens
gtcatgaggaaagag

SEQ ID NO: 437755 - DNA, 15 bp, Homo sapiens
tcatgaggaaagaga

SEQ ID NO: 437756 - DNA, 15 bp, Homo sapiens
catgaggaaagagag

SEQ ID NO: 437757 - DNA, 15 bp, Homo sapiens
atgaggaaagagaga

SEQ ID NO: 437758 - DNA, 15 bp, Homo sapiens
tgaggaaagagagag

SEQ ID NO: 437759 - DNA, 15 bp, Homo sapiens
gaggaaagagagaga

SEQ ID NO: 437760 - DNA, 15 bp, Homo sapiens
aggaaagagagagag

SEQ ID NO: 437761 - DNA, 15 bp, Homo sapiens
ggaaagagagagaga

SEQ ID NO: 437762 - DNA, 15 bp, Homo sapiens
gaaagagagagagaa

SEQ ID NO: 437763 - DNA, 15 bp, Homo sapiens
aaagagagagagaaa

SEQ ID NO: 437764 - DNA, 15 bp, Homo sapiens
aagagagagagaaat

SEQ ID NO: 437765 - DNA, 15 bp, Homo sapiens
agagagagagaaata

SEQ ID NO: 437766 - DNA, 15 bp, Homo sapiens
gagagagagaaatag

SEQ ID NO: 437767 - DNA, 15 bp, Homo sapiens
agagagagaaatagg

SEQ ID NO: 437768 - DNA, 15 bp, Homo sapiens
gagagagaaatagga

SEQ ID NO: 437769 - DNA, 15 bp, Homo sapiens
agagagaaataggag

SEQ ID NO: 437770 - DNA, 15 bp, Homo sapiens
gagagaaataggagg

SEQ ID NO: 437771 - DNA, 15 bp, Homo sapiens
agagaaataggaggg

SEQ ID NO: 437772 - DNA, 15 bp, Homo sapiens
gagaaataggagggg

SEQ ID NO: 437773 - DNA, 15 bp, Homo sapiens
agaaataggaggggg

SEQ ID NO: 437774 - DNA, 15 bp, Homo sapiens
gaaataggagggggg

SEQ ID NO: 437775 - DNA, 15 bp, Homo sapiens
aaataggaggggggt

SEQ ID NO: 437776 - DNA, 15 bp, Homo sapiens
aataggaggggggta

SEQ ID NO: 437777 - DNA, 15 bp, Homo sapiens
ataggaggggggtaa

SEQ ID NO: 437778 - DNA, 15 bp, Homo sapiens
taggaggggggtaaa

SEQ ID NO: 437779 - DNA, 15 bp, Homo sapiens
aggaggggggtaaag

SEQ ID NO: 437780 - DNA, 15 bp, Homo sapiens
ggaggggggtaaaga

SEQ ID NO: 437781 - DNA, 15 bp, Homo sapiens
gaggggggtaaagag

SEQ ID NO: 437782 - DNA, 15 bp, Homo sapiens
aggggggtaaagaga

SEQ ID NO: 437783 - DNA, 15 bp, Homo sapiens
ggggggtaaagagag

SEQ ID NO: 437784 - DNA, 15 bp, Homo sapiens
gggggtaaagagaga

SEQ ID NO: 437785 - DNA, 15 bp, Homo sapiens
ggggtaaagagagag

SEQ ID NO: 437786 - DNA, 15 bp, Homo sapiens
gggtaaagagagaga

SEQ ID NO: 437787 - DNA, 15 bp, Homo sapiens
ggtaaagagagagag

SEQ ID NO: 437788 - DNA, 15 bp, Homo sapiens
gtaaagagagagaga

SEQ ID NO: 437789 - DNA, 15 bp, Homo sapiens
taaagagagagagat

SEQ ID NO: 437790 - DNA, 15 bp, Homo sapiens
aaagagagagagata

SEQ ID NO: 437791 - DNA, 15 bp, Homo sapiens
aagagagagagatat

SEQ ID NO: 437792 - DNA, 15 bp, Homo sapiens
agagagagagatatt

SEQ ID NO: 437793 - DNA, 15 bp, Homo sapiens
gagagagagatattg

SEQ ID NO: 437794 - DNA, 15 bp, Homo sapiens
agagagagatattga

SEQ ID NO: 437795 - DNA, 15 bp, Homo sapiens
gagagagatattgag

SEQ ID NO: 437796 - DNA, 15 bp, Homo sapiens
agagagatattgaga

SEQ ID NO: 437797 - DNA, 15 bp, Homo sapiens
gagagatattgagag

SEQ ID NO: 437798 - DNA, 15 bp, Homo sapiens
agagatattgagaga

SEQ ID NO: 437799 - DNA, 15 bp, Homo sapiens
gagatattgagagag

SEQ ID NO: 437800 - DNA, 15 bp, Homo sapiens
agatattgagagaga

SEQ ID NO: 437801 - DNA, 15 bp, Homo sapiens
gatattgagagagag

SEQ ID NO: 437802 - DNA, 15 bp, Homo sapiens
atattgagagagagc

SEQ ID NO: 437803 - DNA, 15 bp, Homo sapiens
tattgagagagagca

SEQ ID NO: 437804 - DNA, 15 bp, Homo sapiens
attgagagagagcaa

SEQ ID NO: 437805 - DNA, 15 bp, Homo sapiens
ttgagagagagcaag

SEQ ID NO: 437806 - DNA, 15 bp, Homo sapiens
tgagagagagcaagt

SEQ ID NO: 437807 - DNA, 15 bp, Homo sapiens
gagagagagcaagtc

SEQ ID NO: 437808 - DNA, 15 bp, Homo sapiens
agagagagcaagtca

SEQ ID NO: 437809 - DNA, 15 bp, Homo sapiens
gagagagcaagtcaa

SEQ ID NO: 437810 - DNA, 15 bp, Homo sapiens
agagagcaagtcaag

SEQ ID NO: 437811 - DNA, 15 bp, Homo sapiens
gagagcaagtcaagt

SEQ ID NO: 437812 - DNA, 15 bp, Homo sapiens
agagcaagtcaagtc

SEQ ID NO: 437813 - DNA, 15 bp, Homo sapiens
gagcaagtcaagtct

SEQ ID NO: 437814 - DNA, 15 bp, Homo sapiens
agcaagtcaagtctt

SEQ ID NO: 437815 - DNA, 15 bp, Homo sapiens
gcaagtcaagtcttt

SEQ ID NO: 437816 - DNA, 15 bp, Homo sapiens
caagtcaagtctttt

SEQ ID NO: 437817 - DNA, 15 bp, Homo sapiens
aagtcaagtcttttc

SEQ ID NO: 437818 - DNA, 15 bp, Homo sapiens
agtcaagtcttttcc

SEQ ID NO: 437819 - DNA, 15 bp, Homo sapiens
gtcaagtcttttcct

SEQ ID NO: 437820 - DNA, 15 bp, Homo sapiens
tcaagtcttttcctt

SEQ ID NO: 437821 - DNA, 15 bp, Homo sapiens
caagtcttttccttt

SEQ ID NO: 437822 - DNA, 15 bp, Homo sapiens
aagtcttttcctttg

SEQ ID NO: 437823 - DNA, 15 bp, Homo sapiens
agtcttttcctttga

SEQ ID NO: 437824 - DNA, 15 bp, Homo sapiens
gtcttttcctttgag

SEQ ID NO: 437825 - DNA, 15 bp, Homo sapiens
tcttttcctttgagt

SEQ ID NO: 437826 - DNA, 15 bp, Homo sapiens
cttttcctttgagtt

SEQ ID NO: 437827 - DNA, 15 bp, Homo sapiens
ttttcctttgagttc

SEQ ID NO: 437828 - DNA, 15 bp, Homo sapiens
tttcctttgagttct

SEQ ID NO: 437829 - DNA, 15 bp, Homo sapiens
ttcctttgagttctt

SEQ ID NO: 437830 - DNA, 15 bp, Homo sapiens
tcctttgagttctta

SEQ ID NO: 437831 - DNA, 15 bp, Homo sapiens
cctttgagttcttat

SEQ ID NO: 437832 - DNA, 15 bp, Homo sapiens
ctttgagttcttatt

SEQ ID NO: 437833 - DNA, 15 bp, Homo sapiens
tttgagttcttattg

SEQ ID NO: 437834 - DNA, 15 bp, Homo sapiens
ttgagttcttattgg

SEQ ID NO: 437835 - DNA, 15 bp, Homo sapiens
tgagttcttattggc

SEQ ID NO: 437836 - DNA, 15 bp, Homo sapiens
gagttcttattggct

SEQ ID NO: 437837 - DNA, 15 bp, Homo sapiens
agttcttattggcta

SEQ ID NO: 437838 - DNA, 15 bp, Homo sapiens
gttcttattggctaa

SEQ ID NO: 437839 - DNA, 15 bp, Homo sapiens
ttcttattggctaat

SEQ ID NO: 437840 - DNA, 15 bp, Homo sapiens
tcttattggctaatc

SEQ ID NO: 437841 - DNA, 15 bp, Homo sapiens
cttattggctaatca

SEQ ID NO: 437842 - DNA, 15 bp, Homo sapiens
ttattggctaatcaa

SEQ ID NO: 437843 - DNA, 15 bp, Homo sapiens
tattggctaatcaac

SEQ ID NO: 437844 - DNA, 15 bp, Homo sapiens
attggctaatcaacc

SEQ ID NO: 437845 - DNA, 15 bp, Homo sapiens
ttggctaatcaacct

SEQ ID NO: 437846 - DNA, 15 bp, Homo sapiens
tggctaatcaacctg

SEQ ID NO: 437847 - DNA, 15 bp, Homo sapiens
ggctaatcaacctgg

SEQ ID NO: 437848 - DNA, 15 bp, Homo sapiens
gctaatcaacctggt

SEQ ID NO: 437849 - DNA, 15 bp, Homo sapiens
ctaatcaacctggtt

SEQ ID NO: 437850 - DNA, 15 bp, Homo sapiens
taatcaacctggttt

SEQ ID NO: 437851 - DNA, 15 bp, Homo sapiens
aatcaacctggtttg

SEQ ID NO: 437852 - DNA, 15 bp, Homo sapiens
atcaacctggtttgc

SEQ ID NO: 437853 - DNA, 15 bp, Homo sapiens
tcaacctggtttgct

SEQ ID NO: 437854 - DNA, 15 bp, Homo sapiens
caacctggtttgctt

SEQ ID NO: 437855 - DNA, 15 bp, Homo sapiens
aacctggtttgctta

SEQ ID NO: 437856 - DNA, 15 bp, Homo sapiens
acctggtttgcttat

SEQ ID NO: 437857 - DNA, 15 bp, Homo sapiens
cctggtttgcttatg

SEQ ID NO: 437858 - DNA, 15 bp, Homo sapiens
ctggtttgcttatgt

SEQ ID NO: 437859 - DNA, 15 bp, Homo sapiens
tggtttgcttatgtg

SEQ ID NO: 437860 - DNA, 15 bp, Homo sapiens
ggtttgcttatgtga

SEQ ID NO: 437861 - DNA, 15 bp, Homo sapiens
gtttgcttatgtgaa

SEQ ID NO: 437862 - DNA, 15 bp, Homo sapiens
tttgcttatgtgaaa

SEQ ID NO: 437863 - DNA, 15 bp, Homo sapiens
ttgcttatgtgaaaa

SEQ ID NO: 437864 - DNA, 15 bp, Homo sapiens
tgcttatgtgaaaat

SEQ ID NO: 437865 - DNA, 15 bp, Homo sapiens
gcttatgtgaaaatc

SEQ ID NO: 437866 - DNA, 15 bp, Homo sapiens
cttatgtgaaaatct

SEQ ID NO: 437867 - DNA, 15 bp, Homo sapiens
ttatgtgaaaatctc

SEQ ID NO: 437868 - DNA, 15 bp, Homo sapiens
tatgtgaaaatctct

SEQ ID NO: 437869 - DNA, 15 bp, Homo sapiens
atgtgaaaatctcta

SEQ ID NO: 437870 - DNA, 15 bp, Homo sapiens
tgtgaaaatctctac

SEQ ID NO: 437871 - DNA, 15 bp, Homo sapiens
gtgaaaatctctaca

SEQ ID NO: 437872 - DNA, 15 bp, Homo sapiens
tgaaaatctctacag

SEQ ID NO: 437873 - DNA, 15 bp, Homo sapiens
gaaaatctctacaga

SEQ ID NO: 437874 - DNA, 15 bp, Homo sapiens
aaaatctctacagat

SEQ ID NO: 437875 - DNA, 15 bp, Homo sapiens
aaatctctacagata

SEQ ID NO: 437876 - DNA, 15 bp, Homo sapiens
aatctctacagatat

SEQ ID NO: 437877 - DNA, 15 bp, Homo sapiens
atctctacagatatc

SEQ ID NO: 437878 - DNA, 15 bp, Homo sapiens
tctctacagatatct

SEQ ID NO: 437879 - DNA, 15 bp, Homo sapiens
ctctacagatatcta

SEQ ID NO: 437880 - DNA, 15 bp, Homo sapiens
tctacagatatctaa

SEQ ID NO: 437881 - DNA, 15 bp, Homo sapiens
ctacagatatctaag

SEQ ID NO: 437882 - DNA, 15 bp, Homo sapiens
tacagatatctaagc

SEQ ID NO: 437883 - DNA, 15 bp, Homo sapiens
acagatatctaagcc

SEQ ID NO: 437884 - DNA, 15 bp, Homo sapiens
cagatatctaagcct

SEQ ID NO: 437885 - DNA, 15 bp, Homo sapiens
agatatctaagcctc

SEQ ID NO: 437886 - DNA, 15 bp, Homo sapiens
gatatctaagcctcc

SEQ ID NO: 437887 - DNA, 15 bp, Homo sapiens
atatctaagcctccc

SEQ ID NO: 437888 - DNA, 15 bp, Homo sapiens
tatctaagcctccca

SEQ ID NO: 437889 - DNA, 15 bp, Homo sapiens
atctaagcctcccag

SEQ ID NO: 437890 - DNA, 15 bp, Homo sapiens
tctaagcctcccaga

SEQ ID NO: 437891 - DNA, 15 bp, Homo sapiens
ctaagcctcccagag

SEQ ID NO: 437892 - DNA, 15 bp, Homo sapiens
taagcctcccagagc

SEQ ID NO: 437893 - DNA, 15 bp, Homo sapiens
aagcctcccagagct

SEQ ID NO: 437894 - DNA, 15 bp, Homo sapiens
agcctcccagagcta

SEQ ID NO: 437895 - DNA, 15 bp, Homo sapiens
gcctcccagagctag

SEQ ID NO: 437896 - DNA, 15 bp, Homo sapiens
cctcccagagctagt

SEQ ID NO: 437897 - DNA, 15 bp, Homo sapiens
ctcccagagctagtt

SEQ ID NO: 437898 - DNA, 15 bp, Homo sapiens
tcccagagctagtta

SEQ ID NO: 437899 - DNA, 15 bp, Homo sapiens
cccagagctagttat

SEQ ID NO: 437900 - DNA, 15 bp, Homo sapiens
ccagagctagttata

SEQ ID NO: 437901 - DNA, 15 bp, Homo sapiens
cagagctagttataa

SEQ ID NO: 437902 - DNA, 15 bp, Homo sapiens
agagctagttataaa

SEQ ID NO: 437903 - DNA, 15 bp, Homo sapiens
gagctagttataaaa

SEQ ID NO: 437904 - DNA, 15 bp, Homo sapiens
agctagttataaaat

SEQ ID NO: 437905 - DNA, 15 bp, Homo sapiens
gctagttataaaata

SEQ ID NO: 437906 - DNA, 15 bp, Homo sapiens
ctagttataaaatag

SEQ ID NO: 437907 - DNA, 15 bp, Homo sapiens
tagttataaaatagt

SEQ ID NO: 437908 - DNA, 15 bp, Homo sapiens
agttataaaatagta

SEQ ID NO: 437909 - DNA, 15 bp, Homo sapiens
gttataaaatagtaa

SEQ ID NO: 437910 - DNA, 15 bp, Homo sapiens
ttataaaatagtaaa

SEQ ID NO: 437911 - DNA, 15 bp, Homo sapiens
tataaaatagtaaaa

SEQ ID NO: 437912 - DNA, 15 bp, Homo sapiens
ataaaatagtaaaaa

SEQ ID NO: 437913 - DNA, 15 bp, Homo sapiens
taaaatagtaaaaag

SEQ ID NO: 437914 - DNA, 15 bp, Homo sapiens
aaaatagtaaaaagg

SEQ ID NO: 437915 - DNA, 15 bp, Homo sapiens
aaatagtaaaaagga

SEQ ID NO: 437916 - DNA, 15 bp, Homo sapiens
aatagtaaaaaggaa

SEQ ID NO: 437917 - DNA, 15 bp, Homo sapiens
atagtaaaaaggaat

SEQ ID NO: 437918 - DNA, 15 bp, Homo sapiens
tagtaaaaaggaatg

SEQ ID NO: 437919 - DNA, 15 bp, Homo sapiens
agtaaaaaggaatga

SEQ ID NO: 437920 - DNA, 15 bp, Homo sapiens
gtaaaaaggaatgaa

SEQ ID NO: 437921 - DNA, 15 bp, Homo sapiens
taaaaaggaatgaaa

SEQ ID NO: 437922 - DNA, 15 bp, Homo sapiens
aaaaaggaatgaaag

SEQ ID NO: 437923 - DNA, 15 bp, Homo sapiens
aaaaggaatgaaaga

SEQ ID NO: 437924 - DNA, 15 bp, Homo sapiens
aaaggaatgaaagag

SEQ ID NO: 437925 - DNA, 15 bp, Homo sapiens
aaggaatgaaagagt

SEQ ID NO: 437926 - DNA, 15 bp, Homo sapiens
aggaatgaaagagta

SEQ ID NO: 437927 - DNA, 15 bp, Homo sapiens
ggaatgaaagagtaa

SEQ ID NO: 437928 - DNA, 15 bp, Homo sapiens
gaatgaaagagtaac

SEQ ID NO: 437929 - DNA, 15 bp, Homo sapiens
aatgaaagagtaacc

SEQ ID NO: 437930 - DNA, 15 bp, Homo sapiens
atgaaagagtaacct

SEQ ID NO: 437931 - DNA, 15 bp, Homo sapiens
tgaaagagtaacctt

SEQ ID NO: 437932 - DNA, 15 bp, Homo sapiens
gaaagagtaaccttc

SEQ ID NO: 437933 - DNA, 15 bp, Homo sapiens
aaagagtaaccttcc

SEQ ID NO: 437934 - DNA, 15 bp, Homo sapiens
aagagtaaccttcct

SEQ ID NO: 437935 - DNA, 15 bp, Homo sapiens
agagtaaccttcctc

SEQ ID NO: 437936 - DNA, 15 bp, Homo sapiens
gagtaaccttcctca

SEQ ID NO: 437937 - DNA, 15 bp, Homo sapiens
agtaaccttcctcaa

SEQ ID NO: 437938 - DNA, 15 bp, Homo sapiens
gtaaccttcctcaag

SEQ ID NO: 437939 - DNA, 15 bp, Homo sapiens
taaccttcctcaaga

SEQ ID NO: 437940 - DNA, 15 bp, Homo sapiens
aaccttcctcaagaa

SEQ ID NO: 437941 - DNA, 15 bp, Homo sapiens
accttcctcaagaac

SEQ ID NO: 437942 - DNA, 15 bp, Homo sapiens
ccttcctcaagaacc

SEQ ID NO: 437943 - DNA, 15 bp, Homo sapiens
cttcctcaagaacct

SEQ ID NO: 437944 - DNA, 15 bp, Homo sapiens
ttcctcaagaaccta

SEQ ID NO: 437945 - DNA, 15 bp, Homo sapiens
tcctcaagaacctac

SEQ ID NO: 437946 - DNA, 15 bp, Homo sapiens
cctcaagaacctact

SEQ ID NO: 437947 - DNA, 15 bp, Homo sapiens
ctcaagaacctactg

SEQ ID NO: 437948 - DNA, 15 bp, Homo sapiens
tcaagaacctactgt

SEQ ID NO: 437949 - DNA, 15 bp, Homo sapiens
caagaacctactgtg

SEQ ID NO: 437950 - DNA, 15 bp, Homo sapiens
aagaacctactgtgt

SEQ ID NO: 437951 - DNA, 15 bp, Homo sapiens
agaacctactgtgtg

SEQ ID NO: 437952 - DNA, 15 bp, Homo sapiens
gaacctactgtgtgc

SEQ ID NO: 437953 - DNA, 15 bp, Homo sapiens
aacctactgtgtgcc

SEQ ID NO: 437954 - DNA, 15 bp, Homo sapiens
cctactgtgtgccac

SEQ ID NO: 437955 - DNA, 15 bp, Homo sapiens
ctactgtgtgccaca

SEQ ID NO: 437956 - DNA, 15 bp, Homo sapiens
tactgtgtgccacac

SEQ ID NO: 437957 - DNA, 15 bp, Homo sapiens
actgtgtgccacaca

SEQ ID NO: 437958 - DNA, 15 bp, Homo sapiens
ctgtgtgccacacat

SEQ ID NO: 437959 - DNA, 15 bp, Homo sapiens
tgtgtgccacacatg

SEQ ID NO: 437960 - DNA, 15 bp, Homo sapiens
gtgtgccacacatgt

SEQ ID NO: 437961 - DNA, 15 bp, Homo sapiens
tgtgccacacatgtg

SEQ ID NO: 437962 - DNA, 15 bp, Homo sapiens
gtgccacacatgtgc

SEQ ID NO: 437963 - DNA, 15 bp, Homo sapiens
tgccacacatgtgcc

SEQ ID NO: 437964 - DNA, 15 bp, Homo sapiens
gccacacatgtgcca

SEQ ID NO: 437965 - DNA, 15 bp, Homo sapiens
ccacacatgtgccag

SEQ ID NO: 437966 - DNA, 15 bp, Homo sapiens
cacacatgtgccagt

SEQ ID NO: 437967 - DNA, 15 bp, Homo sapiens
acacatgtgccagta

SEQ ID NO: 437968 - DNA, 15 bp, Homo sapiens
cacatgtgccagtag

SEQ ID NO: 437969 - DNA, 15 bp, Homo sapiens
acatgtgccagtagc

SEQ ID NO: 437970 - DNA, 15 bp, Homo sapiens
catgtgccagtagct

SEQ ID NO: 437971 - DNA, 15 bp, Homo sapiens
atgtgccagtagctt

SEQ ID NO: 437972 - DNA, 15 bp, Homo sapiens
tgtgccagtagcttt

SEQ ID NO: 437973 - DNA, 15 bp, Homo sapiens
gtgccagtagctttc

SEQ ID NO: 437974 - DNA, 15 bp, Homo sapiens
tgccagtagctttct

SEQ ID NO: 437975 - DNA, 15 bp, Homo sapiens
gccagtagctttcta

SEQ ID NO: 437976 - DNA, 15 bp, Homo sapiens
ccagtagctttctat

SEQ ID NO: 437977 - DNA, 15 bp, Homo sapiens
cagtagctttctatg

SEQ ID NO: 437978 - DNA, 15 bp, Homo sapiens
agtagctttctatgt

SEQ ID NO: 437979 - DNA, 15 bp, Homo sapiens
gtagctttctatgta

SEQ ID NO: 437980 - DNA, 15 bp, Homo sapiens
tagctttctatgtat

SEQ ID NO: 437981 - DNA, 15 bp, Homo sapiens
agctttctatgtatt

SEQ ID NO: 437982 - DNA, 15 bp, Homo sapiens
gctttctatgtatta

SEQ ID NO: 437983 - DNA, 15 bp, Homo sapiens
ctttctatgtattaa

SEQ ID NO: 437984 - DNA, 15 bp, Homo sapiens
tttctatgtattaac

SEQ ID NO: 437985 - DNA, 15 bp, Homo sapiens
ttctatgtattaact

SEQ ID NO: 437986 - DNA, 15 bp, Homo sapiens
tctatgtattaactg

SEQ ID NO: 437987 - DNA, 15 bp, Homo sapiens
ctatgtattaactga

SEQ ID NO: 437988 - DNA, 15 bp, Homo sapiens
tatgtattaactgag

SEQ ID NO: 437989 - DNA, 15 bp, Homo sapiens
atgtattaactgagg

SEQ ID NO: 437990 - DNA, 15 bp, Homo sapiens
tgtattaactgaggt

SEQ ID NO: 437991 - DNA, 15 bp, Homo sapiens
gtattaactgaggtt

SEQ ID NO: 437992 - DNA, 15 bp, Homo sapiens
tattaactgaggttg

SEQ ID NO: 437993 - DNA, 15 bp, Homo sapiens
attaactgaggttga

SEQ ID NO: 437994 - DNA, 15 bp, Homo sapiens
ttaactgaggttgaa

SEQ ID NO: 437995 - DNA, 15 bp, Homo sapiens
taactgaggttgaaa

SEQ ID NO: 437996 - DNA, 15 bp, Homo sapiens
aactgaggttgaaag

SEQ ID NO: 437997 - DNA, 15 bp, Homo sapiens
actgaggttgaaaga

SEQ ID NO: 437998 - DNA, 15 bp, Homo sapiens
ctgaggttgaaagag

SEQ ID NO: 437999 - DNA, 15 bp, Homo sapiens
tgaggttgaaagaga

SEQ ID NO: 438000 - DNA, 15 bp, Homo sapiens
gaggttgaaagagat

SEQ ID NO: 438001 - DNA, 15 bp, Homo sapiens
aggttgaaagagata

SEQ ID NO: 438002 - DNA, 15 bp, Homo sapiens
ggttgaaagagataa

SEQ ID NO: 438003 - DNA, 15 bp, Homo sapiens
gttgaaagagataag

SEQ ID NO: 438004 - DNA, 15 bp, Homo sapiens
ttgaaagagataagg

SEQ ID NO: 438005 - DNA, 15 bp, Homo sapiens
tgaaagagataagga

SEQ ID NO: 438006 - DNA, 15 bp, Homo sapiens
gaaagagataaggaa

SEQ ID NO: 438007 - DNA, 15 bp, Homo sapiens
aaagagataaggaat

SEQ ID NO: 438008 - DNA, 15 bp, Homo sapiens
aagagataaggaata

SEQ ID NO: 438009 - DNA, 15 bp, Homo sapiens
agagataaggaatat

SEQ ID NO: 438010 - DNA, 15 bp, Homo sapiens
gagataaggaatata

SEQ ID NO: 438011 - DNA, 15 bp, Homo sapiens
agataaggaatatat

SEQ ID NO: 438012 - DNA, 15 bp, Homo sapiens
gataaggaatatatc

SEQ ID NO: 438013 - DNA, 15 bp, Homo sapiens
ataaggaatatatct

SEQ ID NO: 438014 - DNA, 15 bp, Homo sapiens
taaggaatatatcta

SEQ ID NO: 438015 - DNA, 15 bp, Homo sapiens
aaggaatatatctag

SEQ ID NO: 438016 - DNA, 15 bp, Homo sapiens
aggaatatatctagg

SEQ ID NO: 438017 - DNA, 15 bp, Homo sapiens
ggaatatatctagga

SEQ ID NO: 438018 - DNA, 15 bp, Homo sapiens
gaatatatctaggat

SEQ ID NO: 438019 - DNA, 15 bp, Homo sapiens
aatatatctaggatt

SEQ ID NO: 438020 - DNA, 15 bp, Homo sapiens
atatatctaggatta

SEQ ID NO: 438021 - DNA, 15 bp, Homo sapiens
tatatctaggattat

SEQ ID NO: 438022 - DNA, 15 bp, Homo sapiens
atatctaggattatg

SEQ ID NO: 438023 - DNA, 15 bp, Homo sapiens
tatctaggattatgt

SEQ ID NO: 438024 - DNA, 15 bp, Homo sapiens
atctaggattatgta

SEQ ID NO: 438025 - DNA, 15 bp, Homo sapiens
tctaggattatgtaa

SEQ ID NO: 438026 - DNA, 15 bp, Homo sapiens
ctaggattatgtaac

SEQ ID NO: 438027 - DNA, 15 bp, Homo sapiens
taggattatgtaact

SEQ ID NO: 438028 - DNA, 15 bp, Homo sapiens
aggattatgtaacta

SEQ ID NO: 438029 - DNA, 15 bp, Homo sapiens
ggattatgtaactag

SEQ ID NO: 438030 - DNA, 15 bp, Homo sapiens
gattatgtaactagt

SEQ ID NO: 438031 - DNA, 15 bp, Homo sapiens
attatgtaactagtt

SEQ ID NO: 438032 - DNA, 15 bp, Homo sapiens
ttatgtaactagtta

SEQ ID NO: 438033 - DNA, 15 bp, Homo sapiens
tatgtaactagttag

SEQ ID NO: 438034 - DNA, 15 bp, Homo sapiens
atgtaactagttagt

SEQ ID NO: 438035 - DNA, 15 bp, Homo sapiens
tgtaactagttagta

SEQ ID NO: 438036 - DNA, 15 bp, Homo sapiens
gtaactagttagtat

SEQ ID NO: 438037 - DNA, 15 bp, Homo sapiens
taactagttagtatt

SEQ ID NO: 438038 - DNA, 15 bp, Homo sapiens
aactagttagtattg

SEQ ID NO: 438039 - DNA, 15 bp, Homo sapiens
actagttagtattgg

SEQ ID NO: 438040 - DNA, 15 bp, Homo sapiens
ctagttagtattgga

SEQ ID NO: 438041 - DNA, 15 bp, Homo sapiens
tagttagtattggaa

SEQ ID NO: 438042 - DNA, 15 bp, Homo sapiens
agttagtattggaac

SEQ ID NO: 438043 - DNA, 15 bp, Homo sapiens
gttagtattggaact

SEQ ID NO: 438044 - DNA, 15 bp, Homo sapiens
ttagtattggaactg

SEQ ID NO: 438045 - DNA, 15 bp, Homo sapiens
tagtattggaactgg

SEQ ID NO: 438046 - DNA, 15 bp, Homo sapiens
agtattggaactggc

SEQ ID NO: 438047 - DNA, 15 bp, Homo sapiens
gtattggaactggca

SEQ ID NO: 438048 - DNA, 15 bp, Homo sapiens
tattggaactggcat

SEQ ID NO: 438049 - DNA, 15 bp, Homo sapiens
attggaactggcatg

SEQ ID NO: 438050 - DNA, 15 bp, Homo sapiens
ttggaactggcatgc

SEQ ID NO: 438051 - DNA, 15 bp, Homo sapiens
tggaactggcatgca

SEQ ID NO: 438052 - DNA, 15 bp, Homo sapiens
ggaactggcatgcaa

SEQ ID NO: 438053 - DNA, 15 bp, Homo sapiens
gaactggcatgcaat

SEQ ID NO: 438054 - DNA, 15 bp, Homo sapiens
aactggcatgcaatc

SEQ ID NO: 438055 - DNA, 15 bp, Homo sapiens
actggcatgcaatct

SEQ ID NO: 438056 - DNA, 15 bp, Homo sapiens
ctggcatgcaatctc

SEQ ID NO: 438057 - DNA, 15 bp, Homo sapiens
tggcatgcaatctcc

SEQ ID NO: 438058 - DNA, 15 bp, Homo sapiens
ggcatgcaatctcct

SEQ ID NO: 438059 - DNA, 15 bp, Homo sapiens
gcatgcaatctccta

SEQ ID NO: 438060 - DNA, 15 bp, Homo sapiens
catgcaatctcctaa

SEQ ID NO: 438061 - DNA, 15 bp, Homo sapiens
atgcaatctcctaat

SEQ ID NO: 438062 - DNA, 15 bp, Homo sapiens
tgcaatctcctaatc

SEQ ID NO: 438063 - DNA, 15 bp, Homo sapiens
gcaatctcctaatct

SEQ ID NO: 438064 - DNA, 15 bp, Homo sapiens
caatctcctaatctt

SEQ ID NO: 438065 - DNA, 15 bp, Homo sapiens
aatctcctaatcttt

SEQ ID NO: 438066 - DNA, 15 bp, Homo sapiens
atctcctaatctttt

SEQ ID NO: 438067 - DNA, 15 bp, Homo sapiens
tctcctaatcttttc

SEQ ID NO: 438068 - DNA, 15 bp, Homo sapiens
ctcctaatcttttct

SEQ ID NO: 438069 - DNA, 15 bp, Homo sapiens
tcctaatcttttctt

SEQ ID NO: 438070 - DNA, 15 bp, Homo sapiens
cctaatcttttcttc

SEQ ID NO: 438071 - DNA, 15 bp, Homo sapiens
ctaatcttttcttct

SEQ ID NO: 438072 - DNA, 15 bp, Homo sapiens
taatcttttcttcta

SEQ ID NO: 438073 - DNA, 15 bp, Homo sapiens
aatcttttcttctac

SEQ ID NO: 438074 - DNA, 15 bp, Homo sapiens
atcttttcttctacc

SEQ ID NO: 438075 - DNA, 15 bp, Homo sapiens
tcttttcttctacca

SEQ ID NO: 438076 - DNA, 15 bp, Homo sapiens
cttttcttctaccaa

SEQ ID NO: 438077 - DNA, 15 bp, Homo sapiens
ttttcttctaccaaa

SEQ ID NO: 438078 - DNA, 15 bp, Homo sapiens
tttcttctaccaaat

SEQ ID NO: 438079 - DNA, 15 bp, Homo sapiens
ttcttctaccaaatt

SEQ ID NO: 438080 - DNA, 15 bp, Homo sapiens
tcttctaccaaattg

SEQ ID NO: 438081 - DNA, 15 bp, Homo sapiens
cttctaccaaattgt

SEQ ID NO: 438082 - DNA, 15 bp, Homo sapiens
ttctaccaaattgtc

SEQ ID NO: 438083 - DNA, 15 bp, Homo sapiens
tctaccaaattgtcc

SEQ ID NO: 438084 - DNA, 15 bp, Homo sapiens
ctaccaaattgtcca

SEQ ID NO: 438085 - DNA, 15 bp, Homo sapiens
taccaaattgtccaa

SEQ ID NO: 438086 - DNA, 15 bp, Homo sapiens
accaaattgtccaac

SEQ ID NO: 438087 - DNA, 15 bp, Homo sapiens
ccaaattgtccaaca

SEQ ID NO: 438088 - DNA, 15 bp, Homo sapiens
caaattgtccaacag

SEQ ID NO: 438089 - DNA, 15 bp, Homo sapiens
aaattgtccaacagt

SEQ ID NO: 438090 - DNA, 15 bp, Homo sapiens
aattgtccaacagta

SEQ ID NO: 438091 - DNA, 15 bp, Homo sapiens
attgtccaacagtaa

SEQ ID NO: 438092 - DNA, 15 bp, Homo sapiens
ttgtccaacagtaaa

SEQ ID NO: 438093 - DNA, 15 bp, Homo sapiens
tgtccaacagtaaaa

SEQ ID NO: 438094 - DNA, 15 bp, Homo sapiens
gtccaacagtaaaaa

SEQ ID NO: 438095 - DNA, 15 bp, Homo sapiens
tccaacagtaaaaat

SEQ ID NO: 438096 - DNA, 15 bp, Homo sapiens
ccaacagtaaaaatg

SEQ ID NO: 438097 - DNA, 15 bp, Homo sapiens
caacagtaaaaatgc

SEQ ID NO: 438098 - DNA, 15 bp, Homo sapiens
aacagtaaaaatgcc

SEQ ID NO: 438099 - DNA, 15 bp, Homo sapiens
acagtaaaaatgcca

SEQ ID NO: 438100 - DNA, 15 bp, Homo sapiens
cagtaaaaatgccag

SEQ ID NO: 438101 - DNA, 15 bp, Homo sapiens
agtaaaaatgccagt

SEQ ID NO: 438102 - DNA, 15 bp, Homo sapiens
gtaaaaatgccagtt

SEQ ID NO: 438103 - DNA, 15 bp, Homo sapiens
taaaaatgccagttg

SEQ ID NO: 438104 - DNA, 15 bp, Homo sapiens
aaaaatgccagttgt

SEQ ID NO: 438105 - DNA, 15 bp, Homo sapiens
aaaatgccagttgtg

SEQ ID NO: 438106 - DNA, 15 bp, Homo sapiens
aaatgccagttgtga

SEQ ID NO: 438107 - DNA, 15 bp, Homo sapiens
aatgccagttgtgaa

SEQ ID NO: 438108 - DNA, 15 bp, Homo sapiens
atgccagttgtgaat

SEQ ID NO: 438109 - DNA, 15 bp, Homo sapiens
tgccagttgtgaatt

SEQ ID NO: 438110 - DNA, 15 bp, Homo sapiens
gccagttgtgaattt

SEQ ID NO: 438111 - DNA, 15 bp, Homo sapiens
ccagttgtgaatttt

SEQ ID NO: 438112 - DNA, 15 bp, Homo sapiens
cagttgtgaattttt

SEQ ID NO: 438113 - DNA, 15 bp, Homo sapiens
agttgtgaatttttt

SEQ ID NO: 438114 - DNA, 15 bp, Homo sapiens
gttgtgaattttttt

SEQ ID NO: 438115 - DNA, 15 bp, Homo sapiens
ttgtgaatttttttc

SEQ ID NO: 438116 - DNA, 15 bp, Homo sapiens
tgtgaatttttttct

SEQ ID NO: 438117 - DNA, 15 bp, Homo sapiens
gtgaatttttttctt

SEQ ID NO: 438118 - DNA, 15 bp, Homo sapiens
gaatttttttcttta

SEQ ID NO: 438119 - DNA, 15 bp, Homo sapiens
aatttttttctttac

SEQ ID NO: 438120 - DNA, 15 bp, Homo sapiens
atttttttctttact

SEQ ID NO: 438121 - DNA, 15 bp, Homo sapiens
tttttttctttactt

SEQ ID NO: 438122 - DNA, 15 bp, Homo sapiens
ttttttctttacttg

SEQ ID NO: 438123 - DNA, 15 bp, Homo sapiens
tttttctttacttga

SEQ ID NO: 438124 - DNA, 15 bp, Homo sapiens
ttttctttacttgat

SEQ ID NO: 438125 - DNA, 15 bp, Homo sapiens
tttctttacttgatt

SEQ ID NO: 438126 - DNA, 15 bp, Homo sapiens
ttctttacttgattg

SEQ ID NO: 438127 - DNA, 15 bp, Homo sapiens
tctttacttgattgt

SEQ ID NO: 438128 - DNA, 15 bp, Homo sapiens
ctttacttgattgtt

SEQ ID NO: 438129 - DNA, 15 bp, Homo sapiens
tttacttgattgttt

SEQ ID NO: 438130 - DNA, 15 bp, Homo sapiens
ttacttgattgtttt

SEQ ID NO: 438131 - DNA, 15 bp, Homo sapiens
tacttgattgtttta

SEQ ID NO: 438132 - DNA, 15 bp, Homo sapiens
acttgattgttttaa

SEQ ID NO: 438133 - DNA, 15 bp, Homo sapiens
cttgattgttttaat

SEQ ID NO: 438134 - DNA, 15 bp, Homo sapiens
ttgattgttttaata

SEQ ID NO: 438135 - DNA, 15 bp, Homo sapiens
tgattgttttaatat

SEQ ID NO: 438136 - DNA, 15 bp, Homo sapiens
gattgttttaatatt

SEQ ID NO: 438137 - DNA, 15 bp, Homo sapiens
attgttttaatattt

SEQ ID NO: 438138 - DNA, 15 bp, Homo sapiens
tgttttaatatttcc

SEQ ID NO: 438139 - DNA, 15 bp, Homo sapiens
gttttaatatttcct

SEQ ID NO: 438140 - DNA, 15 bp, Homo sapiens
ttttaatatttcctt

SEQ ID NO: 438141 - DNA, 15 bp, Homo sapiens
tttaatatttccttt

SEQ ID NO: 438142 - DNA, 15 bp, Homo sapiens
ttaatatttcctttt

SEQ ID NO: 438143 - DNA, 15 bp, Homo sapiens
taatatttccttttc

SEQ ID NO: 438144 - DNA, 15 bp, Homo sapiens
aatatttccttttcg

SEQ ID NO: 438145 - DNA, 15 bp, Homo sapiens
atatttccttttcgt

SEQ ID NO: 438146 - DNA, 15 bp, Homo sapiens
tatttccttttcgtc

SEQ ID NO: 438147 - DNA, 15 bp, Homo sapiens
atttccttttcgtct

SEQ ID NO: 438148 - DNA, 15 bp, Homo sapiens
tttccttttcgtctt

SEQ ID NO: 438149 - DNA, 15 bp, Homo sapiens
ttccttttcgtcttt

SEQ ID NO: 438150 - DNA, 15 bp, Homo sapiens
tccttttcgtctttt

SEQ ID NO: 438151 - DNA, 15 bp, Homo sapiens
ccttttcgtcttttg

SEQ ID NO: 438152 - DNA, 15 bp, Homo sapiens
cttttcgtcttttgg

SEQ ID NO: 438153 - DNA, 15 bp, Homo sapiens
ttttcgtcttttggt

SEQ ID NO: 438154 - DNA, 15 bp, Homo sapiens
tttcgtcttttggta

SEQ ID NO: 438155 - DNA, 15 bp, Homo sapiens
ttcgtcttttggtag

SEQ ID NO: 438156 - DNA, 15 bp, Homo sapiens
tcgtcttttggtaga

SEQ ID NO: 438157 - DNA, 15 bp, Homo sapiens
cgtcttttggtagaa

SEQ ID NO: 438158 - DNA, 15 bp, Homo sapiens
gtcttttggtagaat

SEQ ID NO: 438159 - DNA, 15 bp, Homo sapiens
tcttttggtagaata

SEQ ID NO: 438160 - DNA, 15 bp, Homo sapiens
cttttggtagaataa

SEQ ID NO: 438161 - DNA, 15 bp, Homo sapiens
ttttggtagaataaa

SEQ ID NO: 438162 - DNA, 15 bp, Homo sapiens
tttggtagaataaaa

SEQ ID NO: 438163 - DNA, 15 bp, Homo sapiens
ttggtagaataaaac

SEQ ID NO: 438164 - DNA, 15 bp, Homo sapiens
tggtagaataaaaca

SEQ ID NO: 438165 - DNA, 15 bp, Homo sapiens
ggtagaataaaacaa

SEQ ID NO: 438166 - DNA, 15 bp, Homo sapiens
gtagaataaaacaat

SEQ ID NO: 438167 - DNA, 15 bp, Homo sapiens
tagaataaaacaata

SEQ ID NO: 438168 - DNA, 15 bp, Homo sapiens
agaataaaacaataa

SEQ ID NO: 438169 - DNA, 15 bp, Homo sapiens
gaataaaacaataag

SEQ ID NO: 438170 - DNA, 15 bp, Homo sapiens
aataaaacaataaga

SEQ ID NO: 438171 - DNA, 15 bp, Homo sapiens
ataaaacaataagat

SEQ ID NO: 438172 - DNA, 15 bp, Homo sapiens
taaaacaataagatt

SEQ ID NO: 438173 - DNA, 15 bp, Homo sapiens
aaaacaataagatta

SEQ ID NO: 438174 - DNA, 15 bp, Homo sapiens
aaacaataagattat

SEQ ID NO: 438175 - DNA, 15 bp, Homo sapiens
aacaataagattata

SEQ ID NO: 438176 - DNA, 15 bp, Homo sapiens
acaataagattatag

SEQ ID NO: 438177 - DNA, 15 bp, Homo sapiens
caataagattataga

SEQ ID NO: 438178 - DNA, 15 bp, Homo sapiens
aataagattatagat

SEQ ID NO: 438179 - DNA, 15 bp, Homo sapiens
ataagattatagata

SEQ ID NO: 438180 - DNA, 15 bp, Homo sapiens
taagattatagatac

SEQ ID NO: 438181 - DNA, 15 bp, Homo sapiens
aagattatagataca

SEQ ID NO: 438182 - DNA, 15 bp, Homo sapiens
agattatagatacat

SEQ ID NO: 438183 - DNA, 15 bp, Homo sapiens
gattatagatacatg

SEQ ID NO: 438184 - DNA, 15 bp, Homo sapiens
attatagatacatgc

SEQ ID NO: 438185 - DNA, 15 bp, Homo sapiens
ttatagatacatgca

SEQ ID NO: 438186 - DNA, 15 bp, Homo sapiens
tatagatacatgcaa

SEQ ID NO: 438187 - DNA, 15 bp, Homo sapiens
atagatacatgcaaa

SEQ ID NO: 438188 - DNA, 15 bp, Homo sapiens
tagatacatgcaaaa

SEQ ID NO: 438189 - DNA, 15 bp, Homo sapiens
agatacatgcaaaaa

SEQ ID NO: 438190 - DNA, 15 bp, Homo sapiens
gatacatgcaaaaaa

SEQ ID NO: 438191 - DNA, 15 bp, Homo sapiens
atacatgcaaaaaag

SEQ ID NO: 438192 - DNA, 15 bp, Homo sapiens
tacatgcaaaaaagc

SEQ ID NO: 438193 - DNA, 15 bp, Homo sapiens
acatgcaaaaaagca

SEQ ID NO: 438194 - DNA, 15 bp, Homo sapiens
catgcaaaaaagcaa

SEQ ID NO: 438195 - DNA, 15 bp, Homo sapiens
atgcaaaaaagcaaa

SEQ ID NO: 438196 - DNA, 15 bp, Homo sapiens
tgcaaaaaagcaaat

SEQ ID NO: 438197 - DNA, 15 bp, Homo sapiens
gcaaaaaagcaaata

SEQ ID NO: 438198 - DNA, 15 bp, Homo sapiens
caaaaaagcaaatag

SEQ ID NO: 438199 - DNA, 15 bp, Homo sapiens
aaaaaagcaaatagt

SEQ ID NO: 438200 - DNA, 15 bp, Homo sapiens
aaaaagcaaatagta

SEQ ID NO: 438201 - DNA, 15 bp, Homo sapiens
aaaagcaaatagtat

SEQ ID NO: 438202 - DNA, 15 bp, Homo sapiens
aaagcaaatagtata

SEQ ID NO: 438203 - DNA, 15 bp, Homo sapiens
aagcaaatagtataa

SEQ ID NO: 438204 - DNA, 15 bp, Homo sapiens
agcaaatagtataaa

SEQ ID NO: 438205 - DNA, 15 bp, Homo sapiens
gcaaatagtataaat

SEQ ID NO: 438206 - DNA, 15 bp, Homo sapiens
caaatagtataaata

SEQ ID NO: 438207 - DNA, 15 bp, Homo sapiens
aaatagtataaataa

SEQ ID NO: 438208 - DNA, 15 bp, Homo sapiens
aatagtataaataag

SEQ ID NO: 438209 - DNA, 15 bp, Homo sapiens
atagtataaataagg

SEQ ID NO: 438210 - DNA, 15 bp, Homo sapiens
tagtataaataaggt

SEQ ID NO: 438211 - DNA, 15 bp, Homo sapiens
agtataaataaggta

SEQ ID NO: 438212 - DNA, 15 bp, Homo sapiens
gtataaataaggtat

SEQ ID NO: 438213 - DNA, 15 bp, Homo sapiens
tataaataaggtatt

SEQ ID NO: 438214 - DNA, 15 bp, Homo sapiens
ataaataaggtattt

SEQ ID NO: 438215 - DNA, 15 bp, Homo sapiens
taaataaggtatttg

SEQ ID NO: 438216 - DNA, 15 bp, Homo sapiens
aaataaggtatttgg

SEQ ID NO: 438217 - DNA, 15 bp, Homo sapiens
aataaggtatttgga

SEQ ID NO: 438218 - DNA, 15 bp, Homo sapiens
ataaggtatttggaa

SEQ ID NO: 438219 - DNA, 15 bp, Homo sapiens
taaggtatttggaat

SEQ ID NO: 438220 - DNA, 15 bp, Homo sapiens
aaggtatttggaatt

SEQ ID NO: 438221 - DNA, 15 bp, Homo sapiens
aggtatttggaatta

SEQ ID NO: 438222 - DNA, 15 bp, Homo sapiens
ggtatttggaattac

SEQ ID NO: 438223 - DNA, 15 bp, Homo sapiens
gtatttggaattacc

SEQ ID NO: 438224 - DNA, 15 bp, Homo sapiens
tatttggaattacca

SEQ ID NO: 438225 - DNA, 15 bp, Homo sapiens
atttggaattaccat

SEQ ID NO: 438226 - DNA, 15 bp, Homo sapiens
tttggaattaccata

SEQ ID NO: 438227 - DNA, 15 bp, Homo sapiens
ttggaattaccatac

SEQ ID NO: 438228 - DNA, 15 bp, Homo sapiens
tggaattaccatacc

SEQ ID NO: 438229 - DNA, 15 bp, Homo sapiens
ggaattaccatacct

SEQ ID NO: 438230 - DNA, 15 bp, Homo sapiens
gaattaccatacctg

SEQ ID NO: 438231 - DNA, 15 bp, Homo sapiens
aattaccatacctga

SEQ ID NO: 438232 - DNA, 15 bp, Homo sapiens
attaccatacctgaa

SEQ ID NO: 438233 - DNA, 15 bp, Homo sapiens
ttaccatacctgaaa

SEQ ID NO: 438234 - DNA, 15 bp, Homo sapiens
taccatacctgaaat

SEQ ID NO: 438235 - DNA, 15 bp, Homo sapiens
accatacctgaaatg

SEQ ID NO: 438236 - DNA, 15 bp, Homo sapiens
ccatacctgaaatga

SEQ ID NO: 438237 - DNA, 15 bp, Homo sapiens
catacctgaaatgac

SEQ ID NO: 438238 - DNA, 15 bp, Homo sapiens
atacctgaaatgact

SEQ ID NO: 438239 - DNA, 15 bp, Homo sapiens
tacctgaaatgactt

SEQ ID NO: 438240 - DNA, 15 bp, Homo sapiens
acctgaaatgacttt

SEQ ID NO: 438241 - DNA, 15 bp, Homo sapiens
cctgaaatgactttg

SEQ ID NO: 438242 - DNA, 15 bp, Homo sapiens
ctgaaatgactttgt

SEQ ID NO: 438243 - DNA, 15 bp, Homo sapiens
tgaaatgactttgta

SEQ ID NO: 438244 - DNA, 15 bp, Homo sapiens
gaaatgactttgtaa

SEQ ID NO: 438245 - DNA, 15 bp, Homo sapiens
aaatgactttgtaag

SEQ ID NO: 438246 - DNA, 15 bp, Homo sapiens
aatgactttgtaagg

SEQ ID NO: 438247 - DNA, 15 bp, Homo sapiens
atgactttgtaaggt

SEQ ID NO: 438248 - DNA, 15 bp, Homo sapiens
tgactttgtaaggtt

SEQ ID NO: 438249 - DNA, 15 bp, Homo sapiens
gactttgtaaggttg

SEQ ID NO: 438250 - DNA, 15 bp, Homo sapiens
actttgtaaggttga

SEQ ID NO: 438251 - DNA, 15 bp, Homo sapiens
ctttgtaaggttgat

SEQ ID NO: 438252 - DNA, 15 bp, Homo sapiens
tttgtaaggttgatc

SEQ ID NO: 438253 - DNA, 15 bp, Homo sapiens
ttgtaaggttgatcc

SEQ ID NO: 438254 - DNA, 15 bp, Homo sapiens
tgtaaggttgatcct

SEQ ID NO: 438255 - DNA, 15 bp, Homo sapiens
gtaaggttgatcctt

SEQ ID NO: 438256 - DNA, 15 bp, Homo sapiens
taaggttgatccttc

SEQ ID NO: 438257 - DNA, 15 bp, Homo sapiens
aaggttgatccttct

SEQ ID NO: 438258 - DNA, 15 bp, Homo sapiens
aggttgatccttcta

SEQ ID NO: 438259 - DNA, 15 bp, Homo sapiens
ggttgatccttctat

SEQ ID NO: 438260 - DNA, 15 bp, Homo sapiens
gttgatccttctatt

SEQ ID NO: 438261 - DNA, 15 bp, Homo sapiens
ttgatccttctattt

SEQ ID NO: 438262 - DNA, 15 bp, Homo sapiens
tgatccttctatttc

SEQ ID NO: 438263 - DNA, 15 bp, Homo sapiens
gatccttctatttca

SEQ ID NO: 438264 - DNA, 15 bp, Homo sapiens
atccttctatttcac

SEQ ID NO: 438265 - DNA, 15 bp, Homo sapiens
tccttctatttcaca

SEQ ID NO: 438266 - DNA, 15 bp, Homo sapiens
ccttctatttcacaa

SEQ ID NO: 438267 - DNA, 15 bp, Homo sapiens
cttctatttcacaat

SEQ ID NO: 438268 - DNA, 15 bp, Homo sapiens
ttctatttcacaata

SEQ ID NO: 438269 - DNA, 15 bp, Homo sapiens
tctatttcacaatag

SEQ ID NO: 438270 - DNA, 15 bp, Homo sapiens
ctatttcacaatagt

SEQ ID NO: 438271 - DNA, 15 bp, Homo sapiens
tatttcacaatagtt

SEQ ID NO: 438272 - DNA, 15 bp, Homo sapiens
atttcacaatagttt

SEQ ID NO: 438273 - DNA, 15 bp, Homo sapiens
tttcacaatagtttt

SEQ ID NO: 438274 - DNA, 15 bp, Homo sapiens
ttcacaatagttttt

SEQ ID NO: 438275 - DNA, 15 bp, Homo sapiens
tcacaatagtttttt

SEQ ID NO: 438276 - DNA, 15 bp, Homo sapiens
cacaatagttttttt

SEQ ID NO: 438277 - DNA, 15 bp, Homo sapiens
acaatagtttttttg

SEQ ID NO: 438278 - DNA, 15 bp, Homo sapiens
caatagtttttttgt

SEQ ID NO: 438279 - DNA, 15 bp, Homo sapiens
aatagtttttttgta

SEQ ID NO: 438280 - DNA, 15 bp, Homo sapiens
atagtttttttgtaa

SEQ ID NO: 438281 - DNA, 15 bp, Homo sapiens
tagtttttttgtaag

SEQ ID NO: 438282 - DNA, 15 bp, Homo sapiens
agtttttttgtaagt

SEQ ID NO: 438283 - DNA, 15 bp, Homo sapiens
gtttttttgtaagtg

SEQ ID NO: 438284 - DNA, 15 bp, Homo sapiens
tttttttgtaagtgc

SEQ ID NO: 438285 - DNA, 15 bp, Homo sapiens
ttttttgtaagtgct

SEQ ID NO: 438286 - DNA, 15 bp, Homo sapiens
tttttgtaagtgctt

SEQ ID NO: 438287 - DNA, 15 bp, Homo sapiens
ttttgtaagtgcttt

SEQ ID NO: 438288 - DNA, 15 bp, Homo sapiens
tttgtaagtgcttta

SEQ ID NO: 438289 - DNA, 15 bp, Homo sapiens
ttgtaagtgctttac

SEQ ID NO: 438290 - DNA, 15 bp, Homo sapiens
tgtaagtgctttaca

SEQ ID NO: 438291 - DNA, 15 bp, Homo sapiens
gtaagtgctttacac

SEQ ID NO: 438292 - DNA, 15 bp, Homo sapiens
taagtgctttacaca

SEQ ID NO: 438293 - DNA, 15 bp, Homo sapiens
aagtgctttacacag

SEQ ID NO: 438294 - DNA, 15 bp, Homo sapiens
agtgctttacacaga

SEQ ID NO: 438295 - DNA, 15 bp, Homo sapiens
gtgctttacacagat

SEQ ID NO: 438296 - DNA, 15 bp, Homo sapiens
tgctttacacagatg

SEQ ID NO: 438297 - DNA, 15 bp, Homo sapiens
gctttacacagatgt

SEQ ID NO: 438298 - DNA, 15 bp, Homo sapiens
ctttacacagatgtg

SEQ ID NO: 438299 - DNA, 15 bp, Homo sapiens
tttacacagatgtga

SEQ ID NO: 438300 - DNA, 15 bp, Homo sapiens
ttacacagatgtgag

SEQ ID NO: 438301 - DNA, 15 bp, Homo sapiens
tacacagatgtgaga

SEQ ID NO: 438302 - DNA, 15 bp, Homo sapiens
acacagatgtgagaa

SEQ ID NO: 438303 - DNA, 15 bp, Homo sapiens
cacagatgtgagaag

SEQ ID NO: 438304 - DNA, 15 bp, Homo sapiens
acagatgtgagaagg

SEQ ID NO: 438305 - DNA, 15 bp, Homo sapiens
cagatgtgagaagga

SEQ ID NO: 438306 - DNA, 15 bp, Homo sapiens
agatgtgagaaggag

SEQ ID NO: 438307 - DNA, 15 bp, Homo sapiens
gatgtgagaaggagg

SEQ ID NO: 438308 - DNA, 15 bp, Homo sapiens
atgtgagaaggagga

SEQ ID NO: 438309 - DNA, 15 bp, Homo sapiens
tgtgagaaggaggaa

SEQ ID NO: 438310 - DNA, 15 bp, Homo sapiens
gtgagaaggaggaag

SEQ ID NO: 438311 - DNA, 15 bp, Homo sapiens
tgagaaggaggaaga

SEQ ID NO: 438312 - DNA, 15 bp, Homo sapiens
gagaaggaggaagaa

SEQ ID NO: 438313 - DNA, 15 bp, Homo sapiens
agaaggaggaagaaa

SEQ ID NO: 438314 - DNA, 15 bp, Homo sapiens
gaaggaggaagaaaa

SEQ ID NO: 438315 - DNA, 15 bp, Homo sapiens
aaggaggaagaaaaa

SEQ ID NO: 438316 - DNA, 15 bp, Homo sapiens
aggaggaagaaaaat

SEQ ID NO: 438317 - DNA, 15 bp, Homo sapiens
ggaggaagaaaaatg

SEQ ID NO: 438318 - DNA, 15 bp, Homo sapiens
gaggaagaaaaatga

SEQ ID NO: 438319 - DNA, 15 bp, Homo sapiens
aggaagaaaaatgaa

SEQ ID NO: 438320 - DNA, 15 bp, Homo sapiens
ggaagaaaaatgaag

SEQ ID NO: 438321 - DNA, 15 bp, Homo sapiens
gaagaaaaatgaagt

SEQ ID NO: 438322 - DNA, 15 bp, Homo sapiens
aagaaaaatgaagtg

SEQ ID NO: 438323 - DNA, 15 bp, Homo sapiens
agaaaaatgaagtga

SEQ ID NO: 438324 - DNA, 15 bp, Homo sapiens
gaaaaatgaagtgaa

SEQ ID NO: 438325 - DNA, 15 bp, Homo sapiens
aaaaatgaagtgaaa

SEQ ID NO: 438326 - DNA, 15 bp, Homo sapiens
aaaatgaagtgaaaa

SEQ ID NO: 438327 - DNA, 15 bp, Homo sapiens
aaatgaagtgaaaat

SEQ ID NO: 438328 - DNA, 15 bp, Homo sapiens
aatgaagtgaaaata

SEQ ID NO: 438329 - DNA, 15 bp, Homo sapiens
atgaagtgaaaatat

SEQ ID NO: 438330 - DNA, 15 bp, Homo sapiens
tgaagtgaaaatatg

SEQ ID NO: 438331 - DNA, 15 bp, Homo sapiens
gaagtgaaaatatgt

SEQ ID NO: 438332 - DNA, 15 bp, Homo sapiens
aagtgaaaatatgtc

SEQ ID NO: 438333 - DNA, 15 bp, Homo sapiens
agtgaaaatatgtcc

SEQ ID NO: 438334 - DNA, 15 bp, Homo sapiens
gtgaaaatatgtcca

SEQ ID NO: 438335 - DNA, 15 bp, Homo sapiens
tgaaaatatgtccac

SEQ ID NO: 438336 - DNA, 15 bp, Homo sapiens
gaaaatatgtccact

SEQ ID NO: 438337 - DNA, 15 bp, Homo sapiens
aaaatatgtccactt

SEQ ID NO: 438338 - DNA, 15 bp, Homo sapiens
aaatatgtccactta

SEQ ID NO: 438339 - DNA, 15 bp, Homo sapiens
aatatgtccacttaa

SEQ ID NO: 438340 - DNA, 15 bp, Homo sapiens
atatgtccacttaaa

SEQ ID NO: 438341 - DNA, 15 bp, Homo sapiens
tatgtccacttaaaa

SEQ ID NO: 438342 - DNA, 15 bp, Homo sapiens
atgtccacttaaaag

SEQ ID NO: 438343 - DNA, 15 bp, Homo sapiens
tgtccacttaaaagt

SEQ ID NO: 438344 - DNA, 15 bp, Homo sapiens
gtccacttaaaagtg

SEQ ID NO: 438345 - DNA, 15 bp, Homo sapiens
tccacttaaaagtgt

SEQ ID NO: 438346 - DNA, 15 bp, Homo sapiens
ccacttaaaagtgta

SEQ ID NO: 438347 - DNA, 15 bp, Homo sapiens
cacttaaaagtgtaa

SEQ ID NO: 438348 - DNA, 15 bp, Homo sapiens
acttaaaagtgtaaa

SEQ ID NO: 438349 - DNA, 15 bp, Homo sapiens
cttaaaagtgtaaag

SEQ ID NO: 438350 - DNA, 15 bp, Homo sapiens
ttaaaagtgtaaagt

SEQ ID NO: 438351 - DNA, 15 bp, Homo sapiens
taaaagtgtaaagtt

SEQ ID NO: 438352 - DNA, 15 bp, Homo sapiens
aaaagtgtaaagttg

SEQ ID NO: 438353 - DNA, 15 bp, Homo sapiens
aaagtgtaaagttga

SEQ ID NO: 438354 - DNA, 15 bp, Homo sapiens
aagtgtaaagttgaa

SEQ ID NO: 438355 - DNA, 15 bp, Homo sapiens
agtgtaaagttgaat

SEQ ID NO: 438356 - DNA, 15 bp, Homo sapiens
gtgtaaagttgaatg

SEQ ID NO: 438357 - DNA, 15 bp, Homo sapiens
tgtaaagttgaatgt

SEQ ID NO: 438358 - DNA, 15 bp, Homo sapiens
gtaaagttgaatgtt

SEQ ID NO: 438359 - DNA, 15 bp, Homo sapiens
taaagttgaatgttc

SEQ ID NO: 438360 - DNA, 15 bp, Homo sapiens
aaagttgaatgttct

SEQ ID NO: 438361 - DNA, 15 bp, Homo sapiens
aagttgaatgttctc

SEQ ID NO: 438362 - DNA, 15 bp, Homo sapiens
agttgaatgttctca

SEQ ID NO: 438363 - DNA, 15 bp, Homo sapiens
gttgaatgttctcaa

SEQ ID NO: 438364 - DNA, 15 bp, Homo sapiens
ttgaatgttctcaat

SEQ ID NO: 438365 - DNA, 15 bp, Homo sapiens
tgaatgttctcaata

SEQ ID NO: 438366 - DNA, 15 bp, Homo sapiens
gaatgttctcaataa

SEQ ID NO: 438367 - DNA, 15 bp, Homo sapiens
aatgttctcaataaa

SEQ ID NO: 438368 - DNA, 15 bp, Homo sapiens
atgttctcaataaag

SEQ ID NO: 438369 - DNA, 15 bp, Homo sapiens
tgttctcaataaaga

SEQ ID NO: 438370 - DNA, 15 bp, Homo sapiens
gttctcaataaagag

SEQ ID NO: 438371 - DNA, 15 bp, Homo sapiens
ttctcaataaagagg

SEQ ID NO: 438372 - DNA, 15 bp, Homo sapiens
tctcaataaagagga

SEQ ID NO: 438373 - DNA, 15 bp, Homo sapiens
ctcaataaagaggag

SEQ ID NO: 438374 - DNA, 15 bp, Homo sapiens
tcaataaagaggagc

SEQ ID NO: 438375 - DNA, 15 bp, Homo sapiens
caataaagaggagca

SEQ ID NO: 438376 - DNA, 15 bp, Homo sapiens
aataaagaggagcac

SEQ ID NO: 438377 - DNA, 15 bp, Homo sapiens
ataaagaggagcact

SEQ ID NO: 438378 - DNA, 15 bp, Homo sapiens
taaagaggagcacta

SEQ ID NO: 438379 - DNA, 15 bp, Homo sapiens
aaagaggagcactaa

SEQ ID NO: 438380 - DNA, 15 bp, Homo sapiens
aagaggagcactaaa

SEQ ID NO: 438381 - DNA, 15 bp, Homo sapiens
agaggagcactaaaa

SEQ ID NO: 438382 - DNA, 15 bp, Homo sapiens
gaggagcactaaaaa

SEQ ID NO: 438383 - DNA, 15 bp, Homo sapiens
aggagcactaaaaat

SEQ ID NO: 438384 - DNA, 15 bp, Homo sapiens
ggagcactaaaaatt

SEQ ID NO: 438385 - DNA, 15 bp, Homo sapiens
gagcactaaaaattc

SEQ ID NO: 438386 - DNA, 15 bp, Homo sapiens
agcactaaaaattca

SEQ ID NO: 438387 - DNA, 15 bp, Homo sapiens
gcactaaaaattcaa

SEQ ID NO: 438388 - DNA, 15 bp, Homo sapiens
cactaaaaattcaat

SEQ ID NO: 438389 - DNA, 15 bp, Homo sapiens
actaaaaattcaatt

SEQ ID NO: 438390 - DNA, 15 bp, Homo sapiens
ctaaaaattcaattc

SEQ ID NO: 438391 - DNA, 15 bp, Homo sapiens
taaaaattcaattcc

SEQ ID NO: 438392 - DNA, 15 bp, Homo sapiens
aaaaattcaattccg

SEQ ID NO: 438393 - DNA, 15 bp, Homo sapiens
aaaattcaattccgt

SEQ ID NO: 438394 - DNA, 15 bp, Homo sapiens
aaattcaattccgtc

SEQ ID NO: 438395 - DNA, 15 bp, Homo sapiens
aattcaattccgtcc

SEQ ID NO: 438396 - DNA, 15 bp, Homo sapiens
attcaattccgtcca

SEQ ID NO: 438397 - DNA, 15 bp, Homo sapiens
ttcaattccgtccaa

SEQ ID NO: 438398 - DNA, 15 bp, Homo sapiens
tcaattccgtccaac

SEQ ID NO: 438399 - DNA, 15 bp, Homo sapiens
caattccgtccaact

SEQ ID NO: 438400 - DNA, 15 bp, Homo sapiens
aattccgtccaactc

SEQ ID NO: 438401 - DNA, 15 bp, Homo sapiens
attccgtccaactca

SEQ ID NO: 438402 - DNA, 15 bp, Homo sapiens
ttccgtccaactcaa

SEQ ID NO: 438403 - DNA, 15 bp, Homo sapiens
tccgtccaactcaat

SEQ ID NO: 438404 - DNA, 15 bp, Homo sapiens
ccgtccaactcaatt

SEQ ID NO: 438405 - DNA, 15 bp, Homo sapiens
cgtccaactcaatta

SEQ ID NO: 438406 - DNA, 15 bp, Homo sapiens
gtccaactcaattaa

SEQ ID NO: 438407 - DNA, 15 bp, Homo sapiens
tccaactcaattaag

SEQ ID NO: 438408 - DNA, 15 bp, Homo sapiens
ccaactcaattaagt

SEQ ID NO: 438409 - DNA, 15 bp, Homo sapiens
caactcaattaagta

SEQ ID NO: 438410 - DNA, 15 bp, Homo sapiens
aactcaattaagtaa

SEQ ID NO: 438411 - DNA, 15 bp, Homo sapiens
actcaattaagtaat

SEQ ID NO: 438412 - DNA, 15 bp, Homo sapiens
ctcaattaagtaatt

SEQ ID NO: 438413 - DNA, 15 bp, Homo sapiens
tcaattaagtaatta

SEQ ID NO: 438414 - DNA, 15 bp, Homo sapiens
caattaagtaattat

SEQ ID NO: 438415 - DNA, 15 bp, Homo sapiens
aattaagtaattata

SEQ ID NO: 438416 - DNA, 15 bp, Homo sapiens
attaagtaattatat

SEQ ID NO: 438417 - DNA, 15 bp, Homo sapiens
ttaagtaattatata

SEQ ID NO: 438418 - DNA, 15 bp, Homo sapiens
taagtaattatatac

SEQ ID NO: 438419 - DNA, 15 bp, Homo sapiens
aagtaattatatact

SEQ ID NO: 438420 - DNA, 15 bp, Homo sapiens
agtaattatatactg

SEQ ID NO: 438421 - DNA, 15 bp, Homo sapiens
gtaattatatactga

SEQ ID NO: 438422 - DNA, 15 bp, Homo sapiens
taattatatactgag

SEQ ID NO: 438423 - DNA, 15 bp, Homo sapiens
aattatatactgagg

SEQ ID NO: 438424 - DNA, 15 bp, Homo sapiens
attatatactgagga

SEQ ID NO: 438425 - DNA, 15 bp, Homo sapiens
ttatatactgaggac

SEQ ID NO: 438426 - DNA, 15 bp, Homo sapiens
tatatactgaggaca

SEQ ID NO: 438427 - DNA, 15 bp, Homo sapiens
atatactgaggacat

SEQ ID NO: 438428 - DNA, 15 bp, Homo sapiens
tatactgaggacata

SEQ ID NO: 438429 - DNA, 15 bp, Homo sapiens
atactgaggacatac

SEQ ID NO: 438430 - DNA, 15 bp, Homo sapiens
tactgaggacatacc

SEQ ID NO: 438431 - DNA, 15 bp, Homo sapiens
actgaggacatacca

SEQ ID NO: 438432 - DNA, 15 bp, Homo sapiens
ctgaggacataccaa

SEQ ID NO: 438433 - DNA, 15 bp, Homo sapiens
tgaggacataccaat

SEQ ID NO: 438434 - DNA, 15 bp, Homo sapiens
gaggacataccaatc

SEQ ID NO: 438435 - DNA, 15 bp, Homo sapiens
aggacataccaatct

SEQ ID NO: 438436 - DNA, 15 bp, Homo sapiens
ggacataccaatctc

SEQ ID NO: 438437 - DNA, 15 bp, Homo sapiens
gacataccaatctct

SEQ ID NO: 438438 - DNA, 15 bp, Homo sapiens
acataccaatctcta

SEQ ID NO: 438439 - DNA, 15 bp, Homo sapiens
cataccaatctctag

SEQ ID NO: 438440 - DNA, 15 bp, Homo sapiens
ataccaatctctaga

SEQ ID NO: 438441 - DNA, 15 bp, Homo sapiens
taccaatctctagac

SEQ ID NO: 438442 - DNA, 15 bp, Homo sapiens
accaatctctagact

SEQ ID NO: 438443 - DNA, 15 bp, Homo sapiens
ccaatctctagactg

SEQ ID NO: 438444 - DNA, 15 bp, Homo sapiens
caatctctagactgg

SEQ ID NO: 438445 - DNA, 15 bp, Homo sapiens
aatctctagactggc

SEQ ID NO: 438446 - DNA, 15 bp, Homo sapiens
atctctagactggct

SEQ ID NO: 438447 - DNA, 15 bp, Homo sapiens
tctctagactggcta

SEQ ID NO: 438448 - DNA, 15 bp, Homo sapiens
ctctagactggctac

SEQ ID NO: 438449 - DNA, 15 bp, Homo sapiens
tctagactggctact

SEQ ID NO: 438450 - DNA, 15 bp, Homo sapiens
ctagactggctacta

SEQ ID NO: 438451 - DNA, 15 bp, Homo sapiens
tagactggctactat

SEQ ID NO: 438452 - DNA, 15 bp, Homo sapiens
agactggctactata

SEQ ID NO: 438453 - DNA, 15 bp, Homo sapiens
gactggctactataa

SEQ ID NO: 438454 - DNA, 15 bp, Homo sapiens
actggctactataaa

SEQ ID NO: 438455 - DNA, 15 bp, Homo sapiens
ctggctactataaaa

SEQ ID NO: 438456 - DNA, 15 bp, Homo sapiens
tggctactataaaat

SEQ ID NO: 438457 - DNA, 15 bp, Homo sapiens
ggctactataaaatc

SEQ ID NO: 438458 - DNA, 15 bp, Homo sapiens
gctactataaaatca

SEQ ID NO: 438459 - DNA, 15 bp, Homo sapiens
ctactataaaatcaa

SEQ ID NO: 438460 - DNA, 15 bp, Homo sapiens
tactataaaatcaat

SEQ ID NO: 438461 - DNA, 15 bp, Homo sapiens
actataaaatcaata

SEQ ID NO: 438462 - DNA, 15 bp, Homo sapiens
ctataaaatcaatat

SEQ ID NO: 438463 - DNA, 15 bp, Homo sapiens
tataaaatcaatatg

SEQ ID NO: 438464 - DNA, 15 bp, Homo sapiens
ataaaatcaatatgg

SEQ ID NO: 438465 - DNA, 15 bp, Homo sapiens
taaaatcaatatgga

SEQ ID NO: 438466 - DNA, 15 bp, Homo sapiens
aaaatcaatatggaa

SEQ ID NO: 438467 - DNA, 15 bp, Homo sapiens
aaatcaatatggaag

SEQ ID NO: 438468 - DNA, 15 bp, Homo sapiens
aatcaatatggaagg

SEQ ID NO: 438469 - DNA, 15 bp, Homo sapiens
atcaatatggaagga

SEQ ID NO: 438470 - DNA, 15 bp, Homo sapiens
tcaatatggaaggaa

SEQ ID NO: 438471 - DNA, 15 bp, Homo sapiens
caatatggaaggaaa

SEQ ID NO: 438472 - DNA, 15 bp, Homo sapiens
aatatggaaggaaag

SEQ ID NO: 438473 - DNA, 15 bp, Homo sapiens
atatggaaggaaaga

SEQ ID NO: 438474 - DNA, 15 bp, Homo sapiens
tatggaaggaaagaa

SEQ ID NO: 438475 - DNA, 15 bp, Homo sapiens
atggaaggaaagaaa

SEQ ID NO: 438476 - DNA, 15 bp, Homo sapiens
tggaaggaaagaaaa

SEQ ID NO: 438477 - DNA, 15 bp, Homo sapiens
ggaaggaaagaaaac

SEQ ID NO: 438478 - DNA, 15 bp, Homo sapiens
gaaggaaagaaaaca

SEQ ID NO: 438479 - DNA, 15 bp, Homo sapiens
aaggaaagaaaacat

SEQ ID NO: 438480 - DNA, 15 bp, Homo sapiens
aggaaagaaaacatt

SEQ ID NO: 438481 - DNA, 15 bp, Homo sapiens
ggaaagaaaacattc

SEQ ID NO: 438482 - DNA, 15 bp, Homo sapiens
gaaagaaaacattct

SEQ ID NO: 438483 - DNA, 15 bp, Homo sapiens
aaagaaaacattctt

SEQ ID NO: 438484 - DNA, 15 bp, Homo sapiens
aagaaaacattcttg

SEQ ID NO: 438485 - DNA, 15 bp, Homo sapiens
agaaaacattcttga

SEQ ID NO: 438486 - DNA, 15 bp, Homo sapiens
gaaaacattcttgac

SEQ ID NO: 438487 - DNA, 15 bp, Homo sapiens
aaaacattcttgaca

SEQ ID NO: 438488 - DNA, 15 bp, Homo sapiens
aaacattcttgacat

SEQ ID NO: 438489 - DNA, 15 bp, Homo sapiens
aacattcttgacatt

SEQ ID NO: 438490 - DNA, 15 bp, Homo sapiens
acattcttgacattg

SEQ ID NO: 438491 - DNA, 15 bp, Homo sapiens
cattcttgacattgg

SEQ ID NO: 438492 - DNA, 15 bp, Homo sapiens
attcttgacattggg

SEQ ID NO: 438493 - DNA, 15 bp, Homo sapiens
ttcttgacattgggc

SEQ ID NO: 438494 - DNA, 15 bp, Homo sapiens
tcttgacattgggct

SEQ ID NO: 438495 - DNA, 15 bp, Homo sapiens
cttgacattgggctt

SEQ ID NO: 438496 - DNA, 15 bp, Homo sapiens
ttgacattgggcttt

SEQ ID NO: 438497 - DNA, 15 bp, Homo sapiens
tgacattgggcttta

SEQ ID NO: 438498 - DNA, 15 bp, Homo sapiens
gacattgggctttaa

SEQ ID NO: 438499 - DNA, 15 bp, Homo sapiens
acattgggctttaaa

SEQ ID NO: 438500 - DNA, 15 bp, Homo sapiens
cattgggctttaaaa

SEQ ID NO: 438501 - DNA, 15 bp, Homo sapiens
attgggctttaaaac

SEQ ID NO: 438502 - DNA, 15 bp, Homo sapiens
ttgggctttaaaacg

SEQ ID NO: 438503 - DNA, 15 bp, Homo sapiens
tgggctttaaaacgt

SEQ ID NO: 438504 - DNA, 15 bp, Homo sapiens
gggctttaaaacgta

SEQ ID NO: 438505 - DNA, 15 bp, Homo sapiens
ggctttaaaacgtaa

SEQ ID NO: 438506 - DNA, 15 bp, Homo sapiens
gctttaaaacgtaag

SEQ ID NO: 438507 - DNA, 15 bp, Homo sapiens
ctttaaaacgtaagt

SEQ ID NO: 438508 - DNA, 15 bp, Homo sapiens
tttaaaacgtaagtg

SEQ ID NO: 438509 - DNA, 15 bp, Homo sapiens
ttaaaacgtaagtgt

SEQ ID NO: 438510 - DNA, 15 bp, Homo sapiens
taaaacgtaagtgta

SEQ ID NO: 438511 - DNA, 15 bp, Homo sapiens
aaaacgtaagtgtag

SEQ ID NO: 438512 - DNA, 15 bp, Homo sapiens
aaacgtaagtgtaga

SEQ ID NO: 438513 - DNA, 15 bp, Homo sapiens
aacgtaagtgtagaa

SEQ ID NO: 438514 - DNA, 15 bp, Homo sapiens
acgtaagtgtagaaa

SEQ ID NO: 438515 - DNA, 15 bp, Homo sapiens
cgtaagtgtagaaaa

SEQ ID NO: 438516 - DNA, 15 bp, Homo sapiens
gtaagtgtagaaaag

SEQ ID NO: 438517 - DNA, 15 bp, Homo sapiens
taagtgtagaaaagc

SEQ ID NO: 438518 - DNA, 15 bp, Homo sapiens
aagtgtagaaaagcc

SEQ ID NO: 438519 - DNA, 15 bp, Homo sapiens
agtgtagaaaagcca

SEQ ID NO: 438520 - DNA, 15 bp, Homo sapiens
gtgtagaaaagccac

SEQ ID NO: 438521 - DNA, 15 bp, Homo sapiens
tgtagaaaagccaca

SEQ ID NO: 438522 - DNA, 15 bp, Homo sapiens
gtagaaaagccacaa

SEQ ID NO: 438523 - DNA, 15 bp, Homo sapiens
tagaaaagccacaat

SEQ ID NO: 438524 - DNA, 15 bp, Homo sapiens
agaaaagccacaatg

SEQ ID NO: 438525 - DNA, 15 bp, Homo sapiens
gaaaagccacaatgg

SEQ ID NO: 438526 - DNA, 15 bp, Homo sapiens
aaaagccacaatgga

SEQ ID NO: 438527 - DNA, 15 bp, Homo sapiens
aaagccacaatggag

SEQ ID NO: 438528 - DNA, 15 bp, Homo sapiens
aagccacaatggaga

SEQ ID NO: 438529 - DNA, 15 bp, Homo sapiens
agccacaatggagat

SEQ ID NO: 438530 - DNA, 15 bp, Homo sapiens
gccacaatggagatt

SEQ ID NO: 438531 - DNA, 15 bp, Homo sapiens
ccacaatggagatta

SEQ ID NO: 438532 - DNA, 15 bp, Homo sapiens
cacaatggagattac

SEQ ID NO: 438533 - DNA, 15 bp, Homo sapiens
acaatggagattaca

SEQ ID NO: 438534 - DNA, 15 bp, Homo sapiens
caatggagattacaa

SEQ ID NO: 438535 - DNA, 15 bp, Homo sapiens
aatggagattacaaa

SEQ ID NO: 438536 - DNA, 15 bp, Homo sapiens
atggagattacaaat

SEQ ID NO: 438537 - DNA, 15 bp, Homo sapiens
tggagattacaaatg

SEQ ID NO: 438538 - DNA, 15 bp, Homo sapiens
ggagattacaaatgt

SEQ ID NO: 438539 - DNA, 15 bp, Homo sapiens
gagattacaaatgtt

SEQ ID NO: 438540 - DNA, 15 bp, Homo sapiens
agattacaaatgttg

SEQ ID NO: 438541 - DNA, 15 bp, Homo sapiens
gattacaaatgttga

SEQ ID NO: 438542 - DNA, 15 bp, Homo sapiens
attacaaatgttgat

SEQ ID NO: 438543 - DNA, 15 bp, Homo sapiens
ttacaaatgttgata

SEQ ID NO: 438544 - DNA, 15 bp, Homo sapiens
tacaaatgttgatat

SEQ ID NO: 438545 - DNA, 15 bp, Homo sapiens
acaaatgttgatatc

SEQ ID NO: 438546 - DNA, 15 bp, Homo sapiens
caaatgttgatatca

SEQ ID NO: 438547 - DNA, 15 bp, Homo sapiens
aaatgttgatatcat

SEQ ID NO: 438548 - DNA, 15 bp, Homo sapiens
aatgttgatatcata

SEQ ID NO: 438549 - DNA, 15 bp, Homo sapiens
atgttgatatcataa

SEQ ID NO: 438550 - DNA, 15 bp, Homo sapiens
tgttgatatcataat

SEQ ID NO: 438551 - DNA, 15 bp, Homo sapiens
gttgatatcataatt

SEQ ID NO: 438552 - DNA, 15 bp, Homo sapiens
ttgatatcataattg

SEQ ID NO: 438553 - DNA, 15 bp, Homo sapiens
tgatatcataattga

SEQ ID NO: 438554 - DNA, 15 bp, Homo sapiens
gatatcataattgag

SEQ ID NO: 438555 - DNA, 15 bp, Homo sapiens
atatcataattgaga

SEQ ID NO: 438556 - DNA, 15 bp, Homo sapiens
tatcataattgagaa

SEQ ID NO: 438557 - DNA, 15 bp, Homo sapiens
atcataattgagaaa

SEQ ID NO: 438558 - DNA, 15 bp, Homo sapiens
tcataattgagaaaa

SEQ ID NO: 438559 - DNA, 15 bp, Homo sapiens
cataattgagaaaaa

SEQ ID NO: 438560 - DNA, 15 bp, Homo sapiens
ataattgagaaaaaa

SEQ ID NO: 438561 - DNA, 15 bp, Homo sapiens
taattgagaaaaaaa

SEQ ID NO: 438562 - DNA, 15 bp, Homo sapiens
aattgagaaaaaaac

SEQ ID NO: 438563 - DNA, 15 bp, Homo sapiens
attgagaaaaaaaca

SEQ ID NO: 438564 - DNA, 15 bp, Homo sapiens
ttgagaaaaaaacac

SEQ ID NO: 438565 - DNA, 15 bp, Homo sapiens
tgagaaaaaaacacc

SEQ ID NO: 438566 - DNA, 15 bp, Homo sapiens
gagaaaaaaacacca

SEQ ID NO: 438567 - DNA, 15 bp, Homo sapiens
agaaaaaaacaccat

SEQ ID NO: 438568 - DNA, 15 bp, Homo sapiens
gaaaaaaacaccata

SEQ ID NO: 438569 - DNA, 15 bp, Homo sapiens
aaaaaaacaccatac

SEQ ID NO: 438570 - DNA, 15 bp, Homo sapiens
aaaaaacaccataca

SEQ ID NO: 438571 - DNA, 15 bp, Homo sapiens
aaaaacaccatacat

SEQ ID NO: 438572 - DNA, 15 bp, Homo sapiens
aaaacaccatacata

SEQ ID NO: 438573 - DNA, 15 bp, Homo sapiens
aaacaccatacatat

SEQ ID NO: 438574 - DNA, 15 bp, Homo sapiens
aacaccatacatatg

SEQ ID NO: 438575 - DNA, 15 bp, Homo sapiens
acaccatacatatgg

SEQ ID NO: 438576 - DNA, 15 bp, Homo sapiens
caccatacatatggg

SEQ ID NO: 438577 - DNA, 15 bp, Homo sapiens
accatacatatggga

SEQ ID NO: 438578 - DNA, 15 bp, Homo sapiens
ccatacatatgggaa

SEQ ID NO: 438579 - DNA, 15 bp, Homo sapiens
catacatatgggaaa

SEQ ID NO: 438580 - DNA, 15 bp, Homo sapiens
atacatatgggaaat

SEQ ID NO: 438581 - DNA, 15 bp, Homo sapiens
tacatatgggaaatg

SEQ ID NO: 438582 - DNA, 15 bp, Homo sapiens
acatatgggaaatgt

SEQ ID NO: 438583 - DNA, 15 bp, Homo sapiens
catatgggaaatgtt

SEQ ID NO: 438584 - DNA, 15 bp, Homo sapiens
atatgggaaatgttt

SEQ ID NO: 438585 - DNA, 15 bp, Homo sapiens
tatgggaaatgttta

SEQ ID NO: 438586 - DNA, 15 bp, Homo sapiens
atgggaaatgtttat

SEQ ID NO: 438587 - DNA, 15 bp, Homo sapiens
tgggaaatgtttatt

SEQ ID NO: 438588 - DNA, 15 bp, Homo sapiens
gggaaatgtttatta

SEQ ID NO: 438589 - DNA, 15 bp, Homo sapiens
ggaaatgtttattaa

SEQ ID NO: 438590 - DNA, 15 bp, Homo sapiens
gaaatgtttattaaa

SEQ ID NO: 438591 - DNA, 15 bp, Homo sapiens
aaatgtttattaaac

SEQ ID NO: 438592 - DNA, 15 bp, Homo sapiens
aatgtttattaaaca

SEQ ID NO: 438593 - DNA, 15 bp, Homo sapiens
atgtttattaaacaa

SEQ ID NO: 438594 - DNA, 15 bp, Homo sapiens
tgtttattaaacaat

SEQ ID NO: 438595 - DNA, 15 bp, Homo sapiens
gtttattaaacaata

SEQ ID NO: 438596 - DNA, 15 bp, Homo sapiens
tttattaaacaataa

SEQ ID NO: 438597 - DNA, 15 bp, Homo sapiens
ttattaaacaataac

SEQ ID NO: 438598 - DNA, 15 bp, Homo sapiens
tattaaacaataaca

SEQ ID NO: 438599 - DNA, 15 bp, Homo sapiens
attaaacaataacac

SEQ ID NO: 438600 - DNA, 15 bp, Homo sapiens
ttaaacaataacact

SEQ ID NO: 438601 - DNA, 15 bp, Homo sapiens
taaacaataacactg

SEQ ID NO: 438602 - DNA, 15 bp, Homo sapiens
aaacaataacactgg

SEQ ID NO: 438603 - DNA, 15 bp, Homo sapiens
aacaataacactggg

SEQ ID NO: 438604 - DNA, 15 bp, Homo sapiens
acaataacactgggc

SEQ ID NO: 438605 - DNA, 15 bp, Homo sapiens
caataacactgggcg

SEQ ID NO: 438606 - DNA, 15 bp, Homo sapiens
aataacactgggcga

SEQ ID NO: 438607 - DNA, 15 bp, Homo sapiens
ataacactgggcgaa

SEQ ID NO: 438608 - DNA, 15 bp, Homo sapiens
taacactgggcgaat

SEQ ID NO: 438609 - DNA, 15 bp, Homo sapiens
aacactgggcgaatt

SEQ ID NO: 438610 - DNA, 15 bp, Homo sapiens
acactgggcgaattc

SEQ ID NO: 438611 - DNA, 15 bp, Homo sapiens
cactgggcgaattct

SEQ ID NO: 438612 - DNA, 15 bp, Homo sapiens
actgggcgaattcta

SEQ ID NO: 438613 - DNA, 15 bp, Homo sapiens
ctgggcgaattctaa

SEQ ID NO: 438614 - DNA, 15 bp, Homo sapiens
tgggcgaattctaat

SEQ ID NO: 438615 - DNA, 15 bp, Homo sapiens
gggcgaattctaata

SEQ ID NO: 438616 - DNA, 15 bp, Homo sapiens
ggcgaattctaataa

SEQ ID NO: 438617 - DNA, 15 bp, Homo sapiens
gcgaattctaataaa

SEQ ID NO: 438618 - DNA, 15 bp, Homo sapiens
cgaattctaataaat

SEQ ID NO: 438619 - DNA, 15 bp, Homo sapiens
gaattctaataaata

SEQ ID NO: 438620 - DNA, 15 bp, Homo sapiens
aattctaataaatat

SEQ ID NO: 438621 - DNA, 15 bp, Homo sapiens
attctaataaatatc

SEQ ID NO: 438622 - DNA, 15 bp, Homo sapiens
ttctaataaatatct

SEQ ID NO: 438623 - DNA, 15 bp, Homo sapiens
tctaataaatatcta

SEQ ID NO: 438624 - DNA, 15 bp, Homo sapiens
ctaataaatatctat

SEQ ID NO: 438625 - DNA, 15 bp, Homo sapiens
taataaatatctatc

SEQ ID NO: 438626 - DNA, 15 bp, Homo sapiens
aataaatatctatca

SEQ ID NO: 438627 - DNA, 15 bp, Homo sapiens
ataaatatctatcat

SEQ ID NO: 438628 - DNA, 15 bp, Homo sapiens
taaatatctatcatt

SEQ ID NO: 438629 - DNA, 15 bp, Homo sapiens
aaatatctatcatta

SEQ ID NO: 438630 - DNA, 15 bp, Homo sapiens
aatatctatcattat

SEQ ID NO: 438631 - DNA, 15 bp, Homo sapiens
atatctatcattatt

SEQ ID NO: 438632 - DNA, 15 bp, Homo sapiens
tatctatcattattt

SEQ ID NO: 438633 - DNA, 15 bp, Homo sapiens
atctatcattatttc

SEQ ID NO: 438634 - DNA, 15 bp, Homo sapiens
tctatcattatttca

SEQ ID NO: 438635 - DNA, 15 bp, Homo sapiens
ctatcattatttcat

SEQ ID NO: 438636 - DNA, 15 bp, Homo sapiens
tatcattatttcatg

SEQ ID NO: 438637 - DNA, 15 bp, Homo sapiens
atcattatttcatgg

SEQ ID NO: 438638 - DNA, 15 bp, Homo sapiens
tcattatttcatggg

SEQ ID NO: 438639 - DNA, 15 bp, Homo sapiens
cattatttcatggga

SEQ ID NO: 438640 - DNA, 15 bp, Homo sapiens
attatttcatgggag

SEQ ID NO: 438641 - DNA, 15 bp, Homo sapiens
ttatttcatgggaga

SEQ ID NO: 438642 - DNA, 15 bp, Homo sapiens
tatttcatgggagaa

SEQ ID NO: 438643 - DNA, 15 bp, Homo sapiens
atttcatgggagaaa

SEQ ID NO: 438644 - DNA, 15 bp, Homo sapiens
tttcatgggagaaac

SEQ ID NO: 438645 - DNA, 15 bp, Homo sapiens
ttcatgggagaaaca

SEQ ID NO: 438646 - DNA, 15 bp, Homo sapiens
tcatgggagaaacat

SEQ ID NO: 438647 - DNA, 15 bp, Homo sapiens
catgggagaaacata

SEQ ID NO: 438648 - DNA, 15 bp, Homo sapiens
atgggagaaacatag

SEQ ID NO: 438649 - DNA, 15 bp, Homo sapiens
tgggagaaacatagt

SEQ ID NO: 438650 - DNA, 15 bp, Homo sapiens
gggagaaacatagtt

SEQ ID NO: 438651 - DNA, 15 bp, Homo sapiens
ggagaaacatagttt

SEQ ID NO: 438652 - DNA, 15 bp, Homo sapiens
gagaaacatagtttc

SEQ ID NO: 438653 - DNA, 15 bp, Homo sapiens
agaaacatagtttca

SEQ ID NO: 438654 - DNA, 15 bp, Homo sapiens
gaaacatagtttcat

SEQ ID NO: 438655 - DNA, 15 bp, Homo sapiens
aaacatagtttcatt

SEQ ID NO: 438656 - DNA, 15 bp, Homo sapiens
aacatagtttcattt

SEQ ID NO: 438657 - DNA, 15 bp, Homo sapiens
acatagtttcatttt

SEQ ID NO: 438658 - DNA, 15 bp, Homo sapiens
catagtttcattttt

SEQ ID NO: 438659 - DNA, 15 bp, Homo sapiens
atagtttcattttta

SEQ ID NO: 438660 - DNA, 15 bp, Homo sapiens
tagtttcatttttaa

SEQ ID NO: 438661 - DNA, 15 bp, Homo sapiens
agtttcatttttaaa

SEQ ID NO: 438662 - DNA, 15 bp, Homo sapiens
gtttcatttttaaaa

SEQ ID NO: 438663 - DNA, 15 bp, Homo sapiens
tttcatttttaaaat

SEQ ID NO: 438664 - DNA, 15 bp, Homo sapiens
ttcatttttaaaatt

SEQ ID NO: 438665 - DNA, 15 bp, Homo sapiens
tcatttttaaaattt

SEQ ID NO: 438666 - DNA, 15 bp, Homo sapiens
catttttaaaattta

SEQ ID NO: 438667 - DNA, 15 bp, Homo sapiens
tttttaaaatttaaa

SEQ ID NO: 438668 - DNA, 15 bp, Homo sapiens
tttaaaatttaaaaa

SEQ ID NO: 438669 - DNA, 15 bp, Homo sapiens
ttaaaatttaaaaaa

SEQ ID NO: 438670 - DNA, 15 bp, Homo sapiens
aaaatttaaaaaata

SEQ ID NO: 438671 - DNA, 15 bp, Homo sapiens
aaatttaaaaaatag

SEQ ID NO: 438672 - DNA, 15 bp, Homo sapiens
aatttaaaaaatagc

SEQ ID NO: 438673 - DNA, 15 bp, Homo sapiens
atttaaaaaatagct

SEQ ID NO: 438674 - DNA, 15 bp, Homo sapiens
tttaaaaaatagctt

SEQ ID NO: 438675 - DNA, 15 bp, Homo sapiens
ttaaaaaatagcttt

SEQ ID NO: 438676 - DNA, 15 bp, Homo sapiens
taaaaaatagctttg

SEQ ID NO: 438677 - DNA, 15 bp, Homo sapiens
aaaaaatagctttgc

SEQ ID NO: 438678 - DNA, 15 bp, Homo sapiens
aaaaatagctttgca

SEQ ID NO: 438679 - DNA, 15 bp, Homo sapiens
aaaatagctttgcat

SEQ ID NO: 438680 - DNA, 15 bp, Homo sapiens
aaatagctttgcata

SEQ ID NO: 438681 - DNA, 15 bp, Homo sapiens
aatagctttgcataa

SEQ ID NO: 438682 - DNA, 15 bp, Homo sapiens
atagctttgcataag

SEQ ID NO: 438683 - DNA, 15 bp, Homo sapiens
tagctttgcataagc

SEQ ID NO: 438684 - DNA, 15 bp, Homo sapiens
agctttgcataagca

SEQ ID NO: 438685 - DNA, 15 bp, Homo sapiens
gctttgcataagcac

SEQ ID NO: 438686 - DNA, 15 bp, Homo sapiens
ctttgcataagcact

SEQ ID NO: 438687 - DNA, 15 bp, Homo sapiens
tttgcataagcactc

SEQ ID NO: 438688 - DNA, 15 bp, Homo sapiens
ttgcataagcactca

SEQ ID NO: 438689 - DNA, 15 bp, Homo sapiens
tgcataagcactcaa

SEQ ID NO: 438690 - DNA, 15 bp, Homo sapiens
gcataagcactcaaa

SEQ ID NO: 438691 - DNA, 15 bp, Homo sapiens
cataagcactcaaag

SEQ ID NO: 438692 - DNA, 15 bp, Homo sapiens
ataagcactcaaagg

SEQ ID NO: 438693 - DNA, 15 bp, Homo sapiens
taagcactcaaagga

SEQ ID NO: 438694 - DNA, 15 bp, Homo sapiens
aagcactcaaaggaa

SEQ ID NO: 438695 - DNA, 15 bp, Homo sapiens
agcactcaaaggaag

SEQ ID NO: 438696 - DNA, 15 bp, Homo sapiens
gcactcaaaggaaga

SEQ ID NO: 438697 - DNA, 15 bp, Homo sapiens
cactcaaaggaagag

SEQ ID NO: 438698 - DNA, 15 bp, Homo sapiens
actcaaaggaagagt

SEQ ID NO: 438699 - DNA, 15 bp, Homo sapiens
ctcaaaggaagagtt

SEQ ID NO: 438700 - DNA, 15 bp, Homo sapiens
tcaaaggaagagttt

SEQ ID NO: 438701 - DNA, 15 bp, Homo sapiens
caaaggaagagtttt

SEQ ID NO: 438702 - DNA, 15 bp, Homo sapiens
aaaggaagagttttt

SEQ ID NO: 438703 - DNA, 15 bp, Homo sapiens
aaggaagagtttttt

SEQ ID NO: 438704 - DNA, 15 bp, Homo sapiens
aggaagagttttttt

SEQ ID NO: 438705 - DNA, 15 bp, Homo sapiens
ggaagagtttttttt

SEQ ID NO: 438706 - DNA, 15 bp, Homo sapiens
gaagagttttttttc

SEQ ID NO: 438707 - DNA, 15 bp, Homo sapiens
aagagttttttttcc

SEQ ID NO: 438708 - DNA, 15 bp, Homo sapiens
agagttttttttcct

SEQ ID NO: 438709 - DNA, 15 bp, Homo sapiens
gagttttttttcctc

SEQ ID NO: 438710 - DNA, 15 bp, Homo sapiens
agttttttttcctct

SEQ ID NO: 438711 - DNA, 15 bp, Homo sapiens
gttttttttcctcta

SEQ ID NO: 438712 - DNA, 15 bp, Homo sapiens
ttttttttcctctac

SEQ ID NO: 438713 - DNA, 15 bp, Homo sapiens
tttttttcctctact

SEQ ID NO: 438714 - DNA, 15 bp, Homo sapiens
ttttttcctctacta

SEQ ID NO: 438715 - DNA, 15 bp, Homo sapiens
tttttcctctactat

SEQ ID NO: 438716 - DNA, 15 bp, Homo sapiens
ttttcctctactatc

SEQ ID NO: 438717 - DNA, 15 bp, Homo sapiens
tttcctctactatca

SEQ ID NO: 438718 - DNA, 15 bp, Homo sapiens
ttcctctactatcaa

SEQ ID NO: 438719 - DNA, 15 bp, Homo sapiens
tcctctactatcaag

SEQ ID NO: 438720 - DNA, 15 bp, Homo sapiens
cctctactatcaaga

SEQ ID NO: 438721 - DNA, 15 bp, Homo sapiens
ctctactatcaagat

SEQ ID NO: 438722 - DNA, 15 bp, Homo sapiens
tctactatcaagatt

SEQ ID NO: 438723 - DNA, 15 bp, Homo sapiens
ctactatcaagattt

SEQ ID NO: 438724 - DNA, 15 bp, Homo sapiens
tactatcaagatttc

SEQ ID NO: 438725 - DNA, 15 bp, Homo sapiens
actatcaagatttct

SEQ ID NO: 438726 - DNA, 15 bp, Homo sapiens
ctatcaagatttctt

SEQ ID NO: 438727 - DNA, 15 bp, Homo sapiens
tatcaagatttcttt

SEQ ID NO: 438728 - DNA, 15 bp, Homo sapiens
atcaagatttctttg

SEQ ID NO: 438729 - DNA, 15 bp, Homo sapiens
tcaagatttctttga

SEQ ID NO: 438730 - DNA, 15 bp, Homo sapiens
caagatttctttgag

SEQ ID NO: 438731 - DNA, 15 bp, Homo sapiens
aagatttctttgaga

SEQ ID NO: 438732 - DNA, 15 bp, Homo sapiens
agatttctttgagat

SEQ ID NO: 438733 - DNA, 15 bp, Homo sapiens
gatttctttgagata

SEQ ID NO: 438734 - DNA, 15 bp, Homo sapiens
atttctttgagatat

SEQ ID NO: 438735 - DNA, 15 bp, Homo sapiens
tttctttgagatata

SEQ ID NO: 438736 - DNA, 15 bp, Homo sapiens
ttctttgagatatac

SEQ ID NO: 438737 - DNA, 15 bp, Homo sapiens
tctttgagatataca

SEQ ID NO: 438738 - DNA, 15 bp, Homo sapiens
ctttgagatatacag

SEQ ID NO: 438739 - DNA, 15 bp, Homo sapiens
tttgagatatacaga

SEQ ID NO: 438740 - DNA, 15 bp, Homo sapiens
ttgagatatacagag

SEQ ID NO: 438741 - DNA, 15 bp, Homo sapiens
tgagatatacagagg

SEQ ID NO: 438742 - DNA, 15 bp, Homo sapiens
gagatatacagaggc

SEQ ID NO: 438743 - DNA, 15 bp, Homo sapiens
agatatacagaggct

SEQ ID NO: 438744 - DNA, 15 bp, Homo sapiens
gatatacagaggctc

SEQ ID NO: 438745 - DNA, 15 bp, Homo sapiens
atatacagaggctca

SEQ ID NO: 438746 - DNA, 15 bp, Homo sapiens
tatacagaggctcaa

SEQ ID NO: 438747 - DNA, 15 bp, Homo sapiens
atacagaggctcaac

SEQ ID NO: 438748 - DNA, 15 bp, Homo sapiens
tacagaggctcaacc

SEQ ID NO: 438749 - DNA, 15 bp, Homo sapiens
acagaggctcaacct

SEQ ID NO: 438750 - DNA, 15 bp, Homo sapiens
cagaggctcaacctt

SEQ ID NO: 438751 - DNA, 15 bp, Homo sapiens
agaggctcaaccttc

SEQ ID NO: 438752 - DNA, 15 bp, Homo sapiens
gaggctcaaccttct

SEQ ID NO: 438753 - DNA, 15 bp, Homo sapiens
aggctcaaccttctt

SEQ ID NO: 438754 - DNA, 15 bp, Homo sapiens
ggctcaaccttctta

SEQ ID NO: 438755 - DNA, 15 bp, Homo sapiens
gctcaaccttcttac

SEQ ID NO: 438756 - DNA, 15 bp, Homo sapiens
ctcaaccttcttaca

SEQ ID NO: 438757 - DNA, 15 bp, Homo sapiens
tcaaccttcttacat

SEQ ID NO: 438758 - DNA, 15 bp, Homo sapiens
caaccttcttacata

SEQ ID NO: 438759 - DNA, 15 bp, Homo sapiens
aaccttcttacataa

SEQ ID NO: 438760 - DNA, 15 bp, Homo sapiens
accttcttacataat

SEQ ID NO: 438761 - DNA, 15 bp, Homo sapiens
ccttcttacataatt

SEQ ID NO: 438762 - DNA, 15 bp, Homo sapiens
cttcttacataattg

SEQ ID NO: 438763 - DNA, 15 bp, Homo sapiens
ttcttacataattga

SEQ ID NO: 438764 - DNA, 15 bp, Homo sapiens
tcttacataattgaa

SEQ ID NO: 438765 - DNA, 15 bp, Homo sapiens
cttacataattgaat

SEQ ID NO: 438766 - DNA, 15 bp, Homo sapiens
ttacataattgaatt

SEQ ID NO: 438767 - DNA, 15 bp, Homo sapiens
tacataattgaattg

SEQ ID NO: 438768 - DNA, 15 bp, Homo sapiens
acataattgaattga

SEQ ID NO: 438769 - DNA, 15 bp, Homo sapiens
cataattgaattgag

SEQ ID NO: 438770 - DNA, 15 bp, Homo sapiens
ataattgaattgagg

SEQ ID NO: 438771 - DNA, 15 bp, Homo sapiens
taattgaattgaggt

SEQ ID NO: 438772 - DNA, 15 bp, Homo sapiens
aattgaattgaggta

SEQ ID NO: 438773 - DNA, 15 bp, Homo sapiens
attgaattgaggtaa

SEQ ID NO: 438774 - DNA, 15 bp, Homo sapiens
ttgaattgaggtaaa

SEQ ID NO: 438775 - DNA, 15 bp, Homo sapiens
tgaattgaggtaaaa

SEQ ID NO: 438776 - DNA, 15 bp, Homo sapiens
gaattgaggtaaaat

SEQ ID NO: 438777 - DNA, 15 bp, Homo sapiens
aattgaggtaaaata

SEQ ID NO: 438778 - DNA, 15 bp, Homo sapiens
attgaggtaaaatag

SEQ ID NO: 438779 - DNA, 15 bp, Homo sapiens
ttgaggtaaaataga

SEQ ID NO: 438780 - DNA, 15 bp, Homo sapiens
tgaggtaaaatagac

SEQ ID NO: 438781 - DNA, 15 bp, Homo sapiens
gaggtaaaatagact

SEQ ID NO: 438782 - DNA, 15 bp, Homo sapiens
aggtaaaatagactc

SEQ ID NO: 438783 - DNA, 15 bp, Homo sapiens
ggtaaaatagactct

SEQ ID NO: 438784 - DNA, 15 bp, Homo sapiens
gtaaaatagactctt

SEQ ID NO: 438785 - DNA, 15 bp, Homo sapiens
taaaatagactcttg

SEQ ID NO: 438786 - DNA, 15 bp, Homo sapiens
aaaatagactcttga

SEQ ID NO: 438787 - DNA, 15 bp, Homo sapiens
aaatagactcttgaa

SEQ ID NO: 438788 - DNA, 15 bp, Homo sapiens
aatagactcttgaaa

SEQ ID NO: 438789 - DNA, 15 bp, Homo sapiens
atagactcttgaaat

SEQ ID NO: 438790 - DNA, 15 bp, Homo sapiens
tagactcttgaaata

SEQ ID NO: 438791 - DNA, 15 bp, Homo sapiens
agactcttgaaataa

SEQ ID NO: 438792 - DNA, 15 bp, Homo sapiens
gactcttgaaataaa

SEQ ID NO: 438793 - DNA, 15 bp, Homo sapiens
actcttgaaataaaa

SEQ ID NO: 438794 - DNA, 15 bp, Homo sapiens
ctcttgaaataaaat

SEQ ID NO: 438795 - DNA, 15 bp, Homo sapiens
tcttgaaataaaata

SEQ ID NO: 438796 - DNA, 15 bp, Homo sapiens
cttgaaataaaatat

SEQ ID NO: 438797 - DNA, 15 bp, Homo sapiens
ttgaaataaaatatt

SEQ ID NO: 438798 - DNA, 15 bp, Homo sapiens
tgaaataaaatattt

SEQ ID NO: 438799 - DNA, 15 bp, Homo sapiens
gaaataaaatatttt

SEQ ID NO: 438800 - DNA, 15 bp, Homo sapiens
aaataaaatattttt

SEQ ID NO: 438801 - DNA, 15 bp, Homo sapiens
aataaaatatttttc

SEQ ID NO: 438802 - DNA, 15 bp, Homo sapiens
ataaaatatttttct

SEQ ID NO: 438803 - DNA, 15 bp, Homo sapiens
taaaatatttttcta

SEQ ID NO: 438804 - DNA, 15 bp, Homo sapiens
aaaatatttttctag

SEQ ID NO: 438805 - DNA, 15 bp, Homo sapiens
aaatatttttctagc

SEQ ID NO: 438806 - DNA, 15 bp, Homo sapiens
aatatttttctagca

SEQ ID NO: 438807 - DNA, 15 bp, Homo sapiens
atatttttctagcat

SEQ ID NO: 438808 - DNA, 15 bp, Homo sapiens
tatttttctagcatg

SEQ ID NO: 438809 - DNA, 15 bp, Homo sapiens
atttttctagcatga

SEQ ID NO: 438810 - DNA, 15 bp, Homo sapiens
tttttctagcatgag

SEQ ID NO: 438811 - DNA, 15 bp, Homo sapiens
ttttctagcatgaga

SEQ ID NO: 438812 - DNA, 15 bp, Homo sapiens
tttctagcatgagaa

SEQ ID NO: 438813 - DNA, 15 bp, Homo sapiens
ttctagcatgagaaa

SEQ ID NO: 438814 - DNA, 15 bp, Homo sapiens
tctagcatgagaaaa

SEQ ID NO: 438815 - DNA, 15 bp, Homo sapiens
ctagcatgagaaaat

SEQ ID NO: 438816 - DNA, 15 bp, Homo sapiens
tagcatgagaaaata

SEQ ID NO: 438817 - DNA, 15 bp, Homo sapiens
agcatgagaaaatag

SEQ ID NO: 438818 - DNA, 15 bp, Homo sapiens
gcatgagaaaatagg

SEQ ID NO: 438819 - DNA, 15 bp, Homo sapiens
catgagaaaataggg

SEQ ID NO: 438820 - DNA, 15 bp, Homo sapiens
atgagaaaatagggt

SEQ ID NO: 438821 - DNA, 15 bp, Homo sapiens
tgagaaaatagggtt

SEQ ID NO: 438822 - DNA, 15 bp, Homo sapiens
gagaaaatagggttt

SEQ ID NO: 438823 - DNA, 15 bp, Homo sapiens
agaaaatagggtttg

SEQ ID NO: 438824 - DNA, 15 bp, Homo sapiens
gaaaatagggtttgc

SEQ ID NO: 438825 - DNA, 15 bp, Homo sapiens
aaaatagggtttgca

SEQ ID NO: 438826 - DNA, 15 bp, Homo sapiens
aaatagggtttgcac

SEQ ID NO: 438827 - DNA, 15 bp, Homo sapiens
aatagggtttgcact

SEQ ID NO: 438828 - DNA, 15 bp, Homo sapiens
atagggtttgcactt

SEQ ID NO: 438829 - DNA, 15 bp, Homo sapiens
tagggtttgcacttg

SEQ ID NO: 438830 - DNA, 15 bp, Homo sapiens
agggtttgcacttga

SEQ ID NO: 438831 - DNA, 15 bp, Homo sapiens
gggtttgcacttgat

SEQ ID NO: 438832 - DNA, 15 bp, Homo sapiens
ggtttgcacttgata

SEQ ID NO: 438833 - DNA, 15 bp, Homo sapiens
gtttgcacttgataa

SEQ ID NO: 438834 - DNA, 15 bp, Homo sapiens
tttgcacttgataaa

SEQ ID NO: 438835 - DNA, 15 bp, Homo sapiens
ttgcacttgataaaa

SEQ ID NO: 438836 - DNA, 15 bp, Homo sapiens
tgcacttgataaaat

SEQ ID NO: 438837 - DNA, 15 bp, Homo sapiens
gcacttgataaaatt

SEQ ID NO: 438838 - DNA, 15 bp, Homo sapiens
cacttgataaaattg

SEQ ID NO: 438839 - DNA, 15 bp, Homo sapiens
acttgataaaattgg

SEQ ID NO: 438840 - DNA, 15 bp, Homo sapiens
cttgataaaattggg

SEQ ID NO: 438841 - DNA, 15 bp, Homo sapiens
ttgataaaattgggc

SEQ ID NO: 438842 - DNA, 15 bp, Homo sapiens
tgataaaattgggct

SEQ ID NO: 438843 - DNA, 15 bp, Homo sapiens
gataaaattgggctg

SEQ ID NO: 438844 - DNA, 15 bp, Homo sapiens
ataaaattgggctgg

SEQ ID NO: 438845 - DNA, 15 bp, Homo sapiens
taaaattgggctggg

SEQ ID NO: 438846 - DNA, 15 bp, Homo sapiens
aaaattgggctgggc

SEQ ID NO: 438847 - DNA, 15 bp, Homo sapiens
aaattgggctgggca

SEQ ID NO: 438848 - DNA, 15 bp, Homo sapiens
aattgggctgggcag

SEQ ID NO: 438849 - DNA, 15 bp, Homo sapiens
attgggctgggcagg

SEQ ID NO: 438850 - DNA, 15 bp, Homo sapiens
ttgggctgggcaggt

SEQ ID NO: 438851 - DNA, 15 bp, Homo sapiens
tgggctgggcaggtc

SEQ ID NO: 438852 - DNA, 15 bp, Homo sapiens
gggctgggcaggtca

SEQ ID NO: 438853 - DNA, 15 bp, Homo sapiens
ggctgggcaggtcaa

SEQ ID NO: 438854 - DNA, 15 bp, Homo sapiens
gctgggcaggtcaag

SEQ ID NO: 438855 - DNA, 15 bp, Homo sapiens
ctgggcaggtcaagt

SEQ ID NO: 438856 - DNA, 15 bp, Homo sapiens
tgggcaggtcaagta

SEQ ID NO: 438857 - DNA, 15 bp, Homo sapiens
gggcaggtcaagtaa

SEQ ID NO: 438858 - DNA, 15 bp, Homo sapiens
ggcaggtcaagtaac

SEQ ID NO: 438859 - DNA, 15 bp, Homo sapiens
gcaggtcaagtaact

SEQ ID NO: 438860 - DNA, 15 bp, Homo sapiens
caggtcaagtaactg

SEQ ID NO: 438861 - DNA, 15 bp, Homo sapiens
aggtcaagtaactgg

SEQ ID NO: 438862 - DNA, 15 bp, Homo sapiens
ggtcaagtaactggc

SEQ ID NO: 438863 - DNA, 15 bp, Homo sapiens
gtcaagtaactggcc

SEQ ID NO: 438864 - DNA, 15 bp, Homo sapiens
tcaagtaactggcct

SEQ ID NO: 438865 - DNA, 15 bp, Homo sapiens
caagtaactggccta

SEQ ID NO: 438866 - DNA, 15 bp, Homo sapiens
aagtaactggcctag

SEQ ID NO: 438867 - DNA, 15 bp, Homo sapiens
agtaactggcctagg

SEQ ID NO: 438868 - DNA, 15 bp, Homo sapiens
gtaactggcctaggg

SEQ ID NO: 438869 - DNA, 15 bp, Homo sapiens
taactggcctagggg

SEQ ID NO: 438870 - DNA, 15 bp, Homo sapiens
aactggcctaggggc

SEQ ID NO: 438871 - DNA, 15 bp, Homo sapiens
actggcctaggggca

SEQ ID NO: 438872 - DNA, 15 bp, Homo sapiens
ctggcctaggggcaa

SEQ ID NO: 438873 - DNA, 15 bp, Homo sapiens
tggcctaggggcaat

SEQ ID NO: 438874 - DNA, 15 bp, Homo sapiens
ggcctaggggcaatg

SEQ ID NO: 438875 - DNA, 15 bp, Homo sapiens
gcctaggggcaatgg

SEQ ID NO: 438876 - DNA, 15 bp, Homo sapiens
cctaggggcaatggg

SEQ ID NO: 438877 - DNA, 15 bp, Homo sapiens
ctaggggcaatgggc

SEQ ID NO: 438878 - DNA, 15 bp, Homo sapiens
taggggcaatgggca

SEQ ID NO: 438879 - DNA, 15 bp, Homo sapiens
aggggcaatgggcaa

SEQ ID NO: 438880 - DNA, 15 bp, Homo sapiens
ggggcaatgggcaaa

SEQ ID NO: 438881 - DNA, 15 bp, Homo sapiens
gggcaatgggcaaaa

SEQ ID NO: 438882 - DNA, 15 bp, Homo sapiens
ggcaatgggcaaaat

SEQ ID NO: 438883 - DNA, 15 bp, Homo sapiens
gcaatgggcaaaatg

SEQ ID NO: 438884 - DNA, 15 bp, Homo sapiens
caatgggcaaaatgg

SEQ ID NO: 438885 - DNA, 15 bp, Homo sapiens
aatgggcaaaatggg

SEQ ID NO: 438886 - DNA, 15 bp, Homo sapiens
atgggcaaaatggga

SEQ ID NO: 438887 - DNA, 15 bp, Homo sapiens
tgggcaaaatgggag

SEQ ID NO: 438888 - DNA, 15 bp, Homo sapiens
gggcaaaatgggagc

SEQ ID NO: 438889 - DNA, 15 bp, Homo sapiens
ggcaaaatgggagca

SEQ ID NO: 438890 - DNA, 15 bp, Homo sapiens
gcaaaatgggagcag

SEQ ID NO: 438891 - DNA, 15 bp, Homo sapiens
caaaatgggagcagg

SEQ ID NO: 438892 - DNA, 15 bp, Homo sapiens
aaaatgggagcagga

SEQ ID NO: 438893 - DNA, 15 bp, Homo sapiens
aaatgggagcaggac

SEQ ID NO: 438894 - DNA, 15 bp, Homo sapiens
aatgggagcaggact

SEQ ID NO: 438895 - DNA, 15 bp, Homo sapiens
atgggagcaggactg

SEQ ID NO: 438896 - DNA, 15 bp, Homo sapiens
tgggagcaggactga

SEQ ID NO: 438897 - DNA, 15 bp, Homo sapiens
gggagcaggactgat

SEQ ID NO: 438898 - DNA, 15 bp, Homo sapiens
ggagcaggactgatt

SEQ ID NO: 438899 - DNA, 15 bp, Homo sapiens
gagcaggactgattc

SEQ ID NO: 438900 - DNA, 15 bp, Homo sapiens
agcaggactgattcc

SEQ ID NO: 438901 - DNA, 15 bp, Homo sapiens
gcaggactgattcca

SEQ ID NO: 438902 - DNA, 15 bp, Homo sapiens
caggactgattccaa

SEQ ID NO: 438903 - DNA, 15 bp, Homo sapiens
aggactgattccaaa

SEQ ID NO: 438904 - DNA, 15 bp, Homo sapiens
ggactgattccaaat

SEQ ID NO: 438905 - DNA, 15 bp, Homo sapiens
gactgattccaaatc

SEQ ID NO: 438906 - DNA, 15 bp, Homo sapiens
actgattccaaatcc

SEQ ID NO: 438907 - DNA, 15 bp, Homo sapiens
ctgattccaaatcct

SEQ ID NO: 438908 - DNA, 15 bp, Homo sapiens
tgattccaaatccta

SEQ ID NO: 438909 - DNA, 15 bp, Homo sapiens
gattccaaatcctag

SEQ ID NO: 438910 - DNA, 15 bp, Homo sapiens
attccaaatcctagt

SEQ ID NO: 438911 - DNA, 15 bp, Homo sapiens
ttccaaatcctagtc

SEQ ID NO: 438912 - DNA, 15 bp, Homo sapiens
tccaaatcctagtct

SEQ ID NO: 438913 - DNA, 15 bp, Homo sapiens
ccaaatcctagtctc

SEQ ID NO: 438914 - DNA, 15 bp, Homo sapiens
caaatcctagtctct

SEQ ID NO: 438915 - DNA, 15 bp, Homo sapiens
aaatcctagtctctg

SEQ ID NO: 438916 - DNA, 15 bp, Homo sapiens
aatcctagtctctgt

SEQ ID NO: 438917 - DNA, 15 bp, Homo sapiens
atcctagtctctgtt

SEQ ID NO: 438918 - DNA, 15 bp, Homo sapiens
tcctagtctctgttc

SEQ ID NO: 438919 - DNA, 15 bp, Homo sapiens
cctagtctctgttcc

SEQ ID NO: 438920 - DNA, 15 bp, Homo sapiens
ctagtctctgttcct

SEQ ID NO: 438921 - DNA, 15 bp, Homo sapiens
tagtctctgttcctg

SEQ ID NO: 438922 - DNA, 15 bp, Homo sapiens
agtctctgttcctgg

SEQ ID NO: 438923 - DNA, 15 bp, Homo sapiens
gtctctgttcctggt

SEQ ID NO: 438924 - DNA, 15 bp, Homo sapiens
tctctgttcctggtc

SEQ ID NO: 438925 - DNA, 15 bp, Homo sapiens
ctctgttcctggtcc

SEQ ID NO: 438926 - DNA, 15 bp, Homo sapiens
tctgttcctggtcca

SEQ ID NO: 438927 - DNA, 15 bp, Homo sapiens
ctgttcctggtccag

SEQ ID NO: 438928 - DNA, 15 bp, Homo sapiens
tgttcctggtccagc

SEQ ID NO: 438929 - DNA, 15 bp, Homo sapiens
gttcctggtccagct

SEQ ID NO: 438930 - DNA, 15 bp, Homo sapiens
ttcctggtccagctt

SEQ ID NO: 438931 - DNA, 15 bp, Homo sapiens
tcctggtccagcttt

SEQ ID NO: 438932 - DNA, 15 bp, Homo sapiens
cctggtccagctttg

SEQ ID NO: 438933 - DNA, 15 bp, Homo sapiens
ctggtccagctttgg

SEQ ID NO: 438934 - DNA, 15 bp, Homo sapiens
tggtccagctttggt

SEQ ID NO: 438935 - DNA, 15 bp, Homo sapiens
ggtccagctttggtt

SEQ ID NO: 438936 - DNA, 15 bp, Homo sapiens
gtccagctttggttt

SEQ ID NO: 438937 - DNA, 15 bp, Homo sapiens
tccagctttggtttt

SEQ ID NO: 438938 - DNA, 15 bp, Homo sapiens
ccagctttggttttt

SEQ ID NO: 438939 - DNA, 15 bp, Homo sapiens
cagctttggtttttc

SEQ ID NO: 438940 - DNA, 15 bp, Homo sapiens
agctttggtttttca

SEQ ID NO: 438941 - DNA, 15 bp, Homo sapiens
gctttggtttttcac

SEQ ID NO: 438942 - DNA, 15 bp, Homo sapiens
ctttggtttttcacc

SEQ ID NO: 438943 - DNA, 15 bp, Homo sapiens
tttggtttttcacct

SEQ ID NO: 438944 - DNA, 15 bp, Homo sapiens
ttggtttttcacctg

SEQ ID NO: 438945 - DNA, 15 bp, Homo sapiens
tggtttttcacctgc

SEQ ID NO: 438946 - DNA, 15 bp, Homo sapiens
ggtttttcacctgca

SEQ ID NO: 438947 - DNA, 15 bp, Homo sapiens
gtttttcacctgcat

SEQ ID NO: 438948 - DNA, 15 bp, Homo sapiens
tttttcacctgcatt

SEQ ID NO: 438949 - DNA, 15 bp, Homo sapiens
ttttcacctgcattc

SEQ ID NO: 438950 - DNA, 15 bp, Homo sapiens
tttcacctgcattct

SEQ ID NO: 438951 - DNA, 15 bp, Homo sapiens
ttcacctgcattcta

SEQ ID NO: 438952 - DNA, 15 bp, Homo sapiens
tcacctgcattctag

SEQ ID NO: 438953 - DNA, 15 bp, Homo sapiens
cacctgcattctagg

SEQ ID NO: 438954 - DNA, 15 bp, Homo sapiens
acctgcattctaggg

SEQ ID NO: 438955 - DNA, 15 bp, Homo sapiens
cctgcattctaggga

SEQ ID NO: 438956 - DNA, 15 bp, Homo sapiens
ctgcattctagggaa

SEQ ID NO: 438957 - DNA, 15 bp, Homo sapiens
tgcattctagggaag

SEQ ID NO: 438958 - DNA, 15 bp, Homo sapiens
gcattctagggaagt

SEQ ID NO: 438959 - DNA, 15 bp, Homo sapiens
cattctagggaagtg

SEQ ID NO: 438960 - DNA, 15 bp, Homo sapiens
attctagggaagtgt

SEQ ID NO: 438961 - DNA, 15 bp, Homo sapiens
ttctagggaagtgta

SEQ ID NO: 438962 - DNA, 15 bp, Homo sapiens
tctagggaagtgtat

SEQ ID NO: 438963 - DNA, 15 bp, Homo sapiens
ctagggaagtgtatt

SEQ ID NO: 438964 - DNA, 15 bp, Homo sapiens
tagggaagtgtatta

SEQ ID NO: 438965 - DNA, 15 bp, Homo sapiens
agggaagtgtattat

SEQ ID NO: 438966 - DNA, 15 bp, Homo sapiens
gggaagtgtattata

SEQ ID NO: 438967 - DNA, 15 bp, Homo sapiens
ggaagtgtattatag

SEQ ID NO: 438968 - DNA, 15 bp, Homo sapiens
gaagtgtattatagt

SEQ ID NO: 438969 - DNA, 15 bp, Homo sapiens
aagtgtattatagtc

SEQ ID NO: 438970 - DNA, 15 bp, Homo sapiens
agtgtattatagtct

SEQ ID NO: 438971 - DNA, 15 bp, Homo sapiens
gtgtattatagtctt

SEQ ID NO: 438972 - DNA, 15 bp, Homo sapiens
tgtattatagtcttc

SEQ ID NO: 438973 - DNA, 15 bp, Homo sapiens
gtattatagtcttct

SEQ ID NO: 438974 - DNA, 15 bp, Homo sapiens
tattatagtcttctt

SEQ ID NO: 438975 - DNA, 15 bp, Homo sapiens
attatagtcttcttc

SEQ ID NO: 438976 - DNA, 15 bp, Homo sapiens
ttatagtcttcttcc

SEQ ID NO: 438977 - DNA, 15 bp, Homo sapiens
tatagtcttcttcct

SEQ ID NO: 438978 - DNA, 15 bp, Homo sapiens
atagtcttcttcctc

SEQ ID NO: 438979 - DNA, 15 bp, Homo sapiens
tagtcttcttcctca

SEQ ID NO: 438980 - DNA, 15 bp, Homo sapiens
agtcttcttcctcat

SEQ ID NO: 438981 - DNA, 15 bp, Homo sapiens
gtcttcttcctcatg

SEQ ID NO: 438982 - DNA, 15 bp, Homo sapiens
tcttcttcctcatgg

SEQ ID NO: 438983 - DNA, 15 bp, Homo sapiens
cttcttcctcatggt

SEQ ID NO: 438984 - DNA, 15 bp, Homo sapiens
ttcttcctcatggta

SEQ ID NO: 438985 - DNA, 15 bp, Homo sapiens
tcttcctcatggtat

SEQ ID NO: 438986 - DNA, 15 bp, Homo sapiens
cttcctcatggtata

SEQ ID NO: 438987 - DNA, 15 bp, Homo sapiens
ttcctcatggtataa

SEQ ID NO: 438988 - DNA, 15 bp, Homo sapiens
tcctcatggtataaa

SEQ ID NO: 438989 - DNA, 15 bp, Homo sapiens
cctcatggtataaag

SEQ ID NO: 438990 - DNA, 15 bp, Homo sapiens
ctcatggtataaagg

SEQ ID NO: 438991 - DNA, 15 bp, Homo sapiens
tcatggtataaagga

SEQ ID NO: 438992 - DNA, 15 bp, Homo sapiens
catggtataaaggag

SEQ ID NO: 438993 - DNA, 15 bp, Homo sapiens
atggtataaaggaga

SEQ ID NO: 438994 - DNA, 15 bp, Homo sapiens
tggtataaaggagag

SEQ ID NO: 438995 - DNA, 15 bp, Homo sapiens
ggtataaaggagagc

SEQ ID NO: 438996 - DNA, 15 bp, Homo sapiens
gtataaaggagagcg

SEQ ID NO: 438997 - DNA, 15 bp, Homo sapiens
tataaaggagagcgt

SEQ ID NO: 438998 - DNA, 15 bp, Homo sapiens
ataaaggagagcgtg

SEQ ID NO: 438999 - DNA, 15 bp, Homo sapiens
taaaggagagcgtgg

SEQ ID NO: 439000 - DNA, 15 bp, Homo sapiens
aaaggagagcgtggc

SEQ ID NO: 439001 - DNA, 15 bp, Homo sapiens
aaggagagcgtggca

SEQ ID NO: 439002 - DNA, 15 bp, Homo sapiens
aggagagcgtggcat

SEQ ID NO: 439003 - DNA, 15 bp, Homo sapiens
ggagagcgtggcata

SEQ ID NO: 439004 - DNA, 15 bp, Homo sapiens
gagagcgtggcataa

SEQ ID NO: 439005 - DNA, 15 bp, Homo sapiens
agagcgtggcataaa

SEQ ID NO: 439006 - DNA, 15 bp, Homo sapiens
gagcgtggcataaat

SEQ ID NO: 439007 - DNA, 15 bp, Homo sapiens
agcgtggcataaatg

SEQ ID NO: 439008 - DNA, 15 bp, Homo sapiens
gcgtggcataaatgc

SEQ ID NO: 439009 - DNA, 15 bp, Homo sapiens
cgtggcataaatgct

SEQ ID NO: 439010 - DNA, 15 bp, Homo sapiens
gtggcataaatgctg

SEQ ID NO: 439011 - DNA, 15 bp, Homo sapiens
tggcataaatgctgt

SEQ ID NO: 439012 - DNA, 15 bp, Homo sapiens
ggcataaatgctgtg

SEQ ID NO: 439013 - DNA, 15 bp, Homo sapiens
gcataaatgctgtgc

SEQ ID NO: 439014 - DNA, 15 bp, Homo sapiens
cataaatgctgtgcc

SEQ ID NO: 439015 - DNA, 15 bp, Homo sapiens
ataaatgctgtgcca

SEQ ID NO: 439016 - DNA, 15 bp, Homo sapiens
taaatgctgtgccac

SEQ ID NO: 439017 - DNA, 15 bp, Homo sapiens
aaatgctgtgccact

SEQ ID NO: 439018 - DNA, 15 bp, Homo sapiens
aatgctgtgccacta

SEQ ID NO: 439019 - DNA, 15 bp, Homo sapiens
atgctgtgccactaa

SEQ ID NO: 439020 - DNA, 15 bp, Homo sapiens
tgctgtgccactaat

SEQ ID NO: 439021 - DNA, 15 bp, Homo sapiens
gctgtgccactaatt

SEQ ID NO: 439022 - DNA, 15 bp, Homo sapiens
ctgtgccactaattt

SEQ ID NO: 439023 - DNA, 15 bp, Homo sapiens
tgtgccactaatttg

SEQ ID NO: 439024 - DNA, 15 bp, Homo sapiens
gtgccactaatttgc

SEQ ID NO: 439025 - DNA, 15 bp, Homo sapiens
tgccactaatttgca

SEQ ID NO: 439026 - DNA, 15 bp, Homo sapiens
gccactaatttgcat

SEQ ID NO: 439027 - DNA, 15 bp, Homo sapiens
ccactaatttgcata

SEQ ID NO: 439028 - DNA, 15 bp, Homo sapiens
cactaatttgcatat

SEQ ID NO: 439029 - DNA, 15 bp, Homo sapiens
actaatttgcatatt

SEQ ID NO: 439030 - DNA, 15 bp, Homo sapiens
ctaatttgcatattt

SEQ ID NO: 439031 - DNA, 15 bp, Homo sapiens
taatttgcatatttg

SEQ ID NO: 439032 - DNA, 15 bp, Homo sapiens
aatttgcatatttga

SEQ ID NO: 439033 - DNA, 15 bp, Homo sapiens
atttgcatatttgaa

SEQ ID NO: 439034 - DNA, 15 bp, Homo sapiens
tttgcatatttgaag

SEQ ID NO: 439035 - DNA, 15 bp, Homo sapiens
ttgcatatttgaaga

SEQ ID NO: 439036 - DNA, 15 bp, Homo sapiens
tgcatatttgaagaa

SEQ ID NO: 439037 - DNA, 15 bp, Homo sapiens
gcatatttgaagaag

SEQ ID NO: 439038 - DNA, 15 bp, Homo sapiens
catatttgaagaagt

SEQ ID NO: 439039 - DNA, 15 bp, Homo sapiens
atatttgaagaagta

SEQ ID NO: 439040 - DNA, 15 bp, Homo sapiens
tatttgaagaagtaa

SEQ ID NO: 439041 - DNA, 15 bp, Homo sapiens
atttgaagaagtaaa

SEQ ID NO: 439042 - DNA, 15 bp, Homo sapiens
tttgaagaagtaaag

SEQ ID NO: 439043 - DNA, 15 bp, Homo sapiens
ttgaagaagtaaagg

SEQ ID NO: 439044 - DNA, 15 bp, Homo sapiens
tgaagaagtaaaggt

SEQ ID NO: 439045 - DNA, 15 bp, Homo sapiens
gaagaagtaaaggta

SEQ ID NO: 439046 - DNA, 15 bp, Homo sapiens
aagaagtaaaggtaa

SEQ ID NO: 439047 - DNA, 15 bp, Homo sapiens
agaagtaaaggtaat

SEQ ID NO: 439048 - DNA, 15 bp, Homo sapiens
gaagtaaaggtaatt

SEQ ID NO: 439049 - DNA, 15 bp, Homo sapiens
aagtaaaggtaattg

SEQ ID NO: 439050 - DNA, 15 bp, Homo sapiens
agtaaaggtaattgg

SEQ ID NO: 439051 - DNA, 15 bp, Homo sapiens
gtaaaggtaattgga

SEQ ID NO: 439052 - DNA, 15 bp, Homo sapiens
taaaggtaattggat

SEQ ID NO: 439053 - DNA, 15 bp, Homo sapiens
aaaggtaattggatg

SEQ ID NO: 439054 - DNA, 15 bp, Homo sapiens
aaggtaattggatga

SEQ ID NO: 439055 - DNA, 15 bp, Homo sapiens
aggtaattggatgac

SEQ ID NO: 439056 - DNA, 15 bp, Homo sapiens
ggtaattggatgaca

SEQ ID NO: 439057 - DNA, 15 bp, Homo sapiens
gtaattggatgacag

SEQ ID NO: 439058 - DNA, 15 bp, Homo sapiens
taattggatgacaga

SEQ ID NO: 439059 - DNA, 15 bp, Homo sapiens
aattggatgacagaa

SEQ ID NO: 439060 - DNA, 15 bp, Homo sapiens
attggatgacagaaa

SEQ ID NO: 439061 - DNA, 15 bp, Homo sapiens
ttggatgacagaaaa

SEQ ID NO: 439062 - DNA, 15 bp, Homo sapiens
tggatgacagaaaac

SEQ ID NO: 439063 - DNA, 15 bp, Homo sapiens
ggatgacagaaaaca

SEQ ID NO: 439064 - DNA, 15 bp, Homo sapiens
gatgacagaaaacat

SEQ ID NO: 439065 - DNA, 15 bp, Homo sapiens
atgacagaaaacatc

SEQ ID NO: 439066 - DNA, 15 bp, Homo sapiens
tgacagaaaacatca

SEQ ID NO: 439067 - DNA, 15 bp, Homo sapiens
gacagaaaacatcag

SEQ ID NO: 439068 - DNA, 15 bp, Homo sapiens
acagaaaacatcagg

SEQ ID NO: 439069 - DNA, 15 bp, Homo sapiens
cagaaaacatcagga

SEQ ID NO: 439070 - DNA, 15 bp, Homo sapiens
agaaaacatcaggat

SEQ ID NO: 439071 - DNA, 15 bp, Homo sapiens
gaaaacatcaggatt

SEQ ID NO: 439072 - DNA, 15 bp, Homo sapiens
aaaacatcaggattg

SEQ ID NO: 439073 - DNA, 15 bp, Homo sapiens
aaacatcaggattga

SEQ ID NO: 439074 - DNA, 15 bp, Homo sapiens
aacatcaggattgat

SEQ ID NO: 439075 - DNA, 15 bp, Homo sapiens
acatcaggattgatc

SEQ ID NO: 439076 - DNA, 15 bp, Homo sapiens
catcaggattgatct

SEQ ID NO: 439077 - DNA, 15 bp, Homo sapiens
atcaggattgatctt

SEQ ID NO: 439078 - DNA, 15 bp, Homo sapiens
tcaggattgatcttt

SEQ ID NO: 439079 - DNA, 15 bp, Homo sapiens
caggattgatctttc

SEQ ID NO: 439080 - DNA, 15 bp, Homo sapiens
aggattgatctttcc

SEQ ID NO: 439081 - DNA, 15 bp, Homo sapiens
ggattgatctttcct

SEQ ID NO: 439082 - DNA, 15 bp, Homo sapiens
gattgatctttcctt

SEQ ID NO: 439083 - DNA, 15 bp, Homo sapiens
attgatctttccttt

SEQ ID NO: 439084 - DNA, 15 bp, Homo sapiens
ttgatctttcctttt

SEQ ID NO: 439085 - DNA, 15 bp, Homo sapiens
tgatctttccttttt

SEQ ID NO: 439086 - DNA, 15 bp, Homo sapiens
gatctttcctttttc

SEQ ID NO: 439087 - DNA, 15 bp, Homo sapiens
atctttcctttttcc

SEQ ID NO: 439088 - DNA, 15 bp, Homo sapiens
tctttcctttttcct

SEQ ID NO: 439089 - DNA, 15 bp, Homo sapiens
ctttcctttttcctc

SEQ ID NO: 439090 - DNA, 15 bp, Homo sapiens
tttcctttttcctct

SEQ ID NO: 439091 - DNA, 15 bp, Homo sapiens
ttcctttttcctctc

SEQ ID NO: 439092 - DNA, 15 bp, Homo sapiens
tcctttttcctctct

SEQ ID NO: 439093 - DNA, 15 bp, Homo sapiens
cctttttcctctctt

SEQ ID NO: 439094 - DNA, 15 bp, Homo sapiens
ctttttcctctcttc

SEQ ID NO: 439095 - DNA, 15 bp, Homo sapiens
tttttcctctcttcc

SEQ ID NO: 439096 - DNA, 15 bp, Homo sapiens
ttttcctctcttcct

SEQ ID NO: 439097 - DNA, 15 bp, Homo sapiens
tttcctctcttcctt

SEQ ID NO: 439098 - DNA, 15 bp, Homo sapiens
ttcctctcttccttt

SEQ ID NO: 439099 - DNA, 15 bp, Homo sapiens
tcctctcttcctttg

SEQ ID NO: 439100 - DNA, 15 bp, Homo sapiens
cctctcttcctttgt

SEQ ID NO: 439101 - DNA, 15 bp, Homo sapiens
ctctcttcctttgtc

SEQ ID NO: 439102 - DNA, 15 bp, Homo sapiens
tctcttcctttgtct

SEQ ID NO: 439103 - DNA, 15 bp, Homo sapiens
ctcttcctttgtctt

SEQ ID NO: 439104 - DNA, 15 bp, Homo sapiens
tcttcctttgtcttc

SEQ ID NO: 439105 - DNA, 15 bp, Homo sapiens
cttcctttgtcttct

SEQ ID NO: 439106 - DNA, 15 bp, Homo sapiens
ttcctttgtcttctt

SEQ ID NO: 439107 - DNA, 15 bp, Homo sapiens
tcctttgtcttcttc

SEQ ID NO: 439108 - DNA, 15 bp, Homo sapiens
cctttgtcttcttcc

SEQ ID NO: 439109 - DNA, 15 bp, Homo sapiens
ctttgtcttcttcct

SEQ ID NO: 439110 - DNA, 15 bp, Homo sapiens
tttgtcttcttcctg

SEQ ID NO: 439111 - DNA, 15 bp, Homo sapiens
ttgtcttcttcctgt

SEQ ID NO: 439112 - DNA, 15 bp, Homo sapiens
tgtcttcttcctgtt

SEQ ID NO: 439113 - DNA, 15 bp, Homo sapiens
gtcttcttcctgttt

SEQ ID NO: 439114 - DNA, 15 bp, Homo sapiens
tcttcttcctgtttc

SEQ ID NO: 439115 - DNA, 15 bp, Homo sapiens
cttcttcctgtttct

SEQ ID NO: 439116 - DNA, 15 bp, Homo sapiens
ttcttcctgtttctt

SEQ ID NO: 439117 - DNA, 15 bp, Homo sapiens
tcttcctgtttcttc

SEQ ID NO: 439118 - DNA, 15 bp, Homo sapiens
cttcctgtttcttct

SEQ ID NO: 439119 - DNA, 15 bp, Homo sapiens
ttcctgtttcttctt

SEQ ID NO: 439120 - DNA, 15 bp, Homo sapiens
tcctgtttcttcttt

SEQ ID NO: 439121 - DNA, 15 bp, Homo sapiens
cctgtttcttctttc

SEQ ID NO: 439122 - DNA, 15 bp, Homo sapiens
tgtttcttctttcta

SEQ ID NO: 439123 - DNA, 15 bp, Homo sapiens
gtttcttctttctaa

SEQ ID NO: 439124 - DNA, 15 bp, Homo sapiens
tttcttctttctaaa

SEQ ID NO: 439125 - DNA, 15 bp, Homo sapiens
ttcttctttctaaaa

SEQ ID NO: 439126 - DNA, 15 bp, Homo sapiens
tcttctttctaaaag

SEQ ID NO: 439127 - DNA, 15 bp, Homo sapiens
cttctttctaaaaga

SEQ ID NO: 439128 - DNA, 15 bp, Homo sapiens
ttctttctaaaagat

SEQ ID NO: 439129 - DNA, 15 bp, Homo sapiens
tctttctaaaagata

SEQ ID NO: 439130 - DNA, 15 bp, Homo sapiens
ctttctaaaagatag

SEQ ID NO: 439131 - DNA, 15 bp, Homo sapiens
tttctaaaagatagt

SEQ ID NO: 439132 - DNA, 15 bp, Homo sapiens
ttctaaaagatagtt

SEQ ID NO: 439133 - DNA, 15 bp, Homo sapiens
tctaaaagatagtta

SEQ ID NO: 439134 - DNA, 15 bp, Homo sapiens
ctaaaagatagttat

SEQ ID NO: 439135 - DNA, 15 bp, Homo sapiens
taaaagatagttatc

SEQ ID NO: 439136 - DNA, 15 bp, Homo sapiens
aaaagatagttatct

SEQ ID NO: 439137 - DNA, 15 bp, Homo sapiens
aaagatagttatctg

SEQ ID NO: 439138 - DNA, 15 bp, Homo sapiens
aagatagttatctgt

SEQ ID NO: 439139 - DNA, 15 bp, Homo sapiens
agatagttatctgtg

SEQ ID NO: 439140 - DNA, 15 bp, Homo sapiens
gatagttatctgtgg

SEQ ID NO: 439141 - DNA, 15 bp, Homo sapiens
atagttatctgtggt

SEQ ID NO: 439142 - DNA, 15 bp, Homo sapiens
tagttatctgtggtc

SEQ ID NO: 439143 - DNA, 15 bp, Homo sapiens
agttatctgtggtcc

SEQ ID NO: 439144 - DNA, 15 bp, Homo sapiens
gttatctgtggtccc

SEQ ID NO: 439145 - DNA, 15 bp, Homo sapiens
ttatctgtggtccct

SEQ ID NO: 439146 - DNA, 15 bp, Homo sapiens
tatctgtggtccctt

SEQ ID NO: 439147 - DNA, 15 bp, Homo sapiens
atctgtggtccctta

SEQ ID NO: 439148 - DNA, 15 bp, Homo sapiens
tctgtggtcccttaa

SEQ ID NO: 439149 - DNA, 15 bp, Homo sapiens
ctgtggtcccttaaa

SEQ ID NO: 439150 - DNA, 15 bp, Homo sapiens
tgtggtcccttaaat

SEQ ID NO: 439151 - DNA, 15 bp, Homo sapiens
gtggtcccttaaata

SEQ ID NO: 439152 - DNA, 15 bp, Homo sapiens
tggtcccttaaatag

SEQ ID NO: 439153 - DNA, 15 bp, Homo sapiens
ggtcccttaaatagc

SEQ ID NO: 439154 - DNA, 15 bp, Homo sapiens
gtcccttaaatagct

SEQ ID NO: 439155 - DNA, 15 bp, Homo sapiens
tcccttaaatagctt

SEQ ID NO: 439156 - DNA, 15 bp, Homo sapiens
cccttaaatagcttt

SEQ ID NO: 439157 - DNA, 15 bp, Homo sapiens
ccttaaatagctttg

SEQ ID NO: 439158 - DNA, 15 bp, Homo sapiens
cttaaatagctttgt

SEQ ID NO: 439159 - DNA, 15 bp, Homo sapiens
ttaaatagctttgta

SEQ ID NO: 439160 - DNA, 15 bp, Homo sapiens
taaatagctttgtaa

SEQ ID NO: 439161 - DNA, 15 bp, Homo sapiens
aaatagctttgtaat

SEQ ID NO: 439162 - DNA, 15 bp, Homo sapiens
aatagctttgtaatg

SEQ ID NO: 439163 - DNA, 15 bp, Homo sapiens
atagctttgtaatgc

SEQ ID NO: 439164 - DNA, 15 bp, Homo sapiens
tagctttgtaatgca

SEQ ID NO: 439165 - DNA, 15 bp, Homo sapiens
agctttgtaatgcaa

SEQ ID NO: 439166 - DNA, 15 bp, Homo sapiens
gctttgtaatgcaat

SEQ ID NO: 439167 - DNA, 15 bp, Homo sapiens
ctttgtaatgcaata

SEQ ID NO: 439168 - DNA, 15 bp, Homo sapiens
tttgtaatgcaataa

SEQ ID NO: 439169 - DNA, 15 bp, Homo sapiens
ttgtaatgcaataaa

SEQ ID NO: 439170 - DNA, 15 bp, Homo sapiens
tgtaatgcaataaat

SEQ ID NO: 439171 - DNA, 15 bp, Homo sapiens
gtaatgcaataaata

SEQ ID NO: 439172 - DNA, 15 bp, Homo sapiens
taatgcaataaataa

SEQ ID NO: 439173 - DNA, 15 bp, Homo sapiens
aatgcaataaataaa

SEQ ID NO: 439174 - DNA, 15 bp, Homo sapiens
atgcaataaataaat

SEQ ID NO: 439175 - DNA, 15 bp, Homo sapiens
tgcaataaataaatt

SEQ ID NO: 439176 - DNA, 15 bp, Homo sapiens
gcaataaataaattg

SEQ ID NO: 439177 - DNA, 15 bp, Homo sapiens
caataaataaattgg

SEQ ID NO: 439178 - DNA, 15 bp, Homo sapiens
aataaataaattggt

SEQ ID NO: 439179 - DNA, 15 bp, Homo sapiens
ataaataaattggtg

SEQ ID NO: 439180 - DNA, 15 bp, Homo sapiens
taaataaattggtgt

SEQ ID NO: 439181 - DNA, 15 bp, Homo sapiens
aaataaattggtgtt

SEQ ID NO: 439182 - DNA, 15 bp, Homo sapiens
aataaattggtgttt

SEQ ID NO: 439183 - DNA, 15 bp, Homo sapiens
ataaattggtgttta

SEQ ID NO: 439184 - DNA, 15 bp, Homo sapiens
taaattggtgtttaa

SEQ ID NO: 439185 - DNA, 15 bp, Homo sapiens
aaattggtgtttaaa

SEQ ID NO: 439186 - DNA, 15 bp, Homo sapiens
aattggtgtttaaaa

SEQ ID NO: 439187 - DNA, 15 bp, Homo sapiens
attggtgtttaaaaa

SEQ ID NO: 439188 - DNA, 15 bp, Homo sapiens
ttggtgtttaaaaat

SEQ ID NO: 439189 - DNA, 15 bp, Homo sapiens
tggtgtttaaaaatt

SEQ ID NO: 439190 - DNA, 15 bp, Homo sapiens
ggtgtttaaaaatta

SEQ ID NO: 439191 - DNA, 15 bp, Homo sapiens
gtgtttaaaaattat

SEQ ID NO: 439192 - DNA, 15 bp, Homo sapiens
tgtttaaaaattatg

SEQ ID NO: 439193 - DNA, 15 bp, Homo sapiens
gtttaaaaattatga

SEQ ID NO: 439194 - DNA, 15 bp, Homo sapiens
tttaaaaattatgaa

SEQ ID NO: 439195 - DNA, 15 bp, Homo sapiens
ttaaaaattatgaaa

SEQ ID NO: 439196 - DNA, 15 bp, Homo sapiens
taaaaattatgaaat

SEQ ID NO: 439197 - DNA, 15 bp, Homo sapiens
aaaaattatgaaata

SEQ ID NO: 439198 - DNA, 15 bp, Homo sapiens
aaaattatgaaatat

SEQ ID NO: 439199 - DNA, 15 bp, Homo sapiens
aaattatgaaatatg

SEQ ID NO: 439200 - DNA, 15 bp, Homo sapiens
aattatgaaatatga

SEQ ID NO: 439201 - DNA, 15 bp, Homo sapiens
attatgaaatatgaa

SEQ ID NO: 439202 - DNA, 15 bp, Homo sapiens
ttatgaaatatgaat

SEQ ID NO: 439203 - DNA, 15 bp, Homo sapiens
tatgaaatatgaata

SEQ ID NO: 439204 - DNA, 15 bp, Homo sapiens
atgaaatatgaatat

SEQ ID NO: 439205 - DNA, 15 bp, Homo sapiens
tgaaatatgaatata

SEQ ID NO: 439206 - DNA, 15 bp, Homo sapiens
gaaatatgaatataa

SEQ ID NO: 439207 - DNA, 15 bp, Homo sapiens
aaatatgaatataaa

SEQ ID NO: 439208 - DNA, 15 bp, Homo sapiens
aatatgaatataaaa

SEQ ID NO: 439209 - DNA, 15 bp, Homo sapiens
atatgaatataaaat

SEQ ID NO: 439210 - DNA, 15 bp, Homo sapiens
tatgaatataaaata

SEQ ID NO: 439211 - DNA, 15 bp, Homo sapiens
atgaatataaaataa

SEQ ID NO: 439212 - DNA, 15 bp, Homo sapiens
tgaatataaaataat

SEQ ID NO: 439213 - DNA, 15 bp, Homo sapiens
gaatataaaataata

SEQ ID NO: 439214 - DNA, 15 bp, Homo sapiens
atataaaataatatt

SEQ ID NO: 439215 - DNA, 15 bp, Homo sapiens
tataaaataatattc

SEQ ID NO: 439216 - DNA, 15 bp, Homo sapiens
ataaaataatattca

SEQ ID NO: 439217 - DNA, 15 bp, Homo sapiens
taaaataatattcat

SEQ ID NO: 439218 - DNA, 15 bp, Homo sapiens
aaaataatattcata

SEQ ID NO: 439219 - DNA, 15 bp, Homo sapiens
aaataatattcataa

SEQ ID NO: 439220 - DNA, 15 bp, Homo sapiens
aataatattcataat

SEQ ID NO: 439221 - DNA, 15 bp, Homo sapiens
ataatattcataata

SEQ ID NO: 439222 - DNA, 15 bp, Homo sapiens
taatattcataatac

SEQ ID NO: 439223 - DNA, 15 bp, Homo sapiens
aatattcataataca

SEQ ID NO: 439224 - DNA, 15 bp, Homo sapiens
atattcataatacat

SEQ ID NO: 439225 - DNA, 15 bp, Homo sapiens
tattcataatacatg

SEQ ID NO: 439226 - DNA, 15 bp, Homo sapiens
attcataatacatga

SEQ ID NO: 439227 - DNA, 15 bp, Homo sapiens
ttcataatacatgat

SEQ ID NO: 439228 - DNA, 15 bp, Homo sapiens
tcataatacatgata

SEQ ID NO: 439229 - DNA, 15 bp, Homo sapiens
cataatacatgatac

SEQ ID NO: 439230 - DNA, 15 bp, Homo sapiens
ataatacatgataca

SEQ ID NO: 439231 - DNA, 15 bp, Homo sapiens
taatacatgatacat

SEQ ID NO: 439232 - DNA, 15 bp, Homo sapiens
aatacatgatacata

SEQ ID NO: 439233 - DNA, 15 bp, Homo sapiens
atacatgatacataa

SEQ ID NO: 439234 - DNA, 15 bp, Homo sapiens
tacatgatacataaa

SEQ ID NO: 439235 - DNA, 15 bp, Homo sapiens
acatgatacataaat

SEQ ID NO: 439236 - DNA, 15 bp, Homo sapiens
catgatacataaata

SEQ ID NO: 439237 - DNA, 15 bp, Homo sapiens
atgatacataaatat

SEQ ID NO: 439238 - DNA, 15 bp, Homo sapiens
tgatacataaatata

SEQ ID NO: 439239 - DNA, 15 bp, Homo sapiens
gatacataaatatat

SEQ ID NO: 439240 - DNA, 15 bp, Homo sapiens
atacataaatatata

SEQ ID NO: 439241 - DNA, 15 bp, Homo sapiens
tacataaatatataa

SEQ ID NO: 439242 - DNA, 15 bp, Homo sapiens
acataaatatataat

SEQ ID NO: 439243 - DNA, 15 bp, Homo sapiens
cataaatatataata

SEQ ID NO: 439244 - DNA, 15 bp, Homo sapiens
ataaatatataatat

SEQ ID NO: 439245 - DNA, 15 bp, Homo sapiens
taaatatataatata

SEQ ID NO: 439246 - DNA, 15 bp, Homo sapiens
aaatatataatataa

SEQ ID NO: 439247 - DNA, 15 bp, Homo sapiens
aatatataatataaa

SEQ ID NO: 439248 - DNA, 15 bp, Homo sapiens
atatataatataaat

SEQ ID NO: 439249 - DNA, 15 bp, Homo sapiens
tatataatataaata

SEQ ID NO: 439250 - DNA, 15 bp, Homo sapiens
atataatataaataa

SEQ ID NO: 439251 - DNA, 15 bp, Homo sapiens
tataatataaataaa

SEQ ID NO: 439252 - DNA, 15 bp, Homo sapiens
ataatataaataaat

SEQ ID NO: 439253 - DNA, 15 bp, Homo sapiens
taatataaataaata

SEQ ID NO: 439254 - DNA, 15 bp, Homo sapiens
aatataaataaatat

SEQ ID NO: 439255 - DNA, 15 bp, Homo sapiens
tataaataaatataa

SEQ ID NO: 439256 - DNA, 15 bp, Homo sapiens
ataaataaatataaa

SEQ ID NO: 439257 - DNA, 15 bp, Homo sapiens
aaataaatataaaag

SEQ ID NO: 439258 - DNA, 15 bp, Homo sapiens
aataaatataaaagt

SEQ ID NO: 439259 - DNA, 15 bp, Homo sapiens
ataaatataaaagta

SEQ ID NO: 439260 - DNA, 15 bp, Homo sapiens
taaatataaaagtat

SEQ ID NO: 439261 - DNA, 15 bp, Homo sapiens
aaatataaaagtata

SEQ ID NO: 439262 - DNA, 15 bp, Homo sapiens
aatataaaagtataa

SEQ ID NO: 439263 - DNA, 15 bp, Homo sapiens
atataaaagtataag

SEQ ID NO: 439264 - DNA, 15 bp, Homo sapiens
tataaaagtataagt

SEQ ID NO: 439265 - DNA, 15 bp, Homo sapiens
ataaaagtataagta

SEQ ID NO: 439266 - DNA, 15 bp, Homo sapiens
taaaagtataagtaa

SEQ ID NO: 439267 - DNA, 15 bp, Homo sapiens
aaaagtataagtaag

SEQ ID NO: 439268 - DNA, 15 bp, Homo sapiens
aaagtataagtaaga

SEQ ID NO: 439269 - DNA, 15 bp, Homo sapiens
aagtataagtaagag

SEQ ID NO: 439270 - DNA, 15 bp, Homo sapiens
agtataagtaagagg

SEQ ID NO: 439271 - DNA, 15 bp, Homo sapiens
gtataagtaagaggc

SEQ ID NO: 439272 - DNA, 15 bp, Homo sapiens
tataagtaagaggct

SEQ ID NO: 439273 - DNA, 15 bp, Homo sapiens
ataagtaagaggcta

SEQ ID NO: 439274 - DNA, 15 bp, Homo sapiens
taagtaagaggctag

SEQ ID NO: 439275 - DNA, 15 bp, Homo sapiens
aagtaagaggctagg

SEQ ID NO: 439276 - DNA, 15 bp, Homo sapiens
agtaagaggctaggt

SEQ ID NO: 439277 - DNA, 15 bp, Homo sapiens
gtaagaggctaggtg

SEQ ID NO: 439278 - DNA, 15 bp, Homo sapiens
taagaggctaggtgc

SEQ ID NO: 439279 - DNA, 15 bp, Homo sapiens
aagaggctaggtgcg

SEQ ID NO: 439280 - DNA, 15 bp, Homo sapiens
agaggctaggtgcgg

SEQ ID NO: 439281 - DNA, 15 bp, Homo sapiens
gaggctaggtgcggt

SEQ ID NO: 439282 - DNA, 15 bp, Homo sapiens
aggctaggtgcggtg

SEQ ID NO: 439283 - DNA, 15 bp, Homo sapiens
ggctaggtgcggtgg

SEQ ID NO: 439284 - DNA, 15 bp, Homo sapiens
gctaggtgcggtggc

SEQ ID NO: 439285 - DNA, 15 bp, Homo sapiens
ctaggtgcggtggct

SEQ ID NO: 439286 - DNA, 15 bp, Homo sapiens
taggtgcggtggctt

SEQ ID NO: 439287 - DNA, 15 bp, Homo sapiens
cctgtaatcttagcc

SEQ ID NO: 439288 - DNA, 15 bp, Homo sapiens
ctgtaatcttagccc

SEQ ID NO: 439289 - DNA, 15 bp, Homo sapiens
tgtaatcttagccct

SEQ ID NO: 439290 - DNA, 15 bp, Homo sapiens
gtaatcttagccctt

SEQ ID NO: 439291 - DNA, 15 bp, Homo sapiens
taatcttagcccttt

SEQ ID NO: 439292 - DNA, 15 bp, Homo sapiens
aatcttagccctttg

SEQ ID NO: 439293 - DNA, 15 bp, Homo sapiens
atcttagccctttgg

SEQ ID NO: 439294 - DNA, 15 bp, Homo sapiens
tcttagccctttggg

SEQ ID NO: 439295 - DNA, 15 bp, Homo sapiens
cttagccctttggga

SEQ ID NO: 439296 - DNA, 15 bp, Homo sapiens
ttagccctttgggag

SEQ ID NO: 439297 - DNA, 15 bp, Homo sapiens
tagccctttgggaga

SEQ ID NO: 439298 - DNA, 15 bp, Homo sapiens
agccctttgggagac

SEQ ID NO: 439299 - DNA, 15 bp, Homo sapiens
gccctttgggagact

SEQ ID NO: 439300 - DNA, 15 bp, Homo sapiens
ccctttgggagactg

SEQ ID NO: 439301 - DNA, 15 bp, Homo sapiens
cctttgggagactga

SEQ ID NO: 439302 - DNA, 15 bp, Homo sapiens
ctttgggagactgag

SEQ ID NO: 439303 - DNA, 15 bp, Homo sapiens
tttgggagactgagg

SEQ ID NO: 439304 - DNA, 15 bp, Homo sapiens
gaggtgggaggatca

SEQ ID NO: 439305 - DNA, 15 bp, Homo sapiens
aggtgggaggatcac

SEQ ID NO: 439306 - DNA, 15 bp, Homo sapiens
ggtgggaggatcaca

SEQ ID NO: 439307 - DNA, 15 bp, Homo sapiens
gtgggaggatcacat

SEQ ID NO: 439308 - DNA, 15 bp, Homo sapiens
tgggaggatcacatg

SEQ ID NO: 439309 - DNA, 15 bp, Homo sapiens
gggaggatcacatga

SEQ ID NO: 439310 - DNA, 15 bp, Homo sapiens
ggaggatcacatgag

SEQ ID NO: 439311 - DNA, 15 bp, Homo sapiens
gaggatcacatgagg

SEQ ID NO: 439312 - DNA, 15 bp, Homo sapiens
aggatcacatgaggc

SEQ ID NO: 439313 - DNA, 15 bp, Homo sapiens
ggatcacatgaggcc

SEQ ID NO: 439314 - DNA, 15 bp, Homo sapiens
gatcacatgaggcca

SEQ ID NO: 439315 - DNA, 15 bp, Homo sapiens
atcacatgaggccag

SEQ ID NO: 439316 - DNA, 15 bp, Homo sapiens
tcacatgaggccaga

SEQ ID NO: 439317 - DNA, 15 bp, Homo sapiens
cacatgaggccagaa

SEQ ID NO: 439318 - DNA, 15 bp, Homo sapiens
acatgaggccagaag

SEQ ID NO: 439319 - DNA, 15 bp, Homo sapiens
catgaggccagaagt

SEQ ID NO: 439320 - DNA, 15 bp, Homo sapiens
atgaggccagaagtt

SEQ ID NO: 439321 - DNA, 15 bp, Homo sapiens
tgaggccagaagttt

SEQ ID NO: 439322 - DNA, 15 bp, Homo sapiens
gaggccagaagtttg

SEQ ID NO: 439323 - DNA, 15 bp, Homo sapiens
aggccagaagtttga

SEQ ID NO: 439324 - DNA, 15 bp, Homo sapiens
ggccagaagtttgag

SEQ ID NO: 439325 - DNA, 15 bp, Homo sapiens
gccagaagtttgaga

SEQ ID NO: 439326 - DNA, 15 bp, Homo sapiens
ccagaagtttgagac

SEQ ID NO: 439327 - DNA, 15 bp, Homo sapiens
cagaagtttgagacc

SEQ ID NO: 439328 - DNA, 15 bp, Homo sapiens
agaagtttgagacca

SEQ ID NO: 439329 - DNA, 15 bp, Homo sapiens
gaagtttgagaccag

SEQ ID NO: 439330 - DNA, 15 bp, Homo sapiens
aagtttgagaccagc

SEQ ID NO: 439331 - DNA, 15 bp, Homo sapiens
cctgggtaacatagt

SEQ ID NO: 439332 - DNA, 15 bp, Homo sapiens
ctgggtaacatagtg

SEQ ID NO: 439333 - DNA, 15 bp, Homo sapiens
tgggtaacatagtga

SEQ ID NO: 439334 - DNA, 15 bp, Homo sapiens
gggtaacatagtgag

SEQ ID NO: 439335 - DNA, 15 bp, Homo sapiens
ggtaacatagtgaga

SEQ ID NO: 439336 - DNA, 15 bp, Homo sapiens
gtaacatagtgagac

SEQ ID NO: 439337 - DNA, 15 bp, Homo sapiens
taacatagtgagacc

SEQ ID NO: 439338 - DNA, 15 bp, Homo sapiens
aacatagtgagacct

SEQ ID NO: 439339 - DNA, 15 bp, Homo sapiens
acatagtgagacctc

SEQ ID NO: 439340 - DNA, 15 bp, Homo sapiens
catagtgagacctca

SEQ ID NO: 439341 - DNA, 15 bp, Homo sapiens
atagtgagacctcat

SEQ ID NO: 439342 - DNA, 15 bp, Homo sapiens
tagtgagacctcatc

SEQ ID NO: 439343 - DNA, 15 bp, Homo sapiens
agtgagacctcatcc

SEQ ID NO: 439344 - DNA, 15 bp, Homo sapiens
gtgagacctcatccc

SEQ ID NO: 439345 - DNA, 15 bp, Homo sapiens
tgagacctcatccct

SEQ ID NO: 439346 - DNA, 15 bp, Homo sapiens
gagacctcatcccta

SEQ ID NO: 439347 - DNA, 15 bp, Homo sapiens
agacctcatccctaa

SEQ ID NO: 439348 - DNA, 15 bp, Homo sapiens
gacctcatccctaaa

SEQ ID NO: 439349 - DNA, 15 bp, Homo sapiens
acctcatccctaaaa

SEQ ID NO: 439350 - DNA, 15 bp, Homo sapiens
cctcatccctaaaaa

SEQ ID NO: 439351 - DNA, 15 bp, Homo sapiens
ctcatccctaaaaaa

SEQ ID NO: 439352 - DNA, 15 bp, Homo sapiens
tcatccctaaaaaaa

SEQ ID NO: 439353 - DNA, 15 bp, Homo sapiens
catccctaaaaaaaa

SEQ ID NO: 439354 - DNA, 15 bp, Homo sapiens
atccctaaaaaaaaa

SEQ ID NO: 439355 - DNA, 15 bp, Homo sapiens
tccctaaaaaaaaaa

SEQ ID NO: 439356 - DNA, 15 bp, Homo sapiens
ccctaaaaaaaaaaa

SEQ ID NO: 439357 - DNA, 15 bp, Homo sapiens
aaaattagctggcca

SEQ ID NO: 439358 - DNA, 15 bp, Homo sapiens
aaattagctggccac

SEQ ID NO: 439359 - DNA, 15 bp, Homo sapiens
aattagctggccact

SEQ ID NO: 439360 - DNA, 15 bp, Homo sapiens
attagctggccactg

SEQ ID NO: 439361 - DNA, 15 bp, Homo sapiens
ttagctggccactgt

SEQ ID NO: 439362 - DNA, 15 bp, Homo sapiens
tagctggccactgtg

SEQ ID NO: 439363 - DNA, 15 bp, Homo sapiens
agctggccactgtgg

SEQ ID NO: 439364 - DNA, 15 bp, Homo sapiens
gctggccactgtggc

SEQ ID NO: 439365 - DNA, 15 bp, Homo sapiens
ctggccactgtggca

SEQ ID NO: 439366 - DNA, 15 bp, Homo sapiens
tggccactgtggcac

SEQ ID NO: 439367 - DNA, 15 bp, Homo sapiens
ggccactgtggcaca

SEQ ID NO: 439368 - DNA, 15 bp, Homo sapiens
gccactgtggcacat

SEQ ID NO: 439369 - DNA, 15 bp, Homo sapiens
ccactgtggcacata

SEQ ID NO: 439370 - DNA, 15 bp, Homo sapiens
cactgtggcacataa

SEQ ID NO: 439371 - DNA, 15 bp, Homo sapiens
actgtggcacataac

SEQ ID NO: 439372 - DNA, 15 bp, Homo sapiens
ctgtggcacataact

SEQ ID NO: 439373 - DNA, 15 bp, Homo sapiens
tgtggcacataactg

SEQ ID NO: 439374 - DNA, 15 bp, Homo sapiens
gtggcacataactgt

SEQ ID NO: 439375 - DNA, 15 bp, Homo sapiens
tggcacataactgtg

SEQ ID NO: 439376 - DNA, 15 bp, Homo sapiens
ggcacataactgtga

SEQ ID NO: 439377 - DNA, 15 bp, Homo sapiens
gcacataactgtgat

SEQ ID NO: 439378 - DNA, 15 bp, Homo sapiens
cacataactgtgatc

SEQ ID NO: 439379 - DNA, 15 bp, Homo sapiens
acataactgtgatcc

SEQ ID NO: 439380 - DNA, 15 bp, Homo sapiens
cataactgtgatccc

SEQ ID NO: 439381 - DNA, 15 bp, Homo sapiens
ataactgtgatccca

SEQ ID NO: 439382 - DNA, 15 bp, Homo sapiens
taactgtgatcccag

SEQ ID NO: 439383 - DNA, 15 bp, Homo sapiens
aactgtgatcccagc

SEQ ID NO: 439384 - DNA, 15 bp, Homo sapiens
actgtgatcccagct

SEQ ID NO: 439385 - DNA, 15 bp, Homo sapiens
atggtaacactcaca

SEQ ID NO: 439386 - DNA, 15 bp, Homo sapiens
tggtaacactcacac

SEQ ID NO: 439387 - DNA, 15 bp, Homo sapiens
ggtaacactcacact

SEQ ID NO: 439388 - DNA, 15 bp, Homo sapiens
gtaacactcacactt

SEQ ID NO: 439389 - DNA, 15 bp, Homo sapiens
taacactcacacttg

SEQ ID NO: 439390 - DNA, 15 bp, Homo sapiens
aacactcacacttgg

SEQ ID NO: 439391 - DNA, 15 bp, Homo sapiens
acactcacacttggc

SEQ ID NO: 439392 - DNA, 15 bp, Homo sapiens
cactcacacttggct

SEQ ID NO: 439393 - DNA, 15 bp, Homo sapiens
actcacacttggcta

SEQ ID NO: 439394 - DNA, 15 bp, Homo sapiens
ctcacacttggctat

SEQ ID NO: 439395 - DNA, 15 bp, Homo sapiens
tcacacttggctatt

SEQ ID NO: 439396 - DNA, 15 bp, Homo sapiens
cacacttggctatta

SEQ ID NO: 439397 - DNA, 15 bp, Homo sapiens
acacttggctattaa

SEQ ID NO: 439398 - DNA, 15 bp, Homo sapiens
cacttggctattaag

SEQ ID NO: 439399 - DNA, 15 bp, Homo sapiens
acttggctattaaga

SEQ ID NO: 439400 - DNA, 15 bp, Homo sapiens
cttggctattaagaa

SEQ ID NO: 439401 - DNA, 15 bp, Homo sapiens
ttggctattaagaat

SEQ ID NO: 439402 - DNA, 15 bp, Homo sapiens
tggctattaagaata

SEQ ID NO: 439403 - DNA, 15 bp, Homo sapiens
ggctattaagaatat

SEQ ID NO: 439404 - DNA, 15 bp, Homo sapiens
gctattaagaatata

SEQ ID NO: 439405 - DNA, 15 bp, Homo sapiens
ctattaagaatatat

SEQ ID NO: 439406 - DNA, 15 bp, Homo sapiens
tattaagaatatata

SEQ ID NO: 439407 - DNA, 15 bp, Homo sapiens
attaagaatatataa

SEQ ID NO: 439408 - DNA, 15 bp, Homo sapiens
ttaagaatatataat

SEQ ID NO: 439409 - DNA, 15 bp, Homo sapiens
taagaatatataatc

SEQ ID NO: 439410 - DNA, 15 bp, Homo sapiens
aagaatatataatca

SEQ ID NO: 439411 - DNA, 15 bp, Homo sapiens
agaatatataatcag

SEQ ID NO: 439412 - DNA, 15 bp, Homo sapiens
gaatatataatcaga

SEQ ID NO: 439413 - DNA, 15 bp, Homo sapiens
aatatataatcagac

SEQ ID NO: 439414 - DNA, 15 bp, Homo sapiens
atatataatcagaca

SEQ ID NO: 439415 - DNA, 15 bp, Homo sapiens
tatataatcagacat

SEQ ID NO: 439416 - DNA, 15 bp, Homo sapiens
atataatcagacatc

SEQ ID NO: 439417 - DNA, 15 bp, Homo sapiens
tataatcagacatcc

SEQ ID NO: 439418 - DNA, 15 bp, Homo sapiens
ataatcagacatcca

SEQ ID NO: 439419 - DNA, 15 bp, Homo sapiens
taatcagacatccaa

SEQ ID NO: 439420 - DNA, 15 bp, Homo sapiens
aatcagacatccaaa

SEQ ID NO: 439421 - DNA, 15 bp, Homo sapiens
atcagacatccaaat

SEQ ID NO: 439422 - DNA, 15 bp, Homo sapiens
tcagacatccaaatt

SEQ ID NO: 439423 - DNA, 15 bp, Homo sapiens
cagacatccaaatta

SEQ ID NO: 439424 - DNA, 15 bp, Homo sapiens
agacatccaaattat

SEQ ID NO: 439425 - DNA, 15 bp, Homo sapiens
gacatccaaattatt

SEQ ID NO: 439426 - DNA, 15 bp, Homo sapiens
acatccaaattattc

SEQ ID NO: 439427 - DNA, 15 bp, Homo sapiens
catccaaattattct

SEQ ID NO: 439428 - DNA, 15 bp, Homo sapiens
atccaaattattctt

SEQ ID NO: 439429 - DNA, 15 bp, Homo sapiens
tccaaattattcttt

SEQ ID NO: 439430 - DNA, 15 bp, Homo sapiens
ccaaattattctttt

SEQ ID NO: 439431 - DNA, 15 bp, Homo sapiens
caaattattcttttt

SEQ ID NO: 439432 - DNA, 15 bp, Homo sapiens
aaattattctttttc

SEQ ID NO: 439433 - DNA, 15 bp, Homo sapiens
aattattctttttct

SEQ ID NO: 439434 - DNA, 15 bp, Homo sapiens
attattctttttctt

SEQ ID NO: 439435 - DNA, 15 bp, Homo sapiens
ttattctttttcttt

SEQ ID NO: 439436 - DNA, 15 bp, Homo sapiens
tattctttttctttt

SEQ ID NO: 439437 - DNA, 15 bp, Homo sapiens
attctttttcttttt

SEQ ID NO: 439438 - DNA, 15 bp, Homo sapiens
tttttctttttttta

SEQ ID NO: 439439 - DNA, 15 bp, Homo sapiens
ttttcttttttttaa

SEQ ID NO: 439440 - DNA, 15 bp, Homo sapiens
tttcttttttttaat

SEQ ID NO: 439441 - DNA, 15 bp, Homo sapiens
ttcttttttttaatc

SEQ ID NO: 439442 - DNA, 15 bp, Homo sapiens
tcttttttttaatca

SEQ ID NO: 439443 - DNA, 15 bp, Homo sapiens
cttttttttaatcac

SEQ ID NO: 439444 - DNA, 15 bp, Homo sapiens
ttttttttaatcaca

SEQ ID NO: 439445 - DNA, 15 bp, Homo sapiens
tttttttaatcacag

SEQ ID NO: 439446 - DNA, 15 bp, Homo sapiens
ttttttaatcacaga

SEQ ID NO: 439447 - DNA, 15 bp, Homo sapiens
tttttaatcacagaa

SEQ ID NO: 439448 - DNA, 15 bp, Homo sapiens
ttttaatcacagaat

SEQ ID NO: 439449 - DNA, 15 bp, Homo sapiens
tttaatcacagaatt

SEQ ID NO: 439450 - DNA, 15 bp, Homo sapiens
ttaatcacagaatta

SEQ ID NO: 439451 - DNA, 15 bp, Homo sapiens
taatcacagaattaa

SEQ ID NO: 439452 - DNA, 15 bp, Homo sapiens
aatcacagaattaac

SEQ ID NO: 439453 - DNA, 15 bp, Homo sapiens
atcacagaattaact

SEQ ID NO: 439454 - DNA, 15 bp, Homo sapiens
tcacagaattaactc

SEQ ID NO: 439455 - DNA, 15 bp, Homo sapiens
cacagaattaactcc

SEQ ID NO: 439456 - DNA, 15 bp, Homo sapiens
acagaattaactcct

SEQ ID NO: 439457 - DNA, 15 bp, Homo sapiens
cagaattaactcctg

SEQ ID NO: 439458 - DNA, 15 bp, Homo sapiens
agaattaactcctga

SEQ ID NO: 439459 - DNA, 15 bp, Homo sapiens
gaattaactcctgag

SEQ ID NO: 439460 - DNA, 15 bp, Homo sapiens
aattaactcctgagg

SEQ ID NO: 439461 - DNA, 15 bp, Homo sapiens
attaactcctgagga

SEQ ID NO: 439462 - DNA, 15 bp, Homo sapiens
ttaactcctgaggag

SEQ ID NO: 439463 - DNA, 15 bp, Homo sapiens
taactcctgaggaga

SEQ ID NO: 439464 - DNA, 15 bp, Homo sapiens
aactcctgaggagag

SEQ ID NO: 439465 - DNA, 15 bp, Homo sapiens
actcctgaggagaga

SEQ ID NO: 439466 - DNA, 15 bp, Homo sapiens
ctcctgaggagagag

SEQ ID NO: 439467 - DNA, 15 bp, Homo sapiens
tcctgaggagagagc

SEQ ID NO: 439468 - DNA, 15 bp, Homo sapiens
cctgaggagagagcc

SEQ ID NO: 439469 - DNA, 15 bp, Homo sapiens
ctgaggagagagccc

SEQ ID NO: 439470 - DNA, 15 bp, Homo sapiens
tgaggagagagccca

SEQ ID NO: 439471 - DNA, 15 bp, Homo sapiens
gaggagagagcccaa

SEQ ID NO: 439472 - DNA, 15 bp, Homo sapiens
aggagagagcccaaa

SEQ ID NO: 439473 - DNA, 15 bp, Homo sapiens
ggagagagcccaaaa

SEQ ID NO: 439474 - DNA, 15 bp, Homo sapiens
gagagagcccaaaag

SEQ ID NO: 439475 - DNA, 15 bp, Homo sapiens
agagagcccaaaaga

SEQ ID NO: 439476 - DNA, 15 bp, Homo sapiens
gagagcccaaaagat

SEQ ID NO: 439477 - DNA, 15 bp, Homo sapiens
agagcccaaaagatt

SEQ ID NO: 439478 - DNA, 15 bp, Homo sapiens
gagcccaaaagattg

SEQ ID NO: 439479 - DNA, 15 bp, Homo sapiens
agcccaaaagattgc

SEQ ID NO: 439480 - DNA, 15 bp, Homo sapiens
gcccaaaagattgcc

SEQ ID NO: 439481 - DNA, 15 bp, Homo sapiens
cccaaaagattgcca

SEQ ID NO: 439482 - DNA, 15 bp, Homo sapiens
ccaaaagattgccaa

SEQ ID NO: 439483 - DNA, 15 bp, Homo sapiens
caaaagattgccaaa

SEQ ID NO: 439484 - DNA, 15 bp, Homo sapiens
aaaagattgccaaag

SEQ ID NO: 439485 - DNA, 15 bp, Homo sapiens
aaagattgccaaagc

SEQ ID NO: 439486 - DNA, 15 bp, Homo sapiens
aagattgccaaagcc

SEQ ID NO: 439487 - DNA, 15 bp, Homo sapiens
agattgccaaagcca

SEQ ID NO: 439488 - DNA, 15 bp, Homo sapiens
gattgccaaagccat

SEQ ID NO: 439489 - DNA, 15 bp, Homo sapiens
attgccaaagccatg

SEQ ID NO: 439490 - DNA, 15 bp, Homo sapiens
ttgccaaagccatgc

SEQ ID NO: 439491 - DNA, 15 bp, Homo sapiens
tgccaaagccatgcg

SEQ ID NO: 439492 - DNA, 15 bp, Homo sapiens
gccaaagccatgcgc

SEQ ID NO: 439493 - DNA, 15 bp, Homo sapiens
ccaaagccatgcgca

SEQ ID NO: 439494 - DNA, 15 bp, Homo sapiens
caaagccatgcgcaa

SEQ ID NO: 439495 - DNA, 15 bp, Homo sapiens
aaagccatgcgcaaa

SEQ ID NO: 439496 - DNA, 15 bp, Homo sapiens
aagccatgcgcaaac

SEQ ID NO: 439497 - DNA, 15 bp, Homo sapiens
agccatgcgcaaaca

SEQ ID NO: 439498 - DNA, 15 bp, Homo sapiens
gccatgcgcaaacag

SEQ ID NO: 439499 - DNA, 15 bp, Homo sapiens
ccatgcgcaaacagt

SEQ ID NO: 439500 - DNA, 15 bp, Homo sapiens
catgcgcaaacagtc

SEQ ID NO: 439501 - DNA, 15 bp, Homo sapiens
atgcgcaaacagtct

SEQ ID NO: 439502 - DNA, 15 bp, Homo sapiens
tgcgcaaacagtctt

SEQ ID NO: 439503 - DNA, 15 bp, Homo sapiens
gcgcaaacagtcttc

SEQ ID NO: 439504 - DNA, 15 bp, Homo sapiens
cgcaaacagtcttct

SEQ ID NO: 439505 - DNA, 15 bp, Homo sapiens
gcaaacagtcttctg

SEQ ID NO: 439506 - DNA, 15 bp, Homo sapiens
caaacagtcttctga

SEQ ID NO: 439507 - DNA, 15 bp, Homo sapiens
aaacagtcttctgaa

SEQ ID NO: 439508 - DNA, 15 bp, Homo sapiens
aacagtcttctgaag

SEQ ID NO: 439509 - DNA, 15 bp, Homo sapiens
acagtcttctgaagt

SEQ ID NO: 439510 - DNA, 15 bp, Homo sapiens
cagtcttctgaagtc

SEQ ID NO: 439511 - DNA, 15 bp, Homo sapiens
agtcttctgaagtca

SEQ ID NO: 439512 - DNA, 15 bp, Homo sapiens
gtcttctgaagtcaa

SEQ ID NO: 439513 - DNA, 15 bp, Homo sapiens
tcttctgaagtcaaa

SEQ ID NO: 439514 - DNA, 15 bp, Homo sapiens
cttctgaagtcaaag

SEQ ID NO: 439515 - DNA, 15 bp, Homo sapiens
ttctgaagtcaaaga

SEQ ID NO: 439516 - DNA, 15 bp, Homo sapiens
tctgaagtcaaagaa

SEQ ID NO: 439517 - DNA, 15 bp, Homo sapiens
ctgaagtcaaagaaa

SEQ ID NO: 439518 - DNA, 15 bp, Homo sapiens
tgaagtcaaagaaaa

SEQ ID NO: 439519 - DNA, 15 bp, Homo sapiens
gaagtcaaagaaaaa

SEQ ID NO: 439520 - DNA, 15 bp, Homo sapiens
aagtcaaagaaaaat

SEQ ID NO: 439521 - DNA, 15 bp, Homo sapiens
agtcaaagaaaaatg

SEQ ID NO: 439522 - DNA, 15 bp, Homo sapiens
gtcaaagaaaaatgg

SEQ ID NO: 439523 - DNA, 15 bp, Homo sapiens
tcaaagaaaaatggg

SEQ ID NO: 439524 - DNA, 15 bp, Homo sapiens
caaagaaaaatggga

SEQ ID NO: 439525 - DNA, 15 bp, Homo sapiens
aaagaaaaatgggaa

SEQ ID NO: 439526 - DNA, 15 bp, Homo sapiens
aagaaaaatgggaaa

SEQ ID NO: 439527 - DNA, 15 bp, Homo sapiens
agaaaaatgggaaag

SEQ ID NO: 439528 - DNA, 15 bp, Homo sapiens
gaaaaatgggaaagt

SEQ ID NO: 439529 - DNA, 15 bp, Homo sapiens
aaaaatgggaaagtc

SEQ ID NO: 439530 - DNA, 15 bp, Homo sapiens
aaaatgggaaagtct

SEQ ID NO: 439531 - DNA, 15 bp, Homo sapiens
aaatgggaaagtcta

SEQ ID NO: 439532 - DNA, 15 bp, Homo sapiens
aatgggaaagtctaa

SEQ ID NO: 439533 - DNA, 15 bp, Homo sapiens
atgggaaagtctaaa

SEQ ID NO: 439534 - DNA, 15 bp, Homo sapiens
tgggaaagtctaaat

SEQ ID NO: 439535 - DNA, 15 bp, Homo sapiens
gggaaagtctaaatg

SEQ ID NO: 439536 - DNA, 15 bp, Homo sapiens
ggaaagtctaaatgc

SEQ ID NO: 439537 - DNA, 15 bp, Homo sapiens
gaaagtctaaatgct

SEQ ID NO: 439538 - DNA, 15 bp, Homo sapiens
aaagtctaaatgctg

SEQ ID NO: 439539 - DNA, 15 bp, Homo sapiens
aagtctaaatgctgt

SEQ ID NO: 439540 - DNA, 15 bp, Homo sapiens
agtctaaatgctgta

SEQ ID NO: 439541 - DNA, 15 bp, Homo sapiens
gtctaaatgctgtaa

SEQ ID NO: 439542 - DNA, 15 bp, Homo sapiens
tctaaatgctgtaac

SEQ ID NO: 439543 - DNA, 15 bp, Homo sapiens
ctaaatgctgtaact

SEQ ID NO: 439544 - DNA, 15 bp, Homo sapiens
taaatgctgtaacta

SEQ ID NO: 439545 - DNA, 15 bp, Homo sapiens
aaatgctgtaactag

SEQ ID NO: 439546 - DNA, 15 bp, Homo sapiens
aatgctgtaactagc

SEQ ID NO: 439547 - DNA, 15 bp, Homo sapiens
atgctgtaactagca

SEQ ID NO: 439548 - DNA, 15 bp, Homo sapiens
tgctgtaactagcaa

SEQ ID NO: 439549 - DNA, 15 bp, Homo sapiens
gctgtaactagcaat

SEQ ID NO: 439550 - DNA, 15 bp, Homo sapiens
ctgtaactagcaatt

SEQ ID NO: 439551 - DNA, 15 bp, Homo sapiens
tgtaactagcaattg

SEQ ID NO: 439552 - DNA, 15 bp, Homo sapiens
gtaactagcaattgg

SEQ ID NO: 439553 - DNA, 15 bp, Homo sapiens
taactagcaattggc

SEQ ID NO: 439554 - DNA, 15 bp, Homo sapiens
aactagcaattggca

SEQ ID NO: 439555 - DNA, 15 bp, Homo sapiens
actagcaattggcaa

SEQ ID NO: 439556 - DNA, 15 bp, Homo sapiens
ctagcaattggcaaa

SEQ ID NO: 439557 - DNA, 15 bp, Homo sapiens
tagcaattggcaaaa

SEQ ID NO: 439558 - DNA, 15 bp, Homo sapiens
agcaattggcaaaag

SEQ ID NO: 439559 - DNA, 15 bp, Homo sapiens
gcaattggcaaaagc

SEQ ID NO: 439560 - DNA, 15 bp, Homo sapiens
caattggcaaaagca

SEQ ID NO: 439561 - DNA, 15 bp, Homo sapiens
aattggcaaaagcaa

SEQ ID NO: 439562 - DNA, 15 bp, Homo sapiens
attggcaaaagcaag

SEQ ID NO: 439563 - DNA, 15 bp, Homo sapiens
ttggcaaaagcaagt

SEQ ID NO: 439564 - DNA, 15 bp, Homo sapiens
tggcaaaagcaagtg

SEQ ID NO: 439565 - DNA, 15 bp, Homo sapiens
ggcaaaagcaagtgg

SEQ ID NO: 439566 - DNA, 15 bp, Homo sapiens
gcaaaagcaagtgga

SEQ ID NO: 439567 - DNA, 15 bp, Homo sapiens
caaaagcaagtggac

SEQ ID NO: 439568 - DNA, 15 bp, Homo sapiens
aaaagcaagtggaca

SEQ ID NO: 439569 - DNA, 15 bp, Homo sapiens
aaagcaagtggacaa

SEQ ID NO: 439570 - DNA, 15 bp, Homo sapiens
aagcaagtggacaag

SEQ ID NO: 439571 - DNA, 15 bp, Homo sapiens
agcaagtggacaagg

SEQ ID NO: 439572 - DNA, 15 bp, Homo sapiens
gcaagtggacaaggc

SEQ ID NO: 439573 - DNA, 15 bp, Homo sapiens
caagtggacaaggca

SEQ ID NO: 439574 - DNA, 15 bp, Homo sapiens
aagtggacaaggcat

SEQ ID NO: 439575 - DNA, 15 bp, Homo sapiens
agtggacaaggcatt

SEQ ID NO: 439576 - DNA, 15 bp, Homo sapiens
gtggacaaggcattg

SEQ ID NO: 439577 - DNA, 15 bp, Homo sapiens
tggacaaggcattgg

SEQ ID NO: 439578 - DNA, 15 bp, Homo sapiens
ggacaaggcattgga

SEQ ID NO: 439579 - DNA, 15 bp, Homo sapiens
gacaaggcattggag

SEQ ID NO: 439580 - DNA, 15 bp, Homo sapiens
acaaggcattggaga

SEQ ID NO: 439581 - DNA, 15 bp, Homo sapiens
caaggcattggagaa

SEQ ID NO: 439582 - DNA, 15 bp, Homo sapiens
aaggcattggagaaa

SEQ ID NO: 439583 - DNA, 15 bp, Homo sapiens
aggcattggagaaac

SEQ ID NO: 439584 - DNA, 15 bp, Homo sapiens
ggcattggagaaact

SEQ ID NO: 439585 - DNA, 15 bp, Homo sapiens
gcattggagaaactc

SEQ ID NO: 439586 - DNA, 15 bp, Homo sapiens
cattggagaaactca

SEQ ID NO: 439587 - DNA, 15 bp, Homo sapiens
attggagaaactcag

SEQ ID NO: 439588 - DNA, 15 bp, Homo sapiens
ttggagaaactcaga

SEQ ID NO: 439589 - DNA, 15 bp, Homo sapiens
tggagaaactcagag

SEQ ID NO: 439590 - DNA, 15 bp, Homo sapiens
ggagaaactcagaga

SEQ ID NO: 439591 - DNA, 15 bp, Homo sapiens
gagaaactcagagac

SEQ ID NO: 439592 - DNA, 15 bp, Homo sapiens
agaaactcagagacc

SEQ ID NO: 439593 - DNA, 15 bp, Homo sapiens
gaaactcagagacct

SEQ ID NO: 439594 - DNA, 15 bp, Homo sapiens
aaactcagagacctg

SEQ ID NO: 439595 - DNA, 15 bp, Homo sapiens
aactcagagacctgc

SEQ ID NO: 439596 - DNA, 15 bp, Homo sapiens
actcagagacctgca

SEQ ID NO: 439597 - DNA, 15 bp, Homo sapiens
ctcagagacctgcag

SEQ ID NO: 439598 - DNA, 15 bp, Homo sapiens
tcagagacctgcagg

SEQ ID NO: 439599 - DNA, 15 bp, Homo sapiens
cagagacctgcaggg

SEQ ID NO: 439600 - DNA, 15 bp, Homo sapiens
agagacctgcaggga

SEQ ID NO: 439601 - DNA, 15 bp, Homo sapiens
gagacctgcagggag

SEQ ID NO: 439602 - DNA, 15 bp, Homo sapiens
agacctgcagggagc

SEQ ID NO: 439603 - DNA, 15 bp, Homo sapiens
gacctgcagggagct

SEQ ID NO: 439604 - DNA, 15 bp, Homo sapiens
acctgcagggagcta

SEQ ID NO: 439605 - DNA, 15 bp, Homo sapiens
cctgcagggagctat

SEQ ID NO: 439606 - DNA, 15 bp, Homo sapiens
ctgcagggagctatg

SEQ ID NO: 439607 - DNA, 15 bp, Homo sapiens
tgcagggagctatgg

SEQ ID NO: 439608 - DNA, 15 bp, Homo sapiens
gcagggagctatgga

SEQ ID NO: 439609 - DNA, 15 bp, Homo sapiens
cagggagctatggat

SEQ ID NO: 439610 - DNA, 15 bp, Homo sapiens
agggagctatggatg

SEQ ID NO: 439611 - DNA, 15 bp, Homo sapiens
gggagctatggatga

SEQ ID NO: 439612 - DNA, 15 bp, Homo sapiens
ggagctatggatgac

SEQ ID NO: 439613 - DNA, 15 bp, Homo sapiens
gagctatggatgacc

SEQ ID NO: 439614 - DNA, 15 bp, Homo sapiens
agctatggatgacct

SEQ ID NO: 439615 - DNA, 15 bp, Homo sapiens
gctatggatgacctg

SEQ ID NO: 439616 - DNA, 15 bp, Homo sapiens
ctatggatgacctgg

SEQ ID NO: 439617 - DNA, 15 bp, Homo sapiens
tatggatgacctgga

SEQ ID NO: 439618 - DNA, 15 bp, Homo sapiens
atggatgacctggac

SEQ ID NO: 439619 - DNA, 15 bp, Homo sapiens
tggatgacctggacg

SEQ ID NO: 439620 - DNA, 15 bp, Homo sapiens
ggatgacctggacgc

SEQ ID NO: 439621 - DNA, 15 bp, Homo sapiens
gatgacctggacgct

SEQ ID NO: 439622 - DNA, 15 bp, Homo sapiens
atgacctggacgctg

SEQ ID NO: 439623 - DNA, 15 bp, Homo sapiens
tgacctggacgctga

SEQ ID NO: 439624 - DNA, 15 bp, Homo sapiens
gacctggacgctgac

SEQ ID NO: 439625 - DNA, 15 bp, Homo sapiens
acctggacgctgaca

SEQ ID NO: 439626 - DNA, 15 bp, Homo sapiens
cctggacgctgacat

SEQ ID NO: 439627 - DNA, 15 bp, Homo sapiens
ctggacgctgacatg

SEQ ID NO: 439628 - DNA, 15 bp, Homo sapiens
tggacgctgacatga

SEQ ID NO: 439629 - DNA, 15 bp, Homo sapiens
ggacgctgacatgaa

SEQ ID NO: 439630 - DNA, 15 bp, Homo sapiens
gacgctgacatgaag

SEQ ID NO: 439631 - DNA, 15 bp, Homo sapiens
acgctgacatgaagg

SEQ ID NO: 439632 - DNA, 15 bp, Homo sapiens
cgctgacatgaagga

SEQ ID NO: 439633 - DNA, 15 bp, Homo sapiens
gctgacatgaaggag

SEQ ID NO: 439634 - DNA, 15 bp, Homo sapiens
ctgacatgaaggagg

SEQ ID NO: 439635 - DNA, 15 bp, Homo sapiens
tgacatgaaggaggc

SEQ ID NO: 439636 - DNA, 15 bp, Homo sapiens
gacatgaaggaggca

SEQ ID NO: 439637 - DNA, 15 bp, Homo sapiens
acatgaaggaggcag

SEQ ID NO: 439638 - DNA, 15 bp, Homo sapiens
tgaaggaggcagagt

SEQ ID NO: 439639 - DNA, 15 bp, Homo sapiens
gaaggaggcagagtc

SEQ ID NO: 439640 - DNA, 15 bp, Homo sapiens
aaggaggcagagtcc

SEQ ID NO: 439641 - DNA, 15 bp, Homo sapiens
aggaggcagagtccg

SEQ ID NO: 439642 - DNA, 15 bp, Homo sapiens
ggaggcagagtccgt

SEQ ID NO: 439643 - DNA, 15 bp, Homo sapiens
gaggcagagtccgtg

SEQ ID NO: 439644 - DNA, 15 bp, Homo sapiens
aggcagagtccgtgc

SEQ ID NO: 439645 - DNA, 15 bp, Homo sapiens
ggcagagtccgtgcg

SEQ ID NO: 439646 - DNA, 15 bp, Homo sapiens
gcagagtccgtgcgg

SEQ ID NO: 439647 - DNA, 15 bp, Homo sapiens
cagagtccgtgcgga

SEQ ID NO: 439648 - DNA, 15 bp, Homo sapiens
agagtccgtgcggaa

SEQ ID NO: 439649 - DNA, 15 bp, Homo sapiens
gagtccgtgcggaat

SEQ ID NO: 439650 - DNA, 15 bp, Homo sapiens
agtccgtgcggaatg

SEQ ID NO: 439651 - DNA, 15 bp, Homo sapiens
gtccgtgcggaatgg

SEQ ID NO: 439652 - DNA, 15 bp, Homo sapiens
tccgtgcggaatggc

SEQ ID NO: 439653 - DNA, 15 bp, Homo sapiens
ccgtgcggaatggct

SEQ ID NO: 439654 - DNA, 15 bp, Homo sapiens
cgtgcggaatggctg

SEQ ID NO: 439655 - DNA, 15 bp, Homo sapiens
gtgcggaatggctgg

SEQ ID NO: 439656 - DNA, 15 bp, Homo sapiens
tgcggaatggctgga

SEQ ID NO: 439657 - DNA, 15 bp, Homo sapiens
gcggaatggctggaa

SEQ ID NO: 439658 - DNA, 15 bp, Homo sapiens
cggaatggctggaag

SEQ ID NO: 439659 - DNA, 15 bp, Homo sapiens
ggaatggctggaagc

SEQ ID NO: 439660 - DNA, 15 bp, Homo sapiens
gaatggctggaagcc

SEQ ID NO: 439661 - DNA, 15 bp, Homo sapiens
aatggctggaagccc

SEQ ID NO: 439662 - DNA, 15 bp, Homo sapiens
atggctggaagcccg

SEQ ID NO: 439663 - DNA, 15 bp, Homo sapiens
tggctggaagcccgt

SEQ ID NO: 439664 - DNA, 15 bp, Homo sapiens
ggctggaagcccgtg

SEQ ID NO: 439665 - DNA, 15 bp, Homo sapiens
gctggaagcccgtgg

SEQ ID NO: 439666 - DNA, 15 bp, Homo sapiens
ctggaagcccgtggg

SEQ ID NO: 439667 - DNA, 15 bp, Homo sapiens
tggaagcccgtggga

SEQ ID NO: 439668 - DNA, 15 bp, Homo sapiens
ggaagcccgtgggag

SEQ ID NO: 439669 - DNA, 15 bp, Homo sapiens
gaagcccgtgggaga

SEQ ID NO: 439670 - DNA, 15 bp, Homo sapiens
aagcccgtgggagac

SEQ ID NO: 439671 - DNA, 15 bp, Homo sapiens
agcccgtgggagact

SEQ ID NO: 439672 - DNA, 15 bp, Homo sapiens
gcccgtgggagactt

SEQ ID NO: 439673 - DNA, 15 bp, Homo sapiens
cccgtgggagactta

SEQ ID NO: 439674 - DNA, 15 bp, Homo sapiens
ccgtgggagacttac

SEQ ID NO: 439675 - DNA, 15 bp, Homo sapiens
cgtgggagacttact

SEQ ID NO: 439676 - DNA, 15 bp, Homo sapiens
gtgggagacttactc

SEQ ID NO: 439677 - DNA, 15 bp, Homo sapiens
tgggagacttactca

SEQ ID NO: 439678 - DNA, 15 bp, Homo sapiens
gggagacttactcat

SEQ ID NO: 439679 - DNA, 15 bp, Homo sapiens
ggagacttactcatt

SEQ ID NO: 439680 - DNA, 15 bp, Homo sapiens
gagacttactcattg

SEQ ID NO: 439681 - DNA, 15 bp, Homo sapiens
agacttactcattga

SEQ ID NO: 439682 - DNA, 15 bp, Homo sapiens
gacttactcattgac

SEQ ID NO: 439683 - DNA, 15 bp, Homo sapiens
acttactcattgact

SEQ ID NO: 439684 - DNA, 15 bp, Homo sapiens
cttactcattgactc

SEQ ID NO: 439685 - DNA, 15 bp, Homo sapiens
ttactcattgactcg

SEQ ID NO: 439686 - DNA, 15 bp, Homo sapiens
tactcattgactcgc

SEQ ID NO: 439687 - DNA, 15 bp, Homo sapiens
actcattgactcgct

SEQ ID NO: 439688 - DNA, 15 bp, Homo sapiens
ctcattgactcgctg

SEQ ID NO: 439689 - DNA, 15 bp, Homo sapiens
tcattgactcgctgc

SEQ ID NO: 439690 - DNA, 15 bp, Homo sapiens
cattgactcgctgca

SEQ ID NO: 439691 - DNA, 15 bp, Homo sapiens
attgactcgctgcag

SEQ ID NO: 439692 - DNA, 15 bp, Homo sapiens
ttgactcgctgcagg

SEQ ID NO: 439693 - DNA, 15 bp, Homo sapiens
tgactcgctgcagga

SEQ ID NO: 439694 - DNA, 15 bp, Homo sapiens
gactcgctgcaggat

SEQ ID NO: 439695 - DNA, 15 bp, Homo sapiens
actcgctgcaggatc

SEQ ID NO: 439696 - DNA, 15 bp, Homo sapiens
ctcgctgcaggatca

SEQ ID NO: 439697 - DNA, 15 bp, Homo sapiens
tcgctgcaggatcac

SEQ ID NO: 439698 - DNA, 15 bp, Homo sapiens
cgctgcaggatcaca

SEQ ID NO: 439699 - DNA, 15 bp, Homo sapiens
gctgcaggatcacat

SEQ ID NO: 439700 - DNA, 15 bp, Homo sapiens
ctgcaggatcacatt

SEQ ID NO: 439701 - DNA, 15 bp, Homo sapiens
tgcaggatcacattg

SEQ ID NO: 439702 - DNA, 15 bp, Homo sapiens
gcaggatcacattga

SEQ ID NO: 439703 - DNA, 15 bp, Homo sapiens
caggatcacattgaa

SEQ ID NO: 439704 - DNA, 15 bp, Homo sapiens
aggatcacattgaaa

SEQ ID NO: 439705 - DNA, 15 bp, Homo sapiens
ggatcacattgaaaa

SEQ ID NO: 439706 - DNA, 15 bp, Homo sapiens
gatcacattgaaaaa

SEQ ID NO: 439707 - DNA, 15 bp, Homo sapiens
atcacattgaaaaaa

SEQ ID NO: 439708 - DNA, 15 bp, Homo sapiens
tcacattgaaaaaat

SEQ ID NO: 439709 - DNA, 15 bp, Homo sapiens
cacattgaaaaaatc

SEQ ID NO: 439710 - DNA, 15 bp, Homo sapiens
acattgaaaaaatca

SEQ ID NO: 439711 - DNA, 15 bp, Homo sapiens
cattgaaaaaatcat

SEQ ID NO: 439712 - DNA, 15 bp, Homo sapiens
attgaaaaaatcatg

SEQ ID NO: 439713 - DNA, 15 bp, Homo sapiens
ttgaaaaaatcatgg

SEQ ID NO: 439714 - DNA, 15 bp, Homo sapiens
tgaaaaaatcatggt

SEQ ID NO: 439715 - DNA, 15 bp, Homo sapiens
gaaaaaatcatggtc

SEQ ID NO: 439716 - DNA, 15 bp, Homo sapiens
aaaaaatcatggtca

SEQ ID NO: 439717 - DNA, 15 bp, Homo sapiens
aaaaatcatggtcag

SEQ ID NO: 439718 - DNA, 15 bp, Homo sapiens
aaaatcatggtcagc

SEQ ID NO: 439719 - DNA, 15 bp, Homo sapiens
aaatcatggtcagca

SEQ ID NO: 439720 - DNA, 15 bp, Homo sapiens
aatcatggtcagcat

SEQ ID NO: 439721 - DNA, 15 bp, Homo sapiens
atcatggtcagcatc

SEQ ID NO: 439722 - DNA, 15 bp, Homo sapiens
tcatggtcagcatca

SEQ ID NO: 439723 - DNA, 15 bp, Homo sapiens
catggtcagcatcat

SEQ ID NO: 439724 - DNA, 15 bp, Homo sapiens
atggtcagcatcatt

SEQ ID NO: 439725 - DNA, 15 bp, Homo sapiens
tggtcagcatcattg

SEQ ID NO: 439726 - DNA, 15 bp, Homo sapiens
ggtcagcatcattgt

SEQ ID NO: 439727 - DNA, 15 bp, Homo sapiens
gtcagcatcattgtc

SEQ ID NO: 439728 - DNA, 15 bp, Homo sapiens
tcagcatcattgtct

SEQ ID NO: 439729 - DNA, 15 bp, Homo sapiens
cagcatcattgtctt

SEQ ID NO: 439730 - DNA, 15 bp, Homo sapiens
agcatcattgtcttt

SEQ ID NO: 439731 - DNA, 15 bp, Homo sapiens
gcatcattgtctttg

SEQ ID NO: 439732 - DNA, 15 bp, Homo sapiens
catcattgtctttga

SEQ ID NO: 439733 - DNA, 15 bp, Homo sapiens
atcattgtctttgaa

SEQ ID NO: 439734 - DNA, 15 bp, Homo sapiens
tcattgtctttgaag

SEQ ID NO: 439735 - DNA, 15 bp, Homo sapiens
cattgtctttgaagg

SEQ ID NO: 439736 - DNA, 15 bp, Homo sapiens
attgtctttgaagga

SEQ ID NO: 439737 - DNA, 15 bp, Homo sapiens
ttgtctttgaaggat

SEQ ID NO: 439738 - DNA, 15 bp, Homo sapiens
tgtctttgaaggatt

SEQ ID NO: 439739 - DNA, 15 bp, Homo sapiens
gtctttgaaggattt

SEQ ID NO: 439740 - DNA, 15 bp, Homo sapiens
tctttgaaggatttt

SEQ ID NO: 439741 - DNA, 15 bp, Homo sapiens
ctttgaaggattttt

SEQ ID NO: 439742 - DNA, 15 bp, Homo sapiens
tttgaaggattttta

SEQ ID NO: 439743 - DNA, 15 bp, Homo sapiens
ttgaaggatttttaa

SEQ ID NO: 439744 - DNA, 15 bp, Homo sapiens
tgaaggatttttaag

SEQ ID NO: 439745 - DNA, 15 bp, Homo sapiens
gaaggatttttaaga

SEQ ID NO: 439746 - DNA, 15 bp, Homo sapiens
aaggatttttaagaa

SEQ ID NO: 439747 - DNA, 15 bp, Homo sapiens
aggatttttaagaaa

SEQ ID NO: 439748 - DNA, 15 bp, Homo sapiens
ggatttttaagaaat

SEQ ID NO: 439749 - DNA, 15 bp, Homo sapiens
gatttttaagaaatg

SEQ ID NO: 439750 - DNA, 15 bp, Homo sapiens
atttttaagaaatgt

SEQ ID NO: 439751 - DNA, 15 bp, Homo sapiens
tttttaagaaatgtt

SEQ ID NO: 439752 - DNA, 15 bp, Homo sapiens
ttttaagaaatgttt

SEQ ID NO: 439753 - DNA, 15 bp, Homo sapiens
tttaagaaatgtttt

SEQ ID NO: 439754 - DNA, 15 bp, Homo sapiens
ttaagaaatgttttc

SEQ ID NO: 439755 - DNA, 15 bp, Homo sapiens
taagaaatgttttct

SEQ ID NO: 439756 - DNA, 15 bp, Homo sapiens
aagaaatgttttctt

SEQ ID NO: 439757 - DNA, 15 bp, Homo sapiens
agaaatgttttcttg

SEQ ID NO: 439758 - DNA, 15 bp, Homo sapiens
gaaatgttttcttgt

SEQ ID NO: 439759 - DNA, 15 bp, Homo sapiens
aaatgttttcttgtt

SEQ ID NO: 439760 - DNA, 15 bp, Homo sapiens
aatgttttcttgtta

SEQ ID NO: 439761 - DNA, 15 bp, Homo sapiens
atgttttcttgttaa

SEQ ID NO: 439762 - DNA, 15 bp, Homo sapiens
tgttttcttgttaaa

SEQ ID NO: 439763 - DNA, 15 bp, Homo sapiens
gttttcttgttaaat

SEQ ID NO: 439764 - DNA, 15 bp, Homo sapiens
ttttcttgttaaata

SEQ ID NO: 439765 - DNA, 15 bp, Homo sapiens
tttcttgttaaatat

SEQ ID NO: 439766 - DNA, 15 bp, Homo sapiens
ttcttgttaaatata

SEQ ID NO: 439767 - DNA, 15 bp, Homo sapiens
tcttgttaaatataa

SEQ ID NO: 439768 - DNA, 15 bp, Homo sapiens
cttgttaaatataac

SEQ ID NO: 439769 - DNA, 15 bp, Homo sapiens
ttgttaaatataaca

SEQ ID NO: 439770 - DNA, 15 bp, Homo sapiens
tgttaaatataacac

SEQ ID NO: 439771 - DNA, 15 bp, Homo sapiens
gttaaatataacaca

SEQ ID NO: 439772 - DNA, 15 bp, Homo sapiens
ttaaatataacacaa

SEQ ID NO: 439773 - DNA, 15 bp, Homo sapiens
taaatataacacaaa

SEQ ID NO: 439774 - DNA, 15 bp, Homo sapiens
aaatataacacaaat

SEQ ID NO: 439775 - DNA, 15 bp, Homo sapiens
aatataacacaaata

SEQ ID NO: 439776 - DNA, 15 bp, Homo sapiens
atataacacaaataa

SEQ ID NO: 439777 - DNA, 15 bp, Homo sapiens
tataacacaaataaa

SEQ ID NO: 439778 - DNA, 15 bp, Homo sapiens
ataacacaaataaag

SEQ ID NO: 439779 - DNA, 15 bp, Homo sapiens
taacacaaataaaga

SEQ ID NO: 439780 - DNA, 15 bp, Homo sapiens
aacacaaataaagag

SEQ ID NO: 439781 - DNA, 15 bp, Homo sapiens
acacaaataaagaga

SEQ ID NO: 439782 - DNA, 15 bp, Homo sapiens
cacaaataaagagag

SEQ ID NO: 439783 - DNA, 15 bp, Homo sapiens
acaaataaagagagc

SEQ ID NO: 439784 - DNA, 15 bp, Homo sapiens
caaataaagagagcc

SEQ ID NO: 439785 - DNA, 15 bp, Homo sapiens
aaataaagagagcca

SEQ ID NO: 439786 - DNA, 15 bp, Homo sapiens
aataaagagagccac

SEQ ID NO: 439787 - DNA, 15 bp, Homo sapiens
ataaagagagccacg

SEQ ID NO: 439788 - DNA, 15 bp, Homo sapiens
taaagagagccacgt

SEQ ID NO: 439789 - DNA, 15 bp, Homo sapiens
aaagagagccacgta

SEQ ID NO: 439790 - DNA, 15 bp, Homo sapiens
aagagagccacgtat

SEQ ID NO: 439791 - DNA, 15 bp, Homo sapiens
agagagccacgtata

SEQ ID NO: 439792 - DNA, 15 bp, Homo sapiens
gagagccacgtatat

SEQ ID NO: 439793 - DNA, 15 bp, Homo sapiens
agagccacgtatata

SEQ ID NO: 439794 - DNA, 15 bp, Homo sapiens
gagccacgtatataa

SEQ ID NO: 439795 - DNA, 15 bp, Homo sapiens
agccacgtatataaa

SEQ ID NO: 439796 - DNA, 15 bp, Homo sapiens
gccacgtatataaat

SEQ ID NO: 439797 - DNA, 15 bp, Homo sapiens
ccacgtatataaatt

SEQ ID NO: 439798 - DNA, 15 bp, Homo sapiens
cacgtatataaattg

SEQ ID NO: 439799 - DNA, 15 bp, Homo sapiens
acgtatataaattgt

SEQ ID NO: 439800 - DNA, 15 bp, Homo sapiens
cgtatataaattgtt

SEQ ID NO: 439801 - DNA, 15 bp, Homo sapiens
gtatataaattgtta

SEQ ID NO: 439802 - DNA, 15 bp, Homo sapiens
tatataaattgttat

SEQ ID NO: 439803 - DNA, 15 bp, Homo sapiens
atataaattgttata

SEQ ID NO: 439804 - DNA, 15 bp, Homo sapiens
tataaattgttataa

SEQ ID NO: 439805 - DNA, 15 bp, Homo sapiens
ataaattgttataag

SEQ ID NO: 439806 - DNA, 15 bp, Homo sapiens
taaattgttataagg

SEQ ID NO: 439807 - DNA, 15 bp, Homo sapiens
aaattgttataaggg

SEQ ID NO: 439808 - DNA, 15 bp, Homo sapiens
aattgttataaggga

SEQ ID NO: 439809 - DNA, 15 bp, Homo sapiens
attgttataagggat

SEQ ID NO: 439810 - DNA, 15 bp, Homo sapiens
ttgttataagggatt

SEQ ID NO: 439811 - DNA, 15 bp, Homo sapiens
tgttataagggattg

SEQ ID NO: 439812 - DNA, 15 bp, Homo sapiens
gttataagggattgt

SEQ ID NO: 439813 - DNA, 15 bp, Homo sapiens
ttataagggattgtt

SEQ ID NO: 439814 - DNA, 15 bp, Homo sapiens
tataagggattgtta

SEQ ID NO: 439815 - DNA, 15 bp, Homo sapiens
ataagggattgttac

SEQ ID NO: 439816 - DNA, 15 bp, Homo sapiens
taagggattgttaca

SEQ ID NO: 439817 - DNA, 15 bp, Homo sapiens
aagggattgttacaa

SEQ ID NO: 439818 - DNA, 15 bp, Homo sapiens
agggattgttacaaa

SEQ ID NO: 439819 - DNA, 15 bp, Homo sapiens
gggattgttacaaag

SEQ ID NO: 439820 - DNA, 15 bp, Homo sapiens
ggattgttacaaagc

SEQ ID NO: 439821 - DNA, 15 bp, Homo sapiens
gattgttacaaagcc

SEQ ID NO: 439822 - DNA, 15 bp, Homo sapiens
attgttacaaagcca

SEQ ID NO: 439823 - DNA, 15 bp, Homo sapiens
ttgttacaaagccaa

SEQ ID NO: 439824 - DNA, 15 bp, Homo sapiens
tgttacaaagccaac

SEQ ID NO: 439825 - DNA, 15 bp, Homo sapiens
gttacaaagccaacg

SEQ ID NO: 439826 - DNA, 15 bp, Homo sapiens
ttacaaagccaacgc

SEQ ID NO: 439827 - DNA, 15 bp, Homo sapiens
tacaaagccaacgcc

SEQ ID NO: 439828 - DNA, 15 bp, Homo sapiens
acaaagccaacgccg

SEQ ID NO: 439829 - DNA, 15 bp, Homo sapiens
caaagccaacgccgc

SEQ ID NO: 439830 - DNA, 15 bp, Homo sapiens
aaagccaacgccgct

SEQ ID NO: 439831 - DNA, 15 bp, Homo sapiens
aagccaacgccgctg

SEQ ID NO: 439832 - DNA, 15 bp, Homo sapiens
agccaacgccgctgc

SEQ ID NO: 439833 - DNA, 15 bp, Homo sapiens
gccaacgccgctgca

SEQ ID NO: 439834 - DNA, 15 bp, Homo sapiens
ccaacgccgctgcaa

SEQ ID NO: 439835 - DNA, 15 bp, Homo sapiens
caacgccgctgcaac

SEQ ID NO: 439836 - DNA, 15 bp, Homo sapiens
aacgccgctgcaacc

SEQ ID NO: 439837 - DNA, 15 bp, Homo sapiens
acgccgctgcaaccc

SEQ ID NO: 439838 - DNA, 15 bp, Homo sapiens
cgccgctgcaacccc

SEQ ID NO: 439839 - DNA, 15 bp, Homo sapiens
gccgctgcaacccca

SEQ ID NO: 439840 - DNA, 15 bp, Homo sapiens
ccgctgcaaccccac

SEQ ID NO: 439841 - DNA, 15 bp, Homo sapiens
cgctgcaaccccacc

SEQ ID NO: 439842 - DNA, 15 bp, Homo sapiens
gctgcaaccccaccc

SEQ ID NO: 439843 - DNA, 15 bp, Homo sapiens
ctgcaaccccaccca

SEQ ID NO: 439844 - DNA, 15 bp, Homo sapiens
tgcaaccccacccat

SEQ ID NO: 439845 - DNA, 15 bp, Homo sapiens
gcaaccccacccatc

SEQ ID NO: 439846 - DNA, 15 bp, Homo sapiens
caaccccacccatca

SEQ ID NO: 439847 - DNA, 15 bp, Homo sapiens
aaccccacccatcag

SEQ ID NO: 439848 - DNA, 15 bp, Homo sapiens
accccacccatcagg

SEQ ID NO: 439849 - DNA, 15 bp, Homo sapiens
ccccacccatcagga

SEQ ID NO: 439850 - DNA, 15 bp, Homo sapiens
cccacccatcaggag

SEQ ID NO: 439851 - DNA, 15 bp, Homo sapiens
ccacccatcaggagt

SEQ ID NO: 439852 - DNA, 15 bp, Homo sapiens
cacccatcaggagtc

SEQ ID NO: 439853 - DNA, 15 bp, Homo sapiens
acccatcaggagtca

SEQ ID NO: 439854 - DNA, 15 bp, Homo sapiens
cccatcaggagtcag

SEQ ID NO: 439855 - DNA, 15 bp, Homo sapiens
ccatcaggagtcagg

SEQ ID NO: 439856 - DNA, 15 bp, Homo sapiens
catcaggagtcagga

SEQ ID NO: 439857 - DNA, 15 bp, Homo sapiens
atcaggagtcaggac

SEQ ID NO: 439858 - DNA, 15 bp, Homo sapiens
tcaggagtcaggaca

SEQ ID NO: 439859 - DNA, 15 bp, Homo sapiens
caggagtcaggacag

SEQ ID NO: 439860 - DNA, 15 bp, Homo sapiens
aggagtcaggacagg

SEQ ID NO: 439861 - DNA, 15 bp, Homo sapiens
ggagtcaggacaggt

SEQ ID NO: 439862 - DNA, 15 bp, Homo sapiens
gagtcaggacaggtg

SEQ ID NO: 439863 - DNA, 15 bp, Homo sapiens
agtcaggacaggtgc

SEQ ID NO: 439864 - DNA, 15 bp, Homo sapiens
gtcaggacaggtgct

SEQ ID NO: 439865 - DNA, 15 bp, Homo sapiens
tcaggacaggtgctt

SEQ ID NO: 439866 - DNA, 15 bp, Homo sapiens
caggacaggtgcttt

SEQ ID NO: 439867 - DNA, 15 bp, Homo sapiens
aggacaggtgctttc

SEQ ID NO: 439868 - DNA, 15 bp, Homo sapiens
ggacaggtgctttcc

SEQ ID NO: 439869 - DNA, 15 bp, Homo sapiens
gacaggtgctttcca

SEQ ID NO: 439870 - DNA, 15 bp, Homo sapiens
acaggtgctttccat

SEQ ID NO: 439871 - DNA, 15 bp, Homo sapiens
caggtgctttccata

SEQ ID NO: 439872 - DNA, 15 bp, Homo sapiens
aggtgctttccatat

SEQ ID NO: 439873 - DNA, 15 bp, Homo sapiens
ggtgctttccatatg

SEQ ID NO: 439874 - DNA, 15 bp, Homo sapiens
gtgctttccatatga

SEQ ID NO: 439875 - DNA, 15 bp, Homo sapiens
tgctttccatatgac

SEQ ID NO: 439876 - DNA, 15 bp, Homo sapiens
gctttccatatgacc

SEQ ID NO: 439877 - DNA, 15 bp, Homo sapiens
ctttccatatgaccc

SEQ ID NO: 439878 - DNA, 15 bp, Homo sapiens
tttccatatgaccct

SEQ ID NO: 439879 - DNA, 15 bp, Homo sapiens
ttccatatgaccctc

SEQ ID NO: 439880 - DNA, 15 bp, Homo sapiens
tccatatgaccctca

SEQ ID NO: 439881 - DNA, 15 bp, Homo sapiens
ccatatgaccctcat

SEQ ID NO: 439882 - DNA, 15 bp, Homo sapiens
catatgaccctcatt

SEQ ID NO: 439883 - DNA, 15 bp, Homo sapiens
atatgaccctcattg

SEQ ID NO: 439884 - DNA, 15 bp, Homo sapiens
tatgaccctcattgg

SEQ ID NO: 439885 - DNA, 15 bp, Homo sapiens
atgaccctcattggg

SEQ ID NO: 439886 - DNA, 15 bp, Homo sapiens
tgaccctcattgggg

SEQ ID NO: 439887 - DNA, 15 bp, Homo sapiens
gaccctcattggggt

SEQ ID NO: 439888 - DNA, 15 bp, Homo sapiens
accctcattggggtt

SEQ ID NO: 439889 - DNA, 15 bp, Homo sapiens
ccctcattggggttc

SEQ ID NO: 439890 - DNA, 15 bp, Homo sapiens
cctcattggggttca

SEQ ID NO: 439891 - DNA, 15 bp, Homo sapiens
ctcattggggttcat

SEQ ID NO: 439892 - DNA, 15 bp, Homo sapiens
tcattggggttcatt

SEQ ID NO: 439893 - DNA, 15 bp, Homo sapiens
cattggggttcattg

SEQ ID NO: 439894 - DNA, 15 bp, Homo sapiens
attggggttcattgg

SEQ ID NO: 439895 - DNA, 15 bp, Homo sapiens
ttggggttcattgga

SEQ ID NO: 439896 - DNA, 15 bp, Homo sapiens
tggggttcattggaa

SEQ ID NO: 439897 - DNA, 15 bp, Homo sapiens
ggggttcattggaac

SEQ ID NO: 439898 - DNA, 15 bp, Homo sapiens
gggttcattggaacc

SEQ ID NO: 439899 - DNA, 15 bp, Homo sapiens
ggttcattggaaccc

SEQ ID NO: 439900 - DNA, 15 bp, Homo sapiens
gttcattggaacccc

SEQ ID NO: 439901 - DNA, 15 bp, Homo sapiens
ttcattggaaccccc

SEQ ID NO: 439902 - DNA, 15 bp, Homo sapiens
tcattggaaccccct

SEQ ID NO: 439903 - DNA, 15 bp, Homo sapiens
cattggaaccccctg

SEQ ID NO: 439904 - DNA, 15 bp, Homo sapiens
attggaaccccctgc

SEQ ID NO: 439905 - DNA, 15 bp, Homo sapiens
ttggaaccccctgcc

SEQ ID NO: 439906 - DNA, 15 bp, Homo sapiens
tggaaccccctgccc

SEQ ID NO: 439907 - DNA, 15 bp, Homo sapiens
ggaaccccctgcccc

SEQ ID NO: 439908 - DNA, 15 bp, Homo sapiens
gaaccccctgccccc

SEQ ID NO: 439909 - DNA, 15 bp, Homo sapiens
aaccccctgccccca

SEQ ID NO: 439910 - DNA, 15 bp, Homo sapiens
accccctgcccccaa

SEQ ID NO: 439911 - DNA, 15 bp, Homo sapiens
ccccctgcccccaaa

SEQ ID NO: 439912 - DNA, 15 bp, Homo sapiens
cccctgcccccaaat

SEQ ID NO: 439913 - DNA, 15 bp, Homo sapiens
ccctgcccccaaata

SEQ ID NO: 439914 - DNA, 15 bp, Homo sapiens
cctgcccccaaataa

SEQ ID NO: 439915 - DNA, 15 bp, Homo sapiens
ctgcccccaaataac

SEQ ID NO: 439916 - DNA, 15 bp, Homo sapiens
tgcccccaaataaca

SEQ ID NO: 439917 - DNA, 15 bp, Homo sapiens
gcccccaaataacaa

SEQ ID NO: 439918 - DNA, 15 bp, Homo sapiens
cccccaaataacaac

SEQ ID NO: 439919 - DNA, 15 bp, Homo sapiens
ccccaaataacaact

SEQ ID NO: 439920 - DNA, 15 bp, Homo sapiens
cccaaataacaacta

SEQ ID NO: 439921 - DNA, 15 bp, Homo sapiens
ccaaataacaactaa

SEQ ID NO: 439922 - DNA, 15 bp, Homo sapiens
caaataacaactaat

SEQ ID NO: 439923 - DNA, 15 bp, Homo sapiens
aaataacaactaatg

SEQ ID NO: 439924 - DNA, 15 bp, Homo sapiens
aataacaactaatgc

SEQ ID NO: 439925 - DNA, 15 bp, Homo sapiens
ataacaactaatgca

SEQ ID NO: 439926 - DNA, 15 bp, Homo sapiens
taacaactaatgcaa

SEQ ID NO: 439927 - DNA, 15 bp, Homo sapiens
aacaactaatgcaac

SEQ ID NO: 439928 - DNA, 15 bp, Homo sapiens
acaactaatgcaact

SEQ ID NO: 439929 - DNA, 15 bp, Homo sapiens
caactaatgcaactt

SEQ ID NO: 439930 - DNA, 15 bp, Homo sapiens
aactaatgcaacttt

SEQ ID NO: 439931 - DNA, 15 bp, Homo sapiens
actaatgcaactttt

SEQ ID NO: 439932 - DNA, 15 bp, Homo sapiens
ctaatgcaactttta

SEQ ID NO: 439933 - DNA, 15 bp, Homo sapiens
taatgcaacttttat

SEQ ID NO: 439934 - DNA, 15 bp, Homo sapiens
aatgcaacttttatg

SEQ ID NO: 439935 - DNA, 15 bp, Homo sapiens
atgcaacttttatga

SEQ ID NO: 439936 - DNA, 15 bp, Homo sapiens
tgcaacttttatgat

SEQ ID NO: 439937 - DNA, 15 bp, Homo sapiens
gcaacttttatgata

SEQ ID NO: 439938 - DNA, 15 bp, Homo sapiens
caacttttatgataa

SEQ ID NO: 439939 - DNA, 15 bp, Homo sapiens
aacttttatgataat

SEQ ID NO: 439940 - DNA, 15 bp, Homo sapiens
acttttatgataatt

SEQ ID NO: 439941 - DNA, 15 bp, Homo sapiens
cttttatgataattt

SEQ ID NO: 439942 - DNA, 15 bp, Homo sapiens
ttttatgataattta

SEQ ID NO: 439943 - DNA, 15 bp, Homo sapiens
tttatgataatttac

SEQ ID NO: 439944 - DNA, 15 bp, Homo sapiens
ttatgataatttaca

SEQ ID NO: 439945 - DNA, 15 bp, Homo sapiens
tatgataatttacat

SEQ ID NO: 439946 - DNA, 15 bp, Homo sapiens
atgataatttacatt

SEQ ID NO: 439947 - DNA, 15 bp, Homo sapiens
tgataatttacattt

SEQ ID NO: 439948 - DNA, 15 bp, Homo sapiens
gataatttacattta

SEQ ID NO: 439949 - DNA, 15 bp, Homo sapiens
ataatttacatttat

SEQ ID NO: 439950 - DNA, 15 bp, Homo sapiens
taatttacatttatt

SEQ ID NO: 439951 - DNA, 15 bp, Homo sapiens
aatttacatttattt

SEQ ID NO: 439952 - DNA, 15 bp, Homo sapiens
atttacatttatttt

SEQ ID NO: 439953 - DNA, 15 bp, Homo sapiens
tttacatttattttt

SEQ ID NO: 439954 - DNA, 15 bp, Homo sapiens
ttacatttattttta

SEQ ID NO: 439955 - DNA, 15 bp, Homo sapiens
tacatttatttttat

SEQ ID NO: 439956 - DNA, 15 bp, Homo sapiens
acatttatttttatt

SEQ ID NO: 439957 - DNA, 15 bp, Homo sapiens
catttatttttattt

SEQ ID NO: 439958 - DNA, 15 bp, Homo sapiens
tatttttatttttta

SEQ ID NO: 439959 - DNA, 15 bp, Homo sapiens
atttttattttttat

SEQ ID NO: 439960 - DNA, 15 bp, Homo sapiens
tttttattttttatc

SEQ ID NO: 439961 - DNA, 15 bp, Homo sapiens
ttttattttttatcc

SEQ ID NO: 439962 - DNA, 15 bp, Homo sapiens
tttattttttatcca

SEQ ID NO: 439963 - DNA, 15 bp, Homo sapiens
ttattttttatccaa

SEQ ID NO: 439964 - DNA, 15 bp, Homo sapiens
tattttttatccaac

SEQ ID NO: 439965 - DNA, 15 bp, Homo sapiens
attttttatccaact

SEQ ID NO: 439966 - DNA, 15 bp, Homo sapiens
ttttttatccaactg

SEQ ID NO: 439967 - DNA, 15 bp, Homo sapiens
tttttatccaactgt

SEQ ID NO: 439968 - DNA, 15 bp, Homo sapiens
ttttatccaactgtg

SEQ ID NO: 439969 - DNA, 15 bp, Homo sapiens
tttatccaactgtgc

SEQ ID NO: 439970 - DNA, 15 bp, Homo sapiens
ttatccaactgtgca

SEQ ID NO: 439971 - DNA, 15 bp, Homo sapiens
tatccaactgtgcat

SEQ ID NO: 439972 - DNA, 15 bp, Homo sapiens
atccaactgtgcatc

SEQ ID NO: 439973 - DNA, 15 bp, Homo sapiens
tccaactgtgcatct

SEQ ID NO: 439974 - DNA, 15 bp, Homo sapiens
ccaactgtgcatctc

SEQ ID NO: 439975 - DNA, 15 bp, Homo sapiens
caactgtgcatctct

SEQ ID NO: 439976 - DNA, 15 bp, Homo sapiens
aactgtgcatctcta

SEQ ID NO: 439977 - DNA, 15 bp, Homo sapiens
actgtgcatctctag

SEQ ID NO: 439978 - DNA, 15 bp, Homo sapiens
ctgtgcatctctaga

SEQ ID NO: 439979 - DNA, 15 bp, Homo sapiens
tgtgcatctctagac

SEQ ID NO: 439980 - DNA, 15 bp, Homo sapiens
gtgcatctctagaca

SEQ ID NO: 439981 - DNA, 15 bp, Homo sapiens
tgcatctctagacaa

SEQ ID NO: 439982 - DNA, 15 bp, Homo sapiens
gcatctctagacaat

SEQ ID NO: 439983 - DNA, 15 bp, Homo sapiens
catctctagacaatg

SEQ ID NO: 439984 - DNA, 15 bp, Homo sapiens
atctctagacaatgt

SEQ ID NO: 439985 - DNA, 15 bp, Homo sapiens
tctctagacaatgta

SEQ ID NO: 439986 - DNA, 15 bp, Homo sapiens
ctctagacaatgtag

SEQ ID NO: 439987 - DNA, 15 bp, Homo sapiens
tctagacaatgtaga

SEQ ID NO: 439988 - DNA, 15 bp, Homo sapiens
ctagacaatgtagat

SEQ ID NO: 439989 - DNA, 15 bp, Homo sapiens
tagacaatgtagatt

SEQ ID NO: 439990 - DNA, 15 bp, Homo sapiens
agacaatgtagatta

SEQ ID NO: 439991 - DNA, 15 bp, Homo sapiens
gacaatgtagattag

SEQ ID NO: 439992 - DNA, 15 bp, Homo sapiens
acaatgtagattagg

SEQ ID NO: 439993 - DNA, 15 bp, Homo sapiens
caatgtagattaggt

SEQ ID NO: 439994 - DNA, 15 bp, Homo sapiens
aatgtagattaggtt

SEQ ID NO: 439995 - DNA, 15 bp, Homo sapiens
atgtagattaggttt

SEQ ID NO: 439996 - DNA, 15 bp, Homo sapiens
tgtagattaggttta

SEQ ID NO: 439997 - DNA, 15 bp, Homo sapiens
gtagattaggtttac

SEQ ID NO: 439998 - DNA, 15 bp, Homo sapiens
tagattaggtttacc

SEQ ID NO: 439999 - DNA, 15 bp, Homo sapiens
agattaggtttacct

SEQ ID NO: 440000 - DNA, 15 bp, Homo sapiens
gattaggtttaccta

SEQ ID NO: 440001 - DNA, 15 bp, Homo sapiens
attaggtttacctat

SEQ ID NO: 440002 - DNA, 15 bp, Homo sapiens
ttaggtttacctatt

SEQ ID NO: 440003 - DNA, 15 bp, Homo sapiens
taggtttacctattt

SEQ ID NO: 440004 - DNA, 15 bp, Homo sapiens
aggtttacctatttt

SEQ ID NO: 440005 - DNA, 15 bp, Homo sapiens
ggtttacctattttt

SEQ ID NO: 440006 - DNA, 15 bp, Homo sapiens
gtttacctattttta

SEQ ID NO: 440007 - DNA, 15 bp, Homo sapiens
tttacctatttttaa

SEQ ID NO: 440008 - DNA, 15 bp, Homo sapiens
ttacctatttttaaa

SEQ ID NO: 440009 - DNA, 15 bp, Homo sapiens
tacctatttttaaaa

SEQ ID NO: 440010 - DNA, 15 bp, Homo sapiens
acctatttttaaaaa

SEQ ID NO: 440011 - DNA, 15 bp, Homo sapiens
cctatttttaaaaaa

SEQ ID NO: 440012 - DNA, 15 bp, Homo sapiens
ctatttttaaaaaat

SEQ ID NO: 440013 - DNA, 15 bp, Homo sapiens
tatttttaaaaaata

SEQ ID NO: 440014 - DNA, 15 bp, Homo sapiens
atttttaaaaaatat

SEQ ID NO: 440015 - DNA, 15 bp, Homo sapiens
tttttaaaaaatatt

SEQ ID NO: 440016 - DNA, 15 bp, Homo sapiens
ttttaaaaaatattt

SEQ ID NO: 440017 - DNA, 15 bp, Homo sapiens
tttaaaaaatatttt

SEQ ID NO: 440018 - DNA, 15 bp, Homo sapiens
ttaaaaaatattttt

SEQ ID NO: 440019 - DNA, 15 bp, Homo sapiens
taaaaaatattttta

SEQ ID NO: 440020 - DNA, 15 bp, Homo sapiens
aaaatatttttaatc

SEQ ID NO: 440021 - DNA, 15 bp, Homo sapiens
aaatatttttaatcc

SEQ ID NO: 440022 - DNA, 15 bp, Homo sapiens
aatatttttaatccc

SEQ ID NO: 440023 - DNA, 15 bp, Homo sapiens
atatttttaatcccc

SEQ ID NO: 440024 - DNA, 15 bp, Homo sapiens
tatttttaatcccca

SEQ ID NO: 440025 - DNA, 15 bp, Homo sapiens
atttttaatccccag

SEQ ID NO: 440026 - DNA, 15 bp, Homo sapiens
tttttaatccccaga

SEQ ID NO: 440027 - DNA, 15 bp, Homo sapiens
ttttaatccccagat

SEQ ID NO: 440028 - DNA, 15 bp, Homo sapiens
tttaatccccagatt

SEQ ID NO: 440029 - DNA, 15 bp, Homo sapiens
ttaatccccagattt

SEQ ID NO: 440030 - DNA, 15 bp, Homo sapiens
taatccccagatttc

SEQ ID NO: 440031 - DNA, 15 bp, Homo sapiens
aatccccagatttcc

SEQ ID NO: 440032 - DNA, 15 bp, Homo sapiens
atccccagatttccc

SEQ ID NO: 440033 - DNA, 15 bp, Homo sapiens
tccccagatttcccc

SEQ ID NO: 440034 - DNA, 15 bp, Homo sapiens
ccccagatttcccct

SEQ ID NO: 440035 - DNA, 15 bp, Homo sapiens
cccagatttcccctc

SEQ ID NO: 440036 - DNA, 15 bp, Homo sapiens
ccagatttcccctct

SEQ ID NO: 440037 - DNA, 15 bp, Homo sapiens
cagatttcccctctc

SEQ ID NO: 440038 - DNA, 15 bp, Homo sapiens
agatttcccctctct

SEQ ID NO: 440039 - DNA, 15 bp, Homo sapiens
gatttcccctctctt

SEQ ID NO: 440040 - DNA, 15 bp, Homo sapiens
atttcccctctcttc

SEQ ID NO: 440041 - DNA, 15 bp, Homo sapiens
tttcccctctcttcc

SEQ ID NO: 440042 - DNA, 15 bp, Homo sapiens
ttcccctctcttcct

SEQ ID NO: 440043 - DNA, 15 bp, Homo sapiens
tcccctctcttcctt

SEQ ID NO: 440044 - DNA, 15 bp, Homo sapiens
cccctctcttccttt

SEQ ID NO: 440045 - DNA, 15 bp, Homo sapiens
ccctctcttcctttt

SEQ ID NO: 440046 - DNA, 15 bp, Homo sapiens
cctctcttccttttt

SEQ ID NO: 440047 - DNA, 15 bp, Homo sapiens
ctctcttcctttttc

SEQ ID NO: 440048 - DNA, 15 bp, Homo sapiens
tctcttcctttttcc

SEQ ID NO: 440049 - DNA, 15 bp, Homo sapiens
ctcttcctttttcct

SEQ ID NO: 440050 - DNA, 15 bp, Homo sapiens
tcttcctttttcctt

SEQ ID NO: 440051 - DNA, 15 bp, Homo sapiens
cttcctttttccttt

SEQ ID NO: 440052 - DNA, 15 bp, Homo sapiens
ttcctttttcctttt

SEQ ID NO: 440053 - DNA, 15 bp, Homo sapiens
tcctttttccttttc

SEQ ID NO: 440054 - DNA, 15 bp, Homo sapiens
cctttttccttttca

SEQ ID NO: 440055 - DNA, 15 bp, Homo sapiens
ctttttccttttcag

SEQ ID NO: 440056 - DNA, 15 bp, Homo sapiens
tttttccttttcagt

SEQ ID NO: 440057 - DNA, 15 bp, Homo sapiens
ttttccttttcagtt

SEQ ID NO: 440058 - DNA, 15 bp, Homo sapiens
tttccttttcagttt

SEQ ID NO: 440059 - DNA, 15 bp, Homo sapiens
ttccttttcagttta

SEQ ID NO: 440060 - DNA, 15 bp, Homo sapiens
tccttttcagtttat

SEQ ID NO: 440061 - DNA, 15 bp, Homo sapiens
ccttttcagtttatt

SEQ ID NO: 440062 - DNA, 15 bp, Homo sapiens
cttttcagtttattt

SEQ ID NO: 440063 - DNA, 15 bp, Homo sapiens
ttttcagtttatttg

SEQ ID NO: 440064 - DNA, 15 bp, Homo sapiens
tttcagtttatttgt

SEQ ID NO: 440065 - DNA, 15 bp, Homo sapiens
ttcagtttatttgtt

SEQ ID NO: 440066 - DNA, 15 bp, Homo sapiens
tcagtttatttgtta

SEQ ID NO: 440067 - DNA, 15 bp, Homo sapiens
cagtttatttgttaa

SEQ ID NO: 440068 - DNA, 15 bp, Homo sapiens
agtttatttgttaaa

SEQ ID NO: 440069 - DNA, 15 bp, Homo sapiens
gtttatttgttaaag

SEQ ID NO: 440070 - DNA, 15 bp, Homo sapiens
tttatttgttaaaga

SEQ ID NO: 440071 - DNA, 15 bp, Homo sapiens
ttatttgttaaagac

SEQ ID NO: 440072 - DNA, 15 bp, Homo sapiens
tatttgttaaagaca

SEQ ID NO: 440073 - DNA, 15 bp, Homo sapiens
atttgttaaagacac

SEQ ID NO: 440074 - DNA, 15 bp, Homo sapiens
tttgttaaagacact

SEQ ID NO: 440075 - DNA, 15 bp, Homo sapiens
ttgttaaagacactg

SEQ ID NO: 440076 - DNA, 15 bp, Homo sapiens
tgttaaagacactga

SEQ ID NO: 440077 - DNA, 15 bp, Homo sapiens
gttaaagacactgaa

SEQ ID NO: 440078 - DNA, 15 bp, Homo sapiens
ttaaagacactgaat

SEQ ID NO: 440079 - DNA, 15 bp, Homo sapiens
taaagacactgaatt

SEQ ID NO: 440080 - DNA, 15 bp, Homo sapiens
aaagacactgaattg

SEQ ID NO: 440081 - DNA, 15 bp, Homo sapiens
aagacactgaattgt

SEQ ID NO: 440082 - DNA, 15 bp, Homo sapiens
agacactgaattgtt

SEQ ID NO: 440083 - DNA, 15 bp, Homo sapiens
gacactgaattgttt

SEQ ID NO: 440084 - DNA, 15 bp, Homo sapiens
acactgaattgtttg

SEQ ID NO: 440085 - DNA, 15 bp, Homo sapiens
cactgaattgtttgt

SEQ ID NO: 440086 - DNA, 15 bp, Homo sapiens
actgaattgtttgtt

SEQ ID NO: 440087 - DNA, 15 bp, Homo sapiens
ctgaattgtttgttt

SEQ ID NO: 440088 - DNA, 15 bp, Homo sapiens
tgaattgtttgtttt

SEQ ID NO: 440089 - DNA, 15 bp, Homo sapiens
gaattgtttgttttg

SEQ ID NO: 440090 - DNA, 15 bp, Homo sapiens
aattgtttgttttgt

SEQ ID NO: 440091 - DNA, 15 bp, Homo sapiens
attgtttgttttgta

SEQ ID NO: 440092 - DNA, 15 bp, Homo sapiens
ttgtttgttttgtat

SEQ ID NO: 440093 - DNA, 15 bp, Homo sapiens
tgtttgttttgtatt

SEQ ID NO: 440094 - DNA, 15 bp, Homo sapiens
gtttgttttgtattg

SEQ ID NO: 440095 - DNA, 15 bp, Homo sapiens
tttgttttgtattga

SEQ ID NO: 440096 - DNA, 15 bp, Homo sapiens
ttgttttgtattgat

SEQ ID NO: 440097 - DNA, 15 bp, Homo sapiens
tgttttgtattgatt

SEQ ID NO: 440098 - DNA, 15 bp, Homo sapiens
gttttgtattgattc

SEQ ID NO: 440099 - DNA, 15 bp, Homo sapiens
ttttgtattgattcc

SEQ ID NO: 440100 - DNA, 15 bp, Homo sapiens
tttgtattgattccc

SEQ ID NO: 440101 - DNA, 15 bp, Homo sapiens
ttgtattgattccca

SEQ ID NO: 440102 - DNA, 15 bp, Homo sapiens
tgtattgattcccag

SEQ ID NO: 440103 - DNA, 15 bp, Homo sapiens
gtattgattcccaga

SEQ ID NO: 440104 - DNA, 15 bp, Homo sapiens
tattgattcccagag

SEQ ID NO: 440105 - DNA, 15 bp, Homo sapiens
attgattcccagagc

SEQ ID NO: 440106 - DNA, 15 bp, Homo sapiens
ttgattcccagagcc

SEQ ID NO: 440107 - DNA, 15 bp, Homo sapiens
tgattcccagagcct

SEQ ID NO: 440108 - DNA, 15 bp, Homo sapiens
gattcccagagcctg

SEQ ID NO: 440109 - DNA, 15 bp, Homo sapiens
attcccagagcctgg

SEQ ID NO: 440110 - DNA, 15 bp, Homo sapiens
ttcccagagcctgga

SEQ ID NO: 440111 - DNA, 15 bp, Homo sapiens
tcccagagcctggat

SEQ ID NO: 440112 - DNA, 15 bp, Homo sapiens
cccagagcctggatt

SEQ ID NO: 440113 - DNA, 15 bp, Homo sapiens
ccagagcctggattt

SEQ ID NO: 440114 - DNA, 15 bp, Homo sapiens
cagagcctggatttt

SEQ ID NO: 440115 - DNA, 15 bp, Homo sapiens
agagcctggattttg

SEQ ID NO: 440116 - DNA, 15 bp, Homo sapiens
gagcctggattttgc

SEQ ID NO: 440117 - DNA, 15 bp, Homo sapiens
agcctggattttgca

SEQ ID NO: 440118 - DNA, 15 bp, Homo sapiens
gcctggattttgcag

SEQ ID NO: 440119 - DNA, 15 bp, Homo sapiens
cctggattttgcaga

SEQ ID NO: 440120 - DNA, 15 bp, Homo sapiens
ctggattttgcagaa

SEQ ID NO: 440121 - DNA, 15 bp, Homo sapiens
tggattttgcagaat

SEQ ID NO: 440122 - DNA, 15 bp, Homo sapiens
ggattttgcagaatt

SEQ ID NO: 440123 - DNA, 15 bp, Homo sapiens
gattttgcagaattg

SEQ ID NO: 440124 - DNA, 15 bp, Homo sapiens
ttttgcagaattgtg

SEQ ID NO: 440125 - DNA, 15 bp, Homo sapiens
tttgcagaattgtgt

SEQ ID NO: 440126 - DNA, 15 bp, Homo sapiens
ttgcagaattgtgtc

SEQ ID NO: 440127 - DNA, 15 bp, Homo sapiens
tgcagaattgtgtcc

SEQ ID NO: 440128 - DNA, 15 bp, Homo sapiens
gcagaattgtgtcca

SEQ ID NO: 440129 - DNA, 15 bp, Homo sapiens
cagaattgtgtccat

SEQ ID NO: 440130 - DNA, 15 bp, Homo sapiens
agaattgtgtccata

SEQ ID NO: 440131 - DNA, 15 bp, Homo sapiens
gaattgtgtccatat

SEQ ID NO: 440132 - DNA, 15 bp, Homo sapiens
aattgtgtccatatg

SEQ ID NO: 440133 - DNA, 15 bp, Homo sapiens
attgtgtccatatgg

SEQ ID NO: 440134 - DNA, 15 bp, Homo sapiens
ttgtgtccatatggt

SEQ ID NO: 440135 - DNA, 15 bp, Homo sapiens
tgtgtccatatggta

SEQ ID NO: 440136 - DNA, 15 bp, Homo sapiens
gtgtccatatggtat

SEQ ID NO: 440137 - DNA, 15 bp, Homo sapiens
tgtccatatggtata

SEQ ID NO: 440138 - DNA, 15 bp, Homo sapiens
gtccatatggtatag

SEQ ID NO: 440139 - DNA, 15 bp, Homo sapiens
tccatatggtatagt

SEQ ID NO: 440140 - DNA, 15 bp, Homo sapiens
ccatatggtatagtc

SEQ ID NO: 440141 - DNA, 15 bp, Homo sapiens
catatggtatagtct

SEQ ID NO: 440142 - DNA, 15 bp, Homo sapiens
atatggtatagtctc

SEQ ID NO: 440143 - DNA, 15 bp, Homo sapiens
tatggtatagtctcc

SEQ ID NO: 440144 - DNA, 15 bp, Homo sapiens
atggtatagtctcca

SEQ ID NO: 440145 - DNA, 15 bp, Homo sapiens
tggtatagtctccag

SEQ ID NO: 440146 - DNA, 15 bp, Homo sapiens
ggtatagtctccagg

SEQ ID NO: 440147 - DNA, 15 bp, Homo sapiens
gtatagtctccaggt

SEQ ID NO: 440148 - DNA, 15 bp, Homo sapiens
tatagtctccaggtt

SEQ ID NO: 440149 - DNA, 15 bp, Homo sapiens
atagtctccaggttc

SEQ ID NO: 440150 - DNA, 15 bp, Homo sapiens
tagtctccaggttcc

SEQ ID NO: 440151 - DNA, 15 bp, Homo sapiens
agtctccaggttcct

SEQ ID NO: 440152 - DNA, 15 bp, Homo sapiens
gtctccaggttcctc

SEQ ID NO: 440153 - DNA, 15 bp, Homo sapiens
tctccaggttcctct

SEQ ID NO: 440154 - DNA, 15 bp, Homo sapiens
ctccaggttcctctc

SEQ ID NO: 440155 - DNA, 15 bp, Homo sapiens
tccaggttcctctct

SEQ ID NO: 440156 - DNA, 15 bp, Homo sapiens
ccaggttcctctcta

SEQ ID NO: 440157 - DNA, 15 bp, Homo sapiens
caggttcctctctac

SEQ ID NO: 440158 - DNA, 15 bp, Homo sapiens
aggttcctctctact

SEQ ID NO: 440159 - DNA, 15 bp, Homo sapiens
ggttcctctctactc

SEQ ID NO: 440160 - DNA, 15 bp, Homo sapiens
gttcctctctactcg

SEQ ID NO: 440161 - DNA, 15 bp, Homo sapiens
ttcctctctactcgg

SEQ ID NO: 440162 - DNA, 15 bp, Homo sapiens
tcctctctactcggt

SEQ ID NO: 440163 - DNA, 15 bp, Homo sapiens
cctctctactcggta

SEQ ID NO: 440164 - DNA, 15 bp, Homo sapiens
ctctctactcggtat

SEQ ID NO: 440165 - DNA, 15 bp, Homo sapiens
tctctactcggtatc

SEQ ID NO: 440166 - DNA, 15 bp, Homo sapiens
ctctactcggtatct

SEQ ID NO: 440167 - DNA, 15 bp, Homo sapiens
tctactcggtatctc

SEQ ID NO: 440168 - DNA, 15 bp, Homo sapiens
ctactcggtatctct

SEQ ID NO: 440169 - DNA, 15 bp, Homo sapiens
tactcggtatctctt

SEQ ID NO: 440170 - DNA, 15 bp, Homo sapiens
actcggtatctcttg

SEQ ID NO: 440171 - DNA, 15 bp, Homo sapiens
ctcggtatctcttgt

SEQ ID NO: 440172 - DNA, 15 bp, Homo sapiens
tcggtatctcttgta

SEQ ID NO: 440173 - DNA, 15 bp, Homo sapiens
cggtatctcttgtaa

SEQ ID NO: 440174 - DNA, 15 bp, Homo sapiens
ggtatctcttgtaaa

SEQ ID NO: 440175 - DNA, 15 bp, Homo sapiens
gtatctcttgtaaat

SEQ ID NO: 440176 - DNA, 15 bp, Homo sapiens
tatctcttgtaaatt

SEQ ID NO: 440177 - DNA, 15 bp, Homo sapiens
atctcttgtaaattg

SEQ ID NO: 440178 - DNA, 15 bp, Homo sapiens
tctcttgtaaattgg

SEQ ID NO: 440179 - DNA, 15 bp, Homo sapiens
ctcttgtaaattggt

SEQ ID NO: 440180 - DNA, 15 bp, Homo sapiens
tcttgtaaattggtg

SEQ ID NO: 440181 - DNA, 15 bp, Homo sapiens
cttgtaaattggtgg

SEQ ID NO: 440182 - DNA, 15 bp, Homo sapiens
ttgtaaattggtgga

SEQ ID NO: 440183 - DNA, 15 bp, Homo sapiens
tgtaaattggtggat

SEQ ID NO: 440184 - DNA, 15 bp, Homo sapiens
gtaaattggtggatg

SEQ ID NO: 440185 - DNA, 15 bp, Homo sapiens
taaattggtggatgg

SEQ ID NO: 440186 - DNA, 15 bp, Homo sapiens
aaattggtggatgga

SEQ ID NO: 440187 - DNA, 15 bp, Homo sapiens
aattggtggatggag

SEQ ID NO: 440188 - DNA, 15 bp, Homo sapiens
attggtggatggaga

SEQ ID NO: 440189 - DNA, 15 bp, Homo sapiens
ttggtggatggagat

SEQ ID NO: 440190 - DNA, 15 bp, Homo sapiens
tggtggatggagata

SEQ ID NO: 440191 - DNA, 15 bp, Homo sapiens
ggtggatggagatag

SEQ ID NO: 440192 - DNA, 15 bp, Homo sapiens
gtggatggagataga

SEQ ID NO: 440193 - DNA, 15 bp, Homo sapiens
tggatggagatagag

SEQ ID NO: 440194 - DNA, 15 bp, Homo sapiens
ggatggagatagaga

SEQ ID NO: 440195 - DNA, 15 bp, Homo sapiens
gatggagatagagat

SEQ ID NO: 440196 - DNA, 15 bp, Homo sapiens
atggagatagagatt

SEQ ID NO: 440197 - DNA, 15 bp, Homo sapiens
tggagatagagattt

SEQ ID NO: 440198 - DNA, 15 bp, Homo sapiens
ggagatagagattta

SEQ ID NO: 440199 - DNA, 15 bp, Homo sapiens
gagatagagatttaa

SEQ ID NO: 440200 - DNA, 15 bp, Homo sapiens
agatagagatttaat

SEQ ID NO: 440201 - DNA, 15 bp, Homo sapiens
gatagagatttaatc

SEQ ID NO: 440202 - DNA, 15 bp, Homo sapiens
atagagatttaatca

SEQ ID NO: 440203 - DNA, 15 bp, Homo sapiens
tagagatttaatcaa

SEQ ID NO: 440204 - DNA, 15 bp, Homo sapiens
agagatttaatcaaa

SEQ ID NO: 440205 - DNA, 15 bp, Homo sapiens
gagatttaatcaaaa

SEQ ID NO: 440206 - DNA, 15 bp, Homo sapiens
agatttaatcaaaag

SEQ ID NO: 440207 - DNA, 15 bp, Homo sapiens
gatttaatcaaaagc

SEQ ID NO: 440208 - DNA, 15 bp, Homo sapiens
atttaatcaaaagca

SEQ ID NO: 440209 - DNA, 15 bp, Homo sapiens
tttaatcaaaagcac

SEQ ID NO: 440210 - DNA, 15 bp, Homo sapiens
ttaatcaaaagcaca

SEQ ID NO: 440211 - DNA, 15 bp, Homo sapiens
taatcaaaagcacac

SEQ ID NO: 440212 - DNA, 15 bp, Homo sapiens
aatcaaaagcacact

SEQ ID NO: 440213 - DNA, 15 bp, Homo sapiens
atcaaaagcacactc

SEQ ID NO: 440214 - DNA, 15 bp, Homo sapiens
tcaaaagcacactct

SEQ ID NO: 440215 - DNA, 15 bp, Homo sapiens
caaaagcacactctt

SEQ ID NO: 440216 - DNA, 15 bp, Homo sapiens
aaaagcacactcttt

SEQ ID NO: 440217 - DNA, 15 bp, Homo sapiens
aaagcacactctttt

SEQ ID NO: 440218 - DNA, 15 bp, Homo sapiens
aagcacactctttta

SEQ ID NO: 440219 - DNA, 15 bp, Homo sapiens
agcacactcttttac

SEQ ID NO: 440220 - DNA, 15 bp, Homo sapiens
gcacactcttttact

SEQ ID NO: 440221 - DNA, 15 bp, Homo sapiens
cacactcttttactg

SEQ ID NO: 440222 - DNA, 15 bp, Homo sapiens
acactcttttactgg

SEQ ID NO: 440223 - DNA, 15 bp, Homo sapiens
cactcttttactggg

SEQ ID NO: 440224 - DNA, 15 bp, Homo sapiens
actcttttactggga

SEQ ID NO: 440225 - DNA, 15 bp, Homo sapiens
ctcttttactgggaa

SEQ ID NO: 440226 - DNA, 15 bp, Homo sapiens
tcttttactgggaac

SEQ ID NO: 440227 - DNA, 15 bp, Homo sapiens
cttttactgggaact

SEQ ID NO: 440228 - DNA, 15 bp, Homo sapiens
ttttactgggaactc

SEQ ID NO: 440229 - DNA, 15 bp, Homo sapiens
tttactgggaactct

SEQ ID NO: 440230 - DNA, 15 bp, Homo sapiens
ttactgggaactctc

SEQ ID NO: 440231 - DNA, 15 bp, Homo sapiens
tactgggaactctca

SEQ ID NO: 440232 - DNA, 15 bp, Homo sapiens
actgggaactctcat

SEQ ID NO: 440233 - DNA, 15 bp, Homo sapiens
ctgggaactctcatc

SEQ ID NO: 440234 - DNA, 15 bp, Homo sapiens
tgggaactctcatct

SEQ ID NO: 440235 - DNA, 15 bp, Homo sapiens
gggaactctcatcta

SEQ ID NO: 440236 - DNA, 15 bp, Homo sapiens
ggaactctcatctat

SEQ ID NO: 440237 - DNA, 15 bp, Homo sapiens
gaactctcatctata

SEQ ID NO: 440238 - DNA, 15 bp, Homo sapiens
aactctcatctataa

SEQ ID NO: 440239 - DNA, 15 bp, Homo sapiens
actctcatctataaa

SEQ ID NO: 440240 - DNA, 15 bp, Homo sapiens
ctctcatctataaat

SEQ ID NO: 440241 - DNA, 15 bp, Homo sapiens
tctcatctataaatt

SEQ ID NO: 440242 - DNA, 15 bp, Homo sapiens
ctcatctataaattg

SEQ ID NO: 440243 - DNA, 15 bp, Homo sapiens
tcatctataaattgt

SEQ ID NO: 440244 - DNA, 15 bp, Homo sapiens
catctataaattgta

SEQ ID NO: 440245 - DNA, 15 bp, Homo sapiens
atctataaattgtat

SEQ ID NO: 440246 - DNA, 15 bp, Homo sapiens
tctataaattgtatc

SEQ ID NO: 440247 - DNA, 15 bp, Homo sapiens
ctataaattgtatct

SEQ ID NO: 440248 - DNA, 15 bp, Homo sapiens
tataaattgtatctt

SEQ ID NO: 440249 - DNA, 15 bp, Homo sapiens
ataaattgtatctta

SEQ ID NO: 440250 - DNA, 15 bp, Homo sapiens
taaattgtatcttat

SEQ ID NO: 440251 - DNA, 15 bp, Homo sapiens
aaattgtatcttatt

SEQ ID NO: 440252 - DNA, 15 bp, Homo sapiens
aattgtatcttattg

SEQ ID NO: 440253 - DNA, 15 bp, Homo sapiens
attgtatcttattgt

SEQ ID NO: 440254 - DNA, 15 bp, Homo sapiens
ttgtatcttattgta

SEQ ID NO: 440255 - DNA, 15 bp, Homo sapiens
tgtatcttattgtat

SEQ ID NO: 440256 - DNA, 15 bp, Homo sapiens
gtatcttattgtata

SEQ ID NO: 440257 - DNA, 15 bp, Homo sapiens
tatcttattgtatat

SEQ ID NO: 440258 - DNA, 15 bp, Homo sapiens
atcttattgtatatt

SEQ ID NO: 440259 - DNA, 15 bp, Homo sapiens
tcttattgtatatta

SEQ ID NO: 440260 - DNA, 15 bp, Homo sapiens
cttattgtatattaa

SEQ ID NO: 440261 - DNA, 15 bp, Homo sapiens
ttattgtatattaat

SEQ ID NO: 440262 - DNA, 15 bp, Homo sapiens
tattgtatattaatg

SEQ ID NO: 440263 - DNA, 15 bp, Homo sapiens
attgtatattaatga

SEQ ID NO: 440264 - DNA, 15 bp, Homo sapiens
ttgtatattaatgaa

SEQ ID NO: 440265 - DNA, 15 bp, Homo sapiens
tgtatattaatgaag

SEQ ID NO: 440266 - DNA, 15 bp, Homo sapiens
gtatattaatgaaga

SEQ ID NO: 440267 - DNA, 15 bp, Homo sapiens
tatattaatgaagaa

SEQ ID NO: 440268 - DNA, 15 bp, Homo sapiens
atattaatgaagaat

SEQ ID NO: 440269 - DNA, 15 bp, Homo sapiens
tattaatgaagaatt

SEQ ID NO: 440270 - DNA, 15 bp, Homo sapiens
attaatgaagaatta

SEQ ID NO: 440271 - DNA, 15 bp, Homo sapiens
ttaatgaagaattag

SEQ ID NO: 440272 - DNA, 15 bp, Homo sapiens
taatgaagaattagt

SEQ ID NO: 440273 - DNA, 15 bp, Homo sapiens
aatgaagaattagtt

SEQ ID NO: 440274 - DNA, 15 bp, Homo sapiens
atgaagaattagttt

SEQ ID NO: 440275 - DNA, 15 bp, Homo sapiens
tgaagaattagttta

SEQ ID NO: 440276 - DNA, 15 bp, Homo sapiens
gaagaattagtttag

SEQ ID NO: 440277 - DNA, 15 bp, Homo sapiens
aagaattagtttagc

SEQ ID NO: 440278 - DNA, 15 bp, Homo sapiens
agaattagtttagct

SEQ ID NO: 440279 - DNA, 15 bp, Homo sapiens
gaattagtttagcta

SEQ ID NO: 440280 - DNA, 15 bp, Homo sapiens
aattagtttagctat

SEQ ID NO: 440281 - DNA, 15 bp, Homo sapiens
attagtttagctata

SEQ ID NO: 440282 - DNA, 15 bp, Homo sapiens
ttagtttagctataa

SEQ ID NO: 440283 - DNA, 15 bp, Homo sapiens
tagtttagctataaa

SEQ ID NO: 440284 - DNA, 15 bp, Homo sapiens
agtttagctataaat

SEQ ID NO: 440285 - DNA, 15 bp, Homo sapiens
gtttagctataaatt

SEQ ID NO: 440286 - DNA, 15 bp, Homo sapiens
tttagctataaattc

SEQ ID NO: 440287 - DNA, 15 bp, Homo sapiens
ttagctataaattct

SEQ ID NO: 440288 - DNA, 15 bp, Homo sapiens
tagctataaattctg

SEQ ID NO: 440289 - DNA, 15 bp, Homo sapiens
agctataaattctgt

SEQ ID NO: 440290 - DNA, 15 bp, Homo sapiens
gctataaattctgtt

SEQ ID NO: 440291 - DNA, 15 bp, Homo sapiens
ctataaattctgttt

SEQ ID NO: 440292 - DNA, 15 bp, Homo sapiens
tataaattctgtttg

SEQ ID NO: 440293 - DNA, 15 bp, Homo sapiens
ataaattctgtttgt

SEQ ID NO: 440294 - DNA, 15 bp, Homo sapiens
taaattctgtttgta

SEQ ID NO: 440295 - DNA, 15 bp, Homo sapiens
aaattctgtttgtag

SEQ ID NO: 440296 - DNA, 15 bp, Homo sapiens
aattctgtttgtagt

SEQ ID NO: 440297 - DNA, 15 bp, Homo sapiens
attctgtttgtagta

SEQ ID NO: 440298 - DNA, 15 bp, Homo sapiens
ttctgtttgtagtaa

SEQ ID NO: 440299 - DNA, 15 bp, Homo sapiens
tctgtttgtagtaag

SEQ ID NO: 440300 - DNA, 15 bp, Homo sapiens
ctgtttgtagtaagg

SEQ ID NO: 440301 - DNA, 15 bp, Homo sapiens
tgtttgtagtaagga

SEQ ID NO: 440302 - DNA, 15 bp, Homo sapiens
gtttgtagtaaggaa

SEQ ID NO: 440303 - DNA, 15 bp, Homo sapiens
tttgtagtaaggaat

SEQ ID NO: 440304 - DNA, 15 bp, Homo sapiens
ttgtagtaaggaatt

SEQ ID NO: 440305 - DNA, 15 bp, Homo sapiens
tgtagtaaggaattg

SEQ ID NO: 440306 - DNA, 15 bp, Homo sapiens
gtagtaaggaattgc

SEQ ID NO: 440307 - DNA, 15 bp, Homo sapiens
tagtaaggaattgcc

SEQ ID NO: 440308 - DNA, 15 bp, Homo sapiens
agtaaggaattgccc

SEQ ID NO: 440309 - DNA, 15 bp, Homo sapiens
gtaaggaattgccca

SEQ ID NO: 440310 - DNA, 15 bp, Homo sapiens
taaggaattgcccaa

SEQ ID NO: 440311 - DNA, 15 bp, Homo sapiens
aaggaattgcccaaa

SEQ ID NO: 440312 - DNA, 15 bp, Homo sapiens
aggaattgcccaaag

SEQ ID NO: 440313 - DNA, 15 bp, Homo sapiens
ggaattgcccaaagc

SEQ ID NO: 440314 - DNA, 15 bp, Homo sapiens
gaattgcccaaagct

SEQ ID NO: 440315 - DNA, 15 bp, Homo sapiens
aattgcccaaagcta

SEQ ID NO: 440316 - DNA, 15 bp, Homo sapiens
attgcccaaagctat

SEQ ID NO: 440317 - DNA, 15 bp, Homo sapiens
ttgcccaaagctatg

SEQ ID NO: 440318 - DNA, 15 bp, Homo sapiens
tgcccaaagctatgg

SEQ ID NO: 440319 - DNA, 15 bp, Homo sapiens
gcccaaagctatgga

SEQ ID NO: 440320 - DNA, 15 bp, Homo sapiens
cccaaagctatggat

SEQ ID NO: 440321 - DNA, 15 bp, Homo sapiens
ccaaagctatggatg

SEQ ID NO: 440322 - DNA, 15 bp, Homo sapiens
caaagctatggatgt

SEQ ID NO: 440323 - DNA, 15 bp, Homo sapiens
aaagctatggatgtt

SEQ ID NO: 440324 - DNA, 15 bp, Homo sapiens
aagctatggatgtta

SEQ ID NO: 440325 - DNA, 15 bp, Homo sapiens
agctatggatgttag

SEQ ID NO: 440326 - DNA, 15 bp, Homo sapiens
gctatggatgttaga

SEQ ID NO: 440327 - DNA, 15 bp, Homo sapiens
ctatggatgttagac

SEQ ID NO: 440328 - DNA, 15 bp, Homo sapiens
tatggatgttagact

SEQ ID NO: 440329 - DNA, 15 bp, Homo sapiens
atggatgttagactt

SEQ ID NO: 440330 - DNA, 15 bp, Homo sapiens
tggatgttagactta

SEQ ID NO: 440331 - DNA, 15 bp, Homo sapiens
ggatgttagacttat

SEQ ID NO: 440332 - DNA, 15 bp, Homo sapiens
gatgttagacttatg

SEQ ID NO: 440333 - DNA, 15 bp, Homo sapiens
atgttagacttatgg

SEQ ID NO: 440334 - DNA, 15 bp, Homo sapiens
tgttagacttatggt

SEQ ID NO: 440335 - DNA, 15 bp, Homo sapiens
gttagacttatggtt

SEQ ID NO: 440336 - DNA, 15 bp, Homo sapiens
ttagacttatggtta

SEQ ID NO: 440337 - DNA, 15 bp, Homo sapiens
tagacttatggttac

SEQ ID NO: 440338 - DNA, 15 bp, Homo sapiens
agacttatggttacc

SEQ ID NO: 440339 - DNA, 15 bp, Homo sapiens
gacttatggttacct

SEQ ID NO: 440340 - DNA, 15 bp, Homo sapiens
acttatggttacctc

SEQ ID NO: 440341 - DNA, 15 bp, Homo sapiens
cttatggttacctcc

SEQ ID NO: 440342 - DNA, 15 bp, Homo sapiens
ttatggttacctccc

SEQ ID NO: 440343 - DNA, 15 bp, Homo sapiens
tatggttacctcccc

SEQ ID NO: 440344 - DNA, 15 bp, Homo sapiens
atggttacctcccct

SEQ ID NO: 440345 - DNA, 15 bp, Homo sapiens
tggttacctcccctt

SEQ ID NO: 440346 - DNA, 15 bp, Homo sapiens
ggttacctccccttt

SEQ ID NO: 440347 - DNA, 15 bp, Homo sapiens
gttacctcccctttg

SEQ ID NO: 440348 - DNA, 15 bp, Homo sapiens
ttacctcccctttgg

SEQ ID NO: 440349 - DNA, 15 bp, Homo sapiens
tacctcccctttggt

SEQ ID NO: 440350 - DNA, 15 bp, Homo sapiens
acctcccctttggtt

SEQ ID NO: 440351 - DNA, 15 bp, Homo sapiens
cctcccctttggttc

SEQ ID NO: 440352 - DNA, 15 bp, Homo sapiens
ctcccctttggttcc

SEQ ID NO: 440353 - DNA, 15 bp, Homo sapiens
tcccctttggttccc

SEQ ID NO: 440354 - DNA, 15 bp, Homo sapiens
cccctttggttccca

SEQ ID NO: 440355 - DNA, 15 bp, Homo sapiens
ccctttggttcccat

SEQ ID NO: 440356 - DNA, 15 bp, Homo sapiens
cctttggttcccata

SEQ ID NO: 440357 - DNA, 15 bp, Homo sapiens
ctttggttcccatat

SEQ ID NO: 440358 - DNA, 15 bp, Homo sapiens
tttggttcccatatt

SEQ ID NO: 440359 - DNA, 15 bp, Homo sapiens
ttggttcccatattc

SEQ ID NO: 440360 - DNA, 15 bp, Homo sapiens
tggttcccatattct

SEQ ID NO: 440361 - DNA, 15 bp, Homo sapiens
ggttcccatattcta

SEQ ID NO: 440362 - DNA, 15 bp, Homo sapiens
gttcccatattctag

SEQ ID NO: 440363 - DNA, 15 bp, Homo sapiens
ttcccatattctaga

SEQ ID NO: 440364 - DNA, 15 bp, Homo sapiens
tcccatattctagaa

SEQ ID NO: 440365 - DNA, 15 bp, Homo sapiens
cccatattctagaac

SEQ ID NO: 440366 - DNA, 15 bp, Homo sapiens
ccatattctagaaca

SEQ ID NO: 440367 - DNA, 15 bp, Homo sapiens
catattctagaacat

SEQ ID NO: 440368 - DNA, 15 bp, Homo sapiens
atattctagaacatc

SEQ ID NO: 440369 - DNA, 15 bp, Homo sapiens
tattctagaacatct

SEQ ID NO: 440370 - DNA, 15 bp, Homo sapiens
attctagaacatctc

SEQ ID NO: 440371 - DNA, 15 bp, Homo sapiens
ttctagaacatctcc

SEQ ID NO: 440372 - DNA, 15 bp, Homo sapiens
tctagaacatctcct

SEQ ID NO: 440373 - DNA, 15 bp, Homo sapiens
ctagaacatctcctg

SEQ ID NO: 440374 - DNA, 15 bp, Homo sapiens
tagaacatctcctga

SEQ ID NO: 440375 - DNA, 15 bp, Homo sapiens
agaacatctcctgaa

SEQ ID NO: 440376 - DNA, 15 bp, Homo sapiens
gaacatctcctgaaa

SEQ ID NO: 440377 - DNA, 15 bp, Homo sapiens
aacatctcctgaaaa

SEQ ID NO: 440378 - DNA, 15 bp, Homo sapiens
acatctcctgaaaaa

SEQ ID NO: 440379 - DNA, 15 bp, Homo sapiens
catctcctgaaaaaa

SEQ ID NO: 440380 - DNA, 15 bp, Homo sapiens
atctcctgaaaaaaa

SEQ ID NO: 440381 - DNA, 15 bp, Homo sapiens
tctcctgaaaaaaaa

SEQ ID NO: 440382 - DNA, 15 bp, Homo sapiens
ctcctgaaaaaaaag

SEQ ID NO: 440383 - DNA, 15 bp, Homo sapiens
tcctgaaaaaaaagt

SEQ ID NO: 440384 - DNA, 15 bp, Homo sapiens
cctgaaaaaaaagtt

SEQ ID NO: 440385 - DNA, 15 bp, Homo sapiens
ctgaaaaaaaagtta

SEQ ID NO: 440386 - DNA, 15 bp, Homo sapiens
tgaaaaaaaagttaa

SEQ ID NO: 440387 - DNA, 15 bp, Homo sapiens
gaaaaaaaagttaat

SEQ ID NO: 440388 - DNA, 15 bp, Homo sapiens
aaaaaaaagttaata

SEQ ID NO: 440389 - DNA, 15 bp, Homo sapiens
aaaaaaagttaataa

SEQ ID NO: 440390 - DNA, 15 bp, Homo sapiens
aaaaaagttaataaa

SEQ ID NO: 440391 - DNA, 15 bp, Homo sapiens
aaaaagttaataaaa

SEQ ID NO: 440392 - DNA, 15 bp, Homo sapiens
aaaagttaataaaat

SEQ ID NO: 440393 - DNA, 15 bp, Homo sapiens
aaagttaataaaatt

SEQ ID NO: 440394 - DNA, 15 bp, Homo sapiens
aagttaataaaattt

SEQ ID NO: 440395 - DNA, 15 bp, Homo sapiens
agttaataaaattta

SEQ ID NO: 440396 - DNA, 15 bp, Homo sapiens
gttaataaaatttag

SEQ ID NO: 440397 - DNA, 15 bp, Homo sapiens
ttaataaaatttaga

SEQ ID NO: 440398 - DNA, 15 bp, Homo sapiens
taataaaatttagac

SEQ ID NO: 440399 - DNA, 15 bp, Homo sapiens
aataaaatttagaca

SEQ ID NO: 440400 - DNA, 15 bp, Homo sapiens
ataaaatttagacaa

SEQ ID NO: 440401 - DNA, 15 bp, Homo sapiens
taaaatttagacaat

SEQ ID NO: 440402 - DNA, 15 bp, Homo sapiens
aaaatttagacaata

SEQ ID NO: 440403 - DNA, 15 bp, Homo sapiens
aaatttagacaataa

SEQ ID NO: 440404 - DNA, 15 bp, Homo sapiens
aatttagacaataag

SEQ ID NO: 440405 - DNA, 15 bp, Homo sapiens
atttagacaataaga

SEQ ID NO: 440406 - DNA, 15 bp, Homo sapiens
tttagacaataagag

SEQ ID NO: 440407 - DNA, 15 bp, Homo sapiens
ttagacaataagaga

SEQ ID NO: 440408 - DNA, 15 bp, Homo sapiens
tagacaataagagat

SEQ ID NO: 440409 - DNA, 15 bp, Homo sapiens
agacaataagagata

SEQ ID NO: 440410 - DNA, 15 bp, Homo sapiens
gacaataagagatat

SEQ ID NO: 440411 - DNA, 15 bp, Homo sapiens
acaataagagatata

SEQ ID NO: 440412 - DNA, 15 bp, Homo sapiens
caataagagatataa

SEQ ID NO: 440413 - DNA, 15 bp, Homo sapiens
aataagagatataag

SEQ ID NO: 440414 - DNA, 15 bp, Homo sapiens
ataagagatataaga

SEQ ID NO: 440415 - DNA, 15 bp, Homo sapiens
taagagatataagag

SEQ ID NO: 440416 - DNA, 15 bp, Homo sapiens
aagagatataagaga

SEQ ID NO: 440417 - DNA, 15 bp, Homo sapiens
agagatataagagat

SEQ ID NO: 440418 - DNA, 15 bp, Homo sapiens
gagatataagagatg

SEQ ID NO: 440419 - DNA, 15 bp, Homo sapiens
agatataagagatgg

SEQ ID NO: 440420 - DNA, 15 bp, Homo sapiens
gatataagagatggt

SEQ ID NO: 440421 - DNA, 15 bp, Homo sapiens
atataagagatggtt

SEQ ID NO: 440422 - DNA, 15 bp, Homo sapiens
tataagagatggttt

SEQ ID NO: 440423 - DNA, 15 bp, Homo sapiens
ataagagatggttta

SEQ ID NO: 440424 - DNA, 15 bp, Homo sapiens
taagagatggtttaa

SEQ ID NO: 440425 - DNA, 15 bp, Homo sapiens
aagagatggtttaaa

SEQ ID NO: 440426 - DNA, 15 bp, Homo sapiens
agagatggtttaaag

SEQ ID NO: 440427 - DNA, 15 bp, Homo sapiens
gagatggtttaaagt

SEQ ID NO: 440428 - DNA, 15 bp, Homo sapiens
agatggtttaaagta

SEQ ID NO: 440429 - DNA, 15 bp, Homo sapiens
gatggtttaaagtat

SEQ ID NO: 440430 - DNA, 15 bp, Homo sapiens
atggtttaaagtata

SEQ ID NO: 440431 - DNA, 15 bp, Homo sapiens
tggtttaaagtatac

SEQ ID NO: 440432 - DNA, 15 bp, Homo sapiens
ggtttaaagtatacc

SEQ ID NO: 440433 - DNA, 15 bp, Homo sapiens
gtttaaagtataccc

SEQ ID NO: 440434 - DNA, 15 bp, Homo sapiens
tttaaagtatacccc

SEQ ID NO: 440435 - DNA, 15 bp, Homo sapiens
ttaaagtatacccca

SEQ ID NO: 440436 - DNA, 15 bp, Homo sapiens
taaagtataccccaa

SEQ ID NO: 440437 - DNA, 15 bp, Homo sapiens
aaagtataccccaaa

SEQ ID NO: 440438 - DNA, 15 bp, Homo sapiens
aagtataccccaaat

SEQ ID NO: 440439 - DNA, 15 bp, Homo sapiens
agtataccccaaatc

SEQ ID NO: 440440 - DNA, 15 bp, Homo sapiens
gtataccccaaatct

SEQ ID NO: 440441 - DNA, 15 bp, Homo sapiens
tataccccaaatctc

SEQ ID NO: 440442 - DNA, 15 bp, Homo sapiens
ataccccaaatctca

SEQ ID NO: 440443 - DNA, 15 bp, Homo sapiens
taccccaaatctcat

SEQ ID NO: 440444 - DNA, 15 bp, Homo sapiens
accccaaatctcatt

SEQ ID NO: 440445 - DNA, 15 bp, Homo sapiens
ccccaaatctcattg

SEQ ID NO: 440446 - DNA, 15 bp, Homo sapiens
cccaaatctcattga

SEQ ID NO: 440447 - DNA, 15 bp, Homo sapiens
ccaaatctcattgac

SEQ ID NO: 440448 - DNA, 15 bp, Homo sapiens
caaatctcattgaca

SEQ ID NO: 440449 - DNA, 15 bp, Homo sapiens
aaatctcattgacag

SEQ ID NO: 440450 - DNA, 15 bp, Homo sapiens
aatctcattgacagt

SEQ ID NO: 440451 - DNA, 15 bp, Homo sapiens
atctcattgacagtg

SEQ ID NO: 440452 - DNA, 15 bp, Homo sapiens
tctcattgacagtgt

SEQ ID NO: 440453 - DNA, 15 bp, Homo sapiens
ctcattgacagtgta

SEQ ID NO: 440454 - DNA, 15 bp, Homo sapiens
tcattgacagtgtag

SEQ ID NO: 440455 - DNA, 15 bp, Homo sapiens
cattgacagtgtagt

SEQ ID NO: 440456 - DNA, 15 bp, Homo sapiens
attgacagtgtagtc

SEQ ID NO: 440457 - DNA, 15 bp, Homo sapiens
ttgacagtgtagtca

SEQ ID NO: 440458 - DNA, 15 bp, Homo sapiens
tgacagtgtagtcag

SEQ ID NO: 440459 - DNA, 15 bp, Homo sapiens
gacagtgtagtcaga

SEQ ID NO: 440460 - DNA, 15 bp, Homo sapiens
acagtgtagtcagat

SEQ ID NO: 440461 - DNA, 15 bp, Homo sapiens
cagtgtagtcagata

SEQ ID NO: 440462 - DNA, 15 bp, Homo sapiens
agtgtagtcagataa

SEQ ID NO: 440463 - DNA, 15 bp, Homo sapiens
gtgtagtcagataaa

SEQ ID NO: 440464 - DNA, 15 bp, Homo sapiens
tgtagtcagataaaa

SEQ ID NO: 440465 - DNA, 15 bp, Homo sapiens
gtagtcagataaaaa

SEQ ID NO: 440466 - DNA, 15 bp, Homo sapiens
tagtcagataaaaat

SEQ ID NO: 440467 - DNA, 15 bp, Homo sapiens
agtcagataaaaata

SEQ ID NO: 440468 - DNA, 15 bp, Homo sapiens
gtcagataaaaataa

SEQ ID NO: 440469 - DNA, 15 bp, Homo sapiens
tcagataaaaataag

SEQ ID NO: 440470 - DNA, 15 bp, Homo sapiens
cagataaaaataagt

SEQ ID NO: 440471 - DNA, 15 bp, Homo sapiens
agataaaaataagta

SEQ ID NO: 440472 - DNA, 15 bp, Homo sapiens
gataaaaataagtac

SEQ ID NO: 440473 - DNA, 15 bp, Homo sapiens
ataaaaataagtact

SEQ ID NO: 440474 - DNA, 15 bp, Homo sapiens
taaaaataagtactg

SEQ ID NO: 440475 - DNA, 15 bp, Homo sapiens
aaaaataagtactga

SEQ ID NO: 440476 - DNA, 15 bp, Homo sapiens
aaaataagtactgaa

SEQ ID NO: 440477 - DNA, 15 bp, Homo sapiens
aaataagtactgaat

SEQ ID NO: 440478 - DNA, 15 bp, Homo sapiens
aataagtactgaatt

SEQ ID NO: 440479 - DNA, 15 bp, Homo sapiens
ataagtactgaattt

SEQ ID NO: 440480 - DNA, 15 bp, Homo sapiens
taagtactgaatttt

SEQ ID NO: 440481 - DNA, 15 bp, Homo sapiens
aagtactgaattttg

SEQ ID NO: 440482 - DNA, 15 bp, Homo sapiens
agtactgaattttgc

SEQ ID NO: 440483 - DNA, 15 bp, Homo sapiens
gtactgaattttgct

SEQ ID NO: 440484 - DNA, 15 bp, Homo sapiens
tactgaattttgcta

SEQ ID NO: 440485 - DNA, 15 bp, Homo sapiens
actgaattttgctaa

SEQ ID NO: 440486 - DNA, 15 bp, Homo sapiens
ctgaattttgctaaa

SEQ ID NO: 440487 - DNA, 15 bp, Homo sapiens
tgaattttgctaaat

SEQ ID NO: 440488 - DNA, 15 bp, Homo sapiens
gaattttgctaaata

SEQ ID NO: 440489 - DNA, 15 bp, Homo sapiens
aattttgctaaatat

SEQ ID NO: 440490 - DNA, 15 bp, Homo sapiens
attttgctaaatatt

SEQ ID NO: 440491 - DNA, 15 bp, Homo sapiens
ttttgctaaatatta

SEQ ID NO: 440492 - DNA, 15 bp, Homo sapiens
tttgctaaatattat

SEQ ID NO: 440493 - DNA, 15 bp, Homo sapiens
ttgctaaatattatt

SEQ ID NO: 440494 - DNA, 15 bp, Homo sapiens
tgctaaatattatta

SEQ ID NO: 440495 - DNA, 15 bp, Homo sapiens
gctaaatattattaa

SEQ ID NO: 440496 - DNA, 15 bp, Homo sapiens
ctaaatattattaaa

SEQ ID NO: 440497 - DNA, 15 bp, Homo sapiens
taaatattattaaat

SEQ ID NO: 440498 - DNA, 15 bp, Homo sapiens
aaatattattaaata

SEQ ID NO: 440499 - DNA, 15 bp, Homo sapiens
aatattattaaatat

SEQ ID NO: 440500 - DNA, 15 bp, Homo sapiens
atattattaaatatg

SEQ ID NO: 440501 - DNA, 15 bp, Homo sapiens
tattattaaatatgt

SEQ ID NO: 440502 - DNA, 15 bp, Homo sapiens
attattaaatatgtc

SEQ ID NO: 440503 - DNA, 15 bp, Homo sapiens
ttattaaatatgtca

SEQ ID NO: 440504 - DNA, 15 bp, Homo sapiens
tattaaatatgtcaa

SEQ ID NO: 440505 - DNA, 15 bp, Homo sapiens
attaaatatgtcaaa

SEQ ID NO: 440506 - DNA, 15 bp, Homo sapiens
ttaaatatgtcaaaa

SEQ ID NO: 440507 - DNA, 15 bp, Homo sapiens
taaatatgtcaaaac

SEQ ID NO: 440508 - DNA, 15 bp, Homo sapiens
aaatatgtcaaaaca

SEQ ID NO: 440509 - DNA, 15 bp, Homo sapiens
aatatgtcaaaacaa

SEQ ID NO: 440510 - DNA, 15 bp, Homo sapiens
atatgtcaaaacaac

SEQ ID NO: 440511 - DNA, 15 bp, Homo sapiens
tatgtcaaaacaact

SEQ ID NO: 440512 - DNA, 15 bp, Homo sapiens
atgtcaaaacaactg

SEQ ID NO: 440513 - DNA, 15 bp, Homo sapiens
tgtcaaaacaactgg

SEQ ID NO: 440514 - DNA, 15 bp, Homo sapiens
gtcaaaacaactgga

SEQ ID NO: 440515 - DNA, 15 bp, Homo sapiens
tcaaaacaactggaa

SEQ ID NO: 440516 - DNA, 15 bp, Homo sapiens
caaaacaactggaaa

SEQ ID NO: 440517 - DNA, 15 bp, Homo sapiens
aaaacaactggaaaa

SEQ ID NO: 440518 - DNA, 15 bp, Homo sapiens
aaacaactggaaaac

SEQ ID NO: 440519 - DNA, 15 bp, Homo sapiens
aacaactggaaaacg

SEQ ID NO: 440520 - DNA, 15 bp, Homo sapiens
acaactggaaaacga

SEQ ID NO: 440521 - DNA, 15 bp, Homo sapiens
caactggaaaacgaa

SEQ ID NO: 440522 - DNA, 15 bp, Homo sapiens
aactggaaaacgaaa

SEQ ID NO: 440523 - DNA, 15 bp, Homo sapiens
actggaaaacgaaat

SEQ ID NO: 440524 - DNA, 15 bp, Homo sapiens
ctggaaaacgaaatc

SEQ ID NO: 440525 - DNA, 15 bp, Homo sapiens
tggaaaacgaaatcc

SEQ ID NO: 440526 - DNA, 15 bp, Homo sapiens
ggaaaacgaaatcct

SEQ ID NO: 440527 - DNA, 15 bp, Homo sapiens
gaaaacgaaatcctt

SEQ ID NO: 440528 - DNA, 15 bp, Homo sapiens
aaaacgaaatccttg

SEQ ID NO: 440529 - DNA, 15 bp, Homo sapiens
aaacgaaatccttgg

SEQ ID NO: 440530 - DNA, 15 bp, Homo sapiens
aacgaaatccttggg

SEQ ID NO: 440531 - DNA, 15 bp, Homo sapiens
acgaaatccttgggg

SEQ ID NO: 440532 - DNA, 15 bp, Homo sapiens
cgaaatccttggggg

SEQ ID NO: 440533 - DNA, 15 bp, Homo sapiens
gaaatccttgggggt

SEQ ID NO: 440534 - DNA, 15 bp, Homo sapiens
aaatccttgggggta

SEQ ID NO: 440535 - DNA, 15 bp, Homo sapiens
aatccttgggggtaa

SEQ ID NO: 440536 - DNA, 15 bp, Homo sapiens
atccttgggggtaat

SEQ ID NO: 440537 - DNA, 15 bp, Homo sapiens
tccttgggggtaatc

SEQ ID NO: 440538 - DNA, 15 bp, Homo sapiens
ccttgggggtaatca

SEQ ID NO: 440539 - DNA, 15 bp, Homo sapiens
cttgggggtaatcaa

SEQ ID NO: 440540 - DNA, 15 bp, Homo sapiens
ttgggggtaatcaaa

SEQ ID NO: 440541 - DNA, 15 bp, Homo sapiens
tgggggtaatcaaat

SEQ ID NO: 440542 - DNA, 15 bp, Homo sapiens
gggggtaatcaaata

SEQ ID NO: 440543 - DNA, 15 bp, Homo sapiens
ggggtaatcaaataa

SEQ ID NO: 440544 - DNA, 15 bp, Homo sapiens
gggtaatcaaataat

SEQ ID NO: 440545 - DNA, 15 bp, Homo sapiens
ggtaatcaaataatg

SEQ ID NO: 440546 - DNA, 15 bp, Homo sapiens
gtaatcaaataatgt

SEQ ID NO: 440547 - DNA, 15 bp, Homo sapiens
taatcaaataatgtt

SEQ ID NO: 440548 - DNA, 15 bp, Homo sapiens
aatcaaataatgtta

SEQ ID NO: 440549 - DNA, 15 bp, Homo sapiens
atcaaataatgttaa

SEQ ID NO: 440550 - DNA, 15 bp, Homo sapiens
tcaaataatgttaac

SEQ ID NO: 440551 - DNA, 15 bp, Homo sapiens
caaataatgttaact

SEQ ID NO: 440552 - DNA, 15 bp, Homo sapiens
aaataatgttaactg

SEQ ID NO: 440553 - DNA, 15 bp, Homo sapiens
aataatgttaactgc

SEQ ID NO: 440554 - DNA, 15 bp, Homo sapiens
ataatgttaactgcc

SEQ ID NO: 440555 - DNA, 15 bp, Homo sapiens
taatgttaactgcct

SEQ ID NO: 440556 - DNA, 15 bp, Homo sapiens
aatgttaactgccta

SEQ ID NO: 440557 - DNA, 15 bp, Homo sapiens
atgttaactgcctaa

SEQ ID NO: 440558 - DNA, 15 bp, Homo sapiens
tgttaactgcctaaa

SEQ ID NO: 440559 - DNA, 15 bp, Homo sapiens
gttaactgcctaaaa

SEQ ID NO: 440560 - DNA, 15 bp, Homo sapiens
ttaactgcctaaaat

SEQ ID NO: 440561 - DNA, 15 bp, Homo sapiens
taactgcctaaaatt

SEQ ID NO: 440562 - DNA, 15 bp, Homo sapiens
aactgcctaaaatta

SEQ ID NO: 440563 - DNA, 15 bp, Homo sapiens
actgcctaaaattat

SEQ ID NO: 440564 - DNA, 15 bp, Homo sapiens
ctgcctaaaattatc

SEQ ID NO: 440565 - DNA, 15 bp, Homo sapiens
tgcctaaaattatca

SEQ ID NO: 440566 - DNA, 15 bp, Homo sapiens
gcctaaaattatcat

SEQ ID NO: 440567 - DNA, 15 bp, Homo sapiens
cctaaaattatcatt

SEQ ID NO: 440568 - DNA, 15 bp, Homo sapiens
ctaaaattatcatta

SEQ ID NO: 440569 - DNA, 15 bp, Homo sapiens
taaaattatcattaa

SEQ ID NO: 440570 - DNA, 15 bp, Homo sapiens
aaaattatcattaat

SEQ ID NO: 440571 - DNA, 15 bp, Homo sapiens
aaattatcattaatc

SEQ ID NO: 440572 - DNA, 15 bp, Homo sapiens
aattatcattaatcg

SEQ ID NO: 440573 - DNA, 15 bp, Homo sapiens
attatcattaatcgt

SEQ ID NO: 440574 - DNA, 15 bp, Homo sapiens
ttatcattaatcgtt

SEQ ID NO: 440575 - DNA, 15 bp, Homo sapiens
tatcattaatcgttc

SEQ ID NO: 440576 - DNA, 15 bp, Homo sapiens
atcattaatcgttct

SEQ ID NO: 440577 - DNA, 15 bp, Homo sapiens
tcattaatcgttctt

SEQ ID NO: 440578 - DNA, 15 bp, Homo sapiens
cattaatcgttctta

SEQ ID NO: 440579 - DNA, 15 bp, Homo sapiens
attaatcgttcttat

SEQ ID NO: 440580 - DNA, 15 bp, Homo sapiens
ttaatcgttcttatt

SEQ ID NO: 440581 - DNA, 15 bp, Homo sapiens
taatcgttcttattt

SEQ ID NO: 440582 - DNA, 15 bp, Homo sapiens
aatcgttcttattta

SEQ ID NO: 440583 - DNA, 15 bp, Homo sapiens
atcgttcttatttac

SEQ ID NO: 440584 - DNA, 15 bp, Homo sapiens
tcgttcttatttaca

SEQ ID NO: 440585 - DNA, 15 bp, Homo sapiens
cgttcttatttacag

SEQ ID NO: 440586 - DNA, 15 bp, Homo sapiens
gttcttatttacaga

SEQ ID NO: 440587 - DNA, 15 bp, Homo sapiens
ttcttatttacagaa

SEQ ID NO: 440588 - DNA, 15 bp, Homo sapiens
tcttatttacagaat

SEQ ID NO: 440589 - DNA, 15 bp, Homo sapiens
cttatttacagaata

SEQ ID NO: 440590 - DNA, 15 bp, Homo sapiens
ttatttacagaatac

SEQ ID NO: 440591 - DNA, 15 bp, Homo sapiens
tatttacagaataca

SEQ ID NO: 440592 - DNA, 15 bp, Homo sapiens
atttacagaatacac

SEQ ID NO: 440593 - DNA, 15 bp, Homo sapiens
tttacagaatacaca

SEQ ID NO: 440594 - DNA, 15 bp, Homo sapiens
ttacagaatacacac

SEQ ID NO: 440595 - DNA, 15 bp, Homo sapiens
tacagaatacacacc

SEQ ID NO: 440596 - DNA, 15 bp, Homo sapiens
acagaatacacacct

SEQ ID NO: 440597 - DNA, 15 bp, Homo sapiens
cagaatacacacctt

SEQ ID NO: 440598 - DNA, 15 bp, Homo sapiens
agaatacacaccttc

SEQ ID NO: 440599 - DNA, 15 bp, Homo sapiens
gaatacacaccttct

SEQ ID NO: 440600 - DNA, 15 bp, Homo sapiens
aatacacaccttctg

SEQ ID NO: 440601 - DNA, 15 bp, Homo sapiens
atacacaccttctgg

SEQ ID NO: 440602 - DNA, 15 bp, Homo sapiens
tacacaccttctggc

SEQ ID NO: 440603 - DNA, 15 bp, Homo sapiens
acacaccttctggca

SEQ ID NO: 440604 - DNA, 15 bp, Homo sapiens
cacaccttctggcag

SEQ ID NO: 440605 - DNA, 15 bp, Homo sapiens
acaccttctggcagg

SEQ ID NO: 440606 - DNA, 15 bp, Homo sapiens
caccttctggcagga

SEQ ID NO: 440607 - DNA, 15 bp, Homo sapiens
accttctggcaggag

SEQ ID NO: 440608 - DNA, 15 bp, Homo sapiens
ccttctggcaggaga

SEQ ID NO: 440609 - DNA, 15 bp, Homo sapiens
cttctggcaggagaa

SEQ ID NO: 440610 - DNA, 15 bp, Homo sapiens
ttctggcaggagaag

SEQ ID NO: 440611 - DNA, 15 bp, Homo sapiens
tctggcaggagaagg

SEQ ID NO: 440612 - DNA, 15 bp, Homo sapiens
ctggcaggagaaggg

SEQ ID NO: 440613 - DNA, 15 bp, Homo sapiens
tggcaggagaagggc

SEQ ID NO: 440614 - DNA, 15 bp, Homo sapiens
ggcaggagaagggct

SEQ ID NO: 440615 - DNA, 15 bp, Homo sapiens
gcaggagaagggctt

SEQ ID NO: 440616 - DNA, 15 bp, Homo sapiens
caggagaagggctta

SEQ ID NO: 440617 - DNA, 15 bp, Homo sapiens
aggagaagggcttag

SEQ ID NO: 440618 - DNA, 15 bp, Homo sapiens
ggagaagggcttagg

SEQ ID NO: 440619 - DNA, 15 bp, Homo sapiens
gagaagggcttagga

SEQ ID NO: 440620 - DNA, 15 bp, Homo sapiens
agaagggcttaggag

SEQ ID NO: 440621 - DNA, 15 bp, Homo sapiens
gaagggcttaggagt

SEQ ID NO: 440622 - DNA, 15 bp, Homo sapiens
aagggcttaggagtc

SEQ ID NO: 440623 - DNA, 15 bp, Homo sapiens
agggcttaggagtca

SEQ ID NO: 440624 - DNA, 15 bp, Homo sapiens
gggcttaggagtcac

SEQ ID NO: 440625 - DNA, 15 bp, Homo sapiens
ggcttaggagtcaca

SEQ ID NO: 440626 - DNA, 15 bp, Homo sapiens
gcttaggagtcacac

SEQ ID NO: 440627 - DNA, 15 bp, Homo sapiens
cttaggagtcacacc

SEQ ID NO: 440628 - DNA, 15 bp, Homo sapiens
ttaggagtcacacct

SEQ ID NO: 440629 - DNA, 15 bp, Homo sapiens
taggagtcacacctg

SEQ ID NO: 440630 - DNA, 15 bp, Homo sapiens
aggagtcacacctgc

SEQ ID NO: 440631 - DNA, 15 bp, Homo sapiens
ggagtcacacctgcc

SEQ ID NO: 440632 - DNA, 15 bp, Homo sapiens
gagtcacacctgcca

SEQ ID NO: 440633 - DNA, 15 bp, Homo sapiens
agtcacacctgccaa

SEQ ID NO: 440634 - DNA, 15 bp, Homo sapiens
gtcacacctgccaac

SEQ ID NO: 440635 - DNA, 15 bp, Homo sapiens
tcacacctgccaaca

SEQ ID NO: 440636 - DNA, 15 bp, Homo sapiens
cacacctgccaacag

SEQ ID NO: 440637 - DNA, 15 bp, Homo sapiens
acacctgccaacaga

SEQ ID NO: 440638 - DNA, 15 bp, Homo sapiens
cacctgccaacagac

SEQ ID NO: 440639 - DNA, 15 bp, Homo sapiens
acctgccaacagact

SEQ ID NO: 440640 - DNA, 15 bp, Homo sapiens
cctgccaacagactt

SEQ ID NO: 440641 - DNA, 15 bp, Homo sapiens
ctgccaacagacttc

SEQ ID NO: 440642 - DNA, 15 bp, Homo sapiens
tgccaacagacttcc

SEQ ID NO: 440643 - DNA, 15 bp, Homo sapiens
gccaacagacttcca

SEQ ID NO: 440644 - DNA, 15 bp, Homo sapiens
ccaacagacttccag

SEQ ID NO: 440645 - DNA, 15 bp, Homo sapiens
caacagacttccagt

SEQ ID NO: 440646 - DNA, 15 bp, Homo sapiens
aacagacttccagtt

SEQ ID NO: 440647 - DNA, 15 bp, Homo sapiens
acagacttccagtta

SEQ ID NO: 440648 - DNA, 15 bp, Homo sapiens
cagacttccagttag

SEQ ID NO: 440649 - DNA, 15 bp, Homo sapiens
agacttccagttagc

SEQ ID NO: 440650 - DNA, 15 bp, Homo sapiens
gacttccagttagca

SEQ ID NO: 440651 - DNA, 15 bp, Homo sapiens
acttccagttagcac

SEQ ID NO: 440652 - DNA, 15 bp, Homo sapiens
cttccagttagcacc

SEQ ID NO: 440653 - DNA, 15 bp, Homo sapiens
ttccagttagcacct

SEQ ID NO: 440654 - DNA, 15 bp, Homo sapiens
tccagttagcacctt

SEQ ID NO: 440655 - DNA, 15 bp, Homo sapiens
ccagttagcaccttt

SEQ ID NO: 440656 - DNA, 15 bp, Homo sapiens
cagttagcacctttg

SEQ ID NO: 440657 - DNA, 15 bp, Homo sapiens
agttagcacctttga

SEQ ID NO: 440658 - DNA, 15 bp, Homo sapiens
gttagcacctttgat

SEQ ID NO: 440659 - DNA, 15 bp, Homo sapiens
ttagcacctttgata

SEQ ID NO: 440660 - DNA, 15 bp, Homo sapiens
tagcacctttgatac

SEQ ID NO: 440661 - DNA, 15 bp, Homo sapiens
agcacctttgatact

SEQ ID NO: 440662 - DNA, 15 bp, Homo sapiens
gcacctttgatacta

SEQ ID NO: 440663 - DNA, 15 bp, Homo sapiens
cacctttgatactag

SEQ ID NO: 440664 - DNA, 15 bp, Homo sapiens
acctttgatactagc

SEQ ID NO: 440665 - DNA, 15 bp, Homo sapiens
cctttgatactagca

SEQ ID NO: 440666 - DNA, 15 bp, Homo sapiens
ctttgatactagcag

SEQ ID NO: 440667 - DNA, 15 bp, Homo sapiens
tttgatactagcaga

SEQ ID NO: 440668 - DNA, 15 bp, Homo sapiens
ttgatactagcagat

SEQ ID NO: 440669 - DNA, 15 bp, Homo sapiens
tgatactagcagatg

SEQ ID NO: 440670 - DNA, 15 bp, Homo sapiens
gatactagcagatgt

SEQ ID NO: 440671 - DNA, 15 bp, Homo sapiens
atactagcagatgtt

SEQ ID NO: 440672 - DNA, 15 bp, Homo sapiens
tactagcagatgttc

SEQ ID NO: 440673 - DNA, 15 bp, Homo sapiens
actagcagatgttct

SEQ ID NO: 440674 - DNA, 15 bp, Homo sapiens
ctagcagatgttctg

SEQ ID NO: 440675 - DNA, 15 bp, Homo sapiens
tagcagatgttctgt

SEQ ID NO: 440676 - DNA, 15 bp, Homo sapiens
agcagatgttctgtt

SEQ ID NO: 440677 - DNA, 15 bp, Homo sapiens
gcagatgttctgttt

SEQ ID NO: 440678 - DNA, 15 bp, Homo sapiens
cagatgttctgtttt

SEQ ID NO: 440679 - DNA, 15 bp, Homo sapiens
agatgttctgttttt

SEQ ID NO: 440680 - DNA, 15 bp, Homo sapiens
gatgttctgttttta

SEQ ID NO: 440681 - DNA, 15 bp, Homo sapiens
atgttctgtttttat

SEQ ID NO: 440682 - DNA, 15 bp, Homo sapiens
tgttctgtttttatg

SEQ ID NO: 440683 - DNA, 15 bp, Homo sapiens
gttctgtttttatgg

SEQ ID NO: 440684 - DNA, 15 bp, Homo sapiens
ttctgtttttatggc

SEQ ID NO: 440685 - DNA, 15 bp, Homo sapiens
tctgtttttatggca

SEQ ID NO: 440686 - DNA, 15 bp, Homo sapiens
ctgtttttatggcaa

SEQ ID NO: 440687 - DNA, 15 bp, Homo sapiens
tgtttttatggcaag

SEQ ID NO: 440688 - DNA, 15 bp, Homo sapiens
gtttttatggcaagg

SEQ ID NO: 440689 - DNA, 15 bp, Homo sapiens
tttttatggcaagga

SEQ ID NO: 440690 - DNA, 15 bp, Homo sapiens
ttttatggcaaggaa

SEQ ID NO: 440691 - DNA, 15 bp, Homo sapiens
tttatggcaaggaag

SEQ ID NO: 440692 - DNA, 15 bp, Homo sapiens
ttatggcaaggaagg

SEQ ID NO: 440693 - DNA, 15 bp, Homo sapiens
tatggcaaggaaggc

SEQ ID NO: 440694 - DNA, 15 bp, Homo sapiens
atggcaaggaaggcc

SEQ ID NO: 440695 - DNA, 15 bp, Homo sapiens
tggcaaggaaggcca

SEQ ID NO: 440696 - DNA, 15 bp, Homo sapiens
ggcaaggaaggccac

SEQ ID NO: 440697 - DNA, 15 bp, Homo sapiens
gcaaggaaggccaca

SEQ ID NO: 440698 - DNA, 15 bp, Homo sapiens
caaggaaggccacat

SEQ ID NO: 440699 - DNA, 15 bp, Homo sapiens
aaggaaggccacata

SEQ ID NO: 440700 - DNA, 15 bp, Homo sapiens
aggaaggccacatag

SEQ ID NO: 440701 - DNA, 15 bp, Homo sapiens
ggaaggccacatagt

SEQ ID NO: 440702 - DNA, 15 bp, Homo sapiens
gaaggccacatagtc

SEQ ID NO: 440703 - DNA, 15 bp, Homo sapiens
aaggccacatagtct

SEQ ID NO: 440704 - DNA, 15 bp, Homo sapiens
aggccacatagtctt

SEQ ID NO: 440705 - DNA, 15 bp, Homo sapiens
ggccacatagtcttt

SEQ ID NO: 440706 - DNA, 15 bp, Homo sapiens
gccacatagtctttt

SEQ ID NO: 440707 - DNA, 15 bp, Homo sapiens
ccacatagtctttta

SEQ ID NO: 440708 - DNA, 15 bp, Homo sapiens
cacatagtcttttat

SEQ ID NO: 440709 - DNA, 15 bp, Homo sapiens
acatagtcttttatt

SEQ ID NO: 440710 - DNA, 15 bp, Homo sapiens
catagtcttttattc

SEQ ID NO: 440711 - DNA, 15 bp, Homo sapiens
atagtcttttattct

SEQ ID NO: 440712 - DNA, 15 bp, Homo sapiens
tagtcttttattctg

SEQ ID NO: 440713 - DNA, 15 bp, Homo sapiens
agtcttttattctgt

SEQ ID NO: 440714 - DNA, 15 bp, Homo sapiens
gtcttttattctgtt

SEQ ID NO: 440715 - DNA, 15 bp, Homo sapiens
tcttttattctgtta

SEQ ID NO: 440716 - DNA, 15 bp, Homo sapiens
cttttattctgttat

SEQ ID NO: 440717 - DNA, 15 bp, Homo sapiens
ttttattctgttata

SEQ ID NO: 440718 - DNA, 15 bp, Homo sapiens
tttattctgttatag

SEQ ID NO: 440719 - DNA, 15 bp, Homo sapiens
ttattctgttatagg

SEQ ID NO: 440720 - DNA, 15 bp, Homo sapiens
tattctgttatagga

SEQ ID NO: 440721 - DNA, 15 bp, Homo sapiens
attctgttataggaa

SEQ ID NO: 440722 - DNA, 15 bp, Homo sapiens
ttctgttataggaaa

SEQ ID NO: 440723 - DNA, 15 bp, Homo sapiens
tctgttataggaaag

SEQ ID NO: 440724 - DNA, 15 bp, Homo sapiens
ctgttataggaaagt

SEQ ID NO: 440725 - DNA, 15 bp, Homo sapiens
tgttataggaaagtg

SEQ ID NO: 440726 - DNA, 15 bp, Homo sapiens
gttataggaaagtgc

SEQ ID NO: 440727 - DNA, 15 bp, Homo sapiens
ttataggaaagtgca

SEQ ID NO: 440728 - DNA, 15 bp, Homo sapiens
tataggaaagtgcag

SEQ ID NO: 440729 - DNA, 15 bp, Homo sapiens
ataggaaagtgcagt

SEQ ID NO: 440730 - DNA, 15 bp, Homo sapiens
taggaaagtgcagtc

SEQ ID NO: 440731 - DNA, 15 bp, Homo sapiens
aggaaagtgcagtca

SEQ ID NO: 440732 - DNA, 15 bp, Homo sapiens
ggaaagtgcagtcat

SEQ ID NO: 440733 - DNA, 15 bp, Homo sapiens
gaaagtgcagtcata

SEQ ID NO: 440734 - DNA, 15 bp, Homo sapiens
aaagtgcagtcataa

SEQ ID NO: 440735 - DNA, 15 bp, Homo sapiens
aagtgcagtcataac

SEQ ID NO: 440736 - DNA, 15 bp, Homo sapiens
agtgcagtcataaca

SEQ ID NO: 440737 - DNA, 15 bp, Homo sapiens
gtgcagtcataacat

SEQ ID NO: 440738 - DNA, 15 bp, Homo sapiens
tgcagtcataacatg

SEQ ID NO: 440739 - DNA, 15 bp, Homo sapiens
gcagtcataacatga

SEQ ID NO: 440740 - DNA, 15 bp, Homo sapiens
cagtcataacatgat

SEQ ID NO: 440741 - DNA, 15 bp, Homo sapiens
agtcataacatgata

SEQ ID NO: 440742 - DNA, 15 bp, Homo sapiens
gtcataacatgataa

SEQ ID NO: 440743 - DNA, 15 bp, Homo sapiens
tcataacatgataaa

SEQ ID NO: 440744 - DNA, 15 bp, Homo sapiens
cataacatgataaat

SEQ ID NO: 440745 - DNA, 15 bp, Homo sapiens
ataacatgataaata

SEQ ID NO: 440746 - DNA, 15 bp, Homo sapiens
taacatgataaatag

SEQ ID NO: 440747 - DNA, 15 bp, Homo sapiens
aacatgataaatagg

SEQ ID NO: 440748 - DNA, 15 bp, Homo sapiens
acatgataaataggt

SEQ ID NO: 440749 - DNA, 15 bp, Homo sapiens
catgataaataggtt

SEQ ID NO: 440750 - DNA, 15 bp, Homo sapiens
atgataaataggttc

SEQ ID NO: 440751 - DNA, 15 bp, Homo sapiens
tgataaataggttct

SEQ ID NO: 440752 - DNA, 15 bp, Homo sapiens
gataaataggttctt

SEQ ID NO: 440753 - DNA, 15 bp, Homo sapiens
ataaataggttcttt

SEQ ID NO: 440754 - DNA, 15 bp, Homo sapiens
taaataggttcttta

SEQ ID NO: 440755 - DNA, 15 bp, Homo sapiens
aaataggttctttat

SEQ ID NO: 440756 - DNA, 15 bp, Homo sapiens
aataggttctttatg

SEQ ID NO: 440757 - DNA, 15 bp, Homo sapiens
ataggttctttatgc

SEQ ID NO: 440758 - DNA, 15 bp, Homo sapiens
taggttctttatgct

SEQ ID NO: 440759 - DNA, 15 bp, Homo sapiens
aggttctttatgcta

SEQ ID NO: 440760 - DNA, 15 bp, Homo sapiens
ggttctttatgctag

SEQ ID NO: 440761 - DNA, 15 bp, Homo sapiens
gttctttatgctaga

SEQ ID NO: 440762 - DNA, 15 bp, Homo sapiens
ttctttatgctagaa

SEQ ID NO: 440763 - DNA, 15 bp, Homo sapiens
tctttatgctagaac

SEQ ID NO: 440764 - DNA, 15 bp, Homo sapiens
ctttatgctagaaca

SEQ ID NO: 440765 - DNA, 15 bp, Homo sapiens
tttatgctagaacac

SEQ ID NO: 440766 - DNA, 15 bp, Homo sapiens
ttatgctagaacaca

SEQ ID NO: 440767 - DNA, 15 bp, Homo sapiens
tatgctagaacacac

SEQ ID NO: 440768 - DNA, 15 bp, Homo sapiens
atgctagaacacaca

SEQ ID NO: 440769 - DNA, 15 bp, Homo sapiens
tgctagaacacacag

SEQ ID NO: 440770 - DNA, 15 bp, Homo sapiens
gctagaacacacagc

SEQ ID NO: 440771 - DNA, 15 bp, Homo sapiens
ctagaacacacagca

SEQ ID NO: 440772 - DNA, 15 bp, Homo sapiens
tagaacacacagcag

SEQ ID NO: 440773 - DNA, 15 bp, Homo sapiens
agaacacacagcagt

SEQ ID NO: 440774 - DNA, 15 bp, Homo sapiens
gaacacacagcagtt

SEQ ID NO: 440775 - DNA, 15 bp, Homo sapiens
aacacacagcagttc

SEQ ID NO: 440776 - DNA, 15 bp, Homo sapiens
acacacagcagttct

SEQ ID NO: 440777 - DNA, 15 bp, Homo sapiens
cacacagcagttctg

SEQ ID NO: 440778 - DNA, 15 bp, Homo sapiens
acacagcagttctga

SEQ ID NO: 440779 - DNA, 15 bp, Homo sapiens
cacagcagttctgaa

SEQ ID NO: 440780 - DNA, 15 bp, Homo sapiens
acagcagttctgaaa

SEQ ID NO: 440781 - DNA, 15 bp, Homo sapiens
cagcagttctgaaac

SEQ ID NO: 440782 - DNA, 15 bp, Homo sapiens
agcagttctgaaacc

SEQ ID NO: 440783 - DNA, 15 bp, Homo sapiens
gcagttctgaaacca

SEQ ID NO: 440784 - DNA, 15 bp, Homo sapiens
cagttctgaaaccat

SEQ ID NO: 440785 - DNA, 15 bp, Homo sapiens
agttctgaaaccatt

SEQ ID NO: 440786 - DNA, 15 bp, Homo sapiens
gttctgaaaccattt

SEQ ID NO: 440787 - DNA, 15 bp, Homo sapiens
ttctgaaaccatttt

SEQ ID NO: 440788 - DNA, 15 bp, Homo sapiens
tctgaaaccatttta

SEQ ID NO: 440789 - DNA, 15 bp, Homo sapiens
ctgaaaccattttaa

SEQ ID NO: 440790 - DNA, 15 bp, Homo sapiens
tgaaaccattttaaa

SEQ ID NO: 440791 - DNA, 15 bp, Homo sapiens
gaaaccattttaaaa

SEQ ID NO: 440792 - DNA, 15 bp, Homo sapiens
aaaccattttaaaac

SEQ ID NO: 440793 - DNA, 15 bp, Homo sapiens
aaccattttaaaact

SEQ ID NO: 440794 - DNA, 15 bp, Homo sapiens
accattttaaaactt

SEQ ID NO: 440795 - DNA, 15 bp, Homo sapiens
ccattttaaaacttg

SEQ ID NO: 440796 - DNA, 15 bp, Homo sapiens
cattttaaaacttgc

SEQ ID NO: 440797 - DNA, 15 bp, Homo sapiens
attttaaaacttgct

SEQ ID NO: 440798 - DNA, 15 bp, Homo sapiens
ttttaaaacttgctt

SEQ ID NO: 440799 - DNA, 15 bp, Homo sapiens
tttaaaacttgcttt

SEQ ID NO: 440800 - DNA, 15 bp, Homo sapiens
ttaaaacttgcttta

SEQ ID NO: 440801 - DNA, 15 bp, Homo sapiens
taaaacttgctttat

SEQ ID NO: 440802 - DNA, 15 bp, Homo sapiens
aaaacttgctttatc

SEQ ID NO: 440803 - DNA, 15 bp, Homo sapiens
aaacttgctttatct

SEQ ID NO: 440804 - DNA, 15 bp, Homo sapiens
aacttgctttatctc

SEQ ID NO: 440805 - DNA, 15 bp, Homo sapiens
acttgctttatctcg

SEQ ID NO: 440806 - DNA, 15 bp, Homo sapiens
cttgctttatctcga

SEQ ID NO: 440807 - DNA, 15 bp, Homo sapiens
ttgctttatctcgag

SEQ ID NO: 440808 - DNA, 15 bp, Homo sapiens
tgctttatctcgagc

SEQ ID NO: 440809 - DNA, 15 bp, Homo sapiens
gctttatctcgagcc

SEQ ID NO: 440810 - DNA, 15 bp, Homo sapiens
ctttatctcgagccc

SEQ ID NO: 440811 - DNA, 15 bp, Homo sapiens
tttatctcgagcccc

SEQ ID NO: 440812 - DNA, 15 bp, Homo sapiens
ttatctcgagcccct

SEQ ID NO: 440813 - DNA, 15 bp, Homo sapiens
tatctcgagcccctt

SEQ ID NO: 440814 - DNA, 15 bp, Homo sapiens
atctcgagcccctta

SEQ ID NO: 440815 - DNA, 15 bp, Homo sapiens
tctcgagccccttaa

SEQ ID NO: 440816 - DNA, 15 bp, Homo sapiens
ctcgagccccttaat

SEQ ID NO: 440817 - DNA, 15 bp, Homo sapiens
tcgagccccttaatt

SEQ ID NO: 440818 - DNA, 15 bp, Homo sapiens
cgagccccttaattt

SEQ ID NO: 440819 - DNA, 15 bp, Homo sapiens
gagccccttaatttg

SEQ ID NO: 440820 - DNA, 15 bp, Homo sapiens
agccccttaatttgg

SEQ ID NO: 440821 - DNA, 15 bp, Homo sapiens
gccccttaatttgga

SEQ ID NO: 440822 - DNA, 15 bp, Homo sapiens
ccccttaatttggaa

SEQ ID NO: 440823 - DNA, 15 bp, Homo sapiens
cccttaatttggaag

SEQ ID NO: 440824 - DNA, 15 bp, Homo sapiens
ccttaatttggaagc

SEQ ID NO: 440825 - DNA, 15 bp, Homo sapiens
cttaatttggaagct

SEQ ID NO: 440826 - DNA, 15 bp, Homo sapiens
ttaatttggaagctc

SEQ ID NO: 440827 - DNA, 15 bp, Homo sapiens
taatttggaagctct

SEQ ID NO: 440828 - DNA, 15 bp, Homo sapiens
aatttggaagctctt

SEQ ID NO: 440829 - DNA, 15 bp, Homo sapiens
atttggaagctcttc

SEQ ID NO: 440830 - DNA, 15 bp, Homo sapiens
tttggaagctcttca

SEQ ID NO: 440831 - DNA, 15 bp, Homo sapiens
ttggaagctcttcaa

SEQ ID NO: 440832 - DNA, 15 bp, Homo sapiens
tggaagctcttcaaa

SEQ ID NO: 440833 - DNA, 15 bp, Homo sapiens
ggaagctcttcaaaa

SEQ ID NO: 440834 - DNA, 15 bp, Homo sapiens
gaagctcttcaaaaa

SEQ ID NO: 440835 - DNA, 15 bp, Homo sapiens
aagctcttcaaaaac

SEQ ID NO: 440836 - DNA, 15 bp, Homo sapiens
agctcttcaaaaaca

SEQ ID NO: 440837 - DNA, 15 bp, Homo sapiens
gctcttcaaaaacaa

SEQ ID NO: 440838 - DNA, 15 bp, Homo sapiens
ctcttcaaaaacaaa

SEQ ID NO: 440839 - DNA, 15 bp, Homo sapiens
tcttcaaaaacaaaa

SEQ ID NO: 440840 - DNA, 15 bp, Homo sapiens
cttcaaaaacaaaag

SEQ ID NO: 440841 - DNA, 15 bp, Homo sapiens
ttcaaaaacaaaaga

SEQ ID NO: 440842 - DNA, 15 bp, Homo sapiens
tcaaaaacaaaagat

SEQ ID NO: 440843 - DNA, 15 bp, Homo sapiens
caaaaacaaaagata

SEQ ID NO: 440844 - DNA, 15 bp, Homo sapiens
aaaaacaaaagataa

SEQ ID NO: 440845 - DNA, 15 bp, Homo sapiens
aaaacaaaagataaa

SEQ ID NO: 440846 - DNA, 15 bp, Homo sapiens
aaacaaaagataaac

SEQ ID NO: 440847 - DNA, 15 bp, Homo sapiens
aacaaaagataaact

SEQ ID NO: 440848 - DNA, 15 bp, Homo sapiens
acaaaagataaactt

SEQ ID NO: 440849 - DNA, 15 bp, Homo sapiens
caaaagataaacttt

SEQ ID NO: 440850 - DNA, 15 bp, Homo sapiens
aaaagataaactttc

SEQ ID NO: 440851 - DNA, 15 bp, Homo sapiens
aaagataaactttct

SEQ ID NO: 440852 - DNA, 15 bp, Homo sapiens
aagataaactttctt

SEQ ID NO: 440853 - DNA, 15 bp, Homo sapiens
agataaactttcttg

SEQ ID NO: 440854 - DNA, 15 bp, Homo sapiens
gataaactttcttga

SEQ ID NO: 440855 - DNA, 15 bp, Homo sapiens
ataaactttcttgat

SEQ ID NO: 440856 - DNA, 15 bp, Homo sapiens
taaactttcttgata

SEQ ID NO: 440857 - DNA, 15 bp, Homo sapiens
aaactttcttgatag

SEQ ID NO: 440858 - DNA, 15 bp, Homo sapiens
aactttcttgataga

SEQ ID NO: 440859 - DNA, 15 bp, Homo sapiens
actttcttgatagaa

SEQ ID NO: 440860 - DNA, 15 bp, Homo sapiens
ctttcttgatagaaa

SEQ ID NO: 440861 - DNA, 15 bp, Homo sapiens
tttcttgatagaaag

SEQ ID NO: 440862 - DNA, 15 bp, Homo sapiens
ttcttgatagaaaga

SEQ ID NO: 440863 - DNA, 15 bp, Homo sapiens
tcttgatagaaagac

SEQ ID NO: 440864 - DNA, 15 bp, Homo sapiens
cttgatagaaagact

SEQ ID NO: 440865 - DNA, 15 bp, Homo sapiens
ttgatagaaagactc

SEQ ID NO: 440866 - DNA, 15 bp, Homo sapiens
tgatagaaagactcc

SEQ ID NO: 440867 - DNA, 15 bp, Homo sapiens
gatagaaagactcct

SEQ ID NO: 440868 - DNA, 15 bp, Homo sapiens
atagaaagactcctc

SEQ ID NO: 440869 - DNA, 15 bp, Homo sapiens
tagaaagactcctca

SEQ ID NO: 440870 - DNA, 15 bp, Homo sapiens
agaaagactcctcat

SEQ ID NO: 440871 - DNA, 15 bp, Homo sapiens
gaaagactcctcatt

SEQ ID NO: 440872 - DNA, 15 bp, Homo sapiens
aaagactcctcattg

SEQ ID NO: 440873 - DNA, 15 bp, Homo sapiens
aagactcctcattgc

SEQ ID NO: 440874 - DNA, 15 bp, Homo sapiens
agactcctcattgcc

SEQ ID NO: 440875 - DNA, 15 bp, Homo sapiens
gactcctcattgcca

SEQ ID NO: 440876 - DNA, 15 bp, Homo sapiens
actcctcattgccat

SEQ ID NO: 440877 - DNA, 15 bp, Homo sapiens
ctcctcattgccata

SEQ ID NO: 440878 - DNA, 15 bp, Homo sapiens
tcctcattgccatat

SEQ ID NO: 440879 - DNA, 15 bp, Homo sapiens
cctcattgccatata

SEQ ID NO: 440880 - DNA, 15 bp, Homo sapiens
ctcattgccatataa

SEQ ID NO: 440881 - DNA, 15 bp, Homo sapiens
tcattgccatataac

SEQ ID NO: 440882 - DNA, 15 bp, Homo sapiens
cattgccatataaca

SEQ ID NO: 440883 - DNA, 15 bp, Homo sapiens
attgccatataacac

SEQ ID NO: 440884 - DNA, 15 bp, Homo sapiens
ttgccatataacacc

SEQ ID NO: 440885 - DNA, 15 bp, Homo sapiens
tgccatataacacct

SEQ ID NO: 440886 - DNA, 15 bp, Homo sapiens
gccatataacacctg

SEQ ID NO: 440887 - DNA, 15 bp, Homo sapiens
ccatataacacctga

SEQ ID NO: 440888 - DNA, 15 bp, Homo sapiens
catataacacctgac

SEQ ID NO: 440889 - DNA, 15 bp, Homo sapiens
atataacacctgacc

SEQ ID NO: 440890 - DNA, 15 bp, Homo sapiens
tataacacctgacca

SEQ ID NO: 440891 - DNA, 15 bp, Homo sapiens
ataacacctgaccat

SEQ ID NO: 440892 - DNA, 15 bp, Homo sapiens
taacacctgaccata

SEQ ID NO: 440893 - DNA, 15 bp, Homo sapiens
aacacctgaccataa

SEQ ID NO: 440894 - DNA, 15 bp, Homo sapiens
acacctgaccataaa

SEQ ID NO: 440895 - DNA, 15 bp, Homo sapiens
cacctgaccataaaa

SEQ ID NO: 440896 - DNA, 15 bp, Homo sapiens
acctgaccataaaaa

SEQ ID NO: 440897 - DNA, 15 bp, Homo sapiens
cctgaccataaaaag

SEQ ID NO: 440898 - DNA, 15 bp, Homo sapiens
ctgaccataaaaaga

SEQ ID NO: 440899 - DNA, 15 bp, Homo sapiens
tgaccataaaaagaa

SEQ ID NO: 440900 - DNA, 15 bp, Homo sapiens
gaccataaaaagaaa

SEQ ID NO: 440901 - DNA, 15 bp, Homo sapiens
accataaaaagaaaa

SEQ ID NO: 440902 - DNA, 15 bp, Homo sapiens
ccataaaaagaaaaa

SEQ ID NO: 440903 - DNA, 15 bp, Homo sapiens
cataaaaagaaaaac

SEQ ID NO: 440904 - DNA, 15 bp, Homo sapiens
ataaaaagaaaaaca

SEQ ID NO: 440905 - DNA, 15 bp, Homo sapiens
taaaaagaaaaacaa

SEQ ID NO: 440906 - DNA, 15 bp, Homo sapiens
aaaaagaaaaacaaa

SEQ ID NO: 440907 - DNA, 15 bp, Homo sapiens
aaaagaaaaacaaaa

SEQ ID NO: 440908 - DNA, 15 bp, Homo sapiens
aaagaaaaacaaaaa

SEQ ID NO: 440909 - DNA, 15 bp, Homo sapiens
aagaaaaacaaaaac

SEQ ID NO: 440910 - DNA, 15 bp, Homo sapiens
agaaaaacaaaaacc

SEQ ID NO: 440911 - DNA, 15 bp, Homo sapiens
gaaaaacaaaaacca

SEQ ID NO: 440912 - DNA, 15 bp, Homo sapiens
aaacaaaaaccaaag

SEQ ID NO: 440913 - DNA, 15 bp, Homo sapiens
aacaaaaaccaaaga

SEQ ID NO: 440914 - DNA, 15 bp, Homo sapiens
acaaaaaccaaagac

SEQ ID NO: 440915 - DNA, 15 bp, Homo sapiens
caaaaaccaaagacc

SEQ ID NO: 440916 - DNA, 15 bp, Homo sapiens
aaaaaccaaagacct

SEQ ID NO: 440917 - DNA, 15 bp, Homo sapiens
aaaaccaaagacctt

SEQ ID NO: 440918 - DNA, 15 bp, Homo sapiens
aaaccaaagaccttg

SEQ ID NO: 440919 - DNA, 15 bp, Homo sapiens
aaccaaagaccttgt

SEQ ID NO: 440920 - DNA, 15 bp, Homo sapiens
accaaagaccttgtt

SEQ ID NO: 440921 - DNA, 15 bp, Homo sapiens
ccaaagaccttgttt

SEQ ID NO: 440922 - DNA, 15 bp, Homo sapiens
caaagaccttgtttg

SEQ ID NO: 440923 - DNA, 15 bp, Homo sapiens
aaagaccttgtttgt

SEQ ID NO: 440924 - DNA, 15 bp, Homo sapiens
aagaccttgtttgtc

SEQ ID NO: 440925 - DNA, 15 bp, Homo sapiens
agaccttgtttgtca

SEQ ID NO: 440926 - DNA, 15 bp, Homo sapiens
gaccttgtttgtcaa

SEQ ID NO: 440927 - DNA, 15 bp, Homo sapiens
accttgtttgtcaaa

SEQ ID NO: 440928 - DNA, 15 bp, Homo sapiens
ccttgtttgtcaaag

SEQ ID NO: 440929 - DNA, 15 bp, Homo sapiens
cttgtttgtcaaagc

SEQ ID NO: 440930 - DNA, 15 bp, Homo sapiens
ttgtttgtcaaagct

SEQ ID NO: 440931 - DNA, 15 bp, Homo sapiens
tgtttgtcaaagctt

SEQ ID NO: 440932 - DNA, 15 bp, Homo sapiens
gtttgtcaaagcttt

SEQ ID NO: 440933 - DNA, 15 bp, Homo sapiens
tttgtcaaagctttt

SEQ ID NO: 440934 - DNA, 15 bp, Homo sapiens
ttgtcaaagcttttt

SEQ ID NO: 440935 - DNA, 15 bp, Homo sapiens
tgtcaaagcttttta

SEQ ID NO: 440936 - DNA, 15 bp, Homo sapiens
gtcaaagctttttaa

SEQ ID NO: 440937 - DNA, 15 bp, Homo sapiens
tcaaagctttttaaa

SEQ ID NO: 440938 - DNA, 15 bp, Homo sapiens
caaagctttttaaat

SEQ ID NO: 440939 - DNA, 15 bp, Homo sapiens
aaagctttttaaatg

SEQ ID NO: 440940 - DNA, 15 bp, Homo sapiens
aagctttttaaatgt

SEQ ID NO: 440941 - DNA, 15 bp, Homo sapiens
agctttttaaatgtt

SEQ ID NO: 440942 - DNA, 15 bp, Homo sapiens
gctttttaaatgttt

SEQ ID NO: 440943 - DNA, 15 bp, Homo sapiens
ctttttaaatgtttt

SEQ ID NO: 440944 - DNA, 15 bp, Homo sapiens
tttttaaatgtttta

SEQ ID NO: 440945 - DNA, 15 bp, Homo sapiens
ttttaaatgttttaa

SEQ ID NO: 440946 - DNA, 15 bp, Homo sapiens
tttaaatgttttaac

SEQ ID NO: 440947 - DNA, 15 bp, Homo sapiens
ttaaatgttttaacc

SEQ ID NO: 440948 - DNA, 15 bp, Homo sapiens
taaatgttttaacct

SEQ ID NO: 440949 - DNA, 15 bp, Homo sapiens
aaatgttttaacctg

SEQ ID NO: 440950 - DNA, 15 bp, Homo sapiens
aatgttttaacctgt

SEQ ID NO: 440951 - DNA, 15 bp, Homo sapiens
atgttttaacctgtg

SEQ ID NO: 440952 - DNA, 15 bp, Homo sapiens
tgttttaacctgtgg

SEQ ID NO: 440953 - DNA, 15 bp, Homo sapiens
gttttaacctgtggc

SEQ ID NO: 440954 - DNA, 15 bp, Homo sapiens
ttttaacctgtggct

SEQ ID NO: 440955 - DNA, 15 bp, Homo sapiens
tttaacctgtggctt

SEQ ID NO: 440956 - DNA, 15 bp, Homo sapiens
ttaacctgtggctta

SEQ ID NO: 440957 - DNA, 15 bp, Homo sapiens
taacctgtggcttat

SEQ ID NO: 440958 - DNA, 15 bp, Homo sapiens
aacctgtggcttata

SEQ ID NO: 440959 - DNA, 15 bp, Homo sapiens
acctgtggcttatat

SEQ ID NO: 440960 - DNA, 15 bp, Homo sapiens
cctgtggcttatata

SEQ ID NO: 440961 - DNA, 15 bp, Homo sapiens
ctgtggcttatatag

SEQ ID NO: 440962 - DNA, 15 bp, Homo sapiens
tgtggcttatatagg

SEQ ID NO: 440963 - DNA, 15 bp, Homo sapiens
gtggcttatataggg

SEQ ID NO: 440964 - DNA, 15 bp, Homo sapiens
tggcttatataggga

SEQ ID NO: 440965 - DNA, 15 bp, Homo sapiens
ggcttatatagggaa

SEQ ID NO: 440966 - DNA, 15 bp, Homo sapiens
gcttatatagggaaa

SEQ ID NO: 440967 - DNA, 15 bp, Homo sapiens
cttatatagggaaac

SEQ ID NO: 440968 - DNA, 15 bp, Homo sapiens
ttatatagggaaaca

SEQ ID NO: 440969 - DNA, 15 bp, Homo sapiens
tatatagggaaacat

SEQ ID NO: 440970 - DNA, 15 bp, Homo sapiens
atatagggaaacatt

SEQ ID NO: 440971 - DNA, 15 bp, Homo sapiens
tatagggaaacatta

SEQ ID NO: 440972 - DNA, 15 bp, Homo sapiens
atagggaaacattat

SEQ ID NO: 440973 - DNA, 15 bp, Homo sapiens
tagggaaacattatt

SEQ ID NO: 440974 - DNA, 15 bp, Homo sapiens
agggaaacattattt

SEQ ID NO: 440975 - DNA, 15 bp, Homo sapiens
gggaaacattatttt

SEQ ID NO: 440976 - DNA, 15 bp, Homo sapiens
ggaaacattattttt

SEQ ID NO: 440977 - DNA, 15 bp, Homo sapiens
gaaacattatttttg

SEQ ID NO: 440978 - DNA, 15 bp, Homo sapiens
aaacattatttttgg

SEQ ID NO: 440979 - DNA, 15 bp, Homo sapiens
aacattatttttgga

SEQ ID NO: 440980 - DNA, 15 bp, Homo sapiens
acattatttttggag

SEQ ID NO: 440981 - DNA, 15 bp, Homo sapiens
cattatttttggaga

SEQ ID NO: 440982 - DNA, 15 bp, Homo sapiens
attatttttggagag

SEQ ID NO: 440983 - DNA, 15 bp, Homo sapiens
ttatttttggagagg

SEQ ID NO: 440984 - DNA, 15 bp, Homo sapiens
tatttttggagagga

SEQ ID NO: 440985 - DNA, 15 bp, Homo sapiens
atttttggagaggaa

SEQ ID NO: 440986 - DNA, 15 bp, Homo sapiens
tttttggagaggaaa

SEQ ID NO: 440987 - DNA, 15 bp, Homo sapiens
ttttggagaggaaaa

SEQ ID NO: 440988 - DNA, 15 bp, Homo sapiens
tttggagaggaaaaa

SEQ ID NO: 440989 - DNA, 15 bp, Homo sapiens
ttggagaggaaaaat

SEQ ID NO: 440990 - DNA, 15 bp, Homo sapiens
tggagaggaaaaatt

SEQ ID NO: 440991 - DNA, 15 bp, Homo sapiens
ggagaggaaaaattt

SEQ ID NO: 440992 - DNA, 15 bp, Homo sapiens
gagaggaaaaatttg

SEQ ID NO: 440993 - DNA, 15 bp, Homo sapiens
agaggaaaaatttga

SEQ ID NO: 440994 - DNA, 15 bp, Homo sapiens
gaggaaaaatttgaa

SEQ ID NO: 440995 - DNA, 15 bp, Homo sapiens
aggaaaaatttgaat

SEQ ID NO: 440996 - DNA, 15 bp, Homo sapiens
ggaaaaatttgaatt

SEQ ID NO: 440997 - DNA, 15 bp, Homo sapiens
gaaaaatttgaattt

SEQ ID NO: 440998 - DNA, 15 bp, Homo sapiens
aaaaatttgaatttc

SEQ ID NO: 440999 - DNA, 15 bp, Homo sapiens
aaaatttgaatttct

SEQ ID NO: 441000 - DNA, 15 bp, Homo sapiens
aaatttgaatttctt

SEQ ID NO: 441001 - DNA, 15 bp, Homo sapiens
aatttgaatttcttt

SEQ ID NO: 441002 - DNA, 15 bp, Homo sapiens
tttgaatttcttttt

SEQ ID NO: 441003 - DNA, 15 bp, Homo sapiens
ttgaatttctttttt

SEQ ID NO: 441004 - DNA, 15 bp, Homo sapiens
tgaatttcttttttg

SEQ ID NO: 441005 - DNA, 15 bp, Homo sapiens
gaatttcttttttgt

SEQ ID NO: 441006 - DNA, 15 bp, Homo sapiens
aatttcttttttgtt

SEQ ID NO: 441007 - DNA, 15 bp, Homo sapiens
atttcttttttgttc

SEQ ID NO: 441008 - DNA, 15 bp, Homo sapiens
tttcttttttgttcc

SEQ ID NO: 441009 - DNA, 15 bp, Homo sapiens
ttcttttttgttcca

SEQ ID NO: 441010 - DNA, 15 bp, Homo sapiens
tcttttttgttccaa

SEQ ID NO: 441011 - DNA, 15 bp, Homo sapiens
cttttttgttccaaa

SEQ ID NO: 441012 - DNA, 15 bp, Homo sapiens
ttttttgttccaaaa

SEQ ID NO: 441013 - DNA, 15 bp, Homo sapiens
tttttgttccaaaag

SEQ ID NO: 441014 - DNA, 15 bp, Homo sapiens
ttttgttccaaaaga

SEQ ID NO: 441015 - DNA, 15 bp, Homo sapiens
tttgttccaaaagat

SEQ ID NO: 441016 - DNA, 15 bp, Homo sapiens
ttgttccaaaagatt

SEQ ID NO: 441017 - DNA, 15 bp, Homo sapiens
tgttccaaaagattt

SEQ ID NO: 441018 - DNA, 15 bp, Homo sapiens
gttccaaaagatttt

SEQ ID NO: 441019 - DNA, 15 bp, Homo sapiens
ttccaaaagattttt

SEQ ID NO: 441020 - DNA, 15 bp, Homo sapiens
tccaaaagattttta

SEQ ID NO: 441021 - DNA, 15 bp, Homo sapiens
ccaaaagatttttaa

SEQ ID NO: 441022 - DNA, 15 bp, Homo sapiens
caaaagatttttaaa

SEQ ID NO: 441023 - DNA, 15 bp, Homo sapiens
aaaagatttttaaag

SEQ ID NO: 441024 - DNA, 15 bp, Homo sapiens
aaagatttttaaagc

SEQ ID NO: 441025 - DNA, 15 bp, Homo sapiens
aagatttttaaagcc

SEQ ID NO: 441026 - DNA, 15 bp, Homo sapiens
agatttttaaagcct

SEQ ID NO: 441027 - DNA, 15 bp, Homo sapiens
gatttttaaagcctg

SEQ ID NO: 441028 - DNA, 15 bp, Homo sapiens
atttttaaagcctgt

SEQ ID NO: 441029 - DNA, 15 bp, Homo sapiens
tttttaaagcctgtc

SEQ ID NO: 441030 - DNA, 15 bp, Homo sapiens
ttttaaagcctgtct

SEQ ID NO: 441031 - DNA, 15 bp, Homo sapiens
tttaaagcctgtctt

SEQ ID NO: 441032 - DNA, 15 bp, Homo sapiens
ttaaagcctgtcttg

SEQ ID NO: 441033 - DNA, 15 bp, Homo sapiens
taaagcctgtcttga

SEQ ID NO: 441034 - DNA, 15 bp, Homo sapiens
aaagcctgtcttgaa

SEQ ID NO: 441035 - DNA, 15 bp, Homo sapiens
aagcctgtcttgaag

SEQ ID NO: 441036 - DNA, 15 bp, Homo sapiens
agcctgtcttgaagt

SEQ ID NO: 441037 - DNA, 15 bp, Homo sapiens
gcctgtcttgaagtt

SEQ ID NO: 441038 - DNA, 15 bp, Homo sapiens
cctgtcttgaagtta

SEQ ID NO: 441039 - DNA, 15 bp, Homo sapiens
ctgtcttgaagttat

SEQ ID NO: 441040 - DNA, 15 bp, Homo sapiens
tgtcttgaagttata

SEQ ID NO: 441041 - DNA, 15 bp, Homo sapiens
gtcttgaagttatat

SEQ ID NO: 441042 - DNA, 15 bp, Homo sapiens
tcttgaagttatatt

SEQ ID NO: 441043 - DNA, 15 bp, Homo sapiens
cttgaagttatattc

SEQ ID NO: 441044 - DNA, 15 bp, Homo sapiens
ttgaagttatattct

SEQ ID NO: 441045 - DNA, 15 bp, Homo sapiens
tgaagttatattcta

SEQ ID NO: 441046 - DNA, 15 bp, Homo sapiens
gaagttatattctat

SEQ ID NO: 441047 - DNA, 15 bp, Homo sapiens
aagttatattctatt

SEQ ID NO: 441048 - DNA, 15 bp, Homo sapiens
agttatattctattt

SEQ ID NO: 441049 - DNA, 15 bp, Homo sapiens
gttatattctatttg

SEQ ID NO: 441050 - DNA, 15 bp, Homo sapiens
ttatattctatttgt

SEQ ID NO: 441051 - DNA, 15 bp, Homo sapiens
tatattctatttgtt

SEQ ID NO: 441052 - DNA, 15 bp, Homo sapiens
atattctatttgttt

SEQ ID NO: 441053 - DNA, 15 bp, Homo sapiens
tattctatttgttta

SEQ ID NO: 441054 - DNA, 15 bp, Homo sapiens
attctatttgtttaa

SEQ ID NO: 441055 - DNA, 15 bp, Homo sapiens
ttctatttgtttaaa

SEQ ID NO: 441056 - DNA, 15 bp, Homo sapiens
tctatttgtttaaag

SEQ ID NO: 441057 - DNA, 15 bp, Homo sapiens
ctatttgtttaaagt

SEQ ID NO: 441058 - DNA, 15 bp, Homo sapiens
tatttgtttaaagtt

SEQ ID NO: 441059 - DNA, 15 bp, Homo sapiens
atttgtttaaagttt

SEQ ID NO: 441060 - DNA, 15 bp, Homo sapiens
tttgtttaaagttta

SEQ ID NO: 441061 - DNA, 15 bp, Homo sapiens
ttgtttaaagtttac

SEQ ID NO: 441062 - DNA, 15 bp, Homo sapiens
tgtttaaagtttact

SEQ ID NO: 441063 - DNA, 15 bp, Homo sapiens
gtttaaagtttacta

SEQ ID NO: 441064 - DNA, 15 bp, Homo sapiens
tttaaagtttactat

SEQ ID NO: 441065 - DNA, 15 bp, Homo sapiens
ttaaagtttactatc

SEQ ID NO: 441066 - DNA, 15 bp, Homo sapiens
taaagtttactatct

SEQ ID NO: 441067 - DNA, 15 bp, Homo sapiens
aaagtttactatctt

SEQ ID NO: 441068 - DNA, 15 bp, Homo sapiens
aagtttactatcttt

SEQ ID NO: 441069 - DNA, 15 bp, Homo sapiens
agtttactatctttt

SEQ ID NO: 441070 - DNA, 15 bp, Homo sapiens
gtttactatcttttg

SEQ ID NO: 441071 - DNA, 15 bp, Homo sapiens
tttactatcttttga

SEQ ID NO: 441072 - DNA, 15 bp, Homo sapiens
ttactatcttttgaa

SEQ ID NO: 441073 - DNA, 15 bp, Homo sapiens
tactatcttttgaaa

SEQ ID NO: 441074 - DNA, 15 bp, Homo sapiens
actatcttttgaaat

SEQ ID NO: 441075 - DNA, 15 bp, Homo sapiens
ctatcttttgaaata

SEQ ID NO: 441076 - DNA, 15 bp, Homo sapiens
tatcttttgaaataa

SEQ ID NO: 441077 - DNA, 15 bp, Homo sapiens
atcttttgaaataaa

SEQ ID NO: 441078 - DNA, 15 bp, Homo sapiens
tcttttgaaataaaa

SEQ ID NO: 441079 - DNA, 15 bp, Homo sapiens
cttttgaaataaaat

SEQ ID NO: 441080 - DNA, 15 bp, Homo sapiens
ttttgaaataaaata

SEQ ID NO: 441081 - DNA, 15 bp, Homo sapiens
tttgaaataaaatag

SEQ ID NO: 441082 - DNA, 15 bp, Homo sapiens
ttgaaataaaatagg

SEQ ID NO: 441083 - DNA, 15 bp, Homo sapiens
tgaaataaaataggc

SEQ ID NO: 441084 - DNA, 15 bp, Homo sapiens
gaaataaaataggct

SEQ ID NO: 441085 - DNA, 15 bp, Homo sapiens
aaataaaataggcta

SEQ ID NO: 441086 - DNA, 15 bp, Homo sapiens
aataaaataggctat

SEQ ID NO: 441087 - DNA, 15 bp, Homo sapiens
ataaaataggctatt

SEQ ID NO: 441088 - DNA, 15 bp, Homo sapiens
taaaataggctatta

SEQ ID NO: 441089 - DNA, 15 bp, Homo sapiens
aaaataggctattat

SEQ ID NO: 441090 - DNA, 15 bp, Homo sapiens
aaataggctattatt

SEQ ID NO: 441091 - DNA, 15 bp, Homo sapiens
aataggctattattt

SEQ ID NO: 441092 - DNA, 15 bp, Homo sapiens
ataggctattatttg

SEQ ID NO: 441093 - DNA, 15 bp, Homo sapiens
taggctattatttga

SEQ ID NO: 441094 - DNA, 15 bp, Homo sapiens
aggctattatttgaa

SEQ ID NO: 441095 - DNA, 15 bp, Homo sapiens
ggctattatttgaaa

SEQ ID NO: 441096 - DNA, 15 bp, Homo sapiens
gctattatttgaaat

SEQ ID NO: 441097 - DNA, 15 bp, Homo sapiens
ctattatttgaaatt

SEQ ID NO: 441098 - DNA, 15 bp, Homo sapiens
tattatttgaaatta

SEQ ID NO: 441099 - DNA, 15 bp, Homo sapiens
attatttgaaattat

SEQ ID NO: 441100 - DNA, 15 bp, Homo sapiens
ttatttgaaattata

SEQ ID NO: 441101 - DNA, 15 bp, Homo sapiens
tatttgaaattatat

SEQ ID NO: 441102 - DNA, 15 bp, Homo sapiens
atttgaaattatatg

SEQ ID NO: 441103 - DNA, 15 bp, Homo sapiens
tttgaaattatatgc

SEQ ID NO: 441104 - DNA, 15 bp, Homo sapiens
ttgaaattatatgca

SEQ ID NO: 441105 - DNA, 15 bp, Homo sapiens
tgaaattatatgcat

SEQ ID NO: 441106 - DNA, 15 bp, Homo sapiens
gaaattatatgcatc

SEQ ID NO: 441107 - DNA, 15 bp, Homo sapiens
aaattatatgcatct

SEQ ID NO: 441108 - DNA, 15 bp, Homo sapiens
aattatatgcatctc

SEQ ID NO: 441109 - DNA, 15 bp, Homo sapiens
attatatgcatctca

SEQ ID NO: 441110 - DNA, 15 bp, Homo sapiens
ttatatgcatctcaa

SEQ ID NO: 441111 - DNA, 15 bp, Homo sapiens
tatatgcatctcaaa

SEQ ID NO: 441112 - DNA, 15 bp, Homo sapiens
atatgcatctcaaaa

SEQ ID NO: 441113 - DNA, 15 bp, Homo sapiens
tatgcatctcaaaac

SEQ ID NO: 441114 - DNA, 15 bp, Homo sapiens
atgcatctcaaaaca

SEQ ID NO: 441115 - DNA, 15 bp, Homo sapiens
tgcatctcaaaacat

SEQ ID NO: 441116 - DNA, 15 bp, Homo sapiens
gcatctcaaaacatt

SEQ ID NO: 441117 - DNA, 15 bp, Homo sapiens
catctcaaaacattt

SEQ ID NO: 441118 - DNA, 15 bp, Homo sapiens
atctcaaaacatttt

SEQ ID NO: 441119 - DNA, 15 bp, Homo sapiens
tctcaaaacattttc

SEQ ID NO: 441120 - DNA, 15 bp, Homo sapiens
ctcaaaacattttct

SEQ ID NO: 441121 - DNA, 15 bp, Homo sapiens
tcaaaacattttctg

SEQ ID NO: 441122 - DNA, 15 bp, Homo sapiens
caaaacattttctgg

SEQ ID NO: 441123 - DNA, 15 bp, Homo sapiens
aaaacattttctggc

SEQ ID NO: 441124 - DNA, 15 bp, Homo sapiens
aaacattttctggca

SEQ ID NO: 441125 - DNA, 15 bp, Homo sapiens
aacattttctggcat

SEQ ID NO: 441126 - DNA, 15 bp, Homo sapiens
acattttctggcatt

SEQ ID NO: 441127 - DNA, 15 bp, Homo sapiens
cattttctggcattt

SEQ ID NO: 441128 - DNA, 15 bp, Homo sapiens
attttctggcatttc

SEQ ID NO: 441129 - DNA, 15 bp, Homo sapiens
ttttctggcatttca

SEQ ID NO: 441130 - DNA, 15 bp, Homo sapiens
tttctggcatttcat

SEQ ID NO: 441131 - DNA, 15 bp, Homo sapiens
ttctggcatttcatt

SEQ ID NO: 441132 - DNA, 15 bp, Homo sapiens
tctggcatttcattt

SEQ ID NO: 441133 - DNA, 15 bp, Homo sapiens
ctggcatttcatttt

SEQ ID NO: 441134 - DNA, 15 bp, Homo sapiens
tggcatttcattttt

SEQ ID NO: 441135 - DNA, 15 bp, Homo sapiens
ggcatttcattttta

SEQ ID NO: 441136 - DNA, 15 bp, Homo sapiens
gcatttcatttttaa

SEQ ID NO: 441137 - DNA, 15 bp, Homo sapiens
catttcatttttaat

SEQ ID NO: 441138 - DNA, 15 bp, Homo sapiens
atttcatttttaatc

SEQ ID NO: 441139 - DNA, 15 bp, Homo sapiens
tttcatttttaatct

SEQ ID NO: 441140 - DNA, 15 bp, Homo sapiens
ttcatttttaatctt

SEQ ID NO: 441141 - DNA, 15 bp, Homo sapiens
tcatttttaatcttt

SEQ ID NO: 441142 - DNA, 15 bp, Homo sapiens
catttttaatcttta

SEQ ID NO: 441143 - DNA, 15 bp, Homo sapiens
atttttaatctttaa

SEQ ID NO: 441144 - DNA, 15 bp, Homo sapiens
tttttaatctttaat

SEQ ID NO: 441145 - DNA, 15 bp, Homo sapiens
ttttaatctttaata

SEQ ID NO: 441146 - DNA, 15 bp, Homo sapiens
tttaatctttaatag

SEQ ID NO: 441147 - DNA, 15 bp, Homo sapiens
ttaatctttaataga

SEQ ID NO: 441148 - DNA, 15 bp, Homo sapiens
taatctttaatagat

SEQ ID NO: 441149 - DNA, 15 bp, Homo sapiens
aatctttaatagata

SEQ ID NO: 441150 - DNA, 15 bp, Homo sapiens
atctttaatagataa

SEQ ID NO: 441151 - DNA, 15 bp, Homo sapiens
tctttaatagataaa

SEQ ID NO: 441152 - DNA, 15 bp, Homo sapiens
ctttaatagataaaa

SEQ ID NO: 441153 - DNA, 15 bp, Homo sapiens
tttaatagataaaaa

SEQ ID NO: 441154 - DNA, 15 bp, Homo sapiens
ttaatagataaaaat

SEQ ID NO: 441155 - DNA, 15 bp, Homo sapiens
taatagataaaaata

SEQ ID NO: 441156 - DNA, 15 bp, Homo sapiens
aatagataaaaataa

SEQ ID NO: 441157 - DNA, 15 bp, Homo sapiens
atagataaaaataaa

SEQ ID NO: 441158 - DNA, 15 bp, Homo sapiens
tagataaaaataaaa

SEQ ID NO: 441159 - DNA, 15 bp, Homo sapiens
agataaaaataaaaa

SEQ ID NO: 441160 - DNA, 15 bp, Homo sapiens
gataaaaataaaaag

SEQ ID NO: 441161 - DNA, 15 bp, Homo sapiens
ataaaaataaaaaga

SEQ ID NO: 441162 - DNA, 15 bp, Homo sapiens
taaaaataaaaagat

SEQ ID NO: 441163 - DNA, 15 bp, Homo sapiens
aaaaataaaaagatg

SEQ ID NO: 441164 - DNA, 15 bp, Homo sapiens
aaaataaaaagatgt

SEQ ID NO: 441165 - DNA, 15 bp, Homo sapiens
aaataaaaagatgtt

SEQ ID NO: 441166 - DNA, 15 bp, Homo sapiens
aataaaaagatgttg

SEQ ID NO: 441167 - DNA, 15 bp, Homo sapiens
ataaaaagatgttga

SEQ ID NO: 441168 - DNA, 15 bp, Homo sapiens
taaaaagatgttgat

SEQ ID NO: 441169 - DNA, 15 bp, Homo sapiens
aaaaagatgttgatt

SEQ ID NO: 441170 - DNA, 15 bp, Homo sapiens
aaaagatgttgattt

SEQ ID NO: 441171 - DNA, 15 bp, Homo sapiens
aaagatgttgatttt

SEQ ID NO: 441172 - DNA, 15 bp, Homo sapiens
aagatgttgatttta

SEQ ID NO: 441173 - DNA, 15 bp, Homo sapiens
agatgttgattttaa

SEQ ID NO: 441174 - DNA, 15 bp, Homo sapiens
gatgttgattttaaa

SEQ ID NO: 441175 - DNA, 15 bp, Homo sapiens
atgttgattttaaaa

SEQ ID NO: 441176 - DNA, 15 bp, Homo sapiens
tgttgattttaaaag

SEQ ID NO: 441177 - DNA, 15 bp, Homo sapiens
gttgattttaaaagc

SEQ ID NO: 441178 - DNA, 15 bp, Homo sapiens
ttgattttaaaagct

SEQ ID NO: 441179 - DNA, 15 bp, Homo sapiens
tgattttaaaagcta

SEQ ID NO: 441180 - DNA, 15 bp, Homo sapiens
gattttaaaagctaa

SEQ ID NO: 441181 - DNA, 15 bp, Homo sapiens
attttaaaagctaat

SEQ ID NO: 441182 - DNA, 15 bp, Homo sapiens
ttttaaaagctaatt

SEQ ID NO: 441183 - DNA, 15 bp, Homo sapiens
tttaaaagctaatta

SEQ ID NO: 441184 - DNA, 15 bp, Homo sapiens
ttaaaagctaattac

SEQ ID NO: 441185 - DNA, 15 bp, Homo sapiens
taaaagctaattaca

SEQ ID NO: 441186 - DNA, 15 bp, Homo sapiens
aaaagctaattacag

SEQ ID NO: 441187 - DNA, 15 bp, Homo sapiens
aaagctaattacagt

SEQ ID NO: 441188 - DNA, 15 bp, Homo sapiens
aagctaattacagtt

SEQ ID NO: 441189 - DNA, 15 bp, Homo sapiens
agctaattacagttc

SEQ ID NO: 441190 - DNA, 15 bp, Homo sapiens
gctaattacagttct

SEQ ID NO: 441191 - DNA, 15 bp, Homo sapiens
ctaattacagttctt

SEQ ID NO: 441192 - DNA, 15 bp, Homo sapiens
taattacagttcttg

SEQ ID NO: 441193 - DNA, 15 bp, Homo sapiens
aattacagttcttga

SEQ ID NO: 441194 - DNA, 15 bp, Homo sapiens
attacagttcttgag

SEQ ID NO: 441195 - DNA, 15 bp, Homo sapiens
ttacagttcttgagt

SEQ ID NO: 441196 - DNA, 15 bp, Homo sapiens
tacagttcttgagtc

SEQ ID NO: 441197 - DNA, 15 bp, Homo sapiens
acagttcttgagtcc

SEQ ID NO: 441198 - DNA, 15 bp, Homo sapiens
cagttcttgagtcct

SEQ ID NO: 441199 - DNA, 15 bp, Homo sapiens
agttcttgagtcctc

SEQ ID NO: 441200 - DNA, 15 bp, Homo sapiens
gttcttgagtcctcc

SEQ ID NO: 441201 - DNA, 15 bp, Homo sapiens
ttcttgagtcctcca

SEQ ID NO: 441202 - DNA, 15 bp, Homo sapiens
tcttgagtcctccaa

SEQ ID NO: 441203 - DNA, 15 bp, Homo sapiens
cttgagtcctccaag

SEQ ID NO: 441204 - DNA, 15 bp, Homo sapiens
ttgagtcctccaagg

SEQ ID NO: 441205 - DNA, 15 bp, Homo sapiens
tgagtcctccaaggt

SEQ ID NO: 441206 - DNA, 15 bp, Homo sapiens
gagtcctccaaggta

SEQ ID NO: 441207 - DNA, 15 bp, Homo sapiens
agtcctccaaggtac

SEQ ID NO: 441208 - DNA, 15 bp, Homo sapiens
gtcctccaaggtacc

SEQ ID NO: 441209 - DNA, 15 bp, Homo sapiens
tcctccaaggtacct

SEQ ID NO: 441210 - DNA, 15 bp, Homo sapiens
cctccaaggtaccta

SEQ ID NO: 441211 - DNA, 15 bp, Homo sapiens
ctccaaggtacctac

SEQ ID NO: 441212 - DNA, 15 bp, Homo sapiens
tccaaggtacctacc

SEQ ID NO: 441213 - DNA, 15 bp, Homo sapiens
ccaaggtacctaccc

SEQ ID NO: 441214 - DNA, 15 bp, Homo sapiens
caaggtacctaccca

SEQ ID NO: 441215 - DNA, 15 bp, Homo sapiens
aaggtacctacccat

SEQ ID NO: 441216 - DNA, 15 bp, Homo sapiens
aggtacctacccatg

SEQ ID NO: 441217 - DNA, 15 bp, Homo sapiens
ggtacctacccatgg

SEQ ID NO: 441218 - DNA, 15 bp, Homo sapiens
gtacctacccatgga

SEQ ID NO: 441219 - DNA, 15 bp, Homo sapiens
tacctacccatggag

SEQ ID NO: 441220 - DNA, 15 bp, Homo sapiens
acctacccatggaga

SEQ ID NO: 441221 - DNA, 15 bp, Homo sapiens
cctacccatggagag

SEQ ID NO: 441222 - DNA, 15 bp, Homo sapiens
ctacccatggagaga

SEQ ID NO: 441223 - DNA, 15 bp, Homo sapiens
tacccatggagagaa

SEQ ID NO: 441224 - DNA, 15 bp, Homo sapiens
acccatggagagaat

SEQ ID NO: 441225 - DNA, 15 bp, Homo sapiens
cccatggagagaata

SEQ ID NO: 441226 - DNA, 15 bp, Homo sapiens
ccatggagagaatat

SEQ ID NO: 441227 - DNA, 15 bp, Homo sapiens
catggagagaatatt

SEQ ID NO: 441228 - DNA, 15 bp, Homo sapiens
atggagagaatatta

SEQ ID NO: 441229 - DNA, 15 bp, Homo sapiens
tggagagaatattaa

SEQ ID NO: 441230 - DNA, 15 bp, Homo sapiens
ggagagaatattaat

SEQ ID NO: 441231 - DNA, 15 bp, Homo sapiens
gagagaatattaatg

SEQ ID NO: 441232 - DNA, 15 bp, Homo sapiens
agagaatattaatgc

SEQ ID NO: 441233 - DNA, 15 bp, Homo sapiens
gagaatattaatgca

SEQ ID NO: 441234 - DNA, 15 bp, Homo sapiens
agaatattaatgcat

SEQ ID NO: 441235 - DNA, 15 bp, Homo sapiens
gaatattaatgcata

SEQ ID NO: 441236 - DNA, 15 bp, Homo sapiens
aatattaatgcatat

SEQ ID NO: 441237 - DNA, 15 bp, Homo sapiens
atattaatgcatata

SEQ ID NO: 441238 - DNA, 15 bp, Homo sapiens
tattaatgcatatag

SEQ ID NO: 441239 - DNA, 15 bp, Homo sapiens
attaatgcatatagc

SEQ ID NO: 441240 - DNA, 15 bp, Homo sapiens
ttaatgcatatagct

SEQ ID NO: 441241 - DNA, 15 bp, Homo sapiens
taatgcatatagcta

SEQ ID NO: 441242 - DNA, 15 bp, Homo sapiens
aatgcatatagctaa

SEQ ID NO: 441243 - DNA, 15 bp, Homo sapiens
atgcatatagctaaa

SEQ ID NO: 441244 - DNA, 15 bp, Homo sapiens
tgcatatagctaaaa

SEQ ID NO: 441245 - DNA, 15 bp, Homo sapiens
gcatatagctaaaat

SEQ ID NO: 441246 - DNA, 15 bp, Homo sapiens
catatagctaaaatc

SEQ ID NO: 441247 - DNA, 15 bp, Homo sapiens
atatagctaaaatcc

SEQ ID NO: 441248 - DNA, 15 bp, Homo sapiens
tatagctaaaatcct

SEQ ID NO: 441249 - DNA, 15 bp, Homo sapiens
atagctaaaatcctg

SEQ ID NO: 441250 - DNA, 15 bp, Homo sapiens
tagctaaaatcctga

SEQ ID NO: 441251 - DNA, 15 bp, Homo sapiens
agctaaaatcctgac

SEQ ID NO: 441252 - DNA, 15 bp, Homo sapiens
gctaaaatcctgact

SEQ ID NO: 441253 - DNA, 15 bp, Homo sapiens
ctaaaatcctgacta

SEQ ID NO: 441254 - DNA, 15 bp, Homo sapiens
taaaatcctgactaa

SEQ ID NO: 441255 - DNA, 15 bp, Homo sapiens
aaaatcctgactaaa

SEQ ID NO: 441256 - DNA, 15 bp, Homo sapiens
aaatcctgactaaag

SEQ ID NO: 441257 - DNA, 15 bp, Homo sapiens
aatcctgactaaaga

SEQ ID NO: 441258 - DNA, 15 bp, Homo sapiens
atcctgactaaagaa

SEQ ID NO: 441259 - DNA, 15 bp, Homo sapiens
tcctgactaaagaaa

SEQ ID NO: 441260 - DNA, 15 bp, Homo sapiens
cctgactaaagaaac

SEQ ID NO: 441261 - DNA, 15 bp, Homo sapiens
ctgactaaagaaacc

SEQ ID NO: 441262 - DNA, 15 bp, Homo sapiens
tgactaaagaaacct

SEQ ID NO: 441263 - DNA, 15 bp, Homo sapiens
gactaaagaaacctt

SEQ ID NO: 441264 - DNA, 15 bp, Homo sapiens
actaaagaaaccttg

SEQ ID NO: 441265 - DNA, 15 bp, Homo sapiens
ctaaagaaaccttga

SEQ ID NO: 441266 - DNA, 15 bp, Homo sapiens
taaagaaaccttgaa

SEQ ID NO: 441267 - DNA, 15 bp, Homo sapiens
aaagaaaccttgaag

SEQ ID NO: 441268 - DNA, 15 bp, Homo sapiens
aagaaaccttgaagg

SEQ ID NO: 441269 - DNA, 15 bp, Homo sapiens
agaaaccttgaagga

SEQ ID NO: 441270 - DNA, 15 bp, Homo sapiens
gaaaccttgaaggat

SEQ ID NO: 441271 - DNA, 15 bp, Homo sapiens
aaaccttgaaggatt

SEQ ID NO: 441272 - DNA, 15 bp, Homo sapiens
aaccttgaaggattt

SEQ ID NO: 441273 - DNA, 15 bp, Homo sapiens
accttgaaggatttg

SEQ ID NO: 441274 - DNA, 15 bp, Homo sapiens
ccttgaaggatttga

SEQ ID NO: 441275 - DNA, 15 bp, Homo sapiens
cttgaaggatttgaa

SEQ ID NO: 441276 - DNA, 15 bp, Homo sapiens
ttgaaggatttgaat

SEQ ID NO: 441277 - DNA, 15 bp, Homo sapiens
tgaaggatttgaatt

SEQ ID NO: 441278 - DNA, 15 bp, Homo sapiens
gaaggatttgaattc

SEQ ID NO: 441279 - DNA, 15 bp, Homo sapiens
aaggatttgaattct

SEQ ID NO: 441280 - DNA, 15 bp, Homo sapiens
aggatttgaattctg

SEQ ID NO: 441281 - DNA, 15 bp, Homo sapiens
ggatttgaattctgt

SEQ ID NO: 441282 - DNA, 15 bp, Homo sapiens
gatttgaattctgta

SEQ ID NO: 441283 - DNA, 15 bp, Homo sapiens
atttgaattctgtaa

SEQ ID NO: 441284 - DNA, 15 bp, Homo sapiens
tttgaattctgtaat

SEQ ID NO: 441285 - DNA, 15 bp, Homo sapiens
ttgaattctgtaatt

SEQ ID NO: 441286 - DNA, 15 bp, Homo sapiens
tgaattctgtaattg

SEQ ID NO: 441287 - DNA, 15 bp, Homo sapiens
gaattctgtaattgt

SEQ ID NO: 441288 - DNA, 15 bp, Homo sapiens
aattctgtaattgtt

SEQ ID NO: 441289 - DNA, 15 bp, Homo sapiens
attctgtaattgttc

SEQ ID NO: 441290 - DNA, 15 bp, Homo sapiens
ttctgtaattgttct

SEQ ID NO: 441291 - DNA, 15 bp, Homo sapiens
tctgtaattgttctc

SEQ ID NO: 441292 - DNA, 15 bp, Homo sapiens
ctgtaattgttctca

SEQ ID NO: 441293 - DNA, 15 bp, Homo sapiens
tgtaattgttctcaa

SEQ ID NO: 441294 - DNA, 15 bp, Homo sapiens
gtaattgttctcaaa

SEQ ID NO: 441295 - DNA, 15 bp, Homo sapiens
taattgttctcaaac

SEQ ID NO: 441296 - DNA, 15 bp, Homo sapiens
aattgttctcaaact

SEQ ID NO: 441297 - DNA, 15 bp, Homo sapiens
attgttctcaaactg

SEQ ID NO: 441298 - DNA, 15 bp, Homo sapiens
ttgttctcaaactga

SEQ ID NO: 441299 - DNA, 15 bp, Homo sapiens
tgttctcaaactgaa

SEQ ID NO: 441300 - DNA, 15 bp, Homo sapiens
gttctcaaactgaat

SEQ ID NO: 441301 - DNA, 15 bp, Homo sapiens
ttctcaaactgaatc

SEQ ID NO: 441302 - DNA, 15 bp, Homo sapiens
tctcaaactgaatct

SEQ ID NO: 441303 - DNA, 15 bp, Homo sapiens
ctcaaactgaatctg

SEQ ID NO: 441304 - DNA, 15 bp, Homo sapiens
tcaaactgaatctga

SEQ ID NO: 441305 - DNA, 15 bp, Homo sapiens
caaactgaatctgag

SEQ ID NO: 441306 - DNA, 15 bp, Homo sapiens
aaactgaatctgaga

SEQ ID NO: 441307 - DNA, 15 bp, Homo sapiens
aactgaatctgagag

SEQ ID NO: 441308 - DNA, 15 bp, Homo sapiens
actgaatctgagaga

SEQ ID NO: 441309 - DNA, 15 bp, Homo sapiens
ctgaatctgagagac

SEQ ID NO: 441310 - DNA, 15 bp, Homo sapiens
tgaatctgagagacc

SEQ ID NO: 441311 - DNA, 15 bp, Homo sapiens
gaatctgagagaccc

SEQ ID NO: 441312 - DNA, 15 bp, Homo sapiens
aatctgagagaccca

SEQ ID NO: 441313 - DNA, 15 bp, Homo sapiens
atctgagagacccag

SEQ ID NO: 441314 - DNA, 15 bp, Homo sapiens
tctgagagacccaga

SEQ ID NO: 441315 - DNA, 15 bp, Homo sapiens
ctgagagacccagac

SEQ ID NO: 441316 - DNA, 15 bp, Homo sapiens
tgagagacccagacc

SEQ ID NO: 441317 - DNA, 15 bp, Homo sapiens
gagagacccagacct

SEQ ID NO: 441318 - DNA, 15 bp, Homo sapiens
agagacccagacctt

SEQ ID NO: 441319 - DNA, 15 bp, Homo sapiens
gagacccagaccttt

SEQ ID NO: 441320 - DNA, 15 bp, Homo sapiens
agacccagacctttt

SEQ ID NO: 441321 - DNA, 15 bp, Homo sapiens
gacccagaccttttc

SEQ ID NO: 441322 - DNA, 15 bp, Homo sapiens
acccagaccttttca

SEQ ID NO: 441323 - DNA, 15 bp, Homo sapiens
cccagaccttttcaa

SEQ ID NO: 441324 - DNA, 15 bp, Homo sapiens
ccagaccttttcaaa

SEQ ID NO: 441325 - DNA, 15 bp, Homo sapiens
cagaccttttcaaag

SEQ ID NO: 441326 - DNA, 15 bp, Homo sapiens
agaccttttcaaagt

SEQ ID NO: 441327 - DNA, 15 bp, Homo sapiens
gaccttttcaaagtt

SEQ ID NO: 441328 - DNA, 15 bp, Homo sapiens
ccttttcaaagttca

SEQ ID NO: 441329 - DNA, 15 bp, Homo sapiens
cttttcaaagttcag

SEQ ID NO: 441330 - DNA, 15 bp, Homo sapiens
ttttcaaagttcaga

SEQ ID NO: 441331 - DNA, 15 bp, Homo sapiens
tttcaaagttcagac

SEQ ID NO: 441332 - DNA, 15 bp, Homo sapiens
ttcaaagttcagact

SEQ ID NO: 441333 - DNA, 15 bp, Homo sapiens
tcaaagttcagactg

SEQ ID NO: 441334 - DNA, 15 bp, Homo sapiens
caaagttcagactga

SEQ ID NO: 441335 - DNA, 15 bp, Homo sapiens
aaagttcagactgaa

SEQ ID NO: 441336 - DNA, 15 bp, Homo sapiens
aagttcagactgaaa

SEQ ID NO: 441337 - DNA, 15 bp, Homo sapiens
agttcagactgaaaa

SEQ ID NO: 441338 - DNA, 15 bp, Homo sapiens
gttcagactgaaaaa

SEQ ID NO: 441339 - DNA, 15 bp, Homo sapiens
ttcagactgaaaaat

SEQ ID NO: 441340 - DNA, 15 bp, Homo sapiens
tcagactgaaaaatc

SEQ ID NO: 441341 - DNA, 15 bp, Homo sapiens
cagactgaaaaatcc

SEQ ID NO: 441342 - DNA, 15 bp, Homo sapiens
agactgaaaaatccc

SEQ ID NO: 441343 - DNA, 15 bp, Homo sapiens
gactgaaaaatccct

SEQ ID NO: 441344 - DNA, 15 bp, Homo sapiens
actgaaaaatccctt

SEQ ID NO: 441345 - DNA, 15 bp, Homo sapiens
ctgaaaaatcccttt

SEQ ID NO: 441346 - DNA, 15 bp, Homo sapiens
tgaaaaatccctttg

SEQ ID NO: 441347 - DNA, 15 bp, Homo sapiens
gaaaaatccctttgc

SEQ ID NO: 441348 - DNA, 15 bp, Homo sapiens
aaaaatccctttgcc

SEQ ID NO: 441349 - DNA, 15 bp, Homo sapiens
aaaatccctttgccc

SEQ ID NO: 441350 - DNA, 15 bp, Homo sapiens
aaatccctttgccca

SEQ ID NO: 441351 - DNA, 15 bp, Homo sapiens
aatccctttgcccac

SEQ ID NO: 441352 - DNA, 15 bp, Homo sapiens
atccctttgcccacc

SEQ ID NO: 441353 - DNA, 15 bp, Homo sapiens
tccctttgcccaccc

SEQ ID NO: 441354 - DNA, 15 bp, Homo sapiens
ccctttgcccaccct

SEQ ID NO: 441355 - DNA, 15 bp, Homo sapiens
cctttgcccacccta

SEQ ID NO: 441356 - DNA, 15 bp, Homo sapiens
ctttgcccaccctaa

SEQ ID NO: 441357 - DNA, 15 bp, Homo sapiens
tttgcccaccctaac

SEQ ID NO: 441358 - DNA, 15 bp, Homo sapiens
ttgcccaccctaacc

SEQ ID NO: 441359 - DNA, 15 bp, Homo sapiens
tgcccaccctaaccc

SEQ ID NO: 441360 - DNA, 15 bp, Homo sapiens
gcccaccctaaccca

SEQ ID NO: 441361 - DNA, 15 bp, Homo sapiens
cccaccctaacccac

SEQ ID NO: 441362 - DNA, 15 bp, Homo sapiens
ccaccctaacccacc

SEQ ID NO: 441363 - DNA, 15 bp, Homo sapiens
caccctaacccaccc

SEQ ID NO: 441364 - DNA, 15 bp, Homo sapiens
accctaacccacccc

SEQ ID NO: 441365 - DNA, 15 bp, Homo sapiens
ccctaacccacccct

SEQ ID NO: 441366 - DNA, 15 bp, Homo sapiens
cctaacccacccctc

SEQ ID NO: 441367 - DNA, 15 bp, Homo sapiens
ctaacccacccctcc

SEQ ID NO: 441368 - DNA, 15 bp, Homo sapiens
taacccacccctcct

SEQ ID NO: 441369 - DNA, 15 bp, Homo sapiens
aacccacccctcctc

SEQ ID NO: 441370 - DNA, 15 bp, Homo sapiens
acccacccctcctcc

SEQ ID NO: 441371 - DNA, 15 bp, Homo sapiens
cccacccctcctcct

SEQ ID NO: 441372 - DNA, 15 bp, Homo sapiens
ccacccctcctcctt

SEQ ID NO: 441373 - DNA, 15 bp, Homo sapiens
cacccctcctccttc

SEQ ID NO: 441374 - DNA, 15 bp, Homo sapiens
acccctcctccttcc

SEQ ID NO: 441375 - DNA, 15 bp, Homo sapiens
cccctcctccttccc

SEQ ID NO: 441376 - DNA, 15 bp, Homo sapiens
ccctcctccttccct

SEQ ID NO: 441377 - DNA, 15 bp, Homo sapiens
cctcctccttccctg

SEQ ID NO: 441378 - DNA, 15 bp, Homo sapiens
ctcctccttccctgt

SEQ ID NO: 441379 - DNA, 15 bp, Homo sapiens
tcctccttccctgtg

SEQ ID NO: 441380 - DNA, 15 bp, Homo sapiens
cctccttccctgtgc

SEQ ID NO: 441381 - DNA, 15 bp, Homo sapiens
ctccttccctgtgct

SEQ ID NO: 441382 - DNA, 15 bp, Homo sapiens
tccttccctgtgctt

SEQ ID NO: 441383 - DNA, 15 bp, Homo sapiens
ccttccctgtgcttc

SEQ ID NO: 441384 - DNA, 15 bp, Homo sapiens
cttccctgtgcttct

SEQ ID NO: 441385 - DNA, 15 bp, Homo sapiens
ttccctgtgcttcta

SEQ ID NO: 441386 - DNA, 15 bp, Homo sapiens
tccctgtgcttctat

SEQ ID NO: 441387 - DNA, 15 bp, Homo sapiens
ccctgtgcttctata

SEQ ID NO: 441388 - DNA, 15 bp, Homo sapiens
cctgtgcttctatat

SEQ ID NO: 441389 - DNA, 15 bp, Homo sapiens
ctgtgcttctatatt

SEQ ID NO: 441390 - DNA, 15 bp, Homo sapiens
tgtgcttctatatta

SEQ ID NO: 441391 - DNA, 15 bp, Homo sapiens
gtgcttctatattaa

SEQ ID NO: 441392 - DNA, 15 bp, Homo sapiens
tgcttctatattaat

SEQ ID NO: 441393 - DNA, 15 bp, Homo sapiens
gcttctatattaatt

SEQ ID NO: 441394 - DNA, 15 bp, Homo sapiens
cttctatattaattg

SEQ ID NO: 441395 - DNA, 15 bp, Homo sapiens
ttctatattaattgt

SEQ ID NO: 441396 - DNA, 15 bp, Homo sapiens
tctatattaattgtg

SEQ ID NO: 441397 - DNA, 15 bp, Homo sapiens
ctatattaattgtga

SEQ ID NO: 441398 - DNA, 15 bp, Homo sapiens
tatattaattgtgaa

SEQ ID NO: 441399 - DNA, 15 bp, Homo sapiens
atattaattgtgaat

SEQ ID NO: 441400 - DNA, 15 bp, Homo sapiens
tattaattgtgaatt

SEQ ID NO: 441401 - DNA, 15 bp, Homo sapiens
attaattgtgaattt

SEQ ID NO: 441402 - DNA, 15 bp, Homo sapiens
ttaattgtgaatttt

SEQ ID NO: 441403 - DNA, 15 bp, Homo sapiens
taattgtgaattttt

SEQ ID NO: 441404 - DNA, 15 bp, Homo sapiens
aattgtgaatttttt

SEQ ID NO: 441405 - DNA, 15 bp, Homo sapiens
attgtgaatttttta

SEQ ID NO: 441406 - DNA, 15 bp, Homo sapiens
ttgtgaattttttac

SEQ ID NO: 441407 - DNA, 15 bp, Homo sapiens
tgtgaattttttaca

SEQ ID NO: 441408 - DNA, 15 bp, Homo sapiens
gtgaattttttacac

SEQ ID NO: 441409 - DNA, 15 bp, Homo sapiens
tgaattttttacact

SEQ ID NO: 441410 - DNA, 15 bp, Homo sapiens
gaattttttacactt

SEQ ID NO: 441411 - DNA, 15 bp, Homo sapiens
aattttttacactta

SEQ ID NO: 441412 - DNA, 15 bp, Homo sapiens
attttttacacttat

SEQ ID NO: 441413 - DNA, 15 bp, Homo sapiens
ttttttacacttata

SEQ ID NO: 441414 - DNA, 15 bp, Homo sapiens
tttttacacttataa

SEQ ID NO: 441415 - DNA, 15 bp, Homo sapiens
ttttacacttataat

SEQ ID NO: 441416 - DNA, 15 bp, Homo sapiens
tttacacttataatg

SEQ ID NO: 441417 - DNA, 15 bp, Homo sapiens
ttacacttataatgc

SEQ ID NO: 441418 - DNA, 15 bp, Homo sapiens
tacacttataatgcc

SEQ ID NO: 441419 - DNA, 15 bp, Homo sapiens
acacttataatgcct

SEQ ID NO: 441420 - DNA, 15 bp, Homo sapiens
cacttataatgcctc

SEQ ID NO: 441421 - DNA, 15 bp, Homo sapiens
acttataatgcctct

SEQ ID NO: 441422 - DNA, 15 bp, Homo sapiens
cttataatgcctcta

SEQ ID NO: 441423 - DNA, 15 bp, Homo sapiens
ttataatgcctctat

SEQ ID NO: 441424 - DNA, 15 bp, Homo sapiens
tataatgcctctatt

SEQ ID NO: 441425 - DNA, 15 bp, Homo sapiens
ataatgcctctatta

SEQ ID NO: 441426 - DNA, 15 bp, Homo sapiens
taatgcctctattac

SEQ ID NO: 441427 - DNA, 15 bp, Homo sapiens
aatgcctctattacc

SEQ ID NO: 441428 - DNA, 15 bp, Homo sapiens
atgcctctattacca

SEQ ID NO: 441429 - DNA, 15 bp, Homo sapiens
tgcctctattaccat

SEQ ID NO: 441430 - DNA, 15 bp, Homo sapiens
gcctctattaccata

SEQ ID NO: 441431 - DNA, 15 bp, Homo sapiens
cctctattaccatac

SEQ ID NO: 441432 - DNA, 15 bp, Homo sapiens
ctctattaccataca

SEQ ID NO: 441433 - DNA, 15 bp, Homo sapiens
tctattaccatacaa

SEQ ID NO: 441434 - DNA, 15 bp, Homo sapiens
ctattaccatacaac

SEQ ID NO: 441435 - DNA, 15 bp, Homo sapiens
tattaccatacaact

SEQ ID NO: 441436 - DNA, 15 bp, Homo sapiens
attaccatacaactg

SEQ ID NO: 441437 - DNA, 15 bp, Homo sapiens
ttaccatacaactgc

SEQ ID NO: 441438 - DNA, 15 bp, Homo sapiens
taccatacaactgct

SEQ ID NO: 441439 - DNA, 15 bp, Homo sapiens
accatacaactgctc

SEQ ID NO: 441440 - DNA, 15 bp, Homo sapiens
ccatacaactgctct

SEQ ID NO: 441441 - DNA, 15 bp, Homo sapiens
catacaactgctctt

SEQ ID NO: 441442 - DNA, 15 bp, Homo sapiens
atacaactgctcttc

SEQ ID NO: 441443 - DNA, 15 bp, Homo sapiens
tacaactgctcttct

SEQ ID NO: 441444 - DNA, 15 bp, Homo sapiens
acaactgctcttctt

SEQ ID NO: 441445 - DNA, 15 bp, Homo sapiens
caactgctcttctta

SEQ ID NO: 441446 - DNA, 15 bp, Homo sapiens
aactgctcttcttat

SEQ ID NO: 441447 - DNA, 15 bp, Homo sapiens
actgctcttcttatt

SEQ ID NO: 441448 - DNA, 15 bp, Homo sapiens
ctgctcttcttattt

SEQ ID NO: 441449 - DNA, 15 bp, Homo sapiens
tgctcttcttattta

SEQ ID NO: 441450 - DNA, 15 bp, Homo sapiens
gctcttcttatttaa

SEQ ID NO: 441451 - DNA, 15 bp, Homo sapiens
ctcttcttatttaat

SEQ ID NO: 441452 - DNA, 15 bp, Homo sapiens
tcttcttatttaatt

SEQ ID NO: 441453 - DNA, 15 bp, Homo sapiens
cttcttatttaattg

SEQ ID NO: 441454 - DNA, 15 bp, Homo sapiens
ttcttatttaattgt

SEQ ID NO: 441455 - DNA, 15 bp, Homo sapiens
tcttatttaattgta

SEQ ID NO: 441456 - DNA, 15 bp, Homo sapiens
cttatttaattgtat

SEQ ID NO: 441457 - DNA, 15 bp, Homo sapiens
ttatttaattgtatt

SEQ ID NO: 441458 - DNA, 15 bp, Homo sapiens
tatttaattgtattt

SEQ ID NO: 441459 - DNA, 15 bp, Homo sapiens
atttaattgtatttg

SEQ ID NO: 441460 - DNA, 15 bp, Homo sapiens
tttaattgtatttgt

SEQ ID NO: 441461 - DNA, 15 bp, Homo sapiens
ttaattgtatttgtg

SEQ ID NO: 441462 - DNA, 15 bp, Homo sapiens
taattgtatttgtgt

SEQ ID NO: 441463 - DNA, 15 bp, Homo sapiens
aattgtatttgtgtg

SEQ ID NO: 441464 - DNA, 15 bp, Homo sapiens
attgtatttgtgtgt

SEQ ID NO: 441465 - DNA, 15 bp, Homo sapiens
ttgtatttgtgtgtt

SEQ ID NO: 441466 - DNA, 15 bp, Homo sapiens
tgtatttgtgtgttt

SEQ ID NO: 441467 - DNA, 15 bp, Homo sapiens
gtatttgtgtgtttt

SEQ ID NO: 441468 - DNA, 15 bp, Homo sapiens
atttgtgtgtttttc

SEQ ID NO: 441469 - DNA, 15 bp, Homo sapiens
tttgtgtgtttttct

SEQ ID NO: 441470 - DNA, 15 bp, Homo sapiens
ttgtgtgtttttctg

SEQ ID NO: 441471 - DNA, 15 bp, Homo sapiens
tgtgtgtttttctgt

SEQ ID NO: 441472 - DNA, 15 bp, Homo sapiens
gtgtgtttttctgtg

SEQ ID NO: 441473 - DNA, 15 bp, Homo sapiens
tgtgtttttctgtgt

SEQ ID NO: 441474 - DNA, 15 bp, Homo sapiens
gtgtttttctgtgtg

SEQ ID NO: 441475 - DNA, 15 bp, Homo sapiens
tgtttttctgtgtgt

SEQ ID NO: 441476 - DNA, 15 bp, Homo sapiens
gtttttctgtgtgtg

SEQ ID NO: 441477 - DNA, 15 bp, Homo sapiens
tttttctgtgtgtgc

SEQ ID NO: 441478 - DNA, 15 bp, Homo sapiens
ttttctgtgtgtgca

SEQ ID NO: 441479 - DNA, 15 bp, Homo sapiens
tttctgtgtgtgcac

SEQ ID NO: 441480 - DNA, 15 bp, Homo sapiens
ttctgtgtgtgcaca

SEQ ID NO: 441481 - DNA, 15 bp, Homo sapiens
tctgtgtgtgcacat

SEQ ID NO: 441482 - DNA, 15 bp, Homo sapiens
ctgtgtgtgcacatt

SEQ ID NO: 441483 - DNA, 15 bp, Homo sapiens
tgtgtgtgcacattc

SEQ ID NO: 441484 - DNA, 15 bp, Homo sapiens
gtgtgtgcacattct

SEQ ID NO: 441485 - DNA, 15 bp, Homo sapiens
tgtgtgcacattctg

SEQ ID NO: 441486 - DNA, 15 bp, Homo sapiens
gtgtgcacattctgt

SEQ ID NO: 441487 - DNA, 15 bp, Homo sapiens
tgtgcacattctgtc

SEQ ID NO: 441488 - DNA, 15 bp, Homo sapiens
gtgcacattctgtca

SEQ ID NO: 441489 - DNA, 15 bp, Homo sapiens
tgcacattctgtcat

SEQ ID NO: 441490 - DNA, 15 bp, Homo sapiens
gcacattctgtcatc

SEQ ID NO: 441491 - DNA, 15 bp, Homo sapiens
cacattctgtcatcc

SEQ ID NO: 441492 - DNA, 15 bp, Homo sapiens
acattctgtcatcca

SEQ ID NO: 441493 - DNA, 15 bp, Homo sapiens
cattctgtcatccat

SEQ ID NO: 441494 - DNA, 15 bp, Homo sapiens
attctgtcatccatt

SEQ ID NO: 441495 - DNA, 15 bp, Homo sapiens
ttctgtcatccatta

SEQ ID NO: 441496 - DNA, 15 bp, Homo sapiens
tctgtcatccattaa

SEQ ID NO: 441497 - DNA, 15 bp, Homo sapiens
ctgtcatccattaaa

SEQ ID NO: 441498 - DNA, 15 bp, Homo sapiens
tgtcatccattaaaa

SEQ ID NO: 441499 - DNA, 15 bp, Homo sapiens
gtcatccattaaaat

SEQ ID NO: 441500 - DNA, 15 bp, Homo sapiens
tcatccattaaaatg

SEQ ID NO: 441501 - DNA, 15 bp, Homo sapiens
catccattaaaatgc

SEQ ID NO: 441502 - DNA, 15 bp, Homo sapiens
atccattaaaatgcc

SEQ ID NO: 441503 - DNA, 15 bp, Homo sapiens
tccattaaaatgccg

SEQ ID NO: 441504 - DNA, 15 bp, Homo sapiens
ccattaaaatgccga

SEQ ID NO: 441505 - DNA, 15 bp, Homo sapiens
cattaaaatgccgaa

SEQ ID NO: 441506 - DNA, 15 bp, Homo sapiens
attaaaatgccgaat

SEQ ID NO: 441507 - DNA, 15 bp, Homo sapiens
ttaaaatgccgaatc

SEQ ID NO: 441508 - DNA, 15 bp, Homo sapiens
taaaatgccgaatct

SEQ ID NO: 441509 - DNA, 15 bp, Homo sapiens
aaaatgccgaatctg

SEQ ID NO: 441510 - DNA, 15 bp, Homo sapiens
aaatgccgaatctgc

SEQ ID NO: 441511 - DNA, 15 bp, Homo sapiens
aatgccgaatctgca

SEQ ID NO: 441512 - DNA, 15 bp, Homo sapiens
atgccgaatctgcag

SEQ ID NO: 441513 - DNA, 15 bp, Homo sapiens
tgccgaatctgcagc

SEQ ID NO: 441514 - DNA, 15 bp, Homo sapiens
gccgaatctgcagca

SEQ ID NO: 441515 - DNA, 15 bp, Homo sapiens
ccgaatctgcagcaa

SEQ ID NO: 441516 - DNA, 15 bp, Homo sapiens
cgaatctgcagcaat

SEQ ID NO: 441517 - DNA, 15 bp, Homo sapiens
gaatctgcagcaatg

SEQ ID NO: 441518 - DNA, 15 bp, Homo sapiens
aatctgcagcaatgg

SEQ ID NO: 441519 - DNA, 15 bp, Homo sapiens
atctgcagcaatgga

SEQ ID NO: 441520 - DNA, 15 bp, Homo sapiens
tctgcagcaatggaa

SEQ ID NO: 441521 - DNA, 15 bp, Homo sapiens
ctgcagcaatggaaa

SEQ ID NO: 441522 - DNA, 15 bp, Homo sapiens
tgcagcaatggaaaa

SEQ ID NO: 441523 - DNA, 15 bp, Homo sapiens
gcagcaatggaaaaa

SEQ ID NO: 441524 - DNA, 15 bp, Homo sapiens
cagcaatggaaaaaa

SEQ ID NO: 441525 - DNA, 15 bp, Homo sapiens
agcaatggaaaaaaa

SEQ ID NO: 441526 - DNA, 15 bp, Homo sapiens
gcaatggaaaaaaaa

SEQ ID NO: 441527 - DNA, 15 bp, Homo sapiens
caatggaaaaaaaac

SEQ ID NO: 441528 - DNA, 15 bp, Homo sapiens
aatggaaaaaaaact

SEQ ID NO: 441529 - DNA, 15 bp, Homo sapiens
atggaaaaaaaacta

SEQ ID NO: 441530 - DNA, 15 bp, Homo sapiens
tggaaaaaaaactat

SEQ ID NO: 441531 - DNA, 15 bp, Homo sapiens
ggaaaaaaaactatc

SEQ ID NO: 441532 - DNA, 15 bp, Homo sapiens
gaaaaaaaactatct

SEQ ID NO: 441533 - DNA, 15 bp, Homo sapiens
aaaaaaaactatctc

SEQ ID NO: 441534 - DNA, 15 bp, Homo sapiens
aaaaaaactatctca

SEQ ID NO: 441535 - DNA, 15 bp, Homo sapiens
aaaaaactatctcaa

SEQ ID NO: 441536 - DNA, 15 bp, Homo sapiens
aaaaactatctcaac

SEQ ID NO: 441537 - DNA, 15 bp, Homo sapiens
aaaactatctcaact

SEQ ID NO: 441538 - DNA, 15 bp, Homo sapiens
aaactatctcaactc

SEQ ID NO: 441539 - DNA, 15 bp, Homo sapiens
aactatctcaactct

SEQ ID NO: 441540 - DNA, 15 bp, Homo sapiens
actatctcaactctt

SEQ ID NO: 441541 - DNA, 15 bp, Homo sapiens
ctatctcaactcttc

SEQ ID NO: 441542 - DNA, 15 bp, Homo sapiens
tatctcaactcttct

SEQ ID NO: 441543 - DNA, 15 bp, Homo sapiens
atctcaactcttctt

SEQ ID NO: 441544 - DNA, 15 bp, Homo sapiens
tctcaactcttcttc

SEQ ID NO: 441545 - DNA, 15 bp, Homo sapiens
ctcaactcttcttct

SEQ ID NO: 441546 - DNA, 15 bp, Homo sapiens
tcaactcttcttctc

SEQ ID NO: 441547 - DNA, 15 bp, Homo sapiens
caactcttcttctcc

SEQ ID NO: 441548 - DNA, 15 bp, Homo sapiens
aactcttcttctcct

SEQ ID NO: 441549 - DNA, 15 bp, Homo sapiens
actcttcttctcctt

SEQ ID NO: 441550 - DNA, 15 bp, Homo sapiens
ctcttcttctccttc

SEQ ID NO: 441551 - DNA, 15 bp, Homo sapiens
tcttcttctccttcc

SEQ ID NO: 441552 - DNA, 15 bp, Homo sapiens
cttcttctccttcca

SEQ ID NO: 441553 - DNA, 15 bp, Homo sapiens
ttcttctccttccat

SEQ ID NO: 441554 - DNA, 15 bp, Homo sapiens
tcttctccttccata

SEQ ID NO: 441555 - DNA, 15 bp, Homo sapiens
cttctccttccatac

SEQ ID NO: 441556 - DNA, 15 bp, Homo sapiens
ttctccttccatact

SEQ ID NO: 441557 - DNA, 15 bp, Homo sapiens
tctccttccatactg

SEQ ID NO: 441558 - DNA, 15 bp, Homo sapiens
ctccttccatactga

SEQ ID NO: 441559 - DNA, 15 bp, Homo sapiens
tccttccatactgaa

SEQ ID NO: 441560 - DNA, 15 bp, Homo sapiens
ccttccatactgaag

SEQ ID NO: 441561 - DNA, 15 bp, Homo sapiens
cttccatactgaagc

SEQ ID NO: 441562 - DNA, 15 bp, Homo sapiens
ttccatactgaagca

SEQ ID NO: 441563 - DNA, 15 bp, Homo sapiens
tccatactgaagcaa

SEQ ID NO: 441564 - DNA, 15 bp, Homo sapiens
ccatactgaagcaat

SEQ ID NO: 441565 - DNA, 15 bp, Homo sapiens
catactgaagcaatt

SEQ ID NO: 441566 - DNA, 15 bp, Homo sapiens
atactgaagcaattc

SEQ ID NO: 441567 - DNA, 15 bp, Homo sapiens
tactgaagcaattcc

SEQ ID NO: 441568 - DNA, 15 bp, Homo sapiens
actgaagcaattccc

SEQ ID NO: 441569 - DNA, 15 bp, Homo sapiens
ctgaagcaattccca

SEQ ID NO: 441570 - DNA, 15 bp, Homo sapiens
tgaagcaattcccat

SEQ ID NO: 441571 - DNA, 15 bp, Homo sapiens
gaagcaattcccatg

SEQ ID NO: 441572 - DNA, 15 bp, Homo sapiens
aagcaattcccatga

SEQ ID NO: 441573 - DNA, 15 bp, Homo sapiens
agcaattcccatgaa

SEQ ID NO: 441574 - DNA, 15 bp, Homo sapiens
gcaattcccatgaat

SEQ ID NO: 441575 - DNA, 15 bp, Homo sapiens
caattcccatgaatt

SEQ ID NO: 441576 - DNA, 15 bp, Homo sapiens
aattcccatgaattt

SEQ ID NO: 441577 - DNA, 15 bp, Homo sapiens
attcccatgaatttg

SEQ ID NO: 441578 - DNA, 15 bp, Homo sapiens
ttcccatgaatttgt

SEQ ID NO: 441579 - DNA, 15 bp, Homo sapiens
tcccatgaatttgta

SEQ ID NO: 441580 - DNA, 15 bp, Homo sapiens
cccatgaatttgtat

SEQ ID NO: 441581 - DNA, 15 bp, Homo sapiens
ccatgaatttgtatg

SEQ ID NO: 441582 - DNA, 15 bp, Homo sapiens
catgaatttgtatgc

SEQ ID NO: 441583 - DNA, 15 bp, Homo sapiens
atgaatttgtatgca

SEQ ID NO: 441584 - DNA, 15 bp, Homo sapiens
tgaatttgtatgcat

SEQ ID NO: 441585 - DNA, 15 bp, Homo sapiens
gaatttgtatgcatc

SEQ ID NO: 441586 - DNA, 15 bp, Homo sapiens
aatttgtatgcatcc

SEQ ID NO: 441587 - DNA, 15 bp, Homo sapiens
atttgtatgcatccc

SEQ ID NO: 441588 - DNA, 15 bp, Homo sapiens
tttgtatgcatccct

SEQ ID NO: 441589 - DNA, 15 bp, Homo sapiens
ttgtatgcatccctt

SEQ ID NO: 441590 - DNA, 15 bp, Homo sapiens
tgtatgcatcccttc

SEQ ID NO: 441591 - DNA, 15 bp, Homo sapiens
gtatgcatcccttcc

SEQ ID NO: 441592 - DNA, 15 bp, Homo sapiens
tatgcatcccttcct

SEQ ID NO: 441593 - DNA, 15 bp, Homo sapiens
atgcatcccttcctc

SEQ ID NO: 441594 - DNA, 15 bp, Homo sapiens
tgcatcccttcctct

SEQ ID NO: 441595 - DNA, 15 bp, Homo sapiens
gcatcccttcctcta

SEQ ID NO: 441596 - DNA, 15 bp, Homo sapiens
catcccttcctctac

SEQ ID NO: 441597 - DNA, 15 bp, Homo sapiens
atcccttcctctacc

SEQ ID NO: 441598 - DNA, 15 bp, Homo sapiens
tcccttcctctaccc

SEQ ID NO: 441599 - DNA, 15 bp, Homo sapiens
cccttcctctaccct

SEQ ID NO: 441600 - DNA, 15 bp, Homo sapiens
ccttcctctaccctg

SEQ ID NO: 441601 - DNA, 15 bp, Homo sapiens
cttcctctaccctgt

SEQ ID NO: 441602 - DNA, 15 bp, Homo sapiens
ttcctctaccctgtc

SEQ ID NO: 441603 - DNA, 15 bp, Homo sapiens
tcctctaccctgtct

SEQ ID NO: 441604 - DNA, 15 bp, Homo sapiens
cctctaccctgtctt

SEQ ID NO: 441605 - DNA, 15 bp, Homo sapiens
ctctaccctgtcttt

SEQ ID NO: 441606 - DNA, 15 bp, Homo sapiens
tctaccctgtctttg

SEQ ID NO: 441607 - DNA, 15 bp, Homo sapiens
ctaccctgtctttga

SEQ ID NO: 441608 - DNA, 15 bp, Homo sapiens
taccctgtctttgaa

SEQ ID NO: 441609 - DNA, 15 bp, Homo sapiens
accctgtctttgaaa

SEQ ID NO: 441610 - DNA, 15 bp, Homo sapiens
ccctgtctttgaaat

SEQ ID NO: 441611 - DNA, 15 bp, Homo sapiens
cctgtctttgaaatg

SEQ ID NO: 441612 - DNA, 15 bp, Homo sapiens
ctgtctttgaaatgt

SEQ ID NO: 441613 - DNA, 15 bp, Homo sapiens
tgtctttgaaatgtt

SEQ ID NO: 441614 - DNA, 15 bp, Homo sapiens
gtctttgaaatgttg

SEQ ID NO: 441615 - DNA, 15 bp, Homo sapiens
tctttgaaatgttgg

SEQ ID NO: 441616 - DNA, 15 bp, Homo sapiens
ctttgaaatgttggt

SEQ ID NO: 441617 - DNA, 15 bp, Homo sapiens
tttgaaatgttggta

SEQ ID NO: 441618 - DNA, 15 bp, Homo sapiens
ttgaaatgttggtag

SEQ ID NO: 441619 - DNA, 15 bp, Homo sapiens
tgaaatgttggtagc

SEQ ID NO: 441620 - DNA, 15 bp, Homo sapiens
gaaatgttggtagct

SEQ ID NO: 441621 - DNA, 15 bp, Homo sapiens
aaatgttggtagctg

SEQ ID NO: 441622 - DNA, 15 bp, Homo sapiens
aatgttggtagctgc

SEQ ID NO: 441623 - DNA, 15 bp, Homo sapiens
atgttggtagctgca

SEQ ID NO: 441624 - DNA, 15 bp, Homo sapiens
tgttggtagctgcag

SEQ ID NO: 441625 - DNA, 15 bp, Homo sapiens
gttggtagctgcagg

SEQ ID NO: 441626 - DNA, 15 bp, Homo sapiens
ttggtagctgcaggg

SEQ ID NO: 441627 - DNA, 15 bp, Homo sapiens
tggtagctgcagggt

SEQ ID NO: 441628 - DNA, 15 bp, Homo sapiens
ggtagctgcagggtt

SEQ ID NO: 441629 - DNA, 15 bp, Homo sapiens
gtagctgcagggttc

SEQ ID NO: 441630 - DNA, 15 bp, Homo sapiens
tagctgcagggttcg

SEQ ID NO: 441631 - DNA, 15 bp, Homo sapiens
agctgcagggttcgg

SEQ ID NO: 441632 - DNA, 15 bp, Homo sapiens
gctgcagggttcggt

SEQ ID NO: 441633 - DNA, 15 bp, Homo sapiens
ctgcagggttcggta

SEQ ID NO: 441634 - DNA, 15 bp, Homo sapiens
tgcagggttcggtaa

SEQ ID NO: 441635 - DNA, 15 bp, Homo sapiens
gcagggttcggtaat

SEQ ID NO: 441636 - DNA, 15 bp, Homo sapiens
cagggttcggtaata

SEQ ID NO: 441637 - DNA, 15 bp, Homo sapiens
agggttcggtaatat

SEQ ID NO: 441638 - DNA, 15 bp, Homo sapiens
gggttcggtaatatt

SEQ ID NO: 441639 - DNA, 15 bp, Homo sapiens
ggttcggtaatattt

SEQ ID NO: 441640 - DNA, 15 bp, Homo sapiens
gttcggtaatatttc

SEQ ID NO: 441641 - DNA, 15 bp, Homo sapiens
ttcggtaatatttct

SEQ ID NO: 441642 - DNA, 15 bp, Homo sapiens
tcggtaatatttctt

SEQ ID NO: 441643 - DNA, 15 bp, Homo sapiens
cggtaatatttctta

SEQ ID NO: 441644 - DNA, 15 bp, Homo sapiens
ggtaatatttcttac

SEQ ID NO: 441645 - DNA, 15 bp, Homo sapiens
gtaatatttcttact

SEQ ID NO: 441646 - DNA, 15 bp, Homo sapiens
taatatttcttactt

SEQ ID NO: 441647 - DNA, 15 bp, Homo sapiens
aatatttcttacttt

SEQ ID NO: 441648 - DNA, 15 bp, Homo sapiens
atatttcttacttta

SEQ ID NO: 441649 - DNA, 15 bp, Homo sapiens
tatttcttactttac

SEQ ID NO: 441650 - DNA, 15 bp, Homo sapiens
atttcttactttaca

SEQ ID NO: 441651 - DNA, 15 bp, Homo sapiens
tttcttactttacac

SEQ ID NO: 441652 - DNA, 15 bp, Homo sapiens
ttcttactttacaca

SEQ ID NO: 441653 - DNA, 15 bp, Homo sapiens
tcttactttacacat

SEQ ID NO: 441654 - DNA, 15 bp, Homo sapiens
cttactttacacatg

SEQ ID NO: 441655 - DNA, 15 bp, Homo sapiens
ttactttacacatgt

SEQ ID NO: 441656 - DNA, 15 bp, Homo sapiens
tactttacacatgtt

SEQ ID NO: 441657 - DNA, 15 bp, Homo sapiens
actttacacatgttg

SEQ ID NO: 441658 - DNA, 15 bp, Homo sapiens
ctttacacatgttga

SEQ ID NO: 441659 - DNA, 15 bp, Homo sapiens
tttacacatgttgac

SEQ ID NO: 441660 - DNA, 15 bp, Homo sapiens
ttacacatgttgact

SEQ ID NO: 441661 - DNA, 15 bp, Homo sapiens
tacacatgttgactt

SEQ ID NO: 441662 - DNA, 15 bp, Homo sapiens
acacatgttgacttc

SEQ ID NO: 441663 - DNA, 15 bp, Homo sapiens
cacatgttgacttca

SEQ ID NO: 441664 - DNA, 15 bp, Homo sapiens
acatgttgacttcaa

SEQ ID NO: 441665 - DNA, 15 bp, Homo sapiens
catgttgacttcaaa

SEQ ID NO: 441666 - DNA, 15 bp, Homo sapiens
atgttgacttcaaac

SEQ ID NO: 441667 - DNA, 15 bp, Homo sapiens
tgttgacttcaaact

SEQ ID NO: 441668 - DNA, 15 bp, Homo sapiens
gttgacttcaaactt

SEQ ID NO: 441669 - DNA, 15 bp, Homo sapiens
ttgacttcaaacttc

SEQ ID NO: 441670 - DNA, 15 bp, Homo sapiens
tgacttcaaacttcc

SEQ ID NO: 441671 - DNA, 15 bp, Homo sapiens
gacttcaaacttcca

SEQ ID NO: 441672 - DNA, 15 bp, Homo sapiens
acttcaaacttccaa

SEQ ID NO: 441673 - DNA, 15 bp, Homo sapiens
cttcaaacttccaac

SEQ ID NO: 441674 - DNA, 15 bp, Homo sapiens
ttcaaacttccaaca

SEQ ID NO: 441675 - DNA, 15 bp, Homo sapiens
tcaaacttccaacat

SEQ ID NO: 441676 - DNA, 15 bp, Homo sapiens
caaacttccaacatt

SEQ ID NO: 441677 - DNA, 15 bp, Homo sapiens
aaacttccaacattc

SEQ ID NO: 441678 - DNA, 15 bp, Homo sapiens
aacttccaacattca

SEQ ID NO: 441679 - DNA, 15 bp, Homo sapiens
acttccaacattcat

SEQ ID NO: 441680 - DNA, 15 bp, Homo sapiens
cttccaacattcata

SEQ ID NO: 441681 - DNA, 15 bp, Homo sapiens
ttccaacattcatag

SEQ ID NO: 441682 - DNA, 15 bp, Homo sapiens
tccaacattcatagt

SEQ ID NO: 441683 - DNA, 15 bp, Homo sapiens
ccaacattcatagtt

SEQ ID NO: 441684 - DNA, 15 bp, Homo sapiens
caacattcatagttc

SEQ ID NO: 441685 - DNA, 15 bp, Homo sapiens
aacattcatagttct

SEQ ID NO: 441686 - DNA, 15 bp, Homo sapiens
acattcatagttctc

SEQ ID NO: 441687 - DNA, 15 bp, Homo sapiens
cattcatagttctca

SEQ ID NO: 441688 - DNA, 15 bp, Homo sapiens
attcatagttctcac

SEQ ID NO: 441689 - DNA, 15 bp, Homo sapiens
ttcatagttctcacc

SEQ ID NO: 441690 - DNA, 15 bp, Homo sapiens
tcatagttctcaccc

SEQ ID NO: 441691 - DNA, 15 bp, Homo sapiens
catagttctcaccct

SEQ ID NO: 441692 - DNA, 15 bp, Homo sapiens
atagttctcaccctg

SEQ ID NO: 441693 - DNA, 15 bp, Homo sapiens
tagttctcaccctga

SEQ ID NO: 441694 - DNA, 15 bp, Homo sapiens
agttctcaccctgac

SEQ ID NO: 441695 - DNA, 15 bp, Homo sapiens
gttctcaccctgact

SEQ ID NO: 441696 - DNA, 15 bp, Homo sapiens
ttctcaccctgactc

SEQ ID NO: 441697 - DNA, 15 bp, Homo sapiens
tctcaccctgactct

SEQ ID NO: 441698 - DNA, 15 bp, Homo sapiens
ctcaccctgactcta

SEQ ID NO: 441699 - DNA, 15 bp, Homo sapiens
tcaccctgactctag

SEQ ID NO: 441700 - DNA, 15 bp, Homo sapiens
caccctgactctagt

SEQ ID NO: 441701 - DNA, 15 bp, Homo sapiens
accctgactctagtc

SEQ ID NO: 441702 - DNA, 15 bp, Homo sapiens
ccctgactctagtct

SEQ ID NO: 441703 - DNA, 15 bp, Homo sapiens
cctgactctagtctc

SEQ ID NO: 441704 - DNA, 15 bp, Homo sapiens
ctgactctagtctct

SEQ ID NO: 441705 - DNA, 15 bp, Homo sapiens
tgactctagtctctt

SEQ ID NO: 441706 - DNA, 15 bp, Homo sapiens
gactctagtctctta

SEQ ID NO: 441707 - DNA, 15 bp, Homo sapiens
actctagtctcttaa

SEQ ID NO: 441708 - DNA, 15 bp, Homo sapiens
ctctagtctcttaaa

SEQ ID NO: 441709 - DNA, 15 bp, Homo sapiens
tctagtctcttaaag

SEQ ID NO: 441710 - DNA, 15 bp, Homo sapiens
ctagtctcttaaaga

SEQ ID NO: 441711 - DNA, 15 bp, Homo sapiens
tagtctcttaaagag

SEQ ID NO: 441712 - DNA, 15 bp, Homo sapiens
agtctcttaaagaga

SEQ ID NO: 441713 - DNA, 15 bp, Homo sapiens
gtctcttaaagagac

SEQ ID NO: 441714 - DNA, 15 bp, Homo sapiens
tctcttaaagagact

SEQ ID NO: 441715 - DNA, 15 bp, Homo sapiens
ctcttaaagagactt

SEQ ID NO: 441716 - DNA, 15 bp, Homo sapiens
tcttaaagagactta

SEQ ID NO: 441717 - DNA, 15 bp, Homo sapiens
cttaaagagacttaa

SEQ ID NO: 441718 - DNA, 15 bp, Homo sapiens
ttaaagagacttaaa

SEQ ID NO: 441719 - DNA, 15 bp, Homo sapiens
taaagagacttaaag

SEQ ID NO: 441720 - DNA, 15 bp, Homo sapiens
aaagagacttaaaga

SEQ ID NO: 441721 - DNA, 15 bp, Homo sapiens
aagagacttaaagag

SEQ ID NO: 441722 - DNA, 15 bp, Homo sapiens
agagacttaaagagc

SEQ ID NO: 441723 - DNA, 15 bp, Homo sapiens
gagacttaaagagcc

SEQ ID NO: 441724 - DNA, 15 bp, Homo sapiens
agacttaaagagcct

SEQ ID NO: 441725 - DNA, 15 bp, Homo sapiens
gacttaaagagcctc

SEQ ID NO: 441726 - DNA, 15 bp, Homo sapiens
acttaaagagcctcc

SEQ ID NO: 441727 - DNA, 15 bp, Homo sapiens
cttaaagagcctccc

SEQ ID NO: 441728 - DNA, 15 bp, Homo sapiens
ttaaagagcctcccc

SEQ ID NO: 441729 - DNA, 15 bp, Homo sapiens
taaagagcctcccca

SEQ ID NO: 441730 - DNA, 15 bp, Homo sapiens
aaagagcctccccac

SEQ ID NO: 441731 - DNA, 15 bp, Homo sapiens
aagagcctccccact

SEQ ID NO: 441732 - DNA, 15 bp, Homo sapiens
agagcctccccactt

SEQ ID NO: 441733 - DNA, 15 bp, Homo sapiens
gagcctccccactta

SEQ ID NO: 441734 - DNA, 15 bp, Homo sapiens
agcctccccacttaa

SEQ ID NO: 441735 - DNA, 15 bp, Homo sapiens
gcctccccacttaaa

SEQ ID NO: 441736 - DNA, 15 bp, Homo sapiens
cctccccacttaaag

SEQ ID NO: 441737 - DNA, 15 bp, Homo sapiens
ctccccacttaaaga

SEQ ID NO: 441738 - DNA, 15 bp, Homo sapiens
tccccacttaaagag

SEQ ID NO: 441739 - DNA, 15 bp, Homo sapiens
ccccacttaaagagt

SEQ ID NO: 441740 - DNA, 15 bp, Homo sapiens
cccacttaaagagtg

SEQ ID NO: 441741 - DNA, 15 bp, Homo sapiens
ccacttaaagagtgg

SEQ ID NO: 441742 - DNA, 15 bp, Homo sapiens
cacttaaagagtgga

SEQ ID NO: 441743 - DNA, 15 bp, Homo sapiens
acttaaagagtggac

SEQ ID NO: 441744 - DNA, 15 bp, Homo sapiens
cttaaagagtggaca

SEQ ID NO: 441745 - DNA, 15 bp, Homo sapiens
ttaaagagtggacaa

SEQ ID NO: 441746 - DNA, 15 bp, Homo sapiens
taaagagtggacaat

SEQ ID NO: 441747 - DNA, 15 bp, Homo sapiens
aaagagtggacaatg

SEQ ID NO: 441748 - DNA, 15 bp, Homo sapiens
aagagtggacaatgt

SEQ ID NO: 441749 - DNA, 15 bp, Homo sapiens
agagtggacaatgta

SEQ ID NO: 441750 - DNA, 15 bp, Homo sapiens
gagtggacaatgtag

SEQ ID NO: 441751 - DNA, 15 bp, Homo sapiens
agtggacaatgtaga

SEQ ID NO: 441752 - DNA, 15 bp, Homo sapiens
gtggacaatgtagaa

SEQ ID NO: 441753 - DNA, 15 bp, Homo sapiens
tggacaatgtagaaa

SEQ ID NO: 441754 - DNA, 15 bp, Homo sapiens
ggacaatgtagaaat

SEQ ID NO: 441755 - DNA, 15 bp, Homo sapiens
gacaatgtagaaatg

SEQ ID NO: 441756 - DNA, 15 bp, Homo sapiens
acaatgtagaaatga

SEQ ID NO: 441757 - DNA, 15 bp, Homo sapiens
caatgtagaaatgag

SEQ ID NO: 441758 - DNA, 15 bp, Homo sapiens
aatgtagaaatgagg

SEQ ID NO: 441759 - DNA, 15 bp, Homo sapiens
atgtagaaatgagga

SEQ ID NO: 441760 - DNA, 15 bp, Homo sapiens
tgtagaaatgaggaa

SEQ ID NO: 441761 - DNA, 15 bp, Homo sapiens
gtagaaatgaggaaa

SEQ ID NO: 441762 - DNA, 15 bp, Homo sapiens
tagaaatgaggaaac

SEQ ID NO: 441763 - DNA, 15 bp, Homo sapiens
agaaatgaggaaacc

SEQ ID NO: 441764 - DNA, 15 bp, Homo sapiens
gaaatgaggaaacct

SEQ ID NO: 441765 - DNA, 15 bp, Homo sapiens
aaatgaggaaacctg

SEQ ID NO: 441766 - DNA, 15 bp, Homo sapiens
aatgaggaaacctga

SEQ ID NO: 441767 - DNA, 15 bp, Homo sapiens
atgaggaaacctgag

SEQ ID NO: 441768 - DNA, 15 bp, Homo sapiens
tgaggaaacctgagg

SEQ ID NO: 441769 - DNA, 15 bp, Homo sapiens
gaggaaacctgaggg

SEQ ID NO: 441770 - DNA, 15 bp, Homo sapiens
aggaaacctgagggc

SEQ ID NO: 441771 - DNA, 15 bp, Homo sapiens
ggaaacctgagggca

SEQ ID NO: 441772 - DNA, 15 bp, Homo sapiens
gaaacctgagggcaa

SEQ ID NO: 441773 - DNA, 15 bp, Homo sapiens
aaacctgagggcaaa

SEQ ID NO: 441774 - DNA, 15 bp, Homo sapiens
aacctgagggcaaag

SEQ ID NO: 441775 - DNA, 15 bp, Homo sapiens
acctgagggcaaagc

SEQ ID NO: 441776 - DNA, 15 bp, Homo sapiens
cctgagggcaaagct

SEQ ID NO: 441777 - DNA, 15 bp, Homo sapiens
ctgagggcaaagcta

SEQ ID NO: 441778 - DNA, 15 bp, Homo sapiens
tgagggcaaagctaa

SEQ ID NO: 441779 - DNA, 15 bp, Homo sapiens
gagggcaaagctaat

SEQ ID NO: 441780 - DNA, 15 bp, Homo sapiens
agggcaaagctaatg

SEQ ID NO: 441781 - DNA, 15 bp, Homo sapiens
gggcaaagctaatgg

SEQ ID NO: 441782 - DNA, 15 bp, Homo sapiens
ggcaaagctaatggg

SEQ ID NO: 441783 - DNA, 15 bp, Homo sapiens
gcaaagctaatggga

SEQ ID NO: 441784 - DNA, 15 bp, Homo sapiens
caaagctaatgggat

SEQ ID NO: 441785 - DNA, 15 bp, Homo sapiens
aaagctaatgggatg

SEQ ID NO: 441786 - DNA, 15 bp, Homo sapiens
aagctaatgggatgt

SEQ ID NO: 441787 - DNA, 15 bp, Homo sapiens
agctaatgggatgtt

SEQ ID NO: 441788 - DNA, 15 bp, Homo sapiens
gctaatgggatgttt

SEQ ID NO: 441789 - DNA, 15 bp, Homo sapiens
ctaatgggatgttta

SEQ ID NO: 441790 - DNA, 15 bp, Homo sapiens
taatgggatgtttac

SEQ ID NO: 441791 - DNA, 15 bp, Homo sapiens
aatgggatgtttaca

SEQ ID NO: 441792 - DNA, 15 bp, Homo sapiens
atgggatgtttacaa

SEQ ID NO: 441793 - DNA, 15 bp, Homo sapiens
tgggatgtttacaac

SEQ ID NO: 441794 - DNA, 15 bp, Homo sapiens
gggatgtttacaaca

SEQ ID NO: 441795 - DNA, 15 bp, Homo sapiens
ggatgtttacaacac

SEQ ID NO: 441796 - DNA, 15 bp, Homo sapiens
gatgtttacaacacc

SEQ ID NO: 441797 - DNA, 15 bp, Homo sapiens
atgtttacaacacct

SEQ ID NO: 441798 - DNA, 15 bp, Homo sapiens
tgtttacaacaccta

SEQ ID NO: 441799 - DNA, 15 bp, Homo sapiens
gtttacaacacctac

SEQ ID NO: 441800 - DNA, 15 bp, Homo sapiens
tttacaacacctact

SEQ ID NO: 441801 - DNA, 15 bp, Homo sapiens
ttacaacacctacta

SEQ ID NO: 441802 - DNA, 15 bp, Homo sapiens
tacaacacctactac

SEQ ID NO: 441803 - DNA, 15 bp, Homo sapiens
acaacacctactact

SEQ ID NO: 441804 - DNA, 15 bp, Homo sapiens
caacacctactactt

SEQ ID NO: 441805 - DNA, 15 bp, Homo sapiens
aacacctactacttc

SEQ ID NO: 441806 - DNA, 15 bp, Homo sapiens
acacctactacttct

SEQ ID NO: 441807 - DNA, 15 bp, Homo sapiens
cacctactacttcta

SEQ ID NO: 441808 - DNA, 15 bp, Homo sapiens
acctactacttctaa

SEQ ID NO: 441809 - DNA, 15 bp, Homo sapiens
cctactacttctaaa

SEQ ID NO: 441810 - DNA, 15 bp, Homo sapiens
ctactacttctaaat

SEQ ID NO: 441811 - DNA, 15 bp, Homo sapiens
tactacttctaaatt

SEQ ID NO: 441812 - DNA, 15 bp, Homo sapiens
actacttctaaattt

SEQ ID NO: 441813 - DNA, 15 bp, Homo sapiens
ctacttctaaattta

SEQ ID NO: 441814 - DNA, 15 bp, Homo sapiens
tacttctaaatttag

SEQ ID NO: 441815 - DNA, 15 bp, Homo sapiens
acttctaaatttagt

SEQ ID NO: 441816 - DNA, 15 bp, Homo sapiens
cttctaaatttagtt

SEQ ID NO: 441817 - DNA, 15 bp, Homo sapiens
ttctaaatttagttt

SEQ ID NO: 441818 - DNA, 15 bp, Homo sapiens
tctaaatttagtttg

SEQ ID NO: 441819 - DNA, 15 bp, Homo sapiens
ctaaatttagtttgg

SEQ ID NO: 441820 - DNA, 15 bp, Homo sapiens
taaatttagtttggt

SEQ ID NO: 441821 - DNA, 15 bp, Homo sapiens
aaatttagtttggta

SEQ ID NO: 441822 - DNA, 15 bp, Homo sapiens
aatttagtttggtac

SEQ ID NO: 441823 - DNA, 15 bp, Homo sapiens
atttagtttggtaca

SEQ ID NO: 441824 - DNA, 15 bp, Homo sapiens
tttagtttggtacat

SEQ ID NO: 441825 - DNA, 15 bp, Homo sapiens
ttagtttggtacatt

SEQ ID NO: 441826 - DNA, 15 bp, Homo sapiens
tagtttggtacatta

SEQ ID NO: 441827 - DNA, 15 bp, Homo sapiens
agtttggtacattat

SEQ ID NO: 441828 - DNA, 15 bp, Homo sapiens
gtttggtacattatt

SEQ ID NO: 441829 - DNA, 15 bp, Homo sapiens
tttggtacattatta

SEQ ID NO: 441830 - DNA, 15 bp, Homo sapiens
ttggtacattattaa

SEQ ID NO: 441831 - DNA, 15 bp, Homo sapiens
tggtacattattaac

SEQ ID NO: 441832 - DNA, 15 bp, Homo sapiens
ggtacattattaact

SEQ ID NO: 441833 - DNA, 15 bp, Homo sapiens
gtacattattaacta

SEQ ID NO: 441834 - DNA, 15 bp, Homo sapiens
tacattattaactat

SEQ ID NO: 441835 - DNA, 15 bp, Homo sapiens
acattattaactata

SEQ ID NO: 441836 - DNA, 15 bp, Homo sapiens
cattattaactataa

SEQ ID NO: 441837 - DNA, 15 bp, Homo sapiens
attattaactataat

SEQ ID NO: 441838 - DNA, 15 bp, Homo sapiens
ttattaactataatt

SEQ ID NO: 441839 - DNA, 15 bp, Homo sapiens
tattaactataattt

SEQ ID NO: 441840 - DNA, 15 bp, Homo sapiens
attaactataatttt

SEQ ID NO: 441841 - DNA, 15 bp, Homo sapiens
ttaactataattttg

SEQ ID NO: 441842 - DNA, 15 bp, Homo sapiens
taactataattttgt

SEQ ID NO: 441843 - DNA, 15 bp, Homo sapiens
aactataattttgtg

SEQ ID NO: 441844 - DNA, 15 bp, Homo sapiens
actataattttgtgg

SEQ ID NO: 441845 - DNA, 15 bp, Homo sapiens
ctataattttgtggc

SEQ ID NO: 441846 - DNA, 15 bp, Homo sapiens
tataattttgtggcc

SEQ ID NO: 441847 - DNA, 15 bp, Homo sapiens
ataattttgtggcca

SEQ ID NO: 441848 - DNA, 15 bp, Homo sapiens
taattttgtggccaa

SEQ ID NO: 441849 - DNA, 15 bp, Homo sapiens
aattttgtggccaat

SEQ ID NO: 441850 - DNA, 15 bp, Homo sapiens
attttgtggccaatt

SEQ ID NO: 441851 - DNA, 15 bp, Homo sapiens
ttttgtggccaattt

SEQ ID NO: 441852 - DNA, 15 bp, Homo sapiens
tttgtggccaattta

SEQ ID NO: 441853 - DNA, 15 bp, Homo sapiens
ttgtggccaatttaa

SEQ ID NO: 441854 - DNA, 15 bp, Homo sapiens
tgtggccaatttaaa

SEQ ID NO: 441855 - DNA, 15 bp, Homo sapiens
gtggccaatttaaat

SEQ ID NO: 441856 - DNA, 15 bp, Homo sapiens
tggccaatttaaatt

SEQ ID NO: 441857 - DNA, 15 bp, Homo sapiens
ggccaatttaaattt

SEQ ID NO: 441858 - DNA, 15 bp, Homo sapiens
gccaatttaaattta

SEQ ID NO: 441859 - DNA, 15 bp, Homo sapiens
ccaatttaaatttaa

SEQ ID NO: 441860 - DNA, 15 bp, Homo sapiens
caatttaaatttaaa

SEQ ID NO: 441861 - DNA, 15 bp, Homo sapiens
aatttaaatttaaac

SEQ ID NO: 441862 - DNA, 15 bp, Homo sapiens
atttaaatttaaact

SEQ ID NO: 441863 - DNA, 15 bp, Homo sapiens
tttaaatttaaactg

SEQ ID NO: 441864 - DNA, 15 bp, Homo sapiens
ttaaatttaaactgt

SEQ ID NO: 441865 - DNA, 15 bp, Homo sapiens
taaatttaaactgtt

SEQ ID NO: 441866 - DNA, 15 bp, Homo sapiens
aaatttaaactgttt

SEQ ID NO: 441867 - DNA, 15 bp, Homo sapiens
aatttaaactgtttt

SEQ ID NO: 441868 - DNA, 15 bp, Homo sapiens
atttaaactgttttc

SEQ ID NO: 441869 - DNA, 15 bp, Homo sapiens
tttaaactgttttct

SEQ ID NO: 441870 - DNA, 15 bp, Homo sapiens
ttaaactgttttctt

SEQ ID NO: 441871 - DNA, 15 bp, Homo sapiens
taaactgttttcttt

SEQ ID NO: 441872 - DNA, 15 bp, Homo sapiens
aaactgttttctttt

SEQ ID NO: 441873 - DNA, 15 bp, Homo sapiens
aactgttttctttta

SEQ ID NO: 441874 - DNA, 15 bp, Homo sapiens
actgttttcttttaa

SEQ ID NO: 441875 - DNA, 15 bp, Homo sapiens
ctgttttcttttaat

SEQ ID NO: 441876 - DNA, 15 bp, Homo sapiens
tgttttcttttaata

SEQ ID NO: 441877 - DNA, 15 bp, Homo sapiens
gttttcttttaatat

SEQ ID NO: 441878 - DNA, 15 bp, Homo sapiens
ttttcttttaatatc

SEQ ID NO: 441879 - DNA, 15 bp, Homo sapiens
tttcttttaatatcc

SEQ ID NO: 441880 - DNA, 15 bp, Homo sapiens
ttcttttaatatccc

SEQ ID NO: 441881 - DNA, 15 bp, Homo sapiens
tcttttaatatccca

SEQ ID NO: 441882 - DNA, 15 bp, Homo sapiens
cttttaatatcccag

SEQ ID NO: 441883 - DNA, 15 bp, Homo sapiens
ttttaatatcccagt

SEQ ID NO: 441884 - DNA, 15 bp, Homo sapiens
tttaatatcccagtt

SEQ ID NO: 441885 - DNA, 15 bp, Homo sapiens
ttaatatcccagttc

SEQ ID NO: 441886 - DNA, 15 bp, Homo sapiens
taatatcccagttcc

SEQ ID NO: 441887 - DNA, 15 bp, Homo sapiens
aatatcccagttcca

SEQ ID NO: 441888 - DNA, 15 bp, Homo sapiens
atatcccagttccat

SEQ ID NO: 441889 - DNA, 15 bp, Homo sapiens
tatcccagttccatt

SEQ ID NO: 441890 - DNA, 15 bp, Homo sapiens
atcccagttccatta

SEQ ID NO: 441891 - DNA, 15 bp, Homo sapiens
tcccagttccattat

SEQ ID NO: 441892 - DNA, 15 bp, Homo sapiens
cccagttccattatc

SEQ ID NO: 441893 - DNA, 15 bp, Homo sapiens
ccagttccattatcc

SEQ ID NO: 441894 - DNA, 15 bp, Homo sapiens
cagttccattatcca

SEQ ID NO: 441895 - DNA, 15 bp, Homo sapiens
agttccattatccat

SEQ ID NO: 441896 - DNA, 15 bp, Homo sapiens
gttccattatccatt

SEQ ID NO: 441897 - DNA, 15 bp, Homo sapiens
ttccattatccattc

SEQ ID NO: 441898 - DNA, 15 bp, Homo sapiens
tccattatccattct

SEQ ID NO: 441899 - DNA, 15 bp, Homo sapiens
ccattatccattctg

SEQ ID NO: 441900 - DNA, 15 bp, Homo sapiens
cattatccattctgt

SEQ ID NO: 441901 - DNA, 15 bp, Homo sapiens
attatccattctgtg

SEQ ID NO: 441902 - DNA, 15 bp, Homo sapiens
ttatccattctgtgt

SEQ ID NO: 441903 - DNA, 15 bp, Homo sapiens
tatccattctgtgtt

SEQ ID NO: 441904 - DNA, 15 bp, Homo sapiens
atccattctgtgtta

SEQ ID NO: 441905 - DNA, 15 bp, Homo sapiens
tccattctgtgttag

SEQ ID NO: 441906 - DNA, 15 bp, Homo sapiens
ccattctgtgttagc

SEQ ID NO: 441907 - DNA, 15 bp, Homo sapiens
cattctgtgttagct

SEQ ID NO: 441908 - DNA, 15 bp, Homo sapiens
attctgtgttagctt

SEQ ID NO: 441909 - DNA, 15 bp, Homo sapiens
ttctgtgttagctta

SEQ ID NO: 441910 - DNA, 15 bp, Homo sapiens
tctgtgttagcttaa

SEQ ID NO: 441911 - DNA, 15 bp, Homo sapiens
ctgtgttagcttaat

SEQ ID NO: 441912 - DNA, 15 bp, Homo sapiens
tgtgttagcttaata

SEQ ID NO: 441913 - DNA, 15 bp, Homo sapiens
gtgttagcttaatat

SEQ ID NO: 441914 - DNA, 15 bp, Homo sapiens
tgttagcttaatatt

SEQ ID NO: 441915 - DNA, 15 bp, Homo sapiens
gttagcttaatattg

SEQ ID NO: 441916 - DNA, 15 bp, Homo sapiens
ttagcttaatattgc

SEQ ID NO: 441917 - DNA, 15 bp, Homo sapiens
tagcttaatattgct

SEQ ID NO: 441918 - DNA, 15 bp, Homo sapiens
agcttaatattgctc

SEQ ID NO: 441919 - DNA, 15 bp, Homo sapiens
gcttaatattgctca

SEQ ID NO: 441920 - DNA, 15 bp, Homo sapiens
cttaatattgctcaa

SEQ ID NO: 441921 - DNA, 15 bp, Homo sapiens
ttaatattgctcaaa

SEQ ID NO: 441922 - DNA, 15 bp, Homo sapiens
taatattgctcaaat

SEQ ID NO: 441923 - DNA, 15 bp, Homo sapiens
aatattgctcaaata

SEQ ID NO: 441924 - DNA, 15 bp, Homo sapiens
atattgctcaaatat

SEQ ID NO: 441925 - DNA, 15 bp, Homo sapiens
tattgctcaaatatc

SEQ ID NO: 441926 - DNA, 15 bp, Homo sapiens
attgctcaaatatca

SEQ ID NO: 441927 - DNA, 15 bp, Homo sapiens
ttgctcaaatatcat

SEQ ID NO: 441928 - DNA, 15 bp, Homo sapiens
tgctcaaatatcatt

SEQ ID NO: 441929 - DNA, 15 bp, Homo sapiens
gctcaaatatcattt

SEQ ID NO: 441930 - DNA, 15 bp, Homo sapiens
ctcaaatatcatttt

SEQ ID NO: 441931 - DNA, 15 bp, Homo sapiens
tcaaatatcattttt

SEQ ID NO: 441932 - DNA, 15 bp, Homo sapiens
caaatatcatttttg

SEQ ID NO: 441933 - DNA, 15 bp, Homo sapiens
aaatatcatttttgt

SEQ ID NO: 441934 - DNA, 15 bp, Homo sapiens
aatatcatttttgtg

SEQ ID NO: 441935 - DNA, 15 bp, Homo sapiens
atatcatttttgtgg

SEQ ID NO: 441936 - DNA, 15 bp, Homo sapiens
tatcatttttgtggg

SEQ ID NO: 441937 - DNA, 15 bp, Homo sapiens
atcatttttgtgggc

SEQ ID NO: 441938 - DNA, 15 bp, Homo sapiens
tcatttttgtgggcc

SEQ ID NO: 441939 - DNA, 15 bp, Homo sapiens
catttttgtgggcct

SEQ ID NO: 441940 - DNA, 15 bp, Homo sapiens
atttttgtgggcctt

SEQ ID NO: 441941 - DNA, 15 bp, Homo sapiens
tttttgtgggccttt

SEQ ID NO: 441942 - DNA, 15 bp, Homo sapiens
ttttgtgggcctttg

SEQ ID NO: 441943 - DNA, 15 bp, Homo sapiens
tttgtgggcctttgt

SEQ ID NO: 441944 - DNA, 15 bp, Homo sapiens
ttgtgggcctttgtc

SEQ ID NO: 441945 - DNA, 15 bp, Homo sapiens
tgtgggcctttgtca

SEQ ID NO: 441946 - DNA, 15 bp, Homo sapiens
gtgggcctttgtcaa

SEQ ID NO: 441947 - DNA, 15 bp, Homo sapiens
tgggcctttgtcaat

SEQ ID NO: 441948 - DNA, 15 bp, Homo sapiens
gggcctttgtcaata

SEQ ID NO: 441949 - DNA, 15 bp, Homo sapiens
ggcctttgtcaatag

SEQ ID NO: 441950 - DNA, 15 bp, Homo sapiens
gcctttgtcaataga

SEQ ID NO: 441951 - DNA, 15 bp, Homo sapiens
cctttgtcaatagaa

SEQ ID NO: 441952 - DNA, 15 bp, Homo sapiens
ctttgtcaatagaaa

SEQ ID NO: 441953 - DNA, 15 bp, Homo sapiens
tttgtcaatagaaat

SEQ ID NO: 441954 - DNA, 15 bp, Homo sapiens
ttgtcaatagaaatt

SEQ ID NO: 441955 - DNA, 15 bp, Homo sapiens
tgtcaatagaaatta

SEQ ID NO: 441956 - DNA, 15 bp, Homo sapiens
gtcaatagaaattaa

SEQ ID NO: 441957 - DNA, 15 bp, Homo sapiens
tcaatagaaattaat

SEQ ID NO: 441958 - DNA, 15 bp, Homo sapiens
caatagaaattaatt

SEQ ID NO: 441959 - DNA, 15 bp, Homo sapiens
aatagaaattaattc

SEQ ID NO: 441960 - DNA, 15 bp, Homo sapiens
atagaaattaattct

SEQ ID NO: 441961 - DNA, 15 bp, Homo sapiens
tagaaattaattctg

SEQ ID NO: 441962 - DNA, 15 bp, Homo sapiens
agaaattaattctgt

SEQ ID NO: 441963 - DNA, 15 bp, Homo sapiens
gaaattaattctgtc

SEQ ID NO: 441964 - DNA, 15 bp, Homo sapiens
aaattaattctgtct

SEQ ID NO: 441965 - DNA, 15 bp, Homo sapiens
aattaattctgtctc

SEQ ID NO: 441966 - DNA, 15 bp, Homo sapiens
attaattctgtctct

SEQ ID NO: 441967 - DNA, 15 bp, Homo sapiens
ttaattctgtctctc

SEQ ID NO: 441968 - DNA, 15 bp, Homo sapiens
taattctgtctctct

SEQ ID NO: 441969 - DNA, 15 bp, Homo sapiens
aattctgtctctctt

SEQ ID NO: 441970 - DNA, 15 bp, Homo sapiens
attctgtctctcttg

SEQ ID NO: 441971 - DNA, 15 bp, Homo sapiens
ttctgtctctcttgg

SEQ ID NO: 441972 - DNA, 15 bp, Homo sapiens
tctgtctctcttgga

SEQ ID NO: 441973 - DNA, 15 bp, Homo sapiens
ctgtctctcttggat

SEQ ID NO: 441974 - DNA, 15 bp, Homo sapiens
tgtctctcttggatt

SEQ ID NO: 441975 - DNA, 15 bp, Homo sapiens
gtctctcttggattg

SEQ ID NO: 441976 - DNA, 15 bp, Homo sapiens
tctctcttggattgc

SEQ ID NO: 441977 - DNA, 15 bp, Homo sapiens
ctctcttggattgca

SEQ ID NO: 441978 - DNA, 15 bp, Homo sapiens
tctcttggattgcaa

SEQ ID NO: 441979 - DNA, 15 bp, Homo sapiens
ctcttggattgcaag

SEQ ID NO: 441980 - DNA, 15 bp, Homo sapiens
tcttggattgcaagt

SEQ ID NO: 441981 - DNA, 15 bp, Homo sapiens
cttggattgcaagtt

SEQ ID NO: 441982 - DNA, 15 bp, Homo sapiens
ttggattgcaagttc

SEQ ID NO: 441983 - DNA, 15 bp, Homo sapiens
tggattgcaagttct

SEQ ID NO: 441984 - DNA, 15 bp, Homo sapiens
ggattgcaagttctg

SEQ ID NO: 441985 - DNA, 15 bp, Homo sapiens
gattgcaagttctgt

SEQ ID NO: 441986 - DNA, 15 bp, Homo sapiens
attgcaagttctgtg

SEQ ID NO: 441987 - DNA, 15 bp, Homo sapiens
ttgcaagttctgtgc

SEQ ID NO: 441988 - DNA, 15 bp, Homo sapiens
tgcaagttctgtgct

SEQ ID NO: 441989 - DNA, 15 bp, Homo sapiens
gcaagttctgtgctg

SEQ ID NO: 441990 - DNA, 15 bp, Homo sapiens
caagttctgtgctga

SEQ ID NO: 441991 - DNA, 15 bp, Homo sapiens
aagttctgtgctgaa

SEQ ID NO: 441992 - DNA, 15 bp, Homo sapiens
agttctgtgctgaat

SEQ ID NO: 441993 - DNA, 15 bp, Homo sapiens
gttctgtgctgaata

SEQ ID NO: 441994 - DNA, 15 bp, Homo sapiens
ttctgtgctgaatag

SEQ ID NO: 441995 - DNA, 15 bp, Homo sapiens
tctgtgctgaatagt

SEQ ID NO: 441996 - DNA, 15 bp, Homo sapiens
ctgtgctgaatagtg

SEQ ID NO: 441997 - DNA, 15 bp, Homo sapiens
tgtgctgaatagtga

SEQ ID NO: 441998 - DNA, 15 bp, Homo sapiens
gtgctgaatagtgag

SEQ ID NO: 441999 - DNA, 15 bp, Homo sapiens
tgctgaatagtgagg

SEQ ID NO: 442000 - DNA, 15 bp, Homo sapiens
gctgaatagtgaggg

SEQ ID NO: 442001 - DNA, 15 bp, Homo sapiens
ctgaatagtgagggt

SEQ ID NO: 442002 - DNA, 15 bp, Homo sapiens
tgaatagtgagggtc

SEQ ID NO: 442003 - DNA, 15 bp, Homo sapiens
gaatagtgagggtct

SEQ ID NO: 442004 - DNA, 15 bp, Homo sapiens
aatagtgagggtcta

SEQ ID NO: 442005 - DNA, 15 bp, Homo sapiens
atagtgagggtctat

SEQ ID NO: 442006 - DNA, 15 bp, Homo sapiens
tagtgagggtctatt

SEQ ID NO: 442007 - DNA, 15 bp, Homo sapiens
agtgagggtctattc

SEQ ID NO: 442008 - DNA, 15 bp, Homo sapiens
gtgagggtctattcc

SEQ ID NO: 442009 - DNA, 15 bp, Homo sapiens
tgagggtctattccc

SEQ ID NO: 442010 - DNA, 15 bp, Homo sapiens
gagggtctattccca

SEQ ID NO: 442011 - DNA, 15 bp, Homo sapiens
agggtctattcccaa

SEQ ID NO: 442012 - DNA, 15 bp, Homo sapiens
gggtctattcccaag

SEQ ID NO: 442013 - DNA, 15 bp, Homo sapiens
ggtctattcccaagc

SEQ ID NO: 442014 - DNA, 15 bp, Homo sapiens
gtctattcccaagca

SEQ ID NO: 442015 - DNA, 15 bp, Homo sapiens
tctattcccaagcag

SEQ ID NO: 442016 - DNA, 15 bp, Homo sapiens
ctattcccaagcagc

SEQ ID NO: 442017 - DNA, 15 bp, Homo sapiens
tattcccaagcagct

SEQ ID NO: 442018 - DNA, 15 bp, Homo sapiens
attcccaagcagctt

SEQ ID NO: 442019 - DNA, 15 bp, Homo sapiens
ttcccaagcagcttc

SEQ ID NO: 442020 - DNA, 15 bp, Homo sapiens
tcccaagcagcttcc

SEQ ID NO: 442021 - DNA, 15 bp, Homo sapiens
cccaagcagcttcca

SEQ ID NO: 442022 - DNA, 15 bp, Homo sapiens
ccaagcagcttccat

SEQ ID NO: 442023 - DNA, 15 bp, Homo sapiens
caagcagcttccatt

SEQ ID NO: 442024 - DNA, 15 bp, Homo sapiens
aagcagcttccattc

SEQ ID NO: 442025 - DNA, 15 bp, Homo sapiens
agcagcttccattct

SEQ ID NO: 442026 - DNA, 15 bp, Homo sapiens
gcagcttccattctt

SEQ ID NO: 442027 - DNA, 15 bp, Homo sapiens
cagcttccattcttt

SEQ ID NO: 442028 - DNA, 15 bp, Homo sapiens
agcttccattcttta

SEQ ID NO: 442029 - DNA, 15 bp, Homo sapiens
gcttccattctttac

SEQ ID NO: 442030 - DNA, 15 bp, Homo sapiens
cttccattctttact

SEQ ID NO: 442031 - DNA, 15 bp, Homo sapiens
ttccattctttactg

SEQ ID NO: 442032 - DNA, 15 bp, Homo sapiens
tccattctttactgg

SEQ ID NO: 442033 - DNA, 15 bp, Homo sapiens
ccattctttactggg

SEQ ID NO: 442034 - DNA, 15 bp, Homo sapiens
cattctttactggga

SEQ ID NO: 442035 - DNA, 15 bp, Homo sapiens
attctttactgggaa

SEQ ID NO: 442036 - DNA, 15 bp, Homo sapiens
ttctttactgggaac

SEQ ID NO: 442037 - DNA, 15 bp, Homo sapiens
tctttactgggaacg

SEQ ID NO: 442038 - DNA, 15 bp, Homo sapiens
ctttactgggaacgt

SEQ ID NO: 442039 - DNA, 15 bp, Homo sapiens
tttactgggaacgtc

SEQ ID NO: 442040 - DNA, 15 bp, Homo sapiens
ttactgggaacgtca

SEQ ID NO: 442041 - DNA, 15 bp, Homo sapiens
tactgggaacgtcaa

SEQ ID NO: 442042 - DNA, 15 bp, Homo sapiens
actgggaacgtcaag

SEQ ID NO: 442043 - DNA, 15 bp, Homo sapiens
ctgggaacgtcaaga

SEQ ID NO: 442044 - DNA, 15 bp, Homo sapiens
tgggaacgtcaagaa

SEQ ID NO: 442045 - DNA, 15 bp, Homo sapiens
gggaacgtcaagaat

SEQ ID NO: 442046 - DNA, 15 bp, Homo sapiens
ggaacgtcaagaatg

SEQ ID NO: 442047 - DNA, 15 bp, Homo sapiens
gaacgtcaagaatgt

SEQ ID NO: 442048 - DNA, 15 bp, Homo sapiens
aacgtcaagaatgtg

SEQ ID NO: 442049 - DNA, 15 bp, Homo sapiens
acgtcaagaatgtgg

SEQ ID NO: 442050 - DNA, 15 bp, Homo sapiens
cgtcaagaatgtgga

SEQ ID NO: 442051 - DNA, 15 bp, Homo sapiens
gtcaagaatgtggat

SEQ ID NO: 442052 - DNA, 15 bp, Homo sapiens
tcaagaatgtggatg

SEQ ID NO: 442053 - DNA, 15 bp, Homo sapiens
caagaatgtggatgc

SEQ ID NO: 442054 - DNA, 15 bp, Homo sapiens
aagaatgtggatgct

SEQ ID NO: 442055 - DNA, 15 bp, Homo sapiens
agaatgtggatgctc

SEQ ID NO: 442056 - DNA, 15 bp, Homo sapiens
gaatgtggatgctca

SEQ ID NO: 442057 - DNA, 15 bp, Homo sapiens
aatgtggatgctcat

SEQ ID NO: 442058 - DNA, 15 bp, Homo sapiens
atgtggatgctcata

SEQ ID NO: 442059 - DNA, 15 bp, Homo sapiens
tgtggatgctcataa

SEQ ID NO: 442060 - DNA, 15 bp, Homo sapiens
gtggatgctcataat

SEQ ID NO: 442061 - DNA, 15 bp, Homo sapiens
tggatgctcataatt

SEQ ID NO: 442062 - DNA, 15 bp, Homo sapiens
ggatgctcataatta

SEQ ID NO: 442063 - DNA, 15 bp, Homo sapiens
gatgctcataattac

SEQ ID NO: 442064 - DNA, 15 bp, Homo sapiens
atgctcataattaca

SEQ ID NO: 442065 - DNA, 15 bp, Homo sapiens
tgctcataattacaa

SEQ ID NO: 442066 - DNA, 15 bp, Homo sapiens
gctcataattacaat

SEQ ID NO: 442067 - DNA, 15 bp, Homo sapiens
ctcataattacaatt

SEQ ID NO: 442068 - DNA, 15 bp, Homo sapiens
tcataattacaattt

SEQ ID NO: 442069 - DNA, 15 bp, Homo sapiens
cataattacaatttc

SEQ ID NO: 442070 - DNA, 15 bp, Homo sapiens
ataattacaatttct

SEQ ID NO: 442071 - DNA, 15 bp, Homo sapiens
taattacaatttcta

SEQ ID NO: 442072 - DNA, 15 bp, Homo sapiens
aattacaatttctaa

SEQ ID NO: 442073 - DNA, 15 bp, Homo sapiens
attacaatttctaag

SEQ ID NO: 442074 - DNA, 15 bp, Homo sapiens
ttacaatttctaagt

SEQ ID NO: 442075 - DNA, 15 bp, Homo sapiens
tacaatttctaagtg

SEQ ID NO: 442076 - DNA, 15 bp, Homo sapiens
acaatttctaagtgc

SEQ ID NO: 442077 - DNA, 15 bp, Homo sapiens
caatttctaagtgct

SEQ ID NO: 442078 - DNA, 15 bp, Homo sapiens
aatttctaagtgctc

SEQ ID NO: 442079 - DNA, 15 bp, Homo sapiens
atttctaagtgctct

SEQ ID NO: 442080 - DNA, 15 bp, Homo sapiens
tttctaagtgctctt

SEQ ID NO: 442081 - DNA, 15 bp, Homo sapiens
ttctaagtgctctta

SEQ ID NO: 442082 - DNA, 15 bp, Homo sapiens
tctaagtgctcttag

SEQ ID NO: 442083 - DNA, 15 bp, Homo sapiens
ctaagtgctcttagt

SEQ ID NO: 442084 - DNA, 15 bp, Homo sapiens
taagtgctcttagta

SEQ ID NO: 442085 - DNA, 15 bp, Homo sapiens
aagtgctcttagtaa

SEQ ID NO: 442086 - DNA, 15 bp, Homo sapiens
agtgctcttagtaag

SEQ ID NO: 442087 - DNA, 15 bp, Homo sapiens
gtgctcttagtaagt

SEQ ID NO: 442088 - DNA, 15 bp, Homo sapiens
tgctcttagtaagtt

SEQ ID NO: 442089 - DNA, 15 bp, Homo sapiens
gctcttagtaagttg

SEQ ID NO: 442090 - DNA, 15 bp, Homo sapiens
ctcttagtaagttgt

SEQ ID NO: 442091 - DNA, 15 bp, Homo sapiens
tcttagtaagttgtt

SEQ ID NO: 442092 - DNA, 15 bp, Homo sapiens
cttagtaagttgttt

SEQ ID NO: 442093 - DNA, 15 bp, Homo sapiens
ttagtaagttgtttt

SEQ ID NO: 442094 - DNA, 15 bp, Homo sapiens
tagtaagttgtttta

SEQ ID NO: 442095 - DNA, 15 bp, Homo sapiens
agtaagttgttttaa

SEQ ID NO: 442096 - DNA, 15 bp, Homo sapiens
gtaagttgttttaat

SEQ ID NO: 442097 - DNA, 15 bp, Homo sapiens
taagttgttttaatg

SEQ ID NO: 442098 - DNA, 15 bp, Homo sapiens
aagttgttttaatga

SEQ ID NO: 442099 - DNA, 15 bp, Homo sapiens
agttgttttaatgat

SEQ ID NO: 442100 - DNA, 15 bp, Homo sapiens
gttgttttaatgatt

SEQ ID NO: 442101 - DNA, 15 bp, Homo sapiens
ttgttttaatgattc

SEQ ID NO: 442102 - DNA, 15 bp, Homo sapiens
tgttttaatgattct

SEQ ID NO: 442103 - DNA, 15 bp, Homo sapiens
gttttaatgattcta

SEQ ID NO: 442104 - DNA, 15 bp, Homo sapiens
ttttaatgattctag

SEQ ID NO: 442105 - DNA, 15 bp, Homo sapiens
tttaatgattctaga

SEQ ID NO: 442106 - DNA, 15 bp, Homo sapiens
ttaatgattctagac

SEQ ID NO: 442107 - DNA, 15 bp, Homo sapiens
taatgattctagacc

SEQ ID NO: 442108 - DNA, 15 bp, Homo sapiens
aatgattctagacct

SEQ ID NO: 442109 - DNA, 15 bp, Homo sapiens
atgattctagacctt

SEQ ID NO: 442110 - DNA, 15 bp, Homo sapiens
tgattctagaccttg

SEQ ID NO: 442111 - DNA, 15 bp, Homo sapiens
gattctagaccttgc

SEQ ID NO: 442112 - DNA, 15 bp, Homo sapiens
attctagaccttgct

SEQ ID NO: 442113 - DNA, 15 bp, Homo sapiens
ttctagaccttgctc

SEQ ID NO: 442114 - DNA, 15 bp, Homo sapiens
tctagaccttgctca

SEQ ID NO: 442115 - DNA, 15 bp, Homo sapiens
ctagaccttgctcag

SEQ ID NO: 442116 - DNA, 15 bp, Homo sapiens
tagaccttgctcaga

SEQ ID NO: 442117 - DNA, 15 bp, Homo sapiens
agaccttgctcagag

SEQ ID NO: 442118 - DNA, 15 bp, Homo sapiens
gaccttgctcagagg

SEQ ID NO: 442119 - DNA, 15 bp, Homo sapiens
accttgctcagaggt

SEQ ID NO: 442120 - DNA, 15 bp, Homo sapiens
ccttgctcagaggtg

SEQ ID NO: 442121 - DNA, 15 bp, Homo sapiens
cttgctcagaggtgg

SEQ ID NO: 442122 - DNA, 15 bp, Homo sapiens
ttgctcagaggtggc

SEQ ID NO: 442123 - DNA, 15 bp, Homo sapiens
tgctcagaggtggca

SEQ ID NO: 442124 - DNA, 15 bp, Homo sapiens
gctcagaggtggcat

SEQ ID NO: 442125 - DNA, 15 bp, Homo sapiens
ctcagaggtggcatt

SEQ ID NO: 442126 - DNA, 15 bp, Homo sapiens
tcagaggtggcattt

SEQ ID NO: 442127 - DNA, 15 bp, Homo sapiens
cagaggtggcatttg

SEQ ID NO: 442128 - DNA, 15 bp, Homo sapiens
agaggtggcatttgt

SEQ ID NO: 442129 - DNA, 15 bp, Homo sapiens
gaggtggcatttgtc

SEQ ID NO: 442130 - DNA, 15 bp, Homo sapiens
aggtggcatttgtca

SEQ ID NO: 442131 - DNA, 15 bp, Homo sapiens
ggtggcatttgtcaa

SEQ ID NO: 442132 - DNA, 15 bp, Homo sapiens
gtggcatttgtcaat

SEQ ID NO: 442133 - DNA, 15 bp, Homo sapiens
tggcatttgtcaatt

SEQ ID NO: 442134 - DNA, 15 bp, Homo sapiens
ggcatttgtcaattc

SEQ ID NO: 442135 - DNA, 15 bp, Homo sapiens
gcatttgtcaattct

SEQ ID NO: 442136 - DNA, 15 bp, Homo sapiens
catttgtcaattcta

SEQ ID NO: 442137 - DNA, 15 bp, Homo sapiens
atttgtcaattctaa

SEQ ID NO: 442138 - DNA, 15 bp, Homo sapiens
tttgtcaattctaag

SEQ ID NO: 442139 - DNA, 15 bp, Homo sapiens
ttgtcaattctaaga

SEQ ID NO: 442140 - DNA, 15 bp, Homo sapiens
tgtcaattctaagac

SEQ ID NO: 442141 - DNA, 15 bp, Homo sapiens
gtcaattctaagact

SEQ ID NO: 442142 - DNA, 15 bp, Homo sapiens
tcaattctaagactc

SEQ ID NO: 442143 - DNA, 15 bp, Homo sapiens
caattctaagactca

SEQ ID NO: 442144 - DNA, 15 bp, Homo sapiens
aattctaagactcat

SEQ ID NO: 442145 - DNA, 15 bp, Homo sapiens
attctaagactcatt

SEQ ID NO: 442146 - DNA, 15 bp, Homo sapiens
ttctaagactcattt

SEQ ID NO: 442147 - DNA, 15 bp, Homo sapiens
tctaagactcattta

SEQ ID NO: 442148 - DNA, 15 bp, Homo sapiens
ctaagactcatttac

SEQ ID NO: 442149 - DNA, 15 bp, Homo sapiens
taagactcatttacc

SEQ ID NO: 442150 - DNA, 15 bp, Homo sapiens
aagactcatttacct

SEQ ID NO: 442151 - DNA, 15 bp, Homo sapiens
agactcatttacctt

SEQ ID NO: 442152 - DNA, 15 bp, Homo sapiens
gactcatttaccttt

SEQ ID NO: 442153 - DNA, 15 bp, Homo sapiens
actcatttacctttt

SEQ ID NO: 442154 - DNA, 15 bp, Homo sapiens
ctcatttaccttttt

SEQ ID NO: 442155 - DNA, 15 bp, Homo sapiens
tcatttacctttttt

SEQ ID NO: 442156 - DNA, 15 bp, Homo sapiens
catttaccttttttc

SEQ ID NO: 442157 - DNA, 15 bp, Homo sapiens
atttaccttttttct

SEQ ID NO: 442158 - DNA, 15 bp, Homo sapiens
tttaccttttttctg

SEQ ID NO: 442159 - DNA, 15 bp, Homo sapiens
ttaccttttttctgt

SEQ ID NO: 442160 - DNA, 15 bp, Homo sapiens
taccttttttctgta

SEQ ID NO: 442161 - DNA, 15 bp, Homo sapiens
accttttttctgtag

SEQ ID NO: 442162 - DNA, 15 bp, Homo sapiens
ccttttttctgtaga

SEQ ID NO: 442163 - DNA, 15 bp, Homo sapiens
cttttttctgtagac

SEQ ID NO: 442164 - DNA, 15 bp, Homo sapiens
ttttttctgtagact

SEQ ID NO: 442165 - DNA, 15 bp, Homo sapiens
tttttctgtagactc

SEQ ID NO: 442166 - DNA, 15 bp, Homo sapiens
ttttctgtagactcc

SEQ ID NO: 442167 - DNA, 15 bp, Homo sapiens
tttctgtagactcca

SEQ ID NO: 442168 - DNA, 15 bp, Homo sapiens
ttctgtagactccac

SEQ ID NO: 442169 - DNA, 15 bp, Homo sapiens
tctgtagactccact

SEQ ID NO: 442170 - DNA, 15 bp, Homo sapiens
ctgtagactccactc

SEQ ID NO: 442171 - DNA, 15 bp, Homo sapiens
tgtagactccactct

SEQ ID NO: 442172 - DNA, 15 bp, Homo sapiens
gtagactccactctt

SEQ ID NO: 442173 - DNA, 15 bp, Homo sapiens
tagactccactcttc

SEQ ID NO: 442174 - DNA, 15 bp, Homo sapiens
agactccactcttcc

SEQ ID NO: 442175 - DNA, 15 bp, Homo sapiens
gactccactcttcct

SEQ ID NO: 442176 - DNA, 15 bp, Homo sapiens
actccactcttcctg

SEQ ID NO: 442177 - DNA, 15 bp, Homo sapiens
ctccactcttcctgc

SEQ ID NO: 442178 - DNA, 15 bp, Homo sapiens
tccactcttcctgcc

SEQ ID NO: 442179 - DNA, 15 bp, Homo sapiens
ccactcttcctgccc

SEQ ID NO: 442180 - DNA, 15 bp, Homo sapiens
cactcttcctgccca

SEQ ID NO: 442181 - DNA, 15 bp, Homo sapiens
actcttcctgcccaa

SEQ ID NO: 442182 - DNA, 15 bp, Homo sapiens
ctcttcctgcccaag

SEQ ID NO: 442183 - DNA, 15 bp, Homo sapiens
tcttcctgcccaagc

SEQ ID NO: 442184 - DNA, 15 bp, Homo sapiens
cttcctgcccaagcc

SEQ ID NO: 442185 - DNA, 15 bp, Homo sapiens
ttcctgcccaagccc

SEQ ID NO: 442186 - DNA, 15 bp, Homo sapiens
tcctgcccaagccct

SEQ ID NO: 442187 - DNA, 15 bp, Homo sapiens
cctgcccaagcccta

SEQ ID NO: 442188 - DNA, 15 bp, Homo sapiens
ctgcccaagccctaa

SEQ ID NO: 442189 - DNA, 15 bp, Homo sapiens
tgcccaagccctaac

SEQ ID NO: 442190 - DNA, 15 bp, Homo sapiens
gcccaagccctaacc

SEQ ID NO: 442191 - DNA, 15 bp, Homo sapiens
cccaagccctaacca

SEQ ID NO: 442192 - DNA, 15 bp, Homo sapiens
ccaagccctaaccac

SEQ ID NO: 442193 - DNA, 15 bp, Homo sapiens
caagccctaaccaca

SEQ ID NO: 442194 - DNA, 15 bp, Homo sapiens
aagccctaaccacag

SEQ ID NO: 442195 - DNA, 15 bp, Homo sapiens
agccctaaccacaga

SEQ ID NO: 442196 - DNA, 15 bp, Homo sapiens
gccctaaccacagac

SEQ ID NO: 442197 - DNA, 15 bp, Homo sapiens
ccctaaccacagaca

SEQ ID NO: 442198 - DNA, 15 bp, Homo sapiens
cctaaccacagacag

SEQ ID NO: 442199 - DNA, 15 bp, Homo sapiens
ctaaccacagacagt

SEQ ID NO: 442200 - DNA, 15 bp, Homo sapiens
taaccacagacagtg

SEQ ID NO: 442201 - DNA, 15 bp, Homo sapiens
aaccacagacagtga

SEQ ID NO: 442202 - DNA, 15 bp, Homo sapiens
accacagacagtgat

SEQ ID NO: 442203 - DNA, 15 bp, Homo sapiens
ccacagacagtgatt

SEQ ID NO: 442204 - DNA, 15 bp, Homo sapiens
cacagacagtgatta

SEQ ID NO: 442205 - DNA, 15 bp, Homo sapiens
acagacagtgattat

SEQ ID NO: 442206 - DNA, 15 bp, Homo sapiens
cagacagtgattata

SEQ ID NO: 442207 - DNA, 15 bp, Homo sapiens
agacagtgattataa

SEQ ID NO: 442208 - DNA, 15 bp, Homo sapiens
gacagtgattataaa

SEQ ID NO: 442209 - DNA, 15 bp, Homo sapiens
acagtgattataaat

SEQ ID NO: 442210 - DNA, 15 bp, Homo sapiens
cagtgattataaatg

SEQ ID NO: 442211 - DNA, 15 bp, Homo sapiens
agtgattataaatga

SEQ ID NO: 442212 - DNA, 15 bp, Homo sapiens
gtgattataaatgat

SEQ ID NO: 442213 - DNA, 15 bp, Homo sapiens
tgattataaatgatt

SEQ ID NO: 442214 - DNA, 15 bp, Homo sapiens
gattataaatgattt

SEQ ID NO: 442215 - DNA, 15 bp, Homo sapiens
attataaatgatttt

SEQ ID NO: 442216 - DNA, 15 bp, Homo sapiens
ttataaatgattttg

SEQ ID NO: 442217 - DNA, 15 bp, Homo sapiens
tataaatgattttga

SEQ ID NO: 442218 - DNA, 15 bp, Homo sapiens
ataaatgattttgac

SEQ ID NO: 442219 - DNA, 15 bp, Homo sapiens
taaatgattttgaca

SEQ ID NO: 442220 - DNA, 15 bp, Homo sapiens
aaatgattttgacag

SEQ ID NO: 442221 - DNA, 15 bp, Homo sapiens
aatgattttgacagg

SEQ ID NO: 442222 - DNA, 15 bp, Homo sapiens
atgattttgacaggg

SEQ ID NO: 442223 - DNA, 15 bp, Homo sapiens
tgattttgacaggga

SEQ ID NO: 442224 - DNA, 15 bp, Homo sapiens
gattttgacagggat

SEQ ID NO: 442225 - DNA, 15 bp, Homo sapiens
attttgacagggata

SEQ ID NO: 442226 - DNA, 15 bp, Homo sapiens
ttttgacagggatag

SEQ ID NO: 442227 - DNA, 15 bp, Homo sapiens
tttgacagggataga

SEQ ID NO: 442228 - DNA, 15 bp, Homo sapiens
ttgacagggatagat

SEQ ID NO: 442229 - DNA, 15 bp, Homo sapiens
tgacagggatagatc

SEQ ID NO: 442230 - DNA, 15 bp, Homo sapiens
gacagggatagatct

SEQ ID NO: 442231 - DNA, 15 bp, Homo sapiens
acagggatagatctt

SEQ ID NO: 442232 - DNA, 15 bp, Homo sapiens
cagggatagatctta

SEQ ID NO: 442233 - DNA, 15 bp, Homo sapiens
agggatagatcttac

SEQ ID NO: 442234 - DNA, 15 bp, Homo sapiens
gggatagatcttacc

SEQ ID NO: 442235 - DNA, 15 bp, Homo sapiens
ggatagatcttacct

SEQ ID NO: 442236 - DNA, 15 bp, Homo sapiens
gatagatcttacctc

SEQ ID NO: 442237 - DNA, 15 bp, Homo sapiens
atagatcttacctct

SEQ ID NO: 442238 - DNA, 15 bp, Homo sapiens
tagatcttacctctt

SEQ ID NO: 442239 - DNA, 15 bp, Homo sapiens
agatcttacctcttg

SEQ ID NO: 442240 - DNA, 15 bp, Homo sapiens
gatcttacctcttga

SEQ ID NO: 442241 - DNA, 15 bp, Homo sapiens
atcttacctcttgag

SEQ ID NO: 442242 - DNA, 15 bp, Homo sapiens
tcttacctcttgagt

SEQ ID NO: 442243 - DNA, 15 bp, Homo sapiens
cttacctcttgagtc

SEQ ID NO: 442244 - DNA, 15 bp, Homo sapiens
ttacctcttgagtct

SEQ ID NO: 442245 - DNA, 15 bp, Homo sapiens
tacctcttgagtctg

SEQ ID NO: 442246 - DNA, 15 bp, Homo sapiens
acctcttgagtctgt

SEQ ID NO: 442247 - DNA, 15 bp, Homo sapiens
cctcttgagtctgta

SEQ ID NO: 442248 - DNA, 15 bp, Homo sapiens
ctcttgagtctgtaa

SEQ ID NO: 442249 - DNA, 15 bp, Homo sapiens
tcttgagtctgtaat

SEQ ID NO: 442250 - DNA, 15 bp, Homo sapiens
cttgagtctgtaata

SEQ ID NO: 442251 - DNA, 15 bp, Homo sapiens
ttgagtctgtaatag

SEQ ID NO: 442252 - DNA, 15 bp, Homo sapiens
tgagtctgtaatagg

SEQ ID NO: 442253 - DNA, 15 bp, Homo sapiens
gagtctgtaataggc

SEQ ID NO: 442254 - DNA, 15 bp, Homo sapiens
agtctgtaataggca

SEQ ID NO: 442255 - DNA, 15 bp, Homo sapiens
gtctgtaataggcat

SEQ ID NO: 442256 - DNA, 15 bp, Homo sapiens
tctgtaataggcatt

SEQ ID NO: 442257 - DNA, 15 bp, Homo sapiens
ctgtaataggcattg

SEQ ID NO: 442258 - DNA, 15 bp, Homo sapiens
tgtaataggcattgg

SEQ ID NO: 442259 - DNA, 15 bp, Homo sapiens
gtaataggcattggt

SEQ ID NO: 442260 - DNA, 15 bp, Homo sapiens
taataggcattggtt

SEQ ID NO: 442261 - DNA, 15 bp, Homo sapiens
aataggcattggttt

SEQ ID NO: 442262 - DNA, 15 bp, Homo sapiens
ataggcattggtttc

SEQ ID NO: 442263 - DNA, 15 bp, Homo sapiens
taggcattggtttca

SEQ ID NO: 442264 - DNA, 15 bp, Homo sapiens
aggcattggtttcat

SEQ ID NO: 442265 - DNA, 15 bp, Homo sapiens
ggcattggtttcatg

SEQ ID NO: 442266 - DNA, 15 bp, Homo sapiens
gcattggtttcatgg

SEQ ID NO: 442267 - DNA, 15 bp, Homo sapiens
cattggtttcatggt

SEQ ID NO: 442268 - DNA, 15 bp, Homo sapiens
attggtttcatggtt

SEQ ID NO: 442269 - DNA, 15 bp, Homo sapiens
ttggtttcatggtta

SEQ ID NO: 442270 - DNA, 15 bp, Homo sapiens
tggtttcatggttag

SEQ ID NO: 442271 - DNA, 15 bp, Homo sapiens
ggtttcatggttagg

SEQ ID NO: 442272 - DNA, 15 bp, Homo sapiens
gtttcatggttagga

SEQ ID NO: 442273 - DNA, 15 bp, Homo sapiens
tttcatggttaggaa

SEQ ID NO: 442274 - DNA, 15 bp, Homo sapiens
ttcatggttaggaat

SEQ ID NO: 442275 - DNA, 15 bp, Homo sapiens
tcatggttaggaatg

SEQ ID NO: 442276 - DNA, 15 bp, Homo sapiens
catggttaggaatgt

SEQ ID NO: 442277 - DNA, 15 bp, Homo sapiens
atggttaggaatgtt

SEQ ID NO: 442278 - DNA, 15 bp, Homo sapiens
tggttaggaatgttg

SEQ ID NO: 442279 - DNA, 15 bp, Homo sapiens
ggttaggaatgttgt

SEQ ID NO: 442280 - DNA, 15 bp, Homo sapiens
gttaggaatgttgtt

SEQ ID NO: 442281 - DNA, 15 bp, Homo sapiens
ttaggaatgttgttt

SEQ ID NO: 442282 - DNA, 15 bp, Homo sapiens
taggaatgttgtttc

SEQ ID NO: 442283 - DNA, 15 bp, Homo sapiens
aggaatgttgtttct

SEQ ID NO: 442284 - DNA, 15 bp, Homo sapiens
ggaatgttgtttcta

SEQ ID NO: 442285 - DNA, 15 bp, Homo sapiens
gaatgttgtttctac

SEQ ID NO: 442286 - DNA, 15 bp, Homo sapiens
aatgttgtttctact

SEQ ID NO: 442287 - DNA, 15 bp, Homo sapiens
atgttgtttctactg

SEQ ID NO: 442288 - DNA, 15 bp, Homo sapiens
tgttgtttctactgg

SEQ ID NO: 442289 - DNA, 15 bp, Homo sapiens
gttgtttctactggc

SEQ ID NO: 442290 - DNA, 15 bp, Homo sapiens
ttgtttctactggcc

SEQ ID NO: 442291 - DNA, 15 bp, Homo sapiens
tgtttctactggcca

SEQ ID NO: 442292 - DNA, 15 bp, Homo sapiens
gtttctactggccac

SEQ ID NO: 442293 - DNA, 15 bp, Homo sapiens
tttctactggccact

SEQ ID NO: 442294 - DNA, 15 bp, Homo sapiens
ttctactggccactt

SEQ ID NO: 442295 - DNA, 15 bp, Homo sapiens
tctactggccacttt

SEQ ID NO: 442296 - DNA, 15 bp, Homo sapiens
ctactggccactttc

SEQ ID NO: 442297 - DNA, 15 bp, Homo sapiens
tactggccactttct

SEQ ID NO: 442298 - DNA, 15 bp, Homo sapiens
actggccactttcta

SEQ ID NO: 442299 - DNA, 15 bp, Homo sapiens
ctggccactttctaa

SEQ ID NO: 442300 - DNA, 15 bp, Homo sapiens
tggccactttctaat

SEQ ID NO: 442301 - DNA, 15 bp, Homo sapiens
ggccactttctaatt

SEQ ID NO: 442302 - DNA, 15 bp, Homo sapiens
gccactttctaattt

SEQ ID NO: 442303 - DNA, 15 bp, Homo sapiens
ccactttctaattta

SEQ ID NO: 442304 - DNA, 15 bp, Homo sapiens
cactttctaatttaa

SEQ ID NO: 442305 - DNA, 15 bp, Homo sapiens
actttctaatttaat

SEQ ID NO: 442306 - DNA, 15 bp, Homo sapiens
ctttctaatttaatt

SEQ ID NO: 442307 - DNA, 15 bp, Homo sapiens
tttctaatttaattt

SEQ ID NO: 442308 - DNA, 15 bp, Homo sapiens
ttctaatttaatttt

SEQ ID NO: 442309 - DNA, 15 bp, Homo sapiens
tctaatttaatttta

SEQ ID NO: 442310 - DNA, 15 bp, Homo sapiens
ctaatttaattttaa

SEQ ID NO: 442311 - DNA, 15 bp, Homo sapiens
taatttaattttaag

SEQ ID NO: 442312 - DNA, 15 bp, Homo sapiens
aatttaattttaagt

SEQ ID NO: 442313 - DNA, 15 bp, Homo sapiens
atttaattttaagtg

SEQ ID NO: 442314 - DNA, 15 bp, Homo sapiens
tttaattttaagtgg

SEQ ID NO: 442315 - DNA, 15 bp, Homo sapiens
ttaattttaagtgga

SEQ ID NO: 442316 - DNA, 15 bp, Homo sapiens
taattttaagtggaa

SEQ ID NO: 442317 - DNA, 15 bp, Homo sapiens
aattttaagtggaaa

SEQ ID NO: 442318 - DNA, 15 bp, Homo sapiens
attttaagtggaaac

SEQ ID NO: 442319 - DNA, 15 bp, Homo sapiens
ttttaagtggaaaca

SEQ ID NO: 442320 - DNA, 15 bp, Homo sapiens
tttaagtggaaacat

SEQ ID NO: 442321 - DNA, 15 bp, Homo sapiens
ttaagtggaaacatg

SEQ ID NO: 442322 - DNA, 15 bp, Homo sapiens
taagtggaaacatgt

SEQ ID NO: 442323 - DNA, 15 bp, Homo sapiens
aagtggaaacatgtt

SEQ ID NO: 442324 - DNA, 15 bp, Homo sapiens
agtggaaacatgtta

SEQ ID NO: 442325 - DNA, 15 bp, Homo sapiens
gtggaaacatgttaa

SEQ ID NO: 442326 - DNA, 15 bp, Homo sapiens
tggaaacatgttaaa

SEQ ID NO: 442327 - DNA, 15 bp, Homo sapiens
ggaaacatgttaaaa

SEQ ID NO: 442328 - DNA, 15 bp, Homo sapiens
gaaacatgttaaaat

SEQ ID NO: 442329 - DNA, 15 bp, Homo sapiens
aaacatgttaaaatc

SEQ ID NO: 442330 - DNA, 15 bp, Homo sapiens
aacatgttaaaatca

SEQ ID NO: 442331 - DNA, 15 bp, Homo sapiens
acatgttaaaatcaa

SEQ ID NO: 442332 - DNA, 15 bp, Homo sapiens
catgttaaaatcaag

SEQ ID NO: 442333 - DNA, 15 bp, Homo sapiens
atgttaaaatcaagt

SEQ ID NO: 442334 - DNA, 15 bp, Homo sapiens
tgttaaaatcaagtt

SEQ ID NO: 442335 - DNA, 15 bp, Homo sapiens
gttaaaatcaagttg

SEQ ID NO: 442336 - DNA, 15 bp, Homo sapiens
ttaaaatcaagttgt

SEQ ID NO: 442337 - DNA, 15 bp, Homo sapiens
taaaatcaagttgtt

SEQ ID NO: 442338 - DNA, 15 bp, Homo sapiens
aaaatcaagttgttg

SEQ ID NO: 442339 - DNA, 15 bp, Homo sapiens
aaatcaagttgttgc

SEQ ID NO: 442340 - DNA, 15 bp, Homo sapiens
aatcaagttgttgca

SEQ ID NO: 442341 - DNA, 15 bp, Homo sapiens
atcaagttgttgcat

SEQ ID NO: 442342 - DNA, 15 bp, Homo sapiens
tcaagttgttgcatt

SEQ ID NO: 442343 - DNA, 15 bp, Homo sapiens
caagttgttgcattt

SEQ ID NO: 442344 - DNA, 15 bp, Homo sapiens
aagttgttgcatttg

SEQ ID NO: 442345 - DNA, 15 bp, Homo sapiens
agttgttgcatttgg

SEQ ID NO: 442346 - DNA, 15 bp, Homo sapiens
gttgttgcatttggt

SEQ ID NO: 442347 - DNA, 15 bp, Homo sapiens
ttgttgcatttggtg

SEQ ID NO: 442348 - DNA, 15 bp, Homo sapiens
tgttgcatttggtga

SEQ ID NO: 442349 - DNA, 15 bp, Homo sapiens
gttgcatttggtgaa

SEQ ID NO: 442350 - DNA, 15 bp, Homo sapiens
ttgcatttggtgaaa

SEQ ID NO: 442351 - DNA, 15 bp, Homo sapiens
tgcatttggtgaaaa

SEQ ID NO: 442352 - DNA, 15 bp, Homo sapiens
gcatttggtgaaaaa

SEQ ID NO: 442353 - DNA, 15 bp, Homo sapiens
catttggtgaaaaaa

SEQ ID NO: 442354 - DNA, 15 bp, Homo sapiens
atttggtgaaaaaat

SEQ ID NO: 442355 - DNA, 15 bp, Homo sapiens
tttggtgaaaaaata

SEQ ID NO: 442356 - DNA, 15 bp, Homo sapiens
ttggtgaaaaaatat

SEQ ID NO: 442357 - DNA, 15 bp, Homo sapiens
tggtgaaaaaatatt

SEQ ID NO: 442358 - DNA, 15 bp, Homo sapiens
ggtgaaaaaatatta

SEQ ID NO: 442359 - DNA, 15 bp, Homo sapiens
gtgaaaaaatattaa

SEQ ID NO: 442360 - DNA, 15 bp, Homo sapiens
tgaaaaaatattaag

SEQ ID NO: 442361 - DNA, 15 bp, Homo sapiens
gaaaaaatattaagg

SEQ ID NO: 442362 - DNA, 15 bp, Homo sapiens
aaaaaatattaaggt

SEQ ID NO: 442363 - DNA, 15 bp, Homo sapiens
aaaaatattaaggta

SEQ ID NO: 442364 - DNA, 15 bp, Homo sapiens
aaaatattaaggtag

SEQ ID NO: 442365 - DNA, 15 bp, Homo sapiens
aaatattaaggtagc

SEQ ID NO: 442366 - DNA, 15 bp, Homo sapiens
aatattaaggtagct

SEQ ID NO: 442367 - DNA, 15 bp, Homo sapiens
atattaaggtagcta

SEQ ID NO: 442368 - DNA, 15 bp, Homo sapiens
tattaaggtagctat

SEQ ID NO: 442369 - DNA, 15 bp, Homo sapiens
attaaggtagctatg

SEQ ID NO: 442370 - DNA, 15 bp, Homo sapiens
ttaaggtagctatgt

SEQ ID NO: 442371 - DNA, 15 bp, Homo sapiens
taaggtagctatgtt

SEQ ID NO: 442372 - DNA, 15 bp, Homo sapiens
aaggtagctatgtta

SEQ ID NO: 442373 - DNA, 15 bp, Homo sapiens
aggtagctatgttaa

SEQ ID NO: 442374 - DNA, 15 bp, Homo sapiens
ggtagctatgttaaa

SEQ ID NO: 442375 - DNA, 15 bp, Homo sapiens
gtagctatgttaaaa

SEQ ID NO: 442376 - DNA, 15 bp, Homo sapiens
tagctatgttaaaac

SEQ ID NO: 442377 - DNA, 15 bp, Homo sapiens
agctatgttaaaaca

SEQ ID NO: 442378 - DNA, 15 bp, Homo sapiens
gctatgttaaaacag

SEQ ID NO: 442379 - DNA, 15 bp, Homo sapiens
ctatgttaaaacaga

SEQ ID NO: 442380 - DNA, 15 bp, Homo sapiens
tatgttaaaacagaa

SEQ ID NO: 442381 - DNA, 15 bp, Homo sapiens
atgttaaaacagaat

SEQ ID NO: 442382 - DNA, 15 bp, Homo sapiens
tgttaaaacagaata

SEQ ID NO: 442383 - DNA, 15 bp, Homo sapiens
gttaaaacagaataa

SEQ ID NO: 442384 - DNA, 15 bp, Homo sapiens
ttaaaacagaataaa

SEQ ID NO: 442385 - DNA, 15 bp, Homo sapiens
taaaacagaataaaa

SEQ ID NO: 442386 - DNA, 15 bp, Homo sapiens
aaaacagaataaaaa

SEQ ID NO: 442387 - DNA, 15 bp, Homo sapiens
aaacagaataaaaag

SEQ ID NO: 442388 - DNA, 15 bp, Homo sapiens
aacagaataaaaaga

SEQ ID NO: 442389 - DNA, 15 bp, Homo sapiens
acagaataaaaagaa

SEQ ID NO: 442390 - DNA, 15 bp, Homo sapiens
cagaataaaaagaaa

SEQ ID NO: 442391 - DNA, 15 bp, Homo sapiens
agaataaaaagaaaa

SEQ ID NO: 442392 - DNA, 15 bp, Homo sapiens
gaataaaaagaaaac

SEQ ID NO: 442393 - DNA, 15 bp, Homo sapiens
aataaaaagaaaaca

SEQ ID NO: 442394 - DNA, 15 bp, Homo sapiens
ataaaaagaaaacac

SEQ ID NO: 442395 - DNA, 15 bp, Homo sapiens
taaaaagaaaacacg

SEQ ID NO: 442396 - DNA, 15 bp, Homo sapiens
aaaaagaaaacacga

SEQ ID NO: 442397 - DNA, 15 bp, Homo sapiens
aaaagaaaacacgaa

SEQ ID NO: 442398 - DNA, 15 bp, Homo sapiens
aaagaaaacacgaat

SEQ ID NO: 442399 - DNA, 15 bp, Homo sapiens
aagaaaacacgaata

SEQ ID NO: 442400 - DNA, 15 bp, Homo sapiens
agaaaacacgaatac

SEQ ID NO: 442401 - DNA, 15 bp, Homo sapiens
gaaaacacgaataca

SEQ ID NO: 442402 - DNA, 15 bp, Homo sapiens
aaaacacgaatacaa

SEQ ID NO: 442403 - DNA, 15 bp, Homo sapiens
aaacacgaatacaaa

SEQ ID NO: 442404 - DNA, 15 bp, Homo sapiens
aacacgaatacaaac

SEQ ID NO: 442405 - DNA, 15 bp, Homo sapiens
acacgaatacaaact

SEQ ID NO: 442406 - DNA, 15 bp, Homo sapiens
cacgaatacaaacta

SEQ ID NO: 442407 - DNA, 15 bp, Homo sapiens
acgaatacaaactaa

SEQ ID NO: 442408 - DNA, 15 bp, Homo sapiens
cgaatacaaactaaa

SEQ ID NO: 442409 - DNA, 15 bp, Homo sapiens
gaatacaaactaaag

SEQ ID NO: 442410 - DNA, 15 bp, Homo sapiens
aatacaaactaaaga

SEQ ID NO: 442411 - DNA, 15 bp, Homo sapiens
atacaaactaaagat

SEQ ID NO: 442412 - DNA, 15 bp, Homo sapiens
tacaaactaaagata

SEQ ID NO: 442413 - DNA, 15 bp, Homo sapiens
acaaactaaagatag

SEQ ID NO: 442414 - DNA, 15 bp, Homo sapiens
caaactaaagataga

SEQ ID NO: 442415 - DNA, 15 bp, Homo sapiens
aaactaaagatagaa

SEQ ID NO: 442416 - DNA, 15 bp, Homo sapiens
aactaaagatagaat

SEQ ID NO: 442417 - DNA, 15 bp, Homo sapiens
actaaagatagaatc

SEQ ID NO: 442418 - DNA, 15 bp, Homo sapiens
ctaaagatagaatca

SEQ ID NO: 442419 - DNA, 15 bp, Homo sapiens
taaagatagaatcaa

SEQ ID NO: 442420 - DNA, 15 bp, Homo sapiens
aaagatagaatcaac

SEQ ID NO: 442421 - DNA, 15 bp, Homo sapiens
aagatagaatcaaca

SEQ ID NO: 442422 - DNA, 15 bp, Homo sapiens
agatagaatcaacat

SEQ ID NO: 442423 - DNA, 15 bp, Homo sapiens
gatagaatcaacatt

SEQ ID NO: 442424 - DNA, 15 bp, Homo sapiens
atagaatcaacatta

SEQ ID NO: 442425 - DNA, 15 bp, Homo sapiens
tagaatcaacattag

SEQ ID NO: 442426 - DNA, 15 bp, Homo sapiens
agaatcaacattaga

SEQ ID NO: 442427 - DNA, 15 bp, Homo sapiens
gaatcaacattagat

SEQ ID NO: 442428 - DNA, 15 bp, Homo sapiens
aatcaacattagata

SEQ ID NO: 442429 - DNA, 15 bp, Homo sapiens
atcaacattagatat

SEQ ID NO: 442430 - DNA, 15 bp, Homo sapiens
tcaacattagatatc

SEQ ID NO: 442431 - DNA, 15 bp, Homo sapiens
caacattagatatca

SEQ ID NO: 442432 - DNA, 15 bp, Homo sapiens
aacattagatatcag

SEQ ID NO: 442433 - DNA, 15 bp, Homo sapiens
acattagatatcagt

SEQ ID NO: 442434 - DNA, 15 bp, Homo sapiens
cattagatatcagta

SEQ ID NO: 442435 - DNA, 15 bp, Homo sapiens
attagatatcagtaa

SEQ ID NO: 442436 - DNA, 15 bp, Homo sapiens
ttagatatcagtaaa

SEQ ID NO: 442437 - DNA, 15 bp, Homo sapiens
tagatatcagtaaag

SEQ ID NO: 442438 - DNA, 15 bp, Homo sapiens
agatatcagtaaagt

SEQ ID NO: 442439 - DNA, 15 bp, Homo sapiens
gatatcagtaaagtg

SEQ ID NO: 442440 - DNA, 15 bp, Homo sapiens
atatcagtaaagtgg

SEQ ID NO: 442441 - DNA, 15 bp, Homo sapiens
tatcagtaaagtgga

SEQ ID NO: 442442 - DNA, 15 bp, Homo sapiens
atcagtaaagtggaa

SEQ ID NO: 442443 - DNA, 15 bp, Homo sapiens
tcagtaaagtggaaa

SEQ ID NO: 442444 - DNA, 15 bp, Homo sapiens
cagtaaagtggaaaa

SEQ ID NO: 442445 - DNA, 15 bp, Homo sapiens
agtaaagtggaaaat

SEQ ID NO: 442446 - DNA, 15 bp, Homo sapiens
gtaaagtggaaaata

SEQ ID NO: 442447 - DNA, 15 bp, Homo sapiens
taaagtggaaaataa

SEQ ID NO: 442448 - DNA, 15 bp, Homo sapiens
aaagtggaaaataat

SEQ ID NO: 442449 - DNA, 15 bp, Homo sapiens
aagtggaaaataatg

SEQ ID NO: 442450 - DNA, 15 bp, Homo sapiens
agtggaaaataatgg

SEQ ID NO: 442451 - DNA, 15 bp, Homo sapiens
gtggaaaataatggc

SEQ ID NO: 442452 - DNA, 15 bp, Homo sapiens
tggaaaataatggca

SEQ ID NO: 442453 - DNA, 15 bp, Homo sapiens
ggaaaataatggcat

SEQ ID NO: 442454 - DNA, 15 bp, Homo sapiens
gaaaataatggcata

SEQ ID NO: 442455 - DNA, 15 bp, Homo sapiens
aaaataatggcatac

SEQ ID NO: 442456 - DNA, 15 bp, Homo sapiens
aaataatggcataca

SEQ ID NO: 442457 - DNA, 15 bp, Homo sapiens
aataatggcatacat

SEQ ID NO: 442458 - DNA, 15 bp, Homo sapiens
ataatggcatacatt

SEQ ID NO: 442459 - DNA, 15 bp, Homo sapiens
taatggcatacattt

SEQ ID NO: 442460 - DNA, 15 bp, Homo sapiens
aatggcatacatttt

SEQ ID NO: 442461 - DNA, 15 bp, Homo sapiens
atggcatacattttc

SEQ ID NO: 442462 - DNA, 15 bp, Homo sapiens
tggcatacattttcc

SEQ ID NO: 442463 - DNA, 15 bp, Homo sapiens
ggcatacattttcca

SEQ ID NO: 442464 - DNA, 15 bp, Homo sapiens
gcatacattttccag

SEQ ID NO: 442465 - DNA, 15 bp, Homo sapiens
catacattttccaga

SEQ ID NO: 442466 - DNA, 15 bp, Homo sapiens
atacattttccagag

SEQ ID NO: 442467 - DNA, 15 bp, Homo sapiens
tacattttccagagt

SEQ ID NO: 442468 - DNA, 15 bp, Homo sapiens
acattttccagagta

SEQ ID NO: 442469 - DNA, 15 bp, Homo sapiens
cattttccagagtaa

SEQ ID NO: 442470 - DNA, 15 bp, Homo sapiens
attttccagagtaaa

SEQ ID NO: 442471 - DNA, 15 bp, Homo sapiens
ttttccagagtaaac

SEQ ID NO: 442472 - DNA, 15 bp, Homo sapiens
tttccagagtaaact

SEQ ID NO: 442473 - DNA, 15 bp, Homo sapiens
ttccagagtaaactg

SEQ ID NO: 442474 - DNA, 15 bp, Homo sapiens
tccagagtaaactgc

SEQ ID NO: 442475 - DNA, 15 bp, Homo sapiens
ccagagtaaactgca

SEQ ID NO: 442476 - DNA, 15 bp, Homo sapiens
cagagtaaactgcat

SEQ ID NO: 442477 - DNA, 15 bp, Homo sapiens
agagtaaactgcata

SEQ ID NO: 442478 - DNA, 15 bp, Homo sapiens
gagtaaactgcatat

SEQ ID NO: 442479 - DNA, 15 bp, Homo sapiens
agtaaactgcatata

SEQ ID NO: 442480 - DNA, 15 bp, Homo sapiens
gtaaactgcatataa

SEQ ID NO: 442481 - DNA, 15 bp, Homo sapiens
taaactgcatataat

SEQ ID NO: 442482 - DNA, 15 bp, Homo sapiens
aaactgcatataata

SEQ ID NO: 442483 - DNA, 15 bp, Homo sapiens
aactgcatataatag

SEQ ID NO: 442484 - DNA, 15 bp, Homo sapiens
actgcatataataga

SEQ ID NO: 442485 - DNA, 15 bp, Homo sapiens
ctgcatataatagaa

SEQ ID NO: 442486 - DNA, 15 bp, Homo sapiens
tgcatataatagaaa

SEQ ID NO: 442487 - DNA, 15 bp, Homo sapiens
gcatataatagaaag

SEQ ID NO: 442488 - DNA, 15 bp, Homo sapiens
catataatagaaagc

SEQ ID NO: 442489 - DNA, 15 bp, Homo sapiens
atataatagaaagca

SEQ ID NO: 442490 - DNA, 15 bp, Homo sapiens
tataatagaaagcat

SEQ ID NO: 442491 - DNA, 15 bp, Homo sapiens
ataatagaaagcatg

SEQ ID NO: 442492 - DNA, 15 bp, Homo sapiens
taatagaaagcatga

SEQ ID NO: 442493 - DNA, 15 bp, Homo sapiens
aatagaaagcatgaa

SEQ ID NO: 442494 - DNA, 15 bp, Homo sapiens
atagaaagcatgaaa

SEQ ID NO: 442495 - DNA, 15 bp, Homo sapiens
tagaaagcatgaaag

SEQ ID NO: 442496 - DNA, 15 bp, Homo sapiens
agaaagcatgaaagg

SEQ ID NO: 442497 - DNA, 15 bp, Homo sapiens
gaaagcatgaaagga

SEQ ID NO: 442498 - DNA, 15 bp, Homo sapiens
aaagcatgaaaggaa

SEQ ID NO: 442499 - DNA, 15 bp, Homo sapiens
aagcatgaaaggaaa

SEQ ID NO: 442500 - DNA, 15 bp, Homo sapiens
agcatgaaaggaaat

SEQ ID NO: 442501 - DNA, 15 bp, Homo sapiens
gcatgaaaggaaata

SEQ ID NO: 442502 - DNA, 15 bp, Homo sapiens
catgaaaggaaatac

SEQ ID NO: 442503 - DNA, 15 bp, Homo sapiens
atgaaaggaaataca

SEQ ID NO: 442504 - DNA, 15 bp, Homo sapiens
tgaaaggaaatacat

SEQ ID NO: 442505 - DNA, 15 bp, Homo sapiens
gaaaggaaatacata

SEQ ID NO: 442506 - DNA, 15 bp, Homo sapiens
aaaggaaatacataa

SEQ ID NO: 442507 - DNA, 15 bp, Homo sapiens
aaggaaatacataat

SEQ ID NO: 442508 - DNA, 15 bp, Homo sapiens
aggaaatacataatc

SEQ ID NO: 442509 - DNA, 15 bp, Homo sapiens
ggaaatacataatca

SEQ ID NO: 442510 - DNA, 15 bp, Homo sapiens
gaaatacataatcat

SEQ ID NO: 442511 - DNA, 15 bp, Homo sapiens
aaatacataatcatt

SEQ ID NO: 442512 - DNA, 15 bp, Homo sapiens
aatacataatcattt

SEQ ID NO: 442513 - DNA, 15 bp, Homo sapiens
atacataatcatttt

SEQ ID NO: 442514 - DNA, 15 bp, Homo sapiens
tacataatcatttta

SEQ ID NO: 442515 - DNA, 15 bp, Homo sapiens
acataatcattttaa

SEQ ID NO: 442516 - DNA, 15 bp, Homo sapiens
cataatcattttaaa

SEQ ID NO: 442517 - DNA, 15 bp, Homo sapiens
ataatcattttaaaa

SEQ ID NO: 442518 - DNA, 15 bp, Homo sapiens
taatcattttaaaag

SEQ ID NO: 442519 - DNA, 15 bp, Homo sapiens
aatcattttaaaagt

SEQ ID NO: 442520 - DNA, 15 bp, Homo sapiens
atcattttaaaagtt

SEQ ID NO: 442521 - DNA, 15 bp, Homo sapiens
tcattttaaaagttt

SEQ ID NO: 442522 - DNA, 15 bp, Homo sapiens
cattttaaaagtttg

SEQ ID NO: 442523 - DNA, 15 bp, Homo sapiens
attttaaaagtttga

SEQ ID NO: 442524 - DNA, 15 bp, Homo sapiens
ttttaaaagtttgaa

SEQ ID NO: 442525 - DNA, 15 bp, Homo sapiens
tttaaaagtttgaat

SEQ ID NO: 442526 - DNA, 15 bp, Homo sapiens
ttaaaagtttgaatt

SEQ ID NO: 442527 - DNA, 15 bp, Homo sapiens
taaaagtttgaatta

SEQ ID NO: 442528 - DNA, 15 bp, Homo sapiens
aaaagtttgaattat

SEQ ID NO: 442529 - DNA, 15 bp, Homo sapiens
aaagtttgaattata

SEQ ID NO: 442530 - DNA, 15 bp, Homo sapiens
aagtttgaattataa

SEQ ID NO: 442531 - DNA, 15 bp, Homo sapiens
agtttgaattataat

SEQ ID NO: 442532 - DNA, 15 bp, Homo sapiens
gtttgaattataatt

SEQ ID NO: 442533 - DNA, 15 bp, Homo sapiens
tttgaattataattt

SEQ ID NO: 442534 - DNA, 15 bp, Homo sapiens
ttgaattataatttt

SEQ ID NO: 442535 - DNA, 15 bp, Homo sapiens
tgaattataattttt

SEQ ID NO: 442536 - DNA, 15 bp, Homo sapiens
gaattataatttttc

SEQ ID NO: 442537 - DNA, 15 bp, Homo sapiens
aattataatttttct

SEQ ID NO: 442538 - DNA, 15 bp, Homo sapiens
attataatttttctc

SEQ ID NO: 442539 - DNA, 15 bp, Homo sapiens
ttataatttttctct

SEQ ID NO: 442540 - DNA, 15 bp, Homo sapiens
tataatttttctctt

SEQ ID NO: 442541 - DNA, 15 bp, Homo sapiens
ataatttttctcttc

SEQ ID NO: 442542 - DNA, 15 bp, Homo sapiens
taatttttctcttca

SEQ ID NO: 442543 - DNA, 15 bp, Homo sapiens
aatttttctcttcac

SEQ ID NO: 442544 - DNA, 15 bp, Homo sapiens
atttttctcttcaca

SEQ ID NO: 442545 - DNA, 15 bp, Homo sapiens
tttttctcttcacac

SEQ ID NO: 442546 - DNA, 15 bp, Homo sapiens
ttttctcttcacaca

SEQ ID NO: 442547 - DNA, 15 bp, Homo sapiens
tttctcttcacacat

SEQ ID NO: 442548 - DNA, 15 bp, Homo sapiens
ttctcttcacacatt

SEQ ID NO: 442549 - DNA, 15 bp, Homo sapiens
tctcttcacacattt

SEQ ID NO: 442550 - DNA, 15 bp, Homo sapiens
ctcttcacacattta

SEQ ID NO: 442551 - DNA, 15 bp, Homo sapiens
tcttcacacatttat

SEQ ID NO: 442552 - DNA, 15 bp, Homo sapiens
cttcacacatttatt

SEQ ID NO: 442553 - DNA, 15 bp, Homo sapiens
ttcacacatttattt

SEQ ID NO: 442554 - DNA, 15 bp, Homo sapiens
tcacacatttattta

SEQ ID NO: 442555 - DNA, 15 bp, Homo sapiens
cacacatttatttat

SEQ ID NO: 442556 - DNA, 15 bp, Homo sapiens
acacatttatttata

SEQ ID NO: 442557 - DNA, 15 bp, Homo sapiens
cacatttatttatat

SEQ ID NO: 442558 - DNA, 15 bp, Homo sapiens
acatttatttatatt

SEQ ID NO: 442559 - DNA, 15 bp, Homo sapiens
catttatttatattt

SEQ ID NO: 442560 - DNA, 15 bp, Homo sapiens
atttatttatatttt

SEQ ID NO: 442561 - DNA, 15 bp, Homo sapiens
tttatttatattttt

SEQ ID NO: 442562 - DNA, 15 bp, Homo sapiens
tatttatatttttgg

SEQ ID NO: 442563 - DNA, 15 bp, Homo sapiens
atttatatttttggg

SEQ ID NO: 442564 - DNA, 15 bp, Homo sapiens
tttatatttttgggt

SEQ ID NO: 442565 - DNA, 15 bp, Homo sapiens
ttatatttttgggta

SEQ ID NO: 442566 - DNA, 15 bp, Homo sapiens
tatatttttgggtaa

SEQ ID NO: 442567 - DNA, 15 bp, Homo sapiens
atatttttgggtaat

SEQ ID NO: 442568 - DNA, 15 bp, Homo sapiens
tatttttgggtaata

SEQ ID NO: 442569 - DNA, 15 bp, Homo sapiens
atttttgggtaataa

SEQ ID NO: 442570 - DNA, 15 bp, Homo sapiens
tttttgggtaataaa

SEQ ID NO: 442571 - DNA, 15 bp, Homo sapiens
ttttgggtaataaac

SEQ ID NO: 442572 - DNA, 15 bp, Homo sapiens
tttgggtaataaaca

SEQ ID NO: 442573 - DNA, 15 bp, Homo sapiens
ttgggtaataaacaa

SEQ ID NO: 442574 - DNA, 15 bp, Homo sapiens
tgggtaataaacaat

SEQ ID NO: 442575 - DNA, 15 bp, Homo sapiens
gggtaataaacaatg

SEQ ID NO: 442576 - DNA, 15 bp, Homo sapiens
ggtaataaacaatga

SEQ ID NO: 442577 - DNA, 15 bp, Homo sapiens
gtaataaacaatgac

SEQ ID NO: 442578 - DNA, 15 bp, Homo sapiens
taataaacaatgact

SEQ ID NO: 442579 - DNA, 15 bp, Homo sapiens
aataaacaatgactt

SEQ ID NO: 442580 - DNA, 15 bp, Homo sapiens
ataaacaatgacttt

SEQ ID NO: 442581 - DNA, 15 bp, Homo sapiens
taaacaatgactttt

SEQ ID NO: 442582 - DNA, 15 bp, Homo sapiens
aaacaatgacttttt

SEQ ID NO: 442583 - DNA, 15 bp, Homo sapiens
aacaatgactttttg

SEQ ID NO: 442584 - DNA, 15 bp, Homo sapiens
acaatgactttttgg

SEQ ID NO: 442585 - DNA, 15 bp, Homo sapiens
caatgactttttggt

SEQ ID NO: 442586 - DNA, 15 bp, Homo sapiens
aatgactttttggtt

SEQ ID NO: 442587 - DNA, 15 bp, Homo sapiens
atgactttttggttc

SEQ ID NO: 442588 - DNA, 15 bp, Homo sapiens
tgactttttggttct

SEQ ID NO: 442589 - DNA, 15 bp, Homo sapiens
gactttttggttctt

SEQ ID NO: 442590 - DNA, 15 bp, Homo sapiens
actttttggttcttc

SEQ ID NO: 442591 - DNA, 15 bp, Homo sapiens
ctttttggttcttca

SEQ ID NO: 442592 - DNA, 15 bp, Homo sapiens
tttttggttcttcat

SEQ ID NO: 442593 - DNA, 15 bp, Homo sapiens
ttttggttcttcatc

SEQ ID NO: 442594 - DNA, 15 bp, Homo sapiens
tttggttcttcatcc

SEQ ID NO: 442595 - DNA, 15 bp, Homo sapiens
ttggttcttcatcca

SEQ ID NO: 442596 - DNA, 15 bp, Homo sapiens
tggttcttcatccaa

SEQ ID NO: 442597 - DNA, 15 bp, Homo sapiens
ggttcttcatccaag

SEQ ID NO: 442598 - DNA, 15 bp, Homo sapiens
gttcttcatccaagt

SEQ ID NO: 442599 - DNA, 15 bp, Homo sapiens
ttcttcatccaagtt

SEQ ID NO: 442600 - DNA, 15 bp, Homo sapiens
tcttcatccaagtta

SEQ ID NO: 442601 - DNA, 15 bp, Homo sapiens
cttcatccaagttac

SEQ ID NO: 442602 - DNA, 15 bp, Homo sapiens
ttcatccaagttact

SEQ ID NO: 442603 - DNA, 15 bp, Homo sapiens
tcatccaagttactg

SEQ ID NO: 442604 - DNA, 15 bp, Homo sapiens
catccaagttactga

SEQ ID NO: 442605 - DNA, 15 bp, Homo sapiens
atccaagttactgaa

SEQ ID NO: 442606 - DNA, 15 bp, Homo sapiens
tccaagttactgaag

SEQ ID NO: 442607 - DNA, 15 bp, Homo sapiens
ccaagttactgaaga

SEQ ID NO: 442608 - DNA, 15 bp, Homo sapiens
caagttactgaagac

SEQ ID NO: 442609 - DNA, 15 bp, Homo sapiens
aagttactgaagacc

SEQ ID NO: 442610 - DNA, 15 bp, Homo sapiens
agttactgaagacct

SEQ ID NO: 442611 - DNA, 15 bp, Homo sapiens
gttactgaagacctg

SEQ ID NO: 442612 - DNA, 15 bp, Homo sapiens
ttactgaagacctga

SEQ ID NO: 442613 - DNA, 15 bp, Homo sapiens
tactgaagacctgaa

SEQ ID NO: 442614 - DNA, 15 bp, Homo sapiens
actgaagacctgaat

SEQ ID NO: 442615 - DNA, 15 bp, Homo sapiens
ctgaagacctgaatt

SEQ ID NO: 442616 - DNA, 15 bp, Homo sapiens
tgaagacctgaatta

SEQ ID NO: 442617 - DNA, 15 bp, Homo sapiens
gaagacctgaattaa

SEQ ID NO: 442618 - DNA, 15 bp, Homo sapiens
aagacctgaattaag

SEQ ID NO: 442619 - DNA, 15 bp, Homo sapiens
agacctgaattaagt

SEQ ID NO: 442620 - DNA, 15 bp, Homo sapiens
gacctgaattaagtc

SEQ ID NO: 442621 - DNA, 15 bp, Homo sapiens
acctgaattaagtca

SEQ ID NO: 442622 - DNA, 15 bp, Homo sapiens
cctgaattaagtcag

SEQ ID NO: 442623 - DNA, 15 bp, Homo sapiens
ctgaattaagtcagc

SEQ ID NO: 442624 - DNA, 15 bp, Homo sapiens
tgaattaagtcagct

SEQ ID NO: 442625 - DNA, 15 bp, Homo sapiens
gaattaagtcagctg

SEQ ID NO: 442626 - DNA, 15 bp, Homo sapiens
aattaagtcagctgt

SEQ ID NO: 442627 - DNA, 15 bp, Homo sapiens
attaagtcagctgtt

SEQ ID NO: 442628 - DNA, 15 bp, Homo sapiens
ttaagtcagctgttg

SEQ ID NO: 442629 - DNA, 15 bp, Homo sapiens
taagtcagctgttgt

SEQ ID NO: 442630 - DNA, 15 bp, Homo sapiens
aagtcagctgttgtt

SEQ ID NO: 442631 - DNA, 15 bp, Homo sapiens
agtcagctgttgttg

SEQ ID NO: 442632 - DNA, 15 bp, Homo sapiens
gtcagctgttgttga

SEQ ID NO: 442633 - DNA, 15 bp, Homo sapiens
tcagctgttgttgag

SEQ ID NO: 442634 - DNA, 15 bp, Homo sapiens
cagctgttgttgagt

SEQ ID NO: 442635 - DNA, 15 bp, Homo sapiens
agctgttgttgagtg

SEQ ID NO: 442636 - DNA, 15 bp, Homo sapiens
gctgttgttgagtgg

SEQ ID NO: 442637 - DNA, 15 bp, Homo sapiens
ctgttgttgagtggg

SEQ ID NO: 442638 - DNA, 15 bp, Homo sapiens
tgttgttgagtgggc

SEQ ID NO: 442639 - DNA, 15 bp, Homo sapiens
gttgttgagtgggca

SEQ ID NO: 442640 - DNA, 15 bp, Homo sapiens
ttgttgagtgggcaa

SEQ ID NO: 442641 - DNA, 15 bp, Homo sapiens
tgttgagtgggcaac

SEQ ID NO: 442642 - DNA, 15 bp, Homo sapiens
gttgagtgggcaact

SEQ ID NO: 442643 - DNA, 15 bp, Homo sapiens
ttgagtgggcaactg

SEQ ID NO: 442644 - DNA, 15 bp, Homo sapiens
tgagtgggcaactgt

SEQ ID NO: 442645 - DNA, 15 bp, Homo sapiens
gagtgggcaactgta

SEQ ID NO: 442646 - DNA, 15 bp, Homo sapiens
agtgggcaactgtag

SEQ ID NO: 442647 - DNA, 15 bp, Homo sapiens
gtgggcaactgtagt

SEQ ID NO: 442648 - DNA, 15 bp, Homo sapiens
tgggcaactgtagtt

SEQ ID NO: 442649 - DNA, 15 bp, Homo sapiens
gggcaactgtagttg

SEQ ID NO: 442650 - DNA, 15 bp, Homo sapiens
ggcaactgtagttga

SEQ ID NO: 442651 - DNA, 15 bp, Homo sapiens
gcaactgtagttgat

SEQ ID NO: 442652 - DNA, 15 bp, Homo sapiens
caactgtagttgatt

SEQ ID NO: 442653 - DNA, 15 bp, Homo sapiens
aactgtagttgattt

SEQ ID NO: 442654 - DNA, 15 bp, Homo sapiens
actgtagttgatttc

SEQ ID NO: 442655 - DNA, 15 bp, Homo sapiens
ctgtagttgatttcc

SEQ ID NO: 442656 - DNA, 15 bp, Homo sapiens
tgtagttgatttcct

SEQ ID NO: 442657 - DNA, 15 bp, Homo sapiens
gtagttgatttcctc

SEQ ID NO: 442658 - DNA, 15 bp, Homo sapiens
tagttgatttcctct

SEQ ID NO: 442659 - DNA, 15 bp, Homo sapiens
agttgatttcctctg

SEQ ID NO: 442660 - DNA, 15 bp, Homo sapiens
gttgatttcctctga

SEQ ID NO: 442661 - DNA, 15 bp, Homo sapiens
ttgatttcctctgag

SEQ ID NO: 442662 - DNA, 15 bp, Homo sapiens
tgatttcctctgagc

SEQ ID NO: 442663 - DNA, 15 bp, Homo sapiens
gatttcctctgagct

SEQ ID NO: 442664 - DNA, 15 bp, Homo sapiens
atttcctctgagctg

SEQ ID NO: 442665 - DNA, 15 bp, Homo sapiens
tttcctctgagctgg

SEQ ID NO: 442666 - DNA, 15 bp, Homo sapiens
ttcctctgagctggc

SEQ ID NO: 442667 - DNA, 15 bp, Homo sapiens
tcctctgagctggcc

SEQ ID NO: 442668 - DNA, 15 bp, Homo sapiens
cctctgagctggcct

SEQ ID NO: 442669 - DNA, 15 bp, Homo sapiens
ctctgagctggcctt

SEQ ID NO: 442670 - DNA, 15 bp, Homo sapiens
tctgagctggccttg

SEQ ID NO: 442671 - DNA, 15 bp, Homo sapiens
ctgagctggccttgc

SEQ ID NO: 442672 - DNA, 15 bp, Homo sapiens
tgagctggccttgcc

SEQ ID NO: 442673 - DNA, 15 bp, Homo sapiens
gagctggccttgcca

SEQ ID NO: 442674 - DNA, 15 bp, Homo sapiens
agctggccttgccat

SEQ ID NO: 442675 - DNA, 15 bp, Homo sapiens
gctggccttgccatt

SEQ ID NO: 442676 - DNA, 15 bp, Homo sapiens
ctggccttgccattt

SEQ ID NO: 442677 - DNA, 15 bp, Homo sapiens
tggccttgccattta

SEQ ID NO: 442678 - DNA, 15 bp, Homo sapiens
ggccttgccatttat

SEQ ID NO: 442679 - DNA, 15 bp, Homo sapiens
gccttgccatttatt

SEQ ID NO: 442680 - DNA, 15 bp, Homo sapiens
ccttgccatttattt

SEQ ID NO: 442681 - DNA, 15 bp, Homo sapiens
cttgccatttatttg

SEQ ID NO: 442682 - DNA, 15 bp, Homo sapiens
ttgccatttatttgg

SEQ ID NO: 442683 - DNA, 15 bp, Homo sapiens
tgccatttatttgga

SEQ ID NO: 442684 - DNA, 15 bp, Homo sapiens
gccatttatttggaa

SEQ ID NO: 442685 - DNA, 15 bp, Homo sapiens
ccatttatttggaag

SEQ ID NO: 442686 - DNA, 15 bp, Homo sapiens
catttatttggaagt

SEQ ID NO: 442687 - DNA, 15 bp, Homo sapiens
atttatttggaagta

SEQ ID NO: 442688 - DNA, 15 bp, Homo sapiens
tttatttggaagtac

SEQ ID NO: 442689 - DNA, 15 bp, Homo sapiens
ttatttggaagtaca

SEQ ID NO: 442690 - DNA, 15 bp, Homo sapiens
tatttggaagtacaa

SEQ ID NO: 442691 - DNA, 15 bp, Homo sapiens
atttggaagtacaat

SEQ ID NO: 442692 - DNA, 15 bp, Homo sapiens
tttggaagtacaatt

SEQ ID NO: 442693 - DNA, 15 bp, Homo sapiens
ttggaagtacaattc

SEQ ID NO: 442694 - DNA, 15 bp, Homo sapiens
tggaagtacaattcc

SEQ ID NO: 442695 - DNA, 15 bp, Homo sapiens
ggaagtacaattcca

SEQ ID NO: 442696 - DNA, 15 bp, Homo sapiens
gaagtacaattccag

SEQ ID NO: 442697 - DNA, 15 bp, Homo sapiens
aagtacaattccagg

SEQ ID NO: 442698 - DNA, 15 bp, Homo sapiens
agtacaattccagga

SEQ ID NO: 442699 - DNA, 15 bp, Homo sapiens
gtacaattccaggac

SEQ ID NO: 442700 - DNA, 15 bp, Homo sapiens
tacaattccaggacc

SEQ ID NO: 442701 - DNA, 15 bp, Homo sapiens
acaattccaggaccc

SEQ ID NO: 442702 - DNA, 15 bp, Homo sapiens
caattccaggacccc

SEQ ID NO: 442703 - DNA, 15 bp, Homo sapiens
aattccaggaccccg

SEQ ID NO: 442704 - DNA, 15 bp, Homo sapiens
attccaggaccccgc

SEQ ID NO: 442705 - DNA, 15 bp, Homo sapiens
ttccaggaccccgca

SEQ ID NO: 442706 - DNA, 15 bp, Homo sapiens
tccaggaccccgcat

SEQ ID NO: 442707 - DNA, 15 bp, Homo sapiens
ccaggaccccgcatg

SEQ ID NO: 442708 - DNA, 15 bp, Homo sapiens
caggaccccgcatgt

SEQ ID NO: 442709 - DNA, 15 bp, Homo sapiens
aggaccccgcatgta

SEQ ID NO: 442710 - DNA, 15 bp, Homo sapiens
ggaccccgcatgtac

SEQ ID NO: 442711 - DNA, 15 bp, Homo sapiens
gaccccgcatgtacc

SEQ ID NO: 442712 - DNA, 15 bp, Homo sapiens
accccgcatgtacca

SEQ ID NO: 442713 - DNA, 15 bp, Homo sapiens
ccccgcatgtaccaa

SEQ ID NO: 442714 - DNA, 15 bp, Homo sapiens
cccgcatgtaccaaa

SEQ ID NO: 442715 - DNA, 15 bp, Homo sapiens
ccgcatgtaccaaaa

SEQ ID NO: 442716 - DNA, 15 bp, Homo sapiens
cgcatgtaccaaaac

SEQ ID NO: 442717 - DNA, 15 bp, Homo sapiens
gcatgtaccaaaact

SEQ ID NO: 442718 - DNA, 15 bp, Homo sapiens
catgtaccaaaactc

SEQ ID NO: 442719 - DNA, 15 bp, Homo sapiens
atgtaccaaaactca

SEQ ID NO: 442720 - DNA, 15 bp, Homo sapiens
tgtaccaaaactcat

SEQ ID NO: 442721 - DNA, 15 bp, Homo sapiens
gtaccaaaactcatg

SEQ ID NO: 442722 - DNA, 15 bp, Homo sapiens
taccaaaactcatgt

SEQ ID NO: 442723 - DNA, 15 bp, Homo sapiens
accaaaactcatgta

SEQ ID NO: 442724 - DNA, 15 bp, Homo sapiens
ccaaaactcatgtat

SEQ ID NO: 442725 - DNA, 15 bp, Homo sapiens
caaaactcatgtata

SEQ ID NO: 442726 - DNA, 15 bp, Homo sapiens
aaaactcatgtatac

SEQ ID NO: 442727 - DNA, 15 bp, Homo sapiens
aaactcatgtatact

SEQ ID NO: 442728 - DNA, 15 bp, Homo sapiens
aactcatgtatactc

SEQ ID NO: 442729 - DNA, 15 bp, Homo sapiens
actcatgtatactca

SEQ ID NO: 442730 - DNA, 15 bp, Homo sapiens
ctcatgtatactcaa

SEQ ID NO: 442731 - DNA, 15 bp, Homo sapiens
tcatgtatactcaag

SEQ ID NO: 442732 - DNA, 15 bp, Homo sapiens
catgtatactcaagt

SEQ ID NO: 442733 - DNA, 15 bp, Homo sapiens
atgtatactcaagtc

SEQ ID NO: 442734 - DNA, 15 bp, Homo sapiens
tgtatactcaagtcc

SEQ ID NO: 442735 - DNA, 15 bp, Homo sapiens
gtatactcaagtccc

SEQ ID NO: 442736 - DNA, 15 bp, Homo sapiens
tatactcaagtccca

SEQ ID NO: 442737 - DNA, 15 bp, Homo sapiens
atactcaagtcccac

SEQ ID NO: 442738 - DNA, 15 bp, Homo sapiens
tactcaagtcccaca

SEQ ID NO: 442739 - DNA, 15 bp, Homo sapiens
actcaagtcccacat

SEQ ID NO: 442740 - DNA, 15 bp, Homo sapiens
ctcaagtcccacatt

SEQ ID NO: 442741 - DNA, 15 bp, Homo sapiens
tcaagtcccacattt

SEQ ID NO: 442742 - DNA, 15 bp, Homo sapiens
caagtcccacatttc

SEQ ID NO: 442743 - DNA, 15 bp, Homo sapiens
aagtcccacatttcc

SEQ ID NO: 442744 - DNA, 15 bp, Homo sapiens
agtcccacatttccc

SEQ ID NO: 442745 - DNA, 15 bp, Homo sapiens
gtcccacatttcccc

SEQ ID NO: 442746 - DNA, 15 bp, Homo sapiens
tcccacatttcccca

SEQ ID NO: 442747 - DNA, 15 bp, Homo sapiens
cccacatttccccat

SEQ ID NO: 442748 - DNA, 15 bp, Homo sapiens
ccacatttccccatg

SEQ ID NO: 442749 - DNA, 15 bp, Homo sapiens
cacatttccccatgg

SEQ ID NO: 442750 - DNA, 15 bp, Homo sapiens
acatttccccatgga

SEQ ID NO: 442751 - DNA, 15 bp, Homo sapiens
catttccccatggaa

SEQ ID NO: 442752 - DNA, 15 bp, Homo sapiens
atttccccatggaac

SEQ ID NO: 442753 - DNA, 15 bp, Homo sapiens
tttccccatggaacc

SEQ ID NO: 442754 - DNA, 15 bp, Homo sapiens
ttccccatggaacct

SEQ ID NO: 442755 - DNA, 15 bp, Homo sapiens
tccccatggaacctg

SEQ ID NO: 442756 - DNA, 15 bp, Homo sapiens
ccccatggaacctgc

SEQ ID NO: 442757 - DNA, 15 bp, Homo sapiens
cccatggaacctgca

SEQ ID NO: 442758 - DNA, 15 bp, Homo sapiens
ccatggaacctgcat

SEQ ID NO: 442759 - DNA, 15 bp, Homo sapiens
catggaacctgcatg

SEQ ID NO: 442760 - DNA, 15 bp, Homo sapiens
atggaacctgcatgt

SEQ ID NO: 442761 - DNA, 15 bp, Homo sapiens
tggaacctgcatgta

SEQ ID NO: 442762 - DNA, 15 bp, Homo sapiens
ggaacctgcatgtag

SEQ ID NO: 442763 - DNA, 15 bp, Homo sapiens
gaacctgcatgtagg

SEQ ID NO: 442764 - DNA, 15 bp, Homo sapiens
aacctgcatgtagga

SEQ ID NO: 442765 - DNA, 15 bp, Homo sapiens
acctgcatgtaggaa

SEQ ID NO: 442766 - DNA, 15 bp, Homo sapiens
cctgcatgtaggaaa

SEQ ID NO: 442767 - DNA, 15 bp, Homo sapiens
ctgcatgtaggaaaa

SEQ ID NO: 442768 - DNA, 15 bp, Homo sapiens
tgcatgtaggaaaag

SEQ ID NO: 442769 - DNA, 15 bp, Homo sapiens
gcatgtaggaaaagt

SEQ ID NO: 442770 - DNA, 15 bp, Homo sapiens
catgtaggaaaagtc

SEQ ID NO: 442771 - DNA, 15 bp, Homo sapiens
atgtaggaaaagtca

SEQ ID NO: 442772 - DNA, 15 bp, Homo sapiens
tgtaggaaaagtcag

SEQ ID NO: 442773 - DNA, 15 bp, Homo sapiens
gtaggaaaagtcagc

SEQ ID NO: 442774 - DNA, 15 bp, Homo sapiens
taggaaaagtcagct

SEQ ID NO: 442775 - DNA, 15 bp, Homo sapiens
aggaaaagtcagctc

SEQ ID NO: 442776 - DNA, 15 bp, Homo sapiens
ggaaaagtcagctct

SEQ ID NO: 442777 - DNA, 15 bp, Homo sapiens
gaaaagtcagctctc

SEQ ID NO: 442778 - DNA, 15 bp, Homo sapiens
aaaagtcagctctcc

SEQ ID NO: 442779 - DNA, 15 bp, Homo sapiens
aaagtcagctctcca

SEQ ID NO: 442780 - DNA, 15 bp, Homo sapiens
aagtcagctctccat

SEQ ID NO: 442781 - DNA, 15 bp, Homo sapiens
agtcagctctccata

SEQ ID NO: 442782 - DNA, 15 bp, Homo sapiens
gtcagctctccatat

SEQ ID NO: 442783 - DNA, 15 bp, Homo sapiens
tcagctctccatata

SEQ ID NO: 442784 - DNA, 15 bp, Homo sapiens
cagctctccatatat

SEQ ID NO: 442785 - DNA, 15 bp, Homo sapiens
agctctccatatata

SEQ ID NO: 442786 - DNA, 15 bp, Homo sapiens
gctctccatatatat

SEQ ID NO: 442787 - DNA, 15 bp, Homo sapiens
ctctccatatatata

SEQ ID NO: 442788 - DNA, 15 bp, Homo sapiens
tctccatatatatat

SEQ ID NO: 442789 - DNA, 15 bp, Homo sapiens
ctccatatatatatg

SEQ ID NO: 442790 - DNA, 15 bp, Homo sapiens
tccatatatatatgg

SEQ ID NO: 442791 - DNA, 15 bp, Homo sapiens
ccatatatatatggg

SEQ ID NO: 442792 - DNA, 15 bp, Homo sapiens
catatatatatgggt

SEQ ID NO: 442793 - DNA, 15 bp, Homo sapiens
atatatatatgggtt

SEQ ID NO: 442794 - DNA, 15 bp, Homo sapiens
tatatatatgggttt

SEQ ID NO: 442795 - DNA, 15 bp, Homo sapiens
atatatatgggtttc

SEQ ID NO: 442796 - DNA, 15 bp, Homo sapiens
tatatatgggtttcg

SEQ ID NO: 442797 - DNA, 15 bp, Homo sapiens
atatatgggtttcgc

SEQ ID NO: 442798 - DNA, 15 bp, Homo sapiens
tatatgggtttcgca

SEQ ID NO: 442799 - DNA, 15 bp, Homo sapiens
atatgggtttcgcat

SEQ ID NO: 442800 - DNA, 15 bp, Homo sapiens
tatgggtttcgcatc

SEQ ID NO: 442801 - DNA, 15 bp, Homo sapiens
atgggtttcgcatcc

SEQ ID NO: 442802 - DNA, 15 bp, Homo sapiens
tgggtttcgcatcct

SEQ ID NO: 442803 - DNA, 15 bp, Homo sapiens
gggtttcgcatcctg

SEQ ID NO: 442804 - DNA, 15 bp, Homo sapiens
ggtttcgcatcctgc

SEQ ID NO: 442805 - DNA, 15 bp, Homo sapiens
gtttcgcatcctgca

SEQ ID NO: 442806 - DNA, 15 bp, Homo sapiens
tttcgcatcctgcaa

SEQ ID NO: 442807 - DNA, 15 bp, Homo sapiens
ttcgcatcctgcaaa

SEQ ID NO: 442808 - DNA, 15 bp, Homo sapiens
tcgcatcctgcaaat

SEQ ID NO: 442809 - DNA, 15 bp, Homo sapiens
cgcatcctgcaaata

SEQ ID NO: 442810 - DNA, 15 bp, Homo sapiens
gcatcctgcaaatac

SEQ ID NO: 442811 - DNA, 15 bp, Homo sapiens
catcctgcaaatact

SEQ ID NO: 442812 - DNA, 15 bp, Homo sapiens
atcctgcaaatactg

SEQ ID NO: 442813 - DNA, 15 bp, Homo sapiens
tcctgcaaatactgt

SEQ ID NO: 442814 - DNA, 15 bp, Homo sapiens
ctgcaaatactgtat

SEQ ID NO: 442815 - DNA, 15 bp, Homo sapiens
tgcaaatactgtatt

SEQ ID NO: 442816 - DNA, 15 bp, Homo sapiens
gcaaatactgtattt

SEQ ID NO: 442817 - DNA, 15 bp, Homo sapiens
caaatactgtatttt

SEQ ID NO: 442818 - DNA, 15 bp, Homo sapiens
aaatactgtattttc

SEQ ID NO: 442819 - DNA, 15 bp, Homo sapiens
aatactgtattttcc

SEQ ID NO: 442820 - DNA, 15 bp, Homo sapiens
atactgtattttcca

SEQ ID NO: 442821 - DNA, 15 bp, Homo sapiens
tactgtattttccat

SEQ ID NO: 442822 - DNA, 15 bp, Homo sapiens
actgtattttccata

SEQ ID NO: 442823 - DNA, 15 bp, Homo sapiens
ctgtattttccatat

SEQ ID NO: 442824 - DNA, 15 bp, Homo sapiens
tgtattttccatatg

SEQ ID NO: 442825 - DNA, 15 bp, Homo sapiens
gtattttccatatgt

SEQ ID NO: 442826 - DNA, 15 bp, Homo sapiens
tattttccatatgtt

SEQ ID NO: 442827 - DNA, 15 bp, Homo sapiens
attttccatatgttt

SEQ ID NO: 442828 - DNA, 15 bp, Homo sapiens
ttttccatatgtttg

SEQ ID NO: 442829 - DNA, 15 bp, Homo sapiens
tttccatatgtttgg

SEQ ID NO: 442830 - DNA, 15 bp, Homo sapiens
ttccatatgtttggt

SEQ ID NO: 442831 - DNA, 15 bp, Homo sapiens
tccatatgtttggtt

SEQ ID NO: 442832 - DNA, 15 bp, Homo sapiens
ccatatgtttggttg

SEQ ID NO: 442833 - DNA, 15 bp, Homo sapiens
catatgtttggttga

SEQ ID NO: 442834 - DNA, 15 bp, Homo sapiens
atatgtttggttgaa

SEQ ID NO: 442835 - DNA, 15 bp, Homo sapiens
tatgtttggttgaaa

SEQ ID NO: 442836 - DNA, 15 bp, Homo sapiens
atgtttggttgaaaa

SEQ ID NO: 442837 - DNA, 15 bp, Homo sapiens
tgtttggttgaaaaa

SEQ ID NO: 442838 - DNA, 15 bp, Homo sapiens
gtttggttgaaaaaa

SEQ ID NO: 442839 - DNA, 15 bp, Homo sapiens
tttggttgaaaaaaa

SEQ ID NO: 442840 - DNA, 15 bp, Homo sapiens
ttggttgaaaaaaat

SEQ ID NO: 442841 - DNA, 15 bp, Homo sapiens
tggttgaaaaaaatc

SEQ ID NO: 442842 - DNA, 15 bp, Homo sapiens
ggttgaaaaaaatct

SEQ ID NO: 442843 - DNA, 15 bp, Homo sapiens
gttgaaaaaaatctg

SEQ ID NO: 442844 - DNA, 15 bp, Homo sapiens
ttgaaaaaaatctgt

SEQ ID NO: 442845 - DNA, 15 bp, Homo sapiens
tgaaaaaaatctgtg

SEQ ID NO: 442846 - DNA, 15 bp, Homo sapiens
gaaaaaaatctgtgc

SEQ ID NO: 442847 - DNA, 15 bp, Homo sapiens
aaaaaaatctgtgca

SEQ ID NO: 442848 - DNA, 15 bp, Homo sapiens
aaaaaatctgtgcat

SEQ ID NO: 442849 - DNA, 15 bp, Homo sapiens
aaaaatctgtgcata

SEQ ID NO: 442850 - DNA, 15 bp, Homo sapiens
aaaatctgtgcataa

SEQ ID NO: 442851 - DNA, 15 bp, Homo sapiens
aaatctgtgcataaa

SEQ ID NO: 442852 - DNA, 15 bp, Homo sapiens
aatctgtgcataaat

SEQ ID NO: 442853 - DNA, 15 bp, Homo sapiens
atctgtgcataaatg

SEQ ID NO: 442854 - DNA, 15 bp, Homo sapiens
tctgtgcataaatgg

SEQ ID NO: 442855 - DNA, 15 bp, Homo sapiens
ctgtgcataaatgga

SEQ ID NO: 442856 - DNA, 15 bp, Homo sapiens
tgtgcataaatggac

SEQ ID NO: 442857 - DNA, 15 bp, Homo sapiens
gtgcataaatggacc

SEQ ID NO: 442858 - DNA, 15 bp, Homo sapiens
tgcataaatggaccc

SEQ ID NO: 442859 - DNA, 15 bp, Homo sapiens
gcataaatggaccca

SEQ ID NO: 442860 - DNA, 15 bp, Homo sapiens
cataaatggacccag

SEQ ID NO: 442861 - DNA, 15 bp, Homo sapiens
ataaatggacccagg

SEQ ID NO: 442862 - DNA, 15 bp, Homo sapiens
taaatggacccagga

SEQ ID NO: 442863 - DNA, 15 bp, Homo sapiens
aaatggacccaggaa

SEQ ID NO: 442864 - DNA, 15 bp, Homo sapiens
aatggacccaggaag

SEQ ID NO: 442865 - DNA, 15 bp, Homo sapiens
atggacccaggaagt

SEQ ID NO: 442866 - DNA, 15 bp, Homo sapiens
tggacccaggaagtt

SEQ ID NO: 442867 - DNA, 15 bp, Homo sapiens
ggacccaggaagttt

SEQ ID NO: 442868 - DNA, 15 bp, Homo sapiens
gacccaggaagtttg

SEQ ID NO: 442869 - DNA, 15 bp, Homo sapiens
acccaggaagtttgg

SEQ ID NO: 442870 - DNA, 15 bp, Homo sapiens
ccaggaagtttggtt

SEQ ID NO: 442871 - DNA, 15 bp, Homo sapiens
caggaagtttggttg

SEQ ID NO: 442872 - DNA, 15 bp, Homo sapiens
aggaagtttggttga

SEQ ID NO: 442873 - DNA, 15 bp, Homo sapiens
ggaagtttggttgag

SEQ ID NO: 442874 - DNA, 15 bp, Homo sapiens
gaagtttggttgaga

SEQ ID NO: 442875 - DNA, 15 bp, Homo sapiens
aagtttggttgagaa

SEQ ID NO: 442876 - DNA, 15 bp, Homo sapiens
agtttggttgagaaa

SEQ ID NO: 442877 - DNA, 15 bp, Homo sapiens
gtttggttgagaaaa

SEQ ID NO: 442878 - DNA, 15 bp, Homo sapiens
tttggttgagaaaaa

SEQ ID NO: 442879 - DNA, 15 bp, Homo sapiens
ttggttgagaaaaat

SEQ ID NO: 442880 - DNA, 15 bp, Homo sapiens
tggttgagaaaaatc

SEQ ID NO: 442881 - DNA, 15 bp, Homo sapiens
ggttgagaaaaatct

SEQ ID NO: 442882 - DNA, 15 bp, Homo sapiens
gttgagaaaaatctg

SEQ ID NO: 442883 - DNA, 15 bp, Homo sapiens
ttgagaaaaatctgt

SEQ ID NO: 442884 - DNA, 15 bp, Homo sapiens
tgagaaaaatctgtg

SEQ ID NO: 442885 - DNA, 15 bp, Homo sapiens
gagaaaaatctgtgc

SEQ ID NO: 442886 - DNA, 15 bp, Homo sapiens
agaaaaatctgtgca

SEQ ID NO: 442887 - DNA, 15 bp, Homo sapiens
gaaaaatctgtgcat

SEQ ID NO: 442888 - DNA, 15 bp, Homo sapiens
aaaatctgtgcatat

SEQ ID NO: 442889 - DNA, 15 bp, Homo sapiens
aaatctgtgcatatg

SEQ ID NO: 442890 - DNA, 15 bp, Homo sapiens
aatctgtgcatatgt

SEQ ID NO: 442891 - DNA, 15 bp, Homo sapiens
atctgtgcatatgtg

SEQ ID NO: 442892 - DNA, 15 bp, Homo sapiens
tctgtgcatatgtga

SEQ ID NO: 442893 - DNA, 15 bp, Homo sapiens
ctgtgcatatgtgaa

SEQ ID NO: 442894 - DNA, 15 bp, Homo sapiens
tgtgcatatgtgaac

SEQ ID NO: 442895 - DNA, 15 bp, Homo sapiens
gtgcatatgtgaacc

SEQ ID NO: 442896 - DNA, 15 bp, Homo sapiens
tgcatatgtgaaccc

SEQ ID NO: 442897 - DNA, 15 bp, Homo sapiens
gcatatgtgaaccca

SEQ ID NO: 442898 - DNA, 15 bp, Homo sapiens
catatgtgaacccat

SEQ ID NO: 442899 - DNA, 15 bp, Homo sapiens
atatgtgaacccatg

SEQ ID NO: 442900 - DNA, 15 bp, Homo sapiens
tatgtgaacccatgc

SEQ ID NO: 442901 - DNA, 15 bp, Homo sapiens
atgtgaacccatgca

SEQ ID NO: 442902 - DNA, 15 bp, Homo sapiens
tgtgaacccatgcag

SEQ ID NO: 442903 - DNA, 15 bp, Homo sapiens
gtgaacccatgcagt

SEQ ID NO: 442904 - DNA, 15 bp, Homo sapiens
tgaacccatgcagtt

SEQ ID NO: 442905 - DNA, 15 bp, Homo sapiens
gaacccatgcagttc

SEQ ID NO: 442906 - DNA, 15 bp, Homo sapiens
aacccatgcagttca

SEQ ID NO: 442907 - DNA, 15 bp, Homo sapiens
acccatgcagttcag

SEQ ID NO: 442908 - DNA, 15 bp, Homo sapiens
cccatgcagttcaga

SEQ ID NO: 442909 - DNA, 15 bp, Homo sapiens
ccatgcagttcagac

SEQ ID NO: 442910 - DNA, 15 bp, Homo sapiens
catgcagttcagacc

SEQ ID NO: 442911 - DNA, 15 bp, Homo sapiens
atgcagttcagacct

SEQ ID NO: 442912 - DNA, 15 bp, Homo sapiens
tgcagttcagaccta

SEQ ID NO: 442913 - DNA, 15 bp, Homo sapiens
gcagttcagacctaa

SEQ ID NO: 442914 - DNA, 15 bp, Homo sapiens
cagttcagacctaag

SEQ ID NO: 442915 - DNA, 15 bp, Homo sapiens
agttcagacctaagt

SEQ ID NO: 442916 - DNA, 15 bp, Homo sapiens
gttcagacctaagtt

SEQ ID NO: 442917 - DNA, 15 bp, Homo sapiens
ttcagacctaagtta

SEQ ID NO: 442918 - DNA, 15 bp, Homo sapiens
tcagacctaagttat

SEQ ID NO: 442919 - DNA, 15 bp, Homo sapiens
cagacctaagttatt

SEQ ID NO: 442920 - DNA, 15 bp, Homo sapiens
agacctaagttattt

SEQ ID NO: 442921 - DNA, 15 bp, Homo sapiens
gacctaagttattta

SEQ ID NO: 442922 - DNA, 15 bp, Homo sapiens
acctaagttatttaa

SEQ ID NO: 442923 - DNA, 15 bp, Homo sapiens
cctaagttatttaag

SEQ ID NO: 442924 - DNA, 15 bp, Homo sapiens
ctaagttatttaagg

SEQ ID NO: 442925 - DNA, 15 bp, Homo sapiens
taagttatttaagga

SEQ ID NO: 442926 - DNA, 15 bp, Homo sapiens
aagttatttaaggat

SEQ ID NO: 442927 - DNA, 15 bp, Homo sapiens
agttatttaaggatc

SEQ ID NO: 442928 - DNA, 15 bp, Homo sapiens
gttatttaaggatca

SEQ ID NO: 442929 - DNA, 15 bp, Homo sapiens
ttatttaaggatcaa

SEQ ID NO: 442930 - DNA, 15 bp, Homo sapiens
tatttaaggatcaac

SEQ ID NO: 442931 - DNA, 15 bp, Homo sapiens
atttaaggatcaact

SEQ ID NO: 442932 - DNA, 15 bp, Homo sapiens
tttaaggatcaactg

SEQ ID NO: 442933 - DNA, 15 bp, Homo sapiens
ttaaggatcaactgt

SEQ ID NO: 442934 - DNA, 15 bp, Homo sapiens
taaggatcaactgta

SEQ ID NO: 442935 - DNA, 15 bp, Homo sapiens
aaggatcaactgtat

SEQ ID NO: 442936 - DNA, 15 bp, Homo sapiens
aggatcaactgtatt

SEQ ID NO: 442937 - DNA, 15 bp, Homo sapiens
ggatcaactgtatta

SEQ ID NO: 442938 - DNA, 15 bp, Homo sapiens
gatcaactgtattag

SEQ ID NO: 442939 - DNA, 15 bp, Homo sapiens
atcaactgtattagc

SEQ ID NO: 442940 - DNA, 15 bp, Homo sapiens
tcaactgtattagct

SEQ ID NO: 442941 - DNA, 15 bp, Homo sapiens
caactgtattagctt

SEQ ID NO: 442942 - DNA, 15 bp, Homo sapiens
aactgtattagcttt

SEQ ID NO: 442943 - DNA, 15 bp, Homo sapiens
actgtattagctttt

SEQ ID NO: 442944 - DNA, 15 bp, Homo sapiens
ctgtattagcttttg

SEQ ID NO: 442945 - DNA, 15 bp, Homo sapiens
tgtattagcttttgt

SEQ ID NO: 442946 - DNA, 15 bp, Homo sapiens
gtattagcttttgtt

SEQ ID NO: 442947 - DNA, 15 bp, Homo sapiens
tattagcttttgtta

SEQ ID NO: 442948 - DNA, 15 bp, Homo sapiens
attagcttttgttat

SEQ ID NO: 442949 - DNA, 15 bp, Homo sapiens
ttagcttttgttata

SEQ ID NO: 442950 - DNA, 15 bp, Homo sapiens
tagcttttgttatat

SEQ ID NO: 442951 - DNA, 15 bp, Homo sapiens
agcttttgttatatt

SEQ ID NO: 442952 - DNA, 15 bp, Homo sapiens
gcttttgttatattc

SEQ ID NO: 442953 - DNA, 15 bp, Homo sapiens
cttttgttatattcg

SEQ ID NO: 442954 - DNA, 15 bp, Homo sapiens
ttttgttatattcgt

SEQ ID NO: 442955 - DNA, 15 bp, Homo sapiens
tttgttatattcgtt

SEQ ID NO: 442956 - DNA, 15 bp, Homo sapiens
ttgttatattcgttt

SEQ ID NO: 442957 - DNA, 15 bp, Homo sapiens
tgttatattcgtttc

SEQ ID NO: 442958 - DNA, 15 bp, Homo sapiens
gttatattcgtttcc

SEQ ID NO: 442959 - DNA, 15 bp, Homo sapiens
ttatattcgtttcca

SEQ ID NO: 442960 - DNA, 15 bp, Homo sapiens
tatattcgtttccaa

SEQ ID NO: 442961 - DNA, 15 bp, Homo sapiens
atattcgtttccaat

SEQ ID NO: 442962 - DNA, 15 bp, Homo sapiens
tattcgtttccaata

SEQ ID NO: 442963 - DNA, 15 bp, Homo sapiens
attcgtttccaataa

SEQ ID NO: 442964 - DNA, 15 bp, Homo sapiens
ttcgtttccaataat

SEQ ID NO: 442965 - DNA, 15 bp, Homo sapiens
tcgtttccaataata

SEQ ID NO: 442966 - DNA, 15 bp, Homo sapiens
cgtttccaataatat

SEQ ID NO: 442967 - DNA, 15 bp, Homo sapiens
gtttccaataatata

SEQ ID NO: 442968 - DNA, 15 bp, Homo sapiens
tttccaataatatat

SEQ ID NO: 442969 - DNA, 15 bp, Homo sapiens
ttccaataatatatt

SEQ ID NO: 442970 - DNA, 15 bp, Homo sapiens
tccaataatatattt

SEQ ID NO: 442971 - DNA, 15 bp, Homo sapiens
ccaataatatatttt

SEQ ID NO: 442972 - DNA, 15 bp, Homo sapiens
caataatatattttt

SEQ ID NO: 442973 - DNA, 15 bp, Homo sapiens
aataatatatttttt

SEQ ID NO: 442974 - DNA, 15 bp, Homo sapiens
ataatatattttttg

SEQ ID NO: 442975 - DNA, 15 bp, Homo sapiens
taatatattttttgt

SEQ ID NO: 442976 - DNA, 15 bp, Homo sapiens
aatatattttttgtt

SEQ ID NO: 442977 - DNA, 15 bp, Homo sapiens
atatattttttgttc

SEQ ID NO: 442978 - DNA, 15 bp, Homo sapiens
tatattttttgttct

SEQ ID NO: 442979 - DNA, 15 bp, Homo sapiens
atattttttgttctt

SEQ ID NO: 442980 - DNA, 15 bp, Homo sapiens
tattttttgttcttt

SEQ ID NO: 442981 - DNA, 15 bp, Homo sapiens
attttttgttctttt

SEQ ID NO: 442982 - DNA, 15 bp, Homo sapiens
ttttttgttcttttc

SEQ ID NO: 442983 - DNA, 15 bp, Homo sapiens
tttttgttcttttct

SEQ ID NO: 442984 - DNA, 15 bp, Homo sapiens
ttttgttcttttctt

SEQ ID NO: 442985 - DNA, 15 bp, Homo sapiens
tttgttcttttcttc

SEQ ID NO: 442986 - DNA, 15 bp, Homo sapiens
ttgttcttttcttct

SEQ ID NO: 442987 - DNA, 15 bp, Homo sapiens
tgttcttttcttcta

SEQ ID NO: 442988 - DNA, 15 bp, Homo sapiens
gttcttttcttctag

SEQ ID NO: 442989 - DNA, 15 bp, Homo sapiens
ttcttttcttctagg

SEQ ID NO: 442990 - DNA, 15 bp, Homo sapiens
tcttttcttctaggc

SEQ ID NO: 442991 - DNA, 15 bp, Homo sapiens
cttttcttctaggca

SEQ ID NO: 442992 - DNA, 15 bp, Homo sapiens
ttttcttctaggcat

SEQ ID NO: 442993 - DNA, 15 bp, Homo sapiens
tttcttctaggcatt

SEQ ID NO: 442994 - DNA, 15 bp, Homo sapiens
ttcttctaggcattt

SEQ ID NO: 442995 - DNA, 15 bp, Homo sapiens
tcttctaggcattta

SEQ ID NO: 442996 - DNA, 15 bp, Homo sapiens
cttctaggcatttag

SEQ ID NO: 442997 - DNA, 15 bp, Homo sapiens
ttctaggcatttaga

SEQ ID NO: 442998 - DNA, 15 bp, Homo sapiens
tctaggcatttagag

SEQ ID NO: 442999 - DNA, 15 bp, Homo sapiens
ctaggcatttagaga

SEQ ID NO: 443000 - DNA, 15 bp, Homo sapiens
taggcatttagagaa

SEQ ID NO: 443001 - DNA, 15 bp, Homo sapiens
aggcatttagagaag

SEQ ID NO: 443002 - DNA, 15 bp, Homo sapiens
ggcatttagagaaga

SEQ ID NO: 443003 - DNA, 15 bp, Homo sapiens
gcatttagagaagaa

SEQ ID NO: 443004 - DNA, 15 bp, Homo sapiens
catttagagaagaaa

SEQ ID NO: 443005 - DNA, 15 bp, Homo sapiens
atttagagaagaaat

SEQ ID NO: 443006 - DNA, 15 bp, Homo sapiens
tttagagaagaaatt

SEQ ID NO: 443007 - DNA, 15 bp, Homo sapiens
ttagagaagaaattg

SEQ ID NO: 443008 - DNA, 15 bp, Homo sapiens
tagagaagaaattgc

SEQ ID NO: 443009 - DNA, 15 bp, Homo sapiens
agagaagaaattgca

SEQ ID NO: 443010 - DNA, 15 bp, Homo sapiens
gagaagaaattgcac

SEQ ID NO: 443011 - DNA, 15 bp, Homo sapiens
agaagaaattgcacc

SEQ ID NO: 443012 - DNA, 15 bp, Homo sapiens
gaagaaattgcacca

SEQ ID NO: 443013 - DNA, 15 bp, Homo sapiens
aagaaattgcaccaa

SEQ ID NO: 443014 - DNA, 15 bp, Homo sapiens
agaaattgcaccaat

SEQ ID NO: 443015 - DNA, 15 bp, Homo sapiens
gaaattgcaccaatc

SEQ ID NO: 443016 - DNA, 15 bp, Homo sapiens
aaattgcaccaatca

SEQ ID NO: 443017 - DNA, 15 bp, Homo sapiens
aattgcaccaatcaa

SEQ ID NO: 443018 - DNA, 15 bp, Homo sapiens
attgcaccaatcaac

SEQ ID NO: 443019 - DNA, 15 bp, Homo sapiens
ttgcaccaatcaact

SEQ ID NO: 443020 - DNA, 15 bp, Homo sapiens
tgcaccaatcaactt

SEQ ID NO: 443021 - DNA, 15 bp, Homo sapiens
gcaccaatcaacttt

SEQ ID NO: 443022 - DNA, 15 bp, Homo sapiens
caccaatcaacttta

SEQ ID NO: 443023 - DNA, 15 bp, Homo sapiens
accaatcaactttaa

SEQ ID NO: 443024 - DNA, 15 bp, Homo sapiens
ccaatcaactttaaa

SEQ ID NO: 443025 - DNA, 15 bp, Homo sapiens
caatcaactttaaag

SEQ ID NO: 443026 - DNA, 15 bp, Homo sapiens
aatcaactttaaagt

SEQ ID NO: 443027 - DNA, 15 bp, Homo sapiens
atcaactttaaagtt

SEQ ID NO: 443028 - DNA, 15 bp, Homo sapiens
tcaactttaaagtta

SEQ ID NO: 443029 - DNA, 15 bp, Homo sapiens
caactttaaagttaa

SEQ ID NO: 443030 - DNA, 15 bp, Homo sapiens
aactttaaagttaaa

SEQ ID NO: 443031 - DNA, 15 bp, Homo sapiens
actttaaagttaaaa

SEQ ID NO: 443032 - DNA, 15 bp, Homo sapiens
ctttaaagttaaaac

SEQ ID NO: 443033 - DNA, 15 bp, Homo sapiens
tttaaagttaaaacg

SEQ ID NO: 443034 - DNA, 15 bp, Homo sapiens
ttaaagttaaaacgg

SEQ ID NO: 443035 - DNA, 15 bp, Homo sapiens
taaagttaaaacggt

SEQ ID NO: 443036 - DNA, 15 bp, Homo sapiens
aaagttaaaacggtg

SEQ ID NO: 443037 - DNA, 15 bp, Homo sapiens
aagttaaaacggtga

SEQ ID NO: 443038 - DNA, 15 bp, Homo sapiens
agttaaaacggtgaa

SEQ ID NO: 443039 - DNA, 15 bp, Homo sapiens
gttaaaacggtgaat

SEQ ID NO: 443040 - DNA, 15 bp, Homo sapiens
ttaaaacggtgaatg

SEQ ID NO: 443041 - DNA, 15 bp, Homo sapiens
taaaacggtgaatga

SEQ ID NO: 443042 - DNA, 15 bp, Homo sapiens
aaaacggtgaatgat

SEQ ID NO: 443043 - DNA, 15 bp, Homo sapiens
aaacggtgaatgatt

SEQ ID NO: 443044 - DNA, 15 bp, Homo sapiens
aacggtgaatgattt

SEQ ID NO: 443045 - DNA, 15 bp, Homo sapiens
acggtgaatgattta

SEQ ID NO: 443046 - DNA, 15 bp, Homo sapiens
cggtgaatgatttat

SEQ ID NO: 443047 - DNA, 15 bp, Homo sapiens
ggtgaatgatttatc

SEQ ID NO: 443048 - DNA, 15 bp, Homo sapiens
gtgaatgatttatcc

SEQ ID NO: 443049 - DNA, 15 bp, Homo sapiens
tgaatgatttatcca

SEQ ID NO: 443050 - DNA, 15 bp, Homo sapiens
gaatgatttatccag

SEQ ID NO: 443051 - DNA, 15 bp, Homo sapiens
aatgatttatccagt

SEQ ID NO: 443052 - DNA, 15 bp, Homo sapiens
atgatttatccagtc

SEQ ID NO: 443053 - DNA, 15 bp, Homo sapiens
tgatttatccagtca

SEQ ID NO: 443054 - DNA, 15 bp, Homo sapiens
gatttatccagtcag

SEQ ID NO: 443055 - DNA, 15 bp, Homo sapiens
atttatccagtcagc

SEQ ID NO: 443056 - DNA, 15 bp, Homo sapiens
tttatccagtcagct

SEQ ID NO: 443057 - DNA, 15 bp, Homo sapiens
ttatccagtcagctg

SEQ ID NO: 443058 - DNA, 15 bp, Homo sapiens
tatccagtcagctgt

SEQ ID NO: 443059 - DNA, 15 bp, Homo sapiens
atccagtcagctgtc

SEQ ID NO: 443060 - DNA, 15 bp, Homo sapiens
tccagtcagctgtct

SEQ ID NO: 443061 - DNA, 15 bp, Homo sapiens
ccagtcagctgtctc

SEQ ID NO: 443062 - DNA, 15 bp, Homo sapiens
cagtcagctgtctcc

SEQ ID NO: 443063 - DNA, 15 bp, Homo sapiens
agtcagctgtctcca

SEQ ID NO: 443064 - DNA, 15 bp, Homo sapiens
gtcagctgtctccac

SEQ ID NO: 443065 - DNA, 15 bp, Homo sapiens
tcagctgtctccact

SEQ ID NO: 443066 - DNA, 15 bp, Homo sapiens
cagctgtctccactt

SEQ ID NO: 443067 - DNA, 15 bp, Homo sapiens
agctgtctccacttg

SEQ ID NO: 443068 - DNA, 15 bp, Homo sapiens
gctgtctccacttga

SEQ ID NO: 443069 - DNA, 15 bp, Homo sapiens
ctgtctccacttgac

SEQ ID NO: 443070 - DNA, 15 bp, Homo sapiens
tgtctccacttgacc

SEQ ID NO: 443071 - DNA, 15 bp, Homo sapiens
gtctccacttgacct

SEQ ID NO: 443072 - DNA, 15 bp, Homo sapiens
tctccacttgacctg

SEQ ID NO: 443073 - DNA, 15 bp, Homo sapiens
ctccacttgacctgc

SEQ ID NO: 443074 - DNA, 15 bp, Homo sapiens
tccacttgacctgca

SEQ ID NO: 443075 - DNA, 15 bp, Homo sapiens
ccacttgacctgcat

SEQ ID NO: 443076 - DNA, 15 bp, Homo sapiens
cacttgacctgcatc

SEQ ID NO: 443077 - DNA, 15 bp, Homo sapiens
acttgacctgcatcc

SEQ ID NO: 443078 - DNA, 15 bp, Homo sapiens
cttgacctgcatccc

SEQ ID NO: 443079 - DNA, 15 bp, Homo sapiens
ttgacctgcatccct

SEQ ID NO: 443080 - DNA, 15 bp, Homo sapiens
tgacctgcatccctc

SEQ ID NO: 443081 - DNA, 15 bp, Homo sapiens
gacctgcatccctct

SEQ ID NO: 443082 - DNA, 15 bp, Homo sapiens
acctgcatccctctc

SEQ ID NO: 443083 - DNA, 15 bp, Homo sapiens
cctgcatccctctct

SEQ ID NO: 443084 - DNA, 15 bp, Homo sapiens
ctgcatccctctcta

SEQ ID NO: 443085 - DNA, 15 bp, Homo sapiens
tgcatccctctctaa

SEQ ID NO: 443086 - DNA, 15 bp, Homo sapiens
gcatccctctctaaa

SEQ ID NO: 443087 - DNA, 15 bp, Homo sapiens
catccctctctaaag

SEQ ID NO: 443088 - DNA, 15 bp, Homo sapiens
atccctctctaaaga

SEQ ID NO: 443089 - DNA, 15 bp, Homo sapiens
tccctctctaaagat

SEQ ID NO: 443090 - DNA, 15 bp, Homo sapiens
ccctctctaaagatg

SEQ ID NO: 443091 - DNA, 15 bp, Homo sapiens
cctctctaaagatgt

SEQ ID NO: 443092 - DNA, 15 bp, Homo sapiens
ctctctaaagatgtc

SEQ ID NO: 443093 - DNA, 15 bp, Homo sapiens
tctctaaagatgtct

SEQ ID NO: 443094 - DNA, 15 bp, Homo sapiens
ctctaaagatgtctc

SEQ ID NO: 443095 - DNA, 15 bp, Homo sapiens
tctaaagatgtctcg

SEQ ID NO: 443096 - DNA, 15 bp, Homo sapiens
ctaaagatgtctcgc

SEQ ID NO: 443097 - DNA, 15 bp, Homo sapiens
taaagatgtctcgcc

SEQ ID NO: 443098 - DNA, 15 bp, Homo sapiens
aaagatgtctcgcca

SEQ ID NO: 443099 - DNA, 15 bp, Homo sapiens
aagatgtctcgccag

SEQ ID NO: 443100 - DNA, 15 bp, Homo sapiens
agatgtctcgccagc

SEQ ID NO: 443101 - DNA, 15 bp, Homo sapiens
gatgtctcgccagct

SEQ ID NO: 443102 - DNA, 15 bp, Homo sapiens
atgtctcgccagcta

SEQ ID NO: 443103 - DNA, 15 bp, Homo sapiens
tgtctcgccagctag

SEQ ID NO: 443104 - DNA, 15 bp, Homo sapiens
gtctcgccagctaga

SEQ ID NO: 443105 - DNA, 15 bp, Homo sapiens
tctcgccagctagat

SEQ ID NO: 443106 - DNA, 15 bp, Homo sapiens
ctcgccagctagatg

SEQ ID NO: 443107 - DNA, 15 bp, Homo sapiens
tcgccagctagatga

SEQ ID NO: 443108 - DNA, 15 bp, Homo sapiens
cgccagctagatgac

SEQ ID NO: 443109 - DNA, 15 bp, Homo sapiens
gccagctagatgacc

SEQ ID NO: 443110 - DNA, 15 bp, Homo sapiens
ccagctagatgacct

SEQ ID NO: 443111 - DNA, 15 bp, Homo sapiens
cagctagatgacctt

SEQ ID NO: 443112 - DNA, 15 bp, Homo sapiens
agctagatgacctta

SEQ ID NO: 443113 - DNA, 15 bp, Homo sapiens
gctagatgaccttaa

SEQ ID NO: 443114 - DNA, 15 bp, Homo sapiens
ctagatgaccttaat

SEQ ID NO: 443115 - DNA, 15 bp, Homo sapiens
tagatgaccttaata

SEQ ID NO: 443116 - DNA, 15 bp, Homo sapiens
agatgaccttaatat

SEQ ID NO: 443117 - DNA, 15 bp, Homo sapiens
gatgaccttaatatg

SEQ ID NO: 443118 - DNA, 15 bp, Homo sapiens
atgaccttaatatgc

SEQ ID NO: 443119 - DNA, 15 bp, Homo sapiens
tgaccttaatatgcg

SEQ ID NO: 443120 - DNA, 15 bp, Homo sapiens
gaccttaatatgcga

SEQ ID NO: 443121 - DNA, 15 bp, Homo sapiens
accttaatatgcgat

SEQ ID NO: 443122 - DNA, 15 bp, Homo sapiens
ccttaatatgcgatg

SEQ ID NO: 443123 - DNA, 15 bp, Homo sapiens
cttaatatgcgatgg

SEQ ID NO: 443124 - DNA, 15 bp, Homo sapiens
ttaatatgcgatgga

SEQ ID NO: 443125 - DNA, 15 bp, Homo sapiens
taatatgcgatggaa

SEQ ID NO: 443126 - DNA, 15 bp, Homo sapiens
aatatgcgatggaaa

SEQ ID NO: 443127 - DNA, 15 bp, Homo sapiens
atatgcgatggaaac

SEQ ID NO: 443128 - DNA, 15 bp, Homo sapiens
tatgcgatggaaact

SEQ ID NO: 443129 - DNA, 15 bp, Homo sapiens
atgcgatggaaactt

SEQ ID NO: 443130 - DNA, 15 bp, Homo sapiens
tgcgatggaaacttt

SEQ ID NO: 443131 - DNA, 15 bp, Homo sapiens
gcgatggaaactttt

SEQ ID NO: 443132 - DNA, 15 bp, Homo sapiens
cgatggaaactttta

SEQ ID NO: 443133 - DNA, 15 bp, Homo sapiens
gatggaaacttttac

SEQ ID NO: 443134 - DNA, 15 bp, Homo sapiens
atggaaacttttaca

SEQ ID NO: 443135 - DNA, 15 bp, Homo sapiens
tggaaacttttacag

SEQ ID NO: 443136 - DNA, 15 bp, Homo sapiens
ggaaacttttacagg

SEQ ID NO: 443137 - DNA, 15 bp, Homo sapiens
gaaacttttacaggt

SEQ ID NO: 443138 - DNA, 15 bp, Homo sapiens
aaacttttacaggta

SEQ ID NO: 443139 - DNA, 15 bp, Homo sapiens
aacttttacaggtat

SEQ ID NO: 443140 - DNA, 15 bp, Homo sapiens
acttttacaggtatc

SEQ ID NO: 443141 - DNA, 15 bp, Homo sapiens
cttttacaggtatca

SEQ ID NO: 443142 - DNA, 15 bp, Homo sapiens
ttttacaggtatcag

SEQ ID NO: 443143 - DNA, 15 bp, Homo sapiens
tttacaggtatcagc

SEQ ID NO: 443144 - DNA, 15 bp, Homo sapiens
ttacaggtatcagct

SEQ ID NO: 443145 - DNA, 15 bp, Homo sapiens
tacaggtatcagctt

SEQ ID NO: 443146 - DNA, 15 bp, Homo sapiens
acaggtatcagctta

SEQ ID NO: 443147 - DNA, 15 bp, Homo sapiens
caggtatcagcttat

SEQ ID NO: 443148 - DNA, 15 bp, Homo sapiens
aggtatcagcttatt

SEQ ID NO: 443149 - DNA, 15 bp, Homo sapiens
ggtatcagcttattc

SEQ ID NO: 443150 - DNA, 15 bp, Homo sapiens
gtatcagcttattcc

SEQ ID NO: 443151 - DNA, 15 bp, Homo sapiens
tatcagcttattccc

SEQ ID NO: 443152 - DNA, 15 bp, Homo sapiens
atcagcttattcccc

SEQ ID NO: 443153 - DNA, 15 bp, Homo sapiens
tcagcttattcccct

SEQ ID NO: 443154 - DNA, 15 bp, Homo sapiens
cagcttattcccctt

SEQ ID NO: 443155 - DNA, 15 bp, Homo sapiens
agcttattccccttc

SEQ ID NO: 443156 - DNA, 15 bp, Homo sapiens
gcttattccccttca

SEQ ID NO: 443157 - DNA, 15 bp, Homo sapiens
cttattccccttcat

SEQ ID NO: 443158 - DNA, 15 bp, Homo sapiens
ttattccccttcata

SEQ ID NO: 443159 - DNA, 15 bp, Homo sapiens
tattccccttcataa

SEQ ID NO: 443160 - DNA, 15 bp, Homo sapiens
attccccttcataat

SEQ ID NO: 443161 - DNA, 15 bp, Homo sapiens
ttccccttcataatg

SEQ ID NO: 443162 - DNA, 15 bp, Homo sapiens
tccccttcataatgc

SEQ ID NO: 443163 - DNA, 15 bp, Homo sapiens
ccccttcataatgca

SEQ ID NO: 443164 - DNA, 15 bp, Homo sapiens
cccttcataatgcag

SEQ ID NO: 443165 - DNA, 15 bp, Homo sapiens
ccttcataatgcagg

SEQ ID NO: 443166 - DNA, 15 bp, Homo sapiens
cttcataatgcaggc

SEQ ID NO: 443167 - DNA, 15 bp, Homo sapiens
ttcataatgcaggct

SEQ ID NO: 443168 - DNA, 15 bp, Homo sapiens
tcataatgcaggctt

SEQ ID NO: 443169 - DNA, 15 bp, Homo sapiens
cataatgcaggctta

SEQ ID NO: 443170 - DNA, 15 bp, Homo sapiens
ataatgcaggcttac

SEQ ID NO: 443171 - DNA, 15 bp, Homo sapiens
taatgcaggcttaca

SEQ ID NO: 443172 - DNA, 15 bp, Homo sapiens
aatgcaggcttacac

SEQ ID NO: 443173 - DNA, 15 bp, Homo sapiens
atgcaggcttacacc

SEQ ID NO: 443174 - DNA, 15 bp, Homo sapiens
tgcaggcttacacct

SEQ ID NO: 443175 - DNA, 15 bp, Homo sapiens
gcaggcttacacctt

SEQ ID NO: 443176 - DNA, 15 bp, Homo sapiens
caggcttacaccttg

SEQ ID NO: 443177 - DNA, 15 bp, Homo sapiens
aggcttacaccttgg

SEQ ID NO: 443178 - DNA, 15 bp, Homo sapiens
ggcttacaccttggg

SEQ ID NO: 443179 - DNA, 15 bp, Homo sapiens
gcttacaccttgggt

SEQ ID NO: 443180 - DNA, 15 bp, Homo sapiens
cttacaccttgggtg

SEQ ID NO: 443181 - DNA, 15 bp, Homo sapiens
ttacaccttgggtgg

SEQ ID NO: 443182 - DNA, 15 bp, Homo sapiens
tacaccttgggtggt

SEQ ID NO: 443183 - DNA, 15 bp, Homo sapiens
acaccttgggtggtc

SEQ ID NO: 443184 - DNA, 15 bp, Homo sapiens
caccttgggtggtct

SEQ ID NO: 443185 - DNA, 15 bp, Homo sapiens
accttgggtggtctt

SEQ ID NO: 443186 - DNA, 15 bp, Homo sapiens
ccttgggtggtcttt

SEQ ID NO: 443187 - DNA, 15 bp, Homo sapiens
cttgggtggtcttta

SEQ ID NO: 443188 - DNA, 15 bp, Homo sapiens
ttgggtggtctttaa

SEQ ID NO: 443189 - DNA, 15 bp, Homo sapiens
tgggtggtctttaaa

SEQ ID NO: 443190 - DNA, 15 bp, Homo sapiens
gggtggtctttaaac

SEQ ID NO: 443191 - DNA, 15 bp, Homo sapiens
ggtggtctttaaacc

SEQ ID NO: 443192 - DNA, 15 bp, Homo sapiens
gtggtctttaaaccc

SEQ ID NO: 443193 - DNA, 15 bp, Homo sapiens
tggtctttaaaccct

SEQ ID NO: 443194 - DNA, 15 bp, Homo sapiens
ggtctttaaacccta

SEQ ID NO: 443195 - DNA, 15 bp, Homo sapiens
gtctttaaaccctac

SEQ ID NO: 443196 - DNA, 15 bp, Homo sapiens
tctttaaaccctacc

SEQ ID NO: 443197 - DNA, 15 bp, Homo sapiens
ctttaaaccctacct

SEQ ID NO: 443198 - DNA, 15 bp, Homo sapiens
tttaaaccctacctc

SEQ ID NO: 443199 - DNA, 15 bp, Homo sapiens
ttaaaccctacctca

SEQ ID NO: 443200 - DNA, 15 bp, Homo sapiens
taaaccctacctcac

SEQ ID NO: 443201 - DNA, 15 bp, Homo sapiens
aaaccctacctcact

SEQ ID NO: 443202 - DNA, 15 bp, Homo sapiens
aaccctacctcacta

SEQ ID NO: 443203 - DNA, 15 bp, Homo sapiens
accctacctcactat

SEQ ID NO: 443204 - DNA, 15 bp, Homo sapiens
ccctacctcactata

SEQ ID NO: 443205 - DNA, 15 bp, Homo sapiens
cctacctcactatat

SEQ ID NO: 443206 - DNA, 15 bp, Homo sapiens
ctacctcactatatt

SEQ ID NO: 443207 - DNA, 15 bp, Homo sapiens
tacctcactatatta

SEQ ID NO: 443208 - DNA, 15 bp, Homo sapiens
acctcactatattac

SEQ ID NO: 443209 - DNA, 15 bp, Homo sapiens
cctcactatattacc

SEQ ID NO: 443210 - DNA, 15 bp, Homo sapiens
ctcactatattacca

SEQ ID NO: 443211 - DNA, 15 bp, Homo sapiens
tcactatattaccac

SEQ ID NO: 443212 - DNA, 15 bp, Homo sapiens
cactatattaccact

SEQ ID NO: 443213 - DNA, 15 bp, Homo sapiens
actatattaccactc

SEQ ID NO: 443214 - DNA, 15 bp, Homo sapiens
ctatattaccactca

SEQ ID NO: 443215 - DNA, 15 bp, Homo sapiens
tatattaccactcac

SEQ ID NO: 443216 - DNA, 15 bp, Homo sapiens
atattaccactcacc

SEQ ID NO: 443217 - DNA, 15 bp, Homo sapiens
tattaccactcaccg

SEQ ID NO: 443218 - DNA, 15 bp, Homo sapiens
attaccactcaccgt

SEQ ID NO: 443219 - DNA, 15 bp, Homo sapiens
ttaccactcaccgtt

SEQ ID NO: 443220 - DNA, 15 bp, Homo sapiens
taccactcaccgttt

SEQ ID NO: 443221 - DNA, 15 bp, Homo sapiens
accactcaccgtttt

SEQ ID NO: 443222 - DNA, 15 bp, Homo sapiens
ccactcaccgttttc

SEQ ID NO: 443223 - DNA, 15 bp, Homo sapiens
actcaccgttttctc

SEQ ID NO: 443224 - DNA, 15 bp, Homo sapiens
ctcaccgttttctct

SEQ ID NO: 443225 - DNA, 15 bp, Homo sapiens
tcaccgttttctctt

SEQ ID NO: 443226 - DNA, 15 bp, Homo sapiens
caccgttttctcttt

SEQ ID NO: 443227 - DNA, 15 bp, Homo sapiens
accgttttctctttc

SEQ ID NO: 443228 - DNA, 15 bp, Homo sapiens
ccgttttctctttct

SEQ ID NO: 443229 - DNA, 15 bp, Homo sapiens
cgttttctctttctt

SEQ ID NO: 443230 - DNA, 15 bp, Homo sapiens
gttttctctttcttt

SEQ ID NO: 443231 - DNA, 15 bp, Homo sapiens
ttttctctttctttg

SEQ ID NO: 443232 - DNA, 15 bp, Homo sapiens
tttctctttctttgc

SEQ ID NO: 443233 - DNA, 15 bp, Homo sapiens
ttctctttctttgct

SEQ ID NO: 443234 - DNA, 15 bp, Homo sapiens
tctctttctttgctg

SEQ ID NO: 443235 - DNA, 15 bp, Homo sapiens
ctctttctttgctga

SEQ ID NO: 443236 - DNA, 15 bp, Homo sapiens
tctttctttgctgat

SEQ ID NO: 443237 - DNA, 15 bp, Homo sapiens
ctttctttgctgatg

SEQ ID NO: 443238 - DNA, 15 bp, Homo sapiens
tttctttgctgatgg

SEQ ID NO: 443239 - DNA, 15 bp, Homo sapiens
ttctttgctgatggt

SEQ ID NO: 443240 - DNA, 15 bp, Homo sapiens
tctttgctgatggta

SEQ ID NO: 443241 - DNA, 15 bp, Homo sapiens
ctttgctgatggtat

SEQ ID NO: 443242 - DNA, 15 bp, Homo sapiens
tttgctgatggtatt

SEQ ID NO: 443243 - DNA, 15 bp, Homo sapiens
ttgctgatggtattt

SEQ ID NO: 443244 - DNA, 15 bp, Homo sapiens
tgctgatggtatttg

SEQ ID NO: 443245 - DNA, 15 bp, Homo sapiens
gctgatggtatttga

SEQ ID NO: 443246 - DNA, 15 bp, Homo sapiens
ctgatggtatttgat

SEQ ID NO: 443247 - DNA, 15 bp, Homo sapiens
tgatggtatttgata

SEQ ID NO: 443248 - DNA, 15 bp, Homo sapiens
gatggtatttgataa

SEQ ID NO: 443249 - DNA, 15 bp, Homo sapiens
atggtatttgataat

SEQ ID NO: 443250 - DNA, 15 bp, Homo sapiens
tggtatttgataatg

SEQ ID NO: 443251 - DNA, 15 bp, Homo sapiens
ggtatttgataatga

SEQ ID NO: 443252 - DNA, 15 bp, Homo sapiens
gtatttgataatgaa

SEQ ID NO: 443253 - DNA, 15 bp, Homo sapiens
tatttgataatgaat

SEQ ID NO: 443254 - DNA, 15 bp, Homo sapiens
atttgataatgaatt

SEQ ID NO: 443255 - DNA, 15 bp, Homo sapiens
tttgataatgaattt

SEQ ID NO: 443256 - DNA, 15 bp, Homo sapiens
ttgataatgaattta

SEQ ID NO: 443257 - DNA, 15 bp, Homo sapiens
tgataatgaatttag

SEQ ID NO: 443258 - DNA, 15 bp, Homo sapiens
gataatgaatttagc

SEQ ID NO: 443259 - DNA, 15 bp, Homo sapiens
ataatgaatttagca

SEQ ID NO: 443260 - DNA, 15 bp, Homo sapiens
taatgaatttagcat

SEQ ID NO: 443261 - DNA, 15 bp, Homo sapiens
aatgaatttagcatg

SEQ ID NO: 443262 - DNA, 15 bp, Homo sapiens
atgaatttagcatgt

SEQ ID NO: 443263 - DNA, 15 bp, Homo sapiens
tgaatttagcatgtg

SEQ ID NO: 443264 - DNA, 15 bp, Homo sapiens
gaatttagcatgtga

SEQ ID NO: 443265 - DNA, 15 bp, Homo sapiens
aatttagcatgtgat

SEQ ID NO: 443266 - DNA, 15 bp, Homo sapiens
atttagcatgtgatg

SEQ ID NO: 443267 - DNA, 15 bp, Homo sapiens
tttagcatgtgatga

SEQ ID NO: 443268 - DNA, 15 bp, Homo sapiens
ttagcatgtgatgac

SEQ ID NO: 443269 - DNA, 15 bp, Homo sapiens
tagcatgtgatgaca

SEQ ID NO: 443270 - DNA, 15 bp, Homo sapiens
agcatgtgatgacat

SEQ ID NO: 443271 - DNA, 15 bp, Homo sapiens
gcatgtgatgacatc

SEQ ID NO: 443272 - DNA, 15 bp, Homo sapiens
catgtgatgacatca

SEQ ID NO: 443273 - DNA, 15 bp, Homo sapiens
atgtgatgacatcag

SEQ ID NO: 443274 - DNA, 15 bp, Homo sapiens
tgtgatgacatcagg

SEQ ID NO: 443275 - DNA, 15 bp, Homo sapiens
gtgatgacatcaggt

SEQ ID NO: 443276 - DNA, 15 bp, Homo sapiens
tgatgacatcaggta

SEQ ID NO: 443277 - DNA, 15 bp, Homo sapiens
gatgacatcaggtat

SEQ ID NO: 443278 - DNA, 15 bp, Homo sapiens
atgacatcaggtatt

SEQ ID NO: 443279 - DNA, 15 bp, Homo sapiens
tgacatcaggtattt

SEQ ID NO: 443280 - DNA, 15 bp, Homo sapiens
gacatcaggtatttg

SEQ ID NO: 443281 - DNA, 15 bp, Homo sapiens
acatcaggtatttgt

SEQ ID NO: 443282 - DNA, 15 bp, Homo sapiens
catcaggtatttgtc

SEQ ID NO: 443283 - DNA, 15 bp, Homo sapiens
atcaggtatttgtct

SEQ ID NO: 443284 - DNA, 15 bp, Homo sapiens
tcaggtatttgtctt

SEQ ID NO: 443285 - DNA, 15 bp, Homo sapiens
caggtatttgtcttt

SEQ ID NO: 443286 - DNA, 15 bp, Homo sapiens
aggtatttgtctttc

SEQ ID NO: 443287 - DNA, 15 bp, Homo sapiens
ggtatttgtctttca

SEQ ID NO: 443288 - DNA, 15 bp, Homo sapiens
gtatttgtctttcag

SEQ ID NO: 443289 - DNA, 15 bp, Homo sapiens
tatttgtctttcagt

SEQ ID NO: 443290 - DNA, 15 bp, Homo sapiens
atttgtctttcagta

SEQ ID NO: 443291 - DNA, 15 bp, Homo sapiens
tttgtctttcagtat

SEQ ID NO: 443292 - DNA, 15 bp, Homo sapiens
ttgtctttcagtatc

SEQ ID NO: 443293 - DNA, 15 bp, Homo sapiens
tgtctttcagtatct

SEQ ID NO: 443294 - DNA, 15 bp, Homo sapiens
gtctttcagtatctt

SEQ ID NO: 443295 - DNA, 15 bp, Homo sapiens
tctttcagtatcttg

SEQ ID NO: 443296 - DNA, 15 bp, Homo sapiens
ctttcagtatcttga

SEQ ID NO: 443297 - DNA, 15 bp, Homo sapiens
tttcagtatcttgaa

SEQ ID NO: 443298 - DNA, 15 bp, Homo sapiens
ttcagtatcttgaac

SEQ ID NO: 443299 - DNA, 15 bp, Homo sapiens
tcagtatcttgaacc

SEQ ID NO: 443300 - DNA, 15 bp, Homo sapiens
cagtatcttgaacct

SEQ ID NO: 443301 - DNA, 15 bp, Homo sapiens
agtatcttgaaccta

SEQ ID NO: 443302 - DNA, 15 bp, Homo sapiens
gtatcttgaacctaa

SEQ ID NO: 443303 - DNA, 15 bp, Homo sapiens
tatcttgaacctaaa

SEQ ID NO: 443304 - DNA, 15 bp, Homo sapiens
atcttgaacctaaag

SEQ ID NO: 443305 - DNA, 15 bp, Homo sapiens
tcttgaacctaaagg

SEQ ID NO: 443306 - DNA, 15 bp, Homo sapiens
cttgaacctaaaggc

SEQ ID NO: 443307 - DNA, 15 bp, Homo sapiens
ttgaacctaaaggcc

SEQ ID NO: 443308 - DNA, 15 bp, Homo sapiens
tgaacctaaaggcct

SEQ ID NO: 443309 - DNA, 15 bp, Homo sapiens
gaacctaaaggcctc

SEQ ID NO: 443310 - DNA, 15 bp, Homo sapiens
aacctaaaggcctca

SEQ ID NO: 443311 - DNA, 15 bp, Homo sapiens
acctaaaggcctcat

SEQ ID NO: 443312 - DNA, 15 bp, Homo sapiens
cctaaaggcctcatt

SEQ ID NO: 443313 - DNA, 15 bp, Homo sapiens
ctaaaggcctcattt

SEQ ID NO: 443314 - DNA, 15 bp, Homo sapiens
taaaggcctcattta

SEQ ID NO: 443315 - DNA, 15 bp, Homo sapiens
aaaggcctcatttat

SEQ ID NO: 443316 - DNA, 15 bp, Homo sapiens
aaggcctcatttatt

SEQ ID NO: 443317 - DNA, 15 bp, Homo sapiens
aggcctcatttattt

SEQ ID NO: 443318 - DNA, 15 bp, Homo sapiens
ggcctcatttattta

SEQ ID NO: 443319 - DNA, 15 bp, Homo sapiens
gcctcatttatttat

SEQ ID NO: 443320 - DNA, 15 bp, Homo sapiens
cctcatttatttata

SEQ ID NO: 443321 - DNA, 15 bp, Homo sapiens
ctcatttatttatag

SEQ ID NO: 443322 - DNA, 15 bp, Homo sapiens
tcatttatttataga

SEQ ID NO: 443323 - DNA, 15 bp, Homo sapiens
catttatttatagag

SEQ ID NO: 443324 - DNA, 15 bp, Homo sapiens
atttatttatagagt

SEQ ID NO: 443325 - DNA, 15 bp, Homo sapiens
tttatttatagagtt

SEQ ID NO: 443326 - DNA, 15 bp, Homo sapiens
ttatttatagagttt

SEQ ID NO: 443327 - DNA, 15 bp, Homo sapiens
tatttatagagttta

SEQ ID NO: 443328 - DNA, 15 bp, Homo sapiens
atttatagagtttaa

SEQ ID NO: 443329 - DNA, 15 bp, Homo sapiens
tttatagagtttaat

SEQ ID NO: 443330 - DNA, 15 bp, Homo sapiens
ttatagagtttaatt

SEQ ID NO: 443331 - DNA, 15 bp, Homo sapiens
tatagagtttaattt

SEQ ID NO: 443332 - DNA, 15 bp, Homo sapiens
atagagtttaattta

SEQ ID NO: 443333 - DNA, 15 bp, Homo sapiens
tagagtttaatttaa

SEQ ID NO: 443334 - DNA, 15 bp, Homo sapiens
agagtttaatttaat

SEQ ID NO: 443335 - DNA, 15 bp, Homo sapiens
gagtttaatttaatt

SEQ ID NO: 443336 - DNA, 15 bp, Homo sapiens
agtttaatttaattt

SEQ ID NO: 443337 - DNA, 15 bp, Homo sapiens
gtttaatttaatttt

SEQ ID NO: 443338 - DNA, 15 bp, Homo sapiens
tttaatttaattttt

SEQ ID NO: 443339 - DNA, 15 bp, Homo sapiens
ttaatttaatttttt

SEQ ID NO: 443340 - DNA, 15 bp, Homo sapiens
taatttaattttttg

SEQ ID NO: 443341 - DNA, 15 bp, Homo sapiens
aatttaattttttga

SEQ ID NO: 443342 - DNA, 15 bp, Homo sapiens
atttaattttttgat

SEQ ID NO: 443343 - DNA, 15 bp, Homo sapiens
tttaattttttgatg

SEQ ID NO: 443344 - DNA, 15 bp, Homo sapiens
ttaattttttgatgt

SEQ ID NO: 443345 - DNA, 15 bp, Homo sapiens
aattttttgatgtac

SEQ ID NO: 443346 - DNA, 15 bp, Homo sapiens
attttttgatgtact

SEQ ID NO: 443347 - DNA, 15 bp, Homo sapiens
ttttttgatgtacta

SEQ ID NO: 443348 - DNA, 15 bp, Homo sapiens
tttttgatgtactat

SEQ ID NO: 443349 - DNA, 15 bp, Homo sapiens
ttttgatgtactatt

SEQ ID NO: 443350 - DNA, 15 bp, Homo sapiens
tttgatgtactattc

SEQ ID NO: 443351 - DNA, 15 bp, Homo sapiens
ttgatgtactattca

SEQ ID NO: 443352 - DNA, 15 bp, Homo sapiens
tgatgtactattcat

SEQ ID NO: 443353 - DNA, 15 bp, Homo sapiens
gatgtactattcata

SEQ ID NO: 443354 - DNA, 15 bp, Homo sapiens
atgtactattcatat

SEQ ID NO: 443355 - DNA, 15 bp, Homo sapiens
tgtactattcatatg

SEQ ID NO: 443356 - DNA, 15 bp, Homo sapiens
gtactattcatatga

SEQ ID NO: 443357 - DNA, 15 bp, Homo sapiens
tactattcatatgat

SEQ ID NO: 443358 - DNA, 15 bp, Homo sapiens
actattcatatgata

SEQ ID NO: 443359 - DNA, 15 bp, Homo sapiens
ctattcatatgatat

SEQ ID NO: 443360 - DNA, 15 bp, Homo sapiens
tattcatatgatatt

SEQ ID NO: 443361 - DNA, 15 bp, Homo sapiens
attcatatgatattt

SEQ ID NO: 443362 - DNA, 15 bp, Homo sapiens
ttcatatgatatttg

SEQ ID NO: 443363 - DNA, 15 bp, Homo sapiens
tcatatgatatttgt

SEQ ID NO: 443364 - DNA, 15 bp, Homo sapiens
catatgatatttgta

SEQ ID NO: 443365 - DNA, 15 bp, Homo sapiens
atatgatatttgtag

SEQ ID NO: 443366 - DNA, 15 bp, Homo sapiens
tatgatatttgtaga

SEQ ID NO: 443367 - DNA, 15 bp, Homo sapiens
atgatatttgtagaa

SEQ ID NO: 443368 - DNA, 15 bp, Homo sapiens
tgatatttgtagaaa

SEQ ID NO: 443369 - DNA, 15 bp, Homo sapiens
gatatttgtagaaaa

SEQ ID NO: 443370 - DNA, 15 bp, Homo sapiens
atatttgtagaaaat

SEQ ID NO: 443371 - DNA, 15 bp, Homo sapiens
tatttgtagaaaatt

SEQ ID NO: 443372 - DNA, 15 bp, Homo sapiens
atttgtagaaaattg

SEQ ID NO: 443373 - DNA, 15 bp, Homo sapiens
tttgtagaaaattgc

SEQ ID NO: 443374 - DNA, 15 bp, Homo sapiens
ttgtagaaaattgca

SEQ ID NO: 443375 - DNA, 15 bp, Homo sapiens
tgtagaaaattgcaa

SEQ ID NO: 443376 - DNA, 15 bp, Homo sapiens
gtagaaaattgcaaa

SEQ ID NO: 443377 - DNA, 15 bp, Homo sapiens
tagaaaattgcaaaa

SEQ ID NO: 443378 - DNA, 15 bp, Homo sapiens
agaaaattgcaaaag

SEQ ID NO: 443379 - DNA, 15 bp, Homo sapiens
gaaaattgcaaaagg

SEQ ID NO: 443380 - DNA, 15 bp, Homo sapiens
aaaattgcaaaaggt

SEQ ID NO: 443381 - DNA, 15 bp, Homo sapiens
aaattgcaaaaggtt

SEQ ID NO: 443382 - DNA, 15 bp, Homo sapiens
aattgcaaaaggtta

SEQ ID NO: 443383 - DNA, 15 bp, Homo sapiens
attgcaaaaggttaa

SEQ ID NO: 443384 - DNA, 15 bp, Homo sapiens
ttgcaaaaggttaaa

SEQ ID NO: 443385 - DNA, 15 bp, Homo sapiens
tgcaaaaggttaaat

SEQ ID NO: 443386 - DNA, 15 bp, Homo sapiens
gcaaaaggttaaata

SEQ ID NO: 443387 - DNA, 15 bp, Homo sapiens
caaaaggttaaataa

SEQ ID NO: 443388 - DNA, 15 bp, Homo sapiens
aaaaggttaaataaa

SEQ ID NO: 443389 - DNA, 15 bp, Homo sapiens
aaaggttaaataaat

SEQ ID NO: 443390 - DNA, 15 bp, Homo sapiens
aaggttaaataaatc

SEQ ID NO: 443391 - DNA, 15 bp, Homo sapiens
aggttaaataaatca

SEQ ID NO: 443392 - DNA, 15 bp, Homo sapiens
ggttaaataaatcac

SEQ ID NO: 443393 - DNA, 15 bp, Homo sapiens
gttaaataaatcaca

SEQ ID NO: 443394 - DNA, 15 bp, Homo sapiens
ttaaataaatcacag

SEQ ID NO: 443395 - DNA, 15 bp, Homo sapiens
taaataaatcacagt

SEQ ID NO: 443396 - DNA, 15 bp, Homo sapiens
aaataaatcacagta

SEQ ID NO: 443397 - DNA, 15 bp, Homo sapiens
aataaatcacagtaa

SEQ ID NO: 443398 - DNA, 15 bp, Homo sapiens
ataaatcacagtaat

SEQ ID NO: 443399 - DNA, 15 bp, Homo sapiens
taaatcacagtaatt

SEQ ID NO: 443400 - DNA, 15 bp, Homo sapiens
aaatcacagtaattg

SEQ ID NO: 443401 - DNA, 15 bp, Homo sapiens
aatcacagtaattga

SEQ ID NO: 443402 - DNA, 15 bp, Homo sapiens
atcacagtaattgaa

SEQ ID NO: 443403 - DNA, 15 bp, Homo sapiens
tcacagtaattgaaa

SEQ ID NO: 443404 - DNA, 15 bp, Homo sapiens
cacagtaattgaaac

SEQ ID NO: 443405 - DNA, 15 bp, Homo sapiens
acagtaattgaaacc

SEQ ID NO: 443406 - DNA, 15 bp, Homo sapiens
cagtaattgaaacct

SEQ ID NO: 443407 - DNA, 15 bp, Homo sapiens
agtaattgaaacctg

SEQ ID NO: 443408 - DNA, 15 bp, Homo sapiens
gtaattgaaacctgt

SEQ ID NO: 443409 - DNA, 15 bp, Homo sapiens
taattgaaacctgtg

SEQ ID NO: 443410 - DNA, 15 bp, Homo sapiens
aattgaaacctgtgg

SEQ ID NO: 443411 - DNA, 15 bp, Homo sapiens
attgaaacctgtggt

SEQ ID NO: 443412 - DNA, 15 bp, Homo sapiens
ttgaaacctgtggta

SEQ ID NO: 443413 - DNA, 15 bp, Homo sapiens
tgaaacctgtggtag

SEQ ID NO: 443414 - DNA, 15 bp, Homo sapiens
gaaacctgtggtagg

SEQ ID NO: 443415 - DNA, 15 bp, Homo sapiens
aaacctgtggtaggt

SEQ ID NO: 443416 - DNA, 15 bp, Homo sapiens
aacctgtggtaggtc

SEQ ID NO: 443417 - DNA, 15 bp, Homo sapiens
acctgtggtaggtca

SEQ ID NO: 443418 - DNA, 15 bp, Homo sapiens
cctgtggtaggtcac

SEQ ID NO: 443419 - DNA, 15 bp, Homo sapiens
cacatattcttttgg

SEQ ID NO: 443420 - DNA, 15 bp, Homo sapiens
acatattcttttgga

SEQ ID NO: 443421 - DNA, 15 bp, Homo sapiens
catattcttttggaa

SEQ ID NO: 443422 - DNA, 15 bp, Homo sapiens
atattcttttggaag

SEQ ID NO: 443423 - DNA, 15 bp, Homo sapiens
tattcttttggaagt

SEQ ID NO: 443424 - DNA, 15 bp, Homo sapiens
attcttttggaagtg

SEQ ID NO: 443425 - DNA, 15 bp, Homo sapiens
ttcttttggaagtga

SEQ ID NO: 443426 - DNA, 15 bp, Homo sapiens
tcttttggaagtgaa

SEQ ID NO: 443427 - DNA, 15 bp, Homo sapiens
cttttggaagtgaaa

SEQ ID NO: 443428 - DNA, 15 bp, Homo sapiens
ttttggaagtgaaat

SEQ ID NO: 443429 - DNA, 15 bp, Homo sapiens
tttggaagtgaaata

SEQ ID NO: 443430 - DNA, 15 bp, Homo sapiens
ttggaagtgaaatat

SEQ ID NO: 443431 - DNA, 15 bp, Homo sapiens
tggaagtgaaatatt

SEQ ID NO: 443432 - DNA, 15 bp, Homo sapiens
ggaagtgaaatattg

SEQ ID NO: 443433 - DNA, 15 bp, Homo sapiens
gaagtgaaatattgt

SEQ ID NO: 443434 - DNA, 15 bp, Homo sapiens
aagtgaaatattgtg

SEQ ID NO: 443435 - DNA, 15 bp, Homo sapiens
agtgaaatattgtga

SEQ ID NO: 443436 - DNA, 15 bp, Homo sapiens
gtgaaatattgtgaa

SEQ ID NO: 443437 - DNA, 15 bp, Homo sapiens
tgaaatattgtgaaa

SEQ ID NO: 443438 - DNA, 15 bp, Homo sapiens
gaaatattgtgaaat

SEQ ID NO: 443439 - DNA, 15 bp, Homo sapiens
aaatattgtgaaatt

SEQ ID NO: 443440 - DNA, 15 bp, Homo sapiens
aatattgtgaaattt

SEQ ID NO: 443441 - DNA, 15 bp, Homo sapiens
atattgtgaaattta

SEQ ID NO: 443442 - DNA, 15 bp, Homo sapiens
tattgtgaaatttat

SEQ ID NO: 443443 - DNA, 15 bp, Homo sapiens
attgtgaaatttata

SEQ ID NO: 443444 - DNA, 15 bp, Homo sapiens
ttgtgaaatttatac

SEQ ID NO: 443445 - DNA, 15 bp, Homo sapiens
tgtgaaatttataca

SEQ ID NO: 443446 - DNA, 15 bp, Homo sapiens
gtgaaatttatacac

SEQ ID NO: 443447 - DNA, 15 bp, Homo sapiens
tgaaatttatacaca

SEQ ID NO: 443448 - DNA, 15 bp, Homo sapiens
gaaatttatacacat

SEQ ID NO: 443449 - DNA, 15 bp, Homo sapiens
aaatttatacacatt

SEQ ID NO: 443450 - DNA, 15 bp, Homo sapiens
aatttatacacattt

SEQ ID NO: 443451 - DNA, 15 bp, Homo sapiens
atttatacacatttt

SEQ ID NO: 443452 - DNA, 15 bp, Homo sapiens
tttatacacattttt

SEQ ID NO: 443453 - DNA, 15 bp, Homo sapiens
ttatacacatttttg

SEQ ID NO: 443454 - DNA, 15 bp, Homo sapiens
tatacacatttttgt

SEQ ID NO: 443455 - DNA, 15 bp, Homo sapiens
atacacatttttgta

SEQ ID NO: 443456 - DNA, 15 bp, Homo sapiens
tacacatttttgtaa

SEQ ID NO: 443457 - DNA, 15 bp, Homo sapiens
acacatttttgtaaa

SEQ ID NO: 443458 - DNA, 15 bp, Homo sapiens
cacatttttgtaaaa

SEQ ID NO: 443459 - DNA, 15 bp, Homo sapiens
acatttttgtaaaag

SEQ ID NO: 443460 - DNA, 15 bp, Homo sapiens
catttttgtaaaagt

SEQ ID NO: 443461 - DNA, 15 bp, Homo sapiens
atttttgtaaaagtc

SEQ ID NO: 443462 - DNA, 15 bp, Homo sapiens
tttttgtaaaagtca

SEQ ID NO: 443463 - DNA, 15 bp, Homo sapiens
ttttgtaaaagtcaa

SEQ ID NO: 443464 - DNA, 15 bp, Homo sapiens
tttgtaaaagtcaaa

SEQ ID NO: 443465 - DNA, 15 bp, Homo sapiens
ttgtaaaagtcaaat

SEQ ID NO: 443466 - DNA, 15 bp, Homo sapiens
tgtaaaagtcaaata

SEQ ID NO: 443467 - DNA, 15 bp, Homo sapiens
gtaaaagtcaaatac

SEQ ID NO: 443468 - DNA, 15 bp, Homo sapiens
taaaagtcaaataca

SEQ ID NO: 443469 - DNA, 15 bp, Homo sapiens
aaaagtcaaatacat

SEQ ID NO: 443470 - DNA, 15 bp, Homo sapiens
aaagtcaaatacatg

SEQ ID NO: 443471 - DNA, 15 bp, Homo sapiens
aagtcaaatacatgg

SEQ ID NO: 443472 - DNA, 15 bp, Homo sapiens
agtcaaatacatggc

SEQ ID NO: 443473 - DNA, 15 bp, Homo sapiens
gtcaaatacatggcc

SEQ ID NO: 443474 - DNA, 15 bp, Homo sapiens
tcaaatacatggcct

SEQ ID NO: 443475 - DNA, 15 bp, Homo sapiens
caaatacatggcctt

SEQ ID NO: 443476 - DNA, 15 bp, Homo sapiens
aaatacatggccttg

SEQ ID NO: 443477 - DNA, 15 bp, Homo sapiens
aatacatggccttgt

SEQ ID NO: 443478 - DNA, 15 bp, Homo sapiens
atacatggccttgta

SEQ ID NO: 443479 - DNA, 15 bp, Homo sapiens
tacatggccttgtat

SEQ ID NO: 443480 - DNA, 15 bp, Homo sapiens
acatggccttgtatt

SEQ ID NO: 443481 - DNA, 15 bp, Homo sapiens
catggccttgtatta

SEQ ID NO: 443482 - DNA, 15 bp, Homo sapiens
atggccttgtattat

SEQ ID NO: 443483 - DNA, 15 bp, Homo sapiens
tggccttgtattatc

SEQ ID NO: 443484 - DNA, 15 bp, Homo sapiens
ggccttgtattatct

SEQ ID NO: 443485 - DNA, 15 bp, Homo sapiens
gccttgtattatcta

SEQ ID NO: 443486 - DNA, 15 bp, Homo sapiens
ccttgtattatctaa

SEQ ID NO: 443487 - DNA, 15 bp, Homo sapiens
cttgtattatctaac

SEQ ID NO: 443488 - DNA, 15 bp, Homo sapiens
ttgtattatctaaca

SEQ ID NO: 443489 - DNA, 15 bp, Homo sapiens
tgtattatctaacac

SEQ ID NO: 443490 - DNA, 15 bp, Homo sapiens
gtattatctaacact

SEQ ID NO: 443491 - DNA, 15 bp, Homo sapiens
tattatctaacactg

SEQ ID NO: 443492 - DNA, 15 bp, Homo sapiens
attatctaacactga

SEQ ID NO: 443493 - DNA, 15 bp, Homo sapiens
ttatctaacactgag

SEQ ID NO: 443494 - DNA, 15 bp, Homo sapiens
tatctaacactgaga

SEQ ID NO: 443495 - DNA, 15 bp, Homo sapiens
atctaacactgagaa

SEQ ID NO: 443496 - DNA, 15 bp, Homo sapiens
tctaacactgagaat

SEQ ID NO: 443497 - DNA, 15 bp, Homo sapiens
ctaacactgagaatc

SEQ ID NO: 443498 - DNA, 15 bp, Homo sapiens
taacactgagaatcc

SEQ ID NO: 443499 - DNA, 15 bp, Homo sapiens
aacactgagaatcca

SEQ ID NO: 443500 - DNA, 15 bp, Homo sapiens
acactgagaatccaa

SEQ ID NO: 443501 - DNA, 15 bp, Homo sapiens
cactgagaatccaag

SEQ ID NO: 443502 - DNA, 15 bp, Homo sapiens
actgagaatccaagg

SEQ ID NO: 443503 - DNA, 15 bp, Homo sapiens
ctgagaatccaagga

SEQ ID NO: 443504 - DNA, 15 bp, Homo sapiens
tgagaatccaaggag

SEQ ID NO: 443505 - DNA, 15 bp, Homo sapiens
gagaatccaaggagg

SEQ ID NO: 443506 - DNA, 15 bp, Homo sapiens
agaatccaaggaggt

SEQ ID NO: 443507 - DNA, 15 bp, Homo sapiens
gaatccaaggaggta

SEQ ID NO: 443508 - DNA, 15 bp, Homo sapiens
aatccaaggaggtag

SEQ ID NO: 443509 - DNA, 15 bp, Homo sapiens
atccaaggaggtaga

SEQ ID NO: 443510 - DNA, 15 bp, Homo sapiens
tccaaggaggtagaa

SEQ ID NO: 443511 - DNA, 15 bp, Homo sapiens
ccaaggaggtagaag

SEQ ID NO: 443512 - DNA, 15 bp, Homo sapiens
caaggaggtagaagt

SEQ ID NO: 443513 - DNA, 15 bp, Homo sapiens
aaggaggtagaagtt

SEQ ID NO: 443514 - DNA, 15 bp, Homo sapiens
aggaggtagaagtta

SEQ ID NO: 443515 - DNA, 15 bp, Homo sapiens
ggaggtagaagttat

SEQ ID NO: 443516 - DNA, 15 bp, Homo sapiens
gaggtagaagttatt

SEQ ID NO: 443517 - DNA, 15 bp, Homo sapiens
aggtagaagttattc

SEQ ID NO: 443518 - DNA, 15 bp, Homo sapiens
ggtagaagttattca

SEQ ID NO: 443519 - DNA, 15 bp, Homo sapiens
gtagaagttattcaa

SEQ ID NO: 443520 - DNA, 15 bp, Homo sapiens
tagaagttattcaaa

SEQ ID NO: 443521 - DNA, 15 bp, Homo sapiens
agaagttattcaaat

SEQ ID NO: 443522 - DNA, 15 bp, Homo sapiens
gaagttattcaaatc

SEQ ID NO: 443523 - DNA, 15 bp, Homo sapiens
aagttattcaaatca

SEQ ID NO: 443524 - DNA, 15 bp, Homo sapiens
agttattcaaatcaa

SEQ ID NO: 443525 - DNA, 15 bp, Homo sapiens
gttattcaaatcaaa

SEQ ID NO: 443526 - DNA, 15 bp, Homo sapiens
ttattcaaatcaaaa

SEQ ID NO: 443527 - DNA, 15 bp, Homo sapiens
tattcaaatcaaaac

SEQ ID NO: 443528 - DNA, 15 bp, Homo sapiens
attcaaatcaaaaca

SEQ ID NO: 443529 - DNA, 15 bp, Homo sapiens
ttcaaatcaaaacaa

SEQ ID NO: 443530 - DNA, 15 bp, Homo sapiens
tcaaatcaaaacaat

SEQ ID NO: 443531 - DNA, 15 bp, Homo sapiens
caaatcaaaacaatt

SEQ ID NO: 443532 - DNA, 15 bp, Homo sapiens
aaatcaaaacaatta

SEQ ID NO: 443533 - DNA, 15 bp, Homo sapiens
aatcaaaacaattat

SEQ ID NO: 443534 - DNA, 15 bp, Homo sapiens
atcaaaacaattatt

SEQ ID NO: 443535 - DNA, 15 bp, Homo sapiens
tcaaaacaattatta

SEQ ID NO: 443536 - DNA, 15 bp, Homo sapiens
caaaacaattattaa

SEQ ID NO: 443537 - DNA, 15 bp, Homo sapiens
aaaacaattattaaa

SEQ ID NO: 443538 - DNA, 15 bp, Homo sapiens
aaacaattattaaaa

SEQ ID NO: 443539 - DNA, 15 bp, Homo sapiens
aacaattattaaaat

SEQ ID NO: 443540 - DNA, 15 bp, Homo sapiens
acaattattaaaatg

SEQ ID NO: 443541 - DNA, 15 bp, Homo sapiens
caattattaaaatga

SEQ ID NO: 443542 - DNA, 15 bp, Homo sapiens
aattattaaaatgag

SEQ ID NO: 443543 - DNA, 15 bp, Homo sapiens
attattaaaatgagt

SEQ ID NO: 443544 - DNA, 15 bp, Homo sapiens
ttattaaaatgagtg

SEQ ID NO: 443545 - DNA, 15 bp, Homo sapiens
tattaaaatgagtgg

SEQ ID NO: 443546 - DNA, 15 bp, Homo sapiens
attaaaatgagtggg

SEQ ID NO: 443547 - DNA, 15 bp, Homo sapiens
ttaaaatgagtgggg

SEQ ID NO: 443548 - DNA, 15 bp, Homo sapiens
taaaatgagtgggga

SEQ ID NO: 443549 - DNA, 15 bp, Homo sapiens
aaaatgagtggggaa

SEQ ID NO: 443550 - DNA, 15 bp, Homo sapiens
aaatgagtggggaag

SEQ ID NO: 443551 - DNA, 15 bp, Homo sapiens
aatgagtggggaagt

SEQ ID NO: 443552 - DNA, 15 bp, Homo sapiens
atgagtggggaagtg

SEQ ID NO: 443553 - DNA, 15 bp, Homo sapiens
tgagtggggaagtgt

SEQ ID NO: 443554 - DNA, 15 bp, Homo sapiens
gagtggggaagtgta

SEQ ID NO: 443555 - DNA, 15 bp, Homo sapiens
agtggggaagtgtaa

SEQ ID NO: 443556 - DNA, 15 bp, Homo sapiens
gtggggaagtgtaaa

SEQ ID NO: 443557 - DNA, 15 bp, Homo sapiens
tggggaagtgtaaac

SEQ ID NO: 443558 - DNA, 15 bp, Homo sapiens
ggggaagtgtaaaca

SEQ ID NO: 443559 - DNA, 15 bp, Homo sapiens
gggaagtgtaaacaa

SEQ ID NO: 443560 - DNA, 15 bp, Homo sapiens
ggaagtgtaaacaaa

SEQ ID NO: 443561 - DNA, 15 bp, Homo sapiens
gaagtgtaaacaaag

SEQ ID NO: 443562 - DNA, 15 bp, Homo sapiens
aagtgtaaacaaagt

SEQ ID NO: 443563 - DNA, 15 bp, Homo sapiens
agtgtaaacaaagtc

SEQ ID NO: 443564 - DNA, 15 bp, Homo sapiens
gtgtaaacaaagtcc

SEQ ID NO: 443565 - DNA, 15 bp, Homo sapiens
tgtaaacaaagtccc

SEQ ID NO: 443566 - DNA, 15 bp, Homo sapiens
gtaaacaaagtccca

SEQ ID NO: 443567 - DNA, 15 bp, Homo sapiens
taaacaaagtcccaa

SEQ ID NO: 443568 - DNA, 15 bp, Homo sapiens
aaacaaagtcccaat

SEQ ID NO: 443569 - DNA, 15 bp, Homo sapiens
aacaaagtcccaatt

SEQ ID NO: 443570 - DNA, 15 bp, Homo sapiens
acaaagtcccaatta

SEQ ID NO: 443571 - DNA, 15 bp, Homo sapiens
caaagtcccaattaa

SEQ ID NO: 443572 - DNA, 15 bp, Homo sapiens
aaagtcccaattaat

SEQ ID NO: 443573 - DNA, 15 bp, Homo sapiens
aagtcccaattaata

SEQ ID NO: 443574 - DNA, 15 bp, Homo sapiens
agtcccaattaatac

SEQ ID NO: 443575 - DNA, 15 bp, Homo sapiens
gtcccaattaataca

SEQ ID NO: 443576 - DNA, 15 bp, Homo sapiens
tcccaattaatacat

SEQ ID NO: 443577 - DNA, 15 bp, Homo sapiens
cccaattaatacatt

SEQ ID NO: 443578 - DNA, 15 bp, Homo sapiens
ccaattaatacattt

SEQ ID NO: 443579 - DNA, 15 bp, Homo sapiens
caattaatacattta

SEQ ID NO: 443580 - DNA, 15 bp, Homo sapiens
aattaatacatttaa

SEQ ID NO: 443581 - DNA, 15 bp, Homo sapiens
attaatacatttaat

SEQ ID NO: 443582 - DNA, 15 bp, Homo sapiens
ttaatacatttaata

SEQ ID NO: 443583 - DNA, 15 bp, Homo sapiens
taatacatttaataa

SEQ ID NO: 443584 - DNA, 15 bp, Homo sapiens
aatacatttaataat

SEQ ID NO: 443585 - DNA, 15 bp, Homo sapiens
atacatttaataatt

SEQ ID NO: 443586 - DNA, 15 bp, Homo sapiens
tacatttaataattg

SEQ ID NO: 443587 - DNA, 15 bp, Homo sapiens
acatttaataattgt

SEQ ID NO: 443588 - DNA, 15 bp, Homo sapiens
catttaataattgtt

SEQ ID NO: 443589 - DNA, 15 bp, Homo sapiens
atttaataattgtta

SEQ ID NO: 443590 - DNA, 15 bp, Homo sapiens
tttaataattgttat

SEQ ID NO: 443591 - DNA, 15 bp, Homo sapiens
ttaataattgttatc

SEQ ID NO: 443592 - DNA, 15 bp, Homo sapiens
taataattgttatcc

SEQ ID NO: 443593 - DNA, 15 bp, Homo sapiens
aataattgttatcct

SEQ ID NO: 443594 - DNA, 15 bp, Homo sapiens
ataattgttatcctt

SEQ ID NO: 443595 - DNA, 15 bp, Homo sapiens
taattgttatccttt

SEQ ID NO: 443596 - DNA, 15 bp, Homo sapiens
aattgttatcctttg

SEQ ID NO: 443597 - DNA, 15 bp, Homo sapiens
attgttatcctttgc

SEQ ID NO: 443598 - DNA, 15 bp, Homo sapiens
ttgttatcctttgct

SEQ ID NO: 443599 - DNA, 15 bp, Homo sapiens
tgttatcctttgctg

SEQ ID NO: 443600 - DNA, 15 bp, Homo sapiens
gttatcctttgctgc

SEQ ID NO: 443601 - DNA, 15 bp, Homo sapiens
ttatcctttgctgct

SEQ ID NO: 443602 - DNA, 15 bp, Homo sapiens
tatcctttgctgctt

SEQ ID NO: 443603 - DNA, 15 bp, Homo sapiens
atcctttgctgcttg

SEQ ID NO: 443604 - DNA, 15 bp, Homo sapiens
tcctttgctgcttgg

SEQ ID NO: 443605 - DNA, 15 bp, Homo sapiens
cctttgctgcttgga

SEQ ID NO: 443606 - DNA, 15 bp, Homo sapiens
ctttgctgcttggaa

SEQ ID NO: 443607 - DNA, 15 bp, Homo sapiens
tttgctgcttggaat

SEQ ID NO: 443608 - DNA, 15 bp, Homo sapiens
ttgctgcttggaatc

SEQ ID NO: 443609 - DNA, 15 bp, Homo sapiens
tgctgcttggaatct

SEQ ID NO: 443610 - DNA, 15 bp, Homo sapiens
gctgcttggaatctt

SEQ ID NO: 443611 - DNA, 15 bp, Homo sapiens
ctgcttggaatcttt

SEQ ID NO: 443612 - DNA, 15 bp, Homo sapiens
tgcttggaatctttg

SEQ ID NO: 443613 - DNA, 15 bp, Homo sapiens
gcttggaatctttgg

SEQ ID NO: 443614 - DNA, 15 bp, Homo sapiens
cttggaatctttggc

SEQ ID NO: 443615 - DNA, 15 bp, Homo sapiens
ttggaatctttggct

SEQ ID NO: 443616 - DNA, 15 bp, Homo sapiens
tggaatctttggctt

SEQ ID NO: 443617 - DNA, 15 bp, Homo sapiens
ggaatctttggcttt

SEQ ID NO: 443618 - DNA, 15 bp, Homo sapiens
gaatctttggcttta

SEQ ID NO: 443619 - DNA, 15 bp, Homo sapiens
aatctttggctttat

SEQ ID NO: 443620 - DNA, 15 bp, Homo sapiens
atctttggctttatt

SEQ ID NO: 443621 - DNA, 15 bp, Homo sapiens
tctttggctttatta

SEQ ID NO: 443622 - DNA, 15 bp, Homo sapiens
ctttggctttattat

SEQ ID NO: 443623 - DNA, 15 bp, Homo sapiens
tttggctttattata

SEQ ID NO: 443624 - DNA, 15 bp, Homo sapiens
ttggctttattatat

SEQ ID NO: 443625 - DNA, 15 bp, Homo sapiens
tggctttattatatt

SEQ ID NO: 443626 - DNA, 15 bp, Homo sapiens
ggctttattatattt

SEQ ID NO: 443627 - DNA, 15 bp, Homo sapiens
gctttattatatttc

SEQ ID NO: 443628 - DNA, 15 bp, Homo sapiens
ctttattatatttct

SEQ ID NO: 443629 - DNA, 15 bp, Homo sapiens
tttattatatttctt

SEQ ID NO: 443630 - DNA, 15 bp, Homo sapiens
ttattatatttcttg

SEQ ID NO: 443631 - DNA, 15 bp, Homo sapiens
tattatatttcttgg

SEQ ID NO: 443632 - DNA, 15 bp, Homo sapiens
attatatttcttgga

SEQ ID NO: 443633 - DNA, 15 bp, Homo sapiens
ttatatttcttggac

SEQ ID NO: 443634 - DNA, 15 bp, Homo sapiens
tatatttcttggact

SEQ ID NO: 443635 - DNA, 15 bp, Homo sapiens
atatttcttggactt

SEQ ID NO: 443636 - DNA, 15 bp, Homo sapiens
tatttcttggacttc

SEQ ID NO: 443637 - DNA, 15 bp, Homo sapiens
atttcttggacttca

SEQ ID NO: 443638 - DNA, 15 bp, Homo sapiens
tttcttggacttcag

SEQ ID NO: 443639 - DNA, 15 bp, Homo sapiens
ttcttggacttcagc

SEQ ID NO: 443640 - DNA, 15 bp, Homo sapiens
tcttggacttcagcc

SEQ ID NO: 443641 - DNA, 15 bp, Homo sapiens
cttggacttcagcca

SEQ ID NO: 443642 - DNA, 15 bp, Homo sapiens
ttggacttcagccat

SEQ ID NO: 443643 - DNA, 15 bp, Homo sapiens
tggacttcagccatg

SEQ ID NO: 443644 - DNA, 15 bp, Homo sapiens
ggacttcagccatgg

SEQ ID NO: 443645 - DNA, 15 bp, Homo sapiens
gacttcagccatggt

SEQ ID NO: 443646 - DNA, 15 bp, Homo sapiens
acttcagccatggtt

SEQ ID NO: 443647 - DNA, 15 bp, Homo sapiens
cttcagccatggtta

SEQ ID NO: 443648 - DNA, 15 bp, Homo sapiens
ttcagccatggttat

SEQ ID NO: 443649 - DNA, 15 bp, Homo sapiens
tcagccatggttata

SEQ ID NO: 443650 - DNA, 15 bp, Homo sapiens
cagccatggttataa

SEQ ID NO: 443651 - DNA, 15 bp, Homo sapiens
agccatggttataaa

SEQ ID NO: 443652 - DNA, 15 bp, Homo sapiens
gccatggttataaaa

SEQ ID NO: 443653 - DNA, 15 bp, Homo sapiens
ccatggttataaaag

SEQ ID NO: 443654 - DNA, 15 bp, Homo sapiens
catggttataaaaga

SEQ ID NO: 443655 - DNA, 15 bp, Homo sapiens
atggttataaaagaa

SEQ ID NO: 443656 - DNA, 15 bp, Homo sapiens
tggttataaaagaag

SEQ ID NO: 443657 - DNA, 15 bp, Homo sapiens
ggttataaaagaagc

SEQ ID NO: 443658 - DNA, 15 bp, Homo sapiens
gttataaaagaagcc

SEQ ID NO: 443659 - DNA, 15 bp, Homo sapiens
ttataaaagaagcct

SEQ ID NO: 443660 - DNA, 15 bp, Homo sapiens
tataaaagaagcctg

SEQ ID NO: 443661 - DNA, 15 bp, Homo sapiens
ataaaagaagcctgt

SEQ ID NO: 443662 - DNA, 15 bp, Homo sapiens
taaaagaagcctgtt

SEQ ID NO: 443663 - DNA, 15 bp, Homo sapiens
aaaagaagcctgttt

SEQ ID NO: 443664 - DNA, 15 bp, Homo sapiens
aaagaagcctgttta

SEQ ID NO: 443665 - DNA, 15 bp, Homo sapiens
aagaagcctgtttag

SEQ ID NO: 443666 - DNA, 15 bp, Homo sapiens
agaagcctgtttagt

SEQ ID NO: 443667 - DNA, 15 bp, Homo sapiens
gaagcctgtttagtt

SEQ ID NO: 443668 - DNA, 15 bp, Homo sapiens
aagcctgtttagtta

SEQ ID NO: 443669 - DNA, 15 bp, Homo sapiens
agcctgtttagttag

SEQ ID NO: 443670 - DNA, 15 bp, Homo sapiens
gcctgtttagttagg

SEQ ID NO: 443671 - DNA, 15 bp, Homo sapiens
cctgtttagttaggc

SEQ ID NO: 443672 - DNA, 15 bp, Homo sapiens
ctgtttagttaggca

SEQ ID NO: 443673 - DNA, 15 bp, Homo sapiens
tgtttagttaggcac

SEQ ID NO: 443674 - DNA, 15 bp, Homo sapiens
gtttagttaggcaca

SEQ ID NO: 443675 - DNA, 15 bp, Homo sapiens
tttagttaggcacaa

SEQ ID NO: 443676 - DNA, 15 bp, Homo sapiens
ttagttaggcacaaa

SEQ ID NO: 443677 - DNA, 15 bp, Homo sapiens
tagttaggcacaaaa

SEQ ID NO: 443678 - DNA, 15 bp, Homo sapiens
agttaggcacaaaat

SEQ ID NO: 443679 - DNA, 15 bp, Homo sapiens
gttaggcacaaaata

SEQ ID NO: 443680 - DNA, 15 bp, Homo sapiens
ttaggcacaaaataa

SEQ ID NO: 443681 - DNA, 15 bp, Homo sapiens
taggcacaaaataaa

SEQ ID NO: 443682 - DNA, 15 bp, Homo sapiens
aggcacaaaataaaa

SEQ ID NO: 443683 - DNA, 15 bp, Homo sapiens
ggcacaaaataaaaa

SEQ ID NO: 443684 - DNA, 15 bp, Homo sapiens
gcacaaaataaaaac

SEQ ID NO: 443685 - DNA, 15 bp, Homo sapiens
cacaaaataaaaact

SEQ ID NO: 443686 - DNA, 15 bp, Homo sapiens
acaaaataaaaactg

SEQ ID NO: 443687 - DNA, 15 bp, Homo sapiens
caaaataaaaactga

SEQ ID NO: 443688 - DNA, 15 bp, Homo sapiens
aaaataaaaactgac

SEQ ID NO: 443689 - DNA, 15 bp, Homo sapiens
aaataaaaactgacc

SEQ ID NO: 443690 - DNA, 15 bp, Homo sapiens
aataaaaactgacct

SEQ ID NO: 443691 - DNA, 15 bp, Homo sapiens
ataaaaactgaccta

SEQ ID NO: 443692 - DNA, 15 bp, Homo sapiens
taaaaactgacctat

SEQ ID NO: 443693 - DNA, 15 bp, Homo sapiens
aaaaactgacctatt

SEQ ID NO: 443694 - DNA, 15 bp, Homo sapiens
aaaactgacctatta

SEQ ID NO: 443695 - DNA, 15 bp, Homo sapiens
aaactgacctattag

SEQ ID NO: 443696 - DNA, 15 bp, Homo sapiens
aactgacctattagc

SEQ ID NO: 443697 - DNA, 15 bp, Homo sapiens
actgacctattagcc

SEQ ID NO: 443698 - DNA, 15 bp, Homo sapiens
ctgacctattagcct

SEQ ID NO: 443699 - DNA, 15 bp, Homo sapiens
tgacctattagcctg

SEQ ID NO: 443700 - DNA, 15 bp, Homo sapiens
gacctattagcctgg

SEQ ID NO: 443701 - DNA, 15 bp, Homo sapiens
acctattagcctggt

SEQ ID NO: 443702 - DNA, 15 bp, Homo sapiens
cctattagcctggtg

SEQ ID NO: 443703 - DNA, 15 bp, Homo sapiens
ctattagcctggtgc

SEQ ID NO: 443704 - DNA, 15 bp, Homo sapiens
tattagcctggtgcc

SEQ ID NO: 443705 - DNA, 15 bp, Homo sapiens
attagcctggtgcca

SEQ ID NO: 443706 - DNA, 15 bp, Homo sapiens
ttagcctggtgccaa

SEQ ID NO: 443707 - DNA, 15 bp, Homo sapiens
tagcctggtgccaac

SEQ ID NO: 443708 - DNA, 15 bp, Homo sapiens
agcctggtgccaaca

SEQ ID NO: 443709 - DNA, 15 bp, Homo sapiens
gcctggtgccaacac

SEQ ID NO: 443710 - DNA, 15 bp, Homo sapiens
cctggtgccaacact

SEQ ID NO: 443711 - DNA, 15 bp, Homo sapiens
ctggtgccaacactg

SEQ ID NO: 443712 - DNA, 15 bp, Homo sapiens
tggtgccaacactga

SEQ ID NO: 443713 - DNA, 15 bp, Homo sapiens
ggtgccaacactgaa

SEQ ID NO: 443714 - DNA, 15 bp, Homo sapiens
gtgccaacactgaaa

SEQ ID NO: 443715 - DNA, 15 bp, Homo sapiens
tgccaacactgaaat

SEQ ID NO: 443716 - DNA, 15 bp, Homo sapiens
gccaacactgaaatg

SEQ ID NO: 443717 - DNA, 15 bp, Homo sapiens
ccaacactgaaatga

SEQ ID NO: 443718 - DNA, 15 bp, Homo sapiens
caacactgaaatgag

SEQ ID NO: 443719 - DNA, 15 bp, Homo sapiens
aacactgaaatgagg

SEQ ID NO: 443720 - DNA, 15 bp, Homo sapiens
acactgaaatgaggt

SEQ ID NO: 443721 - DNA, 15 bp, Homo sapiens
cactgaaatgaggtt

SEQ ID NO: 443722 - DNA, 15 bp, Homo sapiens
actgaaatgaggttg

SEQ ID NO: 443723 - DNA, 15 bp, Homo sapiens
ctgaaatgaggttgg

SEQ ID NO: 443724 - DNA, 15 bp, Homo sapiens
tgaaatgaggttggc

SEQ ID NO: 443725 - DNA, 15 bp, Homo sapiens
gaaatgaggttggct

SEQ ID NO: 443726 - DNA, 15 bp, Homo sapiens
aaatgaggttggctc

SEQ ID NO: 443727 - DNA, 15 bp, Homo sapiens
aatgaggttggctct

SEQ ID NO: 443728 - DNA, 15 bp, Homo sapiens
atgaggttggctcta

SEQ ID NO: 443729 - DNA, 15 bp, Homo sapiens
tgaggttggctctaa

SEQ ID NO: 443730 - DNA, 15 bp, Homo sapiens
gaggttggctctaat

SEQ ID NO: 443731 - DNA, 15 bp, Homo sapiens
aggttggctctaatg

SEQ ID NO: 443732 - DNA, 15 bp, Homo sapiens
ggttggctctaatga

SEQ ID NO: 443733 - DNA, 15 bp, Homo sapiens
gttggctctaatgag

SEQ ID NO: 443734 - DNA, 15 bp, Homo sapiens
ttggctctaatgaga

SEQ ID NO: 443735 - DNA, 15 bp, Homo sapiens
tggctctaatgagaa

SEQ ID NO: 443736 - DNA, 15 bp, Homo sapiens
ggctctaatgagaaa

SEQ ID NO: 443737 - DNA, 15 bp, Homo sapiens
gctctaatgagaaat

SEQ ID NO: 443738 - DNA, 15 bp, Homo sapiens
ctctaatgagaaatg

SEQ ID NO: 443739 - DNA, 15 bp, Homo sapiens
tctaatgagaaatgt

SEQ ID NO: 443740 - DNA, 15 bp, Homo sapiens
ctaatgagaaatgta

SEQ ID NO: 443741 - DNA, 15 bp, Homo sapiens
taatgagaaatgtaa

SEQ ID NO: 443742 - DNA, 15 bp, Homo sapiens
aatgagaaatgtaac

SEQ ID NO: 443743 - DNA, 15 bp, Homo sapiens
atgagaaatgtaaca

SEQ ID NO: 443744 - DNA, 15 bp, Homo sapiens
tgagaaatgtaacat

SEQ ID NO: 443745 - DNA, 15 bp, Homo sapiens
gagaaatgtaacata

SEQ ID NO: 443746 - DNA, 15 bp, Homo sapiens
agaaatgtaacatac

SEQ ID NO: 443747 - DNA, 15 bp, Homo sapiens
gaaatgtaacatacc

SEQ ID NO: 443748 - DNA, 15 bp, Homo sapiens
aaatgtaacatacct

SEQ ID NO: 443749 - DNA, 15 bp, Homo sapiens
aatgtaacataccta

SEQ ID NO: 443750 - DNA, 15 bp, Homo sapiens
atgtaacatacctac

SEQ ID NO: 443751 - DNA, 15 bp, Homo sapiens
tgtaacatacctact

SEQ ID NO: 443752 - DNA, 15 bp, Homo sapiens
gtaacatacctactt

SEQ ID NO: 443753 - DNA, 15 bp, Homo sapiens
taacatacctacttc

SEQ ID NO: 443754 - DNA, 15 bp, Homo sapiens
aacatacctacttcc

SEQ ID NO: 443755 - DNA, 15 bp, Homo sapiens
acatacctacttcct

SEQ ID NO: 443756 - DNA, 15 bp, Homo sapiens
catacctacttcctc

SEQ ID NO: 443757 - DNA, 15 bp, Homo sapiens
atacctacttcctca

SEQ ID NO: 443758 - DNA, 15 bp, Homo sapiens
tacctacttcctcat

SEQ ID NO: 443759 - DNA, 15 bp, Homo sapiens
acctacttcctcatt

SEQ ID NO: 443760 - DNA, 15 bp, Homo sapiens
cctacttcctcattt

SEQ ID NO: 443761 - DNA, 15 bp, Homo sapiens
ctacttcctcatttt

SEQ ID NO: 443762 - DNA, 15 bp, Homo sapiens
tacttcctcattttc

SEQ ID NO: 443763 - DNA, 15 bp, Homo sapiens
acttcctcattttca

SEQ ID NO: 443764 - DNA, 15 bp, Homo sapiens
cttcctcattttcat

SEQ ID NO: 443765 - DNA, 15 bp, Homo sapiens
ttcctcattttcatc

SEQ ID NO: 443766 - DNA, 15 bp, Homo sapiens
tcctcattttcatcc

SEQ ID NO: 443767 - DNA, 15 bp, Homo sapiens
cctcattttcatccc

SEQ ID NO: 443768 - DNA, 15 bp, Homo sapiens
ctcattttcatccct

SEQ ID NO: 443769 - DNA, 15 bp, Homo sapiens
tcattttcatccctg

SEQ ID NO: 443770 - DNA, 15 bp, Homo sapiens
cattttcatccctgt

SEQ ID NO: 443771 - DNA, 15 bp, Homo sapiens
attttcatccctgtt

SEQ ID NO: 443772 - DNA, 15 bp, Homo sapiens
ttttcatccctgttt

SEQ ID NO: 443773 - DNA, 15 bp, Homo sapiens
tttcatccctgttta

SEQ ID NO: 443774 - DNA, 15 bp, Homo sapiens
ttcatccctgtttat

SEQ ID NO: 443775 - DNA, 15 bp, Homo sapiens
tcatccctgtttata

SEQ ID NO: 443776 - DNA, 15 bp, Homo sapiens
catccctgtttatac

SEQ ID NO: 443777 - DNA, 15 bp, Homo sapiens
atccctgtttatact

SEQ ID NO: 443778 - DNA, 15 bp, Homo sapiens
tccctgtttatactt

SEQ ID NO: 443779 - DNA, 15 bp, Homo sapiens
ccctgtttatacttt

SEQ ID NO: 443780 - DNA, 15 bp, Homo sapiens
cctgtttatactttg

SEQ ID NO: 443781 - DNA, 15 bp, Homo sapiens
ctgtttatactttgg

SEQ ID NO: 443782 - DNA, 15 bp, Homo sapiens
tgtttatactttggt

SEQ ID NO: 443783 - DNA, 15 bp, Homo sapiens
gtttatactttggtg

SEQ ID NO: 443784 - DNA, 15 bp, Homo sapiens
tttatactttggtgg

SEQ ID NO: 443785 - DNA, 15 bp, Homo sapiens
ttatactttggtggg

SEQ ID NO: 443786 - DNA, 15 bp, Homo sapiens
tatactttggtgggc

SEQ ID NO: 443787 - DNA, 15 bp, Homo sapiens
atactttggtgggca

SEQ ID NO: 443788 - DNA, 15 bp, Homo sapiens
tactttggtgggcat

SEQ ID NO: 443789 - DNA, 15 bp, Homo sapiens
actttggtgggcata

SEQ ID NO: 443790 - DNA, 15 bp, Homo sapiens
ctttggtgggcatag

SEQ ID NO: 443791 - DNA, 15 bp, Homo sapiens
tttggtgggcataga

SEQ ID NO: 443792 - DNA, 15 bp, Homo sapiens
ttggtgggcatagat

SEQ ID NO: 443793 - DNA, 15 bp, Homo sapiens
tggtgggcatagatt

SEQ ID NO: 443794 - DNA, 15 bp, Homo sapiens
ggtgggcatagattg

SEQ ID NO: 443795 - DNA, 15 bp, Homo sapiens
gtgggcatagattga

SEQ ID NO: 443796 - DNA, 15 bp, Homo sapiens
tgggcatagattgag

SEQ ID NO: 443797 - DNA, 15 bp, Homo sapiens
gggcatagattgaga

SEQ ID NO: 443798 - DNA, 15 bp, Homo sapiens
ggcatagattgagaa

SEQ ID NO: 443799 - DNA, 15 bp, Homo sapiens
gcatagattgagaac

SEQ ID NO: 443800 - DNA, 15 bp, Homo sapiens
catagattgagaaca

SEQ ID NO: 443801 - DNA, 15 bp, Homo sapiens
atagattgagaacag

SEQ ID NO: 443802 - DNA, 15 bp, Homo sapiens
tagattgagaacaga

SEQ ID NO: 443803 - DNA, 15 bp, Homo sapiens
agattgagaacagag

SEQ ID NO: 443804 - DNA, 15 bp, Homo sapiens
gattgagaacagagt

SEQ ID NO: 443805 - DNA, 15 bp, Homo sapiens
attgagaacagagtg

SEQ ID NO: 443806 - DNA, 15 bp, Homo sapiens
ttgagaacagagtgc

SEQ ID NO: 443807 - DNA, 15 bp, Homo sapiens
tgagaacagagtgct

SEQ ID NO: 443808 - DNA, 15 bp, Homo sapiens
gagaacagagtgctt

SEQ ID NO: 443809 - DNA, 15 bp, Homo sapiens
agaacagagtgcttg

SEQ ID NO: 443810 - DNA, 15 bp, Homo sapiens
gaacagagtgcttgc

SEQ ID NO: 443811 - DNA, 15 bp, Homo sapiens
aacagagtgcttgcc

SEQ ID NO: 443812 - DNA, 15 bp, Homo sapiens
acagagtgcttgcct

SEQ ID NO: 443813 - DNA, 15 bp, Homo sapiens
cagagtgcttgcctt

SEQ ID NO: 443814 - DNA, 15 bp, Homo sapiens
agagtgcttgccttt

SEQ ID NO: 443815 - DNA, 15 bp, Homo sapiens
gagtgcttgcctttt

SEQ ID NO: 443816 - DNA, 15 bp, Homo sapiens
agtgcttgcctttta

SEQ ID NO: 443817 - DNA, 15 bp, Homo sapiens
gtgcttgccttttat

SEQ ID NO: 443818 - DNA, 15 bp, Homo sapiens
tgcttgccttttata

SEQ ID NO: 443819 - DNA, 15 bp, Homo sapiens
gcttgccttttataa

SEQ ID NO: 443820 - DNA, 15 bp, Homo sapiens
cttgccttttataaa

SEQ ID NO: 443821 - DNA, 15 bp, Homo sapiens
ttgccttttataaag

SEQ ID NO: 443822 - DNA, 15 bp, Homo sapiens
tgccttttataaaga

SEQ ID NO: 443823 - DNA, 15 bp, Homo sapiens
gccttttataaagag

SEQ ID NO: 443824 - DNA, 15 bp, Homo sapiens
ccttttataaagaga

SEQ ID NO: 443825 - DNA, 15 bp, Homo sapiens
cttttataaagagag

SEQ ID NO: 443826 - DNA, 15 bp, Homo sapiens
ttttataaagagagg

SEQ ID NO: 443827 - DNA, 15 bp, Homo sapiens
tttataaagagagga

SEQ ID NO: 443828 - DNA, 15 bp, Homo sapiens
ttataaagagaggag

SEQ ID NO: 443829 - DNA, 15 bp, Homo sapiens
tataaagagaggagg

SEQ ID NO: 443830 - DNA, 15 bp, Homo sapiens
ataaagagaggagga

SEQ ID NO: 443831 - DNA, 15 bp, Homo sapiens
taaagagaggaggaa

SEQ ID NO: 443832 - DNA, 15 bp, Homo sapiens
aaagagaggaggaat

SEQ ID NO: 443833 - DNA, 15 bp, Homo sapiens
aagagaggaggaatt

SEQ ID NO: 443834 - DNA, 15 bp, Homo sapiens
agagaggaggaattg

SEQ ID NO: 443835 - DNA, 15 bp, Homo sapiens
gagaggaggaattgt

SEQ ID NO: 443836 - DNA, 15 bp, Homo sapiens
agaggaggaattgtt

SEQ ID NO: 443837 - DNA, 15 bp, Homo sapiens
gaggaggaattgttg

SEQ ID NO: 443838 - DNA, 15 bp, Homo sapiens
aggaggaattgttga

SEQ ID NO: 443839 - DNA, 15 bp, Homo sapiens
ggaggaattgttgag

SEQ ID NO: 443840 - DNA, 15 bp, Homo sapiens
gaggaattgttgagt

SEQ ID NO: 443841 - DNA, 15 bp, Homo sapiens
aggaattgttgagta

SEQ ID NO: 443842 - DNA, 15 bp, Homo sapiens
ggaattgttgagtag

SEQ ID NO: 443843 - DNA, 15 bp, Homo sapiens
gaattgttgagtaga

SEQ ID NO: 443844 - DNA, 15 bp, Homo sapiens
aattgttgagtagaa

SEQ ID NO: 443845 - DNA, 15 bp, Homo sapiens
attgttgagtagaag

SEQ ID NO: 443846 - DNA, 15 bp, Homo sapiens
ttgttgagtagaaga

SEQ ID NO: 443847 - DNA, 15 bp, Homo sapiens
tgttgagtagaagaa

SEQ ID NO: 443848 - DNA, 15 bp, Homo sapiens
gttgagtagaagaat

SEQ ID NO: 443849 - DNA, 15 bp, Homo sapiens
ttgagtagaagaatt

SEQ ID NO: 443850 - DNA, 15 bp, Homo sapiens
tgagtagaagaattg

SEQ ID NO: 443851 - DNA, 15 bp, Homo sapiens
gagtagaagaattgc

SEQ ID NO: 443852 - DNA, 15 bp, Homo sapiens
agtagaagaattgct

SEQ ID NO: 443853 - DNA, 15 bp, Homo sapiens
gtagaagaattgctc

SEQ ID NO: 443854 - DNA, 15 bp, Homo sapiens
tagaagaattgctca

SEQ ID NO: 443855 - DNA, 15 bp, Homo sapiens
agaagaattgctcag

SEQ ID NO: 443856 - DNA, 15 bp, Homo sapiens
gaagaattgctcagc

SEQ ID NO: 443857 - DNA, 15 bp, Homo sapiens
aagaattgctcagct

SEQ ID NO: 443858 - DNA, 15 bp, Homo sapiens
agaattgctcagcta

SEQ ID NO: 443859 - DNA, 15 bp, Homo sapiens
gaattgctcagctag

SEQ ID NO: 443860 - DNA, 15 bp, Homo sapiens
aattgctcagctagt

SEQ ID NO: 443861 - DNA, 15 bp, Homo sapiens
attgctcagctagtg

SEQ ID NO: 443862 - DNA, 15 bp, Homo sapiens
ttgctcagctagtgt

SEQ ID NO: 443863 - DNA, 15 bp, Homo sapiens
tgctcagctagtgtt

SEQ ID NO: 443864 - DNA, 15 bp, Homo sapiens
gctcagctagtgttc

SEQ ID NO: 443865 - DNA, 15 bp, Homo sapiens
ctcagctagtgttca

SEQ ID NO: 443866 - DNA, 15 bp, Homo sapiens
tcagctagtgttcag

SEQ ID NO: 443867 - DNA, 15 bp, Homo sapiens
cagctagtgttcaga

SEQ ID NO: 443868 - DNA, 15 bp, Homo sapiens
agctagtgttcagaa

SEQ ID NO: 443869 - DNA, 15 bp, Homo sapiens
gctagtgttcagaaa

SEQ ID NO: 443870 - DNA, 15 bp, Homo sapiens
ctagtgttcagaaat

SEQ ID NO: 443871 - DNA, 15 bp, Homo sapiens
tagtgttcagaaatt

SEQ ID NO: 443872 - DNA, 15 bp, Homo sapiens
agtgttcagaaattg

SEQ ID NO: 443873 - DNA, 15 bp, Homo sapiens
gtgttcagaaattga

SEQ ID NO: 443874 - DNA, 15 bp, Homo sapiens
tgttcagaaattgag

SEQ ID NO: 443875 - DNA, 15 bp, Homo sapiens
gttcagaaattgaga

SEQ ID NO: 443876 - DNA, 15 bp, Homo sapiens
ttcagaaattgagat

SEQ ID NO: 443877 - DNA, 15 bp, Homo sapiens
tcagaaattgagatc

SEQ ID NO: 443878 - DNA, 15 bp, Homo sapiens
cagaaattgagatca

SEQ ID NO: 443879 - DNA, 15 bp, Homo sapiens
agaaattgagatcac

SEQ ID NO: 443880 - DNA, 15 bp, Homo sapiens
gaaattgagatcaca

SEQ ID NO: 443881 - DNA, 15 bp, Homo sapiens
aaattgagatcacat

SEQ ID NO: 443882 - DNA, 15 bp, Homo sapiens
aattgagatcacatc

SEQ ID NO: 443883 - DNA, 15 bp, Homo sapiens
attgagatcacatct

SEQ ID NO: 443884 - DNA, 15 bp, Homo sapiens
ttgagatcacatctg

SEQ ID NO: 443885 - DNA, 15 bp, Homo sapiens
tgagatcacatctga

SEQ ID NO: 443886 - DNA, 15 bp, Homo sapiens
gagatcacatctgag

SEQ ID NO: 443887 - DNA, 15 bp, Homo sapiens
agatcacatctgagc

SEQ ID NO: 443888 - DNA, 15 bp, Homo sapiens
gatcacatctgagct

SEQ ID NO: 443889 - DNA, 15 bp, Homo sapiens
atcacatctgagctc

SEQ ID NO: 443890 - DNA, 15 bp, Homo sapiens
tcacatctgagctcg

SEQ ID NO: 443891 - DNA, 15 bp, Homo sapiens
cacatctgagctcga

SEQ ID NO: 443892 - DNA, 15 bp, Homo sapiens
acatctgagctcgac

SEQ ID NO: 443893 - DNA, 15 bp, Homo sapiens
catctgagctcgacc

SEQ ID NO: 443894 - DNA, 15 bp, Homo sapiens
atctgagctcgaccg

SEQ ID NO: 443895 - DNA, 15 bp, Homo sapiens
tctgagctcgaccgt

SEQ ID NO: 443896 - DNA, 15 bp, Homo sapiens
ctgagctcgaccgtt

SEQ ID NO: 443897 - DNA, 15 bp, Homo sapiens
tgagctcgaccgttt

SEQ ID NO: 443898 - DNA, 15 bp, Homo sapiens
gagctcgaccgttta

SEQ ID NO: 443899 - DNA, 15 bp, Homo sapiens
agctcgaccgtttat

SEQ ID NO: 443900 - DNA, 15 bp, Homo sapiens
gctcgaccgtttatt

SEQ ID NO: 443901 - DNA, 15 bp, Homo sapiens
ctcgaccgtttattt

SEQ ID NO: 443902 - DNA, 15 bp, Homo sapiens
tcgaccgtttattta

SEQ ID NO: 443903 - DNA, 15 bp, Homo sapiens
cgaccgtttatttac

SEQ ID NO: 443904 - DNA, 15 bp, Homo sapiens
gaccgtttatttact

SEQ ID NO: 443905 - DNA, 15 bp, Homo sapiens
accgtttatttactg

SEQ ID NO: 443906 - DNA, 15 bp, Homo sapiens
ccgtttatttactgg

SEQ ID NO: 443907 - DNA, 15 bp, Homo sapiens
cgtttatttactggc

SEQ ID NO: 443908 - DNA, 15 bp, Homo sapiens
gtttatttactggct

SEQ ID NO: 443909 - DNA, 15 bp, Homo sapiens
tttatttactggctg

SEQ ID NO: 443910 - DNA, 15 bp, Homo sapiens
ttatttactggctgt

SEQ ID NO: 443911 - DNA, 15 bp, Homo sapiens
tatttactggctgtc

SEQ ID NO: 443912 - DNA, 15 bp, Homo sapiens
atttactggctgtca

SEQ ID NO: 443913 - DNA, 15 bp, Homo sapiens
tttactggctgtcac

SEQ ID NO: 443914 - DNA, 15 bp, Homo sapiens
ttactggctgtcact

SEQ ID NO: 443915 - DNA, 15 bp, Homo sapiens
tactggctgtcactc

SEQ ID NO: 443916 - DNA, 15 bp, Homo sapiens
actggctgtcactct

SEQ ID NO: 443917 - DNA, 15 bp, Homo sapiens
ctggctgtcactctt

SEQ ID NO: 443918 - DNA, 15 bp, Homo sapiens
tggctgtcactcttt

SEQ ID NO: 443919 - DNA, 15 bp, Homo sapiens
ggctgtcactctttg

SEQ ID NO: 443920 - DNA, 15 bp, Homo sapiens
gctgtcactctttgg

SEQ ID NO: 443921 - DNA, 15 bp, Homo sapiens
ctgtcactctttggg

SEQ ID NO: 443922 - DNA, 15 bp, Homo sapiens
tgtcactctttgggc

SEQ ID NO: 443923 - DNA, 15 bp, Homo sapiens
gtcactctttgggca

SEQ ID NO: 443924 - DNA, 15 bp, Homo sapiens
tcactctttgggcaa

SEQ ID NO: 443925 - DNA, 15 bp, Homo sapiens
cactctttgggcaag

SEQ ID NO: 443926 - DNA, 15 bp, Homo sapiens
actctttgggcaagt

SEQ ID NO: 443927 - DNA, 15 bp, Homo sapiens
ctctttgggcaagtt

SEQ ID NO: 443928 - DNA, 15 bp, Homo sapiens
tctttgggcaagtta

SEQ ID NO: 443929 - DNA, 15 bp, Homo sapiens
ctttgggcaagttat

SEQ ID NO: 443930 - DNA, 15 bp, Homo sapiens
tttgggcaagttatt

SEQ ID NO: 443931 - DNA, 15 bp, Homo sapiens
ttgggcaagttattt

SEQ ID NO: 443932 - DNA, 15 bp, Homo sapiens
tgggcaagttatttt

SEQ ID NO: 443933 - DNA, 15 bp, Homo sapiens
gggcaagttatttta

SEQ ID NO: 443934 - DNA, 15 bp, Homo sapiens
ggcaagttattttat

SEQ ID NO: 443935 - DNA, 15 bp, Homo sapiens
gcaagttattttatc

SEQ ID NO: 443936 - DNA, 15 bp, Homo sapiens
caagttattttatct

SEQ ID NO: 443937 - DNA, 15 bp, Homo sapiens
aagttattttatctc

SEQ ID NO: 443938 - DNA, 15 bp, Homo sapiens
agttattttatctct

SEQ ID NO: 443939 - DNA, 15 bp, Homo sapiens
gttattttatctcta

SEQ ID NO: 443940 - DNA, 15 bp, Homo sapiens
ttattttatctctac

SEQ ID NO: 443941 - DNA, 15 bp, Homo sapiens
tattttatctctaca

SEQ ID NO: 443942 - DNA, 15 bp, Homo sapiens
attttatctctacac

SEQ ID NO: 443943 - DNA, 15 bp, Homo sapiens
ttttatctctacaca

SEQ ID NO: 443944 - DNA, 15 bp, Homo sapiens
tttatctctacacat

SEQ ID NO: 443945 - DNA, 15 bp, Homo sapiens
ttatctctacacatt

SEQ ID NO: 443946 - DNA, 15 bp, Homo sapiens
tatctctacacattt

SEQ ID NO: 443947 - DNA, 15 bp, Homo sapiens
atctctacacattta

SEQ ID NO: 443948 - DNA, 15 bp, Homo sapiens
tctctacacatttag

SEQ ID NO: 443949 - DNA, 15 bp, Homo sapiens
ctctacacatttagt

SEQ ID NO: 443950 - DNA, 15 bp, Homo sapiens
tctacacatttagtt

SEQ ID NO: 443951 - DNA, 15 bp, Homo sapiens
ctacacatttagttc

SEQ ID NO: 443952 - DNA, 15 bp, Homo sapiens
tacacatttagttcc

SEQ ID NO: 443953 - DNA, 15 bp, Homo sapiens
acacatttagttcct

SEQ ID NO: 443954 - DNA, 15 bp, Homo sapiens
cacatttagttcctc

SEQ ID NO: 443955 - DNA, 15 bp, Homo sapiens
acatttagttcctca

SEQ ID NO: 443956 - DNA, 15 bp, Homo sapiens
catttagttcctcat

SEQ ID NO: 443957 - DNA, 15 bp, Homo sapiens
atttagttcctcatc

SEQ ID NO: 443958 - DNA, 15 bp, Homo sapiens
tttagttcctcatct

SEQ ID NO: 443959 - DNA, 15 bp, Homo sapiens
ttagttcctcatcta

SEQ ID NO: 443960 - DNA, 15 bp, Homo sapiens
tagttcctcatctat

SEQ ID NO: 443961 - DNA, 15 bp, Homo sapiens
agttcctcatctatc

SEQ ID NO: 443962 - DNA, 15 bp, Homo sapiens
gttcctcatctatca

SEQ ID NO: 443963 - DNA, 15 bp, Homo sapiens
ttcctcatctatcaa

SEQ ID NO: 443964 - DNA, 15 bp, Homo sapiens
tcctcatctatcaaa

SEQ ID NO: 443965 - DNA, 15 bp, Homo sapiens
cctcatctatcaaat

SEQ ID NO: 443966 - DNA, 15 bp, Homo sapiens
ctcatctatcaaatg

SEQ ID NO: 443967 - DNA, 15 bp, Homo sapiens
tcatctatcaaatgg

SEQ ID NO: 443968 - DNA, 15 bp, Homo sapiens
catctatcaaatgga

SEQ ID NO: 443969 - DNA, 15 bp, Homo sapiens
atctatcaaatggaa

SEQ ID NO: 443970 - DNA, 15 bp, Homo sapiens
tctatcaaatggaac

SEQ ID NO: 443971 - DNA, 15 bp, Homo sapiens
ctatcaaatggaact

SEQ ID NO: 443972 - DNA, 15 bp, Homo sapiens
tatcaaatggaactt

SEQ ID NO: 443973 - DNA, 15 bp, Homo sapiens
atcaaatggaacttt

SEQ ID NO: 443974 - DNA, 15 bp, Homo sapiens
tcaaatggaacttta

SEQ ID NO: 443975 - DNA, 15 bp, Homo sapiens
caaatggaactttaa

SEQ ID NO: 443976 - DNA, 15 bp, Homo sapiens
aaatggaactttaac

SEQ ID NO: 443977 - DNA, 15 bp, Homo sapiens
aatggaactttaacg

SEQ ID NO: 443978 - DNA, 15 bp, Homo sapiens
atggaactttaacgt

SEQ ID NO: 443979 - DNA, 15 bp, Homo sapiens
tggaactttaacgtg

SEQ ID NO: 443980 - DNA, 15 bp, Homo sapiens
ggaactttaacgtgt

SEQ ID NO: 443981 - DNA, 15 bp, Homo sapiens
gaactttaacgtgta

SEQ ID NO: 443982 - DNA, 15 bp, Homo sapiens
aactttaacgtgtat

SEQ ID NO: 443983 - DNA, 15 bp, Homo sapiens
actttaacgtgtatc

SEQ ID NO: 443984 - DNA, 15 bp, Homo sapiens
ctttaacgtgtatct

SEQ ID NO: 443985 - DNA, 15 bp, Homo sapiens
tttaacgtgtatctt

SEQ ID NO: 443986 - DNA, 15 bp, Homo sapiens
ttaacgtgtatcttg

SEQ ID NO: 443987 - DNA, 15 bp, Homo sapiens
taacgtgtatcttgc

SEQ ID NO: 443988 - DNA, 15 bp, Homo sapiens
aacgtgtatcttgct

SEQ ID NO: 443989 - DNA, 15 bp, Homo sapiens
acgtgtatcttgctg

SEQ ID NO: 443990 - DNA, 15 bp, Homo sapiens
cgtgtatcttgctgg

SEQ ID NO: 443991 - DNA, 15 bp, Homo sapiens
gtgtatcttgctggc

SEQ ID NO: 443992 - DNA, 15 bp, Homo sapiens
tgtatcttgctggct

SEQ ID NO: 443993 - DNA, 15 bp, Homo sapiens
gtatcttgctggctt

SEQ ID NO: 443994 - DNA, 15 bp, Homo sapiens
tatcttgctggcttc

SEQ ID NO: 443995 - DNA, 15 bp, Homo sapiens
atcttgctggcttcc

SEQ ID NO: 443996 - DNA, 15 bp, Homo sapiens
tcttgctggcttcct

SEQ ID NO: 443997 - DNA, 15 bp, Homo sapiens
cttgctggcttcctt

SEQ ID NO: 443998 - DNA, 15 bp, Homo sapiens
ttgctggcttcctta

SEQ ID NO: 443999 - DNA, 15 bp, Homo sapiens
tgctggcttccttac

SEQ ID NO: 444000 - DNA, 15 bp, Homo sapiens
gctggcttccttacc

SEQ ID NO: 444001 - DNA, 15 bp, Homo sapiens
ctggcttccttaccg

SEQ ID NO: 444002 - DNA, 15 bp, Homo sapiens
tggcttccttaccga

SEQ ID NO: 444003 - DNA, 15 bp, Homo sapiens
ggcttccttaccgaa

SEQ ID NO: 444004 - DNA, 15 bp, Homo sapiens
gcttccttaccgaaa

SEQ ID NO: 444005 - DNA, 15 bp, Homo sapiens
cttccttaccgaaaa

SEQ ID NO: 444006 - DNA, 15 bp, Homo sapiens
ttccttaccgaaaac

SEQ ID NO: 444007 - DNA, 15 bp, Homo sapiens
tccttaccgaaaaca

SEQ ID NO: 444008 - DNA, 15 bp, Homo sapiens
ccttaccgaaaacat

SEQ ID NO: 444009 - DNA, 15 bp, Homo sapiens
cttaccgaaaacata

SEQ ID NO: 444010 - DNA, 15 bp, Homo sapiens
ttaccgaaaacatat

SEQ ID NO: 444011 - DNA, 15 bp, Homo sapiens
taccgaaaacatata

SEQ ID NO: 444012 - DNA, 15 bp, Homo sapiens
accgaaaacatatat

SEQ ID NO: 444013 - DNA, 15 bp, Homo sapiens
ccgaaaacatatatt

SEQ ID NO: 444014 - DNA, 15 bp, Homo sapiens
cgaaaacatatattt

SEQ ID NO: 444015 - DNA, 15 bp, Homo sapiens
gaaaacatatatttg

SEQ ID NO: 444016 - DNA, 15 bp, Homo sapiens
aaaacatatatttga

SEQ ID NO: 444017 - DNA, 15 bp, Homo sapiens
aaacatatatttgaa

SEQ ID NO: 444018 - DNA, 15 bp, Homo sapiens
aacatatatttgaaa

SEQ ID NO: 444019 - DNA, 15 bp, Homo sapiens
acatatatttgaaaa

SEQ ID NO: 444020 - DNA, 15 bp, Homo sapiens
catatatttgaaaat

SEQ ID NO: 444021 - DNA, 15 bp, Homo sapiens
atatatttgaaaatg

SEQ ID NO: 444022 - DNA, 15 bp, Homo sapiens
tatatttgaaaatgc

SEQ ID NO: 444023 - DNA, 15 bp, Homo sapiens
atatttgaaaatgct

SEQ ID NO: 444024 - DNA, 15 bp, Homo sapiens
tatttgaaaatgctt

SEQ ID NO: 444025 - DNA, 15 bp, Homo sapiens
atttgaaaatgcttg

SEQ ID NO: 444026 - DNA, 15 bp, Homo sapiens
tttgaaaatgcttgg

SEQ ID NO: 444027 - DNA, 15 bp, Homo sapiens
ttgaaaatgcttggc

SEQ ID NO: 444028 - DNA, 15 bp, Homo sapiens
tgaaaatgcttggca

SEQ ID NO: 444029 - DNA, 15 bp, Homo sapiens
gaaaatgcttggcaa

SEQ ID NO: 444030 - DNA, 15 bp, Homo sapiens
aaaatgcttggcaaa

SEQ ID NO: 444031 - DNA, 15 bp, Homo sapiens
aaatgcttggcaaag

SEQ ID NO: 444032 - DNA, 15 bp, Homo sapiens
aatgcttggcaaagt

SEQ ID NO: 444033 - DNA, 15 bp, Homo sapiens
atgcttggcaaagtt

SEQ ID NO: 444034 - DNA, 15 bp, Homo sapiens
tgcttggcaaagttt

SEQ ID NO: 444035 - DNA, 15 bp, Homo sapiens
gcttggcaaagttta

SEQ ID NO: 444036 - DNA, 15 bp, Homo sapiens
cttggcaaagtttag

SEQ ID NO: 444037 - DNA, 15 bp, Homo sapiens
ttggcaaagtttaga

SEQ ID NO: 444038 - DNA, 15 bp, Homo sapiens
tggcaaagtttagaa

SEQ ID NO: 444039 - DNA, 15 bp, Homo sapiens
ggcaaagtttagaat

SEQ ID NO: 444040 - DNA, 15 bp, Homo sapiens
gcaaagtttagaatg

SEQ ID NO: 444041 - DNA, 15 bp, Homo sapiens
caaagtttagaatgc

SEQ ID NO: 444042 - DNA, 15 bp, Homo sapiens
aaagtttagaatgct

SEQ ID NO: 444043 - DNA, 15 bp, Homo sapiens
aagtttagaatgctg

SEQ ID NO: 444044 - DNA, 15 bp, Homo sapiens
agtttagaatgctga

SEQ ID NO: 444045 - DNA, 15 bp, Homo sapiens
gtttagaatgctgaa

SEQ ID NO: 444046 - DNA, 15 bp, Homo sapiens
tttagaatgctgaat

SEQ ID NO: 444047 - DNA, 15 bp, Homo sapiens
ttagaatgctgaata

SEQ ID NO: 444048 - DNA, 15 bp, Homo sapiens
tagaatgctgaatag

SEQ ID NO: 444049 - DNA, 15 bp, Homo sapiens
agaatgctgaatagt

SEQ ID NO: 444050 - DNA, 15 bp, Homo sapiens
gaatgctgaatagtt

SEQ ID NO: 444051 - DNA, 15 bp, Homo sapiens
aatgctgaatagttg

SEQ ID NO: 444052 - DNA, 15 bp, Homo sapiens
atgctgaatagttgt

SEQ ID NO: 444053 - DNA, 15 bp, Homo sapiens
tgctgaatagttgta

SEQ ID NO: 444054 - DNA, 15 bp, Homo sapiens
gctgaatagttgtaa

SEQ ID NO: 444055 - DNA, 15 bp, Homo sapiens
ctgaatagttgtaag

SEQ ID NO: 444056 - DNA, 15 bp, Homo sapiens
tgaatagttgtaaga

SEQ ID NO: 444057 - DNA, 15 bp, Homo sapiens
gaatagttgtaagat

SEQ ID NO: 444058 - DNA, 15 bp, Homo sapiens
aatagttgtaagata

SEQ ID NO: 444059 - DNA, 15 bp, Homo sapiens
atagttgtaagatat

SEQ ID NO: 444060 - DNA, 15 bp, Homo sapiens
tagttgtaagatatt

SEQ ID NO: 444061 - DNA, 15 bp, Homo sapiens
agttgtaagatatta

SEQ ID NO: 444062 - DNA, 15 bp, Homo sapiens
gttgtaagatattaa

SEQ ID NO: 444063 - DNA, 15 bp, Homo sapiens
ttgtaagatattaat

SEQ ID NO: 444064 - DNA, 15 bp, Homo sapiens
tgtaagatattaatg

SEQ ID NO: 444065 - DNA, 15 bp, Homo sapiens
gtaagatattaatgt

SEQ ID NO: 444066 - DNA, 15 bp, Homo sapiens
taagatattaatgtg

SEQ ID NO: 444067 - DNA, 15 bp, Homo sapiens
aagatattaatgtga

SEQ ID NO: 444068 - DNA, 15 bp, Homo sapiens
agatattaatgtgac

SEQ ID NO: 444069 - DNA, 15 bp, Homo sapiens
gatattaatgtgaca

SEQ ID NO: 444070 - DNA, 15 bp, Homo sapiens
atattaatgtgacat

SEQ ID NO: 444071 - DNA, 15 bp, Homo sapiens
tattaatgtgacatg

SEQ ID NO: 444072 - DNA, 15 bp, Homo sapiens
attaatgtgacatga

SEQ ID NO: 444073 - DNA, 15 bp, Homo sapiens
ttaatgtgacatgaa

SEQ ID NO: 444074 - DNA, 15 bp, Homo sapiens
taatgtgacatgaaa

SEQ ID NO: 444075 - DNA, 15 bp, Homo sapiens
aatgtgacatgaaat

SEQ ID NO: 444076 - DNA, 15 bp, Homo sapiens
atgtgacatgaaatt

SEQ ID NO: 444077 - DNA, 15 bp, Homo sapiens
tgtgacatgaaattg

SEQ ID NO: 444078 - DNA, 15 bp, Homo sapiens
gtgacatgaaattga

SEQ ID NO: 444079 - DNA, 15 bp, Homo sapiens
tgacatgaaattgag

SEQ ID NO: 444080 - DNA, 15 bp, Homo sapiens
gacatgaaattgaga

SEQ ID NO: 444081 - DNA, 15 bp, Homo sapiens
acatgaaattgagaa

SEQ ID NO: 444082 - DNA, 15 bp, Homo sapiens
catgaaattgagaaa

SEQ ID NO: 444083 - DNA, 15 bp, Homo sapiens
atgaaattgagaaaa

SEQ ID NO: 444084 - DNA, 15 bp, Homo sapiens
tgaaattgagaaaaa

SEQ ID NO: 444085 - DNA, 15 bp, Homo sapiens
gaaattgagaaaaaa

SEQ ID NO: 444086 - DNA, 15 bp, Homo sapiens
aaattgagaaaaaaa

SEQ ID NO: 444087 - DNA, 15 bp, Homo sapiens
aattgagaaaaaaag

SEQ ID NO: 444088 - DNA, 15 bp, Homo sapiens
attgagaaaaaaagt

SEQ ID NO: 444089 - DNA, 15 bp, Homo sapiens
ttgagaaaaaaagta

SEQ ID NO: 444090 - DNA, 15 bp, Homo sapiens
tgagaaaaaaagtat

SEQ ID NO: 444091 - DNA, 15 bp, Homo sapiens
gagaaaaaaagtatt

SEQ ID NO: 444092 - DNA, 15 bp, Homo sapiens
agaaaaaaagtattg

SEQ ID NO: 444093 - DNA, 15 bp, Homo sapiens
gaaaaaaagtattgg

SEQ ID NO: 444094 - DNA, 15 bp, Homo sapiens
aaaaaaagtattggt

SEQ ID NO: 444095 - DNA, 15 bp, Homo sapiens
aaaaaagtattggtg

SEQ ID NO: 444096 - DNA, 15 bp, Homo sapiens
aaaaagtattggtga

SEQ ID NO: 444097 - DNA, 15 bp, Homo sapiens
aaaagtattggtgac

SEQ ID NO: 444098 - DNA, 15 bp, Homo sapiens
aaagtattggtgaca

SEQ ID NO: 444099 - DNA, 15 bp, Homo sapiens
aagtattggtgacaa

SEQ ID NO: 444100 - DNA, 15 bp, Homo sapiens
agtattggtgacaac

SEQ ID NO: 444101 - DNA, 15 bp, Homo sapiens
gtattggtgacaact

SEQ ID NO: 444102 - DNA, 15 bp, Homo sapiens
tattggtgacaactg

SEQ ID NO: 444103 - DNA, 15 bp, Homo sapiens
attggtgacaactgg

SEQ ID NO: 444104 - DNA, 15 bp, Homo sapiens
ttggtgacaactggc

SEQ ID NO: 444105 - DNA, 15 bp, Homo sapiens
tggtgacaactggct

SEQ ID NO: 444106 - DNA, 15 bp, Homo sapiens
ggtgacaactggcta

SEQ ID NO: 444107 - DNA, 15 bp, Homo sapiens
gtgacaactggctac

SEQ ID NO: 444108 - DNA, 15 bp, Homo sapiens
tgacaactggctacg

SEQ ID NO: 444109 - DNA, 15 bp, Homo sapiens
gacaactggctacgt

SEQ ID NO: 444110 - DNA, 15 bp, Homo sapiens
acaactggctacgtg

SEQ ID NO: 444111 - DNA, 15 bp, Homo sapiens
caactggctacgtga

SEQ ID NO: 444112 - DNA, 15 bp, Homo sapiens
aactggctacgtgag

SEQ ID NO: 444113 - DNA, 15 bp, Homo sapiens
actggctacgtgagg

SEQ ID NO: 444114 - DNA, 15 bp, Homo sapiens
ctggctacgtgagga

SEQ ID NO: 444115 - DNA, 15 bp, Homo sapiens
tggctacgtgaggat

SEQ ID NO: 444116 - DNA, 15 bp, Homo sapiens
ggctacgtgaggatc

SEQ ID NO: 444117 - DNA, 15 bp, Homo sapiens
gctacgtgaggatct

SEQ ID NO: 444118 - DNA, 15 bp, Homo sapiens
ctacgtgaggatctg

SEQ ID NO: 444119 - DNA, 15 bp, Homo sapiens
tacgtgaggatctga

SEQ ID NO: 444120 - DNA, 15 bp, Homo sapiens
acgtgaggatctgat

SEQ ID NO: 444121 - DNA, 15 bp, Homo sapiens
cgtgaggatctgatg

SEQ ID NO: 444122 - DNA, 15 bp, Homo sapiens
gtgaggatctgatga

SEQ ID NO: 444123 - DNA, 15 bp, Homo sapiens
tgaggatctgatgat

SEQ ID NO: 444124 - DNA, 15 bp, Homo sapiens
gaggatctgatgata

SEQ ID NO: 444125 - DNA, 15 bp, Homo sapiens
aggatctgatgatat

SEQ ID NO: 444126 - DNA, 15 bp, Homo sapiens
ggatctgatgatatt

SEQ ID NO: 444127 - DNA, 15 bp, Homo sapiens
gatctgatgatattt

SEQ ID NO: 444128 - DNA, 15 bp, Homo sapiens
atctgatgatatttg

SEQ ID NO: 444129 - DNA, 15 bp, Homo sapiens
tctgatgatatttgc

SEQ ID NO: 444130 - DNA, 15 bp, Homo sapiens
ctgatgatatttgca

SEQ ID NO: 444131 - DNA, 15 bp, Homo sapiens
tgatgatatttgcaa

SEQ ID NO: 444132 - DNA, 15 bp, Homo sapiens
gatgatatttgcaaa

SEQ ID NO: 444133 - DNA, 15 bp, Homo sapiens
atgatatttgcaaag

SEQ ID NO: 444134 - DNA, 15 bp, Homo sapiens
tgatatttgcaaagt

SEQ ID NO: 444135 - DNA, 15 bp, Homo sapiens
gatatttgcaaagta

SEQ ID NO: 444136 - DNA, 15 bp, Homo sapiens
atatttgcaaagtat

SEQ ID NO: 444137 - DNA, 15 bp, Homo sapiens
tatttgcaaagtatg

SEQ ID NO: 444138 - DNA, 15 bp, Homo sapiens
atttgcaaagtatga

SEQ ID NO: 444139 - DNA, 15 bp, Homo sapiens
tttgcaaagtatgaa

SEQ ID NO: 444140 - DNA, 15 bp, Homo sapiens
ttgcaaagtatgaaa

SEQ ID NO: 444141 - DNA, 15 bp, Homo sapiens
tgcaaagtatgaaaa

SEQ ID NO: 444142 - DNA, 15 bp, Homo sapiens
gcaaagtatgaaaat

SEQ ID NO: 444143 - DNA, 15 bp, Homo sapiens
caaagtatgaaaatt

SEQ ID NO: 444144 - DNA, 15 bp, Homo sapiens
aaagtatgaaaattc

SEQ ID NO: 444145 - DNA, 15 bp, Homo sapiens
aagtatgaaaattcc

SEQ ID NO: 444146 - DNA, 15 bp, Homo sapiens
agtatgaaaattcca

SEQ ID NO: 444147 - DNA, 15 bp, Homo sapiens
gtatgaaaattccaa

SEQ ID NO: 444148 - DNA, 15 bp, Homo sapiens
tatgaaaattccaag

SEQ ID NO: 444149 - DNA, 15 bp, Homo sapiens
atgaaaattccaagt

SEQ ID NO: 444150 - DNA, 15 bp, Homo sapiens
tgaaaattccaagta

SEQ ID NO: 444151 - DNA, 15 bp, Homo sapiens
gaaaattccaagtat

SEQ ID NO: 444152 - DNA, 15 bp, Homo sapiens
aaaattccaagtatt

SEQ ID NO: 444153 - DNA, 15 bp, Homo sapiens
aaattccaagtatta

SEQ ID NO: 444154 - DNA, 15 bp, Homo sapiens
aattccaagtattat

SEQ ID NO: 444155 - DNA, 15 bp, Homo sapiens
attccaagtattatt

SEQ ID NO: 444156 - DNA, 15 bp, Homo sapiens
ttccaagtattattt

SEQ ID NO: 444157 - DNA, 15 bp, Homo sapiens
tccaagtattatttg

SEQ ID NO: 444158 - DNA, 15 bp, Homo sapiens
ccaagtattatttga

SEQ ID NO: 444159 - DNA, 15 bp, Homo sapiens
caagtattatttgaa

SEQ ID NO: 444160 - DNA, 15 bp, Homo sapiens
aagtattatttgaat

SEQ ID NO: 444161 - DNA, 15 bp, Homo sapiens
agtattatttgaatt

SEQ ID NO: 444162 - DNA, 15 bp, Homo sapiens
gtattatttgaattt

SEQ ID NO: 444163 - DNA, 15 bp, Homo sapiens
tattatttgaatttt

SEQ ID NO: 444164 - DNA, 15 bp, Homo sapiens
attatttgaattttt

SEQ ID NO: 444165 - DNA, 15 bp, Homo sapiens
ttatttgaattttta

SEQ ID NO: 444166 - DNA, 15 bp, Homo sapiens
tatttgaatttttat

SEQ ID NO: 444167 - DNA, 15 bp, Homo sapiens
atttgaatttttata

SEQ ID NO: 444168 - DNA, 15 bp, Homo sapiens
tttgaatttttatat

SEQ ID NO: 444169 - DNA, 15 bp, Homo sapiens
ttgaatttttatatt

SEQ ID NO: 444170 - DNA, 15 bp, Homo sapiens
tgaatttttatattt

SEQ ID NO: 444171 - DNA, 15 bp, Homo sapiens
gaatttttatatttg

SEQ ID NO: 444172 - DNA, 15 bp, Homo sapiens
aatttttatatttgt

SEQ ID NO: 444173 - DNA, 15 bp, Homo sapiens
atttttatatttgtt

SEQ ID NO: 444174 - DNA, 15 bp, Homo sapiens
tttttatatttgttc

SEQ ID NO: 444175 - DNA, 15 bp, Homo sapiens
ttttatatttgttca

SEQ ID NO: 444176 - DNA, 15 bp, Homo sapiens
tttatatttgttcat

SEQ ID NO: 444177 - DNA, 15 bp, Homo sapiens
ttatatttgttcatt

SEQ ID NO: 444178 - DNA, 15 bp, Homo sapiens
tatatttgttcattt

SEQ ID NO: 444179 - DNA, 15 bp, Homo sapiens
atatttgttcattta

SEQ ID NO: 444180 - DNA, 15 bp, Homo sapiens
tatttgttcatttag

SEQ ID NO: 444181 - DNA, 15 bp, Homo sapiens
atttgttcatttagc

SEQ ID NO: 444182 - DNA, 15 bp, Homo sapiens
tttgttcatttagca

SEQ ID NO: 444183 - DNA, 15 bp, Homo sapiens
ttgttcatttagcaa

SEQ ID NO: 444184 - DNA, 15 bp, Homo sapiens
tgttcatttagcaaa

SEQ ID NO: 444185 - DNA, 15 bp, Homo sapiens
gttcatttagcaaaa

SEQ ID NO: 444186 - DNA, 15 bp, Homo sapiens
ttcatttagcaaaat

SEQ ID NO: 444187 - DNA, 15 bp, Homo sapiens
tcatttagcaaaatt

SEQ ID NO: 444188 - DNA, 15 bp, Homo sapiens
catttagcaaaattc

SEQ ID NO: 444189 - DNA, 15 bp, Homo sapiens
atttagcaaaattct

SEQ ID NO: 444190 - DNA, 15 bp, Homo sapiens
tttagcaaaattctt

SEQ ID NO: 444191 - DNA, 15 bp, Homo sapiens
ttagcaaaattcttt

SEQ ID NO: 444192 - DNA, 15 bp, Homo sapiens
tagcaaaattctttt

SEQ ID NO: 444193 - DNA, 15 bp, Homo sapiens
agcaaaattctttta

SEQ ID NO: 444194 - DNA, 15 bp, Homo sapiens
gcaaaattcttttat

SEQ ID NO: 444195 - DNA, 15 bp, Homo sapiens
caaaattcttttatg

SEQ ID NO: 444196 - DNA, 15 bp, Homo sapiens
aaaattcttttatgg

SEQ ID NO: 444197 - DNA, 15 bp, Homo sapiens
aaattcttttatggc

SEQ ID NO: 444198 - DNA, 15 bp, Homo sapiens
aattcttttatggca

SEQ ID NO: 444199 - DNA, 15 bp, Homo sapiens
attcttttatggcac

SEQ ID NO: 444200 - DNA, 15 bp, Homo sapiens
ttcttttatggcact

SEQ ID NO: 444201 - DNA, 15 bp, Homo sapiens
tcttttatggcacta

SEQ ID NO: 444202 - DNA, 15 bp, Homo sapiens
cttttatggcactaa

SEQ ID NO: 444203 - DNA, 15 bp, Homo sapiens
ttttatggcactaaa

SEQ ID NO: 444204 - DNA, 15 bp, Homo sapiens
tttatggcactaaat

SEQ ID NO: 444205 - DNA, 15 bp, Homo sapiens
ttatggcactaaatt

SEQ ID NO: 444206 - DNA, 15 bp, Homo sapiens
tatggcactaaattc

SEQ ID NO: 444207 - DNA, 15 bp, Homo sapiens
atggcactaaattca

SEQ ID NO: 444208 - DNA, 15 bp, Homo sapiens
tggcactaaattcac

SEQ ID NO: 444209 - DNA, 15 bp, Homo sapiens
ggcactaaattcaca

SEQ ID NO: 444210 - DNA, 15 bp, Homo sapiens
gcactaaattcacat

SEQ ID NO: 444211 - DNA, 15 bp, Homo sapiens
cactaaattcacatg

SEQ ID NO: 444212 - DNA, 15 bp, Homo sapiens
actaaattcacatgt

SEQ ID NO: 444213 - DNA, 15 bp, Homo sapiens
ctaaattcacatgta

SEQ ID NO: 444214 - DNA, 15 bp, Homo sapiens
taaattcacatgtac

SEQ ID NO: 444215 - DNA, 15 bp, Homo sapiens
aaattcacatgtact

SEQ ID NO: 444216 - DNA, 15 bp, Homo sapiens
aattcacatgtacta

SEQ ID NO: 444217 - DNA, 15 bp, Homo sapiens
attcacatgtactat

SEQ ID NO: 444218 - DNA, 15 bp, Homo sapiens
ttcacatgtactatt

SEQ ID NO: 444219 - DNA, 15 bp, Homo sapiens
tcacatgtactattc

SEQ ID NO: 444220 - DNA, 15 bp, Homo sapiens
cacatgtactattct

SEQ ID NO: 444221 - DNA, 15 bp, Homo sapiens
acatgtactattctt

SEQ ID NO: 444222 - DNA, 15 bp, Homo sapiens
catgtactattcttc

SEQ ID NO: 444223 - DNA, 15 bp, Homo sapiens
atgtactattcttct

SEQ ID NO: 444224 - DNA, 15 bp, Homo sapiens
tgtactattcttctt

SEQ ID NO: 444225 - DNA, 15 bp, Homo sapiens
gtactattcttctta

SEQ ID NO: 444226 - DNA, 15 bp, Homo sapiens
tactattcttcttaa

SEQ ID NO: 444227 - DNA, 15 bp, Homo sapiens
actattcttcttaaa

SEQ ID NO: 444228 - DNA, 15 bp, Homo sapiens
ctattcttcttaaat

SEQ ID NO: 444229 - DNA, 15 bp, Homo sapiens
tattcttcttaaata

SEQ ID NO: 444230 - DNA, 15 bp, Homo sapiens
attcttcttaaataa

SEQ ID NO: 444231 - DNA, 15 bp, Homo sapiens
ttcttcttaaataag

SEQ ID NO: 444232 - DNA, 15 bp, Homo sapiens
tcttcttaaataagt

SEQ ID NO: 444233 - DNA, 15 bp, Homo sapiens
cttcttaaataagtc

SEQ ID NO: 444234 - DNA, 15 bp, Homo sapiens
ttcttaaataagtct

SEQ ID NO: 444235 - DNA, 15 bp, Homo sapiens
tcttaaataagtctt

SEQ ID NO: 444236 - DNA, 15 bp, Homo sapiens
cttaaataagtctta

SEQ ID NO: 444237 - DNA, 15 bp, Homo sapiens
ttaaataagtcttaa

SEQ ID NO: 444238 - DNA, 15 bp, Homo sapiens
taaataagtcttaaa

SEQ ID NO: 444239 - DNA, 15 bp, Homo sapiens
aaataagtcttaaaa

SEQ ID NO: 444240 - DNA, 15 bp, Homo sapiens
aataagtcttaaaat

SEQ ID NO: 444241 - DNA, 15 bp, Homo sapiens
ataagtcttaaaata

SEQ ID NO: 444242 - DNA, 15 bp, Homo sapiens
taagtcttaaaataa

SEQ ID NO: 444243 - DNA, 15 bp, Homo sapiens
aagtcttaaaataat

SEQ ID NO: 444244 - DNA, 15 bp, Homo sapiens
agtcttaaaataatt

SEQ ID NO: 444245 - DNA, 15 bp, Homo sapiens
gtcttaaaataattg

SEQ ID NO: 444246 - DNA, 15 bp, Homo sapiens
tcttaaaataattgg

SEQ ID NO: 444247 - DNA, 15 bp, Homo sapiens
cttaaaataattggt

SEQ ID NO: 444248 - DNA, 15 bp, Homo sapiens
ttaaaataattggtt

SEQ ID NO: 444249 - DNA, 15 bp, Homo sapiens
taaaataattggtta

SEQ ID NO: 444250 - DNA, 15 bp, Homo sapiens
aaaataattggttaa

SEQ ID NO: 444251 - DNA, 15 bp, Homo sapiens
aaataattggttaat

SEQ ID NO: 444252 - DNA, 15 bp, Homo sapiens
aataattggttaatg

SEQ ID NO: 444253 - DNA, 15 bp, Homo sapiens
ataattggttaatgt

SEQ ID NO: 444254 - DNA, 15 bp, Homo sapiens
taattggttaatgta

SEQ ID NO: 444255 - DNA, 15 bp, Homo sapiens
aattggttaatgtag

SEQ ID NO: 444256 - DNA, 15 bp, Homo sapiens
attggttaatgtagg

SEQ ID NO: 444257 - DNA, 15 bp, Homo sapiens
ttggttaatgtagga

SEQ ID NO: 444258 - DNA, 15 bp, Homo sapiens
tggttaatgtaggaa

SEQ ID NO: 444259 - DNA, 15 bp, Homo sapiens
ggttaatgtaggaat

SEQ ID NO: 444260 - DNA, 15 bp, Homo sapiens
gttaatgtaggaata

SEQ ID NO: 444261 - DNA, 15 bp, Homo sapiens
ttaatgtaggaataa

SEQ ID NO: 444262 - DNA, 15 bp, Homo sapiens
taatgtaggaataat

SEQ ID NO: 444263 - DNA, 15 bp, Homo sapiens
aatgtaggaataata

SEQ ID NO: 444264 - DNA, 15 bp, Homo sapiens
atgtaggaataatat

SEQ ID NO: 444265 - DNA, 15 bp, Homo sapiens
tgtaggaataatata

SEQ ID NO: 444266 - DNA, 15 bp, Homo sapiens
gtaggaataatatat

SEQ ID NO: 444267 - DNA, 15 bp, Homo sapiens
taggaataatatatt

SEQ ID NO: 444268 - DNA, 15 bp, Homo sapiens
aggaataatatattt

SEQ ID NO: 444269 - DNA, 15 bp, Homo sapiens
ggaataatatatttt

SEQ ID NO: 444270 - DNA, 15 bp, Homo sapiens
gaataatatattttt

SEQ ID NO: 444271 - DNA, 15 bp, Homo sapiens
ataatatatttttta

SEQ ID NO: 444272 - DNA, 15 bp, Homo sapiens
taatatattttttat

SEQ ID NO: 444273 - DNA, 15 bp, Homo sapiens
aatatattttttata

SEQ ID NO: 444274 - DNA, 15 bp, Homo sapiens
atatattttttataa

SEQ ID NO: 444275 - DNA, 15 bp, Homo sapiens
tatattttttataag

SEQ ID NO: 444276 - DNA, 15 bp, Homo sapiens
atattttttataagt

SEQ ID NO: 444277 - DNA, 15 bp, Homo sapiens
tattttttataagta

SEQ ID NO: 444278 - DNA, 15 bp, Homo sapiens
attttttataagtaa

SEQ ID NO: 444279 - DNA, 15 bp, Homo sapiens
ttttttataagtaag

SEQ ID NO: 444280 - DNA, 15 bp, Homo sapiens
tttttataagtaaga

SEQ ID NO: 444281 - DNA, 15 bp, Homo sapiens
ttttataagtaagaa

SEQ ID NO: 444282 - DNA, 15 bp, Homo sapiens
tttataagtaagaag

SEQ ID NO: 444283 - DNA, 15 bp, Homo sapiens
ttataagtaagaagt

SEQ ID NO: 444284 - DNA, 15 bp, Homo sapiens
tataagtaagaagta

SEQ ID NO: 444285 - DNA, 15 bp, Homo sapiens
ataagtaagaagtaa

SEQ ID NO: 444286 - DNA, 15 bp, Homo sapiens
taagtaagaagtaac

SEQ ID NO: 444287 - DNA, 15 bp, Homo sapiens
aagtaagaagtaact

SEQ ID NO: 444288 - DNA, 15 bp, Homo sapiens
agtaagaagtaacta

SEQ ID NO: 444289 - DNA, 15 bp, Homo sapiens
gtaagaagtaactag

SEQ ID NO: 444290 - DNA, 15 bp, Homo sapiens
taagaagtaactaga

SEQ ID NO: 444291 - DNA, 15 bp, Homo sapiens
aagaagtaactagaa

SEQ ID NO: 444292 - DNA, 15 bp, Homo sapiens
agaagtaactagaat

SEQ ID NO: 444293 - DNA, 15 bp, Homo sapiens
gaagtaactagaatt

SEQ ID NO: 444294 - DNA, 15 bp, Homo sapiens
aagtaactagaattg

SEQ ID NO: 444295 - DNA, 15 bp, Homo sapiens
agtaactagaattgt

SEQ ID NO: 444296 - DNA, 15 bp, Homo sapiens
gtaactagaattgta

SEQ ID NO: 444297 - DNA, 15 bp, Homo sapiens
taactagaattgtaa

SEQ ID NO: 444298 - DNA, 15 bp, Homo sapiens
aactagaattgtaaa

SEQ ID NO: 444299 - DNA, 15 bp, Homo sapiens
actagaattgtaaaa

SEQ ID NO: 444300 - DNA, 15 bp, Homo sapiens
ctagaattgtaaaaa

SEQ ID NO: 444301 - DNA, 15 bp, Homo sapiens
tagaattgtaaaaaa

SEQ ID NO: 444302 - DNA, 15 bp, Homo sapiens
agaattgtaaaaaaa

SEQ ID NO: 444303 - DNA, 15 bp, Homo sapiens
gaattgtaaaaaaaa

SEQ ID NO: 444304 - DNA, 15 bp, Homo sapiens
aattgtaaaaaaaaa

SEQ ID NO: 444305 - DNA, 15 bp, Homo sapiens
attgtaaaaaaaaaa

SEQ ID NO: 444306 - DNA, 15 bp, Homo sapiens
ttgtaaaaaaaaaaa

SEQ ID NO: 444307 - DNA, 15 bp, Homo sapiens
tgtaaaaaaaaaaaa

SEQ ID NO: 444308 - DNA, 15 bp, Homo sapiens
aaaaaaaaaagtacc

SEQ ID NO: 444309 - DNA, 15 bp, Homo sapiens
aaaaaaaaagtacct

SEQ ID NO: 444310 - DNA, 15 bp, Homo sapiens
aaaaaaaagtacctc

SEQ ID NO: 444311 - DNA, 15 bp, Homo sapiens
aaaaaaagtacctca

SEQ ID NO: 444312 - DNA, 15 bp, Homo sapiens
aaaaaagtacctcaa

SEQ ID NO: 444313 - DNA, 15 bp, Homo sapiens
aaaaagtacctcaat

SEQ ID NO: 444314 - DNA, 15 bp, Homo sapiens
aaaagtacctcaatt

SEQ ID NO: 444315 - DNA, 15 bp, Homo sapiens
aaagtacctcaattt

SEQ ID NO: 444316 - DNA, 15 bp, Homo sapiens
aagtacctcaattta

SEQ ID NO: 444317 - DNA, 15 bp, Homo sapiens
agtacctcaatttaa

SEQ ID NO: 444318 - DNA, 15 bp, Homo sapiens
gtacctcaatttaaa

SEQ ID NO: 444319 - DNA, 15 bp, Homo sapiens
tacctcaatttaaaa

SEQ ID NO: 444320 - DNA, 15 bp, Homo sapiens
acctcaatttaaaaa

SEQ ID NO: 444321 - DNA, 15 bp, Homo sapiens
cctcaatttaaaaac

SEQ ID NO: 444322 - DNA, 15 bp, Homo sapiens
ctcaatttaaaaacc

SEQ ID NO: 444323 - DNA, 15 bp, Homo sapiens
tcaatttaaaaaccc

SEQ ID NO: 444324 - DNA, 15 bp, Homo sapiens
caatttaaaaacccc

SEQ ID NO: 444325 - DNA, 15 bp, Homo sapiens
aatttaaaaacccca

SEQ ID NO: 444326 - DNA, 15 bp, Homo sapiens
atttaaaaaccccat

SEQ ID NO: 444327 - DNA, 15 bp, Homo sapiens
tttaaaaaccccata

SEQ ID NO: 444328 - DNA, 15 bp, Homo sapiens
ttaaaaaccccataa

SEQ ID NO: 444329 - DNA, 15 bp, Homo sapiens
taaaaaccccataaa

SEQ ID NO: 444330 - DNA, 15 bp, Homo sapiens
aaaaaccccataaaa

SEQ ID NO: 444331 - DNA, 15 bp, Homo sapiens
aaaaccccataaaat

SEQ ID NO: 444332 - DNA, 15 bp, Homo sapiens
aaaccccataaaatc

SEQ ID NO: 444333 - DNA, 15 bp, Homo sapiens
aaccccataaaatct

SEQ ID NO: 444334 - DNA, 15 bp, Homo sapiens
accccataaaatctc

SEQ ID NO: 444335 - DNA, 15 bp, Homo sapiens
ccccataaaatctca

SEQ ID NO: 444336 - DNA, 15 bp, Homo sapiens
cccataaaatctcag

SEQ ID NO: 444337 - DNA, 15 bp, Homo sapiens
ccataaaatctcagt

SEQ ID NO: 444338 - DNA, 15 bp, Homo sapiens
cataaaatctcagtc

SEQ ID NO: 444339 - DNA, 15 bp, Homo sapiens
ataaaatctcagtca

SEQ ID NO: 444340 - DNA, 15 bp, Homo sapiens
taaaatctcagtcat

SEQ ID NO: 444341 - DNA, 15 bp, Homo sapiens
aaaatctcagtcata

SEQ ID NO: 444342 - DNA, 15 bp, Homo sapiens
aaatctcagtcatag

SEQ ID NO: 444343 - DNA, 15 bp, Homo sapiens
aatctcagtcatagt

SEQ ID NO: 444344 - DNA, 15 bp, Homo sapiens
atctcagtcatagta

SEQ ID NO: 444345 - DNA, 15 bp, Homo sapiens
tctcagtcatagtaa

SEQ ID NO: 444346 - DNA, 15 bp, Homo sapiens
ctcagtcatagtaag

SEQ ID NO: 444347 - DNA, 15 bp, Homo sapiens
tcagtcatagtaagg

SEQ ID NO: 444348 - DNA, 15 bp, Homo sapiens
cagtcatagtaaggt

SEQ ID NO: 444349 - DNA, 15 bp, Homo sapiens
agtcatagtaaggtc

SEQ ID NO: 444350 - DNA, 15 bp, Homo sapiens
gtcatagtaaggtct

SEQ ID NO: 444351 - DNA, 15 bp, Homo sapiens
tcatagtaaggtcta

SEQ ID NO: 444352 - DNA, 15 bp, Homo sapiens
catagtaaggtctag

SEQ ID NO: 444353 - DNA, 15 bp, Homo sapiens
atagtaaggtctagt

SEQ ID NO: 444354 - DNA, 15 bp, Homo sapiens
tagtaaggtctagtg

SEQ ID NO: 444355 - DNA, 15 bp, Homo sapiens
agtaaggtctagtgc

SEQ ID NO: 444356 - DNA, 15 bp, Homo sapiens
gtaaggtctagtgca

SEQ ID NO: 444357 - DNA, 15 bp, Homo sapiens
taaggtctagtgcaa

SEQ ID NO: 444358 - DNA, 15 bp, Homo sapiens
aaggtctagtgcaaa

SEQ ID NO: 444359 - DNA, 15 bp, Homo sapiens
aggtctagtgcaaaa

SEQ ID NO: 444360 - DNA, 15 bp, Homo sapiens
ggtctagtgcaaaag

SEQ ID NO: 444361 - DNA, 15 bp, Homo sapiens
gtctagtgcaaaagt

SEQ ID NO: 444362 - DNA, 15 bp, Homo sapiens
tctagtgcaaaagta

SEQ ID NO: 444363 - DNA, 15 bp, Homo sapiens
ctagtgcaaaagtag

SEQ ID NO: 444364 - DNA, 15 bp, Homo sapiens
tagtgcaaaagtagg

SEQ ID NO: 444365 - DNA, 15 bp, Homo sapiens
agtgcaaaagtagga

SEQ ID NO: 444366 - DNA, 15 bp, Homo sapiens
gtgcaaaagtaggag

SEQ ID NO: 444367 - DNA, 15 bp, Homo sapiens
tgcaaaagtaggaga

SEQ ID NO: 444368 - DNA, 15 bp, Homo sapiens
gcaaaagtaggagac

SEQ ID NO: 444369 - DNA, 15 bp, Homo sapiens
caaaagtaggagact

SEQ ID NO: 444370 - DNA, 15 bp, Homo sapiens
aaaagtaggagactg

SEQ ID NO: 444371 - DNA, 15 bp, Homo sapiens
aaagtaggagactgg

SEQ ID NO: 444372 - DNA, 15 bp, Homo sapiens
aagtaggagactggg

SEQ ID NO: 444373 - DNA, 15 bp, Homo sapiens
agtaggagactgggc

SEQ ID NO: 444374 - DNA, 15 bp, Homo sapiens
gtaggagactgggct

SEQ ID NO: 444375 - DNA, 15 bp, Homo sapiens
taggagactgggctc

SEQ ID NO: 444376 - DNA, 15 bp, Homo sapiens
aggagactgggctct

SEQ ID NO: 444377 - DNA, 15 bp, Homo sapiens
ggagactgggctctc

SEQ ID NO: 444378 - DNA, 15 bp, Homo sapiens
gagactgggctctct

SEQ ID NO: 444379 - DNA, 15 bp, Homo sapiens
agactgggctctctg

SEQ ID NO: 444380 - DNA, 15 bp, Homo sapiens
gactgggctctctgt

SEQ ID NO: 444381 - DNA, 15 bp, Homo sapiens
actgggctctctgta

SEQ ID NO: 444382 - DNA, 15 bp, Homo sapiens
ctgggctctctgtat

SEQ ID NO: 444383 - DNA, 15 bp, Homo sapiens
tgggctctctgtatg

SEQ ID NO: 444384 - DNA, 15 bp, Homo sapiens
gggctctctgtatgt

SEQ ID NO: 444385 - DNA, 15 bp, Homo sapiens
ggctctctgtatgtt

SEQ ID NO: 444386 - DNA, 15 bp, Homo sapiens
gctctctgtatgttt

SEQ ID NO: 444387 - DNA, 15 bp, Homo sapiens
ctctctgtatgtttc

SEQ ID NO: 444388 - DNA, 15 bp, Homo sapiens
tctctgtatgtttca

SEQ ID NO: 444389 - DNA, 15 bp, Homo sapiens
ctctgtatgtttcag

SEQ ID NO: 444390 - DNA, 15 bp, Homo sapiens
tctgtatgtttcaga

SEQ ID NO: 444391 - DNA, 15 bp, Homo sapiens
ctgtatgtttcagat

SEQ ID NO: 444392 - DNA, 15 bp, Homo sapiens
tgtatgtttcagatg

SEQ ID NO: 444393 - DNA, 15 bp, Homo sapiens
gtatgtttcagatga

SEQ ID NO: 444394 - DNA, 15 bp, Homo sapiens
tatgtttcagatgaa

SEQ ID NO: 444395 - DNA, 15 bp, Homo sapiens
atgtttcagatgaaa

SEQ ID NO: 444396 - DNA, 15 bp, Homo sapiens
tgtttcagatgaaag

SEQ ID NO: 444397 - DNA, 15 bp, Homo sapiens
gtttcagatgaaagt

SEQ ID NO: 444398 - DNA, 15 bp, Homo sapiens
tttcagatgaaagta

SEQ ID NO: 444399 - DNA, 15 bp, Homo sapiens
ttcagatgaaagtaa

SEQ ID NO: 444400 - DNA, 15 bp, Homo sapiens
tcagatgaaagtaag

SEQ ID NO: 444401 - DNA, 15 bp, Homo sapiens
cagatgaaagtaaga

SEQ ID NO: 444402 - DNA, 15 bp, Homo sapiens
agatgaaagtaagaa

SEQ ID NO: 444403 - DNA, 15 bp, Homo sapiens
atgaaagtaagaaat

SEQ ID NO: 444404 - DNA, 15 bp, Homo sapiens
tgaaagtaagaaatt

SEQ ID NO: 444405 - DNA, 15 bp, Homo sapiens
gaaagtaagaaattg

SEQ ID NO: 444406 - DNA, 15 bp, Homo sapiens
aaagtaagaaattgg

SEQ ID NO: 444407 - DNA, 15 bp, Homo sapiens
aagtaagaaattggg

SEQ ID NO: 444408 - DNA, 15 bp, Homo sapiens
agtaagaaattggga

SEQ ID NO: 444409 - DNA, 15 bp, Homo sapiens
gtaagaaattgggat

SEQ ID NO: 444410 - DNA, 15 bp, Homo sapiens
taagaaattgggatt

SEQ ID NO: 444411 - DNA, 15 bp, Homo sapiens
aagaaattgggattt

SEQ ID NO: 444412 - DNA, 15 bp, Homo sapiens
agaaattgggatttt

SEQ ID NO: 444413 - DNA, 15 bp, Homo sapiens
gaaattgggattttt

SEQ ID NO: 444414 - DNA, 15 bp, Homo sapiens
aaattgggatttttc

SEQ ID NO: 444415 - DNA, 15 bp, Homo sapiens
aattgggatttttct

SEQ ID NO: 444416 - DNA, 15 bp, Homo sapiens
attgggatttttctg

SEQ ID NO: 444417 - DNA, 15 bp, Homo sapiens
ttgggatttttctgc

SEQ ID NO: 444418 - DNA, 15 bp, Homo sapiens
tgggatttttctgcc

SEQ ID NO: 444419 - DNA, 15 bp, Homo sapiens
gggatttttctgcct

SEQ ID NO: 444420 - DNA, 15 bp, Homo sapiens
ggatttttctgccta

SEQ ID NO: 444421 - DNA, 15 bp, Homo sapiens
gatttttctgcctag

SEQ ID NO: 444422 - DNA, 15 bp, Homo sapiens
atttttctgcctaga

SEQ ID NO: 444423 - DNA, 15 bp, Homo sapiens
tttttctgcctagac

SEQ ID NO: 444424 - DNA, 15 bp, Homo sapiens
ttttctgcctagacg

SEQ ID NO: 444425 - DNA, 15 bp, Homo sapiens
tttctgcctagacga

SEQ ID NO: 444426 - DNA, 15 bp, Homo sapiens
ttctgcctagacgat

SEQ ID NO: 444427 - DNA, 15 bp, Homo sapiens
tctgcctagacgatt

SEQ ID NO: 444428 - DNA, 15 bp, Homo sapiens
ctgcctagacgattg

SEQ ID NO: 444429 - DNA, 15 bp, Homo sapiens
tgcctagacgattgc

SEQ ID NO: 444430 - DNA, 15 bp, Homo sapiens
gcctagacgattgcc

SEQ ID NO: 444431 - DNA, 15 bp, Homo sapiens
cctagacgattgcct

SEQ ID NO: 444432 - DNA, 15 bp, Homo sapiens
ctagacgattgcctt

SEQ ID NO: 444433 - DNA, 15 bp, Homo sapiens
tagacgattgccttg

SEQ ID NO: 444434 - DNA, 15 bp, Homo sapiens
agacgattgccttgg

SEQ ID NO: 444435 - DNA, 15 bp, Homo sapiens
gacgattgccttggt

SEQ ID NO: 444436 - DNA, 15 bp, Homo sapiens
acgattgccttggtt

SEQ ID NO: 444437 - DNA, 15 bp, Homo sapiens
cgattgccttggttc

SEQ ID NO: 444438 - DNA, 15 bp, Homo sapiens
gattgccttggttct

SEQ ID NO: 444439 - DNA, 15 bp, Homo sapiens
attgccttggttctt

SEQ ID NO: 444440 - DNA, 15 bp, Homo sapiens
ttgccttggttcttc

SEQ ID NO: 444441 - DNA, 15 bp, Homo sapiens
tgccttggttcttca

SEQ ID NO: 444442 - DNA, 15 bp, Homo sapiens
gccttggttcttcac

SEQ ID NO: 444443 - DNA, 15 bp, Homo sapiens
ccttggttcttcaca

SEQ ID NO: 444444 - DNA, 15 bp, Homo sapiens
cttggttcttcacaa

SEQ ID NO: 444445 - DNA, 15 bp, Homo sapiens
ttggttcttcacaac

SEQ ID NO: 444446 - DNA, 15 bp, Homo sapiens
tggttcttcacaact

SEQ ID NO: 444447 - DNA, 15 bp, Homo sapiens
ggttcttcacaactt

SEQ ID NO: 444448 - DNA, 15 bp, Homo sapiens
gttcttcacaacttt

SEQ ID NO: 444449 - DNA, 15 bp, Homo sapiens
ttcttcacaactttt

SEQ ID NO: 444450 - DNA, 15 bp, Homo sapiens
tcttcacaacttttt

SEQ ID NO: 444451 - DNA, 15 bp, Homo sapiens
cttcacaactttttg

SEQ ID NO: 444452 - DNA, 15 bp, Homo sapiens
ttcacaactttttgc

SEQ ID NO: 444453 - DNA, 15 bp, Homo sapiens
tcacaactttttgcc

SEQ ID NO: 444454 - DNA, 15 bp, Homo sapiens
cacaactttttgcct

SEQ ID NO: 444455 - DNA, 15 bp, Homo sapiens
acaactttttgccta

SEQ ID NO: 444456 - DNA, 15 bp, Homo sapiens
caactttttgcctat

SEQ ID NO: 444457 - DNA, 15 bp, Homo sapiens
aactttttgcctatt

SEQ ID NO: 444458 - DNA, 15 bp, Homo sapiens
actttttgcctattt

SEQ ID NO: 444459 - DNA, 15 bp, Homo sapiens
ctttttgcctatttt

SEQ ID NO: 444460 - DNA, 15 bp, Homo sapiens
tttttgcctattttt

SEQ ID NO: 444461 - DNA, 15 bp, Homo sapiens
ttttgcctattttta

SEQ ID NO: 444462 - DNA, 15 bp, Homo sapiens
tttgcctatttttaa

SEQ ID NO: 444463 - DNA, 15 bp, Homo sapiens
ttgcctatttttaaa

SEQ ID NO: 444464 - DNA, 15 bp, Homo sapiens
tgcctatttttaaat

SEQ ID NO: 444465 - DNA, 15 bp, Homo sapiens
gcctatttttaaatt

SEQ ID NO: 444466 - DNA, 15 bp, Homo sapiens
cctatttttaaattc

SEQ ID NO: 444467 - DNA, 15 bp, Homo sapiens
ctatttttaaattcc

SEQ ID NO: 444468 - DNA, 15 bp, Homo sapiens
tatttttaaattcct

SEQ ID NO: 444469 - DNA, 15 bp, Homo sapiens
atttttaaattcctt

SEQ ID NO: 444470 - DNA, 15 bp, Homo sapiens
tttttaaattccttc

SEQ ID NO: 444471 - DNA, 15 bp, Homo sapiens
ttttaaattccttct

SEQ ID NO: 444472 - DNA, 15 bp, Homo sapiens
tttaaattccttctt

SEQ ID NO: 444473 - DNA, 15 bp, Homo sapiens
ttaaattccttcttt

SEQ ID NO: 444474 - DNA, 15 bp, Homo sapiens
taaattccttctttt

SEQ ID NO: 444475 - DNA, 15 bp, Homo sapiens
aaattccttcttttt

SEQ ID NO: 444476 - DNA, 15 bp, Homo sapiens
aattccttcttttta

SEQ ID NO: 444477 - DNA, 15 bp, Homo sapiens
attccttctttttaa

SEQ ID NO: 444478 - DNA, 15 bp, Homo sapiens
ttccttctttttaaa

SEQ ID NO: 444479 - DNA, 15 bp, Homo sapiens
tccttctttttaaat

SEQ ID NO: 444480 - DNA, 15 bp, Homo sapiens
ccttctttttaaatg

SEQ ID NO: 444481 - DNA, 15 bp, Homo sapiens
cttctttttaaatgt

SEQ ID NO: 444482 - DNA, 15 bp, Homo sapiens
ttctttttaaatgtt

SEQ ID NO: 444483 - DNA, 15 bp, Homo sapiens
tctttttaaatgtta

SEQ ID NO: 444484 - DNA, 15 bp, Homo sapiens
ctttttaaatgttat

SEQ ID NO: 444485 - DNA, 15 bp, Homo sapiens
tttttaaatgttata

SEQ ID NO: 444486 - DNA, 15 bp, Homo sapiens
ttttaaatgttatag

SEQ ID NO: 444487 - DNA, 15 bp, Homo sapiens
tttaaatgttataga

SEQ ID NO: 444488 - DNA, 15 bp, Homo sapiens
ttaaatgttatagaa

SEQ ID NO: 444489 - DNA, 15 bp, Homo sapiens
taaatgttatagaat

SEQ ID NO: 444490 - DNA, 15 bp, Homo sapiens
aaatgttatagaatt

SEQ ID NO: 444491 - DNA, 15 bp, Homo sapiens
aatgttatagaattg

SEQ ID NO: 444492 - DNA, 15 bp, Homo sapiens
atgttatagaattga

SEQ ID NO: 444493 - DNA, 15 bp, Homo sapiens
tgttatagaattgaa

SEQ ID NO: 444494 - DNA, 15 bp, Homo sapiens
gttatagaattgaat

SEQ ID NO: 444495 - DNA, 15 bp, Homo sapiens
ttatagaattgaatt

SEQ ID NO: 444496 - DNA, 15 bp, Homo sapiens
tatagaattgaattt

SEQ ID NO: 444497 - DNA, 15 bp, Homo sapiens
atagaattgaattta

SEQ ID NO: 444498 - DNA, 15 bp, Homo sapiens
tagaattgaatttac

SEQ ID NO: 444499 - DNA, 15 bp, Homo sapiens
agaattgaatttact

SEQ ID NO: 444500 - DNA, 15 bp, Homo sapiens
gaattgaatttactt

SEQ ID NO: 444501 - DNA, 15 bp, Homo sapiens
aattgaatttactta

SEQ ID NO: 444502 - DNA, 15 bp, Homo sapiens
attgaatttacttaa

SEQ ID NO: 444503 - DNA, 15 bp, Homo sapiens
ttgaatttacttaaa

SEQ ID NO: 444504 - DNA, 15 bp, Homo sapiens
tgaatttacttaaat

SEQ ID NO: 444505 - DNA, 15 bp, Homo sapiens
gaatttacttaaatg

SEQ ID NO: 444506 - DNA, 15 bp, Homo sapiens
aatttacttaaatgc

SEQ ID NO: 444507 - DNA, 15 bp, Homo sapiens
atttacttaaatgcc

SEQ ID NO: 444508 - DNA, 15 bp, Homo sapiens
tttacttaaatgcca

SEQ ID NO: 444509 - DNA, 15 bp, Homo sapiens
ttacttaaatgccat

SEQ ID NO: 444510 - DNA, 15 bp, Homo sapiens
tacttaaatgccatc

SEQ ID NO: 444511 - DNA, 15 bp, Homo sapiens
acttaaatgccatct

SEQ ID NO: 444512 - DNA, 15 bp, Homo sapiens
cttaaatgccatctg

SEQ ID NO: 444513 - DNA, 15 bp, Homo sapiens
ttaaatgccatctgt

SEQ ID NO: 444514 - DNA, 15 bp, Homo sapiens
taaatgccatctgta

SEQ ID NO: 444515 - DNA, 15 bp, Homo sapiens
aaatgccatctgtac

SEQ ID NO: 444516 - DNA, 15 bp, Homo sapiens
aatgccatctgtact

SEQ ID NO: 444517 - DNA, 15 bp, Homo sapiens
atgccatctgtactc

SEQ ID NO: 444518 - DNA, 15 bp, Homo sapiens
tgccatctgtactca

SEQ ID NO: 444519 - DNA, 15 bp, Homo sapiens
gccatctgtactcaa

SEQ ID NO: 444520 - DNA, 15 bp, Homo sapiens
ccatctgtactcaat

SEQ ID NO: 444521 - DNA, 15 bp, Homo sapiens
catctgtactcaata

SEQ ID NO: 444522 - DNA, 15 bp, Homo sapiens
atctgtactcaatag

SEQ ID NO: 444523 - DNA, 15 bp, Homo sapiens
tctgtactcaatagc

SEQ ID NO: 444524 - DNA, 15 bp, Homo sapiens
ctgtactcaatagct

SEQ ID NO: 444525 - DNA, 15 bp, Homo sapiens
tgtactcaatagcta

SEQ ID NO: 444526 - DNA, 15 bp, Homo sapiens
gtactcaatagctac

SEQ ID NO: 444527 - DNA, 15 bp, Homo sapiens
tactcaatagctact

SEQ ID NO: 444528 - DNA, 15 bp, Homo sapiens
actcaatagctactc

SEQ ID NO: 444529 - DNA, 15 bp, Homo sapiens
ctcaatagctactcc

SEQ ID NO: 444530 - DNA, 15 bp, Homo sapiens
tcaatagctactcct

SEQ ID NO: 444531 - DNA, 15 bp, Homo sapiens
caatagctactcctg

SEQ ID NO: 444532 - DNA, 15 bp, Homo sapiens
aatagctactcctgt

SEQ ID NO: 444533 - DNA, 15 bp, Homo sapiens
atagctactcctgtg

SEQ ID NO: 444534 - DNA, 15 bp, Homo sapiens
tagctactcctgtga

SEQ ID NO: 444535 - DNA, 15 bp, Homo sapiens
agctactcctgtgac

SEQ ID NO: 444536 - DNA, 15 bp, Homo sapiens
gctactcctgtgact

SEQ ID NO: 444537 - DNA, 15 bp, Homo sapiens
ctactcctgtgacta

SEQ ID NO: 444538 - DNA, 15 bp, Homo sapiens
tactcctgtgactac

SEQ ID NO: 444539 - DNA, 15 bp, Homo sapiens
actcctgtgactacg

SEQ ID NO: 444540 - DNA, 15 bp, Homo sapiens
ctcctgtgactacga

SEQ ID NO: 444541 - DNA, 15 bp, Homo sapiens
tcctgtgactacgat

SEQ ID NO: 444542 - DNA, 15 bp, Homo sapiens
cctgtgactacgatg

SEQ ID NO: 444543 - DNA, 15 bp, Homo sapiens
ctgtgactacgatgc

SEQ ID NO: 444544 - DNA, 15 bp, Homo sapiens
tgtgactacgatgca

SEQ ID NO: 444545 - DNA, 15 bp, Homo sapiens
gtgactacgatgcaa

SEQ ID NO: 444546 - DNA, 15 bp, Homo sapiens
tgactacgatgcaaa

SEQ ID NO: 444547 - DNA, 15 bp, Homo sapiens
gactacgatgcaaag

SEQ ID NO: 444548 - DNA, 15 bp, Homo sapiens
actacgatgcaaagt

SEQ ID NO: 444549 - DNA, 15 bp, Homo sapiens
ctacgatgcaaagta

SEQ ID NO: 444550 - DNA, 15 bp, Homo sapiens
tacgatgcaaagtaa

SEQ ID NO: 444551 - DNA, 15 bp, Homo sapiens
acgatgcaaagtaaa

SEQ ID NO: 444552 - DNA, 15 bp, Homo sapiens
cgatgcaaagtaaac

SEQ ID NO: 444553 - DNA, 15 bp, Homo sapiens
gatgcaaagtaaaca

SEQ ID NO: 444554 - DNA, 15 bp, Homo sapiens
atgcaaagtaaacaa

SEQ ID NO: 444555 - DNA, 15 bp, Homo sapiens
tgcaaagtaaacaat

SEQ ID NO: 444556 - DNA, 15 bp, Homo sapiens
gcaaagtaaacaatg

SEQ ID NO: 444557 - DNA, 15 bp, Homo sapiens
caaagtaaacaatgt

SEQ ID NO: 444558 - DNA, 15 bp, Homo sapiens
aaagtaaacaatgtt

SEQ ID NO: 444559 - DNA, 15 bp, Homo sapiens
aagtaaacaatgtta

SEQ ID NO: 444560 - DNA, 15 bp, Homo sapiens
agtaaacaatgttat

SEQ ID NO: 444561 - DNA, 15 bp, Homo sapiens
gtaaacaatgttatt

SEQ ID NO: 444562 - DNA, 15 bp, Homo sapiens
taaacaatgttatta

SEQ ID NO: 444563 - DNA, 15 bp, Homo sapiens
aaacaatgttattag

SEQ ID NO: 444564 - DNA, 15 bp, Homo sapiens
aacaatgttattagt

SEQ ID NO: 444565 - DNA, 15 bp, Homo sapiens
acaatgttattagtc

SEQ ID NO: 444566 - DNA, 15 bp, Homo sapiens
caatgttattagtca

SEQ ID NO: 444567 - DNA, 15 bp, Homo sapiens
aatgttattagtcat

SEQ ID NO: 444568 - DNA, 15 bp, Homo sapiens
atgttattagtcatc

SEQ ID NO: 444569 - DNA, 15 bp, Homo sapiens
tgttattagtcatct

SEQ ID NO: 444570 - DNA, 15 bp, Homo sapiens
gttattagtcatctg

SEQ ID NO: 444571 - DNA, 15 bp, Homo sapiens
ttattagtcatctgg

SEQ ID NO: 444572 - DNA, 15 bp, Homo sapiens
tattagtcatctgga

SEQ ID NO: 444573 - DNA, 15 bp, Homo sapiens
attagtcatctggaa

SEQ ID NO: 444574 - DNA, 15 bp, Homo sapiens
ttagtcatctggaaa

SEQ ID NO: 444575 - DNA, 15 bp, Homo sapiens
tagtcatctggaaaa

SEQ ID NO: 444576 - DNA, 15 bp, Homo sapiens
agtcatctggaaaat

SEQ ID NO: 444577 - DNA, 15 bp, Homo sapiens
gtcatctggaaaatt

SEQ ID NO: 444578 - DNA, 15 bp, Homo sapiens
tcatctggaaaattc

SEQ ID NO: 444579 - DNA, 15 bp, Homo sapiens
catctggaaaattcg

SEQ ID NO: 444580 - DNA, 15 bp, Homo sapiens
atctggaaaattcgg

SEQ ID NO: 444581 - DNA, 15 bp, Homo sapiens
tctggaaaattcggt

SEQ ID NO: 444582 - DNA, 15 bp, Homo sapiens
ctggaaaattcggtc

SEQ ID NO: 444583 - DNA, 15 bp, Homo sapiens
tggaaaattcggtct

SEQ ID NO: 444584 - DNA, 15 bp, Homo sapiens
ggaaaattcggtctt

SEQ ID NO: 444585 - DNA, 15 bp, Homo sapiens
gaaaattcggtcttg

SEQ ID NO: 444586 - DNA, 15 bp, Homo sapiens
aaaattcggtcttga

SEQ ID NO: 444587 - DNA, 15 bp, Homo sapiens
aaattcggtcttgaa

SEQ ID NO: 444588 - DNA, 15 bp, Homo sapiens
aattcggtcttgaaa

SEQ ID NO: 444589 - DNA, 15 bp, Homo sapiens
attcggtcttgaaaa

SEQ ID NO: 444590 - DNA, 15 bp, Homo sapiens
ttcggtcttgaaaaa

SEQ ID NO: 444591 - DNA, 15 bp, Homo sapiens
tcggtcttgaaaaat

SEQ ID NO: 444592 - DNA, 15 bp, Homo sapiens
cggtcttgaaaaatc

SEQ ID NO: 444593 - DNA, 15 bp, Homo sapiens
ggtcttgaaaaatct

SEQ ID NO: 444594 - DNA, 15 bp, Homo sapiens
gtcttgaaaaatcta

SEQ ID NO: 444595 - DNA, 15 bp, Homo sapiens
tcttgaaaaatctaa

SEQ ID NO: 444596 - DNA, 15 bp, Homo sapiens
cttgaaaaatctaat

SEQ ID NO: 444597 - DNA, 15 bp, Homo sapiens
ttgaaaaatctaatt

SEQ ID NO: 444598 - DNA, 15 bp, Homo sapiens
tgaaaaatctaattt

SEQ ID NO: 444599 - DNA, 15 bp, Homo sapiens
gaaaaatctaatttt

SEQ ID NO: 444600 - DNA, 15 bp, Homo sapiens
aaaaatctaattttt

SEQ ID NO: 444601 - DNA, 15 bp, Homo sapiens
aaaatctaattttta

SEQ ID NO: 444602 - DNA, 15 bp, Homo sapiens
aaatctaatttttaa

SEQ ID NO: 444603 - DNA, 15 bp, Homo sapiens
aatctaatttttaat

SEQ ID NO: 444604 - DNA, 15 bp, Homo sapiens
atctaatttttaatc

SEQ ID NO: 444605 - DNA, 15 bp, Homo sapiens
tctaatttttaatct

SEQ ID NO: 444606 - DNA, 15 bp, Homo sapiens
ctaatttttaatctg

SEQ ID NO: 444607 - DNA, 15 bp, Homo sapiens
taatttttaatctgg

SEQ ID NO: 444608 - DNA, 15 bp, Homo sapiens
aatttttaatctgga

SEQ ID NO: 444609 - DNA, 15 bp, Homo sapiens
atttttaatctggat

SEQ ID NO: 444610 - DNA, 15 bp, Homo sapiens
tttttaatctggata

SEQ ID NO: 444611 - DNA, 15 bp, Homo sapiens
ttttaatctggatat

SEQ ID NO: 444612 - DNA, 15 bp, Homo sapiens
tttaatctggatata

SEQ ID NO: 444613 - DNA, 15 bp, Homo sapiens
ttaatctggatatac

SEQ ID NO: 444614 - DNA, 15 bp, Homo sapiens
taatctggatatacc

SEQ ID NO: 444615 - DNA, 15 bp, Homo sapiens
aatctggatatacca

SEQ ID NO: 444616 - DNA, 15 bp, Homo sapiens
atctggatataccag

SEQ ID NO: 444617 - DNA, 15 bp, Homo sapiens
tctggatataccagg

SEQ ID NO: 444618 - DNA, 15 bp, Homo sapiens
ctggatataccaggt

SEQ ID NO: 444619 - DNA, 15 bp, Homo sapiens
tggatataccaggta

SEQ ID NO: 444620 - DNA, 15 bp, Homo sapiens
ggatataccaggtaa

SEQ ID NO: 444621 - DNA, 15 bp, Homo sapiens
gatataccaggtaaa

SEQ ID NO: 444622 - DNA, 15 bp, Homo sapiens
atataccaggtaaaa

SEQ ID NO: 444623 - DNA, 15 bp, Homo sapiens
tataccaggtaaaat

SEQ ID NO: 444624 - DNA, 15 bp, Homo sapiens
ataccaggtaaaatt

SEQ ID NO: 444625 - DNA, 15 bp, Homo sapiens
taccaggtaaaatta

SEQ ID NO: 444626 - DNA, 15 bp, Homo sapiens
accaggtaaaattaa

SEQ ID NO: 444627 - DNA, 15 bp, Homo sapiens
ccaggtaaaattaat

SEQ ID NO: 444628 - DNA, 15 bp, Homo sapiens
caggtaaaattaatt

SEQ ID NO: 444629 - DNA, 15 bp, Homo sapiens
aggtaaaattaattt

SEQ ID NO: 444630 - DNA, 15 bp, Homo sapiens
ggtaaaattaatttt

SEQ ID NO: 444631 - DNA, 15 bp, Homo sapiens
gtaaaattaattttg

SEQ ID NO: 444632 - DNA, 15 bp, Homo sapiens
aaaattaattttggt

SEQ ID NO: 444633 - DNA, 15 bp, Homo sapiens
aaattaattttggtt

SEQ ID NO: 444634 - DNA, 15 bp, Homo sapiens
aattaattttggttt

SEQ ID NO: 444635 - DNA, 15 bp, Homo sapiens
attaattttggtttt

SEQ ID NO: 444636 - DNA, 15 bp, Homo sapiens
ttaattttggtttta

SEQ ID NO: 444637 - DNA, 15 bp, Homo sapiens
taattttggttttag

SEQ ID NO: 444638 - DNA, 15 bp, Homo sapiens
aattttggttttagc

SEQ ID NO: 444639 - DNA, 15 bp, Homo sapiens
attttggttttagct

SEQ ID NO: 444640 - DNA, 15 bp, Homo sapiens
ttttggttttagctt

SEQ ID NO: 444641 - DNA, 15 bp, Homo sapiens
tttggttttagcttt

SEQ ID NO: 444642 - DNA, 15 bp, Homo sapiens
ttggttttagcttta

SEQ ID NO: 444643 - DNA, 15 bp, Homo sapiens
tggttttagctttat

SEQ ID NO: 444644 - DNA, 15 bp, Homo sapiens
ggttttagctttatc

SEQ ID NO: 444645 - DNA, 15 bp, Homo sapiens
gttttagctttatca

SEQ ID NO: 444646 - DNA, 15 bp, Homo sapiens
ttttagctttatcaa

SEQ ID NO: 444647 - DNA, 15 bp, Homo sapiens
tttagctttatcaaa

SEQ ID NO: 444648 - DNA, 15 bp, Homo sapiens
ttagctttatcaaaa

SEQ ID NO: 444649 - DNA, 15 bp, Homo sapiens
tagctttatcaaaaa

SEQ ID NO: 444650 - DNA, 15 bp, Homo sapiens
agctttatcaaaaat

SEQ ID NO: 444651 - DNA, 15 bp, Homo sapiens
gctttatcaaaaata

SEQ ID NO: 444652 - DNA, 15 bp, Homo sapiens
ctttatcaaaaatat

SEQ ID NO: 444653 - DNA, 15 bp, Homo sapiens
tttatcaaaaatata

SEQ ID NO: 444654 - DNA, 15 bp, Homo sapiens
ttatcaaaaatatat

SEQ ID NO: 444655 - DNA, 15 bp, Homo sapiens
tatcaaaaatatata

SEQ ID NO: 444656 - DNA, 15 bp, Homo sapiens
atcaaaaatatatat

SEQ ID NO: 444657 - DNA, 15 bp, Homo sapiens
tcaaaaatatatatg

SEQ ID NO: 444658 - DNA, 15 bp, Homo sapiens
caaaaatatatatgg

SEQ ID NO: 444659 - DNA, 15 bp, Homo sapiens
aaaaatatatatgga

SEQ ID NO: 444660 - DNA, 15 bp, Homo sapiens
aaaatatatatggag

SEQ ID NO: 444661 - DNA, 15 bp, Homo sapiens
aaatatatatggagt

SEQ ID NO: 444662 - DNA, 15 bp, Homo sapiens
aatatatatggagta

SEQ ID NO: 444663 - DNA, 15 bp, Homo sapiens
atatatatggagtac

SEQ ID NO: 444664 - DNA, 15 bp, Homo sapiens
tatatatggagtaca

SEQ ID NO: 444665 - DNA, 15 bp, Homo sapiens
atatatggagtacag

SEQ ID NO: 444666 - DNA, 15 bp, Homo sapiens
tatatggagtacagt

SEQ ID NO: 444667 - DNA, 15 bp, Homo sapiens
atatggagtacagtt

SEQ ID NO: 444668 - DNA, 15 bp, Homo sapiens
tatggagtacagttt

SEQ ID NO: 444669 - DNA, 15 bp, Homo sapiens
atggagtacagtttc

SEQ ID NO: 444670 - DNA, 15 bp, Homo sapiens
tggagtacagtttcc

SEQ ID NO: 444671 - DNA, 15 bp, Homo sapiens
ggagtacagtttcca

SEQ ID NO: 444672 - DNA, 15 bp, Homo sapiens
gagtacagtttccag

SEQ ID NO: 444673 - DNA, 15 bp, Homo sapiens
agtacagtttccaga

SEQ ID NO: 444674 - DNA, 15 bp, Homo sapiens
gtacagtttccagat

SEQ ID NO: 444675 - DNA, 15 bp, Homo sapiens
tacagtttccagatg

SEQ ID NO: 444676 - DNA, 15 bp, Homo sapiens
acagtttccagatgg

SEQ ID NO: 444677 - DNA, 15 bp, Homo sapiens
cagtttccagatggc

SEQ ID NO: 444678 - DNA, 15 bp, Homo sapiens
agtttccagatggca

SEQ ID NO: 444679 - DNA, 15 bp, Homo sapiens
gtttccagatggcac

SEQ ID NO: 444680 - DNA, 15 bp, Homo sapiens
tttccagatggcact

SEQ ID NO: 444681 - DNA, 15 bp, Homo sapiens
ttccagatggcacta

SEQ ID NO: 444682 - DNA, 15 bp, Homo sapiens
tccagatggcactaa

SEQ ID NO: 444683 - DNA, 15 bp, Homo sapiens
ccagatggcactaag

SEQ ID NO: 444684 - DNA, 15 bp, Homo sapiens
cagatggcactaagg

SEQ ID NO: 444685 - DNA, 15 bp, Homo sapiens
agatggcactaaggt

SEQ ID NO: 444686 - DNA, 15 bp, Homo sapiens
gatggcactaaggtt

SEQ ID NO: 444687 - DNA, 15 bp, Homo sapiens
atggcactaaggttt

SEQ ID NO: 444688 - DNA, 15 bp, Homo sapiens
tggcactaaggttta

SEQ ID NO: 444689 - DNA, 15 bp, Homo sapiens
ggcactaaggtttaa

SEQ ID NO: 444690 - DNA, 15 bp, Homo sapiens
gcactaaggtttaaa

SEQ ID NO: 444691 - DNA, 15 bp, Homo sapiens
cactaaggtttaaac

SEQ ID NO: 444692 - DNA, 15 bp, Homo sapiens
actaaggtttaaact

SEQ ID NO: 444693 - DNA, 15 bp, Homo sapiens
ctaaggtttaaactg

SEQ ID NO: 444694 - DNA, 15 bp, Homo sapiens
taaggtttaaactgt

SEQ ID NO: 444695 - DNA, 15 bp, Homo sapiens
aaggtttaaactgta

SEQ ID NO: 444696 - DNA, 15 bp, Homo sapiens
aggtttaaactgtag

SEQ ID NO: 444697 - DNA, 15 bp, Homo sapiens
ggtttaaactgtagt

SEQ ID NO: 444698 - DNA, 15 bp, Homo sapiens
gtttaaactgtagta

SEQ ID NO: 444699 - DNA, 15 bp, Homo sapiens
tttaaactgtagtat

SEQ ID NO: 444700 - DNA, 15 bp, Homo sapiens
ttaaactgtagtatt

SEQ ID NO: 444701 - DNA, 15 bp, Homo sapiens
taaactgtagtattt

SEQ ID NO: 444702 - DNA, 15 bp, Homo sapiens
aaactgtagtattta

SEQ ID NO: 444703 - DNA, 15 bp, Homo sapiens
aactgtagtatttat

SEQ ID NO: 444704 - DNA, 15 bp, Homo sapiens
actgtagtatttata

SEQ ID NO: 444705 - DNA, 15 bp, Homo sapiens
ctgtagtatttataa

SEQ ID NO: 444706 - DNA, 15 bp, Homo sapiens
tgtagtatttataag

SEQ ID NO: 444707 - DNA, 15 bp, Homo sapiens
gtagtatttataagc

SEQ ID NO: 444708 - DNA, 15 bp, Homo sapiens
tagtatttataagca

SEQ ID NO: 444709 - DNA, 15 bp, Homo sapiens
agtatttataagcaa

SEQ ID NO: 444710 - DNA, 15 bp, Homo sapiens
gtatttataagcaac

SEQ ID NO: 444711 - DNA, 15 bp, Homo sapiens
tatttataagcaaca

SEQ ID NO: 444712 - DNA, 15 bp, Homo sapiens
atttataagcaacac

SEQ ID NO: 444713 - DNA, 15 bp, Homo sapiens
tttataagcaacacc

SEQ ID NO: 444714 - DNA, 15 bp, Homo sapiens
ttataagcaacacca

SEQ ID NO: 444715 - DNA, 15 bp, Homo sapiens
tataagcaacaccat

SEQ ID NO: 444716 - DNA, 15 bp, Homo sapiens
ataagcaacaccatt

SEQ ID NO: 444717 - DNA, 15 bp, Homo sapiens
taagcaacaccattt

SEQ ID NO: 444718 - DNA, 15 bp, Homo sapiens
aagcaacaccatttg

SEQ ID NO: 444719 - DNA, 15 bp, Homo sapiens
agcaacaccatttga

SEQ ID NO: 444720 - DNA, 15 bp, Homo sapiens
gcaacaccatttgaa

SEQ ID NO: 444721 - DNA, 15 bp, Homo sapiens
caacaccatttgaaa

SEQ ID NO: 444722 - DNA, 15 bp, Homo sapiens
aacaccatttgaaag

SEQ ID NO: 444723 - DNA, 15 bp, Homo sapiens
acaccatttgaaagt

SEQ ID NO: 444724 - DNA, 15 bp, Homo sapiens
caccatttgaaagtt

SEQ ID NO: 444725 - DNA, 15 bp, Homo sapiens
accatttgaaagttt

SEQ ID NO: 444726 - DNA, 15 bp, Homo sapiens
ccatttgaaagttta

SEQ ID NO: 444727 - DNA, 15 bp, Homo sapiens
catttgaaagtttaa

SEQ ID NO: 444728 - DNA, 15 bp, Homo sapiens
atttgaaagtttaaa

SEQ ID NO: 444729 - DNA, 15 bp, Homo sapiens
tttgaaagtttaaaa

SEQ ID NO: 444730 - DNA, 15 bp, Homo sapiens
ttgaaagtttaaaag

SEQ ID NO: 444731 - DNA, 15 bp, Homo sapiens
tgaaagtttaaaagt

SEQ ID NO: 444732 - DNA, 15 bp, Homo sapiens
gaaagtttaaaagta

SEQ ID NO: 444733 - DNA, 15 bp, Homo sapiens
aaagtttaaaagtat

SEQ ID NO: 444734 - DNA, 15 bp, Homo sapiens
aagtttaaaagtatt

SEQ ID NO: 444735 - DNA, 15 bp, Homo sapiens
agtttaaaagtattt

SEQ ID NO: 444736 - DNA, 15 bp, Homo sapiens
gtttaaaagtatttt

SEQ ID NO: 444737 - DNA, 15 bp, Homo sapiens
tttaaaagtattttt

SEQ ID NO: 444738 - DNA, 15 bp, Homo sapiens
ttaaaagtattttta

SEQ ID NO: 444739 - DNA, 15 bp, Homo sapiens
taaaagtatttttat

SEQ ID NO: 444740 - DNA, 15 bp, Homo sapiens
aaaagtatttttatc

SEQ ID NO: 444741 - DNA, 15 bp, Homo sapiens
aaagtatttttatca

SEQ ID NO: 444742 - DNA, 15 bp, Homo sapiens
aagtatttttatcaa

SEQ ID NO: 444743 - DNA, 15 bp, Homo sapiens
agtatttttatcaac

SEQ ID NO: 444744 - DNA, 15 bp, Homo sapiens
gtatttttatcaaca

SEQ ID NO: 444745 - DNA, 15 bp, Homo sapiens
tatttttatcaacag

SEQ ID NO: 444746 - DNA, 15 bp, Homo sapiens
atttttatcaacagg

SEQ ID NO: 444747 - DNA, 15 bp, Homo sapiens
tttttatcaacaggt

SEQ ID NO: 444748 - DNA, 15 bp, Homo sapiens
ttttatcaacaggtt

SEQ ID NO: 444749 - DNA, 15 bp, Homo sapiens
tttatcaacaggtta

SEQ ID NO: 444750 - DNA, 15 bp, Homo sapiens
ttatcaacaggttag

SEQ ID NO: 444751 - DNA, 15 bp, Homo sapiens
tatcaacaggttaga

SEQ ID NO: 444752 - DNA, 15 bp, Homo sapiens
atcaacaggttagat

SEQ ID NO: 444753 - DNA, 15 bp, Homo sapiens
tcaacaggttagatt

SEQ ID NO: 444754 - DNA, 15 bp, Homo sapiens
caacaggttagatta

SEQ ID NO: 444755 - DNA, 15 bp, Homo sapiens
aacaggttagattag

SEQ ID NO: 444756 - DNA, 15 bp, Homo sapiens
acaggttagattagt

SEQ ID NO: 444757 - DNA, 15 bp, Homo sapiens
caggttagattagtt

SEQ ID NO: 444758 - DNA, 15 bp, Homo sapiens
aggttagattagttg

SEQ ID NO: 444759 - DNA, 15 bp, Homo sapiens
ggttagattagttgg

SEQ ID NO: 444760 - DNA, 15 bp, Homo sapiens
gttagattagttggc

SEQ ID NO: 444761 - DNA, 15 bp, Homo sapiens
ttagattagttggca

SEQ ID NO: 444762 - DNA, 15 bp, Homo sapiens
tagattagttggcat

SEQ ID NO: 444763 - DNA, 15 bp, Homo sapiens
agattagttggcatt

SEQ ID NO: 444764 - DNA, 15 bp, Homo sapiens
gattagttggcatta

SEQ ID NO: 444765 - DNA, 15 bp, Homo sapiens
attagttggcattag

SEQ ID NO: 444766 - DNA, 15 bp, Homo sapiens
ttagttggcattaga

SEQ ID NO: 444767 - DNA, 15 bp, Homo sapiens
tagttggcattagac

SEQ ID NO: 444768 - DNA, 15 bp, Homo sapiens
agttggcattagacc

SEQ ID NO: 444769 - DNA, 15 bp, Homo sapiens
gttggcattagacct

SEQ ID NO: 444770 - DNA, 15 bp, Homo sapiens
ttggcattagacctt

SEQ ID NO: 444771 - DNA, 15 bp, Homo sapiens
tggcattagaccttg

SEQ ID NO: 444772 - DNA, 15 bp, Homo sapiens
ggcattagaccttga

SEQ ID NO: 444773 - DNA, 15 bp, Homo sapiens
gcattagaccttgaa

SEQ ID NO: 444774 - DNA, 15 bp, Homo sapiens
cattagaccttgaac

SEQ ID NO: 444775 - DNA, 15 bp, Homo sapiens
attagaccttgaacc

SEQ ID NO: 444776 - DNA, 15 bp, Homo sapiens
ttagaccttgaacct

SEQ ID NO: 444777 - DNA, 15 bp, Homo sapiens
tagaccttgaacctg

SEQ ID NO: 444778 - DNA, 15 bp, Homo sapiens
agaccttgaacctgt

SEQ ID NO: 444779 - DNA, 15 bp, Homo sapiens
gaccttgaacctgta

SEQ ID NO: 444780 - DNA, 15 bp, Homo sapiens
accttgaacctgtat

SEQ ID NO: 444781 - DNA, 15 bp, Homo sapiens
ccttgaacctgtatt

SEQ ID NO: 444782 - DNA, 15 bp, Homo sapiens
cttgaacctgtattg

SEQ ID NO: 444783 - DNA, 15 bp, Homo sapiens
ttgaacctgtattgt

SEQ ID NO: 444784 - DNA, 15 bp, Homo sapiens
tgaacctgtattgtt

SEQ ID NO: 444785 - DNA, 15 bp, Homo sapiens
gaacctgtattgttt

SEQ ID NO: 444786 - DNA, 15 bp, Homo sapiens
aacctgtattgtttc

SEQ ID NO: 444787 - DNA, 15 bp, Homo sapiens
acctgtattgtttct

SEQ ID NO: 444788 - DNA, 15 bp, Homo sapiens
cctgtattgtttctt

SEQ ID NO: 444789 - DNA, 15 bp, Homo sapiens
ctgtattgtttcttg

SEQ ID NO: 444790 - DNA, 15 bp, Homo sapiens
tgtattgtttcttgt

SEQ ID NO: 444791 - DNA, 15 bp, Homo sapiens
gtattgtttcttgtt

SEQ ID NO: 444792 - DNA, 15 bp, Homo sapiens
tattgtttcttgttt

SEQ ID NO: 444793 - DNA, 15 bp, Homo sapiens
attgtttcttgtttt

SEQ ID NO: 444794 - DNA, 15 bp, Homo sapiens
ttgtttcttgtttta

SEQ ID NO: 444795 - DNA, 15 bp, Homo sapiens
tgtttcttgttttac

SEQ ID NO: 444796 - DNA, 15 bp, Homo sapiens
gtttcttgttttact

SEQ ID NO: 444797 - DNA, 15 bp, Homo sapiens
tttcttgttttactt

SEQ ID NO: 444798 - DNA, 15 bp, Homo sapiens
ttcttgttttacttc

SEQ ID NO: 444799 - DNA, 15 bp, Homo sapiens
tcttgttttacttca

SEQ ID NO: 444800 - DNA, 15 bp, Homo sapiens
cttgttttacttcaa

SEQ ID NO: 444801 - DNA, 15 bp, Homo sapiens
ttgttttacttcaaa

SEQ ID NO: 444802 - DNA, 15 bp, Homo sapiens
tgttttacttcaaat

SEQ ID NO: 444803 - DNA, 15 bp, Homo sapiens
gttttacttcaaatg

SEQ ID NO: 444804 - DNA, 15 bp, Homo sapiens
ttttacttcaaatga

SEQ ID NO: 444805 - DNA, 15 bp, Homo sapiens
tttacttcaaatgaa

SEQ ID NO: 444806 - DNA, 15 bp, Homo sapiens
ttacttcaaatgaat

SEQ ID NO: 444807 - DNA, 15 bp, Homo sapiens
tacttcaaatgaatc

SEQ ID NO: 444808 - DNA, 15 bp, Homo sapiens
acttcaaatgaatcc

SEQ ID NO: 444809 - DNA, 15 bp, Homo sapiens
cttcaaatgaatcct

SEQ ID NO: 444810 - DNA, 15 bp, Homo sapiens
ttcaaatgaatcctt

SEQ ID NO: 444811 - DNA, 15 bp, Homo sapiens
tcaaatgaatcctta

SEQ ID NO: 444812 - DNA, 15 bp, Homo sapiens
caaatgaatccttaa

SEQ ID NO: 444813 - DNA, 15 bp, Homo sapiens
aaatgaatccttaaa

SEQ ID NO: 444814 - DNA, 15 bp, Homo sapiens
aatgaatccttaaag

SEQ ID NO: 444815 - DNA, 15 bp, Homo sapiens
atgaatccttaaagc

SEQ ID NO: 444816 - DNA, 15 bp, Homo sapiens
tgaatccttaaagcc

SEQ ID NO: 444817 - DNA, 15 bp, Homo sapiens
gaatccttaaagcca

SEQ ID NO: 444818 - DNA, 15 bp, Homo sapiens
aatccttaaagccat

SEQ ID NO: 444819 - DNA, 15 bp, Homo sapiens
atccttaaagccatt

SEQ ID NO: 444820 - DNA, 15 bp, Homo sapiens
tccttaaagccattt

SEQ ID NO: 444821 - DNA, 15 bp, Homo sapiens
ccttaaagccatttt

SEQ ID NO: 444822 - DNA, 15 bp, Homo sapiens
cttaaagccattttt

SEQ ID NO: 444823 - DNA, 15 bp, Homo sapiens
ttaaagccatttttt

SEQ ID NO: 444824 - DNA, 15 bp, Homo sapiens
taaagccattttttg

SEQ ID NO: 444825 - DNA, 15 bp, Homo sapiens
aaagccattttttgt

SEQ ID NO: 444826 - DNA, 15 bp, Homo sapiens
aagccattttttgtt

SEQ ID NO: 444827 - DNA, 15 bp, Homo sapiens
agccattttttgttt

SEQ ID NO: 444828 - DNA, 15 bp, Homo sapiens
gccattttttgtttg

SEQ ID NO: 444829 - DNA, 15 bp, Homo sapiens
ccattttttgtttgg

SEQ ID NO: 444830 - DNA, 15 bp, Homo sapiens
cattttttgtttggc

SEQ ID NO: 444831 - DNA, 15 bp, Homo sapiens
attttttgtttggcc

SEQ ID NO: 444832 - DNA, 15 bp, Homo sapiens
ttttttgtttggccc

SEQ ID NO: 444833 - DNA, 15 bp, Homo sapiens
tttttgtttggccca

SEQ ID NO: 444834 - DNA, 15 bp, Homo sapiens
ttttgtttggcccag

SEQ ID NO: 444835 - DNA, 15 bp, Homo sapiens
tttgtttggcccagt

SEQ ID NO: 444836 - DNA, 15 bp, Homo sapiens
ttgtttggcccagtg

SEQ ID NO: 444837 - DNA, 15 bp, Homo sapiens
tgtttggcccagtgg

SEQ ID NO: 444838 - DNA, 15 bp, Homo sapiens
gtttggcccagtgga

SEQ ID NO: 444839 - DNA, 15 bp, Homo sapiens
tttggcccagtggat

SEQ ID NO: 444840 - DNA, 15 bp, Homo sapiens
ttggcccagtggatc

SEQ ID NO: 444841 - DNA, 15 bp, Homo sapiens
tggcccagtggatct

SEQ ID NO: 444842 - DNA, 15 bp, Homo sapiens
ggcccagtggatctc

SEQ ID NO: 444843 - DNA, 15 bp, Homo sapiens
gcccagtggatctca

SEQ ID NO: 444844 - DNA, 15 bp, Homo sapiens
cccagtggatctcat

SEQ ID NO: 444845 - DNA, 15 bp, Homo sapiens
ccagtggatctcata

SEQ ID NO: 444846 - DNA, 15 bp, Homo sapiens
cagtggatctcataa

SEQ ID NO: 444847 - DNA, 15 bp, Homo sapiens
agtggatctcataat

SEQ ID NO: 444848 - DNA, 15 bp, Homo sapiens
gtggatctcataatt

SEQ ID NO: 444849 - DNA, 15 bp, Homo sapiens
tggatctcataatta

SEQ ID NO: 444850 - DNA, 15 bp, Homo sapiens
ggatctcataattat

SEQ ID NO: 444851 - DNA, 15 bp, Homo sapiens
gatctcataattata

SEQ ID NO: 444852 - DNA, 15 bp, Homo sapiens
atctcataattatag

SEQ ID NO: 444853 - DNA, 15 bp, Homo sapiens
tctcataattatagg

SEQ ID NO: 444854 - DNA, 15 bp, Homo sapiens
ctcataattatagga

SEQ ID NO: 444855 - DNA, 15 bp, Homo sapiens
tcataattataggaa

SEQ ID NO: 444856 - DNA, 15 bp, Homo sapiens
cataattataggaat

SEQ ID NO: 444857 - DNA, 15 bp, Homo sapiens
ataattataggaatc

SEQ ID NO: 444858 - DNA, 15 bp, Homo sapiens
taattataggaatcc

SEQ ID NO: 444859 - DNA, 15 bp, Homo sapiens
aattataggaatcca

SEQ ID NO: 444860 - DNA, 15 bp, Homo sapiens
attataggaatccag

SEQ ID NO: 444861 - DNA, 15 bp, Homo sapiens
ttataggaatccagc

SEQ ID NO: 444862 - DNA, 15 bp, Homo sapiens
tataggaatccagct

SEQ ID NO: 444863 - DNA, 15 bp, Homo sapiens
ataggaatccagctc

SEQ ID NO: 444864 - DNA, 15 bp, Homo sapiens
taggaatccagctca

SEQ ID NO: 444865 - DNA, 15 bp, Homo sapiens
aggaatccagctcag

SEQ ID NO: 444866 - DNA, 15 bp, Homo sapiens
ggaatccagctcaga

SEQ ID NO: 444867 - DNA, 15 bp, Homo sapiens
gaatccagctcagaa

SEQ ID NO: 444868 - DNA, 15 bp, Homo sapiens
aatccagctcagaaa

SEQ ID NO: 444869 - DNA, 15 bp, Homo sapiens
atccagctcagaaac

SEQ ID NO: 444870 - DNA, 15 bp, Homo sapiens
tccagctcagaaacc

SEQ ID NO: 444871 - DNA, 15 bp, Homo sapiens
ccagctcagaaacca

SEQ ID NO: 444872 - DNA, 15 bp, Homo sapiens
cagctcagaaaccag

SEQ ID NO: 444873 - DNA, 15 bp, Homo sapiens
agctcagaaaccaga

SEQ ID NO: 444874 - DNA, 15 bp, Homo sapiens
gctcagaaaccagag

SEQ ID NO: 444875 - DNA, 15 bp, Homo sapiens
ctcagaaaccagagc

SEQ ID NO: 444876 - DNA, 15 bp, Homo sapiens
tcagaaaccagagca

SEQ ID NO: 444877 - DNA, 15 bp, Homo sapiens
cagaaaccagagcag

SEQ ID NO: 444878 - DNA, 15 bp, Homo sapiens
agaaaccagagcagt

SEQ ID NO: 444879 - DNA, 15 bp, Homo sapiens
gaaaccagagcagtt

SEQ ID NO: 444880 - DNA, 15 bp, Homo sapiens
aaaccagagcagttc

SEQ ID NO: 444881 - DNA, 15 bp, Homo sapiens
aaccagagcagttca

SEQ ID NO: 444882 - DNA, 15 bp, Homo sapiens
accagagcagttcat

SEQ ID NO: 444883 - DNA, 15 bp, Homo sapiens
ccagagcagttcatt

SEQ ID NO: 444884 - DNA, 15 bp, Homo sapiens
cagagcagttcattg

SEQ ID NO: 444885 - DNA, 15 bp, Homo sapiens
agagcagttcattga

SEQ ID NO: 444886 - DNA, 15 bp, Homo sapiens
gagcagttcattgaa

SEQ ID NO: 444887 - DNA, 15 bp, Homo sapiens
agcagttcattgaat

SEQ ID NO: 444888 - DNA, 15 bp, Homo sapiens
gcagttcattgaatt

SEQ ID NO: 444889 - DNA, 15 bp, Homo sapiens
cagttcattgaattt

SEQ ID NO: 444890 - DNA, 15 bp, Homo sapiens
agttcattgaatttg

SEQ ID NO: 444891 - DNA, 15 bp, Homo sapiens
gttcattgaatttgc

SEQ ID NO: 444892 - DNA, 15 bp, Homo sapiens
ttcattgaatttgct

SEQ ID NO: 444893 - DNA, 15 bp, Homo sapiens
tcattgaatttgcta

SEQ ID NO: 444894 - DNA, 15 bp, Homo sapiens
cattgaatttgctat

SEQ ID NO: 444895 - DNA, 15 bp, Homo sapiens
attgaatttgctata

SEQ ID NO: 444896 - DNA, 15 bp, Homo sapiens
ttgaatttgctataa

SEQ ID NO: 444897 - DNA, 15 bp, Homo sapiens
tgaatttgctataaa

SEQ ID NO: 444898 - DNA, 15 bp, Homo sapiens
gaatttgctataaaa

SEQ ID NO: 444899 - DNA, 15 bp, Homo sapiens
aatttgctataaaat

SEQ ID NO: 444900 - DNA, 15 bp, Homo sapiens
atttgctataaaatg

SEQ ID NO: 444901 - DNA, 15 bp, Homo sapiens
tttgctataaaatgt

SEQ ID NO: 444902 - DNA, 15 bp, Homo sapiens
ttgctataaaatgtt

SEQ ID NO: 444903 - DNA, 15 bp, Homo sapiens
tgctataaaatgttc

SEQ ID NO: 444904 - DNA, 15 bp, Homo sapiens
gctataaaatgttca

SEQ ID NO: 444905 - DNA, 15 bp, Homo sapiens
ctataaaatgttcag

SEQ ID NO: 444906 - DNA, 15 bp, Homo sapiens
tataaaatgttcagt

SEQ ID NO: 444907 - DNA, 15 bp, Homo sapiens
ataaaatgttcagtt

SEQ ID NO: 444908 - DNA, 15 bp, Homo sapiens
taaaatgttcagttg

SEQ ID NO: 444909 - DNA, 15 bp, Homo sapiens
aaaatgttcagttgt

SEQ ID NO: 444910 - DNA, 15 bp, Homo sapiens
aaatgttcagttgtt

SEQ ID NO: 444911 - DNA, 15 bp, Homo sapiens
aatgttcagttgttt

SEQ ID NO: 444912 - DNA, 15 bp, Homo sapiens
atgttcagttgtttt

SEQ ID NO: 444913 - DNA, 15 bp, Homo sapiens
tgttcagttgttttg

SEQ ID NO: 444914 - DNA, 15 bp, Homo sapiens
gttcagttgttttgc

SEQ ID NO: 444915 - DNA, 15 bp, Homo sapiens
ttcagttgttttgca

SEQ ID NO: 444916 - DNA, 15 bp, Homo sapiens
tcagttgttttgcat

SEQ ID NO: 444917 - DNA, 15 bp, Homo sapiens
cagttgttttgcatt

SEQ ID NO: 444918 - DNA, 15 bp, Homo sapiens
agttgttttgcatta

SEQ ID NO: 444919 - DNA, 15 bp, Homo sapiens
gttgttttgcattaa

SEQ ID NO: 444920 - DNA, 15 bp, Homo sapiens
ttgttttgcattaag

SEQ ID NO: 444921 - DNA, 15 bp, Homo sapiens
tgttttgcattaagg

SEQ ID NO: 444922 - DNA, 15 bp, Homo sapiens
gttttgcattaaggt

SEQ ID NO: 444923 - DNA, 15 bp, Homo sapiens
ttttgcattaaggtg

SEQ ID NO: 444924 - DNA, 15 bp, Homo sapiens
tttgcattaaggtgt

SEQ ID NO: 444925 - DNA, 15 bp, Homo sapiens
ttgcattaaggtgta

SEQ ID NO: 444926 - DNA, 15 bp, Homo sapiens
tgcattaaggtgtaa

SEQ ID NO: 444927 - DNA, 15 bp, Homo sapiens
gcattaaggtgtaag

SEQ ID NO: 444928 - DNA, 15 bp, Homo sapiens
cattaaggtgtaagg

SEQ ID NO: 444929 - DNA, 15 bp, Homo sapiens
attaaggtgtaaggc

SEQ ID NO: 444930 - DNA, 15 bp, Homo sapiens
ttaaggtgtaaggct

SEQ ID NO: 444931 - DNA, 15 bp, Homo sapiens
taaggtgtaaggctt

SEQ ID NO: 444932 - DNA, 15 bp, Homo sapiens
aaggtgtaaggcttt

SEQ ID NO: 444933 - DNA, 15 bp, Homo sapiens
aggtgtaaggctttt

SEQ ID NO: 444934 - DNA, 15 bp, Homo sapiens
ggtgtaaggcttttt

SEQ ID NO: 444935 - DNA, 15 bp, Homo sapiens
gtgtaaggctttttg

SEQ ID NO: 444936 - DNA, 15 bp, Homo sapiens
tgtaaggctttttgg

SEQ ID NO: 444937 - DNA, 15 bp, Homo sapiens
gtaaggctttttggt

SEQ ID NO: 444938 - DNA, 15 bp, Homo sapiens
taaggctttttggtt

SEQ ID NO: 444939 - DNA, 15 bp, Homo sapiens
aaggctttttggttt

SEQ ID NO: 444940 - DNA, 15 bp, Homo sapiens
aggctttttggtttc

SEQ ID NO: 444941 - DNA, 15 bp, Homo sapiens
ggctttttggtttcc

SEQ ID NO: 444942 - DNA, 15 bp, Homo sapiens
gctttttggtttcca

SEQ ID NO: 444943 - DNA, 15 bp, Homo sapiens
ctttttggtttccaa

SEQ ID NO: 444944 - DNA, 15 bp, Homo sapiens
tttttggtttccaac

SEQ ID NO: 444945 - DNA, 15 bp, Homo sapiens
ttttggtttccaacg

SEQ ID NO: 444946 - DNA, 15 bp, Homo sapiens
tttggtttccaacgt

SEQ ID NO: 444947 - DNA, 15 bp, Homo sapiens
ttggtttccaacgtt

SEQ ID NO: 444948 - DNA, 15 bp, Homo sapiens
tggtttccaacgttt

SEQ ID NO: 444949 - DNA, 15 bp, Homo sapiens
ggtttccaacgtttc

SEQ ID NO: 444950 - DNA, 15 bp, Homo sapiens
gtttccaacgtttcc

SEQ ID NO: 444951 - DNA, 15 bp, Homo sapiens
tttccaacgtttcca

SEQ ID NO: 444952 - DNA, 15 bp, Homo sapiens
ttccaacgtttccaa

SEQ ID NO: 444953 - DNA, 15 bp, Homo sapiens
tccaacgtttccaat

SEQ ID NO: 444954 - DNA, 15 bp, Homo sapiens
ccaacgtttccaata

SEQ ID NO: 444955 - DNA, 15 bp, Homo sapiens
caacgtttccaataa

SEQ ID NO: 444956 - DNA, 15 bp, Homo sapiens
aacgtttccaataat

SEQ ID NO: 444957 - DNA, 15 bp, Homo sapiens
acgtttccaataatc

SEQ ID NO: 444958 - DNA, 15 bp, Homo sapiens
cgtttccaataatct

SEQ ID NO: 444959 - DNA, 15 bp, Homo sapiens
gtttccaataatctc

SEQ ID NO: 444960 - DNA, 15 bp, Homo sapiens
tttccaataatctcc

SEQ ID NO: 444961 - DNA, 15 bp, Homo sapiens
ttccaataatctccc

SEQ ID NO: 444962 - DNA, 15 bp, Homo sapiens
tccaataatctccct

SEQ ID NO: 444963 - DNA, 15 bp, Homo sapiens
ccaataatctccctt

SEQ ID NO: 444964 - DNA, 15 bp, Homo sapiens
caataatctcccttt

SEQ ID NO: 444965 - DNA, 15 bp, Homo sapiens
aataatctccctttg

SEQ ID NO: 444966 - DNA, 15 bp, Homo sapiens
ataatctccctttgt

SEQ ID NO: 444967 - DNA, 15 bp, Homo sapiens
taatctccctttgtt

SEQ ID NO: 444968 - DNA, 15 bp, Homo sapiens
aatctccctttgttt

SEQ ID NO: 444969 - DNA, 15 bp, Homo sapiens
atctccctttgtttc

SEQ ID NO: 444970 - DNA, 15 bp, Homo sapiens
tctccctttgtttcc

SEQ ID NO: 444971 - DNA, 15 bp, Homo sapiens
ctccctttgtttcct

SEQ ID NO: 444972 - DNA, 15 bp, Homo sapiens
tccctttgtttcctc

SEQ ID NO: 444973 - DNA, 15 bp, Homo sapiens
ccctttgtttcctca

SEQ ID NO: 444974 - DNA, 15 bp, Homo sapiens
cctttgtttcctcag

SEQ ID NO: 444975 - DNA, 15 bp, Homo sapiens
ctttgtttcctcagc

SEQ ID NO: 444976 - DNA, 15 bp, Homo sapiens
tttgtttcctcagcg

SEQ ID NO: 444977 - DNA, 15 bp, Homo sapiens
ttgtttcctcagcgt

SEQ ID NO: 444978 - DNA, 15 bp, Homo sapiens
tgtttcctcagcgtc

SEQ ID NO: 444979 - DNA, 15 bp, Homo sapiens
gtttcctcagcgtca

SEQ ID NO: 444980 - DNA, 15 bp, Homo sapiens
tttcctcagcgtcag

SEQ ID NO: 444981 - DNA, 15 bp, Homo sapiens
ttcctcagcgtcagt

SEQ ID NO: 444982 - DNA, 15 bp, Homo sapiens
tcctcagcgtcagtc

SEQ ID NO: 444983 - DNA, 15 bp, Homo sapiens
cctcagcgtcagtcc

SEQ ID NO: 444984 - DNA, 15 bp, Homo sapiens
ctcagcgtcagtcca

SEQ ID NO: 444985 - DNA, 15 bp, Homo sapiens
tcagcgtcagtccag

SEQ ID NO: 444986 - DNA, 15 bp, Homo sapiens
cagcgtcagtccagc

SEQ ID NO: 444987 - DNA, 15 bp, Homo sapiens
agcgtcagtccagct

SEQ ID NO: 444988 - DNA, 15 bp, Homo sapiens
gcgtcagtccagctg

SEQ ID NO: 444989 - DNA, 15 bp, Homo sapiens
cgtcagtccagctgc

SEQ ID NO: 444990 - DNA, 15 bp, Homo sapiens
gtcagtccagctgcc

SEQ ID NO: 444991 - DNA, 15 bp, Homo sapiens
tcagtccagctgccg

SEQ ID NO: 444992 - DNA, 15 bp, Homo sapiens
cagtccagctgccgt

SEQ ID NO: 444993 - DNA, 15 bp, Homo sapiens
agtccagctgccgtg

SEQ ID NO: 444994 - DNA, 15 bp, Homo sapiens
gtccagctgccgtgg

SEQ ID NO: 444995 - DNA, 15 bp, Homo sapiens
tccagctgccgtggc

SEQ ID NO: 444996 - DNA, 15 bp, Homo sapiens
ccagctgccgtggca

SEQ ID NO: 444997 - DNA, 15 bp, Homo sapiens
cagctgccgtggcaa

SEQ ID NO: 444998 - DNA, 15 bp, Homo sapiens
agctgccgtggcaaa

SEQ ID NO: 444999 - DNA, 15 bp, Homo sapiens
gctgccgtggcaaag

SEQ ID NO: 445000 - DNA, 15 bp, Homo sapiens
ctgccgtggcaaaga

SEQ ID NO: 445001 - DNA, 15 bp, Homo sapiens
tgccgtggcaaagat

SEQ ID NO: 445002 - DNA, 15 bp, Homo sapiens
gccgtggcaaagatc

SEQ ID NO: 445003 - DNA, 15 bp, Homo sapiens
ccgtggcaaagatcc

SEQ ID NO: 445004 - DNA, 15 bp, Homo sapiens
cgtggcaaagatcca

SEQ ID NO: 445005 - DNA, 15 bp, Homo sapiens
gtggcaaagatccat

SEQ ID NO: 445006 - DNA, 15 bp, Homo sapiens
tggcaaagatccatt

SEQ ID NO: 445007 - DNA, 15 bp, Homo sapiens
ggcaaagatccattt

SEQ ID NO: 445008 - DNA, 15 bp, Homo sapiens
gcaaagatccatttc

SEQ ID NO: 445009 - DNA, 15 bp, Homo sapiens
caaagatccatttca

SEQ ID NO: 445010 - DNA, 15 bp, Homo sapiens
aaagatccatttcac

SEQ ID NO: 445011 - DNA, 15 bp, Homo sapiens
aagatccatttcaca

SEQ ID NO: 445012 - DNA, 15 bp, Homo sapiens
agatccatttcacat

SEQ ID NO: 445013 - DNA, 15 bp, Homo sapiens
gatccatttcacata

SEQ ID NO: 445014 - DNA, 15 bp, Homo sapiens
atccatttcacataa

SEQ ID NO: 445015 - DNA, 15 bp, Homo sapiens
tccatttcacataat

SEQ ID NO: 445016 - DNA, 15 bp, Homo sapiens
ccatttcacataata

SEQ ID NO: 445017 - DNA, 15 bp, Homo sapiens
catttcacataataa

SEQ ID NO: 445018 - DNA, 15 bp, Homo sapiens
atttcacataataaa

SEQ ID NO: 445019 - DNA, 15 bp, Homo sapiens
tttcacataataaag

SEQ ID NO: 445020 - DNA, 15 bp, Homo sapiens
ttcacataataaagt

SEQ ID NO: 445021 - DNA, 15 bp, Homo sapiens
tcacataataaagtg

SEQ ID NO: 445022 - DNA, 15 bp, Homo sapiens
cacataataaagtgc

SEQ ID NO: 445023 - DNA, 15 bp, Homo sapiens
acataataaagtgcc

SEQ ID NO: 445024 - DNA, 15 bp, Homo sapiens
cataataaagtgccc

SEQ ID NO: 445025 - DNA, 15 bp, Homo sapiens
ataataaagtgccct

SEQ ID NO: 445026 - DNA, 15 bp, Homo sapiens
taataaagtgcccta

SEQ ID NO: 445027 - DNA, 15 bp, Homo sapiens
aataaagtgccctat

SEQ ID NO: 445028 - DNA, 15 bp, Homo sapiens
ataaagtgccctatt

SEQ ID NO: 445029 - DNA, 15 bp, Homo sapiens
taaagtgccctatta

SEQ ID NO: 445030 - DNA, 15 bp, Homo sapiens
aaagtgccctattac

SEQ ID NO: 445031 - DNA, 15 bp, Homo sapiens
aagtgccctattaca

SEQ ID NO: 445032 - DNA, 15 bp, Homo sapiens
agtgccctattacat

SEQ ID NO: 445033 - DNA, 15 bp, Homo sapiens
gtgccctattacatc

SEQ ID NO: 445034 - DNA, 15 bp, Homo sapiens
tgccctattacatca

SEQ ID NO: 445035 - DNA, 15 bp, Homo sapiens
gccctattacatcaa

SEQ ID NO: 445036 - DNA, 15 bp, Homo sapiens
ccctattacatcaag

SEQ ID NO: 445037 - DNA, 15 bp, Homo sapiens
cctattacatcaagt

SEQ ID NO: 445038 - DNA, 15 bp, Homo sapiens
ctattacatcaagta

SEQ ID NO: 445039 - DNA, 15 bp, Homo sapiens
tattacatcaagtaa

SEQ ID NO: 445040 - DNA, 15 bp, Homo sapiens
attacatcaagtaag

SEQ ID NO: 445041 - DNA, 15 bp, Homo sapiens
ttacatcaagtaagt

SEQ ID NO: 445042 - DNA, 15 bp, Homo sapiens
tacatcaagtaagtt

SEQ ID NO: 445043 - DNA, 15 bp, Homo sapiens
acatcaagtaagttg

SEQ ID NO: 445044 - DNA, 15 bp, Homo sapiens
catcaagtaagttga

SEQ ID NO: 445045 - DNA, 15 bp, Homo sapiens
atcaagtaagttgat

SEQ ID NO: 445046 - DNA, 15 bp, Homo sapiens
tcaagtaagttgatt

SEQ ID NO: 445047 - DNA, 15 bp, Homo sapiens
caagtaagttgattt

SEQ ID NO: 445048 - DNA, 15 bp, Homo sapiens
aagtaagttgatttt

SEQ ID NO: 445049 - DNA, 15 bp, Homo sapiens
agtaagttgatttta

SEQ ID NO: 445050 - DNA, 15 bp, Homo sapiens
gtaagttgattttaa

SEQ ID NO: 445051 - DNA, 15 bp, Homo sapiens
taagttgattttaat

SEQ ID NO: 445052 - DNA, 15 bp, Homo sapiens
aagttgattttaatt

SEQ ID NO: 445053 - DNA, 15 bp, Homo sapiens
agttgattttaattc

SEQ ID NO: 445054 - DNA, 15 bp, Homo sapiens
gttgattttaattct

SEQ ID NO: 445055 - DNA, 15 bp, Homo sapiens
ttgattttaattctc

SEQ ID NO: 445056 - DNA, 15 bp, Homo sapiens
tgattttaattctcc

SEQ ID NO: 445057 - DNA, 15 bp, Homo sapiens
gattttaattctcct

SEQ ID NO: 445058 - DNA, 15 bp, Homo sapiens
attttaattctcctt

SEQ ID NO: 445059 - DNA, 15 bp, Homo sapiens
ttttaattctccttt

SEQ ID NO: 445060 - DNA, 15 bp, Homo sapiens
tttaattctccttta

SEQ ID NO: 445061 - DNA, 15 bp, Homo sapiens
ttaattctcctttat

SEQ ID NO: 445062 - DNA, 15 bp, Homo sapiens
taattctcctttatg

SEQ ID NO: 445063 - DNA, 15 bp, Homo sapiens
aattctcctttatga

SEQ ID NO: 445064 - DNA, 15 bp, Homo sapiens
attctcctttatgat

SEQ ID NO: 445065 - DNA, 15 bp, Homo sapiens
ttctcctttatgata

SEQ ID NO: 445066 - DNA, 15 bp, Homo sapiens
tctcctttatgatac

SEQ ID NO: 445067 - DNA, 15 bp, Homo sapiens
ctcctttatgatacc

SEQ ID NO: 445068 - DNA, 15 bp, Homo sapiens
tcctttatgatacca

SEQ ID NO: 445069 - DNA, 15 bp, Homo sapiens
cctttatgataccaa

SEQ ID NO: 445070 - DNA, 15 bp, Homo sapiens
ctttatgataccaag

SEQ ID NO: 445071 - DNA, 15 bp, Homo sapiens
tttatgataccaaga

SEQ ID NO: 445072 - DNA, 15 bp, Homo sapiens
ttatgataccaagaa

SEQ ID NO: 445073 - DNA, 15 bp, Homo sapiens
tatgataccaagaaa

SEQ ID NO: 445074 - DNA, 15 bp, Homo sapiens
atgataccaagaaaa

SEQ ID NO: 445075 - DNA, 15 bp, Homo sapiens
tgataccaagaaaat

SEQ ID NO: 445076 - DNA, 15 bp, Homo sapiens
gataccaagaaaatc

SEQ ID NO: 445077 - DNA, 15 bp, Homo sapiens
ataccaagaaaatca

SEQ ID NO: 445078 - DNA, 15 bp, Homo sapiens
taccaagaaaatcat

SEQ ID NO: 445079 - DNA, 15 bp, Homo sapiens
accaagaaaatcatg

SEQ ID NO: 445080 - DNA, 15 bp, Homo sapiens
ccaagaaaatcatgt

SEQ ID NO: 445081 - DNA, 15 bp, Homo sapiens
caagaaaatcatgtt

SEQ ID NO: 445082 - DNA, 15 bp, Homo sapiens
aagaaaatcatgttt

SEQ ID NO: 445083 - DNA, 15 bp, Homo sapiens
agaaaatcatgtttt

SEQ ID NO: 445084 - DNA, 15 bp, Homo sapiens
gaaaatcatgtttta

SEQ ID NO: 445085 - DNA, 15 bp, Homo sapiens
aaaatcatgttttat

SEQ ID NO: 445086 - DNA, 15 bp, Homo sapiens
aaatcatgttttatt

SEQ ID NO: 445087 - DNA, 15 bp, Homo sapiens
aatcatgttttattg

SEQ ID NO: 445088 - DNA, 15 bp, Homo sapiens
atcatgttttattga

SEQ ID NO: 445089 - DNA, 15 bp, Homo sapiens
tcatgttttattgat

SEQ ID NO: 445090 - DNA, 15 bp, Homo sapiens
catgttttattgata

SEQ ID NO: 445091 - DNA, 15 bp, Homo sapiens
atgttttattgataa

SEQ ID NO: 445092 - DNA, 15 bp, Homo sapiens
tgttttattgataac

SEQ ID NO: 445093 - DNA, 15 bp, Homo sapiens
gttttattgataact

SEQ ID NO: 445094 - DNA, 15 bp, Homo sapiens
ttttattgataactt

SEQ ID NO: 445095 - DNA, 15 bp, Homo sapiens
tttattgataactta

SEQ ID NO: 445096 - DNA, 15 bp, Homo sapiens
ttattgataacttaa

SEQ ID NO: 445097 - DNA, 15 bp, Homo sapiens
tattgataacttaag

SEQ ID NO: 445098 - DNA, 15 bp, Homo sapiens
attgataacttaaga

SEQ ID NO: 445099 - DNA, 15 bp, Homo sapiens
ttgataacttaagag

SEQ ID NO: 445100 - DNA, 15 bp, Homo sapiens
tgataacttaagagg

SEQ ID NO: 445101 - DNA, 15 bp, Homo sapiens
gataacttaagaggc

SEQ ID NO: 445102 - DNA, 15 bp, Homo sapiens
ataacttaagaggct

SEQ ID NO: 445103 - DNA, 15 bp, Homo sapiens
taacttaagaggctt

SEQ ID NO: 445104 - DNA, 15 bp, Homo sapiens
aacttaagaggcttc

SEQ ID NO: 445105 - DNA, 15 bp, Homo sapiens
acttaagaggcttct

SEQ ID NO: 445106 - DNA, 15 bp, Homo sapiens
cttaagaggcttctc

SEQ ID NO: 445107 - DNA, 15 bp, Homo sapiens
ttaagaggcttctct

SEQ ID NO: 445108 - DNA, 15 bp, Homo sapiens
taagaggcttctctc

SEQ ID NO: 445109 - DNA, 15 bp, Homo sapiens
aagaggcttctctcc

SEQ ID NO: 445110 - DNA, 15 bp, Homo sapiens
agaggcttctctccc

SEQ ID NO: 445111 - DNA, 15 bp, Homo sapiens
gaggcttctctcccc

SEQ ID NO: 445112 - DNA, 15 bp, Homo sapiens
aggcttctctcccca

SEQ ID NO: 445113 - DNA, 15 bp, Homo sapiens
ggcttctctccccat

SEQ ID NO: 445114 - DNA, 15 bp, Homo sapiens
gcttctctccccata

SEQ ID NO: 445115 - DNA, 15 bp, Homo sapiens
cttctctccccataa

SEQ ID NO: 445116 - DNA, 15 bp, Homo sapiens
ttctctccccataac

SEQ ID NO: 445117 - DNA, 15 bp, Homo sapiens
tctctccccataact

SEQ ID NO: 445118 - DNA, 15 bp, Homo sapiens
ctctccccataactt

SEQ ID NO: 445119 - DNA, 15 bp, Homo sapiens
tctccccataacttt

SEQ ID NO: 445120 - DNA, 15 bp, Homo sapiens
ctccccataactttt

SEQ ID NO: 445121 - DNA, 15 bp, Homo sapiens
tccccataactttta

SEQ ID NO: 445122 - DNA, 15 bp, Homo sapiens
ccccataacttttaa

SEQ ID NO: 445123 - DNA, 15 bp, Homo sapiens
cccataacttttaaa

SEQ ID NO: 445124 - DNA, 15 bp, Homo sapiens
ccataacttttaaaa

SEQ ID NO: 445125 - DNA, 15 bp, Homo sapiens
taacttttaaaaata

SEQ ID NO: 445126 - DNA, 15 bp, Homo sapiens
aacttttaaaaatag

SEQ ID NO: 445127 - DNA, 15 bp, Homo sapiens
acttttaaaaataga

SEQ ID NO: 445128 - DNA, 15 bp, Homo sapiens
cttttaaaaatagaa

SEQ ID NO: 445129 - DNA, 15 bp, Homo sapiens
ttttaaaaatagaat

SEQ ID NO: 445130 - DNA, 15 bp, Homo sapiens
tttaaaaatagaatt

SEQ ID NO: 445131 - DNA, 15 bp, Homo sapiens
ttaaaaatagaattc

SEQ ID NO: 445132 - DNA, 15 bp, Homo sapiens
taaaaatagaattca

SEQ ID NO: 445133 - DNA, 15 bp, Homo sapiens
aaaaatagaattcag

SEQ ID NO: 445134 - DNA, 15 bp, Homo sapiens
aaaatagaattcagt

SEQ ID NO: 445135 - DNA, 15 bp, Homo sapiens
aaatagaattcagtc

SEQ ID NO: 445136 - DNA, 15 bp, Homo sapiens
aatagaattcagtcc

SEQ ID NO: 445137 - DNA, 15 bp, Homo sapiens
atagaattcagtcct

SEQ ID NO: 445138 - DNA, 15 bp, Homo sapiens
tagaattcagtccta

SEQ ID NO: 445139 - DNA, 15 bp, Homo sapiens
agaattcagtcctat

SEQ ID NO: 445140 - DNA, 15 bp, Homo sapiens
gaattcagtcctatt

SEQ ID NO: 445141 - DNA, 15 bp, Homo sapiens
aattcagtcctatta

SEQ ID NO: 445142 - DNA, 15 bp, Homo sapiens
attcagtcctattat

SEQ ID NO: 445143 - DNA, 15 bp, Homo sapiens
ttcagtcctattatc

SEQ ID NO: 445144 - DNA, 15 bp, Homo sapiens
tcagtcctattatct

SEQ ID NO: 445145 - DNA, 15 bp, Homo sapiens
cagtcctattatctg

SEQ ID NO: 445146 - DNA, 15 bp, Homo sapiens
agtcctattatctga

SEQ ID NO: 445147 - DNA, 15 bp, Homo sapiens
gtcctattatctgaa

SEQ ID NO: 445148 - DNA, 15 bp, Homo sapiens
tcctattatctgaaa

SEQ ID NO: 445149 - DNA, 15 bp, Homo sapiens
cctattatctgaaag

SEQ ID NO: 445150 - DNA, 15 bp, Homo sapiens
ctattatctgaaaga

SEQ ID NO: 445151 - DNA, 15 bp, Homo sapiens
tattatctgaaagaa

SEQ ID NO: 445152 - DNA, 15 bp, Homo sapiens
attatctgaaagaaa

SEQ ID NO: 445153 - DNA, 15 bp, Homo sapiens
ttatctgaaagaaac

SEQ ID NO: 445154 - DNA, 15 bp, Homo sapiens
tatctgaaagaaact

SEQ ID NO: 445155 - DNA, 15 bp, Homo sapiens
atctgaaagaaactg

SEQ ID NO: 445156 - DNA, 15 bp, Homo sapiens
tctgaaagaaactgt

SEQ ID NO: 445157 - DNA, 15 bp, Homo sapiens
ctgaaagaaactgtg

SEQ ID NO: 445158 - DNA, 15 bp, Homo sapiens
tgaaagaaactgtga

SEQ ID NO: 445159 - DNA, 15 bp, Homo sapiens
gaaagaaactgtgat

SEQ ID NO: 445160 - DNA, 15 bp, Homo sapiens
aaagaaactgtgata

SEQ ID NO: 445161 - DNA, 15 bp, Homo sapiens
aagaaactgtgatat

SEQ ID NO: 445162 - DNA, 15 bp, Homo sapiens
agaaactgtgatata

SEQ ID NO: 445163 - DNA, 15 bp, Homo sapiens
gaaactgtgatatag

SEQ ID NO: 445164 - DNA, 15 bp, Homo sapiens
aaactgtgatatagt

SEQ ID NO: 445165 - DNA, 15 bp, Homo sapiens
aactgtgatatagtt

SEQ ID NO: 445166 - DNA, 15 bp, Homo sapiens
actgtgatatagtta

SEQ ID NO: 445167 - DNA, 15 bp, Homo sapiens
ctgtgatatagttaa

SEQ ID NO: 445168 - DNA, 15 bp, Homo sapiens
tgtgatatagttaat

SEQ ID NO: 445169 - DNA, 15 bp, Homo sapiens
gtgatatagttaata

SEQ ID NO: 445170 - DNA, 15 bp, Homo sapiens
tgatatagttaatat

SEQ ID NO: 445171 - DNA, 15 bp, Homo sapiens
gatatagttaatatt

SEQ ID NO: 445172 - DNA, 15 bp, Homo sapiens
atatagttaatatta

SEQ ID NO: 445173 - DNA, 15 bp, Homo sapiens
tatagttaatattaa

SEQ ID NO: 445174 - DNA, 15 bp, Homo sapiens
atagttaatattaaa

SEQ ID NO: 445175 - DNA, 15 bp, Homo sapiens
tagttaatattaaaa

SEQ ID NO: 445176 - DNA, 15 bp, Homo sapiens
agttaatattaaaaa

SEQ ID NO: 445177 - DNA, 15 bp, Homo sapiens
gttaatattaaaaag

SEQ ID NO: 445178 - DNA, 15 bp, Homo sapiens
ttaatattaaaaaga

SEQ ID NO: 445179 - DNA, 15 bp, Homo sapiens
taatattaaaaagaa

SEQ ID NO: 445180 - DNA, 15 bp, Homo sapiens
aatattaaaaagaaa

SEQ ID NO: 445181 - DNA, 15 bp, Homo sapiens
atattaaaaagaaac

SEQ ID NO: 445182 - DNA, 15 bp, Homo sapiens
tattaaaaagaaact

SEQ ID NO: 445183 - DNA, 15 bp, Homo sapiens
attaaaaagaaacta

SEQ ID NO: 445184 - DNA, 15 bp, Homo sapiens
ttaaaaagaaactac

SEQ ID NO: 445185 - DNA, 15 bp, Homo sapiens
taaaaagaaactact

SEQ ID NO: 445186 - DNA, 15 bp, Homo sapiens
aaaaagaaactactt

SEQ ID NO: 445187 - DNA, 15 bp, Homo sapiens
aaaagaaactacttt

SEQ ID NO: 445188 - DNA, 15 bp, Homo sapiens
aaagaaactactttt

SEQ ID NO: 445189 - DNA, 15 bp, Homo sapiens
aagaaactactttta

SEQ ID NO: 445190 - DNA, 15 bp, Homo sapiens
agaaactacttttaa

SEQ ID NO: 445191 - DNA, 15 bp, Homo sapiens
gaaactacttttaac

SEQ ID NO: 445192 - DNA, 15 bp, Homo sapiens
aaactacttttaaca

SEQ ID NO: 445193 - DNA, 15 bp, Homo sapiens
aactacttttaacat

SEQ ID NO: 445194 - DNA, 15 bp, Homo sapiens
actacttttaacatg

SEQ ID NO: 445195 - DNA, 15 bp, Homo sapiens
ctacttttaacatga

SEQ ID NO: 445196 - DNA, 15 bp, Homo sapiens
tacttttaacatgag

SEQ ID NO: 445197 - DNA, 15 bp, Homo sapiens
acttttaacatgaga

SEQ ID NO: 445198 - DNA, 15 bp, Homo sapiens
cttttaacatgagaa

SEQ ID NO: 445199 - DNA, 15 bp, Homo sapiens
ttttaacatgagaat

SEQ ID NO: 445200 - DNA, 15 bp, Homo sapiens
tttaacatgagaatt

SEQ ID NO: 445201 - DNA, 15 bp, Homo sapiens
ttaacatgagaatta

SEQ ID NO: 445202 - DNA, 15 bp, Homo sapiens
taacatgagaattat

SEQ ID NO: 445203 - DNA, 15 bp, Homo sapiens
aacatgagaattata

SEQ ID NO: 445204 - DNA, 15 bp, Homo sapiens
acatgagaattatat

SEQ ID NO: 445205 - DNA, 15 bp, Homo sapiens
catgagaattatatt

SEQ ID NO: 445206 - DNA, 15 bp, Homo sapiens
atgagaattatattt

SEQ ID NO: 445207 - DNA, 15 bp, Homo sapiens
tgagaattatatttt

SEQ ID NO: 445208 - DNA, 15 bp, Homo sapiens
gagaattatattttt

SEQ ID NO: 445209 - DNA, 15 bp, Homo sapiens
agaattatatttttc

SEQ ID NO: 445210 - DNA, 15 bp, Homo sapiens
gaattatatttttca

SEQ ID NO: 445211 - DNA, 15 bp, Homo sapiens
aattatatttttcat

SEQ ID NO: 445212 - DNA, 15 bp, Homo sapiens
attatatttttcatg

SEQ ID NO: 445213 - DNA, 15 bp, Homo sapiens
ttatatttttcatgt

SEQ ID NO: 445214 - DNA, 15 bp, Homo sapiens
tatatttttcatgta

SEQ ID NO: 445215 - DNA, 15 bp, Homo sapiens
atatttttcatgtat

SEQ ID NO: 445216 - DNA, 15 bp, Homo sapiens
tatttttcatgtatc

SEQ ID NO: 445217 - DNA, 15 bp, Homo sapiens
atttttcatgtatca

SEQ ID NO: 445218 - DNA, 15 bp, Homo sapiens
tttttcatgtatcag

SEQ ID NO: 445219 - DNA, 15 bp, Homo sapiens
ttttcatgtatcaga

SEQ ID NO: 445220 - DNA, 15 bp, Homo sapiens
tttcatgtatcagat

SEQ ID NO: 445221 - DNA, 15 bp, Homo sapiens
ttcatgtatcagatt

SEQ ID NO: 445222 - DNA, 15 bp, Homo sapiens
tcatgtatcagatta

SEQ ID NO: 445223 - DNA, 15 bp, Homo sapiens
catgtatcagattag

SEQ ID NO: 445224 - DNA, 15 bp, Homo sapiens
atgtatcagattagg

SEQ ID NO: 445225 - DNA, 15 bp, Homo sapiens
tgtatcagattaggg

SEQ ID NO: 445226 - DNA, 15 bp, Homo sapiens
gtatcagattaggga

SEQ ID NO: 445227 - DNA, 15 bp, Homo sapiens
tatcagattagggat

SEQ ID NO: 445228 - DNA, 15 bp, Homo sapiens
atcagattagggata

SEQ ID NO: 445229 - DNA, 15 bp, Homo sapiens
tcagattagggatat

SEQ ID NO: 445230 - DNA, 15 bp, Homo sapiens
cagattagggatata

SEQ ID NO: 445231 - DNA, 15 bp, Homo sapiens
agattagggatatag

SEQ ID NO: 445232 - DNA, 15 bp, Homo sapiens
gattagggatatagg

SEQ ID NO: 445233 - DNA, 15 bp, Homo sapiens
attagggatataggt

SEQ ID NO: 445234 - DNA, 15 bp, Homo sapiens
ttagggatataggtg

SEQ ID NO: 445235 - DNA, 15 bp, Homo sapiens
tagggatataggtgt

SEQ ID NO: 445236 - DNA, 15 bp, Homo sapiens
agggatataggtgtg

SEQ ID NO: 445237 - DNA, 15 bp, Homo sapiens
gggatataggtgtgt

SEQ ID NO: 445238 - DNA, 15 bp, Homo sapiens
ggatataggtgtgtt

SEQ ID NO: 445239 - DNA, 15 bp, Homo sapiens
gatataggtgtgttt

SEQ ID NO: 445240 - DNA, 15 bp, Homo sapiens
atataggtgtgttta

SEQ ID NO: 445241 - DNA, 15 bp, Homo sapiens
tataggtgtgtttag

SEQ ID NO: 445242 - DNA, 15 bp, Homo sapiens
ataggtgtgtttagc

SEQ ID NO: 445243 - DNA, 15 bp, Homo sapiens
taggtgtgtttagct

SEQ ID NO: 445244 - DNA, 15 bp, Homo sapiens
aggtgtgtttagctg

SEQ ID NO: 445245 - DNA, 15 bp, Homo sapiens
ggtgtgtttagctga

SEQ ID NO: 445246 - DNA, 15 bp, Homo sapiens
gtgtgtttagctgat

SEQ ID NO: 445247 - DNA, 15 bp, Homo sapiens
tgtgtttagctgata

SEQ ID NO: 445248 - DNA, 15 bp, Homo sapiens
gtgtttagctgatat

SEQ ID NO: 445249 - DNA, 15 bp, Homo sapiens
tgtttagctgatata

SEQ ID NO: 445250 - DNA, 15 bp, Homo sapiens
gtttagctgatatat

SEQ ID NO: 445251 - DNA, 15 bp, Homo sapiens
tttagctgatatatt

SEQ ID NO: 445252 - DNA, 15 bp, Homo sapiens
ttagctgatatattt

SEQ ID NO: 445253 - DNA, 15 bp, Homo sapiens
tagctgatatatttt

SEQ ID NO: 445254 - DNA, 15 bp, Homo sapiens
agctgatatatttta

SEQ ID NO: 445255 - DNA, 15 bp, Homo sapiens
gctgatatattttaa

SEQ ID NO: 445256 - DNA, 15 bp, Homo sapiens
ctgatatattttaaa

SEQ ID NO: 445257 - DNA, 15 bp, Homo sapiens
tgatatattttaaag

SEQ ID NO: 445258 - DNA, 15 bp, Homo sapiens
gatatattttaaagt

SEQ ID NO: 445259 - DNA, 15 bp, Homo sapiens
atatattttaaagta

SEQ ID NO: 445260 - DNA, 15 bp, Homo sapiens
tatattttaaagtag

SEQ ID NO: 445261 - DNA, 15 bp, Homo sapiens
atattttaaagtaga

SEQ ID NO: 445262 - DNA, 15 bp, Homo sapiens
tattttaaagtagag

SEQ ID NO: 445263 - DNA, 15 bp, Homo sapiens
attttaaagtagaga

SEQ ID NO: 445264 - DNA, 15 bp, Homo sapiens
ttttaaagtagagat

SEQ ID NO: 445265 - DNA, 15 bp, Homo sapiens
tttaaagtagagatt

SEQ ID NO: 445266 - DNA, 15 bp, Homo sapiens
ttaaagtagagattt

SEQ ID NO: 445267 - DNA, 15 bp, Homo sapiens
taaagtagagattta

SEQ ID NO: 445268 - DNA, 15 bp, Homo sapiens
aaagtagagatttaa

SEQ ID NO: 445269 - DNA, 15 bp, Homo sapiens
aagtagagatttaaa

SEQ ID NO: 445270 - DNA, 15 bp, Homo sapiens
agtagagatttaaat

SEQ ID NO: 445271 - DNA, 15 bp, Homo sapiens
gtagagatttaaata

SEQ ID NO: 445272 - DNA, 15 bp, Homo sapiens
tagagatttaaatat

SEQ ID NO: 445273 - DNA, 15 bp, Homo sapiens
agagatttaaatatt

SEQ ID NO: 445274 - DNA, 15 bp, Homo sapiens
gagatttaaatattt

SEQ ID NO: 445275 - DNA, 15 bp, Homo sapiens
agatttaaatatttg

SEQ ID NO: 445276 - DNA, 15 bp, Homo sapiens
gatttaaatatttgg

SEQ ID NO: 445277 - DNA, 15 bp, Homo sapiens
atttaaatatttgga

SEQ ID NO: 445278 - DNA, 15 bp, Homo sapiens
tttaaatatttggag

SEQ ID NO: 445279 - DNA, 15 bp, Homo sapiens
ttaaatatttggaga

SEQ ID NO: 445280 - DNA, 15 bp, Homo sapiens
taaatatttggagac

SEQ ID NO: 445281 - DNA, 15 bp, Homo sapiens
aaatatttggagaca

SEQ ID NO: 445282 - DNA, 15 bp, Homo sapiens
aatatttggagacag

SEQ ID NO: 445283 - DNA, 15 bp, Homo sapiens
atatttggagacaga

SEQ ID NO: 445284 - DNA, 15 bp, Homo sapiens
tatttggagacagac

SEQ ID NO: 445285 - DNA, 15 bp, Homo sapiens
atttggagacagaca

SEQ ID NO: 445286 - DNA, 15 bp, Homo sapiens
tttggagacagacaa

SEQ ID NO: 445287 - DNA, 15 bp, Homo sapiens
ttggagacagacaat

SEQ ID NO: 445288 - DNA, 15 bp, Homo sapiens
tggagacagacaata

SEQ ID NO: 445289 - DNA, 15 bp, Homo sapiens
ggagacagacaataa

SEQ ID NO: 445290 - DNA, 15 bp, Homo sapiens
gagacagacaataag

SEQ ID NO: 445291 - DNA, 15 bp, Homo sapiens
agacagacaataagc

SEQ ID NO: 445292 - DNA, 15 bp, Homo sapiens
gacagacaataagct

SEQ ID NO: 445293 - DNA, 15 bp, Homo sapiens
acagacaataagcta

SEQ ID NO: 445294 - DNA, 15 bp, Homo sapiens
cagacaataagctat

SEQ ID NO: 445295 - DNA, 15 bp, Homo sapiens
agacaataagctatg

SEQ ID NO: 445296 - DNA, 15 bp, Homo sapiens
gacaataagctatga

SEQ ID NO: 445297 - DNA, 15 bp, Homo sapiens
acaataagctatgat

SEQ ID NO: 445298 - DNA, 15 bp, Homo sapiens
caataagctatgatg

SEQ ID NO: 445299 - DNA, 15 bp, Homo sapiens
aataagctatgatgg

SEQ ID NO: 445300 - DNA, 15 bp, Homo sapiens
ataagctatgatggc

SEQ ID NO: 445301 - DNA, 15 bp, Homo sapiens
taagctatgatggcc

SEQ ID NO: 445302 - DNA, 15 bp, Homo sapiens
aagctatgatggcca

SEQ ID NO: 445303 - DNA, 15 bp, Homo sapiens
agctatgatggccat

SEQ ID NO: 445304 - DNA, 15 bp, Homo sapiens
gctatgatggccata

SEQ ID NO: 445305 - DNA, 15 bp, Homo sapiens
ctatgatggccatac

SEQ ID NO: 445306 - DNA, 15 bp, Homo sapiens
tatgatggccatact

SEQ ID NO: 445307 - DNA, 15 bp, Homo sapiens
atgatggccatactg

SEQ ID NO: 445308 - DNA, 15 bp, Homo sapiens
tgatggccatactgt

SEQ ID NO: 445309 - DNA, 15 bp, Homo sapiens
gatggccatactgta

SEQ ID NO: 445310 - DNA, 15 bp, Homo sapiens
atggccatactgtat

SEQ ID NO: 445311 - DNA, 15 bp, Homo sapiens
tggccatactgtatt

SEQ ID NO: 445312 - DNA, 15 bp, Homo sapiens
ggccatactgtattc

SEQ ID NO: 445313 - DNA, 15 bp, Homo sapiens
gccatactgtattcc

SEQ ID NO: 445314 - DNA, 15 bp, Homo sapiens
ccatactgtattcca

SEQ ID NO: 445315 - DNA, 15 bp, Homo sapiens
catactgtattccag

SEQ ID NO: 445316 - DNA, 15 bp, Homo sapiens
atactgtattccagc

SEQ ID NO: 445317 - DNA, 15 bp, Homo sapiens
tactgtattccagcc

SEQ ID NO: 445318 - DNA, 15 bp, Homo sapiens
actgtattccagcct

SEQ ID NO: 445319 - DNA, 15 bp, Homo sapiens
ctgtattccagcctg

SEQ ID NO: 445320 - DNA, 15 bp, Homo sapiens
tgtattccagcctgg

SEQ ID NO: 445321 - DNA, 15 bp, Homo sapiens
gtattccagcctgga

SEQ ID NO: 445322 - DNA, 15 bp, Homo sapiens
tattccagcctggac

SEQ ID NO: 445323 - DNA, 15 bp, Homo sapiens
attccagcctggaca

SEQ ID NO: 445324 - DNA, 15 bp, Homo sapiens
ttccagcctggacaa

SEQ ID NO: 445325 - DNA, 15 bp, Homo sapiens
tccagcctggacaac

SEQ ID NO: 445326 - DNA, 15 bp, Homo sapiens
agcctggacaacaaa

SEQ ID NO: 445327 - DNA, 15 bp, Homo sapiens
gcctggacaacaaag

SEQ ID NO: 445328 - DNA, 15 bp, Homo sapiens
cctggacaacaaagc

SEQ ID NO: 445329 - DNA, 15 bp, Homo sapiens
ctggacaacaaagca

SEQ ID NO: 445330 - DNA, 15 bp, Homo sapiens
tggacaacaaagcaa

SEQ ID NO: 445331 - DNA, 15 bp, Homo sapiens
ggacaacaaagcaag

SEQ ID NO: 445332 - DNA, 15 bp, Homo sapiens
gacaacaaagcaaga

SEQ ID NO: 445333 - DNA, 15 bp, Homo sapiens
acaacaaagcaagat

SEQ ID NO: 445334 - DNA, 15 bp, Homo sapiens
caacaaagcaagatc

SEQ ID NO: 445335 - DNA, 15 bp, Homo sapiens
aacaaagcaagatcc

SEQ ID NO: 445336 - DNA, 15 bp, Homo sapiens
acaaagcaagatcca

SEQ ID NO: 445337 - DNA, 15 bp, Homo sapiens
caaagcaagatccag

SEQ ID NO: 445338 - DNA, 15 bp, Homo sapiens
aaagcaagatccagt

SEQ ID NO: 445339 - DNA, 15 bp, Homo sapiens
aagcaagatccagtc

SEQ ID NO: 445340 - DNA, 15 bp, Homo sapiens
agcaagatccagtct

SEQ ID NO: 445341 - DNA, 15 bp, Homo sapiens
gcaagatccagtctc

SEQ ID NO: 445342 - DNA, 15 bp, Homo sapiens
caagatccagtctct

SEQ ID NO: 445343 - DNA, 15 bp, Homo sapiens
aagatccagtctcta

SEQ ID NO: 445344 - DNA, 15 bp, Homo sapiens
agatccagtctctaa

SEQ ID NO: 445345 - DNA, 15 bp, Homo sapiens
gatccagtctctaaa

SEQ ID NO: 445346 - DNA, 15 bp, Homo sapiens
atccagtctctaaaa

SEQ ID NO: 445347 - DNA, 15 bp, Homo sapiens
tccagtctctaaaaa

SEQ ID NO: 445348 - DNA, 15 bp, Homo sapiens
ccagtctctaaaaag

SEQ ID NO: 445349 - DNA, 15 bp, Homo sapiens
cagtctctaaaaagt

SEQ ID NO: 445350 - DNA, 15 bp, Homo sapiens
agtctctaaaaagta

SEQ ID NO: 445351 - DNA, 15 bp, Homo sapiens
gtctctaaaaagtaa

SEQ ID NO: 445352 - DNA, 15 bp, Homo sapiens
tctctaaaaagtaaa

SEQ ID NO: 445353 - DNA, 15 bp, Homo sapiens
ctctaaaaagtaaaa

SEQ ID NO: 445354 - DNA, 15 bp, Homo sapiens
tctaaaaagtaaaaa

SEQ ID NO: 445355 - DNA, 15 bp, Homo sapiens
ctaaaaagtaaaaaa

SEQ ID NO: 445356 - DNA, 15 bp, Homo sapiens
taaaaagtaaaaaaa

SEQ ID NO: 445357 - DNA, 15 bp, Homo sapiens
aaaaaaaaaaattgg

SEQ ID NO: 445358 - DNA, 15 bp, Homo sapiens
aaaaaaaaaattgga

SEQ ID NO: 445359 - DNA, 15 bp, Homo sapiens
aaaaaaaaattggag

SEQ ID NO: 445360 - DNA, 15 bp, Homo sapiens
aaaaaaaattggaga

SEQ ID NO: 445361 - DNA, 15 bp, Homo sapiens
aaaaaaattggagaa

SEQ ID NO: 445362 - DNA, 15 bp, Homo sapiens
aaaaaattggagaaa

SEQ ID NO: 445363 - DNA, 15 bp, Homo sapiens
aaaaattggagaaaa

SEQ ID NO: 445364 - DNA, 15 bp, Homo sapiens
aaaattggagaaaaa

SEQ ID NO: 445365 - DNA, 15 bp, Homo sapiens
aaattggagaaaaat

SEQ ID NO: 445366 - DNA, 15 bp, Homo sapiens
aattggagaaaaatg

SEQ ID NO: 445367 - DNA, 15 bp, Homo sapiens
attggagaaaaatga

SEQ ID NO: 445368 - DNA, 15 bp, Homo sapiens
ttggagaaaaatgac

SEQ ID NO: 445369 - DNA, 15 bp, Homo sapiens
tggagaaaaatgaca

SEQ ID NO: 445370 - DNA, 15 bp, Homo sapiens
ggagaaaaatgacag

SEQ ID NO: 445371 - DNA, 15 bp, Homo sapiens
gagaaaaatgacaga

SEQ ID NO: 445372 - DNA, 15 bp, Homo sapiens
agaaaaatgacagaa

SEQ ID NO: 445373 - DNA, 15 bp, Homo sapiens
gaaaaatgacagaat

SEQ ID NO: 445374 - DNA, 15 bp, Homo sapiens
aaaaatgacagaatt

SEQ ID NO: 445375 - DNA, 15 bp, Homo sapiens
aaaatgacagaattt

SEQ ID NO: 445376 - DNA, 15 bp, Homo sapiens
aaatgacagaatttc

SEQ ID NO: 445377 - DNA, 15 bp, Homo sapiens
aatgacagaatttca

SEQ ID NO: 445378 - DNA, 15 bp, Homo sapiens
atgacagaatttcaa

SEQ ID NO: 445379 - DNA, 15 bp, Homo sapiens
tgacagaatttcaaa

SEQ ID NO: 445380 - DNA, 15 bp, Homo sapiens
gacagaatttcaaaa

SEQ ID NO: 445381 - DNA, 15 bp, Homo sapiens
acagaatttcaaaat

SEQ ID NO: 445382 - DNA, 15 bp, Homo sapiens
cagaatttcaaaata

SEQ ID NO: 445383 - DNA, 15 bp, Homo sapiens
agaatttcaaaatac

SEQ ID NO: 445384 - DNA, 15 bp, Homo sapiens
gaatttcaaaatact

SEQ ID NO: 445385 - DNA, 15 bp, Homo sapiens
aatttcaaaatactc

SEQ ID NO: 445386 - DNA, 15 bp, Homo sapiens
atttcaaaatactct

SEQ ID NO: 445387 - DNA, 15 bp, Homo sapiens
tttcaaaatactctt

SEQ ID NO: 445388 - DNA, 15 bp, Homo sapiens
ttcaaaatactcttg

SEQ ID NO: 445389 - DNA, 15 bp, Homo sapiens
tcaaaatactcttga

SEQ ID NO: 445390 - DNA, 15 bp, Homo sapiens
caaaatactcttgac

SEQ ID NO: 445391 - DNA, 15 bp, Homo sapiens
aaaatactcttgaca

SEQ ID NO: 445392 - DNA, 15 bp, Homo sapiens
aaatactcttgacat

SEQ ID NO: 445393 - DNA, 15 bp, Homo sapiens
aatactcttgacata

SEQ ID NO: 445394 - DNA, 15 bp, Homo sapiens
atactcttgacataa

SEQ ID NO: 445395 - DNA, 15 bp, Homo sapiens
tactcttgacataat

SEQ ID NO: 445396 - DNA, 15 bp, Homo sapiens
actcttgacataatg

SEQ ID NO: 445397 - DNA, 15 bp, Homo sapiens
ctcttgacataatga

SEQ ID NO: 445398 - DNA, 15 bp, Homo sapiens
tcttgacataatgat

SEQ ID NO: 445399 - DNA, 15 bp, Homo sapiens
cttgacataatgata

SEQ ID NO: 445400 - DNA, 15 bp, Homo sapiens
ttgacataatgatat

SEQ ID NO: 445401 - DNA, 15 bp, Homo sapiens
tgacataatgatatt

SEQ ID NO: 445402 - DNA, 15 bp, Homo sapiens
gacataatgatattt

SEQ ID NO: 445403 - DNA, 15 bp, Homo sapiens
acataatgatatttg

SEQ ID NO: 445404 - DNA, 15 bp, Homo sapiens
cataatgatatttgt

SEQ ID NO: 445405 - DNA, 15 bp, Homo sapiens
ataatgatatttgtc

SEQ ID NO: 445406 - DNA, 15 bp, Homo sapiens
taatgatatttgtca

SEQ ID NO: 445407 - DNA, 15 bp, Homo sapiens
aatgatatttgtcaa

SEQ ID NO: 445408 - DNA, 15 bp, Homo sapiens
atgatatttgtcaaa

SEQ ID NO: 445409 - DNA, 15 bp, Homo sapiens
tgatatttgtcaaat

SEQ ID NO: 445410 - DNA, 15 bp, Homo sapiens
gatatttgtcaaatt

SEQ ID NO: 445411 - DNA, 15 bp, Homo sapiens
atatttgtcaaattg

SEQ ID NO: 445412 - DNA, 15 bp, Homo sapiens
tatttgtcaaattgt

SEQ ID NO: 445413 - DNA, 15 bp, Homo sapiens
atttgtcaaattgta

SEQ ID NO: 445414 - DNA, 15 bp, Homo sapiens
tttgtcaaattgtac

SEQ ID NO: 445415 - DNA, 15 bp, Homo sapiens
ttgtcaaattgtaca

SEQ ID NO: 445416 - DNA, 15 bp, Homo sapiens
tgtcaaattgtacaa

SEQ ID NO: 445417 - DNA, 15 bp, Homo sapiens
gtcaaattgtacaaa

SEQ ID NO: 445418 - DNA, 15 bp, Homo sapiens
tcaaattgtacaaat

SEQ ID NO: 445419 - DNA, 15 bp, Homo sapiens
caaattgtacaaatt

SEQ ID NO: 445420 - DNA, 15 bp, Homo sapiens
aaattgtacaaattc

SEQ ID NO: 445421 - DNA, 15 bp, Homo sapiens
aattgtacaaattct

SEQ ID NO: 445422 - DNA, 15 bp, Homo sapiens
attgtacaaattcta

SEQ ID NO: 445423 - DNA, 15 bp, Homo sapiens
ttgtacaaattctaa

SEQ ID NO: 445424 - DNA, 15 bp, Homo sapiens
tgtacaaattctaaa

SEQ ID NO: 445425 - DNA, 15 bp, Homo sapiens
gtacaaattctaaac

SEQ ID NO: 445426 - DNA, 15 bp, Homo sapiens
tacaaattctaaacc

SEQ ID NO: 445427 - DNA, 15 bp, Homo sapiens
acaaattctaaacca

SEQ ID NO: 445428 - DNA, 15 bp, Homo sapiens
caaattctaaaccat

SEQ ID NO: 445429 - DNA, 15 bp, Homo sapiens
aaattctaaaccatt

SEQ ID NO: 445430 - DNA, 15 bp, Homo sapiens
aattctaaaccattt

SEQ ID NO: 445431 - DNA, 15 bp, Homo sapiens
attctaaaccatttt

SEQ ID NO: 445432 - DNA, 15 bp, Homo sapiens
ttctaaaccattttt

SEQ ID NO: 445433 - DNA, 15 bp, Homo sapiens
tctaaaccatttttc

SEQ ID NO: 445434 - DNA, 15 bp, Homo sapiens
ctaaaccatttttct

SEQ ID NO: 445435 - DNA, 15 bp, Homo sapiens
taaaccatttttctt

SEQ ID NO: 445436 - DNA, 15 bp, Homo sapiens
aaaccatttttcttc

SEQ ID NO: 445437 - DNA, 15 bp, Homo sapiens
aaccatttttcttcc

SEQ ID NO: 445438 - DNA, 15 bp, Homo sapiens
accatttttcttcct

SEQ ID NO: 445439 - DNA, 15 bp, Homo sapiens
ccatttttcttcctc

SEQ ID NO: 445440 - DNA, 15 bp, Homo sapiens
catttttcttcctct

SEQ ID NO: 445441 - DNA, 15 bp, Homo sapiens
atttttcttcctcta

SEQ ID NO: 445442 - DNA, 15 bp, Homo sapiens
tttttcttcctctaa

SEQ ID NO: 445443 - DNA, 15 bp, Homo sapiens
ttttcttcctctaag

SEQ ID NO: 445444 - DNA, 15 bp, Homo sapiens
tttcttcctctaaga

SEQ ID NO: 445445 - DNA, 15 bp, Homo sapiens
ttcttcctctaagaa

SEQ ID NO: 445446 - DNA, 15 bp, Homo sapiens
tcttcctctaagaaa

SEQ ID NO: 445447 - DNA, 15 bp, Homo sapiens
cttcctctaagaaaa

SEQ ID NO: 445448 - DNA, 15 bp, Homo sapiens
ttcctctaagaaaat

SEQ ID NO: 445449 - DNA, 15 bp, Homo sapiens
tcctctaagaaaatc

SEQ ID NO: 445450 - DNA, 15 bp, Homo sapiens
cctctaagaaaatcc

SEQ ID NO: 445451 - DNA, 15 bp, Homo sapiens
ctctaagaaaatcca

SEQ ID NO: 445452 - DNA, 15 bp, Homo sapiens
tctaagaaaatccat

SEQ ID NO: 445453 - DNA, 15 bp, Homo sapiens
ctaagaaaatccata

SEQ ID NO: 445454 - DNA, 15 bp, Homo sapiens
taagaaaatccatat

SEQ ID NO: 445455 - DNA, 15 bp, Homo sapiens
aagaaaatccatata

SEQ ID NO: 445456 - DNA, 15 bp, Homo sapiens
agaaaatccatataa

SEQ ID NO: 445457 - DNA, 15 bp, Homo sapiens
gaaaatccatataaa

SEQ ID NO: 445458 - DNA, 15 bp, Homo sapiens
aaaatccatataaaa

SEQ ID NO: 445459 - DNA, 15 bp, Homo sapiens
aaatccatataaaaa

SEQ ID NO: 445460 - DNA, 15 bp, Homo sapiens
aatccatataaaaat

SEQ ID NO: 445461 - DNA, 15 bp, Homo sapiens
atccatataaaaatg

SEQ ID NO: 445462 - DNA, 15 bp, Homo sapiens
tccatataaaaatgt

SEQ ID NO: 445463 - DNA, 15 bp, Homo sapiens
ccatataaaaatgtc

SEQ ID NO: 445464 - DNA, 15 bp, Homo sapiens
catataaaaatgtct

SEQ ID NO: 445465 - DNA, 15 bp, Homo sapiens
atataaaaatgtctt

SEQ ID NO: 445466 - DNA, 15 bp, Homo sapiens
tataaaaatgtctta

SEQ ID NO: 445467 - DNA, 15 bp, Homo sapiens
ataaaaatgtcttat

SEQ ID NO: 445468 - DNA, 15 bp, Homo sapiens
taaaaatgtcttata

SEQ ID NO: 445469 - DNA, 15 bp, Homo sapiens
aaaaatgtcttatac

SEQ ID NO: 445470 - DNA, 15 bp, Homo sapiens
aaaatgtcttatact

SEQ ID NO: 445471 - DNA, 15 bp, Homo sapiens
aaatgtcttatactc

SEQ ID NO: 445472 - DNA, 15 bp, Homo sapiens
aatgtcttatactct

SEQ ID NO: 445473 - DNA, 15 bp, Homo sapiens
atgtcttatactctt

SEQ ID NO: 445474 - DNA, 15 bp, Homo sapiens
tgtcttatactcttg

SEQ ID NO: 445475 - DNA, 15 bp, Homo sapiens
gtcttatactcttgt

SEQ ID NO: 445476 - DNA, 15 bp, Homo sapiens
tcttatactcttgtc

SEQ ID NO: 445477 - DNA, 15 bp, Homo sapiens
cttatactcttgtca

SEQ ID NO: 445478 - DNA, 15 bp, Homo sapiens
ttatactcttgtcat

SEQ ID NO: 445479 - DNA, 15 bp, Homo sapiens
tatactcttgtcatt

SEQ ID NO: 445480 - DNA, 15 bp, Homo sapiens
atactcttgtcattt

SEQ ID NO: 445481 - DNA, 15 bp, Homo sapiens
tactcttgtcatttt

SEQ ID NO: 445482 - DNA, 15 bp, Homo sapiens
actcttgtcatttta

SEQ ID NO: 445483 - DNA, 15 bp, Homo sapiens
ctcttgtcattttat

SEQ ID NO: 445484 - DNA, 15 bp, Homo sapiens
tcttgtcattttatt

SEQ ID NO: 445485 - DNA, 15 bp, Homo sapiens
cttgtcattttattc

SEQ ID NO: 445486 - DNA, 15 bp, Homo sapiens
ttgtcattttattcc

SEQ ID NO: 445487 - DNA, 15 bp, Homo sapiens
tgtcattttattcca

SEQ ID NO: 445488 - DNA, 15 bp, Homo sapiens
gtcattttattccac

SEQ ID NO: 445489 - DNA, 15 bp, Homo sapiens
tcattttattccacc

SEQ ID NO: 445490 - DNA, 15 bp, Homo sapiens
cattttattccacca

SEQ ID NO: 445491 - DNA, 15 bp, Homo sapiens
attttattccaccaa

SEQ ID NO: 445492 - DNA, 15 bp, Homo sapiens
ttttattccaccaat

SEQ ID NO: 445493 - DNA, 15 bp, Homo sapiens
tttattccaccaata

SEQ ID NO: 445494 - DNA, 15 bp, Homo sapiens
ttattccaccaataa

SEQ ID NO: 445495 - DNA, 15 bp, Homo sapiens
tattccaccaataag

SEQ ID NO: 445496 - DNA, 15 bp, Homo sapiens
attccaccaataaga

SEQ ID NO: 445497 - DNA, 15 bp, Homo sapiens
ttccaccaataagaa

SEQ ID NO: 445498 - DNA, 15 bp, Homo sapiens
tccaccaataagaaa

SEQ ID NO: 445499 - DNA, 15 bp, Homo sapiens
ccaccaataagaaat

SEQ ID NO: 445500 - DNA, 15 bp, Homo sapiens
caccaataagaaata

SEQ ID NO: 445501 - DNA, 15 bp, Homo sapiens
accaataagaaataa

SEQ ID NO: 445502 - DNA, 15 bp, Homo sapiens
ccaataagaaataat

SEQ ID NO: 445503 - DNA, 15 bp, Homo sapiens
caataagaaataatg

SEQ ID NO: 445504 - DNA, 15 bp, Homo sapiens
aataagaaataatga

SEQ ID NO: 445505 - DNA, 15 bp, Homo sapiens
ataagaaataatgat

SEQ ID NO: 445506 - DNA, 15 bp, Homo sapiens
taagaaataatgatt

SEQ ID NO: 445507 - DNA, 15 bp, Homo sapiens
aagaaataatgattt

SEQ ID NO: 445508 - DNA, 15 bp, Homo sapiens
agaaataatgattta

SEQ ID NO: 445509 - DNA, 15 bp, Homo sapiens
gaaataatgatttat

SEQ ID NO: 445510 - DNA, 15 bp, Homo sapiens
aaataatgatttatc

SEQ ID NO: 445511 - DNA, 15 bp, Homo sapiens
aataatgatttatca

SEQ ID NO: 445512 - DNA, 15 bp, Homo sapiens
ataatgatttatcat

SEQ ID NO: 445513 - DNA, 15 bp, Homo sapiens
taatgatttatcatg

SEQ ID NO: 445514 - DNA, 15 bp, Homo sapiens
aatgatttatcatga

SEQ ID NO: 445515 - DNA, 15 bp, Homo sapiens
atgatttatcatgaa

SEQ ID NO: 445516 - DNA, 15 bp, Homo sapiens
tgatttatcatgaaa

SEQ ID NO: 445517 - DNA, 15 bp, Homo sapiens
gatttatcatgaaaa

SEQ ID NO: 445518 - DNA, 15 bp, Homo sapiens
atttatcatgaaaaa

SEQ ID NO: 445519 - DNA, 15 bp, Homo sapiens
tttatcatgaaaaag

SEQ ID NO: 445520 - DNA, 15 bp, Homo sapiens
ttatcatgaaaaagt

SEQ ID NO: 445521 - DNA, 15 bp, Homo sapiens
tatcatgaaaaagtg

SEQ ID NO: 445522 - DNA, 15 bp, Homo sapiens
atcatgaaaaagtga

SEQ ID NO: 445523 - DNA, 15 bp, Homo sapiens
tcatgaaaaagtgaa

SEQ ID NO: 445524 - DNA, 15 bp, Homo sapiens
catgaaaaagtgaaa

SEQ ID NO: 445525 - DNA, 15 bp, Homo sapiens
atgaaaaagtgaaat

SEQ ID NO: 445526 - DNA, 15 bp, Homo sapiens
tgaaaaagtgaaata

SEQ ID NO: 445527 - DNA, 15 bp, Homo sapiens
gaaaaagtgaaatat

SEQ ID NO: 445528 - DNA, 15 bp, Homo sapiens
aaaaagtgaaatatt

SEQ ID NO: 445529 - DNA, 15 bp, Homo sapiens
aaaagtgaaatattg

SEQ ID NO: 445530 - DNA, 15 bp, Homo sapiens
aaagtgaaatattgt

SEQ ID NO: 445531 - DNA, 15 bp, Homo sapiens
aagtgaaatattgtc

SEQ ID NO: 445532 - DNA, 15 bp, Homo sapiens
agtgaaatattgtca

SEQ ID NO: 445533 - DNA, 15 bp, Homo sapiens
gtgaaatattgtcaa

SEQ ID NO: 445534 - DNA, 15 bp, Homo sapiens
tgaaatattgtcaag

SEQ ID NO: 445535 - DNA, 15 bp, Homo sapiens
gaaatattgtcaagt

SEQ ID NO: 445536 - DNA, 15 bp, Homo sapiens
aaatattgtcaagtt

SEQ ID NO: 445537 - DNA, 15 bp, Homo sapiens
aatattgtcaagttt

SEQ ID NO: 445538 - DNA, 15 bp, Homo sapiens
atattgtcaagtttt

SEQ ID NO: 445539 - DNA, 15 bp, Homo sapiens
tattgtcaagttttt

SEQ ID NO: 445540 - DNA, 15 bp, Homo sapiens
attgtcaagtttttc

SEQ ID NO: 445541 - DNA, 15 bp, Homo sapiens
ttgtcaagtttttct

SEQ ID NO: 445542 - DNA, 15 bp, Homo sapiens
tgtcaagtttttctt

SEQ ID NO: 445543 - DNA, 15 bp, Homo sapiens
gtcaagtttttcttt

SEQ ID NO: 445544 - DNA, 15 bp, Homo sapiens
tcaagtttttctttg

SEQ ID NO: 445545 - DNA, 15 bp, Homo sapiens
caagtttttctttgt

SEQ ID NO: 445546 - DNA, 15 bp, Homo sapiens
aagtttttctttgtc

SEQ ID NO: 445547 - DNA, 15 bp, Homo sapiens
agtttttctttgtct

SEQ ID NO: 445548 - DNA, 15 bp, Homo sapiens
gtttttctttgtctt

SEQ ID NO: 445549 - DNA, 15 bp, Homo sapiens
tttttctttgtctta

SEQ ID NO: 445550 - DNA, 15 bp, Homo sapiens
ttttctttgtcttat

SEQ ID NO: 445551 - DNA, 15 bp, Homo sapiens
tttctttgtcttata

SEQ ID NO: 445552 - DNA, 15 bp, Homo sapiens
ttctttgtcttatag

SEQ ID NO: 445553 - DNA, 15 bp, Homo sapiens
tctttgtcttataga

SEQ ID NO: 445554 - DNA, 15 bp, Homo sapiens
ctttgtcttatagaa

SEQ ID NO: 445555 - DNA, 15 bp, Homo sapiens
tttgtcttatagaag

SEQ ID NO: 445556 - DNA, 15 bp, Homo sapiens
ttgtcttatagaagt

SEQ ID NO: 445557 - DNA, 15 bp, Homo sapiens
tgtcttatagaagtt

SEQ ID NO: 445558 - DNA, 15 bp, Homo sapiens
gtcttatagaagtta

SEQ ID NO: 445559 - DNA, 15 bp, Homo sapiens
tcttatagaagttat

SEQ ID NO: 445560 - DNA, 15 bp, Homo sapiens
cttatagaagttatc

SEQ ID NO: 445561 - DNA, 15 bp, Homo sapiens
ttatagaagttatct

SEQ ID NO: 445562 - DNA, 15 bp, Homo sapiens
tatagaagttatctg

SEQ ID NO: 445563 - DNA, 15 bp, Homo sapiens
atagaagttatctgc

SEQ ID NO: 445564 - DNA, 15 bp, Homo sapiens
tagaagttatctgca

SEQ ID NO: 445565 - DNA, 15 bp, Homo sapiens
agaagttatctgcat

SEQ ID NO: 445566 - DNA, 15 bp, Homo sapiens
gaagttatctgcatt

SEQ ID NO: 445567 - DNA, 15 bp, Homo sapiens
aagttatctgcatta

SEQ ID NO: 445568 - DNA, 15 bp, Homo sapiens
agttatctgcattat

SEQ ID NO: 445569 - DNA, 15 bp, Homo sapiens
gttatctgcattatt

SEQ ID NO: 445570 - DNA, 15 bp, Homo sapiens
ttatctgcattatta

SEQ ID NO: 445571 - DNA, 15 bp, Homo sapiens
tatctgcattattag

SEQ ID NO: 445572 - DNA, 15 bp, Homo sapiens
atctgcattattagc

SEQ ID NO: 445573 - DNA, 15 bp, Homo sapiens
tctgcattattagca

SEQ ID NO: 445574 - DNA, 15 bp, Homo sapiens
ctgcattattagcat

SEQ ID NO: 445575 - DNA, 15 bp, Homo sapiens
tgcattattagcata

SEQ ID NO: 445576 - DNA, 15 bp, Homo sapiens
gcattattagcatag

SEQ ID NO: 445577 - DNA, 15 bp, Homo sapiens
cattattagcatagg

SEQ ID NO: 445578 - DNA, 15 bp, Homo sapiens
attattagcataggc

SEQ ID NO: 445579 - DNA, 15 bp, Homo sapiens
ttattagcataggct

SEQ ID NO: 445580 - DNA, 15 bp, Homo sapiens
tattagcataggctc

SEQ ID NO: 445581 - DNA, 15 bp, Homo sapiens
attagcataggctca

SEQ ID NO: 445582 - DNA, 15 bp, Homo sapiens
ttagcataggctcat

SEQ ID NO: 445583 - DNA, 15 bp, Homo sapiens
tagcataggctcatc

SEQ ID NO: 445584 - DNA, 15 bp, Homo sapiens
agcataggctcatca

SEQ ID NO: 445585 - DNA, 15 bp, Homo sapiens
gcataggctcatcat

SEQ ID NO: 445586 - DNA, 15 bp, Homo sapiens
cataggctcatcatt

SEQ ID NO: 445587 - DNA, 15 bp, Homo sapiens
ataggctcatcattc

SEQ ID NO: 445588 - DNA, 15 bp, Homo sapiens
taggctcatcattct

SEQ ID NO: 445589 - DNA, 15 bp, Homo sapiens
aggctcatcattctt

SEQ ID NO: 445590 - DNA, 15 bp, Homo sapiens
gctcatcattctttg

SEQ ID NO: 445591 - DNA, 15 bp, Homo sapiens
ctcatcattctttga

SEQ ID NO: 445592 - DNA, 15 bp, Homo sapiens
tcatcattctttgat

SEQ ID NO: 445593 - DNA, 15 bp, Homo sapiens
catcattctttgatt

SEQ ID NO: 445594 - DNA, 15 bp, Homo sapiens
atcattctttgattc

SEQ ID NO: 445595 - DNA, 15 bp, Homo sapiens
tcattctttgattct

SEQ ID NO: 445596 - DNA, 15 bp, Homo sapiens
cattctttgattctg

SEQ ID NO: 445597 - DNA, 15 bp, Homo sapiens
attctttgattctgt

SEQ ID NO: 445598 - DNA, 15 bp, Homo sapiens
ttctttgattctgtt

SEQ ID NO: 445599 - DNA, 15 bp, Homo sapiens
tctttgattctgttg

SEQ ID NO: 445600 - DNA, 15 bp, Homo sapiens
ctttgattctgttgt

SEQ ID NO: 445601 - DNA, 15 bp, Homo sapiens
tttgattctgttgtc

SEQ ID NO: 445602 - DNA, 15 bp, Homo sapiens
ttgattctgttgtcc

SEQ ID NO: 445603 - DNA, 15 bp, Homo sapiens
tgattctgttgtcca

SEQ ID NO: 445604 - DNA, 15 bp, Homo sapiens
gattctgttgtccag

SEQ ID NO: 445605 - DNA, 15 bp, Homo sapiens
attctgttgtccagt

SEQ ID NO: 445606 - DNA, 15 bp, Homo sapiens
ttctgttgtccagtt

SEQ ID NO: 445607 - DNA, 15 bp, Homo sapiens
tctgttgtccagtta

SEQ ID NO: 445608 - DNA, 15 bp, Homo sapiens
ctgttgtccagttag

SEQ ID NO: 445609 - DNA, 15 bp, Homo sapiens
tgttgtccagttagt

SEQ ID NO: 445610 - DNA, 15 bp, Homo sapiens
gttgtccagttagtt

SEQ ID NO: 445611 - DNA, 15 bp, Homo sapiens
ttgtccagttagttt

SEQ ID NO: 445612 - DNA, 15 bp, Homo sapiens
tgtccagttagtttc

SEQ ID NO: 445613 - DNA, 15 bp, Homo sapiens
gtccagttagtttct

SEQ ID NO: 445614 - DNA, 15 bp, Homo sapiens
tccagttagtttctc

SEQ ID NO: 445615 - DNA, 15 bp, Homo sapiens
ccagttagtttctcc

SEQ ID NO: 445616 - DNA, 15 bp, Homo sapiens
cagttagtttctcct

SEQ ID NO: 445617 - DNA, 15 bp, Homo sapiens
agttagtttctcctt

SEQ ID NO: 445618 - DNA, 15 bp, Homo sapiens
gttagtttctccttc

SEQ ID NO: 445619 - DNA, 15 bp, Homo sapiens
ttagtttctccttct

SEQ ID NO: 445620 - DNA, 15 bp, Homo sapiens
tagtttctccttctt

SEQ ID NO: 445621 - DNA, 15 bp, Homo sapiens
agtttctccttcttg

SEQ ID NO: 445622 - DNA, 15 bp, Homo sapiens
gtttctccttcttgc

SEQ ID NO: 445623 - DNA, 15 bp, Homo sapiens
tttctccttcttgca

SEQ ID NO: 445624 - DNA, 15 bp, Homo sapiens
ttctccttcttgcat

SEQ ID NO: 445625 - DNA, 15 bp, Homo sapiens
tctccttcttgcata

SEQ ID NO: 445626 - DNA, 15 bp, Homo sapiens
ctccttcttgcatac

SEQ ID NO: 445627 - DNA, 15 bp, Homo sapiens
tccttcttgcatact

SEQ ID NO: 445628 - DNA, 15 bp, Homo sapiens
ccttcttgcatactg

SEQ ID NO: 445629 - DNA, 15 bp, Homo sapiens
cttcttgcatactgt

SEQ ID NO: 445630 - DNA, 15 bp, Homo sapiens
ttcttgcatactgtt

SEQ ID NO: 445631 - DNA, 15 bp, Homo sapiens
tcttgcatactgttt

SEQ ID NO: 445632 - DNA, 15 bp, Homo sapiens
cttgcatactgtttc

SEQ ID NO: 445633 - DNA, 15 bp, Homo sapiens
ttgcatactgtttct

SEQ ID NO: 445634 - DNA, 15 bp, Homo sapiens
tgcatactgtttctt

SEQ ID NO: 445635 - DNA, 15 bp, Homo sapiens
gcatactgtttcttc

SEQ ID NO: 445636 - DNA, 15 bp, Homo sapiens
catactgtttcttct

SEQ ID NO: 445637 - DNA, 15 bp, Homo sapiens
atactgtttcttctt

SEQ ID NO: 445638 - DNA, 15 bp, Homo sapiens
tactgtttcttcttc

SEQ ID NO: 445639 - DNA, 15 bp, Homo sapiens
actgtttcttcttct

SEQ ID NO: 445640 - DNA, 15 bp, Homo sapiens
ctgtttcttcttctt

SEQ ID NO: 445641 - DNA, 15 bp, Homo sapiens
tgtttcttcttctta

SEQ ID NO: 445642 - DNA, 15 bp, Homo sapiens
gtttcttcttcttat

SEQ ID NO: 445643 - DNA, 15 bp, Homo sapiens
tttcttcttcttata

SEQ ID NO: 445644 - DNA, 15 bp, Homo sapiens
ttcttcttcttatat

SEQ ID NO: 445645 - DNA, 15 bp, Homo sapiens
tcttcttcttatatg

SEQ ID NO: 445646 - DNA, 15 bp, Homo sapiens
cttcttcttatatga

SEQ ID NO: 445647 - DNA, 15 bp, Homo sapiens
ttcttcttatatgac

SEQ ID NO: 445648 - DNA, 15 bp, Homo sapiens
tcttcttatatgaca

SEQ ID NO: 445649 - DNA, 15 bp, Homo sapiens
cttcttatatgacat

SEQ ID NO: 445650 - DNA, 15 bp, Homo sapiens
ttcttatatgacatt

SEQ ID NO: 445651 - DNA, 15 bp, Homo sapiens
tcttatatgacattt

SEQ ID NO: 445652 - DNA, 15 bp, Homo sapiens
cttatatgacatttt

SEQ ID NO: 445653 - DNA, 15 bp, Homo sapiens
ttatatgacatttta

SEQ ID NO: 445654 - DNA, 15 bp, Homo sapiens
tatatgacattttat

SEQ ID NO: 445655 - DNA, 15 bp, Homo sapiens
atatgacattttata

SEQ ID NO: 445656 - DNA, 15 bp, Homo sapiens
tatgacattttataa

SEQ ID NO: 445657 - DNA, 15 bp, Homo sapiens
atgacattttataag

SEQ ID NO: 445658 - DNA, 15 bp, Homo sapiens
tgacattttataagt

SEQ ID NO: 445659 - DNA, 15 bp, Homo sapiens
gacattttataagtt

SEQ ID NO: 445660 - DNA, 15 bp, Homo sapiens
acattttataagttt

SEQ ID NO: 445661 - DNA, 15 bp, Homo sapiens
cattttataagtttt

SEQ ID NO: 445662 - DNA, 15 bp, Homo sapiens
attttataagttttg

SEQ ID NO: 445663 - DNA, 15 bp, Homo sapiens
ttttataagttttgt

SEQ ID NO: 445664 - DNA, 15 bp, Homo sapiens
tttataagttttgta

SEQ ID NO: 445665 - DNA, 15 bp, Homo sapiens
ttataagttttgtat

SEQ ID NO: 445666 - DNA, 15 bp, Homo sapiens
tataagttttgtata

SEQ ID NO: 445667 - DNA, 15 bp, Homo sapiens
ataagttttgtataa

SEQ ID NO: 445668 - DNA, 15 bp, Homo sapiens
taagttttgtataat

SEQ ID NO: 445669 - DNA, 15 bp, Homo sapiens
aagttttgtataatt

SEQ ID NO: 445670 - DNA, 15 bp, Homo sapiens
agttttgtataattt

SEQ ID NO: 445671 - DNA, 15 bp, Homo sapiens
gttttgtataattta

SEQ ID NO: 445672 - DNA, 15 bp, Homo sapiens
ttttgtataatttac

SEQ ID NO: 445673 - DNA, 15 bp, Homo sapiens
tttgtataatttaca

SEQ ID NO: 445674 - DNA, 15 bp, Homo sapiens
ttgtataatttacac

SEQ ID NO: 445675 - DNA, 15 bp, Homo sapiens
tgtataatttacaca

SEQ ID NO: 445676 - DNA, 15 bp, Homo sapiens
gtataatttacacag

SEQ ID NO: 445677 - DNA, 15 bp, Homo sapiens
tataatttacacagg

SEQ ID NO: 445678 - DNA, 15 bp, Homo sapiens
ataatttacacaggc

SEQ ID NO: 445679 - DNA, 15 bp, Homo sapiens
taatttacacaggct

SEQ ID NO: 445680 - DNA, 15 bp, Homo sapiens
aatttacacaggctc

SEQ ID NO: 445681 - DNA, 15 bp, Homo sapiens
atttacacaggctct

SEQ ID NO: 445682 - DNA, 15 bp, Homo sapiens
tttacacaggctctt

SEQ ID NO: 445683 - DNA, 15 bp, Homo sapiens
ttacacaggctctta

SEQ ID NO: 445684 - DNA, 15 bp, Homo sapiens
tacacaggctcttag

SEQ ID NO: 445685 - DNA, 15 bp, Homo sapiens
acacaggctcttagt

SEQ ID NO: 445686 - DNA, 15 bp, Homo sapiens
cacaggctcttagta

SEQ ID NO: 445687 - DNA, 15 bp, Homo sapiens
acaggctcttagtag

SEQ ID NO: 445688 - DNA, 15 bp, Homo sapiens
caggctcttagtagg

SEQ ID NO: 445689 - DNA, 15 bp, Homo sapiens
aggctcttagtaggc

SEQ ID NO: 445690 - DNA, 15 bp, Homo sapiens
ggctcttagtaggcg

SEQ ID NO: 445691 - DNA, 15 bp, Homo sapiens
gctcttagtaggcgt

SEQ ID NO: 445692 - DNA, 15 bp, Homo sapiens
ctcttagtaggcgtt

SEQ ID NO: 445693 - DNA, 15 bp, Homo sapiens
tcttagtaggcgttg

SEQ ID NO: 445694 - DNA, 15 bp, Homo sapiens
cttagtaggcgttga

SEQ ID NO: 445695 - DNA, 15 bp, Homo sapiens
ttagtaggcgttgat

SEQ ID NO: 445696 - DNA, 15 bp, Homo sapiens
tagtaggcgttgatc

SEQ ID NO: 445697 - DNA, 15 bp, Homo sapiens
agtaggcgttgatcc

SEQ ID NO: 445698 - DNA, 15 bp, Homo sapiens
gtaggcgttgatcct

SEQ ID NO: 445699 - DNA, 15 bp, Homo sapiens
taggcgttgatcctt

SEQ ID NO: 445700 - DNA, 15 bp, Homo sapiens
aggcgttgatccttg

SEQ ID NO: 445701 - DNA, 15 bp, Homo sapiens
ggcgttgatccttgg

SEQ ID NO: 445702 - DNA, 15 bp, Homo sapiens
gcgttgatccttggc

SEQ ID NO: 445703 - DNA, 15 bp, Homo sapiens
cgttgatccttggct

SEQ ID NO: 445704 - DNA, 15 bp, Homo sapiens
gttgatccttggctt

SEQ ID NO: 445705 - DNA, 15 bp, Homo sapiens
ttgatccttggctta

SEQ ID NO: 445706 - DNA, 15 bp, Homo sapiens
tgatccttggcttag

SEQ ID NO: 445707 - DNA, 15 bp, Homo sapiens
gatccttggcttagg

SEQ ID NO: 445708 - DNA, 15 bp, Homo sapiens
atccttggcttaggg

SEQ ID NO: 445709 - DNA, 15 bp, Homo sapiens
tccttggcttagggc

SEQ ID NO: 445710 - DNA, 15 bp, Homo sapiens
ccttggcttagggct

SEQ ID NO: 445711 - DNA, 15 bp, Homo sapiens
cttggcttagggcta

SEQ ID NO: 445712 - DNA, 15 bp, Homo sapiens
ttggcttagggctat

SEQ ID NO: 445713 - DNA, 15 bp, Homo sapiens
tggcttagggctata

SEQ ID NO: 445714 - DNA, 15 bp, Homo sapiens
ggcttagggctatat

SEQ ID NO: 445715 - DNA, 15 bp, Homo sapiens
gcttagggctatata

SEQ ID NO: 445716 - DNA, 15 bp, Homo sapiens
cttagggctatatat

SEQ ID NO: 445717 - DNA, 15 bp, Homo sapiens
ttagggctatatatt

SEQ ID NO: 445718 - DNA, 15 bp, Homo sapiens
tagggctatatattg

SEQ ID NO: 445719 - DNA, 15 bp, Homo sapiens
agggctatatattgt

SEQ ID NO: 445720 - DNA, 15 bp, Homo sapiens
gggctatatattgtc

SEQ ID NO: 445721 - DNA, 15 bp, Homo sapiens
ggctatatattgtca

SEQ ID NO: 445722 - DNA, 15 bp, Homo sapiens
gctatatattgtcat

SEQ ID NO: 445723 - DNA, 15 bp, Homo sapiens
ctatatattgtcatg

SEQ ID NO: 445724 - DNA, 15 bp, Homo sapiens
tatatattgtcatgg

SEQ ID NO: 445725 - DNA, 15 bp, Homo sapiens
atatattgtcatgga

SEQ ID NO: 445726 - DNA, 15 bp, Homo sapiens
tatattgtcatggaa

SEQ ID NO: 445727 - DNA, 15 bp, Homo sapiens
atattgtcatggaac

SEQ ID NO: 445728 - DNA, 15 bp, Homo sapiens
tattgtcatggaaca

SEQ ID NO: 445729 - DNA, 15 bp, Homo sapiens
attgtcatggaacag

SEQ ID NO: 445730 - DNA, 15 bp, Homo sapiens
ttgtcatggaacaga

SEQ ID NO: 445731 - DNA, 15 bp, Homo sapiens
tgtcatggaacagaa

SEQ ID NO: 445732 - DNA, 15 bp, Homo sapiens
gtcatggaacagaat

SEQ ID NO: 445733 - DNA, 15 bp, Homo sapiens
tcatggaacagaatg

SEQ ID NO: 445734 - DNA, 15 bp, Homo sapiens
catggaacagaatga

SEQ ID NO: 445735 - DNA, 15 bp, Homo sapiens
atggaacagaatgat

SEQ ID NO: 445736 - DNA, 15 bp, Homo sapiens
tggaacagaatgata

SEQ ID NO: 445737 - DNA, 15 bp, Homo sapiens
ggaacagaatgataa

SEQ ID NO: 445738 - DNA, 15 bp, Homo sapiens
gaacagaatgataaa

SEQ ID NO: 445739 - DNA, 15 bp, Homo sapiens
aacagaatgataaaa

SEQ ID NO: 445740 - DNA, 15 bp, Homo sapiens
acagaatgataaaat

SEQ ID NO: 445741 - DNA, 15 bp, Homo sapiens
cagaatgataaaatt

SEQ ID NO: 445742 - DNA, 15 bp, Homo sapiens
agaatgataaaattc

SEQ ID NO: 445743 - DNA, 15 bp, Homo sapiens
gaatgataaaattct

SEQ ID NO: 445744 - DNA, 15 bp, Homo sapiens
aatgataaaattcta

SEQ ID NO: 445745 - DNA, 15 bp, Homo sapiens
atgataaaattctac

SEQ ID NO: 445746 - DNA, 15 bp, Homo sapiens
tgataaaattctact

SEQ ID NO: 445747 - DNA, 15 bp, Homo sapiens
gataaaattctactt

SEQ ID NO: 445748 - DNA, 15 bp, Homo sapiens
ataaaattctacttc

SEQ ID NO: 445749 - DNA, 15 bp, Homo sapiens
taaaattctacttct

SEQ ID NO: 445750 - DNA, 15 bp, Homo sapiens
aaaattctacttcta

SEQ ID NO: 445751 - DNA, 15 bp, Homo sapiens
aaattctacttctat

SEQ ID NO: 445752 - DNA, 15 bp, Homo sapiens
aattctacttctata

SEQ ID NO: 445753 - DNA, 15 bp, Homo sapiens
attctacttctatag

SEQ ID NO: 445754 - DNA, 15 bp, Homo sapiens
ttctacttctatagt

SEQ ID NO: 445755 - DNA, 15 bp, Homo sapiens
tctacttctatagtc

SEQ ID NO: 445756 - DNA, 15 bp, Homo sapiens
ctacttctatagtcc

SEQ ID NO: 445757 - DNA, 15 bp, Homo sapiens
tacttctatagtccc

SEQ ID NO: 445758 - DNA, 15 bp, Homo sapiens
acttctatagtccct

SEQ ID NO: 445759 - DNA, 15 bp, Homo sapiens
cttctatagtccctt

SEQ ID NO: 445760 - DNA, 15 bp, Homo sapiens
ttctatagtcccttg

SEQ ID NO: 445761 - DNA, 15 bp, Homo sapiens
tctatagtcccttgg

SEQ ID NO: 445762 - DNA, 15 bp, Homo sapiens
ctatagtcccttgga

SEQ ID NO: 445763 - DNA, 15 bp, Homo sapiens
tatagtcccttggag

SEQ ID NO: 445764 - DNA, 15 bp, Homo sapiens
atagtcccttggagt

SEQ ID NO: 445765 - DNA, 15 bp, Homo sapiens
tagtcccttggagtg

SEQ ID NO: 445766 - DNA, 15 bp, Homo sapiens
agtcccttggagtgt

SEQ ID NO: 445767 - DNA, 15 bp, Homo sapiens
gtcccttggagtgta

SEQ ID NO: 445768 - DNA, 15 bp, Homo sapiens
tcccttggagtgtaa

SEQ ID NO: 445769 - DNA, 15 bp, Homo sapiens
cccttggagtgtaac

SEQ ID NO: 445770 - DNA, 15 bp, Homo sapiens
ccttggagtgtaact

SEQ ID NO: 445771 - DNA, 15 bp, Homo sapiens
cttggagtgtaactt

SEQ ID NO: 445772 - DNA, 15 bp, Homo sapiens
ttggagtgtaactta

SEQ ID NO: 445773 - DNA, 15 bp, Homo sapiens
tggagtgtaacttag

SEQ ID NO: 445774 - DNA, 15 bp, Homo sapiens
ggagtgtaacttagt

SEQ ID NO: 445775 - DNA, 15 bp, Homo sapiens
gagtgtaacttagta

SEQ ID NO: 445776 - DNA, 15 bp, Homo sapiens
agtgtaacttagtaa

SEQ ID NO: 445777 - DNA, 15 bp, Homo sapiens
gtgtaacttagtaaa

SEQ ID NO: 445778 - DNA, 15 bp, Homo sapiens
tgtaacttagtaaag

SEQ ID NO: 445779 - DNA, 15 bp, Homo sapiens
gtaacttagtaaaga

SEQ ID NO: 445780 - DNA, 15 bp, Homo sapiens
taacttagtaaagat

SEQ ID NO: 445781 - DNA, 15 bp, Homo sapiens
aacttagtaaagata

SEQ ID NO: 445782 - DNA, 15 bp, Homo sapiens
acttagtaaagatat

SEQ ID NO: 445783 - DNA, 15 bp, Homo sapiens
cttagtaaagatatt

SEQ ID NO: 445784 - DNA, 15 bp, Homo sapiens
ttagtaaagatatta

SEQ ID NO: 445785 - DNA, 15 bp, Homo sapiens
tagtaaagatattaa

SEQ ID NO: 445786 - DNA, 15 bp, Homo sapiens
agtaaagatattaat

SEQ ID NO: 445787 - DNA, 15 bp, Homo sapiens
gtaaagatattaatt

SEQ ID NO: 445788 - DNA, 15 bp, Homo sapiens
taaagatattaattt

SEQ ID NO: 445789 - DNA, 15 bp, Homo sapiens
aaagatattaattta

SEQ ID NO: 445790 - DNA, 15 bp, Homo sapiens
aagatattaatttac

SEQ ID NO: 445791 - DNA, 15 bp, Homo sapiens
agatattaatttaca

SEQ ID NO: 445792 - DNA, 15 bp, Homo sapiens
gatattaatttacaa

SEQ ID NO: 445793 - DNA, 15 bp, Homo sapiens
atattaatttacaac

SEQ ID NO: 445794 - DNA, 15 bp, Homo sapiens
tattaatttacaacg

SEQ ID NO: 445795 - DNA, 15 bp, Homo sapiens
attaatttacaacgt

SEQ ID NO: 445796 - DNA, 15 bp, Homo sapiens
ttaatttacaacgtg

SEQ ID NO: 445797 - DNA, 15 bp, Homo sapiens
taatttacaacgtgc

SEQ ID NO: 445798 - DNA, 15 bp, Homo sapiens
aatttacaacgtgct

SEQ ID NO: 445799 - DNA, 15 bp, Homo sapiens
atttacaacgtgctc

SEQ ID NO: 445800 - DNA, 15 bp, Homo sapiens
tttacaacgtgctct

SEQ ID NO: 445801 - DNA, 15 bp, Homo sapiens
ttacaacgtgctcta

SEQ ID NO: 445802 - DNA, 15 bp, Homo sapiens
tacaacgtgctctag

SEQ ID NO: 445803 - DNA, 15 bp, Homo sapiens
acaacgtgctctagt

SEQ ID NO: 445804 - DNA, 15 bp, Homo sapiens
caacgtgctctagtg

SEQ ID NO: 445805 - DNA, 15 bp, Homo sapiens
aacgtgctctagtga

SEQ ID NO: 445806 - DNA, 15 bp, Homo sapiens
acgtgctctagtgat

SEQ ID NO: 445807 - DNA, 15 bp, Homo sapiens
cgtgctctagtgatg

SEQ ID NO: 445808 - DNA, 15 bp, Homo sapiens
gtgctctagtgatga

SEQ ID NO: 445809 - DNA, 15 bp, Homo sapiens
tgctctagtgatgag

SEQ ID NO: 445810 - DNA, 15 bp, Homo sapiens
gctctagtgatgagt

SEQ ID NO: 445811 - DNA, 15 bp, Homo sapiens
ctctagtgatgagtc

SEQ ID NO: 445812 - DNA, 15 bp, Homo sapiens
tctagtgatgagtca

SEQ ID NO: 445813 - DNA, 15 bp, Homo sapiens
ctagtgatgagtcat

SEQ ID NO: 445814 - DNA, 15 bp, Homo sapiens
tagtgatgagtcata

SEQ ID NO: 445815 - DNA, 15 bp, Homo sapiens
agtgatgagtcatag

SEQ ID NO: 445816 - DNA, 15 bp, Homo sapiens
gtgatgagtcatagt

SEQ ID NO: 445817 - DNA, 15 bp, Homo sapiens
tgatgagtcatagtt

SEQ ID NO: 445818 - DNA, 15 bp, Homo sapiens
gatgagtcatagttg

SEQ ID NO: 445819 - DNA, 15 bp, Homo sapiens
atgagtcatagttga

SEQ ID NO: 445820 - DNA, 15 bp, Homo sapiens
tgagtcatagttgac

SEQ ID NO: 445821 - DNA, 15 bp, Homo sapiens
gagtcatagttgacc

SEQ ID NO: 445822 - DNA, 15 bp, Homo sapiens
agtcatagttgaccc

SEQ ID NO: 445823 - DNA, 15 bp, Homo sapiens
gtcatagttgaccct

SEQ ID NO: 445824 - DNA, 15 bp, Homo sapiens
tcatagttgacccta

SEQ ID NO: 445825 - DNA, 15 bp, Homo sapiens
catagttgaccctat

SEQ ID NO: 445826 - DNA, 15 bp, Homo sapiens
atagttgaccctatt

SEQ ID NO: 445827 - DNA, 15 bp, Homo sapiens
tagttgaccctattt

SEQ ID NO: 445828 - DNA, 15 bp, Homo sapiens
agttgaccctatttt

SEQ ID NO: 445829 - DNA, 15 bp, Homo sapiens
gttgaccctatttta

SEQ ID NO: 445830 - DNA, 15 bp, Homo sapiens
ttgaccctattttat

SEQ ID NO: 445831 - DNA, 15 bp, Homo sapiens
tgaccctattttatg

SEQ ID NO: 445832 - DNA, 15 bp, Homo sapiens
gaccctattttatgt

SEQ ID NO: 445833 - DNA, 15 bp, Homo sapiens
accctattttatgtg

SEQ ID NO: 445834 - DNA, 15 bp, Homo sapiens
ccctattttatgtgt

SEQ ID NO: 445835 - DNA, 15 bp, Homo sapiens
cctattttatgtgtc

SEQ ID NO: 445836 - DNA, 15 bp, Homo sapiens
ctattttatgtgtca

SEQ ID NO: 445837 - DNA, 15 bp, Homo sapiens
tattttatgtgtcag

SEQ ID NO: 445838 - DNA, 15 bp, Homo sapiens
attttatgtgtcaga

SEQ ID NO: 445839 - DNA, 15 bp, Homo sapiens
ttttatgtgtcagac

SEQ ID NO: 445840 - DNA, 15 bp, Homo sapiens
tttatgtgtcagacg

SEQ ID NO: 445841 - DNA, 15 bp, Homo sapiens
ttatgtgtcagacga

SEQ ID NO: 445842 - DNA, 15 bp, Homo sapiens
tatgtgtcagacgaa

SEQ ID NO: 445843 - DNA, 15 bp, Homo sapiens
atgtgtcagacgaac

SEQ ID NO: 445844 - DNA, 15 bp, Homo sapiens
tgtgtcagacgaaca

SEQ ID NO: 445845 - DNA, 15 bp, Homo sapiens
gtgtcagacgaacag

SEQ ID NO: 445846 - DNA, 15 bp, Homo sapiens
tgtcagacgaacagc

SEQ ID NO: 445847 - DNA, 15 bp, Homo sapiens
gtcagacgaacagca

SEQ ID NO: 445848 - DNA, 15 bp, Homo sapiens
tcagacgaacagcat

SEQ ID NO: 445849 - DNA, 15 bp, Homo sapiens
cagacgaacagcatc

SEQ ID NO: 445850 - DNA, 15 bp, Homo sapiens
agacgaacagcatca

SEQ ID NO: 445851 - DNA, 15 bp, Homo sapiens
gacgaacagcatcat

SEQ ID NO: 445852 - DNA, 15 bp, Homo sapiens
acgaacagcatcata

SEQ ID NO: 445853 - DNA, 15 bp, Homo sapiens
cgaacagcatcataa

SEQ ID NO: 445854 - DNA, 15 bp, Homo sapiens
gaacagcatcataat

SEQ ID NO: 445855 - DNA, 15 bp, Homo sapiens
aacagcatcataatc

SEQ ID NO: 445856 - DNA, 15 bp, Homo sapiens
acagcatcataatca

SEQ ID NO: 445857 - DNA, 15 bp, Homo sapiens
cagcatcataatcat

SEQ ID NO: 445858 - DNA, 15 bp, Homo sapiens
agcatcataatcatg

SEQ ID NO: 445859 - DNA, 15 bp, Homo sapiens
gcatcataatcatga

SEQ ID NO: 445860 - DNA, 15 bp, Homo sapiens
catcataatcatgac

SEQ ID NO: 445861 - DNA, 15 bp, Homo sapiens
atcataatcatgaca

SEQ ID NO: 445862 - DNA, 15 bp, Homo sapiens
tcataatcatgacaa

SEQ ID NO: 445863 - DNA, 15 bp, Homo sapiens
cataatcatgacaac

SEQ ID NO: 445864 - DNA, 15 bp, Homo sapiens
ataatcatgacaaca

SEQ ID NO: 445865 - DNA, 15 bp, Homo sapiens
taatcatgacaacac

SEQ ID NO: 445866 - DNA, 15 bp, Homo sapiens
aatcatgacaacact

SEQ ID NO: 445867 - DNA, 15 bp, Homo sapiens
atcatgacaacactt

SEQ ID NO: 445868 - DNA, 15 bp, Homo sapiens
tcatgacaacactta

SEQ ID NO: 445869 - DNA, 15 bp, Homo sapiens
catgacaacacttac

SEQ ID NO: 445870 - DNA, 15 bp, Homo sapiens
atgacaacacttact

SEQ ID NO: 445871 - DNA, 15 bp, Homo sapiens
tgacaacacttactt

SEQ ID NO: 445872 - DNA, 15 bp, Homo sapiens
gacaacacttactta

SEQ ID NO: 445873 - DNA, 15 bp, Homo sapiens
acaacacttacttat

SEQ ID NO: 445874 - DNA, 15 bp, Homo sapiens
caacacttacttatt

SEQ ID NO: 445875 - DNA, 15 bp, Homo sapiens
aacacttacttattg

SEQ ID NO: 445876 - DNA, 15 bp, Homo sapiens
acacttacttattgt

SEQ ID NO: 445877 - DNA, 15 bp, Homo sapiens
cacttacttattgtc

SEQ ID NO: 445878 - DNA, 15 bp, Homo sapiens
acttacttattgtca

SEQ ID NO: 445879 - DNA, 15 bp, Homo sapiens
cttacttattgtcag

SEQ ID NO: 445880 - DNA, 15 bp, Homo sapiens
ttacttattgtcagg

SEQ ID NO: 445881 - DNA, 15 bp, Homo sapiens
tacttattgtcagga

SEQ ID NO: 445882 - DNA, 15 bp, Homo sapiens
acttattgtcaggag

SEQ ID NO: 445883 - DNA, 15 bp, Homo sapiens
cttattgtcaggaga

SEQ ID NO: 445884 - DNA, 15 bp, Homo sapiens
ttattgtcaggagac

SEQ ID NO: 445885 - DNA, 15 bp, Homo sapiens
tattgtcaggagaca

SEQ ID NO: 445886 - DNA, 15 bp, Homo sapiens
attgtcaggagacag

SEQ ID NO: 445887 - DNA, 15 bp, Homo sapiens
ttgtcaggagacagc

SEQ ID NO: 445888 - DNA, 15 bp, Homo sapiens
tgtcaggagacagct

SEQ ID NO: 445889 - DNA, 15 bp, Homo sapiens
gtcaggagacagctc

SEQ ID NO: 445890 - DNA, 15 bp, Homo sapiens
tcaggagacagctct

SEQ ID NO: 445891 - DNA, 15 bp, Homo sapiens
caggagacagctctg

SEQ ID NO: 445892 - DNA, 15 bp, Homo sapiens
aggagacagctctgt

SEQ ID NO: 445893 - DNA, 15 bp, Homo sapiens
ggagacagctctgtc

SEQ ID NO: 445894 - DNA, 15 bp, Homo sapiens
gagacagctctgtct

SEQ ID NO: 445895 - DNA, 15 bp, Homo sapiens
agacagctctgtctc

SEQ ID NO: 445896 - DNA, 15 bp, Homo sapiens
gacagctctgtctca

SEQ ID NO: 445897 - DNA, 15 bp, Homo sapiens
acagctctgtctcag

SEQ ID NO: 445898 - DNA, 15 bp, Homo sapiens
cagctctgtctcagg

SEQ ID NO: 445899 - DNA, 15 bp, Homo sapiens
agctctgtctcaggt

SEQ ID NO: 445900 - DNA, 15 bp, Homo sapiens
gctctgtctcaggtt

SEQ ID NO: 445901 - DNA, 15 bp, Homo sapiens
ctctgtctcaggtta

SEQ ID NO: 445902 - DNA, 15 bp, Homo sapiens
tctgtctcaggttag

SEQ ID NO: 445903 - DNA, 15 bp, Homo sapiens
ctgtctcaggttagc

SEQ ID NO: 445904 - DNA, 15 bp, Homo sapiens
tgtctcaggttagct

SEQ ID NO: 445905 - DNA, 15 bp, Homo sapiens
gtctcaggttagctg

SEQ ID NO: 445906 - DNA, 15 bp, Homo sapiens
tctcaggttagctgt

SEQ ID NO: 445907 - DNA, 15 bp, Homo sapiens
ctcaggttagctgtg

SEQ ID NO: 445908 - DNA, 15 bp, Homo sapiens
tcaggttagctgtgt

SEQ ID NO: 445909 - DNA, 15 bp, Homo sapiens
caggttagctgtgtg

SEQ ID NO: 445910 - DNA, 15 bp, Homo sapiens
aggttagctgtgtga

SEQ ID NO: 445911 - DNA, 15 bp, Homo sapiens
ggttagctgtgtgac

SEQ ID NO: 445912 - DNA, 15 bp, Homo sapiens
gttagctgtgtgacc

SEQ ID NO: 445913 - DNA, 15 bp, Homo sapiens
ttagctgtgtgacct

SEQ ID NO: 445914 - DNA, 15 bp, Homo sapiens
tagctgtgtgacctc

SEQ ID NO: 445915 - DNA, 15 bp, Homo sapiens
agctgtgtgacctca

SEQ ID NO: 445916 - DNA, 15 bp, Homo sapiens
gctgtgtgacctcag

SEQ ID NO: 445917 - DNA, 15 bp, Homo sapiens
ctgtgtgacctcagg

SEQ ID NO: 445918 - DNA, 15 bp, Homo sapiens
tgtgtgacctcaggt

SEQ ID NO: 445919 - DNA, 15 bp, Homo sapiens
gtgtgacctcaggta

SEQ ID NO: 445920 - DNA, 15 bp, Homo sapiens
tgtgacctcaggtaa

SEQ ID NO: 445921 - DNA, 15 bp, Homo sapiens
gtgacctcaggtaag

SEQ ID NO: 445922 - DNA, 15 bp, Homo sapiens
tgacctcaggtaagt

SEQ ID NO: 445923 - DNA, 15 bp, Homo sapiens
gacctcaggtaagtc

SEQ ID NO: 445924 - DNA, 15 bp, Homo sapiens
acctcaggtaagtca

SEQ ID NO: 445925 - DNA, 15 bp, Homo sapiens
cctcaggtaagtcag

SEQ ID NO: 445926 - DNA, 15 bp, Homo sapiens
ctcaggtaagtcaga

SEQ ID NO: 445927 - DNA, 15 bp, Homo sapiens
tcaggtaagtcagat

SEQ ID NO: 445928 - DNA, 15 bp, Homo sapiens
caggtaagtcagatg

SEQ ID NO: 445929 - DNA, 15 bp, Homo sapiens
aggtaagtcagatga

SEQ ID NO: 445930 - DNA, 15 bp, Homo sapiens
ggtaagtcagatgaa

SEQ ID NO: 445931 - DNA, 15 bp, Homo sapiens
gtaagtcagatgaag

SEQ ID NO: 445932 - DNA, 15 bp, Homo sapiens
taagtcagatgaaga

SEQ ID NO: 445933 - DNA, 15 bp, Homo sapiens
aagtcagatgaagat

SEQ ID NO: 445934 - DNA, 15 bp, Homo sapiens
agtcagatgaagatc

SEQ ID NO: 445935 - DNA, 15 bp, Homo sapiens
gtcagatgaagatct

SEQ ID NO: 445936 - DNA, 15 bp, Homo sapiens
tcagatgaagatctc

SEQ ID NO: 445937 - DNA, 15 bp, Homo sapiens
cagatgaagatctct

SEQ ID NO: 445938 - DNA, 15 bp, Homo sapiens
agatgaagatctctg

SEQ ID NO: 445939 - DNA, 15 bp, Homo sapiens
gatgaagatctctgg

SEQ ID NO: 445940 - DNA, 15 bp, Homo sapiens
atgaagatctctggg

SEQ ID NO: 445941 - DNA, 15 bp, Homo sapiens
tgaagatctctgggc

SEQ ID NO: 445942 - DNA, 15 bp, Homo sapiens
gaagatctctgggcc

SEQ ID NO: 445943 - DNA, 15 bp, Homo sapiens
aagatctctgggcca

SEQ ID NO: 445944 - DNA, 15 bp, Homo sapiens
agatctctgggccaa

SEQ ID NO: 445945 - DNA, 15 bp, Homo sapiens
gatctctgggccaag

SEQ ID NO: 445946 - DNA, 15 bp, Homo sapiens
atctctgggccaagt

SEQ ID NO: 445947 - DNA, 15 bp, Homo sapiens
tctctgggccaagtt

SEQ ID NO: 445948 - DNA, 15 bp, Homo sapiens
ctctgggccaagttt

SEQ ID NO: 445949 - DNA, 15 bp, Homo sapiens
tctgggccaagtttc

SEQ ID NO: 445950 - DNA, 15 bp, Homo sapiens
ctgggccaagtttcc

SEQ ID NO: 445951 - DNA, 15 bp, Homo sapiens
tgggccaagtttcct

SEQ ID NO: 445952 - DNA, 15 bp, Homo sapiens
gggccaagtttcctt

SEQ ID NO: 445953 - DNA, 15 bp, Homo sapiens
ggccaagtttccttt

SEQ ID NO: 445954 - DNA, 15 bp, Homo sapiens
gccaagtttcctttt

SEQ ID NO: 445955 - DNA, 15 bp, Homo sapiens
ccaagtttccttttt

SEQ ID NO: 445956 - DNA, 15 bp, Homo sapiens
caagtttccttttta

SEQ ID NO: 445957 - DNA, 15 bp, Homo sapiens
aagtttcctttttat

SEQ ID NO: 445958 - DNA, 15 bp, Homo sapiens
agtttcctttttatc

SEQ ID NO: 445959 - DNA, 15 bp, Homo sapiens
gtttcctttttatca

SEQ ID NO: 445960 - DNA, 15 bp, Homo sapiens
tttcctttttatcat

SEQ ID NO: 445961 - DNA, 15 bp, Homo sapiens
ttcctttttatcatt

SEQ ID NO: 445962 - DNA, 15 bp, Homo sapiens
tcctttttatcattt

SEQ ID NO: 445963 - DNA, 15 bp, Homo sapiens
cctttttatcatttc

SEQ ID NO: 445964 - DNA, 15 bp, Homo sapiens
ctttttatcatttct

SEQ ID NO: 445965 - DNA, 15 bp, Homo sapiens
tttttatcatttcta

SEQ ID NO: 445966 - DNA, 15 bp, Homo sapiens
ttttatcatttctaa

SEQ ID NO: 445967 - DNA, 15 bp, Homo sapiens
tttatcatttctaac

SEQ ID NO: 445968 - DNA, 15 bp, Homo sapiens
ttatcatttctaaca

SEQ ID NO: 445969 - DNA, 15 bp, Homo sapiens
tatcatttctaacat

SEQ ID NO: 445970 - DNA, 15 bp, Homo sapiens
atcatttctaacatg

SEQ ID NO: 445971 - DNA, 15 bp, Homo sapiens
tcatttctaacatgg

SEQ ID NO: 445972 - DNA, 15 bp, Homo sapiens
catttctaacatggg

SEQ ID NO: 445973 - DNA, 15 bp, Homo sapiens
atttctaacatgggg

SEQ ID NO: 445974 - DNA, 15 bp, Homo sapiens
tttctaacatggggt

SEQ ID NO: 445975 - DNA, 15 bp, Homo sapiens
ttctaacatggggtg

SEQ ID NO: 445976 - DNA, 15 bp, Homo sapiens
tctaacatggggtgt

SEQ ID NO: 445977 - DNA, 15 bp, Homo sapiens
ctaacatggggtgtg

SEQ ID NO: 445978 - DNA, 15 bp, Homo sapiens
taacatggggtgtgg

SEQ ID NO: 445979 - DNA, 15 bp, Homo sapiens
aacatggggtgtggt

SEQ ID NO: 445980 - DNA, 15 bp, Homo sapiens
acatggggtgtggta

SEQ ID NO: 445981 - DNA, 15 bp, Homo sapiens
catggggtgtggtat

SEQ ID NO: 445982 - DNA, 15 bp, Homo sapiens
atggggtgtggtatc

SEQ ID NO: 445983 - DNA, 15 bp, Homo sapiens
tggggtgtggtatct

SEQ ID NO: 445984 - DNA, 15 bp, Homo sapiens
ggggtgtggtatctc

SEQ ID NO: 445985 - DNA, 15 bp, Homo sapiens
gggtgtggtatctcc

SEQ ID NO: 445986 - DNA, 15 bp, Homo sapiens
ggtgtggtatctcca

SEQ ID NO: 445987 - DNA, 15 bp, Homo sapiens
gtgtggtatctccaa

SEQ ID NO: 445988 - DNA, 15 bp, Homo sapiens
tgtggtatctccaaa

SEQ ID NO: 445989 - DNA, 15 bp, Homo sapiens
gtggtatctccaaaa

SEQ ID NO: 445990 - DNA, 15 bp, Homo sapiens
tggtatctccaaaat

SEQ ID NO: 445991 - DNA, 15 bp, Homo sapiens
ggtatctccaaaatc

SEQ ID NO: 445992 - DNA, 15 bp, Homo sapiens
gtatctccaaaatct

SEQ ID NO: 445993 - DNA, 15 bp, Homo sapiens
tatctccaaaatcta

SEQ ID NO: 445994 - DNA, 15 bp, Homo sapiens
atctccaaaatctat

SEQ ID NO: 445995 - DNA, 15 bp, Homo sapiens
tctccaaaatctata

SEQ ID NO: 445996 - DNA, 15 bp, Homo sapiens
ctccaaaatctatac

SEQ ID NO: 445997 - DNA, 15 bp, Homo sapiens
tccaaaatctataca

SEQ ID NO: 445998 - DNA, 15 bp, Homo sapiens
ccaaaatctatacaa

SEQ ID NO: 445999 - DNA, 15 bp, Homo sapiens
caaaatctatacaaa

SEQ ID NO: 446000 - DNA, 15 bp, Homo sapiens
aaaatctatacaaat

SEQ ID NO: 446001 - DNA, 15 bp, Homo sapiens
aaatctatacaaatg

SEQ ID NO: 446002 - DNA, 15 bp, Homo sapiens
aatctatacaaatgc

SEQ ID NO: 446003 - DNA, 15 bp, Homo sapiens
atctatacaaatgct

SEQ ID NO: 446004 - DNA, 15 bp, Homo sapiens
tctatacaaatgcta

SEQ ID NO: 446005 - DNA, 15 bp, Homo sapiens
ctatacaaatgctaa

SEQ ID NO: 446006 - DNA, 15 bp, Homo sapiens
tatacaaatgctaat

SEQ ID NO: 446007 - DNA, 15 bp, Homo sapiens
atacaaatgctaata

SEQ ID NO: 446008 - DNA, 15 bp, Homo sapiens
tacaaatgctaataa

SEQ ID NO: 446009 - DNA, 15 bp, Homo sapiens
acaaatgctaataat

SEQ ID NO: 446010 - DNA, 15 bp, Homo sapiens
caaatgctaataatc

SEQ ID NO: 446011 - DNA, 15 bp, Homo sapiens
aaatgctaataatct

SEQ ID NO: 446012 - DNA, 15 bp, Homo sapiens
aatgctaataatctg

SEQ ID NO: 446013 - DNA, 15 bp, Homo sapiens
atgctaataatctgc

SEQ ID NO: 446014 - DNA, 15 bp, Homo sapiens
tgctaataatctgct

SEQ ID NO: 446015 - DNA, 15 bp, Homo sapiens
gctaataatctgctc

SEQ ID NO: 446016 - DNA, 15 bp, Homo sapiens
ctaataatctgctct

SEQ ID NO: 446017 - DNA, 15 bp, Homo sapiens
taataatctgctctt

SEQ ID NO: 446018 - DNA, 15 bp, Homo sapiens
aataatctgctcttc

SEQ ID NO: 446019 - DNA, 15 bp, Homo sapiens
ataatctgctcttcc

SEQ ID NO: 446020 - DNA, 15 bp, Homo sapiens
taatctgctcttcca

SEQ ID NO: 446021 - DNA, 15 bp, Homo sapiens
aatctgctcttccag

SEQ ID NO: 446022 - DNA, 15 bp, Homo sapiens
atctgctcttccagt

SEQ ID NO: 446023 - DNA, 15 bp, Homo sapiens
tctgctcttccagta

SEQ ID NO: 446024 - DNA, 15 bp, Homo sapiens
ctgctcttccagtat

SEQ ID NO: 446025 - DNA, 15 bp, Homo sapiens
tgctcttccagtata

SEQ ID NO: 446026 - DNA, 15 bp, Homo sapiens
gctcttccagtatac

SEQ ID NO: 446027 - DNA, 15 bp, Homo sapiens
ctcttccagtatact

SEQ ID NO: 446028 - DNA, 15 bp, Homo sapiens
tcttccagtatactt

SEQ ID NO: 446029 - DNA, 15 bp, Homo sapiens
cttccagtatacttc

SEQ ID NO: 446030 - DNA, 15 bp, Homo sapiens
ttccagtatacttcc

SEQ ID NO: 446031 - DNA, 15 bp, Homo sapiens
tccagtatacttcct

SEQ ID NO: 446032 - DNA, 15 bp, Homo sapiens
ccagtatacttcctg

SEQ ID NO: 446033 - DNA, 15 bp, Homo sapiens
cagtatacttcctga

SEQ ID NO: 446034 - DNA, 15 bp, Homo sapiens
agtatacttcctgaa

SEQ ID NO: 446035 - DNA, 15 bp, Homo sapiens
gtatacttcctgaaa

SEQ ID NO: 446036 - DNA, 15 bp, Homo sapiens
tatacttcctgaaaa

SEQ ID NO: 446037 - DNA, 15 bp, Homo sapiens
atacttcctgaaaac

SEQ ID NO: 446038 - DNA, 15 bp, Homo sapiens
tacttcctgaaaacg

SEQ ID NO: 446039 - DNA, 15 bp, Homo sapiens
acttcctgaaaacgt

SEQ ID NO: 446040 - DNA, 15 bp, Homo sapiens
cttcctgaaaacgtt

SEQ ID NO: 446041 - DNA, 15 bp, Homo sapiens
ttcctgaaaacgttg

SEQ ID NO: 446042 - DNA, 15 bp, Homo sapiens
tcctgaaaacgttgt

SEQ ID NO: 446043 - DNA, 15 bp, Homo sapiens
cctgaaaacgttgtg

SEQ ID NO: 446044 - DNA, 15 bp, Homo sapiens
ctgaaaacgttgtgt

SEQ ID NO: 446045 - DNA, 15 bp, Homo sapiens
tgaaaacgttgtgtg

SEQ ID NO: 446046 - DNA, 15 bp, Homo sapiens
gaaaacgttgtgtga

SEQ ID NO: 446047 - DNA, 15 bp, Homo sapiens
aaaacgttgtgtgaa

SEQ ID NO: 446048 - DNA, 15 bp, Homo sapiens
aaacgttgtgtgaag

SEQ ID NO: 446049 - DNA, 15 bp, Homo sapiens
aacgttgtgtgaagt

SEQ ID NO: 446050 - DNA, 15 bp, Homo sapiens
acgttgtgtgaagtc

SEQ ID NO: 446051 - DNA, 15 bp, Homo sapiens
cgttgtgtgaagtcc

SEQ ID NO: 446052 - DNA, 15 bp, Homo sapiens
gttgtgtgaagtcca

SEQ ID NO: 446053 - DNA, 15 bp, Homo sapiens
ttgtgtgaagtccat

SEQ ID NO: 446054 - DNA, 15 bp, Homo sapiens
tgtgtgaagtccatg

SEQ ID NO: 446055 - DNA, 15 bp, Homo sapiens
gtgtgaagtccatgt

SEQ ID NO: 446056 - DNA, 15 bp, Homo sapiens
tgtgaagtccatgtt

SEQ ID NO: 446057 - DNA, 15 bp, Homo sapiens
gtgaagtccatgttg

SEQ ID NO: 446058 - DNA, 15 bp, Homo sapiens
tgaagtccatgttgg

SEQ ID NO: 446059 - DNA, 15 bp, Homo sapiens
gaagtccatgttggt

SEQ ID NO: 446060 - DNA, 15 bp, Homo sapiens
aagtccatgttggtg

SEQ ID NO: 446061 - DNA, 15 bp, Homo sapiens
agtccatgttggtga

SEQ ID NO: 446062 - DNA, 15 bp, Homo sapiens
gtccatgttggtgaa

SEQ ID NO: 446063 - DNA, 15 bp, Homo sapiens
tccatgttggtgaaa

SEQ ID NO: 446064 - DNA, 15 bp, Homo sapiens
ccatgttggtgaaat

SEQ ID NO: 446065 - DNA, 15 bp, Homo sapiens
catgttggtgaaata

SEQ ID NO: 446066 - DNA, 15 bp, Homo sapiens
atgttggtgaaatag

SEQ ID NO: 446067 - DNA, 15 bp, Homo sapiens
tgttggtgaaatagt

SEQ ID NO: 446068 - DNA, 15 bp, Homo sapiens
gttggtgaaatagtc

SEQ ID NO: 446069 - DNA, 15 bp, Homo sapiens
ttggtgaaatagtct

SEQ ID NO: 446070 - DNA, 15 bp, Homo sapiens
tggtgaaatagtctt

SEQ ID NO: 446071 - DNA, 15 bp, Homo sapiens
ggtgaaatagtcttt

SEQ ID NO: 446072 - DNA, 15 bp, Homo sapiens
gtgaaatagtctttt

SEQ ID NO: 446073 - DNA, 15 bp, Homo sapiens
tgaaatagtcttttc

SEQ ID NO: 446074 - DNA, 15 bp, Homo sapiens
gaaatagtcttttct

SEQ ID NO: 446075 - DNA, 15 bp, Homo sapiens
aaatagtcttttctt

SEQ ID NO: 446076 - DNA, 15 bp, Homo sapiens
aatagtcttttctta

SEQ ID NO: 446077 - DNA, 15 bp, Homo sapiens
atagtcttttcttat

SEQ ID NO: 446078 - DNA, 15 bp, Homo sapiens
tagtcttttcttata

SEQ ID NO: 446079 - DNA, 15 bp, Homo sapiens
agtcttttcttataa

SEQ ID NO: 446080 - DNA, 15 bp, Homo sapiens
gtcttttcttataat

SEQ ID NO: 446081 - DNA, 15 bp, Homo sapiens
tcttttcttataatt

SEQ ID NO: 446082 - DNA, 15 bp, Homo sapiens
cttttcttataattt

SEQ ID NO: 446083 - DNA, 15 bp, Homo sapiens
ttttcttataatttt

SEQ ID NO: 446084 - DNA, 15 bp, Homo sapiens
tttcttataattttt

SEQ ID NO: 446085 - DNA, 15 bp, Homo sapiens
ttcttataatttttt

SEQ ID NO: 446086 - DNA, 15 bp, Homo sapiens
tcttataatttttta

SEQ ID NO: 446087 - DNA, 15 bp, Homo sapiens
cttataattttttat

SEQ ID NO: 446088 - DNA, 15 bp, Homo sapiens
ttataattttttatt

SEQ ID NO: 446089 - DNA, 15 bp, Homo sapiens
tataattttttatta

SEQ ID NO: 446090 - DNA, 15 bp, Homo sapiens
ataattttttattac

SEQ ID NO: 446091 - DNA, 15 bp, Homo sapiens
taattttttattaca

SEQ ID NO: 446092 - DNA, 15 bp, Homo sapiens
aattttttattacag

SEQ ID NO: 446093 - DNA, 15 bp, Homo sapiens
attttttattacagt

SEQ ID NO: 446094 - DNA, 15 bp, Homo sapiens
ttttttattacagtc

SEQ ID NO: 446095 - DNA, 15 bp, Homo sapiens
tttttattacagtct

SEQ ID NO: 446096 - DNA, 15 bp, Homo sapiens
ttttattacagtctg

SEQ ID NO: 446097 - DNA, 15 bp, Homo sapiens
tttattacagtctga

SEQ ID NO: 446098 - DNA, 15 bp, Homo sapiens
ttattacagtctgag

SEQ ID NO: 446099 - DNA, 15 bp, Homo sapiens
tattacagtctgaga

SEQ ID NO: 446100 - DNA, 15 bp, Homo sapiens
attacagtctgagat

SEQ ID NO: 446101 - DNA, 15 bp, Homo sapiens
ttacagtctgagatg

SEQ ID NO: 446102 - DNA, 15 bp, Homo sapiens
tacagtctgagatgt

SEQ ID NO: 446103 - DNA, 15 bp, Homo sapiens
acagtctgagatgta

SEQ ID NO: 446104 - DNA, 15 bp, Homo sapiens
cagtctgagatgtaa

SEQ ID NO: 446105 - DNA, 15 bp, Homo sapiens
agtctgagatgtaag

SEQ ID NO: 446106 - DNA, 15 bp, Homo sapiens
gtctgagatgtaagc

SEQ ID NO: 446107 - DNA, 15 bp, Homo sapiens
tctgagatgtaagct

SEQ ID NO: 446108 - DNA, 15 bp, Homo sapiens
ctgagatgtaagctc

SEQ ID NO: 446109 - DNA, 15 bp, Homo sapiens
tgagatgtaagctca

SEQ ID NO: 446110 - DNA, 15 bp, Homo sapiens
gagatgtaagctcag

SEQ ID NO: 446111 - DNA, 15 bp, Homo sapiens
agatgtaagctcagg

SEQ ID NO: 446112 - DNA, 15 bp, Homo sapiens
gatgtaagctcaggg

SEQ ID NO: 446113 - DNA, 15 bp, Homo sapiens
atgtaagctcagggt

SEQ ID NO: 446114 - DNA, 15 bp, Homo sapiens
tgtaagctcagggta

SEQ ID NO: 446115 - DNA, 15 bp, Homo sapiens
gtaagctcagggtaa

SEQ ID NO: 446116 - DNA, 15 bp, Homo sapiens
taagctcagggtaaa

SEQ ID NO: 446117 - DNA, 15 bp, Homo sapiens
aagctcagggtaaaa

SEQ ID NO: 446118 - DNA, 15 bp, Homo sapiens
agctcagggtaaaaa

SEQ ID NO: 446119 - DNA, 15 bp, Homo sapiens
gctcagggtaaaaaa

SEQ ID NO: 446120 - DNA, 15 bp, Homo sapiens
ctcagggtaaaaaac

SEQ ID NO: 446121 - DNA, 15 bp, Homo sapiens
tcagggtaaaaaaca

SEQ ID NO: 446122 - DNA, 15 bp, Homo sapiens
cagggtaaaaaacag

SEQ ID NO: 446123 - DNA, 15 bp, Homo sapiens
agggtaaaaaacagg

SEQ ID NO: 446124 - DNA, 15 bp, Homo sapiens
gggtaaaaaacaggt

SEQ ID NO: 446125 - DNA, 15 bp, Homo sapiens
ggtaaaaaacaggtt

SEQ ID NO: 446126 - DNA, 15 bp, Homo sapiens
gtaaaaaacaggttt

SEQ ID NO: 446127 - DNA, 15 bp, Homo sapiens
taaaaaacaggtttg

SEQ ID NO: 446128 - DNA, 15 bp, Homo sapiens
aaaaaacaggtttgc

SEQ ID NO: 446129 - DNA, 15 bp, Homo sapiens
aaaaacaggtttgca

SEQ ID NO: 446130 - DNA, 15 bp, Homo sapiens
aaaacaggtttgcat

SEQ ID NO: 446131 - DNA, 15 bp, Homo sapiens
aaacaggtttgcata

SEQ ID NO: 446132 - DNA, 15 bp, Homo sapiens
aacaggtttgcataa

SEQ ID NO: 446133 - DNA, 15 bp, Homo sapiens
acaggtttgcataat

SEQ ID NO: 446134 - DNA, 15 bp, Homo sapiens
caggtttgcataata

SEQ ID NO: 446135 - DNA, 15 bp, Homo sapiens
aggtttgcataatat

SEQ ID NO: 446136 - DNA, 15 bp, Homo sapiens
ggtttgcataatata

SEQ ID NO: 446137 - DNA, 15 bp, Homo sapiens
gtttgcataatatat

SEQ ID NO: 446138 - DNA, 15 bp, Homo sapiens
tttgcataatatata

SEQ ID NO: 446139 - DNA, 15 bp, Homo sapiens
ttgcataatatataa

SEQ ID NO: 446140 - DNA, 15 bp, Homo sapiens
tgcataatatataat

SEQ ID NO: 446141 - DNA, 15 bp, Homo sapiens
gcataatatataata

SEQ ID NO: 446142 - DNA, 15 bp, Homo sapiens
cataatatataataa

SEQ ID NO: 446143 - DNA, 15 bp, Homo sapiens
ataatatataataaa

SEQ ID NO: 446144 - DNA, 15 bp, Homo sapiens
taatatataataaat

SEQ ID NO: 446145 - DNA, 15 bp, Homo sapiens
aatatataataaata

SEQ ID NO: 446146 - DNA, 15 bp, Homo sapiens
atatataataaatat

SEQ ID NO: 446147 - DNA, 15 bp, Homo sapiens
tatataataaatata

SEQ ID NO: 446148 - DNA, 15 bp, Homo sapiens
atataataaatataa

SEQ ID NO: 446149 - DNA, 15 bp, Homo sapiens
tataataaatataat

SEQ ID NO: 446150 - DNA, 15 bp, Homo sapiens
ataataaatataata

SEQ ID NO: 446151 - DNA, 15 bp, Homo sapiens
taataaatataataa

SEQ ID NO: 446152 - DNA, 15 bp, Homo sapiens
aataaatataataag

SEQ ID NO: 446153 - DNA, 15 bp, Homo sapiens
ataaatataataagc

SEQ ID NO: 446154 - DNA, 15 bp, Homo sapiens
taaatataataagca

SEQ ID NO: 446155 - DNA, 15 bp, Homo sapiens
aaatataataagcaa

SEQ ID NO: 446156 - DNA, 15 bp, Homo sapiens
aatataataagcaat

SEQ ID NO: 446157 - DNA, 15 bp, Homo sapiens
atataataagcaata

SEQ ID NO: 446158 - DNA, 15 bp, Homo sapiens
tataataagcaatat

SEQ ID NO: 446159 - DNA, 15 bp, Homo sapiens
ataataagcaatata

SEQ ID NO: 446160 - DNA, 15 bp, Homo sapiens
taataagcaatatac

SEQ ID NO: 446161 - DNA, 15 bp, Homo sapiens
aataagcaatatacg

SEQ ID NO: 446162 - DNA, 15 bp, Homo sapiens
ataagcaatatacgt

SEQ ID NO: 446163 - DNA, 15 bp, Homo sapiens
taagcaatatacgtt

SEQ ID NO: 446164 - DNA, 15 bp, Homo sapiens
aagcaatatacgtta

SEQ ID NO: 446165 - DNA, 15 bp, Homo sapiens
agcaatatacgttac

SEQ ID NO: 446166 - DNA, 15 bp, Homo sapiens
gcaatatacgttaca

SEQ ID NO: 446167 - DNA, 15 bp, Homo sapiens
caatatacgttacat

SEQ ID NO: 446168 - DNA, 15 bp, Homo sapiens
aatatacgttacatt

SEQ ID NO: 446169 - DNA, 15 bp, Homo sapiens
atatacgttacatta

SEQ ID NO: 446170 - DNA, 15 bp, Homo sapiens
tatacgttacattag

SEQ ID NO: 446171 - DNA, 15 bp, Homo sapiens
atacgttacattagc

SEQ ID NO: 446172 - DNA, 15 bp, Homo sapiens
tacgttacattagct

SEQ ID NO: 446173 - DNA, 15 bp, Homo sapiens
acgttacattagctt

SEQ ID NO: 446174 - DNA, 15 bp, Homo sapiens
cgttacattagctta

SEQ ID NO: 446175 - DNA, 15 bp, Homo sapiens
gttacattagcttat

SEQ ID NO: 446176 - DNA, 15 bp, Homo sapiens
ttacattagcttatg

SEQ ID NO: 446177 - DNA, 15 bp, Homo sapiens
tacattagcttatgg

SEQ ID NO: 446178 - DNA, 15 bp, Homo sapiens
acattagcttatggg

SEQ ID NO: 446179 - DNA, 15 bp, Homo sapiens
cattagcttatggga

SEQ ID NO: 446180 - DNA, 15 bp, Homo sapiens
attagcttatgggag

SEQ ID NO: 446181 - DNA, 15 bp, Homo sapiens
ttagcttatgggagt

SEQ ID NO: 446182 - DNA, 15 bp, Homo sapiens
tagcttatgggagtt

SEQ ID NO: 446183 - DNA, 15 bp, Homo sapiens
agcttatgggagttt

SEQ ID NO: 446184 - DNA, 15 bp, Homo sapiens
gcttatgggagttta

SEQ ID NO: 446185 - DNA, 15 bp, Homo sapiens
cttatgggagtttaa

SEQ ID NO: 446186 - DNA, 15 bp, Homo sapiens
ttatgggagtttaat

SEQ ID NO: 446187 - DNA, 15 bp, Homo sapiens
tatgggagtttaata

SEQ ID NO: 446188 - DNA, 15 bp, Homo sapiens
atgggagtttaatat

SEQ ID NO: 446189 - DNA, 15 bp, Homo sapiens
tgggagtttaatatt

SEQ ID NO: 446190 - DNA, 15 bp, Homo sapiens
gggagtttaatattt

SEQ ID NO: 446191 - DNA, 15 bp, Homo sapiens
ggagtttaatatttt

SEQ ID NO: 446192 - DNA, 15 bp, Homo sapiens
gagtttaatattttt

SEQ ID NO: 446193 - DNA, 15 bp, Homo sapiens
agtttaatattttta

SEQ ID NO: 446194 - DNA, 15 bp, Homo sapiens
gtttaatatttttat

SEQ ID NO: 446195 - DNA, 15 bp, Homo sapiens
tttaatatttttatc

SEQ ID NO: 446196 - DNA, 15 bp, Homo sapiens
ttaatatttttatca

SEQ ID NO: 446197 - DNA, 15 bp, Homo sapiens
taatatttttatcag

SEQ ID NO: 446198 - DNA, 15 bp, Homo sapiens
aatatttttatcagt

SEQ ID NO: 446199 - DNA, 15 bp, Homo sapiens
atatttttatcagtg

SEQ ID NO: 446200 - DNA, 15 bp, Homo sapiens
tatttttatcagtgt

SEQ ID NO: 446201 - DNA, 15 bp, Homo sapiens
atttttatcagtgta

SEQ ID NO: 446202 - DNA, 15 bp, Homo sapiens
tttttatcagtgtat

SEQ ID NO: 446203 - DNA, 15 bp, Homo sapiens
ttttatcagtgtata

SEQ ID NO: 446204 - DNA, 15 bp, Homo sapiens
tttatcagtgtataa

SEQ ID NO: 446205 - DNA, 15 bp, Homo sapiens
ttatcagtgtataac

SEQ ID NO: 446206 - DNA, 15 bp, Homo sapiens
tatcagtgtataacc

SEQ ID NO: 446207 - DNA, 15 bp, Homo sapiens
atcagtgtataacct

SEQ ID NO: 446208 - DNA, 15 bp, Homo sapiens
tcagtgtataaccta

SEQ ID NO: 446209 - DNA, 15 bp, Homo sapiens
cagtgtataacctac

SEQ ID NO: 446210 - DNA, 15 bp, Homo sapiens
agtgtataacctaca

SEQ ID NO: 446211 - DNA, 15 bp, Homo sapiens
gtgtataacctacaa

SEQ ID NO: 446212 - DNA, 15 bp, Homo sapiens
tgtataacctacaat

SEQ ID NO: 446213 - DNA, 15 bp, Homo sapiens
gtataacctacaatg

SEQ ID NO: 446214 - DNA, 15 bp, Homo sapiens
tataacctacaatgc

SEQ ID NO: 446215 - DNA, 15 bp, Homo sapiens
ataacctacaatgca

SEQ ID NO: 446216 - DNA, 15 bp, Homo sapiens
taacctacaatgcac

SEQ ID NO: 446217 - DNA, 15 bp, Homo sapiens
aacctacaatgcact

SEQ ID NO: 446218 - DNA, 15 bp, Homo sapiens
acctacaatgcactg

SEQ ID NO: 446219 - DNA, 15 bp, Homo sapiens
cctacaatgcactga

SEQ ID NO: 446220 - DNA, 15 bp, Homo sapiens
ctacaatgcactgag

SEQ ID NO: 446221 - DNA, 15 bp, Homo sapiens
tacaatgcactgagt

SEQ ID NO: 446222 - DNA, 15 bp, Homo sapiens
acaatgcactgagtt

SEQ ID NO: 446223 - DNA, 15 bp, Homo sapiens
caatgcactgagttg

SEQ ID NO: 446224 - DNA, 15 bp, Homo sapiens
aatgcactgagttgt

SEQ ID NO: 446225 - DNA, 15 bp, Homo sapiens
atgcactgagttgtg

SEQ ID NO: 446226 - DNA, 15 bp, Homo sapiens
tgcactgagttgtga

SEQ ID NO: 446227 - DNA, 15 bp, Homo sapiens
gcactgagttgtgaa

SEQ ID NO: 446228 - DNA, 15 bp, Homo sapiens
cactgagttgtgaac

SEQ ID NO: 446229 - DNA, 15 bp, Homo sapiens
actgagttgtgaact

SEQ ID NO: 446230 - DNA, 15 bp, Homo sapiens
ctgagttgtgaactg

SEQ ID NO: 446231 - DNA, 15 bp, Homo sapiens
tgagttgtgaactga

SEQ ID NO: 446232 - DNA, 15 bp, Homo sapiens
gagttgtgaactgag

SEQ ID NO: 446233 - DNA, 15 bp, Homo sapiens
agttgtgaactgagt

SEQ ID NO: 446234 - DNA, 15 bp, Homo sapiens
gttgtgaactgagtt

SEQ ID NO: 446235 - DNA, 15 bp, Homo sapiens
ttgtgaactgagttg

SEQ ID NO: 446236 - DNA, 15 bp, Homo sapiens
tgtgaactgagttga

SEQ ID NO: 446237 - DNA, 15 bp, Homo sapiens
gtgaactgagttgag

SEQ ID NO: 446238 - DNA, 15 bp, Homo sapiens
tgaactgagttgaga

SEQ ID NO: 446239 - DNA, 15 bp, Homo sapiens
gaactgagttgagaa

SEQ ID NO: 446240 - DNA, 15 bp, Homo sapiens
aactgagttgagaac

SEQ ID NO: 446241 - DNA, 15 bp, Homo sapiens
actgagttgagaaca

SEQ ID NO: 446242 - DNA, 15 bp, Homo sapiens
ctgagttgagaacaa

SEQ ID NO: 446243 - DNA, 15 bp, Homo sapiens
tgagttgagaacaag

SEQ ID NO: 446244 - DNA, 15 bp, Homo sapiens
gagttgagaacaagg

SEQ ID NO: 446245 - DNA, 15 bp, Homo sapiens
agttgagaacaaggt

SEQ ID NO: 446246 - DNA, 15 bp, Homo sapiens
gttgagaacaaggta

SEQ ID NO: 446247 - DNA, 15 bp, Homo sapiens
ttgagaacaaggtat

SEQ ID NO: 446248 - DNA, 15 bp, Homo sapiens
tgagaacaaggtatt

SEQ ID NO: 446249 - DNA, 15 bp, Homo sapiens
gagaacaaggtatta

SEQ ID NO: 446250 - DNA, 15 bp, Homo sapiens
agaacaaggtattaa

SEQ ID NO: 446251 - DNA, 15 bp, Homo sapiens
gaacaaggtattaaa

SEQ ID NO: 446252 - DNA, 15 bp, Homo sapiens
aacaaggtattaaag

SEQ ID NO: 446253 - DNA, 15 bp, Homo sapiens
acaaggtattaaagc

SEQ ID NO: 446254 - DNA, 15 bp, Homo sapiens
caaggtattaaagca

SEQ ID NO: 446255 - DNA, 15 bp, Homo sapiens
aaggtattaaagcaa

SEQ ID NO: 446256 - DNA, 15 bp, Homo sapiens
aggtattaaagcaat

SEQ ID NO: 446257 - DNA, 15 bp, Homo sapiens
ggtattaaagcaatt

SEQ ID NO: 446258 - DNA, 15 bp, Homo sapiens
gtattaaagcaattg

SEQ ID NO: 446259 - DNA, 15 bp, Homo sapiens
tattaaagcaattga

SEQ ID NO: 446260 - DNA, 15 bp, Homo sapiens
attaaagcaattgat

SEQ ID NO: 446261 - DNA, 15 bp, Homo sapiens
ttaaagcaattgatt

SEQ ID NO: 446262 - DNA, 15 bp, Homo sapiens
taaagcaattgattg

SEQ ID NO: 446263 - DNA, 15 bp, Homo sapiens
aaagcaattgattgg

SEQ ID NO: 446264 - DNA, 15 bp, Homo sapiens
aagcaattgattggt

SEQ ID NO: 446265 - DNA, 15 bp, Homo sapiens
agcaattgattggtg

SEQ ID NO: 446266 - DNA, 15 bp, Homo sapiens
gcaattgattggtgt

SEQ ID NO: 446267 - DNA, 15 bp, Homo sapiens
caattgattggtgtc

SEQ ID NO: 446268 - DNA, 15 bp, Homo sapiens
aattgattggtgtca

SEQ ID NO: 446269 - DNA, 15 bp, Homo sapiens
attgattggtgtcaa

SEQ ID NO: 446270 - DNA, 15 bp, Homo sapiens
ttgattggtgtcaaa

SEQ ID NO: 446271 - DNA, 15 bp, Homo sapiens
tgattggtgtcaaat

SEQ ID NO: 446272 - DNA, 15 bp, Homo sapiens
gattggtgtcaaatt

SEQ ID NO: 446273 - DNA, 15 bp, Homo sapiens
attggtgtcaaattt

SEQ ID NO: 446274 - DNA, 15 bp, Homo sapiens
ttggtgtcaaatttg

SEQ ID NO: 446275 - DNA, 15 bp, Homo sapiens
tggtgtcaaatttgc

SEQ ID NO: 446276 - DNA, 15 bp, Homo sapiens
ggtgtcaaatttgcc

SEQ ID NO: 446277 - DNA, 15 bp, Homo sapiens
gtgtcaaatttgccc

SEQ ID NO: 446278 - DNA, 15 bp, Homo sapiens
tgtcaaatttgccca

SEQ ID NO: 446279 - DNA, 15 bp, Homo sapiens
gtcaaatttgcccaa

SEQ ID NO: 446280 - DNA, 15 bp, Homo sapiens
tcaaatttgcccaag

SEQ ID NO: 446281 - DNA, 15 bp, Homo sapiens
caaatttgcccaagt

SEQ ID NO: 446282 - DNA, 15 bp, Homo sapiens
aaatttgcccaagta

SEQ ID NO: 446283 - DNA, 15 bp, Homo sapiens
aatttgcccaagtaa

SEQ ID NO: 446284 - DNA, 15 bp, Homo sapiens
atttgcccaagtaag

SEQ ID NO: 446285 - DNA, 15 bp, Homo sapiens
tttgcccaagtaaga

SEQ ID NO: 446286 - DNA, 15 bp, Homo sapiens
ttgcccaagtaagaa

SEQ ID NO: 446287 - DNA, 15 bp, Homo sapiens
tgcccaagtaagaat

SEQ ID NO: 446288 - DNA, 15 bp, Homo sapiens
gcccaagtaagaatg

SEQ ID NO: 446289 - DNA, 15 bp, Homo sapiens
cccaagtaagaatgg

SEQ ID NO: 446290 - DNA, 15 bp, Homo sapiens
ccaagtaagaatgga

SEQ ID NO: 446291 - DNA, 15 bp, Homo sapiens
caagtaagaatggaa

SEQ ID NO: 446292 - DNA, 15 bp, Homo sapiens
aagtaagaatggaaa

SEQ ID NO: 446293 - DNA, 15 bp, Homo sapiens
agtaagaatggaaag

SEQ ID NO: 446294 - DNA, 15 bp, Homo sapiens
gtaagaatggaaaga

SEQ ID NO: 446295 - DNA, 15 bp, Homo sapiens
taagaatggaaagag

SEQ ID NO: 446296 - DNA, 15 bp, Homo sapiens
aagaatggaaagagg

SEQ ID NO: 446297 - DNA, 15 bp, Homo sapiens
agaatggaaagaggt

SEQ ID NO: 446298 - DNA, 15 bp, Homo sapiens
gaatggaaagaggtc

SEQ ID NO: 446299 - DNA, 15 bp, Homo sapiens
aatggaaagaggtca

SEQ ID NO: 446300 - DNA, 15 bp, Homo sapiens
atggaaagaggtcag

SEQ ID NO: 446301 - DNA, 15 bp, Homo sapiens
tggaaagaggtcaga

SEQ ID NO: 446302 - DNA, 15 bp, Homo sapiens
ggaaagaggtcagac

SEQ ID NO: 446303 - DNA, 15 bp, Homo sapiens
gaaagaggtcagacg

SEQ ID NO: 446304 - DNA, 15 bp, Homo sapiens
aaagaggtcagacgc

SEQ ID NO: 446305 - DNA, 15 bp, Homo sapiens
aagaggtcagacgct

SEQ ID NO: 446306 - DNA, 15 bp, Homo sapiens
agaggtcagacgctg

SEQ ID NO: 446307 - DNA, 15 bp, Homo sapiens
gaggtcagacgctgg

SEQ ID NO: 446308 - DNA, 15 bp, Homo sapiens
aggtcagacgctggt

SEQ ID NO: 446309 - DNA, 15 bp, Homo sapiens
ggtcagacgctggtt

SEQ ID NO: 446310 - DNA, 15 bp, Homo sapiens
gtcagacgctggtta

SEQ ID NO: 446311 - DNA, 15 bp, Homo sapiens
tcagacgctggttaa

SEQ ID NO: 446312 - DNA, 15 bp, Homo sapiens
cagacgctggttaag

SEQ ID NO: 446313 - DNA, 15 bp, Homo sapiens
agacgctggttaagt

SEQ ID NO: 446314 - DNA, 15 bp, Homo sapiens
gacgctggttaagtt

SEQ ID NO: 446315 - DNA, 15 bp, Homo sapiens
acgctggttaagttg

SEQ ID NO: 446316 - DNA, 15 bp, Homo sapiens
cgctggttaagttgg

SEQ ID NO: 446317 - DNA, 15 bp, Homo sapiens
gctggttaagttggc

SEQ ID NO: 446318 - DNA, 15 bp, Homo sapiens
ctggttaagttggca

SEQ ID NO: 446319 - DNA, 15 bp, Homo sapiens
tggttaagttggcat

SEQ ID NO: 446320 - DNA, 15 bp, Homo sapiens
ggttaagttggcatg

SEQ ID NO: 446321 - DNA, 15 bp, Homo sapiens
gttaagttggcatgt

SEQ ID NO: 446322 - DNA, 15 bp, Homo sapiens
ttaagttggcatgtc

SEQ ID NO: 446323 - DNA, 15 bp, Homo sapiens
taagttggcatgtct

SEQ ID NO: 446324 - DNA, 15 bp, Homo sapiens
aagttggcatgtctc

SEQ ID NO: 446325 - DNA, 15 bp, Homo sapiens
agttggcatgtctct

SEQ ID NO: 446326 - DNA, 15 bp, Homo sapiens
gttggcatgtctcta

SEQ ID NO: 446327 - DNA, 15 bp, Homo sapiens
ttggcatgtctctag

SEQ ID NO: 446328 - DNA, 15 bp, Homo sapiens
tggcatgtctctagt

SEQ ID NO: 446329 - DNA, 15 bp, Homo sapiens
ggcatgtctctagtg

SEQ ID NO: 446330 - DNA, 15 bp, Homo sapiens
gcatgtctctagtga

SEQ ID NO: 446331 - DNA, 15 bp, Homo sapiens
catgtctctagtgaa

SEQ ID NO: 446332 - DNA, 15 bp, Homo sapiens
atgtctctagtgaaa

SEQ ID NO: 446333 - DNA, 15 bp, Homo sapiens
tgtctctagtgaaag

SEQ ID NO: 446334 - DNA, 15 bp, Homo sapiens
gtctctagtgaaaga

SEQ ID NO: 446335 - DNA, 15 bp, Homo sapiens
tctctagtgaaagaa

SEQ ID NO: 446336 - DNA, 15 bp, Homo sapiens
ctctagtgaaagaag

SEQ ID NO: 446337 - DNA, 15 bp, Homo sapiens
tctagtgaaagaaga

SEQ ID NO: 446338 - DNA, 15 bp, Homo sapiens
ctagtgaaagaagat

SEQ ID NO: 446339 - DNA, 15 bp, Homo sapiens
tagtgaaagaagatg

SEQ ID NO: 446340 - DNA, 15 bp, Homo sapiens
agtgaaagaagatgt

SEQ ID NO: 446341 - DNA, 15 bp, Homo sapiens
gtgaaagaagatgtg

SEQ ID NO: 446342 - DNA, 15 bp, Homo sapiens
tgaaagaagatgtga

SEQ ID NO: 446343 - DNA, 15 bp, Homo sapiens
gaaagaagatgtgat

SEQ ID NO: 446344 - DNA, 15 bp, Homo sapiens
aaagaagatgtgatt

SEQ ID NO: 446345 - DNA, 15 bp, Homo sapiens
aagaagatgtgatta

SEQ ID NO: 446346 - DNA, 15 bp, Homo sapiens
agaagatgtgattat

SEQ ID NO: 446347 - DNA, 15 bp, Homo sapiens
gaagatgtgattatc

SEQ ID NO: 446348 - DNA, 15 bp, Homo sapiens
aagatgtgattatct

SEQ ID NO: 446349 - DNA, 15 bp, Homo sapiens
agatgtgattatcta

SEQ ID NO: 446350 - DNA, 15 bp, Homo sapiens
gatgtgattatctaa

SEQ ID NO: 446351 - DNA, 15 bp, Homo sapiens
atgtgattatctaac

SEQ ID NO: 446352 - DNA, 15 bp, Homo sapiens
tgtgattatctaact

SEQ ID NO: 446353 - DNA, 15 bp, Homo sapiens
gtgattatctaactg

SEQ ID NO: 446354 - DNA, 15 bp, Homo sapiens
tgattatctaactga

SEQ ID NO: 446355 - DNA, 15 bp, Homo sapiens
gattatctaactgaa

SEQ ID NO: 446356 - DNA, 15 bp, Homo sapiens
attatctaactgaaa

SEQ ID NO: 446357 - DNA, 15 bp, Homo sapiens
ttatctaactgaaaa

SEQ ID NO: 446358 - DNA, 15 bp, Homo sapiens
tatctaactgaaaat

SEQ ID NO: 446359 - DNA, 15 bp, Homo sapiens
atctaactgaaaatg

SEQ ID NO: 446360 - DNA, 15 bp, Homo sapiens
tctaactgaaaatgt

SEQ ID NO: 446361 - DNA, 15 bp, Homo sapiens
ctaactgaaaatgtt

SEQ ID NO: 446362 - DNA, 15 bp, Homo sapiens
taactgaaaatgttt

SEQ ID NO: 446363 - DNA, 15 bp, Homo sapiens
aactgaaaatgttta

SEQ ID NO: 446364 - DNA, 15 bp, Homo sapiens
actgaaaatgtttaa

SEQ ID NO: 446365 - DNA, 15 bp, Homo sapiens
ctgaaaatgtttaaa

SEQ ID NO: 446366 - DNA, 15 bp, Homo sapiens
tgaaaatgtttaaaa

SEQ ID NO: 446367 - DNA, 15 bp, Homo sapiens
gaaaatgtttaaaac

SEQ ID NO: 446368 - DNA, 15 bp, Homo sapiens
aaaatgtttaaaact

SEQ ID NO: 446369 - DNA, 15 bp, Homo sapiens
aaatgtttaaaactg

SEQ ID NO: 446370 - DNA, 15 bp, Homo sapiens
aatgtttaaaactgt

SEQ ID NO: 446371 - DNA, 15 bp, Homo sapiens
atgtttaaaactgtt

SEQ ID NO: 446372 - DNA, 15 bp, Homo sapiens
tgtttaaaactgttt

SEQ ID NO: 446373 - DNA, 15 bp, Homo sapiens
gtttaaaactgttta

SEQ ID NO: 446374 - DNA, 15 bp, Homo sapiens
tttaaaactgtttac

SEQ ID NO: 446375 - DNA, 15 bp, Homo sapiens
ttaaaactgtttaca

SEQ ID NO: 446376 - DNA, 15 bp, Homo sapiens
taaaactgtttacat

SEQ ID NO: 446377 - DNA, 15 bp, Homo sapiens
aaaactgtttacatt

SEQ ID NO: 446378 - DNA, 15 bp, Homo sapiens
aaactgtttacattt

SEQ ID NO: 446379 - DNA, 15 bp, Homo sapiens
aactgtttacatttt

SEQ ID NO: 446380 - DNA, 15 bp, Homo sapiens
actgtttacattttt

SEQ ID NO: 446381 - DNA, 15 bp, Homo sapiens
ctgtttacattttta

SEQ ID NO: 446382 - DNA, 15 bp, Homo sapiens
tgtttacatttttat

SEQ ID NO: 446383 - DNA, 15 bp, Homo sapiens
gtttacatttttatt

SEQ ID NO: 446384 - DNA, 15 bp, Homo sapiens
tttacatttttattg

SEQ ID NO: 446385 - DNA, 15 bp, Homo sapiens
ttacatttttattgt

SEQ ID NO: 446386 - DNA, 15 bp, Homo sapiens
tacatttttattgta

SEQ ID NO: 446387 - DNA, 15 bp, Homo sapiens
acatttttattgtac

SEQ ID NO: 446388 - DNA, 15 bp, Homo sapiens
catttttattgtaca

SEQ ID NO: 446389 - DNA, 15 bp, Homo sapiens
atttttattgtacac

SEQ ID NO: 446390 - DNA, 15 bp, Homo sapiens
tttttattgtacact

SEQ ID NO: 446391 - DNA, 15 bp, Homo sapiens
ttttattgtacacta

SEQ ID NO: 446392 - DNA, 15 bp, Homo sapiens
tttattgtacactat

SEQ ID NO: 446393 - DNA, 15 bp, Homo sapiens
ttattgtacactata

SEQ ID NO: 446394 - DNA, 15 bp, Homo sapiens
tattgtacactataa

SEQ ID NO: 446395 - DNA, 15 bp, Homo sapiens
attgtacactataac

SEQ ID NO: 446396 - DNA, 15 bp, Homo sapiens
ttgtacactataaca

SEQ ID NO: 446397 - DNA, 15 bp, Homo sapiens
tgtacactataacaa

SEQ ID NO: 446398 - DNA, 15 bp, Homo sapiens
gtacactataacaat

SEQ ID NO: 446399 - DNA, 15 bp, Homo sapiens
tacactataacaata

SEQ ID NO: 446400 - DNA, 15 bp, Homo sapiens
acactataacaataa

SEQ ID NO: 446401 - DNA, 15 bp, Homo sapiens
cactataacaataat

SEQ ID NO: 446402 - DNA, 15 bp, Homo sapiens
actataacaataata

SEQ ID NO: 446403 - DNA, 15 bp, Homo sapiens
ctataacaataataa

SEQ ID NO: 446404 - DNA, 15 bp, Homo sapiens
tataacaataataat

SEQ ID NO: 446405 - DNA, 15 bp, Homo sapiens
ataacaataataata

SEQ ID NO: 446406 - DNA, 15 bp, Homo sapiens
taacaataataatag

SEQ ID NO: 446407 - DNA, 15 bp, Homo sapiens
aacaataataatagt

SEQ ID NO: 446408 - DNA, 15 bp, Homo sapiens
acaataataatagta

SEQ ID NO: 446409 - DNA, 15 bp, Homo sapiens
caataataatagtaa

SEQ ID NO: 446410 - DNA, 15 bp, Homo sapiens
aataataatagtaat

SEQ ID NO: 446411 - DNA, 15 bp, Homo sapiens
ataataatagtaata

SEQ ID NO: 446412 - DNA, 15 bp, Homo sapiens
taataatagtaatag

SEQ ID NO: 446413 - DNA, 15 bp, Homo sapiens
taatagtaatagtat

SEQ ID NO: 446414 - DNA, 15 bp, Homo sapiens
aatagtaatagtatt

SEQ ID NO: 446415 - DNA, 15 bp, Homo sapiens
atagtaatagtatta

SEQ ID NO: 446416 - DNA, 15 bp, Homo sapiens
tagtaatagtattag

SEQ ID NO: 446417 - DNA, 15 bp, Homo sapiens
agtaatagtattaga

SEQ ID NO: 446418 - DNA, 15 bp, Homo sapiens
gtaatagtattagag

SEQ ID NO: 446419 - DNA, 15 bp, Homo sapiens
taatagtattagaga

SEQ ID NO: 446420 - DNA, 15 bp, Homo sapiens
aatagtattagagaa

SEQ ID NO: 446421 - DNA, 15 bp, Homo sapiens
atagtattagagaac

SEQ ID NO: 446422 - DNA, 15 bp, Homo sapiens
tagtattagagaact

SEQ ID NO: 446423 - DNA, 15 bp, Homo sapiens
agtattagagaactt

SEQ ID NO: 446424 - DNA, 15 bp, Homo sapiens
gtattagagaacttt

SEQ ID NO: 446425 - DNA, 15 bp, Homo sapiens
tattagagaacttta

SEQ ID NO: 446426 - DNA, 15 bp, Homo sapiens
attagagaactttaa

SEQ ID NO: 446427 - DNA, 15 bp, Homo sapiens
ttagagaactttaat

SEQ ID NO: 446428 - DNA, 15 bp, Homo sapiens
tagagaactttaatt

SEQ ID NO: 446429 - DNA, 15 bp, Homo sapiens
agagaactttaattt

SEQ ID NO: 446430 - DNA, 15 bp, Homo sapiens
gagaactttaatttg

SEQ ID NO: 446431 - DNA, 15 bp, Homo sapiens
agaactttaatttgc

SEQ ID NO: 446432 - DNA, 15 bp, Homo sapiens
gaactttaatttgct

SEQ ID NO: 446433 - DNA, 15 bp, Homo sapiens
aactttaatttgctt

SEQ ID NO: 446434 - DNA, 15 bp, Homo sapiens
actttaatttgcttg

SEQ ID NO: 446435 - DNA, 15 bp, Homo sapiens
ctttaatttgcttgg

SEQ ID NO: 446436 - DNA, 15 bp, Homo sapiens
tttaatttgcttggt

SEQ ID NO: 446437 - DNA, 15 bp, Homo sapiens
ttaatttgcttggtt

SEQ ID NO: 446438 - DNA, 15 bp, Homo sapiens
taatttgcttggttg

SEQ ID NO: 446439 - DNA, 15 bp, Homo sapiens
aatttgcttggttga

SEQ ID NO: 446440 - DNA, 15 bp, Homo sapiens
atttgcttggttgaa

SEQ ID NO: 446441 - DNA, 15 bp, Homo sapiens
tttgcttggttgaat

SEQ ID NO: 446442 - DNA, 15 bp, Homo sapiens
ttgcttggttgaata

SEQ ID NO: 446443 - DNA, 15 bp, Homo sapiens
tgcttggttgaatat

SEQ ID NO: 446444 - DNA, 15 bp, Homo sapiens
gcttggttgaatatt

SEQ ID NO: 446445 - DNA, 15 bp, Homo sapiens
cttggttgaatattg

SEQ ID NO: 446446 - DNA, 15 bp, Homo sapiens
ttggttgaatattga

SEQ ID NO: 446447 - DNA, 15 bp, Homo sapiens
tggttgaatattgac

SEQ ID NO: 446448 - DNA, 15 bp, Homo sapiens
ggttgaatattgact

SEQ ID NO: 446449 - DNA, 15 bp, Homo sapiens
gttgaatattgactt

SEQ ID NO: 446450 - DNA, 15 bp, Homo sapiens
ttgaatattgacttg

SEQ ID NO: 446451 - DNA, 15 bp, Homo sapiens
tgaatattgacttga

SEQ ID NO: 446452 - DNA, 15 bp, Homo sapiens
gaatattgacttgaa

SEQ ID NO: 446453 - DNA, 15 bp, Homo sapiens
aatattgacttgaat

SEQ ID NO: 446454 - DNA, 15 bp, Homo sapiens
atattgacttgaatt

SEQ ID NO: 446455 - DNA, 15 bp, Homo sapiens
tattgacttgaattt

SEQ ID NO: 446456 - DNA, 15 bp, Homo sapiens
attgacttgaattta

SEQ ID NO: 446457 - DNA, 15 bp, Homo sapiens
ttgacttgaatttaa

SEQ ID NO: 446458 - DNA, 15 bp, Homo sapiens
tgacttgaatttaat

SEQ ID NO: 446459 - DNA, 15 bp, Homo sapiens
gacttgaatttaatc

SEQ ID NO: 446460 - DNA, 15 bp, Homo sapiens
acttgaatttaatct

SEQ ID NO: 446461 - DNA, 15 bp, Homo sapiens
cttgaatttaatctt

SEQ ID NO: 446462 - DNA, 15 bp, Homo sapiens
ttgaatttaatctta

SEQ ID NO: 446463 - DNA, 15 bp, Homo sapiens
tgaatttaatcttac

SEQ ID NO: 446464 - DNA, 15 bp, Homo sapiens
gaatttaatcttaca

SEQ ID NO: 446465 - DNA, 15 bp, Homo sapiens
aatttaatcttacaa

SEQ ID NO: 446466 - DNA, 15 bp, Homo sapiens
atttaatcttacaaa

SEQ ID NO: 446467 - DNA, 15 bp, Homo sapiens
tttaatcttacaaat

SEQ ID NO: 446468 - DNA, 15 bp, Homo sapiens
ttaatcttacaaatt

SEQ ID NO: 446469 - DNA, 15 bp, Homo sapiens
taatcttacaaattt

SEQ ID NO: 446470 - DNA, 15 bp, Homo sapiens
aatcttacaaattta

SEQ ID NO: 446471 - DNA, 15 bp, Homo sapiens
atcttacaaatttag

SEQ ID NO: 446472 - DNA, 15 bp, Homo sapiens
tcttacaaatttaga

SEQ ID NO: 446473 - DNA, 15 bp, Homo sapiens
cttacaaatttagat

SEQ ID NO: 446474 - DNA, 15 bp, Homo sapiens
ttacaaatttagata

SEQ ID NO: 446475 - DNA, 15 bp, Homo sapiens
tacaaatttagatat

SEQ ID NO: 446476 - DNA, 15 bp, Homo sapiens
acaaatttagatata

SEQ ID NO: 446477 - DNA, 15 bp, Homo sapiens
caaatttagatataa

SEQ ID NO: 446478 - DNA, 15 bp, Homo sapiens
aaatttagatataaa

SEQ ID NO: 446479 - DNA, 15 bp, Homo sapiens
aatttagatataaat

SEQ ID NO: 446480 - DNA, 15 bp, Homo sapiens
atttagatataaatc

SEQ ID NO: 446481 - DNA, 15 bp, Homo sapiens
tttagatataaatct

SEQ ID NO: 446482 - DNA, 15 bp, Homo sapiens
ttagatataaatctg

SEQ ID NO: 446483 - DNA, 15 bp, Homo sapiens
tagatataaatctga

SEQ ID NO: 446484 - DNA, 15 bp, Homo sapiens
agatataaatctgat

SEQ ID NO: 446485 - DNA, 15 bp, Homo sapiens
gatataaatctgatg

SEQ ID NO: 446486 - DNA, 15 bp, Homo sapiens
atataaatctgatgt

SEQ ID NO: 446487 - DNA, 15 bp, Homo sapiens
tataaatctgatgta

SEQ ID NO: 446488 - DNA, 15 bp, Homo sapiens
ataaatctgatgtac

SEQ ID NO: 446489 - DNA, 15 bp, Homo sapiens
taaatctgatgtact

SEQ ID NO: 446490 - DNA, 15 bp, Homo sapiens
aaatctgatgtactg

SEQ ID NO: 446491 - DNA, 15 bp, Homo sapiens
aatctgatgtactgt

SEQ ID NO: 446492 - DNA, 15 bp, Homo sapiens
atctgatgtactgtg

SEQ ID NO: 446493 - DNA, 15 bp, Homo sapiens
tctgatgtactgtgg

SEQ ID NO: 446494 - DNA, 15 bp, Homo sapiens
ctgatgtactgtggt

SEQ ID NO: 446495 - DNA, 15 bp, Homo sapiens
tgatgtactgtggta

SEQ ID NO: 446496 - DNA, 15 bp, Homo sapiens
gatgtactgtggtag

SEQ ID NO: 446497 - DNA, 15 bp, Homo sapiens
atgtactgtggtagg

SEQ ID NO: 446498 - DNA, 15 bp, Homo sapiens
tgtactgtggtaggc

SEQ ID NO: 446499 - DNA, 15 bp, Homo sapiens
gtactgtggtaggca

SEQ ID NO: 446500 - DNA, 15 bp, Homo sapiens
tactgtggtaggcaa

SEQ ID NO: 446501 - DNA, 15 bp, Homo sapiens
actgtggtaggcaaa

SEQ ID NO: 446502 - DNA, 15 bp, Homo sapiens
ctgtggtaggcaaaa

SEQ ID NO: 446503 - DNA, 15 bp, Homo sapiens
tgtggtaggcaaaat

SEQ ID NO: 446504 - DNA, 15 bp, Homo sapiens
gtggtaggcaaaata

SEQ ID NO: 446505 - DNA, 15 bp, Homo sapiens
tggtaggcaaaataa

SEQ ID NO: 446506 - DNA, 15 bp, Homo sapiens
ggtaggcaaaataat

SEQ ID NO: 446507 - DNA, 15 bp, Homo sapiens
gtaggcaaaataata

SEQ ID NO: 446508 - DNA, 15 bp, Homo sapiens
taggcaaaataataa

SEQ ID NO: 446509 - DNA, 15 bp, Homo sapiens
aggcaaaataataac

SEQ ID NO: 446510 - DNA, 15 bp, Homo sapiens
ggcaaaataataact

SEQ ID NO: 446511 - DNA, 15 bp, Homo sapiens
gcaaaataataactg

SEQ ID NO: 446512 - DNA, 15 bp, Homo sapiens
caaaataataactgc

SEQ ID NO: 446513 - DNA, 15 bp, Homo sapiens
aaaataataactgct

SEQ ID NO: 446514 - DNA, 15 bp, Homo sapiens
aaataataactgctc

SEQ ID NO: 446515 - DNA, 15 bp, Homo sapiens
aataataactgctcc

SEQ ID NO: 446516 - DNA, 15 bp, Homo sapiens
ataataactgctccc

SEQ ID NO: 446517 - DNA, 15 bp, Homo sapiens
taataactgctccca

SEQ ID NO: 446518 - DNA, 15 bp, Homo sapiens
aataactgctcccaa

SEQ ID NO: 446519 - DNA, 15 bp, Homo sapiens
ataactgctcccaac

SEQ ID NO: 446520 - DNA, 15 bp, Homo sapiens
taactgctcccaacc

SEQ ID NO: 446521 - DNA, 15 bp, Homo sapiens
aactgctcccaaccc

SEQ ID NO: 446522 - DNA, 15 bp, Homo sapiens
actgctcccaacccc

SEQ ID NO: 446523 - DNA, 15 bp, Homo sapiens
ctgctcccaacccct

SEQ ID NO: 446524 - DNA, 15 bp, Homo sapiens
tgctcccaacccctg

SEQ ID NO: 446525 - DNA, 15 bp, Homo sapiens
gctcccaacccctga

SEQ ID NO: 446526 - DNA, 15 bp, Homo sapiens
ctcccaacccctgaa

SEQ ID NO: 446527 - DNA, 15 bp, Homo sapiens
tcccaacccctgaaa

SEQ ID NO: 446528 - DNA, 15 bp, Homo sapiens
cccaacccctgaaag

SEQ ID NO: 446529 - DNA, 15 bp, Homo sapiens
ccaacccctgaaaga

SEQ ID NO: 446530 - DNA, 15 bp, Homo sapiens
caacccctgaaagat

SEQ ID NO: 446531 - DNA, 15 bp, Homo sapiens
aacccctgaaagatg

SEQ ID NO: 446532 - DNA, 15 bp, Homo sapiens
acccctgaaagatgc

SEQ ID NO: 446533 - DNA, 15 bp, Homo sapiens
cccctgaaagatgct

SEQ ID NO: 446534 - DNA, 15 bp, Homo sapiens
ccctgaaagatgctc

SEQ ID NO: 446535 - DNA, 15 bp, Homo sapiens
cctgaaagatgctca

SEQ ID NO: 446536 - DNA, 15 bp, Homo sapiens
ctgaaagatgctcac

SEQ ID NO: 446537 - DNA, 15 bp, Homo sapiens
tgaaagatgctcaca

SEQ ID NO: 446538 - DNA, 15 bp, Homo sapiens
gaaagatgctcacat

SEQ ID NO: 446539 - DNA, 15 bp, Homo sapiens
aaagatgctcacatc

SEQ ID NO: 446540 - DNA, 15 bp, Homo sapiens
aagatgctcacatca

SEQ ID NO: 446541 - DNA, 15 bp, Homo sapiens
agatgctcacatcat

SEQ ID NO: 446542 - DNA, 15 bp, Homo sapiens
gatgctcacatcata

SEQ ID NO: 446543 - DNA, 15 bp, Homo sapiens
atgctcacatcataa

SEQ ID NO: 446544 - DNA, 15 bp, Homo sapiens
tgctcacatcataat

SEQ ID NO: 446545 - DNA, 15 bp, Homo sapiens
gctcacatcataatc

SEQ ID NO: 446546 - DNA, 15 bp, Homo sapiens
ctcacatcataatcc

SEQ ID NO: 446547 - DNA, 15 bp, Homo sapiens
tcacatcataatccc

SEQ ID NO: 446548 - DNA, 15 bp, Homo sapiens
cacatcataatccct

SEQ ID NO: 446549 - DNA, 15 bp, Homo sapiens
acatcataatccctg

SEQ ID NO: 446550 - DNA, 15 bp, Homo sapiens
catcataatccctgg

SEQ ID NO: 446551 - DNA, 15 bp, Homo sapiens
atcataatccctgga

SEQ ID NO: 446552 - DNA, 15 bp, Homo sapiens
tcataatccctggaa

SEQ ID NO: 446553 - DNA, 15 bp, Homo sapiens
cataatccctggaac

SEQ ID NO: 446554 - DNA, 15 bp, Homo sapiens
ataatccctggaacc

SEQ ID NO: 446555 - DNA, 15 bp, Homo sapiens
taatccctggaacct

SEQ ID NO: 446556 - DNA, 15 bp, Homo sapiens
aatccctggaacctg

SEQ ID NO: 446557 - DNA, 15 bp, Homo sapiens
atccctggaacctgt

SEQ ID NO: 446558 - DNA, 15 bp, Homo sapiens
tccctggaacctgtg

SEQ ID NO: 446559 - DNA, 15 bp, Homo sapiens
ccctggaacctgtga

SEQ ID NO: 446560 - DNA, 15 bp, Homo sapiens
cctggaacctgtgaa

SEQ ID NO: 446561 - DNA, 15 bp, Homo sapiens
ctggaacctgtgaaa

SEQ ID NO: 446562 - DNA, 15 bp, Homo sapiens
tggaacctgtgaaaa

SEQ ID NO: 446563 - DNA, 15 bp, Homo sapiens
ggaacctgtgaaaat

SEQ ID NO: 446564 - DNA, 15 bp, Homo sapiens
gaacctgtgaaaatg

SEQ ID NO: 446565 - DNA, 15 bp, Homo sapiens
aacctgtgaaaatgt

SEQ ID NO: 446566 - DNA, 15 bp, Homo sapiens
acctgtgaaaatgtt

SEQ ID NO: 446567 - DNA, 15 bp, Homo sapiens
cctgtgaaaatgtta

SEQ ID NO: 446568 - DNA, 15 bp, Homo sapiens
ctgtgaaaatgttag

SEQ ID NO: 446569 - DNA, 15 bp, Homo sapiens
tgtgaaaatgttagg

SEQ ID NO: 446570 - DNA, 15 bp, Homo sapiens
gtgaaaatgttaggt

SEQ ID NO: 446571 - DNA, 15 bp, Homo sapiens
tgaaaatgttaggtt

SEQ ID NO: 446572 - DNA, 15 bp, Homo sapiens
gaaaatgttaggtta

SEQ ID NO: 446573 - DNA, 15 bp, Homo sapiens
aaaatgttaggttac

SEQ ID NO: 446574 - DNA, 15 bp, Homo sapiens
aaatgttaggttaca

SEQ ID NO: 446575 - DNA, 15 bp, Homo sapiens
aatgttaggttacaa

SEQ ID NO: 446576 - DNA, 15 bp, Homo sapiens
atgttaggttacaaa

SEQ ID NO: 446577 - DNA, 15 bp, Homo sapiens
tgttaggttacaaag

SEQ ID NO: 446578 - DNA, 15 bp, Homo sapiens
gttaggttacaaagc

SEQ ID NO: 446579 - DNA, 15 bp, Homo sapiens
ttaggttacaaagca

SEQ ID NO: 446580 - DNA, 15 bp, Homo sapiens
taggttacaaagcaa

SEQ ID NO: 446581 - DNA, 15 bp, Homo sapiens
aggttacaaagcaag

SEQ ID NO: 446582 - DNA, 15 bp, Homo sapiens
ggttacaaagcaagg

SEQ ID NO: 446583 - DNA, 15 bp, Homo sapiens
gttacaaagcaaggg

SEQ ID NO: 446584 - DNA, 15 bp, Homo sapiens
ttacaaagcaaggga

SEQ ID NO: 446585 - DNA, 15 bp, Homo sapiens
tacaaagcaagggag

SEQ ID NO: 446586 - DNA, 15 bp, Homo sapiens
acaaagcaagggaga

SEQ ID NO: 446587 - DNA, 15 bp, Homo sapiens
caaagcaagggagaa

SEQ ID NO: 446588 - DNA, 15 bp, Homo sapiens
aaagcaagggagaat

SEQ ID NO: 446589 - DNA, 15 bp, Homo sapiens
aagcaagggagaatt

SEQ ID NO: 446590 - DNA, 15 bp, Homo sapiens
agcaagggagaatta

SEQ ID NO: 446591 - DNA, 15 bp, Homo sapiens
gcaagggagaattaa

SEQ ID NO: 446592 - DNA, 15 bp, Homo sapiens
caagggagaattaag

SEQ ID NO: 446593 - DNA, 15 bp, Homo sapiens
aagggagaattaagg

SEQ ID NO: 446594 - DNA, 15 bp, Homo sapiens
agggagaattaaggt

SEQ ID NO: 446595 - DNA, 15 bp, Homo sapiens
gggagaattaaggtc

SEQ ID NO: 446596 - DNA, 15 bp, Homo sapiens
ggagaattaaggtcg

SEQ ID NO: 446597 - DNA, 15 bp, Homo sapiens
gagaattaaggtcgt

SEQ ID NO: 446598 - DNA, 15 bp, Homo sapiens
agaattaaggtcgta

SEQ ID NO: 446599 - DNA, 15 bp, Homo sapiens
gaattaaggtcgtaa

SEQ ID NO: 446600 - DNA, 15 bp, Homo sapiens
aattaaggtcgtaaa

SEQ ID NO: 446601 - DNA, 15 bp, Homo sapiens
attaaggtcgtaaat

SEQ ID NO: 446602 - DNA, 15 bp, Homo sapiens
ttaaggtcgtaaatg

SEQ ID NO: 446603 - DNA, 15 bp, Homo sapiens
taaggtcgtaaatgg

SEQ ID NO: 446604 - DNA, 15 bp, Homo sapiens
aaggtcgtaaatgga

SEQ ID NO: 446605 - DNA, 15 bp, Homo sapiens
aggtcgtaaatggaa

SEQ ID NO: 446606 - DNA, 15 bp, Homo sapiens
ggtcgtaaatggaat

SEQ ID NO: 446607 - DNA, 15 bp, Homo sapiens
gtcgtaaatggaatt

SEQ ID NO: 446608 - DNA, 15 bp, Homo sapiens
tcgtaaatggaatta

SEQ ID NO: 446609 - DNA, 15 bp, Homo sapiens
cgtaaatggaattaa

SEQ ID NO: 446610 - DNA, 15 bp, Homo sapiens
gtaaatggaattaag

SEQ ID NO: 446611 - DNA, 15 bp, Homo sapiens
taaatggaattaagg

SEQ ID NO: 446612 - DNA, 15 bp, Homo sapiens
aaatggaattaaggt

SEQ ID NO: 446613 - DNA, 15 bp, Homo sapiens
aatggaattaaggtt

SEQ ID NO: 446614 - DNA, 15 bp, Homo sapiens
atggaattaaggttg

SEQ ID NO: 446615 - DNA, 15 bp, Homo sapiens
tggaattaaggttgc

SEQ ID NO: 446616 - DNA, 15 bp, Homo sapiens
ggaattaaggttgca

SEQ ID NO: 446617 - DNA, 15 bp, Homo sapiens
gaattaaggttgcaa

SEQ ID NO: 446618 - DNA, 15 bp, Homo sapiens
aattaaggttgcaaa

SEQ ID NO: 446619 - DNA, 15 bp, Homo sapiens
attaaggttgcaaat

SEQ ID NO: 446620 - DNA, 15 bp, Homo sapiens
ttaaggttgcaaatc

SEQ ID NO: 446621 - DNA, 15 bp, Homo sapiens
taaggttgcaaatca

SEQ ID NO: 446622 - DNA, 15 bp, Homo sapiens
aaggttgcaaatcaa

SEQ ID NO: 446623 - DNA, 15 bp, Homo sapiens
aggttgcaaatcaac

SEQ ID NO: 446624 - DNA, 15 bp, Homo sapiens
ggttgcaaatcaact

SEQ ID NO: 446625 - DNA, 15 bp, Homo sapiens
gttgcaaatcaactg

SEQ ID NO: 446626 - DNA, 15 bp, Homo sapiens
ttgcaaatcaactga

SEQ ID NO: 446627 - DNA, 15 bp, Homo sapiens
tgcaaatcaactgac

SEQ ID NO: 446628 - DNA, 15 bp, Homo sapiens
gcaaatcaactgacc

SEQ ID NO: 446629 - DNA, 15 bp, Homo sapiens
caaatcaactgacct

SEQ ID NO: 446630 - DNA, 15 bp, Homo sapiens
aaatcaactgacctt

SEQ ID NO: 446631 - DNA, 15 bp, Homo sapiens
aatcaactgaccttt

SEQ ID NO: 446632 - DNA, 15 bp, Homo sapiens
atcaactgaccttta

SEQ ID NO: 446633 - DNA, 15 bp, Homo sapiens
tcaactgacctttaa

SEQ ID NO: 446634 - DNA, 15 bp, Homo sapiens
caactgacctttaat

SEQ ID NO: 446635 - DNA, 15 bp, Homo sapiens
aactgacctttaatt

SEQ ID NO: 446636 - DNA, 15 bp, Homo sapiens
actgacctttaatta

SEQ ID NO: 446637 - DNA, 15 bp, Homo sapiens
ctgacctttaattag

SEQ ID NO: 446638 - DNA, 15 bp, Homo sapiens
tgacctttaattagg

SEQ ID NO: 446639 - DNA, 15 bp, Homo sapiens
gacctttaattaggg

SEQ ID NO: 446640 - DNA, 15 bp, Homo sapiens
acctttaattaggga

SEQ ID NO: 446641 - DNA, 15 bp, Homo sapiens
cctttaattagggag

SEQ ID NO: 446642 - DNA, 15 bp, Homo sapiens
ctttaattagggaga

SEQ ID NO: 446643 - DNA, 15 bp, Homo sapiens
tttaattagggagat

SEQ ID NO: 446644 - DNA, 15 bp, Homo sapiens
ttaattagggagatt

SEQ ID NO: 446645 - DNA, 15 bp, Homo sapiens
taattagggagatta

SEQ ID NO: 446646 - DNA, 15 bp, Homo sapiens
aattagggagattat

SEQ ID NO: 446647 - DNA, 15 bp, Homo sapiens
attagggagattatt

SEQ ID NO: 446648 - DNA, 15 bp, Homo sapiens
ttagggagattattc

SEQ ID NO: 446649 - DNA, 15 bp, Homo sapiens
tagggagattattct

SEQ ID NO: 446650 - DNA, 15 bp, Homo sapiens
agggagattattctg

SEQ ID NO: 446651 - DNA, 15 bp, Homo sapiens
gggagattattctgg

SEQ ID NO: 446652 - DNA, 15 bp, Homo sapiens
ggagattattctgga

SEQ ID NO: 446653 - DNA, 15 bp, Homo sapiens
gagattattctggat

SEQ ID NO: 446654 - DNA, 15 bp, Homo sapiens
agattattctggatt

SEQ ID NO: 446655 - DNA, 15 bp, Homo sapiens
gattattctggatta

SEQ ID NO: 446656 - DNA, 15 bp, Homo sapiens
attattctggattat

SEQ ID NO: 446657 - DNA, 15 bp, Homo sapiens
ttattctggattatc

SEQ ID NO: 446658 - DNA, 15 bp, Homo sapiens
tattctggattatcc

SEQ ID NO: 446659 - DNA, 15 bp, Homo sapiens
attctggattatcct

SEQ ID NO: 446660 - DNA, 15 bp, Homo sapiens
ttctggattatcctg

SEQ ID NO: 446661 - DNA, 15 bp, Homo sapiens
tctggattatcctga

SEQ ID NO: 446662 - DNA, 15 bp, Homo sapiens
ctggattatcctgat

SEQ ID NO: 446663 - DNA, 15 bp, Homo sapiens
tggattatcctgatg

SEQ ID NO: 446664 - DNA, 15 bp, Homo sapiens
ggattatcctgatgg

SEQ ID NO: 446665 - DNA, 15 bp, Homo sapiens
gattatcctgatggg

SEQ ID NO: 446666 - DNA, 15 bp, Homo sapiens
attatcctgatgggc

SEQ ID NO: 446667 - DNA, 15 bp, Homo sapiens
ttatcctgatgggct

SEQ ID NO: 446668 - DNA, 15 bp, Homo sapiens
tatcctgatgggctt

SEQ ID NO: 446669 - DNA, 15 bp, Homo sapiens
atcctgatgggctta

SEQ ID NO: 446670 - DNA, 15 bp, Homo sapiens
tcctgatgggcttaa

SEQ ID NO: 446671 - DNA, 15 bp, Homo sapiens
cctgatgggcttaat

SEQ ID NO: 446672 - DNA, 15 bp, Homo sapiens
ctgatgggcttaatg

SEQ ID NO: 446673 - DNA, 15 bp, Homo sapiens
tgatgggcttaatgt

SEQ ID NO: 446674 - DNA, 15 bp, Homo sapiens
gatgggcttaatgta

SEQ ID NO: 446675 - DNA, 15 bp, Homo sapiens
atgggcttaatgtaa

SEQ ID NO: 446676 - DNA, 15 bp, Homo sapiens
tgggcttaatgtaat

SEQ ID NO: 446677 - DNA, 15 bp, Homo sapiens
gggcttaatgtaatc

SEQ ID NO: 446678 - DNA, 15 bp, Homo sapiens
ggcttaatgtaatcc

SEQ ID NO: 446679 - DNA, 15 bp, Homo sapiens
gcttaatgtaatccc

SEQ ID NO: 446680 - DNA, 15 bp, Homo sapiens
cttaatgtaatccca

SEQ ID NO: 446681 - DNA, 15 bp, Homo sapiens
ttaatgtaatcccag

SEQ ID NO: 446682 - DNA, 15 bp, Homo sapiens
taatgtaatcccagg

SEQ ID NO: 446683 - DNA, 15 bp, Homo sapiens
aatgtaatcccaggg

SEQ ID NO: 446684 - DNA, 15 bp, Homo sapiens
atgtaatcccagggg

SEQ ID NO: 446685 - DNA, 15 bp, Homo sapiens
tgtaatcccaggggc

SEQ ID NO: 446686 - DNA, 15 bp, Homo sapiens
gtaatcccaggggcc

SEQ ID NO: 446687 - DNA, 15 bp, Homo sapiens
taatcccaggggcct

SEQ ID NO: 446688 - DNA, 15 bp, Homo sapiens
aatcccaggggcctt

SEQ ID NO: 446689 - DNA, 15 bp, Homo sapiens
atcccaggggccttt

SEQ ID NO: 446690 - DNA, 15 bp, Homo sapiens
tcccaggggccttta

SEQ ID NO: 446691 - DNA, 15 bp, Homo sapiens
cccaggggcctttaa

SEQ ID NO: 446692 - DNA, 15 bp, Homo sapiens
ccaggggcctttaaa

SEQ ID NO: 446693 - DNA, 15 bp, Homo sapiens
caggggcctttaaaa

SEQ ID NO: 446694 - DNA, 15 bp, Homo sapiens
aggggcctttaaaag

SEQ ID NO: 446695 - DNA, 15 bp, Homo sapiens
ggggcctttaaaagt

SEQ ID NO: 446696 - DNA, 15 bp, Homo sapiens
gggcctttaaaagtg

SEQ ID NO: 446697 - DNA, 15 bp, Homo sapiens
ggcctttaaaagtgg

SEQ ID NO: 446698 - DNA, 15 bp, Homo sapiens
gcctttaaaagtggc

SEQ ID NO: 446699 - DNA, 15 bp, Homo sapiens
cctttaaaagtggca

SEQ ID NO: 446700 - DNA, 15 bp, Homo sapiens
ctttaaaagtggcag

SEQ ID NO: 446701 - DNA, 15 bp, Homo sapiens
ttaaaagtggcaggg

SEQ ID NO: 446702 - DNA, 15 bp, Homo sapiens
taaaagtggcagggg

SEQ ID NO: 446703 - DNA, 15 bp, Homo sapiens
aaaagtggcagggga

SEQ ID NO: 446704 - DNA, 15 bp, Homo sapiens
aaagtggcaggggag

SEQ ID NO: 446705 - DNA, 15 bp, Homo sapiens
aagtggcaggggagg

SEQ ID NO: 446706 - DNA, 15 bp, Homo sapiens
agtggcaggggaggc

SEQ ID NO: 446707 - DNA, 15 bp, Homo sapiens
gtggcaggggaggca

SEQ ID NO: 446708 - DNA, 15 bp, Homo sapiens
tggcaggggaggcag

SEQ ID NO: 446709 - DNA, 15 bp, Homo sapiens
ggcaggggaggcaga

SEQ ID NO: 446710 - DNA, 15 bp, Homo sapiens
gcaggggaggcagag

SEQ ID NO: 446711 - DNA, 15 bp, Homo sapiens
caggggaggcagaga

SEQ ID NO: 446712 - DNA, 15 bp, Homo sapiens
aggggaggcagagat

SEQ ID NO: 446713 - DNA, 15 bp, Homo sapiens
ggggaggcagagatt

SEQ ID NO: 446714 - DNA, 15 bp, Homo sapiens
gggaggcagagattt

SEQ ID NO: 446715 - DNA, 15 bp, Homo sapiens
ggaggcagagatttg

SEQ ID NO: 446716 - DNA, 15 bp, Homo sapiens
gaggcagagatttga

SEQ ID NO: 446717 - DNA, 15 bp, Homo sapiens
aggcagagatttgag

SEQ ID NO: 446718 - DNA, 15 bp, Homo sapiens
ggcagagatttgaga

SEQ ID NO: 446719 - DNA, 15 bp, Homo sapiens
gcagagatttgagaa

SEQ ID NO: 446720 - DNA, 15 bp, Homo sapiens
cagagatttgagaat

SEQ ID NO: 446721 - DNA, 15 bp, Homo sapiens
agagatttgagaatg

SEQ ID NO: 446722 - DNA, 15 bp, Homo sapiens
gagatttgagaatgc

SEQ ID NO: 446723 - DNA, 15 bp, Homo sapiens
agatttgagaatgct

SEQ ID NO: 446724 - DNA, 15 bp, Homo sapiens
gatttgagaatgcta

SEQ ID NO: 446725 - DNA, 15 bp, Homo sapiens
atttgagaatgctag

SEQ ID NO: 446726 - DNA, 15 bp, Homo sapiens
tttgagaatgctagc

SEQ ID NO: 446727 - DNA, 15 bp, Homo sapiens
ttgagaatgctagct

SEQ ID NO: 446728 - DNA, 15 bp, Homo sapiens
tgagaatgctagcta

SEQ ID NO: 446729 - DNA, 15 bp, Homo sapiens
gagaatgctagctac

SEQ ID NO: 446730 - DNA, 15 bp, Homo sapiens
agaatgctagctact

SEQ ID NO: 446731 - DNA, 15 bp, Homo sapiens
gaatgctagctacta

SEQ ID NO: 446732 - DNA, 15 bp, Homo sapiens
aatgctagctactag

SEQ ID NO: 446733 - DNA, 15 bp, Homo sapiens
atgctagctactagc

SEQ ID NO: 446734 - DNA, 15 bp, Homo sapiens
tgctagctactagct

SEQ ID NO: 446735 - DNA, 15 bp, Homo sapiens
gctagctactagctt

SEQ ID NO: 446736 - DNA, 15 bp, Homo sapiens
ctagctactagcttg

SEQ ID NO: 446737 - DNA, 15 bp, Homo sapiens
tagctactagcttgg

SEQ ID NO: 446738 - DNA, 15 bp, Homo sapiens
agctactagcttgga

SEQ ID NO: 446739 - DNA, 15 bp, Homo sapiens
gctactagcttggaa

SEQ ID NO: 446740 - DNA, 15 bp, Homo sapiens
ctactagcttggaag

SEQ ID NO: 446741 - DNA, 15 bp, Homo sapiens
tactagcttggaagg

SEQ ID NO: 446742 - DNA, 15 bp, Homo sapiens
actagcttggaaggt

SEQ ID NO: 446743 - DNA, 15 bp, Homo sapiens
ctagcttggaaggta

SEQ ID NO: 446744 - DNA, 15 bp, Homo sapiens
tagcttggaaggtaa

SEQ ID NO: 446745 - DNA, 15 bp, Homo sapiens
agcttggaaggtaaa

SEQ ID NO: 446746 - DNA, 15 bp, Homo sapiens
gcttggaaggtaaag

SEQ ID NO: 446747 - DNA, 15 bp, Homo sapiens
cttggaaggtaaagg

SEQ ID NO: 446748 - DNA, 15 bp, Homo sapiens
ttggaaggtaaagga

SEQ ID NO: 446749 - DNA, 15 bp, Homo sapiens
tggaaggtaaaggaa

SEQ ID NO: 446750 - DNA, 15 bp, Homo sapiens
ggaaggtaaaggaag

SEQ ID NO: 446751 - DNA, 15 bp, Homo sapiens
gaaggtaaaggaagc

SEQ ID NO: 446752 - DNA, 15 bp, Homo sapiens
aaggtaaaggaagca

SEQ ID NO: 446753 - DNA, 15 bp, Homo sapiens
aggtaaaggaagcag

SEQ ID NO: 446754 - DNA, 15 bp, Homo sapiens
ggtaaaggaagcaga

SEQ ID NO: 446755 - DNA, 15 bp, Homo sapiens
gtaaaggaagcagac

SEQ ID NO: 446756 - DNA, 15 bp, Homo sapiens
taaaggaagcagaca

SEQ ID NO: 446757 - DNA, 15 bp, Homo sapiens
aaaggaagcagacat

SEQ ID NO: 446758 - DNA, 15 bp, Homo sapiens
aaggaagcagacatg

SEQ ID NO: 446759 - DNA, 15 bp, Homo sapiens
aggaagcagacatga

SEQ ID NO: 446760 - DNA, 15 bp, Homo sapiens
ggaagcagacatgat

SEQ ID NO: 446761 - DNA, 15 bp, Homo sapiens
gaagcagacatgatc

SEQ ID NO: 446762 - DNA, 15 bp, Homo sapiens
aagcagacatgatcc

SEQ ID NO: 446763 - DNA, 15 bp, Homo sapiens
agcagacatgatcct

SEQ ID NO: 446764 - DNA, 15 bp, Homo sapiens
gcagacatgatcctt

SEQ ID NO: 446765 - DNA, 15 bp, Homo sapiens
cagacatgatcctta

SEQ ID NO: 446766 - DNA, 15 bp, Homo sapiens
agacatgatccttaa

SEQ ID NO: 446767 - DNA, 15 bp, Homo sapiens
gacatgatccttaaa

SEQ ID NO: 446768 - DNA, 15 bp, Homo sapiens
acatgatccttaaat

SEQ ID NO: 446769 - DNA, 15 bp, Homo sapiens
catgatccttaaatg

SEQ ID NO: 446770 - DNA, 15 bp, Homo sapiens
atgatccttaaatgc

SEQ ID NO: 446771 - DNA, 15 bp, Homo sapiens
tgatccttaaatgca

SEQ ID NO: 446772 - DNA, 15 bp, Homo sapiens
gatccttaaatgcag

SEQ ID NO: 446773 - DNA, 15 bp, Homo sapiens
atccttaaatgcagg

SEQ ID NO: 446774 - DNA, 15 bp, Homo sapiens
tccttaaatgcaggc

SEQ ID NO: 446775 - DNA, 15 bp, Homo sapiens
ccttaaatgcaggca

SEQ ID NO: 446776 - DNA, 15 bp, Homo sapiens
cttaaatgcaggcag

SEQ ID NO: 446777 - DNA, 15 bp, Homo sapiens
ttaaatgcaggcagc

SEQ ID NO: 446778 - DNA, 15 bp, Homo sapiens
taaatgcaggcagct

SEQ ID NO: 446779 - DNA, 15 bp, Homo sapiens
aaatgcaggcagctt

SEQ ID NO: 446780 - DNA, 15 bp, Homo sapiens
aatgcaggcagcttc

SEQ ID NO: 446781 - DNA, 15 bp, Homo sapiens
atgcaggcagcttct

SEQ ID NO: 446782 - DNA, 15 bp, Homo sapiens
tgcaggcagcttcta

SEQ ID NO: 446783 - DNA, 15 bp, Homo sapiens
gcaggcagcttctag

SEQ ID NO: 446784 - DNA, 15 bp, Homo sapiens
caggcagcttctaga

SEQ ID NO: 446785 - DNA, 15 bp, Homo sapiens
aggcagcttctagaa

SEQ ID NO: 446786 - DNA, 15 bp, Homo sapiens
ggcagcttctagaag

SEQ ID NO: 446787 - DNA, 15 bp, Homo sapiens
gcagcttctagaagc

SEQ ID NO: 446788 - DNA, 15 bp, Homo sapiens
gcttctagaagctgg

SEQ ID NO: 446789 - DNA, 15 bp, Homo sapiens
cttctagaagctgga

SEQ ID NO: 446790 - DNA, 15 bp, Homo sapiens
ttctagaagctggaa

SEQ ID NO: 446791 - DNA, 15 bp, Homo sapiens
tctagaagctggaaa

SEQ ID NO: 446792 - DNA, 15 bp, Homo sapiens
ctagaagctggaaaa

SEQ ID NO: 446793 - DNA, 15 bp, Homo sapiens
tagaagctggaaaag

SEQ ID NO: 446794 - DNA, 15 bp, Homo sapiens
agaagctggaaaagg

SEQ ID NO: 446795 - DNA, 15 bp, Homo sapiens
gaagctggaaaaggc

SEQ ID NO: 446796 - DNA, 15 bp, Homo sapiens
aagctggaaaaggca

SEQ ID NO: 446797 - DNA, 15 bp, Homo sapiens
agctggaaaaggcaa

SEQ ID NO: 446798 - DNA, 15 bp, Homo sapiens
gctggaaaaggcaaa

SEQ ID NO: 446799 - DNA, 15 bp, Homo sapiens
ctggaaaaggcaaag

SEQ ID NO: 446800 - DNA, 15 bp, Homo sapiens
tggaaaaggcaaaga

SEQ ID NO: 446801 - DNA, 15 bp, Homo sapiens
ggaaaaggcaaagaa

SEQ ID NO: 446802 - DNA, 15 bp, Homo sapiens
gaaaaggcaaagaaa

SEQ ID NO: 446803 - DNA, 15 bp, Homo sapiens
aaaaggcaaagaaat

SEQ ID NO: 446804 - DNA, 15 bp, Homo sapiens
aaaggcaaagaaatg

SEQ ID NO: 446805 - DNA, 15 bp, Homo sapiens
aaggcaaagaaatgg

SEQ ID NO: 446806 - DNA, 15 bp, Homo sapiens
aggcaaagaaatggg

SEQ ID NO: 446807 - DNA, 15 bp, Homo sapiens
ggcaaagaaatggga

SEQ ID NO: 446808 - DNA, 15 bp, Homo sapiens
gcaaagaaatgggat

SEQ ID NO: 446809 - DNA, 15 bp, Homo sapiens
caaagaaatgggatt

SEQ ID NO: 446810 - DNA, 15 bp, Homo sapiens
aaagaaatgggattc

SEQ ID NO: 446811 - DNA, 15 bp, Homo sapiens
aagaaatgggattct

SEQ ID NO: 446812 - DNA, 15 bp, Homo sapiens
agaaatgggattctc

SEQ ID NO: 446813 - DNA, 15 bp, Homo sapiens
gaaatgggattctct

SEQ ID NO: 446814 - DNA, 15 bp, Homo sapiens
aaatgggattctctc

SEQ ID NO: 446815 - DNA, 15 bp, Homo sapiens
aatgggattctctct

SEQ ID NO: 446816 - DNA, 15 bp, Homo sapiens
atgggattctctctt

SEQ ID NO: 446817 - DNA, 15 bp, Homo sapiens
tgggattctctctta

SEQ ID NO: 446818 - DNA, 15 bp, Homo sapiens
gggattctctcttag

SEQ ID NO: 446819 - DNA, 15 bp, Homo sapiens
ggattctctcttaga

SEQ ID NO: 446820 - DNA, 15 bp, Homo sapiens
gattctctcttagaa

SEQ ID NO: 446821 - DNA, 15 bp, Homo sapiens
attctctcttagaac

SEQ ID NO: 446822 - DNA, 15 bp, Homo sapiens
ttctctcttagaacc

SEQ ID NO: 446823 - DNA, 15 bp, Homo sapiens
tctctcttagaacct

SEQ ID NO: 446824 - DNA, 15 bp, Homo sapiens
ctctcttagaacctc

SEQ ID NO: 446825 - DNA, 15 bp, Homo sapiens
tctcttagaacctcc

SEQ ID NO: 446826 - DNA, 15 bp, Homo sapiens
ctcttagaacctcca

SEQ ID NO: 446827 - DNA, 15 bp, Homo sapiens
tcttagaacctccag

SEQ ID NO: 446828 - DNA, 15 bp, Homo sapiens
cttagaacctccaga

SEQ ID NO: 446829 - DNA, 15 bp, Homo sapiens
ttagaacctccagag

SEQ ID NO: 446830 - DNA, 15 bp, Homo sapiens
tagaacctccagaga

SEQ ID NO: 446831 - DNA, 15 bp, Homo sapiens
agaacctccagagaa

SEQ ID NO: 446832 - DNA, 15 bp, Homo sapiens
gaacctccagagaag

SEQ ID NO: 446833 - DNA, 15 bp, Homo sapiens
aacctccagagaagg

SEQ ID NO: 446834 - DNA, 15 bp, Homo sapiens
acctccagagaagga

SEQ ID NO: 446835 - DNA, 15 bp, Homo sapiens
cctccagagaaggaa

SEQ ID NO: 446836 - DNA, 15 bp, Homo sapiens
ctccagagaaggaat

SEQ ID NO: 446837 - DNA, 15 bp, Homo sapiens
tccagagaaggaatt

SEQ ID NO: 446838 - DNA, 15 bp, Homo sapiens
ccagagaaggaattc

SEQ ID NO: 446839 - DNA, 15 bp, Homo sapiens
cagagaaggaattca

SEQ ID NO: 446840 - DNA, 15 bp, Homo sapiens
agagaaggaattcag

SEQ ID NO: 446841 - DNA, 15 bp, Homo sapiens
gagaaggaattcagc

SEQ ID NO: 446842 - DNA, 15 bp, Homo sapiens
agaaggaattcagcc

SEQ ID NO: 446843 - DNA, 15 bp, Homo sapiens
gaaggaattcagccc

SEQ ID NO: 446844 - DNA, 15 bp, Homo sapiens
aaggaattcagccct

SEQ ID NO: 446845 - DNA, 15 bp, Homo sapiens
aggaattcagccctg

SEQ ID NO: 446846 - DNA, 15 bp, Homo sapiens
ggaattcagccctgc

SEQ ID NO: 446847 - DNA, 15 bp, Homo sapiens
gaattcagccctgcc

SEQ ID NO: 446848 - DNA, 15 bp, Homo sapiens
aattcagccctgcca

SEQ ID NO: 446849 - DNA, 15 bp, Homo sapiens
attcagccctgccaa

SEQ ID NO: 446850 - DNA, 15 bp, Homo sapiens
ttcagccctgccaac

SEQ ID NO: 446851 - DNA, 15 bp, Homo sapiens
tcagccctgccaact

SEQ ID NO: 446852 - DNA, 15 bp, Homo sapiens
cagccctgccaactt

SEQ ID NO: 446853 - DNA, 15 bp, Homo sapiens
agccctgccaacttt

SEQ ID NO: 446854 - DNA, 15 bp, Homo sapiens
gccctgccaactttg

SEQ ID NO: 446855 - DNA, 15 bp, Homo sapiens
ccctgccaactttga

SEQ ID NO: 446856 - DNA, 15 bp, Homo sapiens
cctgccaactttgat

SEQ ID NO: 446857 - DNA, 15 bp, Homo sapiens
ctgccaactttgatt

SEQ ID NO: 446858 - DNA, 15 bp, Homo sapiens
tgccaactttgattt

SEQ ID NO: 446859 - DNA, 15 bp, Homo sapiens
gccaactttgatttt

SEQ ID NO: 446860 - DNA, 15 bp, Homo sapiens
ccaactttgatttta

SEQ ID NO: 446861 - DNA, 15 bp, Homo sapiens
caactttgattttat

SEQ ID NO: 446862 - DNA, 15 bp, Homo sapiens
aactttgattttatc

SEQ ID NO: 446863 - DNA, 15 bp, Homo sapiens
actttgattttatcc

SEQ ID NO: 446864 - DNA, 15 bp, Homo sapiens
ctttgattttatccc

SEQ ID NO: 446865 - DNA, 15 bp, Homo sapiens
tttgattttatccca

SEQ ID NO: 446866 - DNA, 15 bp, Homo sapiens
ttgattttatcccag

SEQ ID NO: 446867 - DNA, 15 bp, Homo sapiens
tgattttatcccagg

SEQ ID NO: 446868 - DNA, 15 bp, Homo sapiens
gattttatcccaggg

SEQ ID NO: 446869 - DNA, 15 bp, Homo sapiens
attttatcccaggga

SEQ ID NO: 446870 - DNA, 15 bp, Homo sapiens
ttttatcccagggag

SEQ ID NO: 446871 - DNA, 15 bp, Homo sapiens
tttatcccagggaga

SEQ ID NO: 446872 - DNA, 15 bp, Homo sapiens
ttatcccagggagac

SEQ ID NO: 446873 - DNA, 15 bp, Homo sapiens
tatcccagggagaca

SEQ ID NO: 446874 - DNA, 15 bp, Homo sapiens
atcccagggagacat

SEQ ID NO: 446875 - DNA, 15 bp, Homo sapiens
tcccagggagacatt

SEQ ID NO: 446876 - DNA, 15 bp, Homo sapiens
cccagggagacattt

SEQ ID NO: 446877 - DNA, 15 bp, Homo sapiens
ccagggagacatttt

SEQ ID NO: 446878 - DNA, 15 bp, Homo sapiens
cagggagacattttt

SEQ ID NO: 446879 - DNA, 15 bp, Homo sapiens
agggagacatttttg

SEQ ID NO: 446880 - DNA, 15 bp, Homo sapiens
gggagacatttttgt

SEQ ID NO: 446881 - DNA, 15 bp, Homo sapiens
ggagacatttttgta

SEQ ID NO: 446882 - DNA, 15 bp, Homo sapiens
gagacatttttgtaa

SEQ ID NO: 446883 - DNA, 15 bp, Homo sapiens
agacatttttgtaac

SEQ ID NO: 446884 - DNA, 15 bp, Homo sapiens
gacatttttgtaaca

SEQ ID NO: 446885 - DNA, 15 bp, Homo sapiens
acatttttgtaacag

SEQ ID NO: 446886 - DNA, 15 bp, Homo sapiens
catttttgtaacagc

SEQ ID NO: 446887 - DNA, 15 bp, Homo sapiens
atttttgtaacagca

SEQ ID NO: 446888 - DNA, 15 bp, Homo sapiens
tttttgtaacagcaa

SEQ ID NO: 446889 - DNA, 15 bp, Homo sapiens
ttttgtaacagcaat

SEQ ID NO: 446890 - DNA, 15 bp, Homo sapiens
tttgtaacagcaata

SEQ ID NO: 446891 - DNA, 15 bp, Homo sapiens
ttgtaacagcaatag

SEQ ID NO: 446892 - DNA, 15 bp, Homo sapiens
tgtaacagcaataga

SEQ ID NO: 446893 - DNA, 15 bp, Homo sapiens
gtaacagcaatagaa

SEQ ID NO: 446894 - DNA, 15 bp, Homo sapiens
taacagcaatagaaa

SEQ ID NO: 446895 - DNA, 15 bp, Homo sapiens
aacagcaatagaaaa

SEQ ID NO: 446896 - DNA, 15 bp, Homo sapiens
acagcaatagaaaat

SEQ ID NO: 446897 - DNA, 15 bp, Homo sapiens
cagcaatagaaaatt

SEQ ID NO: 446898 - DNA, 15 bp, Homo sapiens
agcaatagaaaatta

SEQ ID NO: 446899 - DNA, 15 bp, Homo sapiens
gcaatagaaaattaa

SEQ ID NO: 446900 - DNA, 15 bp, Homo sapiens
caatagaaaattaat

SEQ ID NO: 446901 - DNA, 15 bp, Homo sapiens
aatagaaaattaatg

SEQ ID NO: 446902 - DNA, 15 bp, Homo sapiens
atagaaaattaatgc

SEQ ID NO: 446903 - DNA, 15 bp, Homo sapiens
tagaaaattaatgca

SEQ ID NO: 446904 - DNA, 15 bp, Homo sapiens
agaaaattaatgcat

SEQ ID NO: 446905 - DNA, 15 bp, Homo sapiens
gaaaattaatgcatg

SEQ ID NO: 446906 - DNA, 15 bp, Homo sapiens
aaaattaatgcatgt

SEQ ID NO: 446907 - DNA, 15 bp, Homo sapiens
aaattaatgcatgta

SEQ ID NO: 446908 - DNA, 15 bp, Homo sapiens
aattaatgcatgtac

SEQ ID NO: 446909 - DNA, 15 bp, Homo sapiens
attaatgcatgtact

SEQ ID NO: 446910 - DNA, 15 bp, Homo sapiens
ttaatgcatgtacta

SEQ ID NO: 446911 - DNA, 15 bp, Homo sapiens
taatgcatgtactat

SEQ ID NO: 446912 - DNA, 15 bp, Homo sapiens
aatgcatgtactata

SEQ ID NO: 446913 - DNA, 15 bp, Homo sapiens
atgcatgtactataa

SEQ ID NO: 446914 - DNA, 15 bp, Homo sapiens
tgcatgtactataaa

SEQ ID NO: 446915 - DNA, 15 bp, Homo sapiens
gcatgtactataaaa

SEQ ID NO: 446916 - DNA, 15 bp, Homo sapiens
catgtactataaaaa

SEQ ID NO: 446917 - DNA, 15 bp, Homo sapiens
atgtactataaaaaa

SEQ ID NO: 446918 - DNA, 15 bp, Homo sapiens
tgtactataaaaaaa

SEQ ID NO: 446919 - DNA, 15 bp, Homo sapiens
gtactataaaaaaat

SEQ ID NO: 446920 - DNA, 15 bp, Homo sapiens
tactataaaaaaatc

SEQ ID NO: 446921 - DNA, 15 bp, Homo sapiens
actataaaaaaatca

SEQ ID NO: 446922 - DNA, 15 bp, Homo sapiens
ctataaaaaaatcaa

SEQ ID NO: 446923 - DNA, 15 bp, Homo sapiens
tataaaaaaatcaag

SEQ ID NO: 446924 - DNA, 15 bp, Homo sapiens
ataaaaaaatcaaga

SEQ ID NO: 446925 - DNA, 15 bp, Homo sapiens
taaaaaaatcaagaa

SEQ ID NO: 446926 - DNA, 15 bp, Homo sapiens
aaaaaaatcaagaag

SEQ ID NO: 446927 - DNA, 15 bp, Homo sapiens
aaaaaatcaagaagt

SEQ ID NO: 446928 - DNA, 15 bp, Homo sapiens
aaaaatcaagaagtt

SEQ ID NO: 446929 - DNA, 15 bp, Homo sapiens
aaaatcaagaagttc

SEQ ID NO: 446930 - DNA, 15 bp, Homo sapiens
aaatcaagaagttca

SEQ ID NO: 446931 - DNA, 15 bp, Homo sapiens
aatcaagaagttcac

SEQ ID NO: 446932 - DNA, 15 bp, Homo sapiens
atcaagaagttcacg

SEQ ID NO: 446933 - DNA, 15 bp, Homo sapiens
tcaagaagttcacgc

SEQ ID NO: 446934 - DNA, 15 bp, Homo sapiens
caagaagttcacgca

SEQ ID NO: 446935 - DNA, 15 bp, Homo sapiens
aagaagttcacgcaa

SEQ ID NO: 446936 - DNA, 15 bp, Homo sapiens
agaagttcacgcaaa

SEQ ID NO: 446937 - DNA, 15 bp, Homo sapiens
gaagttcacgcaaat

SEQ ID NO: 446938 - DNA, 15 bp, Homo sapiens
aagttcacgcaaatt

SEQ ID NO: 446939 - DNA, 15 bp, Homo sapiens
agttcacgcaaatta

SEQ ID NO: 446940 - DNA, 15 bp, Homo sapiens
gttcacgcaaattaa

SEQ ID NO: 446941 - DNA, 15 bp, Homo sapiens
ttcacgcaaattaat

SEQ ID NO: 446942 - DNA, 15 bp, Homo sapiens
tcacgcaaattaatt

SEQ ID NO: 446943 - DNA, 15 bp, Homo sapiens
cacgcaaattaattg

SEQ ID NO: 446944 - DNA, 15 bp, Homo sapiens
acgcaaattaattga

SEQ ID NO: 446945 - DNA, 15 bp, Homo sapiens
cgcaaattaattgaa

SEQ ID NO: 446946 - DNA, 15 bp, Homo sapiens
gcaaattaattgaaa

SEQ ID NO: 446947 - DNA, 15 bp, Homo sapiens
caaattaattgaaat

SEQ ID NO: 446948 - DNA, 15 bp, Homo sapiens
aaattaattgaaatt

SEQ ID NO: 446949 - DNA, 15 bp, Homo sapiens
aattaattgaaatta

SEQ ID NO: 446950 - DNA, 15 bp, Homo sapiens
attaattgaaattaa

SEQ ID NO: 446951 - DNA, 15 bp, Homo sapiens
ttaattgaaattaat

SEQ ID NO: 446952 - DNA, 15 bp, Homo sapiens
taattgaaattaatt

SEQ ID NO: 446953 - DNA, 15 bp, Homo sapiens
aattgaaattaatta

SEQ ID NO: 446954 - DNA, 15 bp, Homo sapiens
attgaaattaattaa

SEQ ID NO: 446955 - DNA, 15 bp, Homo sapiens
ttgaaattaattaat

SEQ ID NO: 446956 - DNA, 15 bp, Homo sapiens
tgaaattaattaatt

SEQ ID NO: 446957 - DNA, 15 bp, Homo sapiens
gaaattaattaattt

SEQ ID NO: 446958 - DNA, 15 bp, Homo sapiens
aaattaattaattta

SEQ ID NO: 446959 - DNA, 15 bp, Homo sapiens
aattaattaatttat

SEQ ID NO: 446960 - DNA, 15 bp, Homo sapiens
attaattaatttatt

SEQ ID NO: 446961 - DNA, 15 bp, Homo sapiens
ttaattaatttattg

SEQ ID NO: 446962 - DNA, 15 bp, Homo sapiens
taattaatttattga

SEQ ID NO: 446963 - DNA, 15 bp, Homo sapiens
aattaatttattgaa

SEQ ID NO: 446964 - DNA, 15 bp, Homo sapiens
attaatttattgaat

SEQ ID NO: 446965 - DNA, 15 bp, Homo sapiens
ttaatttattgaatt

SEQ ID NO: 446966 - DNA, 15 bp, Homo sapiens
taatttattgaattg

SEQ ID NO: 446967 - DNA, 15 bp, Homo sapiens
aatttattgaattga

SEQ ID NO: 446968 - DNA, 15 bp, Homo sapiens
atttattgaattgac

SEQ ID NO: 446969 - DNA, 15 bp, Homo sapiens
tttattgaattgact

SEQ ID NO: 446970 - DNA, 15 bp, Homo sapiens
ttattgaattgactt

SEQ ID NO: 446971 - DNA, 15 bp, Homo sapiens
tattgaattgactta

SEQ ID NO: 446972 - DNA, 15 bp, Homo sapiens
attgaattgacttag

SEQ ID NO: 446973 - DNA, 15 bp, Homo sapiens
ttgaattgacttaga

SEQ ID NO: 446974 - DNA, 15 bp, Homo sapiens
tgaattgacttagag

SEQ ID NO: 446975 - DNA, 15 bp, Homo sapiens
gaattgacttagagt

SEQ ID NO: 446976 - DNA, 15 bp, Homo sapiens
aattgacttagagtc

SEQ ID NO: 446977 - DNA, 15 bp, Homo sapiens
attgacttagagtct

SEQ ID NO: 446978 - DNA, 15 bp, Homo sapiens
ttgacttagagtctt

SEQ ID NO: 446979 - DNA, 15 bp, Homo sapiens
tgacttagagtcttt

SEQ ID NO: 446980 - DNA, 15 bp, Homo sapiens
gacttagagtctttt

SEQ ID NO: 446981 - DNA, 15 bp, Homo sapiens
acttagagtctttta

SEQ ID NO: 446982 - DNA, 15 bp, Homo sapiens
cttagagtcttttat

SEQ ID NO: 446983 - DNA, 15 bp, Homo sapiens
ttagagtcttttatc

SEQ ID NO: 446984 - DNA, 15 bp, Homo sapiens
tagagtcttttatca

SEQ ID NO: 446985 - DNA, 15 bp, Homo sapiens
agagtcttttatcat

SEQ ID NO: 446986 - DNA, 15 bp, Homo sapiens
gagtcttttatcatc

SEQ ID NO: 446987 - DNA, 15 bp, Homo sapiens
agtcttttatcatct

SEQ ID NO: 446988 - DNA, 15 bp, Homo sapiens
gtcttttatcatctg

SEQ ID NO: 446989 - DNA, 15 bp, Homo sapiens
tcttttatcatctga

SEQ ID NO: 446990 - DNA, 15 bp, Homo sapiens
cttttatcatctgat

SEQ ID NO: 446991 - DNA, 15 bp, Homo sapiens
ttttatcatctgatt

SEQ ID NO: 446992 - DNA, 15 bp, Homo sapiens
tttatcatctgattt

SEQ ID NO: 446993 - DNA, 15 bp, Homo sapiens
ttatcatctgatttt

SEQ ID NO: 446994 - DNA, 15 bp, Homo sapiens
tatcatctgattttt

SEQ ID NO: 446995 - DNA, 15 bp, Homo sapiens
atcatctgatttttt

SEQ ID NO: 446996 - DNA, 15 bp, Homo sapiens
tcatctgattttttt

SEQ ID NO: 446997 - DNA, 15 bp, Homo sapiens
catctgattttttta

SEQ ID NO: 446998 - DNA, 15 bp, Homo sapiens
atctgatttttttaa

SEQ ID NO: 446999 - DNA, 15 bp, Homo sapiens
tctgatttttttaaa

SEQ ID NO: 447000 - DNA, 15 bp, Homo sapiens
ctgatttttttaaaa

SEQ ID NO: 447001 - DNA, 15 bp, Homo sapiens
tgatttttttaaaaa

SEQ ID NO: 447002 - DNA, 15 bp, Homo sapiens
atttttttaaaaatg

SEQ ID NO: 447003 - DNA, 15 bp, Homo sapiens
tttttttaaaaatgc

SEQ ID NO: 447004 - DNA, 15 bp, Homo sapiens
ttttttaaaaatgca

SEQ ID NO: 447005 - DNA, 15 bp, Homo sapiens
tttttaaaaatgcaa

SEQ ID NO: 447006 - DNA, 15 bp, Homo sapiens
ttttaaaaatgcaaa

SEQ ID NO: 447007 - DNA, 15 bp, Homo sapiens
tttaaaaatgcaaac

SEQ ID NO: 447008 - DNA, 15 bp, Homo sapiens
ttaaaaatgcaaact

SEQ ID NO: 447009 - DNA, 15 bp, Homo sapiens
taaaaatgcaaactg

SEQ ID NO: 447010 - DNA, 15 bp, Homo sapiens
aaaaatgcaaactgg

SEQ ID NO: 447011 - DNA, 15 bp, Homo sapiens
aaaatgcaaactgga

SEQ ID NO: 447012 - DNA, 15 bp, Homo sapiens
aaatgcaaactggat

SEQ ID NO: 447013 - DNA, 15 bp, Homo sapiens
aatgcaaactggatc

SEQ ID NO: 447014 - DNA, 15 bp, Homo sapiens
atgcaaactggatct

SEQ ID NO: 447015 - DNA, 15 bp, Homo sapiens
tgcaaactggatcta

SEQ ID NO: 447016 - DNA, 15 bp, Homo sapiens
gcaaactggatctag

SEQ ID NO: 447017 - DNA, 15 bp, Homo sapiens
caaactggatctagt

SEQ ID NO: 447018 - DNA, 15 bp, Homo sapiens
aaactggatctagtt

SEQ ID NO: 447019 - DNA, 15 bp, Homo sapiens
aactggatctagttt

SEQ ID NO: 447020 - DNA, 15 bp, Homo sapiens
actggatctagtttt

SEQ ID NO: 447021 - DNA, 15 bp, Homo sapiens
ctggatctagttttt

SEQ ID NO: 447022 - DNA, 15 bp, Homo sapiens
tggatctagtttttg

SEQ ID NO: 447023 - DNA, 15 bp, Homo sapiens
ggatctagtttttgg

SEQ ID NO: 447024 - DNA, 15 bp, Homo sapiens
gatctagtttttggg

SEQ ID NO: 447025 - DNA, 15 bp, Homo sapiens
atctagtttttgggt

SEQ ID NO: 447026 - DNA, 15 bp, Homo sapiens
tctagtttttgggtt

SEQ ID NO: 447027 - DNA, 15 bp, Homo sapiens
ctagtttttgggttt

SEQ ID NO: 447028 - DNA, 15 bp, Homo sapiens
tagtttttgggtttt

SEQ ID NO: 447029 - DNA, 15 bp, Homo sapiens
agtttttgggtttta

SEQ ID NO: 447030 - DNA, 15 bp, Homo sapiens
gtttttgggttttac

SEQ ID NO: 447031 - DNA, 15 bp, Homo sapiens
tttttgggttttact

SEQ ID NO: 447032 - DNA, 15 bp, Homo sapiens
ttttgggttttacta

SEQ ID NO: 447033 - DNA, 15 bp, Homo sapiens
tttgggttttactaa

SEQ ID NO: 447034 - DNA, 15 bp, Homo sapiens
ttgggttttactaaa

SEQ ID NO: 447035 - DNA, 15 bp, Homo sapiens
tgggttttactaaat

SEQ ID NO: 447036 - DNA, 15 bp, Homo sapiens
gggttttactaaata

SEQ ID NO: 447037 - DNA, 15 bp, Homo sapiens
ggttttactaaataa

SEQ ID NO: 447038 - DNA, 15 bp, Homo sapiens
gttttactaaataaa

SEQ ID NO: 447039 - DNA, 15 bp, Homo sapiens
ttttactaaataaaa

SEQ ID NO: 447040 - DNA, 15 bp, Homo sapiens
tttactaaataaaaa

SEQ ID NO: 447041 - DNA, 15 bp, Homo sapiens
ttactaaataaaaaa

SEQ ID NO: 447042 - DNA, 15 bp, Homo sapiens
tactaaataaaaaaa

SEQ ID NO: 447043 - DNA, 15 bp, Homo sapiens
actaaataaaaaaaa

SEQ ID NO: 447044 - DNA, 15 bp, Homo sapiens
ctaaataaaaaaaat

SEQ ID NO: 447045 - DNA, 15 bp, Homo sapiens
taaataaaaaaaatt

SEQ ID NO: 447046 - DNA, 15 bp, Homo sapiens
aataaaaaaaattaa

SEQ ID NO: 447047 - DNA, 15 bp, Homo sapiens
ataaaaaaaattaaa

SEQ ID NO: 447048 - DNA, 15 bp, Homo sapiens
taaaaaaaattaaat

SEQ ID NO: 447049 - DNA, 15 bp, Homo sapiens
aaaaaaaattaaata

SEQ ID NO: 447050 - DNA, 15 bp, Homo sapiens
aaaaaaattaaatat

SEQ ID NO: 447051 - DNA, 15 bp, Homo sapiens
aaaaaattaaatatc

SEQ ID NO: 447052 - DNA, 15 bp, Homo sapiens
aaaaattaaatatct

SEQ ID NO: 447053 - DNA, 15 bp, Homo sapiens
aaaattaaatatctt

SEQ ID NO: 447054 - DNA, 15 bp, Homo sapiens
aaattaaatatcttg

SEQ ID NO: 447055 - DNA, 15 bp, Homo sapiens
aattaaatatcttgc

SEQ ID NO: 447056 - DNA, 15 bp, Homo sapiens
attaaatatcttgct

SEQ ID NO: 447057 - DNA, 15 bp, Homo sapiens
ttaaatatcttgctt

SEQ ID NO: 447058 - DNA, 15 bp, Homo sapiens
taaatatcttgcttt

SEQ ID NO: 447059 - DNA, 15 bp, Homo sapiens
aaatatcttgcttta

SEQ ID NO: 447060 - DNA, 15 bp, Homo sapiens
aatatcttgctttat

SEQ ID NO: 447061 - DNA, 15 bp, Homo sapiens
atatcttgctttatg

SEQ ID NO: 447062 - DNA, 15 bp, Homo sapiens
tatcttgctttatgt

SEQ ID NO: 447063 - DNA, 15 bp, Homo sapiens
atcttgctttatgtt

SEQ ID NO: 447064 - DNA, 15 bp, Homo sapiens
tcttgctttatgttt

SEQ ID NO: 447065 - DNA, 15 bp, Homo sapiens
cttgctttatgttta

SEQ ID NO: 447066 - DNA, 15 bp, Homo sapiens
ttgctttatgtttat

SEQ ID NO: 447067 - DNA, 15 bp, Homo sapiens
tgctttatgtttata

SEQ ID NO: 447068 - DNA, 15 bp, Homo sapiens
gctttatgtttatat

SEQ ID NO: 447069 - DNA, 15 bp, Homo sapiens
ctttatgtttatatc

SEQ ID NO: 447070 - DNA, 15 bp, Homo sapiens
tttatgtttatatca

SEQ ID NO: 447071 - DNA, 15 bp, Homo sapiens
ttatgtttatatcat

SEQ ID NO: 447072 - DNA, 15 bp, Homo sapiens
tatgtttatatcatg

SEQ ID NO: 447073 - DNA, 15 bp, Homo sapiens
atgtttatatcatga

SEQ ID NO: 447074 - DNA, 15 bp, Homo sapiens
tgtttatatcatgat

SEQ ID NO: 447075 - DNA, 15 bp, Homo sapiens
gtttatatcatgatt

SEQ ID NO: 447076 - DNA, 15 bp, Homo sapiens
tttatatcatgatta

SEQ ID NO: 447077 - DNA, 15 bp, Homo sapiens
ttatatcatgattat

SEQ ID NO: 447078 - DNA, 15 bp, Homo sapiens
tatatcatgattatc

SEQ ID NO: 447079 - DNA, 15 bp, Homo sapiens
atatcatgattatct

SEQ ID NO: 447080 - DNA, 15 bp, Homo sapiens
tatcatgattatctg

SEQ ID NO: 447081 - DNA, 15 bp, Homo sapiens
atcatgattatctgt

SEQ ID NO: 447082 - DNA, 15 bp, Homo sapiens
tcatgattatctgtg

SEQ ID NO: 447083 - DNA, 15 bp, Homo sapiens
catgattatctgtgt

SEQ ID NO: 447084 - DNA, 15 bp, Homo sapiens
atgattatctgtgtg

SEQ ID NO: 447085 - DNA, 15 bp, Homo sapiens
tgattatctgtgtgg

SEQ ID NO: 447086 - DNA, 15 bp, Homo sapiens
gattatctgtgtggt

SEQ ID NO: 447087 - DNA, 15 bp, Homo sapiens
attatctgtgtggtt

SEQ ID NO: 447088 - DNA, 15 bp, Homo sapiens
ttatctgtgtggttt

SEQ ID NO: 447089 - DNA, 15 bp, Homo sapiens
tatctgtgtggtttg

SEQ ID NO: 447090 - DNA, 15 bp, Homo sapiens
atctgtgtggtttgg

SEQ ID NO: 447091 - DNA, 15 bp, Homo sapiens
tctgtgtggtttggg

SEQ ID NO: 447092 - DNA, 15 bp, Homo sapiens
ctgtgtggtttggga

SEQ ID NO: 447093 - DNA, 15 bp, Homo sapiens
tgtgtggtttgggac

SEQ ID NO: 447094 - DNA, 15 bp, Homo sapiens
gtgtggtttgggact

SEQ ID NO: 447095 - DNA, 15 bp, Homo sapiens
tgtggtttgggactt

SEQ ID NO: 447096 - DNA, 15 bp, Homo sapiens
gtggtttgggacttt

SEQ ID NO: 447097 - DNA, 15 bp, Homo sapiens
tggtttgggactttt

SEQ ID NO: 447098 - DNA, 15 bp, Homo sapiens
ggtttgggactttta

SEQ ID NO: 447099 - DNA, 15 bp, Homo sapiens
gtttgggacttttaa

SEQ ID NO: 447100 - DNA, 15 bp, Homo sapiens
tttgggacttttaaa

SEQ ID NO: 447101 - DNA, 15 bp, Homo sapiens
ttgggacttttaaag

SEQ ID NO: 447102 - DNA, 15 bp, Homo sapiens
tgggacttttaaagt

SEQ ID NO: 447103 - DNA, 15 bp, Homo sapiens
gggacttttaaagtc

SEQ ID NO: 447104 - DNA, 15 bp, Homo sapiens
ggacttttaaagtcc

SEQ ID NO: 447105 - DNA, 15 bp, Homo sapiens
gacttttaaagtcca

SEQ ID NO: 447106 - DNA, 15 bp, Homo sapiens
acttttaaagtccat

SEQ ID NO: 447107 - DNA, 15 bp, Homo sapiens
cttttaaagtccatc

SEQ ID NO: 447108 - DNA, 15 bp, Homo sapiens
ttttaaagtccatcc

SEQ ID NO: 447109 - DNA, 15 bp, Homo sapiens
tttaaagtccatcct

SEQ ID NO: 447110 - DNA, 15 bp, Homo sapiens
ttaaagtccatcctt

SEQ ID NO: 447111 - DNA, 15 bp, Homo sapiens
taaagtccatcctta

SEQ ID NO: 447112 - DNA, 15 bp, Homo sapiens
aaagtccatccttaa

SEQ ID NO: 447113 - DNA, 15 bp, Homo sapiens
aagtccatccttaat

SEQ ID NO: 447114 - DNA, 15 bp, Homo sapiens
agtccatccttaatt

SEQ ID NO: 447115 - DNA, 15 bp, Homo sapiens
gtccatccttaattt

SEQ ID NO: 447116 - DNA, 15 bp, Homo sapiens
tccatccttaatttt

SEQ ID NO: 447117 - DNA, 15 bp, Homo sapiens
ccatccttaatttta

SEQ ID NO: 447118 - DNA, 15 bp, Homo sapiens
catccttaattttag

SEQ ID NO: 447119 - DNA, 15 bp, Homo sapiens
atccttaattttagc

SEQ ID NO: 447120 - DNA, 15 bp, Homo sapiens
tccttaattttagct

SEQ ID NO: 447121 - DNA, 15 bp, Homo sapiens
ccttaattttagctc

SEQ ID NO: 447122 - DNA, 15 bp, Homo sapiens
cttaattttagctct

SEQ ID NO: 447123 - DNA, 15 bp, Homo sapiens
ttaattttagctctt

SEQ ID NO: 447124 - DNA, 15 bp, Homo sapiens
taattttagctcttt

SEQ ID NO: 447125 - DNA, 15 bp, Homo sapiens
aattttagctctttt

SEQ ID NO: 447126 - DNA, 15 bp, Homo sapiens
attttagctcttttt

SEQ ID NO: 447127 - DNA, 15 bp, Homo sapiens
ttttagctctttttt

SEQ ID NO: 447128 - DNA, 15 bp, Homo sapiens
tttagctctttttta

SEQ ID NO: 447129 - DNA, 15 bp, Homo sapiens
ttagctcttttttaa

SEQ ID NO: 447130 - DNA, 15 bp, Homo sapiens
tagctcttttttaaa

SEQ ID NO: 447131 - DNA, 15 bp, Homo sapiens
agctcttttttaaaa

SEQ ID NO: 447132 - DNA, 15 bp, Homo sapiens
gctcttttttaaaaa

SEQ ID NO: 447133 - DNA, 15 bp, Homo sapiens
ctcttttttaaaaat

SEQ ID NO: 447134 - DNA, 15 bp, Homo sapiens
tcttttttaaaaatg

SEQ ID NO: 447135 - DNA, 15 bp, Homo sapiens
cttttttaaaaatga

SEQ ID NO: 447136 - DNA, 15 bp, Homo sapiens
ttttttaaaaatgaa

SEQ ID NO: 447137 - DNA, 15 bp, Homo sapiens
tttttaaaaatgaat

SEQ ID NO: 447138 - DNA, 15 bp, Homo sapiens
tttaaaaatgaattt

SEQ ID NO: 447139 - DNA, 15 bp, Homo sapiens
ttaaaaatgaatttc

SEQ ID NO: 447140 - DNA, 15 bp, Homo sapiens
taaaaatgaatttct

SEQ ID NO: 447141 - DNA, 15 bp, Homo sapiens
aaaaatgaatttcta

SEQ ID NO: 447142 - DNA, 15 bp, Homo sapiens
aaaatgaatttctat

SEQ ID NO: 447143 - DNA, 15 bp, Homo sapiens
aaatgaatttctata

SEQ ID NO: 447144 - DNA, 15 bp, Homo sapiens
aatgaatttctatat

SEQ ID NO: 447145 - DNA, 15 bp, Homo sapiens
atgaatttctatatg

SEQ ID NO: 447146 - DNA, 15 bp, Homo sapiens
tgaatttctatatgt

SEQ ID NO: 447147 - DNA, 15 bp, Homo sapiens
gaatttctatatgtt

SEQ ID NO: 447148 - DNA, 15 bp, Homo sapiens
aatttctatatgttt

SEQ ID NO: 447149 - DNA, 15 bp, Homo sapiens
atttctatatgttta

SEQ ID NO: 447150 - DNA, 15 bp, Homo sapiens
tttctatatgtttag

SEQ ID NO: 447151 - DNA, 15 bp, Homo sapiens
ttctatatgtttagg

SEQ ID NO: 447152 - DNA, 15 bp, Homo sapiens
tctatatgtttaggt

SEQ ID NO: 447153 - DNA, 15 bp, Homo sapiens
ctatatgtttaggtt

SEQ ID NO: 447154 - DNA, 15 bp, Homo sapiens
tatatgtttaggtta

SEQ ID NO: 447155 - DNA, 15 bp, Homo sapiens
atatgtttaggttaa

SEQ ID NO: 447156 - DNA, 15 bp, Homo sapiens
tatgtttaggttaat

SEQ ID NO: 447157 - DNA, 15 bp, Homo sapiens
atgtttaggttaatt

SEQ ID NO: 447158 - DNA, 15 bp, Homo sapiens
tgtttaggttaatta

SEQ ID NO: 447159 - DNA, 15 bp, Homo sapiens
gtttaggttaattat

SEQ ID NO: 447160 - DNA, 15 bp, Homo sapiens
tttaggttaattata

SEQ ID NO: 447161 - DNA, 15 bp, Homo sapiens
ttaggttaattatat

SEQ ID NO: 447162 - DNA, 15 bp, Homo sapiens
taggttaattatata

SEQ ID NO: 447163 - DNA, 15 bp, Homo sapiens
aggttaattatatat

SEQ ID NO: 447164 - DNA, 15 bp, Homo sapiens
ggttaattatatatg

SEQ ID NO: 447165 - DNA, 15 bp, Homo sapiens
gttaattatatatga

SEQ ID NO: 447166 - DNA, 15 bp, Homo sapiens
ttaattatatatgac

SEQ ID NO: 447167 - DNA, 15 bp, Homo sapiens
taattatatatgact

SEQ ID NO: 447168 - DNA, 15 bp, Homo sapiens
aattatatatgactg

SEQ ID NO: 447169 - DNA, 15 bp, Homo sapiens
attatatatgactga

SEQ ID NO: 447170 - DNA, 15 bp, Homo sapiens
ttatatatgactgag

SEQ ID NO: 447171 - DNA, 15 bp, Homo sapiens
tatatatgactgaga

SEQ ID NO: 447172 - DNA, 15 bp, Homo sapiens
atatatgactgagaa

SEQ ID NO: 447173 - DNA, 15 bp, Homo sapiens
tatatgactgagaat

SEQ ID NO: 447174 - DNA, 15 bp, Homo sapiens
atatgactgagaatt

SEQ ID NO: 447175 - DNA, 15 bp, Homo sapiens
tatgactgagaattg

SEQ ID NO: 447176 - DNA, 15 bp, Homo sapiens
atgactgagaattgt

SEQ ID NO: 447177 - DNA, 15 bp, Homo sapiens
tgactgagaattgtc

SEQ ID NO: 447178 - DNA, 15 bp, Homo sapiens
gactgagaattgtct

SEQ ID NO: 447179 - DNA, 15 bp, Homo sapiens
actgagaattgtcta

SEQ ID NO: 447180 - DNA, 15 bp, Homo sapiens
ctgagaattgtctaa

SEQ ID NO: 447181 - DNA, 15 bp, Homo sapiens
tgagaattgtctaaa

SEQ ID NO: 447182 - DNA, 15 bp, Homo sapiens
gagaattgtctaaat

SEQ ID NO: 447183 - DNA, 15 bp, Homo sapiens
agaattgtctaaatc

SEQ ID NO: 447184 - DNA, 15 bp, Homo sapiens
gaattgtctaaatca

SEQ ID NO: 447185 - DNA, 15 bp, Homo sapiens
aattgtctaaatcag

SEQ ID NO: 447186 - DNA, 15 bp, Homo sapiens
attgtctaaatcaga

SEQ ID NO: 447187 - DNA, 15 bp, Homo sapiens
ttgtctaaatcagaa

SEQ ID NO: 447188 - DNA, 15 bp, Homo sapiens
tgtctaaatcagaat

SEQ ID NO: 447189 - DNA, 15 bp, Homo sapiens
gtctaaatcagaatt

SEQ ID NO: 447190 - DNA, 15 bp, Homo sapiens
tctaaatcagaattt

SEQ ID NO: 447191 - DNA, 15 bp, Homo sapiens
ctaaatcagaatttc

SEQ ID NO: 447192 - DNA, 15 bp, Homo sapiens
taaatcagaatttct

SEQ ID NO: 447193 - DNA, 15 bp, Homo sapiens
aaatcagaatttctc

SEQ ID NO: 447194 - DNA, 15 bp, Homo sapiens
aatcagaatttctct

SEQ ID NO: 447195 - DNA, 15 bp, Homo sapiens
atcagaatttctcta

SEQ ID NO: 447196 - DNA, 15 bp, Homo sapiens
tcagaatttctctaa

SEQ ID NO: 447197 - DNA, 15 bp, Homo sapiens
cagaatttctctaat

SEQ ID NO: 447198 - DNA, 15 bp, Homo sapiens
agaatttctctaatt

SEQ ID NO: 447199 - DNA, 15 bp, Homo sapiens
gaatttctctaattc

SEQ ID NO: 447200 - DNA, 15 bp, Homo sapiens
aatttctctaattca

SEQ ID NO: 447201 - DNA, 15 bp, Homo sapiens
atttctctaattcaa

SEQ ID NO: 447202 - DNA, 15 bp, Homo sapiens
tttctctaattcaaa

SEQ ID NO: 447203 - DNA, 15 bp, Homo sapiens
ttctctaattcaaaa

SEQ ID NO: 447204 - DNA, 15 bp, Homo sapiens
tctctaattcaaaat

SEQ ID NO: 447205 - DNA, 15 bp, Homo sapiens
ctctaattcaaaatg

SEQ ID NO: 447206 - DNA, 15 bp, Homo sapiens
tctaattcaaaatgt

SEQ ID NO: 447207 - DNA, 15 bp, Homo sapiens
ctaattcaaaatgtt

SEQ ID NO: 447208 - DNA, 15 bp, Homo sapiens
taattcaaaatgttt

SEQ ID NO: 447209 - DNA, 15 bp, Homo sapiens
aattcaaaatgttta

SEQ ID NO: 447210 - DNA, 15 bp, Homo sapiens
attcaaaatgtttat

SEQ ID NO: 447211 - DNA, 15 bp, Homo sapiens
ttcaaaatgtttata

SEQ ID NO: 447212 - DNA, 15 bp, Homo sapiens
tcaaaatgtttataa

SEQ ID NO: 447213 - DNA, 15 bp, Homo sapiens
caaaatgtttataat

SEQ ID NO: 447214 - DNA, 15 bp, Homo sapiens
aaaatgtttataatt

SEQ ID NO: 447215 - DNA, 15 bp, Homo sapiens
aaatgtttataattt

SEQ ID NO: 447216 - DNA, 15 bp, Homo sapiens
aatgtttataatttt

SEQ ID NO: 447217 - DNA, 15 bp, Homo sapiens
atgtttataattttg

SEQ ID NO: 447218 - DNA, 15 bp, Homo sapiens
tgtttataattttgg

SEQ ID NO: 447219 - DNA, 15 bp, Homo sapiens
gtttataattttgga

SEQ ID NO: 447220 - DNA, 15 bp, Homo sapiens
tttataattttggaa

SEQ ID NO: 447221 - DNA, 15 bp, Homo sapiens
ttataattttggaag

SEQ ID NO: 447222 - DNA, 15 bp, Homo sapiens
tataattttggaagg

SEQ ID NO: 447223 - DNA, 15 bp, Homo sapiens
ataattttggaagga

SEQ ID NO: 447224 - DNA, 15 bp, Homo sapiens
taattttggaaggat

SEQ ID NO: 447225 - DNA, 15 bp, Homo sapiens
aattttggaaggatc

SEQ ID NO: 447226 - DNA, 15 bp, Homo sapiens
attttggaaggatct

SEQ ID NO: 447227 - DNA, 15 bp, Homo sapiens
ttttggaaggatctg

SEQ ID NO: 447228 - DNA, 15 bp, Homo sapiens
tttggaaggatctgg

SEQ ID NO: 447229 - DNA, 15 bp, Homo sapiens
ttggaaggatctggt

SEQ ID NO: 447230 - DNA, 15 bp, Homo sapiens
tggaaggatctggta

SEQ ID NO: 447231 - DNA, 15 bp, Homo sapiens
ggaaggatctggtag

SEQ ID NO: 447232 - DNA, 15 bp, Homo sapiens
gaaggatctggtagg

SEQ ID NO: 447233 - DNA, 15 bp, Homo sapiens
aaggatctggtagga

SEQ ID NO: 447234 - DNA, 15 bp, Homo sapiens
aggatctggtaggat

SEQ ID NO: 447235 - DNA, 15 bp, Homo sapiens
ggatctggtaggatt

SEQ ID NO: 447236 - DNA, 15 bp, Homo sapiens
gatctggtaggattg

SEQ ID NO: 447237 - DNA, 15 bp, Homo sapiens
atctggtaggattgt

SEQ ID NO: 447238 - DNA, 15 bp, Homo sapiens
tctggtaggattgta

SEQ ID NO: 447239 - DNA, 15 bp, Homo sapiens
ctggtaggattgtat

SEQ ID NO: 447240 - DNA, 15 bp, Homo sapiens
tggtaggattgtatt

SEQ ID NO: 447241 - DNA, 15 bp, Homo sapiens
ggtaggattgtattc

SEQ ID NO: 447242 - DNA, 15 bp, Homo sapiens
gtaggattgtattct

SEQ ID NO: 447243 - DNA, 15 bp, Homo sapiens
taggattgtattctt

SEQ ID NO: 447244 - DNA, 15 bp, Homo sapiens
aggattgtattcttg

SEQ ID NO: 447245 - DNA, 15 bp, Homo sapiens
ggattgtattcttgt

SEQ ID NO: 447246 - DNA, 15 bp, Homo sapiens
gattgtattcttgtt

SEQ ID NO: 447247 - DNA, 15 bp, Homo sapiens
attgtattcttgttc

SEQ ID NO: 447248 - DNA, 15 bp, Homo sapiens
ttgtattcttgttct

SEQ ID NO: 447249 - DNA, 15 bp, Homo sapiens
tgtattcttgttctt

SEQ ID NO: 447250 - DNA, 15 bp, Homo sapiens
gtattcttgttcttg

SEQ ID NO: 447251 - DNA, 15 bp, Homo sapiens
tattcttgttcttgt

SEQ ID NO: 447252 - DNA, 15 bp, Homo sapiens
attcttgttcttgtg

SEQ ID NO: 447253 - DNA, 15 bp, Homo sapiens
ttcttgttcttgtgg

SEQ ID NO: 447254 - DNA, 15 bp, Homo sapiens
tcttgttcttgtggg

SEQ ID NO: 447255 - DNA, 15 bp, Homo sapiens
cttgttcttgtgggg

SEQ ID NO: 447256 - DNA, 15 bp, Homo sapiens
ttgttcttgtggggc

SEQ ID NO: 447257 - DNA, 15 bp, Homo sapiens
tgttcttgtggggca

SEQ ID NO: 447258 - DNA, 15 bp, Homo sapiens
gttcttgtggggcag

SEQ ID NO: 447259 - DNA, 15 bp, Homo sapiens
ttcttgtggggcaga

SEQ ID NO: 447260 - DNA, 15 bp, Homo sapiens
tcttgtggggcagag

SEQ ID NO: 447261 - DNA, 15 bp, Homo sapiens
cttgtggggcagagt

SEQ ID NO: 447262 - DNA, 15 bp, Homo sapiens
ttgtggggcagagtt

SEQ ID NO: 447263 - DNA, 15 bp, Homo sapiens
tgtggggcagagttc

SEQ ID NO: 447264 - DNA, 15 bp, Homo sapiens
gtggggcagagttct

SEQ ID NO: 447265 - DNA, 15 bp, Homo sapiens
tggggcagagttctt

SEQ ID NO: 447266 - DNA, 15 bp, Homo sapiens
ggggcagagttctta

SEQ ID NO: 447267 - DNA, 15 bp, Homo sapiens
gggcagagttcttat

SEQ ID NO: 447268 - DNA, 15 bp, Homo sapiens
ggcagagttcttatg

SEQ ID NO: 447269 - DNA, 15 bp, Homo sapiens
gcagagttcttatgg

SEQ ID NO: 447270 - DNA, 15 bp, Homo sapiens
cagagttcttatggg

SEQ ID NO: 447271 - DNA, 15 bp, Homo sapiens
agagttcttatgggg

SEQ ID NO: 447272 - DNA, 15 bp, Homo sapiens
gagttcttatggggc

SEQ ID NO: 447273 - DNA, 15 bp, Homo sapiens
agttcttatggggca

SEQ ID NO: 447274 - DNA, 15 bp, Homo sapiens
gttcttatggggcag

SEQ ID NO: 447275 - DNA, 15 bp, Homo sapiens
ttcttatggggcaga

SEQ ID NO: 447276 - DNA, 15 bp, Homo sapiens
tcttatggggcagat

SEQ ID NO: 447277 - DNA, 15 bp, Homo sapiens
cttatggggcagatt

SEQ ID NO: 447278 - DNA, 15 bp, Homo sapiens
ttatggggcagattg

SEQ ID NO: 447279 - DNA, 15 bp, Homo sapiens
tatggggcagattgg

SEQ ID NO: 447280 - DNA, 15 bp, Homo sapiens
atggggcagattggt

SEQ ID NO: 447281 - DNA, 15 bp, Homo sapiens
tggggcagattggta

SEQ ID NO: 447282 - DNA, 15 bp, Homo sapiens
ggggcagattggtag

SEQ ID NO: 447283 - DNA, 15 bp, Homo sapiens
gggcagattggtaga

SEQ ID NO: 447284 - DNA, 15 bp, Homo sapiens
ggcagattggtagaa

SEQ ID NO: 447285 - DNA, 15 bp, Homo sapiens
gcagattggtagaat

SEQ ID NO: 447286 - DNA, 15 bp, Homo sapiens
cagattggtagaata

SEQ ID NO: 447287 - DNA, 15 bp, Homo sapiens
agattggtagaataa

SEQ ID NO: 447288 - DNA, 15 bp, Homo sapiens
gattggtagaataaa

SEQ ID NO: 447289 - DNA, 15 bp, Homo sapiens
attggtagaataaaa

SEQ ID NO: 447290 - DNA, 15 bp, Homo sapiens
ttggtagaataaaag

SEQ ID NO: 447291 - DNA, 15 bp, Homo sapiens
tggtagaataaaagt

SEQ ID NO: 447292 - DNA, 15 bp, Homo sapiens
ggtagaataaaagtt

SEQ ID NO: 447293 - DNA, 15 bp, Homo sapiens
gtagaataaaagtta

SEQ ID NO: 447294 - DNA, 15 bp, Homo sapiens
tagaataaaagttag

SEQ ID NO: 447295 - DNA, 15 bp, Homo sapiens
agaataaaagttagt

SEQ ID NO: 447296 - DNA, 15 bp, Homo sapiens
gaataaaagttagtt

SEQ ID NO: 447297 - DNA, 15 bp, Homo sapiens
aataaaagttagttt

SEQ ID NO: 447298 - DNA, 15 bp, Homo sapiens
ataaaagttagtttt

SEQ ID NO: 447299 - DNA, 15 bp, Homo sapiens
taaaagttagtttta

SEQ ID NO: 447300 - DNA, 15 bp, Homo sapiens
aaaagttagttttac

SEQ ID NO: 447301 - DNA, 15 bp, Homo sapiens
aaagttagttttacc

SEQ ID NO: 447302 - DNA, 15 bp, Homo sapiens
aagttagttttacct

SEQ ID NO: 447303 - DNA, 15 bp, Homo sapiens
agttagttttacctg

SEQ ID NO: 447304 - DNA, 15 bp, Homo sapiens
gttagttttacctgg

SEQ ID NO: 447305 - DNA, 15 bp, Homo sapiens
ttagttttacctggc

SEQ ID NO: 447306 - DNA, 15 bp, Homo sapiens
tagttttacctggct

SEQ ID NO: 447307 - DNA, 15 bp, Homo sapiens
agttttacctggctt

SEQ ID NO: 447308 - DNA, 15 bp, Homo sapiens
gttttacctggcttc

SEQ ID NO: 447309 - DNA, 15 bp, Homo sapiens
ttttacctggcttcc

SEQ ID NO: 447310 - DNA, 15 bp, Homo sapiens
tttacctggcttccc

SEQ ID NO: 447311 - DNA, 15 bp, Homo sapiens
ttacctggcttccca

SEQ ID NO: 447312 - DNA, 15 bp, Homo sapiens
tacctggcttcccat

SEQ ID NO: 447313 - DNA, 15 bp, Homo sapiens
acctggcttcccatt

SEQ ID NO: 447314 - DNA, 15 bp, Homo sapiens
cctggcttcccattg

SEQ ID NO: 447315 - DNA, 15 bp, Homo sapiens
ctggcttcccattgg

SEQ ID NO: 447316 - DNA, 15 bp, Homo sapiens
tggcttcccattggc

SEQ ID NO: 447317 - DNA, 15 bp, Homo sapiens
ggcttcccattggct

SEQ ID NO: 447318 - DNA, 15 bp, Homo sapiens
gcttcccattggcta

SEQ ID NO: 447319 - DNA, 15 bp, Homo sapiens
cttcccattggctag

SEQ ID NO: 447320 - DNA, 15 bp, Homo sapiens
ttcccattggctaga

SEQ ID NO: 447321 - DNA, 15 bp, Homo sapiens
tcccattggctagag

SEQ ID NO: 447322 - DNA, 15 bp, Homo sapiens
cccattggctagagc

SEQ ID NO: 447323 - DNA, 15 bp, Homo sapiens
ccattggctagagca

SEQ ID NO: 447324 - DNA, 15 bp, Homo sapiens
cattggctagagcac

SEQ ID NO: 447325 - DNA, 15 bp, Homo sapiens
attggctagagcact

SEQ ID NO: 447326 - DNA, 15 bp, Homo sapiens
ttggctagagcacta

SEQ ID NO: 447327 - DNA, 15 bp, Homo sapiens
tggctagagcactat

SEQ ID NO: 447328 - DNA, 15 bp, Homo sapiens
ggctagagcactatt

SEQ ID NO: 447329 - DNA, 15 bp, Homo sapiens
gctagagcactatta

SEQ ID NO: 447330 - DNA, 15 bp, Homo sapiens
ctagagcactattac

SEQ ID NO: 447331 - DNA, 15 bp, Homo sapiens
tagagcactattacc

SEQ ID NO: 447332 - DNA, 15 bp, Homo sapiens
agagcactattacca

SEQ ID NO: 447333 - DNA, 15 bp, Homo sapiens
gagcactattaccag

SEQ ID NO: 447334 - DNA, 15 bp, Homo sapiens
agcactattaccagc

SEQ ID NO: 447335 - DNA, 15 bp, Homo sapiens
gcactattaccagca

SEQ ID NO: 447336 - DNA, 15 bp, Homo sapiens
cactattaccagcac

SEQ ID NO: 447337 - DNA, 15 bp, Homo sapiens
actattaccagcact

SEQ ID NO: 447338 - DNA, 15 bp, Homo sapiens
ctattaccagcactg

SEQ ID NO: 447339 - DNA, 15 bp, Homo sapiens
tattaccagcactgg

SEQ ID NO: 447340 - DNA, 15 bp, Homo sapiens
attaccagcactgga

SEQ ID NO: 447341 - DNA, 15 bp, Homo sapiens
ttaccagcactggaa

SEQ ID NO: 447342 - DNA, 15 bp, Homo sapiens
taccagcactggaaa

SEQ ID NO: 447343 - DNA, 15 bp, Homo sapiens
accagcactggaaaa

SEQ ID NO: 447344 - DNA, 15 bp, Homo sapiens
ccagcactggaaaat

SEQ ID NO: 447345 - DNA, 15 bp, Homo sapiens
cagcactggaaaata

SEQ ID NO: 447346 - DNA, 15 bp, Homo sapiens
agcactggaaaatag

SEQ ID NO: 447347 - DNA, 15 bp, Homo sapiens
gcactggaaaataga

SEQ ID NO: 447348 - DNA, 15 bp, Homo sapiens
cactggaaaatagat

SEQ ID NO: 447349 - DNA, 15 bp, Homo sapiens
actggaaaatagata

SEQ ID NO: 447350 - DNA, 15 bp, Homo sapiens
ctggaaaatagatat

SEQ ID NO: 447351 - DNA, 15 bp, Homo sapiens
tggaaaatagatata

SEQ ID NO: 447352 - DNA, 15 bp, Homo sapiens
ggaaaatagatataa

SEQ ID NO: 447353 - DNA, 15 bp, Homo sapiens
gaaaatagatataat

SEQ ID NO: 447354 - DNA, 15 bp, Homo sapiens
aaaatagatataata

SEQ ID NO: 447355 - DNA, 15 bp, Homo sapiens
aaatagatataatat

SEQ ID NO: 447356 - DNA, 15 bp, Homo sapiens
aatagatataatata

SEQ ID NO: 447357 - DNA, 15 bp, Homo sapiens
atagatataatataa

SEQ ID NO: 447358 - DNA, 15 bp, Homo sapiens
tagatataatataat

SEQ ID NO: 447359 - DNA, 15 bp, Homo sapiens
agatataatataatg

SEQ ID NO: 447360 - DNA, 15 bp, Homo sapiens
gatataatataatga

SEQ ID NO: 447361 - DNA, 15 bp, Homo sapiens
atataatataatgat

SEQ ID NO: 447362 - DNA, 15 bp, Homo sapiens
tataatataatgatg

SEQ ID NO: 447363 - DNA, 15 bp, Homo sapiens
ataatataatgatgg

SEQ ID NO: 447364 - DNA, 15 bp, Homo sapiens
taatataatgatggc

SEQ ID NO: 447365 - DNA, 15 bp, Homo sapiens
aatataatgatggcc

SEQ ID NO: 447366 - DNA, 15 bp, Homo sapiens
atataatgatggcca

SEQ ID NO: 447367 - DNA, 15 bp, Homo sapiens
tataatgatggccac

SEQ ID NO: 447368 - DNA, 15 bp, Homo sapiens
ataatgatggccact

SEQ ID NO: 447369 - DNA, 15 bp, Homo sapiens
taatgatggccacta

SEQ ID NO: 447370 - DNA, 15 bp, Homo sapiens
aatgatggccactat

SEQ ID NO: 447371 - DNA, 15 bp, Homo sapiens
atgatggccactatt

SEQ ID NO: 447372 - DNA, 15 bp, Homo sapiens
tgatggccactattt

SEQ ID NO: 447373 - DNA, 15 bp, Homo sapiens
gatggccactatttt

SEQ ID NO: 447374 - DNA, 15 bp, Homo sapiens
atggccactatttta

SEQ ID NO: 447375 - DNA, 15 bp, Homo sapiens
tggccactattttaa

SEQ ID NO: 447376 - DNA, 15 bp, Homo sapiens
ggccactattttaaa

SEQ ID NO: 447377 - DNA, 15 bp, Homo sapiens
gccactattttaaat

SEQ ID NO: 447378 - DNA, 15 bp, Homo sapiens
ccactattttaaata

SEQ ID NO: 447379 - DNA, 15 bp, Homo sapiens
cactattttaaataa

SEQ ID NO: 447380 - DNA, 15 bp, Homo sapiens
actattttaaataat

SEQ ID NO: 447381 - DNA, 15 bp, Homo sapiens
ctattttaaataata

SEQ ID NO: 447382 - DNA, 15 bp, Homo sapiens
tattttaaataataa

SEQ ID NO: 447383 - DNA, 15 bp, Homo sapiens
attttaaataataac

SEQ ID NO: 447384 - DNA, 15 bp, Homo sapiens
ttttaaataataacg

SEQ ID NO: 447385 - DNA, 15 bp, Homo sapiens
tttaaataataacgt

SEQ ID NO: 447386 - DNA, 15 bp, Homo sapiens
ttaaataataacgtt

SEQ ID NO: 447387 - DNA, 15 bp, Homo sapiens
taaataataacgttt

SEQ ID NO: 447388 - DNA, 15 bp, Homo sapiens
aaataataacgttta

SEQ ID NO: 447389 - DNA, 15 bp, Homo sapiens
aataataacgtttag

SEQ ID NO: 447390 - DNA, 15 bp, Homo sapiens
ataataacgtttagg

SEQ ID NO: 447391 - DNA, 15 bp, Homo sapiens
taataacgtttagga

SEQ ID NO: 447392 - DNA, 15 bp, Homo sapiens
aataacgtttaggac

SEQ ID NO: 447393 - DNA, 15 bp, Homo sapiens
ataacgtttaggact

SEQ ID NO: 447394 - DNA, 15 bp, Homo sapiens
taacgtttaggactg

SEQ ID NO: 447395 - DNA, 15 bp, Homo sapiens
aacgtttaggactgt

SEQ ID NO: 447396 - DNA, 15 bp, Homo sapiens
acgtttaggactgta

SEQ ID NO: 447397 - DNA, 15 bp, Homo sapiens
cgtttaggactgtag

SEQ ID NO: 447398 - DNA, 15 bp, Homo sapiens
gtttaggactgtagc

SEQ ID NO: 447399 - DNA, 15 bp, Homo sapiens
tttaggactgtagca

SEQ ID NO: 447400 - DNA, 15 bp, Homo sapiens
ttaggactgtagcat

SEQ ID NO: 447401 - DNA, 15 bp, Homo sapiens
taggactgtagcatt

SEQ ID NO: 447402 - DNA, 15 bp, Homo sapiens
aggactgtagcattt

SEQ ID NO: 447403 - DNA, 15 bp, Homo sapiens
ggactgtagcattta

SEQ ID NO: 447404 - DNA, 15 bp, Homo sapiens
gactgtagcatttaa

SEQ ID NO: 447405 - DNA, 15 bp, Homo sapiens
actgtagcatttaaa

SEQ ID NO: 447406 - DNA, 15 bp, Homo sapiens
ctgtagcatttaaaa

SEQ ID NO: 447407 - DNA, 15 bp, Homo sapiens
tgtagcatttaaaaa

SEQ ID NO: 447408 - DNA, 15 bp, Homo sapiens
gtagcatttaaaaaa

SEQ ID NO: 447409 - DNA, 15 bp, Homo sapiens
tagcatttaaaaaaa

SEQ ID NO: 447410 - DNA, 15 bp, Homo sapiens
agcatttaaaaaaat

SEQ ID NO: 447411 - DNA, 15 bp, Homo sapiens
gcatttaaaaaaatc

SEQ ID NO: 447412 - DNA, 15 bp, Homo sapiens
catttaaaaaaatct

SEQ ID NO: 447413 - DNA, 15 bp, Homo sapiens
atttaaaaaaatctt

SEQ ID NO: 447414 - DNA, 15 bp, Homo sapiens
tttaaaaaaatcttc

SEQ ID NO: 447415 - DNA, 15 bp, Homo sapiens
ttaaaaaaatcttct

SEQ ID NO: 447416 - DNA, 15 bp, Homo sapiens
taaaaaaatcttctc

SEQ ID NO: 447417 - DNA, 15 bp, Homo sapiens
aaaaaaatcttctcc

SEQ ID NO: 447418 - DNA, 15 bp, Homo sapiens
aaaaaatcttctcca

SEQ ID NO: 447419 - DNA, 15 bp, Homo sapiens
aaaaatcttctccat

SEQ ID NO: 447420 - DNA, 15 bp, Homo sapiens
aaaatcttctccatc

SEQ ID NO: 447421 - DNA, 15 bp, Homo sapiens
aaatcttctccatca

SEQ ID NO: 447422 - DNA, 15 bp, Homo sapiens
aatcttctccatcac

SEQ ID NO: 447423 - DNA, 15 bp, Homo sapiens
atcttctccatcacc

SEQ ID NO: 447424 - DNA, 15 bp, Homo sapiens
tcttctccatcacca

SEQ ID NO: 447425 - DNA, 15 bp, Homo sapiens
cttctccatcaccag

SEQ ID NO: 447426 - DNA, 15 bp, Homo sapiens
ttctccatcaccagt

SEQ ID NO: 447427 - DNA, 15 bp, Homo sapiens
tctccatcaccagta

SEQ ID NO: 447428 - DNA, 15 bp, Homo sapiens
ctccatcaccagtaa

SEQ ID NO: 447429 - DNA, 15 bp, Homo sapiens
tccatcaccagtaaa

SEQ ID NO: 447430 - DNA, 15 bp, Homo sapiens
ccatcaccagtaaaa

SEQ ID NO: 447431 - DNA, 15 bp, Homo sapiens
catcaccagtaaaag

SEQ ID NO: 447432 - DNA, 15 bp, Homo sapiens
atcaccagtaaaaga

SEQ ID NO: 447433 - DNA, 15 bp, Homo sapiens
tcaccagtaaaagat

SEQ ID NO: 447434 - DNA, 15 bp, Homo sapiens
caccagtaaaagatc

SEQ ID NO: 447435 - DNA, 15 bp, Homo sapiens
accagtaaaagatca

SEQ ID NO: 447436 - DNA, 15 bp, Homo sapiens
ccagtaaaagatcag

SEQ ID NO: 447437 - DNA, 15 bp, Homo sapiens
cagtaaaagatcaga

SEQ ID NO: 447438 - DNA, 15 bp, Homo sapiens
agtaaaagatcagat

SEQ ID NO: 447439 - DNA, 15 bp, Homo sapiens
gtaaaagatcagatt

SEQ ID NO: 447440 - DNA, 15 bp, Homo sapiens
taaaagatcagattg

SEQ ID NO: 447441 - DNA, 15 bp, Homo sapiens
aaaagatcagattgt

SEQ ID NO: 447442 - DNA, 15 bp, Homo sapiens
aaagatcagattgtt

SEQ ID NO: 447443 - DNA, 15 bp, Homo sapiens
aagatcagattgttt

SEQ ID NO: 447444 - DNA, 15 bp, Homo sapiens
agatcagattgttta

SEQ ID NO: 447445 - DNA, 15 bp, Homo sapiens
ttaaggcagagaaat

SEQ ID NO: 447446 - DNA, 15 bp, Homo sapiens
taaggcagagaaata

SEQ ID NO: 447447 - DNA, 15 bp, Homo sapiens
aaggcagagaaataa

SEQ ID NO: 447448 - DNA, 15 bp, Homo sapiens
aggcagagaaataaa

SEQ ID NO: 447449 - DNA, 15 bp, Homo sapiens
ggcagagaaataaac

SEQ ID NO: 447450 - DNA, 15 bp, Homo sapiens
gcagagaaataaacc

SEQ ID NO: 447451 - DNA, 15 bp, Homo sapiens
cagagaaataaacca

SEQ ID NO: 447452 - DNA, 15 bp, Homo sapiens
agagaaataaaccag

SEQ ID NO: 447453 - DNA, 15 bp, Homo sapiens
gagaaataaaccagt

SEQ ID NO: 447454 - DNA, 15 bp, Homo sapiens
agaaataaaccagtt

SEQ ID NO: 447455 - DNA, 15 bp, Homo sapiens
gaaataaaccagttt

SEQ ID NO: 447456 - DNA, 15 bp, Homo sapiens
aaataaaccagtttg

SEQ ID NO: 447457 - DNA, 15 bp, Homo sapiens
aataaaccagtttgg

SEQ ID NO: 447458 - DNA, 15 bp, Homo sapiens
ataaaccagtttggg

SEQ ID NO: 447459 - DNA, 15 bp, Homo sapiens
taaaccagtttgggg

SEQ ID NO: 447460 - DNA, 15 bp, Homo sapiens
aaaccagtttgggga

SEQ ID NO: 447461 - DNA, 15 bp, Homo sapiens
aaccagtttggggag

SEQ ID NO: 447462 - DNA, 15 bp, Homo sapiens
accagtttggggaga

SEQ ID NO: 447463 - DNA, 15 bp, Homo sapiens
ccagtttggggagag

SEQ ID NO: 447464 - DNA, 15 bp, Homo sapiens
cagtttggggagaga

SEQ ID NO: 447465 - DNA, 15 bp, Homo sapiens
agtttggggagagag

SEQ ID NO: 447466 - DNA, 15 bp, Homo sapiens
gtttggggagagaga

SEQ ID NO: 447467 - DNA, 15 bp, Homo sapiens
tttggggagagagat

SEQ ID NO: 447468 - DNA, 15 bp, Homo sapiens
ttggggagagagata

SEQ ID NO: 447469 - DNA, 15 bp, Homo sapiens
tggggagagagatag

SEQ ID NO: 447470 - DNA, 15 bp, Homo sapiens
ggggagagagatagc

SEQ ID NO: 447471 - DNA, 15 bp, Homo sapiens
gggagagagatagca

SEQ ID NO: 447472 - DNA, 15 bp, Homo sapiens
ggagagagatagcag

SEQ ID NO: 447473 - DNA, 15 bp, Homo sapiens
gagagagatagcagt

SEQ ID NO: 447474 - DNA, 15 bp, Homo sapiens
agagagatagcagta

SEQ ID NO: 447475 - DNA, 15 bp, Homo sapiens
gagagatagcagtag

SEQ ID NO: 447476 - DNA, 15 bp, Homo sapiens
agagatagcagtagt

SEQ ID NO: 447477 - DNA, 15 bp, Homo sapiens
gagatagcagtagtg

SEQ ID NO: 447478 - DNA, 15 bp, Homo sapiens
agatagcagtagtga

SEQ ID NO: 447479 - DNA, 15 bp, Homo sapiens
gatagcagtagtgaa

SEQ ID NO: 447480 - DNA, 15 bp, Homo sapiens
atagcagtagtgaat

SEQ ID NO: 447481 - DNA, 15 bp, Homo sapiens
tagcagtagtgaatt

SEQ ID NO: 447482 - DNA, 15 bp, Homo sapiens
agcagtagtgaattt

SEQ ID NO: 447483 - DNA, 15 bp, Homo sapiens
gcagtagtgaatttc

SEQ ID NO: 447484 - DNA, 15 bp, Homo sapiens
cagtagtgaatttct

SEQ ID NO: 447485 - DNA, 15 bp, Homo sapiens
agtagtgaatttctg

SEQ ID NO: 447486 - DNA, 15 bp, Homo sapiens
gtagtgaatttctgt

SEQ ID NO: 447487 - DNA, 15 bp, Homo sapiens
tagtgaatttctgtt

SEQ ID NO: 447488 - DNA, 15 bp, Homo sapiens
agtgaatttctgttt

SEQ ID NO: 447489 - DNA, 15 bp, Homo sapiens
gtgaatttctgtttt

SEQ ID NO: 447490 - DNA, 15 bp, Homo sapiens
tgaatttctgttttg

SEQ ID NO: 447491 - DNA, 15 bp, Homo sapiens
gaatttctgttttgg

SEQ ID NO: 447492 - DNA, 15 bp, Homo sapiens
aatttctgttttgga

SEQ ID NO: 447493 - DNA, 15 bp, Homo sapiens
atttctgttttggag

SEQ ID NO: 447494 - DNA, 15 bp, Homo sapiens
tttctgttttggagt

SEQ ID NO: 447495 - DNA, 15 bp, Homo sapiens
ttctgttttggagtt

SEQ ID NO: 447496 - DNA, 15 bp, Homo sapiens
tctgttttggagttt

SEQ ID NO: 447497 - DNA, 15 bp, Homo sapiens
ctgttttggagtttg

SEQ ID NO: 447498 - DNA, 15 bp, Homo sapiens
tgttttggagtttgg

SEQ ID NO: 447499 - DNA, 15 bp, Homo sapiens
gttttggagtttggg

SEQ ID NO: 447500 - DNA, 15 bp, Homo sapiens
ttttggagtttggga

SEQ ID NO: 447501 - DNA, 15 bp, Homo sapiens
tttggagtttgggaa

SEQ ID NO: 447502 - DNA, 15 bp, Homo sapiens
ttggagtttgggaaa

SEQ ID NO: 447503 - DNA, 15 bp, Homo sapiens
tggagtttgggaaag

SEQ ID NO: 447504 - DNA, 15 bp, Homo sapiens
ggagtttgggaaagc

SEQ ID NO: 447505 - DNA, 15 bp, Homo sapiens
gagtttgggaaagca

SEQ ID NO: 447506 - DNA, 15 bp, Homo sapiens
agtttgggaaagcaa

SEQ ID NO: 447507 - DNA, 15 bp, Homo sapiens
gtttgggaaagcaag

SEQ ID NO: 447508 - DNA, 15 bp, Homo sapiens
tttgggaaagcaagt

SEQ ID NO: 447509 - DNA, 15 bp, Homo sapiens
ttgggaaagcaagtt

SEQ ID NO: 447510 - DNA, 15 bp, Homo sapiens
tgggaaagcaagttt

SEQ ID NO: 447511 - DNA, 15 bp, Homo sapiens
gggaaagcaagttta

SEQ ID NO: 447512 - DNA, 15 bp, Homo sapiens
ggaaagcaagtttat

SEQ ID NO: 447513 - DNA, 15 bp, Homo sapiens
gaaagcaagtttatt

SEQ ID NO: 447514 - DNA, 15 bp, Homo sapiens
aaagcaagtttatta

SEQ ID NO: 447515 - DNA, 15 bp, Homo sapiens
aagcaagtttattag

SEQ ID NO: 447516 - DNA, 15 bp, Homo sapiens
agcaagtttattagg

SEQ ID NO: 447517 - DNA, 15 bp, Homo sapiens
gcaagtttattaggg

SEQ ID NO: 447518 - DNA, 15 bp, Homo sapiens
caagtttattaggga

SEQ ID NO: 447519 - DNA, 15 bp, Homo sapiens
aagtttattagggaa

SEQ ID NO: 447520 - DNA, 15 bp, Homo sapiens
agtttattagggaat

SEQ ID NO: 447521 - DNA, 15 bp, Homo sapiens
gtttattagggaata

SEQ ID NO: 447522 - DNA, 15 bp, Homo sapiens
tttattagggaatat

SEQ ID NO: 447523 - DNA, 15 bp, Homo sapiens
ttattagggaatata

SEQ ID NO: 447524 - DNA, 15 bp, Homo sapiens
tattagggaatatag

SEQ ID NO: 447525 - DNA, 15 bp, Homo sapiens
attagggaatatagt

SEQ ID NO: 447526 - DNA, 15 bp, Homo sapiens
ttagggaatatagtg

SEQ ID NO: 447527 - DNA, 15 bp, Homo sapiens
tagggaatatagtgc

SEQ ID NO: 447528 - DNA, 15 bp, Homo sapiens
agggaatatagtgca

SEQ ID NO: 447529 - DNA, 15 bp, Homo sapiens
gggaatatagtgcag

SEQ ID NO: 447530 - DNA, 15 bp, Homo sapiens
ggaatatagtgcagt

SEQ ID NO: 447531 - DNA, 15 bp, Homo sapiens
gaatatagtgcagtt

SEQ ID NO: 447532 - DNA, 15 bp, Homo sapiens
aatatagtgcagttg

SEQ ID NO: 447533 - DNA, 15 bp, Homo sapiens
atatagtgcagttgc

SEQ ID NO: 447534 - DNA, 15 bp, Homo sapiens
tatagtgcagttgcc

SEQ ID NO: 447535 - DNA, 15 bp, Homo sapiens
atagtgcagttgcca

SEQ ID NO: 447536 - DNA, 15 bp, Homo sapiens
tagtgcagttgccag

SEQ ID NO: 447537 - DNA, 15 bp, Homo sapiens
agtgcagttgccagg

SEQ ID NO: 447538 - DNA, 15 bp, Homo sapiens
gtgcagttgccagga

SEQ ID NO: 447539 - DNA, 15 bp, Homo sapiens
tgcagttgccaggag

SEQ ID NO: 447540 - DNA, 15 bp, Homo sapiens
gcagttgccaggagt

SEQ ID NO: 447541 - DNA, 15 bp, Homo sapiens
cagttgccaggagtt

SEQ ID NO: 447542 - DNA, 15 bp, Homo sapiens
agttgccaggagttg

SEQ ID NO: 447543 - DNA, 15 bp, Homo sapiens
gttgccaggagttgg

SEQ ID NO: 447544 - DNA, 15 bp, Homo sapiens
ttgccaggagttgga

SEQ ID NO: 447545 - DNA, 15 bp, Homo sapiens
tgccaggagttggac

SEQ ID NO: 447546 - DNA, 15 bp, Homo sapiens
gccaggagttggaca

SEQ ID NO: 447547 - DNA, 15 bp, Homo sapiens
ccaggagttggacat

SEQ ID NO: 447548 - DNA, 15 bp, Homo sapiens
caggagttggacatt

SEQ ID NO: 447549 - DNA, 15 bp, Homo sapiens
aggagttggacattt

SEQ ID NO: 447550 - DNA, 15 bp, Homo sapiens
ggagttggacatttg

SEQ ID NO: 447551 - DNA, 15 bp, Homo sapiens
gagttggacatttga

SEQ ID NO: 447552 - DNA, 15 bp, Homo sapiens
agttggacatttgag

SEQ ID NO: 447553 - DNA, 15 bp, Homo sapiens
gttggacatttgagg

SEQ ID NO: 447554 - DNA, 15 bp, Homo sapiens
ttggacatttgaggt

SEQ ID NO: 447555 - DNA, 15 bp, Homo sapiens
tggacatttgaggtt

SEQ ID NO: 447556 - DNA, 15 bp, Homo sapiens
ggacatttgaggttt

SEQ ID NO: 447557 - DNA, 15 bp, Homo sapiens
gacatttgaggtttg

SEQ ID NO: 447558 - DNA, 15 bp, Homo sapiens
acatttgaggtttga

SEQ ID NO: 447559 - DNA, 15 bp, Homo sapiens
catttgaggtttgaa

SEQ ID NO: 447560 - DNA, 15 bp, Homo sapiens
atttgaggtttgaaa

SEQ ID NO: 447561 - DNA, 15 bp, Homo sapiens
tttgaggtttgaaat

SEQ ID NO: 447562 - DNA, 15 bp, Homo sapiens
ttgaggtttgaaatc

SEQ ID NO: 447563 - DNA, 15 bp, Homo sapiens
tgaggtttgaaatca

SEQ ID NO: 447564 - DNA, 15 bp, Homo sapiens
gaggtttgaaatcac

SEQ ID NO: 447565 - DNA, 15 bp, Homo sapiens
aggtttgaaatcaca

SEQ ID NO: 447566 - DNA, 15 bp, Homo sapiens
ggtttgaaatcacat

SEQ ID NO: 447567 - DNA, 15 bp, Homo sapiens
gtttgaaatcacata

SEQ ID NO: 447568 - DNA, 15 bp, Homo sapiens
tttgaaatcacatat

SEQ ID NO: 447569 - DNA, 15 bp, Homo sapiens
ttgaaatcacatatt

SEQ ID NO: 447570 - DNA, 15 bp, Homo sapiens
tgaaatcacatattt

SEQ ID NO: 447571 - DNA, 15 bp, Homo sapiens
gaaatcacatatttt

SEQ ID NO: 447572 - DNA, 15 bp, Homo sapiens
aaatcacatatttta

SEQ ID NO: 447573 - DNA, 15 bp, Homo sapiens
aatcacatattttaa

SEQ ID NO: 447574 - DNA, 15 bp, Homo sapiens
atcacatattttaaa

SEQ ID NO: 447575 - DNA, 15 bp, Homo sapiens
tcacatattttaaag

SEQ ID NO: 447576 - DNA, 15 bp, Homo sapiens
cacatattttaaagt

SEQ ID NO: 447577 - DNA, 15 bp, Homo sapiens
acatattttaaagta

SEQ ID NO: 447578 - DNA, 15 bp, Homo sapiens
catattttaaagtaa

SEQ ID NO: 447579 - DNA, 15 bp, Homo sapiens
atattttaaagtaaa

SEQ ID NO: 447580 - DNA, 15 bp, Homo sapiens
attttaaagtaaatt

SEQ ID NO: 447581 - DNA, 15 bp, Homo sapiens
ttttaaagtaaattg

SEQ ID NO: 447582 - DNA, 15 bp, Homo sapiens
tttaaagtaaattga

SEQ ID NO: 447583 - DNA, 15 bp, Homo sapiens
ttaaagtaaattgag

SEQ ID NO: 447584 - DNA, 15 bp, Homo sapiens
taaagtaaattgagt

SEQ ID NO: 447585 - DNA, 15 bp, Homo sapiens
aaagtaaattgagtc

SEQ ID NO: 447586 - DNA, 15 bp, Homo sapiens
aagtaaattgagtct

SEQ ID NO: 447587 - DNA, 15 bp, Homo sapiens
agtaaattgagtctg

SEQ ID NO: 447588 - DNA, 15 bp, Homo sapiens
gtaaattgagtctgt

SEQ ID NO: 447589 - DNA, 15 bp, Homo sapiens
taaattgagtctgtc

SEQ ID NO: 447590 - DNA, 15 bp, Homo sapiens
aaattgagtctgtct

SEQ ID NO: 447591 - DNA, 15 bp, Homo sapiens
aattgagtctgtctg

SEQ ID NO: 447592 - DNA, 15 bp, Homo sapiens
attgagtctgtctgt

SEQ ID NO: 447593 - DNA, 15 bp, Homo sapiens
ttgagtctgtctgtt

SEQ ID NO: 447594 - DNA, 15 bp, Homo sapiens
tgagtctgtctgttg

SEQ ID NO: 447595 - DNA, 15 bp, Homo sapiens
gagtctgtctgttga

SEQ ID NO: 447596 - DNA, 15 bp, Homo sapiens
agtctgtctgttgag

SEQ ID NO: 447597 - DNA, 15 bp, Homo sapiens
gtctgtctgttgagt

SEQ ID NO: 447598 - DNA, 15 bp, Homo sapiens
tctgtctgttgagtg

SEQ ID NO: 447599 - DNA, 15 bp, Homo sapiens
ctgtctgttgagtga

SEQ ID NO: 447600 - DNA, 15 bp, Homo sapiens
tgtctgttgagtgat

SEQ ID NO: 447601 - DNA, 15 bp, Homo sapiens
gtctgttgagtgatt

SEQ ID NO: 447602 - DNA, 15 bp, Homo sapiens
tctgttgagtgattt

SEQ ID NO: 447603 - DNA, 15 bp, Homo sapiens
ctgttgagtgatttt

SEQ ID NO: 447604 - DNA, 15 bp, Homo sapiens
tgttgagtgattttc

SEQ ID NO: 447605 - DNA, 15 bp, Homo sapiens
gttgagtgattttct

SEQ ID NO: 447606 - DNA, 15 bp, Homo sapiens
ttgagtgattttctc

SEQ ID NO: 447607 - DNA, 15 bp, Homo sapiens
tgagtgattttctcc

SEQ ID NO: 447608 - DNA, 15 bp, Homo sapiens
gagtgattttctcca

SEQ ID NO: 447609 - DNA, 15 bp, Homo sapiens
agtgattttctccag

SEQ ID NO: 447610 - DNA, 15 bp, Homo sapiens
gtgattttctccagt

SEQ ID NO: 447611 - DNA, 15 bp, Homo sapiens
tgattttctccagtt

SEQ ID NO: 447612 - DNA, 15 bp, Homo sapiens
gattttctccagttg

SEQ ID NO: 447613 - DNA, 15 bp, Homo sapiens
attttctccagttgt

SEQ ID NO: 447614 - DNA, 15 bp, Homo sapiens
ttttctccagttgtt

SEQ ID NO: 447615 - DNA, 15 bp, Homo sapiens
tttctccagttgttt

SEQ ID NO: 447616 - DNA, 15 bp, Homo sapiens
ttctccagttgtttt

SEQ ID NO: 447617 - DNA, 15 bp, Homo sapiens
tctccagttgttttt

SEQ ID NO: 447618 - DNA, 15 bp, Homo sapiens
ctccagttgttttta

SEQ ID NO: 447619 - DNA, 15 bp, Homo sapiens
tccagttgtttttat

SEQ ID NO: 447620 - DNA, 15 bp, Homo sapiens
ccagttgtttttatc

SEQ ID NO: 447621 - DNA, 15 bp, Homo sapiens
cagttgtttttatcc

SEQ ID NO: 447622 - DNA, 15 bp, Homo sapiens
agttgtttttatcca

SEQ ID NO: 447623 - DNA, 15 bp, Homo sapiens
gttgtttttatccac

SEQ ID NO: 447624 - DNA, 15 bp, Homo sapiens
ttgtttttatccaca

SEQ ID NO: 447625 - DNA, 15 bp, Homo sapiens
tgtttttatccacag

SEQ ID NO: 447626 - DNA, 15 bp, Homo sapiens
gtttttatccacagc

SEQ ID NO: 447627 - DNA, 15 bp, Homo sapiens
tttttatccacagct

SEQ ID NO: 447628 - DNA, 15 bp, Homo sapiens
ttttatccacagctg

SEQ ID NO: 447629 - DNA, 15 bp, Homo sapiens
tttatccacagctgc

SEQ ID NO: 447630 - DNA, 15 bp, Homo sapiens
ttatccacagctgct

SEQ ID NO: 447631 - DNA, 15 bp, Homo sapiens
tatccacagctgctc

SEQ ID NO: 447632 - DNA, 15 bp, Homo sapiens
atccacagctgctca

SEQ ID NO: 447633 - DNA, 15 bp, Homo sapiens
tccacagctgctcag

SEQ ID NO: 447634 - DNA, 15 bp, Homo sapiens
ccacagctgctcagg

SEQ ID NO: 447635 - DNA, 15 bp, Homo sapiens
cacagctgctcaggt

SEQ ID NO: 447636 - DNA, 15 bp, Homo sapiens
acagctgctcaggtc

SEQ ID NO: 447637 - DNA, 15 bp, Homo sapiens
cagctgctcaggtcc

SEQ ID NO: 447638 - DNA, 15 bp, Homo sapiens
agctgctcaggtcca

SEQ ID NO: 447639 - DNA, 15 bp, Homo sapiens
gctgctcaggtccag

SEQ ID NO: 447640 - DNA, 15 bp, Homo sapiens
ctgctcaggtccaga

SEQ ID NO: 447641 - DNA, 15 bp, Homo sapiens
tgctcaggtccagag

SEQ ID NO: 447642 - DNA, 15 bp, Homo sapiens
gctcaggtccagagt

SEQ ID NO: 447643 - DNA, 15 bp, Homo sapiens
ctcaggtccagagta

SEQ ID NO: 447644 - DNA, 15 bp, Homo sapiens
tcaggtccagagtag

SEQ ID NO: 447645 - DNA, 15 bp, Homo sapiens
caggtccagagtagg

SEQ ID NO: 447646 - DNA, 15 bp, Homo sapiens
aggtccagagtaggc

SEQ ID NO: 447647 - DNA, 15 bp, Homo sapiens
ggtccagagtaggca

SEQ ID NO: 447648 - DNA, 15 bp, Homo sapiens
gtccagagtaggcaa

SEQ ID NO: 447649 - DNA, 15 bp, Homo sapiens
tccagagtaggcaag

SEQ ID NO: 447650 - DNA, 15 bp, Homo sapiens
ccagagtaggcaagt

SEQ ID NO: 447651 - DNA, 15 bp, Homo sapiens
cagagtaggcaagta

SEQ ID NO: 447652 - DNA, 15 bp, Homo sapiens
agagtaggcaagtaa

SEQ ID NO: 447653 - DNA, 15 bp, Homo sapiens
gagtaggcaagtaat

SEQ ID NO: 447654 - DNA, 15 bp, Homo sapiens
agtaggcaagtaatt

SEQ ID NO: 447655 - DNA, 15 bp, Homo sapiens
gtaggcaagtaattg

SEQ ID NO: 447656 - DNA, 15 bp, Homo sapiens
taggcaagtaattga

SEQ ID NO: 447657 - DNA, 15 bp, Homo sapiens
aggcaagtaattgag

SEQ ID NO: 447658 - DNA, 15 bp, Homo sapiens
ggcaagtaattgagc

SEQ ID NO: 447659 - DNA, 15 bp, Homo sapiens
gcaagtaattgagct

SEQ ID NO: 447660 - DNA, 15 bp, Homo sapiens
caagtaattgagctg

SEQ ID NO: 447661 - DNA, 15 bp, Homo sapiens
aagtaattgagctga

SEQ ID NO: 447662 - DNA, 15 bp, Homo sapiens
agtaattgagctgat

SEQ ID NO: 447663 - DNA, 15 bp, Homo sapiens
gtaattgagctgatc

SEQ ID NO: 447664 - DNA, 15 bp, Homo sapiens
taattgagctgatcc

SEQ ID NO: 447665 - DNA, 15 bp, Homo sapiens
aattgagctgatcca

SEQ ID NO: 447666 - DNA, 15 bp, Homo sapiens
attgagctgatccag

SEQ ID NO: 447667 - DNA, 15 bp, Homo sapiens
ttgagctgatccagg

SEQ ID NO: 447668 - DNA, 15 bp, Homo sapiens
tgagctgatccaggc

SEQ ID NO: 447669 - DNA, 15 bp, Homo sapiens
gagctgatccaggcc

SEQ ID NO: 447670 - DNA, 15 bp, Homo sapiens
agctgatccaggcct

SEQ ID NO: 447671 - DNA, 15 bp, Homo sapiens
gctgatccaggcctg

SEQ ID NO: 447672 - DNA, 15 bp, Homo sapiens
ctgatccaggcctgg

SEQ ID NO: 447673 - DNA, 15 bp, Homo sapiens
tgatccaggcctggg

SEQ ID NO: 447674 - DNA, 15 bp, Homo sapiens
gatccaggcctggga

SEQ ID NO: 447675 - DNA, 15 bp, Homo sapiens
atccaggcctgggat

SEQ ID NO: 447676 - DNA, 15 bp, Homo sapiens
tccaggcctgggatt

SEQ ID NO: 447677 - DNA, 15 bp, Homo sapiens
ccaggcctgggattt

SEQ ID NO: 447678 - DNA, 15 bp, Homo sapiens
caggcctgggatttg

SEQ ID NO: 447679 - DNA, 15 bp, Homo sapiens
aggcctgggatttgc

SEQ ID NO: 447680 - DNA, 15 bp, Homo sapiens
ggcctgggatttgca

SEQ ID NO: 447681 - DNA, 15 bp, Homo sapiens
gcctgggatttgcaa

SEQ ID NO: 447682 - DNA, 15 bp, Homo sapiens
cctgggatttgcaag

SEQ ID NO: 447683 - DNA, 15 bp, Homo sapiens
ctgggatttgcaagg

SEQ ID NO: 447684 - DNA, 15 bp, Homo sapiens
tgggatttgcaaggg

SEQ ID NO: 447685 - DNA, 15 bp, Homo sapiens
gggatttgcaagggg

SEQ ID NO: 447686 - DNA, 15 bp, Homo sapiens
ggatttgcaaggggt

SEQ ID NO: 447687 - DNA, 15 bp, Homo sapiens
gatttgcaaggggtg

SEQ ID NO: 447688 - DNA, 15 bp, Homo sapiens
atttgcaaggggtga

SEQ ID NO: 447689 - DNA, 15 bp, Homo sapiens
tttgcaaggggtgag

SEQ ID NO: 447690 - DNA, 15 bp, Homo sapiens
ttgcaaggggtgaga

SEQ ID NO: 447691 - DNA, 15 bp, Homo sapiens
tgcaaggggtgagag

SEQ ID NO: 447692 - DNA, 15 bp, Homo sapiens
gcaaggggtgagaga

SEQ ID NO: 447693 - DNA, 15 bp, Homo sapiens
caaggggtgagagag

SEQ ID NO: 447694 - DNA, 15 bp, Homo sapiens
aaggggtgagagaga

SEQ ID NO: 447695 - DNA, 15 bp, Homo sapiens
aggggtgagagagaa

SEQ ID NO: 447696 - DNA, 15 bp, Homo sapiens
ggggtgagagagaag

SEQ ID NO: 447697 - DNA, 15 bp, Homo sapiens
gggtgagagagaagc

SEQ ID NO: 447698 - DNA, 15 bp, Homo sapiens
ggtgagagagaagca

SEQ ID NO: 447699 - DNA, 15 bp, Homo sapiens
gtgagagagaagcaa

SEQ ID NO: 447700 - DNA, 15 bp, Homo sapiens
tgagagagaagcaag

SEQ ID NO: 447701 - DNA, 15 bp, Homo sapiens
gagagagaagcaagg

SEQ ID NO: 447702 - DNA, 15 bp, Homo sapiens
agagagaagcaaggg

SEQ ID NO: 447703 - DNA, 15 bp, Homo sapiens
gagagaagcaaggga

SEQ ID NO: 447704 - DNA, 15 bp, Homo sapiens
agagaagcaagggag

SEQ ID NO: 447705 - DNA, 15 bp, Homo sapiens
gagaagcaagggaga

SEQ ID NO: 447706 - DNA, 15 bp, Homo sapiens
agaagcaagggagat

SEQ ID NO: 447707 - DNA, 15 bp, Homo sapiens
gaagcaagggagatg

SEQ ID NO: 447708 - DNA, 15 bp, Homo sapiens
aagcaagggagatga

SEQ ID NO: 447709 - DNA, 15 bp, Homo sapiens
agcaagggagatgag

SEQ ID NO: 447710 - DNA, 15 bp, Homo sapiens
gcaagggagatgagg

SEQ ID NO: 447711 - DNA, 15 bp, Homo sapiens
caagggagatgaggt

SEQ ID NO: 447712 - DNA, 15 bp, Homo sapiens
aagggagatgaggtt

SEQ ID NO: 447713 - DNA, 15 bp, Homo sapiens
agggagatgaggtta

SEQ ID NO: 447714 - DNA, 15 bp, Homo sapiens
gggagatgaggttat

SEQ ID NO: 447715 - DNA, 15 bp, Homo sapiens
ggagatgaggttatt

SEQ ID NO: 447716 - DNA, 15 bp, Homo sapiens
gagatgaggttattt

SEQ ID NO: 447717 - DNA, 15 bp, Homo sapiens
agatgaggttatttg

SEQ ID NO: 447718 - DNA, 15 bp, Homo sapiens
gatgaggttatttgt

SEQ ID NO: 447719 - DNA, 15 bp, Homo sapiens
atgaggttatttgta

SEQ ID NO: 447720 - DNA, 15 bp, Homo sapiens
tgaggttatttgtaa

SEQ ID NO: 447721 - DNA, 15 bp, Homo sapiens
gaggttatttgtaat

SEQ ID NO: 447722 - DNA, 15 bp, Homo sapiens
aggttatttgtaatg

SEQ ID NO: 447723 - DNA, 15 bp, Homo sapiens
ggttatttgtaatga

SEQ ID NO: 447724 - DNA, 15 bp, Homo sapiens
gttatttgtaatgat

SEQ ID NO: 447725 - DNA, 15 bp, Homo sapiens
ttatttgtaatgatt

SEQ ID NO: 447726 - DNA, 15 bp, Homo sapiens
tatttgtaatgattc

SEQ ID NO: 447727 - DNA, 15 bp, Homo sapiens
atttgtaatgattct

SEQ ID NO: 447728 - DNA, 15 bp, Homo sapiens
tttgtaatgattcta

SEQ ID NO: 447729 - DNA, 15 bp, Homo sapiens
ttgtaatgattctaa

SEQ ID NO: 447730 - DNA, 15 bp, Homo sapiens
tgtaatgattctaat

SEQ ID NO: 447731 - DNA, 15 bp, Homo sapiens
gtaatgattctaatg

SEQ ID NO: 447732 - DNA, 15 bp, Homo sapiens
taatgattctaatga

SEQ ID NO: 447733 - DNA, 15 bp, Homo sapiens
aatgattctaatgat

SEQ ID NO: 447734 - DNA, 15 bp, Homo sapiens
atgattctaatgata

SEQ ID NO: 447735 - DNA, 15 bp, Homo sapiens
tgattctaatgatag

SEQ ID NO: 447736 - DNA, 15 bp, Homo sapiens
gattctaatgataga

SEQ ID NO: 447737 - DNA, 15 bp, Homo sapiens
attctaatgatagac

SEQ ID NO: 447738 - DNA, 15 bp, Homo sapiens
ttctaatgatagacc

SEQ ID NO: 447739 - DNA, 15 bp, Homo sapiens
tctaatgatagacca

SEQ ID NO: 447740 - DNA, 15 bp, Homo sapiens
ctaatgatagaccat

SEQ ID NO: 447741 - DNA, 15 bp, Homo sapiens
taatgatagaccatg

SEQ ID NO: 447742 - DNA, 15 bp, Homo sapiens
aatgatagaccatgg

SEQ ID NO: 447743 - DNA, 15 bp, Homo sapiens
atgatagaccatgga

SEQ ID NO: 447744 - DNA, 15 bp, Homo sapiens
tgatagaccatggac

SEQ ID NO: 447745 - DNA, 15 bp, Homo sapiens
gatagaccatggact

SEQ ID NO: 447746 - DNA, 15 bp, Homo sapiens
atagaccatggactc

SEQ ID NO: 447747 - DNA, 15 bp, Homo sapiens
tagaccatggactca

SEQ ID NO: 447748 - DNA, 15 bp, Homo sapiens
agaccatggactcaa

SEQ ID NO: 447749 - DNA, 15 bp, Homo sapiens
gaccatggactcaaa

SEQ ID NO: 447750 - DNA, 15 bp, Homo sapiens
accatggactcaaat

SEQ ID NO: 447751 - DNA, 15 bp, Homo sapiens
ccatggactcaaatt

SEQ ID NO: 447752 - DNA, 15 bp, Homo sapiens
catggactcaaattt

SEQ ID NO: 447753 - DNA, 15 bp, Homo sapiens
atggactcaaatttg

SEQ ID NO: 447754 - DNA, 15 bp, Homo sapiens
tggactcaaatttgg

SEQ ID NO: 447755 - DNA, 15 bp, Homo sapiens
ggactcaaatttgga

SEQ ID NO: 447756 - DNA, 15 bp, Homo sapiens
gactcaaatttggac

SEQ ID NO: 447757 - DNA, 15 bp, Homo sapiens
actcaaatttggaca

SEQ ID NO: 447758 - DNA, 15 bp, Homo sapiens
ctcaaatttggacag

SEQ ID NO: 447759 - DNA, 15 bp, Homo sapiens
tcaaatttggacaga

SEQ ID NO: 447760 - DNA, 15 bp, Homo sapiens
caaatttggacagat

SEQ ID NO: 447761 - DNA, 15 bp, Homo sapiens
aaatttggacagatt

SEQ ID NO: 447762 - DNA, 15 bp, Homo sapiens
aatttggacagattc

SEQ ID NO: 447763 - DNA, 15 bp, Homo sapiens
atttggacagattca

SEQ ID NO: 447764 - DNA, 15 bp, Homo sapiens
tttggacagattcat

SEQ ID NO: 447765 - DNA, 15 bp, Homo sapiens
ttggacagattcatc

SEQ ID NO: 447766 - DNA, 15 bp, Homo sapiens
tggacagattcatca

SEQ ID NO: 447767 - DNA, 15 bp, Homo sapiens
ggacagattcatcaa

SEQ ID NO: 447768 - DNA, 15 bp, Homo sapiens
gacagattcatcaag

SEQ ID NO: 447769 - DNA, 15 bp, Homo sapiens
acagattcatcaaga

SEQ ID NO: 447770 - DNA, 15 bp, Homo sapiens
cagattcatcaagaa

SEQ ID NO: 447771 - DNA, 15 bp, Homo sapiens
agattcatcaagaaa

SEQ ID NO: 447772 - DNA, 15 bp, Homo sapiens
gattcatcaagaaat

SEQ ID NO: 447773 - DNA, 15 bp, Homo sapiens
attcatcaagaaata

SEQ ID NO: 447774 - DNA, 15 bp, Homo sapiens
ttcatcaagaaatat

SEQ ID NO: 447775 - DNA, 15 bp, Homo sapiens
tcatcaagaaatatt

SEQ ID NO: 447776 - DNA, 15 bp, Homo sapiens
catcaagaaatattt

SEQ ID NO: 447777 - DNA, 15 bp, Homo sapiens
atcaagaaatatttt

SEQ ID NO: 447778 - DNA, 15 bp, Homo sapiens
tcaagaaatatttta

SEQ ID NO: 447779 - DNA, 15 bp, Homo sapiens
caagaaatattttaa

SEQ ID NO: 447780 - DNA, 15 bp, Homo sapiens
gaaatattttaaaac

SEQ ID NO: 447781 - DNA, 15 bp, Homo sapiens
aaatattttaaaacc

SEQ ID NO: 447782 - DNA, 15 bp, Homo sapiens
aatattttaaaacct

SEQ ID NO: 447783 - DNA, 15 bp, Homo sapiens
atattttaaaacctt

SEQ ID NO: 447784 - DNA, 15 bp, Homo sapiens
tattttaaaacctta

SEQ ID NO: 447785 - DNA, 15 bp, Homo sapiens
attttaaaaccttaa

SEQ ID NO: 447786 - DNA, 15 bp, Homo sapiens
ttttaaaaccttaat

SEQ ID NO: 447787 - DNA, 15 bp, Homo sapiens
tttaaaaccttaatt

SEQ ID NO: 447788 - DNA, 15 bp, Homo sapiens
ttaaaaccttaatta

SEQ ID NO: 447789 - DNA, 15 bp, Homo sapiens
taaaaccttaattat

SEQ ID NO: 447790 - DNA, 15 bp, Homo sapiens
aaaaccttaattatg

SEQ ID NO: 447791 - DNA, 15 bp, Homo sapiens
aaaccttaattatgc

SEQ ID NO: 447792 - DNA, 15 bp, Homo sapiens
aaccttaattatgca

SEQ ID NO: 447793 - DNA, 15 bp, Homo sapiens
accttaattatgcaa

SEQ ID NO: 447794 - DNA, 15 bp, Homo sapiens
ccttaattatgcaaa

SEQ ID NO: 447795 - DNA, 15 bp, Homo sapiens
cttaattatgcaaat

SEQ ID NO: 447796 - DNA, 15 bp, Homo sapiens
ttaattatgcaaata

SEQ ID NO: 447797 - DNA, 15 bp, Homo sapiens
taattatgcaaatat

SEQ ID NO: 447798 - DNA, 15 bp, Homo sapiens
aattatgcaaatata

SEQ ID NO: 447799 - DNA, 15 bp, Homo sapiens
attatgcaaatatac

SEQ ID NO: 447800 - DNA, 15 bp, Homo sapiens
ttatgcaaatatact

SEQ ID NO: 447801 - DNA, 15 bp, Homo sapiens
tatgcaaatatactt

SEQ ID NO: 447802 - DNA, 15 bp, Homo sapiens
atgcaaatatacttc

SEQ ID NO: 447803 - DNA, 15 bp, Homo sapiens
tgcaaatatacttcc

SEQ ID NO: 447804 - DNA, 15 bp, Homo sapiens
gcaaatatacttcca

SEQ ID NO: 447805 - DNA, 15 bp, Homo sapiens
caaatatacttccat

SEQ ID NO: 447806 - DNA, 15 bp, Homo sapiens
aaatatacttccata

SEQ ID NO: 447807 - DNA, 15 bp, Homo sapiens
aatatacttccatat

SEQ ID NO: 447808 - DNA, 15 bp, Homo sapiens
atatacttccatatc

SEQ ID NO: 447809 - DNA, 15 bp, Homo sapiens
tatacttccatatca

SEQ ID NO: 447810 - DNA, 15 bp, Homo sapiens
atacttccatatcaa

SEQ ID NO: 447811 - DNA, 15 bp, Homo sapiens
tacttccatatcaag

SEQ ID NO: 447812 - DNA, 15 bp, Homo sapiens
acttccatatcaaga

SEQ ID NO: 447813 - DNA, 15 bp, Homo sapiens
cttccatatcaagag

SEQ ID NO: 447814 - DNA, 15 bp, Homo sapiens
ttccatatcaagagc

SEQ ID NO: 447815 - DNA, 15 bp, Homo sapiens
tccatatcaagagct

SEQ ID NO: 447816 - DNA, 15 bp, Homo sapiens
ccatatcaagagctt

SEQ ID NO: 447817 - DNA, 15 bp, Homo sapiens
catatcaagagctta

SEQ ID NO: 447818 - DNA, 15 bp, Homo sapiens
atatcaagagcttag

SEQ ID NO: 447819 - DNA, 15 bp, Homo sapiens
tatcaagagcttagc

SEQ ID NO: 447820 - DNA, 15 bp, Homo sapiens
atcaagagcttagct

SEQ ID NO: 447821 - DNA, 15 bp, Homo sapiens
tcaagagcttagctt

SEQ ID NO: 447822 - DNA, 15 bp, Homo sapiens
caagagcttagctta

SEQ ID NO: 447823 - DNA, 15 bp, Homo sapiens
aagagcttagcttaa

SEQ ID NO: 447824 - DNA, 15 bp, Homo sapiens
agagcttagcttaaa

SEQ ID NO: 447825 - DNA, 15 bp, Homo sapiens
gagcttagcttaaaa

SEQ ID NO: 447826 - DNA, 15 bp, Homo sapiens
agcttagcttaaaat

SEQ ID NO: 447827 - DNA, 15 bp, Homo sapiens
gcttagcttaaaatg

SEQ ID NO: 447828 - DNA, 15 bp, Homo sapiens
cttagcttaaaatga

SEQ ID NO: 447829 - DNA, 15 bp, Homo sapiens
ttagcttaaaatgag

SEQ ID NO: 447830 - DNA, 15 bp, Homo sapiens
tagcttaaaatgaga

SEQ ID NO: 447831 - DNA, 15 bp, Homo sapiens
agcttaaaatgagac

SEQ ID NO: 447832 - DNA, 15 bp, Homo sapiens
gcttaaaatgagact

SEQ ID NO: 447833 - DNA, 15 bp, Homo sapiens
cttaaaatgagacta

SEQ ID NO: 447834 - DNA, 15 bp, Homo sapiens
ttaaaatgagactat

SEQ ID NO: 447835 - DNA, 15 bp, Homo sapiens
taaaatgagactatc

SEQ ID NO: 447836 - DNA, 15 bp, Homo sapiens
aaaatgagactatct

SEQ ID NO: 447837 - DNA, 15 bp, Homo sapiens
aaatgagactatctc

SEQ ID NO: 447838 - DNA, 15 bp, Homo sapiens
aatgagactatctct

SEQ ID NO: 447839 - DNA, 15 bp, Homo sapiens
atgagactatctctg

SEQ ID NO: 447840 - DNA, 15 bp, Homo sapiens
tgagactatctctgt

SEQ ID NO: 447841 - DNA, 15 bp, Homo sapiens
gagactatctctgtt

SEQ ID NO: 447842 - DNA, 15 bp, Homo sapiens
gactatctctgttta

SEQ ID NO: 447843 - DNA, 15 bp, Homo sapiens
actatctctgtttaa

SEQ ID NO: 447844 - DNA, 15 bp, Homo sapiens
ctatctctgtttaaa

SEQ ID NO: 447845 - DNA, 15 bp, Homo sapiens
tatctctgtttaaat

SEQ ID NO: 447846 - DNA, 15 bp, Homo sapiens
atctctgtttaaatc

SEQ ID NO: 447847 - DNA, 15 bp, Homo sapiens
tctctgtttaaatcc

SEQ ID NO: 447848 - DNA, 15 bp, Homo sapiens
ctctgtttaaatccc

SEQ ID NO: 447849 - DNA, 15 bp, Homo sapiens
tctgtttaaatccca

SEQ ID NO: 447850 - DNA, 15 bp, Homo sapiens
ctgtttaaatcccat

SEQ ID NO: 447851 - DNA, 15 bp, Homo sapiens
tgtttaaatcccatt

SEQ ID NO: 447852 - DNA, 15 bp, Homo sapiens
gtttaaatcccattt

SEQ ID NO: 447853 - DNA, 15 bp, Homo sapiens
tttaaatcccatttc

SEQ ID NO: 447854 - DNA, 15 bp, Homo sapiens
ttaaatcccatttct

SEQ ID NO: 447855 - DNA, 15 bp, Homo sapiens
taaatcccatttcta

SEQ ID NO: 447856 - DNA, 15 bp, Homo sapiens
aaatcccatttctat

SEQ ID NO: 447857 - DNA, 15 bp, Homo sapiens
aatcccatttctatt

SEQ ID NO: 447858 - DNA, 15 bp, Homo sapiens
atcccatttctatta

SEQ ID NO: 447859 - DNA, 15 bp, Homo sapiens
tcccatttctattac

SEQ ID NO: 447860 - DNA, 15 bp, Homo sapiens
cccatttctattact

SEQ ID NO: 447861 - DNA, 15 bp, Homo sapiens
ccatttctattactt

SEQ ID NO: 447862 - DNA, 15 bp, Homo sapiens
catttctattactta

SEQ ID NO: 447863 - DNA, 15 bp, Homo sapiens
atttctattacttac

SEQ ID NO: 447864 - DNA, 15 bp, Homo sapiens
ttctattacttacta

SEQ ID NO: 447865 - DNA, 15 bp, Homo sapiens
tctattacttactat

SEQ ID NO: 447866 - DNA, 15 bp, Homo sapiens
ctattacttactata

SEQ ID NO: 447867 - DNA, 15 bp, Homo sapiens
tattacttactatag

SEQ ID NO: 447868 - DNA, 15 bp, Homo sapiens
attacttactatagg

SEQ ID NO: 447869 - DNA, 15 bp, Homo sapiens
ttacttactatagga

SEQ ID NO: 447870 - DNA, 15 bp, Homo sapiens
tacttactataggac

SEQ ID NO: 447871 - DNA, 15 bp, Homo sapiens
acttactataggacc

SEQ ID NO: 447872 - DNA, 15 bp, Homo sapiens
cttactataggacct

SEQ ID NO: 447873 - DNA, 15 bp, Homo sapiens
ttactataggacctc

SEQ ID NO: 447874 - DNA, 15 bp, Homo sapiens
tactataggacctca

SEQ ID NO: 447875 - DNA, 15 bp, Homo sapiens
actataggacctcag

SEQ ID NO: 447876 - DNA, 15 bp, Homo sapiens
ctataggacctcaga

SEQ ID NO: 447877 - DNA, 15 bp, Homo sapiens
tataggacctcagac

SEQ ID NO: 447878 - DNA, 15 bp, Homo sapiens
ataggacctcagaca

SEQ ID NO: 447879 - DNA, 15 bp, Homo sapiens
taggacctcagacaa

SEQ ID NO: 447880 - DNA, 15 bp, Homo sapiens
aggacctcagacaag

SEQ ID NO: 447881 - DNA, 15 bp, Homo sapiens
ggacctcagacaagc

SEQ ID NO: 447882 - DNA, 15 bp, Homo sapiens
gacctcagacaagct

SEQ ID NO: 447883 - DNA, 15 bp, Homo sapiens
acctcagacaagcta

SEQ ID NO: 447884 - DNA, 15 bp, Homo sapiens
cctcagacaagctat

SEQ ID NO: 447885 - DNA, 15 bp, Homo sapiens
ctcagacaagctatc

SEQ ID NO: 447886 - DNA, 15 bp, Homo sapiens
tcagacaagctatct

SEQ ID NO: 447887 - DNA, 15 bp, Homo sapiens
cagacaagctatcta

SEQ ID NO: 447888 - DNA, 15 bp, Homo sapiens
agacaagctatctaa

SEQ ID NO: 447889 - DNA, 15 bp, Homo sapiens
gacaagctatctaag

SEQ ID NO: 447890 - DNA, 15 bp, Homo sapiens
acaagctatctaagc

SEQ ID NO: 447891 - DNA, 15 bp, Homo sapiens
caagctatctaagca

SEQ ID NO: 447892 - DNA, 15 bp, Homo sapiens
aagctatctaagcac

SEQ ID NO: 447893 - DNA, 15 bp, Homo sapiens
agctatctaagcact

SEQ ID NO: 447894 - DNA, 15 bp, Homo sapiens
gctatctaagcactc

SEQ ID NO: 447895 - DNA, 15 bp, Homo sapiens
ctatctaagcactct

SEQ ID NO: 447896 - DNA, 15 bp, Homo sapiens
tatctaagcactctc

SEQ ID NO: 447897 - DNA, 15 bp, Homo sapiens
atctaagcactctct

SEQ ID NO: 447898 - DNA, 15 bp, Homo sapiens
tctaagcactctctg

SEQ ID NO: 447899 - DNA, 15 bp, Homo sapiens
ctaagcactctctgc

SEQ ID NO: 447900 - DNA, 15 bp, Homo sapiens
taagcactctctgcc

SEQ ID NO: 447901 - DNA, 15 bp, Homo sapiens
aagcactctctgccc

SEQ ID NO: 447902 - DNA, 15 bp, Homo sapiens
agcactctctgccct

SEQ ID NO: 447903 - DNA, 15 bp, Homo sapiens
gcactctctgcccta

SEQ ID NO: 447904 - DNA, 15 bp, Homo sapiens
cactctctgccctag

SEQ ID NO: 447905 - DNA, 15 bp, Homo sapiens
actctctgccctagt

SEQ ID NO: 447906 - DNA, 15 bp, Homo sapiens
ctctctgccctagtt

SEQ ID NO: 447907 - DNA, 15 bp, Homo sapiens
tctctgccctagttt

SEQ ID NO: 447908 - DNA, 15 bp, Homo sapiens
ctctgccctagtttt

SEQ ID NO: 447909 - DNA, 15 bp, Homo sapiens
tctgccctagttttt

SEQ ID NO: 447910 - DNA, 15 bp, Homo sapiens
ctgccctagtttttt

SEQ ID NO: 447911 - DNA, 15 bp, Homo sapiens
tgccctagttttttc

SEQ ID NO: 447912 - DNA, 15 bp, Homo sapiens
gccctagttttttcc

SEQ ID NO: 447913 - DNA, 15 bp, Homo sapiens
ccctagttttttcca

SEQ ID NO: 447914 - DNA, 15 bp, Homo sapiens
cctagttttttccat

SEQ ID NO: 447915 - DNA, 15 bp, Homo sapiens
ctagttttttccatc

SEQ ID NO: 447916 - DNA, 15 bp, Homo sapiens
tagttttttccatct

SEQ ID NO: 447917 - DNA, 15 bp, Homo sapiens
agttttttccatctg

SEQ ID NO: 447918 - DNA, 15 bp, Homo sapiens
gttttttccatctgt

SEQ ID NO: 447919 - DNA, 15 bp, Homo sapiens
ttttttccatctgta

SEQ ID NO: 447920 - DNA, 15 bp, Homo sapiens
tttttccatctgtaa

SEQ ID NO: 447921 - DNA, 15 bp, Homo sapiens
ttttccatctgtaag

SEQ ID NO: 447922 - DNA, 15 bp, Homo sapiens
tttccatctgtaaga

SEQ ID NO: 447923 - DNA, 15 bp, Homo sapiens
ttccatctgtaagat

SEQ ID NO: 447924 - DNA, 15 bp, Homo sapiens
tccatctgtaagatg

SEQ ID NO: 447925 - DNA, 15 bp, Homo sapiens
ccatctgtaagatgg

SEQ ID NO: 447926 - DNA, 15 bp, Homo sapiens
catctgtaagatgga

SEQ ID NO: 447927 - DNA, 15 bp, Homo sapiens
atctgtaagatggag

SEQ ID NO: 447928 - DNA, 15 bp, Homo sapiens
tctgtaagatggaga

SEQ ID NO: 447929 - DNA, 15 bp, Homo sapiens
ctgtaagatggagac

SEQ ID NO: 447930 - DNA, 15 bp, Homo sapiens
tgtaagatggagaca

SEQ ID NO: 447931 - DNA, 15 bp, Homo sapiens
gtaagatggagacaa

SEQ ID NO: 447932 - DNA, 15 bp, Homo sapiens
taagatggagacaat

SEQ ID NO: 447933 - DNA, 15 bp, Homo sapiens
aagatggagacaata

SEQ ID NO: 447934 - DNA, 15 bp, Homo sapiens
agatggagacaatat

SEQ ID NO: 447935 - DNA, 15 bp, Homo sapiens
gatggagacaatatt

SEQ ID NO: 447936 - DNA, 15 bp, Homo sapiens
atggagacaatattg

SEQ ID NO: 447937 - DNA, 15 bp, Homo sapiens
tggagacaatattgt

SEQ ID NO: 447938 - DNA, 15 bp, Homo sapiens
ggagacaatattgtc

SEQ ID NO: 447939 - DNA, 15 bp, Homo sapiens
gagacaatattgtca

SEQ ID NO: 447940 - DNA, 15 bp, Homo sapiens
agacaatattgtcac

SEQ ID NO: 447941 - DNA, 15 bp, Homo sapiens
gacaatattgtcacc

SEQ ID NO: 447942 - DNA, 15 bp, Homo sapiens
acaatattgtcaccc

SEQ ID NO: 447943 - DNA, 15 bp, Homo sapiens
caatattgtcaccca

SEQ ID NO: 447944 - DNA, 15 bp, Homo sapiens
aatattgtcacccaa

SEQ ID NO: 447945 - DNA, 15 bp, Homo sapiens
atattgtcacccaag

SEQ ID NO: 447946 - DNA, 15 bp, Homo sapiens
tattgtcacccaagt

SEQ ID NO: 447947 - DNA, 15 bp, Homo sapiens
attgtcacccaagtc

SEQ ID NO: 447948 - DNA, 15 bp, Homo sapiens
ttgtcacccaagtca

SEQ ID NO: 447949 - DNA, 15 bp, Homo sapiens
tgtcacccaagtcat

SEQ ID NO: 447950 - DNA, 15 bp, Homo sapiens
gtcacccaagtcata

SEQ ID NO: 447951 - DNA, 15 bp, Homo sapiens
tcacccaagtcatag

SEQ ID NO: 447952 - DNA, 15 bp, Homo sapiens
cacccaagtcataga

SEQ ID NO: 447953 - DNA, 15 bp, Homo sapiens
acccaagtcatagaa

SEQ ID NO: 447954 - DNA, 15 bp, Homo sapiens
cccaagtcatagaat

SEQ ID NO: 447955 - DNA, 15 bp, Homo sapiens
ccaagtcatagaatt

SEQ ID NO: 447956 - DNA, 15 bp, Homo sapiens
caagtcatagaattg

SEQ ID NO: 447957 - DNA, 15 bp, Homo sapiens
aagtcatagaattgt

SEQ ID NO: 447958 - DNA, 15 bp, Homo sapiens
agtcatagaattgta

SEQ ID NO: 447959 - DNA, 15 bp, Homo sapiens
gtcatagaattgtaa

SEQ ID NO: 447960 - DNA, 15 bp, Homo sapiens
tcatagaattgtaat

SEQ ID NO: 447961 - DNA, 15 bp, Homo sapiens
catagaattgtaatc

SEQ ID NO: 447962 - DNA, 15 bp, Homo sapiens
atagaattgtaatcc

SEQ ID NO: 447963 - DNA, 15 bp, Homo sapiens
tagaattgtaatcca

SEQ ID NO: 447964 - DNA, 15 bp, Homo sapiens
agaattgtaatccaa

SEQ ID NO: 447965 - DNA, 15 bp, Homo sapiens
gaattgtaatccaaa

SEQ ID NO: 447966 - DNA, 15 bp, Homo sapiens
aattgtaatccaaat

SEQ ID NO: 447967 - DNA, 15 bp, Homo sapiens
attgtaatccaaata

SEQ ID NO: 447968 - DNA, 15 bp, Homo sapiens
ttgtaatccaaatag

SEQ ID NO: 447969 - DNA, 15 bp, Homo sapiens
tgtaatccaaataga

SEQ ID NO: 447970 - DNA, 15 bp, Homo sapiens
gtaatccaaatagaa

SEQ ID NO: 447971 - DNA, 15 bp, Homo sapiens
taatccaaatagaat

SEQ ID NO: 447972 - DNA, 15 bp, Homo sapiens
aatccaaatagaatt

SEQ ID NO: 447973 - DNA, 15 bp, Homo sapiens
atccaaatagaattt

SEQ ID NO: 447974 - DNA, 15 bp, Homo sapiens
tccaaatagaattta

SEQ ID NO: 447975 - DNA, 15 bp, Homo sapiens
ccaaatagaatttac

SEQ ID NO: 447976 - DNA, 15 bp, Homo sapiens
caaatagaatttaca

SEQ ID NO: 447977 - DNA, 15 bp, Homo sapiens
aaatagaatttacac

SEQ ID NO: 447978 - DNA, 15 bp, Homo sapiens
aatagaatttacaca

SEQ ID NO: 447979 - DNA, 15 bp, Homo sapiens
atagaatttacacat

SEQ ID NO: 447980 - DNA, 15 bp, Homo sapiens
tagaatttacacata

SEQ ID NO: 447981 - DNA, 15 bp, Homo sapiens
agaatttacacatag

SEQ ID NO: 447982 - DNA, 15 bp, Homo sapiens
gaatttacacataga

SEQ ID NO: 447983 - DNA, 15 bp, Homo sapiens
aatttacacatagaa

SEQ ID NO: 447984 - DNA, 15 bp, Homo sapiens
atttacacatagaaa

SEQ ID NO: 447985 - DNA, 15 bp, Homo sapiens
tttacacatagaaaa

SEQ ID NO: 447986 - DNA, 15 bp, Homo sapiens
ttacacatagaaaaa

SEQ ID NO: 447987 - DNA, 15 bp, Homo sapiens
tacacatagaaaaag

SEQ ID NO: 447988 - DNA, 15 bp, Homo sapiens
acacatagaaaaagt

SEQ ID NO: 447989 - DNA, 15 bp, Homo sapiens
cacatagaaaaagtt

SEQ ID NO: 447990 - DNA, 15 bp, Homo sapiens
acatagaaaaagttt

SEQ ID NO: 447991 - DNA, 15 bp, Homo sapiens
catagaaaaagttta

SEQ ID NO: 447992 - DNA, 15 bp, Homo sapiens
atagaaaaagtttat

SEQ ID NO: 447993 - DNA, 15 bp, Homo sapiens
tagaaaaagtttatc

SEQ ID NO: 447994 - DNA, 15 bp, Homo sapiens
agaaaaagtttatcc

SEQ ID NO: 447995 - DNA, 15 bp, Homo sapiens
gaaaaagtttatcca

SEQ ID NO: 447996 - DNA, 15 bp, Homo sapiens
aaaaagtttatccaa

SEQ ID NO: 447997 - DNA, 15 bp, Homo sapiens
aaaagtttatccaaa

SEQ ID NO: 447998 - DNA, 15 bp, Homo sapiens
aaagtttatccaaaa

SEQ ID NO: 447999 - DNA, 15 bp, Homo sapiens
aagtttatccaaaaa

SEQ ID NO: 448000 - DNA, 15 bp, Homo sapiens
agtttatccaaaaaa

SEQ ID NO: 448001 - DNA, 15 bp, Homo sapiens
gtttatccaaaaaag

SEQ ID NO: 448002 - DNA, 15 bp, Homo sapiens
tttatccaaaaaagt

SEQ ID NO: 448003 - DNA, 15 bp, Homo sapiens
ttatccaaaaaagtt

SEQ ID NO: 448004 - DNA, 15 bp, Homo sapiens
tatccaaaaaagttt

SEQ ID NO: 448005 - DNA, 15 bp, Homo sapiens
atccaaaaaagttta

SEQ ID NO: 448006 - DNA, 15 bp, Homo sapiens
tccaaaaaagtttac

SEQ ID NO: 448007 - DNA, 15 bp, Homo sapiens
ccaaaaaagtttact

SEQ ID NO: 448008 - DNA, 15 bp, Homo sapiens
caaaaaagtttactt

SEQ ID NO: 448009 - DNA, 15 bp, Homo sapiens
aaaaaagtttacttg

SEQ ID NO: 448010 - DNA, 15 bp, Homo sapiens
aaaaagtttacttgg

SEQ ID NO: 448011 - DNA, 15 bp, Homo sapiens
aaaagtttacttggt

SEQ ID NO: 448012 - DNA, 15 bp, Homo sapiens
aaagtttacttggta

SEQ ID NO: 448013 - DNA, 15 bp, Homo sapiens
aagtttacttggtac

SEQ ID NO: 448014 - DNA, 15 bp, Homo sapiens
agtttacttggtaca

SEQ ID NO: 448015 - DNA, 15 bp, Homo sapiens
gtttacttggtacaa

SEQ ID NO: 448016 - DNA, 15 bp, Homo sapiens
tttacttggtacaaa

SEQ ID NO: 448017 - DNA, 15 bp, Homo sapiens
ttacttggtacaaat

SEQ ID NO: 448018 - DNA, 15 bp, Homo sapiens
tacttggtacaaatc

SEQ ID NO: 448019 - DNA, 15 bp, Homo sapiens
acttggtacaaatcg

SEQ ID NO: 448020 - DNA, 15 bp, Homo sapiens
cttggtacaaatcga

SEQ ID NO: 448021 - DNA, 15 bp, Homo sapiens
ttggtacaaatcgag

SEQ ID NO: 448022 - DNA, 15 bp, Homo sapiens
tggtacaaatcgagc

SEQ ID NO: 448023 - DNA, 15 bp, Homo sapiens
ggtacaaatcgagca

SEQ ID NO: 448024 - DNA, 15 bp, Homo sapiens
gtacaaatcgagcac

SEQ ID NO: 448025 - DNA, 15 bp, Homo sapiens
tacaaatcgagcact

SEQ ID NO: 448026 - DNA, 15 bp, Homo sapiens
acaaatcgagcactc

SEQ ID NO: 448027 - DNA, 15 bp, Homo sapiens
caaatcgagcactca

SEQ ID NO: 448028 - DNA, 15 bp, Homo sapiens
aaatcgagcactcaa

SEQ ID NO: 448029 - DNA, 15 bp, Homo sapiens
aatcgagcactcaaa

SEQ ID NO: 448030 - DNA, 15 bp, Homo sapiens
atcgagcactcaaat

SEQ ID NO: 448031 - DNA, 15 bp, Homo sapiens
tcgagcactcaaata

SEQ ID NO: 448032 - DNA, 15 bp, Homo sapiens
cgagcactcaaatag

SEQ ID NO: 448033 - DNA, 15 bp, Homo sapiens
gagcactcaaatagc

SEQ ID NO: 448034 - DNA, 15 bp, Homo sapiens
agcactcaaatagca

SEQ ID NO: 448035 - DNA, 15 bp, Homo sapiens
gcactcaaatagcat

SEQ ID NO: 448036 - DNA, 15 bp, Homo sapiens
cactcaaatagcatg

SEQ ID NO: 448037 - DNA, 15 bp, Homo sapiens
actcaaatagcatgt

SEQ ID NO: 448038 - DNA, 15 bp, Homo sapiens
ctcaaatagcatgtt

SEQ ID NO: 448039 - DNA, 15 bp, Homo sapiens
tcaaatagcatgtta

SEQ ID NO: 448040 - DNA, 15 bp, Homo sapiens
caaatagcatgttat

SEQ ID NO: 448041 - DNA, 15 bp, Homo sapiens
aaatagcatgttatt

SEQ ID NO: 448042 - DNA, 15 bp, Homo sapiens
aatagcatgttatta

SEQ ID NO: 448043 - DNA, 15 bp, Homo sapiens
atagcatgttattac

SEQ ID NO: 448044 - DNA, 15 bp, Homo sapiens
tagcatgttattact

SEQ ID NO: 448045 - DNA, 15 bp, Homo sapiens
agcatgttattactg

SEQ ID NO: 448046 - DNA, 15 bp, Homo sapiens
gcatgttattactgt

SEQ ID NO: 448047 - DNA, 15 bp, Homo sapiens
catgttattactgtg

SEQ ID NO: 448048 - DNA, 15 bp, Homo sapiens
atgttattactgtga

SEQ ID NO: 448049 - DNA, 15 bp, Homo sapiens
tgttattactgtgat

SEQ ID NO: 448050 - DNA, 15 bp, Homo sapiens
gttattactgtgatt

SEQ ID NO: 448051 - DNA, 15 bp, Homo sapiens
ttattactgtgatta

SEQ ID NO: 448052 - DNA, 15 bp, Homo sapiens
tattactgtgattaa

SEQ ID NO: 448053 - DNA, 15 bp, Homo sapiens
attactgtgattaat

SEQ ID NO: 448054 - DNA, 15 bp, Homo sapiens
ttactgtgattaata

SEQ ID NO: 448055 - DNA, 15 bp, Homo sapiens
tactgtgattaatat

SEQ ID NO: 448056 - DNA, 15 bp, Homo sapiens
actgtgattaatata

SEQ ID NO: 448057 - DNA, 15 bp, Homo sapiens
ctgtgattaatatac

SEQ ID NO: 448058 - DNA, 15 bp, Homo sapiens
tgtgattaatataca

SEQ ID NO: 448059 - DNA, 15 bp, Homo sapiens
gtgattaatatacat

SEQ ID NO: 448060 - DNA, 15 bp, Homo sapiens
tgattaatatacatc

SEQ ID NO: 448061 - DNA, 15 bp, Homo sapiens
gattaatatacatcc

SEQ ID NO: 448062 - DNA, 15 bp, Homo sapiens
attaatatacatcct

SEQ ID NO: 448063 - DNA, 15 bp, Homo sapiens
ttaatatacatcctg

SEQ ID NO: 448064 - DNA, 15 bp, Homo sapiens
taatatacatcctga

SEQ ID NO: 448065 - DNA, 15 bp, Homo sapiens
aatatacatcctgac

SEQ ID NO: 448066 - DNA, 15 bp, Homo sapiens
atatacatcctgacc

SEQ ID NO: 448067 - DNA, 15 bp, Homo sapiens
tatacatcctgacct

SEQ ID NO: 448068 - DNA, 15 bp, Homo sapiens
atacatcctgaccta

SEQ ID NO: 448069 - DNA, 15 bp, Homo sapiens
tacatcctgacctag

SEQ ID NO: 448070 - DNA, 15 bp, Homo sapiens
acatcctgacctagt

SEQ ID NO: 448071 - DNA, 15 bp, Homo sapiens
catcctgacctagta

SEQ ID NO: 448072 - DNA, 15 bp, Homo sapiens
atcctgacctagtat

SEQ ID NO: 448073 - DNA, 15 bp, Homo sapiens
tcctgacctagtata

SEQ ID NO: 448074 - DNA, 15 bp, Homo sapiens
cctgacctagtatat

SEQ ID NO: 448075 - DNA, 15 bp, Homo sapiens
ctgacctagtatatt

SEQ ID NO: 448076 - DNA, 15 bp, Homo sapiens
tgacctagtatattt

SEQ ID NO: 448077 - DNA, 15 bp, Homo sapiens
gacctagtatatttt

SEQ ID NO: 448078 - DNA, 15 bp, Homo sapiens
acctagtatatttta

SEQ ID NO: 448079 - DNA, 15 bp, Homo sapiens
cctagtatattttac

SEQ ID NO: 448080 - DNA, 15 bp, Homo sapiens
ctagtatattttact

SEQ ID NO: 448081 - DNA, 15 bp, Homo sapiens
tagtatattttactt

SEQ ID NO: 448082 - DNA, 15 bp, Homo sapiens
agtatattttacttt

SEQ ID NO: 448083 - DNA, 15 bp, Homo sapiens
gtatattttactttg

SEQ ID NO: 448084 - DNA, 15 bp, Homo sapiens
tatattttactttgc

SEQ ID NO: 448085 - DNA, 15 bp, Homo sapiens
atattttactttgca

SEQ ID NO: 448086 - DNA, 15 bp, Homo sapiens
tattttactttgcac

SEQ ID NO: 448087 - DNA, 15 bp, Homo sapiens
attttactttgcaca

SEQ ID NO: 448088 - DNA, 15 bp, Homo sapiens
ttttactttgcacag

SEQ ID NO: 448089 - DNA, 15 bp, Homo sapiens
tttactttgcacagc

SEQ ID NO: 448090 - DNA, 15 bp, Homo sapiens
ttactttgcacagca

SEQ ID NO: 448091 - DNA, 15 bp, Homo sapiens
tactttgcacagcaa

SEQ ID NO: 448092 - DNA, 15 bp, Homo sapiens
actttgcacagcaaa

SEQ ID NO: 448093 - DNA, 15 bp, Homo sapiens
ctttgcacagcaaag

SEQ ID NO: 448094 - DNA, 15 bp, Homo sapiens
tttgcacagcaaaga

SEQ ID NO: 448095 - DNA, 15 bp, Homo sapiens
ttgcacagcaaagaa

SEQ ID NO: 448096 - DNA, 15 bp, Homo sapiens
tgcacagcaaagaag

SEQ ID NO: 448097 - DNA, 15 bp, Homo sapiens
gcacagcaaagaaga

SEQ ID NO: 448098 - DNA, 15 bp, Homo sapiens
cacagcaaagaagaa

SEQ ID NO: 448099 - DNA, 15 bp, Homo sapiens
acagcaaagaagaaa

SEQ ID NO: 448100 - DNA, 15 bp, Homo sapiens
cagcaaagaagaaat

SEQ ID NO: 448101 - DNA, 15 bp, Homo sapiens
agcaaagaagaaata

SEQ ID NO: 448102 - DNA, 15 bp, Homo sapiens
gcaaagaagaaatat

SEQ ID NO: 448103 - DNA, 15 bp, Homo sapiens
caaagaagaaatatt

SEQ ID NO: 448104 - DNA, 15 bp, Homo sapiens
aaagaagaaatattt

SEQ ID NO: 448105 - DNA, 15 bp, Homo sapiens
aagaagaaatatttt

SEQ ID NO: 448106 - DNA, 15 bp, Homo sapiens
gaagaaatatttttt

SEQ ID NO: 448107 - DNA, 15 bp, Homo sapiens
aagaaatattttttt

SEQ ID NO: 448108 - DNA, 15 bp, Homo sapiens
agaaatatttttttc

SEQ ID NO: 448109 - DNA, 15 bp, Homo sapiens
gaaatatttttttct

SEQ ID NO: 448110 - DNA, 15 bp, Homo sapiens
aaatatttttttctt

SEQ ID NO: 448111 - DNA, 15 bp, Homo sapiens
aatatttttttcttt

SEQ ID NO: 448112 - DNA, 15 bp, Homo sapiens
atatttttttctttg

SEQ ID NO: 448113 - DNA, 15 bp, Homo sapiens
tatttttttctttga

SEQ ID NO: 448114 - DNA, 15 bp, Homo sapiens
atttttttctttgat

SEQ ID NO: 448115 - DNA, 15 bp, Homo sapiens
tttttttctttgatt

SEQ ID NO: 448116 - DNA, 15 bp, Homo sapiens
ttttttctttgattg

SEQ ID NO: 448117 - DNA, 15 bp, Homo sapiens
tttttctttgattgt

SEQ ID NO: 448118 - DNA, 15 bp, Homo sapiens
ttttctttgattgtc

SEQ ID NO: 448119 - DNA, 15 bp, Homo sapiens
tttctttgattgtct

SEQ ID NO: 448120 - DNA, 15 bp, Homo sapiens
ttctttgattgtctt

SEQ ID NO: 448121 - DNA, 15 bp, Homo sapiens
tctttgattgtctta

SEQ ID NO: 448122 - DNA, 15 bp, Homo sapiens
ctttgattgtcttat

SEQ ID NO: 448123 - DNA, 15 bp, Homo sapiens
tttgattgtcttatc

SEQ ID NO: 448124 - DNA, 15 bp, Homo sapiens
ttgattgtcttatct

SEQ ID NO: 448125 - DNA, 15 bp, Homo sapiens
tgattgtcttatctc

SEQ ID NO: 448126 - DNA, 15 bp, Homo sapiens
gattgtcttatctca

SEQ ID NO: 448127 - DNA, 15 bp, Homo sapiens
attgtcttatctcag

SEQ ID NO: 448128 - DNA, 15 bp, Homo sapiens
ttgtcttatctcaga

SEQ ID NO: 448129 - DNA, 15 bp, Homo sapiens
tgtcttatctcagag

SEQ ID NO: 448130 - DNA, 15 bp, Homo sapiens
gtcttatctcagagc

SEQ ID NO: 448131 - DNA, 15 bp, Homo sapiens
tcttatctcagagca

SEQ ID NO: 448132 - DNA, 15 bp, Homo sapiens
cttatctcagagcaa

SEQ ID NO: 448133 - DNA, 15 bp, Homo sapiens
ttatctcagagcaat

SEQ ID NO: 448134 - DNA, 15 bp, Homo sapiens
tatctcagagcaata

SEQ ID NO: 448135 - DNA, 15 bp, Homo sapiens
atctcagagcaatat

SEQ ID NO: 448136 - DNA, 15 bp, Homo sapiens
tctcagagcaatata

SEQ ID NO: 448137 - DNA, 15 bp, Homo sapiens
ctcagagcaatatac

SEQ ID NO: 448138 - DNA, 15 bp, Homo sapiens
tcagagcaatataca

SEQ ID NO: 448139 - DNA, 15 bp, Homo sapiens
cagagcaatatacat

SEQ ID NO: 448140 - DNA, 15 bp, Homo sapiens
agagcaatatacata

SEQ ID NO: 448141 - DNA, 15 bp, Homo sapiens
gagcaatatacatag

SEQ ID NO: 448142 - DNA, 15 bp, Homo sapiens
agcaatatacatagt

SEQ ID NO: 448143 - DNA, 15 bp, Homo sapiens
gcaatatacatagtt

SEQ ID NO: 448144 - DNA, 15 bp, Homo sapiens
caatatacatagttc

SEQ ID NO: 448145 - DNA, 15 bp, Homo sapiens
aatatacatagttct

SEQ ID NO: 448146 - DNA, 15 bp, Homo sapiens
atatacatagttctt

SEQ ID NO: 448147 - DNA, 15 bp, Homo sapiens
tatacatagttcttg

SEQ ID NO: 448148 - DNA, 15 bp, Homo sapiens
atacatagttcttgt

SEQ ID NO: 448149 - DNA, 15 bp, Homo sapiens
tacatagttcttgtc

SEQ ID NO: 448150 - DNA, 15 bp, Homo sapiens
acatagttcttgtcc

SEQ ID NO: 448151 - DNA, 15 bp, Homo sapiens
catagttcttgtccc

SEQ ID NO: 448152 - DNA, 15 bp, Homo sapiens
atagttcttgtcccc

SEQ ID NO: 448153 - DNA, 15 bp, Homo sapiens
tagttcttgtcccca

SEQ ID NO: 448154 - DNA, 15 bp, Homo sapiens
agttcttgtccccac

SEQ ID NO: 448155 - DNA, 15 bp, Homo sapiens
gttcttgtccccaca

SEQ ID NO: 448156 - DNA, 15 bp, Homo sapiens
ttcttgtccccacat

SEQ ID NO: 448157 - DNA, 15 bp, Homo sapiens
tcttgtccccacatt

SEQ ID NO: 448158 - DNA, 15 bp, Homo sapiens
cttgtccccacattt

SEQ ID NO: 448159 - DNA, 15 bp, Homo sapiens
ttgtccccacatttg

SEQ ID NO: 448160 - DNA, 15 bp, Homo sapiens
tgtccccacatttgt

SEQ ID NO: 448161 - DNA, 15 bp, Homo sapiens
gtccccacatttgta

SEQ ID NO: 448162 - DNA, 15 bp, Homo sapiens
tccccacatttgtat

SEQ ID NO: 448163 - DNA, 15 bp, Homo sapiens
ccccacatttgtatt

SEQ ID NO: 448164 - DNA, 15 bp, Homo sapiens
cccacatttgtattt

SEQ ID NO: 448165 - DNA, 15 bp, Homo sapiens
ccacatttgtatttt

SEQ ID NO: 448166 - DNA, 15 bp, Homo sapiens
cacatttgtattttt

SEQ ID NO: 448167 - DNA, 15 bp, Homo sapiens
acatttgtattttta

SEQ ID NO: 448168 - DNA, 15 bp, Homo sapiens
catttgtatttttac

SEQ ID NO: 448169 - DNA, 15 bp, Homo sapiens
atttgtatttttact

SEQ ID NO: 448170 - DNA, 15 bp, Homo sapiens
tttgtatttttactt

SEQ ID NO: 448171 - DNA, 15 bp, Homo sapiens
ttgtatttttactta

SEQ ID NO: 448172 - DNA, 15 bp, Homo sapiens
tgtatttttacttat

SEQ ID NO: 448173 - DNA, 15 bp, Homo sapiens
gtatttttacttatc

SEQ ID NO: 448174 - DNA, 15 bp, Homo sapiens
tatttttacttatct

SEQ ID NO: 448175 - DNA, 15 bp, Homo sapiens
atttttacttatctt

SEQ ID NO: 448176 - DNA, 15 bp, Homo sapiens
tttttacttatcttt

SEQ ID NO: 448177 - DNA, 15 bp, Homo sapiens
ttttacttatcttta

SEQ ID NO: 448178 - DNA, 15 bp, Homo sapiens
tttacttatctttag

SEQ ID NO: 448179 - DNA, 15 bp, Homo sapiens
ttacttatctttagt

SEQ ID NO: 448180 - DNA, 15 bp, Homo sapiens
tacttatctttagtt

SEQ ID NO: 448181 - DNA, 15 bp, Homo sapiens
acttatctttagttt

SEQ ID NO: 448182 - DNA, 15 bp, Homo sapiens
cttatctttagtttt

SEQ ID NO: 448183 - DNA, 15 bp, Homo sapiens
ttatctttagttttg

SEQ ID NO: 448184 - DNA, 15 bp, Homo sapiens
tatctttagttttgt

SEQ ID NO: 448185 - DNA, 15 bp, Homo sapiens
atctttagttttgtt

SEQ ID NO: 448186 - DNA, 15 bp, Homo sapiens
tctttagttttgttc

SEQ ID NO: 448187 - DNA, 15 bp, Homo sapiens
ctttagttttgttct

SEQ ID NO: 448188 - DNA, 15 bp, Homo sapiens
tttagttttgttctg

SEQ ID NO: 448189 - DNA, 15 bp, Homo sapiens
ttagttttgttctgt

SEQ ID NO: 448190 - DNA, 15 bp, Homo sapiens
tagttttgttctgtt

SEQ ID NO: 448191 - DNA, 15 bp, Homo sapiens
agttttgttctgtta

SEQ ID NO: 448192 - DNA, 15 bp, Homo sapiens
gttttgttctgttat

SEQ ID NO: 448193 - DNA, 15 bp, Homo sapiens
ttttgttctgttata

SEQ ID NO: 448194 - DNA, 15 bp, Homo sapiens
tttgttctgttatat

SEQ ID NO: 448195 - DNA, 15 bp, Homo sapiens
ttgttctgttatatg

SEQ ID NO: 448196 - DNA, 15 bp, Homo sapiens
tgttctgttatatgc

SEQ ID NO: 448197 - DNA, 15 bp, Homo sapiens
gttctgttatatgcc

SEQ ID NO: 448198 - DNA, 15 bp, Homo sapiens
ttctgttatatgcct

SEQ ID NO: 448199 - DNA, 15 bp, Homo sapiens
tctgttatatgcctt

SEQ ID NO: 448200 - DNA, 15 bp, Homo sapiens
ctgttatatgccttt

SEQ ID NO: 448201 - DNA, 15 bp, Homo sapiens
tgttatatgccttta

SEQ ID NO: 448202 - DNA, 15 bp, Homo sapiens
gttatatgcctttat

SEQ ID NO: 448203 - DNA, 15 bp, Homo sapiens
ttatatgcctttata

SEQ ID NO: 448204 - DNA, 15 bp, Homo sapiens
tatatgcctttataa

SEQ ID NO: 448205 - DNA, 15 bp, Homo sapiens
atatgcctttataat

SEQ ID NO: 448206 - DNA, 15 bp, Homo sapiens
tatgcctttataatt

SEQ ID NO: 448207 - DNA, 15 bp, Homo sapiens
atgcctttataatta

SEQ ID NO: 448208 - DNA, 15 bp, Homo sapiens
tgcctttataattat

SEQ ID NO: 448209 - DNA, 15 bp, Homo sapiens
gcctttataattata

SEQ ID NO: 448210 - DNA, 15 bp, Homo sapiens
cctttataattataa

SEQ ID NO: 448211 - DNA, 15 bp, Homo sapiens
ctttataattataat

SEQ ID NO: 448212 - DNA, 15 bp, Homo sapiens
tttataattataatt

SEQ ID NO: 448213 - DNA, 15 bp, Homo sapiens
ttataattataattg

SEQ ID NO: 448214 - DNA, 15 bp, Homo sapiens
tataattataattgg

SEQ ID NO: 448215 - DNA, 15 bp, Homo sapiens
ataattataattgga

SEQ ID NO: 448216 - DNA, 15 bp, Homo sapiens
taattataattggaa

SEQ ID NO: 448217 - DNA, 15 bp, Homo sapiens
aattataattggaat

SEQ ID NO: 448218 - DNA, 15 bp, Homo sapiens
attataattggaatg

SEQ ID NO: 448219 - DNA, 15 bp, Homo sapiens
ttataattggaatgg

SEQ ID NO: 448220 - DNA, 15 bp, Homo sapiens
tataattggaatgga

SEQ ID NO: 448221 - DNA, 15 bp, Homo sapiens
ataattggaatggaa

SEQ ID NO: 448222 - DNA, 15 bp, Homo sapiens
taattggaatggaat

SEQ ID NO: 448223 - DNA, 15 bp, Homo sapiens
aattggaatggaatg

SEQ ID NO: 448224 - DNA, 15 bp, Homo sapiens
attggaatggaatga

SEQ ID NO: 448225 - DNA, 15 bp, Homo sapiens
ttggaatggaatgat

SEQ ID NO: 448226 - DNA, 15 bp, Homo sapiens
tggaatggaatgata

SEQ ID NO: 448227 - DNA, 15 bp, Homo sapiens
ggaatggaatgatat

SEQ ID NO: 448228 - DNA, 15 bp, Homo sapiens
gaatggaatgatata

SEQ ID NO: 448229 - DNA, 15 bp, Homo sapiens
aatggaatgatatat

SEQ ID NO: 448230 - DNA, 15 bp, Homo sapiens
atggaatgatatata

SEQ ID NO: 448231 - DNA, 15 bp, Homo sapiens
tggaatgatatataa

SEQ ID NO: 448232 - DNA, 15 bp, Homo sapiens
ggaatgatatataac

SEQ ID NO: 448233 - DNA, 15 bp, Homo sapiens
gaatgatatataaca

SEQ ID NO: 448234 - DNA, 15 bp, Homo sapiens
aatgatatataacaa

SEQ ID NO: 448235 - DNA, 15 bp, Homo sapiens
atgatatataacaaa

SEQ ID NO: 448236 - DNA, 15 bp, Homo sapiens
tgatatataacaaac

SEQ ID NO: 448237 - DNA, 15 bp, Homo sapiens
gatatataacaaacc

SEQ ID NO: 448238 - DNA, 15 bp, Homo sapiens
atatataacaaacct

SEQ ID NO: 448239 - DNA, 15 bp, Homo sapiens
tatataacaaacctc

SEQ ID NO: 448240 - DNA, 15 bp, Homo sapiens
atataacaaacctca

SEQ ID NO: 448241 - DNA, 15 bp, Homo sapiens
tataacaaacctcac

SEQ ID NO: 448242 - DNA, 15 bp, Homo sapiens
ataacaaacctcaca

SEQ ID NO: 448243 - DNA, 15 bp, Homo sapiens
taacaaacctcacaa

SEQ ID NO: 448244 - DNA, 15 bp, Homo sapiens
aacaaacctcacaaa

SEQ ID NO: 448245 - DNA, 15 bp, Homo sapiens
acaaacctcacaaaa

SEQ ID NO: 448246 - DNA, 15 bp, Homo sapiens
caaacctcacaaaat

SEQ ID NO: 448247 - DNA, 15 bp, Homo sapiens
aaacctcacaaaatc

SEQ ID NO: 448248 - DNA, 15 bp, Homo sapiens
aacctcacaaaatcc

SEQ ID NO: 448249 - DNA, 15 bp, Homo sapiens
acctcacaaaatcca

SEQ ID NO: 448250 - DNA, 15 bp, Homo sapiens
cctcacaaaatccag

SEQ ID NO: 448251 - DNA, 15 bp, Homo sapiens
ctcacaaaatccagt

SEQ ID NO: 448252 - DNA, 15 bp, Homo sapiens
tcacaaaatccagtt

SEQ ID NO: 448253 - DNA, 15 bp, Homo sapiens
cacaaaatccagtta

SEQ ID NO: 448254 - DNA, 15 bp, Homo sapiens
acaaaatccagttat

SEQ ID NO: 448255 - DNA, 15 bp, Homo sapiens
caaaatccagttata

SEQ ID NO: 448256 - DNA, 15 bp, Homo sapiens
aaaatccagttataa

SEQ ID NO: 448257 - DNA, 15 bp, Homo sapiens
aaatccagttataag

SEQ ID NO: 448258 - DNA, 15 bp, Homo sapiens
aatccagttataagc

SEQ ID NO: 448259 - DNA, 15 bp, Homo sapiens
atccagttataagca

SEQ ID NO: 448260 - DNA, 15 bp, Homo sapiens
tccagttataagcat

SEQ ID NO: 448261 - DNA, 15 bp, Homo sapiens
ccagttataagcata

SEQ ID NO: 448262 - DNA, 15 bp, Homo sapiens
cagttataagcataa

SEQ ID NO: 448263 - DNA, 15 bp, Homo sapiens
agttataagcataaa

SEQ ID NO: 448264 - DNA, 15 bp, Homo sapiens
gttataagcataaaa

SEQ ID NO: 448265 - DNA, 15 bp, Homo sapiens
ttataagcataaaat

SEQ ID NO: 448266 - DNA, 15 bp, Homo sapiens
tataagcataaaatt

SEQ ID NO: 448267 - DNA, 15 bp, Homo sapiens
ataagcataaaattg

SEQ ID NO: 448268 - DNA, 15 bp, Homo sapiens
taagcataaaattgg

SEQ ID NO: 448269 - DNA, 15 bp, Homo sapiens
aagcataaaattgga

SEQ ID NO: 448270 - DNA, 15 bp, Homo sapiens
agcataaaattggat

SEQ ID NO: 448271 - DNA, 15 bp, Homo sapiens
gcataaaattggata

SEQ ID NO: 448272 - DNA, 15 bp, Homo sapiens
cataaaattggatag

SEQ ID NO: 448273 - DNA, 15 bp, Homo sapiens
ataaaattggatagc

SEQ ID NO: 448274 - DNA, 15 bp, Homo sapiens
taaaattggatagct

SEQ ID NO: 448275 - DNA, 15 bp, Homo sapiens
aaaattggatagcta

SEQ ID NO: 448276 - DNA, 15 bp, Homo sapiens
aaattggatagctag

SEQ ID NO: 448277 - DNA, 15 bp, Homo sapiens
aattggatagctagt

SEQ ID NO: 448278 - DNA, 15 bp, Homo sapiens
attggatagctagta

SEQ ID NO: 448279 - DNA, 15 bp, Homo sapiens
ttggatagctagtaa

SEQ ID NO: 448280 - DNA, 15 bp, Homo sapiens
tggatagctagtaac

SEQ ID NO: 448281 - DNA, 15 bp, Homo sapiens
ggatagctagtaaca

SEQ ID NO: 448282 - DNA, 15 bp, Homo sapiens
gatagctagtaacaa

SEQ ID NO: 448283 - DNA, 15 bp, Homo sapiens
atagctagtaacaaa

SEQ ID NO: 448284 - DNA, 15 bp, Homo sapiens
tagctagtaacaaat

SEQ ID NO: 448285 - DNA, 15 bp, Homo sapiens
agctagtaacaaata

SEQ ID NO: 448286 - DNA, 15 bp, Homo sapiens
gctagtaacaaataa

SEQ ID NO: 448287 - DNA, 15 bp, Homo sapiens
ctagtaacaaataag

SEQ ID NO: 448288 - DNA, 15 bp, Homo sapiens
tagtaacaaataagt

SEQ ID NO: 448289 - DNA, 15 bp, Homo sapiens
agtaacaaataagta

SEQ ID NO: 448290 - DNA, 15 bp, Homo sapiens
gtaacaaataagtat

SEQ ID NO: 448291 - DNA, 15 bp, Homo sapiens
taacaaataagtata

SEQ ID NO: 448292 - DNA, 15 bp, Homo sapiens
aacaaataagtatat

SEQ ID NO: 448293 - DNA, 15 bp, Homo sapiens
acaaataagtatatt

SEQ ID NO: 448294 - DNA, 15 bp, Homo sapiens
caaataagtatattt

SEQ ID NO: 448295 - DNA, 15 bp, Homo sapiens
aaataagtatatttg

SEQ ID NO: 448296 - DNA, 15 bp, Homo sapiens
aataagtatatttgg

SEQ ID NO: 448297 - DNA, 15 bp, Homo sapiens
ataagtatatttggg

SEQ ID NO: 448298 - DNA, 15 bp, Homo sapiens
taagtatatttgggt

SEQ ID NO: 448299 - DNA, 15 bp, Homo sapiens
aagtatatttgggta

SEQ ID NO: 448300 - DNA, 15 bp, Homo sapiens
agtatatttgggtaa

SEQ ID NO: 448301 - DNA, 15 bp, Homo sapiens
gtatatttgggtaag

SEQ ID NO: 448302 - DNA, 15 bp, Homo sapiens
tatatttgggtaagt

SEQ ID NO: 448303 - DNA, 15 bp, Homo sapiens
atatttgggtaagtg

SEQ ID NO: 448304 - DNA, 15 bp, Homo sapiens
tatttgggtaagtgt

SEQ ID NO: 448305 - DNA, 15 bp, Homo sapiens
atttgggtaagtgtt

SEQ ID NO: 448306 - DNA, 15 bp, Homo sapiens
tttgggtaagtgtta

SEQ ID NO: 448307 - DNA, 15 bp, Homo sapiens
ttgggtaagtgttag

SEQ ID NO: 448308 - DNA, 15 bp, Homo sapiens
tgggtaagtgttagt

SEQ ID NO: 448309 - DNA, 15 bp, Homo sapiens
gggtaagtgttagtt

SEQ ID NO: 448310 - DNA, 15 bp, Homo sapiens
ggtaagtgttagttt

SEQ ID NO: 448311 - DNA, 15 bp, Homo sapiens
gtaagtgttagtttt

SEQ ID NO: 448312 - DNA, 15 bp, Homo sapiens
taagtgttagttttt

SEQ ID NO: 448313 - DNA, 15 bp, Homo sapiens
aagtgttagtttttg

SEQ ID NO: 448314 - DNA, 15 bp, Homo sapiens
agtgttagtttttgg

SEQ ID NO: 448315 - DNA, 15 bp, Homo sapiens
gtgttagtttttgga

SEQ ID NO: 448316 - DNA, 15 bp, Homo sapiens
tgttagtttttggag

SEQ ID NO: 448317 - DNA, 15 bp, Homo sapiens
gttagtttttggaga

SEQ ID NO: 448318 - DNA, 15 bp, Homo sapiens
ttagtttttggagaa

SEQ ID NO: 448319 - DNA, 15 bp, Homo sapiens
tagtttttggagaaa

SEQ ID NO: 448320 - DNA, 15 bp, Homo sapiens
agtttttggagaaac

SEQ ID NO: 448321 - DNA, 15 bp, Homo sapiens
gtttttggagaaaca

SEQ ID NO: 448322 - DNA, 15 bp, Homo sapiens
tttttggagaaacaa

SEQ ID NO: 448323 - DNA, 15 bp, Homo sapiens
ttttggagaaacaag

SEQ ID NO: 448324 - DNA, 15 bp, Homo sapiens
tttggagaaacaagt

SEQ ID NO: 448325 - DNA, 15 bp, Homo sapiens
ttggagaaacaagtt

SEQ ID NO: 448326 - DNA, 15 bp, Homo sapiens
tggagaaacaagttg

SEQ ID NO: 448327 - DNA, 15 bp, Homo sapiens
ggagaaacaagttgc

SEQ ID NO: 448328 - DNA, 15 bp, Homo sapiens
gagaaacaagttgcc

SEQ ID NO: 448329 - DNA, 15 bp, Homo sapiens
agaaacaagttgcct

SEQ ID NO: 448330 - DNA, 15 bp, Homo sapiens
gaaacaagttgcctt

SEQ ID NO: 448331 - DNA, 15 bp, Homo sapiens
aaacaagttgccttc

SEQ ID NO: 448332 - DNA, 15 bp, Homo sapiens
aacaagttgccttct

SEQ ID NO: 448333 - DNA, 15 bp, Homo sapiens
acaagttgccttctg

SEQ ID NO: 448334 - DNA, 15 bp, Homo sapiens
caagttgccttctga

SEQ ID NO: 448335 - DNA, 15 bp, Homo sapiens
aagttgccttctgat

SEQ ID NO: 448336 - DNA, 15 bp, Homo sapiens
agttgccttctgatc

SEQ ID NO: 448337 - DNA, 15 bp, Homo sapiens
gttgccttctgatca

SEQ ID NO: 448338 - DNA, 15 bp, Homo sapiens
ttgccttctgatcat

SEQ ID NO: 448339 - DNA, 15 bp, Homo sapiens
tgccttctgatcatc

SEQ ID NO: 448340 - DNA, 15 bp, Homo sapiens
gccttctgatcatcc

SEQ ID NO: 448341 - DNA, 15 bp, Homo sapiens
ccttctgatcatcct

SEQ ID NO: 448342 - DNA, 15 bp, Homo sapiens
cttctgatcatcctt

SEQ ID NO: 448343 - DNA, 15 bp, Homo sapiens
ttctgatcatccttt

SEQ ID NO: 448344 - DNA, 15 bp, Homo sapiens
tctgatcatccttta

SEQ ID NO: 448345 - DNA, 15 bp, Homo sapiens
ctgatcatcctttaa

SEQ ID NO: 448346 - DNA, 15 bp, Homo sapiens
tgatcatcctttaag

SEQ ID NO: 448347 - DNA, 15 bp, Homo sapiens
gatcatcctttaagg

SEQ ID NO: 448348 - DNA, 15 bp, Homo sapiens
atcatcctttaaggt

SEQ ID NO: 448349 - DNA, 15 bp, Homo sapiens
tcatcctttaaggtt

SEQ ID NO: 448350 - DNA, 15 bp, Homo sapiens
catcctttaaggttt

SEQ ID NO: 448351 - DNA, 15 bp, Homo sapiens
atcctttaaggtttc

SEQ ID NO: 448352 - DNA, 15 bp, Homo sapiens
tcctttaaggtttca

SEQ ID NO: 448353 - DNA, 15 bp, Homo sapiens
cctttaaggtttcat

SEQ ID NO: 448354 - DNA, 15 bp, Homo sapiens
ctttaaggtttcatg

SEQ ID NO: 448355 - DNA, 15 bp, Homo sapiens
tttaaggtttcatgg

SEQ ID NO: 448356 - DNA, 15 bp, Homo sapiens
ttaaggtttcatgga

SEQ ID NO: 448357 - DNA, 15 bp, Homo sapiens
taaggtttcatggaa

SEQ ID NO: 448358 - DNA, 15 bp, Homo sapiens
aaggtttcatggaaa

SEQ ID NO: 448359 - DNA, 15 bp, Homo sapiens
aggtttcatggaaaa

SEQ ID NO: 448360 - DNA, 15 bp, Homo sapiens
ggtttcatggaaaaa

SEQ ID NO: 448361 - DNA, 15 bp, Homo sapiens
gtttcatggaaaaat

SEQ ID NO: 448362 - DNA, 15 bp, Homo sapiens
tttcatggaaaaata

SEQ ID NO: 448363 - DNA, 15 bp, Homo sapiens
ttcatggaaaaatat

SEQ ID NO: 448364 - DNA, 15 bp, Homo sapiens
tcatggaaaaatatg

SEQ ID NO: 448365 - DNA, 15 bp, Homo sapiens
catggaaaaatatga

SEQ ID NO: 448366 - DNA, 15 bp, Homo sapiens
atggaaaaatatgag

SEQ ID NO: 448367 - DNA, 15 bp, Homo sapiens
tggaaaaatatgaga

SEQ ID NO: 448368 - DNA, 15 bp, Homo sapiens
ggaaaaatatgagac

SEQ ID NO: 448369 - DNA, 15 bp, Homo sapiens
gaaaaatatgagacc

SEQ ID NO: 448370 - DNA, 15 bp, Homo sapiens
aaaaatatgagacca

SEQ ID NO: 448371 - DNA, 15 bp, Homo sapiens
aaaatatgagaccac

SEQ ID NO: 448372 - DNA, 15 bp, Homo sapiens
aaatatgagaccact

SEQ ID NO: 448373 - DNA, 15 bp, Homo sapiens
aatatgagaccactc

SEQ ID NO: 448374 - DNA, 15 bp, Homo sapiens
atatgagaccactct

SEQ ID NO: 448375 - DNA, 15 bp, Homo sapiens
tatgagaccactcta

SEQ ID NO: 448376 - DNA, 15 bp, Homo sapiens
atgagaccactctaa

SEQ ID NO: 448377 - DNA, 15 bp, Homo sapiens
tgagaccactctaat

SEQ ID NO: 448378 - DNA, 15 bp, Homo sapiens
gagaccactctaatg

SEQ ID NO: 448379 - DNA, 15 bp, Homo sapiens
agaccactctaatga

SEQ ID NO: 448380 - DNA, 15 bp, Homo sapiens
gaccactctaatgag

SEQ ID NO: 448381 - DNA, 15 bp, Homo sapiens
accactctaatgagg

SEQ ID NO: 448382 - DNA, 15 bp, Homo sapiens
ccactctaatgagga

SEQ ID NO: 448383 - DNA, 15 bp, Homo sapiens
cactctaatgaggac

SEQ ID NO: 448384 - DNA, 15 bp, Homo sapiens
actctaatgaggaca

SEQ ID NO: 448385 - DNA, 15 bp, Homo sapiens
ctctaatgaggacaa

SEQ ID NO: 448386 - DNA, 15 bp, Homo sapiens
tctaatgaggacaaa

SEQ ID NO: 448387 - DNA, 15 bp, Homo sapiens
ctaatgaggacaaat

SEQ ID NO: 448388 - DNA, 15 bp, Homo sapiens
taatgaggacaaatg

SEQ ID NO: 448389 - DNA, 15 bp, Homo sapiens
aatgaggacaaatgg

SEQ ID NO: 448390 - DNA, 15 bp, Homo sapiens
atgaggacaaatggg

SEQ ID NO: 448391 - DNA, 15 bp, Homo sapiens
tgaggacaaatgggt

SEQ ID NO: 448392 - DNA, 15 bp, Homo sapiens
gaggacaaatgggtt

SEQ ID NO: 448393 - DNA, 15 bp, Homo sapiens
aggacaaatgggttt

SEQ ID NO: 448394 - DNA, 15 bp, Homo sapiens
ggacaaatgggttta

SEQ ID NO: 448395 - DNA, 15 bp, Homo sapiens
gacaaatgggtttaa

SEQ ID NO: 448396 - DNA, 15 bp, Homo sapiens
acaaatgggtttaag

SEQ ID NO: 448397 - DNA, 15 bp, Homo sapiens
caaatgggtttaaga

SEQ ID NO: 448398 - DNA, 15 bp, Homo sapiens
aaatgggtttaagaa

SEQ ID NO: 448399 - DNA, 15 bp, Homo sapiens
aatgggtttaagaag

SEQ ID NO: 448400 - DNA, 15 bp, Homo sapiens
atgggtttaagaagt

SEQ ID NO: 448401 - DNA, 15 bp, Homo sapiens
tgggtttaagaagta

SEQ ID NO: 448402 - DNA, 15 bp, Homo sapiens
gggtttaagaagtat

SEQ ID NO: 448403 - DNA, 15 bp, Homo sapiens
ggtttaagaagtatc

SEQ ID NO: 448404 - DNA, 15 bp, Homo sapiens
gtttaagaagtatct

SEQ ID NO: 448405 - DNA, 15 bp, Homo sapiens
tttaagaagtatctt

SEQ ID NO: 448406 - DNA, 15 bp, Homo sapiens
ttaagaagtatcttc

SEQ ID NO: 448407 - DNA, 15 bp, Homo sapiens
taagaagtatcttcc

SEQ ID NO: 448408 - DNA, 15 bp, Homo sapiens
aagaagtatcttcca

SEQ ID NO: 448409 - DNA, 15 bp, Homo sapiens
agaagtatcttccac

SEQ ID NO: 448410 - DNA, 15 bp, Homo sapiens
gaagtatcttccaca

SEQ ID NO: 448411 - DNA, 15 bp, Homo sapiens
aagtatcttccacag

SEQ ID NO: 448412 - DNA, 15 bp, Homo sapiens
agtatcttccacaga

SEQ ID NO: 448413 - DNA, 15 bp, Homo sapiens
gtatcttccacagag

SEQ ID NO: 448414 - DNA, 15 bp, Homo sapiens
tatcttccacagagc

SEQ ID NO: 448415 - DNA, 15 bp, Homo sapiens
atcttccacagagca

SEQ ID NO: 448416 - DNA, 15 bp, Homo sapiens
tcttccacagagcag

SEQ ID NO: 448417 - DNA, 15 bp, Homo sapiens
cttccacagagcagt

SEQ ID NO: 448418 - DNA, 15 bp, Homo sapiens
ttccacagagcagtc

SEQ ID NO: 448419 - DNA, 15 bp, Homo sapiens
tccacagagcagtca

SEQ ID NO: 448420 - DNA, 15 bp, Homo sapiens
ccacagagcagtcat

SEQ ID NO: 448421 - DNA, 15 bp, Homo sapiens
cacagagcagtcatt

SEQ ID NO: 448422 - DNA, 15 bp, Homo sapiens
acagagcagtcattt

SEQ ID NO: 448423 - DNA, 15 bp, Homo sapiens
cagagcagtcatttg

SEQ ID NO: 448424 - DNA, 15 bp, Homo sapiens
agagcagtcatttgc

SEQ ID NO: 448425 - DNA, 15 bp, Homo sapiens
gagcagtcatttgcc

SEQ ID NO: 448426 - DNA, 15 bp, Homo sapiens
agcagtcatttgccc

SEQ ID NO: 448427 - DNA, 15 bp, Homo sapiens
gcagtcatttgccca

SEQ ID NO: 448428 - DNA, 15 bp, Homo sapiens
cagtcatttgcccag

SEQ ID NO: 448429 - DNA, 15 bp, Homo sapiens
agtcatttgcccaga

SEQ ID NO: 448430 - DNA, 15 bp, Homo sapiens
gtcatttgcccagaa

SEQ ID NO: 448431 - DNA, 15 bp, Homo sapiens
tcatttgcccagaaa

SEQ ID NO: 448432 - DNA, 15 bp, Homo sapiens
catttgcccagaaat

SEQ ID NO: 448433 - DNA, 15 bp, Homo sapiens
atttgcccagaaatc

SEQ ID NO: 448434 - DNA, 15 bp, Homo sapiens
tttgcccagaaatca

SEQ ID NO: 448435 - DNA, 15 bp, Homo sapiens
ttgcccagaaatcaa

SEQ ID NO: 448436 - DNA, 15 bp, Homo sapiens
tgcccagaaatcaag

SEQ ID NO: 448437 - DNA, 15 bp, Homo sapiens
gcccagaaatcaaga

SEQ ID NO: 448438 - DNA, 15 bp, Homo sapiens
cccagaaatcaagat

SEQ ID NO: 448439 - DNA, 15 bp, Homo sapiens
ccagaaatcaagatt

SEQ ID NO: 448440 - DNA, 15 bp, Homo sapiens
cagaaatcaagattt

SEQ ID NO: 448441 - DNA, 15 bp, Homo sapiens
agaaatcaagatttt

SEQ ID NO: 448442 - DNA, 15 bp, Homo sapiens
gaaatcaagatttta

SEQ ID NO: 448443 - DNA, 15 bp, Homo sapiens
aaatcaagattttac

SEQ ID NO: 448444 - DNA, 15 bp, Homo sapiens
aatcaagattttacc

SEQ ID NO: 448445 - DNA, 15 bp, Homo sapiens
atcaagattttacca

SEQ ID NO: 448446 - DNA, 15 bp, Homo sapiens
tcaagattttaccag

SEQ ID NO: 448447 - DNA, 15 bp, Homo sapiens
caagattttaccagc

SEQ ID NO: 448448 - DNA, 15 bp, Homo sapiens
aagattttaccagcc

SEQ ID NO: 448449 - DNA, 15 bp, Homo sapiens
agattttaccagcct

SEQ ID NO: 448450 - DNA, 15 bp, Homo sapiens
gattttaccagccta

SEQ ID NO: 448451 - DNA, 15 bp, Homo sapiens
attttaccagcctat

SEQ ID NO: 448452 - DNA, 15 bp, Homo sapiens
ttttaccagcctatc

SEQ ID NO: 448453 - DNA, 15 bp, Homo sapiens
tttaccagcctatca

SEQ ID NO: 448454 - DNA, 15 bp, Homo sapiens
ttaccagcctatcaa

SEQ ID NO: 448455 - DNA, 15 bp, Homo sapiens
taccagcctatcaaa

SEQ ID NO: 448456 - DNA, 15 bp, Homo sapiens
accagcctatcaaaa

SEQ ID NO: 448457 - DNA, 15 bp, Homo sapiens
ccagcctatcaaaag

SEQ ID NO: 448458 - DNA, 15 bp, Homo sapiens
cagcctatcaaaagt

SEQ ID NO: 448459 - DNA, 15 bp, Homo sapiens
agcctatcaaaagtg

SEQ ID NO: 448460 - DNA, 15 bp, Homo sapiens
gcctatcaaaagtgc

SEQ ID NO: 448461 - DNA, 15 bp, Homo sapiens
cctatcaaaagtgca

SEQ ID NO: 448462 - DNA, 15 bp, Homo sapiens
ctatcaaaagtgcat

SEQ ID NO: 448463 - DNA, 15 bp, Homo sapiens
tatcaaaagtgcatg

SEQ ID NO: 448464 - DNA, 15 bp, Homo sapiens
atcaaaagtgcatgt

SEQ ID NO: 448465 - DNA, 15 bp, Homo sapiens
tcaaaagtgcatgtc

SEQ ID NO: 448466 - DNA, 15 bp, Homo sapiens
caaaagtgcatgtcc

SEQ ID NO: 448467 - DNA, 15 bp, Homo sapiens
aaaagtgcatgtcct

SEQ ID NO: 448468 - DNA, 15 bp, Homo sapiens
aaagtgcatgtcctt

SEQ ID NO: 448469 - DNA, 15 bp, Homo sapiens
aagtgcatgtccttt

SEQ ID NO: 448470 - DNA, 15 bp, Homo sapiens
agtgcatgtcctttg

SEQ ID NO: 448471 - DNA, 15 bp, Homo sapiens
gtgcatgtcctttgc

SEQ ID NO: 448472 - DNA, 15 bp, Homo sapiens
tgcatgtcctttgct

SEQ ID NO: 448473 - DNA, 15 bp, Homo sapiens
gcatgtcctttgctg

SEQ ID NO: 448474 - DNA, 15 bp, Homo sapiens
catgtcctttgctgt

SEQ ID NO: 448475 - DNA, 15 bp, Homo sapiens
atgtcctttgctgtt

SEQ ID NO: 448476 - DNA, 15 bp, Homo sapiens
tgtcctttgctgttg

SEQ ID NO: 448477 - DNA, 15 bp, Homo sapiens
gtcctttgctgttgg

SEQ ID NO: 448478 - DNA, 15 bp, Homo sapiens
tcctttgctgttggt

SEQ ID NO: 448479 - DNA, 15 bp, Homo sapiens
cctttgctgttggtt

SEQ ID NO: 448480 - DNA, 15 bp, Homo sapiens
ctttgctgttggttc

SEQ ID NO: 448481 - DNA, 15 bp, Homo sapiens
tttgctgttggttca

SEQ ID NO: 448482 - DNA, 15 bp, Homo sapiens
ttgctgttggttcat

SEQ ID NO: 448483 - DNA, 15 bp, Homo sapiens
tgctgttggttcatt

SEQ ID NO: 448484 - DNA, 15 bp, Homo sapiens
gctgttggttcattg

SEQ ID NO: 448485 - DNA, 15 bp, Homo sapiens
ctgttggttcattgt

SEQ ID NO: 448486 - DNA, 15 bp, Homo sapiens
tgttggttcattgtg

SEQ ID NO: 448487 - DNA, 15 bp, Homo sapiens
gttggttcattgtgt

SEQ ID NO: 448488 - DNA, 15 bp, Homo sapiens
ttggttcattgtgtt

SEQ ID NO: 448489 - DNA, 15 bp, Homo sapiens
tggttcattgtgtta

SEQ ID NO: 448490 - DNA, 15 bp, Homo sapiens
ggttcattgtgttac

SEQ ID NO: 448491 - DNA, 15 bp, Homo sapiens
gttcattgtgttaca

SEQ ID NO: 448492 - DNA, 15 bp, Homo sapiens
ttcattgtgttacat

SEQ ID NO: 448493 - DNA, 15 bp, Homo sapiens
tcattgtgttacatg

SEQ ID NO: 448494 - DNA, 15 bp, Homo sapiens
cattgtgttacatgt

SEQ ID NO: 448495 - DNA, 15 bp, Homo sapiens
attgtgttacatgtt

SEQ ID NO: 448496 - DNA, 15 bp, Homo sapiens
ttgtgttacatgtta

SEQ ID NO: 448497 - DNA, 15 bp, Homo sapiens
tgtgttacatgttag

SEQ ID NO: 448498 - DNA, 15 bp, Homo sapiens
gtgttacatgttagg

SEQ ID NO: 448499 - DNA, 15 bp, Homo sapiens
tgttacatgttaggc

SEQ ID NO: 448500 - DNA, 15 bp, Homo sapiens
gttacatgttaggca

SEQ ID NO: 448501 - DNA, 15 bp, Homo sapiens
ttacatgttaggcag

SEQ ID NO: 448502 - DNA, 15 bp, Homo sapiens
tacatgttaggcagt

SEQ ID NO: 448503 - DNA, 15 bp, Homo sapiens
acatgttaggcagta

SEQ ID NO: 448504 - DNA, 15 bp, Homo sapiens
catgttaggcagtat

SEQ ID NO: 448505 - DNA, 15 bp, Homo sapiens
atgttaggcagtatt

SEQ ID NO: 448506 - DNA, 15 bp, Homo sapiens
tgttaggcagtattg

SEQ ID NO: 448507 - DNA, 15 bp, Homo sapiens
gttaggcagtattgc

SEQ ID NO: 448508 - DNA, 15 bp, Homo sapiens
ttaggcagtattgca

SEQ ID NO: 448509 - DNA, 15 bp, Homo sapiens
taggcagtattgcag

SEQ ID NO: 448510 - DNA, 15 bp, Homo sapiens
aggcagtattgcagc

SEQ ID NO: 448511 - DNA, 15 bp, Homo sapiens
ggcagtattgcagca

SEQ ID NO: 448512 - DNA, 15 bp, Homo sapiens
gcagtattgcagcac

SEQ ID NO: 448513 - DNA, 15 bp, Homo sapiens
cagtattgcagcaca

SEQ ID NO: 448514 - DNA, 15 bp, Homo sapiens
agtattgcagcacaa

SEQ ID NO: 448515 - DNA, 15 bp, Homo sapiens
gtattgcagcacaac

SEQ ID NO: 448516 - DNA, 15 bp, Homo sapiens
tattgcagcacaact

SEQ ID NO: 448517 - DNA, 15 bp, Homo sapiens
attgcagcacaactt

SEQ ID NO: 448518 - DNA, 15 bp, Homo sapiens
ttgcagcacaacttt

SEQ ID NO: 448519 - DNA, 15 bp, Homo sapiens
tgcagcacaactttt

SEQ ID NO: 448520 - DNA, 15 bp, Homo sapiens
gcagcacaacttttt

SEQ ID NO: 448521 - DNA, 15 bp, Homo sapiens
cagcacaactttttt

SEQ ID NO: 448522 - DNA, 15 bp, Homo sapiens
agcacaacttttttt

SEQ ID NO: 448523 - DNA, 15 bp, Homo sapiens
gcacaactttttttg

SEQ ID NO: 448524 - DNA, 15 bp, Homo sapiens
cacaactttttttgt

SEQ ID NO: 448525 - DNA, 15 bp, Homo sapiens
acaactttttttgtt

SEQ ID NO: 448526 - DNA, 15 bp, Homo sapiens
caactttttttgttt

SEQ ID NO: 448527 - DNA, 15 bp, Homo sapiens
aactttttttgtttt

SEQ ID NO: 448528 - DNA, 15 bp, Homo sapiens
actttttttgtttta

SEQ ID NO: 448529 - DNA, 15 bp, Homo sapiens
ctttttttgttttat

SEQ ID NO: 448530 - DNA, 15 bp, Homo sapiens
tttttttgttttatt

SEQ ID NO: 448531 - DNA, 15 bp, Homo sapiens
tttttgttttatttg

SEQ ID NO: 448532 - DNA, 15 bp, Homo sapiens
ttttgttttatttgt

SEQ ID NO: 448533 - DNA, 15 bp, Homo sapiens
tttgttttatttgtt

SEQ ID NO: 448534 - DNA, 15 bp, Homo sapiens
ttgttttatttgttg

SEQ ID NO: 448535 - DNA, 15 bp, Homo sapiens
tgttttatttgttgg

SEQ ID NO: 448536 - DNA, 15 bp, Homo sapiens
gttttatttgttggt

SEQ ID NO: 448537 - DNA, 15 bp, Homo sapiens
ttttatttgttggtg

SEQ ID NO: 448538 - DNA, 15 bp, Homo sapiens
tttatttgttggtgc

SEQ ID NO: 448539 - DNA, 15 bp, Homo sapiens
ttatttgttggtgct

SEQ ID NO: 448540 - DNA, 15 bp, Homo sapiens
tatttgttggtgcta

SEQ ID NO: 448541 - DNA, 15 bp, Homo sapiens
atttgttggtgctac

SEQ ID NO: 448542 - DNA, 15 bp, Homo sapiens
tttgttggtgctaca

SEQ ID NO: 448543 - DNA, 15 bp, Homo sapiens
ttgttggtgctacag

SEQ ID NO: 448544 - DNA, 15 bp, Homo sapiens
tgttggtgctacagt

SEQ ID NO: 448545 - DNA, 15 bp, Homo sapiens
gttggtgctacagtc

SEQ ID NO: 448546 - DNA, 15 bp, Homo sapiens
ttggtgctacagtct

SEQ ID NO: 448547 - DNA, 15 bp, Homo sapiens
tggtgctacagtctt

SEQ ID NO: 448548 - DNA, 15 bp, Homo sapiens
ggtgctacagtctta

SEQ ID NO: 448549 - DNA, 15 bp, Homo sapiens
gtgctacagtcttat

SEQ ID NO: 448550 - DNA, 15 bp, Homo sapiens
tgctacagtcttata

SEQ ID NO: 448551 - DNA, 15 bp, Homo sapiens
gctacagtcttatat

SEQ ID NO: 448552 - DNA, 15 bp, Homo sapiens
ctacagtcttatatt

SEQ ID NO: 448553 - DNA, 15 bp, Homo sapiens
tacagtcttatatta

SEQ ID NO: 448554 - DNA, 15 bp, Homo sapiens
acagtcttatattat

SEQ ID NO: 448555 - DNA, 15 bp, Homo sapiens
cagtcttatattatt

SEQ ID NO: 448556 - DNA, 15 bp, Homo sapiens
agtcttatattattt

SEQ ID NO: 448557 - DNA, 15 bp, Homo sapiens
gtcttatattatttg

SEQ ID NO: 448558 - DNA, 15 bp, Homo sapiens
tcttatattatttgt

SEQ ID NO: 448559 - DNA, 15 bp, Homo sapiens
cttatattatttgtg

SEQ ID NO: 448560 - DNA, 15 bp, Homo sapiens
ttatattatttgtgt

SEQ ID NO: 448561 - DNA, 15 bp, Homo sapiens
tatattatttgtgtt

SEQ ID NO: 448562 - DNA, 15 bp, Homo sapiens
atattatttgtgttt

SEQ ID NO: 448563 - DNA, 15 bp, Homo sapiens
tattatttgtgtttt

SEQ ID NO: 448564 - DNA, 15 bp, Homo sapiens
attatttgtgtttta

SEQ ID NO: 448565 - DNA, 15 bp, Homo sapiens
ttatttgtgttttac

SEQ ID NO: 448566 - DNA, 15 bp, Homo sapiens
tatttgtgttttact

SEQ ID NO: 448567 - DNA, 15 bp, Homo sapiens
atttgtgttttactt

SEQ ID NO: 448568 - DNA, 15 bp, Homo sapiens
tttgtgttttacttt

SEQ ID NO: 448569 - DNA, 15 bp, Homo sapiens
ttgtgttttactttc

SEQ ID NO: 448570 - DNA, 15 bp, Homo sapiens
tgtgttttactttct

SEQ ID NO: 448571 - DNA, 15 bp, Homo sapiens
gtgttttactttctg

SEQ ID NO: 448572 - DNA, 15 bp, Homo sapiens
tgttttactttctgt

SEQ ID NO: 448573 - DNA, 15 bp, Homo sapiens
gttttactttctgtg

SEQ ID NO: 448574 - DNA, 15 bp, Homo sapiens
ttttactttctgtgg

SEQ ID NO: 448575 - DNA, 15 bp, Homo sapiens
tttactttctgtggc

SEQ ID NO: 448576 - DNA, 15 bp, Homo sapiens
ttactttctgtggct

SEQ ID NO: 448577 - DNA, 15 bp, Homo sapiens
tactttctgtggctt

SEQ ID NO: 448578 - DNA, 15 bp, Homo sapiens
actttctgtggctta

SEQ ID NO: 448579 - DNA, 15 bp, Homo sapiens
ctttctgtggcttat

SEQ ID NO: 448580 - DNA, 15 bp, Homo sapiens
tttctgtggcttatc

SEQ ID NO: 448581 - DNA, 15 bp, Homo sapiens
ttctgtggcttatca

SEQ ID NO: 448582 - DNA, 15 bp, Homo sapiens
tctgtggcttatcag

SEQ ID NO: 448583 - DNA, 15 bp, Homo sapiens
ctgtggcttatcagt

SEQ ID NO: 448584 - DNA, 15 bp, Homo sapiens
tgtggcttatcagtg

SEQ ID NO: 448585 - DNA, 15 bp, Homo sapiens
gtggcttatcagtgt

SEQ ID NO: 448586 - DNA, 15 bp, Homo sapiens
tggcttatcagtgtt

SEQ ID NO: 448587 - DNA, 15 bp, Homo sapiens
ggcttatcagtgtta

SEQ ID NO: 448588 - DNA, 15 bp, Homo sapiens
gcttatcagtgttat

SEQ ID NO: 448589 - DNA, 15 bp, Homo sapiens
cttatcagtgttata

SEQ ID NO: 448590 - DNA, 15 bp, Homo sapiens
ttatcagtgttatat

SEQ ID NO: 448591 - DNA, 15 bp, Homo sapiens
tatcagtgttatatt

SEQ ID NO: 448592 - DNA, 15 bp, Homo sapiens
atcagtgttatattg

SEQ ID NO: 448593 - DNA, 15 bp, Homo sapiens
tcagtgttatattgt

SEQ ID NO: 448594 - DNA, 15 bp, Homo sapiens
cagtgttatattgtt

SEQ ID NO: 448595 - DNA, 15 bp, Homo sapiens
agtgttatattgtta

SEQ ID NO: 448596 - DNA, 15 bp, Homo sapiens
gtgttatattgttat

SEQ ID NO: 448597 - DNA, 15 bp, Homo sapiens
tgttatattgttatg

SEQ ID NO: 448598 - DNA, 15 bp, Homo sapiens
gttatattgttatga

SEQ ID NO: 448599 - DNA, 15 bp, Homo sapiens
ttatattgttatgaa

SEQ ID NO: 448600 - DNA, 15 bp, Homo sapiens
tatattgttatgaat

SEQ ID NO: 448601 - DNA, 15 bp, Homo sapiens
atattgttatgaata

SEQ ID NO: 448602 - DNA, 15 bp, Homo sapiens
tattgttatgaataa

SEQ ID NO: 448603 - DNA, 15 bp, Homo sapiens
attgttatgaataat

SEQ ID NO: 448604 - DNA, 15 bp, Homo sapiens
ttgttatgaataata

SEQ ID NO: 448605 - DNA, 15 bp, Homo sapiens
tgttatgaataataa

SEQ ID NO: 448606 - DNA, 15 bp, Homo sapiens
gttatgaataataat

SEQ ID NO: 448607 - DNA, 15 bp, Homo sapiens
ttatgaataataata

SEQ ID NO: 448608 - DNA, 15 bp, Homo sapiens
tatgaataataatag

SEQ ID NO: 448609 - DNA, 15 bp, Homo sapiens
atgaataataataga

SEQ ID NO: 448610 - DNA, 15 bp, Homo sapiens
tgaataataatagat

SEQ ID NO: 448611 - DNA, 15 bp, Homo sapiens
gaataataatagata

SEQ ID NO: 448612 - DNA, 15 bp, Homo sapiens
aataataatagatag

SEQ ID NO: 448613 - DNA, 15 bp, Homo sapiens
ataataatagatagg

SEQ ID NO: 448614 - DNA, 15 bp, Homo sapiens
taataatagataggt

SEQ ID NO: 448615 - DNA, 15 bp, Homo sapiens
aataatagataggtg

SEQ ID NO: 448616 - DNA, 15 bp, Homo sapiens
ataatagataggtgg

SEQ ID NO: 448617 - DNA, 15 bp, Homo sapiens
taatagataggtgga

SEQ ID NO: 448618 - DNA, 15 bp, Homo sapiens
aatagataggtggaa

SEQ ID NO: 448619 - DNA, 15 bp, Homo sapiens
atagataggtggaag

SEQ ID NO: 448620 - DNA, 15 bp, Homo sapiens
tagataggtggaagg

SEQ ID NO: 448621 - DNA, 15 bp, Homo sapiens
agataggtggaagga

SEQ ID NO: 448622 - DNA, 15 bp, Homo sapiens
gataggtggaaggat

SEQ ID NO: 448623 - DNA, 15 bp, Homo sapiens
ataggtggaaggata

SEQ ID NO: 448624 - DNA, 15 bp, Homo sapiens
taggtggaaggatat

SEQ ID NO: 448625 - DNA, 15 bp, Homo sapiens
aggtggaaggatata

SEQ ID NO: 448626 - DNA, 15 bp, Homo sapiens
ggtggaaggatatac

SEQ ID NO: 448627 - DNA, 15 bp, Homo sapiens
gtggaaggatatact

SEQ ID NO: 448628 - DNA, 15 bp, Homo sapiens
tggaaggatatacta

SEQ ID NO: 448629 - DNA, 15 bp, Homo sapiens
ggaaggatatactac

SEQ ID NO: 448630 - DNA, 15 bp, Homo sapiens
gaaggatatactact

SEQ ID NO: 448631 - DNA, 15 bp, Homo sapiens
aaggatatactactt

SEQ ID NO: 448632 - DNA, 15 bp, Homo sapiens
aggatatactacttc

SEQ ID NO: 448633 - DNA, 15 bp, Homo sapiens
ggatatactacttct

SEQ ID NO: 448634 - DNA, 15 bp, Homo sapiens
gatatactacttctt

SEQ ID NO: 448635 - DNA, 15 bp, Homo sapiens
atatactacttctta

SEQ ID NO: 448636 - DNA, 15 bp, Homo sapiens
tatactacttcttaa

SEQ ID NO: 448637 - DNA, 15 bp, Homo sapiens
atactacttcttaac

SEQ ID NO: 448638 - DNA, 15 bp, Homo sapiens
tactacttcttaacc

SEQ ID NO: 448639 - DNA, 15 bp, Homo sapiens
actacttcttaacct

SEQ ID NO: 448640 - DNA, 15 bp, Homo sapiens
ctacttcttaacctt

SEQ ID NO: 448641 - DNA, 15 bp, Homo sapiens
tacttcttaacctta

SEQ ID NO: 448642 - DNA, 15 bp, Homo sapiens
acttcttaaccttat

SEQ ID NO: 448643 - DNA, 15 bp, Homo sapiens
cttcttaaccttatt

SEQ ID NO: 448644 - DNA, 15 bp, Homo sapiens
ttcttaaccttattg

SEQ ID NO: 448645 - DNA, 15 bp, Homo sapiens
tcttaaccttattgg

SEQ ID NO: 448646 - DNA, 15 bp, Homo sapiens
cttaaccttattggc

SEQ ID NO: 448647 - DNA, 15 bp, Homo sapiens
ttaaccttattggct

SEQ ID NO: 448648 - DNA, 15 bp, Homo sapiens
taaccttattggctt

SEQ ID NO: 448649 - DNA, 15 bp, Homo sapiens
aaccttattggctta

SEQ ID NO: 448650 - DNA, 15 bp, Homo sapiens
accttattggcttaa

SEQ ID NO: 448651 - DNA, 15 bp, Homo sapiens
ccttattggcttaat

SEQ ID NO: 448652 - DNA, 15 bp, Homo sapiens
cttattggcttaata

SEQ ID NO: 448653 - DNA, 15 bp, Homo sapiens
ttattggcttaatat

SEQ ID NO: 448654 - DNA, 15 bp, Homo sapiens
tattggcttaatatt

SEQ ID NO: 448655 - DNA, 15 bp, Homo sapiens
attggcttaatattt

SEQ ID NO: 448656 - DNA, 15 bp, Homo sapiens
ttggcttaatatttt

SEQ ID NO: 448657 - DNA, 15 bp, Homo sapiens
tggcttaatatttta

SEQ ID NO: 448658 - DNA, 15 bp, Homo sapiens
ggcttaatattttaa

SEQ ID NO: 448659 - DNA, 15 bp, Homo sapiens
gcttaatattttaat

SEQ ID NO: 448660 - DNA, 15 bp, Homo sapiens
ttaatattttaataa

SEQ ID NO: 448661 - DNA, 15 bp, Homo sapiens
taatattttaataat

SEQ ID NO: 448662 - DNA, 15 bp, Homo sapiens
aatattttaataatg

SEQ ID NO: 448663 - DNA, 15 bp, Homo sapiens
atattttaataatgt

SEQ ID NO: 448664 - DNA, 15 bp, Homo sapiens
tattttaataatgtc

SEQ ID NO: 448665 - DNA, 15 bp, Homo sapiens
attttaataatgtcc

SEQ ID NO: 448666 - DNA, 15 bp, Homo sapiens
ttttaataatgtcca

SEQ ID NO: 448667 - DNA, 15 bp, Homo sapiens
tttaataatgtccat

SEQ ID NO: 448668 - DNA, 15 bp, Homo sapiens
ttaataatgtccata

SEQ ID NO: 448669 - DNA, 15 bp, Homo sapiens
taataatgtccataa

SEQ ID NO: 448670 - DNA, 15 bp, Homo sapiens
aataatgtccataaa

SEQ ID NO: 448671 - DNA, 15 bp, Homo sapiens
ataatgtccataaaa

SEQ ID NO: 448672 - DNA, 15 bp, Homo sapiens
taatgtccataaaat

SEQ ID NO: 448673 - DNA, 15 bp, Homo sapiens
aatgtccataaaatg

SEQ ID NO: 448674 - DNA, 15 bp, Homo sapiens
atgtccataaaatgc

SEQ ID NO: 448675 - DNA, 15 bp, Homo sapiens
tgtccataaaatgca

SEQ ID NO: 448676 - DNA, 15 bp, Homo sapiens
gtccataaaatgcag

SEQ ID NO: 448677 - DNA, 15 bp, Homo sapiens
tccataaaatgcaga

SEQ ID NO: 448678 - DNA, 15 bp, Homo sapiens
ccataaaatgcagag

SEQ ID NO: 448679 - DNA, 15 bp, Homo sapiens
cataaaatgcagaga

SEQ ID NO: 448680 - DNA, 15 bp, Homo sapiens
ataaaatgcagagat

SEQ ID NO: 448681 - DNA, 15 bp, Homo sapiens
taaaatgcagagatt

SEQ ID NO: 448682 - DNA, 15 bp, Homo sapiens
aaaatgcagagatta

SEQ ID NO: 448683 - DNA, 15 bp, Homo sapiens
aaatgcagagattat

SEQ ID NO: 448684 - DNA, 15 bp, Homo sapiens
aatgcagagattata

SEQ ID NO: 448685 - DNA, 15 bp, Homo sapiens
atgcagagattatat

SEQ ID NO: 448686 - DNA, 15 bp, Homo sapiens
tgcagagattatatg

SEQ ID NO: 448687 - DNA, 15 bp, Homo sapiens
gcagagattatatgt

SEQ ID NO: 448688 - DNA, 15 bp, Homo sapiens
cagagattatatgtt

SEQ ID NO: 448689 - DNA, 15 bp, Homo sapiens
agagattatatgtta

SEQ ID NO: 448690 - DNA, 15 bp, Homo sapiens
gagattatatgttat

SEQ ID NO: 448691 - DNA, 15 bp, Homo sapiens
agattatatgttatc

SEQ ID NO: 448692 - DNA, 15 bp, Homo sapiens
gattatatgttatcc

SEQ ID NO: 448693 - DNA, 15 bp, Homo sapiens
attatatgttatccc

SEQ ID NO: 448694 - DNA, 15 bp, Homo sapiens
ttatatgttatccca

SEQ ID NO: 448695 - DNA, 15 bp, Homo sapiens
tatatgttatcccag

SEQ ID NO: 448696 - DNA, 15 bp, Homo sapiens
atatgttatcccagc

SEQ ID NO: 448697 - DNA, 15 bp, Homo sapiens
tatgttatcccagct

SEQ ID NO: 448698 - DNA, 15 bp, Homo sapiens
atgttatcccagctg

SEQ ID NO: 448699 - DNA, 15 bp, Homo sapiens
tgttatcccagctgg

SEQ ID NO: 448700 - DNA, 15 bp, Homo sapiens
gttatcccagctggg

SEQ ID NO: 448701 - DNA, 15 bp, Homo sapiens
ttatcccagctgggg

SEQ ID NO: 448702 - DNA, 15 bp, Homo sapiens
tatcccagctggggc

SEQ ID NO: 448703 - DNA, 15 bp, Homo sapiens
atcccagctggggct

SEQ ID NO: 448704 - DNA, 15 bp, Homo sapiens
tcccagctggggctc

SEQ ID NO: 448705 - DNA, 15 bp, Homo sapiens
cccagctggggctct

SEQ ID NO: 448706 - DNA, 15 bp, Homo sapiens
ccagctggggctctt

SEQ ID NO: 448707 - DNA, 15 bp, Homo sapiens
cagctggggctcttc

SEQ ID NO: 448708 - DNA, 15 bp, Homo sapiens
agctggggctcttca

SEQ ID NO: 448709 - DNA, 15 bp, Homo sapiens
gctggggctcttcag

SEQ ID NO: 448710 - DNA, 15 bp, Homo sapiens
ctggggctcttcaga

SEQ ID NO: 448711 - DNA, 15 bp, Homo sapiens
tggggctcttcagag

SEQ ID NO: 448712 - DNA, 15 bp, Homo sapiens
ggggctcttcagagt

SEQ ID NO: 448713 - DNA, 15 bp, Homo sapiens
gggctcttcagagta

SEQ ID NO: 448714 - DNA, 15 bp, Homo sapiens
ggctcttcagagtaa

SEQ ID NO: 448715 - DNA, 15 bp, Homo sapiens
gctcttcagagtaag

SEQ ID NO: 448716 - DNA, 15 bp, Homo sapiens
ctcttcagagtaagg

SEQ ID NO: 448717 - DNA, 15 bp, Homo sapiens
tcttcagagtaaggg

SEQ ID NO: 448718 - DNA, 15 bp, Homo sapiens
cttcagagtaagggg

SEQ ID NO: 448719 - DNA, 15 bp, Homo sapiens
ttcagagtaaggggg

SEQ ID NO: 448720 - DNA, 15 bp, Homo sapiens
tcagagtaagggggc

SEQ ID NO: 448721 - DNA, 15 bp, Homo sapiens
cagagtaagggggca

SEQ ID NO: 448722 - DNA, 15 bp, Homo sapiens
agagtaagggggcac

SEQ ID NO: 448723 - DNA, 15 bp, Homo sapiens
gagtaagggggcact

SEQ ID NO: 448724 - DNA, 15 bp, Homo sapiens
agtaagggggcactt

SEQ ID NO: 448725 - DNA, 15 bp, Homo sapiens
gtaagggggcacttt

SEQ ID NO: 448726 - DNA, 15 bp, Homo sapiens
taagggggcactttt

SEQ ID NO: 448727 - DNA, 15 bp, Homo sapiens
aagggggcactttta

SEQ ID NO: 448728 - DNA, 15 bp, Homo sapiens
agggggcacttttaa

SEQ ID NO: 448729 - DNA, 15 bp, Homo sapiens
gggggcacttttaat

SEQ ID NO: 448730 - DNA, 15 bp, Homo sapiens
ggggcacttttaata

SEQ ID NO: 448731 - DNA, 15 bp, Homo sapiens
gggcacttttaataa

SEQ ID NO: 448732 - DNA, 15 bp, Homo sapiens
ggcacttttaataat

SEQ ID NO: 448733 - DNA, 15 bp, Homo sapiens
gcacttttaataatt

SEQ ID NO: 448734 - DNA, 15 bp, Homo sapiens
cacttttaataatta

SEQ ID NO: 448735 - DNA, 15 bp, Homo sapiens
acttttaataattat

SEQ ID NO: 448736 - DNA, 15 bp, Homo sapiens
cttttaataattata

SEQ ID NO: 448737 - DNA, 15 bp, Homo sapiens
ttttaataattatac

SEQ ID NO: 448738 - DNA, 15 bp, Homo sapiens
tttaataattatacc

SEQ ID NO: 448739 - DNA, 15 bp, Homo sapiens
ttaataattatacca

SEQ ID NO: 448740 - DNA, 15 bp, Homo sapiens
taataattataccag

SEQ ID NO: 448741 - DNA, 15 bp, Homo sapiens
aataattataccagg

SEQ ID NO: 448742 - DNA, 15 bp, Homo sapiens
ataattataccagga

SEQ ID NO: 448743 - DNA, 15 bp, Homo sapiens
taattataccaggat

SEQ ID NO: 448744 - DNA, 15 bp, Homo sapiens
aattataccaggatg

SEQ ID NO: 448745 - DNA, 15 bp, Homo sapiens
attataccaggatgc

SEQ ID NO: 448746 - DNA, 15 bp, Homo sapiens
ttataccaggatgct

SEQ ID NO: 448747 - DNA, 15 bp, Homo sapiens
tataccaggatgctg

SEQ ID NO: 448748 - DNA, 15 bp, Homo sapiens
ataccaggatgctga

SEQ ID NO: 448749 - DNA, 15 bp, Homo sapiens
taccaggatgctgat

SEQ ID NO: 448750 - DNA, 15 bp, Homo sapiens
accaggatgctgata

SEQ ID NO: 448751 - DNA, 15 bp, Homo sapiens
ccaggatgctgatat

SEQ ID NO: 448752 - DNA, 15 bp, Homo sapiens
caggatgctgatatg

SEQ ID NO: 448753 - DNA, 15 bp, Homo sapiens
aggatgctgatatgt

SEQ ID NO: 448754 - DNA, 15 bp, Homo sapiens
ggatgctgatatgta

SEQ ID NO: 448755 - DNA, 15 bp, Homo sapiens
gatgctgatatgtaa

SEQ ID NO: 448756 - DNA, 15 bp, Homo sapiens
atgctgatatgtaat

SEQ ID NO: 448757 - DNA, 15 bp, Homo sapiens
tgctgatatgtaatt

SEQ ID NO: 448758 - DNA, 15 bp, Homo sapiens
gctgatatgtaattc

SEQ ID NO: 448759 - DNA, 15 bp, Homo sapiens
ctgatatgtaattcc

SEQ ID NO: 448760 - DNA, 15 bp, Homo sapiens
tgatatgtaattcct

SEQ ID NO: 448761 - DNA, 15 bp, Homo sapiens
gatatgtaattcctg

SEQ ID NO: 448762 - DNA, 15 bp, Homo sapiens
atatgtaattcctgt

SEQ ID NO: 448763 - DNA, 15 bp, Homo sapiens
tatgtaattcctgta

SEQ ID NO: 448764 - DNA, 15 bp, Homo sapiens
atgtaattcctgtat

SEQ ID NO: 448765 - DNA, 15 bp, Homo sapiens
tgtaattcctgtata

SEQ ID NO: 448766 - DNA, 15 bp, Homo sapiens
gtaattcctgtatac

SEQ ID NO: 448767 - DNA, 15 bp, Homo sapiens
taattcctgtataca

SEQ ID NO: 448768 - DNA, 15 bp, Homo sapiens
aattcctgtatacag

SEQ ID NO: 448769 - DNA, 15 bp, Homo sapiens
attcctgtatacagt

SEQ ID NO: 448770 - DNA, 15 bp, Homo sapiens
ttcctgtatacagtc

SEQ ID NO: 448771 - DNA, 15 bp, Homo sapiens
tcctgtatacagtct

SEQ ID NO: 448772 - DNA, 15 bp, Homo sapiens
cctgtatacagtcta

SEQ ID NO: 448773 - DNA, 15 bp, Homo sapiens
ctgtatacagtctag

SEQ ID NO: 448774 - DNA, 15 bp, Homo sapiens
tgtatacagtctagt

SEQ ID NO: 448775 - DNA, 15 bp, Homo sapiens
gtatacagtctagta

SEQ ID NO: 448776 - DNA, 15 bp, Homo sapiens
tatacagtctagtat

SEQ ID NO: 448777 - DNA, 15 bp, Homo sapiens
atacagtctagtata

SEQ ID NO: 448778 - DNA, 15 bp, Homo sapiens
tacagtctagtataa

SEQ ID NO: 448779 - DNA, 15 bp, Homo sapiens
acagtctagtataaa

SEQ ID NO: 448780 - DNA, 15 bp, Homo sapiens
cagtctagtataaag

SEQ ID NO: 448781 - DNA, 15 bp, Homo sapiens
agtctagtataaagc

SEQ ID NO: 448782 - DNA, 15 bp, Homo sapiens
gtctagtataaagca

SEQ ID NO: 448783 - DNA, 15 bp, Homo sapiens
tctagtataaagcag

SEQ ID NO: 448784 - DNA, 15 bp, Homo sapiens
ctagtataaagcagg

SEQ ID NO: 448785 - DNA, 15 bp, Homo sapiens
tagtataaagcagga

SEQ ID NO: 448786 - DNA, 15 bp, Homo sapiens
agtataaagcaggat

SEQ ID NO: 448787 - DNA, 15 bp, Homo sapiens
gtataaagcaggatt

SEQ ID NO: 448788 - DNA, 15 bp, Homo sapiens
tataaagcaggattt

SEQ ID NO: 448789 - DNA, 15 bp, Homo sapiens
ataaagcaggattta

SEQ ID NO: 448790 - DNA, 15 bp, Homo sapiens
taaagcaggatttat

SEQ ID NO: 448791 - DNA, 15 bp, Homo sapiens
aaagcaggatttata

SEQ ID NO: 448792 - DNA, 15 bp, Homo sapiens
aagcaggatttatac

SEQ ID NO: 448793 - DNA, 15 bp, Homo sapiens
agcaggatttatact

SEQ ID NO: 448794 - DNA, 15 bp, Homo sapiens
gcaggatttatactg

SEQ ID NO: 448795 - DNA, 15 bp, Homo sapiens
caggatttatactgc

SEQ ID NO: 448796 - DNA, 15 bp, Homo sapiens
aggatttatactgct

SEQ ID NO: 448797 - DNA, 15 bp, Homo sapiens
ggatttatactgctt

SEQ ID NO: 448798 - DNA, 15 bp, Homo sapiens
gatttatactgcttg

SEQ ID NO: 448799 - DNA, 15 bp, Homo sapiens
atttatactgcttga

SEQ ID NO: 448800 - DNA, 15 bp, Homo sapiens
tttatactgcttgaa

SEQ ID NO: 448801 - DNA, 15 bp, Homo sapiens
ttatactgcttgaag

SEQ ID NO: 448802 - DNA, 15 bp, Homo sapiens
tatactgcttgaagg

SEQ ID NO: 448803 - DNA, 15 bp, Homo sapiens
atactgcttgaagga

SEQ ID NO: 448804 - DNA, 15 bp, Homo sapiens
tactgcttgaaggat

SEQ ID NO: 448805 - DNA, 15 bp, Homo sapiens
actgcttgaaggata

SEQ ID NO: 448806 - DNA, 15 bp, Homo sapiens
ctgcttgaaggatag

SEQ ID NO: 448807 - DNA, 15 bp, Homo sapiens
tgcttgaaggatagt

SEQ ID NO: 448808 - DNA, 15 bp, Homo sapiens
gcttgaaggatagtt

SEQ ID NO: 448809 - DNA, 15 bp, Homo sapiens
cttgaaggatagttt

SEQ ID NO: 448810 - DNA, 15 bp, Homo sapiens
ttgaaggatagtttt

SEQ ID NO: 448811 - DNA, 15 bp, Homo sapiens
tgaaggatagttttc

SEQ ID NO: 448812 - DNA, 15 bp, Homo sapiens
gaaggatagttttca

SEQ ID NO: 448813 - DNA, 15 bp, Homo sapiens
aaggatagttttcaa

SEQ ID NO: 448814 - DNA, 15 bp, Homo sapiens
aggatagttttcaaa

SEQ ID NO: 448815 - DNA, 15 bp, Homo sapiens
ggatagttttcaaaa

SEQ ID NO: 448816 - DNA, 15 bp, Homo sapiens
gatagttttcaaaat

SEQ ID NO: 448817 - DNA, 15 bp, Homo sapiens
atagttttcaaaata

SEQ ID NO: 448818 - DNA, 15 bp, Homo sapiens
tagttttcaaaatag

SEQ ID NO: 448819 - DNA, 15 bp, Homo sapiens
agttttcaaaatagg

SEQ ID NO: 448820 - DNA, 15 bp, Homo sapiens
gttttcaaaataggc

SEQ ID NO: 448821 - DNA, 15 bp, Homo sapiens
ttttcaaaataggca

SEQ ID NO: 448822 - DNA, 15 bp, Homo sapiens
tttcaaaataggcaa

SEQ ID NO: 448823 - DNA, 15 bp, Homo sapiens
ttcaaaataggcaaa

SEQ ID NO: 448824 - DNA, 15 bp, Homo sapiens
tcaaaataggcaaaa

SEQ ID NO: 448825 - DNA, 15 bp, Homo sapiens
caaaataggcaaaaa

SEQ ID NO: 448826 - DNA, 15 bp, Homo sapiens
aaaataggcaaaaat

SEQ ID NO: 448827 - DNA, 15 bp, Homo sapiens
aaataggcaaaaatc

SEQ ID NO: 448828 - DNA, 15 bp, Homo sapiens
aataggcaaaaatct

SEQ ID NO: 448829 - DNA, 15 bp, Homo sapiens
ataggcaaaaatctt

SEQ ID NO: 448830 - DNA, 15 bp, Homo sapiens
taggcaaaaatctta

SEQ ID NO: 448831 - DNA, 15 bp, Homo sapiens
aggcaaaaatcttaa

SEQ ID NO: 448832 - DNA, 15 bp, Homo sapiens
ggcaaaaatcttaac

SEQ ID NO: 448833 - DNA, 15 bp, Homo sapiens
gcaaaaatcttaact

SEQ ID NO: 448834 - DNA, 15 bp, Homo sapiens
caaaaatcttaactc

SEQ ID NO: 448835 - DNA, 15 bp, Homo sapiens
aaaaatcttaactct

SEQ ID NO: 448836 - DNA, 15 bp, Homo sapiens
aaaatcttaactctt

SEQ ID NO: 448837 - DNA, 15 bp, Homo sapiens
aaatcttaactctta

SEQ ID NO: 448838 - DNA, 15 bp, Homo sapiens
aatcttaactcttat

SEQ ID NO: 448839 - DNA, 15 bp, Homo sapiens
atcttaactcttata

SEQ ID NO: 448840 - DNA, 15 bp, Homo sapiens
tcttaactcttatac

SEQ ID NO: 448841 - DNA, 15 bp, Homo sapiens
cttaactcttataca

SEQ ID NO: 448842 - DNA, 15 bp, Homo sapiens
ttaactcttatacaa

SEQ ID NO: 448843 - DNA, 15 bp, Homo sapiens
taactcttatacaaa

SEQ ID NO: 448844 - DNA, 15 bp, Homo sapiens
aactcttatacaaat

SEQ ID NO: 448845 - DNA, 15 bp, Homo sapiens
actcttatacaaata

SEQ ID NO: 448846 - DNA, 15 bp, Homo sapiens
ctcttatacaaatac

SEQ ID NO: 448847 - DNA, 15 bp, Homo sapiens
tcttatacaaataca

SEQ ID NO: 448848 - DNA, 15 bp, Homo sapiens
cttatacaaatacaa

SEQ ID NO: 448849 - DNA, 15 bp, Homo sapiens
ttatacaaatacaaa

SEQ ID NO: 448850 - DNA, 15 bp, Homo sapiens
tatacaaatacaaaa

SEQ ID NO: 448851 - DNA, 15 bp, Homo sapiens
atacaaatacaaaaa

SEQ ID NO: 448852 - DNA, 15 bp, Homo sapiens
tacaaatacaaaaag

SEQ ID NO: 448853 - DNA, 15 bp, Homo sapiens
acaaatacaaaaaga

SEQ ID NO: 448854 - DNA, 15 bp, Homo sapiens
caaatacaaaaagag

SEQ ID NO: 448855 - DNA, 15 bp, Homo sapiens
aaatacaaaaagagc

SEQ ID NO: 448856 - DNA, 15 bp, Homo sapiens
aatacaaaaagagca

SEQ ID NO: 448857 - DNA, 15 bp, Homo sapiens
atacaaaaagagcat

SEQ ID NO: 448858 - DNA, 15 bp, Homo sapiens
tacaaaaagagcatg

SEQ ID NO: 448859 - DNA, 15 bp, Homo sapiens
acaaaaagagcatgt

SEQ ID NO: 448860 - DNA, 15 bp, Homo sapiens
caaaaagagcatgtt

SEQ ID NO: 448861 - DNA, 15 bp, Homo sapiens
aaaaagagcatgttt

SEQ ID NO: 448862 - DNA, 15 bp, Homo sapiens
aaaagagcatgtttc

SEQ ID NO: 448863 - DNA, 15 bp, Homo sapiens
aaagagcatgtttca

SEQ ID NO: 448864 - DNA, 15 bp, Homo sapiens
aagagcatgtttcat

SEQ ID NO: 448865 - DNA, 15 bp, Homo sapiens
agagcatgtttcatt

SEQ ID NO: 448866 - DNA, 15 bp, Homo sapiens
gagcatgtttcattt

SEQ ID NO: 448867 - DNA, 15 bp, Homo sapiens
agcatgtttcattta

SEQ ID NO: 448868 - DNA, 15 bp, Homo sapiens
gcatgtttcatttaa

SEQ ID NO: 448869 - DNA, 15 bp, Homo sapiens
catgtttcatttaac

SEQ ID NO: 448870 - DNA, 15 bp, Homo sapiens
atgtttcatttaact

SEQ ID NO: 448871 - DNA, 15 bp, Homo sapiens
tgtttcatttaactc

SEQ ID NO: 448872 - DNA, 15 bp, Homo sapiens
gtttcatttaactca

SEQ ID NO: 448873 - DNA, 15 bp, Homo sapiens
tttcatttaactcat

SEQ ID NO: 448874 - DNA, 15 bp, Homo sapiens
ttcatttaactcata

SEQ ID NO: 448875 - DNA, 15 bp, Homo sapiens
tcatttaactcatag

SEQ ID NO: 448876 - DNA, 15 bp, Homo sapiens
catttaactcatagt

SEQ ID NO: 448877 - DNA, 15 bp, Homo sapiens
atttaactcatagta

SEQ ID NO: 448878 - DNA, 15 bp, Homo sapiens
tttaactcatagtaa

SEQ ID NO: 448879 - DNA, 15 bp, Homo sapiens
ttaactcatagtaag

SEQ ID NO: 448880 - DNA, 15 bp, Homo sapiens
taactcatagtaagg

SEQ ID NO: 448881 - DNA, 15 bp, Homo sapiens
aactcatagtaaggg

SEQ ID NO: 448882 - DNA, 15 bp, Homo sapiens
actcatagtaaggga

SEQ ID NO: 448883 - DNA, 15 bp, Homo sapiens
ctcatagtaagggaa

SEQ ID NO: 448884 - DNA, 15 bp, Homo sapiens
tcatagtaagggaac

SEQ ID NO: 448885 - DNA, 15 bp, Homo sapiens
catagtaagggaacc

SEQ ID NO: 448886 - DNA, 15 bp, Homo sapiens
atagtaagggaacca

SEQ ID NO: 448887 - DNA, 15 bp, Homo sapiens
tagtaagggaaccag

SEQ ID NO: 448888 - DNA, 15 bp, Homo sapiens
agtaagggaaccagt

SEQ ID NO: 448889 - DNA, 15 bp, Homo sapiens
gtaagggaaccagta

SEQ ID NO: 448890 - DNA, 15 bp, Homo sapiens
taagggaaccagtaa

SEQ ID NO: 448891 - DNA, 15 bp, Homo sapiens
aagggaaccagtaag

SEQ ID NO: 448892 - DNA, 15 bp, Homo sapiens
agggaaccagtaaga

SEQ ID NO: 448893 - DNA, 15 bp, Homo sapiens
gggaaccagtaagaa

SEQ ID NO: 448894 - DNA, 15 bp, Homo sapiens
ggaaccagtaagaag

SEQ ID NO: 448895 - DNA, 15 bp, Homo sapiens
gaaccagtaagaagt

SEQ ID NO: 448896 - DNA, 15 bp, Homo sapiens
aaccagtaagaagtt

SEQ ID NO: 448897 - DNA, 15 bp, Homo sapiens
accagtaagaagtta

SEQ ID NO: 448898 - DNA, 15 bp, Homo sapiens
ccagtaagaagttat

SEQ ID NO: 448899 - DNA, 15 bp, Homo sapiens
cagtaagaagttata

SEQ ID NO: 448900 - DNA, 15 bp, Homo sapiens
agtaagaagttataa

SEQ ID NO: 448901 - DNA, 15 bp, Homo sapiens
gtaagaagttataat

SEQ ID NO: 448902 - DNA, 15 bp, Homo sapiens
taagaagttataata

SEQ ID NO: 448903 - DNA, 15 bp, Homo sapiens
aagaagttataatag

SEQ ID NO: 448904 - DNA, 15 bp, Homo sapiens
agaagttataatagg

SEQ ID NO: 448905 - DNA, 15 bp, Homo sapiens
gaagttataataggt

SEQ ID NO: 448906 - DNA, 15 bp, Homo sapiens
aagttataataggtt

SEQ ID NO: 448907 - DNA, 15 bp, Homo sapiens
agttataataggttc

SEQ ID NO: 448908 - DNA, 15 bp, Homo sapiens
gttataataggttcc

SEQ ID NO: 448909 - DNA, 15 bp, Homo sapiens
ttataataggttcca

SEQ ID NO: 448910 - DNA, 15 bp, Homo sapiens
tataataggttccaa

SEQ ID NO: 448911 - DNA, 15 bp, Homo sapiens
ataataggttccaaa

SEQ ID NO: 448912 - DNA, 15 bp, Homo sapiens
taataggttccaaag

SEQ ID NO: 448913 - DNA, 15 bp, Homo sapiens
aataggttccaaaga

SEQ ID NO: 448914 - DNA, 15 bp, Homo sapiens
ataggttccaaagag

SEQ ID NO: 448915 - DNA, 15 bp, Homo sapiens
taggttccaaagaga

SEQ ID NO: 448916 - DNA, 15 bp, Homo sapiens
aggttccaaagagaa

SEQ ID NO: 448917 - DNA, 15 bp, Homo sapiens
ggttccaaagagaat

SEQ ID NO: 448918 - DNA, 15 bp, Homo sapiens
gttccaaagagaata

SEQ ID NO: 448919 - DNA, 15 bp, Homo sapiens
ttccaaagagaatac

SEQ ID NO: 448920 - DNA, 15 bp, Homo sapiens
tccaaagagaataca

SEQ ID NO: 448921 - DNA, 15 bp, Homo sapiens
ccaaagagaatacaa

SEQ ID NO: 448922 - DNA, 15 bp, Homo sapiens
caaagagaatacaaa

SEQ ID NO: 448923 - DNA, 15 bp, Homo sapiens
aaagagaatacaaaa

SEQ ID NO: 448924 - DNA, 15 bp, Homo sapiens
aagagaatacaaaat

SEQ ID NO: 448925 - DNA, 15 bp, Homo sapiens
agagaatacaaaatg

SEQ ID NO: 448926 - DNA, 15 bp, Homo sapiens
gagaatacaaaatgt

SEQ ID NO: 448927 - DNA, 15 bp, Homo sapiens
agaatacaaaatgtc

SEQ ID NO: 448928 - DNA, 15 bp, Homo sapiens
gaatacaaaatgtca

SEQ ID NO: 448929 - DNA, 15 bp, Homo sapiens
aatacaaaatgtcac

SEQ ID NO: 448930 - DNA, 15 bp, Homo sapiens
atacaaaatgtcaca

SEQ ID NO: 448931 - DNA, 15 bp, Homo sapiens
tacaaaatgtcacat

SEQ ID NO: 448932 - DNA, 15 bp, Homo sapiens
acaaaatgtcacata

SEQ ID NO: 448933 - DNA, 15 bp, Homo sapiens
caaaatgtcacatat

SEQ ID NO: 448934 - DNA, 15 bp, Homo sapiens
aaaatgtcacatatt

SEQ ID NO: 448935 - DNA, 15 bp, Homo sapiens
aaatgtcacatattt

SEQ ID NO: 448936 - DNA, 15 bp, Homo sapiens
aatgtcacatattta

SEQ ID NO: 448937 - DNA, 15 bp, Homo sapiens
atgtcacatatttat

SEQ ID NO: 448938 - DNA, 15 bp, Homo sapiens
tgtcacatatttata

SEQ ID NO: 448939 - DNA, 15 bp, Homo sapiens
gtcacatatttatag

SEQ ID NO: 448940 - DNA, 15 bp, Homo sapiens
tcacatatttatagt

SEQ ID NO: 448941 - DNA, 15 bp, Homo sapiens
cacatatttatagtg

SEQ ID NO: 448942 - DNA, 15 bp, Homo sapiens
acatatttatagtga

SEQ ID NO: 448943 - DNA, 15 bp, Homo sapiens
catatttatagtgag

SEQ ID NO: 448944 - DNA, 15 bp, Homo sapiens
atatttatagtgaga

SEQ ID NO: 448945 - DNA, 15 bp, Homo sapiens
tatttatagtgagat

SEQ ID NO: 448946 - DNA, 15 bp, Homo sapiens
atttatagtgagatt

SEQ ID NO: 448947 - DNA, 15 bp, Homo sapiens
tttatagtgagatta

SEQ ID NO: 448948 - DNA, 15 bp, Homo sapiens
ttatagtgagattag

SEQ ID NO: 448949 - DNA, 15 bp, Homo sapiens
tatagtgagattagg

SEQ ID NO: 448950 - DNA, 15 bp, Homo sapiens
atagtgagattaggg

SEQ ID NO: 448951 - DNA, 15 bp, Homo sapiens
tagtgagattaggga

SEQ ID NO: 448952 - DNA, 15 bp, Homo sapiens
agtgagattagggat

SEQ ID NO: 448953 - DNA, 15 bp, Homo sapiens
gtgagattagggatg

SEQ ID NO: 448954 - DNA, 15 bp, Homo sapiens
tgagattagggatgc

SEQ ID NO: 448955 - DNA, 15 bp, Homo sapiens
gagattagggatgct

SEQ ID NO: 448956 - DNA, 15 bp, Homo sapiens
agattagggatgcta

SEQ ID NO: 448957 - DNA, 15 bp, Homo sapiens
gattagggatgctaa

SEQ ID NO: 448958 - DNA, 15 bp, Homo sapiens
attagggatgctaaa

SEQ ID NO: 448959 - DNA, 15 bp, Homo sapiens
ttagggatgctaaaa

SEQ ID NO: 448960 - DNA, 15 bp, Homo sapiens
tagggatgctaaaat

SEQ ID NO: 448961 - DNA, 15 bp, Homo sapiens
agggatgctaaaatg

SEQ ID NO: 448962 - DNA, 15 bp, Homo sapiens
gggatgctaaaatga

SEQ ID NO: 448963 - DNA, 15 bp, Homo sapiens
ggatgctaaaatgaa

SEQ ID NO: 448964 - DNA, 15 bp, Homo sapiens
gatgctaaaatgaat

SEQ ID NO: 448965 - DNA, 15 bp, Homo sapiens
atgctaaaatgaatt

SEQ ID NO: 448966 - DNA, 15 bp, Homo sapiens
tgctaaaatgaattt

SEQ ID NO: 448967 - DNA, 15 bp, Homo sapiens
gctaaaatgaattta

SEQ ID NO: 448968 - DNA, 15 bp, Homo sapiens
ctaaaatgaatttac

SEQ ID NO: 448969 - DNA, 15 bp, Homo sapiens
taaaatgaatttacc

SEQ ID NO: 448970 - DNA, 15 bp, Homo sapiens
aaaatgaatttacct

SEQ ID NO: 448971 - DNA, 15 bp, Homo sapiens
aaatgaatttacctc

SEQ ID NO: 448972 - DNA, 15 bp, Homo sapiens
aatgaatttacctct

SEQ ID NO: 448973 - DNA, 15 bp, Homo sapiens
atgaatttacctctg

SEQ ID NO: 448974 - DNA, 15 bp, Homo sapiens
tgaatttacctctgg

SEQ ID NO: 448975 - DNA, 15 bp, Homo sapiens
gaatttacctctgga

SEQ ID NO: 448976 - DNA, 15 bp, Homo sapiens
aatttacctctggat

SEQ ID NO: 448977 - DNA, 15 bp, Homo sapiens
atttacctctggatg

SEQ ID NO: 448978 - DNA, 15 bp, Homo sapiens
tttacctctggatgc

SEQ ID NO: 448979 - DNA, 15 bp, Homo sapiens
ttacctctggatgca

SEQ ID NO: 448980 - DNA, 15 bp, Homo sapiens
tacctctggatgcaa

SEQ ID NO: 448981 - DNA, 15 bp, Homo sapiens
acctctggatgcaaa

SEQ ID NO: 448982 - DNA, 15 bp, Homo sapiens
cctctggatgcaaag

SEQ ID NO: 448983 - DNA, 15 bp, Homo sapiens
ctctggatgcaaagc

SEQ ID NO: 448984 - DNA, 15 bp, Homo sapiens
tctggatgcaaagct

SEQ ID NO: 448985 - DNA, 15 bp, Homo sapiens
ctggatgcaaagctg

SEQ ID NO: 448986 - DNA, 15 bp, Homo sapiens
tggatgcaaagctga

SEQ ID NO: 448987 - DNA, 15 bp, Homo sapiens
ggatgcaaagctgac

SEQ ID NO: 448988 - DNA, 15 bp, Homo sapiens
gatgcaaagctgaca

SEQ ID NO: 448989 - DNA, 15 bp, Homo sapiens
atgcaaagctgacaa

SEQ ID NO: 448990 - DNA, 15 bp, Homo sapiens
tgcaaagctgacaaa

SEQ ID NO: 448991 - DNA, 15 bp, Homo sapiens
gcaaagctgacaaac

SEQ ID NO: 448992 - DNA, 15 bp, Homo sapiens
caaagctgacaaact

SEQ ID NO: 448993 - DNA, 15 bp, Homo sapiens
aaagctgacaaactg

SEQ ID NO: 448994 - DNA, 15 bp, Homo sapiens
aagctgacaaactgg

SEQ ID NO: 448995 - DNA, 15 bp, Homo sapiens
agctgacaaactggt

SEQ ID NO: 448996 - DNA, 15 bp, Homo sapiens
gctgacaaactggtc

SEQ ID NO: 448997 - DNA, 15 bp, Homo sapiens
ctgacaaactggtca

SEQ ID NO: 448998 - DNA, 15 bp, Homo sapiens
tgacaaactggtcaa

SEQ ID NO: 448999 - DNA, 15 bp, Homo sapiens
gacaaactggtcaat

SEQ ID NO: 449000 - DNA, 15 bp, Homo sapiens
acaaactggtcaata

SEQ ID NO: 449001 - DNA, 15 bp, Homo sapiens
caaactggtcaatat

SEQ ID NO: 449002 - DNA, 15 bp, Homo sapiens
aaactggtcaatatc

SEQ ID NO: 449003 - DNA, 15 bp, Homo sapiens
aactggtcaatatcc

SEQ ID NO: 449004 - DNA, 15 bp, Homo sapiens
actggtcaatatcca

SEQ ID NO: 449005 - DNA, 15 bp, Homo sapiens
ctggtcaatatccac

SEQ ID NO: 449006 - DNA, 15 bp, Homo sapiens
tggtcaatatccaca

SEQ ID NO: 449007 - DNA, 15 bp, Homo sapiens
ggtcaatatccacag

SEQ ID NO: 449008 - DNA, 15 bp, Homo sapiens
gtcaatatccacagg

SEQ ID NO: 449009 - DNA, 15 bp, Homo sapiens
tcaatatccacagga

SEQ ID NO: 449010 - DNA, 15 bp, Homo sapiens
caatatccacaggac

SEQ ID NO: 449011 - DNA, 15 bp, Homo sapiens
aatatccacaggaca

SEQ ID NO: 449012 - DNA, 15 bp, Homo sapiens
atatccacaggacaa

SEQ ID NO: 449013 - DNA, 15 bp, Homo sapiens
tatccacaggacaat

SEQ ID NO: 449014 - DNA, 15 bp, Homo sapiens
atccacaggacaata

SEQ ID NO: 449015 - DNA, 15 bp, Homo sapiens
tccacaggacaataa

SEQ ID NO: 449016 - DNA, 15 bp, Homo sapiens
ccacaggacaataat

SEQ ID NO: 449017 - DNA, 15 bp, Homo sapiens
cacaggacaataatc

SEQ ID NO: 449018 - DNA, 15 bp, Homo sapiens
acaggacaataatca

SEQ ID NO: 449019 - DNA, 15 bp, Homo sapiens
caggacaataatcaa

SEQ ID NO: 449020 - DNA, 15 bp, Homo sapiens
aggacaataatcaat

SEQ ID NO: 449021 - DNA, 15 bp, Homo sapiens
ggacaataatcaatt

SEQ ID NO: 449022 - DNA, 15 bp, Homo sapiens
gacaataatcaattg

SEQ ID NO: 449023 - DNA, 15 bp, Homo sapiens
acaataatcaattgc

SEQ ID NO: 449024 - DNA, 15 bp, Homo sapiens
caataatcaattgca

SEQ ID NO: 449025 - DNA, 15 bp, Homo sapiens
aataatcaattgcat

SEQ ID NO: 449026 - DNA, 15 bp, Homo sapiens
ataatcaattgcatt

SEQ ID NO: 449027 - DNA, 15 bp, Homo sapiens
taatcaattgcattc

SEQ ID NO: 449028 - DNA, 15 bp, Homo sapiens
aatcaattgcattcc

SEQ ID NO: 449029 - DNA, 15 bp, Homo sapiens
atcaattgcattcca

SEQ ID NO: 449030 - DNA, 15 bp, Homo sapiens
tcaattgcattccac

SEQ ID NO: 449031 - DNA, 15 bp, Homo sapiens
caattgcattccact

SEQ ID NO: 449032 - DNA, 15 bp, Homo sapiens
aattgcattccactg

SEQ ID NO: 449033 - DNA, 15 bp, Homo sapiens
attgcattccactgg

SEQ ID NO: 449034 - DNA, 15 bp, Homo sapiens
ttgcattccactggg

SEQ ID NO: 449035 - DNA, 15 bp, Homo sapiens
tgcattccactgggc

SEQ ID NO: 449036 - DNA, 15 bp, Homo sapiens
gcattccactgggca

SEQ ID NO: 449037 - DNA, 15 bp, Homo sapiens
cattccactgggcac

SEQ ID NO: 449038 - DNA, 15 bp, Homo sapiens
attccactgggcaca

SEQ ID NO: 449039 - DNA, 15 bp, Homo sapiens
ttccactgggcacaa

SEQ ID NO: 449040 - DNA, 15 bp, Homo sapiens
tccactgggcacaat

SEQ ID NO: 449041 - DNA, 15 bp, Homo sapiens
ccactgggcacaatt

SEQ ID NO: 449042 - DNA, 15 bp, Homo sapiens
cactgggcacaattt

SEQ ID NO: 449043 - DNA, 15 bp, Homo sapiens
actgggcacaatttg

SEQ ID NO: 449044 - DNA, 15 bp, Homo sapiens
ctgggcacaatttgc

SEQ ID NO: 449045 - DNA, 15 bp, Homo sapiens
tgggcacaatttgca

SEQ ID NO: 449046 - DNA, 15 bp, Homo sapiens
gggcacaatttgcat

SEQ ID NO: 449047 - DNA, 15 bp, Homo sapiens
ggcacaatttgcatt

SEQ ID NO: 449048 - DNA, 15 bp, Homo sapiens
gcacaatttgcattt

SEQ ID NO: 449049 - DNA, 15 bp, Homo sapiens
cacaatttgcattta

SEQ ID NO: 449050 - DNA, 15 bp, Homo sapiens
acaatttgcatttat

SEQ ID NO: 449051 - DNA, 15 bp, Homo sapiens
caatttgcatttata

SEQ ID NO: 449052 - DNA, 15 bp, Homo sapiens
aatttgcatttatat

SEQ ID NO: 449053 - DNA, 15 bp, Homo sapiens
atttgcatttatatg

SEQ ID NO: 449054 - DNA, 15 bp, Homo sapiens
tttgcatttatatgg

SEQ ID NO: 449055 - DNA, 15 bp, Homo sapiens
ttgcatttatatgga

SEQ ID NO: 449056 - DNA, 15 bp, Homo sapiens
tgcatttatatggac

SEQ ID NO: 449057 - DNA, 15 bp, Homo sapiens
gcatttatatggaca

SEQ ID NO: 449058 - DNA, 15 bp, Homo sapiens
catttatatggacag

SEQ ID NO: 449059 - DNA, 15 bp, Homo sapiens
atttatatggacaga

SEQ ID NO: 449060 - DNA, 15 bp, Homo sapiens
tttatatggacagaa

SEQ ID NO: 449061 - DNA, 15 bp, Homo sapiens
ttatatggacagaaa

SEQ ID NO: 449062 - DNA, 15 bp, Homo sapiens
tatatggacagaaat

SEQ ID NO: 449063 - DNA, 15 bp, Homo sapiens
atatggacagaaatc

SEQ ID NO: 449064 - DNA, 15 bp, Homo sapiens
tatggacagaaatca

SEQ ID NO: 449065 - DNA, 15 bp, Homo sapiens
atggacagaaatcat

SEQ ID NO: 449066 - DNA, 15 bp, Homo sapiens
tggacagaaatcatt

SEQ ID NO: 449067 - DNA, 15 bp, Homo sapiens
ggacagaaatcattt

SEQ ID NO: 449068 - DNA, 15 bp, Homo sapiens
gacagaaatcatttg

SEQ ID NO: 449069 - DNA, 15 bp, Homo sapiens
acagaaatcatttgc

SEQ ID NO: 449070 - DNA, 15 bp, Homo sapiens
cagaaatcatttgca

SEQ ID NO: 449071 - DNA, 15 bp, Homo sapiens
agaaatcatttgcat

SEQ ID NO: 449072 - DNA, 15 bp, Homo sapiens
gaaatcatttgcatt

SEQ ID NO: 449073 - DNA, 15 bp, Homo sapiens
aaatcatttgcatta

SEQ ID NO: 449074 - DNA, 15 bp, Homo sapiens
aatcatttgcattac

SEQ ID NO: 449075 - DNA, 15 bp, Homo sapiens
atcatttgcattact

SEQ ID NO: 449076 - DNA, 15 bp, Homo sapiens
tcatttgcattacta

SEQ ID NO: 449077 - DNA, 15 bp, Homo sapiens
catttgcattactat

SEQ ID NO: 449078 - DNA, 15 bp, Homo sapiens
atttgcattactatc

SEQ ID NO: 449079 - DNA, 15 bp, Homo sapiens
tttgcattactatct

SEQ ID NO: 449080 - DNA, 15 bp, Homo sapiens
ttgcattactatctg

SEQ ID NO: 449081 - DNA, 15 bp, Homo sapiens
tgcattactatctgt

SEQ ID NO: 449082 - DNA, 15 bp, Homo sapiens
gcattactatctgtt

SEQ ID NO: 449083 - DNA, 15 bp, Homo sapiens
cattactatctgttt

SEQ ID NO: 449084 - DNA, 15 bp, Homo sapiens
attactatctgtttt

SEQ ID NO: 449085 - DNA, 15 bp, Homo sapiens
ttactatctgttttc

SEQ ID NO: 449086 - DNA, 15 bp, Homo sapiens
tactatctgttttct

SEQ ID NO: 449087 - DNA, 15 bp, Homo sapiens
actatctgttttctt

SEQ ID NO: 449088 - DNA, 15 bp, Homo sapiens
ctatctgttttcttc

SEQ ID NO: 449089 - DNA, 15 bp, Homo sapiens
tatctgttttcttca

SEQ ID NO: 449090 - DNA, 15 bp, Homo sapiens
atctgttttcttcag

SEQ ID NO: 449091 - DNA, 15 bp, Homo sapiens
tctgttttcttcagt

SEQ ID NO: 449092 - DNA, 15 bp, Homo sapiens
ctgttttcttcagtt

SEQ ID NO: 449093 - DNA, 15 bp, Homo sapiens
tgttttcttcagttt

SEQ ID NO: 449094 - DNA, 15 bp, Homo sapiens
gttttcttcagtttg

SEQ ID NO: 449095 - DNA, 15 bp, Homo sapiens
ttttcttcagtttgc

SEQ ID NO: 449096 - DNA, 15 bp, Homo sapiens
tttcttcagtttgca

SEQ ID NO: 449097 - DNA, 15 bp, Homo sapiens
ttcttcagtttgcag

SEQ ID NO: 449098 - DNA, 15 bp, Homo sapiens
tcttcagtttgcaga

SEQ ID NO: 449099 - DNA, 15 bp, Homo sapiens
cttcagtttgcagag

SEQ ID NO: 449100 - DNA, 15 bp, Homo sapiens
ttcagtttgcagagt

SEQ ID NO: 449101 - DNA, 15 bp, Homo sapiens
tcagtttgcagagtt

SEQ ID NO: 449102 - DNA, 15 bp, Homo sapiens
cagtttgcagagttt

SEQ ID NO: 449103 - DNA, 15 bp, Homo sapiens
agtttgcagagttta

SEQ ID NO: 449104 - DNA, 15 bp, Homo sapiens
gtttgcagagtttaa

SEQ ID NO: 449105 - DNA, 15 bp, Homo sapiens
tttgcagagtttaaa

SEQ ID NO: 449106 - DNA, 15 bp, Homo sapiens
ttgcagagtttaaaa

SEQ ID NO: 449107 - DNA, 15 bp, Homo sapiens
tgcagagtttaaaat

SEQ ID NO: 449108 - DNA, 15 bp, Homo sapiens
gcagagtttaaaata

SEQ ID NO: 449109 - DNA, 15 bp, Homo sapiens
cagagtttaaaatag

SEQ ID NO: 449110 - DNA, 15 bp, Homo sapiens
agagtttaaaatagc

SEQ ID NO: 449111 - DNA, 15 bp, Homo sapiens
gagtttaaaatagct

SEQ ID NO: 449112 - DNA, 15 bp, Homo sapiens
agtttaaaatagctc

SEQ ID NO: 449113 - DNA, 15 bp, Homo sapiens
gtttaaaatagctca

SEQ ID NO: 449114 - DNA, 15 bp, Homo sapiens
tttaaaatagctcag

SEQ ID NO: 449115 - DNA, 15 bp, Homo sapiens
ttaaaatagctcaga

SEQ ID NO: 449116 - DNA, 15 bp, Homo sapiens
taaaatagctcagag

SEQ ID NO: 449117 - DNA, 15 bp, Homo sapiens
aaaatagctcagaga

SEQ ID NO: 449118 - DNA, 15 bp, Homo sapiens
aaatagctcagagat

SEQ ID NO: 449119 - DNA, 15 bp, Homo sapiens
aatagctcagagata

SEQ ID NO: 449120 - DNA, 15 bp, Homo sapiens
atagctcagagataa

SEQ ID NO: 449121 - DNA, 15 bp, Homo sapiens
tagctcagagataat

SEQ ID NO: 449122 - DNA, 15 bp, Homo sapiens
agctcagagataatt

SEQ ID NO: 449123 - DNA, 15 bp, Homo sapiens
gctcagagataattt

SEQ ID NO: 449124 - DNA, 15 bp, Homo sapiens
ctcagagataattta

SEQ ID NO: 449125 - DNA, 15 bp, Homo sapiens
tcagagataatttaa

SEQ ID NO: 449126 - DNA, 15 bp, Homo sapiens
cagagataatttaag

SEQ ID NO: 449127 - DNA, 15 bp, Homo sapiens
agagataatttaagc

SEQ ID NO: 449128 - DNA, 15 bp, Homo sapiens
gagataatttaagct

SEQ ID NO: 449129 - DNA, 15 bp, Homo sapiens
agataatttaagctt

SEQ ID NO: 449130 - DNA, 15 bp, Homo sapiens
gataatttaagcttt

SEQ ID NO: 449131 - DNA, 15 bp, Homo sapiens
ataatttaagctttg

SEQ ID NO: 449132 - DNA, 15 bp, Homo sapiens
taatttaagctttgc

SEQ ID NO: 449133 - DNA, 15 bp, Homo sapiens
aatttaagctttgca

SEQ ID NO: 449134 - DNA, 15 bp, Homo sapiens
atttaagctttgcag

SEQ ID NO: 449135 - DNA, 15 bp, Homo sapiens
tttaagctttgcagg

SEQ ID NO: 449136 - DNA, 15 bp, Homo sapiens
ttaagctttgcagga

SEQ ID NO: 449137 - DNA, 15 bp, Homo sapiens
taagctttgcaggat

SEQ ID NO: 449138 - DNA, 15 bp, Homo sapiens
aagctttgcaggata

SEQ ID NO: 449139 - DNA, 15 bp, Homo sapiens
agctttgcaggatac

SEQ ID NO: 449140 - DNA, 15 bp, Homo sapiens
gctttgcaggatacc

SEQ ID NO: 449141 - DNA, 15 bp, Homo sapiens
ctttgcaggataccc

SEQ ID NO: 449142 - DNA, 15 bp, Homo sapiens
tttgcaggataccca

SEQ ID NO: 449143 - DNA, 15 bp, Homo sapiens
ttgcaggatacccac

SEQ ID NO: 449144 - DNA, 15 bp, Homo sapiens
tgcaggatacccact

SEQ ID NO: 449145 - DNA, 15 bp, Homo sapiens
gcaggatacccactc

SEQ ID NO: 449146 - DNA, 15 bp, Homo sapiens
caggatacccactca

SEQ ID NO: 449147 - DNA, 15 bp, Homo sapiens
aggatacccactcat

SEQ ID NO: 449148 - DNA, 15 bp, Homo sapiens
ggatacccactcatt

SEQ ID NO: 449149 - DNA, 15 bp, Homo sapiens
gatacccactcattt

SEQ ID NO: 449150 - DNA, 15 bp, Homo sapiens
atacccactcatttt

SEQ ID NO: 449151 - DNA, 15 bp, Homo sapiens
tacccactcattttt

SEQ ID NO: 449152 - DNA, 15 bp, Homo sapiens
acccactcatttttt

SEQ ID NO: 449153 - DNA, 15 bp, Homo sapiens
cccactcattttttg

SEQ ID NO: 449154 - DNA, 15 bp, Homo sapiens
ccactcattttttgc

SEQ ID NO: 449155 - DNA, 15 bp, Homo sapiens
cactcattttttgcc

SEQ ID NO: 449156 - DNA, 15 bp, Homo sapiens
actcattttttgccc

SEQ ID NO: 449157 - DNA, 15 bp, Homo sapiens
ctcattttttgccca

SEQ ID NO: 449158 - DNA, 15 bp, Homo sapiens
tcattttttgcccac

SEQ ID NO: 449159 - DNA, 15 bp, Homo sapiens
cattttttgcccaca

SEQ ID NO: 449160 - DNA, 15 bp, Homo sapiens
attttttgcccacaa

SEQ ID NO: 449161 - DNA, 15 bp, Homo sapiens
ttttttgcccacaac

SEQ ID NO: 449162 - DNA, 15 bp, Homo sapiens
tttttgcccacaaca

SEQ ID NO: 449163 - DNA, 15 bp, Homo sapiens
ttttgcccacaacaa

SEQ ID NO: 449164 - DNA, 15 bp, Homo sapiens
tttgcccacaacaaa

SEQ ID NO: 449165 - DNA, 15 bp, Homo sapiens
ttgcccacaacaaag

SEQ ID NO: 449166 - DNA, 15 bp, Homo sapiens
tgcccacaacaaaga

SEQ ID NO: 449167 - DNA, 15 bp, Homo sapiens
gcccacaacaaagac

SEQ ID NO: 449168 - DNA, 15 bp, Homo sapiens
cccacaacaaagacc

SEQ ID NO: 449169 - DNA, 15 bp, Homo sapiens
ccacaacaaagacct

SEQ ID NO: 449170 - DNA, 15 bp, Homo sapiens
cacaacaaagacctt

SEQ ID NO: 449171 - DNA, 15 bp, Homo sapiens
acaacaaagaccttc

SEQ ID NO: 449172 - DNA, 15 bp, Homo sapiens
caacaaagaccttca

SEQ ID NO: 449173 - DNA, 15 bp, Homo sapiens
aacaaagaccttcac

SEQ ID NO: 449174 - DNA, 15 bp, Homo sapiens
acaaagaccttcaca

SEQ ID NO: 449175 - DNA, 15 bp, Homo sapiens
caaagaccttcacaa

SEQ ID NO: 449176 - DNA, 15 bp, Homo sapiens
aaagaccttcacaat

SEQ ID NO: 449177 - DNA, 15 bp, Homo sapiens
aagaccttcacaatt

SEQ ID NO: 449178 - DNA, 15 bp, Homo sapiens
agaccttcacaattt

SEQ ID NO: 449179 - DNA, 15 bp, Homo sapiens
gaccttcacaatttt

SEQ ID NO: 449180 - DNA, 15 bp, Homo sapiens
accttcacaattttt

SEQ ID NO: 449181 - DNA, 15 bp, Homo sapiens
ccttcacaatttttc

SEQ ID NO: 449182 - DNA, 15 bp, Homo sapiens
cttcacaatttttcc

SEQ ID NO: 449183 - DNA, 15 bp, Homo sapiens
ttcacaatttttccc

SEQ ID NO: 449184 - DNA, 15 bp, Homo sapiens
tcacaatttttccct

SEQ ID NO: 449185 - DNA, 15 bp, Homo sapiens
cacaatttttccctg

SEQ ID NO: 449186 - DNA, 15 bp, Homo sapiens
acaatttttccctgc

SEQ ID NO: 449187 - DNA, 15 bp, Homo sapiens
caatttttccctgca

SEQ ID NO: 449188 - DNA, 15 bp, Homo sapiens
aatttttccctgcac

SEQ ID NO: 449189 - DNA, 15 bp, Homo sapiens
atttttccctgcaca

SEQ ID NO: 449190 - DNA, 15 bp, Homo sapiens
tttttccctgcacag

SEQ ID NO: 449191 - DNA, 15 bp, Homo sapiens
ttttccctgcacagg

SEQ ID NO: 449192 - DNA, 15 bp, Homo sapiens
tttccctgcacaggc

SEQ ID NO: 449193 - DNA, 15 bp, Homo sapiens
ttccctgcacaggca

SEQ ID NO: 449194 - DNA, 15 bp, Homo sapiens
tccctgcacaggcaa

SEQ ID NO: 449195 - DNA, 15 bp, Homo sapiens
ccctgcacaggcaaa

SEQ ID NO: 449196 - DNA, 15 bp, Homo sapiens
cctgcacaggcaaaa

SEQ ID NO: 449197 - DNA, 15 bp, Homo sapiens
ctgcacaggcaaaac

SEQ ID NO: 449198 - DNA, 15 bp, Homo sapiens
tgcacaggcaaaact

SEQ ID NO: 449199 - DNA, 15 bp, Homo sapiens
gcacaggcaaaactg

SEQ ID NO: 449200 - DNA, 15 bp, Homo sapiens
cacaggcaaaactgg

SEQ ID NO: 449201 - DNA, 15 bp, Homo sapiens
acaggcaaaactgga

SEQ ID NO: 449202 - DNA, 15 bp, Homo sapiens
caggcaaaactggat

SEQ ID NO: 449203 - DNA, 15 bp, Homo sapiens
aggcaaaactggatg

SEQ ID NO: 449204 - DNA, 15 bp, Homo sapiens
ggcaaaactggatgg

SEQ ID NO: 449205 - DNA, 15 bp, Homo sapiens
gcaaaactggatggc

SEQ ID NO: 449206 - DNA, 15 bp, Homo sapiens
caaaactggatggct

SEQ ID NO: 449207 - DNA, 15 bp, Homo sapiens
aaaactggatggctg

SEQ ID NO: 449208 - DNA, 15 bp, Homo sapiens
aaactggatggctgg

SEQ ID NO: 449209 - DNA, 15 bp, Homo sapiens
aactggatggctggc

SEQ ID NO: 449210 - DNA, 15 bp, Homo sapiens
actggatggctggcc

SEQ ID NO: 449211 - DNA, 15 bp, Homo sapiens
ctggatggctggcca

SEQ ID NO: 449212 - DNA, 15 bp, Homo sapiens
tggatggctggccag

SEQ ID NO: 449213 - DNA, 15 bp, Homo sapiens
ggatggctggccagc

SEQ ID NO: 449214 - DNA, 15 bp, Homo sapiens
gatggctggccagcc

SEQ ID NO: 449215 - DNA, 15 bp, Homo sapiens
atggctggccagcct

SEQ ID NO: 449216 - DNA, 15 bp, Homo sapiens
tggctggccagccta

SEQ ID NO: 449217 - DNA, 15 bp, Homo sapiens
ggctggccagcctag

SEQ ID NO: 449218 - DNA, 15 bp, Homo sapiens
gctggccagcctagt

SEQ ID NO: 449219 - DNA, 15 bp, Homo sapiens
ctggccagcctagtt

SEQ ID NO: 449220 - DNA, 15 bp, Homo sapiens
tggccagcctagtta

SEQ ID NO: 449221 - DNA, 15 bp, Homo sapiens
ggccagcctagttac

SEQ ID NO: 449222 - DNA, 15 bp, Homo sapiens
gccagcctagttaca

SEQ ID NO: 449223 - DNA, 15 bp, Homo sapiens
ccagcctagttacat

SEQ ID NO: 449224 - DNA, 15 bp, Homo sapiens
cagcctagttacatg

SEQ ID NO: 449225 - DNA, 15 bp, Homo sapiens
agcctagttacatgt

SEQ ID NO: 449226 - DNA, 15 bp, Homo sapiens
gcctagttacatgtc

SEQ ID NO: 449227 - DNA, 15 bp, Homo sapiens
cctagttacatgtca

SEQ ID NO: 449228 - DNA, 15 bp, Homo sapiens
ctagttacatgtcac

SEQ ID NO: 449229 - DNA, 15 bp, Homo sapiens
tagttacatgtcaca

SEQ ID NO: 449230 - DNA, 15 bp, Homo sapiens
agttacatgtcacat

SEQ ID NO: 449231 - DNA, 15 bp, Homo sapiens
gttacatgtcacatg

SEQ ID NO: 449232 - DNA, 15 bp, Homo sapiens
ttacatgtcacatgt

SEQ ID NO: 449233 - DNA, 15 bp, Homo sapiens
tacatgtcacatgtt

SEQ ID NO: 449234 - DNA, 15 bp, Homo sapiens
acatgtcacatgttc

SEQ ID NO: 449235 - DNA, 15 bp, Homo sapiens
catgtcacatgttct

SEQ ID NO: 449236 - DNA, 15 bp, Homo sapiens
atgtcacatgttctc

SEQ ID NO: 449237 - DNA, 15 bp, Homo sapiens
tgtcacatgttctca

SEQ ID NO: 449238 - DNA, 15 bp, Homo sapiens
gtcacatgttctcac

SEQ ID NO: 449239 - DNA, 15 bp, Homo sapiens
tcacatgttctcact

SEQ ID NO: 449240 - DNA, 15 bp, Homo sapiens
cacatgttctcacta

SEQ ID NO: 449241 - DNA, 15 bp, Homo sapiens
acatgttctcactat

SEQ ID NO: 449242 - DNA, 15 bp, Homo sapiens
catgttctcactatt

SEQ ID NO: 449243 - DNA, 15 bp, Homo sapiens
atgttctcactattg

SEQ ID NO: 449244 - DNA, 15 bp, Homo sapiens
tgttctcactattgt

SEQ ID NO: 449245 - DNA, 15 bp, Homo sapiens
gttctcactattgtt

SEQ ID NO: 449246 - DNA, 15 bp, Homo sapiens
ttctcactattgttt

SEQ ID NO: 449247 - DNA, 15 bp, Homo sapiens
tctcactattgtttg

SEQ ID NO: 449248 - DNA, 15 bp, Homo sapiens
ctcactattgtttgc

SEQ ID NO: 449249 - DNA, 15 bp, Homo sapiens
tcactattgtttgct

SEQ ID NO: 449250 - DNA, 15 bp, Homo sapiens
cactattgtttgctt

SEQ ID NO: 449251 - DNA, 15 bp, Homo sapiens
actattgtttgcttc

SEQ ID NO: 449252 - DNA, 15 bp, Homo sapiens
ctattgtttgcttca

SEQ ID NO: 449253 - DNA, 15 bp, Homo sapiens
tattgtttgcttcat

SEQ ID NO: 449254 - DNA, 15 bp, Homo sapiens
attgtttgcttcata

SEQ ID NO: 449255 - DNA, 15 bp, Homo sapiens
ttgtttgcttcatat

SEQ ID NO: 449256 - DNA, 15 bp, Homo sapiens
tgtttgcttcatatg

SEQ ID NO: 449257 - DNA, 15 bp, Homo sapiens
gtttgcttcatatga

SEQ ID NO: 449258 - DNA, 15 bp, Homo sapiens
tttgcttcatatgat

SEQ ID NO: 449259 - DNA, 15 bp, Homo sapiens
ttgcttcatatgatt

SEQ ID NO: 449260 - DNA, 15 bp, Homo sapiens
tgcttcatatgattt

SEQ ID NO: 449261 - DNA, 15 bp, Homo sapiens
gcttcatatgatttt

SEQ ID NO: 449262 - DNA, 15 bp, Homo sapiens
cttcatatgattttg

SEQ ID NO: 449263 - DNA, 15 bp, Homo sapiens
ttcatatgattttgt

SEQ ID NO: 449264 - DNA, 15 bp, Homo sapiens
tcatatgattttgta

SEQ ID NO: 449265 - DNA, 15 bp, Homo sapiens
catatgattttgtac

SEQ ID NO: 449266 - DNA, 15 bp, Homo sapiens
atatgattttgtact

SEQ ID NO: 449267 - DNA, 15 bp, Homo sapiens
tatgattttgtactt

SEQ ID NO: 449268 - DNA, 15 bp, Homo sapiens
atgattttgtactta

SEQ ID NO: 449269 - DNA, 15 bp, Homo sapiens
tgattttgtacttaa

SEQ ID NO: 449270 - DNA, 15 bp, Homo sapiens
gattttgtacttaac

SEQ ID NO: 449271 - DNA, 15 bp, Homo sapiens
attttgtacttaact

SEQ ID NO: 449272 - DNA, 15 bp, Homo sapiens
ttttgtacttaactg

SEQ ID NO: 449273 - DNA, 15 bp, Homo sapiens
tttgtacttaactgt

SEQ ID NO: 449274 - DNA, 15 bp, Homo sapiens
ttgtacttaactgtt

SEQ ID NO: 449275 - DNA, 15 bp, Homo sapiens
tgtacttaactgtta

SEQ ID NO: 449276 - DNA, 15 bp, Homo sapiens
gtacttaactgttaa

SEQ ID NO: 449277 - DNA, 15 bp, Homo sapiens
tacttaactgttaat

SEQ ID NO: 449278 - DNA, 15 bp, Homo sapiens
acttaactgttaatt

SEQ ID NO: 449279 - DNA, 15 bp, Homo sapiens
cttaactgttaattg

SEQ ID NO: 449280 - DNA, 15 bp, Homo sapiens
ttaactgttaattgc

SEQ ID NO: 449281 - DNA, 15 bp, Homo sapiens
taactgttaattgct

SEQ ID NO: 449282 - DNA, 15 bp, Homo sapiens
aactgttaattgcta

SEQ ID NO: 449283 - DNA, 15 bp, Homo sapiens
actgttaattgctac

SEQ ID NO: 449284 - DNA, 15 bp, Homo sapiens
ctgttaattgctact

SEQ ID NO: 449285 - DNA, 15 bp, Homo sapiens
tgttaattgctactt

SEQ ID NO: 449286 - DNA, 15 bp, Homo sapiens
gttaattgctacttt

SEQ ID NO: 449287 - DNA, 15 bp, Homo sapiens
ttaattgctactttg

SEQ ID NO: 449288 - DNA, 15 bp, Homo sapiens
taattgctactttgt

SEQ ID NO: 449289 - DNA, 15 bp, Homo sapiens
aattgctactttgtt

SEQ ID NO: 449290 - DNA, 15 bp, Homo sapiens
attgctactttgttt

SEQ ID NO: 449291 - DNA, 15 bp, Homo sapiens
ttgctactttgtttt

SEQ ID NO: 449292 - DNA, 15 bp, Homo sapiens
tgctactttgttttt

SEQ ID NO: 449293 - DNA, 15 bp, Homo sapiens
gctactttgtttttt

SEQ ID NO: 449294 - DNA, 15 bp, Homo sapiens
ctactttgttttttg

SEQ ID NO: 449295 - DNA, 15 bp, Homo sapiens
tactttgttttttgt

SEQ ID NO: 449296 - DNA, 15 bp, Homo sapiens
actttgttttttgtt

SEQ ID NO: 449297 - DNA, 15 bp, Homo sapiens
gttttttgttttgtt

SEQ ID NO: 449298 - DNA, 15 bp, Homo sapiens
ttgttttgttttttt

SEQ ID NO: 449299 - DNA, 15 bp, Homo sapiens
gttttgttttttttt

SEQ ID NO: 449300 - DNA, 15 bp, Homo sapiens
gttttttttttttta

SEQ ID NO: 449301 - DNA, 15 bp, Homo sapiens
tttttttttaatttt

SEQ ID NO: 449302 - DNA, 15 bp, Homo sapiens
tttttaattttattc

SEQ ID NO: 449303 - DNA, 15 bp, Homo sapiens
ttttaattttattct

SEQ ID NO: 449304 - DNA, 15 bp, Homo sapiens
tttaattttattctt

SEQ ID NO: 449305 - DNA, 15 bp, Homo sapiens
ttaattttattcttg

SEQ ID NO: 449306 - DNA, 15 bp, Homo sapiens
taattttattcttgg

SEQ ID NO: 449307 - DNA, 15 bp, Homo sapiens
aattttattcttgga

SEQ ID NO: 449308 - DNA, 15 bp, Homo sapiens
attttattcttggat

SEQ ID NO: 449309 - DNA, 15 bp, Homo sapiens
ttttattcttggata

SEQ ID NO: 449310 - DNA, 15 bp, Homo sapiens
tttattcttggatag

SEQ ID NO: 449311 - DNA, 15 bp, Homo sapiens
ttattcttggataga

SEQ ID NO: 449312 - DNA, 15 bp, Homo sapiens
tattcttggatagat

SEQ ID NO: 449313 - DNA, 15 bp, Homo sapiens
attcttggatagatt

SEQ ID NO: 449314 - DNA, 15 bp, Homo sapiens
ttcttggatagattc

SEQ ID NO: 449315 - DNA, 15 bp, Homo sapiens
tcttggatagattcc

SEQ ID NO: 449316 - DNA, 15 bp, Homo sapiens
cttggatagattccc

SEQ ID NO: 449317 - DNA, 15 bp, Homo sapiens
ttggatagattccca

SEQ ID NO: 449318 - DNA, 15 bp, Homo sapiens
tggatagattcccat

SEQ ID NO: 449319 - DNA, 15 bp, Homo sapiens
ggatagattcccatg

SEQ ID NO: 449320 - DNA, 15 bp, Homo sapiens
gatagattcccatgg

SEQ ID NO: 449321 - DNA, 15 bp, Homo sapiens
atagattcccatggc

SEQ ID NO: 449322 - DNA, 15 bp, Homo sapiens
tagattcccatggct

SEQ ID NO: 449323 - DNA, 15 bp, Homo sapiens
agattcccatggctg

SEQ ID NO: 449324 - DNA, 15 bp, Homo sapiens
gattcccatggctgt

SEQ ID NO: 449325 - DNA, 15 bp, Homo sapiens
attcccatggctgtt

SEQ ID NO: 449326 - DNA, 15 bp, Homo sapiens
ttcccatggctgttg

SEQ ID NO: 449327 - DNA, 15 bp, Homo sapiens
tcccatggctgttgc

SEQ ID NO: 449328 - DNA, 15 bp, Homo sapiens
cccatggctgttgcc

SEQ ID NO: 449329 - DNA, 15 bp, Homo sapiens
ccatggctgttgcct

SEQ ID NO: 449330 - DNA, 15 bp, Homo sapiens
catggctgttgcctt

SEQ ID NO: 449331 - DNA, 15 bp, Homo sapiens
atggctgttgccttt

SEQ ID NO: 449332 - DNA, 15 bp, Homo sapiens
tggctgttgcctttt

SEQ ID NO: 449333 - DNA, 15 bp, Homo sapiens
ggctgttgcctttta

SEQ ID NO: 449334 - DNA, 15 bp, Homo sapiens
gctgttgccttttaa

SEQ ID NO: 449335 - DNA, 15 bp, Homo sapiens
ctgttgccttttaaa

SEQ ID NO: 449336 - DNA, 15 bp, Homo sapiens
tgttgccttttaaag

SEQ ID NO: 449337 - DNA, 15 bp, Homo sapiens
gttgccttttaaaga

SEQ ID NO: 449338 - DNA, 15 bp, Homo sapiens
ttgccttttaaagag

SEQ ID NO: 449339 - DNA, 15 bp, Homo sapiens
tgccttttaaagaga

SEQ ID NO: 449340 - DNA, 15 bp, Homo sapiens
gccttttaaagagag

SEQ ID NO: 449341 - DNA, 15 bp, Homo sapiens
ccttttaaagagagg

SEQ ID NO: 449342 - DNA, 15 bp, Homo sapiens
cttttaaagagagga

SEQ ID NO: 449343 - DNA, 15 bp, Homo sapiens
ttttaaagagaggat

SEQ ID NO: 449344 - DNA, 15 bp, Homo sapiens
tttaaagagaggatt

SEQ ID NO: 449345 - DNA, 15 bp, Homo sapiens
ttaaagagaggattt

SEQ ID NO: 449346 - DNA, 15 bp, Homo sapiens
taaagagaggatttt

SEQ ID NO: 449347 - DNA, 15 bp, Homo sapiens
aaagagaggattttt

SEQ ID NO: 449348 - DNA, 15 bp, Homo sapiens
aagagaggattttta

SEQ ID NO: 449349 - DNA, 15 bp, Homo sapiens
agagaggatttttag

SEQ ID NO: 449350 - DNA, 15 bp, Homo sapiens
gagaggatttttagt

SEQ ID NO: 449351 - DNA, 15 bp, Homo sapiens
agaggatttttagta

SEQ ID NO: 449352 - DNA, 15 bp, Homo sapiens
gaggatttttagtaa

SEQ ID NO: 449353 - DNA, 15 bp, Homo sapiens
aggatttttagtaat

SEQ ID NO: 449354 - DNA, 15 bp, Homo sapiens
ggatttttagtaata

SEQ ID NO: 449355 - DNA, 15 bp, Homo sapiens
gatttttagtaataa

SEQ ID NO: 449356 - DNA, 15 bp, Homo sapiens
atttttagtaataaa

SEQ ID NO: 449357 - DNA, 15 bp, Homo sapiens
tttttagtaataaaa

SEQ ID NO: 449358 - DNA, 15 bp, Homo sapiens
ttttagtaataaaat

SEQ ID NO: 449359 - DNA, 15 bp, Homo sapiens
tttagtaataaaatc

SEQ ID NO: 449360 - DNA, 15 bp, Homo sapiens
ttagtaataaaatca

SEQ ID NO: 449361 - DNA, 15 bp, Homo sapiens
tagtaataaaatcat

SEQ ID NO: 449362 - DNA, 15 bp, Homo sapiens
agtaataaaatcata

SEQ ID NO: 449363 - DNA, 15 bp, Homo sapiens
gtaataaaatcataa

SEQ ID NO: 449364 - DNA, 15 bp, Homo sapiens
taataaaatcataat

SEQ ID NO: 449365 - DNA, 15 bp, Homo sapiens
taaaatcataatttt

SEQ ID NO: 449366 - DNA, 15 bp, Homo sapiens
aaaatcataatttta

SEQ ID NO: 449367 - DNA, 15 bp, Homo sapiens
aaatcataattttat

SEQ ID NO: 449368 - DNA, 15 bp, Homo sapiens
aatcataattttatt

SEQ ID NO: 449369 - DNA, 15 bp, Homo sapiens
atcataattttattt

SEQ ID NO: 449370 - DNA, 15 bp, Homo sapiens
tcataattttatttt

SEQ ID NO: 449371 - DNA, 15 bp, Homo sapiens
cataattttatttta

SEQ ID NO: 449372 - DNA, 15 bp, Homo sapiens
ataattttattttag

SEQ ID NO: 449373 - DNA, 15 bp, Homo sapiens
taattttattttaga

SEQ ID NO: 449374 - DNA, 15 bp, Homo sapiens
aattttattttagag

SEQ ID NO: 449375 - DNA, 15 bp, Homo sapiens
attttattttagagc

SEQ ID NO: 449376 - DNA, 15 bp, Homo sapiens
ttttattttagagct

SEQ ID NO: 449377 - DNA, 15 bp, Homo sapiens
tttattttagagctt

SEQ ID NO: 449378 - DNA, 15 bp, Homo sapiens
ttattttagagctta

SEQ ID NO: 449379 - DNA, 15 bp, Homo sapiens
tattttagagcttat

SEQ ID NO: 449380 - DNA, 15 bp, Homo sapiens
attttagagcttatc

SEQ ID NO: 449381 - DNA, 15 bp, Homo sapiens
ttttagagcttatca

SEQ ID NO: 449382 - DNA, 15 bp, Homo sapiens
tttagagcttatcaa

SEQ ID NO: 449383 - DNA, 15 bp, Homo sapiens
ttagagcttatcaag

SEQ ID NO: 449384 - DNA, 15 bp, Homo sapiens
tagagcttatcaagc

SEQ ID NO: 449385 - DNA, 15 bp, Homo sapiens
agagcttatcaagct

SEQ ID NO: 449386 - DNA, 15 bp, Homo sapiens
gagcttatcaagctg

SEQ ID NO: 449387 - DNA, 15 bp, Homo sapiens
agcttatcaagctgc

SEQ ID NO: 449388 - DNA, 15 bp, Homo sapiens
gcttatcaagctgca

SEQ ID NO: 449389 - DNA, 15 bp, Homo sapiens
cttatcaagctgcac

SEQ ID NO: 449390 - DNA, 15 bp, Homo sapiens
ttatcaagctgcaca

SEQ ID NO: 449391 - DNA, 15 bp, Homo sapiens
tatcaagctgcacaa

SEQ ID NO: 449392 - DNA, 15 bp, Homo sapiens
atcaagctgcacaat

SEQ ID NO: 449393 - DNA, 15 bp, Homo sapiens
tcaagctgcacaata

SEQ ID NO: 449394 - DNA, 15 bp, Homo sapiens
caagctgcacaatat

SEQ ID NO: 449395 - DNA, 15 bp, Homo sapiens
aagctgcacaatatg

SEQ ID NO: 449396 - DNA, 15 bp, Homo sapiens
agctgcacaatatga

SEQ ID NO: 449397 - DNA, 15 bp, Homo sapiens
gctgcacaatatgaa

SEQ ID NO: 449398 - DNA, 15 bp, Homo sapiens
ctgcacaatatgaag

SEQ ID NO: 449399 - DNA, 15 bp, Homo sapiens
tgcacaatatgaagt

SEQ ID NO: 449400 - DNA, 15 bp, Homo sapiens
gcacaatatgaagtc

SEQ ID NO: 449401 - DNA, 15 bp, Homo sapiens
cacaatatgaagtcc

SEQ ID NO: 449402 - DNA, 15 bp, Homo sapiens
acaatatgaagtccc

SEQ ID NO: 449403 - DNA, 15 bp, Homo sapiens
caatatgaagtccca

SEQ ID NO: 449404 - DNA, 15 bp, Homo sapiens
aatatgaagtcccac

SEQ ID NO: 449405 - DNA, 15 bp, Homo sapiens
atatgaagtcccact

SEQ ID NO: 449406 - DNA, 15 bp, Homo sapiens
tatgaagtcccactc

SEQ ID NO: 449407 - DNA, 15 bp, Homo sapiens
atgaagtcccactcc

SEQ ID NO: 449408 - DNA, 15 bp, Homo sapiens
tgaagtcccactccc

SEQ ID NO: 449409 - DNA, 15 bp, Homo sapiens
gaagtcccactccct

SEQ ID NO: 449410 - DNA, 15 bp, Homo sapiens
aagtcccactccctg

SEQ ID NO: 449411 - DNA, 15 bp, Homo sapiens
agtcccactccctgt

SEQ ID NO: 449412 - DNA, 15 bp, Homo sapiens
gtcccactccctgtt

SEQ ID NO: 449413 - DNA, 15 bp, Homo sapiens
tcccactccctgttc

SEQ ID NO: 449414 - DNA, 15 bp, Homo sapiens
cccactccctgttca

SEQ ID NO: 449415 - DNA, 15 bp, Homo sapiens
ccactccctgttcat

SEQ ID NO: 449416 - DNA, 15 bp, Homo sapiens
cactccctgttcata

SEQ ID NO: 449417 - DNA, 15 bp, Homo sapiens
actccctgttcatat

SEQ ID NO: 449418 - DNA, 15 bp, Homo sapiens
ctccctgttcatatt

SEQ ID NO: 449419 - DNA, 15 bp, Homo sapiens
tccctgttcatattt

SEQ ID NO: 449420 - DNA, 15 bp, Homo sapiens
ccctgttcatatttg

SEQ ID NO: 449421 - DNA, 15 bp, Homo sapiens
cctgttcatatttga

SEQ ID NO: 449422 - DNA, 15 bp, Homo sapiens
ctgttcatatttgag

SEQ ID NO: 449423 - DNA, 15 bp, Homo sapiens
tgttcatatttgaga

SEQ ID NO: 449424 - DNA, 15 bp, Homo sapiens
gttcatatttgagat

SEQ ID NO: 449425 - DNA, 15 bp, Homo sapiens
ttcatatttgagatt

SEQ ID NO: 449426 - DNA, 15 bp, Homo sapiens
tcatatttgagatta

SEQ ID NO: 449427 - DNA, 15 bp, Homo sapiens
catatttgagattaa

SEQ ID NO: 449428 - DNA, 15 bp, Homo sapiens
atatttgagattaat

SEQ ID NO: 449429 - DNA, 15 bp, Homo sapiens
tatttgagattaatt

SEQ ID NO: 449430 - DNA, 15 bp, Homo sapiens
atttgagattaatta

SEQ ID NO: 449431 - DNA, 15 bp, Homo sapiens
tttgagattaattag

SEQ ID NO: 449432 - DNA, 15 bp, Homo sapiens
ttgagattaattaga

SEQ ID NO: 449433 - DNA, 15 bp, Homo sapiens
tgagattaattagaa

SEQ ID NO: 449434 - DNA, 15 bp, Homo sapiens
gagattaattagaac

SEQ ID NO: 449435 - DNA, 15 bp, Homo sapiens
agattaattagaacc

SEQ ID NO: 449436 - DNA, 15 bp, Homo sapiens
gattaattagaaccc

SEQ ID NO: 449437 - DNA, 15 bp, Homo sapiens
attaattagaaccca

SEQ ID NO: 449438 - DNA, 15 bp, Homo sapiens
ttaattagaacccaa

SEQ ID NO: 449439 - DNA, 15 bp, Homo sapiens
taattagaacccaag

SEQ ID NO: 449440 - DNA, 15 bp, Homo sapiens
aattagaacccaagc

SEQ ID NO: 449441 - DNA, 15 bp, Homo sapiens
attagaacccaagct

SEQ ID NO: 449442 - DNA, 15 bp, Homo sapiens
ttagaacccaagctg

SEQ ID NO: 449443 - DNA, 15 bp, Homo sapiens
tagaacccaagctgt

SEQ ID NO: 449444 - DNA, 15 bp, Homo sapiens
agaacccaagctgtt

SEQ ID NO: 449445 - DNA, 15 bp, Homo sapiens
gaacccaagctgttg

SEQ ID NO: 449446 - DNA, 15 bp, Homo sapiens
aacccaagctgttgt

SEQ ID NO: 449447 - DNA, 15 bp, Homo sapiens
acccaagctgttgtt

SEQ ID NO: 449448 - DNA, 15 bp, Homo sapiens
cccaagctgttgtta

SEQ ID NO: 449449 - DNA, 15 bp, Homo sapiens
ccaagctgttgttat

SEQ ID NO: 449450 - DNA, 15 bp, Homo sapiens
caagctgttgttatt

SEQ ID NO: 449451 - DNA, 15 bp, Homo sapiens
aagctgttgttattt

SEQ ID NO: 449452 - DNA, 15 bp, Homo sapiens
agctgttgttatttt

SEQ ID NO: 449453 - DNA, 15 bp, Homo sapiens
gctgttgttattttg

SEQ ID NO: 449454 - DNA, 15 bp, Homo sapiens
ctgttgttattttgg

SEQ ID NO: 449455 - DNA, 15 bp, Homo sapiens
tgttgttattttggg

SEQ ID NO: 449456 - DNA, 15 bp, Homo sapiens
gttgttattttgggg

SEQ ID NO: 449457 - DNA, 15 bp, Homo sapiens
ttgttattttggggg

SEQ ID NO: 449458 - DNA, 15 bp, Homo sapiens
tgttattttggggga

SEQ ID NO: 449459 - DNA, 15 bp, Homo sapiens
gttattttgggggaa

SEQ ID NO: 449460 - DNA, 15 bp, Homo sapiens
ttattttgggggaaa

SEQ ID NO: 449461 - DNA, 15 bp, Homo sapiens
tattttgggggaaaa

SEQ ID NO: 449462 - DNA, 15 bp, Homo sapiens
attttgggggaaaat

SEQ ID NO: 449463 - DNA, 15 bp, Homo sapiens
ttttgggggaaaatg

SEQ ID NO: 449464 - DNA, 15 bp, Homo sapiens
tttgggggaaaatgc

SEQ ID NO: 449465 - DNA, 15 bp, Homo sapiens
ttgggggaaaatgct

SEQ ID NO: 449466 - DNA, 15 bp, Homo sapiens
tgggggaaaatgcta

SEQ ID NO: 449467 - DNA, 15 bp, Homo sapiens
gggggaaaatgctac

SEQ ID NO: 449468 - DNA, 15 bp, Homo sapiens
ggggaaaatgctact

SEQ ID NO: 449469 - DNA, 15 bp, Homo sapiens
gggaaaatgctactt

SEQ ID NO: 449470 - DNA, 15 bp, Homo sapiens
ggaaaatgctacttt

SEQ ID NO: 449471 - DNA, 15 bp, Homo sapiens
gaaaatgctactttt

SEQ ID NO: 449472 - DNA, 15 bp, Homo sapiens
aaatgctacttttat

SEQ ID NO: 449473 - DNA, 15 bp, Homo sapiens
aatgctacttttatt

SEQ ID NO: 449474 - DNA, 15 bp, Homo sapiens
atgctacttttattc

SEQ ID NO: 449475 - DNA, 15 bp, Homo sapiens
tgctacttttattct

SEQ ID NO: 449476 - DNA, 15 bp, Homo sapiens
gctacttttattctg

SEQ ID NO: 449477 - DNA, 15 bp, Homo sapiens
ctacttttattctgt

SEQ ID NO: 449478 - DNA, 15 bp, Homo sapiens
tacttttattctgtt

SEQ ID NO: 449479 - DNA, 15 bp, Homo sapiens
acttttattctgttt

SEQ ID NO: 449480 - DNA, 15 bp, Homo sapiens
cttttattctgtttt

SEQ ID NO: 449481 - DNA, 15 bp, Homo sapiens
ttttattctgttttg

SEQ ID NO: 449482 - DNA, 15 bp, Homo sapiens
tttattctgttttgg

SEQ ID NO: 449483 - DNA, 15 bp, Homo sapiens
ttattctgttttggt

SEQ ID NO: 449484 - DNA, 15 bp, Homo sapiens
tattctgttttggtt

SEQ ID NO: 449485 - DNA, 15 bp, Homo sapiens
attctgttttggttg

SEQ ID NO: 449486 - DNA, 15 bp, Homo sapiens
ttctgttttggttgc

SEQ ID NO: 449487 - DNA, 15 bp, Homo sapiens
tctgttttggttgcc

SEQ ID NO: 449488 - DNA, 15 bp, Homo sapiens
ctgttttggttgcct

SEQ ID NO: 449489 - DNA, 15 bp, Homo sapiens
tgttttggttgccta

SEQ ID NO: 449490 - DNA, 15 bp, Homo sapiens
gttttggttgcctac

SEQ ID NO: 449491 - DNA, 15 bp, Homo sapiens
ttttggttgcctact

SEQ ID NO: 449492 - DNA, 15 bp, Homo sapiens
tttggttgcctactc

SEQ ID NO: 449493 - DNA, 15 bp, Homo sapiens
ttggttgcctactct

SEQ ID NO: 449494 - DNA, 15 bp, Homo sapiens
tggttgcctactctg

SEQ ID NO: 449495 - DNA, 15 bp, Homo sapiens
ggttgcctactctgg

SEQ ID NO: 449496 - DNA, 15 bp, Homo sapiens
gttgcctactctggg

SEQ ID NO: 449497 - DNA, 15 bp, Homo sapiens
ttgcctactctggga

SEQ ID NO: 449498 - DNA, 15 bp, Homo sapiens
tgcctactctgggag

SEQ ID NO: 449499 - DNA, 15 bp, Homo sapiens
gcctactctgggaga

SEQ ID NO: 449500 - DNA, 15 bp, Homo sapiens
cctactctgggagaa

SEQ ID NO: 449501 - DNA, 15 bp, Homo sapiens
ctactctgggagaac

SEQ ID NO: 449502 - DNA, 15 bp, Homo sapiens
tactctgggagaact

SEQ ID NO: 449503 - DNA, 15 bp, Homo sapiens
actctgggagaactt

SEQ ID NO: 449504 - DNA, 15 bp, Homo sapiens
ctctgggagaacttc

SEQ ID NO: 449505 - DNA, 15 bp, Homo sapiens
tctgggagaacttca

SEQ ID NO: 449506 - DNA, 15 bp, Homo sapiens
ctgggagaacttcag

SEQ ID NO: 449507 - DNA, 15 bp, Homo sapiens
tgggagaacttcagg

SEQ ID NO: 449508 - DNA, 15 bp, Homo sapiens
gggagaacttcaggc

SEQ ID NO: 449509 - DNA, 15 bp, Homo sapiens
ggagaacttcaggca

SEQ ID NO: 449510 - DNA, 15 bp, Homo sapiens
gagaacttcaggcat

SEQ ID NO: 449511 - DNA, 15 bp, Homo sapiens
agaacttcaggcatt

SEQ ID NO: 449512 - DNA, 15 bp, Homo sapiens
gaacttcaggcattt

SEQ ID NO: 449513 - DNA, 15 bp, Homo sapiens
aacttcaggcatttt

SEQ ID NO: 449514 - DNA, 15 bp, Homo sapiens
acttcaggcattttg

SEQ ID NO: 449515 - DNA, 15 bp, Homo sapiens
cttcaggcattttgg

SEQ ID NO: 449516 - DNA, 15 bp, Homo sapiens
ttcaggcattttggc

SEQ ID NO: 449517 - DNA, 15 bp, Homo sapiens
tcaggcattttggca

SEQ ID NO: 449518 - DNA, 15 bp, Homo sapiens
caggcattttggcaa

SEQ ID NO: 449519 - DNA, 15 bp, Homo sapiens
aggcattttggcaag

SEQ ID NO: 449520 - DNA, 15 bp, Homo sapiens
ggcattttggcaaga

SEQ ID NO: 449521 - DNA, 15 bp, Homo sapiens
gcattttggcaagag

SEQ ID NO: 449522 - DNA, 15 bp, Homo sapiens
cattttggcaagagg

SEQ ID NO: 449523 - DNA, 15 bp, Homo sapiens
attttggcaagagga

SEQ ID NO: 449524 - DNA, 15 bp, Homo sapiens
ttttggcaagaggag

SEQ ID NO: 449525 - DNA, 15 bp, Homo sapiens
tttggcaagaggagc

SEQ ID NO: 449526 - DNA, 15 bp, Homo sapiens
ttggcaagaggagct

SEQ ID NO: 449527 - DNA, 15 bp, Homo sapiens
tggcaagaggagctg

SEQ ID NO: 449528 - DNA, 15 bp, Homo sapiens
ggcaagaggagctga

SEQ ID NO: 449529 - DNA, 15 bp, Homo sapiens
gcaagaggagctgag

SEQ ID NO: 449530 - DNA, 15 bp, Homo sapiens
caagaggagctgagc

SEQ ID NO: 449531 - DNA, 15 bp, Homo sapiens
aagaggagctgagct

SEQ ID NO: 449532 - DNA, 15 bp, Homo sapiens
agaggagctgagcta

SEQ ID NO: 449533 - DNA, 15 bp, Homo sapiens
gaggagctgagctat

SEQ ID NO: 449534 - DNA, 15 bp, Homo sapiens
aggagctgagctatc

SEQ ID NO: 449535 - DNA, 15 bp, Homo sapiens
ggagctgagctatct

SEQ ID NO: 449536 - DNA, 15 bp, Homo sapiens
gagctgagctatctg

SEQ ID NO: 449537 - DNA, 15 bp, Homo sapiens
agctgagctatctgc

SEQ ID NO: 449538 - DNA, 15 bp, Homo sapiens
gctgagctatctgca

SEQ ID NO: 449539 - DNA, 15 bp, Homo sapiens
ctgagctatctgcag

SEQ ID NO: 449540 - DNA, 15 bp, Homo sapiens
tgagctatctgcagc

SEQ ID NO: 449541 - DNA, 15 bp, Homo sapiens
gagctatctgcagct

SEQ ID NO: 449542 - DNA, 15 bp, Homo sapiens
agctatctgcagctg

SEQ ID NO: 449543 - DNA, 15 bp, Homo sapiens
gctatctgcagctgt

SEQ ID NO: 449544 - DNA, 15 bp, Homo sapiens
ctatctgcagctgtt

SEQ ID NO: 449545 - DNA, 15 bp, Homo sapiens
tatctgcagctgttc

SEQ ID NO: 449546 - DNA, 15 bp, Homo sapiens
atctgcagctgttca

SEQ ID NO: 449547 - DNA, 15 bp, Homo sapiens
tctgcagctgttcaa

SEQ ID NO: 449548 - DNA, 15 bp, Homo sapiens
ctgcagctgttcaaa

SEQ ID NO: 449549 - DNA, 15 bp, Homo sapiens
tgcagctgttcaaat

SEQ ID NO: 449550 - DNA, 15 bp, Homo sapiens
gcagctgttcaaata

SEQ ID NO: 449551 - DNA, 15 bp, Homo sapiens
cagctgttcaaatac

SEQ ID NO: 449552 - DNA, 15 bp, Homo sapiens
agctgttcaaatact

SEQ ID NO: 449553 - DNA, 15 bp, Homo sapiens
gctgttcaaatactt

SEQ ID NO: 449554 - DNA, 15 bp, Homo sapiens
ctgttcaaatacttt

SEQ ID NO: 449555 - DNA, 15 bp, Homo sapiens
tgttcaaatacttta

SEQ ID NO: 449556 - DNA, 15 bp, Homo sapiens
gttcaaatactttaa

SEQ ID NO: 449557 - DNA, 15 bp, Homo sapiens
ttcaaatactttaag

SEQ ID NO: 449558 - DNA, 15 bp, Homo sapiens
tcaaatactttaagc

SEQ ID NO: 449559 - DNA, 15 bp, Homo sapiens
caaatactttaagcc

SEQ ID NO: 449560 - DNA, 15 bp, Homo sapiens
aaatactttaagcct

SEQ ID NO: 449561 - DNA, 15 bp, Homo sapiens
aatactttaagcctt

SEQ ID NO: 449562 - DNA, 15 bp, Homo sapiens
atactttaagccttt

SEQ ID NO: 449563 - DNA, 15 bp, Homo sapiens
tactttaagcctttg

SEQ ID NO: 449564 - DNA, 15 bp, Homo sapiens
actttaagcctttgg

SEQ ID NO: 449565 - DNA, 15 bp, Homo sapiens
ctttaagcctttggg

SEQ ID NO: 449566 - DNA, 15 bp, Homo sapiens
tttaagcctttgggt

SEQ ID NO: 449567 - DNA, 15 bp, Homo sapiens
ttaagcctttgggtt

SEQ ID NO: 449568 - DNA, 15 bp, Homo sapiens
taagcctttgggttc

SEQ ID NO: 449569 - DNA, 15 bp, Homo sapiens
aagcctttgggttca

SEQ ID NO: 449570 - DNA, 15 bp, Homo sapiens
agcctttgggttcat

SEQ ID NO: 449571 - DNA, 15 bp, Homo sapiens
gcctttgggttcatt

SEQ ID NO: 449572 - DNA, 15 bp, Homo sapiens
cctttgggttcattg

SEQ ID NO: 449573 - DNA, 15 bp, Homo sapiens
ctttgggttcattgt

SEQ ID NO: 449574 - DNA, 15 bp, Homo sapiens
tttgggttcattgtg

SEQ ID NO: 449575 - DNA, 15 bp, Homo sapiens
ttgggttcattgtgg

SEQ ID NO: 449576 - DNA, 15 bp, Homo sapiens
tgggttcattgtgga

SEQ ID NO: 449577 - DNA, 15 bp, Homo sapiens
gggttcattgtggat

SEQ ID NO: 449578 - DNA, 15 bp, Homo sapiens
ggttcattgtggatt

SEQ ID NO: 449579 - DNA, 15 bp, Homo sapiens
gttcattgtggattt

SEQ ID NO: 449580 - DNA, 15 bp, Homo sapiens
ttcattgtggatttt

SEQ ID NO: 449581 - DNA, 15 bp, Homo sapiens
tcattgtggattttg

SEQ ID NO: 449582 - DNA, 15 bp, Homo sapiens
cattgtggattttgc

SEQ ID NO: 449583 - DNA, 15 bp, Homo sapiens
attgtggattttgct

SEQ ID NO: 449584 - DNA, 15 bp, Homo sapiens
ttgtggattttgctt

SEQ ID NO: 449585 - DNA, 15 bp, Homo sapiens
tgtggattttgcttt

SEQ ID NO: 449586 - DNA, 15 bp, Homo sapiens
gtggattttgcttta

SEQ ID NO: 449587 - DNA, 15 bp, Homo sapiens
tggattttgctttaa

SEQ ID NO: 449588 - DNA, 15 bp, Homo sapiens
ggattttgctttaac

SEQ ID NO: 449589 - DNA, 15 bp, Homo sapiens
gattttgctttaacc

SEQ ID NO: 449590 - DNA, 15 bp, Homo sapiens
attttgctttaaccc

SEQ ID NO: 449591 - DNA, 15 bp, Homo sapiens
ttttgctttaaccct

SEQ ID NO: 449592 - DNA, 15 bp, Homo sapiens
tttgctttaaccctc

SEQ ID NO: 449593 - DNA, 15 bp, Homo sapiens
ttgctttaaccctct

SEQ ID NO: 449594 - DNA, 15 bp, Homo sapiens
tgctttaaccctctc

SEQ ID NO: 449595 - DNA, 15 bp, Homo sapiens
gctttaaccctctcc

SEQ ID NO: 449596 - DNA, 15 bp, Homo sapiens
ctttaaccctctccc

SEQ ID NO: 449597 - DNA, 15 bp, Homo sapiens
tttaaccctctcccc

SEQ ID NO: 449598 - DNA, 15 bp, Homo sapiens
ttaaccctctccccc

SEQ ID NO: 449599 - DNA, 15 bp, Homo sapiens
taaccctctcccccg

SEQ ID NO: 449600 - DNA, 15 bp, Homo sapiens
aaccctctcccccga

SEQ ID NO: 449601 - DNA, 15 bp, Homo sapiens
accctctcccccgac

SEQ ID NO: 449602 - DNA, 15 bp, Homo sapiens
ccctctcccccgact

SEQ ID NO: 449603 - DNA, 15 bp, Homo sapiens
cctctcccccgactt

SEQ ID NO: 449604 - DNA, 15 bp, Homo sapiens
ctctcccccgactta

SEQ ID NO: 449605 - DNA, 15 bp, Homo sapiens
tctcccccgacttaa

SEQ ID NO: 449606 - DNA, 15 bp, Homo sapiens
ctcccccgacttaaa

SEQ ID NO: 449607 - DNA, 15 bp, Homo sapiens
tcccccgacttaaaa

SEQ ID NO: 449608 - DNA, 15 bp, Homo sapiens
cccccgacttaaaaa

SEQ ID NO: 449609 - DNA, 15 bp, Homo sapiens
ccccgacttaaaaaa

SEQ ID NO: 449610 - DNA, 15 bp, Homo sapiens
cccgacttaaaaaaa

SEQ ID NO: 449611 - DNA, 15 bp, Homo sapiens
ccgacttaaaaaaaa

SEQ ID NO: 449612 - DNA, 15 bp, Homo sapiens
cgacttaaaaaaaaa

SEQ ID NO: 449613 - DNA, 15 bp, Homo sapiens
gacttaaaaaaaaaa

SEQ ID NO: 449614 - DNA, 15 bp, Homo sapiens
acttaaaaaaaaaac

SEQ ID NO: 449615 - DNA, 15 bp, Homo sapiens
ttaaaaaaaaaacag

SEQ ID NO: 449616 - DNA, 15 bp, Homo sapiens
taaaaaaaaaacagc

SEQ ID NO: 449617 - DNA, 15 bp, Homo sapiens
aaaaaaaaaacagca

SEQ ID NO: 449618 - DNA, 15 bp, Homo sapiens
aaaaaaaaacagcag

SEQ ID NO: 449619 - DNA, 15 bp, Homo sapiens
aaaaaaaacagcagc

SEQ ID NO: 449620 - DNA, 15 bp, Homo sapiens
aaaaaaacagcagcc

SEQ ID NO: 449621 - DNA, 15 bp, Homo sapiens
aaaaaacagcagcca

SEQ ID NO: 449622 - DNA, 15 bp, Homo sapiens
aaaaacagcagccaa

SEQ ID NO: 449623 - DNA, 15 bp, Homo sapiens
aaaacagcagccaac

SEQ ID NO: 449624 - DNA, 15 bp, Homo sapiens
aaacagcagccaact

SEQ ID NO: 449625 - DNA, 15 bp, Homo sapiens
aacagcagccaactg

SEQ ID NO: 449626 - DNA, 15 bp, Homo sapiens
acagcagccaactgc

SEQ ID NO: 449627 - DNA, 15 bp, Homo sapiens
cagcagccaactgca

SEQ ID NO: 449628 - DNA, 15 bp, Homo sapiens
agcagccaactgcat

SEQ ID NO: 449629 - DNA, 15 bp, Homo sapiens
gcagccaactgcatt

SEQ ID NO: 449630 - DNA, 15 bp, Homo sapiens
cagccaactgcattg

SEQ ID NO: 449631 - DNA, 15 bp, Homo sapiens
agccaactgcattgc

SEQ ID NO: 449632 - DNA, 15 bp, Homo sapiens
gccaactgcattgcc

SEQ ID NO: 449633 - DNA, 15 bp, Homo sapiens
ccaactgcattgcct

SEQ ID NO: 449634 - DNA, 15 bp, Homo sapiens
caactgcattgcctg

SEQ ID NO: 449635 - DNA, 15 bp, Homo sapiens
aactgcattgcctgt

SEQ ID NO: 449636 - DNA, 15 bp, Homo sapiens
actgcattgcctgtt

SEQ ID NO: 449637 - DNA, 15 bp, Homo sapiens
ctgcattgcctgttt

SEQ ID NO: 449638 - DNA, 15 bp, Homo sapiens
tgcattgcctgtttt

SEQ ID NO: 449639 - DNA, 15 bp, Homo sapiens
gcattgcctgttttt

SEQ ID NO: 449640 - DNA, 15 bp, Homo sapiens
cattgcctgtttttt

SEQ ID NO: 449641 - DNA, 15 bp, Homo sapiens
attgcctgttttttt

SEQ ID NO: 449642 - DNA, 15 bp, Homo sapiens
ttgcctgtttttttt

SEQ ID NO: 449643 - DNA, 15 bp, Homo sapiens
tgcctgtttttttta

SEQ ID NO: 449644 - DNA, 15 bp, Homo sapiens
gcctgttttttttat

SEQ ID NO: 449645 - DNA, 15 bp, Homo sapiens
cctgttttttttatt

SEQ ID NO: 449646 - DNA, 15 bp, Homo sapiens
ctgttttttttattt

SEQ ID NO: 449647 - DNA, 15 bp, Homo sapiens
tgttttttttatttc

SEQ ID NO: 449648 - DNA, 15 bp, Homo sapiens
gttttttttatttct

SEQ ID NO: 449649 - DNA, 15 bp, Homo sapiens
ttttttttatttctg

SEQ ID NO: 449650 - DNA, 15 bp, Homo sapiens
tttttttatttctgt

SEQ ID NO: 449651 - DNA, 15 bp, Homo sapiens
ttttttatttctgtt

SEQ ID NO: 449652 - DNA, 15 bp, Homo sapiens
tttttatttctgttg

SEQ ID NO: 449653 - DNA, 15 bp, Homo sapiens
ttttatttctgttgt

SEQ ID NO: 449654 - DNA, 15 bp, Homo sapiens
tttatttctgttgtt

SEQ ID NO: 449655 - DNA, 15 bp, Homo sapiens
ttatttctgttgttt

SEQ ID NO: 449656 - DNA, 15 bp, Homo sapiens
tatttctgttgtttg

SEQ ID NO: 449657 - DNA, 15 bp, Homo sapiens
atttctgttgtttgg

SEQ ID NO: 449658 - DNA, 15 bp, Homo sapiens
tttctgttgtttggt

SEQ ID NO: 449659 - DNA, 15 bp, Homo sapiens
ttctgttgtttggta

SEQ ID NO: 449660 - DNA, 15 bp, Homo sapiens
tctgttgtttggtaa

SEQ ID NO: 449661 - DNA, 15 bp, Homo sapiens
ctgttgtttggtaag

SEQ ID NO: 449662 - DNA, 15 bp, Homo sapiens
tgttgtttggtaagc

SEQ ID NO: 449663 - DNA, 15 bp, Homo sapiens
gttgtttggtaagca

SEQ ID NO: 449664 - DNA, 15 bp, Homo sapiens
ttgtttggtaagcag

SEQ ID NO: 449665 - DNA, 15 bp, Homo sapiens
tgtttggtaagcagc

SEQ ID NO: 449666 - DNA, 15 bp, Homo sapiens
gtttggtaagcagca

SEQ ID NO: 449667 - DNA, 15 bp, Homo sapiens
tttggtaagcagcag

SEQ ID NO: 449668 - DNA, 15 bp, Homo sapiens
ttggtaagcagcagt

SEQ ID NO: 449669 - DNA, 15 bp, Homo sapiens
tggtaagcagcagtt

SEQ ID NO: 449670 - DNA, 15 bp, Homo sapiens
ggtaagcagcagtta

SEQ ID NO: 449671 - DNA, 15 bp, Homo sapiens
gtaagcagcagttat

SEQ ID NO: 449672 - DNA, 15 bp, Homo sapiens
taagcagcagttata

SEQ ID NO: 449673 - DNA, 15 bp, Homo sapiens
aagcagcagttatac

SEQ ID NO: 449674 - DNA, 15 bp, Homo sapiens
agcagcagttatact

SEQ ID NO: 449675 - DNA, 15 bp, Homo sapiens
gcagcagttatactt

SEQ ID NO: 449676 - DNA, 15 bp, Homo sapiens
cagcagttatacttt

SEQ ID NO: 449677 - DNA, 15 bp, Homo sapiens
agcagttatactttt

SEQ ID NO: 449678 - DNA, 15 bp, Homo sapiens
gcagttatacttttg

SEQ ID NO: 449679 - DNA, 15 bp, Homo sapiens
cagttatacttttgt

SEQ ID NO: 449680 - DNA, 15 bp, Homo sapiens
agttatacttttgta

SEQ ID NO: 449681 - DNA, 15 bp, Homo sapiens
gttatacttttgtaa

SEQ ID NO: 449682 - DNA, 15 bp, Homo sapiens
ttatacttttgtaac

SEQ ID NO: 449683 - DNA, 15 bp, Homo sapiens
tatacttttgtaacc

SEQ ID NO: 449684 - DNA, 15 bp, Homo sapiens
atacttttgtaacca

SEQ ID NO: 449685 - DNA, 15 bp, Homo sapiens
tacttttgtaaccag

SEQ ID NO: 449686 - DNA, 15 bp, Homo sapiens
acttttgtaaccaga

SEQ ID NO: 449687 - DNA, 15 bp, Homo sapiens
cttttgtaaccagag

SEQ ID NO: 449688 - DNA, 15 bp, Homo sapiens
ttttgtaaccagagg

SEQ ID NO: 449689 - DNA, 15 bp, Homo sapiens
tttgtaaccagaggc

SEQ ID NO: 449690 - DNA, 15 bp, Homo sapiens
ttgtaaccagaggct

SEQ ID NO: 449691 - DNA, 15 bp, Homo sapiens
tgtaaccagaggctg

SEQ ID NO: 449692 - DNA, 15 bp, Homo sapiens
gtaaccagaggctgt

SEQ ID NO: 449693 - DNA, 15 bp, Homo sapiens
taaccagaggctgta

SEQ ID NO: 449694 - DNA, 15 bp, Homo sapiens
aaccagaggctgtat

SEQ ID NO: 449695 - DNA, 15 bp, Homo sapiens
accagaggctgtatt

SEQ ID NO: 449696 - DNA, 15 bp, Homo sapiens
ccagaggctgtattt

SEQ ID NO: 449697 - DNA, 15 bp, Homo sapiens
cagaggctgtattta

SEQ ID NO: 449698 - DNA, 15 bp, Homo sapiens
agaggctgtatttat

SEQ ID NO: 449699 - DNA, 15 bp, Homo sapiens
gaggctgtatttatt

SEQ ID NO: 449700 - DNA, 15 bp, Homo sapiens
aggctgtatttattt

SEQ ID NO: 449701 - DNA, 15 bp, Homo sapiens
ggctgtatttatttt

SEQ ID NO: 449702 - DNA, 15 bp, Homo sapiens
gctgtatttattttc

SEQ ID NO: 449703 - DNA, 15 bp, Homo sapiens
ctgtatttattttct

SEQ ID NO: 449704 - DNA, 15 bp, Homo sapiens
tgtatttattttctg

SEQ ID NO: 449705 - DNA, 15 bp, Homo sapiens
gtatttattttctgt

SEQ ID NO: 449706 - DNA, 15 bp, Homo sapiens
tatttattttctgtg

SEQ ID NO: 449707 - DNA, 15 bp, Homo sapiens
atttattttctgtgt

SEQ ID NO: 449708 - DNA, 15 bp, Homo sapiens
tttattttctgtgtt

SEQ ID NO: 449709 - DNA, 15 bp, Homo sapiens
ttattttctgtgttg

SEQ ID NO: 449710 - DNA, 15 bp, Homo sapiens
tattttctgtgttgg

SEQ ID NO: 449711 - DNA, 15 bp, Homo sapiens
attttctgtgttggc

SEQ ID NO: 449712 - DNA, 15 bp, Homo sapiens
ttttctgtgttggca

SEQ ID NO: 449713 - DNA, 15 bp, Homo sapiens
tttctgtgttggcag

SEQ ID NO: 449714 - DNA, 15 bp, Homo sapiens
ttctgtgttggcagt

SEQ ID NO: 449715 - DNA, 15 bp, Homo sapiens
tctgtgttggcagtt

SEQ ID NO: 449716 - DNA, 15 bp, Homo sapiens
ctgtgttggcagttc

SEQ ID NO: 449717 - DNA, 15 bp, Homo sapiens
tgtgttggcagttct

SEQ ID NO: 449718 - DNA, 15 bp, Homo sapiens
gtgttggcagttctg

SEQ ID NO: 449719 - DNA, 15 bp, Homo sapiens
tgttggcagttctgc

SEQ ID NO: 449720 - DNA, 15 bp, Homo sapiens
gttggcagttctgcc

SEQ ID NO: 449721 - DNA, 15 bp, Homo sapiens
ttggcagttctgcct

SEQ ID NO: 449722 - DNA, 15 bp, Homo sapiens
tggcagttctgccta

SEQ ID NO: 449723 - DNA, 15 bp, Homo sapiens
ggcagttctgcctaa

SEQ ID NO: 449724 - DNA, 15 bp, Homo sapiens
gcagttctgcctaat

SEQ ID NO: 449725 - DNA, 15 bp, Homo sapiens
cagttctgcctaatg

SEQ ID NO: 449726 - DNA, 15 bp, Homo sapiens
agttctgcctaatga

SEQ ID NO: 449727 - DNA, 15 bp, Homo sapiens
gttctgcctaatgaa

SEQ ID NO: 449728 - DNA, 15 bp, Homo sapiens
ttctgcctaatgaat

SEQ ID NO: 449729 - DNA, 15 bp, Homo sapiens
tctgcctaatgaatc

SEQ ID NO: 449730 - DNA, 15 bp, Homo sapiens
ctgcctaatgaatca

SEQ ID NO: 449731 - DNA, 15 bp, Homo sapiens
tgcctaatgaatcaa

SEQ ID NO: 449732 - DNA, 15 bp, Homo sapiens
gcctaatgaatcaac

SEQ ID NO: 449733 - DNA, 15 bp, Homo sapiens
cctaatgaatcaact

SEQ ID NO: 449734 - DNA, 15 bp, Homo sapiens
ctaatgaatcaactg

SEQ ID NO: 449735 - DNA, 15 bp, Homo sapiens
taatgaatcaactgg

SEQ ID NO: 449736 - DNA, 15 bp, Homo sapiens
aatgaatcaactggt

SEQ ID NO: 449737 - DNA, 15 bp, Homo sapiens
atgaatcaactggta

SEQ ID NO: 449738 - DNA, 15 bp, Homo sapiens
tgaatcaactggtat

SEQ ID NO: 449739 - DNA, 15 bp, Homo sapiens
gaatcaactggtatt

SEQ ID NO: 449740 - DNA, 15 bp, Homo sapiens
aatcaactggtattg

SEQ ID NO: 449741 - DNA, 15 bp, Homo sapiens
atcaactggtattga

SEQ ID NO: 449742 - DNA, 15 bp, Homo sapiens
tcaactggtattgaa

SEQ ID NO: 449743 - DNA, 15 bp, Homo sapiens
caactggtattgaat

SEQ ID NO: 449744 - DNA, 15 bp, Homo sapiens
aactggtattgaatt

SEQ ID NO: 449745 - DNA, 15 bp, Homo sapiens
actggtattgaattc

SEQ ID NO: 449746 - DNA, 15 bp, Homo sapiens
ctggtattgaattca

SEQ ID NO: 449747 - DNA, 15 bp, Homo sapiens
tggtattgaattcac

SEQ ID NO: 449748 - DNA, 15 bp, Homo sapiens
ggtattgaattcaca

SEQ ID NO: 449749 - DNA, 15 bp, Homo sapiens
gtattgaattcacaa

SEQ ID NO: 449750 - DNA, 15 bp, Homo sapiens
tattgaattcacaaa

SEQ ID NO: 449751 - DNA, 15 bp, Homo sapiens
attgaattcacaaag

SEQ ID NO: 449752 - DNA, 15 bp, Homo sapiens
ttgaattcacaaagg

SEQ ID NO: 449753 - DNA, 15 bp, Homo sapiens
tgaattcacaaaggg

SEQ ID NO: 449754 - DNA, 15 bp, Homo sapiens
gaattcacaaaggga

SEQ ID NO: 449755 - DNA, 15 bp, Homo sapiens
aattcacaaagggag

SEQ ID NO: 449756 - DNA, 15 bp, Homo sapiens
attcacaaagggaga

SEQ ID NO: 449757 - DNA, 15 bp, Homo sapiens
ttcacaaagggagat

SEQ ID NO: 449758 - DNA, 15 bp, Homo sapiens
tcacaaagggagatg

SEQ ID NO: 449759 - DNA, 15 bp, Homo sapiens
cacaaagggagatgc

SEQ ID NO: 449760 - DNA, 15 bp, Homo sapiens
acaaagggagatgcc

SEQ ID NO: 449761 - DNA, 15 bp, Homo sapiens
caaagggagatgccc

SEQ ID NO: 449762 - DNA, 15 bp, Homo sapiens
aaagggagatgcccg

SEQ ID NO: 449763 - DNA, 15 bp, Homo sapiens
aagggagatgcccgt

SEQ ID NO: 449764 - DNA, 15 bp, Homo sapiens
agggagatgcccgtt

SEQ ID NO: 449765 - DNA, 15 bp, Homo sapiens
gggagatgcccgttc

SEQ ID NO: 449766 - DNA, 15 bp, Homo sapiens
ggagatgcccgttcc

SEQ ID NO: 449767 - DNA, 15 bp, Homo sapiens
gagatgcccgttccc

SEQ ID NO: 449768 - DNA, 15 bp, Homo sapiens
agatgcccgttccct

SEQ ID NO: 449769 - DNA, 15 bp, Homo sapiens
gatgcccgttccctc

SEQ ID NO: 449770 - DNA, 15 bp, Homo sapiens
atgcccgttccctcc

SEQ ID NO: 449771 - DNA, 15 bp, Homo sapiens
tgcccgttccctccc

SEQ ID NO: 449772 - DNA, 15 bp, Homo sapiens
gcccgttccctccct

SEQ ID NO: 449773 - DNA, 15 bp, Homo sapiens
cccgttccctccctc

SEQ ID NO: 449774 - DNA, 15 bp, Homo sapiens
ccgttccctccctcc

SEQ ID NO: 449775 - DNA, 15 bp, Homo sapiens
cgttccctccctcca

SEQ ID NO: 449776 - DNA, 15 bp, Homo sapiens
gttccctccctccat

SEQ ID NO: 449777 - DNA, 15 bp, Homo sapiens
ttccctccctccatc

SEQ ID NO: 449778 - DNA, 15 bp, Homo sapiens
tccctccctccatct

SEQ ID NO: 449779 - DNA, 15 bp, Homo sapiens
ccctccctccatctg

SEQ ID NO: 449780 - DNA, 15 bp, Homo sapiens
cctccctccatctgt

SEQ ID NO: 449781 - DNA, 15 bp, Homo sapiens
ctccctccatctgtt

SEQ ID NO: 449782 - DNA, 15 bp, Homo sapiens
tccctccatctgttt

SEQ ID NO: 449783 - DNA, 15 bp, Homo sapiens
ccctccatctgtttg

SEQ ID NO: 449784 - DNA, 15 bp, Homo sapiens
cctccatctgtttgc

SEQ ID NO: 449785 - DNA, 15 bp, Homo sapiens
ctccatctgtttgcc

SEQ ID NO: 449786 - DNA, 15 bp, Homo sapiens
tccatctgtttgcca

SEQ ID NO: 449787 - DNA, 15 bp, Homo sapiens
ccatctgtttgccaa

SEQ ID NO: 449788 - DNA, 15 bp, Homo sapiens
catctgtttgccaaa

SEQ ID NO: 449789 - DNA, 15 bp, Homo sapiens
atctgtttgccaaat

SEQ ID NO: 449790 - DNA, 15 bp, Homo sapiens
tctgtttgccaaatg

SEQ ID NO: 449791 - DNA, 15 bp, Homo sapiens
ctgtttgccaaatgt

SEQ ID NO: 449792 - DNA, 15 bp, Homo sapiens
tgtttgccaaatgtg

SEQ ID NO: 449793 - DNA, 15 bp, Homo sapiens
gtttgccaaatgtgt

SEQ ID NO: 449794 - DNA, 15 bp, Homo sapiens
tttgccaaatgtgtg

SEQ ID NO: 449795 - DNA, 15 bp, Homo sapiens
ttgccaaatgtgtgt

SEQ ID NO: 449796 - DNA, 15 bp, Homo sapiens
tgccaaatgtgtgtg

SEQ ID NO: 449797 - DNA, 15 bp, Homo sapiens
gccaaatgtgtgtgt

SEQ ID NO: 449798 - DNA, 15 bp, Homo sapiens
ccaaatgtgtgtgtt

SEQ ID NO: 449799 - DNA, 15 bp, Homo sapiens
caaatgtgtgtgttc

SEQ ID NO: 449800 - DNA, 15 bp, Homo sapiens
aaatgtgtgtgttcc

SEQ ID NO: 449801 - DNA, 15 bp, Homo sapiens
aatgtgtgtgttccg

SEQ ID NO: 449802 - DNA, 15 bp, Homo sapiens
atgtgtgtgttccgt

SEQ ID NO: 449803 - DNA, 15 bp, Homo sapiens
tgtgtgtgttccgtc

SEQ ID NO: 449804 - DNA, 15 bp, Homo sapiens
gtgtgtgttccgtca

SEQ ID NO: 449805 - DNA, 15 bp, Homo sapiens
tgtgtgttccgtcag

SEQ ID NO: 449806 - DNA, 15 bp, Homo sapiens
gtgtgttccgtcagc

SEQ ID NO: 449807 - DNA, 15 bp, Homo sapiens
tgtgttccgtcagct

SEQ ID NO: 449808 - DNA, 15 bp, Homo sapiens
gtgttccgtcagctc

SEQ ID NO: 449809 - DNA, 15 bp, Homo sapiens
tgttccgtcagctct

SEQ ID NO: 449810 - DNA, 15 bp, Homo sapiens
gttccgtcagctctc

SEQ ID NO: 449811 - DNA, 15 bp, Homo sapiens
ttccgtcagctctca

SEQ ID NO: 449812 - DNA, 15 bp, Homo sapiens
tccgtcagctctcag

SEQ ID NO: 449813 - DNA, 15 bp, Homo sapiens
ccgtcagctctcagt

SEQ ID NO: 449814 - DNA, 15 bp, Homo sapiens
cgtcagctctcagta

SEQ ID NO: 449815 - DNA, 15 bp, Homo sapiens
gtcagctctcagtag

SEQ ID NO: 449816 - DNA, 15 bp, Homo sapiens
tcagctctcagtagt

SEQ ID NO: 449817 - DNA, 15 bp, Homo sapiens
cagctctcagtagtg

SEQ ID NO: 449818 - DNA, 15 bp, Homo sapiens
agctctcagtagtgg

SEQ ID NO: 449819 - DNA, 15 bp, Homo sapiens
gctctcagtagtggt

SEQ ID NO: 449820 - DNA, 15 bp, Homo sapiens
ctctcagtagtggtt

SEQ ID NO: 449821 - DNA, 15 bp, Homo sapiens
tctcagtagtggttt

SEQ ID NO: 449822 - DNA, 15 bp, Homo sapiens
ctcagtagtggtttc

SEQ ID NO: 449823 - DNA, 15 bp, Homo sapiens
tcagtagtggtttca

SEQ ID NO: 449824 - DNA, 15 bp, Homo sapiens
cagtagtggtttcac

SEQ ID NO: 449825 - DNA, 15 bp, Homo sapiens
agtagtggtttcact

SEQ ID NO: 449826 - DNA, 15 bp, Homo sapiens
gtagtggtttcacta

SEQ ID NO: 449827 - DNA, 15 bp, Homo sapiens
tagtggtttcactaa

SEQ ID NO: 449828 - DNA, 15 bp, Homo sapiens
agtggtttcactaaa

SEQ ID NO: 449829 - DNA, 15 bp, Homo sapiens
gtggtttcactaaaa

SEQ ID NO: 449830 - DNA, 15 bp, Homo sapiens
tggtttcactaaaaa

SEQ ID NO: 449831 - DNA, 15 bp, Homo sapiens
ggtttcactaaaaag

SEQ ID NO: 449832 - DNA, 15 bp, Homo sapiens
gtttcactaaaaaga

SEQ ID NO: 449833 - DNA, 15 bp, Homo sapiens
tttcactaaaaagag

SEQ ID NO: 449834 - DNA, 15 bp, Homo sapiens
ttcactaaaaagagc

SEQ ID NO: 449835 - DNA, 15 bp, Homo sapiens
tcactaaaaagagcc

SEQ ID NO: 449836 - DNA, 15 bp, Homo sapiens
cactaaaaagagcca

SEQ ID NO: 449837 - DNA, 15 bp, Homo sapiens
actaaaaagagccat

SEQ ID NO: 449838 - DNA, 15 bp, Homo sapiens
ctaaaaagagccatt

SEQ ID NO: 449839 - DNA, 15 bp, Homo sapiens
taaaaagagccatta

SEQ ID NO: 449840 - DNA, 15 bp, Homo sapiens
aaaaagagccattag

SEQ ID NO: 449841 - DNA, 15 bp, Homo sapiens
aaaagagccattagc

SEQ ID NO: 449842 - DNA, 15 bp, Homo sapiens
aaagagccattagca

SEQ ID NO: 449843 - DNA, 15 bp, Homo sapiens
aagagccattagcaa

SEQ ID NO: 449844 - DNA, 15 bp, Homo sapiens
agagccattagcaag

SEQ ID NO: 449845 - DNA, 15 bp, Homo sapiens
gagccattagcaaga

SEQ ID NO: 449846 - DNA, 15 bp, Homo sapiens
agccattagcaagag

SEQ ID NO: 449847 - DNA, 15 bp, Homo sapiens
gccattagcaagagg

SEQ ID NO: 449848 - DNA, 15 bp, Homo sapiens
ccattagcaagaggt

SEQ ID NO: 449849 - DNA, 15 bp, Homo sapiens
cattagcaagaggtg

SEQ ID NO: 449850 - DNA, 15 bp, Homo sapiens
attagcaagaggtgt

SEQ ID NO: 449851 - DNA, 15 bp, Homo sapiens
ttagcaagaggtgtt

SEQ ID NO: 449852 - DNA, 15 bp, Homo sapiens
tagcaagaggtgttc

SEQ ID NO: 449853 - DNA, 15 bp, Homo sapiens
gcaagaggtgttcac

SEQ ID NO: 449854 - DNA, 15 bp, Homo sapiens
caagaggtgttcacc

SEQ ID NO: 449855 - DNA, 15 bp, Homo sapiens
aagaggtgttcacct

SEQ ID NO: 449856 - DNA, 15 bp, Homo sapiens
agaggtgttcacctt

SEQ ID NO: 449857 - DNA, 15 bp, Homo sapiens
gaggtgttcaccttg

SEQ ID NO: 449858 - DNA, 15 bp, Homo sapiens
aggtgttcaccttga

SEQ ID NO: 449859 - DNA, 15 bp, Homo sapiens
ggtgttcaccttgaa

SEQ ID NO: 449860 - DNA, 15 bp, Homo sapiens
gtgttcaccttgaat

SEQ ID NO: 449861 - DNA, 15 bp, Homo sapiens
tgttcaccttgaatt

SEQ ID NO: 449862 - DNA, 15 bp, Homo sapiens
gttcaccttgaattc

SEQ ID NO: 449863 - DNA, 15 bp, Homo sapiens
ttcaccttgaattct

SEQ ID NO: 449864 - DNA, 15 bp, Homo sapiens
tcaccttgaattctt

SEQ ID NO: 449865 - DNA, 15 bp, Homo sapiens
caccttgaattctta

SEQ ID NO: 449866 - DNA, 15 bp, Homo sapiens
accttgaattcttag

SEQ ID NO: 449867 - DNA, 15 bp, Homo sapiens
ccttgaattcttagt

SEQ ID NO: 449868 - DNA, 15 bp, Homo sapiens
cttgaattcttagtc

SEQ ID NO: 449869 - DNA, 15 bp, Homo sapiens
ttgaattcttagtcc

SEQ ID NO: 449870 - DNA, 15 bp, Homo sapiens
tgaattcttagtcct

SEQ ID NO: 449871 - DNA, 15 bp, Homo sapiens
gaattcttagtcctc

SEQ ID NO: 449872 - DNA, 15 bp, Homo sapiens
aattcttagtcctcc

SEQ ID NO: 449873 - DNA, 15 bp, Homo sapiens
attcttagtcctccg

SEQ ID NO: 449874 - DNA, 15 bp, Homo sapiens
ttcttagtcctccgc

SEQ ID NO: 449875 - DNA, 15 bp, Homo sapiens
tcttagtcctccgcc

SEQ ID NO: 449876 - DNA, 15 bp, Homo sapiens
cttagtcctccgcct

SEQ ID NO: 449877 - DNA, 15 bp, Homo sapiens
ttagtcctccgcctg

SEQ ID NO: 449878 - DNA, 15 bp, Homo sapiens
tagtcctccgcctga

SEQ ID NO: 449879 - DNA, 15 bp, Homo sapiens
agtcctccgcctgac

SEQ ID NO: 449880 - DNA, 15 bp, Homo sapiens
gtcctccgcctgact

SEQ ID NO: 449881 - DNA, 15 bp, Homo sapiens
tcctccgcctgactg

SEQ ID NO: 449882 - DNA, 15 bp, Homo sapiens
cctccgcctgactga

SEQ ID NO: 449883 - DNA, 15 bp, Homo sapiens
ctccgcctgactgag

SEQ ID NO: 449884 - DNA, 15 bp, Homo sapiens
tccgcctgactgaga

SEQ ID NO: 449885 - DNA, 15 bp, Homo sapiens
ccgcctgactgagaa

SEQ ID NO: 449886 - DNA, 15 bp, Homo sapiens
cgcctgactgagaaa

SEQ ID NO: 449887 - DNA, 15 bp, Homo sapiens
gcctgactgagaaat

SEQ ID NO: 449888 - DNA, 15 bp, Homo sapiens
cctgactgagaaata

SEQ ID NO: 449889 - DNA, 15 bp, Homo sapiens
ctgactgagaaatag

SEQ ID NO: 449890 - DNA, 15 bp, Homo sapiens
tgactgagaaatagt

SEQ ID NO: 449891 - DNA, 15 bp, Homo sapiens
gactgagaaatagtg

SEQ ID NO: 449892 - DNA, 15 bp, Homo sapiens
actgagaaatagtgg

SEQ ID NO: 449893 - DNA, 15 bp, Homo sapiens
ctgagaaatagtggt

SEQ ID NO: 449894 - DNA, 15 bp, Homo sapiens
tgagaaatagtggta

SEQ ID NO: 449895 - DNA, 15 bp, Homo sapiens
gagaaatagtggtat

SEQ ID NO: 449896 - DNA, 15 bp, Homo sapiens
agaaatagtggtatt

SEQ ID NO: 449897 - DNA, 15 bp, Homo sapiens
gaaatagtggtattt

SEQ ID NO: 449898 - DNA, 15 bp, Homo sapiens
aaatagtggtatttt

SEQ ID NO: 449899 - DNA, 15 bp, Homo sapiens
aatagtggtattttc

SEQ ID NO: 449900 - DNA, 15 bp, Homo sapiens
atagtggtattttcc

SEQ ID NO: 449901 - DNA, 15 bp, Homo sapiens
tagtggtattttcct

SEQ ID NO: 449902 - DNA, 15 bp, Homo sapiens
agtggtattttcctc

SEQ ID NO: 449903 - DNA, 15 bp, Homo sapiens
gtggtattttcctct

SEQ ID NO: 449904 - DNA, 15 bp, Homo sapiens
tggtattttcctctt

SEQ ID NO: 449905 - DNA, 15 bp, Homo sapiens
ggtattttcctcttg

SEQ ID NO: 449906 - DNA, 15 bp, Homo sapiens
gtattttcctcttgt

SEQ ID NO: 449907 - DNA, 15 bp, Homo sapiens
tattttcctcttgtg

SEQ ID NO: 449908 - DNA, 15 bp, Homo sapiens
attttcctcttgtga

SEQ ID NO: 449909 - DNA, 15 bp, Homo sapiens
ttttcctcttgtgat

SEQ ID NO: 449910 - DNA, 15 bp, Homo sapiens
tttcctcttgtgatt

SEQ ID NO: 449911 - DNA, 15 bp, Homo sapiens
ttcctcttgtgattc

SEQ ID NO: 449912 - DNA, 15 bp, Homo sapiens
tcctcttgtgattcc

SEQ ID NO: 449913 - DNA, 15 bp, Homo sapiens
cctcttgtgattccg

SEQ ID NO: 449914 - DNA, 15 bp, Homo sapiens
ctcttgtgattccgt

SEQ ID NO: 449915 - DNA, 15 bp, Homo sapiens
tcttgtgattccgta

SEQ ID NO: 449916 - DNA, 15 bp, Homo sapiens
cttgtgattccgtag

SEQ ID NO: 449917 - DNA, 15 bp, Homo sapiens
ttgtgattccgtagg

SEQ ID NO: 449918 - DNA, 15 bp, Homo sapiens
tgtgattccgtaggg

SEQ ID NO: 449919 - DNA, 15 bp, Homo sapiens
gtgattccgtagggg

SEQ ID NO: 449920 - DNA, 15 bp, Homo sapiens
tgattccgtaggggt

SEQ ID NO: 449921 - DNA, 15 bp, Homo sapiens
gattccgtaggggtt

SEQ ID NO: 449922 - DNA, 15 bp, Homo sapiens
attccgtaggggttg

SEQ ID NO: 449923 - DNA, 15 bp, Homo sapiens
ttccgtaggggttgt

SEQ ID NO: 449924 - DNA, 15 bp, Homo sapiens
tccgtaggggttgtg

SEQ ID NO: 449925 - DNA, 15 bp, Homo sapiens
ccgtaggggttgtgt

SEQ ID NO: 449926 - DNA, 15 bp, Homo sapiens
cgtaggggttgtgtg

SEQ ID NO: 449927 - DNA, 15 bp, Homo sapiens
gtaggggttgtgtga

SEQ ID NO: 449928 - DNA, 15 bp, Homo sapiens
taggggttgtgtgag

SEQ ID NO: 449929 - DNA, 15 bp, Homo sapiens
aggggttgtgtgagg

SEQ ID NO: 449930 - DNA, 15 bp, Homo sapiens
ggggttgtgtgaggt

SEQ ID NO: 449931 - DNA, 15 bp, Homo sapiens
gggttgtgtgaggtg

SEQ ID NO: 449932 - DNA, 15 bp, Homo sapiens
ggttgtgtgaggtga

SEQ ID NO: 449933 - DNA, 15 bp, Homo sapiens
gttgtgtgaggtgaa

SEQ ID NO: 449934 - DNA, 15 bp, Homo sapiens
ttgtgtgaggtgaag

SEQ ID NO: 449935 - DNA, 15 bp, Homo sapiens
tgtgtgaggtgaaga

SEQ ID NO: 449936 - DNA, 15 bp, Homo sapiens
gtgtgaggtgaagac

SEQ ID NO: 449937 - DNA, 15 bp, Homo sapiens
tgtgaggtgaagacc

SEQ ID NO: 449938 - DNA, 15 bp, Homo sapiens
gtgaggtgaagaccc

SEQ ID NO: 449939 - DNA, 15 bp, Homo sapiens
tgaggtgaagaccca

SEQ ID NO: 449940 - DNA, 15 bp, Homo sapiens
gaggtgaagacccac

SEQ ID NO: 449941 - DNA, 15 bp, Homo sapiens
aggtgaagacccaca

SEQ ID NO: 449942 - DNA, 15 bp, Homo sapiens
ggtgaagacccacac

SEQ ID NO: 449943 - DNA, 15 bp, Homo sapiens
gtgaagacccacacc

SEQ ID NO: 449944 - DNA, 15 bp, Homo sapiens
tgaagacccacacct

SEQ ID NO: 449945 - DNA, 15 bp, Homo sapiens
gaagacccacacctg

SEQ ID NO: 449946 - DNA, 15 bp, Homo sapiens
aagacccacacctgt

SEQ ID NO: 449947 - DNA, 15 bp, Homo sapiens
agacccacacctgta

SEQ ID NO: 449948 - DNA, 15 bp, Homo sapiens
gacccacacctgtaa

SEQ ID NO: 449949 - DNA, 15 bp, Homo sapiens
acccacacctgtaat

SEQ ID NO: 449950 - DNA, 15 bp, Homo sapiens
cccacacctgtaatt

SEQ ID NO: 449951 - DNA, 15 bp, Homo sapiens
ccacacctgtaattc

SEQ ID NO: 449952 - DNA, 15 bp, Homo sapiens
acctgtaattccaga

SEQ ID NO: 449953 - DNA, 15 bp, Homo sapiens
cctgtaattccagag

SEQ ID NO: 449954 - DNA, 15 bp, Homo sapiens
ctgtaattccagaga

SEQ ID NO: 449955 - DNA, 15 bp, Homo sapiens
tgtaattccagagaa

SEQ ID NO: 449956 - DNA, 15 bp, Homo sapiens
gtaattccagagaaa

SEQ ID NO: 449957 - DNA, 15 bp, Homo sapiens
taattccagagaaag

SEQ ID NO: 449958 - DNA, 15 bp, Homo sapiens
aattccagagaaagc

SEQ ID NO: 449959 - DNA, 15 bp, Homo sapiens
attccagagaaagca

SEQ ID NO: 449960 - DNA, 15 bp, Homo sapiens
ttccagagaaagcat

SEQ ID NO: 449961 - DNA, 15 bp, Homo sapiens
tccagagaaagcata

SEQ ID NO: 449962 - DNA, 15 bp, Homo sapiens
ccagagaaagcatat

SEQ ID NO: 449963 - DNA, 15 bp, Homo sapiens
cagagaaagcatatt

SEQ ID NO: 449964 - DNA, 15 bp, Homo sapiens
agagaaagcatattt

SEQ ID NO: 449965 - DNA, 15 bp, Homo sapiens
gagaaagcatatttg

SEQ ID NO: 449966 - DNA, 15 bp, Homo sapiens
agaaagcatatttgt

SEQ ID NO: 449967 - DNA, 15 bp, Homo sapiens
gaaagcatatttgtt

SEQ ID NO: 449968 - DNA, 15 bp, Homo sapiens
aaagcatatttgttg

SEQ ID NO: 449969 - DNA, 15 bp, Homo sapiens
aagcatatttgttgt

SEQ ID NO: 449970 - DNA, 15 bp, Homo sapiens
agcatatttgttgtt

SEQ ID NO: 449971 - DNA, 15 bp, Homo sapiens
gcatatttgttgttt

SEQ ID NO: 449972 - DNA, 15 bp, Homo sapiens
catatttgttgttta

SEQ ID NO: 449973 - DNA, 15 bp, Homo sapiens
atatttgttgtttaa

SEQ ID NO: 449974 - DNA, 15 bp, Homo sapiens
tatttgttgtttaag

SEQ ID NO: 449975 - DNA, 15 bp, Homo sapiens
atttgttgtttaagt

SEQ ID NO: 449976 - DNA, 15 bp, Homo sapiens
tttgttgtttaagta

SEQ ID NO: 449977 - DNA, 15 bp, Homo sapiens
ttgttgtttaagtat

SEQ ID NO: 449978 - DNA, 15 bp, Homo sapiens
tgttgtttaagtata

SEQ ID NO: 449979 - DNA, 15 bp, Homo sapiens
gttgtttaagtataa

SEQ ID NO: 449980 - DNA, 15 bp, Homo sapiens
ttgtttaagtataac

SEQ ID NO: 449981 - DNA, 15 bp, Homo sapiens
tgtttaagtataacg

SEQ ID NO: 449982 - DNA, 15 bp, Homo sapiens
gtttaagtataacgt

SEQ ID NO: 449983 - DNA, 15 bp, Homo sapiens
tttaagtataacgtc

SEQ ID NO: 449984 - DNA, 15 bp, Homo sapiens
ttaagtataacgtct

SEQ ID NO: 449985 - DNA, 15 bp, Homo sapiens
taagtataacgtctg

SEQ ID NO: 449986 - DNA, 15 bp, Homo sapiens
aagtataacgtctgg

SEQ ID NO: 449987 - DNA, 15 bp, Homo sapiens
agtataacgtctggc

SEQ ID NO: 449988 - DNA, 15 bp, Homo sapiens
gtataacgtctggct

SEQ ID NO: 449989 - DNA, 15 bp, Homo sapiens
tataacgtctggctc

SEQ ID NO: 449990 - DNA, 15 bp, Homo sapiens
ataacgtctggctct

SEQ ID NO: 449991 - DNA, 15 bp, Homo sapiens
taacgtctggctcta

SEQ ID NO: 449992 - DNA, 15 bp, Homo sapiens
aacgtctggctctac

SEQ ID NO: 449993 - DNA, 15 bp, Homo sapiens
acgtctggctctaca

SEQ ID NO: 449994 - DNA, 15 bp, Homo sapiens
cgtctggctctacat

SEQ ID NO: 449995 - DNA, 15 bp, Homo sapiens
gtctggctctacatt

SEQ ID NO: 449996 - DNA, 15 bp, Homo sapiens
tctggctctacatta

SEQ ID NO: 449997 - DNA, 15 bp, Homo sapiens
ctggctctacattac

SEQ ID NO: 449998 - DNA, 15 bp, Homo sapiens
tggctctacattacc

SEQ ID NO: 449999 - DNA, 15 bp, Homo sapiens
ggctctacattaccg

SEQ ID NO: 450000 - DNA, 15 bp, Homo sapiens
gctctacattaccga

SEQ ID NO: 450001 - DNA, 15 bp, Homo sapiens
ctctacattaccgat

SEQ ID NO: 450002 - DNA, 15 bp, Homo sapiens
tctacattaccgatg

SEQ ID NO: 450003 - DNA, 15 bp, Homo sapiens
ctacattaccgatgg

SEQ ID NO: 450004 - DNA, 15 bp, Homo sapiens
tacattaccgatggc

SEQ ID NO: 450005 - DNA, 15 bp, Homo sapiens
acattaccgatggct

SEQ ID NO: 450006 - DNA, 15 bp, Homo sapiens
cattaccgatggctt

SEQ ID NO: 450007 - DNA, 15 bp, Homo sapiens
attaccgatggcttt

SEQ ID NO: 450008 - DNA, 15 bp, Homo sapiens
ttaccgatggcttta

SEQ ID NO: 450009 - DNA, 15 bp, Homo sapiens
taccgatggctttag

SEQ ID NO: 450010 - DNA, 15 bp, Homo sapiens
accgatggctttagt

SEQ ID NO: 450011 - DNA, 15 bp, Homo sapiens
ccgatggctttagtt

SEQ ID NO: 450012 - DNA, 15 bp, Homo sapiens
cgatggctttagttt

SEQ ID NO: 450013 - DNA, 15 bp, Homo sapiens
gatggctttagtttg

SEQ ID NO: 450014 - DNA, 15 bp, Homo sapiens
atggctttagtttgg

SEQ ID NO: 450015 - DNA, 15 bp, Homo sapiens
tggctttagtttggt

SEQ ID NO: 450016 - DNA, 15 bp, Homo sapiens
ggctttagtttggtt

SEQ ID NO: 450017 - DNA, 15 bp, Homo sapiens
gctttagtttggttc

SEQ ID NO: 450018 - DNA, 15 bp, Homo sapiens
ctttagtttggttct

SEQ ID NO: 450019 - DNA, 15 bp, Homo sapiens
tttagtttggttctt

SEQ ID NO: 450020 - DNA, 15 bp, Homo sapiens
ttagtttggttcttg

SEQ ID NO: 450021 - DNA, 15 bp, Homo sapiens
tagtttggttcttga

SEQ ID NO: 450022 - DNA, 15 bp, Homo sapiens
agtttggttcttgag

SEQ ID NO: 450023 - DNA, 15 bp, Homo sapiens
gtttggttcttgagc

SEQ ID NO: 450024 - DNA, 15 bp, Homo sapiens
tttggttcttgagcc

SEQ ID NO: 450025 - DNA, 15 bp, Homo sapiens
ttggttcttgagcct

SEQ ID NO: 450026 - DNA, 15 bp, Homo sapiens
tggttcttgagcctt

SEQ ID NO: 450027 - DNA, 15 bp, Homo sapiens
ggttcttgagccttg

SEQ ID NO: 450028 - DNA, 15 bp, Homo sapiens
gttcttgagccttgg

SEQ ID NO: 450029 - DNA, 15 bp, Homo sapiens
ttcttgagccttggt

SEQ ID NO: 450030 - DNA, 15 bp, Homo sapiens
tcttgagccttggtt

SEQ ID NO: 450031 - DNA, 15 bp, Homo sapiens
cttgagccttggttt

SEQ ID NO: 450032 - DNA, 15 bp, Homo sapiens
ttgagccttggtttg

SEQ ID NO: 450033 - DNA, 15 bp, Homo sapiens
tgagccttggtttgc

SEQ ID NO: 450034 - DNA, 15 bp, Homo sapiens
gagccttggtttgct

SEQ ID NO: 450035 - DNA, 15 bp, Homo sapiens
agccttggtttgctc

SEQ ID NO: 450036 - DNA, 15 bp, Homo sapiens
gccttggtttgctcc

SEQ ID NO: 450037 - DNA, 15 bp, Homo sapiens
ccttggtttgctcca

SEQ ID NO: 450038 - DNA, 15 bp, Homo sapiens
cttggtttgctccat

SEQ ID NO: 450039 - DNA, 15 bp, Homo sapiens
ttggtttgctccatc

SEQ ID NO: 450040 - DNA, 15 bp, Homo sapiens
tggtttgctccatca

SEQ ID NO: 450041 - DNA, 15 bp, Homo sapiens
ggtttgctccatcat

SEQ ID NO: 450042 - DNA, 15 bp, Homo sapiens
gtttgctccatcatg

SEQ ID NO: 450043 - DNA, 15 bp, Homo sapiens
tttgctccatcatga

SEQ ID NO: 450044 - DNA, 15 bp, Homo sapiens
ttgctccatcatgat

SEQ ID NO: 450045 - DNA, 15 bp, Homo sapiens
tgctccatcatgatg

SEQ ID NO: 450046 - DNA, 15 bp, Homo sapiens
gctccatcatgatgg

SEQ ID NO: 450047 - DNA, 15 bp, Homo sapiens
ctccatcatgatggg

SEQ ID NO: 450048 - DNA, 15 bp, Homo sapiens
tccatcatgatggga

SEQ ID NO: 450049 - DNA, 15 bp, Homo sapiens
ccatcatgatgggat

SEQ ID NO: 450050 - DNA, 15 bp, Homo sapiens
catcatgatgggatg

SEQ ID NO: 450051 - DNA, 15 bp, Homo sapiens
atcatgatgggatgt

SEQ ID NO: 450052 - DNA, 15 bp, Homo sapiens
tcatgatgggatgtc

SEQ ID NO: 450053 - DNA, 15 bp, Homo sapiens
catgatgggatgtct

SEQ ID NO: 450054 - DNA, 15 bp, Homo sapiens
atgatgggatgtctg

SEQ ID NO: 450055 - DNA, 15 bp, Homo sapiens
tgatgggatgtctgt

SEQ ID NO: 450056 - DNA, 15 bp, Homo sapiens
gatgggatgtctgtc

SEQ ID NO: 450057 - DNA, 15 bp, Homo sapiens
atgggatgtctgtct

SEQ ID NO: 450058 - DNA, 15 bp, Homo sapiens
tgggatgtctgtctc

SEQ ID NO: 450059 - DNA, 15 bp, Homo sapiens
gggatgtctgtctct

SEQ ID NO: 450060 - DNA, 15 bp, Homo sapiens
ggatgtctgtctctg

SEQ ID NO: 450061 - DNA, 15 bp, Homo sapiens
gatgtctgtctctgg

SEQ ID NO: 450062 - DNA, 15 bp, Homo sapiens
atgtctgtctctgga

SEQ ID NO: 450063 - DNA, 15 bp, Homo sapiens
tgtctgtctctggac

SEQ ID NO: 450064 - DNA, 15 bp, Homo sapiens
gtctgtctctggaca

SEQ ID NO: 450065 - DNA, 15 bp, Homo sapiens
tctgtctctggacag

SEQ ID NO: 450066 - DNA, 15 bp, Homo sapiens
ctgtctctggacagt

SEQ ID NO: 450067 - DNA, 15 bp, Homo sapiens
tgtctctggacagta

SEQ ID NO: 450068 - DNA, 15 bp, Homo sapiens
gtctctggacagtac

SEQ ID NO: 450069 - DNA, 15 bp, Homo sapiens
tctctggacagtact

SEQ ID NO: 450070 - DNA, 15 bp, Homo sapiens
ctctggacagtactg

SEQ ID NO: 450071 - DNA, 15 bp, Homo sapiens
tctggacagtactgt

SEQ ID NO: 450072 - DNA, 15 bp, Homo sapiens
ctggacagtactgtt

SEQ ID NO: 450073 - DNA, 15 bp, Homo sapiens
tggacagtactgttg

SEQ ID NO: 450074 - DNA, 15 bp, Homo sapiens
ggacagtactgttgt

SEQ ID NO: 450075 - DNA, 15 bp, Homo sapiens
gacagtactgttgtc

SEQ ID NO: 450076 - DNA, 15 bp, Homo sapiens
acagtactgttgtcg

SEQ ID NO: 450077 - DNA, 15 bp, Homo sapiens
cagtactgttgtcgt

SEQ ID NO: 450078 - DNA, 15 bp, Homo sapiens
agtactgttgtcgtg

SEQ ID NO: 450079 - DNA, 15 bp, Homo sapiens
gtactgttgtcgtgg

SEQ ID NO: 450080 - DNA, 15 bp, Homo sapiens
tactgttgtcgtggg

SEQ ID NO: 450081 - DNA, 15 bp, Homo sapiens
actgttgtcgtgggg

SEQ ID NO: 450082 - DNA, 15 bp, Homo sapiens
ctgttgtcgtgggga

SEQ ID NO: 450083 - DNA, 15 bp, Homo sapiens
tgttgtcgtggggat

SEQ ID NO: 450084 - DNA, 15 bp, Homo sapiens
gttgtcgtggggatt

SEQ ID NO: 450085 - DNA, 15 bp, Homo sapiens
ttgtcgtggggattg

SEQ ID NO: 450086 - DNA, 15 bp, Homo sapiens
tgtcgtggggattga

SEQ ID NO: 450087 - DNA, 15 bp, Homo sapiens
gtcgtggggattgaa

SEQ ID NO: 450088 - DNA, 15 bp, Homo sapiens
tcgtggggattgaaa

SEQ ID NO: 450089 - DNA, 15 bp, Homo sapiens
cgtggggattgaaat

SEQ ID NO: 450090 - DNA, 15 bp, Homo sapiens
gtggggattgaaatt

SEQ ID NO: 450091 - DNA, 15 bp, Homo sapiens
tggggattgaaattc

SEQ ID NO: 450092 - DNA, 15 bp, Homo sapiens
ggggattgaaattcc

SEQ ID NO: 450093 - DNA, 15 bp, Homo sapiens
gggattgaaattccc

SEQ ID NO: 450094 - DNA, 15 bp, Homo sapiens
ggattgaaattccct

SEQ ID NO: 450095 - DNA, 15 bp, Homo sapiens
gattgaaattccctg

SEQ ID NO: 450096 - DNA, 15 bp, Homo sapiens
attgaaattccctga

SEQ ID NO: 450097 - DNA, 15 bp, Homo sapiens
ttgaaattccctgaa

SEQ ID NO: 450098 - DNA, 15 bp, Homo sapiens
tgaaattccctgaaa

SEQ ID NO: 450099 - DNA, 15 bp, Homo sapiens
gaaattccctgaaag

SEQ ID NO: 450100 - DNA, 15 bp, Homo sapiens
aaattccctgaaaga

SEQ ID NO: 450101 - DNA, 15 bp, Homo sapiens
aattccctgaaagag

SEQ ID NO: 450102 - DNA, 15 bp, Homo sapiens
attccctgaaagaga

SEQ ID NO: 450103 - DNA, 15 bp, Homo sapiens
ttccctgaaagagaa

SEQ ID NO: 450104 - DNA, 15 bp, Homo sapiens
tccctgaaagagaag

SEQ ID NO: 450105 - DNA, 15 bp, Homo sapiens
ccctgaaagagaaga

SEQ ID NO: 450106 - DNA, 15 bp, Homo sapiens
cctgaaagagaagac

SEQ ID NO: 450107 - DNA, 15 bp, Homo sapiens
ctgaaagagaagaca

SEQ ID NO: 450108 - DNA, 15 bp, Homo sapiens
tgaaagagaagacaa

SEQ ID NO: 450109 - DNA, 15 bp, Homo sapiens
gaaagagaagacaag

SEQ ID NO: 450110 - DNA, 15 bp, Homo sapiens
aaagagaagacaaga

SEQ ID NO: 450111 - DNA, 15 bp, Homo sapiens
aagagaagacaagag

SEQ ID NO: 450112 - DNA, 15 bp, Homo sapiens
agagaagacaagaga

SEQ ID NO: 450113 - DNA, 15 bp, Homo sapiens
gagaagacaagagat

SEQ ID NO: 450114 - DNA, 15 bp, Homo sapiens
agaagacaagagatc

SEQ ID NO: 450115 - DNA, 15 bp, Homo sapiens
gaagacaagagatca

SEQ ID NO: 450116 - DNA, 15 bp, Homo sapiens
aagacaagagatcaa

SEQ ID NO: 450117 - DNA, 15 bp, Homo sapiens
agacaagagatcaat

SEQ ID NO: 450118 - DNA, 15 bp, Homo sapiens
gacaagagatcaatg

SEQ ID NO: 450119 - DNA, 15 bp, Homo sapiens
acaagagatcaatga

SEQ ID NO: 450120 - DNA, 15 bp, Homo sapiens
caagagatcaatgaa

SEQ ID NO: 450121 - DNA, 15 bp, Homo sapiens
aagagatcaatgaac

SEQ ID NO: 450122 - DNA, 15 bp, Homo sapiens
agagatcaatgaacc

SEQ ID NO: 450123 - DNA, 15 bp, Homo sapiens
gagatcaatgaaccc

SEQ ID NO: 450124 - DNA, 15 bp, Homo sapiens
agatcaatgaaccct

SEQ ID NO: 450125 - DNA, 15 bp, Homo sapiens
gatcaatgaacccta

SEQ ID NO: 450126 - DNA, 15 bp, Homo sapiens
atcaatgaaccctag

SEQ ID NO: 450127 - DNA, 15 bp, Homo sapiens
tcaatgaaccctagt

SEQ ID NO: 450128 - DNA, 15 bp, Homo sapiens
caatgaaccctagta

SEQ ID NO: 450129 - DNA, 15 bp, Homo sapiens
aatgaaccctagtag

SEQ ID NO: 450130 - DNA, 15 bp, Homo sapiens
atgaaccctagtagg

SEQ ID NO: 450131 - DNA, 15 bp, Homo sapiens
tgaaccctagtaggt

SEQ ID NO: 450132 - DNA, 15 bp, Homo sapiens
gaaccctagtaggtt

SEQ ID NO: 450133 - DNA, 15 bp, Homo sapiens
aaccctagtaggttc

SEQ ID NO: 450134 - DNA, 15 bp, Homo sapiens
accctagtaggttct

SEQ ID NO: 450135 - DNA, 15 bp, Homo sapiens
ccctagtaggttctc

SEQ ID NO: 450136 - DNA, 15 bp, Homo sapiens
cctagtaggttctct

SEQ ID NO: 450137 - DNA, 15 bp, Homo sapiens
ctagtaggttctctc

SEQ ID NO: 450138 - DNA, 15 bp, Homo sapiens
tagtaggttctctca

SEQ ID NO: 450139 - DNA, 15 bp, Homo sapiens
agtaggttctctcag

SEQ ID NO: 450140 - DNA, 15 bp, Homo sapiens
gtaggttctctcaga

SEQ ID NO: 450141 - DNA, 15 bp, Homo sapiens
taggttctctcagac

SEQ ID NO: 450142 - DNA, 15 bp, Homo sapiens
aggttctctcagact

SEQ ID NO: 450143 - DNA, 15 bp, Homo sapiens
ggttctctcagactg

SEQ ID NO: 450144 - DNA, 15 bp, Homo sapiens
gttctctcagactgg

SEQ ID NO: 450145 - DNA, 15 bp, Homo sapiens
ttctctcagactggg

SEQ ID NO: 450146 - DNA, 15 bp, Homo sapiens
tctctcagactggga

SEQ ID NO: 450147 - DNA, 15 bp, Homo sapiens
ctctcagactgggag

SEQ ID NO: 450148 - DNA, 15 bp, Homo sapiens
tctcagactgggagc

SEQ ID NO: 450149 - DNA, 15 bp, Homo sapiens
ctcagactgggagcc

SEQ ID NO: 450150 - DNA, 15 bp, Homo sapiens
tcagactgggagccc

SEQ ID NO: 450151 - DNA, 15 bp, Homo sapiens
cagactgggagccca

SEQ ID NO: 450152 - DNA, 15 bp, Homo sapiens
agactgggagcccat

SEQ ID NO: 450153 - DNA, 15 bp, Homo sapiens
gactgggagcccatg

SEQ ID NO: 450154 - DNA, 15 bp, Homo sapiens
actgggagcccatga

SEQ ID NO: 450155 - DNA, 15 bp, Homo sapiens
ctgggagcccatgat

SEQ ID NO: 450156 - DNA, 15 bp, Homo sapiens
tgggagcccatgatg

SEQ ID NO: 450157 - DNA, 15 bp, Homo sapiens
gggagcccatgatgc

SEQ ID NO: 450158 - DNA, 15 bp, Homo sapiens
ggagcccatgatgcc

SEQ ID NO: 450159 - DNA, 15 bp, Homo sapiens
gagcccatgatgcct

SEQ ID NO: 450160 - DNA, 15 bp, Homo sapiens
agcccatgatgcctt

SEQ ID NO: 450161 - DNA, 15 bp, Homo sapiens
gcccatgatgcctta

SEQ ID NO: 450162 - DNA, 15 bp, Homo sapiens
cccatgatgccttac

SEQ ID NO: 450163 - DNA, 15 bp, Homo sapiens
ccatgatgccttact

SEQ ID NO: 450164 - DNA, 15 bp, Homo sapiens
catgatgccttactg

SEQ ID NO: 450165 - DNA, 15 bp, Homo sapiens
atgatgccttactgg

SEQ ID NO: 450166 - DNA, 15 bp, Homo sapiens
tgatgccttactgga

SEQ ID NO: 450167 - DNA, 15 bp, Homo sapiens
gatgccttactggaa

SEQ ID NO: 450168 - DNA, 15 bp, Homo sapiens
atgccttactggaat

SEQ ID NO: 450169 - DNA, 15 bp, Homo sapiens
tgccttactggaatt

SEQ ID NO: 450170 - DNA, 15 bp, Homo sapiens
gccttactggaattg

SEQ ID NO: 450171 - DNA, 15 bp, Homo sapiens
ccttactggaattgc

SEQ ID NO: 450172 - DNA, 15 bp, Homo sapiens
cttactggaattgca

SEQ ID NO: 450173 - DNA, 15 bp, Homo sapiens
ttactggaattgcat

SEQ ID NO: 450174 - DNA, 15 bp, Homo sapiens
tactggaattgcatt

SEQ ID NO: 450175 - DNA, 15 bp, Homo sapiens
actggaattgcatta

SEQ ID NO: 450176 - DNA, 15 bp, Homo sapiens
ctggaattgcattac

SEQ ID NO: 450177 - DNA, 15 bp, Homo sapiens
tggaattgcattacc

SEQ ID NO: 450178 - DNA, 15 bp, Homo sapiens
ggaattgcattacct

SEQ ID NO: 450179 - DNA, 15 bp, Homo sapiens
gaattgcattacctc

SEQ ID NO: 450180 - DNA, 15 bp, Homo sapiens
aattgcattacctcc

SEQ ID NO: 450181 - DNA, 15 bp, Homo sapiens
attgcattacctcct

SEQ ID NO: 450182 - DNA, 15 bp, Homo sapiens
ttgcattacctcctc

SEQ ID NO: 450183 - DNA, 15 bp, Homo sapiens
tgcattacctcctca

SEQ ID NO: 450184 - DNA, 15 bp, Homo sapiens
gcattacctcctcag

SEQ ID NO: 450185 - DNA, 15 bp, Homo sapiens
cattacctcctcagc

SEQ ID NO: 450186 - DNA, 15 bp, Homo sapiens
attacctcctcagca

SEQ ID NO: 450187 - DNA, 15 bp, Homo sapiens
ttacctcctcagcaa

SEQ ID NO: 450188 - DNA, 15 bp, Homo sapiens
tacctcctcagcaaa

SEQ ID NO: 450189 - DNA, 15 bp, Homo sapiens
acctcctcagcaaat

SEQ ID NO: 450190 - DNA, 15 bp, Homo sapiens
cctcctcagcaaatc

SEQ ID NO: 450191 - DNA, 15 bp, Homo sapiens
ctcctcagcaaatcc

SEQ ID NO: 450192 - DNA, 15 bp, Homo sapiens
tcctcagcaaatcct

SEQ ID NO: 450193 - DNA, 15 bp, Homo sapiens
cctcagcaaatcctt

SEQ ID NO: 450194 - DNA, 15 bp, Homo sapiens
ctcagcaaatccttc

SEQ ID NO: 450195 - DNA, 15 bp, Homo sapiens
tcagcaaatccttcc

SEQ ID NO: 450196 - DNA, 15 bp, Homo sapiens
cagcaaatccttcca

SEQ ID NO: 450197 - DNA, 15 bp, Homo sapiens
agcaaatccttccat

SEQ ID NO: 450198 - DNA, 15 bp, Homo sapiens
gcaaatccttccata

SEQ ID NO: 450199 - DNA, 15 bp, Homo sapiens
caaatccttccatat

SEQ ID NO: 450200 - DNA, 15 bp, Homo sapiens
aaatccttccatatt

SEQ ID NO: 450201 - DNA, 15 bp, Homo sapiens
aatccttccatattt

SEQ ID NO: 450202 - DNA, 15 bp, Homo sapiens
atccttccatatttg

SEQ ID NO: 450203 - DNA, 15 bp, Homo sapiens
tccttccatatttgt

SEQ ID NO: 450204 - DNA, 15 bp, Homo sapiens
ccttccatatttgtt

SEQ ID NO: 450205 - DNA, 15 bp, Homo sapiens
cttccatatttgttg

SEQ ID NO: 450206 - DNA, 15 bp, Homo sapiens
ttccatatttgttgg

SEQ ID NO: 450207 - DNA, 15 bp, Homo sapiens
tccatatttgttggt

SEQ ID NO: 450208 - DNA, 15 bp, Homo sapiens
ccatatttgttggta

SEQ ID NO: 450209 - DNA, 15 bp, Homo sapiens
catatttgttggtaa

SEQ ID NO: 450210 - DNA, 15 bp, Homo sapiens
atatttgttggtaat

SEQ ID NO: 450211 - DNA, 15 bp, Homo sapiens
tatttgttggtaata

SEQ ID NO: 450212 - DNA, 15 bp, Homo sapiens
atttgttggtaatag

SEQ ID NO: 450213 - DNA, 15 bp, Homo sapiens
tttgttggtaatagg

SEQ ID NO: 450214 - DNA, 15 bp, Homo sapiens
ttgttggtaataggg

SEQ ID NO: 450215 - DNA, 15 bp, Homo sapiens
tgttggtaataggga

SEQ ID NO: 450216 - DNA, 15 bp, Homo sapiens
gttggtaatagggag

SEQ ID NO: 450217 - DNA, 15 bp, Homo sapiens
ttggtaatagggagg

SEQ ID NO: 450218 - DNA, 15 bp, Homo sapiens
tggtaatagggagga

SEQ ID NO: 450219 - DNA, 15 bp, Homo sapiens
ggtaatagggaggaa

SEQ ID NO: 450220 - DNA, 15 bp, Homo sapiens
gtaatagggaggaaa

SEQ ID NO: 450221 - DNA, 15 bp, Homo sapiens
taatagggaggaaat

SEQ ID NO: 450222 - DNA, 15 bp, Homo sapiens
aatagggaggaaatt

SEQ ID NO: 450223 - DNA, 15 bp, Homo sapiens
atagggaggaaattc

SEQ ID NO: 450224 - DNA, 15 bp, Homo sapiens
tagggaggaaattct

SEQ ID NO: 450225 - DNA, 15 bp, Homo sapiens
agggaggaaattctt

SEQ ID NO: 450226 - DNA, 15 bp, Homo sapiens
gggaggaaattcttt

SEQ ID NO: 450227 - DNA, 15 bp, Homo sapiens
ggaggaaattctttt

SEQ ID NO: 450228 - DNA, 15 bp, Homo sapiens
gaggaaattcttttt

SEQ ID NO: 450229 - DNA, 15 bp, Homo sapiens
aggaaattctttttg

SEQ ID NO: 450230 - DNA, 15 bp, Homo sapiens
ggaaattctttttga

SEQ ID NO: 450231 - DNA, 15 bp, Homo sapiens
gaaattctttttgag

SEQ ID NO: 450232 - DNA, 15 bp, Homo sapiens
aaattctttttgaga

SEQ ID NO: 450233 - DNA, 15 bp, Homo sapiens
aattctttttgagac

SEQ ID NO: 450234 - DNA, 15 bp, Homo sapiens
attctttttgagact

SEQ ID NO: 450235 - DNA, 15 bp, Homo sapiens
ttctttttgagactc

SEQ ID NO: 450236 - DNA, 15 bp, Homo sapiens
tctttttgagactct

SEQ ID NO: 450237 - DNA, 15 bp, Homo sapiens
ctttttgagactctg

SEQ ID NO: 450238 - DNA, 15 bp, Homo sapiens
tttttgagactctgc

SEQ ID NO: 450239 - DNA, 15 bp, Homo sapiens
ttttgagactctgca

SEQ ID NO: 450240 - DNA, 15 bp, Homo sapiens
tttgagactctgcat

SEQ ID NO: 450241 - DNA, 15 bp, Homo sapiens
ttgagactctgcatt

SEQ ID NO: 450242 - DNA, 15 bp, Homo sapiens
tgagactctgcattt

SEQ ID NO: 450243 - DNA, 15 bp, Homo sapiens
gagactctgcatttc

SEQ ID NO: 450244 - DNA, 15 bp, Homo sapiens
agactctgcatttct

SEQ ID NO: 450245 - DNA, 15 bp, Homo sapiens
gactctgcatttctg

SEQ ID NO: 450246 - DNA, 15 bp, Homo sapiens
actctgcatttctgt

SEQ ID NO: 450247 - DNA, 15 bp, Homo sapiens
ctctgcatttctgta

SEQ ID NO: 450248 - DNA, 15 bp, Homo sapiens
tctgcatttctgtaa

SEQ ID NO: 450249 - DNA, 15 bp, Homo sapiens
ctgcatttctgtaaa

SEQ ID NO: 450250 - DNA, 15 bp, Homo sapiens
tgcatttctgtaaag

SEQ ID NO: 450251 - DNA, 15 bp, Homo sapiens
gcatttctgtaaagc

SEQ ID NO: 450252 - DNA, 15 bp, Homo sapiens
catttctgtaaagct

SEQ ID NO: 450253 - DNA, 15 bp, Homo sapiens
atttctgtaaagctc

SEQ ID NO: 450254 - DNA, 15 bp, Homo sapiens
tttctgtaaagctct

SEQ ID NO: 450255 - DNA, 15 bp, Homo sapiens
ttctgtaaagctctg

SEQ ID NO: 450256 - DNA, 15 bp, Homo sapiens
tctgtaaagctctga

SEQ ID NO: 450257 - DNA, 15 bp, Homo sapiens
ctgtaaagctctgag

SEQ ID NO: 450258 - DNA, 15 bp, Homo sapiens
tgtaaagctctgagc

SEQ ID NO: 450259 - DNA, 15 bp, Homo sapiens
gtaaagctctgagcc

SEQ ID NO: 450260 - DNA, 15 bp, Homo sapiens
taaagctctgagcct

SEQ ID NO: 450261 - DNA, 15 bp, Homo sapiens
aaagctctgagccta

SEQ ID NO: 450262 - DNA, 15 bp, Homo sapiens
aagctctgagcctaa

SEQ ID NO: 450263 - DNA, 15 bp, Homo sapiens
agctctgagcctaat

SEQ ID NO: 450264 - DNA, 15 bp, Homo sapiens
gctctgagcctaatg

SEQ ID NO: 450265 - DNA, 15 bp, Homo sapiens
ctctgagcctaatga

SEQ ID NO: 450266 - DNA, 15 bp, Homo sapiens
tctgagcctaatgat

SEQ ID NO: 450267 - DNA, 15 bp, Homo sapiens
ctgagcctaatgatg

SEQ ID NO: 450268 - DNA, 15 bp, Homo sapiens
tgagcctaatgatga

SEQ ID NO: 450269 - DNA, 15 bp, Homo sapiens
gagcctaatgatgaa

SEQ ID NO: 450270 - DNA, 15 bp, Homo sapiens
agcctaatgatgaat

SEQ ID NO: 450271 - DNA, 15 bp, Homo sapiens
gcctaatgatgaata

SEQ ID NO: 450272 - DNA, 15 bp, Homo sapiens
cctaatgatgaatag

SEQ ID NO: 450273 - DNA, 15 bp, Homo sapiens
ctaatgatgaatagt

SEQ ID NO: 450274 - DNA, 15 bp, Homo sapiens
taatgatgaatagta

SEQ ID NO: 450275 - DNA, 15 bp, Homo sapiens
aatgatgaatagtaa

SEQ ID NO: 450276 - DNA, 15 bp, Homo sapiens
atgatgaatagtaag

SEQ ID NO: 450277 - DNA, 15 bp, Homo sapiens
tgatgaatagtaaga

SEQ ID NO: 450278 - DNA, 15 bp, Homo sapiens
gatgaatagtaagaa

SEQ ID NO: 450279 - DNA, 15 bp, Homo sapiens
atgaatagtaagaat

SEQ ID NO: 450280 - DNA, 15 bp, Homo sapiens
tgaatagtaagaatt

SEQ ID NO: 450281 - DNA, 15 bp, Homo sapiens
gaatagtaagaattt

SEQ ID NO: 450282 - DNA, 15 bp, Homo sapiens
aatagtaagaattta

SEQ ID NO: 450283 - DNA, 15 bp, Homo sapiens
atagtaagaatttag

SEQ ID NO: 450284 - DNA, 15 bp, Homo sapiens
tagtaagaatttagg

SEQ ID NO: 450285 - DNA, 15 bp, Homo sapiens
agtaagaatttaggt

SEQ ID NO: 450286 - DNA, 15 bp, Homo sapiens
gtaagaatttaggtc

SEQ ID NO: 450287 - DNA, 15 bp, Homo sapiens
taagaatttaggtca

SEQ ID NO: 450288 - DNA, 15 bp, Homo sapiens
aagaatttaggtcaa

SEQ ID NO: 450289 - DNA, 15 bp, Homo sapiens
agaatttaggtcaaa

SEQ ID NO: 450290 - DNA, 15 bp, Homo sapiens
gaatttaggtcaaac

SEQ ID NO: 450291 - DNA, 15 bp, Homo sapiens
aatttaggtcaaaca

SEQ ID NO: 450292 - DNA, 15 bp, Homo sapiens
atttaggtcaaacaa

SEQ ID NO: 450293 - DNA, 15 bp, Homo sapiens
tttaggtcaaacaac

SEQ ID NO: 450294 - DNA, 15 bp, Homo sapiens
ttaggtcaaacaact

SEQ ID NO: 450295 - DNA, 15 bp, Homo sapiens
taggtcaaacaactt

SEQ ID NO: 450296 - DNA, 15 bp, Homo sapiens
aggtcaaacaacttc

SEQ ID NO: 450297 - DNA, 15 bp, Homo sapiens
ggtcaaacaacttca

SEQ ID NO: 450298 - DNA, 15 bp, Homo sapiens
gtcaaacaacttcag

SEQ ID NO: 450299 - DNA, 15 bp, Homo sapiens
tcaaacaacttcagt

SEQ ID NO: 450300 - DNA, 15 bp, Homo sapiens
caaacaacttcagta

SEQ ID NO: 450301 - DNA, 15 bp, Homo sapiens
aaacaacttcagtac

SEQ ID NO: 450302 - DNA, 15 bp, Homo sapiens
aacaacttcagtacc

SEQ ID NO: 450303 - DNA, 15 bp, Homo sapiens
acaacttcagtaccc

SEQ ID NO: 450304 - DNA, 15 bp, Homo sapiens
caacttcagtacccg

SEQ ID NO: 450305 - DNA, 15 bp, Homo sapiens
aacttcagtacccgg

SEQ ID NO: 450306 - DNA, 15 bp, Homo sapiens
acttcagtacccggc

SEQ ID NO: 450307 - DNA, 15 bp, Homo sapiens
cttcagtacccggct

SEQ ID NO: 450308 - DNA, 15 bp, Homo sapiens
ttcagtacccggctc

SEQ ID NO: 450309 - DNA, 15 bp, Homo sapiens
tcagtacccggctcc

SEQ ID NO: 450310 - DNA, 15 bp, Homo sapiens
cagtacccggctcca

SEQ ID NO: 450311 - DNA, 15 bp, Homo sapiens
agtacccggctccat

SEQ ID NO: 450312 - DNA, 15 bp, Homo sapiens
gtacccggctccatg

SEQ ID NO: 450313 - DNA, 15 bp, Homo sapiens
tacccggctccatgg

SEQ ID NO: 450314 - DNA, 15 bp, Homo sapiens
acccggctccatggt

SEQ ID NO: 450315 - DNA, 15 bp, Homo sapiens
cccggctccatggtc

SEQ ID NO: 450316 - DNA, 15 bp, Homo sapiens
ccggctccatggtct

SEQ ID NO: 450317 - DNA, 15 bp, Homo sapiens
cggctccatggtctt

SEQ ID NO: 450318 - DNA, 15 bp, Homo sapiens
ggctccatggtcttt

SEQ ID NO: 450319 - DNA, 15 bp, Homo sapiens
gctccatggtctttt

SEQ ID NO: 450320 - DNA, 15 bp, Homo sapiens
ctccatggtcttttg

SEQ ID NO: 450321 - DNA, 15 bp, Homo sapiens
tccatggtcttttga

SEQ ID NO: 450322 - DNA, 15 bp, Homo sapiens
ccatggtcttttgag

SEQ ID NO: 450323 - DNA, 15 bp, Homo sapiens
catggtcttttgagc

SEQ ID NO: 450324 - DNA, 15 bp, Homo sapiens
atggtcttttgagca

SEQ ID NO: 450325 - DNA, 15 bp, Homo sapiens
tggtcttttgagcaa

SEQ ID NO: 450326 - DNA, 15 bp, Homo sapiens
ggtcttttgagcaat

SEQ ID NO: 450327 - DNA, 15 bp, Homo sapiens
gtcttttgagcaatt

SEQ ID NO: 450328 - DNA, 15 bp, Homo sapiens
tcttttgagcaattt

SEQ ID NO: 450329 - DNA, 15 bp, Homo sapiens
cttttgagcaatttg

SEQ ID NO: 450330 - DNA, 15 bp, Homo sapiens
ttttgagcaatttgt

SEQ ID NO: 450331 - DNA, 15 bp, Homo sapiens
tttgagcaatttgta

SEQ ID NO: 450332 - DNA, 15 bp, Homo sapiens
ttgagcaatttgtag

SEQ ID NO: 450333 - DNA, 15 bp, Homo sapiens
tgagcaatttgtagt

SEQ ID NO: 450334 - DNA, 15 bp, Homo sapiens
gagcaatttgtagta

SEQ ID NO: 450335 - DNA, 15 bp, Homo sapiens
agcaatttgtagtat

SEQ ID NO: 450336 - DNA, 15 bp, Homo sapiens
gcaatttgtagtatc

SEQ ID NO: 450337 - DNA, 15 bp, Homo sapiens
caatttgtagtatca

SEQ ID NO: 450338 - DNA, 15 bp, Homo sapiens
aatttgtagtatcac

SEQ ID NO: 450339 - DNA, 15 bp, Homo sapiens
atttgtagtatcact

SEQ ID NO: 450340 - DNA, 15 bp, Homo sapiens
tttgtagtatcacta

SEQ ID NO: 450341 - DNA, 15 bp, Homo sapiens
ttgtagtatcactac

SEQ ID NO: 450342 - DNA, 15 bp, Homo sapiens
tgtagtatcactacc

SEQ ID NO: 450343 - DNA, 15 bp, Homo sapiens
gtagtatcactacca

SEQ ID NO: 450344 - DNA, 15 bp, Homo sapiens
tagtatcactaccat

SEQ ID NO: 450345 - DNA, 15 bp, Homo sapiens
agtatcactaccatc

SEQ ID NO: 450346 - DNA, 15 bp, Homo sapiens
gtatcactaccatca

SEQ ID NO: 450347 - DNA, 15 bp, Homo sapiens
tatcactaccatcaa

SEQ ID NO: 450348 - DNA, 15 bp, Homo sapiens
atcactaccatcaaa

SEQ ID NO: 450349 - DNA, 15 bp, Homo sapiens
tcactaccatcaaac

SEQ ID NO: 450350 - DNA, 15 bp, Homo sapiens
cactaccatcaaacc

SEQ ID NO: 450351 - DNA, 15 bp, Homo sapiens
actaccatcaaaccg

SEQ ID NO: 450352 - DNA, 15 bp, Homo sapiens
ctaccatcaaaccga

SEQ ID NO: 450353 - DNA, 15 bp, Homo sapiens
taccatcaaaccgaa

SEQ ID NO: 450354 - DNA, 15 bp, Homo sapiens
accatcaaaccgaaa

SEQ ID NO: 450355 - DNA, 15 bp, Homo sapiens
ccatcaaaccgaaag

SEQ ID NO: 450356 - DNA, 15 bp, Homo sapiens
catcaaaccgaaagg

SEQ ID NO: 450357 - DNA, 15 bp, Homo sapiens
atcaaaccgaaaggg

SEQ ID NO: 450358 - DNA, 15 bp, Homo sapiens
tcaaaccgaaagggt

SEQ ID NO: 450359 - DNA, 15 bp, Homo sapiens
caaaccgaaagggtg

SEQ ID NO: 450360 - DNA, 15 bp, Homo sapiens
aaaccgaaagggtgg

SEQ ID NO: 450361 - DNA, 15 bp, Homo sapiens
aaccgaaagggtgga

SEQ ID NO: 450362 - DNA, 15 bp, Homo sapiens
accgaaagggtggaa

SEQ ID NO: 450363 - DNA, 15 bp, Homo sapiens
ccgaaagggtggaat

SEQ ID NO: 450364 - DNA, 15 bp, Homo sapiens
cgaaagggtggaatg

SEQ ID NO: 450365 - DNA, 15 bp, Homo sapiens
gaaagggtggaatgg

SEQ ID NO: 450366 - DNA, 15 bp, Homo sapiens
aaagggtggaatggt

SEQ ID NO: 450367 - DNA, 15 bp, Homo sapiens
aagggtggaatggtt

SEQ ID NO: 450368 - DNA, 15 bp, Homo sapiens
agggtggaatggttt

SEQ ID NO: 450369 - DNA, 15 bp, Homo sapiens
gggtggaatggtttt

SEQ ID NO: 450370 - DNA, 15 bp, Homo sapiens
ggtggaatggttttg

SEQ ID NO: 450371 - DNA, 15 bp, Homo sapiens
gtggaatggttttgt

SEQ ID NO: 450372 - DNA, 15 bp, Homo sapiens
tggaatggttttgtt

SEQ ID NO: 450373 - DNA, 15 bp, Homo sapiens
ggaatggttttgttg

SEQ ID NO: 450374 - DNA, 15 bp, Homo sapiens
gaatggttttgttgg

SEQ ID NO: 450375 - DNA, 15 bp, Homo sapiens
aatggttttgttggt

SEQ ID NO: 450376 - DNA, 15 bp, Homo sapiens
atggttttgttggtg

SEQ ID NO: 450377 - DNA, 15 bp, Homo sapiens
tggttttgttggtgt

SEQ ID NO: 450378 - DNA, 15 bp, Homo sapiens
ggttttgttggtgtt

SEQ ID NO: 450379 - DNA, 15 bp, Homo sapiens
gttttgttggtgttc

SEQ ID NO: 450380 - DNA, 15 bp, Homo sapiens
ttttgttggtgttca

SEQ ID NO: 450381 - DNA, 15 bp, Homo sapiens
tttgttggtgttcag

SEQ ID NO: 450382 - DNA, 15 bp, Homo sapiens
ttgttggtgttcagt

SEQ ID NO: 450383 - DNA, 15 bp, Homo sapiens
tgttggtgttcagta

SEQ ID NO: 450384 - DNA, 15 bp, Homo sapiens
gttggtgttcagtag

SEQ ID NO: 450385 - DNA, 15 bp, Homo sapiens
ttggtgttcagtagt

SEQ ID NO: 450386 - DNA, 15 bp, Homo sapiens
tggtgttcagtagtg

SEQ ID NO: 450387 - DNA, 15 bp, Homo sapiens
ggtgttcagtagtgg

SEQ ID NO: 450388 - DNA, 15 bp, Homo sapiens
gtgttcagtagtgga

SEQ ID NO: 450389 - DNA, 15 bp, Homo sapiens
tgttcagtagtggac

SEQ ID NO: 450390 - DNA, 15 bp, Homo sapiens
gttcagtagtggacc

SEQ ID NO: 450391 - DNA, 15 bp, Homo sapiens
ttcagtagtggacca

SEQ ID NO: 450392 - DNA, 15 bp, Homo sapiens
tcagtagtggaccat

SEQ ID NO: 450393 - DNA, 15 bp, Homo sapiens
cagtagtggaccatg

SEQ ID NO: 450394 - DNA, 15 bp, Homo sapiens
agtagtggaccatga

SEQ ID NO: 450395 - DNA, 15 bp, Homo sapiens
gtagtggaccatgaa

SEQ ID NO: 450396 - DNA, 15 bp, Homo sapiens
tagtggaccatgaag

SEQ ID NO: 450397 - DNA, 15 bp, Homo sapiens
agtggaccatgaagt

SEQ ID NO: 450398 - DNA, 15 bp, Homo sapiens
gtggaccatgaagta

SEQ ID NO: 450399 - DNA, 15 bp, Homo sapiens
tggaccatgaagtag

SEQ ID NO: 450400 - DNA, 15 bp, Homo sapiens
ggaccatgaagtaga

SEQ ID NO: 450401 - DNA, 15 bp, Homo sapiens
gaccatgaagtagaa

SEQ ID NO: 450402 - DNA, 15 bp, Homo sapiens
accatgaagtagaag

SEQ ID NO: 450403 - DNA, 15 bp, Homo sapiens
ccatgaagtagaagt

SEQ ID NO: 450404 - DNA, 15 bp, Homo sapiens
catgaagtagaagta

SEQ ID NO: 450405 - DNA, 15 bp, Homo sapiens
atgaagtagaagtat

SEQ ID NO: 450406 - DNA, 15 bp, Homo sapiens
tgaagtagaagtatt

SEQ ID NO: 450407 - DNA, 15 bp, Homo sapiens
gaagtagaagtattt

SEQ ID NO: 450408 - DNA, 15 bp, Homo sapiens
aagtagaagtatttg

SEQ ID NO: 450409 - DNA, 15 bp, Homo sapiens
agtagaagtatttgt

SEQ ID NO: 450410 - DNA, 15 bp, Homo sapiens
gtagaagtatttgtc

SEQ ID NO: 450411 - DNA, 15 bp, Homo sapiens
tagaagtatttgtct

SEQ ID NO: 450412 - DNA, 15 bp, Homo sapiens
agaagtatttgtctc

SEQ ID NO: 450413 - DNA, 15 bp, Homo sapiens
gaagtatttgtctct

SEQ ID NO: 450414 - DNA, 15 bp, Homo sapiens
aagtatttgtctctg

SEQ ID NO: 450415 - DNA, 15 bp, Homo sapiens
agtatttgtctctgc

SEQ ID NO: 450416 - DNA, 15 bp, Homo sapiens
gtatttgtctctgca

SEQ ID NO: 450417 - DNA, 15 bp, Homo sapiens
tatttgtctctgcat

SEQ ID NO: 450418 - DNA, 15 bp, Homo sapiens
atttgtctctgcatt

SEQ ID NO: 450419 - DNA, 15 bp, Homo sapiens
tttgtctctgcattg

SEQ ID NO: 450420 - DNA, 15 bp, Homo sapiens
ttgtctctgcattgg

SEQ ID NO: 450421 - DNA, 15 bp, Homo sapiens
tgtctctgcattgga

SEQ ID NO: 450422 - DNA, 15 bp, Homo sapiens
gtctctgcattggag

SEQ ID NO: 450423 - DNA, 15 bp, Homo sapiens
tctctgcattggagt

SEQ ID NO: 450424 - DNA, 15 bp, Homo sapiens
ctctgcattggagtc

SEQ ID NO: 450425 - DNA, 15 bp, Homo sapiens
tctgcattggagtca

SEQ ID NO: 450426 - DNA, 15 bp, Homo sapiens
ctgcattggagtcaa

SEQ ID NO: 450427 - DNA, 15 bp, Homo sapiens
tgcattggagtcaag

SEQ ID NO: 450428 - DNA, 15 bp, Homo sapiens
gcattggagtcaaga

SEQ ID NO: 450429 - DNA, 15 bp, Homo sapiens
cattggagtcaagaa

SEQ ID NO: 450430 - DNA, 15 bp, Homo sapiens
attggagtcaagaat

SEQ ID NO: 450431 - DNA, 15 bp, Homo sapiens
ttggagtcaagaatc

SEQ ID NO: 450432 - DNA, 15 bp, Homo sapiens
tggagtcaagaatct

SEQ ID NO: 450433 - DNA, 15 bp, Homo sapiens
ggagtcaagaatctg

SEQ ID NO: 450434 - DNA, 15 bp, Homo sapiens
gagtcaagaatctgg

SEQ ID NO: 450435 - DNA, 15 bp, Homo sapiens
agtcaagaatctggg

SEQ ID NO: 450436 - DNA, 15 bp, Homo sapiens
gtcaagaatctgggt

SEQ ID NO: 450437 - DNA, 15 bp, Homo sapiens
tcaagaatctgggta

SEQ ID NO: 450438 - DNA, 15 bp, Homo sapiens
caagaatctgggtag

SEQ ID NO: 450439 - DNA, 15 bp, Homo sapiens
aagaatctgggtaga

SEQ ID NO: 450440 - DNA, 15 bp, Homo sapiens
agaatctgggtagag

SEQ ID NO: 450441 - DNA, 15 bp, Homo sapiens
gaatctgggtagagg

SEQ ID NO: 450442 - DNA, 15 bp, Homo sapiens
aatctgggtagagga

SEQ ID NO: 450443 - DNA, 15 bp, Homo sapiens
atctgggtagaggag

SEQ ID NO: 450444 - DNA, 15 bp, Homo sapiens
tctgggtagaggagc

SEQ ID NO: 450445 - DNA, 15 bp, Homo sapiens
ctgggtagaggagcc

SEQ ID NO: 450446 - DNA, 15 bp, Homo sapiens
tgggtagaggagccc

SEQ ID NO: 450447 - DNA, 15 bp, Homo sapiens
gggtagaggagcccg

SEQ ID NO: 450448 - DNA, 15 bp, Homo sapiens
ggtagaggagcccga

SEQ ID NO: 450449 - DNA, 15 bp, Homo sapiens
gtagaggagcccgac

SEQ ID NO: 450450 - DNA, 15 bp, Homo sapiens
tagaggagcccgaca

SEQ ID NO: 450451 - DNA, 15 bp, Homo sapiens
agaggagcccgacaa

SEQ ID NO: 450452 - DNA, 15 bp, Homo sapiens
gaggagcccgacaac

SEQ ID NO: 450453 - DNA, 15 bp, Homo sapiens
aggagcccgacaact

SEQ ID NO: 450454 - DNA, 15 bp, Homo sapiens
ggagcccgacaactt

SEQ ID NO: 450455 - DNA, 15 bp, Homo sapiens
gagcccgacaacttt

SEQ ID NO: 450456 - DNA, 15 bp, Homo sapiens
agcccgacaactttc

SEQ ID NO: 450457 - DNA, 15 bp, Homo sapiens
gcccgacaactttcc

SEQ ID NO: 450458 - DNA, 15 bp, Homo sapiens
cccgacaactttcca

SEQ ID NO: 450459 - DNA, 15 bp, Homo sapiens
ccgacaactttccat

SEQ ID NO: 450460 - DNA, 15 bp, Homo sapiens
cgacaactttccatc

SEQ ID NO: 450461 - DNA, 15 bp, Homo sapiens
gacaactttccatct

SEQ ID NO: 450462 - DNA, 15 bp, Homo sapiens
acaactttccatctc

SEQ ID NO: 450463 - DNA, 15 bp, Homo sapiens
caactttccatctct

SEQ ID NO: 450464 - DNA, 15 bp, Homo sapiens
aactttccatctctt

SEQ ID NO: 450465 - DNA, 15 bp, Homo sapiens
actttccatctcttt

SEQ ID NO: 450466 - DNA, 15 bp, Homo sapiens
ctttccatctctttc

SEQ ID NO: 450467 - DNA, 15 bp, Homo sapiens
tttccatctctttcc

SEQ ID NO: 450468 - DNA, 15 bp, Homo sapiens
ttccatctctttcca

SEQ ID NO: 450469 - DNA, 15 bp, Homo sapiens
tccatctctttccaa

SEQ ID NO: 450470 - DNA, 15 bp, Homo sapiens
ccatctctttccaag

SEQ ID NO: 450471 - DNA, 15 bp, Homo sapiens
catctctttccaaga

SEQ ID NO: 450472 - DNA, 15 bp, Homo sapiens
atctctttccaagac

SEQ ID NO: 450473 - DNA, 15 bp, Homo sapiens
tctctttccaagaca

SEQ ID NO: 450474 - DNA, 15 bp, Homo sapiens
ctctttccaagacag

SEQ ID NO: 450475 - DNA, 15 bp, Homo sapiens
tctttccaagacaga

SEQ ID NO: 450476 - DNA, 15 bp, Homo sapiens
ctttccaagacagat

SEQ ID NO: 450477 - DNA, 15 bp, Homo sapiens
tttccaagacagatc

SEQ ID NO: 450478 - DNA, 15 bp, Homo sapiens
ttccaagacagatct

SEQ ID NO: 450479 - DNA, 15 bp, Homo sapiens
tccaagacagatctt

SEQ ID NO: 450480 - DNA, 15 bp, Homo sapiens
ccaagacagatcttc

SEQ ID NO: 450481 - DNA, 15 bp, Homo sapiens
caagacagatcttca

SEQ ID NO: 450482 - DNA, 15 bp, Homo sapiens
aagacagatcttcac

SEQ ID NO: 450483 - DNA, 15 bp, Homo sapiens
agacagatcttcaca

SEQ ID NO: 450484 - DNA, 15 bp, Homo sapiens
gacagatcttcacat

SEQ ID NO: 450485 - DNA, 15 bp, Homo sapiens
acagatcttcacatt

SEQ ID NO: 450486 - DNA, 15 bp, Homo sapiens
cagatcttcacattg

SEQ ID NO: 450487 - DNA, 15 bp, Homo sapiens
agatcttcacattgt

SEQ ID NO: 450488 - DNA, 15 bp, Homo sapiens
gatcttcacattgta

SEQ ID NO: 450489 - DNA, 15 bp, Homo sapiens
atcttcacattgtag

SEQ ID NO: 450490 - DNA, 15 bp, Homo sapiens
tcttcacattgtagt

SEQ ID NO: 450491 - DNA, 15 bp, Homo sapiens
cttcacattgtagtt

SEQ ID NO: 450492 - DNA, 15 bp, Homo sapiens
ttcacattgtagtta

SEQ ID NO: 450493 - DNA, 15 bp, Homo sapiens
tcacattgtagttac

SEQ ID NO: 450494 - DNA, 15 bp, Homo sapiens
cacattgtagttaca

SEQ ID NO: 450495 - DNA, 15 bp, Homo sapiens
acattgtagttacat

SEQ ID NO: 450496 - DNA, 15 bp, Homo sapiens
cattgtagttacatt

SEQ ID NO: 450497 - DNA, 15 bp, Homo sapiens
attgtagttacatta

SEQ ID NO: 450498 - DNA, 15 bp, Homo sapiens
ttgtagttacattat

SEQ ID NO: 450499 - DNA, 15 bp, Homo sapiens
tgtagttacattatt

SEQ ID NO: 450500 - DNA, 15 bp, Homo sapiens
gtagttacattattt

SEQ ID NO: 450501 - DNA, 15 bp, Homo sapiens
tagttacattatttt

SEQ ID NO: 450502 - DNA, 15 bp, Homo sapiens
agttacattattttg

SEQ ID NO: 450503 - DNA, 15 bp, Homo sapiens
gttacattattttgt

SEQ ID NO: 450504 - DNA, 15 bp, Homo sapiens
ttacattattttgtt

SEQ ID NO: 450505 - DNA, 15 bp, Homo sapiens
tacattattttgttt

SEQ ID NO: 450506 - DNA, 15 bp, Homo sapiens
acattattttgtttg

SEQ ID NO: 450507 - DNA, 15 bp, Homo sapiens
cattattttgtttga

SEQ ID NO: 450508 - DNA, 15 bp, Homo sapiens
attattttgtttgag

SEQ ID NO: 450509 - DNA, 15 bp, Homo sapiens
ttattttgtttgaga

SEQ ID NO: 450510 - DNA, 15 bp, Homo sapiens
tattttgtttgagat

SEQ ID NO: 450511 - DNA, 15 bp, Homo sapiens
attttgtttgagatc

SEQ ID NO: 450512 - DNA, 15 bp, Homo sapiens
ttttgtttgagatct

SEQ ID NO: 450513 - DNA, 15 bp, Homo sapiens
tttgtttgagatctt

SEQ ID NO: 450514 - DNA, 15 bp, Homo sapiens
ttgtttgagatcttg

SEQ ID NO: 450515 - DNA, 15 bp, Homo sapiens
tgtttgagatcttgg

SEQ ID NO: 450516 - DNA, 15 bp, Homo sapiens
gtttgagatcttgga

SEQ ID NO: 450517 - DNA, 15 bp, Homo sapiens
tttgagatcttggaa

SEQ ID NO: 450518 - DNA, 15 bp, Homo sapiens
ttgagatcttggaat

SEQ ID NO: 450519 - DNA, 15 bp, Homo sapiens
tgagatcttggaatt

SEQ ID NO: 450520 - DNA, 15 bp, Homo sapiens
gagatcttggaattt

SEQ ID NO: 450521 - DNA, 15 bp, Homo sapiens
agatcttggaatttc

SEQ ID NO: 450522 - DNA, 15 bp, Homo sapiens
gatcttggaatttcc

SEQ ID NO: 450523 - DNA, 15 bp, Homo sapiens
atcttggaatttcca

SEQ ID NO: 450524 - DNA, 15 bp, Homo sapiens
tcttggaatttccag

SEQ ID NO: 450525 - DNA, 15 bp, Homo sapiens
cttggaatttccagg

SEQ ID NO: 450526 - DNA, 15 bp, Homo sapiens
ttggaatttccagga

SEQ ID NO: 450527 - DNA, 15 bp, Homo sapiens
tggaatttccaggat

SEQ ID NO: 450528 - DNA, 15 bp, Homo sapiens
ggaatttccaggata

SEQ ID NO: 450529 - DNA, 15 bp, Homo sapiens
gaatttccaggatac

SEQ ID NO: 450530 - DNA, 15 bp, Homo sapiens
aatttccaggataca

SEQ ID NO: 450531 - DNA, 15 bp, Homo sapiens
atttccaggatacat

SEQ ID NO: 450532 - DNA, 15 bp, Homo sapiens
tttccaggatacata

SEQ ID NO: 450533 - DNA, 15 bp, Homo sapiens
ttccaggatacatac

SEQ ID NO: 450534 - DNA, 15 bp, Homo sapiens
tccaggatacatacc

SEQ ID NO: 450535 - DNA, 15 bp, Homo sapiens
ccaggatacataccc

SEQ ID NO: 450536 - DNA, 15 bp, Homo sapiens
caggatacataccca

SEQ ID NO: 450537 - DNA, 15 bp, Homo sapiens
aggatacatacccaa

SEQ ID NO: 450538 - DNA, 15 bp, Homo sapiens
ggatacatacccaat

SEQ ID NO: 450539 - DNA, 15 bp, Homo sapiens
gatacatacccaatt

SEQ ID NO: 450540 - DNA, 15 bp, Homo sapiens
atacatacccaattg

SEQ ID NO: 450541 - DNA, 15 bp, Homo sapiens
tacatacccaattgc

SEQ ID NO: 450542 - DNA, 15 bp, Homo sapiens
acatacccaattgct

SEQ ID NO: 450543 - DNA, 15 bp, Homo sapiens
catacccaattgcta

SEQ ID NO: 450544 - DNA, 15 bp, Homo sapiens
atacccaattgctaa

SEQ ID NO: 450545 - DNA, 15 bp, Homo sapiens
tacccaattgctaat

SEQ ID NO: 450546 - DNA, 15 bp, Homo sapiens
acccaattgctaata

SEQ ID NO: 450547 - DNA, 15 bp, Homo sapiens
cccaattgctaatat

SEQ ID NO: 450548 - DNA, 15 bp, Homo sapiens
ccaattgctaatatt

SEQ ID NO: 450549 - DNA, 15 bp, Homo sapiens
caattgctaatattt

SEQ ID NO: 450550 - DNA, 15 bp, Homo sapiens
aattgctaatatttc

SEQ ID NO: 450551 - DNA, 15 bp, Homo sapiens
attgctaatatttcc

SEQ ID NO: 450552 - DNA, 15 bp, Homo sapiens
ttgctaatatttccg

SEQ ID NO: 450553 - DNA, 15 bp, Homo sapiens
tgctaatatttccgg

SEQ ID NO: 450554 - DNA, 15 bp, Homo sapiens
gctaatatttccggg

SEQ ID NO: 450555 - DNA, 15 bp, Homo sapiens
ctaatatttccggga

SEQ ID NO: 450556 - DNA, 15 bp, Homo sapiens
taatatttccgggat

SEQ ID NO: 450557 - DNA, 15 bp, Homo sapiens
aatatttccgggata

SEQ ID NO: 450558 - DNA, 15 bp, Homo sapiens
atatttccgggatac

SEQ ID NO: 450559 - DNA, 15 bp, Homo sapiens
tatttccgggatacg

SEQ ID NO: 450560 - DNA, 15 bp, Homo sapiens
atttccgggatacgt

SEQ ID NO: 450561 - DNA, 15 bp, Homo sapiens
tttccgggatacgta

SEQ ID NO: 450562 - DNA, 15 bp, Homo sapiens
ttccgggatacgtac

SEQ ID NO: 450563 - DNA, 15 bp, Homo sapiens
tccgggatacgtacc

SEQ ID NO: 450564 - DNA, 15 bp, Homo sapiens
ccgggatacgtaccc

SEQ ID NO: 450565 - DNA, 15 bp, Homo sapiens
cgggatacgtaccca

SEQ ID NO: 450566 - DNA, 15 bp, Homo sapiens
gggatacgtacccaa

SEQ ID NO: 450567 - DNA, 15 bp, Homo sapiens
ggatacgtacccaac

SEQ ID NO: 450568 - DNA, 15 bp, Homo sapiens
gatacgtacccaact

SEQ ID NO: 450569 - DNA, 15 bp, Homo sapiens
atacgtacccaactg

SEQ ID NO: 450570 - DNA, 15 bp, Homo sapiens
tacgtacccaactgc

SEQ ID NO: 450571 - DNA, 15 bp, Homo sapiens
acgtacccaactgca

SEQ ID NO: 450572 - DNA, 15 bp, Homo sapiens
cgtacccaactgcaa

SEQ ID NO: 450573 - DNA, 15 bp, Homo sapiens
gtacccaactgcaaa

SEQ ID NO: 450574 - DNA, 15 bp, Homo sapiens
tacccaactgcaaat

SEQ ID NO: 450575 - DNA, 15 bp, Homo sapiens
acccaactgcaaata

SEQ ID NO: 450576 - DNA, 15 bp, Homo sapiens
cccaactgcaaatac

SEQ ID NO: 450577 - DNA, 15 bp, Homo sapiens
ccaactgcaaataca

SEQ ID NO: 450578 - DNA, 15 bp, Homo sapiens
caactgcaaatacac

SEQ ID NO: 450579 - DNA, 15 bp, Homo sapiens
aactgcaaatacaca

SEQ ID NO: 450580 - DNA, 15 bp, Homo sapiens
actgcaaatacacac

SEQ ID NO: 450581 - DNA, 15 bp, Homo sapiens
ctgcaaatacacact

SEQ ID NO: 450582 - DNA, 15 bp, Homo sapiens
tgcaaatacacactt

SEQ ID NO: 450583 - DNA, 15 bp, Homo sapiens
gcaaatacacacttt

SEQ ID NO: 450584 - DNA, 15 bp, Homo sapiens
caaatacacacttta

SEQ ID NO: 450585 - DNA, 15 bp, Homo sapiens
aaatacacactttaa

SEQ ID NO: 450586 - DNA, 15 bp, Homo sapiens
aatacacactttaaa

SEQ ID NO: 450587 - DNA, 15 bp, Homo sapiens
atacacactttaaat

SEQ ID NO: 450588 - DNA, 15 bp, Homo sapiens
tacacactttaaata

SEQ ID NO: 450589 - DNA, 15 bp, Homo sapiens
acacactttaaatat

SEQ ID NO: 450590 - DNA, 15 bp, Homo sapiens
cacactttaaatatt

SEQ ID NO: 450591 - DNA, 15 bp, Homo sapiens
acactttaaatattt

SEQ ID NO: 450592 - DNA, 15 bp, Homo sapiens
cactttaaatatttt

SEQ ID NO: 450593 - DNA, 15 bp, Homo sapiens
actttaaatattttt

SEQ ID NO: 450594 - DNA, 15 bp, Homo sapiens
ctttaaatatttttc

SEQ ID NO: 450595 - DNA, 15 bp, Homo sapiens
tttaaatatttttca

SEQ ID NO: 450596 - DNA, 15 bp, Homo sapiens
ttaaatatttttcaa

SEQ ID NO: 450597 - DNA, 15 bp, Homo sapiens
taaatatttttcaaa

SEQ ID NO: 450598 - DNA, 15 bp, Homo sapiens
aaatatttttcaaag

SEQ ID NO: 450599 - DNA, 15 bp, Homo sapiens
aatatttttcaaagg

SEQ ID NO: 450600 - DNA, 15 bp, Homo sapiens
atatttttcaaaggt

SEQ ID NO: 450601 - DNA, 15 bp, Homo sapiens
tatttttcaaaggta

SEQ ID NO: 450602 - DNA, 15 bp, Homo sapiens
atttttcaaaggtaa

SEQ ID NO: 450603 - DNA, 15 bp, Homo sapiens
tttttcaaaggtaag

SEQ ID NO: 450604 - DNA, 15 bp, Homo sapiens
ttttcaaaggtaagt

SEQ ID NO: 450605 - DNA, 15 bp, Homo sapiens
tttcaaaggtaagta

SEQ ID NO: 450606 - DNA, 15 bp, Homo sapiens
ttcaaaggtaagtat

SEQ ID NO: 450607 - DNA, 15 bp, Homo sapiens
tcaaaggtaagtatg

SEQ ID NO: 450608 - DNA, 15 bp, Homo sapiens
caaaggtaagtatga

SEQ ID NO: 450609 - DNA, 15 bp, Homo sapiens
aaaggtaagtatgag

SEQ ID NO: 450610 - DNA, 15 bp, Homo sapiens
aaggtaagtatgagt

SEQ ID NO: 450611 - DNA, 15 bp, Homo sapiens
aggtaagtatgagtt

SEQ ID NO: 450612 - DNA, 15 bp, Homo sapiens
ggtaagtatgagtta

SEQ ID NO: 450613 - DNA, 15 bp, Homo sapiens
gtaagtatgagttat

SEQ ID NO: 450614 - DNA, 15 bp, Homo sapiens
taagtatgagttatt

SEQ ID NO: 450615 - DNA, 15 bp, Homo sapiens
aagtatgagttattt

SEQ ID NO: 450616 - DNA, 15 bp, Homo sapiens
agtatgagttatttg

SEQ ID NO: 450617 - DNA, 15 bp, Homo sapiens
gtatgagttatttgg

SEQ ID NO: 450618 - DNA, 15 bp, Homo sapiens
tatgagttatttggg

SEQ ID NO: 450619 - DNA, 15 bp, Homo sapiens
atgagttatttgggg

SEQ ID NO: 450620 - DNA, 15 bp, Homo sapiens
tgagttatttggggt

SEQ ID NO: 450621 - DNA, 15 bp, Homo sapiens
gagttatttggggtt

SEQ ID NO: 450622 - DNA, 15 bp, Homo sapiens
agttatttggggttt

SEQ ID NO: 450623 - DNA, 15 bp, Homo sapiens
gttatttggggtttt

SEQ ID NO: 450624 - DNA, 15 bp, Homo sapiens
ttatttggggttttt

SEQ ID NO: 450625 - DNA, 15 bp, Homo sapiens
tatttggggtttttg

SEQ ID NO: 450626 - DNA, 15 bp, Homo sapiens
atttggggtttttgt

SEQ ID NO: 450627 - DNA, 15 bp, Homo sapiens
tttggggtttttgtt

SEQ ID NO: 450628 - DNA, 15 bp, Homo sapiens
ttggggtttttgtta

SEQ ID NO: 450629 - DNA, 15 bp, Homo sapiens
tggggtttttgttac

SEQ ID NO: 450630 - DNA, 15 bp, Homo sapiens
ggggtttttgttacc

SEQ ID NO: 450631 - DNA, 15 bp, Homo sapiens
gggtttttgttacct

SEQ ID NO: 450632 - DNA, 15 bp, Homo sapiens
ggtttttgttacctg

SEQ ID NO: 450633 - DNA, 15 bp, Homo sapiens
gtttttgttacctgt

SEQ ID NO: 450634 - DNA, 15 bp, Homo sapiens
tttttgttacctgtg

SEQ ID NO: 450635 - DNA, 15 bp, Homo sapiens
ttttgttacctgtgt

SEQ ID NO: 450636 - DNA, 15 bp, Homo sapiens
tttgttacctgtgta

SEQ ID NO: 450637 - DNA, 15 bp, Homo sapiens
ttgttacctgtgtat

SEQ ID NO: 450638 - DNA, 15 bp, Homo sapiens
tgttacctgtgtata

SEQ ID NO: 450639 - DNA, 15 bp, Homo sapiens
gttacctgtgtatat

SEQ ID NO: 450640 - DNA, 15 bp, Homo sapiens
ttacctgtgtatata

SEQ ID NO: 450641 - DNA, 15 bp, Homo sapiens
tacctgtgtatatat

SEQ ID NO: 450642 - DNA, 15 bp, Homo sapiens
acctgtgtatatata

SEQ ID NO: 450643 - DNA, 15 bp, Homo sapiens
cctgtgtatatataa

SEQ ID NO: 450644 - DNA, 15 bp, Homo sapiens
ctgtgtatatataac

SEQ ID NO: 450645 - DNA, 15 bp, Homo sapiens
tgtgtatatataaca

SEQ ID NO: 450646 - DNA, 15 bp, Homo sapiens
gtgtatatataacag

SEQ ID NO: 450647 - DNA, 15 bp, Homo sapiens
tgtatatataacagt

SEQ ID NO: 450648 - DNA, 15 bp, Homo sapiens
gtatatataacagtg

SEQ ID NO: 450649 - DNA, 15 bp, Homo sapiens
tatatataacagtga

SEQ ID NO: 450650 - DNA, 15 bp, Homo sapiens
atatataacagtgat

SEQ ID NO: 450651 - DNA, 15 bp, Homo sapiens
tatataacagtgatg

SEQ ID NO: 450652 - DNA, 15 bp, Homo sapiens
atataacagtgatga

SEQ ID NO: 450653 - DNA, 15 bp, Homo sapiens
tataacagtgatgat

SEQ ID NO: 450654 - DNA, 15 bp, Homo sapiens
ataacagtgatgata

SEQ ID NO: 450655 - DNA, 15 bp, Homo sapiens
taacagtgatgatat

SEQ ID NO: 450656 - DNA, 15 bp, Homo sapiens
aacagtgatgatatt

SEQ ID NO: 450657 - DNA, 15 bp, Homo sapiens
acagtgatgatattc

SEQ ID NO: 450658 - DNA, 15 bp, Homo sapiens
agtgatgatattctt

SEQ ID NO: 450659 - DNA, 15 bp, Homo sapiens
gtgatgatattcttt

SEQ ID NO: 450660 - DNA, 15 bp, Homo sapiens
tgatgatattctttt

SEQ ID NO: 450661 - DNA, 15 bp, Homo sapiens
gatgatattcttttc

SEQ ID NO: 450662 - DNA, 15 bp, Homo sapiens
atgatattcttttcc

SEQ ID NO: 450663 - DNA, 15 bp, Homo sapiens
tgatattcttttccc

SEQ ID NO: 450664 - DNA, 15 bp, Homo sapiens
gatattcttttccca

SEQ ID NO: 450665 - DNA, 15 bp, Homo sapiens
atattcttttcccag

SEQ ID NO: 450666 - DNA, 15 bp, Homo sapiens
tattcttttcccagt

SEQ ID NO: 450667 - DNA, 15 bp, Homo sapiens
attcttttcccagtg

SEQ ID NO: 450668 - DNA, 15 bp, Homo sapiens
ttcttttcccagtga

SEQ ID NO: 450669 - DNA, 15 bp, Homo sapiens
tcttttcccagtgac

SEQ ID NO: 450670 - DNA, 15 bp, Homo sapiens
cttttcccagtgaca

SEQ ID NO: 450671 - DNA, 15 bp, Homo sapiens
ttttcccagtgacat

SEQ ID NO: 450672 - DNA, 15 bp, Homo sapiens
tttcccagtgacatg

SEQ ID NO: 450673 - DNA, 15 bp, Homo sapiens
ttcccagtgacatgc

SEQ ID NO: 450674 - DNA, 15 bp, Homo sapiens
tcccagtgacatgcc

SEQ ID NO: 450675 - DNA, 15 bp, Homo sapiens
cccagtgacatgccc

SEQ ID NO: 450676 - DNA, 15 bp, Homo sapiens
ccagtgacatgcccc

SEQ ID NO: 450677 - DNA, 15 bp, Homo sapiens
cagtgacatgcccca

SEQ ID NO: 450678 - DNA, 15 bp, Homo sapiens
agtgacatgccccag

SEQ ID NO: 450679 - DNA, 15 bp, Homo sapiens
gtgacatgccccagt

SEQ ID NO: 450680 - DNA, 15 bp, Homo sapiens
tgacatgccccagtt

SEQ ID NO: 450681 - DNA, 15 bp, Homo sapiens
gacatgccccagttt

SEQ ID NO: 450682 - DNA, 15 bp, Homo sapiens
acatgccccagtttt

SEQ ID NO: 450683 - DNA, 15 bp, Homo sapiens
catgccccagttttt

SEQ ID NO: 450684 - DNA, 15 bp, Homo sapiens
atgccccagtttttg

SEQ ID NO: 450685 - DNA, 15 bp, Homo sapiens
tgccccagtttttga

SEQ ID NO: 450686 - DNA, 15 bp, Homo sapiens
gccccagtttttgat

SEQ ID NO: 450687 - DNA, 15 bp, Homo sapiens
ccccagtttttgata

SEQ ID NO: 450688 - DNA, 15 bp, Homo sapiens
cccagtttttgatat

SEQ ID NO: 450689 - DNA, 15 bp, Homo sapiens
ccagtttttgatata

SEQ ID NO: 450690 - DNA, 15 bp, Homo sapiens
cagtttttgatatat

SEQ ID NO: 450691 - DNA, 15 bp, Homo sapiens
agtttttgatatatt

SEQ ID NO: 450692 - DNA, 15 bp, Homo sapiens
gtttttgatatatta

SEQ ID NO: 450693 - DNA, 15 bp, Homo sapiens
tttttgatatattac

SEQ ID NO: 450694 - DNA, 15 bp, Homo sapiens
ttttgatatattaca

SEQ ID NO: 450695 - DNA, 15 bp, Homo sapiens
tttgatatattacat

SEQ ID NO: 450696 - DNA, 15 bp, Homo sapiens
ttgatatattacata

SEQ ID NO: 450697 - DNA, 15 bp, Homo sapiens
tgatatattacatag

SEQ ID NO: 450698 - DNA, 15 bp, Homo sapiens
gatatattacatagg

SEQ ID NO: 450699 - DNA, 15 bp, Homo sapiens
atatattacataggc

SEQ ID NO: 450700 - DNA, 15 bp, Homo sapiens
tatattacataggct

SEQ ID NO: 450701 - DNA, 15 bp, Homo sapiens
atattacataggctt

SEQ ID NO: 450702 - DNA, 15 bp, Homo sapiens
tattacataggcttg

SEQ ID NO: 450703 - DNA, 15 bp, Homo sapiens
attacataggcttga

SEQ ID NO: 450704 - DNA, 15 bp, Homo sapiens
ttacataggcttgaa

SEQ ID NO: 450705 - DNA, 15 bp, Homo sapiens
tacataggcttgaaa

SEQ ID NO: 450706 - DNA, 15 bp, Homo sapiens
acataggcttgaaaa

SEQ ID NO: 450707 - DNA, 15 bp, Homo sapiens
cataggcttgaaaaa

SEQ ID NO: 450708 - DNA, 15 bp, Homo sapiens
ataggcttgaaaaat

SEQ ID NO: 450709 - DNA, 15 bp, Homo sapiens
taggcttgaaaaata

SEQ ID NO: 450710 - DNA, 15 bp, Homo sapiens
aggcttgaaaaataa

SEQ ID NO: 450711 - DNA, 15 bp, Homo sapiens
ggcttgaaaaataat

SEQ ID NO: 450712 - DNA, 15 bp, Homo sapiens
gcttgaaaaataatt

SEQ ID NO: 450713 - DNA, 15 bp, Homo sapiens
cttgaaaaataattt

SEQ ID NO: 450714 - DNA, 15 bp, Homo sapiens
ttgaaaaataatttc

SEQ ID NO: 450715 - DNA, 15 bp, Homo sapiens
tgaaaaataatttct

SEQ ID NO: 450716 - DNA, 15 bp, Homo sapiens
gaaaaataatttctc

SEQ ID NO: 450717 - DNA, 15 bp, Homo sapiens
aaaaataatttctct

SEQ ID NO: 450718 - DNA, 15 bp, Homo sapiens
aaaataatttctctt

SEQ ID NO: 450719 - DNA, 15 bp, Homo sapiens
aaataatttctcttg

SEQ ID NO: 450720 - DNA, 15 bp, Homo sapiens
aataatttctcttga

SEQ ID NO: 450721 - DNA, 15 bp, Homo sapiens
ataatttctcttgaa

SEQ ID NO: 450722 - DNA, 15 bp, Homo sapiens
taatttctcttgaat

SEQ ID NO: 450723 - DNA, 15 bp, Homo sapiens
aatttctcttgaatt

SEQ ID NO: 450724 - DNA, 15 bp, Homo sapiens
atttctcttgaattt

SEQ ID NO: 450725 - DNA, 15 bp, Homo sapiens
tttctcttgaatttg

SEQ ID NO: 450726 - DNA, 15 bp, Homo sapiens
ttctcttgaatttga

SEQ ID NO: 450727 - DNA, 15 bp, Homo sapiens
tctcttgaatttgat

SEQ ID NO: 450728 - DNA, 15 bp, Homo sapiens
ctcttgaatttgatt

SEQ ID NO: 450729 - DNA, 15 bp, Homo sapiens
tcttgaatttgattt

SEQ ID NO: 450730 - DNA, 15 bp, Homo sapiens
cttgaatttgatttt

SEQ ID NO: 450731 - DNA, 15 bp, Homo sapiens
ttgaatttgatttta

SEQ ID NO: 450732 - DNA, 15 bp, Homo sapiens
tgaatttgattttat

SEQ ID NO: 450733 - DNA, 15 bp, Homo sapiens
gaatttgattttatg

SEQ ID NO: 450734 - DNA, 15 bp, Homo sapiens
aatttgattttatga

SEQ ID NO: 450735 - DNA, 15 bp, Homo sapiens
atttgattttatgaa

SEQ ID NO: 450736 - DNA, 15 bp, Homo sapiens
tttgattttatgaat

SEQ ID NO: 450737 - DNA, 15 bp, Homo sapiens
ttgattttatgaatg

SEQ ID NO: 450738 - DNA, 15 bp, Homo sapiens
tgattttatgaatgt

SEQ ID NO: 450739 - DNA, 15 bp, Homo sapiens
gattttatgaatgtt

SEQ ID NO: 450740 - DNA, 15 bp, Homo sapiens
attttatgaatgttg

SEQ ID NO: 450741 - DNA, 15 bp, Homo sapiens
ttttatgaatgttgt

SEQ ID NO: 450742 - DNA, 15 bp, Homo sapiens
tttatgaatgttgta

SEQ ID NO: 450743 - DNA, 15 bp, Homo sapiens
ttatgaatgttgtaa

SEQ ID NO: 450744 - DNA, 15 bp, Homo sapiens
tatgaatgttgtaat

SEQ ID NO: 450745 - DNA, 15 bp, Homo sapiens
atgaatgttgtaata

SEQ ID NO: 450746 - DNA, 15 bp, Homo sapiens
tgaatgttgtaatat

SEQ ID NO: 450747 - DNA, 15 bp, Homo sapiens
gaatgttgtaatatc

SEQ ID NO: 450748 - DNA, 15 bp, Homo sapiens
aatgttgtaatatca

SEQ ID NO: 450749 - DNA, 15 bp, Homo sapiens
atgttgtaatatcac

SEQ ID NO: 450750 - DNA, 15 bp, Homo sapiens
tgttgtaatatcact

SEQ ID NO: 450751 - DNA, 15 bp, Homo sapiens
gttgtaatatcactc

SEQ ID NO: 450752 - DNA, 15 bp, Homo sapiens
ttgtaatatcactct

SEQ ID NO: 450753 - DNA, 15 bp, Homo sapiens
tgtaatatcactctc

SEQ ID NO: 450754 - DNA, 15 bp, Homo sapiens
gtaatatcactctct

SEQ ID NO: 450755 - DNA, 15 bp, Homo sapiens
taatatcactctctt

SEQ ID NO: 450756 - DNA, 15 bp, Homo sapiens
aatatcactctctta

SEQ ID NO: 450757 - DNA, 15 bp, Homo sapiens
atatcactctcttag

SEQ ID NO: 450758 - DNA, 15 bp, Homo sapiens
tatcactctcttagg

SEQ ID NO: 450759 - DNA, 15 bp, Homo sapiens
atcactctcttaggt

SEQ ID NO: 450760 - DNA, 15 bp, Homo sapiens
tcactctcttaggta

SEQ ID NO: 450761 - DNA, 15 bp, Homo sapiens
cactctcttaggtac

SEQ ID NO: 450762 - DNA, 15 bp, Homo sapiens
actctcttaggtact

SEQ ID NO: 450763 - DNA, 15 bp, Homo sapiens
ctctcttaggtacta

SEQ ID NO: 450764 - DNA, 15 bp, Homo sapiens
tctcttaggtactat

SEQ ID NO: 450765 - DNA, 15 bp, Homo sapiens
ctcttaggtactatg

SEQ ID NO: 450766 - DNA, 15 bp, Homo sapiens
tcttaggtactatgc

SEQ ID NO: 450767 - DNA, 15 bp, Homo sapiens
cttaggtactatgct

SEQ ID NO: 450768 - DNA, 15 bp, Homo sapiens
ttaggtactatgctg

SEQ ID NO: 450769 - DNA, 15 bp, Homo sapiens
taggtactatgctgg

SEQ ID NO: 450770 - DNA, 15 bp, Homo sapiens
aggtactatgctggt

SEQ ID NO: 450771 - DNA, 15 bp, Homo sapiens
ggtactatgctggtt

SEQ ID NO: 450772 - DNA, 15 bp, Homo sapiens
gtactatgctggttc

SEQ ID NO: 450773 - DNA, 15 bp, Homo sapiens
tactatgctggttca

SEQ ID NO: 450774 - DNA, 15 bp, Homo sapiens
actatgctggttcat

SEQ ID NO: 450775 - DNA, 15 bp, Homo sapiens
ctatgctggttcatt

SEQ ID NO: 450776 - DNA, 15 bp, Homo sapiens
tatgctggttcattt

SEQ ID NO: 450777 - DNA, 15 bp, Homo sapiens
atgctggttcattta

SEQ ID NO: 450778 - DNA, 15 bp, Homo sapiens
tgctggttcatttag

SEQ ID NO: 450779 - DNA, 15 bp, Homo sapiens
gctggttcatttagt

SEQ ID NO: 450780 - DNA, 15 bp, Homo sapiens
ctggttcatttagtt

SEQ ID NO: 450781 - DNA, 15 bp, Homo sapiens
tggttcatttagttt

SEQ ID NO: 450782 - DNA, 15 bp, Homo sapiens
ggttcatttagttta

SEQ ID NO: 450783 - DNA, 15 bp, Homo sapiens
gttcatttagtttac

SEQ ID NO: 450784 - DNA, 15 bp, Homo sapiens
ttcatttagtttact

SEQ ID NO: 450785 - DNA, 15 bp, Homo sapiens
tcatttagtttacta

SEQ ID NO: 450786 - DNA, 15 bp, Homo sapiens
catttagtttactaa

SEQ ID NO: 450787 - DNA, 15 bp, Homo sapiens
atttagtttactaaa

SEQ ID NO: 450788 - DNA, 15 bp, Homo sapiens
tttagtttactaaat

SEQ ID NO: 450789 - DNA, 15 bp, Homo sapiens
ttagtttactaaata

SEQ ID NO: 450790 - DNA, 15 bp, Homo sapiens
tagtttactaaatag

SEQ ID NO: 450791 - DNA, 15 bp, Homo sapiens
agtttactaaatagt

SEQ ID NO: 450792 - DNA, 15 bp, Homo sapiens
gtttactaaatagtt

SEQ ID NO: 450793 - DNA, 15 bp, Homo sapiens
tttactaaatagttt

SEQ ID NO: 450794 - DNA, 15 bp, Homo sapiens
ttactaaatagtttt

SEQ ID NO: 450795 - DNA, 15 bp, Homo sapiens
tactaaatagtttta

SEQ ID NO: 450796 - DNA, 15 bp, Homo sapiens
actaaatagttttat

SEQ ID NO: 450797 - DNA, 15 bp, Homo sapiens
ctaaatagttttata

SEQ ID NO: 450798 - DNA, 15 bp, Homo sapiens
taaatagttttataa

SEQ ID NO: 450799 - DNA, 15 bp, Homo sapiens
aaatagttttataag

SEQ ID NO: 450800 - DNA, 15 bp, Homo sapiens
aatagttttataaga

SEQ ID NO: 450801 - DNA, 15 bp, Homo sapiens
atagttttataagaa

SEQ ID NO: 450802 - DNA, 15 bp, Homo sapiens
tagttttataagaac

SEQ ID NO: 450803 - DNA, 15 bp, Homo sapiens
agttttataagaact

SEQ ID NO: 450804 - DNA, 15 bp, Homo sapiens
gttttataagaacta

SEQ ID NO: 450805 - DNA, 15 bp, Homo sapiens
ttttataagaactag

SEQ ID NO: 450806 - DNA, 15 bp, Homo sapiens
tttataagaactagg

SEQ ID NO: 450807 - DNA, 15 bp, Homo sapiens
ttataagaactaggt

SEQ ID NO: 450808 - DNA, 15 bp, Homo sapiens
tataagaactaggtg

SEQ ID NO: 450809 - DNA, 15 bp, Homo sapiens
ataagaactaggtgt

SEQ ID NO: 450810 - DNA, 15 bp, Homo sapiens
taagaactaggtgtc

SEQ ID NO: 450811 - DNA, 15 bp, Homo sapiens
aagaactaggtgtca

SEQ ID NO: 450812 - DNA, 15 bp, Homo sapiens
agaactaggtgtcat

SEQ ID NO: 450813 - DNA, 15 bp, Homo sapiens
gaactaggtgtcatt

SEQ ID NO: 450814 - DNA, 15 bp, Homo sapiens
aactaggtgtcattt

SEQ ID NO: 450815 - DNA, 15 bp, Homo sapiens
actaggtgtcattta

SEQ ID NO: 450816 - DNA, 15 bp, Homo sapiens
ctaggtgtcatttaa

SEQ ID NO: 450817 - DNA, 15 bp, Homo sapiens
taggtgtcatttaag

SEQ ID NO: 450818 - DNA, 15 bp, Homo sapiens
aggtgtcatttaaga

SEQ ID NO: 450819 - DNA, 15 bp, Homo sapiens
ggtgtcatttaagaa

SEQ ID NO: 450820 - DNA, 15 bp, Homo sapiens
gtgtcatttaagaag

SEQ ID NO: 450821 - DNA, 15 bp, Homo sapiens
tgtcatttaagaagt

SEQ ID NO: 450822 - DNA, 15 bp, Homo sapiens
gtcatttaagaagtc

SEQ ID NO: 450823 - DNA, 15 bp, Homo sapiens
tcatttaagaagtct

SEQ ID NO: 450824 - DNA, 15 bp, Homo sapiens
catttaagaagtctt

SEQ ID NO: 450825 - DNA, 15 bp, Homo sapiens
atttaagaagtcttt

SEQ ID NO: 450826 - DNA, 15 bp, Homo sapiens
tttaagaagtctttg

SEQ ID NO: 450827 - DNA, 15 bp, Homo sapiens
ttaagaagtctttgg

SEQ ID NO: 450828 - DNA, 15 bp, Homo sapiens
taagaagtctttgga

SEQ ID NO: 450829 - DNA, 15 bp, Homo sapiens
aagaagtctttggag

SEQ ID NO: 450830 - DNA, 15 bp, Homo sapiens
agaagtctttggagc

SEQ ID NO: 450831 - DNA, 15 bp, Homo sapiens
gaagtctttggagca

SEQ ID NO: 450832 - DNA, 15 bp, Homo sapiens
aagtctttggagcac

SEQ ID NO: 450833 - DNA, 15 bp, Homo sapiens
agtctttggagcact

SEQ ID NO: 450834 - DNA, 15 bp, Homo sapiens
gtctttggagcacta

SEQ ID NO: 450835 - DNA, 15 bp, Homo sapiens
tctttggagcactat

SEQ ID NO: 450836 - DNA, 15 bp, Homo sapiens
ctttggagcactatt

SEQ ID NO: 450837 - DNA, 15 bp, Homo sapiens
tttggagcactatta

SEQ ID NO: 450838 - DNA, 15 bp, Homo sapiens
ttggagcactattaa

SEQ ID NO: 450839 - DNA, 15 bp, Homo sapiens
tggagcactattaaa

SEQ ID NO: 450840 - DNA, 15 bp, Homo sapiens
ggagcactattaaat

SEQ ID NO: 450841 - DNA, 15 bp, Homo sapiens
gagcactattaaatg

SEQ ID NO: 450842 - DNA, 15 bp, Homo sapiens
agcactattaaatgt

SEQ ID NO: 450843 - DNA, 15 bp, Homo sapiens
gcactattaaatgtt

SEQ ID NO: 450844 - DNA, 15 bp, Homo sapiens
cactattaaatgtta

SEQ ID NO: 450845 - DNA, 15 bp, Homo sapiens
actattaaatgttat

SEQ ID NO: 450846 - DNA, 15 bp, Homo sapiens
ctattaaatgttatg

SEQ ID NO: 450847 - DNA, 15 bp, Homo sapiens
tattaaatgttatga

SEQ ID NO: 450848 - DNA, 15 bp, Homo sapiens
attaaatgttatgaa

SEQ ID NO: 450849 - DNA, 15 bp, Homo sapiens
ttaaatgttatgaat

SEQ ID NO: 450850 - DNA, 15 bp, Homo sapiens
taaatgttatgaatc

SEQ ID NO: 450851 - DNA, 15 bp, Homo sapiens
aaatgttatgaatct

SEQ ID NO: 450852 - DNA, 15 bp, Homo sapiens
aatgttatgaatcta

SEQ ID NO: 450853 - DNA, 15 bp, Homo sapiens
atgttatgaatctac

SEQ ID NO: 450854 - DNA, 15 bp, Homo sapiens
tgttatgaatctacc

SEQ ID NO: 450855 - DNA, 15 bp, Homo sapiens
gttatgaatctaccc

SEQ ID NO: 450856 - DNA, 15 bp, Homo sapiens
ttatgaatctaccct

SEQ ID NO: 450857 - DNA, 15 bp, Homo sapiens
tatgaatctaccctg

SEQ ID NO: 450858 - DNA, 15 bp, Homo sapiens
atgaatctaccctga

SEQ ID NO: 450859 - DNA, 15 bp, Homo sapiens
tgaatctaccctgac

SEQ ID NO: 450860 - DNA, 15 bp, Homo sapiens
gaatctaccctgacc

SEQ ID NO: 450861 - DNA, 15 bp, Homo sapiens
aatctaccctgacct

SEQ ID NO: 450862 - DNA, 15 bp, Homo sapiens
atctaccctgaccta

SEQ ID NO: 450863 - DNA, 15 bp, Homo sapiens
tctaccctgacctag

SEQ ID NO: 450864 - DNA, 15 bp, Homo sapiens
ctaccctgacctaga

SEQ ID NO: 450865 - DNA, 15 bp, Homo sapiens
taccctgacctagat

SEQ ID NO: 450866 - DNA, 15 bp, Homo sapiens
accctgacctagata

SEQ ID NO: 450867 - DNA, 15 bp, Homo sapiens
ccctgacctagataa

SEQ ID NO: 450868 - DNA, 15 bp, Homo sapiens
cctgacctagataag

SEQ ID NO: 450869 - DNA, 15 bp, Homo sapiens
ctgacctagataagg

SEQ ID NO: 450870 - DNA, 15 bp, Homo sapiens
tgacctagataaggg

SEQ ID NO: 450871 - DNA, 15 bp, Homo sapiens
gacctagataagggg

SEQ ID NO: 450872 - DNA, 15 bp, Homo sapiens
acctagataaggggc

SEQ ID NO: 450873 - DNA, 15 bp, Homo sapiens
cctagataaggggca

SEQ ID NO: 450874 - DNA, 15 bp, Homo sapiens
ctagataaggggcag

SEQ ID NO: 450875 - DNA, 15 bp, Homo sapiens
tagataaggggcagt

SEQ ID NO: 450876 - DNA, 15 bp, Homo sapiens
agataaggggcagtt

SEQ ID NO: 450877 - DNA, 15 bp, Homo sapiens
gataaggggcagtta

SEQ ID NO: 450878 - DNA, 15 bp, Homo sapiens
ataaggggcagttaa

SEQ ID NO: 450879 - DNA, 15 bp, Homo sapiens
taaggggcagttaac

SEQ ID NO: 450880 - DNA, 15 bp, Homo sapiens
aaggggcagttaact

SEQ ID NO: 450881 - DNA, 15 bp, Homo sapiens
aggggcagttaactc

SEQ ID NO: 450882 - DNA, 15 bp, Homo sapiens
ggggcagttaactct

SEQ ID NO: 450883 - DNA, 15 bp, Homo sapiens
gggcagttaactctt

SEQ ID NO: 450884 - DNA, 15 bp, Homo sapiens
ggcagttaactcttt

SEQ ID NO: 450885 - DNA, 15 bp, Homo sapiens
gcagttaactctttt

SEQ ID NO: 450886 - DNA, 15 bp, Homo sapiens
cagttaactcttttt

SEQ ID NO: 450887 - DNA, 15 bp, Homo sapiens
agttaactcttttta

SEQ ID NO: 450888 - DNA, 15 bp, Homo sapiens
gttaactctttttaa

SEQ ID NO: 450889 - DNA, 15 bp, Homo sapiens
ttaactctttttaaa

SEQ ID NO: 450890 - DNA, 15 bp, Homo sapiens
taactctttttaaat

SEQ ID NO: 450891 - DNA, 15 bp, Homo sapiens
aactctttttaaatg

SEQ ID NO: 450892 - DNA, 15 bp, Homo sapiens
actctttttaaatgt

SEQ ID NO: 450893 - DNA, 15 bp, Homo sapiens
ctctttttaaatgta

SEQ ID NO: 450894 - DNA, 15 bp, Homo sapiens
tctttttaaatgtaa

SEQ ID NO: 450895 - DNA, 15 bp, Homo sapiens
ctttttaaatgtaag

SEQ ID NO: 450896 - DNA, 15 bp, Homo sapiens
tttttaaatgtaagg

SEQ ID NO: 450897 - DNA, 15 bp, Homo sapiens
ttttaaatgtaaggc

SEQ ID NO: 450898 - DNA, 15 bp, Homo sapiens
tttaaatgtaaggcc

SEQ ID NO: 450899 - DNA, 15 bp, Homo sapiens
ttaaatgtaaggcca

SEQ ID NO: 450900 - DNA, 15 bp, Homo sapiens
taaatgtaaggccac

SEQ ID NO: 450901 - DNA, 15 bp, Homo sapiens
aaatgtaaggccact

SEQ ID NO: 450902 - DNA, 15 bp, Homo sapiens
aatgtaaggccactg

SEQ ID NO: 450903 - DNA, 15 bp, Homo sapiens
atgtaaggccactga

SEQ ID NO: 450904 - DNA, 15 bp, Homo sapiens
tgtaaggccactgac

SEQ ID NO: 450905 - DNA, 15 bp, Homo sapiens
gtaaggccactgacc

SEQ ID NO: 450906 - DNA, 15 bp, Homo sapiens
taaggccactgaccc

SEQ ID NO: 450907 - DNA, 15 bp, Homo sapiens
aaggccactgaccca

SEQ ID NO: 450908 - DNA, 15 bp, Homo sapiens
aggccactgacccac

SEQ ID NO: 450909 - DNA, 15 bp, Homo sapiens
ggccactgacccacc

SEQ ID NO: 450910 - DNA, 15 bp, Homo sapiens
gccactgacccacca

SEQ ID NO: 450911 - DNA, 15 bp, Homo sapiens
ccactgacccaccaa

SEQ ID NO: 450912 - DNA, 15 bp, Homo sapiens
cactgacccaccaaa

SEQ ID NO: 450913 - DNA, 15 bp, Homo sapiens
actgacccaccaaag

SEQ ID NO: 450914 - DNA, 15 bp, Homo sapiens
ctgacccaccaaagt

SEQ ID NO: 450915 - DNA, 15 bp, Homo sapiens
tgacccaccaaagtc

SEQ ID NO: 450916 - DNA, 15 bp, Homo sapiens
gacccaccaaagtca

SEQ ID NO: 450917 - DNA, 15 bp, Homo sapiens
acccaccaaagtcat

SEQ ID NO: 450918 - DNA, 15 bp, Homo sapiens
cccaccaaagtcatg

SEQ ID NO: 450919 - DNA, 15 bp, Homo sapiens
ccaccaaagtcatga

SEQ ID NO: 450920 - DNA, 15 bp, Homo sapiens
caccaaagtcatgaa

SEQ ID NO: 450921 - DNA, 15 bp, Homo sapiens
accaaagtcatgaac

SEQ ID NO: 450922 - DNA, 15 bp, Homo sapiens
ccaaagtcatgaact

SEQ ID NO: 450923 - DNA, 15 bp, Homo sapiens
caaagtcatgaactg

SEQ ID NO: 450924 - DNA, 15 bp, Homo sapiens
aaagtcatgaactgt

SEQ ID NO: 450925 - DNA, 15 bp, Homo sapiens
aagtcatgaactgtt

SEQ ID NO: 450926 - DNA, 15 bp, Homo sapiens
agtcatgaactgttt

SEQ ID NO: 450927 - DNA, 15 bp, Homo sapiens
gtcatgaactgttta

SEQ ID NO: 450928 - DNA, 15 bp, Homo sapiens
tcatgaactgtttac

SEQ ID NO: 450929 - DNA, 15 bp, Homo sapiens
catgaactgtttacc

SEQ ID NO: 450930 - DNA, 15 bp, Homo sapiens
atgaactgtttacct

SEQ ID NO: 450931 - DNA, 15 bp, Homo sapiens
tgaactgtttaccta

SEQ ID NO: 450932 - DNA, 15 bp, Homo sapiens
gaactgtttacctaa

SEQ ID NO: 450933 - DNA, 15 bp, Homo sapiens
aactgtttacctaag

SEQ ID NO: 450934 - DNA, 15 bp, Homo sapiens
actgtttacctaaga

SEQ ID NO: 450935 - DNA, 15 bp, Homo sapiens
ctgtttacctaagaa

SEQ ID NO: 450936 - DNA, 15 bp, Homo sapiens
tgtttacctaagaaa

SEQ ID NO: 450937 - DNA, 15 bp, Homo sapiens
gtttacctaagaaac

SEQ ID NO: 450938 - DNA, 15 bp, Homo sapiens
tttacctaagaaact

SEQ ID NO: 450939 - DNA, 15 bp, Homo sapiens
ttacctaagaaactt

SEQ ID NO: 450940 - DNA, 15 bp, Homo sapiens
tacctaagaaactta

SEQ ID NO: 450941 - DNA, 15 bp, Homo sapiens
acctaagaaacttaa

SEQ ID NO: 450942 - DNA, 15 bp, Homo sapiens
cctaagaaacttaat

SEQ ID NO: 450943 - DNA, 15 bp, Homo sapiens
ctaagaaacttaatt

SEQ ID NO: 450944 - DNA, 15 bp, Homo sapiens
taagaaacttaattg

SEQ ID NO: 450945 - DNA, 15 bp, Homo sapiens
aagaaacttaattga

SEQ ID NO: 450946 - DNA, 15 bp, Homo sapiens
agaaacttaattgaa

SEQ ID NO: 450947 - DNA, 15 bp, Homo sapiens
gaaacttaattgaag

SEQ ID NO: 450948 - DNA, 15 bp, Homo sapiens
aaacttaattgaagc

SEQ ID NO: 450949 - DNA, 15 bp, Homo sapiens
aacttaattgaagca

SEQ ID NO: 450950 - DNA, 15 bp, Homo sapiens
acttaattgaagcat

SEQ ID NO: 450951 - DNA, 15 bp, Homo sapiens
cttaattgaagcatt

SEQ ID NO: 450952 - DNA, 15 bp, Homo sapiens
ttaattgaagcattc

SEQ ID NO: 450953 - DNA, 15 bp, Homo sapiens
taattgaagcattcc

SEQ ID NO: 450954 - DNA, 15 bp, Homo sapiens
aattgaagcattcca

SEQ ID NO: 450955 - DNA, 15 bp, Homo sapiens
attgaagcattccat

SEQ ID NO: 450956 - DNA, 15 bp, Homo sapiens
ttgaagcattccatt

SEQ ID NO: 450957 - DNA, 15 bp, Homo sapiens
tgaagcattccattt

SEQ ID NO: 450958 - DNA, 15 bp, Homo sapiens
gaagcattccattta

SEQ ID NO: 450959 - DNA, 15 bp, Homo sapiens
aagcattccatttat

SEQ ID NO: 450960 - DNA, 15 bp, Homo sapiens
agcattccatttatg

SEQ ID NO: 450961 - DNA, 15 bp, Homo sapiens
gcattccatttatgt

SEQ ID NO: 450962 - DNA, 15 bp, Homo sapiens
cattccatttatgtt

SEQ ID NO: 450963 - DNA, 15 bp, Homo sapiens
attccatttatgttt

SEQ ID NO: 450964 - DNA, 15 bp, Homo sapiens
ttccatttatgtttt

SEQ ID NO: 450965 - DNA, 15 bp, Homo sapiens
tccatttatgtttta

SEQ ID NO: 450966 - DNA, 15 bp, Homo sapiens
ccatttatgttttaa

SEQ ID NO: 450967 - DNA, 15 bp, Homo sapiens
catttatgttttaac

SEQ ID NO: 450968 - DNA, 15 bp, Homo sapiens
atttatgttttaacc

SEQ ID NO: 450969 - DNA, 15 bp, Homo sapiens
tttatgttttaacct

SEQ ID NO: 450970 - DNA, 15 bp, Homo sapiens
ttatgttttaacctc

SEQ ID NO: 450971 - DNA, 15 bp, Homo sapiens
tatgttttaacctca

SEQ ID NO: 450972 - DNA, 15 bp, Homo sapiens
atgttttaacctcaa

SEQ ID NO: 450973 - DNA, 15 bp, Homo sapiens
tgttttaacctcaat

SEQ ID NO: 450974 - DNA, 15 bp, Homo sapiens
gttttaacctcaatt

SEQ ID NO: 450975 - DNA, 15 bp, Homo sapiens
ttttaacctcaattt

SEQ ID NO: 450976 - DNA, 15 bp, Homo sapiens
tttaacctcaattta

SEQ ID NO: 450977 - DNA, 15 bp, Homo sapiens
ttaacctcaatttat

SEQ ID NO: 450978 - DNA, 15 bp, Homo sapiens
taacctcaatttatt

SEQ ID NO: 450979 - DNA, 15 bp, Homo sapiens
aacctcaatttatta

SEQ ID NO: 450980 - DNA, 15 bp, Homo sapiens
acctcaatttattac

SEQ ID NO: 450981 - DNA, 15 bp, Homo sapiens
cctcaatttattacc

SEQ ID NO: 450982 - DNA, 15 bp, Homo sapiens
ctcaatttattaccc

SEQ ID NO: 450983 - DNA, 15 bp, Homo sapiens
tcaatttattacccc

SEQ ID NO: 450984 - DNA, 15 bp, Homo sapiens
caatttattacccca

SEQ ID NO: 450985 - DNA, 15 bp, Homo sapiens
aatttattaccccaa

SEQ ID NO: 450986 - DNA, 15 bp, Homo sapiens
atttattaccccaaa

SEQ ID NO: 450987 - DNA, 15 bp, Homo sapiens
tttattaccccaaaa

SEQ ID NO: 450988 - DNA, 15 bp, Homo sapiens
ttattaccccaaaac

SEQ ID NO: 450989 - DNA, 15 bp, Homo sapiens
tattaccccaaaact

SEQ ID NO: 450990 - DNA, 15 bp, Homo sapiens
attaccccaaaactt

SEQ ID NO: 450991 - DNA, 15 bp, Homo sapiens
ttaccccaaaacttc

SEQ ID NO: 450992 - DNA, 15 bp, Homo sapiens
taccccaaaacttcc

SEQ ID NO: 450993 - DNA, 15 bp, Homo sapiens
accccaaaacttcca

SEQ ID NO: 450994 - DNA, 15 bp, Homo sapiens
ccccaaaacttccat

SEQ ID NO: 450995 - DNA, 15 bp, Homo sapiens
cccaaaacttccatc

SEQ ID NO: 450996 - DNA, 15 bp, Homo sapiens
ccaaaacttccatct

SEQ ID NO: 450997 - DNA, 15 bp, Homo sapiens
caaaacttccatcta

SEQ ID NO: 450998 - DNA, 15 bp, Homo sapiens
aaaacttccatctaa

SEQ ID NO: 450999 - DNA, 15 bp, Homo sapiens
aaacttccatctaac

SEQ ID NO: 451000 - DNA, 15 bp, Homo sapiens
aacttccatctaaca

SEQ ID NO: 451001 - DNA, 15 bp, Homo sapiens
acttccatctaacat

SEQ ID NO: 451002 - DNA, 15 bp, Homo sapiens
cttccatctaacata

SEQ ID NO: 451003 - DNA, 15 bp, Homo sapiens
ttccatctaacatat

SEQ ID NO: 451004 - DNA, 15 bp, Homo sapiens
tccatctaacatatg

SEQ ID NO: 451005 - DNA, 15 bp, Homo sapiens
ccatctaacatatga

SEQ ID NO: 451006 - DNA, 15 bp, Homo sapiens
catctaacatatgaa

SEQ ID NO: 451007 - DNA, 15 bp, Homo sapiens
atctaacatatgaat

SEQ ID NO: 451008 - DNA, 15 bp, Homo sapiens
tctaacatatgaatt

SEQ ID NO: 451009 - DNA, 15 bp, Homo sapiens
ctaacatatgaatta

SEQ ID NO: 451010 - DNA, 15 bp, Homo sapiens
taacatatgaattag

SEQ ID NO: 451011 - DNA, 15 bp, Homo sapiens
aacatatgaattagt

SEQ ID NO: 451012 - DNA, 15 bp, Homo sapiens
acatatgaattagtt

SEQ ID NO: 451013 - DNA, 15 bp, Homo sapiens
catatgaattagttt

SEQ ID NO: 451014 - DNA, 15 bp, Homo sapiens
atatgaattagtttt

SEQ ID NO: 451015 - DNA, 15 bp, Homo sapiens
tatgaattagttttg

SEQ ID NO: 451016 - DNA, 15 bp, Homo sapiens
atgaattagttttga

SEQ ID NO: 451017 - DNA, 15 bp, Homo sapiens
tgaattagttttgaa

SEQ ID NO: 451018 - DNA, 15 bp, Homo sapiens
gaattagttttgaaa

SEQ ID NO: 451019 - DNA, 15 bp, Homo sapiens
tagttttgaaattta

SEQ ID NO: 451020 - DNA, 15 bp, Homo sapiens
agttttgaaatttac

SEQ ID NO: 451021 - DNA, 15 bp, Homo sapiens
gttttgaaatttaca

SEQ ID NO: 451022 - DNA, 15 bp, Homo sapiens
ttttgaaatttacag

SEQ ID NO: 451023 - DNA, 15 bp, Homo sapiens
tttgaaatttacaga

SEQ ID NO: 451024 - DNA, 15 bp, Homo sapiens
ttgaaatttacagaa

SEQ ID NO: 451025 - DNA, 15 bp, Homo sapiens
tgaaatttacagaaa

SEQ ID NO: 451026 - DNA, 15 bp, Homo sapiens
gaaatttacagaaaa

SEQ ID NO: 451027 - DNA, 15 bp, Homo sapiens
aaatttacagaaaaa

SEQ ID NO: 451028 - DNA, 15 bp, Homo sapiens
aatttacagaaaaag

SEQ ID NO: 451029 - DNA, 15 bp, Homo sapiens
atttacagaaaaaga

SEQ ID NO: 451030 - DNA, 15 bp, Homo sapiens
tttacagaaaaagag

SEQ ID NO: 451031 - DNA, 15 bp, Homo sapiens
ttacagaaaaagaga

SEQ ID NO: 451032 - DNA, 15 bp, Homo sapiens
tacagaaaaagagaa

SEQ ID NO: 451033 - DNA, 15 bp, Homo sapiens
acagaaaaagagaaa

SEQ ID NO: 451034 - DNA, 15 bp, Homo sapiens
agaaaaagagaaagt

SEQ ID NO: 451035 - DNA, 15 bp, Homo sapiens
gaaaaagagaaagta

SEQ ID NO: 451036 - DNA, 15 bp, Homo sapiens
aaaaagagaaagtat

SEQ ID NO: 451037 - DNA, 15 bp, Homo sapiens
aaaagagaaagtata

SEQ ID NO: 451038 - DNA, 15 bp, Homo sapiens
aaagagaaagtataa

SEQ ID NO: 451039 - DNA, 15 bp, Homo sapiens
aagagaaagtataaa

SEQ ID NO: 451040 - DNA, 15 bp, Homo sapiens
agagaaagtataaaa

SEQ ID NO: 451041 - DNA, 15 bp, Homo sapiens
gagaaagtataaaac

SEQ ID NO: 451042 - DNA, 15 bp, Homo sapiens
agaaagtataaaact

SEQ ID NO: 451043 - DNA, 15 bp, Homo sapiens
gaaagtataaaactt

SEQ ID NO: 451044 - DNA, 15 bp, Homo sapiens
aaagtataaaacttg

SEQ ID NO: 451045 - DNA, 15 bp, Homo sapiens
aagtataaaacttgc

SEQ ID NO: 451046 - DNA, 15 bp, Homo sapiens
agtataaaacttgct

SEQ ID NO: 451047 - DNA, 15 bp, Homo sapiens
gtataaaacttgctt

SEQ ID NO: 451048 - DNA, 15 bp, Homo sapiens
tataaaacttgcttt

SEQ ID NO: 451049 - DNA, 15 bp, Homo sapiens
ataaaacttgctttt

SEQ ID NO: 451050 - DNA, 15 bp, Homo sapiens
taaaacttgctttta

SEQ ID NO: 451051 - DNA, 15 bp, Homo sapiens
aaaacttgcttttaa

SEQ ID NO: 451052 - DNA, 15 bp, Homo sapiens
aaacttgcttttaaa

SEQ ID NO: 451053 - DNA, 15 bp, Homo sapiens
aacttgcttttaaag

SEQ ID NO: 451054 - DNA, 15 bp, Homo sapiens
acttgcttttaaagt

SEQ ID NO: 451055 - DNA, 15 bp, Homo sapiens
cttgcttttaaagtg

SEQ ID NO: 451056 - DNA, 15 bp, Homo sapiens
ttgcttttaaagtga

SEQ ID NO: 451057 - DNA, 15 bp, Homo sapiens
tgcttttaaagtgaa

SEQ ID NO: 451058 - DNA, 15 bp, Homo sapiens
gcttttaaagtgaag

SEQ ID NO: 451059 - DNA, 15 bp, Homo sapiens
cttttaaagtgaaga

SEQ ID NO: 451060 - DNA, 15 bp, Homo sapiens
ttttaaagtgaagaa

SEQ ID NO: 451061 - DNA, 15 bp, Homo sapiens
tttaaagtgaagaac

SEQ ID NO: 451062 - DNA, 15 bp, Homo sapiens
ttaaagtgaagaaca

SEQ ID NO: 451063 - DNA, 15 bp, Homo sapiens
taaagtgaagaacat

SEQ ID NO: 451064 - DNA, 15 bp, Homo sapiens
aaagtgaagaacatg

SEQ ID NO: 451065 - DNA, 15 bp, Homo sapiens
aagtgaagaacatga

SEQ ID NO: 451066 - DNA, 15 bp, Homo sapiens
agtgaagaacatgag

SEQ ID NO: 451067 - DNA, 15 bp, Homo sapiens
gtgaagaacatgagg

SEQ ID NO: 451068 - DNA, 15 bp, Homo sapiens
tgaagaacatgagga

SEQ ID NO: 451069 - DNA, 15 bp, Homo sapiens
gaagaacatgaggaa

SEQ ID NO: 451070 - DNA, 15 bp, Homo sapiens
aagaacatgaggaaa

SEQ ID NO: 451071 - DNA, 15 bp, Homo sapiens
agaacatgaggaaaa

SEQ ID NO: 451072 - DNA, 15 bp, Homo sapiens
gaacatgaggaaaac

SEQ ID NO: 451073 - DNA, 15 bp, Homo sapiens
aacatgaggaaaaca

SEQ ID NO: 451074 - DNA, 15 bp, Homo sapiens
acatgaggaaaacaa

SEQ ID NO: 451075 - DNA, 15 bp, Homo sapiens
catgaggaaaacaat

SEQ ID NO: 451076 - DNA, 15 bp, Homo sapiens
atgaggaaaacaatt

SEQ ID NO: 451077 - DNA, 15 bp, Homo sapiens
tgaggaaaacaattt

SEQ ID NO: 451078 - DNA, 15 bp, Homo sapiens
gaggaaaacaattta

SEQ ID NO: 451079 - DNA, 15 bp, Homo sapiens
aggaaaacaatttaa

SEQ ID NO: 451080 - DNA, 15 bp, Homo sapiens
ggaaaacaatttaat

SEQ ID NO: 451081 - DNA, 15 bp, Homo sapiens
gaaaacaatttaata

SEQ ID NO: 451082 - DNA, 15 bp, Homo sapiens
aaaacaatttaatac

SEQ ID NO: 451083 - DNA, 15 bp, Homo sapiens
aaacaatttaataca

SEQ ID NO: 451084 - DNA, 15 bp, Homo sapiens
aacaatttaatacat

SEQ ID NO: 451085 - DNA, 15 bp, Homo sapiens
acaatttaatacata

SEQ ID NO: 451086 - DNA, 15 bp, Homo sapiens
caatttaatacatat

SEQ ID NO: 451087 - DNA, 15 bp, Homo sapiens
aatttaatacatata

SEQ ID NO: 451088 - DNA, 15 bp, Homo sapiens
atttaatacatatag

SEQ ID NO: 451089 - DNA, 15 bp, Homo sapiens
tttaatacatataga

SEQ ID NO: 451090 - DNA, 15 bp, Homo sapiens
ttaatacatatagaa

SEQ ID NO: 451091 - DNA, 15 bp, Homo sapiens
taatacatatagaaa

SEQ ID NO: 451092 - DNA, 15 bp, Homo sapiens
aatacatatagaaaa

SEQ ID NO: 451093 - DNA, 15 bp, Homo sapiens
atacatatagaaaat

SEQ ID NO: 451094 - DNA, 15 bp, Homo sapiens
tacatatagaaaata

SEQ ID NO: 451095 - DNA, 15 bp, Homo sapiens
acatatagaaaataa

SEQ ID NO: 451096 - DNA, 15 bp, Homo sapiens
catatagaaaataat

SEQ ID NO: 451097 - DNA, 15 bp, Homo sapiens
atatagaaaataata

SEQ ID NO: 451098 - DNA, 15 bp, Homo sapiens
tatagaaaataataa

SEQ ID NO: 451099 - DNA, 15 bp, Homo sapiens
atagaaaataataat

SEQ ID NO: 451100 - DNA, 15 bp, Homo sapiens
tagaaaataataata

SEQ ID NO: 451101 - DNA, 15 bp, Homo sapiens
agaaaataataatac

SEQ ID NO: 451102 - DNA, 15 bp, Homo sapiens
gaaaataataatact

SEQ ID NO: 451103 - DNA, 15 bp, Homo sapiens
aaaataataatactg

SEQ ID NO: 451104 - DNA, 15 bp, Homo sapiens
aaataataatactgg

SEQ ID NO: 451105 - DNA, 15 bp, Homo sapiens
aataataatactggt

SEQ ID NO: 451106 - DNA, 15 bp, Homo sapiens
ataataatactggtt

SEQ ID NO: 451107 - DNA, 15 bp, Homo sapiens
taataatactggtta

SEQ ID NO: 451108 - DNA, 15 bp, Homo sapiens
aataatactggttaa

SEQ ID NO: 451109 - DNA, 15 bp, Homo sapiens
ataatactggttaat

SEQ ID NO: 451110 - DNA, 15 bp, Homo sapiens
taatactggttaatg

SEQ ID NO: 451111 - DNA, 15 bp, Homo sapiens
aatactggttaatga

SEQ ID NO: 451112 - DNA, 15 bp, Homo sapiens
atactggttaatgag

SEQ ID NO: 451113 - DNA, 15 bp, Homo sapiens
tactggttaatgaga

SEQ ID NO: 451114 - DNA, 15 bp, Homo sapiens
actggttaatgagag

SEQ ID NO: 451115 - DNA, 15 bp, Homo sapiens
ctggttaatgagagg

SEQ ID NO: 451116 - DNA, 15 bp, Homo sapiens
tggttaatgagagga

SEQ ID NO: 451117 - DNA, 15 bp, Homo sapiens
ggttaatgagaggaa

SEQ ID NO: 451118 - DNA, 15 bp, Homo sapiens
gttaatgagaggaag

SEQ ID NO: 451119 - DNA, 15 bp, Homo sapiens
ttaatgagaggaagc

SEQ ID NO: 451120 - DNA, 15 bp, Homo sapiens
taatgagaggaagct

SEQ ID NO: 451121 - DNA, 15 bp, Homo sapiens
aatgagaggaagctg

SEQ ID NO: 451122 - DNA, 15 bp, Homo sapiens
atgagaggaagctga

SEQ ID NO: 451123 - DNA, 15 bp, Homo sapiens
tgagaggaagctgag

SEQ ID NO: 451124 - DNA, 15 bp, Homo sapiens
gagaggaagctgaga

SEQ ID NO: 451125 - DNA, 15 bp, Homo sapiens
agaggaagctgagaa

SEQ ID NO: 451126 - DNA, 15 bp, Homo sapiens
gaggaagctgagaag

SEQ ID NO: 451127 - DNA, 15 bp, Homo sapiens
aggaagctgagaaga

SEQ ID NO: 451128 - DNA, 15 bp, Homo sapiens
ggaagctgagaagag

SEQ ID NO: 451129 - DNA, 15 bp, Homo sapiens
gaagctgagaagagg

SEQ ID NO: 451130 - DNA, 15 bp, Homo sapiens
aagctgagaagagga

SEQ ID NO: 451131 - DNA, 15 bp, Homo sapiens
agctgagaagaggaa

SEQ ID NO: 451132 - DNA, 15 bp, Homo sapiens
gctgagaagaggaac

SEQ ID NO: 451133 - DNA, 15 bp, Homo sapiens
ctgagaagaggaaca

SEQ ID NO: 451134 - DNA, 15 bp, Homo sapiens
tgagaagaggaacac

SEQ ID NO: 451135 - DNA, 15 bp, Homo sapiens
gagaagaggaacaca

SEQ ID NO: 451136 - DNA, 15 bp, Homo sapiens
agaagaggaacacag

SEQ ID NO: 451137 - DNA, 15 bp, Homo sapiens
gaagaggaacacaga

SEQ ID NO: 451138 - DNA, 15 bp, Homo sapiens
aagaggaacacagag

SEQ ID NO: 451139 - DNA, 15 bp, Homo sapiens
agaggaacacagagt

SEQ ID NO: 451140 - DNA, 15 bp, Homo sapiens
gaggaacacagagtc

SEQ ID NO: 451141 - DNA, 15 bp, Homo sapiens
aggaacacagagtct

SEQ ID NO: 451142 - DNA, 15 bp, Homo sapiens
ggaacacagagtcta

SEQ ID NO: 451143 - DNA, 15 bp, Homo sapiens
gaacacagagtctaa

SEQ ID NO: 451144 - DNA, 15 bp, Homo sapiens
aacacagagtctaag

SEQ ID NO: 451145 - DNA, 15 bp, Homo sapiens
acacagagtctaagt

SEQ ID NO: 451146 - DNA, 15 bp, Homo sapiens
cacagagtctaagtg

SEQ ID NO: 451147 - DNA, 15 bp, Homo sapiens
acagagtctaagtgg

SEQ ID NO: 451148 - DNA, 15 bp, Homo sapiens
cagagtctaagtggc

SEQ ID NO: 451149 - DNA, 15 bp, Homo sapiens
agagtctaagtggca

SEQ ID NO: 451150 - DNA, 15 bp, Homo sapiens
gagtctaagtggcaa

SEQ ID NO: 451151 - DNA, 15 bp, Homo sapiens
agtctaagtggcaag

SEQ ID NO: 451152 - DNA, 15 bp, Homo sapiens
gtctaagtggcaaga

SEQ ID NO: 451153 - DNA, 15 bp, Homo sapiens
tctaagtggcaagag

SEQ ID NO: 451154 - DNA, 15 bp, Homo sapiens
ctaagtggcaagaga

SEQ ID NO: 451155 - DNA, 15 bp, Homo sapiens
taagtggcaagagac

SEQ ID NO: 451156 - DNA, 15 bp, Homo sapiens
aagtggcaagagaca

SEQ ID NO: 451157 - DNA, 15 bp, Homo sapiens
agtggcaagagacac

SEQ ID NO: 451158 - DNA, 15 bp, Homo sapiens
gtggcaagagacact

SEQ ID NO: 451159 - DNA, 15 bp, Homo sapiens
tggcaagagacactt

SEQ ID NO: 451160 - DNA, 15 bp, Homo sapiens
ggcaagagacacttg

SEQ ID NO: 451161 - DNA, 15 bp, Homo sapiens
gcaagagacacttgc

SEQ ID NO: 451162 - DNA, 15 bp, Homo sapiens
caagagacacttgcc

SEQ ID NO: 451163 - DNA, 15 bp, Homo sapiens
aagagacacttgcct

SEQ ID NO: 451164 - DNA, 15 bp, Homo sapiens
agagacacttgcctg

SEQ ID NO: 451165 - DNA, 15 bp, Homo sapiens
gagacacttgcctga

SEQ ID NO: 451166 - DNA, 15 bp, Homo sapiens
agacacttgcctgag

SEQ ID NO: 451167 - DNA, 15 bp, Homo sapiens
gacacttgcctgagg

SEQ ID NO: 451168 - DNA, 15 bp, Homo sapiens
acacttgcctgaggg

SEQ ID NO: 451169 - DNA, 15 bp, Homo sapiens
cacttgcctgagggg

SEQ ID NO: 451170 - DNA, 15 bp, Homo sapiens
acttgcctgagggga

SEQ ID NO: 451171 - DNA, 15 bp, Homo sapiens
cttgcctgaggggag

SEQ ID NO: 451172 - DNA, 15 bp, Homo sapiens
ttgcctgaggggagt

SEQ ID NO: 451173 - DNA, 15 bp, Homo sapiens
tgcctgaggggagtg

SEQ ID NO: 451174 - DNA, 15 bp, Homo sapiens
gcctgaggggagtgg

SEQ ID NO: 451175 - DNA, 15 bp, Homo sapiens
cctgaggggagtggg

SEQ ID NO: 451176 - DNA, 15 bp, Homo sapiens
ctgaggggagtgggg

SEQ ID NO: 451177 - DNA, 15 bp, Homo sapiens
tgaggggagtgggga

SEQ ID NO: 451178 - DNA, 15 bp, Homo sapiens
gaggggagtggggaa

SEQ ID NO: 451179 - DNA, 15 bp, Homo sapiens
aggggagtggggaat

SEQ ID NO: 451180 - DNA, 15 bp, Homo sapiens
ggggagtggggaatc

SEQ ID NO: 451181 - DNA, 15 bp, Homo sapiens
gggagtggggaatcc

SEQ ID NO: 451182 - DNA, 15 bp, Homo sapiens
ggagtggggaatcca

SEQ ID NO: 451183 - DNA, 15 bp, Homo sapiens
gagtggggaatccag

SEQ ID NO: 451184 - DNA, 15 bp, Homo sapiens
agtggggaatccaga

SEQ ID NO: 451185 - DNA, 15 bp, Homo sapiens
gtggggaatccagat

SEQ ID NO: 451186 - DNA, 15 bp, Homo sapiens
tggggaatccagata

SEQ ID NO: 451187 - DNA, 15 bp, Homo sapiens
ggggaatccagatac

SEQ ID NO: 451188 - DNA, 15 bp, Homo sapiens
gggaatccagataca

SEQ ID NO: 451189 - DNA, 15 bp, Homo sapiens
ggaatccagatacac

SEQ ID NO: 451190 - DNA, 15 bp, Homo sapiens
gaatccagatacaca

SEQ ID NO: 451191 - DNA, 15 bp, Homo sapiens
aatccagatacacat

SEQ ID NO: 451192 - DNA, 15 bp, Homo sapiens
atccagatacacatg

SEQ ID NO: 451193 - DNA, 15 bp, Homo sapiens
tccagatacacatga

SEQ ID NO: 451194 - DNA, 15 bp, Homo sapiens
ccagatacacatgaa

SEQ ID NO: 451195 - DNA, 15 bp, Homo sapiens
cagatacacatgaag

SEQ ID NO: 451196 - DNA, 15 bp, Homo sapiens
agatacacatgaaga

SEQ ID NO: 451197 - DNA, 15 bp, Homo sapiens
gatacacatgaagag

SEQ ID NO: 451198 - DNA, 15 bp, Homo sapiens
atacacatgaagaga

SEQ ID NO: 451199 - DNA, 15 bp, Homo sapiens
tacacatgaagagaa

SEQ ID NO: 451200 - DNA, 15 bp, Homo sapiens
acacatgaagagaag

SEQ ID NO: 451201 - DNA, 15 bp, Homo sapiens
cacatgaagagaaga

SEQ ID NO: 451202 - DNA, 15 bp, Homo sapiens
acatgaagagaagaa

SEQ ID NO: 451203 - DNA, 15 bp, Homo sapiens
catgaagagaagaaa

SEQ ID NO: 451204 - DNA, 15 bp, Homo sapiens
atgaagagaagaaag

SEQ ID NO: 451205 - DNA, 15 bp, Homo sapiens
tgaagagaagaaagg

SEQ ID NO: 451206 - DNA, 15 bp, Homo sapiens
gaagagaagaaaggg

SEQ ID NO: 451207 - DNA, 15 bp, Homo sapiens
aagagaagaaagggt

SEQ ID NO: 451208 - DNA, 15 bp, Homo sapiens
agagaagaaagggta

SEQ ID NO: 451209 - DNA, 15 bp, Homo sapiens
gagaagaaagggtag

SEQ ID NO: 451210 - DNA, 15 bp, Homo sapiens
agaagaaagggtaga

SEQ ID NO: 451211 - DNA, 15 bp, Homo sapiens
gaagaaagggtagat

SEQ ID NO: 451212 - DNA, 15 bp, Homo sapiens
aagaaagggtagatt

SEQ ID NO: 451213 - DNA, 15 bp, Homo sapiens
agaaagggtagattt

SEQ ID NO: 451214 - DNA, 15 bp, Homo sapiens
gaaagggtagatttg

SEQ ID NO: 451215 - DNA, 15 bp, Homo sapiens
aaagggtagatttgc

SEQ ID NO: 451216 - DNA, 15 bp, Homo sapiens
aagggtagatttgca

SEQ ID NO: 451217 - DNA, 15 bp, Homo sapiens
agggtagatttgcac

SEQ ID NO: 451218 - DNA, 15 bp, Homo sapiens
gggtagatttgcact

SEQ ID NO: 451219 - DNA, 15 bp, Homo sapiens
ggtagatttgcactg

SEQ ID NO: 451220 - DNA, 15 bp, Homo sapiens
gtagatttgcactga

SEQ ID NO: 451221 - DNA, 15 bp, Homo sapiens
tagatttgcactgag

SEQ ID NO: 451222 - DNA, 15 bp, Homo sapiens
agatttgcactgagg

SEQ ID NO: 451223 - DNA, 15 bp, Homo sapiens
gatttgcactgagga

SEQ ID NO: 451224 - DNA, 15 bp, Homo sapiens
atttgcactgaggaa

SEQ ID NO: 451225 - DNA, 15 bp, Homo sapiens
tttgcactgaggaaa

SEQ ID NO: 451226 - DNA, 15 bp, Homo sapiens
ttgcactgaggaaag

SEQ ID NO: 451227 - DNA, 15 bp, Homo sapiens
tgcactgaggaaagt

SEQ ID NO: 451228 - DNA, 15 bp, Homo sapiens
gcactgaggaaagtt

SEQ ID NO: 451229 - DNA, 15 bp, Homo sapiens
cactgaggaaagttc

SEQ ID NO: 451230 - DNA, 15 bp, Homo sapiens
actgaggaaagttcg

SEQ ID NO: 451231 - DNA, 15 bp, Homo sapiens
ctgaggaaagttcga

SEQ ID NO: 451232 - DNA, 15 bp, Homo sapiens
tgaggaaagttcgac

SEQ ID NO: 451233 - DNA, 15 bp, Homo sapiens
gaggaaagttcgact

SEQ ID NO: 451234 - DNA, 15 bp, Homo sapiens
aggaaagttcgactc

SEQ ID NO: 451235 - DNA, 15 bp, Homo sapiens
ggaaagttcgactca

SEQ ID NO: 451236 - DNA, 15 bp, Homo sapiens
gaaagttcgactcaa

SEQ ID NO: 451237 - DNA, 15 bp, Homo sapiens
aaagttcgactcaag

SEQ ID NO: 451238 - DNA, 15 bp, Homo sapiens
aagttcgactcaagg

SEQ ID NO: 451239 - DNA, 15 bp, Homo sapiens
agttcgactcaaggt

SEQ ID NO: 451240 - DNA, 15 bp, Homo sapiens
gttcgactcaaggta

SEQ ID NO: 451241 - DNA, 15 bp, Homo sapiens
ttcgactcaaggtag

SEQ ID NO: 451242 - DNA, 15 bp, Homo sapiens
tcgactcaaggtaga

SEQ ID NO: 451243 - DNA, 15 bp, Homo sapiens
cgactcaaggtagaa

SEQ ID NO: 451244 - DNA, 15 bp, Homo sapiens
gactcaaggtagaag

SEQ ID NO: 451245 - DNA, 15 bp, Homo sapiens
actcaaggtagaaga

SEQ ID NO: 451246 - DNA, 15 bp, Homo sapiens
ctcaaggtagaagag

SEQ ID NO: 451247 - DNA, 15 bp, Homo sapiens
tcaaggtagaagagg

SEQ ID NO: 451248 - DNA, 15 bp, Homo sapiens
caaggtagaagagga

SEQ ID NO: 451249 - DNA, 15 bp, Homo sapiens
aaggtagaagaggag

SEQ ID NO: 451250 - DNA, 15 bp, Homo sapiens
aggtagaagaggagg

SEQ ID NO: 451251 - DNA, 15 bp, Homo sapiens
ggtagaagaggaggg

SEQ ID NO: 451252 - DNA, 15 bp, Homo sapiens
gtagaagaggaggga

SEQ ID NO: 451253 - DNA, 15 bp, Homo sapiens
tagaagaggagggag

SEQ ID NO: 451254 - DNA, 15 bp, Homo sapiens
agaagaggagggagg

SEQ ID NO: 451255 - DNA, 15 bp, Homo sapiens
gaagaggagggaggc

SEQ ID NO: 451256 - DNA, 15 bp, Homo sapiens
aagaggagggaggct

SEQ ID NO: 451257 - DNA, 15 bp, Homo sapiens
agaggagggaggctc

SEQ ID NO: 451258 - DNA, 15 bp, Homo sapiens
gaggagggaggctct

SEQ ID NO: 451259 - DNA, 15 bp, Homo sapiens
aggagggaggctctg

SEQ ID NO: 451260 - DNA, 15 bp, Homo sapiens
ggagggaggctctgt

SEQ ID NO: 451261 - DNA, 15 bp, Homo sapiens
gagggaggctctgta

SEQ ID NO: 451262 - DNA, 15 bp, Homo sapiens
agggaggctctgtag

SEQ ID NO: 451263 - DNA, 15 bp, Homo sapiens
gggaggctctgtaga

SEQ ID NO: 451264 - DNA, 15 bp, Homo sapiens
ggaggctctgtagat

SEQ ID NO: 451265 - DNA, 15 bp, Homo sapiens
gaggctctgtagatt

SEQ ID NO: 451266 - DNA, 15 bp, Homo sapiens
aggctctgtagattg

SEQ ID NO: 451267 - DNA, 15 bp, Homo sapiens
ggctctgtagattgt

SEQ ID NO: 451268 - DNA, 15 bp, Homo sapiens
gctctgtagattgtg

SEQ ID NO: 451269 - DNA, 15 bp, Homo sapiens
ctctgtagattgtgg

SEQ ID NO: 451270 - DNA, 15 bp, Homo sapiens
tctgtagattgtggg

SEQ ID NO: 451271 - DNA, 15 bp, Homo sapiens
ctgtagattgtggga

SEQ ID NO: 451272 - DNA, 15 bp, Homo sapiens
tgtagattgtgggat

SEQ ID NO: 451273 - DNA, 15 bp, Homo sapiens
gtagattgtgggatg

SEQ ID NO: 451274 - DNA, 15 bp, Homo sapiens
tagattgtgggatga

SEQ ID NO: 451275 - DNA, 15 bp, Homo sapiens
agattgtgggatgat

SEQ ID NO: 451276 - DNA, 15 bp, Homo sapiens
gattgtgggatgatg

SEQ ID NO: 451277 - DNA, 15 bp, Homo sapiens
attgtgggatgatgt

SEQ ID NO: 451278 - DNA, 15 bp, Homo sapiens
ttgtgggatgatgtt

SEQ ID NO: 451279 - DNA, 15 bp, Homo sapiens
tgtgggatgatgtta

SEQ ID NO: 451280 - DNA, 15 bp, Homo sapiens
gtgggatgatgttat

SEQ ID NO: 451281 - DNA, 15 bp, Homo sapiens
tgggatgatgttatt

SEQ ID NO: 451282 - DNA, 15 bp, Homo sapiens
gggatgatgttattc

SEQ ID NO: 451283 - DNA, 15 bp, Homo sapiens
ggatgatgttattca

SEQ ID NO: 451284 - DNA, 15 bp, Homo sapiens
gatgatgttattcag

SEQ ID NO: 451285 - DNA, 15 bp, Homo sapiens
atgatgttattcaga

SEQ ID NO: 451286 - DNA, 15 bp, Homo sapiens
tgatgttattcagag

SEQ ID NO: 451287 - DNA, 15 bp, Homo sapiens
gatgttattcagagt

SEQ ID NO: 451288 - DNA, 15 bp, Homo sapiens
atgttattcagagtt

SEQ ID NO: 451289 - DNA, 15 bp, Homo sapiens
tgttattcagagtta

SEQ ID NO: 451290 - DNA, 15 bp, Homo sapiens
gttattcagagttaa

SEQ ID NO: 451291 - DNA, 15 bp, Homo sapiens
ttattcagagttaaa

SEQ ID NO: 451292 - DNA, 15 bp, Homo sapiens
tattcagagttaaac

SEQ ID NO: 451293 - DNA, 15 bp, Homo sapiens
attcagagttaaact

SEQ ID NO: 451294 - DNA, 15 bp, Homo sapiens
ttcagagttaaactt

SEQ ID NO: 451295 - DNA, 15 bp, Homo sapiens
tcagagttaaacttg

SEQ ID NO: 451296 - DNA, 15 bp, Homo sapiens
cagagttaaacttgt

SEQ ID NO: 451297 - DNA, 15 bp, Homo sapiens
agagttaaacttgtt

SEQ ID NO: 451298 - DNA, 15 bp, Homo sapiens
gagttaaacttgttt

SEQ ID NO: 451299 - DNA, 15 bp, Homo sapiens
agttaaacttgtttc

SEQ ID NO: 451300 - DNA, 15 bp, Homo sapiens
gttaaacttgtttct

SEQ ID NO: 451301 - DNA, 15 bp, Homo sapiens
ttaaacttgtttctg

SEQ ID NO: 451302 - DNA, 15 bp, Homo sapiens
taaacttgtttctgc

SEQ ID NO: 451303 - DNA, 15 bp, Homo sapiens
aaacttgtttctgca

SEQ ID NO: 451304 - DNA, 15 bp, Homo sapiens
aacttgtttctgcaa

SEQ ID NO: 451305 - DNA, 15 bp, Homo sapiens
acttgtttctgcaat

SEQ ID NO: 451306 - DNA, 15 bp, Homo sapiens
cttgtttctgcaatc

SEQ ID NO: 451307 - DNA, 15 bp, Homo sapiens
ttgtttctgcaatct

SEQ ID NO: 451308 - DNA, 15 bp, Homo sapiens
tgtttctgcaatctt

SEQ ID NO: 451309 - DNA, 15 bp, Homo sapiens
gtttctgcaatcttt

SEQ ID NO: 451310 - DNA, 15 bp, Homo sapiens
tttctgcaatctttg

SEQ ID NO: 451311 - DNA, 15 bp, Homo sapiens
ttctgcaatctttgg

SEQ ID NO: 451312 - DNA, 15 bp, Homo sapiens
tctgcaatctttgga

SEQ ID NO: 451313 - DNA, 15 bp, Homo sapiens
ctgcaatctttggaa

SEQ ID NO: 451314 - DNA, 15 bp, Homo sapiens
tgcaatctttggaaa

SEQ ID NO: 451315 - DNA, 15 bp, Homo sapiens
gcaatctttggaaat

SEQ ID NO: 451316 - DNA, 15 bp, Homo sapiens
caatctttggaaata

SEQ ID NO: 451317 - DNA, 15 bp, Homo sapiens
aatctttggaaatat

SEQ ID NO: 451318 - DNA, 15 bp, Homo sapiens
atctttggaaatatg

SEQ ID NO: 451319 - DNA, 15 bp, Homo sapiens
tctttggaaatatga

SEQ ID NO: 451320 - DNA, 15 bp, Homo sapiens
ctttggaaatatgac

SEQ ID NO: 451321 - DNA, 15 bp, Homo sapiens
tttggaaatatgacg

SEQ ID NO: 451322 - DNA, 15 bp, Homo sapiens
ttggaaatatgacga

SEQ ID NO: 451323 - DNA, 15 bp, Homo sapiens
tggaaatatgacgag

SEQ ID NO: 451324 - DNA, 15 bp, Homo sapiens
ggaaatatgacgaga

SEQ ID NO: 451325 - DNA, 15 bp, Homo sapiens
gaaatatgacgagac

SEQ ID NO: 451326 - DNA, 15 bp, Homo sapiens
aaatatgacgagact

SEQ ID NO: 451327 - DNA, 15 bp, Homo sapiens
aatatgacgagactt

SEQ ID NO: 451328 - DNA, 15 bp, Homo sapiens
atatgacgagacttt

SEQ ID NO: 451329 - DNA, 15 bp, Homo sapiens
tatgacgagactttt

SEQ ID NO: 451330 - DNA, 15 bp, Homo sapiens
atgacgagactttta

SEQ ID NO: 451331 - DNA, 15 bp, Homo sapiens
tgacgagacttttaa

SEQ ID NO: 451332 - DNA, 15 bp, Homo sapiens
gacgagacttttaag

SEQ ID NO: 451333 - DNA, 15 bp, Homo sapiens
acgagacttttaagg

SEQ ID NO: 451334 - DNA, 15 bp, Homo sapiens
cgagacttttaaggt

SEQ ID NO: 451335 - DNA, 15 bp, Homo sapiens
gagacttttaaggtg

SEQ ID NO: 451336 - DNA, 15 bp, Homo sapiens
agacttttaaggtgt

SEQ ID NO: 451337 - DNA, 15 bp, Homo sapiens
gacttttaaggtgta

SEQ ID NO: 451338 - DNA, 15 bp, Homo sapiens
acttttaaggtgtag

SEQ ID NO: 451339 - DNA, 15 bp, Homo sapiens
cttttaaggtgtagt

SEQ ID NO: 451340 - DNA, 15 bp, Homo sapiens
ttttaaggtgtagtg

SEQ ID NO: 451341 - DNA, 15 bp, Homo sapiens
tttaaggtgtagtga

SEQ ID NO: 451342 - DNA, 15 bp, Homo sapiens
ttaaggtgtagtgac

SEQ ID NO: 451343 - DNA, 15 bp, Homo sapiens
taaggtgtagtgact

SEQ ID NO: 451344 - DNA, 15 bp, Homo sapiens
aaggtgtagtgactc

SEQ ID NO: 451345 - DNA, 15 bp, Homo sapiens
aggtgtagtgactcc

SEQ ID NO: 451346 - DNA, 15 bp, Homo sapiens
ggtgtagtgactccc

SEQ ID NO: 451347 - DNA, 15 bp, Homo sapiens
gtgtagtgactccca

SEQ ID NO: 451348 - DNA, 15 bp, Homo sapiens
tgtagtgactcccac

SEQ ID NO: 451349 - DNA, 15 bp, Homo sapiens
gtagtgactcccaca

SEQ ID NO: 451350 - DNA, 15 bp, Homo sapiens
tagtgactcccacag

SEQ ID NO: 451351 - DNA, 15 bp, Homo sapiens
agtgactcccacagc

SEQ ID NO: 451352 - DNA, 15 bp, Homo sapiens
gtgactcccacagca

SEQ ID NO: 451353 - DNA, 15 bp, Homo sapiens
tgactcccacagcac

SEQ ID NO: 451354 - DNA, 15 bp, Homo sapiens
gactcccacagcact

SEQ ID NO: 451355 - DNA, 15 bp, Homo sapiens
actcccacagcacta

SEQ ID NO: 451356 - DNA, 15 bp, Homo sapiens
ctcccacagcactac

SEQ ID NO: 451357 - DNA, 15 bp, Homo sapiens
tcccacagcactact

SEQ ID NO: 451358 - DNA, 15 bp, Homo sapiens
cccacagcactactt

SEQ ID NO: 451359 - DNA, 15 bp, Homo sapiens
ccacagcactacttc

SEQ ID NO: 451360 - DNA, 15 bp, Homo sapiens
cacagcactacttct

SEQ ID NO: 451361 - DNA, 15 bp, Homo sapiens
acagcactacttctg

SEQ ID NO: 451362 - DNA, 15 bp, Homo sapiens
cagcactacttctgc

SEQ ID NO: 451363 - DNA, 15 bp, Homo sapiens
agcactacttctgct

SEQ ID NO: 451364 - DNA, 15 bp, Homo sapiens
gcactacttctgctg

SEQ ID NO: 451365 - DNA, 15 bp, Homo sapiens
cactacttctgctgt

SEQ ID NO: 451366 - DNA, 15 bp, Homo sapiens
actacttctgctgtt

SEQ ID NO: 451367 - DNA, 15 bp, Homo sapiens
ctacttctgctgttg

SEQ ID NO: 451368 - DNA, 15 bp, Homo sapiens
tacttctgctgttgg

SEQ ID NO: 451369 - DNA, 15 bp, Homo sapiens
acttctgctgttgga

SEQ ID NO: 451370 - DNA, 15 bp, Homo sapiens
cttctgctgttggag

SEQ ID NO: 451371 - DNA, 15 bp, Homo sapiens
ttctgctgttggagg

SEQ ID NO: 451372 - DNA, 15 bp, Homo sapiens
tctgctgttggagga

SEQ ID NO: 451373 - DNA, 15 bp, Homo sapiens
ctgctgttggaggat

SEQ ID NO: 451374 - DNA, 15 bp, Homo sapiens
tgctgttggaggatt

SEQ ID NO: 451375 - DNA, 15 bp, Homo sapiens
gctgttggaggattc

SEQ ID NO: 451376 - DNA, 15 bp, Homo sapiens
ctgttggaggattcg

SEQ ID NO: 451377 - DNA, 15 bp, Homo sapiens
tgttggaggattcgt

SEQ ID NO: 451378 - DNA, 15 bp, Homo sapiens
gttggaggattcgtt

SEQ ID NO: 451379 - DNA, 15 bp, Homo sapiens
ttggaggattcgttc

SEQ ID NO: 451380 - DNA, 15 bp, Homo sapiens
tggaggattcgttct

SEQ ID NO: 451381 - DNA, 15 bp, Homo sapiens
ggaggattcgttctg

SEQ ID NO: 451382 - DNA, 15 bp, Homo sapiens
gaggattcgttctga

SEQ ID NO: 451383 - DNA, 15 bp, Homo sapiens
aggattcgttctgaa

SEQ ID NO: 451384 - DNA, 15 bp, Homo sapiens
ggattcgttctgaat

SEQ ID NO: 451385 - DNA, 15 bp, Homo sapiens
gattcgttctgaatg

SEQ ID NO: 451386 - DNA, 15 bp, Homo sapiens
attcgttctgaatga

SEQ ID NO: 451387 - DNA, 15 bp, Homo sapiens
ttcgttctgaatgat

SEQ ID NO: 451388 - DNA, 15 bp, Homo sapiens
tcgttctgaatgata

SEQ ID NO: 451389 - DNA, 15 bp, Homo sapiens
cgttctgaatgataa

SEQ ID NO: 451390 - DNA, 15 bp, Homo sapiens
gttctgaatgataat

SEQ ID NO: 451391 - DNA, 15 bp, Homo sapiens
ttctgaatgataatc

SEQ ID NO: 451392 - DNA, 15 bp, Homo sapiens
tctgaatgataatct

SEQ ID NO: 451393 - DNA, 15 bp, Homo sapiens
ctgaatgataatcta

SEQ ID NO: 451394 - DNA, 15 bp, Homo sapiens
tgaatgataatctac

SEQ ID NO: 451395 - DNA, 15 bp, Homo sapiens
gaatgataatctaca

SEQ ID NO: 451396 - DNA, 15 bp, Homo sapiens
aatgataatctacat

SEQ ID NO: 451397 - DNA, 15 bp, Homo sapiens
atgataatctacatc

SEQ ID NO: 451398 - DNA, 15 bp, Homo sapiens
tgataatctacatct

SEQ ID NO: 451399 - DNA, 15 bp, Homo sapiens
gataatctacatctg

SEQ ID NO: 451400 - DNA, 15 bp, Homo sapiens
ataatctacatctgt

SEQ ID NO: 451401 - DNA, 15 bp, Homo sapiens
taatctacatctgtt

SEQ ID NO: 451402 - DNA, 15 bp, Homo sapiens
aatctacatctgttt

SEQ ID NO: 451403 - DNA, 15 bp, Homo sapiens
atctacatctgttta

SEQ ID NO: 451404 - DNA, 15 bp, Homo sapiens
tctacatctgtttaa

SEQ ID NO: 451405 - DNA, 15 bp, Homo sapiens
ctacatctgtttaac

SEQ ID NO: 451406 - DNA, 15 bp, Homo sapiens
tacatctgtttaaca

SEQ ID NO: 451407 - DNA, 15 bp, Homo sapiens
acatctgtttaacag

SEQ ID NO: 451408 - DNA, 15 bp, Homo sapiens
catctgtttaacaga

SEQ ID NO: 451409 - DNA, 15 bp, Homo sapiens
atctgtttaacagat

SEQ ID NO: 451410 - DNA, 15 bp, Homo sapiens
tctgtttaacagata

SEQ ID NO: 451411 - DNA, 15 bp, Homo sapiens
ctgtttaacagatat

SEQ ID NO: 451412 - DNA, 15 bp, Homo sapiens
tgtttaacagatatg

SEQ ID NO: 451413 - DNA, 15 bp, Homo sapiens
gtttaacagatatgg

SEQ ID NO: 451414 - DNA, 15 bp, Homo sapiens
tttaacagatatggg

SEQ ID NO: 451415 - DNA, 15 bp, Homo sapiens
ttaacagatatgggt

SEQ ID NO: 451416 - DNA, 15 bp, Homo sapiens
taacagatatgggtt

SEQ ID NO: 451417 - DNA, 15 bp, Homo sapiens
aacagatatgggttt

SEQ ID NO: 451418 - DNA, 15 bp, Homo sapiens
acagatatgggttta

SEQ ID NO: 451419 - DNA, 15 bp, Homo sapiens
cagatatgggtttat

SEQ ID NO: 451420 - DNA, 15 bp, Homo sapiens
agatatgggtttatt

SEQ ID NO: 451421 - DNA, 15 bp, Homo sapiens
gatatgggtttattc

SEQ ID NO: 451422 - DNA, 15 bp, Homo sapiens
atatgggtttattct

SEQ ID NO: 451423 - DNA, 15 bp, Homo sapiens
tatgggtttattctg

SEQ ID NO: 451424 - DNA, 15 bp, Homo sapiens
atgggtttattctgg

SEQ ID NO: 451425 - DNA, 15 bp, Homo sapiens
tgggtttattctgga

SEQ ID NO: 451426 - DNA, 15 bp, Homo sapiens
gggtttattctggag

SEQ ID NO: 451427 - DNA, 15 bp, Homo sapiens
ggtttattctggagc

SEQ ID NO: 451428 - DNA, 15 bp, Homo sapiens
gtttattctggagcc

SEQ ID NO: 451429 - DNA, 15 bp, Homo sapiens
tttattctggagcct

SEQ ID NO: 451430 - DNA, 15 bp, Homo sapiens
ttattctggagcctg

SEQ ID NO: 451431 - DNA, 15 bp, Homo sapiens
tattctggagcctgc

SEQ ID NO: 451432 - DNA, 15 bp, Homo sapiens
attctggagcctgca

SEQ ID NO: 451433 - DNA, 15 bp, Homo sapiens
ttctggagcctgcat

SEQ ID NO: 451434 - DNA, 15 bp, Homo sapiens
tctggagcctgcatt

SEQ ID NO: 451435 - DNA, 15 bp, Homo sapiens
ctggagcctgcattg

SEQ ID NO: 451436 - DNA, 15 bp, Homo sapiens
tggagcctgcattga

SEQ ID NO: 451437 - DNA, 15 bp, Homo sapiens
ggagcctgcattgat

SEQ ID NO: 451438 - DNA, 15 bp, Homo sapiens
gagcctgcattgatc

SEQ ID NO: 451439 - DNA, 15 bp, Homo sapiens
agcctgcattgatct

SEQ ID NO: 451440 - DNA, 15 bp, Homo sapiens
gcctgcattgatctg

SEQ ID NO: 451441 - DNA, 15 bp, Homo sapiens
cctgcattgatctgg

SEQ ID NO: 451442 - DNA, 15 bp, Homo sapiens
ctgcattgatctggc

SEQ ID NO: 451443 - DNA, 15 bp, Homo sapiens
tgcattgatctggcc

SEQ ID NO: 451444 - DNA, 15 bp, Homo sapiens
gcattgatctggcca

SEQ ID NO: 451445 - DNA, 15 bp, Homo sapiens
cattgatctggccac

SEQ ID NO: 451446 - DNA, 15 bp, Homo sapiens
attgatctggccaca

SEQ ID NO: 451447 - DNA, 15 bp, Homo sapiens
ttgatctggccacat

SEQ ID NO: 451448 - DNA, 15 bp, Homo sapiens
tgatctggccacatc

SEQ ID NO: 451449 - DNA, 15 bp, Homo sapiens
gatctggccacatca

SEQ ID NO: 451450 - DNA, 15 bp, Homo sapiens
atctggccacatcaa

SEQ ID NO: 451451 - DNA, 15 bp, Homo sapiens
tctggccacatcaag

SEQ ID NO: 451452 - DNA, 15 bp, Homo sapiens
ctggccacatcaagc

SEQ ID NO: 451453 - DNA, 15 bp, Homo sapiens
aatccacccgcctcg

SEQ ID NO: 451454 - DNA, 15 bp, Homo sapiens
cctcccaaagtgctc

SEQ ID NO: 451455 - DNA, 15 bp, Homo sapiens
ctcccaaagtgctcc

SEQ ID NO: 451456 - DNA, 15 bp, Homo sapiens
tcccaaagtgctccc

SEQ ID NO: 451457 - DNA, 15 bp, Homo sapiens
cccaaagtgctcccg

SEQ ID NO: 451458 - DNA, 15 bp, Homo sapiens
ccaaagtgctcccgt

SEQ ID NO: 451459 - DNA, 15 bp, Homo sapiens
caaagtgctcccgtg

SEQ ID NO: 451460 - DNA, 15 bp, Homo sapiens
aaagtgctcccgtga

SEQ ID NO: 451461 - DNA, 15 bp, Homo sapiens
aagtgctcccgtgag

SEQ ID NO: 451462 - DNA, 15 bp, Homo sapiens
agtgctcccgtgagc

SEQ ID NO: 451463 - DNA, 15 bp, Homo sapiens
gtgctcccgtgagcc

SEQ ID NO: 451464 - DNA, 15 bp, Homo sapiens
tgctcccgtgagcca

SEQ ID NO: 451465 - DNA, 15 bp, Homo sapiens
gctcccgtgagccac

SEQ ID NO: 451466 - DNA, 15 bp, Homo sapiens
ctcccgtgagccact

SEQ ID NO: 451467 - DNA, 15 bp, Homo sapiens
tcccgtgagccactg

SEQ ID NO: 451468 - DNA, 15 bp, Homo sapiens
cccgtgagccactgt

SEQ ID NO: 451469 - DNA, 15 bp, Homo sapiens
ccgtgagccactgtg

SEQ ID NO: 451470 - DNA, 15 bp, Homo sapiens
cactgtgcccggccg

SEQ ID NO: 451471 - DNA, 15 bp, Homo sapiens
actgtgcccggccga

SEQ ID NO: 451472 - DNA, 15 bp, Homo sapiens
ctgtgcccggccgag

SEQ ID NO: 451473 - DNA, 15 bp, Homo sapiens
tgtgcccggccgaga

SEQ ID NO: 451474 - DNA, 15 bp, Homo sapiens
gtgcccggccgagaa

SEQ ID NO: 451475 - DNA, 15 bp, Homo sapiens
tgcccggccgagaac

SEQ ID NO: 451476 - DNA, 15 bp, Homo sapiens
gcccggccgagaact

SEQ ID NO: 451477 - DNA, 15 bp, Homo sapiens
cccggccgagaactg

SEQ ID NO: 451478 - DNA, 15 bp, Homo sapiens
ccggccgagaactgt

SEQ ID NO: 451479 - DNA, 15 bp, Homo sapiens
cggccgagaactgta

SEQ ID NO: 451480 - DNA, 15 bp, Homo sapiens
ggccgagaactgtat

SEQ ID NO: 451481 - DNA, 15 bp, Homo sapiens
gccgagaactgtata

SEQ ID NO: 451482 - DNA, 15 bp, Homo sapiens
ccgagaactgtatat

SEQ ID NO: 451483 - DNA, 15 bp, Homo sapiens
cgagaactgtatatt

SEQ ID NO: 451484 - DNA, 15 bp, Homo sapiens
gagaactgtatattg

SEQ ID NO: 451485 - DNA, 15 bp, Homo sapiens
agaactgtatattgt

SEQ ID NO: 451486 - DNA, 15 bp, Homo sapiens
gaactgtatattgtt

SEQ ID NO: 451487 - DNA, 15 bp, Homo sapiens
aactgtatattgtta

SEQ ID NO: 451488 - DNA, 15 bp, Homo sapiens
actgtatattgttaa

SEQ ID NO: 451489 - DNA, 15 bp, Homo sapiens
ctgtatattgttaaa

SEQ ID NO: 451490 - DNA, 15 bp, Homo sapiens
tgtatattgttaaat

SEQ ID NO: 451491 - DNA, 15 bp, Homo sapiens
gtatattgttaaata

SEQ ID NO: 451492 - DNA, 15 bp, Homo sapiens
tatattgttaaatag

SEQ ID NO: 451493 - DNA, 15 bp, Homo sapiens
atattgttaaatagg

SEQ ID NO: 451494 - DNA, 15 bp, Homo sapiens
tattgttaaatagga

SEQ ID NO: 451495 - DNA, 15 bp, Homo sapiens
attgttaaataggag

SEQ ID NO: 451496 - DNA, 15 bp, Homo sapiens
ttgttaaataggagc

SEQ ID NO: 451497 - DNA, 15 bp, Homo sapiens
tgttaaataggagct

SEQ ID NO: 451498 - DNA, 15 bp, Homo sapiens
gttaaataggagcta

SEQ ID NO: 451499 - DNA, 15 bp, Homo sapiens
ttaaataggagctaa

SEQ ID NO: 451500 - DNA, 15 bp, Homo sapiens
taaataggagctaat

SEQ ID NO: 451501 - DNA, 15 bp, Homo sapiens
aaataggagctaatc

SEQ ID NO: 451502 - DNA, 15 bp, Homo sapiens
aataggagctaatca

SEQ ID NO: 451503 - DNA, 15 bp, Homo sapiens
ataggagctaatcac

SEQ ID NO: 451504 - DNA, 15 bp, Homo sapiens
taggagctaatcacc

SEQ ID NO: 451505 - DNA, 15 bp, Homo sapiens
aggagctaatcacca

SEQ ID NO: 451506 - DNA, 15 bp, Homo sapiens
ggagctaatcaccag

SEQ ID NO: 451507 - DNA, 15 bp, Homo sapiens
gagctaatcaccagc

SEQ ID NO: 451508 - DNA, 15 bp, Homo sapiens
agctaatcaccagcc

SEQ ID NO: 451509 - DNA, 15 bp, Homo sapiens
gctaatcaccagcct

SEQ ID NO: 451510 - DNA, 15 bp, Homo sapiens
ctaatcaccagcctt

SEQ ID NO: 451511 - DNA, 15 bp, Homo sapiens
taatcaccagccttt

SEQ ID NO: 451512 - DNA, 15 bp, Homo sapiens
aatcaccagcctttc

SEQ ID NO: 451513 - DNA, 15 bp, Homo sapiens
atcaccagcctttct

SEQ ID NO: 451514 - DNA, 15 bp, Homo sapiens
tcaccagcctttctt

SEQ ID NO: 451515 - DNA, 15 bp, Homo sapiens
caccagcctttctta

SEQ ID NO: 451516 - DNA, 15 bp, Homo sapiens
accagcctttcttac

SEQ ID NO: 451517 - DNA, 15 bp, Homo sapiens
ccagcctttcttaca

SEQ ID NO: 451518 - DNA, 15 bp, Homo sapiens
cagcctttcttacat

SEQ ID NO: 451519 - DNA, 15 bp, Homo sapiens
agcctttcttacatg

SEQ ID NO: 451520 - DNA, 15 bp, Homo sapiens
gcctttcttacatgg

SEQ ID NO: 451521 - DNA, 15 bp, Homo sapiens
cctttcttacatggc

SEQ ID NO: 451522 - DNA, 15 bp, Homo sapiens
ctttcttacatggca

SEQ ID NO: 451523 - DNA, 15 bp, Homo sapiens
tttcttacatggcat

SEQ ID NO: 451524 - DNA, 15 bp, Homo sapiens
ttcttacatggcata

SEQ ID NO: 451525 - DNA, 15 bp, Homo sapiens
tcttacatggcatat

SEQ ID NO: 451526 - DNA, 15 bp, Homo sapiens
cttacatggcatatt

SEQ ID NO: 451527 - DNA, 15 bp, Homo sapiens
ttacatggcatatta

SEQ ID NO: 451528 - DNA, 15 bp, Homo sapiens
tacatggcatattaa

SEQ ID NO: 451529 - DNA, 15 bp, Homo sapiens
acatggcatattaat

SEQ ID NO: 451530 - DNA, 15 bp, Homo sapiens
catggcatattaatg

SEQ ID NO: 451531 - DNA, 15 bp, Homo sapiens
atggcatattaatgt

SEQ ID NO: 451532 - DNA, 15 bp, Homo sapiens
tggcatattaatgtt

SEQ ID NO: 451533 - DNA, 15 bp, Homo sapiens
ggcatattaatgtta

SEQ ID NO: 451534 - DNA, 15 bp, Homo sapiens
gcatattaatgttaa

SEQ ID NO: 451535 - DNA, 15 bp, Homo sapiens
catattaatgttaaa

SEQ ID NO: 451536 - DNA, 15 bp, Homo sapiens
atattaatgttaaaa

SEQ ID NO: 451537 - DNA, 15 bp, Homo sapiens
tattaatgttaaaag

SEQ ID NO: 451538 - DNA, 15 bp, Homo sapiens
attaatgttaaaaga

SEQ ID NO: 451539 - DNA, 15 bp, Homo sapiens
ttaatgttaaaagaa

SEQ ID NO: 451540 - DNA, 15 bp, Homo sapiens
taatgttaaaagaat

SEQ ID NO: 451541 - DNA, 15 bp, Homo sapiens
aatgttaaaagaatc

SEQ ID NO: 451542 - DNA, 15 bp, Homo sapiens
atgttaaaagaatca

SEQ ID NO: 451543 - DNA, 15 bp, Homo sapiens
tgttaaaagaatcat

SEQ ID NO: 451544 - DNA, 15 bp, Homo sapiens
gttaaaagaatcatg

SEQ ID NO: 451545 - DNA, 15 bp, Homo sapiens
ttaaaagaatcatgt

SEQ ID NO: 451546 - DNA, 15 bp, Homo sapiens
taaaagaatcatgtc

SEQ ID NO: 451547 - DNA, 15 bp, Homo sapiens
aaaagaatcatgtca

SEQ ID NO: 451548 - DNA, 15 bp, Homo sapiens
aaagaatcatgtcat

SEQ ID NO: 451549 - DNA, 15 bp, Homo sapiens
aagaatcatgtcatt

SEQ ID NO: 451550 - DNA, 15 bp, Homo sapiens
agaatcatgtcattg

SEQ ID NO: 451551 - DNA, 15 bp, Homo sapiens
gaatcatgtcattga

SEQ ID NO: 451552 - DNA, 15 bp, Homo sapiens
aatcatgtcattgac

SEQ ID NO: 451553 - DNA, 15 bp, Homo sapiens
atcatgtcattgaca

SEQ ID NO: 451554 - DNA, 15 bp, Homo sapiens
tcatgtcattgacat

SEQ ID NO: 451555 - DNA, 15 bp, Homo sapiens
catgtcattgacatt

SEQ ID NO: 451556 - DNA, 15 bp, Homo sapiens
atgtcattgacattt

SEQ ID NO: 451557 - DNA, 15 bp, Homo sapiens
tgtcattgacattta

SEQ ID NO: 451558 - DNA, 15 bp, Homo sapiens
gtcattgacatttaa

SEQ ID NO: 451559 - DNA, 15 bp, Homo sapiens
tcattgacatttaaa

SEQ ID NO: 451560 - DNA, 15 bp, Homo sapiens
cattgacatttaaaa

SEQ ID NO: 451561 - DNA, 15 bp, Homo sapiens
attgacatttaaaag

SEQ ID NO: 451562 - DNA, 15 bp, Homo sapiens
ttgacatttaaaagt

SEQ ID NO: 451563 - DNA, 15 bp, Homo sapiens
tgacatttaaaagta

SEQ ID NO: 451564 - DNA, 15 bp, Homo sapiens
gacatttaaaagtag

SEQ ID NO: 451565 - DNA, 15 bp, Homo sapiens
acatttaaaagtagt

SEQ ID NO: 451566 - DNA, 15 bp, Homo sapiens
catttaaaagtagtt

SEQ ID NO: 451567 - DNA, 15 bp, Homo sapiens
atttaaaagtagtta

SEQ ID NO: 451568 - DNA, 15 bp, Homo sapiens
tttaaaagtagttaa

SEQ ID NO: 451569 - DNA, 15 bp, Homo sapiens
ttaaaagtagttaaa

SEQ ID NO: 451570 - DNA, 15 bp, Homo sapiens
taaaagtagttaaat

SEQ ID NO: 451571 - DNA, 15 bp, Homo sapiens
aaaagtagttaaatt

SEQ ID NO: 451572 - DNA, 15 bp, Homo sapiens
aaagtagttaaattt

SEQ ID NO: 451573 - DNA, 15 bp, Homo sapiens
aagtagttaaatttc

SEQ ID NO: 451574 - DNA, 15 bp, Homo sapiens
agtagttaaatttct

SEQ ID NO: 451575 - DNA, 15 bp, Homo sapiens
tagttaaatttctaa

SEQ ID NO: 451576 - DNA, 15 bp, Homo sapiens
agttaaatttctaag

SEQ ID NO: 451577 - DNA, 15 bp, Homo sapiens
gttaaatttctaagg

SEQ ID NO: 451578 - DNA, 15 bp, Homo sapiens
ttaaatttctaaggg

SEQ ID NO: 451579 - DNA, 15 bp, Homo sapiens
taaatttctaagggc

SEQ ID NO: 451580 - DNA, 15 bp, Homo sapiens
aaatttctaagggca

SEQ ID NO: 451581 - DNA, 15 bp, Homo sapiens
aatttctaagggcaa

SEQ ID NO: 451582 - DNA, 15 bp, Homo sapiens
atttctaagggcaat

SEQ ID NO: 451583 - DNA, 15 bp, Homo sapiens
tttctaagggcaatg

SEQ ID NO: 451584 - DNA, 15 bp, Homo sapiens
ttctaagggcaatgc

SEQ ID NO: 451585 - DNA, 15 bp, Homo sapiens
tctaagggcaatgca

SEQ ID NO: 451586 - DNA, 15 bp, Homo sapiens
ctaagggcaatgcag

SEQ ID NO: 451587 - DNA, 15 bp, Homo sapiens
taagggcaatgcagt

SEQ ID NO: 451588 - DNA, 15 bp, Homo sapiens
aagggcaatgcagta

SEQ ID NO: 451589 - DNA, 15 bp, Homo sapiens
agggcaatgcagtaa

SEQ ID NO: 451590 - DNA, 15 bp, Homo sapiens
gggcaatgcagtaaa

SEQ ID NO: 451591 - DNA, 15 bp, Homo sapiens
ggcaatgcagtaaac

SEQ ID NO: 451592 - DNA, 15 bp, Homo sapiens
gcaatgcagtaaaca

SEQ ID NO: 451593 - DNA, 15 bp, Homo sapiens
caatgcagtaaacag

SEQ ID NO: 451594 - DNA, 15 bp, Homo sapiens
aatgcagtaaacagg

SEQ ID NO: 451595 - DNA, 15 bp, Homo sapiens
atgcagtaaacaggt

SEQ ID NO: 451596 - DNA, 15 bp, Homo sapiens
tgcagtaaacaggta

SEQ ID NO: 451597 - DNA, 15 bp, Homo sapiens
gcagtaaacaggtat

SEQ ID NO: 451598 - DNA, 15 bp, Homo sapiens
cagtaaacaggtatt

SEQ ID NO: 451599 - DNA, 15 bp, Homo sapiens
agtaaacaggtattg

SEQ ID NO: 451600 - DNA, 15 bp, Homo sapiens
gtaaacaggtattgc

SEQ ID NO: 451601 - DNA, 15 bp, Homo sapiens
taaacaggtattgcc

SEQ ID NO: 451602 - DNA, 15 bp, Homo sapiens
aaacaggtattgcct

SEQ ID NO: 451603 - DNA, 15 bp, Homo sapiens
aacaggtattgcctt

SEQ ID NO: 451604 - DNA, 15 bp, Homo sapiens
acaggtattgccttt

SEQ ID NO: 451605 - DNA, 15 bp, Homo sapiens
caggtattgcctttc

SEQ ID NO: 451606 - DNA, 15 bp, Homo sapiens
aggtattgcctttct

SEQ ID NO: 451607 - DNA, 15 bp, Homo sapiens
ggtattgcctttctt

SEQ ID NO: 451608 - DNA, 15 bp, Homo sapiens
gtattgcctttctta

SEQ ID NO: 451609 - DNA, 15 bp, Homo sapiens
tattgcctttcttag

SEQ ID NO: 451610 - DNA, 15 bp, Homo sapiens
attgcctttcttagg

SEQ ID NO: 451611 - DNA, 15 bp, Homo sapiens
ttgcctttcttagga

SEQ ID NO: 451612 - DNA, 15 bp, Homo sapiens
tgcctttcttaggag

SEQ ID NO: 451613 - DNA, 15 bp, Homo sapiens
gcctttcttaggaga

SEQ ID NO: 451614 - DNA, 15 bp, Homo sapiens
cctttcttaggagaa

SEQ ID NO: 451615 - DNA, 15 bp, Homo sapiens
ctttcttaggagaat

SEQ ID NO: 451616 - DNA, 15 bp, Homo sapiens
tttcttaggagaatt

SEQ ID NO: 451617 - DNA, 15 bp, Homo sapiens
ttcttaggagaattg

SEQ ID NO: 451618 - DNA, 15 bp, Homo sapiens
tcttaggagaattgt

SEQ ID NO: 451619 - DNA, 15 bp, Homo sapiens
cttaggagaattgtg

SEQ ID NO: 451620 - DNA, 15 bp, Homo sapiens
ttaggagaattgtgt

SEQ ID NO: 451621 - DNA, 15 bp, Homo sapiens
taggagaattgtgtg

SEQ ID NO: 451622 - DNA, 15 bp, Homo sapiens
aggagaattgtgtgg

SEQ ID NO: 451623 - DNA, 15 bp, Homo sapiens
ggagaattgtgtggt

SEQ ID NO: 451624 - DNA, 15 bp, Homo sapiens
gagaattgtgtggtt

SEQ ID NO: 451625 - DNA, 15 bp, Homo sapiens
agaattgtgtggttt

SEQ ID NO: 451626 - DNA, 15 bp, Homo sapiens
gaattgtgtggtttg

SEQ ID NO: 451627 - DNA, 15 bp, Homo sapiens
aattgtgtggtttga

SEQ ID NO: 451628 - DNA, 15 bp, Homo sapiens
attgtgtggtttgaa

SEQ ID NO: 451629 - DNA, 15 bp, Homo sapiens
ttgtgtggtttgaaa

SEQ ID NO: 451630 - DNA, 15 bp, Homo sapiens
tgtgtggtttgaaat

SEQ ID NO: 451631 - DNA, 15 bp, Homo sapiens
gtgtggtttgaaatc

SEQ ID NO: 451632 - DNA, 15 bp, Homo sapiens
tgtggtttgaaatca

SEQ ID NO: 451633 - DNA, 15 bp, Homo sapiens
gtggtttgaaatcat

SEQ ID NO: 451634 - DNA, 15 bp, Homo sapiens
tggtttgaaatcatg

SEQ ID NO: 451635 - DNA, 15 bp, Homo sapiens
ggtttgaaatcatgt

SEQ ID NO: 451636 - DNA, 15 bp, Homo sapiens
gtttgaaatcatgtg

SEQ ID NO: 451637 - DNA, 15 bp, Homo sapiens
tttgaaatcatgtga

SEQ ID NO: 451638 - DNA, 15 bp, Homo sapiens
ttgaaatcatgtgag

SEQ ID NO: 451639 - DNA, 15 bp, Homo sapiens
tgaaatcatgtgagc

SEQ ID NO: 451640 - DNA, 15 bp, Homo sapiens
gaaatcatgtgagcc

SEQ ID NO: 451641 - DNA, 15 bp, Homo sapiens
aaatcatgtgagcca

SEQ ID NO: 451642 - DNA, 15 bp, Homo sapiens
atcatgtgagccaaa

SEQ ID NO: 451643 - DNA, 15 bp, Homo sapiens
tcatgtgagccaaaa

SEQ ID NO: 451644 - DNA, 15 bp, Homo sapiens
catgtgagccaaaaa

SEQ ID NO: 451645 - DNA, 15 bp, Homo sapiens
atgtgagccaaaaag

SEQ ID NO: 451646 - DNA, 15 bp, Homo sapiens
tgtgagccaaaaaga

SEQ ID NO: 451647 - DNA, 15 bp, Homo sapiens
gtgagccaaaaagag

SEQ ID NO: 451648 - DNA, 15 bp, Homo sapiens
tgagccaaaaagagt

SEQ ID NO: 451649 - DNA, 15 bp, Homo sapiens
gagccaaaaagagtt

SEQ ID NO: 451650 - DNA, 15 bp, Homo sapiens
agccaaaaagagttg

SEQ ID NO: 451651 - DNA, 15 bp, Homo sapiens
gccaaaaagagttga

SEQ ID NO: 451652 - DNA, 15 bp, Homo sapiens
ccaaaaagagttgat

SEQ ID NO: 451653 - DNA, 15 bp, Homo sapiens
caaaaagagttgatt

SEQ ID NO: 451654 - DNA, 15 bp, Homo sapiens
aaaaagagttgattt

SEQ ID NO: 451655 - DNA, 15 bp, Homo sapiens
aaaagagttgattta

SEQ ID NO: 451656 - DNA, 15 bp, Homo sapiens
aaagagttgatttac

SEQ ID NO: 451657 - DNA, 15 bp, Homo sapiens
aagagttgatttaca

SEQ ID NO: 451658 - DNA, 15 bp, Homo sapiens
agagttgatttacag

SEQ ID NO: 451659 - DNA, 15 bp, Homo sapiens
gagttgatttacagg

SEQ ID NO: 451660 - DNA, 15 bp, Homo sapiens
agttgatttacaggg

SEQ ID NO: 451661 - DNA, 15 bp, Homo sapiens
gttgatttacaggga

SEQ ID NO: 451662 - DNA, 15 bp, Homo sapiens
ttgatttacagggag

SEQ ID NO: 451663 - DNA, 15 bp, Homo sapiens
tgatttacagggagg

SEQ ID NO: 451664 - DNA, 15 bp, Homo sapiens
gatttacagggagga

SEQ ID NO: 451665 - DNA, 15 bp, Homo sapiens
atttacagggaggaa

SEQ ID NO: 451666 - DNA, 15 bp, Homo sapiens
tttacagggaggaat

SEQ ID NO: 451667 - DNA, 15 bp, Homo sapiens
ttacagggaggaatg

SEQ ID NO: 451668 - DNA, 15 bp, Homo sapiens
tacagggaggaatgt

SEQ ID NO: 451669 - DNA, 15 bp, Homo sapiens
acagggaggaatgta

SEQ ID NO: 451670 - DNA, 15 bp, Homo sapiens
cagggaggaatgtaa

SEQ ID NO: 451671 - DNA, 15 bp, Homo sapiens
agggaggaatgtaat

SEQ ID NO: 451672 - DNA, 15 bp, Homo sapiens
gggaggaatgtaatt

SEQ ID NO: 451673 - DNA, 15 bp, Homo sapiens
ggaggaatgtaattg

SEQ ID NO: 451674 - DNA, 15 bp, Homo sapiens
gaggaatgtaattgt

SEQ ID NO: 451675 - DNA, 15 bp, Homo sapiens
aggaatgtaattgta

SEQ ID NO: 451676 - DNA, 15 bp, Homo sapiens
ggaatgtaattgtag

SEQ ID NO: 451677 - DNA, 15 bp, Homo sapiens
gaatgtaattgtagt

SEQ ID NO: 451678 - DNA, 15 bp, Homo sapiens
aatgtaattgtagtt

SEQ ID NO: 451679 - DNA, 15 bp, Homo sapiens
atgtaattgtagttt

SEQ ID NO: 451680 - DNA, 15 bp, Homo sapiens
tgtaattgtagtttt

SEQ ID NO: 451681 - DNA, 15 bp, Homo sapiens
gtaattgtagttttt

SEQ ID NO: 451682 - DNA, 15 bp, Homo sapiens
taattgtagttttta

SEQ ID NO: 451683 - DNA, 15 bp, Homo sapiens
aattgtagtttttac

SEQ ID NO: 451684 - DNA, 15 bp, Homo sapiens
attgtagtttttacc

SEQ ID NO: 451685 - DNA, 15 bp, Homo sapiens
ttgtagtttttacct

SEQ ID NO: 451686 - DNA, 15 bp, Homo sapiens
tgtagtttttacctc

SEQ ID NO: 451687 - DNA, 15 bp, Homo sapiens
gtagtttttacctcc

SEQ ID NO: 451688 - DNA, 15 bp, Homo sapiens
tagtttttacctcct

SEQ ID NO: 451689 - DNA, 15 bp, Homo sapiens
agtttttacctcctt

SEQ ID NO: 451690 - DNA, 15 bp, Homo sapiens
gtttttacctccttc

SEQ ID NO: 451691 - DNA, 15 bp, Homo sapiens
tttttacctccttcg

SEQ ID NO: 451692 - DNA, 15 bp, Homo sapiens
ttttacctccttcgt

SEQ ID NO: 451693 - DNA, 15 bp, Homo sapiens
tttacctccttcgta

SEQ ID NO: 451694 - DNA, 15 bp, Homo sapiens
ttacctccttcgtat

SEQ ID NO: 451695 - DNA, 15 bp, Homo sapiens
tacctccttcgtatt

SEQ ID NO: 451696 - DNA, 15 bp, Homo sapiens
acctccttcgtattg

SEQ ID NO: 451697 - DNA, 15 bp, Homo sapiens
cctccttcgtattga

SEQ ID NO: 451698 - DNA, 15 bp, Homo sapiens
ctccttcgtattgag

SEQ ID NO: 451699 - DNA, 15 bp, Homo sapiens
tccttcgtattgagt

SEQ ID NO: 451700 - DNA, 15 bp, Homo sapiens
ccttcgtattgagtc

SEQ ID NO: 451701 - DNA, 15 bp, Homo sapiens
cttcgtattgagtca

SEQ ID NO: 451702 - DNA, 15 bp, Homo sapiens
ttcgtattgagtcat

SEQ ID NO: 451703 - DNA, 15 bp, Homo sapiens
tcgtattgagtcatc

SEQ ID NO: 451704 - DNA, 15 bp, Homo sapiens
cgtattgagtcatct

SEQ ID NO: 451705 - DNA, 15 bp, Homo sapiens
gtattgagtcatctt

SEQ ID NO: 451706 - DNA, 15 bp, Homo sapiens
tattgagtcatctta

SEQ ID NO: 451707 - DNA, 15 bp, Homo sapiens
attgagtcatcttaa

SEQ ID NO: 451708 - DNA, 15 bp, Homo sapiens
ttgagtcatcttaac

SEQ ID NO: 451709 - DNA, 15 bp, Homo sapiens
tgagtcatcttaacc

SEQ ID NO: 451710 - DNA, 15 bp, Homo sapiens
gagtcatcttaacct

SEQ ID NO: 451711 - DNA, 15 bp, Homo sapiens
agtcatcttaacctt

SEQ ID NO: 451712 - DNA, 15 bp, Homo sapiens
gtcatcttaaccttc

SEQ ID NO: 451713 - DNA, 15 bp, Homo sapiens
tcatcttaaccttca

SEQ ID NO: 451714 - DNA, 15 bp, Homo sapiens
catcttaaccttcag

SEQ ID NO: 451715 - DNA, 15 bp, Homo sapiens
atcttaaccttcagc

SEQ ID NO: 451716 - DNA, 15 bp, Homo sapiens
tcttaaccttcagct

SEQ ID NO: 451717 - DNA, 15 bp, Homo sapiens
cttaaccttcagctt

SEQ ID NO: 451718 - DNA, 15 bp, Homo sapiens
ttaaccttcagcttt

SEQ ID NO: 451719 - DNA, 15 bp, Homo sapiens
taaccttcagctttg

SEQ ID NO: 451720 - DNA, 15 bp, Homo sapiens
aaccttcagctttgc

SEQ ID NO: 451721 - DNA, 15 bp, Homo sapiens
accttcagctttgca

SEQ ID NO: 451722 - DNA, 15 bp, Homo sapiens
ccttcagctttgcac

SEQ ID NO: 451723 - DNA, 15 bp, Homo sapiens
cttcagctttgcacg

SEQ ID NO: 451724 - DNA, 15 bp, Homo sapiens
ttcagctttgcacgc

SEQ ID NO: 451725 - DNA, 15 bp, Homo sapiens
tcagctttgcacgca

SEQ ID NO: 451726 - DNA, 15 bp, Homo sapiens
cagctttgcacgcaa

SEQ ID NO: 451727 - DNA, 15 bp, Homo sapiens
agctttgcacgcaaa

SEQ ID NO: 451728 - DNA, 15 bp, Homo sapiens
gctttgcacgcaaaa

SEQ ID NO: 451729 - DNA, 15 bp, Homo sapiens
ctttgcacgcaaaaa

SEQ ID NO: 451730 - DNA, 15 bp, Homo sapiens
tttgcacgcaaaaaa

SEQ ID NO: 451731 - DNA, 15 bp, Homo sapiens
ttgcacgcaaaaaat

SEQ ID NO: 451732 - DNA, 15 bp, Homo sapiens
tgcacgcaaaaaata

SEQ ID NO: 451733 - DNA, 15 bp, Homo sapiens
gcacgcaaaaaatat

SEQ ID NO: 451734 - DNA, 15 bp, Homo sapiens
cacgcaaaaaatata

SEQ ID NO: 451735 - DNA, 15 bp, Homo sapiens
acgcaaaaaatatat

SEQ ID NO: 451736 - DNA, 15 bp, Homo sapiens
cgcaaaaaatatata

SEQ ID NO: 451737 - DNA, 15 bp, Homo sapiens
caaaaaatatatata

SEQ ID NO: 451738 - DNA, 15 bp, Homo sapiens
aaaaaatatatatag

SEQ ID NO: 451739 - DNA, 15 bp, Homo sapiens
aaaaatatatataga

SEQ ID NO: 451740 - DNA, 15 bp, Homo sapiens
aaaatatatatagat

SEQ ID NO: 451741 - DNA, 15 bp, Homo sapiens
aaatatatatagata

SEQ ID NO: 451742 - DNA, 15 bp, Homo sapiens
aatatatatagatat

SEQ ID NO: 451743 - DNA, 15 bp, Homo sapiens
tatatatagatatac

SEQ ID NO: 451744 - DNA, 15 bp, Homo sapiens
atatatagatataca

SEQ ID NO: 451745 - DNA, 15 bp, Homo sapiens
tatatagatatacaa

SEQ ID NO: 451746 - DNA, 15 bp, Homo sapiens
atatagatatacaat

SEQ ID NO: 451747 - DNA, 15 bp, Homo sapiens
tatagatatacaatt

SEQ ID NO: 451748 - DNA, 15 bp, Homo sapiens
atagatatacaatta

SEQ ID NO: 451749 - DNA, 15 bp, Homo sapiens
tagatatacaattac

SEQ ID NO: 451750 - DNA, 15 bp, Homo sapiens
agatatacaattaca

SEQ ID NO: 451751 - DNA, 15 bp, Homo sapiens
gatatacaattacaa

SEQ ID NO: 451752 - DNA, 15 bp, Homo sapiens
atatacaattacaat

SEQ ID NO: 451753 - DNA, 15 bp, Homo sapiens
tatacaattacaata

SEQ ID NO: 451754 - DNA, 15 bp, Homo sapiens
atacaattacaatat

SEQ ID NO: 451755 - DNA, 15 bp, Homo sapiens
tacaattacaatata

SEQ ID NO: 451756 - DNA, 15 bp, Homo sapiens
acaattacaatatag

SEQ ID NO: 451757 - DNA, 15 bp, Homo sapiens
caattacaatatagc

SEQ ID NO: 451758 - DNA, 15 bp, Homo sapiens
aattacaatatagcc

SEQ ID NO: 451759 - DNA, 15 bp, Homo sapiens
attacaatatagcca

SEQ ID NO: 451760 - DNA, 15 bp, Homo sapiens
ttacaatatagccaa

SEQ ID NO: 451761 - DNA, 15 bp, Homo sapiens
tacaatatagccaac

SEQ ID NO: 451762 - DNA, 15 bp, Homo sapiens
acaatatagccaact

SEQ ID NO: 451763 - DNA, 15 bp, Homo sapiens
caatatagccaactt

SEQ ID NO: 451764 - DNA, 15 bp, Homo sapiens
aatatagccaacttt

SEQ ID NO: 451765 - DNA, 15 bp, Homo sapiens
atatagccaacttta

SEQ ID NO: 451766 - DNA, 15 bp, Homo sapiens
tatagccaactttaa

SEQ ID NO: 451767 - DNA, 15 bp, Homo sapiens
atagccaactttaat

SEQ ID NO: 451768 - DNA, 15 bp, Homo sapiens
tagccaactttaatc

SEQ ID NO: 451769 - DNA, 15 bp, Homo sapiens
agccaactttaatcc

SEQ ID NO: 451770 - DNA, 15 bp, Homo sapiens
gccaactttaatcca

SEQ ID NO: 451771 - DNA, 15 bp, Homo sapiens
ccaactttaatccac

SEQ ID NO: 451772 - DNA, 15 bp, Homo sapiens
caactttaatccact

SEQ ID NO: 451773 - DNA, 15 bp, Homo sapiens
aactttaatccactg

SEQ ID NO: 451774 - DNA, 15 bp, Homo sapiens
actttaatccactgc

SEQ ID NO: 451775 - DNA, 15 bp, Homo sapiens
ctttaatccactgcc

SEQ ID NO: 451776 - DNA, 15 bp, Homo sapiens
tttaatccactgcct

SEQ ID NO: 451777 - DNA, 15 bp, Homo sapiens
ttaatccactgcctt

SEQ ID NO: 451778 - DNA, 15 bp, Homo sapiens
taatccactgcctta

SEQ ID NO: 451779 - DNA, 15 bp, Homo sapiens
aatccactgccttaa

SEQ ID NO: 451780 - DNA, 15 bp, Homo sapiens
atccactgccttaaa

SEQ ID NO: 451781 - DNA, 15 bp, Homo sapiens
tccactgccttaaat

SEQ ID NO: 451782 - DNA, 15 bp, Homo sapiens
ccactgccttaaatt

SEQ ID NO: 451783 - DNA, 15 bp, Homo sapiens
cactgccttaaattt

SEQ ID NO: 451784 - DNA, 15 bp, Homo sapiens
actgccttaaatttg

SEQ ID NO: 451785 - DNA, 15 bp, Homo sapiens
ctgccttaaatttgc

SEQ ID NO: 451786 - DNA, 15 bp, Homo sapiens
tgccttaaatttgct

SEQ ID NO: 451787 - DNA, 15 bp, Homo sapiens
gccttaaatttgctt

SEQ ID NO: 451788 - DNA, 15 bp, Homo sapiens
ccttaaatttgcttt

SEQ ID NO: 451789 - DNA, 15 bp, Homo sapiens
cttaaatttgctttt

SEQ ID NO: 451790 - DNA, 15 bp, Homo sapiens
ttaaatttgcttttg

SEQ ID NO: 451791 - DNA, 15 bp, Homo sapiens
taaatttgcttttgg

SEQ ID NO: 451792 - DNA, 15 bp, Homo sapiens
aaatttgcttttggc

SEQ ID NO: 451793 - DNA, 15 bp, Homo sapiens
aatttgcttttggct

SEQ ID NO: 451794 - DNA, 15 bp, Homo sapiens
atttgcttttggctc

SEQ ID NO: 451795 - DNA, 15 bp, Homo sapiens
tttgcttttggctca

SEQ ID NO: 451796 - DNA, 15 bp, Homo sapiens
ttgcttttggctcac

SEQ ID NO: 451797 - DNA, 15 bp, Homo sapiens
tgcttttggctcact

SEQ ID NO: 451798 - DNA, 15 bp, Homo sapiens
gcttttggctcactt

SEQ ID NO: 451799 - DNA, 15 bp, Homo sapiens
cttttggctcacttt

SEQ ID NO: 451800 - DNA, 15 bp, Homo sapiens
ttttggctcactttt

SEQ ID NO: 451801 - DNA, 15 bp, Homo sapiens
tttggctcacttttt

SEQ ID NO: 451802 - DNA, 15 bp, Homo sapiens
ttggctcacttttta

SEQ ID NO: 451803 - DNA, 15 bp, Homo sapiens
tggctcactttttat

SEQ ID NO: 451804 - DNA, 15 bp, Homo sapiens
ggctcactttttatt

SEQ ID NO: 451805 - DNA, 15 bp, Homo sapiens
gctcactttttattt

SEQ ID NO: 451806 - DNA, 15 bp, Homo sapiens
ctcactttttattta

SEQ ID NO: 451807 - DNA, 15 bp, Homo sapiens
tcactttttatttag

SEQ ID NO: 451808 - DNA, 15 bp, Homo sapiens
cactttttatttagt

SEQ ID NO: 451809 - DNA, 15 bp, Homo sapiens
actttttatttagta

SEQ ID NO: 451810 - DNA, 15 bp, Homo sapiens
ctttttatttagtac

SEQ ID NO: 451811 - DNA, 15 bp, Homo sapiens
tttttatttagtacg

SEQ ID NO: 451812 - DNA, 15 bp, Homo sapiens
ttttatttagtacgt

SEQ ID NO: 451813 - DNA, 15 bp, Homo sapiens
tttatttagtacgtg

SEQ ID NO: 451814 - DNA, 15 bp, Homo sapiens
ttatttagtacgtgc

SEQ ID NO: 451815 - DNA, 15 bp, Homo sapiens
tatttagtacgtgcc

SEQ ID NO: 451816 - DNA, 15 bp, Homo sapiens
atttagtacgtgcca

SEQ ID NO: 451817 - DNA, 15 bp, Homo sapiens
tttagtacgtgccat

SEQ ID NO: 451818 - DNA, 15 bp, Homo sapiens
ttagtacgtgccatc

SEQ ID NO: 451819 - DNA, 15 bp, Homo sapiens
tagtacgtgccatca

SEQ ID NO: 451820 - DNA, 15 bp, Homo sapiens
agtacgtgccatcaa

SEQ ID NO: 451821 - DNA, 15 bp, Homo sapiens
gtacgtgccatcaaa

SEQ ID NO: 451822 - DNA, 15 bp, Homo sapiens
tacgtgccatcaaat

SEQ ID NO: 451823 - DNA, 15 bp, Homo sapiens
acgtgccatcaaatt

SEQ ID NO: 451824 - DNA, 15 bp, Homo sapiens
cgtgccatcaaatta

SEQ ID NO: 451825 - DNA, 15 bp, Homo sapiens
gtgccatcaaattag

SEQ ID NO: 451826 - DNA, 15 bp, Homo sapiens
tgccatcaaattagc

SEQ ID NO: 451827 - DNA, 15 bp, Homo sapiens
gccatcaaattagct

SEQ ID NO: 451828 - DNA, 15 bp, Homo sapiens
ccatcaaattagctc

SEQ ID NO: 451829 - DNA, 15 bp, Homo sapiens
catcaaattagctca

SEQ ID NO: 451830 - DNA, 15 bp, Homo sapiens
atcaaattagctcac

SEQ ID NO: 451831 - DNA, 15 bp, Homo sapiens
tcaaattagctcacc

SEQ ID NO: 451832 - DNA, 15 bp, Homo sapiens
caaattagctcacct

SEQ ID NO: 451833 - DNA, 15 bp, Homo sapiens
aaattagctcaccta

SEQ ID NO: 451834 - DNA, 15 bp, Homo sapiens
aattagctcacctag

SEQ ID NO: 451835 - DNA, 15 bp, Homo sapiens
attagctcacctagt

SEQ ID NO: 451836 - DNA, 15 bp, Homo sapiens
ttagctcacctagtt

SEQ ID NO: 451837 - DNA, 15 bp, Homo sapiens
tagctcacctagttt

SEQ ID NO: 451838 - DNA, 15 bp, Homo sapiens
agctcacctagttta

SEQ ID NO: 451839 - DNA, 15 bp, Homo sapiens
gctcacctagtttaa

SEQ ID NO: 451840 - DNA, 15 bp, Homo sapiens
ctcacctagtttaaa

SEQ ID NO: 451841 - DNA, 15 bp, Homo sapiens
tcacctagtttaaat

SEQ ID NO: 451842 - DNA, 15 bp, Homo sapiens
cacctagtttaaatt

SEQ ID NO: 451843 - DNA, 15 bp, Homo sapiens
acctagtttaaattt

SEQ ID NO: 451844 - DNA, 15 bp, Homo sapiens
cctagtttaaatttg

SEQ ID NO: 451845 - DNA, 15 bp, Homo sapiens
ctagtttaaatttgt

SEQ ID NO: 451846 - DNA, 15 bp, Homo sapiens
tagtttaaatttgtc

SEQ ID NO: 451847 - DNA, 15 bp, Homo sapiens
agtttaaatttgtct

SEQ ID NO: 451848 - DNA, 15 bp, Homo sapiens
gtttaaatttgtcta

SEQ ID NO: 451849 - DNA, 15 bp, Homo sapiens
tttaaatttgtctaa

SEQ ID NO: 451850 - DNA, 15 bp, Homo sapiens
ttaaatttgtctaaa

SEQ ID NO: 451851 - DNA, 15 bp, Homo sapiens
taaatttgtctaaat

SEQ ID NO: 451852 - DNA, 15 bp, Homo sapiens
aaatttgtctaaatt

SEQ ID NO: 451853 - DNA, 15 bp, Homo sapiens
aatttgtctaaattg

SEQ ID NO: 451854 - DNA, 15 bp, Homo sapiens
atttgtctaaattgt

SEQ ID NO: 451855 - DNA, 15 bp, Homo sapiens
tttgtctaaattgtt

SEQ ID NO: 451856 - DNA, 15 bp, Homo sapiens
ttgtctaaattgtta

SEQ ID NO: 451857 - DNA, 15 bp, Homo sapiens
tgtctaaattgttaa

SEQ ID NO: 451858 - DNA, 15 bp, Homo sapiens
gtctaaattgttaaa

SEQ ID NO: 451859 - DNA, 15 bp, Homo sapiens
tctaaattgttaaaa

SEQ ID NO: 451860 - DNA, 15 bp, Homo sapiens
ctaaattgttaaaag

SEQ ID NO: 451861 - DNA, 15 bp, Homo sapiens
taaattgttaaaagc

SEQ ID NO: 451862 - DNA, 15 bp, Homo sapiens
aaattgttaaaagct

SEQ ID NO: 451863 - DNA, 15 bp, Homo sapiens
aattgttaaaagcta

SEQ ID NO: 451864 - DNA, 15 bp, Homo sapiens
attgttaaaagctaa

SEQ ID NO: 451865 - DNA, 15 bp, Homo sapiens
ttgttaaaagctaaa

SEQ ID NO: 451866 - DNA, 15 bp, Homo sapiens
tgttaaaagctaaat

SEQ ID NO: 451867 - DNA, 15 bp, Homo sapiens
gttaaaagctaaatt

SEQ ID NO: 451868 - DNA, 15 bp, Homo sapiens
ttaaaagctaaattc

SEQ ID NO: 451869 - DNA, 15 bp, Homo sapiens
taaaagctaaattca

SEQ ID NO: 451870 - DNA, 15 bp, Homo sapiens
aaaagctaaattcat

SEQ ID NO: 451871 - DNA, 15 bp, Homo sapiens
aaagctaaattcatt

SEQ ID NO: 451872 - DNA, 15 bp, Homo sapiens
aagctaaattcattt

SEQ ID NO: 451873 - DNA, 15 bp, Homo sapiens
agctaaattcatttt

SEQ ID NO: 451874 - DNA, 15 bp, Homo sapiens
gctaaattcattttt

SEQ ID NO: 451875 - DNA, 15 bp, Homo sapiens
ctaaattcattttta

SEQ ID NO: 451876 - DNA, 15 bp, Homo sapiens
taaattcatttttat

SEQ ID NO: 451877 - DNA, 15 bp, Homo sapiens
aaattcatttttata

SEQ ID NO: 451878 - DNA, 15 bp, Homo sapiens
aattcatttttatat

SEQ ID NO: 451879 - DNA, 15 bp, Homo sapiens
attcatttttatata

SEQ ID NO: 451880 - DNA, 15 bp, Homo sapiens
ttcatttttatataa

SEQ ID NO: 451881 - DNA, 15 bp, Homo sapiens
tcatttttatataaa

SEQ ID NO: 451882 - DNA, 15 bp, Homo sapiens
tttatataaaaatgc

SEQ ID NO: 451883 - DNA, 15 bp, Homo sapiens
ttatataaaaatgca

SEQ ID NO: 451884 - DNA, 15 bp, Homo sapiens
tatataaaaatgcaa

SEQ ID NO: 451885 - DNA, 15 bp, Homo sapiens
atataaaaatgcaag

SEQ ID NO: 451886 - DNA, 15 bp, Homo sapiens
tataaaaatgcaaga

SEQ ID NO: 451887 - DNA, 15 bp, Homo sapiens
ataaaaatgcaagaa

SEQ ID NO: 451888 - DNA, 15 bp, Homo sapiens
taaaaatgcaagaaa

SEQ ID NO: 451889 - DNA, 15 bp, Homo sapiens
aaaaatgcaagaaaa

SEQ ID NO: 451890 - DNA, 15 bp, Homo sapiens
aaaatgcaagaaaac

SEQ ID NO: 451891 - DNA, 15 bp, Homo sapiens
aaatgcaagaaaaca

SEQ ID NO: 451892 - DNA, 15 bp, Homo sapiens
aatgcaagaaaacac

SEQ ID NO: 451893 - DNA, 15 bp, Homo sapiens
atgcaagaaaacaca

SEQ ID NO: 451894 - DNA, 15 bp, Homo sapiens
tgcaagaaaacacag

SEQ ID NO: 451895 - DNA, 15 bp, Homo sapiens
gcaagaaaacacaga

SEQ ID NO: 451896 - DNA, 15 bp, Homo sapiens
caagaaaacacagac

SEQ ID NO: 451897 - DNA, 15 bp, Homo sapiens
aagaaaacacagacg

SEQ ID NO: 451898 - DNA, 15 bp, Homo sapiens
agaaaacacagacga

SEQ ID NO: 451899 - DNA, 15 bp, Homo sapiens
gaaaacacagacgag

SEQ ID NO: 451900 - DNA, 15 bp, Homo sapiens
aaaacacagacgaga

SEQ ID NO: 451901 - DNA, 15 bp, Homo sapiens
aaacacagacgagaa

SEQ ID NO: 451902 - DNA, 15 bp, Homo sapiens
aacacagacgagaat

SEQ ID NO: 451903 - DNA, 15 bp, Homo sapiens
acacagacgagaatt

SEQ ID NO: 451904 - DNA, 15 bp, Homo sapiens
cacagacgagaattc

SEQ ID NO: 451905 - DNA, 15 bp, Homo sapiens
acagacgagaattcc

SEQ ID NO: 451906 - DNA, 15 bp, Homo sapiens
cagacgagaattccg

SEQ ID NO: 451907 - DNA, 15 bp, Homo sapiens
agacgagaattccgg

SEQ ID NO: 451908 - DNA, 15 bp, Homo sapiens
gacgagaattccggt

SEQ ID NO: 451909 - DNA, 15 bp, Homo sapiens
acgagaattccggtt

SEQ ID NO: 451910 - DNA, 15 bp, Homo sapiens
cgagaattccggttt

SEQ ID NO: 451911 - DNA, 15 bp, Homo sapiens
gagaattccggtttt

SEQ ID NO: 451912 - DNA, 15 bp, Homo sapiens
agaattccggttttg

SEQ ID NO: 451913 - DNA, 15 bp, Homo sapiens
gaattccggttttgt

SEQ ID NO: 451914 - DNA, 15 bp, Homo sapiens
aattccggttttgtt

SEQ ID NO: 451915 - DNA, 15 bp, Homo sapiens
attccggttttgttt

SEQ ID NO: 451916 - DNA, 15 bp, Homo sapiens
ttccggttttgtttt

SEQ ID NO: 451917 - DNA, 15 bp, Homo sapiens
tccggttttgtttta

SEQ ID NO: 451918 - DNA, 15 bp, Homo sapiens
ccggttttgttttaa

SEQ ID NO: 451919 - DNA, 15 bp, Homo sapiens
cggttttgttttaat

SEQ ID NO: 451920 - DNA, 15 bp, Homo sapiens
ggttttgttttaatt

SEQ ID NO: 451921 - DNA, 15 bp, Homo sapiens
gttttgttttaattt

SEQ ID NO: 451922 - DNA, 15 bp, Homo sapiens
ttttgttttaatttc

SEQ ID NO: 451923 - DNA, 15 bp, Homo sapiens
tttgttttaatttct

SEQ ID NO: 451924 - DNA, 15 bp, Homo sapiens
ttgttttaatttcta

SEQ ID NO: 451925 - DNA, 15 bp, Homo sapiens
tgttttaatttctag

SEQ ID NO: 451926 - DNA, 15 bp, Homo sapiens
gttttaatttctagt

SEQ ID NO: 451927 - DNA, 15 bp, Homo sapiens
ttttaatttctagtg

SEQ ID NO: 451928 - DNA, 15 bp, Homo sapiens
tttaatttctagtgc

SEQ ID NO: 451929 - DNA, 15 bp, Homo sapiens
ttaatttctagtgca

SEQ ID NO: 451930 - DNA, 15 bp, Homo sapiens
taatttctagtgcaa

SEQ ID NO: 451931 - DNA, 15 bp, Homo sapiens
aatttctagtgcaat

SEQ ID NO: 451932 - DNA, 15 bp, Homo sapiens
atttctagtgcaatg

SEQ ID NO: 451933 - DNA, 15 bp, Homo sapiens
tttctagtgcaatgt

SEQ ID NO: 451934 - DNA, 15 bp, Homo sapiens
ttctagtgcaatgtg

SEQ ID NO: 451935 - DNA, 15 bp, Homo sapiens
tctagtgcaatgtgg

SEQ ID NO: 451936 - DNA, 15 bp, Homo sapiens
ctagtgcaatgtggc

SEQ ID NO: 451937 - DNA, 15 bp, Homo sapiens
tagtgcaatgtggct

SEQ ID NO: 451938 - DNA, 15 bp, Homo sapiens
agtgcaatgtggctt

SEQ ID NO: 451939 - DNA, 15 bp, Homo sapiens
gtgcaatgtggcttt

SEQ ID NO: 451940 - DNA, 15 bp, Homo sapiens
tgcaatgtggctttc

SEQ ID NO: 451941 - DNA, 15 bp, Homo sapiens
gcaatgtggctttca

SEQ ID NO: 451942 - DNA, 15 bp, Homo sapiens
caatgtggctttcaa

SEQ ID NO: 451943 - DNA, 15 bp, Homo sapiens
aatgtggctttcaac

SEQ ID NO: 451944 - DNA, 15 bp, Homo sapiens
atgtggctttcaact

SEQ ID NO: 451945 - DNA, 15 bp, Homo sapiens
tgtggctttcaactt

SEQ ID NO: 451946 - DNA, 15 bp, Homo sapiens
gtggctttcaactta

SEQ ID NO: 451947 - DNA, 15 bp, Homo sapiens
tggctttcaacttat

SEQ ID NO: 451948 - DNA, 15 bp, Homo sapiens
ggctttcaacttatt

SEQ ID NO: 451949 - DNA, 15 bp, Homo sapiens
gctttcaacttattg

SEQ ID NO: 451950 - DNA, 15 bp, Homo sapiens
ctttcaacttattgt

SEQ ID NO: 451951 - DNA, 15 bp, Homo sapiens
tttcaacttattgtt

SEQ ID NO: 451952 - DNA, 15 bp, Homo sapiens
ttcaacttattgttt

SEQ ID NO: 451953 - DNA, 15 bp, Homo sapiens
tcaacttattgttta

SEQ ID NO: 451954 - DNA, 15 bp, Homo sapiens
caacttattgtttaa

SEQ ID NO: 451955 - DNA, 15 bp, Homo sapiens
aacttattgtttaac

SEQ ID NO: 451956 - DNA, 15 bp, Homo sapiens
acttattgtttaacc

SEQ ID NO: 451957 - DNA, 15 bp, Homo sapiens
cttattgtttaacct

SEQ ID NO: 451958 - DNA, 15 bp, Homo sapiens
ttattgtttaaccta

SEQ ID NO: 451959 - DNA, 15 bp, Homo sapiens
tattgtttaacctac

SEQ ID NO: 451960 - DNA, 15 bp, Homo sapiens
attgtttaacctact

SEQ ID NO: 451961 - DNA, 15 bp, Homo sapiens
ttgtttaacctactt

SEQ ID NO: 451962 - DNA, 15 bp, Homo sapiens
tgtttaacctacttc

SEQ ID NO: 451963 - DNA, 15 bp, Homo sapiens
gtttaacctacttcc

SEQ ID NO: 451964 - DNA, 15 bp, Homo sapiens
tttaacctacttcct

SEQ ID NO: 451965 - DNA, 15 bp, Homo sapiens
ttaacctacttcctc

SEQ ID NO: 451966 - DNA, 15 bp, Homo sapiens
taacctacttcctct

SEQ ID NO: 451967 - DNA, 15 bp, Homo sapiens
aacctacttcctctg

SEQ ID NO: 451968 - DNA, 15 bp, Homo sapiens
acctacttcctctgg

SEQ ID NO: 451969 - DNA, 15 bp, Homo sapiens
cctacttcctctggt

SEQ ID NO: 451970 - DNA, 15 bp, Homo sapiens
ctacttcctctggtt

SEQ ID NO: 451971 - DNA, 15 bp, Homo sapiens
tacttcctctggttg

SEQ ID NO: 451972 - DNA, 15 bp, Homo sapiens
acttcctctggttgg

SEQ ID NO: 451973 - DNA, 15 bp, Homo sapiens
cttcctctggttggt

SEQ ID NO: 451974 - DNA, 15 bp, Homo sapiens
ttcctctggttggtc

SEQ ID NO: 451975 - DNA, 15 bp, Homo sapiens
tcctctggttggtcc

SEQ ID NO: 451976 - DNA, 15 bp, Homo sapiens
cctctggttggtcca

SEQ ID NO: 451977 - DNA, 15 bp, Homo sapiens
ctctggttggtccag

SEQ ID NO: 451978 - DNA, 15 bp, Homo sapiens
tctggttggtccagc

SEQ ID NO: 451979 - DNA, 15 bp, Homo sapiens
ctggttggtccagcg

SEQ ID NO: 451980 - DNA, 15 bp, Homo sapiens
tggttggtccagcgg

SEQ ID NO: 451981 - DNA, 15 bp, Homo sapiens
ggttggtccagcggt

SEQ ID NO: 451982 - DNA, 15 bp, Homo sapiens
gttggtccagcggtt

SEQ ID NO: 451983 - DNA, 15 bp, Homo sapiens
ttggtccagcggttt

SEQ ID NO: 451984 - DNA, 15 bp, Homo sapiens
tggtccagcggtttt

SEQ ID NO: 451985 - DNA, 15 bp, Homo sapiens
ggtccagcggttttt

SEQ ID NO: 451986 - DNA, 15 bp, Homo sapiens
gtccagcggtttttt

SEQ ID NO: 451987 - DNA, 15 bp, Homo sapiens
tccagcggttttttt

SEQ ID NO: 451988 - DNA, 15 bp, Homo sapiens
ccagcggttttttta

SEQ ID NO: 451989 - DNA, 15 bp, Homo sapiens
cagcggtttttttaa

SEQ ID NO: 451990 - DNA, 15 bp, Homo sapiens
agcggtttttttaag

SEQ ID NO: 451991 - DNA, 15 bp, Homo sapiens
gcggtttttttaagt

SEQ ID NO: 451992 - DNA, 15 bp, Homo sapiens
cggtttttttaagtt

SEQ ID NO: 451993 - DNA, 15 bp, Homo sapiens
ggtttttttaagttt

SEQ ID NO: 451994 - DNA, 15 bp, Homo sapiens
tttttttaagttttc

SEQ ID NO: 451995 - DNA, 15 bp, Homo sapiens
ttttttaagttttct

SEQ ID NO: 451996 - DNA, 15 bp, Homo sapiens
tttttaagttttctc

SEQ ID NO: 451997 - DNA, 15 bp, Homo sapiens
ttttaagttttctct

SEQ ID NO: 451998 - DNA, 15 bp, Homo sapiens
tttaagttttctctt

SEQ ID NO: 451999 - DNA, 15 bp, Homo sapiens
ttaagttttctcttt

SEQ ID NO: 452000 - DNA, 15 bp, Homo sapiens
taagttttctctttg

SEQ ID NO: 452001 - DNA, 15 bp, Homo sapiens
aagttttctctttgg

SEQ ID NO: 452002 - DNA, 15 bp, Homo sapiens
agttttctctttggg

SEQ ID NO: 452003 - DNA, 15 bp, Homo sapiens
gttttctctttgggt

SEQ ID NO: 452004 - DNA, 15 bp, Homo sapiens
ttttctctttgggta

SEQ ID NO: 452005 - DNA, 15 bp, Homo sapiens
tttctctttgggtag

SEQ ID NO: 452006 - DNA, 15 bp, Homo sapiens
ttctctttgggtagc

SEQ ID NO: 452007 - DNA, 15 bp, Homo sapiens
tctctttgggtagct

SEQ ID NO: 452008 - DNA, 15 bp, Homo sapiens
ctctttgggtagcta

SEQ ID NO: 452009 - DNA, 15 bp, Homo sapiens
tctttgggtagctaa

SEQ ID NO: 452010 - DNA, 15 bp, Homo sapiens
ctttgggtagctaag

SEQ ID NO: 452011 - DNA, 15 bp, Homo sapiens
tttgggtagctaagg

SEQ ID NO: 452012 - DNA, 15 bp, Homo sapiens
ttgggtagctaagga

SEQ ID NO: 452013 - DNA, 15 bp, Homo sapiens
tgggtagctaaggag

SEQ ID NO: 452014 - DNA, 15 bp, Homo sapiens
gggtagctaaggaga

SEQ ID NO: 452015 - DNA, 15 bp, Homo sapiens
ggtagctaaggagat

SEQ ID NO: 452016 - DNA, 15 bp, Homo sapiens
gtagctaaggagatg

SEQ ID NO: 452017 - DNA, 15 bp, Homo sapiens
tagctaaggagatgc

SEQ ID NO: 452018 - DNA, 15 bp, Homo sapiens
agctaaggagatgct

SEQ ID NO: 452019 - DNA, 15 bp, Homo sapiens
gctaaggagatgctg

SEQ ID NO: 452020 - DNA, 15 bp, Homo sapiens
ctaaggagatgctgg

SEQ ID NO: 452021 - DNA, 15 bp, Homo sapiens
taaggagatgctgga

SEQ ID NO: 452022 - DNA, 15 bp, Homo sapiens
aaggagatgctggag

SEQ ID NO: 452023 - DNA, 15 bp, Homo sapiens
aggagatgctggagg

SEQ ID NO: 452024 - DNA, 15 bp, Homo sapiens
ggagatgctggaggg

SEQ ID NO: 452025 - DNA, 15 bp, Homo sapiens
gagatgctggaggga

SEQ ID NO: 452026 - DNA, 15 bp, Homo sapiens
agatgctggagggaa

SEQ ID NO: 452027 - DNA, 15 bp, Homo sapiens
gatgctggagggaaa

SEQ ID NO: 452028 - DNA, 15 bp, Homo sapiens
atgctggagggaaaa

SEQ ID NO: 452029 - DNA, 15 bp, Homo sapiens
tgctggagggaaaaa

SEQ ID NO: 452030 - DNA, 15 bp, Homo sapiens
gctggagggaaaaac

SEQ ID NO: 452031 - DNA, 15 bp, Homo sapiens
ctggagggaaaaaca

SEQ ID NO: 452032 - DNA, 15 bp, Homo sapiens
tggagggaaaaacag

SEQ ID NO: 452033 - DNA, 15 bp, Homo sapiens
ggagggaaaaacagc

SEQ ID NO: 452034 - DNA, 15 bp, Homo sapiens
gagggaaaaacagca

SEQ ID NO: 452035 - DNA, 15 bp, Homo sapiens
agggaaaaacagcac

SEQ ID NO: 452036 - DNA, 15 bp, Homo sapiens
gggaaaaacagcacc

SEQ ID NO: 452037 - DNA, 15 bp, Homo sapiens
ggaaaaacagcaccc

SEQ ID NO: 452038 - DNA, 15 bp, Homo sapiens
gaaaaacagcacccg

SEQ ID NO: 452039 - DNA, 15 bp, Homo sapiens
aaaaacagcacccga

SEQ ID NO: 452040 - DNA, 15 bp, Homo sapiens
aaaacagcacccgaa

SEQ ID NO: 452041 - DNA, 15 bp, Homo sapiens
aaacagcacccgaag

SEQ ID NO: 452042 - DNA, 15 bp, Homo sapiens
aacagcacccgaagc

SEQ ID NO: 452043 - DNA, 15 bp, Homo sapiens
acagcacccgaagcc

SEQ ID NO: 452044 - DNA, 15 bp, Homo sapiens
cagcacccgaagcct

SEQ ID NO: 452045 - DNA, 15 bp, Homo sapiens
agcacccgaagcctc

SEQ ID NO: 452046 - DNA, 15 bp, Homo sapiens
gcacccgaagcctcc

SEQ ID NO: 452047 - DNA, 15 bp, Homo sapiens
cacccgaagcctccc

SEQ ID NO: 452048 - DNA, 15 bp, Homo sapiens
acccgaagcctccct

SEQ ID NO: 452049 - DNA, 15 bp, Homo sapiens
cccgaagcctccctc

SEQ ID NO: 452050 - DNA, 15 bp, Homo sapiens
ccgaagcctccctct

SEQ ID NO: 452051 - DNA, 15 bp, Homo sapiens
cgaagcctccctctc

SEQ ID NO: 452052 - DNA, 15 bp, Homo sapiens
gaagcctccctctcc

SEQ ID NO: 452053 - DNA, 15 bp, Homo sapiens
aagcctccctctccc

SEQ ID NO: 452054 - DNA, 15 bp, Homo sapiens
agcctccctctccca

SEQ ID NO: 452055 - DNA, 15 bp, Homo sapiens
gcctccctctcccat

SEQ ID NO: 452056 - DNA, 15 bp, Homo sapiens
cctccctctcccatt

SEQ ID NO: 452057 - DNA, 15 bp, Homo sapiens
ctccctctcccattt

SEQ ID NO: 452058 - DNA, 15 bp, Homo sapiens
tccctctcccatttc

SEQ ID NO: 452059 - DNA, 15 bp, Homo sapiens
ccctctcccatttca

SEQ ID NO: 452060 - DNA, 15 bp, Homo sapiens
cctctcccatttcaa

SEQ ID NO: 452061 - DNA, 15 bp, Homo sapiens
ctctcccatttcaat

SEQ ID NO: 452062 - DNA, 15 bp, Homo sapiens
tctcccatttcaata

SEQ ID NO: 452063 - DNA, 15 bp, Homo sapiens
ctcccatttcaataa

SEQ ID NO: 452064 - DNA, 15 bp, Homo sapiens
tcccatttcaataaa

SEQ ID NO: 452065 - DNA, 15 bp, Homo sapiens
cccatttcaataaaa

SEQ ID NO: 452066 - DNA, 15 bp, Homo sapiens
ccatttcaataaaaa

SEQ ID NO: 452067 - DNA, 15 bp, Homo sapiens
catttcaataaaaag

SEQ ID NO: 452068 - DNA, 15 bp, Homo sapiens
atttcaataaaaagg

SEQ ID NO: 452069 - DNA, 15 bp, Homo sapiens
tttcaataaaaagga

SEQ ID NO: 452070 - DNA, 15 bp, Homo sapiens
ttcaataaaaaggat

SEQ ID NO: 452071 - DNA, 15 bp, Homo sapiens
tcaataaaaaggatg

SEQ ID NO: 452072 - DNA, 15 bp, Homo sapiens
caataaaaaggatgc

SEQ ID NO: 452073 - DNA, 15 bp, Homo sapiens
aataaaaaggatgcc

SEQ ID NO: 452074 - DNA, 15 bp, Homo sapiens
ataaaaaggatgccc

SEQ ID NO: 452075 - DNA, 15 bp, Homo sapiens
taaaaaggatgcccc

SEQ ID NO: 452076 - DNA, 15 bp, Homo sapiens
aaaaaggatgccccc

SEQ ID NO: 452077 - DNA, 15 bp, Homo sapiens
aaaaggatgccccct

SEQ ID NO: 452078 - DNA, 15 bp, Homo sapiens
aaaggatgccccctt

SEQ ID NO: 452079 - DNA, 15 bp, Homo sapiens
aaggatgcccccttt

SEQ ID NO: 452080 - DNA, 15 bp, Homo sapiens
aggatgccccctttt

SEQ ID NO: 452081 - DNA, 15 bp, Homo sapiens
ggatgcccccttttt

SEQ ID NO: 452082 - DNA, 15 bp, Homo sapiens
gatgccccctttttt

SEQ ID NO: 452083 - DNA, 15 bp, Homo sapiens
atgccccctttttta

SEQ ID NO: 452084 - DNA, 15 bp, Homo sapiens
tgcccccttttttaa

SEQ ID NO: 452085 - DNA, 15 bp, Homo sapiens
gcccccttttttaat

SEQ ID NO: 452086 - DNA, 15 bp, Homo sapiens
cccccttttttaatc

SEQ ID NO: 452087 - DNA, 15 bp, Homo sapiens
ccccttttttaatct

SEQ ID NO: 452088 - DNA, 15 bp, Homo sapiens
cccttttttaatctc

SEQ ID NO: 452089 - DNA, 15 bp, Homo sapiens
ccttttttaatctct

SEQ ID NO: 452090 - DNA, 15 bp, Homo sapiens
cttttttaatctctt

SEQ ID NO: 452091 - DNA, 15 bp, Homo sapiens
ttttttaatctcttt

SEQ ID NO: 452092 - DNA, 15 bp, Homo sapiens
tttttaatctcttta

SEQ ID NO: 452093 - DNA, 15 bp, Homo sapiens
ttttaatctctttaa

SEQ ID NO: 452094 - DNA, 15 bp, Homo sapiens
tttaatctctttaaa

SEQ ID NO: 452095 - DNA, 15 bp, Homo sapiens
ttaatctctttaaat

SEQ ID NO: 452096 - DNA, 15 bp, Homo sapiens
taatctctttaaatg

SEQ ID NO: 452097 - DNA, 15 bp, Homo sapiens
aatctctttaaatgt

SEQ ID NO: 452098 - DNA, 15 bp, Homo sapiens
atctctttaaatgtt

SEQ ID NO: 452099 - DNA, 15 bp, Homo sapiens
tctctttaaatgttg

SEQ ID NO: 452100 - DNA, 15 bp, Homo sapiens
ctctttaaatgttgg

SEQ ID NO: 452101 - DNA, 15 bp, Homo sapiens
tctttaaatgttggg

SEQ ID NO: 452102 - DNA, 15 bp, Homo sapiens
ctttaaatgttgggc

SEQ ID NO: 452103 - DNA, 15 bp, Homo sapiens
tttaaatgttgggct

SEQ ID NO: 452104 - DNA, 15 bp, Homo sapiens
ttaaatgttgggctt

SEQ ID NO: 452105 - DNA, 15 bp, Homo sapiens
taaatgttgggcttc

SEQ ID NO: 452106 - DNA, 15 bp, Homo sapiens
aaatgttgggcttct

SEQ ID NO: 452107 - DNA, 15 bp, Homo sapiens
aatgttgggcttctg

SEQ ID NO: 452108 - DNA, 15 bp, Homo sapiens
atgttgggcttctgt

SEQ ID NO: 452109 - DNA, 15 bp, Homo sapiens
tgttgggcttctgtg

SEQ ID NO: 452110 - DNA, 15 bp, Homo sapiens
gttgggcttctgtgt

SEQ ID NO: 452111 - DNA, 15 bp, Homo sapiens
ttgggcttctgtgtg

SEQ ID NO: 452112 - DNA, 15 bp, Homo sapiens
tgggcttctgtgtga

SEQ ID NO: 452113 - DNA, 15 bp, Homo sapiens
gggcttctgtgtgag

SEQ ID NO: 452114 - DNA, 15 bp, Homo sapiens
ggcttctgtgtgagt

SEQ ID NO: 452115 - DNA, 15 bp, Homo sapiens
gcttctgtgtgagtg

SEQ ID NO: 452116 - DNA, 15 bp, Homo sapiens
cttctgtgtgagtgt

SEQ ID NO: 452117 - DNA, 15 bp, Homo sapiens
ttctgtgtgagtgtt

SEQ ID NO: 452118 - DNA, 15 bp, Homo sapiens
tctgtgtgagtgttt

SEQ ID NO: 452119 - DNA, 15 bp, Homo sapiens
ctgtgtgagtgtttt

SEQ ID NO: 452120 - DNA, 15 bp, Homo sapiens
tgtgtgagtgttttt

SEQ ID NO: 452121 - DNA, 15 bp, Homo sapiens
gtgtgagtgtttttt

SEQ ID NO: 452122 - DNA, 15 bp, Homo sapiens
tgtgagtgttttttt

SEQ ID NO: 452123 - DNA, 15 bp, Homo sapiens
gtgagtgtttttttt

SEQ ID NO: 452124 - DNA, 15 bp, Homo sapiens
tgagtgttttttttt

SEQ ID NO: 452125 - DNA, 15 bp, Homo sapiens
gagtgtttttttttt

SEQ ID NO: 452126 - DNA, 15 bp, Homo sapiens
agtgttttttttttt

SEQ ID NO: 452127 - DNA, 15 bp, Homo sapiens
gtgtttttttttttg

SEQ ID NO: 452128 - DNA, 15 bp, Homo sapiens
tgtttttttttttgg

SEQ ID NO: 452129 - DNA, 15 bp, Homo sapiens
gtttttttttttggt

SEQ ID NO: 452130 - DNA, 15 bp, Homo sapiens
tttttttttttggtg

SEQ ID NO: 452131 - DNA, 15 bp, Homo sapiens
ttttttttttggtgg

SEQ ID NO: 452132 - DNA, 15 bp, Homo sapiens
tttttttttggtggg

SEQ ID NO: 452133 - DNA, 15 bp, Homo sapiens
ttttttttggtgggt

SEQ ID NO: 452134 - DNA, 15 bp, Homo sapiens
tttttttggtgggtg

SEQ ID NO: 452135 - DNA, 15 bp, Homo sapiens
ttttttggtgggtga

SEQ ID NO: 452136 - DNA, 15 bp, Homo sapiens
tttttggtgggtgaa

SEQ ID NO: 452137 - DNA, 15 bp, Homo sapiens
ttttggtgggtgaag

SEQ ID NO: 452138 - DNA, 15 bp, Homo sapiens
tttggtgggtgaagg

SEQ ID NO: 452139 - DNA, 15 bp, Homo sapiens
ttggtgggtgaaggg

SEQ ID NO: 452140 - DNA, 15 bp, Homo sapiens
tggtgggtgaagggg

SEQ ID NO: 452141 - DNA, 15 bp, Homo sapiens
ggtgggtgaaggggc

SEQ ID NO: 452142 - DNA, 15 bp, Homo sapiens
gtgggtgaaggggcc

SEQ ID NO: 452143 - DNA, 15 bp, Homo sapiens
tgggtgaaggggcct

SEQ ID NO: 452144 - DNA, 15 bp, Homo sapiens
gggtgaaggggcctg

SEQ ID NO: 452145 - DNA, 15 bp, Homo sapiens
ggtgaaggggcctgc

SEQ ID NO: 452146 - DNA, 15 bp, Homo sapiens
gtgaaggggcctgca

SEQ ID NO: 452147 - DNA, 15 bp, Homo sapiens
tgaaggggcctgcaa

SEQ ID NO: 452148 - DNA, 15 bp, Homo sapiens
gaaggggcctgcaaa

SEQ ID NO: 452149 - DNA, 15 bp, Homo sapiens
aaggggcctgcaaaa

SEQ ID NO: 452150 - DNA, 15 bp, Homo sapiens
aggggcctgcaaaag

SEQ ID NO: 452151 - DNA, 15 bp, Homo sapiens
ggggcctgcaaaagt

SEQ ID NO: 452152 - DNA, 15 bp, Homo sapiens
gggcctgcaaaagtt

SEQ ID NO: 452153 - DNA, 15 bp, Homo sapiens
ggcctgcaaaagttg

SEQ ID NO: 452154 - DNA, 15 bp, Homo sapiens
gcctgcaaaagttgg

SEQ ID NO: 452155 - DNA, 15 bp, Homo sapiens
cctgcaaaagttgga

SEQ ID NO: 452156 - DNA, 15 bp, Homo sapiens
ctgcaaaagttggac

SEQ ID NO: 452157 - DNA, 15 bp, Homo sapiens
tgcaaaagttggaca

SEQ ID NO: 452158 - DNA, 15 bp, Homo sapiens
gcaaaagttggacaa

SEQ ID NO: 452159 - DNA, 15 bp, Homo sapiens
caaaagttggacaaa

SEQ ID NO: 452160 - DNA, 15 bp, Homo sapiens
aaaagttggacaaac

SEQ ID NO: 452161 - DNA, 15 bp, Homo sapiens
aaagttggacaaaca

SEQ ID NO: 452162 - DNA, 15 bp, Homo sapiens
aagttggacaaacaa

SEQ ID NO: 452163 - DNA, 15 bp, Homo sapiens
agttggacaaacaaa

SEQ ID NO: 452164 - DNA, 15 bp, Homo sapiens
gttggacaaacaaaa

SEQ ID NO: 452165 - DNA, 15 bp, Homo sapiens
ttggacaaacaaaag

SEQ ID NO: 452166 - DNA, 15 bp, Homo sapiens
tggacaaacaaaaga

SEQ ID NO: 452167 - DNA, 15 bp, Homo sapiens
ggacaaacaaaagac

SEQ ID NO: 452168 - DNA, 15 bp, Homo sapiens
gacaaacaaaagaca

SEQ ID NO: 452169 - DNA, 15 bp, Homo sapiens
acaaacaaaagacat

SEQ ID NO: 452170 - DNA, 15 bp, Homo sapiens
caaacaaaagacata

SEQ ID NO: 452171 - DNA, 15 bp, Homo sapiens
aaacaaaagacatag

SEQ ID NO: 452172 - DNA, 15 bp, Homo sapiens
aacaaaagacataga

SEQ ID NO: 452173 - DNA, 15 bp, Homo sapiens
acaaaagacatagaa

SEQ ID NO: 452174 - DNA, 15 bp, Homo sapiens
caaaagacatagaac

SEQ ID NO: 452175 - DNA, 15 bp, Homo sapiens
aaaagacatagaact

SEQ ID NO: 452176 - DNA, 15 bp, Homo sapiens
aaagacatagaactg

SEQ ID NO: 452177 - DNA, 15 bp, Homo sapiens
aagacatagaactgg

SEQ ID NO: 452178 - DNA, 15 bp, Homo sapiens
agacatagaactggt

SEQ ID NO: 452179 - DNA, 15 bp, Homo sapiens
gacatagaactggtt

SEQ ID NO: 452180 - DNA, 15 bp, Homo sapiens
acatagaactggttt

SEQ ID NO: 452181 - DNA, 15 bp, Homo sapiens
catagaactggtttg

SEQ ID NO: 452182 - DNA, 15 bp, Homo sapiens
atagaactggtttgc

SEQ ID NO: 452183 - DNA, 15 bp, Homo sapiens
tagaactggtttgct

SEQ ID NO: 452184 - DNA, 15 bp, Homo sapiens
agaactggtttgctt

SEQ ID NO: 452185 - DNA, 15 bp, Homo sapiens
gaactggtttgctta

SEQ ID NO: 452186 - DNA, 15 bp, Homo sapiens
aactggtttgcttag

SEQ ID NO: 452187 - DNA, 15 bp, Homo sapiens
actggtttgcttagt

SEQ ID NO: 452188 - DNA, 15 bp, Homo sapiens
ctggtttgcttagtt

SEQ ID NO: 452189 - DNA, 15 bp, Homo sapiens
tggtttgcttagttt

SEQ ID NO: 452190 - DNA, 15 bp, Homo sapiens
ggtttgcttagtttg

SEQ ID NO: 452191 - DNA, 15 bp, Homo sapiens
gtttgcttagtttgt

SEQ ID NO: 452192 - DNA, 15 bp, Homo sapiens
tttgcttagtttgta

SEQ ID NO: 452193 - DNA, 15 bp, Homo sapiens
ttgcttagtttgtaa

SEQ ID NO: 452194 - DNA, 15 bp, Homo sapiens
tgcttagtttgtaaa

SEQ ID NO: 452195 - DNA, 15 bp, Homo sapiens
gcttagtttgtaaaa

SEQ ID NO: 452196 - DNA, 15 bp, Homo sapiens
cttagtttgtaaaat

SEQ ID NO: 452197 - DNA, 15 bp, Homo sapiens
ttagtttgtaaaatg

SEQ ID NO: 452198 - DNA, 15 bp, Homo sapiens
tagtttgtaaaatga

SEQ ID NO: 452199 - DNA, 15 bp, Homo sapiens
agtttgtaaaatgag

SEQ ID NO: 452200 - DNA, 15 bp, Homo sapiens
gtttgtaaaatgagg

SEQ ID NO: 452201 - DNA, 15 bp, Homo sapiens
tttgtaaaatgaggg

SEQ ID NO: 452202 - DNA, 15 bp, Homo sapiens
ttgtaaaatgagggg

SEQ ID NO: 452203 - DNA, 15 bp, Homo sapiens
tgtaaaatgaggggg

SEQ ID NO: 452204 - DNA, 15 bp, Homo sapiens
gtaaaatgagggggc

SEQ ID NO: 452205 - DNA, 15 bp, Homo sapiens
taaaatgagggggca

SEQ ID NO: 452206 - DNA, 15 bp, Homo sapiens
aaaatgagggggcaa

SEQ ID NO: 452207 - DNA, 15 bp, Homo sapiens
aaatgagggggcaaa

SEQ ID NO: 452208 - DNA, 15 bp, Homo sapiens
aatgagggggcaaat

SEQ ID NO: 452209 - DNA, 15 bp, Homo sapiens
atgagggggcaaatt

SEQ ID NO: 452210 - DNA, 15 bp, Homo sapiens
tgagggggcaaattt

SEQ ID NO: 452211 - DNA, 15 bp, Homo sapiens
gagggggcaaatttt

SEQ ID NO: 452212 - DNA, 15 bp, Homo sapiens
agggggcaaattttg

SEQ ID NO: 452213 - DNA, 15 bp, Homo sapiens
gggggcaaattttga

SEQ ID NO: 452214 - DNA, 15 bp, Homo sapiens
ggggcaaattttgat

SEQ ID NO: 452215 - DNA, 15 bp, Homo sapiens
gggcaaattttgatg

SEQ ID NO: 452216 - DNA, 15 bp, Homo sapiens
ggcaaattttgatga

SEQ ID NO: 452217 - DNA, 15 bp, Homo sapiens
gcaaattttgatgat

SEQ ID NO: 452218 - DNA, 15 bp, Homo sapiens
caaattttgatgata

SEQ ID NO: 452219 - DNA, 15 bp, Homo sapiens
aaattttgatgatat

SEQ ID NO: 452220 - DNA, 15 bp, Homo sapiens
aattttgatgatatc

SEQ ID NO: 452221 - DNA, 15 bp, Homo sapiens
attttgatgatatct

SEQ ID NO: 452222 - DNA, 15 bp, Homo sapiens
ttttgatgatatctg

SEQ ID NO: 452223 - DNA, 15 bp, Homo sapiens
tttgatgatatctga

SEQ ID NO: 452224 - DNA, 15 bp, Homo sapiens
ttgatgatatctgag

SEQ ID NO: 452225 - DNA, 15 bp, Homo sapiens
tgatgatatctgagt

SEQ ID NO: 452226 - DNA, 15 bp, Homo sapiens
gatgatatctgagtt

SEQ ID NO: 452227 - DNA, 15 bp, Homo sapiens
atgatatctgagttt

SEQ ID NO: 452228 - DNA, 15 bp, Homo sapiens
tgatatctgagtttt

SEQ ID NO: 452229 - DNA, 15 bp, Homo sapiens
gatatctgagttttc

SEQ ID NO: 452230 - DNA, 15 bp, Homo sapiens
atatctgagttttct

SEQ ID NO: 452231 - DNA, 15 bp, Homo sapiens
tatctgagttttctt

SEQ ID NO: 452232 - DNA, 15 bp, Homo sapiens
atctgagttttcttt

SEQ ID NO: 452233 - DNA, 15 bp, Homo sapiens
tctgagttttctttt

SEQ ID NO: 452234 - DNA, 15 bp, Homo sapiens
ctgagttttctttta

SEQ ID NO: 452235 - DNA, 15 bp, Homo sapiens
tgagttttcttttaa

SEQ ID NO: 452236 - DNA, 15 bp, Homo sapiens
gagttttcttttaac

SEQ ID NO: 452237 - DNA, 15 bp, Homo sapiens
agttttcttttaact

SEQ ID NO: 452238 - DNA, 15 bp, Homo sapiens
gttttcttttaactc

SEQ ID NO: 452239 - DNA, 15 bp, Homo sapiens
ttttcttttaactct

SEQ ID NO: 452240 - DNA, 15 bp, Homo sapiens
tttcttttaactcta

SEQ ID NO: 452241 - DNA, 15 bp, Homo sapiens
ttcttttaactctac

SEQ ID NO: 452242 - DNA, 15 bp, Homo sapiens
tcttttaactctact

SEQ ID NO: 452243 - DNA, 15 bp, Homo sapiens
cttttaactctacta

SEQ ID NO: 452244 - DNA, 15 bp, Homo sapiens
ttttaactctactaa

SEQ ID NO: 452245 - DNA, 15 bp, Homo sapiens
tttaactctactaat

SEQ ID NO: 452246 - DNA, 15 bp, Homo sapiens
ttaactctactaatc

SEQ ID NO: 452247 - DNA, 15 bp, Homo sapiens
taactctactaatct

SEQ ID NO: 452248 - DNA, 15 bp, Homo sapiens
aactctactaatctc

SEQ ID NO: 452249 - DNA, 15 bp, Homo sapiens
actctactaatctct

SEQ ID NO: 452250 - DNA, 15 bp, Homo sapiens
ctctactaatctctg

SEQ ID NO: 452251 - DNA, 15 bp, Homo sapiens
tctactaatctctga

SEQ ID NO: 452252 - DNA, 15 bp, Homo sapiens
ctactaatctctgat

SEQ ID NO: 452253 - DNA, 15 bp, Homo sapiens
tactaatctctgata

SEQ ID NO: 452254 - DNA, 15 bp, Homo sapiens
actaatctctgatac

SEQ ID NO: 452255 - DNA, 15 bp, Homo sapiens
ctaatctctgatact

SEQ ID NO: 452256 - DNA, 15 bp, Homo sapiens
taatctctgatactc

SEQ ID NO: 452257 - DNA, 15 bp, Homo sapiens
aatctctgatactct

SEQ ID NO: 452258 - DNA, 15 bp, Homo sapiens
atctctgatactctg

SEQ ID NO: 452259 - DNA, 15 bp, Homo sapiens
tctctgatactctgt

SEQ ID NO: 452260 - DNA, 15 bp, Homo sapiens
ctctgatactctgtc

SEQ ID NO: 452261 - DNA, 15 bp, Homo sapiens
tctgatactctgtct

SEQ ID NO: 452262 - DNA, 15 bp, Homo sapiens
ctgatactctgtctt

SEQ ID NO: 452263 - DNA, 15 bp, Homo sapiens
tgatactctgtcttt

SEQ ID NO: 452264 - DNA, 15 bp, Homo sapiens
gatactctgtcttta

SEQ ID NO: 452265 - DNA, 15 bp, Homo sapiens
atactctgtctttag

SEQ ID NO: 452266 - DNA, 15 bp, Homo sapiens
tactctgtctttagg

SEQ ID NO: 452267 - DNA, 15 bp, Homo sapiens
actctgtctttaggg

SEQ ID NO: 452268 - DNA, 15 bp, Homo sapiens
ctctgtctttagggg

SEQ ID NO: 452269 - DNA, 15 bp, Homo sapiens
tctgtctttagggga

SEQ ID NO: 452270 - DNA, 15 bp, Homo sapiens
ctgtctttaggggac

SEQ ID NO: 452271 - DNA, 15 bp, Homo sapiens
tgtctttaggggaca

SEQ ID NO: 452272 - DNA, 15 bp, Homo sapiens
gtctttaggggacaa

SEQ ID NO: 452273 - DNA, 15 bp, Homo sapiens
tctttaggggacaaa

SEQ ID NO: 452274 - DNA, 15 bp, Homo sapiens
ctttaggggacaaag

SEQ ID NO: 452275 - DNA, 15 bp, Homo sapiens
tttaggggacaaaga

SEQ ID NO: 452276 - DNA, 15 bp, Homo sapiens
ttaggggacaaagaa

SEQ ID NO: 452277 - DNA, 15 bp, Homo sapiens
taggggacaaagaaa

SEQ ID NO: 452278 - DNA, 15 bp, Homo sapiens
aggggacaaagaaag

SEQ ID NO: 452279 - DNA, 15 bp, Homo sapiens
ggggacaaagaaaga

SEQ ID NO: 452280 - DNA, 15 bp, Homo sapiens
gggacaaagaaagaa

SEQ ID NO: 452281 - DNA, 15 bp, Homo sapiens
ggacaaagaaagaaa

SEQ ID NO: 452282 - DNA, 15 bp, Homo sapiens
gacaaagaaagaaat

SEQ ID NO: 452283 - DNA, 15 bp, Homo sapiens
acaaagaaagaaatt

SEQ ID NO: 452284 - DNA, 15 bp, Homo sapiens
caaagaaagaaatta

SEQ ID NO: 452285 - DNA, 15 bp, Homo sapiens
aaagaaagaaattac

SEQ ID NO: 452286 - DNA, 15 bp, Homo sapiens
aagaaagaaattaca

SEQ ID NO: 452287 - DNA, 15 bp, Homo sapiens
agaaagaaattacaa

SEQ ID NO: 452288 - DNA, 15 bp, Homo sapiens
gaaagaaattacaat

SEQ ID NO: 452289 - DNA, 15 bp, Homo sapiens
aaagaaattacaata

SEQ ID NO: 452290 - DNA, 15 bp, Homo sapiens
aagaaattacaatat

SEQ ID NO: 452291 - DNA, 15 bp, Homo sapiens
agaaattacaatatc

SEQ ID NO: 452292 - DNA, 15 bp, Homo sapiens
gaaattacaatatct

SEQ ID NO: 452293 - DNA, 15 bp, Homo sapiens
aaattacaatatcta

SEQ ID NO: 452294 - DNA, 15 bp, Homo sapiens
aattacaatatctat

SEQ ID NO: 452295 - DNA, 15 bp, Homo sapiens
attacaatatctatt

SEQ ID NO: 452296 - DNA, 15 bp, Homo sapiens
ttacaatatctattg

SEQ ID NO: 452297 - DNA, 15 bp, Homo sapiens
tacaatatctattgt

SEQ ID NO: 452298 - DNA, 15 bp, Homo sapiens
acaatatctattgtt

SEQ ID NO: 452299 - DNA, 15 bp, Homo sapiens
caatatctattgttt

SEQ ID NO: 452300 - DNA, 15 bp, Homo sapiens
aatatctattgtttc

SEQ ID NO: 452301 - DNA, 15 bp, Homo sapiens
atatctattgtttcc

SEQ ID NO: 452302 - DNA, 15 bp, Homo sapiens
tatctattgtttcca

SEQ ID NO: 452303 - DNA, 15 bp, Homo sapiens
atctattgtttccaa

SEQ ID NO: 452304 - DNA, 15 bp, Homo sapiens
tctattgtttccaaa

SEQ ID NO: 452305 - DNA, 15 bp, Homo sapiens
ctattgtttccaaag

SEQ ID NO: 452306 - DNA, 15 bp, Homo sapiens
tattgtttccaaaga

SEQ ID NO: 452307 - DNA, 15 bp, Homo sapiens
attgtttccaaagag

SEQ ID NO: 452308 - DNA, 15 bp, Homo sapiens
ttgtttccaaagagt

SEQ ID NO: 452309 - DNA, 15 bp, Homo sapiens
tgtttccaaagagtt

SEQ ID NO: 452310 - DNA, 15 bp, Homo sapiens
gtttccaaagagttg

SEQ ID NO: 452311 - DNA, 15 bp, Homo sapiens
tttccaaagagttga

SEQ ID NO: 452312 - DNA, 15 bp, Homo sapiens
ttccaaagagttgag

SEQ ID NO: 452313 - DNA, 15 bp, Homo sapiens
tccaaagagttgagt

SEQ ID NO: 452314 - DNA, 15 bp, Homo sapiens
ccaaagagttgagta

SEQ ID NO: 452315 - DNA, 15 bp, Homo sapiens
caaagagttgagtat

SEQ ID NO: 452316 - DNA, 15 bp, Homo sapiens
aaagagttgagtatt

SEQ ID NO: 452317 - DNA, 15 bp, Homo sapiens
aagagttgagtattg

SEQ ID NO: 452318 - DNA, 15 bp, Homo sapiens
agagttgagtattgg

SEQ ID NO: 452319 - DNA, 15 bp, Homo sapiens
gagttgagtattggt

SEQ ID NO: 452320 - DNA, 15 bp, Homo sapiens
agttgagtattggtt

SEQ ID NO: 452321 - DNA, 15 bp, Homo sapiens
gttgagtattggttg

SEQ ID NO: 452322 - DNA, 15 bp, Homo sapiens
ttgagtattggttgt

SEQ ID NO: 452323 - DNA, 15 bp, Homo sapiens
tgagtattggttgta

SEQ ID NO: 452324 - DNA, 15 bp, Homo sapiens
gagtattggttgtag

SEQ ID NO: 452325 - DNA, 15 bp, Homo sapiens
agtattggttgtagg

SEQ ID NO: 452326 - DNA, 15 bp, Homo sapiens
gtattggttgtagga

SEQ ID NO: 452327 - DNA, 15 bp, Homo sapiens
tattggttgtaggat

SEQ ID NO: 452328 - DNA, 15 bp, Homo sapiens
attggttgtaggatc

SEQ ID NO: 452329 - DNA, 15 bp, Homo sapiens
ttggttgtaggatca

SEQ ID NO: 452330 - DNA, 15 bp, Homo sapiens
tggttgtaggatcat

SEQ ID NO: 452331 - DNA, 15 bp, Homo sapiens
ggttgtaggatcatt

SEQ ID NO: 452332 - DNA, 15 bp, Homo sapiens
gttgtaggatcattt

SEQ ID NO: 452333 - DNA, 15 bp, Homo sapiens
ttgtaggatcatttg

SEQ ID NO: 452334 - DNA, 15 bp, Homo sapiens
tgtaggatcatttga

SEQ ID NO: 452335 - DNA, 15 bp, Homo sapiens
gtaggatcatttgaa

SEQ ID NO: 452336 - DNA, 15 bp, Homo sapiens
taggatcatttgaac

SEQ ID NO: 452337 - DNA, 15 bp, Homo sapiens
aggatcatttgaacc

SEQ ID NO: 452338 - DNA, 15 bp, Homo sapiens
ggatcatttgaacca

SEQ ID NO: 452339 - DNA, 15 bp, Homo sapiens
gatcatttgaaccag

SEQ ID NO: 452340 - DNA, 15 bp, Homo sapiens
atcatttgaaccaga

SEQ ID NO: 452341 - DNA, 15 bp, Homo sapiens
tcatttgaaccagat

SEQ ID NO: 452342 - DNA, 15 bp, Homo sapiens
catttgaaccagatc

SEQ ID NO: 452343 - DNA, 15 bp, Homo sapiens
atttgaaccagatct

SEQ ID NO: 452344 - DNA, 15 bp, Homo sapiens
tttgaaccagatctg

SEQ ID NO: 452345 - DNA, 15 bp, Homo sapiens
ttgaaccagatctgc

SEQ ID NO: 452346 - DNA, 15 bp, Homo sapiens
tgaaccagatctgca

SEQ ID NO: 452347 - DNA, 15 bp, Homo sapiens
gaaccagatctgcaa

SEQ ID NO: 452348 - DNA, 15 bp, Homo sapiens
aaccagatctgcaaa

SEQ ID NO: 452349 - DNA, 15 bp, Homo sapiens
accagatctgcaaaa

SEQ ID NO: 452350 - DNA, 15 bp, Homo sapiens
ccagatctgcaaaag

SEQ ID NO: 452351 - DNA, 15 bp, Homo sapiens
cagatctgcaaaagg

SEQ ID NO: 452352 - DNA, 15 bp, Homo sapiens
agatctgcaaaaggg

SEQ ID NO: 452353 - DNA, 15 bp, Homo sapiens
gatctgcaaaagggc

SEQ ID NO: 452354 - DNA, 15 bp, Homo sapiens
atctgcaaaagggca

SEQ ID NO: 452355 - DNA, 15 bp, Homo sapiens
tctgcaaaagggcag

SEQ ID NO: 452356 - DNA, 15 bp, Homo sapiens
ctgcaaaagggcagg

SEQ ID NO: 452357 - DNA, 15 bp, Homo sapiens
tgcaaaagggcagga

SEQ ID NO: 452358 - DNA, 15 bp, Homo sapiens
gcaaaagggcaggaa

SEQ ID NO: 452359 - DNA, 15 bp, Homo sapiens
caaaagggcaggaaa

SEQ ID NO: 452360 - DNA, 15 bp, Homo sapiens
aaaagggcaggaaaa

SEQ ID NO: 452361 - DNA, 15 bp, Homo sapiens
aaagggcaggaaaac

SEQ ID NO: 452362 - DNA, 15 bp, Homo sapiens
aagggcaggaaaacc

SEQ ID NO: 452363 - DNA, 15 bp, Homo sapiens
agggcaggaaaacca

SEQ ID NO: 452364 - DNA, 15 bp, Homo sapiens
gggcaggaaaaccaa

SEQ ID NO: 452365 - DNA, 15 bp, Homo sapiens
ggcaggaaaaccaaa

SEQ ID NO: 452366 - DNA, 15 bp, Homo sapiens
gcaggaaaaccaaat

SEQ ID NO: 452367 - DNA, 15 bp, Homo sapiens
caggaaaaccaaatc

SEQ ID NO: 452368 - DNA, 15 bp, Homo sapiens
aggaaaaccaaatca

SEQ ID NO: 452369 - DNA, 15 bp, Homo sapiens
ggaaaaccaaatcaa

SEQ ID NO: 452370 - DNA, 15 bp, Homo sapiens
gaaaaccaaatcaat

SEQ ID NO: 452371 - DNA, 15 bp, Homo sapiens
aaaaccaaatcaatc

SEQ ID NO: 452372 - DNA, 15 bp, Homo sapiens
aaaccaaatcaatca

SEQ ID NO: 452373 - DNA, 15 bp, Homo sapiens
aaccaaatcaatcag

SEQ ID NO: 452374 - DNA, 15 bp, Homo sapiens
accaaatcaatcagg

SEQ ID NO: 452375 - DNA, 15 bp, Homo sapiens
ccaaatcaatcagga

SEQ ID NO: 452376 - DNA, 15 bp, Homo sapiens
caaatcaatcaggat

SEQ ID NO: 452377 - DNA, 15 bp, Homo sapiens
aaatcaatcaggatg

SEQ ID NO: 452378 - DNA, 15 bp, Homo sapiens
aatcaatcaggatgg

SEQ ID NO: 452379 - DNA, 15 bp, Homo sapiens
atcaatcaggatggg

SEQ ID NO: 452380 - DNA, 15 bp, Homo sapiens
tcaatcaggatggga

SEQ ID NO: 452381 - DNA, 15 bp, Homo sapiens
caatcaggatgggag

SEQ ID NO: 452382 - DNA, 15 bp, Homo sapiens
aatcaggatgggagg

SEQ ID NO: 452383 - DNA, 15 bp, Homo sapiens
atcaggatgggagga

SEQ ID NO: 452384 - DNA, 15 bp, Homo sapiens
tcaggatgggaggag

SEQ ID NO: 452385 - DNA, 15 bp, Homo sapiens
caggatgggaggagc

SEQ ID NO: 452386 - DNA, 15 bp, Homo sapiens
aggatgggaggagca

SEQ ID NO: 452387 - DNA, 15 bp, Homo sapiens
ggatgggaggagcat

SEQ ID NO: 452388 - DNA, 15 bp, Homo sapiens
gatgggaggagcata

SEQ ID NO: 452389 - DNA, 15 bp, Homo sapiens
atgggaggagcatag

SEQ ID NO: 452390 - DNA, 15 bp, Homo sapiens
tgggaggagcataga

SEQ ID NO: 452391 - DNA, 15 bp, Homo sapiens
gggaggagcatagaa

SEQ ID NO: 452392 - DNA, 15 bp, Homo sapiens
ggaggagcatagaaa

SEQ ID NO: 452393 - DNA, 15 bp, Homo sapiens
gaggagcatagaaat

SEQ ID NO: 452394 - DNA, 15 bp, Homo sapiens
aggagcatagaaata

SEQ ID NO: 452395 - DNA, 15 bp, Homo sapiens
ggagcatagaaataa

SEQ ID NO: 452396 - DNA, 15 bp, Homo sapiens
gagcatagaaataag

SEQ ID NO: 452397 - DNA, 15 bp, Homo sapiens
agcatagaaataaga

SEQ ID NO: 452398 - DNA, 15 bp, Homo sapiens
gcatagaaataagat

SEQ ID NO: 452399 - DNA, 15 bp, Homo sapiens
catagaaataagatg

SEQ ID NO: 452400 - DNA, 15 bp, Homo sapiens
atagaaataagatga

SEQ ID NO: 452401 - DNA, 15 bp, Homo sapiens
tagaaataagatgag

SEQ ID NO: 452402 - DNA, 15 bp, Homo sapiens
agaaataagatgagc

SEQ ID NO: 452403 - DNA, 15 bp, Homo sapiens
gaaataagatgagct

SEQ ID NO: 452404 - DNA, 15 bp, Homo sapiens
aaataagatgagctc

SEQ ID NO: 452405 - DNA, 15 bp, Homo sapiens
aataagatgagctcc

SEQ ID NO: 452406 - DNA, 15 bp, Homo sapiens
ataagatgagctcca

SEQ ID NO: 452407 - DNA, 15 bp, Homo sapiens
taagatgagctccat

SEQ ID NO: 452408 - DNA, 15 bp, Homo sapiens
aagatgagctccatg

SEQ ID NO: 452409 - DNA, 15 bp, Homo sapiens
agatgagctccatga

SEQ ID NO: 452410 - DNA, 15 bp, Homo sapiens
gatgagctccatgaa

SEQ ID NO: 452411 - DNA, 15 bp, Homo sapiens
atgagctccatgaat

SEQ ID NO: 452412 - DNA, 15 bp, Homo sapiens
tgagctccatgaata

SEQ ID NO: 452413 - DNA, 15 bp, Homo sapiens
gagctccatgaatag

SEQ ID NO: 452414 - DNA, 15 bp, Homo sapiens
agctccatgaatagt

SEQ ID NO: 452415 - DNA, 15 bp, Homo sapiens
gctccatgaatagtg

SEQ ID NO: 452416 - DNA, 15 bp, Homo sapiens
ctccatgaatagtga

SEQ ID NO: 452417 - DNA, 15 bp, Homo sapiens
tccatgaatagtgaa

SEQ ID NO: 452418 - DNA, 15 bp, Homo sapiens
ccatgaatagtgaac

SEQ ID NO: 452419 - DNA, 15 bp, Homo sapiens
catgaatagtgaact

SEQ ID NO: 452420 - DNA, 15 bp, Homo sapiens
atgaatagtgaactg

SEQ ID NO: 452421 - DNA, 15 bp, Homo sapiens
tgaatagtgaactgg

SEQ ID NO: 452422 - DNA, 15 bp, Homo sapiens
gaatagtgaactgga

SEQ ID NO: 452423 - DNA, 15 bp, Homo sapiens
aatagtgaactggac

SEQ ID NO: 452424 - DNA, 15 bp, Homo sapiens
atagtgaactggaca

SEQ ID NO: 452425 - DNA, 15 bp, Homo sapiens
tagtgaactggacag

SEQ ID NO: 452426 - DNA, 15 bp, Homo sapiens
agtgaactggacagt

SEQ ID NO: 452427 - DNA, 15 bp, Homo sapiens
gtgaactggacagtg

SEQ ID NO: 452428 - DNA, 15 bp, Homo sapiens
tgaactggacagtgt

SEQ ID NO: 452429 - DNA, 15 bp, Homo sapiens
gaactggacagtgtg

SEQ ID NO: 452430 - DNA, 15 bp, Homo sapiens
aactggacagtgtgg

SEQ ID NO: 452431 - DNA, 15 bp, Homo sapiens
actggacagtgtggt

SEQ ID NO: 452432 - DNA, 15 bp, Homo sapiens
ctggacagtgtggtt

SEQ ID NO: 452433 - DNA, 15 bp, Homo sapiens
tggacagtgtggttg

SEQ ID NO: 452434 - DNA, 15 bp, Homo sapiens
ggacagtgtggttgg

SEQ ID NO: 452435 - DNA, 15 bp, Homo sapiens
gacagtgtggttgga

SEQ ID NO: 452436 - DNA, 15 bp, Homo sapiens
acagtgtggttggaa

SEQ ID NO: 452437 - DNA, 15 bp, Homo sapiens
cagtgtggttggaag

SEQ ID NO: 452438 - DNA, 15 bp, Homo sapiens
agtgtggttggaaga

SEQ ID NO: 452439 - DNA, 15 bp, Homo sapiens
gtgtggttggaagaa

SEQ ID NO: 452440 - DNA, 15 bp, Homo sapiens
tgtggttggaagaaa

SEQ ID NO: 452441 - DNA, 15 bp, Homo sapiens
gtggttggaagaaaa

SEQ ID NO: 452442 - DNA, 15 bp, Homo sapiens
tggttggaagaaaat

SEQ ID NO: 452443 - DNA, 15 bp, Homo sapiens
ggttggaagaaaatg

SEQ ID NO: 452444 - DNA, 15 bp, Homo sapiens
gttggaagaaaatga

SEQ ID NO: 452445 - DNA, 15 bp, Homo sapiens
ttggaagaaaatgaa

SEQ ID NO: 452446 - DNA, 15 bp, Homo sapiens
tggaagaaaatgaag

SEQ ID NO: 452447 - DNA, 15 bp, Homo sapiens
ggaagaaaatgaagt

SEQ ID NO: 452448 - DNA, 15 bp, Homo sapiens
gaagaaaatgaagtg

SEQ ID NO: 452449 - DNA, 15 bp, Homo sapiens
aagaaaatgaagtgt

SEQ ID NO: 452450 - DNA, 15 bp, Homo sapiens
agaaaatgaagtgtc

SEQ ID NO: 452451 - DNA, 15 bp, Homo sapiens
gaaaatgaagtgtcc

SEQ ID NO: 452452 - DNA, 15 bp, Homo sapiens
aaaatgaagtgtcct

SEQ ID NO: 452453 - DNA, 15 bp, Homo sapiens
aaatgaagtgtcctt

SEQ ID NO: 452454 - DNA, 15 bp, Homo sapiens
aatgaagtgtccttg

SEQ ID NO: 452455 - DNA, 15 bp, Homo sapiens
atgaagtgtccttgg

SEQ ID NO: 452456 - DNA, 15 bp, Homo sapiens
tgaagtgtccttggg

SEQ ID NO: 452457 - DNA, 15 bp, Homo sapiens
gaagtgtccttgggg

SEQ ID NO: 452458 - DNA, 15 bp, Homo sapiens
aagtgtccttgggga

SEQ ID NO: 452459 - DNA, 15 bp, Homo sapiens
agtgtccttggggaa

SEQ ID NO: 452460 - DNA, 15 bp, Homo sapiens
gtgtccttggggaag

SEQ ID NO: 452461 - DNA, 15 bp, Homo sapiens
tgtccttggggaaga

SEQ ID NO: 452462 - DNA, 15 bp, Homo sapiens
gtccttggggaagat

SEQ ID NO: 452463 - DNA, 15 bp, Homo sapiens
tccttggggaagatg

SEQ ID NO: 452464 - DNA, 15 bp, Homo sapiens
ccttggggaagatgc

SEQ ID NO: 452465 - DNA, 15 bp, Homo sapiens
cttggggaagatgcc

SEQ ID NO: 452466 - DNA, 15 bp, Homo sapiens
ttggggaagatgccc

SEQ ID NO: 452467 - DNA, 15 bp, Homo sapiens
tggggaagatgcccc

SEQ ID NO: 452468 - DNA, 15 bp, Homo sapiens
ggggaagatgcccct

SEQ ID NO: 452469 - DNA, 15 bp, Homo sapiens
gggaagatgcccctg

SEQ ID NO: 452470 - DNA, 15 bp, Homo sapiens
ggaagatgcccctgg

SEQ ID NO: 452471 - DNA, 15 bp, Homo sapiens
gaagatgcccctgga

SEQ ID NO: 452472 - DNA, 15 bp, Homo sapiens
aagatgcccctggag

SEQ ID NO: 452473 - DNA, 15 bp, Homo sapiens
agatgcccctggagg

SEQ ID NO: 452474 - DNA, 15 bp, Homo sapiens
gatgcccctggagga

SEQ ID NO: 452475 - DNA, 15 bp, Homo sapiens
atgcccctggaggaa

SEQ ID NO: 452476 - DNA, 15 bp, Homo sapiens
tgcccctggaggaaa

SEQ ID NO: 452477 - DNA, 15 bp, Homo sapiens
gcccctggaggaaaa

SEQ ID NO: 452478 - DNA, 15 bp, Homo sapiens
cccctggaggaaaat

SEQ ID NO: 452479 - DNA, 15 bp, Homo sapiens
ccctggaggaaaatc

SEQ ID NO: 452480 - DNA, 15 bp, Homo sapiens
cctggaggaaaatct

SEQ ID NO: 452481 - DNA, 15 bp, Homo sapiens
ctggaggaaaatctc

SEQ ID NO: 452482 - DNA, 15 bp, Homo sapiens
tggaggaaaatctcc

SEQ ID NO: 452483 - DNA, 15 bp, Homo sapiens
ggaggaaaatctcct

SEQ ID NO: 452484 - DNA, 15 bp, Homo sapiens
gaggaaaatctcctt

SEQ ID NO: 452485 - DNA, 15 bp, Homo sapiens
aggaaaatctccttt

SEQ ID NO: 452486 - DNA, 15 bp, Homo sapiens
ggaaaatctccttta

SEQ ID NO: 452487 - DNA, 15 bp, Homo sapiens
gaaaatctcctttat

SEQ ID NO: 452488 - DNA, 15 bp, Homo sapiens
aaaatctcctttatt

SEQ ID NO: 452489 - DNA, 15 bp, Homo sapiens
aaatctcctttattg

SEQ ID NO: 452490 - DNA, 15 bp, Homo sapiens
aatctcctttattgg

SEQ ID NO: 452491 - DNA, 15 bp, Homo sapiens
atctcctttattggg

SEQ ID NO: 452492 - DNA, 15 bp, Homo sapiens
tctcctttattggga

SEQ ID NO: 452493 - DNA, 15 bp, Homo sapiens
ctcctttattgggaa

SEQ ID NO: 452494 - DNA, 15 bp, Homo sapiens
tcctttattgggaaa

SEQ ID NO: 452495 - DNA, 15 bp, Homo sapiens
cctttattgggaaaa

SEQ ID NO: 452496 - DNA, 15 bp, Homo sapiens
ctttattgggaaaaa

SEQ ID NO: 452497 - DNA, 15 bp, Homo sapiens
tttattgggaaaaaa

SEQ ID NO: 452498 - DNA, 15 bp, Homo sapiens
ttattgggaaaaaaa

SEQ ID NO: 452499 - DNA, 15 bp, Homo sapiens
tattgggaaaaaaag

SEQ ID NO: 452500 - DNA, 15 bp, Homo sapiens
attgggaaaaaaagg

SEQ ID NO: 452501 - DNA, 15 bp, Homo sapiens
ttgggaaaaaaagga

SEQ ID NO: 452502 - DNA, 15 bp, Homo sapiens
tgggaaaaaaaggaa

SEQ ID NO: 452503 - DNA, 15 bp, Homo sapiens
gggaaaaaaaggaag

SEQ ID NO: 452504 - DNA, 15 bp, Homo sapiens
ggaaaaaaaggaagg

SEQ ID NO: 452505 - DNA, 15 bp, Homo sapiens
gaaaaaaaggaaggg

SEQ ID NO: 452506 - DNA, 15 bp, Homo sapiens
aaaaaaaggaagggc

SEQ ID NO: 452507 - DNA, 15 bp, Homo sapiens
aaaaaaggaagggcc

SEQ ID NO: 452508 - DNA, 15 bp, Homo sapiens
aaaaaggaagggccc

SEQ ID NO: 452509 - DNA, 15 bp, Homo sapiens
aaaaggaagggccct

SEQ ID NO: 452510 - DNA, 15 bp, Homo sapiens
aaaggaagggccctc

SEQ ID NO: 452511 - DNA, 15 bp, Homo sapiens
aaggaagggccctct

SEQ ID NO: 452512 - DNA, 15 bp, Homo sapiens
aggaagggccctctg

SEQ ID NO: 452513 - DNA, 15 bp, Homo sapiens
ggaagggccctctgc

SEQ ID NO: 452514 - DNA, 15 bp, Homo sapiens
gaagggccctctgcc

SEQ ID NO: 452515 - DNA, 15 bp, Homo sapiens
aagggccctctgcct

SEQ ID NO: 452516 - DNA, 15 bp, Homo sapiens
agggccctctgccta

SEQ ID NO: 452517 - DNA, 15 bp, Homo sapiens
gggccctctgcctac

SEQ ID NO: 452518 - DNA, 15 bp, Homo sapiens
ggccctctgcctact

SEQ ID NO: 452519 - DNA, 15 bp, Homo sapiens
gccctctgcctactg

SEQ ID NO: 452520 - DNA, 15 bp, Homo sapiens
ccctctgcctactgt

SEQ ID NO: 452521 - DNA, 15 bp, Homo sapiens
cctctgcctactgtg

SEQ ID NO: 452522 - DNA, 15 bp, Homo sapiens
ctctgcctactgtgc

SEQ ID NO: 452523 - DNA, 15 bp, Homo sapiens
tctgcctactgtgca

SEQ ID NO: 452524 - DNA, 15 bp, Homo sapiens
ctgcctactgtgcag

SEQ ID NO: 452525 - DNA, 15 bp, Homo sapiens
tgcctactgtgcagt

SEQ ID NO: 452526 - DNA, 15 bp, Homo sapiens
gcctactgtgcagtg

SEQ ID NO: 452527 - DNA, 15 bp, Homo sapiens
cctactgtgcagtgc

SEQ ID NO: 452528 - DNA, 15 bp, Homo sapiens
ctactgtgcagtgca

SEQ ID NO: 452529 - DNA, 15 bp, Homo sapiens
tactgtgcagtgcat

SEQ ID NO: 452530 - DNA, 15 bp, Homo sapiens
actgtgcagtgcatt

SEQ ID NO: 452531 - DNA, 15 bp, Homo sapiens
ctgtgcagtgcattt

SEQ ID NO: 452532 - DNA, 15 bp, Homo sapiens
tgtgcagtgcattta

SEQ ID NO: 452533 - DNA, 15 bp, Homo sapiens
gtgcagtgcatttaa

SEQ ID NO: 452534 - DNA, 15 bp, Homo sapiens
tgcagtgcatttaat

SEQ ID NO: 452535 - DNA, 15 bp, Homo sapiens
gcagtgcatttaata

SEQ ID NO: 452536 - DNA, 15 bp, Homo sapiens
cagtgcatttaataa

SEQ ID NO: 452537 - DNA, 15 bp, Homo sapiens
agtgcatttaataag

SEQ ID NO: 452538 - DNA, 15 bp, Homo sapiens
gtgcatttaataagc

SEQ ID NO: 452539 - DNA, 15 bp, Homo sapiens
tgcatttaataagcc

SEQ ID NO: 452540 - DNA, 15 bp, Homo sapiens
gcatttaataagcca

SEQ ID NO: 452541 - DNA, 15 bp, Homo sapiens
catttaataagccat

SEQ ID NO: 452542 - DNA, 15 bp, Homo sapiens
atttaataagccatg

SEQ ID NO: 452543 - DNA, 15 bp, Homo sapiens
tttaataagccatgt

SEQ ID NO: 452544 - DNA, 15 bp, Homo sapiens
ttaataagccatgtg

SEQ ID NO: 452545 - DNA, 15 bp, Homo sapiens
taataagccatgtga

SEQ ID NO: 452546 - DNA, 15 bp, Homo sapiens
aataagccatgtgac

SEQ ID NO: 452547 - DNA, 15 bp, Homo sapiens
ataagccatgtgaca

SEQ ID NO: 452548 - DNA, 15 bp, Homo sapiens
taagccatgtgacag

SEQ ID NO: 452549 - DNA, 15 bp, Homo sapiens
aagccatgtgacagc

SEQ ID NO: 452550 - DNA, 15 bp, Homo sapiens
agccatgtgacagct

SEQ ID NO: 452551 - DNA, 15 bp, Homo sapiens
gccatgtgacagctg

SEQ ID NO: 452552 - DNA, 15 bp, Homo sapiens
ccatgtgacagctgt

SEQ ID NO: 452553 - DNA, 15 bp, Homo sapiens
catgtgacagctgtg

SEQ ID NO: 452554 - DNA, 15 bp, Homo sapiens
atgtgacagctgtgc

SEQ ID NO: 452555 - DNA, 15 bp, Homo sapiens
tgtgacagctgtgct

SEQ ID NO: 452556 - DNA, 15 bp, Homo sapiens
gtgacagctgtgctt

SEQ ID NO: 452557 - DNA, 15 bp, Homo sapiens
tgacagctgtgcttt

SEQ ID NO: 452558 - DNA, 15 bp, Homo sapiens
gacagctgtgctttc

SEQ ID NO: 452559 - DNA, 15 bp, Homo sapiens
acagctgtgctttct

SEQ ID NO: 452560 - DNA, 15 bp, Homo sapiens
cagctgtgctttctc

SEQ ID NO: 452561 - DNA, 15 bp, Homo sapiens
agctgtgctttctct

SEQ ID NO: 452562 - DNA, 15 bp, Homo sapiens
gctgtgctttctctt

SEQ ID NO: 452563 - DNA, 15 bp, Homo sapiens
ctgtgctttctcttc

SEQ ID NO: 452564 - DNA, 15 bp, Homo sapiens
tgtgctttctcttca

SEQ ID NO: 452565 - DNA, 15 bp, Homo sapiens
gtgctttctcttcat

SEQ ID NO: 452566 - DNA, 15 bp, Homo sapiens
tgctttctcttcatc

SEQ ID NO: 452567 - DNA, 15 bp, Homo sapiens
gctttctcttcatca

SEQ ID NO: 452568 - DNA, 15 bp, Homo sapiens
ctttctcttcatcac

SEQ ID NO: 452569 - DNA, 15 bp, Homo sapiens
tttctcttcatcacc

SEQ ID NO: 452570 - DNA, 15 bp, Homo sapiens
ttctcttcatcacct

SEQ ID NO: 452571 - DNA, 15 bp, Homo sapiens
tctcttcatcacctt

SEQ ID NO: 452572 - DNA, 15 bp, Homo sapiens
ctcttcatcaccttc

SEQ ID NO: 452573 - DNA, 15 bp, Homo sapiens
tcttcatcaccttcc

SEQ ID NO: 452574 - DNA, 15 bp, Homo sapiens
cttcatcaccttcct

SEQ ID NO: 452575 - DNA, 15 bp, Homo sapiens
ttcatcaccttcctc

SEQ ID NO: 452576 - DNA, 15 bp, Homo sapiens
tcatcaccttcctct

SEQ ID NO: 452577 - DNA, 15 bp, Homo sapiens
catcaccttcctctt

SEQ ID NO: 452578 - DNA, 15 bp, Homo sapiens
atcaccttcctcttt

SEQ ID NO: 452579 - DNA, 15 bp, Homo sapiens
tcaccttcctctttt

SEQ ID NO: 452580 - DNA, 15 bp, Homo sapiens
caccttcctcttttt

SEQ ID NO: 452581 - DNA, 15 bp, Homo sapiens
accttcctctttttc

SEQ ID NO: 452582 - DNA, 15 bp, Homo sapiens
ccttcctctttttcc

SEQ ID NO: 452583 - DNA, 15 bp, Homo sapiens
cttcctctttttcct

SEQ ID NO: 452584 - DNA, 15 bp, Homo sapiens
ttcctctttttccta

SEQ ID NO: 452585 - DNA, 15 bp, Homo sapiens
tcctctttttcctac

SEQ ID NO: 452586 - DNA, 15 bp, Homo sapiens
cctctttttcctacc

SEQ ID NO: 452587 - DNA, 15 bp, Homo sapiens
ctctttttcctacca

SEQ ID NO: 452588 - DNA, 15 bp, Homo sapiens
tctttttcctaccaa

SEQ ID NO: 452589 - DNA, 15 bp, Homo sapiens
ctttttcctaccaaa

SEQ ID NO: 452590 - DNA, 15 bp, Homo sapiens
tttttcctaccaaag

SEQ ID NO: 452591 - DNA, 15 bp, Homo sapiens
ttttcctaccaaagg

SEQ ID NO: 452592 - DNA, 15 bp, Homo sapiens
tttcctaccaaaggg

SEQ ID NO: 452593 - DNA, 15 bp, Homo sapiens
ttcctaccaaagggc

SEQ ID NO: 452594 - DNA, 15 bp, Homo sapiens
tcctaccaaagggct

SEQ ID NO: 452595 - DNA, 15 bp, Homo sapiens
cctaccaaagggctg

SEQ ID NO: 452596 - DNA, 15 bp, Homo sapiens
ctaccaaagggctga

SEQ ID NO: 452597 - DNA, 15 bp, Homo sapiens
taccaaagggctgaa

SEQ ID NO: 452598 - DNA, 15 bp, Homo sapiens
accaaagggctgaaa

SEQ ID NO: 452599 - DNA, 15 bp, Homo sapiens
ccaaagggctgaaag

SEQ ID NO: 452600 - DNA, 15 bp, Homo sapiens
caaagggctgaaagg

SEQ ID NO: 452601 - DNA, 15 bp, Homo sapiens
aaagggctgaaaggg

SEQ ID NO: 452602 - DNA, 15 bp, Homo sapiens
aagggctgaaagggg

SEQ ID NO: 452603 - DNA, 15 bp, Homo sapiens
agggctgaaaggggt

SEQ ID NO: 452604 - DNA, 15 bp, Homo sapiens
gggctgaaaggggtg

SEQ ID NO: 452605 - DNA, 15 bp, Homo sapiens
ggctgaaaggggtgg

SEQ ID NO: 452606 - DNA, 15 bp, Homo sapiens
gctgaaaggggtggt

SEQ ID NO: 452607 - DNA, 15 bp, Homo sapiens
ctgaaaggggtggta

SEQ ID NO: 452608 - DNA, 15 bp, Homo sapiens
tgaaaggggtggtac

SEQ ID NO: 452609 - DNA, 15 bp, Homo sapiens
gaaaggggtggtacc

SEQ ID NO: 452610 - DNA, 15 bp, Homo sapiens
aaaggggtggtacct

SEQ ID NO: 452611 - DNA, 15 bp, Homo sapiens
aaggggtggtacctt

SEQ ID NO: 452612 - DNA, 15 bp, Homo sapiens
aggggtggtaccttt

SEQ ID NO: 452613 - DNA, 15 bp, Homo sapiens
ggggtggtacctttt

SEQ ID NO: 452614 - DNA, 15 bp, Homo sapiens
gggtggtaccttttc

SEQ ID NO: 452615 - DNA, 15 bp, Homo sapiens
ggtggtaccttttct

SEQ ID NO: 452616 - DNA, 15 bp, Homo sapiens
gtggtaccttttctc

SEQ ID NO: 452617 - DNA, 15 bp, Homo sapiens
tggtaccttttctca

SEQ ID NO: 452618 - DNA, 15 bp, Homo sapiens
ggtaccttttctcac

SEQ ID NO: 452619 - DNA, 15 bp, Homo sapiens
gtaccttttctcacc

SEQ ID NO: 452620 - DNA, 15 bp, Homo sapiens
taccttttctcaccc

SEQ ID NO: 452621 - DNA, 15 bp, Homo sapiens
accttttctcaccca

SEQ ID NO: 452622 - DNA, 15 bp, Homo sapiens
ccttttctcacccat

SEQ ID NO: 452623 - DNA, 15 bp, Homo sapiens
cttttctcacccatc

SEQ ID NO: 452624 - DNA, 15 bp, Homo sapiens
ttttctcacccatca

SEQ ID NO: 452625 - DNA, 15 bp, Homo sapiens
tttctcacccatcat

SEQ ID NO: 452626 - DNA, 15 bp, Homo sapiens
ttctcacccatcata

SEQ ID NO: 452627 - DNA, 15 bp, Homo sapiens
tctcacccatcataa

SEQ ID NO: 452628 - DNA, 15 bp, Homo sapiens
ctcacccatcataag

SEQ ID NO: 452629 - DNA, 15 bp, Homo sapiens
tcacccatcataagg

SEQ ID NO: 452630 - DNA, 15 bp, Homo sapiens
cacccatcataaggg

SEQ ID NO: 452631 - DNA, 15 bp, Homo sapiens
acccatcataagggt

SEQ ID NO: 452632 - DNA, 15 bp, Homo sapiens
cccatcataagggtc

SEQ ID NO: 452633 - DNA, 15 bp, Homo sapiens
ccatcataagggtca

SEQ ID NO: 452634 - DNA, 15 bp, Homo sapiens
catcataagggtcat

SEQ ID NO: 452635 - DNA, 15 bp, Homo sapiens
atcataagggtcatg

SEQ ID NO: 452636 - DNA, 15 bp, Homo sapiens
tcataagggtcatgg

SEQ ID NO: 452637 - DNA, 15 bp, Homo sapiens
cataagggtcatggt

SEQ ID NO: 452638 - DNA, 15 bp, Homo sapiens
ataagggtcatggtg

SEQ ID NO: 452639 - DNA, 15 bp, Homo sapiens
taagggtcatggtga

SEQ ID NO: 452640 - DNA, 15 bp, Homo sapiens
aagggtcatggtgac

SEQ ID NO: 452641 - DNA, 15 bp, Homo sapiens
agggtcatggtgacc

SEQ ID NO: 452642 - DNA, 15 bp, Homo sapiens
gggtcatggtgaccc

SEQ ID NO: 452643 - DNA, 15 bp, Homo sapiens
ggtcatggtgaccct

SEQ ID NO: 452644 - DNA, 15 bp, Homo sapiens
gtcatggtgaccctc

SEQ ID NO: 452645 - DNA, 15 bp, Homo sapiens
tcatggtgaccctcc

SEQ ID NO: 452646 - DNA, 15 bp, Homo sapiens
catggtgaccctcct

SEQ ID NO: 452647 - DNA, 15 bp, Homo sapiens
atggtgaccctccta

SEQ ID NO: 452648 - DNA, 15 bp, Homo sapiens
tggtgaccctcctat

SEQ ID NO: 452649 - DNA, 15 bp, Homo sapiens
ggtgaccctcctata

SEQ ID NO: 452650 - DNA, 15 bp, Homo sapiens
gtgaccctcctataa

SEQ ID NO: 452651 - DNA, 15 bp, Homo sapiens
tgaccctcctataac

SEQ ID NO: 452652 - DNA, 15 bp, Homo sapiens
gaccctcctataaca

SEQ ID NO: 452653 - DNA, 15 bp, Homo sapiens
accctcctataacaa

SEQ ID NO: 452654 - DNA, 15 bp, Homo sapiens
ccctcctataacaaa

SEQ ID NO: 452655 - DNA, 15 bp, Homo sapiens
cctcctataacaaaa

SEQ ID NO: 452656 - DNA, 15 bp, Homo sapiens
ctcctataacaaaag

SEQ ID NO: 452657 - DNA, 15 bp, Homo sapiens
tcctataacaaaaga

SEQ ID NO: 452658 - DNA, 15 bp, Homo sapiens
cctataacaaaagac

SEQ ID NO: 452659 - DNA, 15 bp, Homo sapiens
ctataacaaaagaca

SEQ ID NO: 452660 - DNA, 15 bp, Homo sapiens
tataacaaaagacag

SEQ ID NO: 452661 - DNA, 15 bp, Homo sapiens
ataacaaaagacagg

SEQ ID NO: 452662 - DNA, 15 bp, Homo sapiens
taacaaaagacaggt

SEQ ID NO: 452663 - DNA, 15 bp, Homo sapiens
aacaaaagacaggtc

SEQ ID NO: 452664 - DNA, 15 bp, Homo sapiens
acaaaagacaggtca

SEQ ID NO: 452665 - DNA, 15 bp, Homo sapiens
caaaagacaggtcaa

SEQ ID NO: 452666 - DNA, 15 bp, Homo sapiens
aaaagacaggtcaac

SEQ ID NO: 452667 - DNA, 15 bp, Homo sapiens
aaagacaggtcaacc

SEQ ID NO: 452668 - DNA, 15 bp, Homo sapiens
aagacaggtcaacca

SEQ ID NO: 452669 - DNA, 15 bp, Homo sapiens
agacaggtcaaccag

SEQ ID NO: 452670 - DNA, 15 bp, Homo sapiens
gacaggtcaaccaga

SEQ ID NO: 452671 - DNA, 15 bp, Homo sapiens
acaggtcaaccagaa

SEQ ID NO: 452672 - DNA, 15 bp, Homo sapiens
caggtcaaccagaaa

SEQ ID NO: 452673 - DNA, 15 bp, Homo sapiens
aggtcaaccagaaaa

SEQ ID NO: 452674 - DNA, 15 bp, Homo sapiens
ggtcaaccagaaaag

SEQ ID NO: 452675 - DNA, 15 bp, Homo sapiens
gtcaaccagaaaagc

SEQ ID NO: 452676 - DNA, 15 bp, Homo sapiens
tcaaccagaaaagca

SEQ ID NO: 452677 - DNA, 15 bp, Homo sapiens
caaccagaaaagcac

SEQ ID NO: 452678 - DNA, 15 bp, Homo sapiens
aaccagaaaagcaca

SEQ ID NO: 452679 - DNA, 15 bp, Homo sapiens
accagaaaagcacaa

SEQ ID NO: 452680 - DNA, 15 bp, Homo sapiens
ccagaaaagcacaag

SEQ ID NO: 452681 - DNA, 15 bp, Homo sapiens
cagaaaagcacaaga

SEQ ID NO: 452682 - DNA, 15 bp, Homo sapiens
agaaaagcacaagaa

SEQ ID NO: 452683 - DNA, 15 bp, Homo sapiens
gaaaagcacaagaaa

SEQ ID NO: 452684 - DNA, 15 bp, Homo sapiens
aaaagcacaagaaat

SEQ ID NO: 452685 - DNA, 15 bp, Homo sapiens
aaagcacaagaaatt

SEQ ID NO: 452686 - DNA, 15 bp, Homo sapiens
aagcacaagaaattt

SEQ ID NO: 452687 - DNA, 15 bp, Homo sapiens
agcacaagaaattta

SEQ ID NO: 452688 - DNA, 15 bp, Homo sapiens
gcacaagaaatttac

SEQ ID NO: 452689 - DNA, 15 bp, Homo sapiens
cacaagaaatttact

SEQ ID NO: 452690 - DNA, 15 bp, Homo sapiens
acaagaaatttactt

SEQ ID NO: 452691 - DNA, 15 bp, Homo sapiens
caagaaatttactta

SEQ ID NO: 452692 - DNA, 15 bp, Homo sapiens
aagaaatttacttaa

SEQ ID NO: 452693 - DNA, 15 bp, Homo sapiens
agaaatttacttaat

SEQ ID NO: 452694 - DNA, 15 bp, Homo sapiens
gaaatttacttaatc

SEQ ID NO: 452695 - DNA, 15 bp, Homo sapiens
aaatttacttaatca

SEQ ID NO: 452696 - DNA, 15 bp, Homo sapiens
aatttacttaatcaa

SEQ ID NO: 452697 - DNA, 15 bp, Homo sapiens
atttacttaatcaaa

SEQ ID NO: 452698 - DNA, 15 bp, Homo sapiens
tttacttaatcaaag

SEQ ID NO: 452699 - DNA, 15 bp, Homo sapiens
ttacttaatcaaagt

SEQ ID NO: 452700 - DNA, 15 bp, Homo sapiens
tacttaatcaaagtt

SEQ ID NO: 452701 - DNA, 15 bp, Homo sapiens
acttaatcaaagttt

SEQ ID NO: 452702 - DNA, 15 bp, Homo sapiens
cttaatcaaagtttt

SEQ ID NO: 452703 - DNA, 15 bp, Homo sapiens
ttaatcaaagtttta

SEQ ID NO: 452704 - DNA, 15 bp, Homo sapiens
taatcaaagttttac

SEQ ID NO: 452705 - DNA, 15 bp, Homo sapiens
aatcaaagttttacc

SEQ ID NO: 452706 - DNA, 15 bp, Homo sapiens
atcaaagttttacct

SEQ ID NO: 452707 - DNA, 15 bp, Homo sapiens
tcaaagttttacctg

SEQ ID NO: 452708 - DNA, 15 bp, Homo sapiens
caaagttttacctga

SEQ ID NO: 452709 - DNA, 15 bp, Homo sapiens
aaagttttacctgac

SEQ ID NO: 452710 - DNA, 15 bp, Homo sapiens
aagttttacctgaca

SEQ ID NO: 452711 - DNA, 15 bp, Homo sapiens
agttttacctgacat

SEQ ID NO: 452712 - DNA, 15 bp, Homo sapiens
gttttacctgacatg

SEQ ID NO: 452713 - DNA, 15 bp, Homo sapiens
ttttacctgacatga

SEQ ID NO: 452714 - DNA, 15 bp, Homo sapiens
tttacctgacatgag

SEQ ID NO: 452715 - DNA, 15 bp, Homo sapiens
ttacctgacatgaga

SEQ ID NO: 452716 - DNA, 15 bp, Homo sapiens
tacctgacatgagaa

SEQ ID NO: 452717 - DNA, 15 bp, Homo sapiens
acctgacatgagaac

SEQ ID NO: 452718 - DNA, 15 bp, Homo sapiens
cctgacatgagaacc

SEQ ID NO: 452719 - DNA, 15 bp, Homo sapiens
ctgacatgagaacct

SEQ ID NO: 452720 - DNA, 15 bp, Homo sapiens
tgacatgagaacctt

SEQ ID NO: 452721 - DNA, 15 bp, Homo sapiens
gacatgagaaccttc

SEQ ID NO: 452722 - DNA, 15 bp, Homo sapiens
acatgagaaccttca

SEQ ID NO: 452723 - DNA, 15 bp, Homo sapiens
catgagaaccttcag

SEQ ID NO: 452724 - DNA, 15 bp, Homo sapiens
atgagaaccttcaga

SEQ ID NO: 452725 - DNA, 15 bp, Homo sapiens
tgagaaccttcagaa

SEQ ID NO: 452726 - DNA, 15 bp, Homo sapiens
gagaaccttcagaag

SEQ ID NO: 452727 - DNA, 15 bp, Homo sapiens
agaaccttcagaaga

SEQ ID NO: 452728 - DNA, 15 bp, Homo sapiens
gaaccttcagaagac

SEQ ID NO: 452729 - DNA, 15 bp, Homo sapiens
aaccttcagaagact

SEQ ID NO: 452730 - DNA, 15 bp, Homo sapiens
accttcagaagactc

SEQ ID NO: 452731 - DNA, 15 bp, Homo sapiens
ccttcagaagactca

SEQ ID NO: 452732 - DNA, 15 bp, Homo sapiens
cttcagaagactcaa

SEQ ID NO: 452733 - DNA, 15 bp, Homo sapiens
ttcagaagactcaaa

SEQ ID NO: 452734 - DNA, 15 bp, Homo sapiens
tcagaagactcaaag

SEQ ID NO: 452735 - DNA, 15 bp, Homo sapiens
cagaagactcaaaga

SEQ ID NO: 452736 - DNA, 15 bp, Homo sapiens
agaagactcaaagaa

SEQ ID NO: 452737 - DNA, 15 bp, Homo sapiens
gaagactcaaagaaa

SEQ ID NO: 452738 - DNA, 15 bp, Homo sapiens
aagactcaaagaaaa

SEQ ID NO: 452739 - DNA, 15 bp, Homo sapiens
agactcaaagaaaac

SEQ ID NO: 452740 - DNA, 15 bp, Homo sapiens
gactcaaagaaaaca

SEQ ID NO: 452741 - DNA, 15 bp, Homo sapiens
actcaaagaaaacag

SEQ ID NO: 452742 - DNA, 15 bp, Homo sapiens
ctcaaagaaaacagg

SEQ ID NO: 452743 - DNA, 15 bp, Homo sapiens
tcaaagaaaacaggg

SEQ ID NO: 452744 - DNA, 15 bp, Homo sapiens
caaagaaaacaggga

SEQ ID NO: 452745 - DNA, 15 bp, Homo sapiens
aaagaaaacagggaa

SEQ ID NO: 452746 - DNA, 15 bp, Homo sapiens
aagaaaacagggaaa

SEQ ID NO: 452747 - DNA, 15 bp, Homo sapiens
agaaaacagggaaaa

SEQ ID NO: 452748 - DNA, 15 bp, Homo sapiens
gaaaacagggaaaag

SEQ ID NO: 452749 - DNA, 15 bp, Homo sapiens
aaaacagggaaaagt

SEQ ID NO: 452750 - DNA, 15 bp, Homo sapiens
aaacagggaaaagtg

SEQ ID NO: 452751 - DNA, 15 bp, Homo sapiens
aacagggaaaagtgt

SEQ ID NO: 452752 - DNA, 15 bp, Homo sapiens
acagggaaaagtgtc

SEQ ID NO: 452753 - DNA, 15 bp, Homo sapiens
cagggaaaagtgtct

SEQ ID NO: 452754 - DNA, 15 bp, Homo sapiens
agggaaaagtgtctg

SEQ ID NO: 452755 - DNA, 15 bp, Homo sapiens
gggaaaagtgtctgt

SEQ ID NO: 452756 - DNA, 15 bp, Homo sapiens
ggaaaagtgtctgtt

SEQ ID NO: 452757 - DNA, 15 bp, Homo sapiens
gaaaagtgtctgttt

SEQ ID NO: 452758 - DNA, 15 bp, Homo sapiens
aaaagtgtctgtttt

SEQ ID NO: 452759 - DNA, 15 bp, Homo sapiens
aaagtgtctgttttt

SEQ ID NO: 452760 - DNA, 15 bp, Homo sapiens
aagtgtctgttttta

SEQ ID NO: 452761 - DNA, 15 bp, Homo sapiens
agtgtctgtttttac

SEQ ID NO: 452762 - DNA, 15 bp, Homo sapiens
gtgtctgtttttaca

SEQ ID NO: 452763 - DNA, 15 bp, Homo sapiens
tgtctgtttttacac

SEQ ID NO: 452764 - DNA, 15 bp, Homo sapiens
gtctgtttttacact

SEQ ID NO: 452765 - DNA, 15 bp, Homo sapiens
tctgtttttacactt

SEQ ID NO: 452766 - DNA, 15 bp, Homo sapiens
ctgtttttacactta

SEQ ID NO: 452767 - DNA, 15 bp, Homo sapiens
tgtttttacacttag

SEQ ID NO: 452768 - DNA, 15 bp, Homo sapiens
gtttttacacttaga

SEQ ID NO: 452769 - DNA, 15 bp, Homo sapiens
tttttacacttagat

SEQ ID NO: 452770 - DNA, 15 bp, Homo sapiens
ttttacacttagatt

SEQ ID NO: 452771 - DNA, 15 bp, Homo sapiens
tttacacttagattg

SEQ ID NO: 452772 - DNA, 15 bp, Homo sapiens
ttacacttagattga

SEQ ID NO: 452773 - DNA, 15 bp, Homo sapiens
tacacttagattgag

SEQ ID NO: 452774 - DNA, 15 bp, Homo sapiens
acacttagattgagt

SEQ ID NO: 452775 - DNA, 15 bp, Homo sapiens
cacttagattgagtg

SEQ ID NO: 452776 - DNA, 15 bp, Homo sapiens
acttagattgagtga

SEQ ID NO: 452777 - DNA, 15 bp, Homo sapiens
cttagattgagtgag

SEQ ID NO: 452778 - DNA, 15 bp, Homo sapiens
ttagattgagtgagg

SEQ ID NO: 452779 - DNA, 15 bp, Homo sapiens
tagattgagtgagga

SEQ ID NO: 452780 - DNA, 15 bp, Homo sapiens
agattgagtgaggaa

SEQ ID NO: 452781 - DNA, 15 bp, Homo sapiens
gattgagtgaggaat

SEQ ID NO: 452782 - DNA, 15 bp, Homo sapiens
attgagtgaggaatg

SEQ ID NO: 452783 - DNA, 15 bp, Homo sapiens
ttgagtgaggaatgg

SEQ ID NO: 452784 - DNA, 15 bp, Homo sapiens
tgagtgaggaatgga

SEQ ID NO: 452785 - DNA, 15 bp, Homo sapiens
gagtgaggaatggat

SEQ ID NO: 452786 - DNA, 15 bp, Homo sapiens
agtgaggaatggatg

SEQ ID NO: 452787 - DNA, 15 bp, Homo sapiens
gtgaggaatggatga

SEQ ID NO: 452788 - DNA, 15 bp, Homo sapiens
tgaggaatggatgac

SEQ ID NO: 452789 - DNA, 15 bp, Homo sapiens
gaggaatggatgact

SEQ ID NO: 452790 - DNA, 15 bp, Homo sapiens
aggaatggatgactg

SEQ ID NO: 452791 - DNA, 15 bp, Homo sapiens
ggaatggatgactgc

SEQ ID NO: 452792 - DNA, 15 bp, Homo sapiens
gaatggatgactgca

SEQ ID NO: 452793 - DNA, 15 bp, Homo sapiens
aatggatgactgcat

SEQ ID NO: 452794 - DNA, 15 bp, Homo sapiens
atggatgactgcatt

SEQ ID NO: 452795 - DNA, 15 bp, Homo sapiens
tggatgactgcattg

SEQ ID NO: 452796 - DNA, 15 bp, Homo sapiens
ggatgactgcattga

SEQ ID NO: 452797 - DNA, 15 bp, Homo sapiens
gatgactgcattgaa

SEQ ID NO: 452798 - DNA, 15 bp, Homo sapiens
atgactgcattgaat

SEQ ID NO: 452799 - DNA, 15 bp, Homo sapiens
tgactgcattgaatt

SEQ ID NO: 452800 - DNA, 15 bp, Homo sapiens
gactgcattgaattg

SEQ ID NO: 452801 - DNA, 15 bp, Homo sapiens
actgcattgaattgt

SEQ ID NO: 452802 - DNA, 15 bp, Homo sapiens
ctgcattgaattgtg

SEQ ID NO: 452803 - DNA, 15 bp, Homo sapiens
tgcattgaattgtga

SEQ ID NO: 452804 - DNA, 15 bp, Homo sapiens
gcattgaattgtgat

SEQ ID NO: 452805 - DNA, 15 bp, Homo sapiens
cattgaattgtgatt

SEQ ID NO: 452806 - DNA, 15 bp, Homo sapiens
attgaattgtgattg

SEQ ID NO: 452807 - DNA, 15 bp, Homo sapiens
ttgaattgtgattgg

SEQ ID NO: 452808 - DNA, 15 bp, Homo sapiens
tgaattgtgattgga

SEQ ID NO: 452809 - DNA, 15 bp, Homo sapiens
gaattgtgattggat

SEQ ID NO: 452810 - DNA, 15 bp, Homo sapiens
aattgtgattggatg

SEQ ID NO: 452811 - DNA, 15 bp, Homo sapiens
attgtgattggatga

SEQ ID NO: 452812 - DNA, 15 bp, Homo sapiens
ttgtgattggatgaa

SEQ ID NO: 452813 - DNA, 15 bp, Homo sapiens
tgtgattggatgaaa

SEQ ID NO: 452814 - DNA, 15 bp, Homo sapiens
gtgattggatgaaag

SEQ ID NO: 452815 - DNA, 15 bp, Homo sapiens
tgattggatgaaagg

SEQ ID NO: 452816 - DNA, 15 bp, Homo sapiens
gattggatgaaaggg

SEQ ID NO: 452817 - DNA, 15 bp, Homo sapiens
attggatgaaagggt

SEQ ID NO: 452818 - DNA, 15 bp, Homo sapiens
ttggatgaaagggta

SEQ ID NO: 452819 - DNA, 15 bp, Homo sapiens
tggatgaaagggtat

SEQ ID NO: 452820 - DNA, 15 bp, Homo sapiens
ggatgaaagggtata

SEQ ID NO: 452821 - DNA, 15 bp, Homo sapiens
gatgaaagggtataa

SEQ ID NO: 452822 - DNA, 15 bp, Homo sapiens
atgaaagggtataat

SEQ ID NO: 452823 - DNA, 15 bp, Homo sapiens
tgaaagggtataatt

SEQ ID NO: 452824 - DNA, 15 bp, Homo sapiens
gaaagggtataattt

SEQ ID NO: 452825 - DNA, 15 bp, Homo sapiens
aaagggtataattta

SEQ ID NO: 452826 - DNA, 15 bp, Homo sapiens
aagggtataatttaa

SEQ ID NO: 452827 - DNA, 15 bp, Homo sapiens
agggtataatttaat

SEQ ID NO: 452828 - DNA, 15 bp, Homo sapiens
gggtataatttaatg

SEQ ID NO: 452829 - DNA, 15 bp, Homo sapiens
ggtataatttaatga

SEQ ID NO: 452830 - DNA, 15 bp, Homo sapiens
gtataatttaatgat

SEQ ID NO: 452831 - DNA, 15 bp, Homo sapiens
tataatttaatgata

SEQ ID NO: 452832 - DNA, 15 bp, Homo sapiens
ataatttaatgataa

SEQ ID NO: 452833 - DNA, 15 bp, Homo sapiens
taatttaatgataat

SEQ ID NO: 452834 - DNA, 15 bp, Homo sapiens
aatttaatgataata

SEQ ID NO: 452835 - DNA, 15 bp, Homo sapiens
atttaatgataatag

SEQ ID NO: 452836 - DNA, 15 bp, Homo sapiens
tttaatgataataga

SEQ ID NO: 452837 - DNA, 15 bp, Homo sapiens
ttaatgataatagac

SEQ ID NO: 452838 - DNA, 15 bp, Homo sapiens
taatgataatagact

SEQ ID NO: 452839 - DNA, 15 bp, Homo sapiens
aatgataatagactg

SEQ ID NO: 452840 - DNA, 15 bp, Homo sapiens
atgataatagactga

SEQ ID NO: 452841 - DNA, 15 bp, Homo sapiens
tgataatagactgag

SEQ ID NO: 452842 - DNA, 15 bp, Homo sapiens
gataatagactgaga

SEQ ID NO: 452843 - DNA, 15 bp, Homo sapiens
ataatagactgagaa

SEQ ID NO: 452844 - DNA, 15 bp, Homo sapiens
taatagactgagaag

SEQ ID NO: 452845 - DNA, 15 bp, Homo sapiens
aatagactgagaagg

SEQ ID NO: 452846 - DNA, 15 bp, Homo sapiens
atagactgagaaggg

SEQ ID NO: 452847 - DNA, 15 bp, Homo sapiens
tagactgagaaggga

SEQ ID NO: 452848 - DNA, 15 bp, Homo sapiens
agactgagaagggaa

SEQ ID NO: 452849 - DNA, 15 bp, Homo sapiens
gactgagaagggaat

SEQ ID NO: 452850 - DNA, 15 bp, Homo sapiens
actgagaagggaatt

SEQ ID NO: 452851 - DNA, 15 bp, Homo sapiens
ctgagaagggaattc

SEQ ID NO: 452852 - DNA, 15 bp, Homo sapiens
tgagaagggaattcc

SEQ ID NO: 452853 - DNA, 15 bp, Homo sapiens
gagaagggaattcca

SEQ ID NO: 452854 - DNA, 15 bp, Homo sapiens
agaagggaattccag

SEQ ID NO: 452855 - DNA, 15 bp, Homo sapiens
gaagggaattccagc

SEQ ID NO: 452856 - DNA, 15 bp, Homo sapiens
aagggaattccagca

SEQ ID NO: 452857 - DNA, 15 bp, Homo sapiens
agggaattccagcaa

SEQ ID NO: 452858 - DNA, 15 bp, Homo sapiens
gggaattccagcaag

SEQ ID NO: 452859 - DNA, 15 bp, Homo sapiens
ggaattccagcaagg

SEQ ID NO: 452860 - DNA, 15 bp, Homo sapiens
gaattccagcaaggc

SEQ ID NO: 452861 - DNA, 15 bp, Homo sapiens
aattccagcaaggcc

SEQ ID NO: 452862 - DNA, 15 bp, Homo sapiens
attccagcaaggcct

SEQ ID NO: 452863 - DNA, 15 bp, Homo sapiens
ttccagcaaggccta

SEQ ID NO: 452864 - DNA, 15 bp, Homo sapiens
tccagcaaggcctat

SEQ ID NO: 452865 - DNA, 15 bp, Homo sapiens
ccagcaaggcctatc

SEQ ID NO: 452866 - DNA, 15 bp, Homo sapiens
cagcaaggcctatct

SEQ ID NO: 452867 - DNA, 15 bp, Homo sapiens
agcaaggcctatcta

SEQ ID NO: 452868 - DNA, 15 bp, Homo sapiens
gcaaggcctatctat

SEQ ID NO: 452869 - DNA, 15 bp, Homo sapiens
caaggcctatctatt

SEQ ID NO: 452870 - DNA, 15 bp, Homo sapiens
aaggcctatctattc

SEQ ID NO: 452871 - DNA, 15 bp, Homo sapiens
aggcctatctattca

SEQ ID NO: 452872 - DNA, 15 bp, Homo sapiens
ggcctatctattcag

SEQ ID NO: 452873 - DNA, 15 bp, Homo sapiens
gcctatctattcaga

SEQ ID NO: 452874 - DNA, 15 bp, Homo sapiens
cctatctattcagat

SEQ ID NO: 452875 - DNA, 15 bp, Homo sapiens
ctatctattcagatt

SEQ ID NO: 452876 - DNA, 15 bp, Homo sapiens
tatctattcagattc

SEQ ID NO: 452877 - DNA, 15 bp, Homo sapiens
atctattcagattct

SEQ ID NO: 452878 - DNA, 15 bp, Homo sapiens
tctattcagattctt

SEQ ID NO: 452879 - DNA, 15 bp, Homo sapiens
ctattcagattcttc

SEQ ID NO: 452880 - DNA, 15 bp, Homo sapiens
tattcagattcttct

SEQ ID NO: 452881 - DNA, 15 bp, Homo sapiens
attcagattcttctt

SEQ ID NO: 452882 - DNA, 15 bp, Homo sapiens
ttcagattcttcttg

SEQ ID NO: 452883 - DNA, 15 bp, Homo sapiens
tcagattcttcttgg

SEQ ID NO: 452884 - DNA, 15 bp, Homo sapiens
cagattcttcttggc

SEQ ID NO: 452885 - DNA, 15 bp, Homo sapiens
agattcttcttggct

SEQ ID NO: 452886 - DNA, 15 bp, Homo sapiens
gattcttcttggctt

SEQ ID NO: 452887 - DNA, 15 bp, Homo sapiens
attcttcttggcttc

SEQ ID NO: 452888 - DNA, 15 bp, Homo sapiens
ttcttcttggcttct

SEQ ID NO: 452889 - DNA, 15 bp, Homo sapiens
tcttcttggcttctc

SEQ ID NO: 452890 - DNA, 15 bp, Homo sapiens
cttcttggcttctcc

SEQ ID NO: 452891 - DNA, 15 bp, Homo sapiens
ttcttggcttctccc

SEQ ID NO: 452892 - DNA, 15 bp, Homo sapiens
tcttggcttctccct

SEQ ID NO: 452893 - DNA, 15 bp, Homo sapiens
cttggcttctccctg

SEQ ID NO: 452894 - DNA, 15 bp, Homo sapiens
ttggcttctccctgc

SEQ ID NO: 452895 - DNA, 15 bp, Homo sapiens
tggcttctccctgca

SEQ ID NO: 452896 - DNA, 15 bp, Homo sapiens
ggcttctccctgcag

SEQ ID NO: 452897 - DNA, 15 bp, Homo sapiens
gcttctccctgcagc

SEQ ID NO: 452898 - DNA, 15 bp, Homo sapiens
cttctccctgcagca

SEQ ID NO: 452899 - DNA, 15 bp, Homo sapiens
ttctccctgcagcat

SEQ ID NO: 452900 - DNA, 15 bp, Homo sapiens
tctccctgcagcata

SEQ ID NO: 452901 - DNA, 15 bp, Homo sapiens
ctccctgcagcatat

SEQ ID NO: 452902 - DNA, 15 bp, Homo sapiens
tccctgcagcatatt

SEQ ID NO: 452903 - DNA, 15 bp, Homo sapiens
ccctgcagcatattc

SEQ ID NO: 452904 - DNA, 15 bp, Homo sapiens
cctgcagcatattcc

SEQ ID NO: 452905 - DNA, 15 bp, Homo sapiens
ctgcagcatattcct

SEQ ID NO: 452906 - DNA, 15 bp, Homo sapiens
tgcagcatattcctt

SEQ ID NO: 452907 - DNA, 15 bp, Homo sapiens
gcagcatattccttt

SEQ ID NO: 452908 - DNA, 15 bp, Homo sapiens
cagcatattcctttc

SEQ ID NO: 452909 - DNA, 15 bp, Homo sapiens
agcatattcctttcc

SEQ ID NO: 452910 - DNA, 15 bp, Homo sapiens
gcatattcctttcct

SEQ ID NO: 452911 - DNA, 15 bp, Homo sapiens
catattcctttcctc

SEQ ID NO: 452912 - DNA, 15 bp, Homo sapiens
atattcctttcctct

SEQ ID NO: 452913 - DNA, 15 bp, Homo sapiens
tattcctttcctcta

SEQ ID NO: 452914 - DNA, 15 bp, Homo sapiens
attcctttcctctag

SEQ ID NO: 452915 - DNA, 15 bp, Homo sapiens
ttcctttcctctagg

SEQ ID NO: 452916 - DNA, 15 bp, Homo sapiens
tcctttcctctaggg

SEQ ID NO: 452917 - DNA, 15 bp, Homo sapiens
cctttcctctaggga

SEQ ID NO: 452918 - DNA, 15 bp, Homo sapiens
ctttcctctagggac

SEQ ID NO: 452919 - DNA, 15 bp, Homo sapiens
tttcctctagggaca

SEQ ID NO: 452920 - DNA, 15 bp, Homo sapiens
ttcctctagggacag

SEQ ID NO: 452921 - DNA, 15 bp, Homo sapiens
tcctctagggacagg

SEQ ID NO: 452922 - DNA, 15 bp, Homo sapiens
cctctagggacagga

SEQ ID NO: 452923 - DNA, 15 bp, Homo sapiens
ctctagggacaggat

SEQ ID NO: 452924 - DNA, 15 bp, Homo sapiens
tctagggacaggata

SEQ ID NO: 452925 - DNA, 15 bp, Homo sapiens
ctagggacaggatac

SEQ ID NO: 452926 - DNA, 15 bp, Homo sapiens
tagggacaggatacc

SEQ ID NO: 452927 - DNA, 15 bp, Homo sapiens
agggacaggatacct

SEQ ID NO: 452928 - DNA, 15 bp, Homo sapiens
gggacaggatacctg

SEQ ID NO: 452929 - DNA, 15 bp, Homo sapiens
ggacaggatacctgt

SEQ ID NO: 452930 - DNA, 15 bp, Homo sapiens
gacaggatacctgtc

SEQ ID NO: 452931 - DNA, 15 bp, Homo sapiens
acaggatacctgtca

SEQ ID NO: 452932 - DNA, 15 bp, Homo sapiens
caggatacctgtcac

SEQ ID NO: 452933 - DNA, 15 bp, Homo sapiens
aggatacctgtcaca

SEQ ID NO: 452934 - DNA, 15 bp, Homo sapiens
ggatacctgtcacag

SEQ ID NO: 452935 - DNA, 15 bp, Homo sapiens
gatacctgtcacagg

SEQ ID NO: 452936 - DNA, 15 bp, Homo sapiens
atacctgtcacagga

SEQ ID NO: 452937 - DNA, 15 bp, Homo sapiens
tacctgtcacaggag

SEQ ID NO: 452938 - DNA, 15 bp, Homo sapiens
acctgtcacaggaga

SEQ ID NO: 452939 - DNA, 15 bp, Homo sapiens
cctgtcacaggagaa

SEQ ID NO: 452940 - DNA, 15 bp, Homo sapiens
ctgtcacaggagaat

SEQ ID NO: 452941 - DNA, 15 bp, Homo sapiens
tgtcacaggagaatc

SEQ ID NO: 452942 - DNA, 15 bp, Homo sapiens
gtcacaggagaatct

SEQ ID NO: 452943 - DNA, 15 bp, Homo sapiens
tcacaggagaatctt

SEQ ID NO: 452944 - DNA, 15 bp, Homo sapiens
cacaggagaatcttc

SEQ ID NO: 452945 - DNA, 15 bp, Homo sapiens
acaggagaatcttca

SEQ ID NO: 452946 - DNA, 15 bp, Homo sapiens
caggagaatcttcag

SEQ ID NO: 452947 - DNA, 15 bp, Homo sapiens
aggagaatcttcagg

SEQ ID NO: 452948 - DNA, 15 bp, Homo sapiens
ggagaatcttcagga

SEQ ID NO: 452949 - DNA, 15 bp, Homo sapiens
gagaatcttcaggag

SEQ ID NO: 452950 - DNA, 15 bp, Homo sapiens
agaatcttcaggaga

SEQ ID NO: 452951 - DNA, 15 bp, Homo sapiens
gaatcttcaggagag

SEQ ID NO: 452952 - DNA, 15 bp, Homo sapiens
aatcttcaggagaga

SEQ ID NO: 452953 - DNA, 15 bp, Homo sapiens
atcttcaggagagaa

SEQ ID NO: 452954 - DNA, 15 bp, Homo sapiens
tcttcaggagagaag

SEQ ID NO: 452955 - DNA, 15 bp, Homo sapiens
cttcaggagagaagg

SEQ ID NO: 452956 - DNA, 15 bp, Homo sapiens
ttcaggagagaaggg

SEQ ID NO: 452957 - DNA, 15 bp, Homo sapiens
tcaggagagaaggga

SEQ ID NO: 452958 - DNA, 15 bp, Homo sapiens
caggagagaagggag

SEQ ID NO: 452959 - DNA, 15 bp, Homo sapiens
aggagagaagggaga

SEQ ID NO: 452960 - DNA, 15 bp, Homo sapiens
ggagagaagggagaa

SEQ ID NO: 452961 - DNA, 15 bp, Homo sapiens
gagagaagggagaag

SEQ ID NO: 452962 - DNA, 15 bp, Homo sapiens
agagaagggagaagg

SEQ ID NO: 452963 - DNA, 15 bp, Homo sapiens
gagaagggagaaggt

SEQ ID NO: 452964 - DNA, 15 bp, Homo sapiens
agaagggagaaggtg

SEQ ID NO: 452965 - DNA, 15 bp, Homo sapiens
gaagggagaaggtga

SEQ ID NO: 452966 - DNA, 15 bp, Homo sapiens
aagggagaaggtgac

SEQ ID NO: 452967 - DNA, 15 bp, Homo sapiens
agggagaaggtgaca

SEQ ID NO: 452968 - DNA, 15 bp, Homo sapiens
gggagaaggtgacag

SEQ ID NO: 452969 - DNA, 15 bp, Homo sapiens
ggagaaggtgacagt

SEQ ID NO: 452970 - DNA, 15 bp, Homo sapiens
gagaaggtgacagtg

SEQ ID NO: 452971 - DNA, 15 bp, Homo sapiens
agaaggtgacagtga

SEQ ID NO: 452972 - DNA, 15 bp, Homo sapiens
gaaggtgacagtgaa

SEQ ID NO: 452973 - DNA, 15 bp, Homo sapiens
aaggtgacagtgaac

SEQ ID NO: 452974 - DNA, 15 bp, Homo sapiens
aggtgacagtgaact

SEQ ID NO: 452975 - DNA, 15 bp, Homo sapiens
ggtgacagtgaactt

SEQ ID NO: 452976 - DNA, 15 bp, Homo sapiens
gtgacagtgaacttg

SEQ ID NO: 452977 - DNA, 15 bp, Homo sapiens
tgacagtgaacttgc

SEQ ID NO: 452978 - DNA, 15 bp, Homo sapiens
gacagtgaacttgct

SEQ ID NO: 452979 - DNA, 15 bp, Homo sapiens
acagtgaacttgcta

SEQ ID NO: 452980 - DNA, 15 bp, Homo sapiens
cagtgaacttgctag

SEQ ID NO: 452981 - DNA, 15 bp, Homo sapiens
agtgaacttgctaga

SEQ ID NO: 452982 - DNA, 15 bp, Homo sapiens
gtgaacttgctagat

SEQ ID NO: 452983 - DNA, 15 bp, Homo sapiens
tgaacttgctagatt

SEQ ID NO: 452984 - DNA, 15 bp, Homo sapiens
gaacttgctagattt

SEQ ID NO: 452985 - DNA, 15 bp, Homo sapiens
aacttgctagatttt

SEQ ID NO: 452986 - DNA, 15 bp, Homo sapiens
acttgctagatttta

SEQ ID NO: 452987 - DNA, 15 bp, Homo sapiens
cttgctagattttat

SEQ ID NO: 452988 - DNA, 15 bp, Homo sapiens
ttgctagattttatg

SEQ ID NO: 452989 - DNA, 15 bp, Homo sapiens
tgctagattttatgg

SEQ ID NO: 452990 - DNA, 15 bp, Homo sapiens
gctagattttatggc

SEQ ID NO: 452991 - DNA, 15 bp, Homo sapiens
ctagattttatggct

SEQ ID NO: 452992 - DNA, 15 bp, Homo sapiens
tagattttatggctt

SEQ ID NO: 452993 - DNA, 15 bp, Homo sapiens
agattttatggcttg

SEQ ID NO: 452994 - DNA, 15 bp, Homo sapiens
gattttatggcttgc

SEQ ID NO: 452995 - DNA, 15 bp, Homo sapiens
attttatggcttgct

SEQ ID NO: 452996 - DNA, 15 bp, Homo sapiens
ttttatggcttgctt

SEQ ID NO: 452997 - DNA, 15 bp, Homo sapiens
tttatggcttgcttt

SEQ ID NO: 452998 - DNA, 15 bp, Homo sapiens
ttatggcttgctttg

SEQ ID NO: 452999 - DNA, 15 bp, Homo sapiens
tatggcttgctttgg

SEQ ID NO: 453000 - DNA, 15 bp, Homo sapiens
atggcttgctttggg

SEQ ID NO: 453001 - DNA, 15 bp, Homo sapiens
tggcttgctttgggg

SEQ ID NO: 453002 - DNA, 15 bp, Homo sapiens
ggcttgctttgggga

SEQ ID NO: 453003 - DNA, 15 bp, Homo sapiens
gcttgctttggggaa

SEQ ID NO: 453004 - DNA, 15 bp, Homo sapiens
cttgctttggggaag

SEQ ID NO: 453005 - DNA, 15 bp, Homo sapiens
ttgctttggggaaga

SEQ ID NO: 453006 - DNA, 15 bp, Homo sapiens
tgctttggggaagag

SEQ ID NO: 453007 - DNA, 15 bp, Homo sapiens
gctttggggaagaga

SEQ ID NO: 453008 - DNA, 15 bp, Homo sapiens
ctttggggaagagaa

SEQ ID NO: 453009 - DNA, 15 bp, Homo sapiens
tttggggaagagaag

SEQ ID NO: 453010 - DNA, 15 bp, Homo sapiens
ttggggaagagaagt

SEQ ID NO: 453011 - DNA, 15 bp, Homo sapiens
tggggaagagaagtt

SEQ ID NO: 453012 - DNA, 15 bp, Homo sapiens
ggggaagagaagttc

SEQ ID NO: 453013 - DNA, 15 bp, Homo sapiens
gggaagagaagttct

SEQ ID NO: 453014 - DNA, 15 bp, Homo sapiens
ggaagagaagttcta

SEQ ID NO: 453015 - DNA, 15 bp, Homo sapiens
gaagagaagttctag

SEQ ID NO: 453016 - DNA, 15 bp, Homo sapiens
aagagaagttctagt

SEQ ID NO: 453017 - DNA, 15 bp, Homo sapiens
agagaagttctagtt

SEQ ID NO: 453018 - DNA, 15 bp, Homo sapiens
gagaagttctagttt

SEQ ID NO: 453019 - DNA, 15 bp, Homo sapiens
agaagttctagtttt

SEQ ID NO: 453020 - DNA, 15 bp, Homo sapiens
gaagttctagttttc

SEQ ID NO: 453021 - DNA, 15 bp, Homo sapiens
aagttctagttttca

SEQ ID NO: 453022 - DNA, 15 bp, Homo sapiens
agttctagttttcat

SEQ ID NO: 453023 - DNA, 15 bp, Homo sapiens
gttctagttttcatg

SEQ ID NO: 453024 - DNA, 15 bp, Homo sapiens
ttctagttttcatga

SEQ ID NO: 453025 - DNA, 15 bp, Homo sapiens
tctagttttcatgac

SEQ ID NO: 453026 - DNA, 15 bp, Homo sapiens
ctagttttcatgacc

SEQ ID NO: 453027 - DNA, 15 bp, Homo sapiens
tagttttcatgaccc

SEQ ID NO: 453028 - DNA, 15 bp, Homo sapiens
agttttcatgaccca

SEQ ID NO: 453029 - DNA, 15 bp, Homo sapiens
gttttcatgacccac

SEQ ID NO: 453030 - DNA, 15 bp, Homo sapiens
ttttcatgacccacc

SEQ ID NO: 453031 - DNA, 15 bp, Homo sapiens
tttcatgacccacct

SEQ ID NO: 453032 - DNA, 15 bp, Homo sapiens
ttcatgacccacctt

SEQ ID NO: 453033 - DNA, 15 bp, Homo sapiens
tcatgacccaccttg

SEQ ID NO: 453034 - DNA, 15 bp, Homo sapiens
catgacccaccttgg

SEQ ID NO: 453035 - DNA, 15 bp, Homo sapiens
atgacccaccttggg

SEQ ID NO: 453036 - DNA, 15 bp, Homo sapiens
tgacccaccttgggg

SEQ ID NO: 453037 - DNA, 15 bp, Homo sapiens
gacccaccttgggga

SEQ ID NO: 453038 - DNA, 15 bp, Homo sapiens
acccaccttggggaa

SEQ ID NO: 453039 - DNA, 15 bp, Homo sapiens
cccaccttggggaag

SEQ ID NO: 453040 - DNA, 15 bp, Homo sapiens
ccaccttggggaagg

SEQ ID NO: 453041 - DNA, 15 bp, Homo sapiens
caccttggggaaggg

SEQ ID NO: 453042 - DNA, 15 bp, Homo sapiens
accttggggaagggg

SEQ ID NO: 453043 - DNA, 15 bp, Homo sapiens
ccttggggaagggga

SEQ ID NO: 453044 - DNA, 15 bp, Homo sapiens
cttggggaaggggaa

SEQ ID NO: 453045 - DNA, 15 bp, Homo sapiens
ttggggaaggggaat

SEQ ID NO: 453046 - DNA, 15 bp, Homo sapiens
tggggaaggggaatt

SEQ ID NO: 453047 - DNA, 15 bp, Homo sapiens
ggggaaggggaattc

SEQ ID NO: 453048 - DNA, 15 bp, Homo sapiens
gggaaggggaattct

SEQ ID NO: 453049 - DNA, 15 bp, Homo sapiens
ggaaggggaattctg

SEQ ID NO: 453050 - DNA, 15 bp, Homo sapiens
gaaggggaattctgg

SEQ ID NO: 453051 - DNA, 15 bp, Homo sapiens
aaggggaattctggt

SEQ ID NO: 453052 - DNA, 15 bp, Homo sapiens
aggggaattctggtt

SEQ ID NO: 453053 - DNA, 15 bp, Homo sapiens
ggggaattctggttt

SEQ ID NO: 453054 - DNA, 15 bp, Homo sapiens
gggaattctggtttc

SEQ ID NO: 453055 - DNA, 15 bp, Homo sapiens
ggaattctggtttct

SEQ ID NO: 453056 - DNA, 15 bp, Homo sapiens
gaattctggtttcta

SEQ ID NO: 453057 - DNA, 15 bp, Homo sapiens
aattctggtttctat

SEQ ID NO: 453058 - DNA, 15 bp, Homo sapiens
attctggtttctatt

SEQ ID NO: 453059 - DNA, 15 bp, Homo sapiens
ttctggtttctattt

SEQ ID NO: 453060 - DNA, 15 bp, Homo sapiens
tctggtttctattta

SEQ ID NO: 453061 - DNA, 15 bp, Homo sapiens
ctggtttctatttat

SEQ ID NO: 453062 - DNA, 15 bp, Homo sapiens
tggtttctatttatc

SEQ ID NO: 453063 - DNA, 15 bp, Homo sapiens
ggtttctatttatca

SEQ ID NO: 453064 - DNA, 15 bp, Homo sapiens
gtttctatttatcac

SEQ ID NO: 453065 - DNA, 15 bp, Homo sapiens
tttctatttatcact

SEQ ID NO: 453066 - DNA, 15 bp, Homo sapiens
ttctatttatcactt

SEQ ID NO: 453067 - DNA, 15 bp, Homo sapiens
tctatttatcacttt

SEQ ID NO: 453068 - DNA, 15 bp, Homo sapiens
ctatttatcactttg

SEQ ID NO: 453069 - DNA, 15 bp, Homo sapiens
tatttatcactttgg

SEQ ID NO: 453070 - DNA, 15 bp, Homo sapiens
atttatcactttgga

SEQ ID NO: 453071 - DNA, 15 bp, Homo sapiens
tttatcactttggaa

SEQ ID NO: 453072 - DNA, 15 bp, Homo sapiens
ttatcactttggaag

SEQ ID NO: 453073 - DNA, 15 bp, Homo sapiens
tatcactttggaagg

SEQ ID NO: 453074 - DNA, 15 bp, Homo sapiens
atcactttggaagga

SEQ ID NO: 453075 - DNA, 15 bp, Homo sapiens
tcactttggaaggag

SEQ ID NO: 453076 - DNA, 15 bp, Homo sapiens
cactttggaaggaga

SEQ ID NO: 453077 - DNA, 15 bp, Homo sapiens
actttggaaggagaa

SEQ ID NO: 453078 - DNA, 15 bp, Homo sapiens
ctttggaaggagaaa

SEQ ID NO: 453079 - DNA, 15 bp, Homo sapiens
tttggaaggagaaag

SEQ ID NO: 453080 - DNA, 15 bp, Homo sapiens
ttggaaggagaaaga

SEQ ID NO: 453081 - DNA, 15 bp, Homo sapiens
tggaaggagaaagag

SEQ ID NO: 453082 - DNA, 15 bp, Homo sapiens
ggaaggagaaagagg

SEQ ID NO: 453083 - DNA, 15 bp, Homo sapiens
gaaggagaaagaggg

SEQ ID NO: 453084 - DNA, 15 bp, Homo sapiens
aaggagaaagagggt

SEQ ID NO: 453085 - DNA, 15 bp, Homo sapiens
aggagaaagagggtc

SEQ ID NO: 453086 - DNA, 15 bp, Homo sapiens
ggagaaagagggtca

SEQ ID NO: 453087 - DNA, 15 bp, Homo sapiens
gagaaagagggtcag

SEQ ID NO: 453088 - DNA, 15 bp, Homo sapiens
agaaagagggtcagg

SEQ ID NO: 453089 - DNA, 15 bp, Homo sapiens
gaaagagggtcagga

SEQ ID NO: 453090 - DNA, 15 bp, Homo sapiens
aaagagggtcaggag

SEQ ID NO: 453091 - DNA, 15 bp, Homo sapiens
aagagggtcaggaga

SEQ ID NO: 453092 - DNA, 15 bp, Homo sapiens
agagggtcaggagac

SEQ ID NO: 453093 - DNA, 15 bp, Homo sapiens
gagggtcaggagaca

SEQ ID NO: 453094 - DNA, 15 bp, Homo sapiens
agggtcaggagacaa

SEQ ID NO: 453095 - DNA, 15 bp, Homo sapiens
gggtcaggagacaag

SEQ ID NO: 453096 - DNA, 15 bp, Homo sapiens
ggtcaggagacaaga

SEQ ID NO: 453097 - DNA, 15 bp, Homo sapiens
gtcaggagacaagag

SEQ ID NO: 453098 - DNA, 15 bp, Homo sapiens
tcaggagacaagaga

SEQ ID NO: 453099 - DNA, 15 bp, Homo sapiens
caggagacaagagac

SEQ ID NO: 453100 - DNA, 15 bp, Homo sapiens
aggagacaagagacc

SEQ ID NO: 453101 - DNA, 15 bp, Homo sapiens
ggagacaagagaccc

SEQ ID NO: 453102 - DNA, 15 bp, Homo sapiens
gagacaagagaccca

SEQ ID NO: 453103 - DNA, 15 bp, Homo sapiens
agacaagagacccag

SEQ ID NO: 453104 - DNA, 15 bp, Homo sapiens
gacaagagacccaga

SEQ ID NO: 453105 - DNA, 15 bp, Homo sapiens
acaagagacccagag

SEQ ID NO: 453106 - DNA, 15 bp, Homo sapiens
caagagacccagagg

SEQ ID NO: 453107 - DNA, 15 bp, Homo sapiens
aagagacccagaggt

SEQ ID NO: 453108 - DNA, 15 bp, Homo sapiens
agagacccagaggtc

SEQ ID NO: 453109 - DNA, 15 bp, Homo sapiens
gagacccagaggtca

SEQ ID NO: 453110 - DNA, 15 bp, Homo sapiens
agacccagaggtcag

SEQ ID NO: 453111 - DNA, 15 bp, Homo sapiens
gacccagaggtcaga

SEQ ID NO: 453112 - DNA, 15 bp, Homo sapiens
acccagaggtcagag

SEQ ID NO: 453113 - DNA, 15 bp, Homo sapiens
cccagaggtcagaga

SEQ ID NO: 453114 - DNA, 15 bp, Homo sapiens
ccagaggtcagagag

SEQ ID NO: 453115 - DNA, 15 bp, Homo sapiens
cagaggtcagagaga

SEQ ID NO: 453116 - DNA, 15 bp, Homo sapiens
agaggtcagagagac

SEQ ID NO: 453117 - DNA, 15 bp, Homo sapiens
gaggtcagagagacc

SEQ ID NO: 453118 - DNA, 15 bp, Homo sapiens
aggtcagagagacct

SEQ ID NO: 453119 - DNA, 15 bp, Homo sapiens
ggtcagagagacctt

SEQ ID NO: 453120 - DNA, 15 bp, Homo sapiens
gtcagagagacctta

SEQ ID NO: 453121 - DNA, 15 bp, Homo sapiens
tcagagagaccttac

SEQ ID NO: 453122 - DNA, 15 bp, Homo sapiens
cagagagaccttact

SEQ ID NO: 453123 - DNA, 15 bp, Homo sapiens
agagagaccttacta

SEQ ID NO: 453124 - DNA, 15 bp, Homo sapiens
gagagaccttactac

SEQ ID NO: 453125 - DNA, 15 bp, Homo sapiens
agagaccttactact

SEQ ID NO: 453126 - DNA, 15 bp, Homo sapiens
gagaccttactactg

SEQ ID NO: 453127 - DNA, 15 bp, Homo sapiens
agaccttactactga

SEQ ID NO: 453128 - DNA, 15 bp, Homo sapiens
gaccttactactgag

SEQ ID NO: 453129 - DNA, 15 bp, Homo sapiens
accttactactgagg

SEQ ID NO: 453130 - DNA, 15 bp, Homo sapiens
ccttactactgaggc

SEQ ID NO: 453131 - DNA, 15 bp, Homo sapiens
cttactactgaggcc

SEQ ID NO: 453132 - DNA, 15 bp, Homo sapiens
ttactactgaggcct

SEQ ID NO: 453133 - DNA, 15 bp, Homo sapiens
tactactgaggcctt

SEQ ID NO: 453134 - DNA, 15 bp, Homo sapiens
actactgaggccttc

SEQ ID NO: 453135 - DNA, 15 bp, Homo sapiens
ctactgaggccttcc

SEQ ID NO: 453136 - DNA, 15 bp, Homo sapiens
tactgaggccttcca

SEQ ID NO: 453137 - DNA, 15 bp, Homo sapiens
actgaggccttccag

SEQ ID NO: 453138 - DNA, 15 bp, Homo sapiens
ctgaggccttccagt

SEQ ID NO: 453139 - DNA, 15 bp, Homo sapiens
tgaggccttccagtc

SEQ ID NO: 453140 - DNA, 15 bp, Homo sapiens
gaggccttccagtct

SEQ ID NO: 453141 - DNA, 15 bp, Homo sapiens
aggccttccagtctc

SEQ ID NO: 453142 - DNA, 15 bp, Homo sapiens
ggccttccagtctcc

SEQ ID NO: 453143 - DNA, 15 bp, Homo sapiens
gccttccagtctcct

SEQ ID NO: 453144 - DNA, 15 bp, Homo sapiens
ccttccagtctcctt

SEQ ID NO: 453145 - DNA, 15 bp, Homo sapiens
cttccagtctccttc

SEQ ID NO: 453146 - DNA, 15 bp, Homo sapiens
ttccagtctccttca

SEQ ID NO: 453147 - DNA, 15 bp, Homo sapiens
tccagtctccttcat

SEQ ID NO: 453148 - DNA, 15 bp, Homo sapiens
ccagtctccttcatt

SEQ ID NO: 453149 - DNA, 15 bp, Homo sapiens
cagtctccttcattt

SEQ ID NO: 453150 - DNA, 15 bp, Homo sapiens
agtctccttcatttc

SEQ ID NO: 453151 - DNA, 15 bp, Homo sapiens
gtctccttcatttca

SEQ ID NO: 453152 - DNA, 15 bp, Homo sapiens
tctccttcatttcaa

SEQ ID NO: 453153 - DNA, 15 bp, Homo sapiens
ctccttcatttcaaa

SEQ ID NO: 453154 - DNA, 15 bp, Homo sapiens
tccttcatttcaaag

SEQ ID NO: 453155 - DNA, 15 bp, Homo sapiens
ccttcatttcaaagt

SEQ ID NO: 453156 - DNA, 15 bp, Homo sapiens
cttcatttcaaagta

SEQ ID NO: 453157 - DNA, 15 bp, Homo sapiens
ttcatttcaaagtac

SEQ ID NO: 453158 - DNA, 15 bp, Homo sapiens
tcatttcaaagtact

SEQ ID NO: 453159 - DNA, 15 bp, Homo sapiens
catttcaaagtactc

SEQ ID NO: 453160 - DNA, 15 bp, Homo sapiens
atttcaaagtactca

SEQ ID NO: 453161 - DNA, 15 bp, Homo sapiens
tttcaaagtactcaa

SEQ ID NO: 453162 - DNA, 15 bp, Homo sapiens
ttcaaagtactcaac

SEQ ID NO: 453163 - DNA, 15 bp, Homo sapiens
tcaaagtactcaacc

SEQ ID NO: 453164 - DNA, 15 bp, Homo sapiens
caaagtactcaaccc

SEQ ID NO: 453165 - DNA, 15 bp, Homo sapiens
aaagtactcaaccca

SEQ ID NO: 453166 - DNA, 15 bp, Homo sapiens
aagtactcaacccac

SEQ ID NO: 453167 - DNA, 15 bp, Homo sapiens
agtactcaacccacc

SEQ ID NO: 453168 - DNA, 15 bp, Homo sapiens
gtactcaacccacca

SEQ ID NO: 453169 - DNA, 15 bp, Homo sapiens
tactcaacccaccat

SEQ ID NO: 453170 - DNA, 15 bp, Homo sapiens
actcaacccaccatg

SEQ ID NO: 453171 - DNA, 15 bp, Homo sapiens
ctcaacccaccatgt

SEQ ID NO: 453172 - DNA, 15 bp, Homo sapiens
tcaacccaccatgtt

SEQ ID NO: 453173 - DNA, 15 bp, Homo sapiens
caacccaccatgttc

SEQ ID NO: 453174 - DNA, 15 bp, Homo sapiens
aacccaccatgttct

SEQ ID NO: 453175 - DNA, 15 bp, Homo sapiens
acccaccatgttctg

SEQ ID NO: 453176 - DNA, 15 bp, Homo sapiens
cccaccatgttctga

SEQ ID NO: 453177 - DNA, 15 bp, Homo sapiens
ccaccatgttctgag

SEQ ID NO: 453178 - DNA, 15 bp, Homo sapiens
caccatgttctgagc

SEQ ID NO: 453179 - DNA, 15 bp, Homo sapiens
accatgttctgagcc

SEQ ID NO: 453180 - DNA, 15 bp, Homo sapiens
ccatgttctgagccc

SEQ ID NO: 453181 - DNA, 15 bp, Homo sapiens
catgttctgagccct

SEQ ID NO: 453182 - DNA, 15 bp, Homo sapiens
atgttctgagccctg

SEQ ID NO: 453183 - DNA, 15 bp, Homo sapiens
tgttctgagccctga

SEQ ID NO: 453184 - DNA, 15 bp, Homo sapiens
gttctgagccctgac

SEQ ID NO: 453185 - DNA, 15 bp, Homo sapiens
ttctgagccctgaca

SEQ ID NO: 453186 - DNA, 15 bp, Homo sapiens
tctgagccctgacac

SEQ ID NO: 453187 - DNA, 15 bp, Homo sapiens
ctgagccctgacacc

SEQ ID NO: 453188 - DNA, 15 bp, Homo sapiens
tgagccctgacacct

SEQ ID NO: 453189 - DNA, 15 bp, Homo sapiens
gagccctgacacctg

SEQ ID NO: 453190 - DNA, 15 bp, Homo sapiens
agccctgacacctgt

SEQ ID NO: 453191 - DNA, 15 bp, Homo sapiens
gccctgacacctgtt

SEQ ID NO: 453192 - DNA, 15 bp, Homo sapiens
ccctgacacctgttg

SEQ ID NO: 453193 - DNA, 15 bp, Homo sapiens
cctgacacctgttga

SEQ ID NO: 453194 - DNA, 15 bp, Homo sapiens
ctgacacctgttgaa

SEQ ID NO: 453195 - DNA, 15 bp, Homo sapiens
tgacacctgttgaaa

SEQ ID NO: 453196 - DNA, 15 bp, Homo sapiens
gacacctgttgaaaa

SEQ ID NO: 453197 - DNA, 15 bp, Homo sapiens
acacctgttgaaaat

SEQ ID NO: 453198 - DNA, 15 bp, Homo sapiens
cacctgttgaaaata

SEQ ID NO: 453199 - DNA, 15 bp, Homo sapiens
acctgttgaaaatac

SEQ ID NO: 453200 - DNA, 15 bp, Homo sapiens
cctgttgaaaatact

SEQ ID NO: 453201 - DNA, 15 bp, Homo sapiens
ctgttgaaaatactt

SEQ ID NO: 453202 - DNA, 15 bp, Homo sapiens
tgttgaaaatacttt

SEQ ID NO: 453203 - DNA, 15 bp, Homo sapiens
gttgaaaatactttc

SEQ ID NO: 453204 - DNA, 15 bp, Homo sapiens
ttgaaaatactttct

SEQ ID NO: 453205 - DNA, 15 bp, Homo sapiens
tgaaaatactttctt

SEQ ID NO: 453206 - DNA, 15 bp, Homo sapiens
gaaaatactttctta

SEQ ID NO: 453207 - DNA, 15 bp, Homo sapiens
aaaatactttcttag

SEQ ID NO: 453208 - DNA, 15 bp, Homo sapiens
aaatactttcttaga

SEQ ID NO: 453209 - DNA, 15 bp, Homo sapiens
aatactttcttagaa

SEQ ID NO: 453210 - DNA, 15 bp, Homo sapiens
atactttcttagaat

SEQ ID NO: 453211 - DNA, 15 bp, Homo sapiens
tactttcttagaatt

SEQ ID NO: 453212 - DNA, 15 bp, Homo sapiens
actttcttagaattt

SEQ ID NO: 453213 - DNA, 15 bp, Homo sapiens
ctttcttagaatttt

SEQ ID NO: 453214 - DNA, 15 bp, Homo sapiens
tttcttagaattttc

SEQ ID NO: 453215 - DNA, 15 bp, Homo sapiens
ttcttagaattttct

SEQ ID NO: 453216 - DNA, 15 bp, Homo sapiens
tcttagaattttctc

SEQ ID NO: 453217 - DNA, 15 bp, Homo sapiens
cttagaattttctct

SEQ ID NO: 453218 - DNA, 15 bp, Homo sapiens
ttagaattttctctg

SEQ ID NO: 453219 - DNA, 15 bp, Homo sapiens
tagaattttctctgt

SEQ ID NO: 453220 - DNA, 15 bp, Homo sapiens
agaattttctctgta

SEQ ID NO: 453221 - DNA, 15 bp, Homo sapiens
gaattttctctgtag

SEQ ID NO: 453222 - DNA, 15 bp, Homo sapiens
aattttctctgtagc

SEQ ID NO: 453223 - DNA, 15 bp, Homo sapiens
attttctctgtagca

SEQ ID NO: 453224 - DNA, 15 bp, Homo sapiens
ttttctctgtagcac

SEQ ID NO: 453225 - DNA, 15 bp, Homo sapiens
tttctctgtagcact

SEQ ID NO: 453226 - DNA, 15 bp, Homo sapiens
ttctctgtagcactg

SEQ ID NO: 453227 - DNA, 15 bp, Homo sapiens
tctctgtagcactgc

SEQ ID NO: 453228 - DNA, 15 bp, Homo sapiens
ctctgtagcactgct

SEQ ID NO: 453229 - DNA, 15 bp, Homo sapiens
tctgtagcactgctt

SEQ ID NO: 453230 - DNA, 15 bp, Homo sapiens
ctgtagcactgcttt

SEQ ID NO: 453231 - DNA, 15 bp, Homo sapiens
tgtagcactgctttg

SEQ ID NO: 453232 - DNA, 15 bp, Homo sapiens
gtagcactgctttga

SEQ ID NO: 453233 - DNA, 15 bp, Homo sapiens
tagcactgctttgag

SEQ ID NO: 453234 - DNA, 15 bp, Homo sapiens
agcactgctttgaga

SEQ ID NO: 453235 - DNA, 15 bp, Homo sapiens
gcactgctttgagat

SEQ ID NO: 453236 - DNA, 15 bp, Homo sapiens
cactgctttgagatg

SEQ ID NO: 453237 - DNA, 15 bp, Homo sapiens
actgctttgagatgt

SEQ ID NO: 453238 - DNA, 15 bp, Homo sapiens
ctgctttgagatgta

SEQ ID NO: 453239 - DNA, 15 bp, Homo sapiens
tgctttgagatgtat

SEQ ID NO: 453240 - DNA, 15 bp, Homo sapiens
gctttgagatgtatc

SEQ ID NO: 453241 - DNA, 15 bp, Homo sapiens
ctttgagatgtatct

SEQ ID NO: 453242 - DNA, 15 bp, Homo sapiens
tttgagatgtatctc

SEQ ID NO: 453243 - DNA, 15 bp, Homo sapiens
ttgagatgtatctca

SEQ ID NO: 453244 - DNA, 15 bp, Homo sapiens
tgagatgtatctcaa

SEQ ID NO: 453245 - DNA, 15 bp, Homo sapiens
gagatgtatctcaac

SEQ ID NO: 453246 - DNA, 15 bp, Homo sapiens
agatgtatctcaaca

SEQ ID NO: 453247 - DNA, 15 bp, Homo sapiens
gatgtatctcaacat

SEQ ID NO: 453248 - DNA, 15 bp, Homo sapiens
atgtatctcaacatg

SEQ ID NO: 453249 - DNA, 15 bp, Homo sapiens
tgtatctcaacatgg

SEQ ID NO: 453250 - DNA, 15 bp, Homo sapiens
gtatctcaacatggt

SEQ ID NO: 453251 - DNA, 15 bp, Homo sapiens
tatctcaacatggtg

SEQ ID NO: 453252 - DNA, 15 bp, Homo sapiens
atctcaacatggtgc

SEQ ID NO: 453253 - DNA, 15 bp, Homo sapiens
tctcaacatggtgct

SEQ ID NO: 453254 - DNA, 15 bp, Homo sapiens
ctcaacatggtgcta

SEQ ID NO: 453255 - DNA, 15 bp, Homo sapiens
tcaacatggtgctaa

SEQ ID NO: 453256 - DNA, 15 bp, Homo sapiens
caacatggtgctaat

SEQ ID NO: 453257 - DNA, 15 bp, Homo sapiens
aacatggtgctaatg

SEQ ID NO: 453258 - DNA, 15 bp, Homo sapiens
acatggtgctaatga

SEQ ID NO: 453259 - DNA, 15 bp, Homo sapiens
catggtgctaatgat

SEQ ID NO: 453260 - DNA, 15 bp, Homo sapiens
atggtgctaatgatc

SEQ ID NO: 453261 - DNA, 15 bp, Homo sapiens
tggtgctaatgatca

SEQ ID NO: 453262 - DNA, 15 bp, Homo sapiens
ggtgctaatgatcat

SEQ ID NO: 453263 - DNA, 15 bp, Homo sapiens
gtgctaatgatcatt

SEQ ID NO: 453264 - DNA, 15 bp, Homo sapiens
tgctaatgatcattt

SEQ ID NO: 453265 - DNA, 15 bp, Homo sapiens
gctaatgatcattta

SEQ ID NO: 453266 - DNA, 15 bp, Homo sapiens
ctaatgatcatttaa

SEQ ID NO: 453267 - DNA, 15 bp, Homo sapiens
taatgatcatttaac

SEQ ID NO: 453268 - DNA, 15 bp, Homo sapiens
aatgatcatttaact

SEQ ID NO: 453269 - DNA, 15 bp, Homo sapiens
atgatcatttaactt

SEQ ID NO: 453270 - DNA, 15 bp, Homo sapiens
tgatcatttaacttt

SEQ ID NO: 453271 - DNA, 15 bp, Homo sapiens
gatcatttaactttt

SEQ ID NO: 453272 - DNA, 15 bp, Homo sapiens
atcatttaacttttt

SEQ ID NO: 453273 - DNA, 15 bp, Homo sapiens
tcatttaactttttt

SEQ ID NO: 453274 - DNA, 15 bp, Homo sapiens
catttaacttttttc

SEQ ID NO: 453275 - DNA, 15 bp, Homo sapiens
ttaacttttttctta

SEQ ID NO: 453276 - DNA, 15 bp, Homo sapiens
taacttttttcttaa

SEQ ID NO: 453277 - DNA, 15 bp, Homo sapiens
aacttttttcttaaa

SEQ ID NO: 453278 - DNA, 15 bp, Homo sapiens
acttttttcttaaat

SEQ ID NO: 453279 - DNA, 15 bp, Homo sapiens
cttttttcttaaata

SEQ ID NO: 453280 - DNA, 15 bp, Homo sapiens
ttttttcttaaatac

SEQ ID NO: 453281 - DNA, 15 bp, Homo sapiens
tttttcttaaatacg

SEQ ID NO: 453282 - DNA, 15 bp, Homo sapiens
ttttcttaaatacgt

SEQ ID NO: 453283 - DNA, 15 bp, Homo sapiens
tttcttaaatacgtg

SEQ ID NO: 453284 - DNA, 15 bp, Homo sapiens
ttcttaaatacgtgt

SEQ ID NO: 453285 - DNA, 15 bp, Homo sapiens
tcttaaatacgtgtt

SEQ ID NO: 453286 - DNA, 15 bp, Homo sapiens
cttaaatacgtgttg

SEQ ID NO: 453287 - DNA, 15 bp, Homo sapiens
ttaaatacgtgttgg

SEQ ID NO: 453288 - DNA, 15 bp, Homo sapiens
taaatacgtgttggg

SEQ ID NO: 453289 - DNA, 15 bp, Homo sapiens
aaatacgtgttgggg

SEQ ID NO: 453290 - DNA, 15 bp, Homo sapiens
aatacgtgttgggga

SEQ ID NO: 453291 - DNA, 15 bp, Homo sapiens
atacgtgttggggaa

SEQ ID NO: 453292 - DNA, 15 bp, Homo sapiens
tacgtgttggggaat

SEQ ID NO: 453293 - DNA, 15 bp, Homo sapiens
acgtgttggggaatt

SEQ ID NO: 453294 - DNA, 15 bp, Homo sapiens
cgtgttggggaattt

SEQ ID NO: 453295 - DNA, 15 bp, Homo sapiens
gtgttggggaatttg

SEQ ID NO: 453296 - DNA, 15 bp, Homo sapiens
tgttggggaatttgg

SEQ ID NO: 453297 - DNA, 15 bp, Homo sapiens
gttggggaatttggg

SEQ ID NO: 453298 - DNA, 15 bp, Homo sapiens
ttggggaatttggga

SEQ ID NO: 453299 - DNA, 15 bp, Homo sapiens
tggggaatttgggag

SEQ ID NO: 453300 - DNA, 15 bp, Homo sapiens
ggggaatttgggaga

SEQ ID NO: 453301 - DNA, 15 bp, Homo sapiens
gggaatttgggagaa

SEQ ID NO: 453302 - DNA, 15 bp, Homo sapiens
ggaatttgggagaag

SEQ ID NO: 453303 - DNA, 15 bp, Homo sapiens
gaatttgggagaaga

SEQ ID NO: 453304 - DNA, 15 bp, Homo sapiens
aatttgggagaagac

SEQ ID NO: 453305 - DNA, 15 bp, Homo sapiens
atttgggagaagact

SEQ ID NO: 453306 - DNA, 15 bp, Homo sapiens
tttgggagaagactt

SEQ ID NO: 453307 - DNA, 15 bp, Homo sapiens
ttgggagaagacttt

SEQ ID NO: 453308 - DNA, 15 bp, Homo sapiens
tgggagaagactttt

SEQ ID NO: 453309 - DNA, 15 bp, Homo sapiens
gggagaagacttttt

SEQ ID NO: 453310 - DNA, 15 bp, Homo sapiens
ggagaagacttttta

SEQ ID NO: 453311 - DNA, 15 bp, Homo sapiens
gagaagactttttat

SEQ ID NO: 453312 - DNA, 15 bp, Homo sapiens
agaagactttttatt

SEQ ID NO: 453313 - DNA, 15 bp, Homo sapiens
gaagactttttattt

SEQ ID NO: 453314 - DNA, 15 bp, Homo sapiens
aagactttttatttc

SEQ ID NO: 453315 - DNA, 15 bp, Homo sapiens
agactttttatttca

SEQ ID NO: 453316 - DNA, 15 bp, Homo sapiens
gactttttatttcag

SEQ ID NO: 453317 - DNA, 15 bp, Homo sapiens
actttttatttcagg

SEQ ID NO: 453318 - DNA, 15 bp, Homo sapiens
ctttttatttcaggc

SEQ ID NO: 453319 - DNA, 15 bp, Homo sapiens
tttttatttcaggca

SEQ ID NO: 453320 - DNA, 15 bp, Homo sapiens
ttttatttcaggcaa

SEQ ID NO: 453321 - DNA, 15 bp, Homo sapiens
tttatttcaggcaaa

SEQ ID NO: 453322 - DNA, 15 bp, Homo sapiens
ttatttcaggcaaac

SEQ ID NO: 453323 - DNA, 15 bp, Homo sapiens
tatttcaggcaaaca

SEQ ID NO: 453324 - DNA, 15 bp, Homo sapiens
atttcaggcaaacat

SEQ ID NO: 453325 - DNA, 15 bp, Homo sapiens
tttcaggcaaacata

SEQ ID NO: 453326 - DNA, 15 bp, Homo sapiens
ttcaggcaaacataa

SEQ ID NO: 453327 - DNA, 15 bp, Homo sapiens
tcaggcaaacataat

SEQ ID NO: 453328 - DNA, 15 bp, Homo sapiens
caggcaaacataata

SEQ ID NO: 453329 - DNA, 15 bp, Homo sapiens
aggcaaacataatat

SEQ ID NO: 453330 - DNA, 15 bp, Homo sapiens
ggcaaacataatatt

SEQ ID NO: 453331 - DNA, 15 bp, Homo sapiens
gcaaacataatattt

SEQ ID NO: 453332 - DNA, 15 bp, Homo sapiens
caaacataatatttt

SEQ ID NO: 453333 - DNA, 15 bp, Homo sapiens
aaacataatattttt

SEQ ID NO: 453334 - DNA, 15 bp, Homo sapiens
aacataatatttttt

SEQ ID NO: 453335 - DNA, 15 bp, Homo sapiens
acataatattttttc

SEQ ID NO: 453336 - DNA, 15 bp, Homo sapiens
cataatattttttca

SEQ ID NO: 453337 - DNA, 15 bp, Homo sapiens
ataatattttttcat

SEQ ID NO: 453338 - DNA, 15 bp, Homo sapiens
taatattttttcatc

SEQ ID NO: 453339 - DNA, 15 bp, Homo sapiens
aatattttttcatca

SEQ ID NO: 453340 - DNA, 15 bp, Homo sapiens
atattttttcatcat

SEQ ID NO: 453341 - DNA, 15 bp, Homo sapiens
tattttttcatcatc

SEQ ID NO: 453342 - DNA, 15 bp, Homo sapiens
attttttcatcatcc

SEQ ID NO: 453343 - DNA, 15 bp, Homo sapiens
ttttttcatcatcca

SEQ ID NO: 453344 - DNA, 15 bp, Homo sapiens
tttttcatcatccaa

SEQ ID NO: 453345 - DNA, 15 bp, Homo sapiens
ttttcatcatccaaa

SEQ ID NO: 453346 - DNA, 15 bp, Homo sapiens
tttcatcatccaaag

SEQ ID NO: 453347 - DNA, 15 bp, Homo sapiens
ttcatcatccaaagt

SEQ ID NO: 453348 - DNA, 15 bp, Homo sapiens
tcatcatccaaagta

SEQ ID NO: 453349 - DNA, 15 bp, Homo sapiens
catcatccaaagtaa

SEQ ID NO: 453350 - DNA, 15 bp, Homo sapiens
atcatccaaagtaac

SEQ ID NO: 453351 - DNA, 15 bp, Homo sapiens
tcatccaaagtaacc

SEQ ID NO: 453352 - DNA, 15 bp, Homo sapiens
catccaaagtaacca

SEQ ID NO: 453353 - DNA, 15 bp, Homo sapiens
atccaaagtaaccaa

SEQ ID NO: 453354 - DNA, 15 bp, Homo sapiens
tccaaagtaaccaaa

SEQ ID NO: 453355 - DNA, 15 bp, Homo sapiens
ccaaagtaaccaaat

SEQ ID NO: 453356 - DNA, 15 bp, Homo sapiens
caaagtaaccaaata

SEQ ID NO: 453357 - DNA, 15 bp, Homo sapiens
aaagtaaccaaatac

SEQ ID NO: 453358 - DNA, 15 bp, Homo sapiens
aagtaaccaaataca

SEQ ID NO: 453359 - DNA, 15 bp, Homo sapiens
agtaaccaaatacat

SEQ ID NO: 453360 - DNA, 15 bp, Homo sapiens
gtaaccaaatacatt

SEQ ID NO: 453361 - DNA, 15 bp, Homo sapiens
taaccaaatacattc

SEQ ID NO: 453362 - DNA, 15 bp, Homo sapiens
aaccaaatacattct

SEQ ID NO: 453363 - DNA, 15 bp, Homo sapiens
accaaatacattctg

SEQ ID NO: 453364 - DNA, 15 bp, Homo sapiens
ccaaatacattctgg

SEQ ID NO: 453365 - DNA, 15 bp, Homo sapiens
caaatacattctggg

SEQ ID NO: 453366 - DNA, 15 bp, Homo sapiens
aaatacattctgggc

SEQ ID NO: 453367 - DNA, 15 bp, Homo sapiens
aatacattctgggca

SEQ ID NO: 453368 - DNA, 15 bp, Homo sapiens
atacattctgggcat

SEQ ID NO: 453369 - DNA, 15 bp, Homo sapiens
tacattctgggcatt

SEQ ID NO: 453370 - DNA, 15 bp, Homo sapiens
acattctgggcattc

SEQ ID NO: 453371 - DNA, 15 bp, Homo sapiens
cattctgggcattca

SEQ ID NO: 453372 - DNA, 15 bp, Homo sapiens
attctgggcattcaa

SEQ ID NO: 453373 - DNA, 15 bp, Homo sapiens
ttctgggcattcaat

SEQ ID NO: 453374 - DNA, 15 bp, Homo sapiens
tctgggcattcaata

SEQ ID NO: 453375 - DNA, 15 bp, Homo sapiens
ctgggcattcaatat

SEQ ID NO: 453376 - DNA, 15 bp, Homo sapiens
tgggcattcaatata

SEQ ID NO: 453377 - DNA, 15 bp, Homo sapiens
gggcattcaatatat

SEQ ID NO: 453378 - DNA, 15 bp, Homo sapiens
ggcattcaatatata

SEQ ID NO: 453379 - DNA, 15 bp, Homo sapiens
gcattcaatatatat

SEQ ID NO: 453380 - DNA, 15 bp, Homo sapiens
cattcaatatatatt

SEQ ID NO: 453381 - DNA, 15 bp, Homo sapiens
attcaatatatattc

SEQ ID NO: 453382 - DNA, 15 bp, Homo sapiens
ttcaatatatattca

SEQ ID NO: 453383 - DNA, 15 bp, Homo sapiens
tcaatatatattcaa

SEQ ID NO: 453384 - DNA, 15 bp, Homo sapiens
caatatatattcaat

SEQ ID NO: 453385 - DNA, 15 bp, Homo sapiens
aatatatattcaata

SEQ ID NO: 453386 - DNA, 15 bp, Homo sapiens
atatatattcaataa

SEQ ID NO: 453387 - DNA, 15 bp, Homo sapiens
tatatattcaataat

SEQ ID NO: 453388 - DNA, 15 bp, Homo sapiens
atatattcaataata

SEQ ID NO: 453389 - DNA, 15 bp, Homo sapiens
tatattcaataataa

SEQ ID NO: 453390 - DNA, 15 bp, Homo sapiens
atattcaataataag

SEQ ID NO: 453391 - DNA, 15 bp, Homo sapiens
tattcaataataagc

SEQ ID NO: 453392 - DNA, 15 bp, Homo sapiens
attcaataataagcc

SEQ ID NO: 453393 - DNA, 15 bp, Homo sapiens
ttcaataataagcct

SEQ ID NO: 453394 - DNA, 15 bp, Homo sapiens
tcaataataagccta

SEQ ID NO: 453395 - DNA, 15 bp, Homo sapiens
caataataagcctat

SEQ ID NO: 453396 - DNA, 15 bp, Homo sapiens
aataataagcctatc

SEQ ID NO: 453397 - DNA, 15 bp, Homo sapiens
ataataagcctatct

SEQ ID NO: 453398 - DNA, 15 bp, Homo sapiens
taataagcctatctt

SEQ ID NO: 453399 - DNA, 15 bp, Homo sapiens
aataagcctatcttc

SEQ ID NO: 453400 - DNA, 15 bp, Homo sapiens
ataagcctatcttca

SEQ ID NO: 453401 - DNA, 15 bp, Homo sapiens
taagcctatcttcaa

SEQ ID NO: 453402 - DNA, 15 bp, Homo sapiens
aagcctatcttcaaa

SEQ ID NO: 453403 - DNA, 15 bp, Homo sapiens
agcctatcttcaaat

SEQ ID NO: 453404 - DNA, 15 bp, Homo sapiens
gcctatcttcaaatt

SEQ ID NO: 453405 - DNA, 15 bp, Homo sapiens
cctatcttcaaattg

SEQ ID NO: 453406 - DNA, 15 bp, Homo sapiens
ctatcttcaaattgt

SEQ ID NO: 453407 - DNA, 15 bp, Homo sapiens
tatcttcaaattgtt

SEQ ID NO: 453408 - DNA, 15 bp, Homo sapiens
atcttcaaattgttt

SEQ ID NO: 453409 - DNA, 15 bp, Homo sapiens
tcttcaaattgtttc

SEQ ID NO: 453410 - DNA, 15 bp, Homo sapiens
cttcaaattgtttct

SEQ ID NO: 453411 - DNA, 15 bp, Homo sapiens
ttcaaattgtttctt

SEQ ID NO: 453412 - DNA, 15 bp, Homo sapiens
tcaaattgtttcttt

SEQ ID NO: 453413 - DNA, 15 bp, Homo sapiens
caaattgtttctttt

SEQ ID NO: 453414 - DNA, 15 bp, Homo sapiens
aaattgtttcttttt

SEQ ID NO: 453415 - DNA, 15 bp, Homo sapiens
aattgtttctttttc

SEQ ID NO: 453416 - DNA, 15 bp, Homo sapiens
attgtttctttttct

SEQ ID NO: 453417 - DNA, 15 bp, Homo sapiens
ttgtttctttttcta

SEQ ID NO: 453418 - DNA, 15 bp, Homo sapiens
tgtttctttttctat

SEQ ID NO: 453419 - DNA, 15 bp, Homo sapiens
gtttctttttctatt

SEQ ID NO: 453420 - DNA, 15 bp, Homo sapiens
tttctttttctattt

SEQ ID NO: 453421 - DNA, 15 bp, Homo sapiens
ttctttttctatttc

SEQ ID NO: 453422 - DNA, 15 bp, Homo sapiens
tctttttctatttca

SEQ ID NO: 453423 - DNA, 15 bp, Homo sapiens
ctttttctatttcag

SEQ ID NO: 453424 - DNA, 15 bp, Homo sapiens
tttttctatttcagc

SEQ ID NO: 453425 - DNA, 15 bp, Homo sapiens
ttttctatttcagct

SEQ ID NO: 453426 - DNA, 15 bp, Homo sapiens
tttctatttcagctg

SEQ ID NO: 453427 - DNA, 15 bp, Homo sapiens
ttctatttcagctga

SEQ ID NO: 453428 - DNA, 15 bp, Homo sapiens
tctatttcagctgac

SEQ ID NO: 453429 - DNA, 15 bp, Homo sapiens
ctatttcagctgacc

SEQ ID NO: 453430 - DNA, 15 bp, Homo sapiens
tatttcagctgacct

SEQ ID NO: 453431 - DNA, 15 bp, Homo sapiens
atttcagctgacctg

SEQ ID NO: 453432 - DNA, 15 bp, Homo sapiens
tttcagctgacctga

SEQ ID NO: 453433 - DNA, 15 bp, Homo sapiens
ttcagctgacctgaa

SEQ ID NO: 453434 - DNA, 15 bp, Homo sapiens
tcagctgacctgaat

SEQ ID NO: 453435 - DNA, 15 bp, Homo sapiens
cagctgacctgaata

SEQ ID NO: 453436 - DNA, 15 bp, Homo sapiens
agctgacctgaataa

SEQ ID NO: 453437 - DNA, 15 bp, Homo sapiens
gctgacctgaataat

SEQ ID NO: 453438 - DNA, 15 bp, Homo sapiens
ctgacctgaataatg

SEQ ID NO: 453439 - DNA, 15 bp, Homo sapiens
tgacctgaataatgt

SEQ ID NO: 453440 - DNA, 15 bp, Homo sapiens
gacctgaataatgta

SEQ ID NO: 453441 - DNA, 15 bp, Homo sapiens
acctgaataatgtac

SEQ ID NO: 453442 - DNA, 15 bp, Homo sapiens
cctgaataatgtacg

SEQ ID NO: 453443 - DNA, 15 bp, Homo sapiens
ctgaataatgtacgt

SEQ ID NO: 453444 - DNA, 15 bp, Homo sapiens
tgaataatgtacgtt

SEQ ID NO: 453445 - DNA, 15 bp, Homo sapiens
gaataatgtacgttt

SEQ ID NO: 453446 - DNA, 15 bp, Homo sapiens
aataatgtacgtttt

SEQ ID NO: 453447 - DNA, 15 bp, Homo sapiens
ataatgtacgttttt

SEQ ID NO: 453448 - DNA, 15 bp, Homo sapiens
taatgtacgtttttc

SEQ ID NO: 453449 - DNA, 15 bp, Homo sapiens
aatgtacgtttttct

SEQ ID NO: 453450 - DNA, 15 bp, Homo sapiens
atgtacgtttttctg

SEQ ID NO: 453451 - DNA, 15 bp, Homo sapiens
tgtacgtttttctgc

SEQ ID NO: 453452 - DNA, 15 bp, Homo sapiens
gtacgtttttctgcc

SEQ ID NO: 453453 - DNA, 15 bp, Homo sapiens
tacgtttttctgcct

SEQ ID NO: 453454 - DNA, 15 bp, Homo sapiens
acgtttttctgccta

SEQ ID NO: 453455 - DNA, 15 bp, Homo sapiens
cgtttttctgcctac

SEQ ID NO: 453456 - DNA, 15 bp, Homo sapiens
gtttttctgcctacc

SEQ ID NO: 453457 - DNA, 15 bp, Homo sapiens
tttttctgcctaccg

SEQ ID NO: 453458 - DNA, 15 bp, Homo sapiens
ttttctgcctaccgt

SEQ ID NO: 453459 - DNA, 15 bp, Homo sapiens
tttctgcctaccgta

SEQ ID NO: 453460 - DNA, 15 bp, Homo sapiens
ttctgcctaccgtac

SEQ ID NO: 453461 - DNA, 15 bp, Homo sapiens
tctgcctaccgtaca

SEQ ID NO: 453462 - DNA, 15 bp, Homo sapiens
ctgcctaccgtacag

SEQ ID NO: 453463 - DNA, 15 bp, Homo sapiens
tgcctaccgtacagc

SEQ ID NO: 453464 - DNA, 15 bp, Homo sapiens
gcctaccgtacagca

SEQ ID NO: 453465 - DNA, 15 bp, Homo sapiens
cctaccgtacagcaa

SEQ ID NO: 453466 - DNA, 15 bp, Homo sapiens
ctaccgtacagcaat

SEQ ID NO: 453467 - DNA, 15 bp, Homo sapiens
taccgtacagcaatc

SEQ ID NO: 453468 - DNA, 15 bp, Homo sapiens
accgtacagcaatca

SEQ ID NO: 453469 - DNA, 15 bp, Homo sapiens
ccgtacagcaatcaa

SEQ ID NO: 453470 - DNA, 15 bp, Homo sapiens
cgtacagcaatcaaa

SEQ ID NO: 453471 - DNA, 15 bp, Homo sapiens
gtacagcaatcaaaa

SEQ ID NO: 453472 - DNA, 15 bp, Homo sapiens
tacagcaatcaaaat

SEQ ID NO: 453473 - DNA, 15 bp, Homo sapiens
acagcaatcaaaatc

SEQ ID NO: 453474 - DNA, 15 bp, Homo sapiens
cagcaatcaaaatcc

SEQ ID NO: 453475 - DNA, 15 bp, Homo sapiens
agcaatcaaaatccg

SEQ ID NO: 453476 - DNA, 15 bp, Homo sapiens
gcaatcaaaatccga

SEQ ID NO: 453477 - DNA, 15 bp, Homo sapiens
caatcaaaatccgaa

SEQ ID NO: 453478 - DNA, 15 bp, Homo sapiens
aatcaaaatccgaag

SEQ ID NO: 453479 - DNA, 15 bp, Homo sapiens
atcaaaatccgaaga

SEQ ID NO: 453480 - DNA, 15 bp, Homo sapiens
tcaaaatccgaagac

SEQ ID NO: 453481 - DNA, 15 bp, Homo sapiens
caaaatccgaagact

SEQ ID NO: 453482 - DNA, 15 bp, Homo sapiens
aaaatccgaagacta

SEQ ID NO: 453483 - DNA, 15 bp, Homo sapiens
aaatccgaagactac

SEQ ID NO: 453484 - DNA, 15 bp, Homo sapiens
aatccgaagactaca

SEQ ID NO: 453485 - DNA, 15 bp, Homo sapiens
atccgaagactacaa

SEQ ID NO: 453486 - DNA, 15 bp, Homo sapiens
tccgaagactacaaa

SEQ ID NO: 453487 - DNA, 15 bp, Homo sapiens
ccgaagactacaaaa

SEQ ID NO: 453488 - DNA, 15 bp, Homo sapiens
cgaagactacaaaaa

SEQ ID NO: 453489 - DNA, 15 bp, Homo sapiens
gaagactacaaaaag

SEQ ID NO: 453490 - DNA, 15 bp, Homo sapiens
aagactacaaaaagc

SEQ ID NO: 453491 - DNA, 15 bp, Homo sapiens
agactacaaaaagca

SEQ ID NO: 453492 - DNA, 15 bp, Homo sapiens
gactacaaaaagcac

SEQ ID NO: 453493 - DNA, 15 bp, Homo sapiens
actacaaaaagcact

SEQ ID NO: 453494 - DNA, 15 bp, Homo sapiens
ctacaaaaagcacta

SEQ ID NO: 453495 - DNA, 15 bp, Homo sapiens
tacaaaaagcactat

SEQ ID NO: 453496 - DNA, 15 bp, Homo sapiens
acaaaaagcactatg

SEQ ID NO: 453497 - DNA, 15 bp, Homo sapiens
caaaaagcactatgt

SEQ ID NO: 453498 - DNA, 15 bp, Homo sapiens
aaaaagcactatgtt

SEQ ID NO: 453499 - DNA, 15 bp, Homo sapiens
aaaagcactatgttg

SEQ ID NO: 453500 - DNA, 15 bp, Homo sapiens
aaagcactatgttgt

SEQ ID NO: 453501 - DNA, 15 bp, Homo sapiens
aagcactatgttgtg

SEQ ID NO: 453502 - DNA, 15 bp, Homo sapiens
agcactatgttgtga

SEQ ID NO: 453503 - DNA, 15 bp, Homo sapiens
gcactatgttgtgag

SEQ ID NO: 453504 - DNA, 15 bp, Homo sapiens
cactatgttgtgagt

SEQ ID NO: 453505 - DNA, 15 bp, Homo sapiens
actatgttgtgagtt

SEQ ID NO: 453506 - DNA, 15 bp, Homo sapiens
ctatgttgtgagtta

SEQ ID NO: 453507 - DNA, 15 bp, Homo sapiens
tatgttgtgagttat

SEQ ID NO: 453508 - DNA, 15 bp, Homo sapiens
atgttgtgagttatt

SEQ ID NO: 453509 - DNA, 15 bp, Homo sapiens
tgttgtgagttattc

SEQ ID NO: 453510 - DNA, 15 bp, Homo sapiens
gttgtgagttattct

SEQ ID NO: 453511 - DNA, 15 bp, Homo sapiens
ttgtgagttattcta

SEQ ID NO: 453512 - DNA, 15 bp, Homo sapiens
tgtgagttattctac

SEQ ID NO: 453513 - DNA, 15 bp, Homo sapiens
gtgagttattctacc

SEQ ID NO: 453514 - DNA, 15 bp, Homo sapiens
tgagttattctacca

SEQ ID NO: 453515 - DNA, 15 bp, Homo sapiens
gagttattctaccaa

SEQ ID NO: 453516 - DNA, 15 bp, Homo sapiens
agttattctaccaaa

SEQ ID NO: 453517 - DNA, 15 bp, Homo sapiens
gttattctaccaaag

SEQ ID NO: 453518 - DNA, 15 bp, Homo sapiens
ttattctaccaaagt

SEQ ID NO: 453519 - DNA, 15 bp, Homo sapiens
tattctaccaaagtt

SEQ ID NO: 453520 - DNA, 15 bp, Homo sapiens
attctaccaaagtta

SEQ ID NO: 453521 - DNA, 15 bp, Homo sapiens
ttctaccaaagttaa

SEQ ID NO: 453522 - DNA, 15 bp, Homo sapiens
tctaccaaagttaat

SEQ ID NO: 453523 - DNA, 15 bp, Homo sapiens
ctaccaaagttaatc

SEQ ID NO: 453524 - DNA, 15 bp, Homo sapiens
taccaaagttaatca

SEQ ID NO: 453525 - DNA, 15 bp, Homo sapiens
accaaagttaatcaa

SEQ ID NO: 453526 - DNA, 15 bp, Homo sapiens
ccaaagttaatcaat

SEQ ID NO: 453527 - DNA, 15 bp, Homo sapiens
caaagttaatcaatc

SEQ ID NO: 453528 - DNA, 15 bp, Homo sapiens
aaagttaatcaatct

SEQ ID NO: 453529 - DNA, 15 bp, Homo sapiens
aagttaatcaatctg

SEQ ID NO: 453530 - DNA, 15 bp, Homo sapiens
agttaatcaatctgt

SEQ ID NO: 453531 - DNA, 15 bp, Homo sapiens
gttaatcaatctgtt

SEQ ID NO: 453532 - DNA, 15 bp, Homo sapiens
ttaatcaatctgtta

SEQ ID NO: 453533 - DNA, 15 bp, Homo sapiens
taatcaatctgttac

SEQ ID NO: 453534 - DNA, 15 bp, Homo sapiens
aatcaatctgttact

SEQ ID NO: 453535 - DNA, 15 bp, Homo sapiens
atcaatctgttactt

SEQ ID NO: 453536 - DNA, 15 bp, Homo sapiens
tcaatctgttacttg

SEQ ID NO: 453537 - DNA, 15 bp, Homo sapiens
caatctgttacttga

SEQ ID NO: 453538 - DNA, 15 bp, Homo sapiens
aatctgttacttgaa

SEQ ID NO: 453539 - DNA, 15 bp, Homo sapiens
atctgttacttgaat

SEQ ID NO: 453540 - DNA, 15 bp, Homo sapiens
tctgttacttgaatt

SEQ ID NO: 453541 - DNA, 15 bp, Homo sapiens
ctgttacttgaattg

SEQ ID NO: 453542 - DNA, 15 bp, Homo sapiens
tgttacttgaattgc

SEQ ID NO: 453543 - DNA, 15 bp, Homo sapiens
gttacttgaattgcg

SEQ ID NO: 453544 - DNA, 15 bp, Homo sapiens
ttacttgaattgcgt

SEQ ID NO: 453545 - DNA, 15 bp, Homo sapiens
tacttgaattgcgtt

SEQ ID NO: 453546 - DNA, 15 bp, Homo sapiens
acttgaattgcgttt

SEQ ID NO: 453547 - DNA, 15 bp, Homo sapiens
cttgaattgcgtttt

SEQ ID NO: 453548 - DNA, 15 bp, Homo sapiens
ttgaattgcgttttt

SEQ ID NO: 453549 - DNA, 15 bp, Homo sapiens
tgaattgcgtttttt

SEQ ID NO: 453550 - DNA, 15 bp, Homo sapiens
gaattgcgttttttt

SEQ ID NO: 453551 - DNA, 15 bp, Homo sapiens
aattgcgtttttttt

SEQ ID NO: 453552 - DNA, 15 bp, Homo sapiens
attgcgttttttttt

SEQ ID NO: 453553 - DNA, 15 bp, Homo sapiens
ttgcgtttttttttt

SEQ ID NO: 453554 - DNA, 15 bp, Homo sapiens
tgcgttttttttttt

SEQ ID NO: 453555 - DNA, 15 bp, Homo sapiens
gcgtttttttttttt

SEQ ID NO: 453556 - DNA, 15 bp, Homo sapiens
gttttttttttttcc

SEQ ID NO: 453557 - DNA, 15 bp, Homo sapiens
ttttttttttccaag

SEQ ID NO: 453558 - DNA, 15 bp, Homo sapiens
tttttttttccaaga

SEQ ID NO: 453559 - DNA, 15 bp, Homo sapiens
ttttttttccaagag

SEQ ID NO: 453560 - DNA, 15 bp, Homo sapiens
tttttttccaagagg

SEQ ID NO: 453561 - DNA, 15 bp, Homo sapiens
ttttttccaagagga

SEQ ID NO: 453562 - DNA, 15 bp, Homo sapiens
tttttccaagaggaa

SEQ ID NO: 453563 - DNA, 15 bp, Homo sapiens
ttttccaagaggaag

SEQ ID NO: 453564 - DNA, 15 bp, Homo sapiens
tttccaagaggaaga

SEQ ID NO: 453565 - DNA, 15 bp, Homo sapiens
ttccaagaggaagat

SEQ ID NO: 453566 - DNA, 15 bp, Homo sapiens
tccaagaggaagata

SEQ ID NO: 453567 - DNA, 15 bp, Homo sapiens
ccaagaggaagataa

SEQ ID NO: 453568 - DNA, 15 bp, Homo sapiens
caagaggaagataaa

SEQ ID NO: 453569 - DNA, 15 bp, Homo sapiens
aagaggaagataaat

SEQ ID NO: 453570 - DNA, 15 bp, Homo sapiens
agaggaagataaatg

SEQ ID NO: 453571 - DNA, 15 bp, Homo sapiens
gaggaagataaatga

SEQ ID NO: 453572 - DNA, 15 bp, Homo sapiens
aggaagataaatgaa

SEQ ID NO: 453573 - DNA, 15 bp, Homo sapiens
ggaagataaatgaag

SEQ ID NO: 453574 - DNA, 15 bp, Homo sapiens
gaagataaatgaaga

SEQ ID NO: 453575 - DNA, 15 bp, Homo sapiens
aagataaatgaagag

SEQ ID NO: 453576 - DNA, 15 bp, Homo sapiens
agataaatgaagagg

SEQ ID NO: 453577 - DNA, 15 bp, Homo sapiens
gataaatgaagagga

SEQ ID NO: 453578 - DNA, 15 bp, Homo sapiens
ataaatgaagaggat

SEQ ID NO: 453579 - DNA, 15 bp, Homo sapiens
taaatgaagaggatg

SEQ ID NO: 453580 - DNA, 15 bp, Homo sapiens
aaatgaagaggatgg

SEQ ID NO: 453581 - DNA, 15 bp, Homo sapiens
aatgaagaggatgga

SEQ ID NO: 453582 - DNA, 15 bp, Homo sapiens
atgaagaggatggag

SEQ ID NO: 453583 - DNA, 15 bp, Homo sapiens
tgaagaggatggagt

SEQ ID NO: 453584 - DNA, 15 bp, Homo sapiens
gaagaggatggagtg

SEQ ID NO: 453585 - DNA, 15 bp, Homo sapiens
aagaggatggagtgt

SEQ ID NO: 453586 - DNA, 15 bp, Homo sapiens
agaggatggagtgtt

SEQ ID NO: 453587 - DNA, 15 bp, Homo sapiens
gaggatggagtgttt

SEQ ID NO: 453588 - DNA, 15 bp, Homo sapiens
aggatggagtgtttg

SEQ ID NO: 453589 - DNA, 15 bp, Homo sapiens
ggatggagtgtttgc

SEQ ID NO: 453590 - DNA, 15 bp, Homo sapiens
gatggagtgtttgcc

SEQ ID NO: 453591 - DNA, 15 bp, Homo sapiens
atggagtgtttgcca

SEQ ID NO: 453592 - DNA, 15 bp, Homo sapiens
tggagtgtttgccaa

SEQ ID NO: 453593 - DNA, 15 bp, Homo sapiens
ggagtgtttgccaag

SEQ ID NO: 453594 - DNA, 15 bp, Homo sapiens
gagtgtttgccaagt

SEQ ID NO: 453595 - DNA, 15 bp, Homo sapiens
agtgtttgccaagtt

SEQ ID NO: 453596 - DNA, 15 bp, Homo sapiens
gtgtttgccaagtta

SEQ ID NO: 453597 - DNA, 15 bp, Homo sapiens
tgtttgccaagttaa

SEQ ID NO: 453598 - DNA, 15 bp, Homo sapiens
gtttgccaagttaat

SEQ ID NO: 453599 - DNA, 15 bp, Homo sapiens
tttgccaagttaatc

SEQ ID NO: 453600 - DNA, 15 bp, Homo sapiens
ttgccaagttaatct

SEQ ID NO: 453601 - DNA, 15 bp, Homo sapiens
tgccaagttaatctg

SEQ ID NO: 453602 - DNA, 15 bp, Homo sapiens
gccaagttaatctgg

SEQ ID NO: 453603 - DNA, 15 bp, Homo sapiens
ccaagttaatctggt

SEQ ID NO: 453604 - DNA, 15 bp, Homo sapiens
caagttaatctggtc

SEQ ID NO: 453605 - DNA, 15 bp, Homo sapiens
aagttaatctggtct

SEQ ID NO: 453606 - DNA, 15 bp, Homo sapiens
agttaatctggtctt

SEQ ID NO: 453607 - DNA, 15 bp, Homo sapiens
gttaatctggtcttc

SEQ ID NO: 453608 - DNA, 15 bp, Homo sapiens
ttaatctggtcttca

SEQ ID NO: 453609 - DNA, 15 bp, Homo sapiens
taatctggtcttcag

SEQ ID NO: 453610 - DNA, 15 bp, Homo sapiens
aatctggtcttcagt

SEQ ID NO: 453611 - DNA, 15 bp, Homo sapiens
atctggtcttcagtg

SEQ ID NO: 453612 - DNA, 15 bp, Homo sapiens
tctggtcttcagtgt

SEQ ID NO: 453613 - DNA, 15 bp, Homo sapiens
ctggtcttcagtgta

SEQ ID NO: 453614 - DNA, 15 bp, Homo sapiens
tggtcttcagtgtac

SEQ ID NO: 453615 - DNA, 15 bp, Homo sapiens
ggtcttcagtgtacc

SEQ ID NO: 453616 - DNA, 15 bp, Homo sapiens
gtcttcagtgtacct

SEQ ID NO: 453617 - DNA, 15 bp, Homo sapiens
tcttcagtgtacctc

SEQ ID NO: 453618 - DNA, 15 bp, Homo sapiens
cttcagtgtacctca

SEQ ID NO: 453619 - DNA, 15 bp, Homo sapiens
ttcagtgtacctcac

SEQ ID NO: 453620 - DNA, 15 bp, Homo sapiens
tcagtgtacctcact

SEQ ID NO: 453621 - DNA, 15 bp, Homo sapiens
cagtgtacctcactc

SEQ ID NO: 453622 - DNA, 15 bp, Homo sapiens
agtgtacctcactca

SEQ ID NO: 453623 - DNA, 15 bp, Homo sapiens
gtgtacctcactcaa

SEQ ID NO: 453624 - DNA, 15 bp, Homo sapiens
tgtacctcactcaag

SEQ ID NO: 453625 - DNA, 15 bp, Homo sapiens
gtacctcactcaagg

SEQ ID NO: 453626 - DNA, 15 bp, Homo sapiens
tacctcactcaagga

SEQ ID NO: 453627 - DNA, 15 bp, Homo sapiens
acctcactcaaggag

SEQ ID NO: 453628 - DNA, 15 bp, Homo sapiens
cctcactcaaggagt

SEQ ID NO: 453629 - DNA, 15 bp, Homo sapiens
ctcactcaaggagtt

SEQ ID NO: 453630 - DNA, 15 bp, Homo sapiens
tcactcaaggagttg

SEQ ID NO: 453631 - DNA, 15 bp, Homo sapiens
cactcaaggagttgg

SEQ ID NO: 453632 - DNA, 15 bp, Homo sapiens
actcaaggagttggt

SEQ ID NO: 453633 - DNA, 15 bp, Homo sapiens
ctcaaggagttggtt

SEQ ID NO: 453634 - DNA, 15 bp, Homo sapiens
tcaaggagttggttt

SEQ ID NO: 453635 - DNA, 15 bp, Homo sapiens
caaggagttggtttt

SEQ ID NO: 453636 - DNA, 15 bp, Homo sapiens
aaggagttggttttg

SEQ ID NO: 453637 - DNA, 15 bp, Homo sapiens
aggagttggttttgt

SEQ ID NO: 453638 - DNA, 15 bp, Homo sapiens
ggagttggttttgtt

SEQ ID NO: 453639 - DNA, 15 bp, Homo sapiens
gagttggttttgttt

SEQ ID NO: 453640 - DNA, 15 bp, Homo sapiens
agttggttttgtttc

SEQ ID NO: 453641 - DNA, 15 bp, Homo sapiens
gttggttttgtttct

SEQ ID NO: 453642 - DNA, 15 bp, Homo sapiens
ttggttttgtttcta

SEQ ID NO: 453643 - DNA, 15 bp, Homo sapiens
tggttttgtttctat

SEQ ID NO: 453644 - DNA, 15 bp, Homo sapiens
ggttttgtttctata

SEQ ID NO: 453645 - DNA, 15 bp, Homo sapiens
gttttgtttctataa

SEQ ID NO: 453646 - DNA, 15 bp, Homo sapiens
ttttgtttctataaa

SEQ ID NO: 453647 - DNA, 15 bp, Homo sapiens
tttgtttctataaat

SEQ ID NO: 453648 - DNA, 15 bp, Homo sapiens
ttgtttctataaatg

SEQ ID NO: 453649 - DNA, 15 bp, Homo sapiens
tgtttctataaatgt

SEQ ID NO: 453650 - DNA, 15 bp, Homo sapiens
gtttctataaatgtt

SEQ ID NO: 453651 - DNA, 15 bp, Homo sapiens
tttctataaatgttt

SEQ ID NO: 453652 - DNA, 15 bp, Homo sapiens
ttctataaatgtttt

SEQ ID NO: 453653 - DNA, 15 bp, Homo sapiens
tctataaatgtttta

SEQ ID NO: 453654 - DNA, 15 bp, Homo sapiens
ctataaatgttttat

SEQ ID NO: 453655 - DNA, 15 bp, Homo sapiens
tataaatgttttatt

SEQ ID NO: 453656 - DNA, 15 bp, Homo sapiens
ataaatgttttatta

SEQ ID NO: 453657 - DNA, 15 bp, Homo sapiens
taaatgttttattac

SEQ ID NO: 453658 - DNA, 15 bp, Homo sapiens
aaatgttttattact

SEQ ID NO: 453659 - DNA, 15 bp, Homo sapiens
aatgttttattactt

SEQ ID NO: 453660 - DNA, 15 bp, Homo sapiens
atgttttattacttg

SEQ ID NO: 453661 - DNA, 15 bp, Homo sapiens
tgttttattacttgc

SEQ ID NO: 453662 - DNA, 15 bp, Homo sapiens
gttttattacttgcc

SEQ ID NO: 453663 - DNA, 15 bp, Homo sapiens
ttttattacttgccc

SEQ ID NO: 453664 - DNA, 15 bp, Homo sapiens
tttattacttgcccc

SEQ ID NO: 453665 - DNA, 15 bp, Homo sapiens
ttattacttgcccca

SEQ ID NO: 453666 - DNA, 15 bp, Homo sapiens
tattacttgccccat

SEQ ID NO: 453667 - DNA, 15 bp, Homo sapiens
attacttgccccatc

SEQ ID NO: 453668 - DNA, 15 bp, Homo sapiens
ttacttgccccatca

SEQ ID NO: 453669 - DNA, 15 bp, Homo sapiens
tacttgccccatcag

SEQ ID NO: 453670 - DNA, 15 bp, Homo sapiens
acttgccccatcagt

SEQ ID NO: 453671 - DNA, 15 bp, Homo sapiens
cttgccccatcagtg

SEQ ID NO: 453672 - DNA, 15 bp, Homo sapiens
ttgccccatcagtgt

SEQ ID NO: 453673 - DNA, 15 bp, Homo sapiens
tgccccatcagtgtg

SEQ ID NO: 453674 - DNA, 15 bp, Homo sapiens
gccccatcagtgtgc

SEQ ID NO: 453675 - DNA, 15 bp, Homo sapiens
ccccatcagtgtgca

SEQ ID NO: 453676 - DNA, 15 bp, Homo sapiens
cccatcagtgtgcag

SEQ ID NO: 453677 - DNA, 15 bp, Homo sapiens
ccatcagtgtgcagt

SEQ ID NO: 453678 - DNA, 15 bp, Homo sapiens
catcagtgtgcagta

SEQ ID NO: 453679 - DNA, 15 bp, Homo sapiens
atcagtgtgcagtac

SEQ ID NO: 453680 - DNA, 15 bp, Homo sapiens
tcagtgtgcagtact

SEQ ID NO: 453681 - DNA, 15 bp, Homo sapiens
cagtgtgcagtactg

SEQ ID NO: 453682 - DNA, 15 bp, Homo sapiens
agtgtgcagtactga

SEQ ID NO: 453683 - DNA, 15 bp, Homo sapiens
gtgtgcagtactgaa

SEQ ID NO: 453684 - DNA, 15 bp, Homo sapiens
tgtgcagtactgaac

SEQ ID NO: 453685 - DNA, 15 bp, Homo sapiens
gtgcagtactgaaca

SEQ ID NO: 453686 - DNA, 15 bp, Homo sapiens
tgcagtactgaacac

SEQ ID NO: 453687 - DNA, 15 bp, Homo sapiens
gcagtactgaacaca

SEQ ID NO: 453688 - DNA, 15 bp, Homo sapiens
cagtactgaacacat

SEQ ID NO: 453689 - DNA, 15 bp, Homo sapiens
agtactgaacacatg

SEQ ID NO: 453690 - DNA, 15 bp, Homo sapiens
gtactgaacacatgc

SEQ ID NO: 453691 - DNA, 15 bp, Homo sapiens
tactgaacacatgcc

SEQ ID NO: 453692 - DNA, 15 bp, Homo sapiens
actgaacacatgcca

SEQ ID NO: 453693 - DNA, 15 bp, Homo sapiens
ctgaacacatgccat

SEQ ID NO: 453694 - DNA, 15 bp, Homo sapiens
tgaacacatgccatt

SEQ ID NO: 453695 - DNA, 15 bp, Homo sapiens
gaacacatgccattc

SEQ ID NO: 453696 - DNA, 15 bp, Homo sapiens
aacacatgccattct

SEQ ID NO: 453697 - DNA, 15 bp, Homo sapiens
acacatgccattctt

SEQ ID NO: 453698 - DNA, 15 bp, Homo sapiens
cacatgccattctta

SEQ ID NO: 453699 - DNA, 15 bp, Homo sapiens
acatgccattcttac

SEQ ID NO: 453700 - DNA, 15 bp, Homo sapiens
catgccattcttact

SEQ ID NO: 453701 - DNA, 15 bp, Homo sapiens
atgccattcttactt

SEQ ID NO: 453702 - DNA, 15 bp, Homo sapiens
tgccattcttacttg

SEQ ID NO: 453703 - DNA, 15 bp, Homo sapiens
gccattcttacttgg

SEQ ID NO: 453704 - DNA, 15 bp, Homo sapiens
ccattcttacttgga

SEQ ID NO: 453705 - DNA, 15 bp, Homo sapiens
cattcttacttggag

SEQ ID NO: 453706 - DNA, 15 bp, Homo sapiens
attcttacttggaga

SEQ ID NO: 453707 - DNA, 15 bp, Homo sapiens
ttcttacttggagaa

SEQ ID NO: 453708 - DNA, 15 bp, Homo sapiens
tcttacttggagaac

SEQ ID NO: 453709 - DNA, 15 bp, Homo sapiens
cttacttggagaaca

SEQ ID NO: 453710 - DNA, 15 bp, Homo sapiens
ttacttggagaacaa

SEQ ID NO: 453711 - DNA, 15 bp, Homo sapiens
tacttggagaacaaa

SEQ ID NO: 453712 - DNA, 15 bp, Homo sapiens
acttggagaacaaaa

SEQ ID NO: 453713 - DNA, 15 bp, Homo sapiens
cttggagaacaaaat

SEQ ID NO: 453714 - DNA, 15 bp, Homo sapiens
ttggagaacaaaatt

SEQ ID NO: 453715 - DNA, 15 bp, Homo sapiens
tggagaacaaaatta

SEQ ID NO: 453716 - DNA, 15 bp, Homo sapiens
ggagaacaaaattaa

SEQ ID NO: 453717 - DNA, 15 bp, Homo sapiens
gagaacaaaattaac

SEQ ID NO: 453718 - DNA, 15 bp, Homo sapiens
agaacaaaattaacc

SEQ ID NO: 453719 - DNA, 15 bp, Homo sapiens
gaacaaaattaacca

SEQ ID NO: 453720 - DNA, 15 bp, Homo sapiens
aacaaaattaaccaa

SEQ ID NO: 453721 - DNA, 15 bp, Homo sapiens
acaaaattaaccaaa

SEQ ID NO: 453722 - DNA, 15 bp, Homo sapiens
caaaattaaccaaaa

SEQ ID NO: 453723 - DNA, 15 bp, Homo sapiens
aaaattaaccaaaac

SEQ ID NO: 453724 - DNA, 15 bp, Homo sapiens
aaattaaccaaaaca

SEQ ID NO: 453725 - DNA, 15 bp, Homo sapiens
aattaaccaaaacac

SEQ ID NO: 453726 - DNA, 15 bp, Homo sapiens
attaaccaaaacaca

SEQ ID NO: 453727 - DNA, 15 bp, Homo sapiens
ttaaccaaaacacag

SEQ ID NO: 453728 - DNA, 15 bp, Homo sapiens
taaccaaaacacagg

SEQ ID NO: 453729 - DNA, 15 bp, Homo sapiens
aaccaaaacacagga

SEQ ID NO: 453730 - DNA, 15 bp, Homo sapiens
accaaaacacaggag

SEQ ID NO: 453731 - DNA, 15 bp, Homo sapiens
ccaaaacacaggagt

SEQ ID NO: 453732 - DNA, 15 bp, Homo sapiens
caaaacacaggagta

SEQ ID NO: 453733 - DNA, 15 bp, Homo sapiens
aaaacacaggagtaa

SEQ ID NO: 453734 - DNA, 15 bp, Homo sapiens
aaacacaggagtaat

SEQ ID NO: 453735 - DNA, 15 bp, Homo sapiens
aacacaggagtaatg

SEQ ID NO: 453736 - DNA, 15 bp, Homo sapiens
acacaggagtaatgt

SEQ ID NO: 453737 - DNA, 15 bp, Homo sapiens
cacaggagtaatgta

SEQ ID NO: 453738 - DNA, 15 bp, Homo sapiens
acaggagtaatgtaa

SEQ ID NO: 453739 - DNA, 15 bp, Homo sapiens
caggagtaatgtaaa

SEQ ID NO: 453740 - DNA, 15 bp, Homo sapiens
aggagtaatgtaaaa

SEQ ID NO: 453741 - DNA, 15 bp, Homo sapiens
ggagtaatgtaaaaa

SEQ ID NO: 453742 - DNA, 15 bp, Homo sapiens
gagtaatgtaaaaag

SEQ ID NO: 453743 - DNA, 15 bp, Homo sapiens
agtaatgtaaaaagc

SEQ ID NO: 453744 - DNA, 15 bp, Homo sapiens
gtaatgtaaaaagct

SEQ ID NO: 453745 - DNA, 15 bp, Homo sapiens
taatgtaaaaagctt

SEQ ID NO: 453746 - DNA, 15 bp, Homo sapiens
aatgtaaaaagcttt

SEQ ID NO: 453747 - DNA, 15 bp, Homo sapiens
atgtaaaaagctttt

SEQ ID NO: 453748 - DNA, 15 bp, Homo sapiens
tgtaaaaagcttttt

SEQ ID NO: 453749 - DNA, 15 bp, Homo sapiens
gtaaaaagctttttc

SEQ ID NO: 453750 - DNA, 15 bp, Homo sapiens
taaaaagctttttca

SEQ ID NO: 453751 - DNA, 15 bp, Homo sapiens
aaaaagctttttcaa

SEQ ID NO: 453752 - DNA, 15 bp, Homo sapiens
aaaagctttttcaaa

SEQ ID NO: 453753 - DNA, 15 bp, Homo sapiens
aaagctttttcaaaa

SEQ ID NO: 453754 - DNA, 15 bp, Homo sapiens
aagctttttcaaaaa

SEQ ID NO: 453755 - DNA, 15 bp, Homo sapiens
agctttttcaaaaat

SEQ ID NO: 453756 - DNA, 15 bp, Homo sapiens
gctttttcaaaaatt

SEQ ID NO: 453757 - DNA, 15 bp, Homo sapiens
ctttttcaaaaattg

SEQ ID NO: 453758 - DNA, 15 bp, Homo sapiens
tttttcaaaaattgt

SEQ ID NO: 453759 - DNA, 15 bp, Homo sapiens
ttttcaaaaattgtg

SEQ ID NO: 453760 - DNA, 15 bp, Homo sapiens
tttcaaaaattgtgc

SEQ ID NO: 453761 - DNA, 15 bp, Homo sapiens
ttcaaaaattgtgct

SEQ ID NO: 453762 - DNA, 15 bp, Homo sapiens
tcaaaaattgtgctg

SEQ ID NO: 453763 - DNA, 15 bp, Homo sapiens
caaaaattgtgctgc

SEQ ID NO: 453764 - DNA, 15 bp, Homo sapiens
aaaaattgtgctgcc

SEQ ID NO: 453765 - DNA, 15 bp, Homo sapiens
aaaattgtgctgcca

SEQ ID NO: 453766 - DNA, 15 bp, Homo sapiens
aaattgtgctgccac

SEQ ID NO: 453767 - DNA, 15 bp, Homo sapiens
aattgtgctgccacc

SEQ ID NO: 453768 - DNA, 15 bp, Homo sapiens
attgtgctgccaccc

SEQ ID NO: 453769 - DNA, 15 bp, Homo sapiens
ttgtgctgccaccca

SEQ ID NO: 453770 - DNA, 15 bp, Homo sapiens
tgtgctgccacccaa

SEQ ID NO: 453771 - DNA, 15 bp, Homo sapiens
gtgctgccacccaat

SEQ ID NO: 453772 - DNA, 15 bp, Homo sapiens
tgctgccacccaatt

SEQ ID NO: 453773 - DNA, 15 bp, Homo sapiens
gctgccacccaattt

SEQ ID NO: 453774 - DNA, 15 bp, Homo sapiens
ctgccacccaattta

SEQ ID NO: 453775 - DNA, 15 bp, Homo sapiens
tgccacccaatttaa

SEQ ID NO: 453776 - DNA, 15 bp, Homo sapiens
gccacccaatttaaa

SEQ ID NO: 453777 - DNA, 15 bp, Homo sapiens
ccacccaatttaaaa

SEQ ID NO: 453778 - DNA, 15 bp, Homo sapiens
cacccaatttaaaag

SEQ ID NO: 453779 - DNA, 15 bp, Homo sapiens
acccaatttaaaagg

SEQ ID NO: 453780 - DNA, 15 bp, Homo sapiens
cccaatttaaaagga

SEQ ID NO: 453781 - DNA, 15 bp, Homo sapiens
ccaatttaaaaggat

SEQ ID NO: 453782 - DNA, 15 bp, Homo sapiens
caatttaaaaggatt

SEQ ID NO: 453783 - DNA, 15 bp, Homo sapiens
aatttaaaaggatta

SEQ ID NO: 453784 - DNA, 15 bp, Homo sapiens
atttaaaaggattaa

SEQ ID NO: 453785 - DNA, 15 bp, Homo sapiens
tttaaaaggattaaa

SEQ ID NO: 453786 - DNA, 15 bp, Homo sapiens
ttaaaaggattaaat

SEQ ID NO: 453787 - DNA, 15 bp, Homo sapiens
taaaaggattaaatc

SEQ ID NO: 453788 - DNA, 15 bp, Homo sapiens
aaaaggattaaatca

SEQ ID NO: 453789 - DNA, 15 bp, Homo sapiens
aaaggattaaatcaa

SEQ ID NO: 453790 - DNA, 15 bp, Homo sapiens
aaggattaaatcaaa

SEQ ID NO: 453791 - DNA, 15 bp, Homo sapiens
aggattaaatcaaag

SEQ ID NO: 453792 - DNA, 15 bp, Homo sapiens
ggattaaatcaaaga

SEQ ID NO: 453793 - DNA, 15 bp, Homo sapiens
gattaaatcaaagaa

SEQ ID NO: 453794 - DNA, 15 bp, Homo sapiens
attaaatcaaagaaa

SEQ ID NO: 453795 - DNA, 15 bp, Homo sapiens
ttaaatcaaagaaag

SEQ ID NO: 453796 - DNA, 15 bp, Homo sapiens
taaatcaaagaaagt

SEQ ID NO: 453797 - DNA, 15 bp, Homo sapiens
aaatcaaagaaagta

SEQ ID NO: 453798 - DNA, 15 bp, Homo sapiens
aatcaaagaaagtat

SEQ ID NO: 453799 - DNA, 15 bp, Homo sapiens
atcaaagaaagtatt

SEQ ID NO: 453800 - DNA, 15 bp, Homo sapiens
tcaaagaaagtatta

SEQ ID NO: 453801 - DNA, 15 bp, Homo sapiens
caaagaaagtattaa

SEQ ID NO: 453802 - DNA, 15 bp, Homo sapiens
aaagaaagtattaag

SEQ ID NO: 453803 - DNA, 15 bp, Homo sapiens
aagaaagtattaagt

SEQ ID NO: 453804 - DNA, 15 bp, Homo sapiens
agaaagtattaagtc

SEQ ID NO: 453805 - DNA, 15 bp, Homo sapiens
gaaagtattaagtca

SEQ ID NO: 453806 - DNA, 15 bp, Homo sapiens
aaagtattaagtcat

SEQ ID NO: 453807 - DNA, 15 bp, Homo sapiens
aagtattaagtcatg

SEQ ID NO: 453808 - DNA, 15 bp, Homo sapiens
agtattaagtcatgt

SEQ ID NO: 453809 - DNA, 15 bp, Homo sapiens
gtattaagtcatgtg

SEQ ID NO: 453810 - DNA, 15 bp, Homo sapiens
tattaagtcatgtgt

SEQ ID NO: 453811 - DNA, 15 bp, Homo sapiens
attaagtcatgtgtt

SEQ ID NO: 453812 - DNA, 15 bp, Homo sapiens
ttaagtcatgtgttt

SEQ ID NO: 453813 - DNA, 15 bp, Homo sapiens
taagtcatgtgtttt

SEQ ID NO: 453814 - DNA, 15 bp, Homo sapiens
aagtcatgtgttttc

SEQ ID NO: 453815 - DNA, 15 bp, Homo sapiens
agtcatgtgttttca

SEQ ID NO: 453816 - DNA, 15 bp, Homo sapiens
gtcatgtgttttcag

SEQ ID NO: 453817 - DNA, 15 bp, Homo sapiens
tgtgttttcagtacc

SEQ ID NO: 453818 - DNA, 15 bp, Homo sapiens
gtgttttcagtacct

SEQ ID NO: 453819 - DNA, 15 bp, Homo sapiens
tgttttcagtacctt

SEQ ID NO: 453820 - DNA, 15 bp, Homo sapiens
gttttcagtaccttt

SEQ ID NO: 453821 - DNA, 15 bp, Homo sapiens
ttttcagtacctttt

SEQ ID NO: 453822 - DNA, 15 bp, Homo sapiens
tttcagtaccttttg

SEQ ID NO: 453823 - DNA, 15 bp, Homo sapiens
ttcagtaccttttgc

SEQ ID NO: 453824 - DNA, 15 bp, Homo sapiens
tcagtaccttttgcc

SEQ ID NO: 453825 - DNA, 15 bp, Homo sapiens
cagtaccttttgccc

SEQ ID NO: 453826 - DNA, 15 bp, Homo sapiens
agtaccttttgccca

SEQ ID NO: 453827 - DNA, 15 bp, Homo sapiens
gtaccttttgcccat

SEQ ID NO: 453828 - DNA, 15 bp, Homo sapiens
taccttttgcccatt

SEQ ID NO: 453829 - DNA, 15 bp, Homo sapiens
accttttgcccattt

SEQ ID NO: 453830 - DNA, 15 bp, Homo sapiens
ccttttgcccatttg

SEQ ID NO: 453831 - DNA, 15 bp, Homo sapiens
cttttgcccatttgg

SEQ ID NO: 453832 - DNA, 15 bp, Homo sapiens
ttttgcccatttggc

SEQ ID NO: 453833 - DNA, 15 bp, Homo sapiens
tttgcccatttggca

SEQ ID NO: 453834 - DNA, 15 bp, Homo sapiens
ttgcccatttggcaa

SEQ ID NO: 453835 - DNA, 15 bp, Homo sapiens
tgcccatttggcaat

SEQ ID NO: 453836 - DNA, 15 bp, Homo sapiens
gcccatttggcaatg

SEQ ID NO: 453837 - DNA, 15 bp, Homo sapiens
cccatttggcaatgt

SEQ ID NO: 453838 - DNA, 15 bp, Homo sapiens
ccatttggcaatgta

SEQ ID NO: 453839 - DNA, 15 bp, Homo sapiens
catttggcaatgtag

SEQ ID NO: 453840 - DNA, 15 bp, Homo sapiens
atttggcaatgtaga

SEQ ID NO: 453841 - DNA, 15 bp, Homo sapiens
tttggcaatgtagag

SEQ ID NO: 453842 - DNA, 15 bp, Homo sapiens
ttggcaatgtagagt

SEQ ID NO: 453843 - DNA, 15 bp, Homo sapiens
tggcaatgtagagtt

SEQ ID NO: 453844 - DNA, 15 bp, Homo sapiens
ggcaatgtagagttc

SEQ ID NO: 453845 - DNA, 15 bp, Homo sapiens
gcaatgtagagttcc

SEQ ID NO: 453846 - DNA, 15 bp, Homo sapiens
caatgtagagttcca

SEQ ID NO: 453847 - DNA, 15 bp, Homo sapiens
aatgtagagttccag

SEQ ID NO: 453848 - DNA, 15 bp, Homo sapiens
atgtagagttccagt

SEQ ID NO: 453849 - DNA, 15 bp, Homo sapiens
tgtagagttccagtt

SEQ ID NO: 453850 - DNA, 15 bp, Homo sapiens
gtagagttccagttt

SEQ ID NO: 453851 - DNA, 15 bp, Homo sapiens
tagagttccagtttg

SEQ ID NO: 453852 - DNA, 15 bp, Homo sapiens
agagttccagtttgt

SEQ ID NO: 453853 - DNA, 15 bp, Homo sapiens
gagttccagtttgtc

SEQ ID NO: 453854 - DNA, 15 bp, Homo sapiens
agttccagtttgtct

SEQ ID NO: 453855 - DNA, 15 bp, Homo sapiens
gttccagtttgtctc

SEQ ID NO: 453856 - DNA, 15 bp, Homo sapiens
ttccagtttgtctca

SEQ ID NO: 453857 - DNA, 15 bp, Homo sapiens
tccagtttgtctcaa

SEQ ID NO: 453858 - DNA, 15 bp, Homo sapiens
ccagtttgtctcaat

SEQ ID NO: 453859 - DNA, 15 bp, Homo sapiens
cagtttgtctcaata

SEQ ID NO: 453860 - DNA, 15 bp, Homo sapiens
agtttgtctcaatac

SEQ ID NO: 453861 - DNA, 15 bp, Homo sapiens
gtttgtctcaatacc

SEQ ID NO: 453862 - DNA, 15 bp, Homo sapiens
tttgtctcaatacca

SEQ ID NO: 453863 - DNA, 15 bp, Homo sapiens
ttgtctcaataccac

SEQ ID NO: 453864 - DNA, 15 bp, Homo sapiens
tgtctcaataccact

SEQ ID NO: 453865 - DNA, 15 bp, Homo sapiens
gtctcaataccacta

SEQ ID NO: 453866 - DNA, 15 bp, Homo sapiens
tctcaataccactat

SEQ ID NO: 453867 - DNA, 15 bp, Homo sapiens
ctcaataccactata

SEQ ID NO: 453868 - DNA, 15 bp, Homo sapiens
tcaataccactatat

SEQ ID NO: 453869 - DNA, 15 bp, Homo sapiens
caataccactatata

SEQ ID NO: 453870 - DNA, 15 bp, Homo sapiens
aataccactatatat

SEQ ID NO: 453871 - DNA, 15 bp, Homo sapiens
ataccactatatata

SEQ ID NO: 453872 - DNA, 15 bp, Homo sapiens
taccactatatataa

SEQ ID NO: 453873 - DNA, 15 bp, Homo sapiens
accactatatataaa

SEQ ID NO: 453874 - DNA, 15 bp, Homo sapiens
ccactatatataaag

SEQ ID NO: 453875 - DNA, 15 bp, Homo sapiens
cactatatataaaga

SEQ ID NO: 453876 - DNA, 15 bp, Homo sapiens
actatatataaagaa

SEQ ID NO: 453877 - DNA, 15 bp, Homo sapiens
ctatatataaagaaa

SEQ ID NO: 453878 - DNA, 15 bp, Homo sapiens
tatatataaagaaac

SEQ ID NO: 453879 - DNA, 15 bp, Homo sapiens
atatataaagaaaca

SEQ ID NO: 453880 - DNA, 15 bp, Homo sapiens
tatataaagaaacac

SEQ ID NO: 453881 - DNA, 15 bp, Homo sapiens
atataaagaaacact

SEQ ID NO: 453882 - DNA, 15 bp, Homo sapiens
tataaagaaacacta

SEQ ID NO: 453883 - DNA, 15 bp, Homo sapiens
ataaagaaacactaa

SEQ ID NO: 453884 - DNA, 15 bp, Homo sapiens
taaagaaacactaaa

SEQ ID NO: 453885 - DNA, 15 bp, Homo sapiens
aaagaaacactaaaa

SEQ ID NO: 453886 - DNA, 15 bp, Homo sapiens
aagaaacactaaaaa

SEQ ID NO: 453887 - DNA, 15 bp, Homo sapiens
agaaacactaaaaaa

SEQ ID NO: 453888 - DNA, 15 bp, Homo sapiens
gaaacactaaaaaat

SEQ ID NO: 453889 - DNA, 15 bp, Homo sapiens
aaacactaaaaaatc

SEQ ID NO: 453890 - DNA, 15 bp, Homo sapiens
aacactaaaaaatca

SEQ ID NO: 453891 - DNA, 15 bp, Homo sapiens
acactaaaaaatcac

SEQ ID NO: 453892 - DNA, 15 bp, Homo sapiens
cactaaaaaatcaca

SEQ ID NO: 453893 - DNA, 15 bp, Homo sapiens
actaaaaaatcacat

SEQ ID NO: 453894 - DNA, 15 bp, Homo sapiens
ctaaaaaatcacatt

SEQ ID NO: 453895 - DNA, 15 bp, Homo sapiens
taaaaaatcacattc

SEQ ID NO: 453896 - DNA, 15 bp, Homo sapiens
aaaaaatcacattcc

SEQ ID NO: 453897 - DNA, 15 bp, Homo sapiens
aaaaatcacattcct

SEQ ID NO: 453898 - DNA, 15 bp, Homo sapiens
aaaatcacattcctg

SEQ ID NO: 453899 - DNA, 15 bp, Homo sapiens
aaatcacattcctga

SEQ ID NO: 453900 - DNA, 15 bp, Homo sapiens
aatcacattcctgat

SEQ ID NO: 453901 - DNA, 15 bp, Homo sapiens
atcacattcctgatc

SEQ ID NO: 453902 - DNA, 15 bp, Homo sapiens
tcacattcctgatct

SEQ ID NO: 453903 - DNA, 15 bp, Homo sapiens
cacattcctgatcta

SEQ ID NO: 453904 - DNA, 15 bp, Homo sapiens
acattcctgatctaa

SEQ ID NO: 453905 - DNA, 15 bp, Homo sapiens
cattcctgatctaaa

SEQ ID NO: 453906 - DNA, 15 bp, Homo sapiens
attcctgatctaaat

SEQ ID NO: 453907 - DNA, 15 bp, Homo sapiens
ttcctgatctaaatt

SEQ ID NO: 453908 - DNA, 15 bp, Homo sapiens
tcctgatctaaattt

SEQ ID NO: 453909 - DNA, 15 bp, Homo sapiens
cctgatctaaatttg

SEQ ID NO: 453910 - DNA, 15 bp, Homo sapiens
ctgatctaaatttga

SEQ ID NO: 453911 - DNA, 15 bp, Homo sapiens
tgatctaaatttgaa

SEQ ID NO: 453912 - DNA, 15 bp, Homo sapiens
gatctaaatttgaac

SEQ ID NO: 453913 - DNA, 15 bp, Homo sapiens
atctaaatttgaact

SEQ ID NO: 453914 - DNA, 15 bp, Homo sapiens
tctaaatttgaactg

SEQ ID NO: 453915 - DNA, 15 bp, Homo sapiens
ctaaatttgaactgg

SEQ ID NO: 453916 - DNA, 15 bp, Homo sapiens
taaatttgaactggc

SEQ ID NO: 453917 - DNA, 15 bp, Homo sapiens
aaatttgaactggca

SEQ ID NO: 453918 - DNA, 15 bp, Homo sapiens
aatttgaactggcac

SEQ ID NO: 453919 - DNA, 15 bp, Homo sapiens
atttgaactggcacc

SEQ ID NO: 453920 - DNA, 15 bp, Homo sapiens
tttgaactggcacct

SEQ ID NO: 453921 - DNA, 15 bp, Homo sapiens
ttgaactggcacctt

SEQ ID NO: 453922 - DNA, 15 bp, Homo sapiens
tgaactggcacctta

SEQ ID NO: 453923 - DNA, 15 bp, Homo sapiens
gaactggcaccttaa

SEQ ID NO: 453924 - DNA, 15 bp, Homo sapiens
aactggcaccttaac

SEQ ID NO: 453925 - DNA, 15 bp, Homo sapiens
actggcaccttaaca

SEQ ID NO: 453926 - DNA, 15 bp, Homo sapiens
ctggcaccttaacaa

SEQ ID NO: 453927 - DNA, 15 bp, Homo sapiens
tggcaccttaacaag

SEQ ID NO: 453928 - DNA, 15 bp, Homo sapiens
ggcaccttaacaagt

SEQ ID NO: 453929 - DNA, 15 bp, Homo sapiens
gcaccttaacaagtg

SEQ ID NO: 453930 - DNA, 15 bp, Homo sapiens
caccttaacaagtga

SEQ ID NO: 453931 - DNA, 15 bp, Homo sapiens
accttaacaagtgag

SEQ ID NO: 453932 - DNA, 15 bp, Homo sapiens
ccttaacaagtgaga

SEQ ID NO: 453933 - DNA, 15 bp, Homo sapiens
cttaacaagtgagat

SEQ ID NO: 453934 - DNA, 15 bp, Homo sapiens
ttaacaagtgagata

SEQ ID NO: 453935 - DNA, 15 bp, Homo sapiens
taacaagtgagataa

SEQ ID NO: 453936 - DNA, 15 bp, Homo sapiens
aacaagtgagataaa

SEQ ID NO: 453937 - DNA, 15 bp, Homo sapiens
acaagtgagataaaa

SEQ ID NO: 453938 - DNA, 15 bp, Homo sapiens
caagtgagataaaag

SEQ ID NO: 453939 - DNA, 15 bp, Homo sapiens
aagtgagataaaagg

SEQ ID NO: 453940 - DNA, 15 bp, Homo sapiens
agtgagataaaaggc

SEQ ID NO: 453941 - DNA, 15 bp, Homo sapiens
gtgagataaaaggct

SEQ ID NO: 453942 - DNA, 15 bp, Homo sapiens
tgagataaaaggctc

SEQ ID NO: 453943 - DNA, 15 bp, Homo sapiens
gagataaaaggctct

SEQ ID NO: 453944 - DNA, 15 bp, Homo sapiens
agataaaaggctcta

SEQ ID NO: 453945 - DNA, 15 bp, Homo sapiens
gataaaaggctctat

SEQ ID NO: 453946 - DNA, 15 bp, Homo sapiens
ataaaaggctctatt

SEQ ID NO: 453947 - DNA, 15 bp, Homo sapiens
taaaaggctctattt

SEQ ID NO: 453948 - DNA, 15 bp, Homo sapiens
aaaaggctctatttt

SEQ ID NO: 453949 - DNA, 15 bp, Homo sapiens
aaaggctctattttc

SEQ ID NO: 453950 - DNA, 15 bp, Homo sapiens
aaggctctattttct

SEQ ID NO: 453951 - DNA, 15 bp, Homo sapiens
aggctctattttctt

SEQ ID NO: 453952 - DNA, 15 bp, Homo sapiens
ggctctattttcttt

SEQ ID NO: 453953 - DNA, 15 bp, Homo sapiens
gctctattttctttt

SEQ ID NO: 453954 - DNA, 15 bp, Homo sapiens
ctctattttctttta

SEQ ID NO: 453955 - DNA, 15 bp, Homo sapiens
tctattttcttttaa

SEQ ID NO: 453956 - DNA, 15 bp, Homo sapiens
ctattttcttttaaa

SEQ ID NO: 453957 - DNA, 15 bp, Homo sapiens
tattttcttttaaat

SEQ ID NO: 453958 - DNA, 15 bp, Homo sapiens
attttcttttaaata

SEQ ID NO: 453959 - DNA, 15 bp, Homo sapiens
ttttcttttaaatat

SEQ ID NO: 453960 - DNA, 15 bp, Homo sapiens
tttcttttaaatata

SEQ ID NO: 453961 - DNA, 15 bp, Homo sapiens
ttcttttaaatatat

SEQ ID NO: 453962 - DNA, 15 bp, Homo sapiens
tcttttaaatatatc

SEQ ID NO: 453963 - DNA, 15 bp, Homo sapiens
cttttaaatatatct

SEQ ID NO: 453964 - DNA, 15 bp, Homo sapiens
ttttaaatatatctt

SEQ ID NO: 453965 - DNA, 15 bp, Homo sapiens
tttaaatatatcttg

SEQ ID NO: 453966 - DNA, 15 bp, Homo sapiens
ttaaatatatcttga

SEQ ID NO: 453967 - DNA, 15 bp, Homo sapiens
taaatatatcttgag

SEQ ID NO: 453968 - DNA, 15 bp, Homo sapiens
aaatatatcttgaga

SEQ ID NO: 453969 - DNA, 15 bp, Homo sapiens
aatatatcttgagac

SEQ ID NO: 453970 - DNA, 15 bp, Homo sapiens
atatatcttgagaca

SEQ ID NO: 453971 - DNA, 15 bp, Homo sapiens
tatatcttgagacat

SEQ ID NO: 453972 - DNA, 15 bp, Homo sapiens
atatcttgagacatt

SEQ ID NO: 453973 - DNA, 15 bp, Homo sapiens
tatcttgagacattt

SEQ ID NO: 453974 - DNA, 15 bp, Homo sapiens
atcttgagacattta

SEQ ID NO: 453975 - DNA, 15 bp, Homo sapiens
tcttgagacatttag

SEQ ID NO: 453976 - DNA, 15 bp, Homo sapiens
cttgagacatttagt

SEQ ID NO: 453977 - DNA, 15 bp, Homo sapiens
ttgagacatttagta

SEQ ID NO: 453978 - DNA, 15 bp, Homo sapiens
tgagacatttagtat

SEQ ID NO: 453979 - DNA, 15 bp, Homo sapiens
gagacatttagtatt

SEQ ID NO: 453980 - DNA, 15 bp, Homo sapiens
agacatttagtatta

SEQ ID NO: 453981 - DNA, 15 bp, Homo sapiens
gacatttagtattat

SEQ ID NO: 453982 - DNA, 15 bp, Homo sapiens
acatttagtattatc

SEQ ID NO: 453983 - DNA, 15 bp, Homo sapiens
catttagtattatca

SEQ ID NO: 453984 - DNA, 15 bp, Homo sapiens
atttagtattatcaa

SEQ ID NO: 453985 - DNA, 15 bp, Homo sapiens
tttagtattatcaat

SEQ ID NO: 453986 - DNA, 15 bp, Homo sapiens
ttagtattatcaatg

SEQ ID NO: 453987 - DNA, 15 bp, Homo sapiens
tagtattatcaatgc

SEQ ID NO: 453988 - DNA, 15 bp, Homo sapiens
agtattatcaatgca

SEQ ID NO: 453989 - DNA, 15 bp, Homo sapiens
gtattatcaatgcat

SEQ ID NO: 453990 - DNA, 15 bp, Homo sapiens
tattatcaatgcatt

SEQ ID NO: 453991 - DNA, 15 bp, Homo sapiens
attatcaatgcattt

SEQ ID NO: 453992 - DNA, 15 bp, Homo sapiens
ttatcaatgcatttt

SEQ ID NO: 453993 - DNA, 15 bp, Homo sapiens
tatcaatgcattttt

SEQ ID NO: 453994 - DNA, 15 bp, Homo sapiens
atcaatgcatttttc

SEQ ID NO: 453995 - DNA, 15 bp, Homo sapiens
tcaatgcatttttcc

SEQ ID NO: 453996 - DNA, 15 bp, Homo sapiens
caatgcatttttcct

SEQ ID NO: 453997 - DNA, 15 bp, Homo sapiens
aatgcatttttcctg

SEQ ID NO: 453998 - DNA, 15 bp, Homo sapiens
atgcatttttcctgt

SEQ ID NO: 453999 - DNA, 15 bp, Homo sapiens
tgcatttttcctgtg

SEQ ID NO: 454000 - DNA, 15 bp, Homo sapiens
gcatttttcctgtgg

SEQ ID NO: 454001 - DNA, 15 bp, Homo sapiens
catttttcctgtgga

SEQ ID NO: 454002 - DNA, 15 bp, Homo sapiens
atttttcctgtggag

SEQ ID NO: 454003 - DNA, 15 bp, Homo sapiens
tttttcctgtggagg

SEQ ID NO: 454004 - DNA, 15 bp, Homo sapiens
ttttcctgtggagga

SEQ ID NO: 454005 - DNA, 15 bp, Homo sapiens
tttcctgtggaggat

SEQ ID NO: 454006 - DNA, 15 bp, Homo sapiens
ttcctgtggaggatg

SEQ ID NO: 454007 - DNA, 15 bp, Homo sapiens
tcctgtggaggatgt

SEQ ID NO: 454008 - DNA, 15 bp, Homo sapiens
cctgtggaggatgtg

SEQ ID NO: 454009 - DNA, 15 bp, Homo sapiens
ctgtggaggatgtgt

SEQ ID NO: 454010 - DNA, 15 bp, Homo sapiens
tgtggaggatgtgtt

SEQ ID NO: 454011 - DNA, 15 bp, Homo sapiens
gtggaggatgtgttc

SEQ ID NO: 454012 - DNA, 15 bp, Homo sapiens
tggaggatgtgttca

SEQ ID NO: 454013 - DNA, 15 bp, Homo sapiens
ggaggatgtgttcag

SEQ ID NO: 454014 - DNA, 15 bp, Homo sapiens
gaggatgtgttcaga

SEQ ID NO: 454015 - DNA, 15 bp, Homo sapiens
aggatgtgttcagag

SEQ ID NO: 454016 - DNA, 15 bp, Homo sapiens
ggatgtgttcagagt

SEQ ID NO: 454017 - DNA, 15 bp, Homo sapiens
gatgtgttcagagtg

SEQ ID NO: 454018 - DNA, 15 bp, Homo sapiens
atgtgttcagagtgg

SEQ ID NO: 454019 - DNA, 15 bp, Homo sapiens
tgtgttcagagtgga

SEQ ID NO: 454020 - DNA, 15 bp, Homo sapiens
gtgttcagagtggaa

SEQ ID NO: 454021 - DNA, 15 bp, Homo sapiens
tgttcagagtggaat

SEQ ID NO: 454022 - DNA, 15 bp, Homo sapiens
gttcagagtggaatt

SEQ ID NO: 454023 - DNA, 15 bp, Homo sapiens
ttcagagtggaattc

SEQ ID NO: 454024 - DNA, 15 bp, Homo sapiens
tcagagtggaattct

SEQ ID NO: 454025 - DNA, 15 bp, Homo sapiens
cagagtggaattctg

SEQ ID NO: 454026 - DNA, 15 bp, Homo sapiens
agagtggaattctgt

SEQ ID NO: 454027 - DNA, 15 bp, Homo sapiens
gagtggaattctgtg

SEQ ID NO: 454028 - DNA, 15 bp, Homo sapiens
agtggaattctgtgg

SEQ ID NO: 454029 - DNA, 15 bp, Homo sapiens
gtggaattctgtggc

SEQ ID NO: 454030 - DNA, 15 bp, Homo sapiens
tggaattctgtggca

SEQ ID NO: 454031 - DNA, 15 bp, Homo sapiens
ggaattctgtggcag

SEQ ID NO: 454032 - DNA, 15 bp, Homo sapiens
gaattctgtggcagt

SEQ ID NO: 454033 - DNA, 15 bp, Homo sapiens
aattctgtggcagtc

SEQ ID NO: 454034 - DNA, 15 bp, Homo sapiens
attctgtggcagtcc

SEQ ID NO: 454035 - DNA, 15 bp, Homo sapiens
ttctgtggcagtcct

SEQ ID NO: 454036 - DNA, 15 bp, Homo sapiens
tctgtggcagtcctt

SEQ ID NO: 454037 - DNA, 15 bp, Homo sapiens
ctgtggcagtccttt

SEQ ID NO: 454038 - DNA, 15 bp, Homo sapiens
tgtggcagtcctttc

SEQ ID NO: 454039 - DNA, 15 bp, Homo sapiens
gtggcagtcctttca

SEQ ID NO: 454040 - DNA, 15 bp, Homo sapiens
tggcagtcctttcat

SEQ ID NO: 454041 - DNA, 15 bp, Homo sapiens
ggcagtcctttcatc

SEQ ID NO: 454042 - DNA, 15 bp, Homo sapiens
gcagtcctttcatca

SEQ ID NO: 454043 - DNA, 15 bp, Homo sapiens
cagtcctttcatcaa

SEQ ID NO: 454044 - DNA, 15 bp, Homo sapiens
agtcctttcatcaaa

SEQ ID NO: 454045 - DNA, 15 bp, Homo sapiens
gtcctttcatcaaaa

SEQ ID NO: 454046 - DNA, 15 bp, Homo sapiens
tcctttcatcaaaag

SEQ ID NO: 454047 - DNA, 15 bp, Homo sapiens
cctttcatcaaaagg

SEQ ID NO: 454048 - DNA, 15 bp, Homo sapiens
ctttcatcaaaagga

SEQ ID NO: 454049 - DNA, 15 bp, Homo sapiens
tttcatcaaaaggat

SEQ ID NO: 454050 - DNA, 15 bp, Homo sapiens
ttcatcaaaaggata

SEQ ID NO: 454051 - DNA, 15 bp, Homo sapiens
tcatcaaaaggatat

SEQ ID NO: 454052 - DNA, 15 bp, Homo sapiens
catcaaaaggatatt

SEQ ID NO: 454053 - DNA, 15 bp, Homo sapiens
atcaaaaggatattt

SEQ ID NO: 454054 - DNA, 15 bp, Homo sapiens
tcaaaaggatatttc

SEQ ID NO: 454055 - DNA, 15 bp, Homo sapiens
caaaaggatatttcc

SEQ ID NO: 454056 - DNA, 15 bp, Homo sapiens
aaaaggatatttcct

SEQ ID NO: 454057 - DNA, 15 bp, Homo sapiens
aaaggatatttcctc

SEQ ID NO: 454058 - DNA, 15 bp, Homo sapiens
aaggatatttcctcc

SEQ ID NO: 454059 - DNA, 15 bp, Homo sapiens
aggatatttcctccc

SEQ ID NO: 454060 - DNA, 15 bp, Homo sapiens
ggatatttcctcccg

SEQ ID NO: 454061 - DNA, 15 bp, Homo sapiens
gatatttcctcccgc

SEQ ID NO: 454062 - DNA, 15 bp, Homo sapiens
atatttcctcccgca

SEQ ID NO: 454063 - DNA, 15 bp, Homo sapiens
tatttcctcccgcaa

SEQ ID NO: 454064 - DNA, 15 bp, Homo sapiens
atttcctcccgcaaa

SEQ ID NO: 454065 - DNA, 15 bp, Homo sapiens
tttcctcccgcaaaa

SEQ ID NO: 454066 - DNA, 15 bp, Homo sapiens
ttcctcccgcaaaat

SEQ ID NO: 454067 - DNA, 15 bp, Homo sapiens
tcctcccgcaaaata

SEQ ID NO: 454068 - DNA, 15 bp, Homo sapiens
cctcccgcaaaataa

SEQ ID NO: 454069 - DNA, 15 bp, Homo sapiens
ctcccgcaaaataac

SEQ ID NO: 454070 - DNA, 15 bp, Homo sapiens
tcccgcaaaataacc

SEQ ID NO: 454071 - DNA, 15 bp, Homo sapiens
cccgcaaaataacct

SEQ ID NO: 454072 - DNA, 15 bp, Homo sapiens
ccgcaaaataaccta

SEQ ID NO: 454073 - DNA, 15 bp, Homo sapiens
cgcaaaataacctaa

SEQ ID NO: 454074 - DNA, 15 bp, Homo sapiens
gcaaaataacctaaa

SEQ ID NO: 454075 - DNA, 15 bp, Homo sapiens
caaaataacctaaaa

SEQ ID NO: 454076 - DNA, 15 bp, Homo sapiens
aaaataacctaaaat

SEQ ID NO: 454077 - DNA, 15 bp, Homo sapiens
aaataacctaaaatt

SEQ ID NO: 454078 - DNA, 15 bp, Homo sapiens
aataacctaaaatta

SEQ ID NO: 454079 - DNA, 15 bp, Homo sapiens
ataacctaaaattaa

SEQ ID NO: 454080 - DNA, 15 bp, Homo sapiens
taacctaaaattaag

SEQ ID NO: 454081 - DNA, 15 bp, Homo sapiens
aacctaaaattaagt

SEQ ID NO: 454082 - DNA, 15 bp, Homo sapiens
acctaaaattaagta

SEQ ID NO: 454083 - DNA, 15 bp, Homo sapiens
cctaaaattaagtag

SEQ ID NO: 454084 - DNA, 15 bp, Homo sapiens
ctaaaattaagtagc

SEQ ID NO: 454085 - DNA, 15 bp, Homo sapiens
taaaattaagtagca

SEQ ID NO: 454086 - DNA, 15 bp, Homo sapiens
aaaattaagtagcag

SEQ ID NO: 454087 - DNA, 15 bp, Homo sapiens
aaattaagtagcagt

SEQ ID NO: 454088 - DNA, 15 bp, Homo sapiens
aattaagtagcagtg

SEQ ID NO: 454089 - DNA, 15 bp, Homo sapiens
attaagtagcagtgt

SEQ ID NO: 454090 - DNA, 15 bp, Homo sapiens
ttaagtagcagtgtg

SEQ ID NO: 454091 - DNA, 15 bp, Homo sapiens
taagtagcagtgtga

SEQ ID NO: 454092 - DNA, 15 bp, Homo sapiens
aagtagcagtgtgaa

SEQ ID NO: 454093 - DNA, 15 bp, Homo sapiens
agtagcagtgtgaat

SEQ ID NO: 454094 - DNA, 15 bp, Homo sapiens
gtagcagtgtgaata

SEQ ID NO: 454095 - DNA, 15 bp, Homo sapiens
tagcagtgtgaatac

SEQ ID NO: 454096 - DNA, 15 bp, Homo sapiens
agcagtgtgaatact

SEQ ID NO: 454097 - DNA, 15 bp, Homo sapiens
gcagtgtgaatactt

SEQ ID NO: 454098 - DNA, 15 bp, Homo sapiens
cagtgtgaatactta

SEQ ID NO: 454099 - DNA, 15 bp, Homo sapiens
agtgtgaatacttag

SEQ ID NO: 454100 - DNA, 15 bp, Homo sapiens
gtgtgaatacttagc

SEQ ID NO: 454101 - DNA, 15 bp, Homo sapiens
tgtgaatacttagca

SEQ ID NO: 454102 - DNA, 15 bp, Homo sapiens
gtgaatacttagcat

SEQ ID NO: 454103 - DNA, 15 bp, Homo sapiens
tgaatacttagcata

SEQ ID NO: 454104 - DNA, 15 bp, Homo sapiens
gaatacttagcatat

SEQ ID NO: 454105 - DNA, 15 bp, Homo sapiens
aatacttagcatata

SEQ ID NO: 454106 - DNA, 15 bp, Homo sapiens
atacttagcatatag

SEQ ID NO: 454107 - DNA, 15 bp, Homo sapiens
tacttagcatataga

SEQ ID NO: 454108 - DNA, 15 bp, Homo sapiens
acttagcatatagat

SEQ ID NO: 454109 - DNA, 15 bp, Homo sapiens
cttagcatatagatt

SEQ ID NO: 454110 - DNA, 15 bp, Homo sapiens
ttagcatatagattt

SEQ ID NO: 454111 - DNA, 15 bp, Homo sapiens
tagcatatagattta

SEQ ID NO: 454112 - DNA, 15 bp, Homo sapiens
agcatatagatttat

SEQ ID NO: 454113 - DNA, 15 bp, Homo sapiens
gcatatagatttatg

SEQ ID NO: 454114 - DNA, 15 bp, Homo sapiens
catatagatttatgc

SEQ ID NO: 454115 - DNA, 15 bp, Homo sapiens
atatagatttatgct

SEQ ID NO: 454116 - DNA, 15 bp, Homo sapiens
tatagatttatgcta

SEQ ID NO: 454117 - DNA, 15 bp, Homo sapiens
atagatttatgctat

SEQ ID NO: 454118 - DNA, 15 bp, Homo sapiens
tagatttatgctatc

SEQ ID NO: 454119 - DNA, 15 bp, Homo sapiens
agatttatgctatct

SEQ ID NO: 454120 - DNA, 15 bp, Homo sapiens
gatttatgctatctg

SEQ ID NO: 454121 - DNA, 15 bp, Homo sapiens
atttatgctatctgg

SEQ ID NO: 454122 - DNA, 15 bp, Homo sapiens
tttatgctatctgga

SEQ ID NO: 454123 - DNA, 15 bp, Homo sapiens
ttatgctatctggat

SEQ ID NO: 454124 - DNA, 15 bp, Homo sapiens
tatgctatctggatt

SEQ ID NO: 454125 - DNA, 15 bp, Homo sapiens
atgctatctggattc

SEQ ID NO: 454126 - DNA, 15 bp, Homo sapiens
tgctatctggattct

SEQ ID NO: 454127 - DNA, 15 bp, Homo sapiens
gctatctggattcta

SEQ ID NO: 454128 - DNA, 15 bp, Homo sapiens
ctatctggattctat

SEQ ID NO: 454129 - DNA, 15 bp, Homo sapiens
tatctggattctatt

SEQ ID NO: 454130 - DNA, 15 bp, Homo sapiens
atctggattctattt

SEQ ID NO: 454131 - DNA, 15 bp, Homo sapiens
tctggattctatttg

SEQ ID NO: 454132 - DNA, 15 bp, Homo sapiens
ctggattctatttgt

SEQ ID NO: 454133 - DNA, 15 bp, Homo sapiens
tggattctatttgtg

SEQ ID NO: 454134 - DNA, 15 bp, Homo sapiens
ggattctatttgtgg

SEQ ID NO: 454135 - DNA, 15 bp, Homo sapiens
gattctatttgtggt

SEQ ID NO: 454136 - DNA, 15 bp, Homo sapiens
attctatttgtggtt

SEQ ID NO: 454137 - DNA, 15 bp, Homo sapiens
ttctatttgtggttg

SEQ ID NO: 454138 - DNA, 15 bp, Homo sapiens
tctatttgtggttgt

SEQ ID NO: 454139 - DNA, 15 bp, Homo sapiens
ctatttgtggttgta

SEQ ID NO: 454140 - DNA, 15 bp, Homo sapiens
tatttgtggttgtag

SEQ ID NO: 454141 - DNA, 15 bp, Homo sapiens
atttgtggttgtagt

SEQ ID NO: 454142 - DNA, 15 bp, Homo sapiens
tttgtggttgtagtt

SEQ ID NO: 454143 - DNA, 15 bp, Homo sapiens
ttgtggttgtagttc

SEQ ID NO: 454144 - DNA, 15 bp, Homo sapiens
tgtggttgtagttct

SEQ ID NO: 454145 - DNA, 15 bp, Homo sapiens
gtggttgtagttcta

SEQ ID NO: 454146 - DNA, 15 bp, Homo sapiens
tggttgtagttctaa

SEQ ID NO: 454147 - DNA, 15 bp, Homo sapiens
ggttgtagttctaat

SEQ ID NO: 454148 - DNA, 15 bp, Homo sapiens
gttgtagttctaatg

SEQ ID NO: 454149 - DNA, 15 bp, Homo sapiens
ttgtagttctaatga

SEQ ID NO: 454150 - DNA, 15 bp, Homo sapiens
tgtagttctaatgat

SEQ ID NO: 454151 - DNA, 15 bp, Homo sapiens
gtagttctaatgatt

SEQ ID NO: 454152 - DNA, 15 bp, Homo sapiens
tagttctaatgattg

SEQ ID NO: 454153 - DNA, 15 bp, Homo sapiens
agttctaatgattga

SEQ ID NO: 454154 - DNA, 15 bp, Homo sapiens
gttctaatgattgag

SEQ ID NO: 454155 - DNA, 15 bp, Homo sapiens
ttctaatgattgagt

SEQ ID NO: 454156 - DNA, 15 bp, Homo sapiens
tctaatgattgagtc

SEQ ID NO: 454157 - DNA, 15 bp, Homo sapiens
ctaatgattgagtct

SEQ ID NO: 454158 - DNA, 15 bp, Homo sapiens
taatgattgagtcta

SEQ ID NO: 454159 - DNA, 15 bp, Homo sapiens
aatgattgagtctac

SEQ ID NO: 454160 - DNA, 15 bp, Homo sapiens
atgattgagtctacc

SEQ ID NO: 454161 - DNA, 15 bp, Homo sapiens
tgattgagtctaccc

SEQ ID NO: 454162 - DNA, 15 bp, Homo sapiens
gattgagtctaccct

SEQ ID NO: 454163 - DNA, 15 bp, Homo sapiens
attgagtctacccta

SEQ ID NO: 454164 - DNA, 15 bp, Homo sapiens
ttgagtctaccctag

SEQ ID NO: 454165 - DNA, 15 bp, Homo sapiens
tgagtctaccctagg

SEQ ID NO: 454166 - DNA, 15 bp, Homo sapiens
gagtctaccctaggc

SEQ ID NO: 454167 - DNA, 15 bp, Homo sapiens
agtctaccctaggcc

SEQ ID NO: 454168 - DNA, 15 bp, Homo sapiens
gtctaccctaggcct

SEQ ID NO: 454169 - DNA, 15 bp, Homo sapiens
tctaccctaggcctt

SEQ ID NO: 454170 - DNA, 15 bp, Homo sapiens
ctaccctaggccttg

SEQ ID NO: 454171 - DNA, 15 bp, Homo sapiens
taccctaggccttgt

SEQ ID NO: 454172 - DNA, 15 bp, Homo sapiens
accctaggccttgtc

SEQ ID NO: 454173 - DNA, 15 bp, Homo sapiens
ccctaggccttgtca

SEQ ID NO: 454174 - DNA, 15 bp, Homo sapiens
cctaggccttgtcag

SEQ ID NO: 454175 - DNA, 15 bp, Homo sapiens
ctaggccttgtcaga

SEQ ID NO: 454176 - DNA, 15 bp, Homo sapiens
taggccttgtcagat

SEQ ID NO: 454177 - DNA, 15 bp, Homo sapiens
aggccttgtcagata

SEQ ID NO: 454178 - DNA, 15 bp, Homo sapiens
ggccttgtcagatag

SEQ ID NO: 454179 - DNA, 15 bp, Homo sapiens
gccttgtcagatagt

SEQ ID NO: 454180 - DNA, 15 bp, Homo sapiens
ccttgtcagatagtt

SEQ ID NO: 454181 - DNA, 15 bp, Homo sapiens
cttgtcagatagttg

SEQ ID NO: 454182 - DNA, 15 bp, Homo sapiens
ttgtcagatagttga

SEQ ID NO: 454183 - DNA, 15 bp, Homo sapiens
tgtcagatagttgat

SEQ ID NO: 454184 - DNA, 15 bp, Homo sapiens
gtcagatagttgatg

SEQ ID NO: 454185 - DNA, 15 bp, Homo sapiens
tcagatagttgatgt

SEQ ID NO: 454186 - DNA, 15 bp, Homo sapiens
cagatagttgatgtg

SEQ ID NO: 454187 - DNA, 15 bp, Homo sapiens
agatagttgatgtgg

SEQ ID NO: 454188 - DNA, 15 bp, Homo sapiens
gatagttgatgtgga

SEQ ID NO: 454189 - DNA, 15 bp, Homo sapiens
atagttgatgtggaa

SEQ ID NO: 454190 - DNA, 15 bp, Homo sapiens
tagttgatgtggaaa

SEQ ID NO: 454191 - DNA, 15 bp, Homo sapiens
agttgatgtggaaag

SEQ ID NO: 454192 - DNA, 15 bp, Homo sapiens
gttgatgtggaaagt

SEQ ID NO: 454193 - DNA, 15 bp, Homo sapiens
ttgatgtggaaagtg

SEQ ID NO: 454194 - DNA, 15 bp, Homo sapiens
tgatgtggaaagtga

SEQ ID NO: 454195 - DNA, 15 bp, Homo sapiens
gatgtggaaagtgat

SEQ ID NO: 454196 - DNA, 15 bp, Homo sapiens
atgtggaaagtgata

SEQ ID NO: 454197 - DNA, 15 bp, Homo sapiens
tgtggaaagtgatat

SEQ ID NO: 454198 - DNA, 15 bp, Homo sapiens
gtggaaagtgatatt

SEQ ID NO: 454199 - DNA, 15 bp, Homo sapiens
tggaaagtgatattt

SEQ ID NO: 454200 - DNA, 15 bp, Homo sapiens
ggaaagtgatattta

SEQ ID NO: 454201 - DNA, 15 bp, Homo sapiens
gaaagtgatatttac

SEQ ID NO: 454202 - DNA, 15 bp, Homo sapiens
aaagtgatatttacc

SEQ ID NO: 454203 - DNA, 15 bp, Homo sapiens
aagtgatatttacct

SEQ ID NO: 454204 - DNA, 15 bp, Homo sapiens
agtgatatttacctg

SEQ ID NO: 454205 - DNA, 15 bp, Homo sapiens
gtgatatttacctgt

SEQ ID NO: 454206 - DNA, 15 bp, Homo sapiens
tgatatttacctgtt

SEQ ID NO: 454207 - DNA, 15 bp, Homo sapiens
gatatttacctgttc

SEQ ID NO: 454208 - DNA, 15 bp, Homo sapiens
atatttacctgttct

SEQ ID NO: 454209 - DNA, 15 bp, Homo sapiens
tatttacctgttctt

SEQ ID NO: 454210 - DNA, 15 bp, Homo sapiens
atttacctgttcttt

SEQ ID NO: 454211 - DNA, 15 bp, Homo sapiens
tttacctgttctttt

SEQ ID NO: 454212 - DNA, 15 bp, Homo sapiens
ttacctgttctttta

SEQ ID NO: 454213 - DNA, 15 bp, Homo sapiens
tacctgttcttttaa

SEQ ID NO: 454214 - DNA, 15 bp, Homo sapiens
acctgttcttttaag

SEQ ID NO: 454215 - DNA, 15 bp, Homo sapiens
cctgttcttttaaga

SEQ ID NO: 454216 - DNA, 15 bp, Homo sapiens
ctgttcttttaagat

SEQ ID NO: 454217 - DNA, 15 bp, Homo sapiens
tgttcttttaagata

SEQ ID NO: 454218 - DNA, 15 bp, Homo sapiens
gttcttttaagatag

SEQ ID NO: 454219 - DNA, 15 bp, Homo sapiens
ttcttttaagatagg

SEQ ID NO: 454220 - DNA, 15 bp, Homo sapiens
tcttttaagataggg

SEQ ID NO: 454221 - DNA, 15 bp, Homo sapiens
cttttaagatagggt

SEQ ID NO: 454222 - DNA, 15 bp, Homo sapiens
ttttaagatagggta

SEQ ID NO: 454223 - DNA, 15 bp, Homo sapiens
tttaagatagggtaa

SEQ ID NO: 454224 - DNA, 15 bp, Homo sapiens
ttaagatagggtaaa

SEQ ID NO: 454225 - DNA, 15 bp, Homo sapiens
taagatagggtaaat

SEQ ID NO: 454226 - DNA, 15 bp, Homo sapiens
aagatagggtaaatt

SEQ ID NO: 454227 - DNA, 15 bp, Homo sapiens
agatagggtaaattg

SEQ ID NO: 454228 - DNA, 15 bp, Homo sapiens
gatagggtaaattga

SEQ ID NO: 454229 - DNA, 15 bp, Homo sapiens
atagggtaaattgaa

SEQ ID NO: 454230 - DNA, 15 bp, Homo sapiens
tagggtaaattgaaa

SEQ ID NO: 454231 - DNA, 15 bp, Homo sapiens
agggtaaattgaaaa

SEQ ID NO: 454232 - DNA, 15 bp, Homo sapiens
gggtaaattgaaaag

SEQ ID NO: 454233 - DNA, 15 bp, Homo sapiens
ggtaaattgaaaagt

SEQ ID NO: 454234 - DNA, 15 bp, Homo sapiens
gtaaattgaaaagtt

SEQ ID NO: 454235 - DNA, 15 bp, Homo sapiens
taaattgaaaagttt

SEQ ID NO: 454236 - DNA, 15 bp, Homo sapiens
aaattgaaaagtttc

SEQ ID NO: 454237 - DNA, 15 bp, Homo sapiens
aattgaaaagtttca

SEQ ID NO: 454238 - DNA, 15 bp, Homo sapiens
attgaaaagtttcaa

SEQ ID NO: 454239 - DNA, 15 bp, Homo sapiens
ttgaaaagtttcaag

SEQ ID NO: 454240 - DNA, 15 bp, Homo sapiens
tgaaaagtttcaagt

SEQ ID NO: 454241 - DNA, 15 bp, Homo sapiens
gaaaagtttcaagta

SEQ ID NO: 454242 - DNA, 15 bp, Homo sapiens
aaaagtttcaagtat

SEQ ID NO: 454243 - DNA, 15 bp, Homo sapiens
aaagtttcaagtatt

SEQ ID NO: 454244 - DNA, 15 bp, Homo sapiens
aagtttcaagtattc

SEQ ID NO: 454245 - DNA, 15 bp, Homo sapiens
agtttcaagtattct

SEQ ID NO: 454246 - DNA, 15 bp, Homo sapiens
gtttcaagtattctt

SEQ ID NO: 454247 - DNA, 15 bp, Homo sapiens
tttcaagtattcttc

SEQ ID NO: 454248 - DNA, 15 bp, Homo sapiens
ttcaagtattcttct

SEQ ID NO: 454249 - DNA, 15 bp, Homo sapiens
tcaagtattcttctt

SEQ ID NO: 454250 - DNA, 15 bp, Homo sapiens
caagtattcttcttt

SEQ ID NO: 454251 - DNA, 15 bp, Homo sapiens
aagtattcttctttg

SEQ ID NO: 454252 - DNA, 15 bp, Homo sapiens
agtattcttctttgc

SEQ ID NO: 454253 - DNA, 15 bp, Homo sapiens
gtattcttctttgct

SEQ ID NO: 454254 - DNA, 15 bp, Homo sapiens
tattcttctttgcta

SEQ ID NO: 454255 - DNA, 15 bp, Homo sapiens
attcttctttgctac

SEQ ID NO: 454256 - DNA, 15 bp, Homo sapiens
ttcttctttgctacc

SEQ ID NO: 454257 - DNA, 15 bp, Homo sapiens
tcttctttgctacct

SEQ ID NO: 454258 - DNA, 15 bp, Homo sapiens
cttctttgctacctt

SEQ ID NO: 454259 - DNA, 15 bp, Homo sapiens
ttctttgctaccttt

SEQ ID NO: 454260 - DNA, 15 bp, Homo sapiens
tctttgctacctttt

SEQ ID NO: 454261 - DNA, 15 bp, Homo sapiens
ctttgctaccttttg

SEQ ID NO: 454262 - DNA, 15 bp, Homo sapiens
tttgctaccttttgt

SEQ ID NO: 454263 - DNA, 15 bp, Homo sapiens
ttgctaccttttgtt

SEQ ID NO: 454264 - DNA, 15 bp, Homo sapiens
tgctaccttttgtta

SEQ ID NO: 454265 - DNA, 15 bp, Homo sapiens
gctaccttttgttaa

SEQ ID NO: 454266 - DNA, 15 bp, Homo sapiens
ctaccttttgttaac

SEQ ID NO: 454267 - DNA, 15 bp, Homo sapiens
taccttttgttaact

SEQ ID NO: 454268 - DNA, 15 bp, Homo sapiens
accttttgttaactg

SEQ ID NO: 454269 - DNA, 15 bp, Homo sapiens
ccttttgttaactgt

SEQ ID NO: 454270 - DNA, 15 bp, Homo sapiens
cttttgttaactgtt

SEQ ID NO: 454271 - DNA, 15 bp, Homo sapiens
ttttgttaactgtta

SEQ ID NO: 454272 - DNA, 15 bp, Homo sapiens
tttgttaactgttaa

SEQ ID NO: 454273 - DNA, 15 bp, Homo sapiens
ttgttaactgttaat

SEQ ID NO: 454274 - DNA, 15 bp, Homo sapiens
tgttaactgttaata

SEQ ID NO: 454275 - DNA, 15 bp, Homo sapiens
gttaactgttaatat

SEQ ID NO: 454276 - DNA, 15 bp, Homo sapiens
ttaactgttaatata

SEQ ID NO: 454277 - DNA, 15 bp, Homo sapiens
taactgttaatatac

SEQ ID NO: 454278 - DNA, 15 bp, Homo sapiens
aactgttaatatacg

SEQ ID NO: 454279 - DNA, 15 bp, Homo sapiens
actgttaatatacgt

SEQ ID NO: 454280 - DNA, 15 bp, Homo sapiens
ctgttaatatacgtc

SEQ ID NO: 454281 - DNA, 15 bp, Homo sapiens
tgttaatatacgtct

SEQ ID NO: 454282 - DNA, 15 bp, Homo sapiens
gttaatatacgtcta

SEQ ID NO: 454283 - DNA, 15 bp, Homo sapiens
ttaatatacgtctag

SEQ ID NO: 454284 - DNA, 15 bp, Homo sapiens
taatatacgtctagg

SEQ ID NO: 454285 - DNA, 15 bp, Homo sapiens
aatatacgtctaggc

SEQ ID NO: 454286 - DNA, 15 bp, Homo sapiens
atatacgtctaggca

SEQ ID NO: 454287 - DNA, 15 bp, Homo sapiens
tatacgtctaggcag

SEQ ID NO: 454288 - DNA, 15 bp, Homo sapiens
atacgtctaggcagt

SEQ ID NO: 454289 - DNA, 15 bp, Homo sapiens
tacgtctaggcagtt

SEQ ID NO: 454290 - DNA, 15 bp, Homo sapiens
acgtctaggcagttc

SEQ ID NO: 454291 - DNA, 15 bp, Homo sapiens
cgtctaggcagttca

SEQ ID NO: 454292 - DNA, 15 bp, Homo sapiens
gtctaggcagttcag

SEQ ID NO: 454293 - DNA, 15 bp, Homo sapiens
tctaggcagttcagt

SEQ ID NO: 454294 - DNA, 15 bp, Homo sapiens
ctaggcagttcagtg

SEQ ID NO: 454295 - DNA, 15 bp, Homo sapiens
taggcagttcagtga

SEQ ID NO: 454296 - DNA, 15 bp, Homo sapiens
aggcagttcagtgat

SEQ ID NO: 454297 - DNA, 15 bp, Homo sapiens
ggcagttcagtgatg

SEQ ID NO: 454298 - DNA, 15 bp, Homo sapiens
gcagttcagtgatgc

SEQ ID NO: 454299 - DNA, 15 bp, Homo sapiens
cagttcagtgatgct

SEQ ID NO: 454300 - DNA, 15 bp, Homo sapiens
agttcagtgatgctt

SEQ ID NO: 454301 - DNA, 15 bp, Homo sapiens
gttcagtgatgcttt

SEQ ID NO: 454302 - DNA, 15 bp, Homo sapiens
ttcagtgatgctttg

SEQ ID NO: 454303 - DNA, 15 bp, Homo sapiens
tcagtgatgctttga

SEQ ID NO: 454304 - DNA, 15 bp, Homo sapiens
cagtgatgctttgaa

SEQ ID NO: 454305 - DNA, 15 bp, Homo sapiens
agtgatgctttgaaa

SEQ ID NO: 454306 - DNA, 15 bp, Homo sapiens
gtgatgctttgaaaa

SEQ ID NO: 454307 - DNA, 15 bp, Homo sapiens
tgatgctttgaaaat

SEQ ID NO: 454308 - DNA, 15 bp, Homo sapiens
gatgctttgaaaatt

SEQ ID NO: 454309 - DNA, 15 bp, Homo sapiens
atgctttgaaaatta

SEQ ID NO: 454310 - DNA, 15 bp, Homo sapiens
tgctttgaaaattat

SEQ ID NO: 454311 - DNA, 15 bp, Homo sapiens
gctttgaaaattatg

SEQ ID NO: 454312 - DNA, 15 bp, Homo sapiens
ctttgaaaattatgc

SEQ ID NO: 454313 - DNA, 15 bp, Homo sapiens
tttgaaaattatgct

SEQ ID NO: 454314 - DNA, 15 bp, Homo sapiens
ttgaaaattatgctt

SEQ ID NO: 454315 - DNA, 15 bp, Homo sapiens
tgaaaattatgcttt

SEQ ID NO: 454316 - DNA, 15 bp, Homo sapiens
gaaaattatgctttg

SEQ ID NO: 454317 - DNA, 15 bp, Homo sapiens
aaaattatgctttga

SEQ ID NO: 454318 - DNA, 15 bp, Homo sapiens
aaattatgctttgaa

SEQ ID NO: 454319 - DNA, 15 bp, Homo sapiens
aattatgctttgaaa

SEQ ID NO: 454320 - DNA, 15 bp, Homo sapiens
attatgctttgaaaa

SEQ ID NO: 454321 - DNA, 15 bp, Homo sapiens
ttatgctttgaaaaa

SEQ ID NO: 454322 - DNA, 15 bp, Homo sapiens
tatgctttgaaaaat

SEQ ID NO: 454323 - DNA, 15 bp, Homo sapiens
atgctttgaaaaatg

SEQ ID NO: 454324 - DNA, 15 bp, Homo sapiens
tgctttgaaaaatga

SEQ ID NO: 454325 - DNA, 15 bp, Homo sapiens
gctttgaaaaatgat

SEQ ID NO: 454326 - DNA, 15 bp, Homo sapiens
ctttgaaaaatgata

SEQ ID NO: 454327 - DNA, 15 bp, Homo sapiens
tttgaaaaatgatat

SEQ ID NO: 454328 - DNA, 15 bp, Homo sapiens
ttgaaaaatgatatg

SEQ ID NO: 454329 - DNA, 15 bp, Homo sapiens
tgaaaaatgatatgt

SEQ ID NO: 454330 - DNA, 15 bp, Homo sapiens
gaaaaatgatatgtt

SEQ ID NO: 454331 - DNA, 15 bp, Homo sapiens
aaaaatgatatgtta

SEQ ID NO: 454332 - DNA, 15 bp, Homo sapiens
aaatgatatgttaag

SEQ ID NO: 454333 - DNA, 15 bp, Homo sapiens
aatgatatgttaagg

SEQ ID NO: 454334 - DNA, 15 bp, Homo sapiens
atgatatgttaaggt

SEQ ID NO: 454335 - DNA, 15 bp, Homo sapiens
tgatatgttaaggtt

SEQ ID NO: 454336 - DNA, 15 bp, Homo sapiens
gatatgttaaggttg

SEQ ID NO: 454337 - DNA, 15 bp, Homo sapiens
atatgttaaggttga

SEQ ID NO: 454338 - DNA, 15 bp, Homo sapiens
tatgttaaggttgaa

SEQ ID NO: 454339 - DNA, 15 bp, Homo sapiens
atgttaaggttgaaa

SEQ ID NO: 454340 - DNA, 15 bp, Homo sapiens
tgttaaggttgaaaa

SEQ ID NO: 454341 - DNA, 15 bp, Homo sapiens
gttaaggttgaaaaa

SEQ ID NO: 454342 - DNA, 15 bp, Homo sapiens
ttaaggttgaaaaat

SEQ ID NO: 454343 - DNA, 15 bp, Homo sapiens
taaggttgaaaaatc

SEQ ID NO: 454344 - DNA, 15 bp, Homo sapiens
aaggttgaaaaatct

SEQ ID NO: 454345 - DNA, 15 bp, Homo sapiens
aggttgaaaaatctg

SEQ ID NO: 454346 - DNA, 15 bp, Homo sapiens
ggttgaaaaatctgc

SEQ ID NO: 454347 - DNA, 15 bp, Homo sapiens
gttgaaaaatctgct

SEQ ID NO: 454348 - DNA, 15 bp, Homo sapiens
ttgaaaaatctgctc

SEQ ID NO: 454349 - DNA, 15 bp, Homo sapiens
tgaaaaatctgctcc

SEQ ID NO: 454350 - DNA, 15 bp, Homo sapiens
gaaaaatctgctcct

SEQ ID NO: 454351 - DNA, 15 bp, Homo sapiens
aaaaatctgctcctt

SEQ ID NO: 454352 - DNA, 15 bp, Homo sapiens
aaaatctgctccttg

SEQ ID NO: 454353 - DNA, 15 bp, Homo sapiens
aaatctgctccttga

SEQ ID NO: 454354 - DNA, 15 bp, Homo sapiens
aatctgctccttgaa

SEQ ID NO: 454355 - DNA, 15 bp, Homo sapiens
atctgctccttgaaa

SEQ ID NO: 454356 - DNA, 15 bp, Homo sapiens
tctgctccttgaaag

SEQ ID NO: 454357 - DNA, 15 bp, Homo sapiens
ctgctccttgaaagt

SEQ ID NO: 454358 - DNA, 15 bp, Homo sapiens
tgctccttgaaagtc

SEQ ID NO: 454359 - DNA, 15 bp, Homo sapiens
gctccttgaaagtca

SEQ ID NO: 454360 - DNA, 15 bp, Homo sapiens
ctccttgaaagtcaa

SEQ ID NO: 454361 - DNA, 15 bp, Homo sapiens
tccttgaaagtcaat

SEQ ID NO: 454362 - DNA, 15 bp, Homo sapiens
ccttgaaagtcaata

SEQ ID NO: 454363 - DNA, 15 bp, Homo sapiens
cttgaaagtcaatag

SEQ ID NO: 454364 - DNA, 15 bp, Homo sapiens
ttgaaagtcaataga

SEQ ID NO: 454365 - DNA, 15 bp, Homo sapiens
tgaaagtcaatagaa

SEQ ID NO: 454366 - DNA, 15 bp, Homo sapiens
gaaagtcaatagaag

SEQ ID NO: 454367 - DNA, 15 bp, Homo sapiens
aaagtcaatagaagt

SEQ ID NO: 454368 - DNA, 15 bp, Homo sapiens
aagtcaatagaagtt

SEQ ID NO: 454369 - DNA, 15 bp, Homo sapiens
agtcaatagaagtta

SEQ ID NO: 454370 - DNA, 15 bp, Homo sapiens
gtcaatagaagttag

SEQ ID NO: 454371 - DNA, 15 bp, Homo sapiens
tcaatagaagttagc

SEQ ID NO: 454372 - DNA, 15 bp, Homo sapiens
caatagaagttagca

SEQ ID NO: 454373 - DNA, 15 bp, Homo sapiens
aatagaagttagcaa

SEQ ID NO: 454374 - DNA, 15 bp, Homo sapiens
atagaagttagcaat

SEQ ID NO: 454375 - DNA, 15 bp, Homo sapiens
tagaagttagcaata

SEQ ID NO: 454376 - DNA, 15 bp, Homo sapiens
agaagttagcaataa

SEQ ID NO: 454377 - DNA, 15 bp, Homo sapiens
gaagttagcaataaa

SEQ ID NO: 454378 - DNA, 15 bp, Homo sapiens
aagttagcaataaat

SEQ ID NO: 454379 - DNA, 15 bp, Homo sapiens
agttagcaataaatt

SEQ ID NO: 454380 - DNA, 15 bp, Homo sapiens
gttagcaataaattt

SEQ ID NO: 454381 - DNA, 15 bp, Homo sapiens
ttagcaataaatttt

SEQ ID NO: 454382 - DNA, 15 bp, Homo sapiens
tagcaataaatttta

SEQ ID NO: 454383 - DNA, 15 bp, Homo sapiens
agcaataaattttaa

SEQ ID NO: 454384 - DNA, 15 bp, Homo sapiens
gcaataaattttaag

SEQ ID NO: 454385 - DNA, 15 bp, Homo sapiens
caataaattttaagc

SEQ ID NO: 454386 - DNA, 15 bp, Homo sapiens
aataaattttaagct

SEQ ID NO: 454387 - DNA, 15 bp, Homo sapiens
ataaattttaagctg

SEQ ID NO: 454388 - DNA, 15 bp, Homo sapiens
taaattttaagctgg

SEQ ID NO: 454389 - DNA, 15 bp, Homo sapiens
aaattttaagctggc

SEQ ID NO: 454390 - DNA, 15 bp, Homo sapiens
aattttaagctggct

SEQ ID NO: 454391 - DNA, 15 bp, Homo sapiens
attttaagctggctg

SEQ ID NO: 454392 - DNA, 15 bp, Homo sapiens
ttttaagctggctgc

SEQ ID NO: 454393 - DNA, 15 bp, Homo sapiens
tttaagctggctgca

SEQ ID NO: 454394 - DNA, 15 bp, Homo sapiens
ttaagctggctgcac

SEQ ID NO: 454395 - DNA, 15 bp, Homo sapiens
taagctggctgcacg

SEQ ID NO: 454396 - DNA, 15 bp, Homo sapiens
aagctggctgcacga

SEQ ID NO: 454397 - DNA, 15 bp, Homo sapiens
agctggctgcacgaa

SEQ ID NO: 454398 - DNA, 15 bp, Homo sapiens
gctggctgcacgaag

SEQ ID NO: 454399 - DNA, 15 bp, Homo sapiens
ctggctgcacgaaga

SEQ ID NO: 454400 - DNA, 15 bp, Homo sapiens
tggctgcacgaagaa

SEQ ID NO: 454401 - DNA, 15 bp, Homo sapiens
ggctgcacgaagaat

SEQ ID NO: 454402 - DNA, 15 bp, Homo sapiens
gctgcacgaagaatt

SEQ ID NO: 454403 - DNA, 15 bp, Homo sapiens
ctgcacgaagaattg

SEQ ID NO: 454404 - DNA, 15 bp, Homo sapiens
tgcacgaagaattga

SEQ ID NO: 454405 - DNA, 15 bp, Homo sapiens
gcacgaagaattgag

SEQ ID NO: 454406 - DNA, 15 bp, Homo sapiens
cacgaagaattgagg

SEQ ID NO: 454407 - DNA, 15 bp, Homo sapiens
acgaagaattgagga

SEQ ID NO: 454408 - DNA, 15 bp, Homo sapiens
cgaagaattgaggaa

SEQ ID NO: 454409 - DNA, 15 bp, Homo sapiens
gaagaattgaggaaa

SEQ ID NO: 454410 - DNA, 15 bp, Homo sapiens
aagaattgaggaaag

SEQ ID NO: 454411 - DNA, 15 bp, Homo sapiens
agaattgaggaaaga

SEQ ID NO: 454412 - DNA, 15 bp, Homo sapiens
gaattgaggaaagag

SEQ ID NO: 454413 - DNA, 15 bp, Homo sapiens
aattgaggaaagaga

SEQ ID NO: 454414 - DNA, 15 bp, Homo sapiens
attgaggaaagagag

SEQ ID NO: 454415 - DNA, 15 bp, Homo sapiens
ttgaggaaagagagg

SEQ ID NO: 454416 - DNA, 15 bp, Homo sapiens
tgaggaaagagaggt

SEQ ID NO: 454417 - DNA, 15 bp, Homo sapiens
gaggaaagagaggta

SEQ ID NO: 454418 - DNA, 15 bp, Homo sapiens
aggaaagagaggtat

SEQ ID NO: 454419 - DNA, 15 bp, Homo sapiens
ggaaagagaggtata

SEQ ID NO: 454420 - DNA, 15 bp, Homo sapiens
gaaagagaggtataa

SEQ ID NO: 454421 - DNA, 15 bp, Homo sapiens
aaagagaggtataat

SEQ ID NO: 454422 - DNA, 15 bp, Homo sapiens
aagagaggtataatg

SEQ ID NO: 454423 - DNA, 15 bp, Homo sapiens
agagaggtataatgt

SEQ ID NO: 454424 - DNA, 15 bp, Homo sapiens
gagaggtataatgtc

SEQ ID NO: 454425 - DNA, 15 bp, Homo sapiens
agaggtataatgtca

SEQ ID NO: 454426 - DNA, 15 bp, Homo sapiens
gaggtataatgtcat

SEQ ID NO: 454427 - DNA, 15 bp, Homo sapiens
aggtataatgtcatt

SEQ ID NO: 454428 - DNA, 15 bp, Homo sapiens
ggtataatgtcattg

SEQ ID NO: 454429 - DNA, 15 bp, Homo sapiens
gtataatgtcattga

SEQ ID NO: 454430 - DNA, 15 bp, Homo sapiens
tataatgtcattgag

SEQ ID NO: 454431 - DNA, 15 bp, Homo sapiens
ataatgtcattgaga

SEQ ID NO: 454432 - DNA, 15 bp, Homo sapiens
taatgtcattgagaa

SEQ ID NO: 454433 - DNA, 15 bp, Homo sapiens
aatgtcattgagaaa

SEQ ID NO: 454434 - DNA, 15 bp, Homo sapiens
atgtcattgagaaaa

SEQ ID NO: 454435 - DNA, 15 bp, Homo sapiens
tgtcattgagaaaaa

SEQ ID NO: 454436 - DNA, 15 bp, Homo sapiens
gtcattgagaaaaaa

SEQ ID NO: 454437 - DNA, 15 bp, Homo sapiens
tcattgagaaaaaat

SEQ ID NO: 454438 - DNA, 15 bp, Homo sapiens
cattgagaaaaaata

SEQ ID NO: 454439 - DNA, 15 bp, Homo sapiens
attgagaaaaaatag

SEQ ID NO: 454440 - DNA, 15 bp, Homo sapiens
ttgagaaaaaatagc

SEQ ID NO: 454441 - DNA, 15 bp, Homo sapiens
tgagaaaaaatagca

SEQ ID NO: 454442 - DNA, 15 bp, Homo sapiens
gagaaaaaatagcaa

SEQ ID NO: 454443 - DNA, 15 bp, Homo sapiens
agaaaaaatagcaat

SEQ ID NO: 454444 - DNA, 15 bp, Homo sapiens
gaaaaaatagcaatg

SEQ ID NO: 454445 - DNA, 15 bp, Homo sapiens
aaaaaatagcaatgc

SEQ ID NO: 454446 - DNA, 15 bp, Homo sapiens
aaaaatagcaatgca

SEQ ID NO: 454447 - DNA, 15 bp, Homo sapiens
aaaatagcaatgcaa

SEQ ID NO: 454448 - DNA, 15 bp, Homo sapiens
aaatagcaatgcaaa

SEQ ID NO: 454449 - DNA, 15 bp, Homo sapiens
aatagcaatgcaaag

SEQ ID NO: 454450 - DNA, 15 bp, Homo sapiens
atagcaatgcaaagc

SEQ ID NO: 454451 - DNA, 15 bp, Homo sapiens
tagcaatgcaaagct

SEQ ID NO: 454452 - DNA, 15 bp, Homo sapiens
agcaatgcaaagctt

SEQ ID NO: 454453 - DNA, 15 bp, Homo sapiens
gcaatgcaaagcttg

SEQ ID NO: 454454 - DNA, 15 bp, Homo sapiens
caatgcaaagcttga

SEQ ID NO: 454455 - DNA, 15 bp, Homo sapiens
aatgcaaagcttgaa

SEQ ID NO: 454456 - DNA, 15 bp, Homo sapiens
atgcaaagcttgaaa

SEQ ID NO: 454457 - DNA, 15 bp, Homo sapiens
tgcaaagcttgaaaa

SEQ ID NO: 454458 - DNA, 15 bp, Homo sapiens
gcaaagcttgaaaat

SEQ ID NO: 454459 - DNA, 15 bp, Homo sapiens
caaagcttgaaaata

SEQ ID NO: 454460 - DNA, 15 bp, Homo sapiens
aaagcttgaaaatag

SEQ ID NO: 454461 - DNA, 15 bp, Homo sapiens
aagcttgaaaatagg

SEQ ID NO: 454462 - DNA, 15 bp, Homo sapiens
agcttgaaaatagga

SEQ ID NO: 454463 - DNA, 15 bp, Homo sapiens
gcttgaaaataggaa

SEQ ID NO: 454464 - DNA, 15 bp, Homo sapiens
cttgaaaataggaaa

SEQ ID NO: 454465 - DNA, 15 bp, Homo sapiens
ttgaaaataggaaaa

SEQ ID NO: 454466 - DNA, 15 bp, Homo sapiens
tgaaaataggaaaag

SEQ ID NO: 454467 - DNA, 15 bp, Homo sapiens
gaaaataggaaaagc

SEQ ID NO: 454468 - DNA, 15 bp, Homo sapiens
aaaataggaaaagct

SEQ ID NO: 454469 - DNA, 15 bp, Homo sapiens
aaataggaaaagctt

SEQ ID NO: 454470 - DNA, 15 bp, Homo sapiens
aataggaaaagctta

SEQ ID NO: 454471 - DNA, 15 bp, Homo sapiens
ataggaaaagcttaa

SEQ ID NO: 454472 - DNA, 15 bp, Homo sapiens
taggaaaagcttaag

SEQ ID NO: 454473 - DNA, 15 bp, Homo sapiens
aggaaaagcttaagc

SEQ ID NO: 454474 - DNA, 15 bp, Homo sapiens
ggaaaagcttaagct

SEQ ID NO: 454475 - DNA, 15 bp, Homo sapiens
gaaaagcttaagcta

SEQ ID NO: 454476 - DNA, 15 bp, Homo sapiens
aaaagcttaagctat

SEQ ID NO: 454477 - DNA, 15 bp, Homo sapiens
aaagcttaagctatg

SEQ ID NO: 454478 - DNA, 15 bp, Homo sapiens
aagcttaagctatgt

SEQ ID NO: 454479 - DNA, 15 bp, Homo sapiens
agcttaagctatgta

SEQ ID NO: 454480 - DNA, 15 bp, Homo sapiens
gcttaagctatgtat

SEQ ID NO: 454481 - DNA, 15 bp, Homo sapiens
cttaagctatgtatg

SEQ ID NO: 454482 - DNA, 15 bp, Homo sapiens
ttaagctatgtatgg

SEQ ID NO: 454483 - DNA, 15 bp, Homo sapiens
taagctatgtatgga

SEQ ID NO: 454484 - DNA, 15 bp, Homo sapiens
aagctatgtatggaa

SEQ ID NO: 454485 - DNA, 15 bp, Homo sapiens
agctatgtatggaag

SEQ ID NO: 454486 - DNA, 15 bp, Homo sapiens
gctatgtatggaaga

SEQ ID NO: 454487 - DNA, 15 bp, Homo sapiens
ctatgtatggaagag

SEQ ID NO: 454488 - DNA, 15 bp, Homo sapiens
tatgtatggaagaga

SEQ ID NO: 454489 - DNA, 15 bp, Homo sapiens
atgtatggaagagaa

SEQ ID NO: 454490 - DNA, 15 bp, Homo sapiens
tgtatggaagagaag

SEQ ID NO: 454491 - DNA, 15 bp, Homo sapiens
gtatggaagagaagt

SEQ ID NO: 454492 - DNA, 15 bp, Homo sapiens
tatggaagagaagtc

SEQ ID NO: 454493 - DNA, 15 bp, Homo sapiens
atggaagagaagtct

SEQ ID NO: 454494 - DNA, 15 bp, Homo sapiens
tggaagagaagtcta

SEQ ID NO: 454495 - DNA, 15 bp, Homo sapiens
ggaagagaagtctac

SEQ ID NO: 454496 - DNA, 15 bp, Homo sapiens
gaagagaagtctaca

SEQ ID NO: 454497 - DNA, 15 bp, Homo sapiens
aagagaagtctacag

SEQ ID NO: 454498 - DNA, 15 bp, Homo sapiens
agagaagtctacagg

SEQ ID NO: 454499 - DNA, 15 bp, Homo sapiens
gagaagtctacaggg

SEQ ID NO: 454500 - DNA, 15 bp, Homo sapiens
agaagtctacagggc

SEQ ID NO: 454501 - DNA, 15 bp, Homo sapiens
gaagtctacagggct

SEQ ID NO: 454502 - DNA, 15 bp, Homo sapiens
aagtctacagggctg

SEQ ID NO: 454503 - DNA, 15 bp, Homo sapiens
agtctacagggctga

SEQ ID NO: 454504 - DNA, 15 bp, Homo sapiens
gtctacagggctgaa

SEQ ID NO: 454505 - DNA, 15 bp, Homo sapiens
tctacagggctgaaa

SEQ ID NO: 454506 - DNA, 15 bp, Homo sapiens
ctacagggctgaaag

SEQ ID NO: 454507 - DNA, 15 bp, Homo sapiens
tacagggctgaaaga

SEQ ID NO: 454508 - DNA, 15 bp, Homo sapiens
acagggctgaaagac

SEQ ID NO: 454509 - DNA, 15 bp, Homo sapiens
cagggctgaaagaca

SEQ ID NO: 454510 - DNA, 15 bp, Homo sapiens
agggctgaaagacac

SEQ ID NO: 454511 - DNA, 15 bp, Homo sapiens
gggctgaaagacacc

SEQ ID NO: 454512 - DNA, 15 bp, Homo sapiens
ggctgaaagacacct

SEQ ID NO: 454513 - DNA, 15 bp, Homo sapiens
gctgaaagacacctc

SEQ ID NO: 454514 - DNA, 15 bp, Homo sapiens
ctgaaagacacctcc

SEQ ID NO: 454515 - DNA, 15 bp, Homo sapiens
tgaaagacacctcca

SEQ ID NO: 454516 - DNA, 15 bp, Homo sapiens
gaaagacacctccag

SEQ ID NO: 454517 - DNA, 15 bp, Homo sapiens
aaagacacctccaga

SEQ ID NO: 454518 - DNA, 15 bp, Homo sapiens
aagacacctccagat

SEQ ID NO: 454519 - DNA, 15 bp, Homo sapiens
agacacctccagatg

SEQ ID NO: 454520 - DNA, 15 bp, Homo sapiens
gacacctccagatga

SEQ ID NO: 454521 - DNA, 15 bp, Homo sapiens
acacctccagatgag

SEQ ID NO: 454522 - DNA, 15 bp, Homo sapiens
cacctccagatgagg

SEQ ID NO: 454523 - DNA, 15 bp, Homo sapiens
acctccagatgaggc

SEQ ID NO: 454524 - DNA, 15 bp, Homo sapiens
cctccagatgaggca

SEQ ID NO: 454525 - DNA, 15 bp, Homo sapiens
ctccagatgaggcaa

SEQ ID NO: 454526 - DNA, 15 bp, Homo sapiens
tccagatgaggcaat

SEQ ID NO: 454527 - DNA, 15 bp, Homo sapiens
ccagatgaggcaatg

SEQ ID NO: 454528 - DNA, 15 bp, Homo sapiens
cagatgaggcaatgc

SEQ ID NO: 454529 - DNA, 15 bp, Homo sapiens
agatgaggcaatgca

SEQ ID NO: 454530 - DNA, 15 bp, Homo sapiens
gatgaggcaatgcaa

SEQ ID NO: 454531 - DNA, 15 bp, Homo sapiens
atgaggcaatgcaag

SEQ ID NO: 454532 - DNA, 15 bp, Homo sapiens
tgaggcaatgcaagg

SEQ ID NO: 454533 - DNA, 15 bp, Homo sapiens
gaggcaatgcaagga

SEQ ID NO: 454534 - DNA, 15 bp, Homo sapiens
aggcaatgcaaggaa

SEQ ID NO: 454535 - DNA, 15 bp, Homo sapiens
ggcaatgcaaggaag

SEQ ID NO: 454536 - DNA, 15 bp, Homo sapiens
gcaatgcaaggaaga

SEQ ID NO: 454537 - DNA, 15 bp, Homo sapiens
caatgcaaggaagaa

SEQ ID NO: 454538 - DNA, 15 bp, Homo sapiens
aatgcaaggaagaat

SEQ ID NO: 454539 - DNA, 15 bp, Homo sapiens
atgcaaggaagaatg

SEQ ID NO: 454540 - DNA, 15 bp, Homo sapiens
tgcaaggaagaatga

SEQ ID NO: 454541 - DNA, 15 bp, Homo sapiens
gcaaggaagaatgag

SEQ ID NO: 454542 - DNA, 15 bp, Homo sapiens
caaggaagaatgaga

SEQ ID NO: 454543 - DNA, 15 bp, Homo sapiens
aaggaagaatgagat

SEQ ID NO: 454544 - DNA, 15 bp, Homo sapiens
aggaagaatgagatg

SEQ ID NO: 454545 - DNA, 15 bp, Homo sapiens
ggaagaatgagatga

SEQ ID NO: 454546 - DNA, 15 bp, Homo sapiens
gaagaatgagatgac

SEQ ID NO: 454547 - DNA, 15 bp, Homo sapiens
aagaatgagatgacc

SEQ ID NO: 454548 - DNA, 15 bp, Homo sapiens
agaatgagatgacct

SEQ ID NO: 454549 - DNA, 15 bp, Homo sapiens
gaatgagatgacctt

SEQ ID NO: 454550 - DNA, 15 bp, Homo sapiens
aatgagatgaccttg

SEQ ID NO: 454551 - DNA, 15 bp, Homo sapiens
atgagatgaccttga

SEQ ID NO: 454552 - DNA, 15 bp, Homo sapiens
tgagatgaccttgac

SEQ ID NO: 454553 - DNA, 15 bp, Homo sapiens
gagatgaccttgact

SEQ ID NO: 454554 - DNA, 15 bp, Homo sapiens
agatgaccttgactt

SEQ ID NO: 454555 - DNA, 15 bp, Homo sapiens
gatgaccttgacttt

SEQ ID NO: 454556 - DNA, 15 bp, Homo sapiens
atgaccttgactttt

SEQ ID NO: 454557 - DNA, 15 bp, Homo sapiens
tgaccttgacttttg

SEQ ID NO: 454558 - DNA, 15 bp, Homo sapiens
gaccttgacttttgc

SEQ ID NO: 454559 - DNA, 15 bp, Homo sapiens
accttgacttttgca

SEQ ID NO: 454560 - DNA, 15 bp, Homo sapiens
ccttgacttttgcat

SEQ ID NO: 454561 - DNA, 15 bp, Homo sapiens
cttgacttttgcata

SEQ ID NO: 454562 - DNA, 15 bp, Homo sapiens
ttgacttttgcataa

SEQ ID NO: 454563 - DNA, 15 bp, Homo sapiens
tgacttttgcataat

SEQ ID NO: 454564 - DNA, 15 bp, Homo sapiens
gacttttgcataatc

SEQ ID NO: 454565 - DNA, 15 bp, Homo sapiens
acttttgcataatcc

SEQ ID NO: 454566 - DNA, 15 bp, Homo sapiens
cttttgcataatcca

SEQ ID NO: 454567 - DNA, 15 bp, Homo sapiens
ttttgcataatccac

SEQ ID NO: 454568 - DNA, 15 bp, Homo sapiens
tttgcataatccaca

SEQ ID NO: 454569 - DNA, 15 bp, Homo sapiens
ttgcataatccacag

SEQ ID NO: 454570 - DNA, 15 bp, Homo sapiens
tgcataatccacaga

SEQ ID NO: 454571 - DNA, 15 bp, Homo sapiens
gcataatccacagag

SEQ ID NO: 454572 - DNA, 15 bp, Homo sapiens
cataatccacagagc

SEQ ID NO: 454573 - DNA, 15 bp, Homo sapiens
ataatccacagagcc

SEQ ID NO: 454574 - DNA, 15 bp, Homo sapiens
taatccacagagcct

SEQ ID NO: 454575 - DNA, 15 bp, Homo sapiens
aatccacagagcctc

SEQ ID NO: 454576 - DNA, 15 bp, Homo sapiens
atccacagagcctca

SEQ ID NO: 454577 - DNA, 15 bp, Homo sapiens
tccacagagcctcaa

SEQ ID NO: 454578 - DNA, 15 bp, Homo sapiens
ccacagagcctcaaa

SEQ ID NO: 454579 - DNA, 15 bp, Homo sapiens
cacagagcctcaaag

SEQ ID NO: 454580 - DNA, 15 bp, Homo sapiens
acagagcctcaaaga

SEQ ID NO: 454581 - DNA, 15 bp, Homo sapiens
cagagcctcaaagat

SEQ ID NO: 454582 - DNA, 15 bp, Homo sapiens
agagcctcaaagata

SEQ ID NO: 454583 - DNA, 15 bp, Homo sapiens
gagcctcaaagataa

SEQ ID NO: 454584 - DNA, 15 bp, Homo sapiens
agcctcaaagataat

SEQ ID NO: 454585 - DNA, 15 bp, Homo sapiens
gcctcaaagataatt

SEQ ID NO: 454586 - DNA, 15 bp, Homo sapiens
cctcaaagataatta

SEQ ID NO: 454587 - DNA, 15 bp, Homo sapiens
ctcaaagataattag

SEQ ID NO: 454588 - DNA, 15 bp, Homo sapiens
tcaaagataattagc

SEQ ID NO: 454589 - DNA, 15 bp, Homo sapiens
caaagataattagca

SEQ ID NO: 454590 - DNA, 15 bp, Homo sapiens
aaagataattagcag

SEQ ID NO: 454591 - DNA, 15 bp, Homo sapiens
aagataattagcagg

SEQ ID NO: 454592 - DNA, 15 bp, Homo sapiens
agataattagcaggt

SEQ ID NO: 454593 - DNA, 15 bp, Homo sapiens
gataattagcaggtg

SEQ ID NO: 454594 - DNA, 15 bp, Homo sapiens
ataattagcaggtgg

SEQ ID NO: 454595 - DNA, 15 bp, Homo sapiens
taattagcaggtggt

SEQ ID NO: 454596 - DNA, 15 bp, Homo sapiens
aattagcaggtggta

SEQ ID NO: 454597 - DNA, 15 bp, Homo sapiens
attagcaggtggtag

SEQ ID NO: 454598 - DNA, 15 bp, Homo sapiens
ttagcaggtggtagt

SEQ ID NO: 454599 - DNA, 15 bp, Homo sapiens
tagcaggtggtagta

SEQ ID NO: 454600 - DNA, 15 bp, Homo sapiens
agcaggtggtagtag

SEQ ID NO: 454601 - DNA, 15 bp, Homo sapiens
gcaggtggtagtagt

SEQ ID NO: 454602 - DNA, 15 bp, Homo sapiens
caggtggtagtagtt

SEQ ID NO: 454603 - DNA, 15 bp, Homo sapiens
aggtggtagtagttg

SEQ ID NO: 454604 - DNA, 15 bp, Homo sapiens
ggtggtagtagttgc

SEQ ID NO: 454605 - DNA, 15 bp, Homo sapiens
gtggtagtagttgca

SEQ ID NO: 454606 - DNA, 15 bp, Homo sapiens
tggtagtagttgcag

SEQ ID NO: 454607 - DNA, 15 bp, Homo sapiens
ggtagtagttgcagc

SEQ ID NO: 454608 - DNA, 15 bp, Homo sapiens
gtagtagttgcagca

SEQ ID NO: 454609 - DNA, 15 bp, Homo sapiens
tagtagttgcagcaa

SEQ ID NO: 454610 - DNA, 15 bp, Homo sapiens
agtagttgcagcaag

SEQ ID NO: 454611 - DNA, 15 bp, Homo sapiens
gtagttgcagcaagt

SEQ ID NO: 454612 - DNA, 15 bp, Homo sapiens
tagttgcagcaagtg

SEQ ID NO: 454613 - DNA, 15 bp, Homo sapiens
agttgcagcaagtgt

SEQ ID NO: 454614 - DNA, 15 bp, Homo sapiens
gttgcagcaagtgtt

SEQ ID NO: 454615 - DNA, 15 bp, Homo sapiens
ttgcagcaagtgttg

SEQ ID NO: 454616 - DNA, 15 bp, Homo sapiens
tgcagcaagtgttgc

SEQ ID NO: 454617 - DNA, 15 bp, Homo sapiens
gcagcaagtgttgca

SEQ ID NO: 454618 - DNA, 15 bp, Homo sapiens
cagcaagtgttgcag

SEQ ID NO: 454619 - DNA, 15 bp, Homo sapiens
agcaagtgttgcaga

SEQ ID NO: 454620 - DNA, 15 bp, Homo sapiens
gcaagtgttgcagaa

SEQ ID NO: 454621 - DNA, 15 bp, Homo sapiens
caagtgttgcagaat

SEQ ID NO: 454622 - DNA, 15 bp, Homo sapiens
aagtgttgcagaatt

SEQ ID NO: 454623 - DNA, 15 bp, Homo sapiens
agtgttgcagaatta

SEQ ID NO: 454624 - DNA, 15 bp, Homo sapiens
gtgttgcagaattac

SEQ ID NO: 454625 - DNA, 15 bp, Homo sapiens
tgttgcagaattacc

SEQ ID NO: 454626 - DNA, 15 bp, Homo sapiens
gttgcagaattaccc

SEQ ID NO: 454627 - DNA, 15 bp, Homo sapiens
ttgcagaattacccg

SEQ ID NO: 454628 - DNA, 15 bp, Homo sapiens
tgcagaattacccgg

SEQ ID NO: 454629 - DNA, 15 bp, Homo sapiens
gcagaattacccgga

SEQ ID NO: 454630 - DNA, 15 bp, Homo sapiens
cagaattacccggac

SEQ ID NO: 454631 - DNA, 15 bp, Homo sapiens
agaattacccggaca

SEQ ID NO: 454632 - DNA, 15 bp, Homo sapiens
gaattacccggacaa

SEQ ID NO: 454633 - DNA, 15 bp, Homo sapiens
aattacccggacaaa

SEQ ID NO: 454634 - DNA, 15 bp, Homo sapiens
attacccggacaaag

SEQ ID NO: 454635 - DNA, 15 bp, Homo sapiens
ttacccggacaaaga

SEQ ID NO: 454636 - DNA, 15 bp, Homo sapiens
tacccggacaaagaa

SEQ ID NO: 454637 - DNA, 15 bp, Homo sapiens
acccggacaaagaaa

SEQ ID NO: 454638 - DNA, 15 bp, Homo sapiens
cccggacaaagaaaa

SEQ ID NO: 454639 - DNA, 15 bp, Homo sapiens
ccggacaaagaaaag

SEQ ID NO: 454640 - DNA, 15 bp, Homo sapiens
cggacaaagaaaaga

SEQ ID NO: 454641 - DNA, 15 bp, Homo sapiens
ggacaaagaaaagaa

SEQ ID NO: 454642 - DNA, 15 bp, Homo sapiens
gacaaagaaaagaaa

SEQ ID NO: 454643 - DNA, 15 bp, Homo sapiens
acaaagaaaagaaag

SEQ ID NO: 454644 - DNA, 15 bp, Homo sapiens
caaagaaaagaaagc

SEQ ID NO: 454645 - DNA, 15 bp, Homo sapiens
aaagaaaagaaagcc

SEQ ID NO: 454646 - DNA, 15 bp, Homo sapiens
aagaaaagaaagcca

SEQ ID NO: 454647 - DNA, 15 bp, Homo sapiens
agaaaagaaagccac

SEQ ID NO: 454648 - DNA, 15 bp, Homo sapiens
gaaaagaaagccacc

SEQ ID NO: 454649 - DNA, 15 bp, Homo sapiens
aaaagaaagccacca

SEQ ID NO: 454650 - DNA, 15 bp, Homo sapiens
aaagaaagccaccac

SEQ ID NO: 454651 - DNA, 15 bp, Homo sapiens
aagaaagccaccacg

SEQ ID NO: 454652 - DNA, 15 bp, Homo sapiens
agaaagccaccacgc

SEQ ID NO: 454653 - DNA, 15 bp, Homo sapiens
gaaagccaccacgct

SEQ ID NO: 454654 - DNA, 15 bp, Homo sapiens
aaagccaccacgctc

SEQ ID NO: 454655 - DNA, 15 bp, Homo sapiens
aagccaccacgctct

SEQ ID NO: 454656 - DNA, 15 bp, Homo sapiens
agccaccacgctctg

SEQ ID NO: 454657 - DNA, 15 bp, Homo sapiens
gccaccacgctctgg

SEQ ID NO: 454658 - DNA, 15 bp, Homo sapiens
ccaccacgctctggc

SEQ ID NO: 454659 - DNA, 15 bp, Homo sapiens
caccacgctctggct

SEQ ID NO: 454660 - DNA, 15 bp, Homo sapiens
accacgctctggcta

SEQ ID NO: 454661 - DNA, 15 bp, Homo sapiens
ccacgctctggctac

SEQ ID NO: 454662 - DNA, 15 bp, Homo sapiens
cacgctctggctact

SEQ ID NO: 454663 - DNA, 15 bp, Homo sapiens
acgctctggctactg

SEQ ID NO: 454664 - DNA, 15 bp, Homo sapiens
cgctctggctactga

SEQ ID NO: 454665 - DNA, 15 bp, Homo sapiens
gctctggctactgat

SEQ ID NO: 454666 - DNA, 15 bp, Homo sapiens
ctctggctactgatc

SEQ ID NO: 454667 - DNA, 15 bp, Homo sapiens
tctggctactgatca

SEQ ID NO: 454668 - DNA, 15 bp, Homo sapiens
ctggctactgatcag

SEQ ID NO: 454669 - DNA, 15 bp, Homo sapiens
tggctactgatcagt

SEQ ID NO: 454670 - DNA, 15 bp, Homo sapiens
ggctactgatcagta

SEQ ID NO: 454671 - DNA, 15 bp, Homo sapiens
gctactgatcagtat

SEQ ID NO: 454672 - DNA, 15 bp, Homo sapiens
ctactgatcagtatg

SEQ ID NO: 454673 - DNA, 15 bp, Homo sapiens
tactgatcagtatgt

SEQ ID NO: 454674 - DNA, 15 bp, Homo sapiens
actgatcagtatgtt

SEQ ID NO: 454675 - DNA, 15 bp, Homo sapiens
ctgatcagtatgttg

SEQ ID NO: 454676 - DNA, 15 bp, Homo sapiens
tgatcagtatgttga

SEQ ID NO: 454677 - DNA, 15 bp, Homo sapiens
gatcagtatgttgag

SEQ ID NO: 454678 - DNA, 15 bp, Homo sapiens
atcagtatgttgagc

SEQ ID NO: 454679 - DNA, 15 bp, Homo sapiens
tcagtatgttgagcg

SEQ ID NO: 454680 - DNA, 15 bp, Homo sapiens
cagtatgttgagcga

SEQ ID NO: 454681 - DNA, 15 bp, Homo sapiens
agtatgttgagcgaa

SEQ ID NO: 454682 - DNA, 15 bp, Homo sapiens
gtatgttgagcgaaa

SEQ ID NO: 454683 - DNA, 15 bp, Homo sapiens
tatgttgagcgaaaa

SEQ ID NO: 454684 - DNA, 15 bp, Homo sapiens
atgttgagcgaaaag

SEQ ID NO: 454685 - DNA, 15 bp, Homo sapiens
tgttgagcgaaaaga

SEQ ID NO: 454686 - DNA, 15 bp, Homo sapiens
gttgagcgaaaagag

SEQ ID NO: 454687 - DNA, 15 bp, Homo sapiens
ttgagcgaaaagaga

SEQ ID NO: 454688 - DNA, 15 bp, Homo sapiens
tgagcgaaaagagaa

SEQ ID NO: 454689 - DNA, 15 bp, Homo sapiens
gagcgaaaagagaat

SEQ ID NO: 454690 - DNA, 15 bp, Homo sapiens
agcgaaaagagaata

SEQ ID NO: 454691 - DNA, 15 bp, Homo sapiens
gcgaaaagagaatag

SEQ ID NO: 454692 - DNA, 15 bp, Homo sapiens
cgaaaagagaatagg

SEQ ID NO: 454693 - DNA, 15 bp, Homo sapiens
gaaaagagaatagga

SEQ ID NO: 454694 - DNA, 15 bp, Homo sapiens
aaaagagaataggaa

SEQ ID NO: 454695 - DNA, 15 bp, Homo sapiens
aaagagaataggaag

SEQ ID NO: 454696 - DNA, 15 bp, Homo sapiens
aagagaataggaagt

SEQ ID NO: 454697 - DNA, 15 bp, Homo sapiens
agagaataggaagta

SEQ ID NO: 454698 - DNA, 15 bp, Homo sapiens
gagaataggaagtaa

SEQ ID NO: 454699 - DNA, 15 bp, Homo sapiens
agaataggaagtaaa

SEQ ID NO: 454700 - DNA, 15 bp, Homo sapiens
gaataggaagtaaat

SEQ ID NO: 454701 - DNA, 15 bp, Homo sapiens
aataggaagtaaatt

SEQ ID NO: 454702 - DNA, 15 bp, Homo sapiens
ataggaagtaaatta

SEQ ID NO: 454703 - DNA, 15 bp, Homo sapiens
taggaagtaaattac

SEQ ID NO: 454704 - DNA, 15 bp, Homo sapiens
aggaagtaaattacg

SEQ ID NO: 454705 - DNA, 15 bp, Homo sapiens
ggaagtaaattacga

SEQ ID NO: 454706 - DNA, 15 bp, Homo sapiens
gaagtaaattacgaa

SEQ ID NO: 454707 - DNA, 15 bp, Homo sapiens
aagtaaattacgaac

SEQ ID NO: 454708 - DNA, 15 bp, Homo sapiens
agtaaattacgaaca

SEQ ID NO: 454709 - DNA, 15 bp, Homo sapiens
gtaaattacgaacac

SEQ ID NO: 454710 - DNA, 15 bp, Homo sapiens
taaattacgaacaca

SEQ ID NO: 454711 - DNA, 15 bp, Homo sapiens
aaattacgaacacac

SEQ ID NO: 454712 - DNA, 15 bp, Homo sapiens
aattacgaacacaca

SEQ ID NO: 454713 - DNA, 15 bp, Homo sapiens
attacgaacacacaa

SEQ ID NO: 454714 - DNA, 15 bp, Homo sapiens
ttacgaacacacaaa

SEQ ID NO: 454715 - DNA, 15 bp, Homo sapiens
tacgaacacacaaaa

SEQ ID NO: 454716 - DNA, 15 bp, Homo sapiens
acgaacacacaaaag

SEQ ID NO: 454717 - DNA, 15 bp, Homo sapiens
cgaacacacaaaagg

SEQ ID NO: 454718 - DNA, 15 bp, Homo sapiens
gaacacacaaaaggg

SEQ ID NO: 454719 - DNA, 15 bp, Homo sapiens
aacacacaaaaggga

SEQ ID NO: 454720 - DNA, 15 bp, Homo sapiens
acacacaaaagggat

SEQ ID NO: 454721 - DNA, 15 bp, Homo sapiens
cacacaaaagggatg

SEQ ID NO: 454722 - DNA, 15 bp, Homo sapiens
acacaaaagggatgt

SEQ ID NO: 454723 - DNA, 15 bp, Homo sapiens
cacaaaagggatgtt

SEQ ID NO: 454724 - DNA, 15 bp, Homo sapiens
acaaaagggatgttt

SEQ ID NO: 454725 - DNA, 15 bp, Homo sapiens
caaaagggatgtttg

SEQ ID NO: 454726 - DNA, 15 bp, Homo sapiens
aaaagggatgtttgg

SEQ ID NO: 454727 - DNA, 15 bp, Homo sapiens
aaagggatgtttggt

SEQ ID NO: 454728 - DNA, 15 bp, Homo sapiens
aagggatgtttggtc

SEQ ID NO: 454729 - DNA, 15 bp, Homo sapiens
agggatgtttggtct

SEQ ID NO: 454730 - DNA, 15 bp, Homo sapiens
gggatgtttggtctg

SEQ ID NO: 454731 - DNA, 15 bp, Homo sapiens
ggatgtttggtctgc

SEQ ID NO: 454732 - DNA, 15 bp, Homo sapiens
gatgtttggtctgcg

SEQ ID NO: 454733 - DNA, 15 bp, Homo sapiens
atgtttggtctgcgc

SEQ ID NO: 454734 - DNA, 15 bp, Homo sapiens
tgtttggtctgcgca

SEQ ID NO: 454735 - DNA, 15 bp, Homo sapiens
gtttggtctgcgcag

SEQ ID NO: 454736 - DNA, 15 bp, Homo sapiens
tttggtctgcgcagg

SEQ ID NO: 454737 - DNA, 15 bp, Homo sapiens
ttggtctgcgcagga

SEQ ID NO: 454738 - DNA, 15 bp, Homo sapiens
tggtctgcgcaggag

SEQ ID NO: 454739 - DNA, 15 bp, Homo sapiens
ggtctgcgcaggagt

SEQ ID NO: 454740 - DNA, 15 bp, Homo sapiens
gtctgcgcaggagtc

SEQ ID NO: 454741 - DNA, 15 bp, Homo sapiens
tctgcgcaggagtcc

SEQ ID NO: 454742 - DNA, 15 bp, Homo sapiens
ctgcgcaggagtcca

SEQ ID NO: 454743 - DNA, 15 bp, Homo sapiens
tgcgcaggagtccat

SEQ ID NO: 454744 - DNA, 15 bp, Homo sapiens
gcgcaggagtccatg

SEQ ID NO: 454745 - DNA, 15 bp, Homo sapiens
cgcaggagtccatgg

SEQ ID NO: 454746 - DNA, 15 bp, Homo sapiens
gcaggagtccatggt

SEQ ID NO: 454747 - DNA, 15 bp, Homo sapiens
caggagtccatggtg

SEQ ID NO: 454748 - DNA, 15 bp, Homo sapiens
aggagtccatggtga

SEQ ID NO: 454749 - DNA, 15 bp, Homo sapiens
ggagtccatggtgac

SEQ ID NO: 454750 - DNA, 15 bp, Homo sapiens
gagtccatggtgaca

SEQ ID NO: 454751 - DNA, 15 bp, Homo sapiens
agtccatggtgacag

SEQ ID NO: 454752 - DNA, 15 bp, Homo sapiens
gtccatggtgacagc

SEQ ID NO: 454753 - DNA, 15 bp, Homo sapiens
tccatggtgacagca

SEQ ID NO: 454754 - DNA, 15 bp, Homo sapiens
ccatggtgacagcag

SEQ ID NO: 454755 - DNA, 15 bp, Homo sapiens
catggtgacagcagt

SEQ ID NO: 454756 - DNA, 15 bp, Homo sapiens
atggtgacagcagtt

SEQ ID NO: 454757 - DNA, 15 bp, Homo sapiens
tggtgacagcagttt

SEQ ID NO: 454758 - DNA, 15 bp, Homo sapiens
ggtgacagcagtttt

SEQ ID NO: 454759 - DNA, 15 bp, Homo sapiens
gtgacagcagttttg

SEQ ID NO: 454760 - DNA, 15 bp, Homo sapiens
tgacagcagttttga

SEQ ID NO: 454761 - DNA, 15 bp, Homo sapiens
gacagcagttttgaa

SEQ ID NO: 454762 - DNA, 15 bp, Homo sapiens
acagcagttttgaaa

SEQ ID NO: 454763 - DNA, 15 bp, Homo sapiens
cagcagttttgaaag

SEQ ID NO: 454764 - DNA, 15 bp, Homo sapiens
agcagttttgaaaga

SEQ ID NO: 454765 - DNA, 15 bp, Homo sapiens
gcagttttgaaagag

SEQ ID NO: 454766 - DNA, 15 bp, Homo sapiens
cagttttgaaagagg

SEQ ID NO: 454767 - DNA, 15 bp, Homo sapiens
agttttgaaagaggc

SEQ ID NO: 454768 - DNA, 15 bp, Homo sapiens
gttttgaaagaggct

SEQ ID NO: 454769 - DNA, 15 bp, Homo sapiens
ttttgaaagaggctc

SEQ ID NO: 454770 - DNA, 15 bp, Homo sapiens
tttgaaagaggctca

SEQ ID NO: 454771 - DNA, 15 bp, Homo sapiens
ttgaaagaggctcag

SEQ ID NO: 454772 - DNA, 15 bp, Homo sapiens
tgaaagaggctcagc

SEQ ID NO: 454773 - DNA, 15 bp, Homo sapiens
gaaagaggctcagct

SEQ ID NO: 454774 - DNA, 15 bp, Homo sapiens
aaagaggctcagctg

SEQ ID NO: 454775 - DNA, 15 bp, Homo sapiens
aagaggctcagctgc

SEQ ID NO: 454776 - DNA, 15 bp, Homo sapiens
agaggctcagctgca

SEQ ID NO: 454777 - DNA, 15 bp, Homo sapiens
gaggctcagctgcac

SEQ ID NO: 454778 - DNA, 15 bp, Homo sapiens
aggctcagctgcaca

SEQ ID NO: 454779 - DNA, 15 bp, Homo sapiens
ggctcagctgcacat

SEQ ID NO: 454780 - DNA, 15 bp, Homo sapiens
gctcagctgcacatc

SEQ ID NO: 454781 - DNA, 15 bp, Homo sapiens
ctcagctgcacatcc

SEQ ID NO: 454782 - DNA, 15 bp, Homo sapiens
tcagctgcacatcca

SEQ ID NO: 454783 - DNA, 15 bp, Homo sapiens
cagctgcacatccag

SEQ ID NO: 454784 - DNA, 15 bp, Homo sapiens
agctgcacatccagg

SEQ ID NO: 454785 - DNA, 15 bp, Homo sapiens
gctgcacatccagga

SEQ ID NO: 454786 - DNA, 15 bp, Homo sapiens
ctgcacatccaggat

SEQ ID NO: 454787 - DNA, 15 bp, Homo sapiens
tgcacatccaggatc

SEQ ID NO: 454788 - DNA, 15 bp, Homo sapiens
gcacatccaggatcc

SEQ ID NO: 454789 - DNA, 15 bp, Homo sapiens
cacatccaggatcca

SEQ ID NO: 454790 - DNA, 15 bp, Homo sapiens
acatccaggatccag

SEQ ID NO: 454791 - DNA, 15 bp, Homo sapiens
catccaggatccagt

SEQ ID NO: 454792 - DNA, 15 bp, Homo sapiens
atccaggatccagtt

SEQ ID NO: 454793 - DNA, 15 bp, Homo sapiens
tccaggatccagttg

SEQ ID NO: 454794 - DNA, 15 bp, Homo sapiens
ccaggatccagttga

SEQ ID NO: 454795 - DNA, 15 bp, Homo sapiens
caggatccagttgat

SEQ ID NO: 454796 - DNA, 15 bp, Homo sapiens
aggatccagttgatg

SEQ ID NO: 454797 - DNA, 15 bp, Homo sapiens
ggatccagttgatgg

SEQ ID NO: 454798 - DNA, 15 bp, Homo sapiens
gatccagttgatggg

SEQ ID NO: 454799 - DNA, 15 bp, Homo sapiens
atccagttgatgggt

SEQ ID NO: 454800 - DNA, 15 bp, Homo sapiens
tccagttgatgggtc

SEQ ID NO: 454801 - DNA, 15 bp, Homo sapiens
ccagttgatgggtct

SEQ ID NO: 454802 - DNA, 15 bp, Homo sapiens
cagttgatgggtctg

SEQ ID NO: 454803 - DNA, 15 bp, Homo sapiens
agttgatgggtctgg

SEQ ID NO: 454804 - DNA, 15 bp, Homo sapiens
gttgatgggtctgga

SEQ ID NO: 454805 - DNA, 15 bp, Homo sapiens
ttgatgggtctggaa

SEQ ID NO: 454806 - DNA, 15 bp, Homo sapiens
tgatgggtctggaag

SEQ ID NO: 454807 - DNA, 15 bp, Homo sapiens
gatgggtctggaagt

SEQ ID NO: 454808 - DNA, 15 bp, Homo sapiens
atgggtctggaagtt

SEQ ID NO: 454809 - DNA, 15 bp, Homo sapiens
tgggtctggaagttc

SEQ ID NO: 454810 - DNA, 15 bp, Homo sapiens
gggtctggaagttct

SEQ ID NO: 454811 - DNA, 15 bp, Homo sapiens
ggtctggaagttctt

SEQ ID NO: 454812 - DNA, 15 bp, Homo sapiens
gtctggaagttcttc

SEQ ID NO: 454813 - DNA, 15 bp, Homo sapiens
tctggaagttcttct

SEQ ID NO: 454814 - DNA, 15 bp, Homo sapiens
ctggaagttcttctc

SEQ ID NO: 454815 - DNA, 15 bp, Homo sapiens
tggaagttcttctca

SEQ ID NO: 454816 - DNA, 15 bp, Homo sapiens
ggaagttcttctcag

SEQ ID NO: 454817 - DNA, 15 bp, Homo sapiens
gaagttcttctcagg

SEQ ID NO: 454818 - DNA, 15 bp, Homo sapiens
aagttcttctcaggc

SEQ ID NO: 454819 - DNA, 15 bp, Homo sapiens
agttcttctcaggcc

SEQ ID NO: 454820 - DNA, 15 bp, Homo sapiens
gttcttctcaggcct

SEQ ID NO: 454821 - DNA, 15 bp, Homo sapiens
ttcttctcaggcctg

SEQ ID NO: 454822 - DNA, 15 bp, Homo sapiens
tcttctcaggcctga

SEQ ID NO: 454823 - DNA, 15 bp, Homo sapiens
cttctcaggcctgat

SEQ ID NO: 454824 - DNA, 15 bp, Homo sapiens
ttctcaggcctgatg

SEQ ID NO: 454825 - DNA, 15 bp, Homo sapiens
tctcaggcctgatga

SEQ ID NO: 454826 - DNA, 15 bp, Homo sapiens
ctcaggcctgatgag

SEQ ID NO: 454827 - DNA, 15 bp, Homo sapiens
tcaggcctgatgagc

SEQ ID NO: 454828 - DNA, 15 bp, Homo sapiens
caggcctgatgagct

SEQ ID NO: 454829 - DNA, 15 bp, Homo sapiens
aggcctgatgagcta

SEQ ID NO: 454830 - DNA, 15 bp, Homo sapiens
ggcctgatgagctat

SEQ ID NO: 454831 - DNA, 15 bp, Homo sapiens
gcctgatgagctata

SEQ ID NO: 454832 - DNA, 15 bp, Homo sapiens
cctgatgagctataa

SEQ ID NO: 454833 - DNA, 15 bp, Homo sapiens
ctgatgagctataaa

SEQ ID NO: 454834 - DNA, 15 bp, Homo sapiens
tgatgagctataaaa

SEQ ID NO: 454835 - DNA, 15 bp, Homo sapiens
gatgagctataaaat

SEQ ID NO: 454836 - DNA, 15 bp, Homo sapiens
atgagctataaaatg

SEQ ID NO: 454837 - DNA, 15 bp, Homo sapiens
tgagctataaaatga

SEQ ID NO: 454838 - DNA, 15 bp, Homo sapiens
gagctataaaatgag

SEQ ID NO: 454839 - DNA, 15 bp, Homo sapiens
agctataaaatgagg

SEQ ID NO: 454840 - DNA, 15 bp, Homo sapiens
gctataaaatgagga

SEQ ID NO: 454841 - DNA, 15 bp, Homo sapiens
ctataaaatgaggac

SEQ ID NO: 454842 - DNA, 15 bp, Homo sapiens
tataaaatgaggaca

SEQ ID NO: 454843 - DNA, 15 bp, Homo sapiens
aaatgaggacaaatg

SEQ ID NO: 454844 - DNA, 15 bp, Homo sapiens
aatgaggacaaatga

SEQ ID NO: 454845 - DNA, 15 bp, Homo sapiens
atgaggacaaatgac

SEQ ID NO: 454846 - DNA, 15 bp, Homo sapiens
tgaggacaaatgact

SEQ ID NO: 454847 - DNA, 15 bp, Homo sapiens
gaggacaaatgactc

SEQ ID NO: 454848 - DNA, 15 bp, Homo sapiens
aggacaaatgactca

SEQ ID NO: 454849 - DNA, 15 bp, Homo sapiens
ggacaaatgactcag

SEQ ID NO: 454850 - DNA, 15 bp, Homo sapiens
gacaaatgactcagc

SEQ ID NO: 454851 - DNA, 15 bp, Homo sapiens
acaaatgactcagcc

SEQ ID NO: 454852 - DNA, 15 bp, Homo sapiens
caaatgactcagcca

SEQ ID NO: 454853 - DNA, 15 bp, Homo sapiens
aaatgactcagccac

SEQ ID NO: 454854 - DNA, 15 bp, Homo sapiens
aatgactcagccaca

SEQ ID NO: 454855 - DNA, 15 bp, Homo sapiens
atgactcagccacaa

SEQ ID NO: 454856 - DNA, 15 bp, Homo sapiens
tgactcagccacaaa

SEQ ID NO: 454857 - DNA, 15 bp, Homo sapiens
gactcagccacaaaa

SEQ ID NO: 454858 - DNA, 15 bp, Homo sapiens
actcagccacaaaat

SEQ ID NO: 454859 - DNA, 15 bp, Homo sapiens
ctcagccacaaaatt

SEQ ID NO: 454860 - DNA, 15 bp, Homo sapiens
tcagccacaaaattt

SEQ ID NO: 454861 - DNA, 15 bp, Homo sapiens
cagccacaaaatttc

SEQ ID NO: 454862 - DNA, 15 bp, Homo sapiens
agccacaaaatttcc

SEQ ID NO: 454863 - DNA, 15 bp, Homo sapiens
gccacaaaatttcca

SEQ ID NO: 454864 - DNA, 15 bp, Homo sapiens
ccacaaaatttccat

SEQ ID NO: 454865 - DNA, 15 bp, Homo sapiens
cacaaaatttccatt

SEQ ID NO: 454866 - DNA, 15 bp, Homo sapiens
acaaaatttccattg

SEQ ID NO: 454867 - DNA, 15 bp, Homo sapiens
caaaatttccattga

SEQ ID NO: 454868 - DNA, 15 bp, Homo sapiens
aaaatttccattgac

SEQ ID NO: 454869 - DNA, 15 bp, Homo sapiens
aaatttccattgaca

SEQ ID NO: 454870 - DNA, 15 bp, Homo sapiens
aatttccattgacag

SEQ ID NO: 454871 - DNA, 15 bp, Homo sapiens
atttccattgacaga

SEQ ID NO: 454872 - DNA, 15 bp, Homo sapiens
tttccattgacagaa

SEQ ID NO: 454873 - DNA, 15 bp, Homo sapiens
ttccattgacagaag

SEQ ID NO: 454874 - DNA, 15 bp, Homo sapiens
tccattgacagaaga

SEQ ID NO: 454875 - DNA, 15 bp, Homo sapiens
ccattgacagaagac

SEQ ID NO: 454876 - DNA, 15 bp, Homo sapiens
cattgacagaagact

SEQ ID NO: 454877 - DNA, 15 bp, Homo sapiens
attgacagaagactg

SEQ ID NO: 454878 - DNA, 15 bp, Homo sapiens
ttgacagaagactgc

SEQ ID NO: 454879 - DNA, 15 bp, Homo sapiens
tgacagaagactgct

SEQ ID NO: 454880 - DNA, 15 bp, Homo sapiens
gacagaagactgctt

SEQ ID NO: 454881 - DNA, 15 bp, Homo sapiens
acagaagactgcttt

SEQ ID NO: 454882 - DNA, 15 bp, Homo sapiens
cagaagactgctttt

SEQ ID NO: 454883 - DNA, 15 bp, Homo sapiens
agaagactgcttttt

SEQ ID NO: 454884 - DNA, 15 bp, Homo sapiens
gaagactgctttttg

SEQ ID NO: 454885 - DNA, 15 bp, Homo sapiens
aagactgctttttgt

SEQ ID NO: 454886 - DNA, 15 bp, Homo sapiens
agactgctttttgtc

SEQ ID NO: 454887 - DNA, 15 bp, Homo sapiens
gactgctttttgtca

SEQ ID NO: 454888 - DNA, 15 bp, Homo sapiens
actgctttttgtcat

SEQ ID NO: 454889 - DNA, 15 bp, Homo sapiens
tgctttttgtcatta

SEQ ID NO: 454890 - DNA, 15 bp, Homo sapiens
gctttttgtcattat

SEQ ID NO: 454891 - DNA, 15 bp, Homo sapiens
ctttttgtcattatg

SEQ ID NO: 454892 - DNA, 15 bp, Homo sapiens
tttttgtcattatga

SEQ ID NO: 454893 - DNA, 15 bp, Homo sapiens
ttttgtcattatgaa

SEQ ID NO: 454894 - DNA, 15 bp, Homo sapiens
tttgtcattatgaac

SEQ ID NO: 454895 - DNA, 15 bp, Homo sapiens
ttgtcattatgaaca

SEQ ID NO: 454896 - DNA, 15 bp, Homo sapiens
tgtcattatgaacat

SEQ ID NO: 454897 - DNA, 15 bp, Homo sapiens
gtcattatgaacatg

SEQ ID NO: 454898 - DNA, 15 bp, Homo sapiens
tcattatgaacatgg

SEQ ID NO: 454899 - DNA, 15 bp, Homo sapiens
cattatgaacatggt

SEQ ID NO: 454900 - DNA, 15 bp, Homo sapiens
attatgaacatggtc

SEQ ID NO: 454901 - DNA, 15 bp, Homo sapiens
ttatgaacatggtcc

SEQ ID NO: 454902 - DNA, 15 bp, Homo sapiens
tatgaacatggtccc

SEQ ID NO: 454903 - DNA, 15 bp, Homo sapiens
atgaacatggtccca

SEQ ID NO: 454904 - DNA, 15 bp, Homo sapiens
tgaacatggtcccag

SEQ ID NO: 454905 - DNA, 15 bp, Homo sapiens
gaacatggtcccagt

SEQ ID NO: 454906 - DNA, 15 bp, Homo sapiens
aacatggtcccagtt

SEQ ID NO: 454907 - DNA, 15 bp, Homo sapiens
acatggtcccagttt

SEQ ID NO: 454908 - DNA, 15 bp, Homo sapiens
catggtcccagtttt

SEQ ID NO: 454909 - DNA, 15 bp, Homo sapiens
atggtcccagttttc

SEQ ID NO: 454910 - DNA, 15 bp, Homo sapiens
tggtcccagttttcg

SEQ ID NO: 454911 - DNA, 15 bp, Homo sapiens
ggtcccagttttcga

SEQ ID NO: 454912 - DNA, 15 bp, Homo sapiens
gtcccagttttcgac

SEQ ID NO: 454913 - DNA, 15 bp, Homo sapiens
tcccagttttcgaca

SEQ ID NO: 454914 - DNA, 15 bp, Homo sapiens
cccagttttcgacaa

SEQ ID NO: 454915 - DNA, 15 bp, Homo sapiens
ccagttttcgacaac

SEQ ID NO: 454916 - DNA, 15 bp, Homo sapiens
cagttttcgacaaca

SEQ ID NO: 454917 - DNA, 15 bp, Homo sapiens
agttttcgacaacac

SEQ ID NO: 454918 - DNA, 15 bp, Homo sapiens
gttttcgacaacact

SEQ ID NO: 454919 - DNA, 15 bp, Homo sapiens
ttttcgacaacactt

SEQ ID NO: 454920 - DNA, 15 bp, Homo sapiens
tttcgacaacactta

SEQ ID NO: 454921 - DNA, 15 bp, Homo sapiens
ttcgacaacacttat

SEQ ID NO: 454922 - DNA, 15 bp, Homo sapiens
tcgacaacacttatg

SEQ ID NO: 454923 - DNA, 15 bp, Homo sapiens
cgacaacacttatgg

SEQ ID NO: 454924 - DNA, 15 bp, Homo sapiens
gacaacacttatggg

SEQ ID NO: 454925 - DNA, 15 bp, Homo sapiens
acaacacttatgggt

SEQ ID NO: 454926 - DNA, 15 bp, Homo sapiens
caacacttatgggtg

SEQ ID NO: 454927 - DNA, 15 bp, Homo sapiens
aacacttatgggtgg

SEQ ID NO: 454928 - DNA, 15 bp, Homo sapiens
acacttatgggtgga

SEQ ID NO: 454929 - DNA, 15 bp, Homo sapiens
cacttatgggtggat

SEQ ID NO: 454930 - DNA, 15 bp, Homo sapiens
acttatgggtggata

SEQ ID NO: 454931 - DNA, 15 bp, Homo sapiens
cttatgggtggataa

SEQ ID NO: 454932 - DNA, 15 bp, Homo sapiens
ttatgggtggataag

SEQ ID NO: 454933 - DNA, 15 bp, Homo sapiens
tatgggtggataagc

SEQ ID NO: 454934 - DNA, 15 bp, Homo sapiens
atgggtggataagca

SEQ ID NO: 454935 - DNA, 15 bp, Homo sapiens
tgggtggataagcat

SEQ ID NO: 454936 - DNA, 15 bp, Homo sapiens
gggtggataagcata

SEQ ID NO: 454937 - DNA, 15 bp, Homo sapiens
ggtggataagcatat

SEQ ID NO: 454938 - DNA, 15 bp, Homo sapiens
gtggataagcatatt

SEQ ID NO: 454939 - DNA, 15 bp, Homo sapiens
tggataagcatatta

SEQ ID NO: 454940 - DNA, 15 bp, Homo sapiens
ggataagcatattaa

SEQ ID NO: 454941 - DNA, 15 bp, Homo sapiens
gataagcatattaac

SEQ ID NO: 454942 - DNA, 15 bp, Homo sapiens
ataagcatattaaca

SEQ ID NO: 454943 - DNA, 15 bp, Homo sapiens
taagcatattaacac

SEQ ID NO: 454944 - DNA, 15 bp, Homo sapiens
aagcatattaacaca

SEQ ID NO: 454945 - DNA, 15 bp, Homo sapiens
agcatattaacacat

SEQ ID NO: 454946 - DNA, 15 bp, Homo sapiens
gcatattaacacatt

SEQ ID NO: 454947 - DNA, 15 bp, Homo sapiens
catattaacacattt

SEQ ID NO: 454948 - DNA, 15 bp, Homo sapiens
atattaacacatttg

SEQ ID NO: 454949 - DNA, 15 bp, Homo sapiens
tattaacacatttgg

SEQ ID NO: 454950 - DNA, 15 bp, Homo sapiens
attaacacatttggt

SEQ ID NO: 454951 - DNA, 15 bp, Homo sapiens
ttaacacatttggtg

SEQ ID NO: 454952 - DNA, 15 bp, Homo sapiens
taacacatttggtgt

SEQ ID NO: 454953 - DNA, 15 bp, Homo sapiens
aacacatttggtgtt

SEQ ID NO: 454954 - DNA, 15 bp, Homo sapiens
acacatttggtgttt

SEQ ID NO: 454955 - DNA, 15 bp, Homo sapiens
cacatttggtgtttt

SEQ ID NO: 454956 - DNA, 15 bp, Homo sapiens
acatttggtgttttc

SEQ ID NO: 454957 - DNA, 15 bp, Homo sapiens
catttggtgttttct

SEQ ID NO: 454958 - DNA, 15 bp, Homo sapiens
atttggtgttttctt

SEQ ID NO: 454959 - DNA, 15 bp, Homo sapiens
tttggtgttttcttc

SEQ ID NO: 454960 - DNA, 15 bp, Homo sapiens
ttggtgttttcttct

SEQ ID NO: 454961 - DNA, 15 bp, Homo sapiens
tggtgttttcttctc

SEQ ID NO: 454962 - DNA, 15 bp, Homo sapiens
ggtgttttcttctct

SEQ ID NO: 454963 - DNA, 15 bp, Homo sapiens
gtgttttcttctctt

SEQ ID NO: 454964 - DNA, 15 bp, Homo sapiens
tgttttcttctcttg

SEQ ID NO: 454965 - DNA, 15 bp, Homo sapiens
gttttcttctcttgg

SEQ ID NO: 454966 - DNA, 15 bp, Homo sapiens
ttttcttctcttggt

SEQ ID NO: 454967 - DNA, 15 bp, Homo sapiens
tttcttctcttggtt

SEQ ID NO: 454968 - DNA, 15 bp, Homo sapiens
ttcttctcttggttc

SEQ ID NO: 454969 - DNA, 15 bp, Homo sapiens
tcttctcttggttct

SEQ ID NO: 454970 - DNA, 15 bp, Homo sapiens
cttctcttggttctt

SEQ ID NO: 454971 - DNA, 15 bp, Homo sapiens
ttctcttggttcttt

SEQ ID NO: 454972 - DNA, 15 bp, Homo sapiens
tctcttggttctttg

SEQ ID NO: 454973 - DNA, 15 bp, Homo sapiens
ctcttggttctttgg

SEQ ID NO: 454974 - DNA, 15 bp, Homo sapiens
tcttggttctttgga

SEQ ID NO: 454975 - DNA, 15 bp, Homo sapiens
cttggttctttggat

SEQ ID NO: 454976 - DNA, 15 bp, Homo sapiens
ttggttctttggatt

SEQ ID NO: 454977 - DNA, 15 bp, Homo sapiens
tggttctttggattc

SEQ ID NO: 454978 - DNA, 15 bp, Homo sapiens
ggttctttggattcc

SEQ ID NO: 454979 - DNA, 15 bp, Homo sapiens
gttctttggattcct

SEQ ID NO: 454980 - DNA, 15 bp, Homo sapiens
ttctttggattcctg

SEQ ID NO: 454981 - DNA, 15 bp, Homo sapiens
tctttggattcctga

SEQ ID NO: 454982 - DNA, 15 bp, Homo sapiens
ctttggattcctgaa

SEQ ID NO: 454983 - DNA, 15 bp, Homo sapiens
tttggattcctgaag

SEQ ID NO: 454984 - DNA, 15 bp, Homo sapiens
ttggattcctgaaga

SEQ ID NO: 454985 - DNA, 15 bp, Homo sapiens
tggattcctgaagaa

SEQ ID NO: 454986 - DNA, 15 bp, Homo sapiens
ggattcctgaagaaa

SEQ ID NO: 454987 - DNA, 15 bp, Homo sapiens
gattcctgaagaaaa

SEQ ID NO: 454988 - DNA, 15 bp, Homo sapiens
attcctgaagaaaaa

SEQ ID NO: 454989 - DNA, 15 bp, Homo sapiens
ttcctgaagaaaaaa

SEQ ID NO: 454990 - DNA, 15 bp, Homo sapiens
tcctgaagaaaaaaa

SEQ ID NO: 454991 - DNA, 15 bp, Homo sapiens
cctgaagaaaaaaac

SEQ ID NO: 454992 - DNA, 15 bp, Homo sapiens
ctgaagaaaaaaacc

SEQ ID NO: 454993 - DNA, 15 bp, Homo sapiens
tgaagaaaaaaaccc

SEQ ID NO: 454994 - DNA, 15 bp, Homo sapiens
gaagaaaaaaacccc

SEQ ID NO: 454995 - DNA, 15 bp, Homo sapiens
aagaaaaaaaccccc

SEQ ID NO: 454996 - DNA, 15 bp, Homo sapiens
agaaaaaaaccccct

SEQ ID NO: 454997 - DNA, 15 bp, Homo sapiens
gaaaaaaaccccctc

SEQ ID NO: 454998 - DNA, 15 bp, Homo sapiens
aaaaaaaccccctcc

SEQ ID NO: 454999 - DNA, 15 bp, Homo sapiens
aaaaaaccccctcct

SEQ ID NO: 455000 - DNA, 15 bp, Homo sapiens
aaaaaccccctcctc

SEQ ID NO: 455001 - DNA, 15 bp, Homo sapiens
aaaaccccctcctca

SEQ ID NO: 455002 - DNA, 15 bp, Homo sapiens
aaaccccctcctcag

SEQ ID NO: 455003 - DNA, 15 bp, Homo sapiens
aaccccctcctcagc

SEQ ID NO: 455004 - DNA, 15 bp, Homo sapiens
accccctcctcagct

SEQ ID NO: 455005 - DNA, 15 bp, Homo sapiens
ccccctcctcagctc

SEQ ID NO: 455006 - DNA, 15 bp, Homo sapiens
cccctcctcagctct

SEQ ID NO: 455007 - DNA, 15 bp, Homo sapiens
ccctcctcagctctt

SEQ ID NO: 455008 - DNA, 15 bp, Homo sapiens
cctcctcagctcttc

SEQ ID NO: 455009 - DNA, 15 bp, Homo sapiens
ctcctcagctcttcc

SEQ ID NO: 455010 - DNA, 15 bp, Homo sapiens
tcctcagctcttccc

SEQ ID NO: 455011 - DNA, 15 bp, Homo sapiens
cctcagctcttcccc

SEQ ID NO: 455012 - DNA, 15 bp, Homo sapiens
ctcagctcttcccct

SEQ ID NO: 455013 - DNA, 15 bp, Homo sapiens
tcagctcttcccctc

SEQ ID NO: 455014 - DNA, 15 bp, Homo sapiens
cagctcttcccctca

SEQ ID NO: 455015 - DNA, 15 bp, Homo sapiens
agctcttcccctcaa

SEQ ID NO: 455016 - DNA, 15 bp, Homo sapiens
gctcttcccctcaaa

SEQ ID NO: 455017 - DNA, 15 bp, Homo sapiens
ctcttcccctcaaac

SEQ ID NO: 455018 - DNA, 15 bp, Homo sapiens
tcttcccctcaaacc

SEQ ID NO: 455019 - DNA, 15 bp, Homo sapiens
cttcccctcaaacct

SEQ ID NO: 455020 - DNA, 15 bp, Homo sapiens
ttcccctcaaacctg

SEQ ID NO: 455021 - DNA, 15 bp, Homo sapiens
tcccctcaaacctga

SEQ ID NO: 455022 - DNA, 15 bp, Homo sapiens
cccctcaaacctgag

SEQ ID NO: 455023 - DNA, 15 bp, Homo sapiens
ccctcaaacctgaga

SEQ ID NO: 455024 - DNA, 15 bp, Homo sapiens
cctcaaacctgagag

SEQ ID NO: 455025 - DNA, 15 bp, Homo sapiens
ctcaaacctgagagg

SEQ ID NO: 455026 - DNA, 15 bp, Homo sapiens
tcaaacctgagagga

SEQ ID NO: 455027 - DNA, 15 bp, Homo sapiens
caaacctgagaggaa

SEQ ID NO: 455028 - DNA, 15 bp, Homo sapiens
aaacctgagaggaac

SEQ ID NO: 455029 - DNA, 15 bp, Homo sapiens
aacctgagaggaaca

SEQ ID NO: 455030 - DNA, 15 bp, Homo sapiens
acctgagaggaacag

SEQ ID NO: 455031 - DNA, 15 bp, Homo sapiens
cctgagaggaacaga

SEQ ID NO: 455032 - DNA, 15 bp, Homo sapiens
ctgagaggaacagaa

SEQ ID NO: 455033 - DNA, 15 bp, Homo sapiens
tgagaggaacagaag

SEQ ID NO: 455034 - DNA, 15 bp, Homo sapiens
gagaggaacagaagg

SEQ ID NO: 455035 - DNA, 15 bp, Homo sapiens
agaggaacagaaggg

SEQ ID NO: 455036 - DNA, 15 bp, Homo sapiens
gaggaacagaaggga

SEQ ID NO: 455037 - DNA, 15 bp, Homo sapiens
aggaacagaagggac

SEQ ID NO: 455038 - DNA, 15 bp, Homo sapiens
ggaacagaagggacg

SEQ ID NO: 455039 - DNA, 15 bp, Homo sapiens
gaacagaagggacgc

SEQ ID NO: 455040 - DNA, 15 bp, Homo sapiens
aacagaagggacgct

SEQ ID NO: 455041 - DNA, 15 bp, Homo sapiens
acagaagggacgctt

SEQ ID NO: 455042 - DNA, 15 bp, Homo sapiens
cagaagggacgcttc

SEQ ID NO: 455043 - DNA, 15 bp, Homo sapiens
agaagggacgcttct

SEQ ID NO: 455044 - DNA, 15 bp, Homo sapiens
gaagggacgcttctc

SEQ ID NO: 455045 - DNA, 15 bp, Homo sapiens
aagggacgcttctcc

SEQ ID NO: 455046 - DNA, 15 bp, Homo sapiens
agggacgcttctcca

SEQ ID NO: 455047 - DNA, 15 bp, Homo sapiens
gggacgcttctccaa

SEQ ID NO: 455048 - DNA, 15 bp, Homo sapiens
ggacgcttctccaac

SEQ ID NO: 455049 - DNA, 15 bp, Homo sapiens
gacgcttctccaact

SEQ ID NO: 455050 - DNA, 15 bp, Homo sapiens
acgcttctccaactt

SEQ ID NO: 455051 - DNA, 15 bp, Homo sapiens
cgcttctccaacttc

SEQ ID NO: 455052 - DNA, 15 bp, Homo sapiens
gcttctccaacttct

SEQ ID NO: 455053 - DNA, 15 bp, Homo sapiens
cttctccaacttcta

SEQ ID NO: 455054 - DNA, 15 bp, Homo sapiens
ttctccaacttctaa

SEQ ID NO: 455055 - DNA, 15 bp, Homo sapiens
tctccaacttctaaa

SEQ ID NO: 455056 - DNA, 15 bp, Homo sapiens
ctccaacttctaaac

SEQ ID NO: 455057 - DNA, 15 bp, Homo sapiens
tccaacttctaaact

SEQ ID NO: 455058 - DNA, 15 bp, Homo sapiens
ccaacttctaaacta

SEQ ID NO: 455059 - DNA, 15 bp, Homo sapiens
caacttctaaactaa

SEQ ID NO: 455060 - DNA, 15 bp, Homo sapiens
aacttctaaactaaa

SEQ ID NO: 455061 - DNA, 15 bp, Homo sapiens
acttctaaactaaac

SEQ ID NO: 455062 - DNA, 15 bp, Homo sapiens
cttctaaactaaacg

SEQ ID NO: 455063 - DNA, 15 bp, Homo sapiens
ttctaaactaaacga

SEQ ID NO: 455064 - DNA, 15 bp, Homo sapiens
tctaaactaaacgag

SEQ ID NO: 455065 - DNA, 15 bp, Homo sapiens
ctaaactaaacgaga

SEQ ID NO: 455066 - DNA, 15 bp, Homo sapiens
taaactaaacgagat

SEQ ID NO: 455067 - DNA, 15 bp, Homo sapiens
aaactaaacgagatt

SEQ ID NO: 455068 - DNA, 15 bp, Homo sapiens
aactaaacgagattg

SEQ ID NO: 455069 - DNA, 15 bp, Homo sapiens
actaaacgagattgg

SEQ ID NO: 455070 - DNA, 15 bp, Homo sapiens
ctaaacgagattggt

SEQ ID NO: 455071 - DNA, 15 bp, Homo sapiens
taaacgagattggta

SEQ ID NO: 455072 - DNA, 15 bp, Homo sapiens
aaacgagattggtaa

SEQ ID NO: 455073 - DNA, 15 bp, Homo sapiens
aacgagattggtaat

SEQ ID NO: 455074 - DNA, 15 bp, Homo sapiens
acgagattggtaatg

SEQ ID NO: 455075 - DNA, 15 bp, Homo sapiens
cgagattggtaatga

SEQ ID NO: 455076 - DNA, 15 bp, Homo sapiens
gagattggtaatgac

SEQ ID NO: 455077 - DNA, 15 bp, Homo sapiens
agattggtaatgaca

SEQ ID NO: 455078 - DNA, 15 bp, Homo sapiens
gattggtaatgacaa

SEQ ID NO: 455079 - DNA, 15 bp, Homo sapiens
attggtaatgacaat

SEQ ID NO: 455080 - DNA, 15 bp, Homo sapiens
ttggtaatgacaatt

SEQ ID NO: 455081 - DNA, 15 bp, Homo sapiens
tggtaatgacaatta

SEQ ID NO: 455082 - DNA, 15 bp, Homo sapiens
ggtaatgacaattaa

SEQ ID NO: 455083 - DNA, 15 bp, Homo sapiens
gtaatgacaattaaa

SEQ ID NO: 455084 - DNA, 15 bp, Homo sapiens
taatgacaattaaac

SEQ ID NO: 455085 - DNA, 15 bp, Homo sapiens
aatgacaattaaaca

SEQ ID NO: 455086 - DNA, 15 bp, Homo sapiens
atgacaattaaacaa

SEQ ID NO: 455087 - DNA, 15 bp, Homo sapiens
tgacaattaaacaac

SEQ ID NO: 455088 - DNA, 15 bp, Homo sapiens
gacaattaaacaact

SEQ ID NO: 455089 - DNA, 15 bp, Homo sapiens
acaattaaacaacta

SEQ ID NO: 455090 - DNA, 15 bp, Homo sapiens
caattaaacaactaa

SEQ ID NO: 455091 - DNA, 15 bp, Homo sapiens
aattaaacaactaaa

SEQ ID NO: 455092 - DNA, 15 bp, Homo sapiens
attaaacaactaaat

SEQ ID NO: 455093 - DNA, 15 bp, Homo sapiens
ttaaacaactaaatg

SEQ ID NO: 455094 - DNA, 15 bp, Homo sapiens
taaacaactaaatga

SEQ ID NO: 455095 - DNA, 15 bp, Homo sapiens
aaacaactaaatgac

SEQ ID NO: 455096 - DNA, 15 bp, Homo sapiens
aacaactaaatgaca

SEQ ID NO: 455097 - DNA, 15 bp, Homo sapiens
acaactaaatgacag

SEQ ID NO: 455098 - DNA, 15 bp, Homo sapiens
caactaaatgacagt

SEQ ID NO: 455099 - DNA, 15 bp, Homo sapiens
aactaaatgacagtt

SEQ ID NO: 455100 - DNA, 15 bp, Homo sapiens
actaaatgacagtta

SEQ ID NO: 455101 - DNA, 15 bp, Homo sapiens
ctaaatgacagttag

SEQ ID NO: 455102 - DNA, 15 bp, Homo sapiens
taaatgacagttaga

SEQ ID NO: 455103 - DNA, 15 bp, Homo sapiens
aaatgacagttagaa

SEQ ID NO: 455104 - DNA, 15 bp, Homo sapiens
aatgacagttagaaa

SEQ ID NO: 455105 - DNA, 15 bp, Homo sapiens
atgacagttagaaaa

SEQ ID NO: 455106 - DNA, 15 bp, Homo sapiens
tgacagttagaaaag

SEQ ID NO: 455107 - DNA, 15 bp, Homo sapiens
gacagttagaaaagg

SEQ ID NO: 455108 - DNA, 15 bp, Homo sapiens
acagttagaaaaggg

SEQ ID NO: 455109 - DNA, 15 bp, Homo sapiens
cagttagaaaagggc

SEQ ID NO: 455110 - DNA, 15 bp, Homo sapiens
agttagaaaagggct

SEQ ID NO: 455111 - DNA, 15 bp, Homo sapiens
gttagaaaagggcta

SEQ ID NO: 455112 - DNA, 15 bp, Homo sapiens
ttagaaaagggctag

SEQ ID NO: 455113 - DNA, 15 bp, Homo sapiens
tagaaaagggctaga

SEQ ID NO: 455114 - DNA, 15 bp, Homo sapiens
agaaaagggctagat

SEQ ID NO: 455115 - DNA, 15 bp, Homo sapiens
gaaaagggctagatt

SEQ ID NO: 455116 - DNA, 15 bp, Homo sapiens
aaaagggctagattg

SEQ ID NO: 455117 - DNA, 15 bp, Homo sapiens
aaagggctagattgt

SEQ ID NO: 455118 - DNA, 15 bp, Homo sapiens
aagggctagattgta

SEQ ID NO: 455119 - DNA, 15 bp, Homo sapiens
agggctagattgtat

SEQ ID NO: 455120 - DNA, 15 bp, Homo sapiens
gggctagattgtatt

SEQ ID NO: 455121 - DNA, 15 bp, Homo sapiens
ggctagattgtattg

SEQ ID NO: 455122 - DNA, 15 bp, Homo sapiens
gctagattgtattgg

SEQ ID NO: 455123 - DNA, 15 bp, Homo sapiens
ctagattgtattgga

SEQ ID NO: 455124 - DNA, 15 bp, Homo sapiens
tagattgtattggat

SEQ ID NO: 455125 - DNA, 15 bp, Homo sapiens
agattgtattggatt

SEQ ID NO: 455126 - DNA, 15 bp, Homo sapiens
gattgtattggattt

SEQ ID NO: 455127 - DNA, 15 bp, Homo sapiens
attgtattggatttc

SEQ ID NO: 455128 - DNA, 15 bp, Homo sapiens
ttgtattggatttca

SEQ ID NO: 455129 - DNA, 15 bp, Homo sapiens
tgtattggatttcaa

SEQ ID NO: 455130 - DNA, 15 bp, Homo sapiens
gtattggatttcaag

SEQ ID NO: 455131 - DNA, 15 bp, Homo sapiens
tattggatttcaagt

SEQ ID NO: 455132 - DNA, 15 bp, Homo sapiens
attggatttcaagta

SEQ ID NO: 455133 - DNA, 15 bp, Homo sapiens
ttggatttcaagtat

SEQ ID NO: 455134 - DNA, 15 bp, Homo sapiens
tggatttcaagtata

SEQ ID NO: 455135 - DNA, 15 bp, Homo sapiens
ggatttcaagtatat

SEQ ID NO: 455136 - DNA, 15 bp, Homo sapiens
gatttcaagtatatg

SEQ ID NO: 455137 - DNA, 15 bp, Homo sapiens
atttcaagtatatga

SEQ ID NO: 455138 - DNA, 15 bp, Homo sapiens
tttcaagtatatgag

SEQ ID NO: 455139 - DNA, 15 bp, Homo sapiens
ttcaagtatatgagg

SEQ ID NO: 455140 - DNA, 15 bp, Homo sapiens
tcaagtatatgaggt

SEQ ID NO: 455141 - DNA, 15 bp, Homo sapiens
caagtatatgaggtg

SEQ ID NO: 455142 - DNA, 15 bp, Homo sapiens
aagtatatgaggtgc

SEQ ID NO: 455143 - DNA, 15 bp, Homo sapiens
agtatatgaggtgct

SEQ ID NO: 455144 - DNA, 15 bp, Homo sapiens
gtatatgaggtgctt

SEQ ID NO: 455145 - DNA, 15 bp, Homo sapiens
tatatgaggtgcttt

SEQ ID NO: 455146 - DNA, 15 bp, Homo sapiens
atatgaggtgctttt

SEQ ID NO: 455147 - DNA, 15 bp, Homo sapiens
tatgaggtgcttttt

SEQ ID NO: 455148 - DNA, 15 bp, Homo sapiens
atgaggtgctttttt

SEQ ID NO: 455149 - DNA, 15 bp, Homo sapiens
tgaggtgcttttttc

SEQ ID NO: 455150 - DNA, 15 bp, Homo sapiens
gaggtgcttttttca

SEQ ID NO: 455151 - DNA, 15 bp, Homo sapiens
aggtgcttttttcag

SEQ ID NO: 455152 - DNA, 15 bp, Homo sapiens
ggtgcttttttcaga

SEQ ID NO: 455153 - DNA, 15 bp, Homo sapiens
gtgcttttttcagag

SEQ ID NO: 455154 - DNA, 15 bp, Homo sapiens
tgcttttttcagagc

SEQ ID NO: 455155 - DNA, 15 bp, Homo sapiens
gcttttttcagagcc

SEQ ID NO: 455156 - DNA, 15 bp, Homo sapiens
cttttttcagagcca

SEQ ID NO: 455157 - DNA, 15 bp, Homo sapiens
ttttttcagagccaa

SEQ ID NO: 455158 - DNA, 15 bp, Homo sapiens
tttttcagagccaac

SEQ ID NO: 455159 - DNA, 15 bp, Homo sapiens
ttttcagagccaact

SEQ ID NO: 455160 - DNA, 15 bp, Homo sapiens
tttcagagccaactg

SEQ ID NO: 455161 - DNA, 15 bp, Homo sapiens
ttcagagccaactga

SEQ ID NO: 455162 - DNA, 15 bp, Homo sapiens
tcagagccaactgac

SEQ ID NO: 455163 - DNA, 15 bp, Homo sapiens
cagagccaactgacc

SEQ ID NO: 455164 - DNA, 15 bp, Homo sapiens
agagccaactgacct

SEQ ID NO: 455165 - DNA, 15 bp, Homo sapiens
gagccaactgacctt

SEQ ID NO: 455166 - DNA, 15 bp, Homo sapiens
agccaactgaccttc

SEQ ID NO: 455167 - DNA, 15 bp, Homo sapiens
gccaactgaccttca

SEQ ID NO: 455168 - DNA, 15 bp, Homo sapiens
ccaactgaccttcac

SEQ ID NO: 455169 - DNA, 15 bp, Homo sapiens
caactgaccttcact

SEQ ID NO: 455170 - DNA, 15 bp, Homo sapiens
aactgaccttcactt

SEQ ID NO: 455171 - DNA, 15 bp, Homo sapiens
actgaccttcacttt

SEQ ID NO: 455172 - DNA, 15 bp, Homo sapiens
ctgaccttcactttt

SEQ ID NO: 455173 - DNA, 15 bp, Homo sapiens
tgaccttcacttttc

SEQ ID NO: 455174 - DNA, 15 bp, Homo sapiens
gaccttcacttttcc

SEQ ID NO: 455175 - DNA, 15 bp, Homo sapiens
accttcacttttcct

SEQ ID NO: 455176 - DNA, 15 bp, Homo sapiens
ccttcacttttccta

SEQ ID NO: 455177 - DNA, 15 bp, Homo sapiens
cttcacttttcctac

SEQ ID NO: 455178 - DNA, 15 bp, Homo sapiens
ttcacttttcctaca

SEQ ID NO: 455179 - DNA, 15 bp, Homo sapiens
tcacttttcctacag

SEQ ID NO: 455180 - DNA, 15 bp, Homo sapiens
cacttttcctacagc

SEQ ID NO: 455181 - DNA, 15 bp, Homo sapiens
acttttcctacagcc

SEQ ID NO: 455182 - DNA, 15 bp, Homo sapiens
cttttcctacagcct

SEQ ID NO: 455183 - DNA, 15 bp, Homo sapiens
ttttcctacagcctt

SEQ ID NO: 455184 - DNA, 15 bp, Homo sapiens
tttcctacagccttc

SEQ ID NO: 455185 - DNA, 15 bp, Homo sapiens
ttcctacagccttct

SEQ ID NO: 455186 - DNA, 15 bp, Homo sapiens
tcctacagccttctc

SEQ ID NO: 455187 - DNA, 15 bp, Homo sapiens
cctacagccttctcc

SEQ ID NO: 455188 - DNA, 15 bp, Homo sapiens
ctacagccttctccc

SEQ ID NO: 455189 - DNA, 15 bp, Homo sapiens
tacagccttctccca

SEQ ID NO: 455190 - DNA, 15 bp, Homo sapiens
acagccttctcccac

SEQ ID NO: 455191 - DNA, 15 bp, Homo sapiens
cagccttctcccact

SEQ ID NO: 455192 - DNA, 15 bp, Homo sapiens
agccttctcccactg

SEQ ID NO: 455193 - DNA, 15 bp, Homo sapiens
gccttctcccactgc

SEQ ID NO: 455194 - DNA, 15 bp, Homo sapiens
ccttctcccactgcc

SEQ ID NO: 455195 - DNA, 15 bp, Homo sapiens
cttctcccactgccc

SEQ ID NO: 455196 - DNA, 15 bp, Homo sapiens
ttctcccactgccct

SEQ ID NO: 455197 - DNA, 15 bp, Homo sapiens
tctcccactgccctc

SEQ ID NO: 455198 - DNA, 15 bp, Homo sapiens
ctcccactgccctcc

SEQ ID NO: 455199 - DNA, 15 bp, Homo sapiens
tcccactgccctcca

SEQ ID NO: 455200 - DNA, 15 bp, Homo sapiens
cccactgccctccag

SEQ ID NO: 455201 - DNA, 15 bp, Homo sapiens
actgccctccagcca

SEQ ID NO: 455202 - DNA, 15 bp, Homo sapiens
ctgccctccagccaa

SEQ ID NO: 455203 - DNA, 15 bp, Homo sapiens
tgccctccagccaag

SEQ ID NO: 455204 - DNA, 15 bp, Homo sapiens
gccctccagccaagg

SEQ ID NO: 455205 - DNA, 15 bp, Homo sapiens
ccctccagccaaggc

SEQ ID NO: 455206 - DNA, 15 bp, Homo sapiens
cctccagccaaggcc

SEQ ID NO: 455207 - DNA, 15 bp, Homo sapiens
ctccagccaaggcct

SEQ ID NO: 455208 - DNA, 15 bp, Homo sapiens
tccagccaaggcctc

SEQ ID NO: 455209 - DNA, 15 bp, Homo sapiens
ccagccaaggcctct

SEQ ID NO: 455210 - DNA, 15 bp, Homo sapiens
cagccaaggcctctg

SEQ ID NO: 455211 - DNA, 15 bp, Homo sapiens
agccaaggcctctgg

SEQ ID NO: 455212 - DNA, 15 bp, Homo sapiens
gccaaggcctctggg

SEQ ID NO: 455213 - DNA, 15 bp, Homo sapiens
ccaaggcctctgggc

SEQ ID NO: 455214 - DNA, 15 bp, Homo sapiens
caaggcctctgggcc

SEQ ID NO: 455215 - DNA, 15 bp, Homo sapiens
aaggcctctgggcca

SEQ ID NO: 455216 - DNA, 15 bp, Homo sapiens
aggcctctgggccac

SEQ ID NO: 455217 - DNA, 15 bp, Homo sapiens
ggcctctgggccact

SEQ ID NO: 455218 - DNA, 15 bp, Homo sapiens
gcctctgggccactc

SEQ ID NO: 455219 - DNA, 15 bp, Homo sapiens
cctctgggccactcc

SEQ ID NO: 455220 - DNA, 15 bp, Homo sapiens
ctctgggccactcct

SEQ ID NO: 455221 - DNA, 15 bp, Homo sapiens
tctgggccactcctg

SEQ ID NO: 455222 - DNA, 15 bp, Homo sapiens
ctgggccactcctgg

SEQ ID NO: 455223 - DNA, 15 bp, Homo sapiens
tgggccactcctgga

SEQ ID NO: 455224 - DNA, 15 bp, Homo sapiens
gggccactcctggag

SEQ ID NO: 455225 - DNA, 15 bp, Homo sapiens
ggccactcctggagc

SEQ ID NO: 455226 - DNA, 15 bp, Homo sapiens
gccactcctggagct

SEQ ID NO: 455227 - DNA, 15 bp, Homo sapiens
ccactcctggagctc

SEQ ID NO: 455228 - DNA, 15 bp, Homo sapiens
cactcctggagctca

SEQ ID NO: 455229 - DNA, 15 bp, Homo sapiens
actcctggagctcat

SEQ ID NO: 455230 - DNA, 15 bp, Homo sapiens
ctcctggagctcatc

SEQ ID NO: 455231 - DNA, 15 bp, Homo sapiens
tcctggagctcatca

SEQ ID NO: 455232 - DNA, 15 bp, Homo sapiens
cctggagctcatcag

SEQ ID NO: 455233 - DNA, 15 bp, Homo sapiens
ctggagctcatcagt

SEQ ID NO: 455234 - DNA, 15 bp, Homo sapiens
tggagctcatcagtt

SEQ ID NO: 455235 - DNA, 15 bp, Homo sapiens
ggagctcatcagttt

SEQ ID NO: 455236 - DNA, 15 bp, Homo sapiens
gagctcatcagttta

SEQ ID NO: 455237 - DNA, 15 bp, Homo sapiens
agctcatcagtttat

SEQ ID NO: 455238 - DNA, 15 bp, Homo sapiens
gctcatcagtttatt

SEQ ID NO: 455239 - DNA, 15 bp, Homo sapiens
ctcatcagtttatta

SEQ ID NO: 455240 - DNA, 15 bp, Homo sapiens
tcatcagtttattat

SEQ ID NO: 455241 - DNA, 15 bp, Homo sapiens
catcagtttattatt

SEQ ID NO: 455242 - DNA, 15 bp, Homo sapiens
atcagtttattatta

SEQ ID NO: 455243 - DNA, 15 bp, Homo sapiens
tcagtttattattaa

SEQ ID NO: 455244 - DNA, 15 bp, Homo sapiens
cagtttattattaat

SEQ ID NO: 455245 - DNA, 15 bp, Homo sapiens
agtttattattaatc

SEQ ID NO: 455246 - DNA, 15 bp, Homo sapiens
gtttattattaatct

SEQ ID NO: 455247 - DNA, 15 bp, Homo sapiens
tttattattaatctg

SEQ ID NO: 455248 - DNA, 15 bp, Homo sapiens
ttattattaatctgc

SEQ ID NO: 455249 - DNA, 15 bp, Homo sapiens
tattattaatctgct

SEQ ID NO: 455250 - DNA, 15 bp, Homo sapiens
attattaatctgctt

SEQ ID NO: 455251 - DNA, 15 bp, Homo sapiens
ttattaatctgcttc

SEQ ID NO: 455252 - DNA, 15 bp, Homo sapiens
tattaatctgcttct

SEQ ID NO: 455253 - DNA, 15 bp, Homo sapiens
attaatctgcttctt

SEQ ID NO: 455254 - DNA, 15 bp, Homo sapiens
ttaatctgcttcttc

SEQ ID NO: 455255 - DNA, 15 bp, Homo sapiens
taatctgcttcttcc

SEQ ID NO: 455256 - DNA, 15 bp, Homo sapiens
aatctgcttcttcct

SEQ ID NO: 455257 - DNA, 15 bp, Homo sapiens
atctgcttcttcctc

SEQ ID NO: 455258 - DNA, 15 bp, Homo sapiens
tctgcttcttcctct

SEQ ID NO: 455259 - DNA, 15 bp, Homo sapiens
ctgcttcttcctctc

SEQ ID NO: 455260 - DNA, 15 bp, Homo sapiens
tgcttcttcctctcc

SEQ ID NO: 455261 - DNA, 15 bp, Homo sapiens
gcttcttcctctccc

SEQ ID NO: 455262 - DNA, 15 bp, Homo sapiens
cttcttcctctccct

SEQ ID NO: 455263 - DNA, 15 bp, Homo sapiens
ttcttcctctccctt

SEQ ID NO: 455264 - DNA, 15 bp, Homo sapiens
tcttcctctcccttc

SEQ ID NO: 455265 - DNA, 15 bp, Homo sapiens
cttcctctcccttcc

SEQ ID NO: 455266 - DNA, 15 bp, Homo sapiens
ttcctctcccttcct

SEQ ID NO: 455267 - DNA, 15 bp, Homo sapiens
tcctctcccttcctt

SEQ ID NO: 455268 - DNA, 15 bp, Homo sapiens
cctctcccttccttt

SEQ ID NO: 455269 - DNA, 15 bp, Homo sapiens
ctctcccttcctttc

SEQ ID NO: 455270 - DNA, 15 bp, Homo sapiens
tctcccttcctttca

SEQ ID NO: 455271 - DNA, 15 bp, Homo sapiens
ctcccttcctttcag

SEQ ID NO: 455272 - DNA, 15 bp, Homo sapiens
tcccttcctttcagt

SEQ ID NO: 455273 - DNA, 15 bp, Homo sapiens
cccttcctttcagtt

SEQ ID NO: 455274 - DNA, 15 bp, Homo sapiens
ccttcctttcagttt

SEQ ID NO: 455275 - DNA, 15 bp, Homo sapiens
cttcctttcagttta

SEQ ID NO: 455276 - DNA, 15 bp, Homo sapiens
ttcctttcagtttac

SEQ ID NO: 455277 - DNA, 15 bp, Homo sapiens
tcctttcagtttact

SEQ ID NO: 455278 - DNA, 15 bp, Homo sapiens
cctttcagtttacta

SEQ ID NO: 455279 - DNA, 15 bp, Homo sapiens
ctttcagtttactag

SEQ ID NO: 455280 - DNA, 15 bp, Homo sapiens
tttcagtttactaga

SEQ ID NO: 455281 - DNA, 15 bp, Homo sapiens
ttcagtttactagaa

SEQ ID NO: 455282 - DNA, 15 bp, Homo sapiens
tcagtttactagaaa

SEQ ID NO: 455283 - DNA, 15 bp, Homo sapiens
cagtttactagaaat

SEQ ID NO: 455284 - DNA, 15 bp, Homo sapiens
agtttactagaaata

SEQ ID NO: 455285 - DNA, 15 bp, Homo sapiens
gtttactagaaatac

SEQ ID NO: 455286 - DNA, 15 bp, Homo sapiens
tttactagaaatacc

SEQ ID NO: 455287 - DNA, 15 bp, Homo sapiens
ttactagaaataccc

SEQ ID NO: 455288 - DNA, 15 bp, Homo sapiens
tactagaaataccct

SEQ ID NO: 455289 - DNA, 15 bp, Homo sapiens
actagaaataccctg

SEQ ID NO: 455290 - DNA, 15 bp, Homo sapiens
ctagaaataccctga

SEQ ID NO: 455291 - DNA, 15 bp, Homo sapiens
tagaaataccctgac

SEQ ID NO: 455292 - DNA, 15 bp, Homo sapiens
agaaataccctgacc

SEQ ID NO: 455293 - DNA, 15 bp, Homo sapiens
gaaataccctgaccc

SEQ ID NO: 455294 - DNA, 15 bp, Homo sapiens
aaataccctgaccct

SEQ ID NO: 455295 - DNA, 15 bp, Homo sapiens
aataccctgaccctt

SEQ ID NO: 455296 - DNA, 15 bp, Homo sapiens
ataccctgacccttt

SEQ ID NO: 455297 - DNA, 15 bp, Homo sapiens
taccctgaccctttc

SEQ ID NO: 455298 - DNA, 15 bp, Homo sapiens
accctgaccctttct

SEQ ID NO: 455299 - DNA, 15 bp, Homo sapiens
ccctgaccctttctc

SEQ ID NO: 455300 - DNA, 15 bp, Homo sapiens
cctgaccctttctct

SEQ ID NO: 455301 - DNA, 15 bp, Homo sapiens
ctgaccctttctctg

SEQ ID NO: 455302 - DNA, 15 bp, Homo sapiens
tgaccctttctctgc

SEQ ID NO: 455303 - DNA, 15 bp, Homo sapiens
gaccctttctctgca

SEQ ID NO: 455304 - DNA, 15 bp, Homo sapiens
accctttctctgcac

SEQ ID NO: 455305 - DNA, 15 bp, Homo sapiens
ccctttctctgcact

SEQ ID NO: 455306 - DNA, 15 bp, Homo sapiens
cctttctctgcactg

SEQ ID NO: 455307 - DNA, 15 bp, Homo sapiens
ctttctctgcactgg

SEQ ID NO: 455308 - DNA, 15 bp, Homo sapiens
tttctctgcactggc

SEQ ID NO: 455309 - DNA, 15 bp, Homo sapiens
ttctctgcactggct

SEQ ID NO: 455310 - DNA, 15 bp, Homo sapiens
tctctgcactggctt

SEQ ID NO: 455311 - DNA, 15 bp, Homo sapiens
ctctgcactggcttg

SEQ ID NO: 455312 - DNA, 15 bp, Homo sapiens
tctgcactggcttgt

SEQ ID NO: 455313 - DNA, 15 bp, Homo sapiens
ctgcactggcttgta

SEQ ID NO: 455314 - DNA, 15 bp, Homo sapiens
tgcactggcttgtaa

SEQ ID NO: 455315 - DNA, 15 bp, Homo sapiens
gcactggcttgtaac

SEQ ID NO: 455316 - DNA, 15 bp, Homo sapiens
cactggcttgtaacc

SEQ ID NO: 455317 - DNA, 15 bp, Homo sapiens
actggcttgtaaccc

SEQ ID NO: 455318 - DNA, 15 bp, Homo sapiens
ctggcttgtaaccct

SEQ ID NO: 455319 - DNA, 15 bp, Homo sapiens
tggcttgtaaccctt

SEQ ID NO: 455320 - DNA, 15 bp, Homo sapiens
ggcttgtaacccttt

SEQ ID NO: 455321 - DNA, 15 bp, Homo sapiens
gcttgtaaccctttt

SEQ ID NO: 455322 - DNA, 15 bp, Homo sapiens
cttgtaacccttttt

SEQ ID NO: 455323 - DNA, 15 bp, Homo sapiens
ttgtaaccctttttt

SEQ ID NO: 455324 - DNA, 15 bp, Homo sapiens
tgtaacccttttttc

SEQ ID NO: 455325 - DNA, 15 bp, Homo sapiens
gtaacccttttttcc

SEQ ID NO: 455326 - DNA, 15 bp, Homo sapiens
taacccttttttcct

SEQ ID NO: 455327 - DNA, 15 bp, Homo sapiens
aacccttttttcctc

SEQ ID NO: 455328 - DNA, 15 bp, Homo sapiens
acccttttttcctcc

SEQ ID NO: 455329 - DNA, 15 bp, Homo sapiens
cccttttttcctccc

SEQ ID NO: 455330 - DNA, 15 bp, Homo sapiens
ccttttttcctccca

SEQ ID NO: 455331 - DNA, 15 bp, Homo sapiens
cttttttcctcccaa

SEQ ID NO: 455332 - DNA, 15 bp, Homo sapiens
ttttttcctcccaaa

SEQ ID NO: 455333 - DNA, 15 bp, Homo sapiens
tttttcctcccaaat

SEQ ID NO: 455334 - DNA, 15 bp, Homo sapiens
ttttcctcccaaata

SEQ ID NO: 455335 - DNA, 15 bp, Homo sapiens
tttcctcccaaatac

SEQ ID NO: 455336 - DNA, 15 bp, Homo sapiens
ttcctcccaaatact

SEQ ID NO: 455337 - DNA, 15 bp, Homo sapiens
tcctcccaaatactg

SEQ ID NO: 455338 - DNA, 15 bp, Homo sapiens
cctcccaaatactgt

SEQ ID NO: 455339 - DNA, 15 bp, Homo sapiens
ctcccaaatactgtt

SEQ ID NO: 455340 - DNA, 15 bp, Homo sapiens
tcccaaatactgtta

SEQ ID NO: 455341 - DNA, 15 bp, Homo sapiens
cccaaatactgttaa

SEQ ID NO: 455342 - DNA, 15 bp, Homo sapiens
ccaaatactgttaaa

SEQ ID NO: 455343 - DNA, 15 bp, Homo sapiens
caaatactgttaaag

SEQ ID NO: 455344 - DNA, 15 bp, Homo sapiens
aaatactgttaaaga

SEQ ID NO: 455345 - DNA, 15 bp, Homo sapiens
aatactgttaaagat

SEQ ID NO: 455346 - DNA, 15 bp, Homo sapiens
atactgttaaagatt

SEQ ID NO: 455347 - DNA, 15 bp, Homo sapiens
tactgttaaagattt

SEQ ID NO: 455348 - DNA, 15 bp, Homo sapiens
actgttaaagattta

SEQ ID NO: 455349 - DNA, 15 bp, Homo sapiens
ctgttaaagatttac

SEQ ID NO: 455350 - DNA, 15 bp, Homo sapiens
tgttaaagatttacc

SEQ ID NO: 455351 - DNA, 15 bp, Homo sapiens
gttaaagatttacct

SEQ ID NO: 455352 - DNA, 15 bp, Homo sapiens
ttaaagatttacctc

SEQ ID NO: 455353 - DNA, 15 bp, Homo sapiens
taaagatttacctct

SEQ ID NO: 455354 - DNA, 15 bp, Homo sapiens
aaagatttacctctt

SEQ ID NO: 455355 - DNA, 15 bp, Homo sapiens
aagatttacctcttt

SEQ ID NO: 455356 - DNA, 15 bp, Homo sapiens
agatttacctctttt

SEQ ID NO: 455357 - DNA, 15 bp, Homo sapiens
gatttacctcttttg

SEQ ID NO: 455358 - DNA, 15 bp, Homo sapiens
atttacctcttttgg

SEQ ID NO: 455359 - DNA, 15 bp, Homo sapiens
tttacctcttttgga

SEQ ID NO: 455360 - DNA, 15 bp, Homo sapiens
ttacctcttttggaa

SEQ ID NO: 455361 - DNA, 15 bp, Homo sapiens
tacctcttttggaaa

SEQ ID NO: 455362 - DNA, 15 bp, Homo sapiens
acctcttttggaaac

SEQ ID NO: 455363 - DNA, 15 bp, Homo sapiens
cctcttttggaaaca

SEQ ID NO: 455364 - DNA, 15 bp, Homo sapiens
ctcttttggaaacat

SEQ ID NO: 455365 - DNA, 15 bp, Homo sapiens
tcttttggaaacatt

SEQ ID NO: 455366 - DNA, 15 bp, Homo sapiens
cttttggaaacattt

SEQ ID NO: 455367 - DNA, 15 bp, Homo sapiens
ttttggaaacattta

SEQ ID NO: 455368 - DNA, 15 bp, Homo sapiens
tttggaaacatttac

SEQ ID NO: 455369 - DNA, 15 bp, Homo sapiens
ttggaaacatttaca

SEQ ID NO: 455370 - DNA, 15 bp, Homo sapiens
tggaaacatttacaa

SEQ ID NO: 455371 - DNA, 15 bp, Homo sapiens
ggaaacatttacaag

SEQ ID NO: 455372 - DNA, 15 bp, Homo sapiens
gaaacatttacaagc

SEQ ID NO: 455373 - DNA, 15 bp, Homo sapiens
aaacatttacaagct

SEQ ID NO: 455374 - DNA, 15 bp, Homo sapiens
aacatttacaagcta

SEQ ID NO: 455375 - DNA, 15 bp, Homo sapiens
acatttacaagctaa

SEQ ID NO: 455376 - DNA, 15 bp, Homo sapiens
catttacaagctaat

SEQ ID NO: 455377 - DNA, 15 bp, Homo sapiens
atttacaagctaatc

SEQ ID NO: 455378 - DNA, 15 bp, Homo sapiens
tttacaagctaatcc

SEQ ID NO: 455379 - DNA, 15 bp, Homo sapiens
ttacaagctaatcct

SEQ ID NO: 455380 - DNA, 15 bp, Homo sapiens
tacaagctaatccta

SEQ ID NO: 455381 - DNA, 15 bp, Homo sapiens
acaagctaatcctac

SEQ ID NO: 455382 - DNA, 15 bp, Homo sapiens
caagctaatcctacc

SEQ ID NO: 455383 - DNA, 15 bp, Homo sapiens
aagctaatcctaccc

SEQ ID NO: 455384 - DNA, 15 bp, Homo sapiens
agctaatcctacccg

SEQ ID NO: 455385 - DNA, 15 bp, Homo sapiens
gctaatcctacccgt

SEQ ID NO: 455386 - DNA, 15 bp, Homo sapiens
ctaatcctacccgtc

SEQ ID NO: 455387 - DNA, 15 bp, Homo sapiens
taatcctacccgtct

SEQ ID NO: 455388 - DNA, 15 bp, Homo sapiens
aatcctacccgtctc

SEQ ID NO: 455389 - DNA, 15 bp, Homo sapiens
atcctacccgtctcc

SEQ ID NO: 455390 - DNA, 15 bp, Homo sapiens
tcctacccgtctcca

SEQ ID NO: 455391 - DNA, 15 bp, Homo sapiens
cctacccgtctccac

SEQ ID NO: 455392 - DNA, 15 bp, Homo sapiens
ctacccgtctccaca

SEQ ID NO: 455393 - DNA, 15 bp, Homo sapiens
tacccgtctccacat

SEQ ID NO: 455394 - DNA, 15 bp, Homo sapiens
acccgtctccacatt

SEQ ID NO: 455395 - DNA, 15 bp, Homo sapiens
cccgtctccacattt

SEQ ID NO: 455396 - DNA, 15 bp, Homo sapiens
ccgtctccacatttt

SEQ ID NO: 455397 - DNA, 15 bp, Homo sapiens
cgtctccacattttt

SEQ ID NO: 455398 - DNA, 15 bp, Homo sapiens
gtctccacatttttt

SEQ ID NO: 455399 - DNA, 15 bp, Homo sapiens
tctccacattttttc

SEQ ID NO: 455400 - DNA, 15 bp, Homo sapiens
ctccacattttttcc

SEQ ID NO: 455401 - DNA, 15 bp, Homo sapiens
tccacattttttccc

SEQ ID NO: 455402 - DNA, 15 bp, Homo sapiens
ccacattttttccca

SEQ ID NO: 455403 - DNA, 15 bp, Homo sapiens
cacattttttcccag

SEQ ID NO: 455404 - DNA, 15 bp, Homo sapiens
acattttttcccagt

SEQ ID NO: 455405 - DNA, 15 bp, Homo sapiens
cattttttcccagta

SEQ ID NO: 455406 - DNA, 15 bp, Homo sapiens
attttttcccagtag

SEQ ID NO: 455407 - DNA, 15 bp, Homo sapiens
ttttttcccagtagt

SEQ ID NO: 455408 - DNA, 15 bp, Homo sapiens
tttttcccagtagtt

SEQ ID NO: 455409 - DNA, 15 bp, Homo sapiens
ttttcccagtagttt

SEQ ID NO: 455410 - DNA, 15 bp, Homo sapiens
tttcccagtagttta

SEQ ID NO: 455411 - DNA, 15 bp, Homo sapiens
ttcccagtagtttat

SEQ ID NO: 455412 - DNA, 15 bp, Homo sapiens
tcccagtagtttatg

SEQ ID NO: 455413 - DNA, 15 bp, Homo sapiens
cccagtagtttatga

SEQ ID NO: 455414 - DNA, 15 bp, Homo sapiens
ccagtagtttatgat

SEQ ID NO: 455415 - DNA, 15 bp, Homo sapiens
cagtagtttatgatt

SEQ ID NO: 455416 - DNA, 15 bp, Homo sapiens
agtagtttatgattg

SEQ ID NO: 455417 - DNA, 15 bp, Homo sapiens
gtagtttatgattgc

SEQ ID NO: 455418 - DNA, 15 bp, Homo sapiens
tagtttatgattgcc

SEQ ID NO: 455419 - DNA, 15 bp, Homo sapiens
agtttatgattgcct

SEQ ID NO: 455420 - DNA, 15 bp, Homo sapiens
gtttatgattgcctg

SEQ ID NO: 455421 - DNA, 15 bp, Homo sapiens
tttatgattgcctgt

SEQ ID NO: 455422 - DNA, 15 bp, Homo sapiens
ttatgattgcctgta

SEQ ID NO: 455423 - DNA, 15 bp, Homo sapiens
tatgattgcctgtaa

SEQ ID NO: 455424 - DNA, 15 bp, Homo sapiens
atgattgcctgtaat

SEQ ID NO: 455425 - DNA, 15 bp, Homo sapiens
tgattgcctgtaata

SEQ ID NO: 455426 - DNA, 15 bp, Homo sapiens
gattgcctgtaatag

SEQ ID NO: 455427 - DNA, 15 bp, Homo sapiens
attgcctgtaatagc

SEQ ID NO: 455428 - DNA, 15 bp, Homo sapiens
ttgcctgtaatagca

SEQ ID NO: 455429 - DNA, 15 bp, Homo sapiens
tgcctgtaatagcag

SEQ ID NO: 455430 - DNA, 15 bp, Homo sapiens
gcctgtaatagcagg

SEQ ID NO: 455431 - DNA, 15 bp, Homo sapiens
cctgtaatagcaggt

SEQ ID NO: 455432 - DNA, 15 bp, Homo sapiens
ctgtaatagcaggtt

SEQ ID NO: 455433 - DNA, 15 bp, Homo sapiens
tgtaatagcaggttc

SEQ ID NO: 455434 - DNA, 15 bp, Homo sapiens
gtaatagcaggttct

SEQ ID NO: 455435 - DNA, 15 bp, Homo sapiens
taatagcaggttctc

SEQ ID NO: 455436 - DNA, 15 bp, Homo sapiens
aatagcaggttctct

SEQ ID NO: 455437 - DNA, 15 bp, Homo sapiens
atagcaggttctctc

SEQ ID NO: 455438 - DNA, 15 bp, Homo sapiens
tagcaggttctctca

SEQ ID NO: 455439 - DNA, 15 bp, Homo sapiens
agcaggttctctcac

SEQ ID NO: 455440 - DNA, 15 bp, Homo sapiens
gcaggttctctcacc

SEQ ID NO: 455441 - DNA, 15 bp, Homo sapiens
caggttctctcacct

SEQ ID NO: 455442 - DNA, 15 bp, Homo sapiens
aggttctctcacctt

SEQ ID NO: 455443 - DNA, 15 bp, Homo sapiens
ggttctctcacctta

SEQ ID NO: 455444 - DNA, 15 bp, Homo sapiens
gttctctcaccttag

SEQ ID NO: 455445 - DNA, 15 bp, Homo sapiens
ttctctcaccttagt

SEQ ID NO: 455446 - DNA, 15 bp, Homo sapiens
tctctcaccttagtg

SEQ ID NO: 455447 - DNA, 15 bp, Homo sapiens
ctctcaccttagtga

SEQ ID NO: 455448 - DNA, 15 bp, Homo sapiens
tctcaccttagtgac

SEQ ID NO: 455449 - DNA, 15 bp, Homo sapiens
ctcaccttagtgaca

SEQ ID NO: 455450 - DNA, 15 bp, Homo sapiens
tcaccttagtgacaa

SEQ ID NO: 455451 - DNA, 15 bp, Homo sapiens
caccttagtgacaag

SEQ ID NO: 455452 - DNA, 15 bp, Homo sapiens
accttagtgacaagt

SEQ ID NO: 455453 - DNA, 15 bp, Homo sapiens
ccttagtgacaagtg

SEQ ID NO: 455454 - DNA, 15 bp, Homo sapiens
cttagtgacaagtgc

SEQ ID NO: 455455 - DNA, 15 bp, Homo sapiens
ttagtgacaagtgct

SEQ ID NO: 455456 - DNA, 15 bp, Homo sapiens
tagtgacaagtgctt

SEQ ID NO: 455457 - DNA, 15 bp, Homo sapiens
agtgacaagtgcttg

SEQ ID NO: 455458 - DNA, 15 bp, Homo sapiens
gtgacaagtgcttgc

SEQ ID NO: 455459 - DNA, 15 bp, Homo sapiens
tgacaagtgcttgcc

SEQ ID NO: 455460 - DNA, 15 bp, Homo sapiens
gacaagtgcttgcct

SEQ ID NO: 455461 - DNA, 15 bp, Homo sapiens
acaagtgcttgcctt

SEQ ID NO: 455462 - DNA, 15 bp, Homo sapiens
caagtgcttgccttt

SEQ ID NO: 455463 - DNA, 15 bp, Homo sapiens
aagtgcttgcctttg

SEQ ID NO: 455464 - DNA, 15 bp, Homo sapiens
agtgcttgcctttgt

SEQ ID NO: 455465 - DNA, 15 bp, Homo sapiens
gtgcttgcctttgtg

SEQ ID NO: 455466 - DNA, 15 bp, Homo sapiens
tgcttgcctttgtgt

SEQ ID NO: 455467 - DNA, 15 bp, Homo sapiens
gcttgcctttgtgtg

SEQ ID NO: 455468 - DNA, 15 bp, Homo sapiens
cttgcctttgtgtgc

SEQ ID NO: 455469 - DNA, 15 bp, Homo sapiens
ttgcctttgtgtgct

SEQ ID NO: 455470 - DNA, 15 bp, Homo sapiens
tgcctttgtgtgctc

SEQ ID NO: 455471 - DNA, 15 bp, Homo sapiens
gcctttgtgtgctcg

SEQ ID NO: 455472 - DNA, 15 bp, Homo sapiens
cctttgtgtgctcga

SEQ ID NO: 455473 - DNA, 15 bp, Homo sapiens
ctttgtgtgctcgaa

SEQ ID NO: 455474 - DNA, 15 bp, Homo sapiens
tttgtgtgctcgaat

SEQ ID NO: 455475 - DNA, 15 bp, Homo sapiens
ttgtgtgctcgaata

SEQ ID NO: 455476 - DNA, 15 bp, Homo sapiens
tgtgtgctcgaataa

SEQ ID NO: 455477 - DNA, 15 bp, Homo sapiens
gtgtgctcgaataat

SEQ ID NO: 455478 - DNA, 15 bp, Homo sapiens
tgtgctcgaataatg

SEQ ID NO: 455479 - DNA, 15 bp, Homo sapiens
gtgctcgaataatgt

SEQ ID NO: 455480 - DNA, 15 bp, Homo sapiens
tgctcgaataatgtt

SEQ ID NO: 455481 - DNA, 15 bp, Homo sapiens
gctcgaataatgttt

SEQ ID NO: 455482 - DNA, 15 bp, Homo sapiens
ctcgaataatgtttg

SEQ ID NO: 455483 - DNA, 15 bp, Homo sapiens
tcgaataatgtttgg

SEQ ID NO: 455484 - DNA, 15 bp, Homo sapiens
cgaataatgtttggt

SEQ ID NO: 455485 - DNA, 15 bp, Homo sapiens
gaataatgtttggtg

SEQ ID NO: 455486 - DNA, 15 bp, Homo sapiens
aataatgtttggtgg

SEQ ID NO: 455487 - DNA, 15 bp, Homo sapiens
ataatgtttggtgga

SEQ ID NO: 455488 - DNA, 15 bp, Homo sapiens
taatgtttggtggat

SEQ ID NO: 455489 - DNA, 15 bp, Homo sapiens
aatgtttggtggatt

SEQ ID NO: 455490 - DNA, 15 bp, Homo sapiens
atgtttggtggattg

SEQ ID NO: 455491 - DNA, 15 bp, Homo sapiens
tgtttggtggattgc

SEQ ID NO: 455492 - DNA, 15 bp, Homo sapiens
gtttggtggattgcc

SEQ ID NO: 455493 - DNA, 15 bp, Homo sapiens
tttggtggattgccc

SEQ ID NO: 455494 - DNA, 15 bp, Homo sapiens
ttggtggattgcccc

SEQ ID NO: 455495 - DNA, 15 bp, Homo sapiens
tggtggattgcccca

SEQ ID NO: 455496 - DNA, 15 bp, Homo sapiens
ggtggattgccccat

SEQ ID NO: 455497 - DNA, 15 bp, Homo sapiens
gtggattgccccatc

SEQ ID NO: 455498 - DNA, 15 bp, Homo sapiens
tggattgccccatct

SEQ ID NO: 455499 - DNA, 15 bp, Homo sapiens
ggattgccccatctc

SEQ ID NO: 455500 - DNA, 15 bp, Homo sapiens
gattgccccatctcc

SEQ ID NO: 455501 - DNA, 15 bp, Homo sapiens
attgccccatctcca

SEQ ID NO: 455502 - DNA, 15 bp, Homo sapiens
ttgccccatctccac

SEQ ID NO: 455503 - DNA, 15 bp, Homo sapiens
tgccccatctccact

SEQ ID NO: 455504 - DNA, 15 bp, Homo sapiens
gccccatctccactg

SEQ ID NO: 455505 - DNA, 15 bp, Homo sapiens
ccccatctccactgt

SEQ ID NO: 455506 - DNA, 15 bp, Homo sapiens
cccatctccactgtg

SEQ ID NO: 455507 - DNA, 15 bp, Homo sapiens
ccatctccactgtga

SEQ ID NO: 455508 - DNA, 15 bp, Homo sapiens
catctccactgtgaa

SEQ ID NO: 455509 - DNA, 15 bp, Homo sapiens
atctccactgtgaac

SEQ ID NO: 455510 - DNA, 15 bp, Homo sapiens
tctccactgtgaact

SEQ ID NO: 455511 - DNA, 15 bp, Homo sapiens
ctccactgtgaacta

SEQ ID NO: 455512 - DNA, 15 bp, Homo sapiens
tccactgtgaactac

SEQ ID NO: 455513 - DNA, 15 bp, Homo sapiens
ccactgtgaactact

SEQ ID NO: 455514 - DNA, 15 bp, Homo sapiens
cactgtgaactactt

SEQ ID NO: 455515 - DNA, 15 bp, Homo sapiens
actgtgaactacttt

SEQ ID NO: 455516 - DNA, 15 bp, Homo sapiens
ctgtgaactacttta

SEQ ID NO: 455517 - DNA, 15 bp, Homo sapiens
tgtgaactactttag

SEQ ID NO: 455518 - DNA, 15 bp, Homo sapiens
gtgaactactttagg

SEQ ID NO: 455519 - DNA, 15 bp, Homo sapiens
tgaactactttaggt

SEQ ID NO: 455520 - DNA, 15 bp, Homo sapiens
gaactactttaggtc

SEQ ID NO: 455521 - DNA, 15 bp, Homo sapiens
aactactttaggtca

SEQ ID NO: 455522 - DNA, 15 bp, Homo sapiens
actactttaggtcat

SEQ ID NO: 455523 - DNA, 15 bp, Homo sapiens
ctactttaggtcatg

SEQ ID NO: 455524 - DNA, 15 bp, Homo sapiens
tactttaggtcatgg

SEQ ID NO: 455525 - DNA, 15 bp, Homo sapiens
actttaggtcatggc

SEQ ID NO: 455526 - DNA, 15 bp, Homo sapiens
ctttaggtcatggct

SEQ ID NO: 455527 - DNA, 15 bp, Homo sapiens
tttaggtcatggctg

SEQ ID NO: 455528 - DNA, 15 bp, Homo sapiens
ttaggtcatggctgt

SEQ ID NO: 455529 - DNA, 15 bp, Homo sapiens
taggtcatggctgtc

SEQ ID NO: 455530 - DNA, 15 bp, Homo sapiens
aggtcatggctgtct

SEQ ID NO: 455531 - DNA, 15 bp, Homo sapiens
ggtcatggctgtctc

SEQ ID NO: 455532 - DNA, 15 bp, Homo sapiens
gtcatggctgtctct

SEQ ID NO: 455533 - DNA, 15 bp, Homo sapiens
tcatggctgtctctc

SEQ ID NO: 455534 - DNA, 15 bp, Homo sapiens
catggctgtctctca

SEQ ID NO: 455535 - DNA, 15 bp, Homo sapiens
atggctgtctctcat

SEQ ID NO: 455536 - DNA, 15 bp, Homo sapiens
tggctgtctctcatt

SEQ ID NO: 455537 - DNA, 15 bp, Homo sapiens
ggctgtctctcatta

SEQ ID NO: 455538 - DNA, 15 bp, Homo sapiens
gctgtctctcattat

SEQ ID NO: 455539 - DNA, 15 bp, Homo sapiens
ctgtctctcattatg

SEQ ID NO: 455540 - DNA, 15 bp, Homo sapiens
tgtctctcattatgt

SEQ ID NO: 455541 - DNA, 15 bp, Homo sapiens
gtctctcattatgtg

SEQ ID NO: 455542 - DNA, 15 bp, Homo sapiens
tctctcattatgtgc

SEQ ID NO: 455543 - DNA, 15 bp, Homo sapiens
ctctcattatgtgca

SEQ ID NO: 455544 - DNA, 15 bp, Homo sapiens
tctcattatgtgcaa

SEQ ID NO: 455545 - DNA, 15 bp, Homo sapiens
ctcattatgtgcaaa

SEQ ID NO: 455546 - DNA, 15 bp, Homo sapiens
tcattatgtgcaaat

SEQ ID NO: 455547 - DNA, 15 bp, Homo sapiens
cattatgtgcaaatc

SEQ ID NO: 455548 - DNA, 15 bp, Homo sapiens
attatgtgcaaatct

SEQ ID NO: 455549 - DNA, 15 bp, Homo sapiens
ttatgtgcaaatctc

SEQ ID NO: 455550 - DNA, 15 bp, Homo sapiens
tatgtgcaaatctcc

SEQ ID NO: 455551 - DNA, 15 bp, Homo sapiens
atgtgcaaatctcca

SEQ ID NO: 455552 - DNA, 15 bp, Homo sapiens
tgtgcaaatctccac

SEQ ID NO: 455553 - DNA, 15 bp, Homo sapiens
gtgcaaatctccacc

SEQ ID NO: 455554 - DNA, 15 bp, Homo sapiens
tgcaaatctccaccc

SEQ ID NO: 455555 - DNA, 15 bp, Homo sapiens
gcaaatctccaccca

SEQ ID NO: 455556 - DNA, 15 bp, Homo sapiens
caaatctccacccag

SEQ ID NO: 455557 - DNA, 15 bp, Homo sapiens
aaatctccacccagc

SEQ ID NO: 455558 - DNA, 15 bp, Homo sapiens
aatctccacccagca

SEQ ID NO: 455559 - DNA, 15 bp, Homo sapiens
atctccacccagcat

SEQ ID NO: 455560 - DNA, 15 bp, Homo sapiens
tctccacccagcata

SEQ ID NO: 455561 - DNA, 15 bp, Homo sapiens
ctccacccagcataa

SEQ ID NO: 455562 - DNA, 15 bp, Homo sapiens
tccacccagcataag

SEQ ID NO: 455563 - DNA, 15 bp, Homo sapiens
ccacccagcataagg

SEQ ID NO: 455564 - DNA, 15 bp, Homo sapiens
cacccagcataaggc

SEQ ID NO: 455565 - DNA, 15 bp, Homo sapiens
acccagcataaggca

SEQ ID NO: 455566 - DNA, 15 bp, Homo sapiens
cccagcataaggcag

SEQ ID NO: 455567 - DNA, 15 bp, Homo sapiens
ccagcataaggcaga

SEQ ID NO: 455568 - DNA, 15 bp, Homo sapiens
cagcataaggcagag

SEQ ID NO: 455569 - DNA, 15 bp, Homo sapiens
agcataaggcagagg

SEQ ID NO: 455570 - DNA, 15 bp, Homo sapiens
gcataaggcagaggg

SEQ ID NO: 455571 - DNA, 15 bp, Homo sapiens
cataaggcagagggc

SEQ ID NO: 455572 - DNA, 15 bp, Homo sapiens
ataaggcagagggca

SEQ ID NO: 455573 - DNA, 15 bp, Homo sapiens
taaggcagagggcag

SEQ ID NO: 455574 - DNA, 15 bp, Homo sapiens
aaggcagagggcagt

SEQ ID NO: 455575 - DNA, 15 bp, Homo sapiens
aggcagagggcagtg

SEQ ID NO: 455576 - DNA, 15 bp, Homo sapiens
ggcagagggcagtgt

SEQ ID NO: 455577 - DNA, 15 bp, Homo sapiens
gcagagggcagtgtc

SEQ ID NO: 455578 - DNA, 15 bp, Homo sapiens
cagagggcagtgtca

SEQ ID NO: 455579 - DNA, 15 bp, Homo sapiens
agagggcagtgtcat

SEQ ID NO: 455580 - DNA, 15 bp, Homo sapiens
gagggcagtgtcatt

SEQ ID NO: 455581 - DNA, 15 bp, Homo sapiens
agggcagtgtcattg

SEQ ID NO: 455582 - DNA, 15 bp, Homo sapiens
gggcagtgtcattgt

SEQ ID NO: 455583 - DNA, 15 bp, Homo sapiens
ggcagtgtcattgtt

SEQ ID NO: 455584 - DNA, 15 bp, Homo sapiens
gcagtgtcattgttc

SEQ ID NO: 455585 - DNA, 15 bp, Homo sapiens
cagtgtcattgttca

SEQ ID NO: 455586 - DNA, 15 bp, Homo sapiens
agtgtcattgttcat

SEQ ID NO: 455587 - DNA, 15 bp, Homo sapiens
gtgtcattgttcatt

SEQ ID NO: 455588 - DNA, 15 bp, Homo sapiens
tgtcattgttcattc

SEQ ID NO: 455589 - DNA, 15 bp, Homo sapiens
gtcattgttcattca

SEQ ID NO: 455590 - DNA, 15 bp, Homo sapiens
tcattgttcattcat

SEQ ID NO: 455591 - DNA, 15 bp, Homo sapiens
cattgttcattcatt

SEQ ID NO: 455592 - DNA, 15 bp, Homo sapiens
attgttcattcattt

SEQ ID NO: 455593 - DNA, 15 bp, Homo sapiens
ttgttcattcatttg

SEQ ID NO: 455594 - DNA, 15 bp, Homo sapiens
tgttcattcatttgt

SEQ ID NO: 455595 - DNA, 15 bp, Homo sapiens
gttcattcatttgtt

SEQ ID NO: 455596 - DNA, 15 bp, Homo sapiens
ttcattcatttgttg

SEQ ID NO: 455597 - DNA, 15 bp, Homo sapiens
tcattcatttgttgg

SEQ ID NO: 455598 - DNA, 15 bp, Homo sapiens
cattcatttgttggg

SEQ ID NO: 455599 - DNA, 15 bp, Homo sapiens
attcatttgttgggc

SEQ ID NO: 455600 - DNA, 15 bp, Homo sapiens
ttcatttgttgggct

SEQ ID NO: 455601 - DNA, 15 bp, Homo sapiens
tcatttgttgggctc

SEQ ID NO: 455602 - DNA, 15 bp, Homo sapiens
catttgttgggctcc

SEQ ID NO: 455603 - DNA, 15 bp, Homo sapiens
atttgttgggctcca

SEQ ID NO: 455604 - DNA, 15 bp, Homo sapiens
tttgttgggctccaa

SEQ ID NO: 455605 - DNA, 15 bp, Homo sapiens
ttgttgggctccaag

SEQ ID NO: 455606 - DNA, 15 bp, Homo sapiens
tgttgggctccaaga

SEQ ID NO: 455607 - DNA, 15 bp, Homo sapiens
gttgggctccaagat

SEQ ID NO: 455608 - DNA, 15 bp, Homo sapiens
ttgggctccaagatt

SEQ ID NO: 455609 - DNA, 15 bp, Homo sapiens
tgggctccaagattg

SEQ ID NO: 455610 - DNA, 15 bp, Homo sapiens
gggctccaagattgt

SEQ ID NO: 455611 - DNA, 15 bp, Homo sapiens
ggctccaagattgtg

SEQ ID NO: 455612 - DNA, 15 bp, Homo sapiens
gctccaagattgtgc

SEQ ID NO: 455613 - DNA, 15 bp, Homo sapiens
ctccaagattgtgca

SEQ ID NO: 455614 - DNA, 15 bp, Homo sapiens
tccaagattgtgcag

SEQ ID NO: 455615 - DNA, 15 bp, Homo sapiens
ccaagattgtgcagg

SEQ ID NO: 455616 - DNA, 15 bp, Homo sapiens
caagattgtgcagga

SEQ ID NO: 455617 - DNA, 15 bp, Homo sapiens
aagattgtgcaggag

SEQ ID NO: 455618 - DNA, 15 bp, Homo sapiens
agattgtgcaggaga

SEQ ID NO: 455619 - DNA, 15 bp, Homo sapiens
gattgtgcaggagat

SEQ ID NO: 455620 - DNA, 15 bp, Homo sapiens
attgtgcaggagata

SEQ ID NO: 455621 - DNA, 15 bp, Homo sapiens
ttgtgcaggagataa

SEQ ID NO: 455622 - DNA, 15 bp, Homo sapiens
tgtgcaggagataaa

SEQ ID NO: 455623 - DNA, 15 bp, Homo sapiens
gtgcaggagataaaa

SEQ ID NO: 455624 - DNA, 15 bp, Homo sapiens
tgcaggagataaaac

SEQ ID NO: 455625 - DNA, 15 bp, Homo sapiens
gcaggagataaaaca

SEQ ID NO: 455626 - DNA, 15 bp, Homo sapiens
caggagataaaacac

SEQ ID NO: 455627 - DNA, 15 bp, Homo sapiens
aggagataaaacact

SEQ ID NO: 455628 - DNA, 15 bp, Homo sapiens
ggagataaaacacta

SEQ ID NO: 455629 - DNA, 15 bp, Homo sapiens
gagataaaacactat

SEQ ID NO: 455630 - DNA, 15 bp, Homo sapiens
agataaaacactata

SEQ ID NO: 455631 - DNA, 15 bp, Homo sapiens
gataaaacactataa

SEQ ID NO: 455632 - DNA, 15 bp, Homo sapiens
ataaaacactataaa

SEQ ID NO: 455633 - DNA, 15 bp, Homo sapiens
taaaacactataaag

SEQ ID NO: 455634 - DNA, 15 bp, Homo sapiens
aaaacactataaaga

SEQ ID NO: 455635 - DNA, 15 bp, Homo sapiens
aaacactataaagag

SEQ ID NO: 455636 - DNA, 15 bp, Homo sapiens
aacactataaagaga

SEQ ID NO: 455637 - DNA, 15 bp, Homo sapiens
acactataaagagac

SEQ ID NO: 455638 - DNA, 15 bp, Homo sapiens
cactataaagagact

SEQ ID NO: 455639 - DNA, 15 bp, Homo sapiens
actataaagagactt

SEQ ID NO: 455640 - DNA, 15 bp, Homo sapiens
ctataaagagacttg

SEQ ID NO: 455641 - DNA, 15 bp, Homo sapiens
tataaagagacttga

SEQ ID NO: 455642 - DNA, 15 bp, Homo sapiens
ataaagagacttgat

SEQ ID NO: 455643 - DNA, 15 bp, Homo sapiens
taaagagacttgatt

SEQ ID NO: 455644 - DNA, 15 bp, Homo sapiens
aaagagacttgattc

SEQ ID NO: 455645 - DNA, 15 bp, Homo sapiens
aagagacttgattct

SEQ ID NO: 455646 - DNA, 15 bp, Homo sapiens
agagacttgattctc

SEQ ID NO: 455647 - DNA, 15 bp, Homo sapiens
gagacttgattctca

SEQ ID NO: 455648 - DNA, 15 bp, Homo sapiens
agacttgattctcac

SEQ ID NO: 455649 - DNA, 15 bp, Homo sapiens
gacttgattctcaca

SEQ ID NO: 455650 - DNA, 15 bp, Homo sapiens
acttgattctcacac

SEQ ID NO: 455651 - DNA, 15 bp, Homo sapiens
cttgattctcacact

SEQ ID NO: 455652 - DNA, 15 bp, Homo sapiens
ttgattctcacactg

SEQ ID NO: 455653 - DNA, 15 bp, Homo sapiens
tgattctcacactga

SEQ ID NO: 455654 - DNA, 15 bp, Homo sapiens
gattctcacactgaa

SEQ ID NO: 455655 - DNA, 15 bp, Homo sapiens
attctcacactgaag

SEQ ID NO: 455656 - DNA, 15 bp, Homo sapiens
ttctcacactgaagg

SEQ ID NO: 455657 - DNA, 15 bp, Homo sapiens
tctcacactgaagga

SEQ ID NO: 455658 - DNA, 15 bp, Homo sapiens
ctcacactgaaggaa

SEQ ID NO: 455659 - DNA, 15 bp, Homo sapiens
tcacactgaaggaac

SEQ ID NO: 455660 - DNA, 15 bp, Homo sapiens
cacactgaaggaact

SEQ ID NO: 455661 - DNA, 15 bp, Homo sapiens
acactgaaggaactc

SEQ ID NO: 455662 - DNA, 15 bp, Homo sapiens
cactgaaggaactca

SEQ ID NO: 455663 - DNA, 15 bp, Homo sapiens
actgaaggaactcat

SEQ ID NO: 455664 - DNA, 15 bp, Homo sapiens
ctgaaggaactcata

SEQ ID NO: 455665 - DNA, 15 bp, Homo sapiens
tgaaggaactcatat

SEQ ID NO: 455666 - DNA, 15 bp, Homo sapiens
gaaggaactcatatt

SEQ ID NO: 455667 - DNA, 15 bp, Homo sapiens
aaggaactcatattt

SEQ ID NO: 455668 - DNA, 15 bp, Homo sapiens
aggaactcatatttc

SEQ ID NO: 455669 - DNA, 15 bp, Homo sapiens
ggaactcatatttcg

SEQ ID NO: 455670 - DNA, 15 bp, Homo sapiens
gaactcatatttcga

SEQ ID NO: 455671 - DNA, 15 bp, Homo sapiens
aactcatatttcgag

SEQ ID NO: 455672 - DNA, 15 bp, Homo sapiens
actcatatttcgaga

SEQ ID NO: 455673 - DNA, 15 bp, Homo sapiens
ctcatatttcgagaa

SEQ ID NO: 455674 - DNA, 15 bp, Homo sapiens
tcatatttcgagaac

SEQ ID NO: 455675 - DNA, 15 bp, Homo sapiens
catatttcgagaacg

SEQ ID NO: 455676 - DNA, 15 bp, Homo sapiens
atatttcgagaacgt

SEQ ID NO: 455677 - DNA, 15 bp, Homo sapiens
tatttcgagaacgtt

SEQ ID NO: 455678 - DNA, 15 bp, Homo sapiens
atttcgagaacgttg

SEQ ID NO: 455679 - DNA, 15 bp, Homo sapiens
tttcgagaacgttgc

SEQ ID NO: 455680 - DNA, 15 bp, Homo sapiens
ttcgagaacgttgca

SEQ ID NO: 455681 - DNA, 15 bp, Homo sapiens
tcgagaacgttgcac

SEQ ID NO: 455682 - DNA, 15 bp, Homo sapiens
cgagaacgttgcaca

SEQ ID NO: 455683 - DNA, 15 bp, Homo sapiens
gagaacgttgcacat

SEQ ID NO: 455684 - DNA, 15 bp, Homo sapiens
agaacgttgcacatg

SEQ ID NO: 455685 - DNA, 15 bp, Homo sapiens
gaacgttgcacatgg

SEQ ID NO: 455686 - DNA, 15 bp, Homo sapiens
aacgttgcacatgga

SEQ ID NO: 455687 - DNA, 15 bp, Homo sapiens
acgttgcacatggac

SEQ ID NO: 455688 - DNA, 15 bp, Homo sapiens
cgttgcacatggacc

SEQ ID NO: 455689 - DNA, 15 bp, Homo sapiens
gttgcacatggaccc

SEQ ID NO: 455690 - DNA, 15 bp, Homo sapiens
ttgcacatggaccca

SEQ ID NO: 455691 - DNA, 15 bp, Homo sapiens
tgcacatggacccaa

SEQ ID NO: 455692 - DNA, 15 bp, Homo sapiens
gcacatggacccaat

SEQ ID NO: 455693 - DNA, 15 bp, Homo sapiens
cacatggacccaatg

SEQ ID NO: 455694 - DNA, 15 bp, Homo sapiens
acatggacccaatgc

SEQ ID NO: 455695 - DNA, 15 bp, Homo sapiens
catggacccaatgcc

SEQ ID NO: 455696 - DNA, 15 bp, Homo sapiens
atggacccaatgccc

SEQ ID NO: 455697 - DNA, 15 bp, Homo sapiens
tggacccaatgccct

SEQ ID NO: 455698 - DNA, 15 bp, Homo sapiens
ggacccaatgccctg

SEQ ID NO: 455699 - DNA, 15 bp, Homo sapiens
gacccaatgccctgc

SEQ ID NO: 455700 - DNA, 15 bp, Homo sapiens
acccaatgccctgct

SEQ ID NO: 455701 - DNA, 15 bp, Homo sapiens
cccaatgccctgctt

SEQ ID NO: 455702 - DNA, 15 bp, Homo sapiens
ccaatgccctgctta

SEQ ID NO: 455703 - DNA, 15 bp, Homo sapiens
caatgccctgcttac

SEQ ID NO: 455704 - DNA, 15 bp, Homo sapiens
aatgccctgcttaca

SEQ ID NO: 455705 - DNA, 15 bp, Homo sapiens
atgccctgcttacaa

SEQ ID NO: 455706 - DNA, 15 bp, Homo sapiens
tgccctgcttacaaa

SEQ ID NO: 455707 - DNA, 15 bp, Homo sapiens
gccctgcttacaaaa

SEQ ID NO: 455708 - DNA, 15 bp, Homo sapiens
ccctgcttacaaaag

SEQ ID NO: 455709 - DNA, 15 bp, Homo sapiens
cctgcttacaaaaga

SEQ ID NO: 455710 - DNA, 15 bp, Homo sapiens
ctgcttacaaaagat

SEQ ID NO: 455711 - DNA, 15 bp, Homo sapiens
tgcttacaaaagatt

SEQ ID NO: 455712 - DNA, 15 bp, Homo sapiens
gcttacaaaagattc

SEQ ID NO: 455713 - DNA, 15 bp, Homo sapiens
cttacaaaagattcc

SEQ ID NO: 455714 - DNA, 15 bp, Homo sapiens
ttacaaaagattcct

SEQ ID NO: 455715 - DNA, 15 bp, Homo sapiens
tacaaaagattcctg

SEQ ID NO: 455716 - DNA, 15 bp, Homo sapiens
acaaaagattcctgc

SEQ ID NO: 455717 - DNA, 15 bp, Homo sapiens
caaaagattcctgct

SEQ ID NO: 455718 - DNA, 15 bp, Homo sapiens
aaaagattcctgctg

SEQ ID NO: 455719 - DNA, 15 bp, Homo sapiens
aaagattcctgctgc

SEQ ID NO: 455720 - DNA, 15 bp, Homo sapiens
aagattcctgctgcc

SEQ ID NO: 455721 - DNA, 15 bp, Homo sapiens
agattcctgctgccc

SEQ ID NO: 455722 - DNA, 15 bp, Homo sapiens
gattcctgctgccct

SEQ ID NO: 455723 - DNA, 15 bp, Homo sapiens
attcctgctgccctc

SEQ ID NO: 455724 - DNA, 15 bp, Homo sapiens
ttcctgctgccctca

SEQ ID NO: 455725 - DNA, 15 bp, Homo sapiens
tcctgctgccctcag

SEQ ID NO: 455726 - DNA, 15 bp, Homo sapiens
cctgctgccctcaga

SEQ ID NO: 455727 - DNA, 15 bp, Homo sapiens
ctgctgccctcagaa

SEQ ID NO: 455728 - DNA, 15 bp, Homo sapiens
tgctgccctcagaat

SEQ ID NO: 455729 - DNA, 15 bp, Homo sapiens
gctgccctcagaatg

SEQ ID NO: 455730 - DNA, 15 bp, Homo sapiens
ctgccctcagaatgg

SEQ ID NO: 455731 - DNA, 15 bp, Homo sapiens
tgccctcagaatgga

SEQ ID NO: 455732 - DNA, 15 bp, Homo sapiens
gccctcagaatggaa

SEQ ID NO: 455733 - DNA, 15 bp, Homo sapiens
ccctcagaatggaat

SEQ ID NO: 455734 - DNA, 15 bp, Homo sapiens
cctcagaatggaatg

SEQ ID NO: 455735 - DNA, 15 bp, Homo sapiens
ctcagaatggaatgg

SEQ ID NO: 455736 - DNA, 15 bp, Homo sapiens
tcagaatggaatggt

SEQ ID NO: 455737 - DNA, 15 bp, Homo sapiens
cagaatggaatggtc

SEQ ID NO: 455738 - DNA, 15 bp, Homo sapiens
agaatggaatggtct

SEQ ID NO: 455739 - DNA, 15 bp, Homo sapiens
gaatggaatggtctt

SEQ ID NO: 455740 - DNA, 15 bp, Homo sapiens
aatggaatggtcttt

SEQ ID NO: 455741 - DNA, 15 bp, Homo sapiens
atggaatggtctttg

SEQ ID NO: 455742 - DNA, 15 bp, Homo sapiens
tggaatggtctttgc

SEQ ID NO: 455743 - DNA, 15 bp, Homo sapiens
ggaatggtctttgcc

SEQ ID NO: 455744 - DNA, 15 bp, Homo sapiens
gaatggtctttgcct

SEQ ID NO: 455745 - DNA, 15 bp, Homo sapiens
aatggtctttgcctg

SEQ ID NO: 455746 - DNA, 15 bp, Homo sapiens
atggtctttgcctgg

SEQ ID NO: 455747 - DNA, 15 bp, Homo sapiens
tggtctttgcctggc

SEQ ID NO: 455748 - DNA, 15 bp, Homo sapiens
ggtctttgcctggct

SEQ ID NO: 455749 - DNA, 15 bp, Homo sapiens
gtctttgcctggctc

SEQ ID NO: 455750 - DNA, 15 bp, Homo sapiens
tctttgcctggctca

SEQ ID NO: 455751 - DNA, 15 bp, Homo sapiens
ctttgcctggctcac

SEQ ID NO: 455752 - DNA, 15 bp, Homo sapiens
tttgcctggctcacc

SEQ ID NO: 455753 - DNA, 15 bp, Homo sapiens
ttgcctggctcacct

SEQ ID NO: 455754 - DNA, 15 bp, Homo sapiens
tgcctggctcacctc

SEQ ID NO: 455755 - DNA, 15 bp, Homo sapiens
gcctggctcacctct

SEQ ID NO: 455756 - DNA, 15 bp, Homo sapiens
cctggctcacctctc

SEQ ID NO: 455757 - DNA, 15 bp, Homo sapiens
ctggctcacctctct

SEQ ID NO: 455758 - DNA, 15 bp, Homo sapiens
tggctcacctctctg

SEQ ID NO: 455759 - DNA, 15 bp, Homo sapiens
ggctcacctctctgt

SEQ ID NO: 455760 - DNA, 15 bp, Homo sapiens
gctcacctctctgtc

SEQ ID NO: 455761 - DNA, 15 bp, Homo sapiens
ctcacctctctgtcc

SEQ ID NO: 455762 - DNA, 15 bp, Homo sapiens
tcacctctctgtcca

SEQ ID NO: 455763 - DNA, 15 bp, Homo sapiens
cacctctctgtccac

SEQ ID NO: 455764 - DNA, 15 bp, Homo sapiens
acctctctgtccacc

SEQ ID NO: 455765 - DNA, 15 bp, Homo sapiens
cctctctgtccacct

SEQ ID NO: 455766 - DNA, 15 bp, Homo sapiens
ctctctgtccacctc

SEQ ID NO: 455767 - DNA, 15 bp, Homo sapiens
tctctgtccacctcc

SEQ ID NO: 455768 - DNA, 15 bp, Homo sapiens
ctctgtccacctcct

SEQ ID NO: 455769 - DNA, 15 bp, Homo sapiens
tctgtccacctcctt

SEQ ID NO: 455770 - DNA, 15 bp, Homo sapiens
ctgtccacctccttc

SEQ ID NO: 455771 - DNA, 15 bp, Homo sapiens
tgtccacctccttcc

SEQ ID NO: 455772 - DNA, 15 bp, Homo sapiens
gtccacctccttccc

SEQ ID NO: 455773 - DNA, 15 bp, Homo sapiens
tccacctccttccct

SEQ ID NO: 455774 - DNA, 15 bp, Homo sapiens
ccacctccttccctc

SEQ ID NO: 455775 - DNA, 15 bp, Homo sapiens
cacctccttccctct

SEQ ID NO: 455776 - DNA, 15 bp, Homo sapiens
acctccttccctctg

SEQ ID NO: 455777 - DNA, 15 bp, Homo sapiens
cctccttccctctgc

SEQ ID NO: 455778 - DNA, 15 bp, Homo sapiens
ctccttccctctgct

SEQ ID NO: 455779 - DNA, 15 bp, Homo sapiens
tccttccctctgctc

SEQ ID NO: 455780 - DNA, 15 bp, Homo sapiens
ccttccctctgctcc

SEQ ID NO: 455781 - DNA, 15 bp, Homo sapiens
cttccctctgctcca

SEQ ID NO: 455782 - DNA, 15 bp, Homo sapiens
ttccctctgctccac

SEQ ID NO: 455783 - DNA, 15 bp, Homo sapiens
tccctctgctccacc

SEQ ID NO: 455784 - DNA, 15 bp, Homo sapiens
ccctctgctccaccg

SEQ ID NO: 455785 - DNA, 15 bp, Homo sapiens
cctctgctccaccgg

SEQ ID NO: 455786 - DNA, 15 bp, Homo sapiens
ctctgctccaccggg

SEQ ID NO: 455787 - DNA, 15 bp, Homo sapiens
tctgctccaccgggg

SEQ ID NO: 455788 - DNA, 15 bp, Homo sapiens
ctgctccaccggggc

SEQ ID NO: 455789 - DNA, 15 bp, Homo sapiens
tgctccaccggggca

SEQ ID NO: 455790 - DNA, 15 bp, Homo sapiens
gctccaccggggcat

SEQ ID NO: 455791 - DNA, 15 bp, Homo sapiens
ctccaccggggcatc

SEQ ID NO: 455792 - DNA, 15 bp, Homo sapiens
tccaccggggcatca

SEQ ID NO: 455793 - DNA, 15 bp, Homo sapiens
ccaccggggcatcac

SEQ ID NO: 455794 - DNA, 15 bp, Homo sapiens
caccggggcatcacc

SEQ ID NO: 455795 - DNA, 15 bp, Homo sapiens
accggggcatcacca

SEQ ID NO: 455796 - DNA, 15 bp, Homo sapiens
ccggggcatcaccat

SEQ ID NO: 455797 - DNA, 15 bp, Homo sapiens
cggggcatcaccatt

SEQ ID NO: 455798 - DNA, 15 bp, Homo sapiens
ggggcatcaccattt

SEQ ID NO: 455799 - DNA, 15 bp, Homo sapiens
gggcatcaccatttc

SEQ ID NO: 455800 - DNA, 15 bp, Homo sapiens
ggcatcaccatttca

SEQ ID NO: 455801 - DNA, 15 bp, Homo sapiens
gcatcaccatttcat

SEQ ID NO: 455802 - DNA, 15 bp, Homo sapiens
catcaccatttcatc

SEQ ID NO: 455803 - DNA, 15 bp, Homo sapiens
atcaccatttcatca

SEQ ID NO: 455804 - DNA, 15 bp, Homo sapiens
tcaccatttcatcat

SEQ ID NO: 455805 - DNA, 15 bp, Homo sapiens
caccatttcatcatc

SEQ ID NO: 455806 - DNA, 15 bp, Homo sapiens
accatttcatcatcc

SEQ ID NO: 455807 - DNA, 15 bp, Homo sapiens
ccatttcatcatcca

SEQ ID NO: 455808 - DNA, 15 bp, Homo sapiens
catttcatcatccac

SEQ ID NO: 455809 - DNA, 15 bp, Homo sapiens
atttcatcatccact

SEQ ID NO: 455810 - DNA, 15 bp, Homo sapiens
tttcatcatccactt

SEQ ID NO: 455811 - DNA, 15 bp, Homo sapiens
ttcatcatccactta

SEQ ID NO: 455812 - DNA, 15 bp, Homo sapiens
tcatcatccacttag

SEQ ID NO: 455813 - DNA, 15 bp, Homo sapiens
catcatccacttagt

SEQ ID NO: 455814 - DNA, 15 bp, Homo sapiens
atcatccacttagtg

SEQ ID NO: 455815 - DNA, 15 bp, Homo sapiens
tcatccacttagtga

SEQ ID NO: 455816 - DNA, 15 bp, Homo sapiens
catccacttagtgat

SEQ ID NO: 455817 - DNA, 15 bp, Homo sapiens
atccacttagtgata

SEQ ID NO: 455818 - DNA, 15 bp, Homo sapiens
tccacttagtgatag

SEQ ID NO: 455819 - DNA, 15 bp, Homo sapiens
ccacttagtgataga

SEQ ID NO: 455820 - DNA, 15 bp, Homo sapiens
cacttagtgatagaa

SEQ ID NO: 455821 - DNA, 15 bp, Homo sapiens
acttagtgatagaaa

SEQ ID NO: 455822 - DNA, 15 bp, Homo sapiens
cttagtgatagaaat

SEQ ID NO: 455823 - DNA, 15 bp, Homo sapiens
ttagtgatagaaatg

SEQ ID NO: 455824 - DNA, 15 bp, Homo sapiens
tagtgatagaaatgg

SEQ ID NO: 455825 - DNA, 15 bp, Homo sapiens
agtgatagaaatggc

SEQ ID NO: 455826 - DNA, 15 bp, Homo sapiens
gtgatagaaatggca

SEQ ID NO: 455827 - DNA, 15 bp, Homo sapiens
tgatagaaatggcaa

SEQ ID NO: 455828 - DNA, 15 bp, Homo sapiens
gatagaaatggcaaa

SEQ ID NO: 455829 - DNA, 15 bp, Homo sapiens
atagaaatggcaaac

SEQ ID NO: 455830 - DNA, 15 bp, Homo sapiens
tagaaatggcaaact

SEQ ID NO: 455831 - DNA, 15 bp, Homo sapiens
agaaatggcaaactc

SEQ ID NO: 455832 - DNA, 15 bp, Homo sapiens
gaaatggcaaactct

SEQ ID NO: 455833 - DNA, 15 bp, Homo sapiens
aaatggcaaactctg

SEQ ID NO: 455834 - DNA, 15 bp, Homo sapiens
aatggcaaactctgt

SEQ ID NO: 455835 - DNA, 15 bp, Homo sapiens
atggcaaactctgta

SEQ ID NO: 455836 - DNA, 15 bp, Homo sapiens
tggcaaactctgtat

SEQ ID NO: 455837 - DNA, 15 bp, Homo sapiens
ggcaaactctgtatt

SEQ ID NO: 455838 - DNA, 15 bp, Homo sapiens
gcaaactctgtattc

SEQ ID NO: 455839 - DNA, 15 bp, Homo sapiens
caaactctgtattcc

SEQ ID NO: 455840 - DNA, 15 bp, Homo sapiens
aaactctgtattcca

SEQ ID NO: 455841 - DNA, 15 bp, Homo sapiens
aactctgtattccat

SEQ ID NO: 455842 - DNA, 15 bp, Homo sapiens
actctgtattccatt

SEQ ID NO: 455843 - DNA, 15 bp, Homo sapiens
ctctgtattccattc

SEQ ID NO: 455844 - DNA, 15 bp, Homo sapiens
tctgtattccattcc

SEQ ID NO: 455845 - DNA, 15 bp, Homo sapiens
ctgtattccattcct

SEQ ID NO: 455846 - DNA, 15 bp, Homo sapiens
tgtattccattcctc

SEQ ID NO: 455847 - DNA, 15 bp, Homo sapiens
gtattccattcctcc

SEQ ID NO: 455848 - DNA, 15 bp, Homo sapiens
tattccattcctcct

SEQ ID NO: 455849 - DNA, 15 bp, Homo sapiens
attccattcctcctg

SEQ ID NO: 455850 - DNA, 15 bp, Homo sapiens
ttccattcctcctgc

SEQ ID NO: 455851 - DNA, 15 bp, Homo sapiens
tccattcctcctgcc

SEQ ID NO: 455852 - DNA, 15 bp, Homo sapiens
ccattcctcctgcct

SEQ ID NO: 455853 - DNA, 15 bp, Homo sapiens
cattcctcctgccta

SEQ ID NO: 455854 - DNA, 15 bp, Homo sapiens
attcctcctgcctaa

SEQ ID NO: 455855 - DNA, 15 bp, Homo sapiens
ttcctcctgcctaaa

SEQ ID NO: 455856 - DNA, 15 bp, Homo sapiens
tcctcctgcctaaaa

SEQ ID NO: 455857 - DNA, 15 bp, Homo sapiens
cctcctgcctaaaaa

SEQ ID NO: 455858 - DNA, 15 bp, Homo sapiens
ctcctgcctaaaaag

SEQ ID NO: 455859 - DNA, 15 bp, Homo sapiens
tcctgcctaaaaagc

SEQ ID NO: 455860 - DNA, 15 bp, Homo sapiens
cctgcctaaaaagca

SEQ ID NO: 455861 - DNA, 15 bp, Homo sapiens
ctgcctaaaaagcac

SEQ ID NO: 455862 - DNA, 15 bp, Homo sapiens
tgcctaaaaagcact

SEQ ID NO: 455863 - DNA, 15 bp, Homo sapiens
gcctaaaaagcactt

SEQ ID NO: 455864 - DNA, 15 bp, Homo sapiens
cctaaaaagcacttg

SEQ ID NO: 455865 - DNA, 15 bp, Homo sapiens
ctaaaaagcacttgt

SEQ ID NO: 455866 - DNA, 15 bp, Homo sapiens
taaaaagcacttgtc

SEQ ID NO: 455867 - DNA, 15 bp, Homo sapiens
aaaaagcacttgtct

SEQ ID NO: 455868 - DNA, 15 bp, Homo sapiens
aaaagcacttgtctt

SEQ ID NO: 455869 - DNA, 15 bp, Homo sapiens
aaagcacttgtctta

SEQ ID NO: 455870 - DNA, 15 bp, Homo sapiens
aagcacttgtcttag

SEQ ID NO: 455871 - DNA, 15 bp, Homo sapiens
agcacttgtcttagc

SEQ ID NO: 455872 - DNA, 15 bp, Homo sapiens
gcacttgtcttagct

SEQ ID NO: 455873 - DNA, 15 bp, Homo sapiens
cacttgtcttagctc

SEQ ID NO: 455874 - DNA, 15 bp, Homo sapiens
acttgtcttagctct

SEQ ID NO: 455875 - DNA, 15 bp, Homo sapiens
cttgtcttagctctt

SEQ ID NO: 455876 - DNA, 15 bp, Homo sapiens
ttgtcttagctcttt

SEQ ID NO: 455877 - DNA, 15 bp, Homo sapiens
tgtcttagctctttg

SEQ ID NO: 455878 - DNA, 15 bp, Homo sapiens
gtcttagctctttgt

SEQ ID NO: 455879 - DNA, 15 bp, Homo sapiens
tcttagctctttgta

SEQ ID NO: 455880 - DNA, 15 bp, Homo sapiens
cttagctctttgtat

SEQ ID NO: 455881 - DNA, 15 bp, Homo sapiens
ttagctctttgtata

SEQ ID NO: 455882 - DNA, 15 bp, Homo sapiens
tagctctttgtatag

SEQ ID NO: 455883 - DNA, 15 bp, Homo sapiens
agctctttgtatagg

SEQ ID NO: 455884 - DNA, 15 bp, Homo sapiens
gctctttgtataggt

SEQ ID NO: 455885 - DNA, 15 bp, Homo sapiens
ctctttgtataggtt

SEQ ID NO: 455886 - DNA, 15 bp, Homo sapiens
tctttgtataggttg

SEQ ID NO: 455887 - DNA, 15 bp, Homo sapiens
ctttgtataggttga

SEQ ID NO: 455888 - DNA, 15 bp, Homo sapiens
tttgtataggttgat

SEQ ID NO: 455889 - DNA, 15 bp, Homo sapiens
ttgtataggttgatg

SEQ ID NO: 455890 - DNA, 15 bp, Homo sapiens
tgtataggttgatgc

SEQ ID NO: 455891 - DNA, 15 bp, Homo sapiens
gtataggttgatgca

SEQ ID NO: 455892 - DNA, 15 bp, Homo sapiens
tataggttgatgcaa

SEQ ID NO: 455893 - DNA, 15 bp, Homo sapiens
ataggttgatgcaaa

SEQ ID NO: 455894 - DNA, 15 bp, Homo sapiens
taggttgatgcaaaa

SEQ ID NO: 455895 - DNA, 15 bp, Homo sapiens
aggttgatgcaaaaa

SEQ ID NO: 455896 - DNA, 15 bp, Homo sapiens
ggttgatgcaaaaat

SEQ ID NO: 455897 - DNA, 15 bp, Homo sapiens
gttgatgcaaaaata

SEQ ID NO: 455898 - DNA, 15 bp, Homo sapiens
ttgatgcaaaaataa

SEQ ID NO: 455899 - DNA, 15 bp, Homo sapiens
tgatgcaaaaataat

SEQ ID NO: 455900 - DNA, 15 bp, Homo sapiens
gatgcaaaaataatt

SEQ ID NO: 455901 - DNA, 15 bp, Homo sapiens
atgcaaaaataattg

SEQ ID NO: 455902 - DNA, 15 bp, Homo sapiens
tgcaaaaataattgc

SEQ ID NO: 455903 - DNA, 15 bp, Homo sapiens
gcaaaaataattgca

SEQ ID NO: 455904 - DNA, 15 bp, Homo sapiens
caaaaataattgcag

SEQ ID NO: 455905 - DNA, 15 bp, Homo sapiens
aaaaataattgcagt

SEQ ID NO: 455906 - DNA, 15 bp, Homo sapiens
aaaataattgcagtt

SEQ ID NO: 455907 - DNA, 15 bp, Homo sapiens
aaataattgcagttt

SEQ ID NO: 455908 - DNA, 15 bp, Homo sapiens
aataattgcagtttt

SEQ ID NO: 455909 - DNA, 15 bp, Homo sapiens
ataattgcagttttt

SEQ ID NO: 455910 - DNA, 15 bp, Homo sapiens
taattgcagtttttg

SEQ ID NO: 455911 - DNA, 15 bp, Homo sapiens
aattgcagtttttgc

SEQ ID NO: 455912 - DNA, 15 bp, Homo sapiens
attgcagtttttgcc

SEQ ID NO: 455913 - DNA, 15 bp, Homo sapiens
ttgcagtttttgccg

SEQ ID NO: 455914 - DNA, 15 bp, Homo sapiens
tgcagtttttgccgt

SEQ ID NO: 455915 - DNA, 15 bp, Homo sapiens
gcagtttttgccgtt

SEQ ID NO: 455916 - DNA, 15 bp, Homo sapiens
cagtttttgccgtta

SEQ ID NO: 455917 - DNA, 15 bp, Homo sapiens
agtttttgccgttaa

SEQ ID NO: 455918 - DNA, 15 bp, Homo sapiens
gtttttgccgttaaa

SEQ ID NO: 455919 - DNA, 15 bp, Homo sapiens
tttttgccgttaaaa

SEQ ID NO: 455920 - DNA, 15 bp, Homo sapiens
ttttgccgttaaaag

SEQ ID NO: 455921 - DNA, 15 bp, Homo sapiens
tttgccgttaaaagt

SEQ ID NO: 455922 - DNA, 15 bp, Homo sapiens
ttgccgttaaaagta

SEQ ID NO: 455923 - DNA, 15 bp, Homo sapiens
tgccgttaaaagtaa

SEQ ID NO: 455924 - DNA, 15 bp, Homo sapiens
gccgttaaaagtaag

SEQ ID NO: 455925 - DNA, 15 bp, Homo sapiens
ccgttaaaagtaagt

SEQ ID NO: 455926 - DNA, 15 bp, Homo sapiens
cgttaaaagtaagtt

SEQ ID NO: 455927 - DNA, 15 bp, Homo sapiens
gttaaaagtaagtta

SEQ ID NO: 455928 - DNA, 15 bp, Homo sapiens
ttaaaagtaagttag

SEQ ID NO: 455929 - DNA, 15 bp, Homo sapiens
taaaagtaagttagg

SEQ ID NO: 455930 - DNA, 15 bp, Homo sapiens
aaaagtaagttaggg

SEQ ID NO: 455931 - DNA, 15 bp, Homo sapiens
aaagtaagttagggt

SEQ ID NO: 455932 - DNA, 15 bp, Homo sapiens
aagtaagttagggta

SEQ ID NO: 455933 - DNA, 15 bp, Homo sapiens
agtaagttagggtat

SEQ ID NO: 455934 - DNA, 15 bp, Homo sapiens
gtaagttagggtatt

SEQ ID NO: 455935 - DNA, 15 bp, Homo sapiens
taagttagggtattt

SEQ ID NO: 455936 - DNA, 15 bp, Homo sapiens
aagttagggtatttc

SEQ ID NO: 455937 - DNA, 15 bp, Homo sapiens
agttagggtatttca

SEQ ID NO: 455938 - DNA, 15 bp, Homo sapiens
gttagggtatttcat

SEQ ID NO: 455939 - DNA, 15 bp, Homo sapiens
ttagggtatttcatt

SEQ ID NO: 455940 - DNA, 15 bp, Homo sapiens
tagggtatttcatta

SEQ ID NO: 455941 - DNA, 15 bp, Homo sapiens
agggtatttcattaa

SEQ ID NO: 455942 - DNA, 15 bp, Homo sapiens
gggtatttcattaaa

SEQ ID NO: 455943 - DNA, 15 bp, Homo sapiens
ggtatttcattaaaa

SEQ ID NO: 455944 - DNA, 15 bp, Homo sapiens
gtatttcattaaaag

SEQ ID NO: 455945 - DNA, 15 bp, Homo sapiens
tatttcattaaaagt

SEQ ID NO: 455946 - DNA, 15 bp, Homo sapiens
atttcattaaaagta

SEQ ID NO: 455947 - DNA, 15 bp, Homo sapiens
tttcattaaaagtaa

SEQ ID NO: 455948 - DNA, 15 bp, Homo sapiens
ttcattaaaagtaat

SEQ ID NO: 455949 - DNA, 15 bp, Homo sapiens
tcattaaaagtaatg

SEQ ID NO: 455950 - DNA, 15 bp, Homo sapiens
taaaagtaatggcaa

SEQ ID NO: 455951 - DNA, 15 bp, Homo sapiens
aaaagtaatggcaaa

SEQ ID NO: 455952 - DNA, 15 bp, Homo sapiens
aaagtaatggcaaaa

SEQ ID NO: 455953 - DNA, 15 bp, Homo sapiens
aagtaatggcaaaaa

SEQ ID NO: 455954 - DNA, 15 bp, Homo sapiens
agtaatggcaaaaac

SEQ ID NO: 455955 - DNA, 15 bp, Homo sapiens
gtaatggcaaaaacc

SEQ ID NO: 455956 - DNA, 15 bp, Homo sapiens
taatggcaaaaacct

SEQ ID NO: 455957 - DNA, 15 bp, Homo sapiens
aatggcaaaaacctc

SEQ ID NO: 455958 - DNA, 15 bp, Homo sapiens
atggcaaaaacctca

SEQ ID NO: 455959 - DNA, 15 bp, Homo sapiens
tggcaaaaacctcaa

SEQ ID NO: 455960 - DNA, 15 bp, Homo sapiens
ggcaaaaacctcaat

SEQ ID NO: 455961 - DNA, 15 bp, Homo sapiens
gcaaaaacctcaatt

SEQ ID NO: 455962 - DNA, 15 bp, Homo sapiens
caaaaacctcaatta

SEQ ID NO: 455963 - DNA, 15 bp, Homo sapiens
aaaaacctcaattac

SEQ ID NO: 455964 - DNA, 15 bp, Homo sapiens
aaaacctcaattact

SEQ ID NO: 455965 - DNA, 15 bp, Homo sapiens
aaacctcaattactt

SEQ ID NO: 455966 - DNA, 15 bp, Homo sapiens
aacctcaattacttt

SEQ ID NO: 455967 - DNA, 15 bp, Homo sapiens
acctcaattactttt

SEQ ID NO: 455968 - DNA, 15 bp, Homo sapiens
cctcaattacttttg

SEQ ID NO: 455969 - DNA, 15 bp, Homo sapiens
ctcaattacttttgc

SEQ ID NO: 455970 - DNA, 15 bp, Homo sapiens
tcaattacttttgca

SEQ ID NO: 455971 - DNA, 15 bp, Homo sapiens
acttttgcaccaact

SEQ ID NO: 455972 - DNA, 15 bp, Homo sapiens
cttttgcaccaactt

SEQ ID NO: 455973 - DNA, 15 bp, Homo sapiens
ttttgcaccaactta

SEQ ID NO: 455974 - DNA, 15 bp, Homo sapiens
tttgcaccaacttaa

SEQ ID NO: 455975 - DNA, 15 bp, Homo sapiens
ttgcaccaacttaat

SEQ ID NO: 455976 - DNA, 15 bp, Homo sapiens
tgcaccaacttaatc

SEQ ID NO: 455977 - DNA, 15 bp, Homo sapiens
gcaccaacttaatcc

SEQ ID NO: 455978 - DNA, 15 bp, Homo sapiens
caccaacttaatcct

SEQ ID NO: 455979 - DNA, 15 bp, Homo sapiens
accaacttaatcctt

SEQ ID NO: 455980 - DNA, 15 bp, Homo sapiens
ccaacttaatccttc

SEQ ID NO: 455981 - DNA, 15 bp, Homo sapiens
caacttaatccttct

SEQ ID NO: 455982 - DNA, 15 bp, Homo sapiens
aacttaatccttctg

SEQ ID NO: 455983 - DNA, 15 bp, Homo sapiens
acttaatccttctgt

SEQ ID NO: 455984 - DNA, 15 bp, Homo sapiens
cttaatccttctgtt

SEQ ID NO: 455985 - DNA, 15 bp, Homo sapiens
ttaatccttctgttc

SEQ ID NO: 455986 - DNA, 15 bp, Homo sapiens
taatccttctgttct

SEQ ID NO: 455987 - DNA, 15 bp, Homo sapiens
aatccttctgttctt

SEQ ID NO: 455988 - DNA, 15 bp, Homo sapiens
atccttctgttcttc

SEQ ID NO: 455989 - DNA, 15 bp, Homo sapiens
tccttctgttcttcc

SEQ ID NO: 455990 - DNA, 15 bp, Homo sapiens
ccttctgttcttccc

SEQ ID NO: 455991 - DNA, 15 bp, Homo sapiens
cttctgttcttccct

SEQ ID NO: 455992 - DNA, 15 bp, Homo sapiens
ttctgttcttccctt

SEQ ID NO: 455993 - DNA, 15 bp, Homo sapiens
tctgttcttcccttg

SEQ ID NO: 455994 - DNA, 15 bp, Homo sapiens
ctgttcttcccttgg

SEQ ID NO: 455995 - DNA, 15 bp, Homo sapiens
tgttcttcccttggc

SEQ ID NO: 455996 - DNA, 15 bp, Homo sapiens
gttcttcccttggct

SEQ ID NO: 455997 - DNA, 15 bp, Homo sapiens
ttcttcccttggctg

SEQ ID NO: 455998 - DNA, 15 bp, Homo sapiens
tcttcccttggctgg

SEQ ID NO: 455999 - DNA, 15 bp, Homo sapiens
cttcccttggctggg

SEQ ID NO: 456000 - DNA, 15 bp, Homo sapiens
ttcccttggctggga

SEQ ID NO: 456001 - DNA, 15 bp, Homo sapiens
tcccttggctgggac

SEQ ID NO: 456002 - DNA, 15 bp, Homo sapiens
cccttggctgggaca

SEQ ID NO: 456003 - DNA, 15 bp, Homo sapiens
ccttggctgggacac

SEQ ID NO: 456004 - DNA, 15 bp, Homo sapiens
cttggctgggacact

SEQ ID NO: 456005 - DNA, 15 bp, Homo sapiens
ttggctgggacactc

SEQ ID NO: 456006 - DNA, 15 bp, Homo sapiens
tggctgggacactca

SEQ ID NO: 456007 - DNA, 15 bp, Homo sapiens
ggctgggacactcat

SEQ ID NO: 456008 - DNA, 15 bp, Homo sapiens
gctgggacactcatt

SEQ ID NO: 456009 - DNA, 15 bp, Homo sapiens
ctgggacactcattc

SEQ ID NO: 456010 - DNA, 15 bp, Homo sapiens
tgggacactcattcc

SEQ ID NO: 456011 - DNA, 15 bp, Homo sapiens
gggacactcattcct

SEQ ID NO: 456012 - DNA, 15 bp, Homo sapiens
ggacactcattcctg

SEQ ID NO: 456013 - DNA, 15 bp, Homo sapiens
gacactcattcctgt

SEQ ID NO: 456014 - DNA, 15 bp, Homo sapiens
acactcattcctgta

SEQ ID NO: 456015 - DNA, 15 bp, Homo sapiens
cactcattcctgtag

SEQ ID NO: 456016 - DNA, 15 bp, Homo sapiens
actcattcctgtagg

SEQ ID NO: 456017 - DNA, 15 bp, Homo sapiens
ctcattcctgtaggt

SEQ ID NO: 456018 - DNA, 15 bp, Homo sapiens
tcattcctgtaggtc

SEQ ID NO: 456019 - DNA, 15 bp, Homo sapiens
cattcctgtaggtct

SEQ ID NO: 456020 - DNA, 15 bp, Homo sapiens
attcctgtaggtctc

SEQ ID NO: 456021 - DNA, 15 bp, Homo sapiens
ttcctgtaggtctca

SEQ ID NO: 456022 - DNA, 15 bp, Homo sapiens
tcctgtaggtctcaa

SEQ ID NO: 456023 - DNA, 15 bp, Homo sapiens
cctgtaggtctcaat

SEQ ID NO: 456024 - DNA, 15 bp, Homo sapiens
ctgtaggtctcaatg

SEQ ID NO: 456025 - DNA, 15 bp, Homo sapiens
tgtaggtctcaatgt

SEQ ID NO: 456026 - DNA, 15 bp, Homo sapiens
gtaggtctcaatgtt

SEQ ID NO: 456027 - DNA, 15 bp, Homo sapiens
taggtctcaatgttg

SEQ ID NO: 456028 - DNA, 15 bp, Homo sapiens
aggtctcaatgttgt

SEQ ID NO: 456029 - DNA, 15 bp, Homo sapiens
ggtctcaatgttgtc

SEQ ID NO: 456030 - DNA, 15 bp, Homo sapiens
gtctcaatgttgtcg

SEQ ID NO: 456031 - DNA, 15 bp, Homo sapiens
tctcaatgttgtcga

SEQ ID NO: 456032 - DNA, 15 bp, Homo sapiens
ctcaatgttgtcgat

SEQ ID NO: 456033 - DNA, 15 bp, Homo sapiens
tcaatgttgtcgatc

SEQ ID NO: 456034 - DNA, 15 bp, Homo sapiens
caatgttgtcgatca

SEQ ID NO: 456035 - DNA, 15 bp, Homo sapiens
aatgttgtcgatcac

SEQ ID NO: 456036 - DNA, 15 bp, Homo sapiens
atgttgtcgatcacc

SEQ ID NO: 456037 - DNA, 15 bp, Homo sapiens
tgttgtcgatcacct

SEQ ID NO: 456038 - DNA, 15 bp, Homo sapiens
gttgtcgatcacctc

SEQ ID NO: 456039 - DNA, 15 bp, Homo sapiens
ttgtcgatcacctct

SEQ ID NO: 456040 - DNA, 15 bp, Homo sapiens
tgtcgatcacctctc

SEQ ID NO: 456041 - DNA, 15 bp, Homo sapiens
gtcgatcacctctct

SEQ ID NO: 456042 - DNA, 15 bp, Homo sapiens
tcgatcacctctctt

SEQ ID NO: 456043 - DNA, 15 bp, Homo sapiens
cgatcacctctcttt

SEQ ID NO: 456044 - DNA, 15 bp, Homo sapiens
gatcacctctctttt

SEQ ID NO: 456045 - DNA, 15 bp, Homo sapiens
atcacctctctttta

SEQ ID NO: 456046 - DNA, 15 bp, Homo sapiens
tcacctctcttttaa

SEQ ID NO: 456047 - DNA, 15 bp, Homo sapiens
cacctctcttttaat

SEQ ID NO: 456048 - DNA, 15 bp, Homo sapiens
acctctcttttaatg

SEQ ID NO: 456049 - DNA, 15 bp, Homo sapiens
cctctcttttaatga

SEQ ID NO: 456050 - DNA, 15 bp, Homo sapiens
ctctcttttaatgag

SEQ ID NO: 456051 - DNA, 15 bp, Homo sapiens
tctcttttaatgagg

SEQ ID NO: 456052 - DNA, 15 bp, Homo sapiens
ctcttttaatgaggt

SEQ ID NO: 456053 - DNA, 15 bp, Homo sapiens
tcttttaatgaggtt

SEQ ID NO: 456054 - DNA, 15 bp, Homo sapiens
cttttaatgaggttt

SEQ ID NO: 456055 - DNA, 15 bp, Homo sapiens
ttttaatgaggtttt

SEQ ID NO: 456056 - DNA, 15 bp, Homo sapiens
tttaatgaggttttc

SEQ ID NO: 456057 - DNA, 15 bp, Homo sapiens
ttaatgaggttttct

SEQ ID NO: 456058 - DNA, 15 bp, Homo sapiens
taatgaggttttcta

SEQ ID NO: 456059 - DNA, 15 bp, Homo sapiens
aatgaggttttctat

SEQ ID NO: 456060 - DNA, 15 bp, Homo sapiens
atgaggttttctatg

SEQ ID NO: 456061 - DNA, 15 bp, Homo sapiens
tgaggttttctatgg

SEQ ID NO: 456062 - DNA, 15 bp, Homo sapiens
gaggttttctatggc

SEQ ID NO: 456063 - DNA, 15 bp, Homo sapiens
aggttttctatggct

SEQ ID NO: 456064 - DNA, 15 bp, Homo sapiens
ggttttctatggctc

SEQ ID NO: 456065 - DNA, 15 bp, Homo sapiens
gttttctatggctcc

SEQ ID NO: 456066 - DNA, 15 bp, Homo sapiens
ttttctatggctcct

SEQ ID NO: 456067 - DNA, 15 bp, Homo sapiens
tttctatggctcctc

SEQ ID NO: 456068 - DNA, 15 bp, Homo sapiens
ttctatggctcctca

SEQ ID NO: 456069 - DNA, 15 bp, Homo sapiens
tctatggctcctcat

SEQ ID NO: 456070 - DNA, 15 bp, Homo sapiens
ctatggctcctcata

SEQ ID NO: 456071 - DNA, 15 bp, Homo sapiens
tatggctcctcatag

SEQ ID NO: 456072 - DNA, 15 bp, Homo sapiens
atggctcctcataga

SEQ ID NO: 456073 - DNA, 15 bp, Homo sapiens
tggctcctcatagaa

SEQ ID NO: 456074 - DNA, 15 bp, Homo sapiens
ggctcctcatagaac

SEQ ID NO: 456075 - DNA, 15 bp, Homo sapiens
gctcctcatagaact

SEQ ID NO: 456076 - DNA, 15 bp, Homo sapiens
ctcctcatagaactg

SEQ ID NO: 456077 - DNA, 15 bp, Homo sapiens
tcctcatagaactgt

SEQ ID NO: 456078 - DNA, 15 bp, Homo sapiens
cctcatagaactgtt

SEQ ID NO: 456079 - DNA, 15 bp, Homo sapiens
ctcatagaactgttc

SEQ ID NO: 456080 - DNA, 15 bp, Homo sapiens
tcatagaactgttct

SEQ ID NO: 456081 - DNA, 15 bp, Homo sapiens
catagaactgttctt

SEQ ID NO: 456082 - DNA, 15 bp, Homo sapiens
atagaactgttcttt

SEQ ID NO: 456083 - DNA, 15 bp, Homo sapiens
tagaactgttctttt

SEQ ID NO: 456084 - DNA, 15 bp, Homo sapiens
agaactgttcttttc

SEQ ID NO: 456085 - DNA, 15 bp, Homo sapiens
gaactgttcttttcc

SEQ ID NO: 456086 - DNA, 15 bp, Homo sapiens
aactgttcttttcct

SEQ ID NO: 456087 - DNA, 15 bp, Homo sapiens
actgttcttttcctt

SEQ ID NO: 456088 - DNA, 15 bp, Homo sapiens
ctgttcttttcctta

SEQ ID NO: 456089 - DNA, 15 bp, Homo sapiens
tgttcttttccttac

SEQ ID NO: 456090 - DNA, 15 bp, Homo sapiens
gttcttttccttaca

SEQ ID NO: 456091 - DNA, 15 bp, Homo sapiens
ttcttttccttacat

SEQ ID NO: 456092 - DNA, 15 bp, Homo sapiens
tcttttccttacatg

SEQ ID NO: 456093 - DNA, 15 bp, Homo sapiens
cttttccttacatga

SEQ ID NO: 456094 - DNA, 15 bp, Homo sapiens
ttttccttacatgac

SEQ ID NO: 456095 - DNA, 15 bp, Homo sapiens
tttccttacatgaca

SEQ ID NO: 456096 - DNA, 15 bp, Homo sapiens
ttccttacatgacac

SEQ ID NO: 456097 - DNA, 15 bp, Homo sapiens
tccttacatgacact

SEQ ID NO: 456098 - DNA, 15 bp, Homo sapiens
ccttacatgacactt

SEQ ID NO: 456099 - DNA, 15 bp, Homo sapiens
cttacatgacacttc

SEQ ID NO: 456100 - DNA, 15 bp, Homo sapiens
ttacatgacacttct

SEQ ID NO: 456101 - DNA, 15 bp, Homo sapiens
tacatgacacttctg

SEQ ID NO: 456102 - DNA, 15 bp, Homo sapiens
acatgacacttctgg

SEQ ID NO: 456103 - DNA, 15 bp, Homo sapiens
catgacacttctggt

SEQ ID NO: 456104 - DNA, 15 bp, Homo sapiens
atgacacttctggtg

SEQ ID NO: 456105 - DNA, 15 bp, Homo sapiens
tgacacttctggtgc

SEQ ID NO: 456106 - DNA, 15 bp, Homo sapiens
gacacttctggtgct

SEQ ID NO: 456107 - DNA, 15 bp, Homo sapiens
acacttctggtgctt

SEQ ID NO: 456108 - DNA, 15 bp, Homo sapiens
cacttctggtgcttg

SEQ ID NO: 456109 - DNA, 15 bp, Homo sapiens
acttctggtgcttgg

SEQ ID NO: 456110 - DNA, 15 bp, Homo sapiens
cttctggtgcttggt

SEQ ID NO: 456111 - DNA, 15 bp, Homo sapiens
ttctggtgcttggtt

SEQ ID NO: 456112 - DNA, 15 bp, Homo sapiens
tctggtgcttggttt

SEQ ID NO: 456113 - DNA, 15 bp, Homo sapiens
ctggtgcttggttta

SEQ ID NO: 456114 - DNA, 15 bp, Homo sapiens
tggtgcttggtttag

SEQ ID NO: 456115 - DNA, 15 bp, Homo sapiens
ggtgcttggtttagg

SEQ ID NO: 456116 - DNA, 15 bp, Homo sapiens
gtgcttggtttaggc

SEQ ID NO: 456117 - DNA, 15 bp, Homo sapiens
tgcttggtttaggca

SEQ ID NO: 456118 - DNA, 15 bp, Homo sapiens
gcttggtttaggcac

SEQ ID NO: 456119 - DNA, 15 bp, Homo sapiens
cttggtttaggcact

SEQ ID NO: 456120 - DNA, 15 bp, Homo sapiens
ttggtttaggcacta

SEQ ID NO: 456121 - DNA, 15 bp, Homo sapiens
tggtttaggcactaa

SEQ ID NO: 456122 - DNA, 15 bp, Homo sapiens
ggtttaggcactaag

SEQ ID NO: 456123 - DNA, 15 bp, Homo sapiens
gtttaggcactaagg

SEQ ID NO: 456124 - DNA, 15 bp, Homo sapiens
tttaggcactaaggc

SEQ ID NO: 456125 - DNA, 15 bp, Homo sapiens
ttaggcactaaggca

SEQ ID NO: 456126 - DNA, 15 bp, Homo sapiens
taggcactaaggcag

SEQ ID NO: 456127 - DNA, 15 bp, Homo sapiens
aggcactaaggcaga

SEQ ID NO: 456128 - DNA, 15 bp, Homo sapiens
ggcactaaggcagag

SEQ ID NO: 456129 - DNA, 15 bp, Homo sapiens
gcactaaggcagagt

SEQ ID NO: 456130 - DNA, 15 bp, Homo sapiens
cactaaggcagagtg

SEQ ID NO: 456131 - DNA, 15 bp, Homo sapiens
actaaggcagagtgt

SEQ ID NO: 456132 - DNA, 15 bp, Homo sapiens
ctaaggcagagtgtc

SEQ ID NO: 456133 - DNA, 15 bp, Homo sapiens
taaggcagagtgtca

SEQ ID NO: 456134 - DNA, 15 bp, Homo sapiens
aaggcagagtgtcaa

SEQ ID NO: 456135 - DNA, 15 bp, Homo sapiens
aggcagagtgtcaat

SEQ ID NO: 456136 - DNA, 15 bp, Homo sapiens
ggcagagtgtcaatg

SEQ ID NO: 456137 - DNA, 15 bp, Homo sapiens
gcagagtgtcaatgg

SEQ ID NO: 456138 - DNA, 15 bp, Homo sapiens
cagagtgtcaatggt

SEQ ID NO: 456139 - DNA, 15 bp, Homo sapiens
agagtgtcaatggta

SEQ ID NO: 456140 - DNA, 15 bp, Homo sapiens
gagtgtcaatggtaa

SEQ ID NO: 456141 - DNA, 15 bp, Homo sapiens
agtgtcaatggtaat

SEQ ID NO: 456142 - DNA, 15 bp, Homo sapiens
gtgtcaatggtaatt

SEQ ID NO: 456143 - DNA, 15 bp, Homo sapiens
tgtcaatggtaattt

SEQ ID NO: 456144 - DNA, 15 bp, Homo sapiens
gtcaatggtaatttt

SEQ ID NO: 456145 - DNA, 15 bp, Homo sapiens
tcaatggtaattttt

SEQ ID NO: 456146 - DNA, 15 bp, Homo sapiens
caatggtaattttta

SEQ ID NO: 456147 - DNA, 15 bp, Homo sapiens
aatggtaatttttaa

SEQ ID NO: 456148 - DNA, 15 bp, Homo sapiens
atggtaatttttaat

SEQ ID NO: 456149 - DNA, 15 bp, Homo sapiens
tggtaatttttaata

SEQ ID NO: 456150 - DNA, 15 bp, Homo sapiens
ggtaatttttaatat

SEQ ID NO: 456151 - DNA, 15 bp, Homo sapiens
gtaatttttaatatt

SEQ ID NO: 456152 - DNA, 15 bp, Homo sapiens
taatttttaatattc

SEQ ID NO: 456153 - DNA, 15 bp, Homo sapiens
aatttttaatattct

SEQ ID NO: 456154 - DNA, 15 bp, Homo sapiens
atttttaatattctg

SEQ ID NO: 456155 - DNA, 15 bp, Homo sapiens
tttttaatattctgt

SEQ ID NO: 456156 - DNA, 15 bp, Homo sapiens
ttttaatattctgtt

SEQ ID NO: 456157 - DNA, 15 bp, Homo sapiens
tttaatattctgttt

SEQ ID NO: 456158 - DNA, 15 bp, Homo sapiens
ttaatattctgttta

SEQ ID NO: 456159 - DNA, 15 bp, Homo sapiens
taatattctgtttat

SEQ ID NO: 456160 - DNA, 15 bp, Homo sapiens
atattctgtttatta

SEQ ID NO: 456161 - DNA, 15 bp, Homo sapiens
tattctgtttattag

SEQ ID NO: 456162 - DNA, 15 bp, Homo sapiens
attctgtttattagt

SEQ ID NO: 456163 - DNA, 15 bp, Homo sapiens
ttctgtttattagtt

SEQ ID NO: 456164 - DNA, 15 bp, Homo sapiens
tctgtttattagtta

SEQ ID NO: 456165 - DNA, 15 bp, Homo sapiens
ctgtttattagttat

SEQ ID NO: 456166 - DNA, 15 bp, Homo sapiens
tgtttattagttatt

SEQ ID NO: 456167 - DNA, 15 bp, Homo sapiens
gtttattagttattg

SEQ ID NO: 456168 - DNA, 15 bp, Homo sapiens
tttattagttattgt

SEQ ID NO: 456169 - DNA, 15 bp, Homo sapiens
ttattagttattgtt

SEQ ID NO: 456170 - DNA, 15 bp, Homo sapiens
tattagttattgttt

SEQ ID NO: 456171 - DNA, 15 bp, Homo sapiens
attagttattgtttg

SEQ ID NO: 456172 - DNA, 15 bp, Homo sapiens
ttagttattgtttgc

SEQ ID NO: 456173 - DNA, 15 bp, Homo sapiens
tagttattgtttgct

SEQ ID NO: 456174 - DNA, 15 bp, Homo sapiens
agttattgtttgctt

SEQ ID NO: 456175 - DNA, 15 bp, Homo sapiens
gttattgtttgcttc

SEQ ID NO: 456176 - DNA, 15 bp, Homo sapiens
ttattgtttgcttct

SEQ ID NO: 456177 - DNA, 15 bp, Homo sapiens
tattgtttgcttctc

SEQ ID NO: 456178 - DNA, 15 bp, Homo sapiens
attgtttgcttctcc

SEQ ID NO: 456179 - DNA, 15 bp, Homo sapiens
ttgtttgcttctcca

SEQ ID NO: 456180 - DNA, 15 bp, Homo sapiens
tgtttgcttctccat

SEQ ID NO: 456181 - DNA, 15 bp, Homo sapiens
gtttgcttctccatc

SEQ ID NO: 456182 - DNA, 15 bp, Homo sapiens
tttgcttctccatca

SEQ ID NO: 456183 - DNA, 15 bp, Homo sapiens
ttgcttctccatcat

SEQ ID NO: 456184 - DNA, 15 bp, Homo sapiens
tgcttctccatcatg

SEQ ID NO: 456185 - DNA, 15 bp, Homo sapiens
gcttctccatcatgg

SEQ ID NO: 456186 - DNA, 15 bp, Homo sapiens
cttctccatcatggg

SEQ ID NO: 456187 - DNA, 15 bp, Homo sapiens
ttctccatcatggga

SEQ ID NO: 456188 - DNA, 15 bp, Homo sapiens
tctccatcatgggat

SEQ ID NO: 456189 - DNA, 15 bp, Homo sapiens
ctccatcatgggatg

SEQ ID NO: 456190 - DNA, 15 bp, Homo sapiens
tccatcatgggatgg

SEQ ID NO: 456191 - DNA, 15 bp, Homo sapiens
ccatcatgggatgga

SEQ ID NO: 456192 - DNA, 15 bp, Homo sapiens
catcatgggatggat

SEQ ID NO: 456193 - DNA, 15 bp, Homo sapiens
atcatgggatggatg

SEQ ID NO: 456194 - DNA, 15 bp, Homo sapiens
tcatgggatggatga

SEQ ID NO: 456195 - DNA, 15 bp, Homo sapiens
catgggatggatgag

SEQ ID NO: 456196 - DNA, 15 bp, Homo sapiens
atgggatggatgagt

SEQ ID NO: 456197 - DNA, 15 bp, Homo sapiens
tgggatggatgagtc

SEQ ID NO: 456198 - DNA, 15 bp, Homo sapiens
gggatggatgagtct

SEQ ID NO: 456199 - DNA, 15 bp, Homo sapiens
ggatggatgagtctg

SEQ ID NO: 456200 - DNA, 15 bp, Homo sapiens
gatggatgagtctgt

SEQ ID NO: 456201 - DNA, 15 bp, Homo sapiens
atggatgagtctgtg

SEQ ID NO: 456202 - DNA, 15 bp, Homo sapiens
tggatgagtctgtgt

SEQ ID NO: 456203 - DNA, 15 bp, Homo sapiens
ggatgagtctgtgtt

SEQ ID NO: 456204 - DNA, 15 bp, Homo sapiens
gatgagtctgtgttc

SEQ ID NO: 456205 - DNA, 15 bp, Homo sapiens
atgagtctgtgttcg

SEQ ID NO: 456206 - DNA, 15 bp, Homo sapiens
tgagtctgtgttcgt

SEQ ID NO: 456207 - DNA, 15 bp, Homo sapiens
gagtctgtgttcgtc

SEQ ID NO: 456208 - DNA, 15 bp, Homo sapiens
agtctgtgttcgtct

SEQ ID NO: 456209 - DNA, 15 bp, Homo sapiens
gtctgtgttcgtctc

SEQ ID NO: 456210 - DNA, 15 bp, Homo sapiens
tctgtgttcgtctct

SEQ ID NO: 456211 - DNA, 15 bp, Homo sapiens
ctgtgttcgtctcta

SEQ ID NO: 456212 - DNA, 15 bp, Homo sapiens
tgtgttcgtctctac

SEQ ID NO: 456213 - DNA, 15 bp, Homo sapiens
gtgttcgtctctact

SEQ ID NO: 456214 - DNA, 15 bp, Homo sapiens
tgttcgtctctactt

SEQ ID NO: 456215 - DNA, 15 bp, Homo sapiens
gttcgtctctactta

SEQ ID NO: 456216 - DNA, 15 bp, Homo sapiens
ttcgtctctacttag

SEQ ID NO: 456217 - DNA, 15 bp, Homo sapiens
tcgtctctacttagg

SEQ ID NO: 456218 - DNA, 15 bp, Homo sapiens
cgtctctacttagga

SEQ ID NO: 456219 - DNA, 15 bp, Homo sapiens
gtctctacttaggac

SEQ ID NO: 456220 - DNA, 15 bp, Homo sapiens
tctctacttaggacc

SEQ ID NO: 456221 - DNA, 15 bp, Homo sapiens
ctctacttaggacct

SEQ ID NO: 456222 - DNA, 15 bp, Homo sapiens
tctacttaggacctc

SEQ ID NO: 456223 - DNA, 15 bp, Homo sapiens
ctacttaggacctca

SEQ ID NO: 456224 - DNA, 15 bp, Homo sapiens
tacttaggacctcat

SEQ ID NO: 456225 - DNA, 15 bp, Homo sapiens
acttaggacctcata

SEQ ID NO: 456226 - DNA, 15 bp, Homo sapiens
cttaggacctcatac

SEQ ID NO: 456227 - DNA, 15 bp, Homo sapiens
ttaggacctcataca

SEQ ID NO: 456228 - DNA, 15 bp, Homo sapiens
taggacctcatacaa

SEQ ID NO: 456229 - DNA, 15 bp, Homo sapiens
aggacctcatacaat

SEQ ID NO: 456230 - DNA, 15 bp, Homo sapiens
ggacctcatacaatt

SEQ ID NO: 456231 - DNA, 15 bp, Homo sapiens
gacctcatacaattt

SEQ ID NO: 456232 - DNA, 15 bp, Homo sapiens
acctcatacaatttc

SEQ ID NO: 456233 - DNA, 15 bp, Homo sapiens
cctcatacaatttct

SEQ ID NO: 456234 - DNA, 15 bp, Homo sapiens
ctcatacaatttctg

SEQ ID NO: 456235 - DNA, 15 bp, Homo sapiens
tcatacaatttctgg

SEQ ID NO: 456236 - DNA, 15 bp, Homo sapiens
catacaatttctggc

SEQ ID NO: 456237 - DNA, 15 bp, Homo sapiens
atacaatttctggca

SEQ ID NO: 456238 - DNA, 15 bp, Homo sapiens
tacaatttctggcac

SEQ ID NO: 456239 - DNA, 15 bp, Homo sapiens
acaatttctggcaca

SEQ ID NO: 456240 - DNA, 15 bp, Homo sapiens
caatttctggcacag

SEQ ID NO: 456241 - DNA, 15 bp, Homo sapiens
aatttctggcacaga

SEQ ID NO: 456242 - DNA, 15 bp, Homo sapiens
atttctggcacagag

SEQ ID NO: 456243 - DNA, 15 bp, Homo sapiens
tttctggcacagagc

SEQ ID NO: 456244 - DNA, 15 bp, Homo sapiens
ttctggcacagagca

SEQ ID NO: 456245 - DNA, 15 bp, Homo sapiens
tctggcacagagcag

SEQ ID NO: 456246 - DNA, 15 bp, Homo sapiens
ctggcacagagcagg

SEQ ID NO: 456247 - DNA, 15 bp, Homo sapiens
tggcacagagcaggg

SEQ ID NO: 456248 - DNA, 15 bp, Homo sapiens
ggcacagagcagggg

SEQ ID NO: 456249 - DNA, 15 bp, Homo sapiens
gcacagagcaggggt

SEQ ID NO: 456250 - DNA, 15 bp, Homo sapiens
cacagagcaggggtt

SEQ ID NO: 456251 - DNA, 15 bp, Homo sapiens
acagagcaggggttg

SEQ ID NO: 456252 - DNA, 15 bp, Homo sapiens
cagagcaggggttgc

SEQ ID NO: 456253 - DNA, 15 bp, Homo sapiens
agagcaggggttgct

SEQ ID NO: 456254 - DNA, 15 bp, Homo sapiens
gagcaggggttgctt

SEQ ID NO: 456255 - DNA, 15 bp, Homo sapiens
agcaggggttgctta

SEQ ID NO: 456256 - DNA, 15 bp, Homo sapiens
gcaggggttgcttag

SEQ ID NO: 456257 - DNA, 15 bp, Homo sapiens
caggggttgcttagg

SEQ ID NO: 456258 - DNA, 15 bp, Homo sapiens
aggggttgcttagga

SEQ ID NO: 456259 - DNA, 15 bp, Homo sapiens
ggggttgcttaggac

SEQ ID NO: 456260 - DNA, 15 bp, Homo sapiens
gggttgcttaggaca

SEQ ID NO: 456261 - DNA, 15 bp, Homo sapiens
ggttgcttaggacac

SEQ ID NO: 456262 - DNA, 15 bp, Homo sapiens
gttgcttaggacaca

SEQ ID NO: 456263 - DNA, 15 bp, Homo sapiens
ttgcttaggacacac

SEQ ID NO: 456264 - DNA, 15 bp, Homo sapiens
tgcttaggacacact

SEQ ID NO: 456265 - DNA, 15 bp, Homo sapiens
gcttaggacacactg

SEQ ID NO: 456266 - DNA, 15 bp, Homo sapiens
cttaggacacactga

SEQ ID NO: 456267 - DNA, 15 bp, Homo sapiens
ttaggacacactgag

SEQ ID NO: 456268 - DNA, 15 bp, Homo sapiens
taggacacactgagt

SEQ ID NO: 456269 - DNA, 15 bp, Homo sapiens
aggacacactgagtg

SEQ ID NO: 456270 - DNA, 15 bp, Homo sapiens
ggacacactgagtga

SEQ ID NO: 456271 - DNA, 15 bp, Homo sapiens
gacacactgagtgaa

SEQ ID NO: 456272 - DNA, 15 bp, Homo sapiens
acacactgagtgaat

SEQ ID NO: 456273 - DNA, 15 bp, Homo sapiens
cacactgagtgaatg

SEQ ID NO: 456274 - DNA, 15 bp, Homo sapiens
acactgagtgaatga

SEQ ID NO: 456275 - DNA, 15 bp, Homo sapiens
cactgagtgaatgat

SEQ ID NO: 456276 - DNA, 15 bp, Homo sapiens
actgagtgaatgatt

SEQ ID NO: 456277 - DNA, 15 bp, Homo sapiens
ctgagtgaatgattt

SEQ ID NO: 456278 - DNA, 15 bp, Homo sapiens
tgagtgaatgatttg

SEQ ID NO: 456279 - DNA, 15 bp, Homo sapiens
gagtgaatgatttga

SEQ ID NO: 456280 - DNA, 15 bp, Homo sapiens
agtgaatgatttgag

SEQ ID NO: 456281 - DNA, 15 bp, Homo sapiens
gtgaatgatttgagt

SEQ ID NO: 456282 - DNA, 15 bp, Homo sapiens
tgaatgatttgagtt

SEQ ID NO: 456283 - DNA, 15 bp, Homo sapiens
gaatgatttgagttt

SEQ ID NO: 456284 - DNA, 15 bp, Homo sapiens
aatgatttgagtttg

SEQ ID NO: 456285 - DNA, 15 bp, Homo sapiens
atgatttgagtttga

SEQ ID NO: 456286 - DNA, 15 bp, Homo sapiens
tgatttgagtttgaa

SEQ ID NO: 456287 - DNA, 15 bp, Homo sapiens
gatttgagtttgaag

SEQ ID NO: 456288 - DNA, 15 bp, Homo sapiens
atttgagtttgaagg

SEQ ID NO: 456289 - DNA, 15 bp, Homo sapiens
tttgagtttgaaggt

SEQ ID NO: 456290 - DNA, 15 bp, Homo sapiens
ttgagtttgaaggtt

SEQ ID NO: 456291 - DNA, 15 bp, Homo sapiens
tgagtttgaaggtta

SEQ ID NO: 456292 - DNA, 15 bp, Homo sapiens
gagtttgaaggttat

SEQ ID NO: 456293 - DNA, 15 bp, Homo sapiens
agtttgaaggttata

SEQ ID NO: 456294 - DNA, 15 bp, Homo sapiens
gtttgaaggttatat

SEQ ID NO: 456295 - DNA, 15 bp, Homo sapiens
tttgaaggttatata

SEQ ID NO: 456296 - DNA, 15 bp, Homo sapiens
ttgaaggttatatag

SEQ ID NO: 456297 - DNA, 15 bp, Homo sapiens
tgaaggttatatagc

SEQ ID NO: 456298 - DNA, 15 bp, Homo sapiens
gaaggttatatagca

SEQ ID NO: 456299 - DNA, 15 bp, Homo sapiens
aaggttatatagcag

SEQ ID NO: 456300 - DNA, 15 bp, Homo sapiens
aggttatatagcagt

SEQ ID NO: 456301 - DNA, 15 bp, Homo sapiens
ggttatatagcagta

SEQ ID NO: 456302 - DNA, 15 bp, Homo sapiens
gttatatagcagtac

SEQ ID NO: 456303 - DNA, 15 bp, Homo sapiens
ttatatagcagtact

SEQ ID NO: 456304 - DNA, 15 bp, Homo sapiens
tatatagcagtactc

SEQ ID NO: 456305 - DNA, 15 bp, Homo sapiens
atatagcagtactcc

SEQ ID NO: 456306 - DNA, 15 bp, Homo sapiens
tatagcagtactcca

SEQ ID NO: 456307 - DNA, 15 bp, Homo sapiens
atagcagtactccag

SEQ ID NO: 456308 - DNA, 15 bp, Homo sapiens
tagcagtactccaga

SEQ ID NO: 456309 - DNA, 15 bp, Homo sapiens
agcagtactccagaa

SEQ ID NO: 456310 - DNA, 15 bp, Homo sapiens
gcagtactccagaag

SEQ ID NO: 456311 - DNA, 15 bp, Homo sapiens
cagtactccagaaga

SEQ ID NO: 456312 - DNA, 15 bp, Homo sapiens
agtactccagaagat

SEQ ID NO: 456313 - DNA, 15 bp, Homo sapiens
gtactccagaagatg

SEQ ID NO: 456314 - DNA, 15 bp, Homo sapiens
tactccagaagatgt

SEQ ID NO: 456315 - DNA, 15 bp, Homo sapiens
actccagaagatgtg

SEQ ID NO: 456316 - DNA, 15 bp, Homo sapiens
ctccagaagatgtgt

SEQ ID NO: 456317 - DNA, 15 bp, Homo sapiens
tccagaagatgtgtc

SEQ ID NO: 456318 - DNA, 15 bp, Homo sapiens
ccagaagatgtgtcc

SEQ ID NO: 456319 - DNA, 15 bp, Homo sapiens
cagaagatgtgtcca

SEQ ID NO: 456320 - DNA, 15 bp, Homo sapiens
agaagatgtgtccaa

SEQ ID NO: 456321 - DNA, 15 bp, Homo sapiens
gaagatgtgtccaag

SEQ ID NO: 456322 - DNA, 15 bp, Homo sapiens
aagatgtgtccaagg

SEQ ID NO: 456323 - DNA, 15 bp, Homo sapiens
agatgtgtccaagga

SEQ ID NO: 456324 - DNA, 15 bp, Homo sapiens
gatgtgtccaaggag

SEQ ID NO: 456325 - DNA, 15 bp, Homo sapiens
atgtgtccaaggaga

SEQ ID NO: 456326 - DNA, 15 bp, Homo sapiens
tgtgtccaaggagat

SEQ ID NO: 456327 - DNA, 15 bp, Homo sapiens
gtgtccaaggagatt

SEQ ID NO: 456328 - DNA, 15 bp, Homo sapiens
tgtccaaggagattt

SEQ ID NO: 456329 - DNA, 15 bp, Homo sapiens
gtccaaggagattta

SEQ ID NO: 456330 - DNA, 15 bp, Homo sapiens
tccaaggagatttat

SEQ ID NO: 456331 - DNA, 15 bp, Homo sapiens
ccaaggagatttata

SEQ ID NO: 456332 - DNA, 15 bp, Homo sapiens
caaggagatttatag

SEQ ID NO: 456333 - DNA, 15 bp, Homo sapiens
aaggagatttatagc

SEQ ID NO: 456334 - DNA, 15 bp, Homo sapiens
aggagatttatagca

SEQ ID NO: 456335 - DNA, 15 bp, Homo sapiens
ggagatttatagcag

SEQ ID NO: 456336 - DNA, 15 bp, Homo sapiens
gagatttatagcagt

SEQ ID NO: 456337 - DNA, 15 bp, Homo sapiens
agatttatagcagta

SEQ ID NO: 456338 - DNA, 15 bp, Homo sapiens
gatttatagcagtac

SEQ ID NO: 456339 - DNA, 15 bp, Homo sapiens
atttatagcagtact

SEQ ID NO: 456340 - DNA, 15 bp, Homo sapiens
tttatagcagtactt

SEQ ID NO: 456341 - DNA, 15 bp, Homo sapiens
ttatagcagtacttt

SEQ ID NO: 456342 - DNA, 15 bp, Homo sapiens
tatagcagtactttt

SEQ ID NO: 456343 - DNA, 15 bp, Homo sapiens
atagcagtacttttc

SEQ ID NO: 456344 - DNA, 15 bp, Homo sapiens
tagcagtacttttca

SEQ ID NO: 456345 - DNA, 15 bp, Homo sapiens
agcagtacttttcat

SEQ ID NO: 456346 - DNA, 15 bp, Homo sapiens
gcagtacttttcata

SEQ ID NO: 456347 - DNA, 15 bp, Homo sapiens
cagtacttttcatag

SEQ ID NO: 456348 - DNA, 15 bp, Homo sapiens
agtacttttcatagt

SEQ ID NO: 456349 - DNA, 15 bp, Homo sapiens
gtacttttcatagta

SEQ ID NO: 456350 - DNA, 15 bp, Homo sapiens
tacttttcatagtaa

SEQ ID NO: 456351 - DNA, 15 bp, Homo sapiens
acttttcatagtaaa

SEQ ID NO: 456352 - DNA, 15 bp, Homo sapiens
cttttcatagtaaaa

SEQ ID NO: 456353 - DNA, 15 bp, Homo sapiens
ttttcatagtaaaac

SEQ ID NO: 456354 - DNA, 15 bp, Homo sapiens
tttcatagtaaaact

SEQ ID NO: 456355 - DNA, 15 bp, Homo sapiens
ttcatagtaaaactc

SEQ ID NO: 456356 - DNA, 15 bp, Homo sapiens
tcatagtaaaactca

SEQ ID NO: 456357 - DNA, 15 bp, Homo sapiens
catagtaaaactcat

SEQ ID NO: 456358 - DNA, 15 bp, Homo sapiens
atagtaaaactcatt

SEQ ID NO: 456359 - DNA, 15 bp, Homo sapiens
tagtaaaactcattc

SEQ ID NO: 456360 - DNA, 15 bp, Homo sapiens
agtaaaactcattca

SEQ ID NO: 456361 - DNA, 15 bp, Homo sapiens
gtaaaactcattcag

SEQ ID NO: 456362 - DNA, 15 bp, Homo sapiens
taaaactcattcagt

SEQ ID NO: 456363 - DNA, 15 bp, Homo sapiens
aaaactcattcagtt

SEQ ID NO: 456364 - DNA, 15 bp, Homo sapiens
aaactcattcagttt

SEQ ID NO: 456365 - DNA, 15 bp, Homo sapiens
aactcattcagtttt

SEQ ID NO: 456366 - DNA, 15 bp, Homo sapiens
actcattcagttttg

SEQ ID NO: 456367 - DNA, 15 bp, Homo sapiens
ctcattcagttttgg

SEQ ID NO: 456368 - DNA, 15 bp, Homo sapiens
tcattcagttttggc

SEQ ID NO: 456369 - DNA, 15 bp, Homo sapiens
cattcagttttggca

SEQ ID NO: 456370 - DNA, 15 bp, Homo sapiens
attcagttttggcat

SEQ ID NO: 456371 - DNA, 15 bp, Homo sapiens
ttcagttttggcata

SEQ ID NO: 456372 - DNA, 15 bp, Homo sapiens
tcagttttggcatat

SEQ ID NO: 456373 - DNA, 15 bp, Homo sapiens
cagttttggcatatt

SEQ ID NO: 456374 - DNA, 15 bp, Homo sapiens
agttttggcatattt

SEQ ID NO: 456375 - DNA, 15 bp, Homo sapiens
gttttggcatattta

SEQ ID NO: 456376 - DNA, 15 bp, Homo sapiens
ttttggcatatttat

SEQ ID NO: 456377 - DNA, 15 bp, Homo sapiens
tttggcatatttata

SEQ ID NO: 456378 - DNA, 15 bp, Homo sapiens
ttggcatatttataa

SEQ ID NO: 456379 - DNA, 15 bp, Homo sapiens
tggcatatttataaa

SEQ ID NO: 456380 - DNA, 15 bp, Homo sapiens
ggcatatttataaat

SEQ ID NO: 456381 - DNA, 15 bp, Homo sapiens
gcatatttataaata

SEQ ID NO: 456382 - DNA, 15 bp, Homo sapiens
catatttataaatat

SEQ ID NO: 456383 - DNA, 15 bp, Homo sapiens
atatttataaatata

SEQ ID NO: 456384 - DNA, 15 bp, Homo sapiens
tatttataaatataa

SEQ ID NO: 456385 - DNA, 15 bp, Homo sapiens
atttataaatataat

SEQ ID NO: 456386 - DNA, 15 bp, Homo sapiens
tttataaatataata

SEQ ID NO: 456387 - DNA, 15 bp, Homo sapiens
ttataaatataatac

SEQ ID NO: 456388 - DNA, 15 bp, Homo sapiens
tataaatataataca

SEQ ID NO: 456389 - DNA, 15 bp, Homo sapiens
ataaatataatacag

SEQ ID NO: 456390 - DNA, 15 bp, Homo sapiens
taaatataatacagc

SEQ ID NO: 456391 - DNA, 15 bp, Homo sapiens
aaatataatacagca

SEQ ID NO: 456392 - DNA, 15 bp, Homo sapiens
aatataatacagcaa

SEQ ID NO: 456393 - DNA, 15 bp, Homo sapiens
atataatacagcaac

SEQ ID NO: 456394 - DNA, 15 bp, Homo sapiens
tataatacagcaaca

SEQ ID NO: 456395 - DNA, 15 bp, Homo sapiens
ataatacagcaacaa

SEQ ID NO: 456396 - DNA, 15 bp, Homo sapiens
taatacagcaacaaa

SEQ ID NO: 456397 - DNA, 15 bp, Homo sapiens
aatacagcaacaaaa

SEQ ID NO: 456398 - DNA, 15 bp, Homo sapiens
atacagcaacaaaaa

SEQ ID NO: 456399 - DNA, 15 bp, Homo sapiens
tacagcaacaaaaat

SEQ ID NO: 456400 - DNA, 15 bp, Homo sapiens
acagcaacaaaaatc

SEQ ID NO: 456401 - DNA, 15 bp, Homo sapiens
cagcaacaaaaatca

SEQ ID NO: 456402 - DNA, 15 bp, Homo sapiens
agcaacaaaaatcaa

SEQ ID NO: 456403 - DNA, 15 bp, Homo sapiens
gcaacaaaaatcaat

SEQ ID NO: 456404 - DNA, 15 bp, Homo sapiens
caacaaaaatcaatg

SEQ ID NO: 456405 - DNA, 15 bp, Homo sapiens
aacaaaaatcaatga

SEQ ID NO: 456406 - DNA, 15 bp, Homo sapiens
acaaaaatcaatgag

SEQ ID NO: 456407 - DNA, 15 bp, Homo sapiens
caaaaatcaatgagc

SEQ ID NO: 456408 - DNA, 15 bp, Homo sapiens
aaaaatcaatgagct

SEQ ID NO: 456409 - DNA, 15 bp, Homo sapiens
aaaatcaatgagcta

SEQ ID NO: 456410 - DNA, 15 bp, Homo sapiens
aaatcaatgagctag

SEQ ID NO: 456411 - DNA, 15 bp, Homo sapiens
aatcaatgagctagt

SEQ ID NO: 456412 - DNA, 15 bp, Homo sapiens
atcaatgagctagta

SEQ ID NO: 456413 - DNA, 15 bp, Homo sapiens
tcaatgagctagtaa

SEQ ID NO: 456414 - DNA, 15 bp, Homo sapiens
caatgagctagtaat

SEQ ID NO: 456415 - DNA, 15 bp, Homo sapiens
aatgagctagtaatc

SEQ ID NO: 456416 - DNA, 15 bp, Homo sapiens
atgagctagtaatca

SEQ ID NO: 456417 - DNA, 15 bp, Homo sapiens
tgagctagtaatcag

SEQ ID NO: 456418 - DNA, 15 bp, Homo sapiens
gagctagtaatcagc

SEQ ID NO: 456419 - DNA, 15 bp, Homo sapiens
agctagtaatcagca

SEQ ID NO: 456420 - DNA, 15 bp, Homo sapiens
gctagtaatcagcat

SEQ ID NO: 456421 - DNA, 15 bp, Homo sapiens
ctagtaatcagcatc

SEQ ID NO: 456422 - DNA, 15 bp, Homo sapiens
tagtaatcagcatca

SEQ ID NO: 456423 - DNA, 15 bp, Homo sapiens
agtaatcagcatcaa

SEQ ID NO: 456424 - DNA, 15 bp, Homo sapiens
gtaatcagcatcaac

SEQ ID NO: 456425 - DNA, 15 bp, Homo sapiens
taatcagcatcaaca

SEQ ID NO: 456426 - DNA, 15 bp, Homo sapiens
aatcagcatcaacat

SEQ ID NO: 456427 - DNA, 15 bp, Homo sapiens
atcagcatcaacatg

SEQ ID NO: 456428 - DNA, 15 bp, Homo sapiens
tcagcatcaacatga

SEQ ID NO: 456429 - DNA, 15 bp, Homo sapiens
cagcatcaacatgat

SEQ ID NO: 456430 - DNA, 15 bp, Homo sapiens
agcatcaacatgatt

SEQ ID NO: 456431 - DNA, 15 bp, Homo sapiens
gcatcaacatgattt

SEQ ID NO: 456432 - DNA, 15 bp, Homo sapiens
catcaacatgattta

SEQ ID NO: 456433 - DNA, 15 bp, Homo sapiens
atcaacatgatttaa

SEQ ID NO: 456434 - DNA, 15 bp, Homo sapiens
tcaacatgatttaat

SEQ ID NO: 456435 - DNA, 15 bp, Homo sapiens
caacatgatttaatc

SEQ ID NO: 456436 - DNA, 15 bp, Homo sapiens
aacatgatttaatct

SEQ ID NO: 456437 - DNA, 15 bp, Homo sapiens
acatgatttaatctt

SEQ ID NO: 456438 - DNA, 15 bp, Homo sapiens
catgatttaatctta

SEQ ID NO: 456439 - DNA, 15 bp, Homo sapiens
atgatttaatcttag

SEQ ID NO: 456440 - DNA, 15 bp, Homo sapiens
tgatttaatcttaga

SEQ ID NO: 456441 - DNA, 15 bp, Homo sapiens
gatttaatcttagaa

SEQ ID NO: 456442 - DNA, 15 bp, Homo sapiens
atttaatcttagaac

SEQ ID NO: 456443 - DNA, 15 bp, Homo sapiens
tttaatcttagaact

SEQ ID NO: 456444 - DNA, 15 bp, Homo sapiens
ttaatcttagaacta

SEQ ID NO: 456445 - DNA, 15 bp, Homo sapiens
taatcttagaactat

SEQ ID NO: 456446 - DNA, 15 bp, Homo sapiens
aatcttagaactata

SEQ ID NO: 456447 - DNA, 15 bp, Homo sapiens
atcttagaactataa

SEQ ID NO: 456448 - DNA, 15 bp, Homo sapiens
tcttagaactataaa

SEQ ID NO: 456449 - DNA, 15 bp, Homo sapiens
cttagaactataaaa

SEQ ID NO: 456450 - DNA, 15 bp, Homo sapiens
ttagaactataaaat

SEQ ID NO: 456451 - DNA, 15 bp, Homo sapiens
tagaactataaaatt

SEQ ID NO: 456452 - DNA, 15 bp, Homo sapiens
agaactataaaatta

SEQ ID NO: 456453 - DNA, 15 bp, Homo sapiens
gaactataaaattaa

SEQ ID NO: 456454 - DNA, 15 bp, Homo sapiens
aactataaaattaaa

SEQ ID NO: 456455 - DNA, 15 bp, Homo sapiens
actataaaattaaat

SEQ ID NO: 456456 - DNA, 15 bp, Homo sapiens
ctataaaattaaatg

SEQ ID NO: 456457 - DNA, 15 bp, Homo sapiens
tataaaattaaatga

SEQ ID NO: 456458 - DNA, 15 bp, Homo sapiens
ataaaattaaatgaa

SEQ ID NO: 456459 - DNA, 15 bp, Homo sapiens
taaaattaaatgaaa

SEQ ID NO: 456460 - DNA, 15 bp, Homo sapiens
aaaattaaatgaaaa

SEQ ID NO: 456461 - DNA, 15 bp, Homo sapiens
aaattaaatgaaaaa

SEQ ID NO: 456462 - DNA, 15 bp, Homo sapiens
aattaaatgaaaaaa

SEQ ID NO: 456463 - DNA, 15 bp, Homo sapiens
attaaatgaaaaaat

SEQ ID NO: 456464 - DNA, 15 bp, Homo sapiens
ttaaatgaaaaaatt

SEQ ID NO: 456465 - DNA, 15 bp, Homo sapiens
taaatgaaaaaatta

SEQ ID NO: 456466 - DNA, 15 bp, Homo sapiens
aaatgaaaaaattaa

SEQ ID NO: 456467 - DNA, 15 bp, Homo sapiens
aatgaaaaaattaaa

SEQ ID NO: 456468 - DNA, 15 bp, Homo sapiens
atgaaaaaattaaat

SEQ ID NO: 456469 - DNA, 15 bp, Homo sapiens
tgaaaaaattaaatg

SEQ ID NO: 456470 - DNA, 15 bp, Homo sapiens
gaaaaaattaaatgg

SEQ ID NO: 456471 - DNA, 15 bp, Homo sapiens
aaaaaattaaatggc

SEQ ID NO: 456472 - DNA, 15 bp, Homo sapiens
aaaaattaaatggca

SEQ ID NO: 456473 - DNA, 15 bp, Homo sapiens
aaaattaaatggcag

SEQ ID NO: 456474 - DNA, 15 bp, Homo sapiens
aaattaaatggcaga

SEQ ID NO: 456475 - DNA, 15 bp, Homo sapiens
aattaaatggcagaa

SEQ ID NO: 456476 - DNA, 15 bp, Homo sapiens
attaaatggcagaaa

SEQ ID NO: 456477 - DNA, 15 bp, Homo sapiens
ttaaatggcagaaaa

SEQ ID NO: 456478 - DNA, 15 bp, Homo sapiens
taaatggcagaaaaa

SEQ ID NO: 456479 - DNA, 15 bp, Homo sapiens
aaatggcagaaaaaa

SEQ ID NO: 456480 - DNA, 15 bp, Homo sapiens
aatggcagaaaaaaa

SEQ ID NO: 456481 - DNA, 15 bp, Homo sapiens
atggcagaaaaaaaa

SEQ ID NO: 456482 - DNA, 15 bp, Homo sapiens
tggcagaaaaaaaat

SEQ ID NO: 456483 - DNA, 15 bp, Homo sapiens
ggcagaaaaaaaatg

SEQ ID NO: 456484 - DNA, 15 bp, Homo sapiens
gcagaaaaaaaatgt

SEQ ID NO: 456485 - DNA, 15 bp, Homo sapiens
cagaaaaaaaatgtg

SEQ ID NO: 456486 - DNA, 15 bp, Homo sapiens
agaaaaaaaatgtgt

SEQ ID NO: 456487 - DNA, 15 bp, Homo sapiens
gaaaaaaaatgtgta

SEQ ID NO: 456488 - DNA, 15 bp, Homo sapiens
aaaaaaaatgtgtac

SEQ ID NO: 456489 - DNA, 15 bp, Homo sapiens
aaaaaaatgtgtacc

SEQ ID NO: 456490 - DNA, 15 bp, Homo sapiens
aaaaaatgtgtacca

SEQ ID NO: 456491 - DNA, 15 bp, Homo sapiens
aaaaatgtgtaccac

SEQ ID NO: 456492 - DNA, 15 bp, Homo sapiens
aaaatgtgtaccact

SEQ ID NO: 456493 - DNA, 15 bp, Homo sapiens
aaatgtgtaccactc

SEQ ID NO: 456494 - DNA, 15 bp, Homo sapiens
aatgtgtaccactct

SEQ ID NO: 456495 - DNA, 15 bp, Homo sapiens
atgtgtaccactctg

SEQ ID NO: 456496 - DNA, 15 bp, Homo sapiens
tgtgtaccactctgt

SEQ ID NO: 456497 - DNA, 15 bp, Homo sapiens
gtgtaccactctgtt

SEQ ID NO: 456498 - DNA, 15 bp, Homo sapiens
tgtaccactctgttc

SEQ ID NO: 456499 - DNA, 15 bp, Homo sapiens
gtaccactctgttcc

SEQ ID NO: 456500 - DNA, 15 bp, Homo sapiens
taccactctgttcca

SEQ ID NO: 456501 - DNA, 15 bp, Homo sapiens
accactctgttccat

SEQ ID NO: 456502 - DNA, 15 bp, Homo sapiens
ccactctgttccatt

SEQ ID NO: 456503 - DNA, 15 bp, Homo sapiens
cactctgttccattt

SEQ ID NO: 456504 - DNA, 15 bp, Homo sapiens
actctgttccattta

SEQ ID NO: 456505 - DNA, 15 bp, Homo sapiens
ctctgttccatttat

SEQ ID NO: 456506 - DNA, 15 bp, Homo sapiens
tctgttccatttata

SEQ ID NO: 456507 - DNA, 15 bp, Homo sapiens
ctgttccatttatat

SEQ ID NO: 456508 - DNA, 15 bp, Homo sapiens
tgttccatttatatg

SEQ ID NO: 456509 - DNA, 15 bp, Homo sapiens
gttccatttatatgt

SEQ ID NO: 456510 - DNA, 15 bp, Homo sapiens
ttccatttatatgta

SEQ ID NO: 456511 - DNA, 15 bp, Homo sapiens
tccatttatatgtag

SEQ ID NO: 456512 - DNA, 15 bp, Homo sapiens
ccatttatatgtagt

SEQ ID NO: 456513 - DNA, 15 bp, Homo sapiens
catttatatgtagtt

SEQ ID NO: 456514 - DNA, 15 bp, Homo sapiens
atttatatgtagttc

SEQ ID NO: 456515 - DNA, 15 bp, Homo sapiens
tttatatgtagttca

SEQ ID NO: 456516 - DNA, 15 bp, Homo sapiens
ttatatgtagttcaa

SEQ ID NO: 456517 - DNA, 15 bp, Homo sapiens
tatatgtagttcaaa

SEQ ID NO: 456518 - DNA, 15 bp, Homo sapiens
atatgtagttcaaac

SEQ ID NO: 456519 - DNA, 15 bp, Homo sapiens
tatgtagttcaaacc

SEQ ID NO: 456520 - DNA, 15 bp, Homo sapiens
atgtagttcaaaccc

SEQ ID NO: 456521 - DNA, 15 bp, Homo sapiens
tgtagttcaaaccca

SEQ ID NO: 456522 - DNA, 15 bp, Homo sapiens
gtagttcaaacccat

SEQ ID NO: 456523 - DNA, 15 bp, Homo sapiens
tagttcaaacccatg

SEQ ID NO: 456524 - DNA, 15 bp, Homo sapiens
agttcaaacccatgc

SEQ ID NO: 456525 - DNA, 15 bp, Homo sapiens
gttcaaacccatgca

SEQ ID NO: 456526 - DNA, 15 bp, Homo sapiens
ttcaaacccatgcaa

SEQ ID NO: 456527 - DNA, 15 bp, Homo sapiens
tcaaacccatgcaaa

SEQ ID NO: 456528 - DNA, 15 bp, Homo sapiens
caaacccatgcaaaa

SEQ ID NO: 456529 - DNA, 15 bp, Homo sapiens
aaacccatgcaaaac

SEQ ID NO: 456530 - DNA, 15 bp, Homo sapiens
aacccatgcaaaact

SEQ ID NO: 456531 - DNA, 15 bp, Homo sapiens
acccatgcaaaacta

SEQ ID NO: 456532 - DNA, 15 bp, Homo sapiens
cccatgcaaaactaa

SEQ ID NO: 456533 - DNA, 15 bp, Homo sapiens
ccatgcaaaactaat

SEQ ID NO: 456534 - DNA, 15 bp, Homo sapiens
catgcaaaactaatg

SEQ ID NO: 456535 - DNA, 15 bp, Homo sapiens
atgcaaaactaatgc

SEQ ID NO: 456536 - DNA, 15 bp, Homo sapiens
tgcaaaactaatgct

SEQ ID NO: 456537 - DNA, 15 bp, Homo sapiens
gcaaaactaatgcta

SEQ ID NO: 456538 - DNA, 15 bp, Homo sapiens
caaaactaatgctat

SEQ ID NO: 456539 - DNA, 15 bp, Homo sapiens
aaaactaatgctata

SEQ ID NO: 456540 - DNA, 15 bp, Homo sapiens
aaactaatgctatat

SEQ ID NO: 456541 - DNA, 15 bp, Homo sapiens
aactaatgctatata

SEQ ID NO: 456542 - DNA, 15 bp, Homo sapiens
actaatgctatatac

SEQ ID NO: 456543 - DNA, 15 bp, Homo sapiens
ctaatgctatataca

SEQ ID NO: 456544 - DNA, 15 bp, Homo sapiens
taatgctatatacac

SEQ ID NO: 456545 - DNA, 15 bp, Homo sapiens
aatgctatatacact

SEQ ID NO: 456546 - DNA, 15 bp, Homo sapiens
atgctatatacactt

SEQ ID NO: 456547 - DNA, 15 bp, Homo sapiens
tgctatatacacttt

SEQ ID NO: 456548 - DNA, 15 bp, Homo sapiens
gctatatacactttt

SEQ ID NO: 456549 - DNA, 15 bp, Homo sapiens
ctatatacactttta

SEQ ID NO: 456550 - DNA, 15 bp, Homo sapiens
tatatacacttttaa

SEQ ID NO: 456551 - DNA, 15 bp, Homo sapiens
atatacacttttaaa

SEQ ID NO: 456552 - DNA, 15 bp, Homo sapiens
tatacacttttaaaa

SEQ ID NO: 456553 - DNA, 15 bp, Homo sapiens
atacacttttaaaaa

SEQ ID NO: 456554 - DNA, 15 bp, Homo sapiens
tacacttttaaaaac

SEQ ID NO: 456555 - DNA, 15 bp, Homo sapiens
acacttttaaaaact

SEQ ID NO: 456556 - DNA, 15 bp, Homo sapiens
cacttttaaaaactg

SEQ ID NO: 456557 - DNA, 15 bp, Homo sapiens
acttttaaaaactga

SEQ ID NO: 456558 - DNA, 15 bp, Homo sapiens
cttttaaaaactgaa

SEQ ID NO: 456559 - DNA, 15 bp, Homo sapiens
ttttaaaaactgaaa

SEQ ID NO: 456560 - DNA, 15 bp, Homo sapiens
tttaaaaactgaaag

SEQ ID NO: 456561 - DNA, 15 bp, Homo sapiens
ttaaaaactgaaagt

SEQ ID NO: 456562 - DNA, 15 bp, Homo sapiens
taaaaactgaaagtg

SEQ ID NO: 456563 - DNA, 15 bp, Homo sapiens
aaaaactgaaagtga

SEQ ID NO: 456564 - DNA, 15 bp, Homo sapiens
aaaactgaaagtgaa

SEQ ID NO: 456565 - DNA, 15 bp, Homo sapiens
aaactgaaagtgaaa

SEQ ID NO: 456566 - DNA, 15 bp, Homo sapiens
aactgaaagtgaaat

SEQ ID NO: 456567 - DNA, 15 bp, Homo sapiens
actgaaagtgaaata

SEQ ID NO: 456568 - DNA, 15 bp, Homo sapiens
ctgaaagtgaaatac

SEQ ID NO: 456569 - DNA, 15 bp, Homo sapiens
tgaaagtgaaataca

SEQ ID NO: 456570 - DNA, 15 bp, Homo sapiens
gaaagtgaaatacaa

SEQ ID NO: 456571 - DNA, 15 bp, Homo sapiens
aaagtgaaatacaaa

SEQ ID NO: 456572 - DNA, 15 bp, Homo sapiens
aagtgaaatacaaag

SEQ ID NO: 456573 - DNA, 15 bp, Homo sapiens
agtgaaatacaaagg

SEQ ID NO: 456574 - DNA, 15 bp, Homo sapiens
gtgaaatacaaaggt

SEQ ID NO: 456575 - DNA, 15 bp, Homo sapiens
tgaaatacaaaggtt

SEQ ID NO: 456576 - DNA, 15 bp, Homo sapiens
gaaatacaaaggtta

SEQ ID NO: 456577 - DNA, 15 bp, Homo sapiens
aaatacaaaggttaa

SEQ ID NO: 456578 - DNA, 15 bp, Homo sapiens
aatacaaaggttaat

SEQ ID NO: 456579 - DNA, 15 bp, Homo sapiens
atacaaaggttaatg

SEQ ID NO: 456580 - DNA, 15 bp, Homo sapiens
tacaaaggttaatgg

SEQ ID NO: 456581 - DNA, 15 bp, Homo sapiens
acaaaggttaatggt

SEQ ID NO: 456582 - DNA, 15 bp, Homo sapiens
caaaggttaatggtt

SEQ ID NO: 456583 - DNA, 15 bp, Homo sapiens
aaaggttaatggtta

SEQ ID NO: 456584 - DNA, 15 bp, Homo sapiens
aaggttaatggttac

SEQ ID NO: 456585 - DNA, 15 bp, Homo sapiens
aggttaatggttacc

SEQ ID NO: 456586 - DNA, 15 bp, Homo sapiens
ggttaatggttaccc

SEQ ID NO: 456587 - DNA, 15 bp, Homo sapiens
gttaatggttacccc

SEQ ID NO: 456588 - DNA, 15 bp, Homo sapiens
ttaatggttacccca

SEQ ID NO: 456589 - DNA, 15 bp, Homo sapiens
taatggttaccccat

SEQ ID NO: 456590 - DNA, 15 bp, Homo sapiens
aatggttaccccata

SEQ ID NO: 456591 - DNA, 15 bp, Homo sapiens
atggttaccccataa

SEQ ID NO: 456592 - DNA, 15 bp, Homo sapiens
tggttaccccataat

SEQ ID NO: 456593 - DNA, 15 bp, Homo sapiens
ggttaccccataatt

SEQ ID NO: 456594 - DNA, 15 bp, Homo sapiens
gttaccccataattg

SEQ ID NO: 456595 - DNA, 15 bp, Homo sapiens
ttaccccataattgt

SEQ ID NO: 456596 - DNA, 15 bp, Homo sapiens
taccccataattgta

SEQ ID NO: 456597 - DNA, 15 bp, Homo sapiens
accccataattgtaa

SEQ ID NO: 456598 - DNA, 15 bp, Homo sapiens
ccccataattgtaag

SEQ ID NO: 456599 - DNA, 15 bp, Homo sapiens
cccataattgtaaga

SEQ ID NO: 456600 - DNA, 15 bp, Homo sapiens
ccataattgtaagag

SEQ ID NO: 456601 - DNA, 15 bp, Homo sapiens
cataattgtaagagg

SEQ ID NO: 456602 - DNA, 15 bp, Homo sapiens
ataattgtaagagga

SEQ ID NO: 456603 - DNA, 15 bp, Homo sapiens
taattgtaagaggat

SEQ ID NO: 456604 - DNA, 15 bp, Homo sapiens
aattgtaagaggatg

SEQ ID NO: 456605 - DNA, 15 bp, Homo sapiens
attgtaagaggatgt

SEQ ID NO: 456606 - DNA, 15 bp, Homo sapiens
ttgtaagaggatgta

SEQ ID NO: 456607 - DNA, 15 bp, Homo sapiens
tgtaagaggatgtaa

SEQ ID NO: 456608 - DNA, 15 bp, Homo sapiens
gtaagaggatgtaat

SEQ ID NO: 456609 - DNA, 15 bp, Homo sapiens
taagaggatgtaatt

SEQ ID NO: 456610 - DNA, 15 bp, Homo sapiens
aagaggatgtaatta

SEQ ID NO: 456611 - DNA, 15 bp, Homo sapiens
agaggatgtaattag

SEQ ID NO: 456612 - DNA, 15 bp, Homo sapiens
gaggatgtaattagg

SEQ ID NO: 456613 - DNA, 15 bp, Homo sapiens
aggatgtaattaggc

SEQ ID NO: 456614 - DNA, 15 bp, Homo sapiens
ggatgtaattaggca

SEQ ID NO: 456615 - DNA, 15 bp, Homo sapiens
gatgtaattaggcag

SEQ ID NO: 456616 - DNA, 15 bp, Homo sapiens
atgtaattaggcagg

SEQ ID NO: 456617 - DNA, 15 bp, Homo sapiens
tgtaattaggcagga

SEQ ID NO: 456618 - DNA, 15 bp, Homo sapiens
gtaattaggcaggat

SEQ ID NO: 456619 - DNA, 15 bp, Homo sapiens
taattaggcaggatt

SEQ ID NO: 456620 - DNA, 15 bp, Homo sapiens
aattaggcaggattc

SEQ ID NO: 456621 - DNA, 15 bp, Homo sapiens
attaggcaggattca

SEQ ID NO: 456622 - DNA, 15 bp, Homo sapiens
ttaggcaggattcaa

SEQ ID NO: 456623 - DNA, 15 bp, Homo sapiens
taggcaggattcaag

SEQ ID NO: 456624 - DNA, 15 bp, Homo sapiens
aggcaggattcaagg

SEQ ID NO: 456625 - DNA, 15 bp, Homo sapiens
ggcaggattcaagga

SEQ ID NO: 456626 - DNA, 15 bp, Homo sapiens
gcaggattcaaggag

SEQ ID NO: 456627 - DNA, 15 bp, Homo sapiens
caggattcaaggagc

SEQ ID NO: 456628 - DNA, 15 bp, Homo sapiens
aggattcaaggagct

SEQ ID NO: 456629 - DNA, 15 bp, Homo sapiens
ggattcaaggagctt

SEQ ID NO: 456630 - DNA, 15 bp, Homo sapiens
gattcaaggagcttc

SEQ ID NO: 456631 - DNA, 15 bp, Homo sapiens
attcaaggagcttcc

SEQ ID NO: 456632 - DNA, 15 bp, Homo sapiens
ttcaaggagcttcca

SEQ ID NO: 456633 - DNA, 15 bp, Homo sapiens
tcaaggagcttccaa

SEQ ID NO: 456634 - DNA, 15 bp, Homo sapiens
caaggagcttccaag

SEQ ID NO: 456635 - DNA, 15 bp, Homo sapiens
aaggagcttccaaga

SEQ ID NO: 456636 - DNA, 15 bp, Homo sapiens
aggagcttccaagat

SEQ ID NO: 456637 - DNA, 15 bp, Homo sapiens
ggagcttccaagata

SEQ ID NO: 456638 - DNA, 15 bp, Homo sapiens
gagcttccaagatag

SEQ ID NO: 456639 - DNA, 15 bp, Homo sapiens
agcttccaagatagt

SEQ ID NO: 456640 - DNA, 15 bp, Homo sapiens
gcttccaagatagtg

SEQ ID NO: 456641 - DNA, 15 bp, Homo sapiens
cttccaagatagtgg

SEQ ID NO: 456642 - DNA, 15 bp, Homo sapiens
ttccaagatagtggt

SEQ ID NO: 456643 - DNA, 15 bp, Homo sapiens
tccaagatagtggta

SEQ ID NO: 456644 - DNA, 15 bp, Homo sapiens
ccaagatagtggtaa

SEQ ID NO: 456645 - DNA, 15 bp, Homo sapiens
caagatagtggtaac

SEQ ID NO: 456646 - DNA, 15 bp, Homo sapiens
aagatagtggtaaca

SEQ ID NO: 456647 - DNA, 15 bp, Homo sapiens
agatagtggtaacat

SEQ ID NO: 456648 - DNA, 15 bp, Homo sapiens
gatagtggtaacatt

SEQ ID NO: 456649 - DNA, 15 bp, Homo sapiens
atagtggtaacattc

SEQ ID NO: 456650 - DNA, 15 bp, Homo sapiens
tagtggtaacattct

SEQ ID NO: 456651 - DNA, 15 bp, Homo sapiens
agtggtaacattctg

SEQ ID NO: 456652 - DNA, 15 bp, Homo sapiens
gtggtaacattctgt

SEQ ID NO: 456653 - DNA, 15 bp, Homo sapiens
tggtaacattctgtt

SEQ ID NO: 456654 - DNA, 15 bp, Homo sapiens
ggtaacattctgttt

SEQ ID NO: 456655 - DNA, 15 bp, Homo sapiens
gtaacattctgtttt

SEQ ID NO: 456656 - DNA, 15 bp, Homo sapiens
taacattctgttttt

SEQ ID NO: 456657 - DNA, 15 bp, Homo sapiens
aacattctgtttttt

SEQ ID NO: 456658 - DNA, 15 bp, Homo sapiens
acattctgttttttt

SEQ ID NO: 456659 - DNA, 15 bp, Homo sapiens
cattctgtttttttc

SEQ ID NO: 456660 - DNA, 15 bp, Homo sapiens
attctgtttttttca

SEQ ID NO: 456661 - DNA, 15 bp, Homo sapiens
ttctgtttttttcag

SEQ ID NO: 456662 - DNA, 15 bp, Homo sapiens
tctgtttttttcagc

SEQ ID NO: 456663 - DNA, 15 bp, Homo sapiens
ctgtttttttcagct

SEQ ID NO: 456664 - DNA, 15 bp, Homo sapiens
tgtttttttcagctg

SEQ ID NO: 456665 - DNA, 15 bp, Homo sapiens
gtttttttcagctgt

SEQ ID NO: 456666 - DNA, 15 bp, Homo sapiens
tttttttcagctgtg

SEQ ID NO: 456667 - DNA, 15 bp, Homo sapiens
ttttttcagctgtgt

SEQ ID NO: 456668 - DNA, 15 bp, Homo sapiens
tttttcagctgtgtg

SEQ ID NO: 456669 - DNA, 15 bp, Homo sapiens
ttttcagctgtgtga

SEQ ID NO: 456670 - DNA, 15 bp, Homo sapiens
tttcagctgtgtgat

SEQ ID NO: 456671 - DNA, 15 bp, Homo sapiens
ttcagctgtgtgatg

SEQ ID NO: 456672 - DNA, 15 bp, Homo sapiens
tcagctgtgtgatgg

SEQ ID NO: 456673 - DNA, 15 bp, Homo sapiens
cagctgtgtgatgga

SEQ ID NO: 456674 - DNA, 15 bp, Homo sapiens
agctgtgtgatggac

SEQ ID NO: 456675 - DNA, 15 bp, Homo sapiens
gctgtgtgatggact

SEQ ID NO: 456676 - DNA, 15 bp, Homo sapiens
ctgtgtgatggacta

SEQ ID NO: 456677 - DNA, 15 bp, Homo sapiens
tgtgtgatggactaa

SEQ ID NO: 456678 - DNA, 15 bp, Homo sapiens
gtgtgatggactaat

SEQ ID NO: 456679 - DNA, 15 bp, Homo sapiens
tgtgatggactaatg

SEQ ID NO: 456680 - DNA, 15 bp, Homo sapiens
gtgatggactaatgg

SEQ ID NO: 456681 - DNA, 15 bp, Homo sapiens
tgatggactaatggg

SEQ ID NO: 456682 - DNA, 15 bp, Homo sapiens
gatggactaatgggt

SEQ ID NO: 456683 - DNA, 15 bp, Homo sapiens
atggactaatgggta

SEQ ID NO: 456684 - DNA, 15 bp, Homo sapiens
tggactaatgggtat

SEQ ID NO: 456685 - DNA, 15 bp, Homo sapiens
ggactaatgggtatt

SEQ ID NO: 456686 - DNA, 15 bp, Homo sapiens
gactaatgggtattt

SEQ ID NO: 456687 - DNA, 15 bp, Homo sapiens
actaatgggtatttg

SEQ ID NO: 456688 - DNA, 15 bp, Homo sapiens
ctaatgggtatttgt

SEQ ID NO: 456689 - DNA, 15 bp, Homo sapiens
taatgggtatttgtt

SEQ ID NO: 456690 - DNA, 15 bp, Homo sapiens
aatgggtatttgttc

SEQ ID NO: 456691 - DNA, 15 bp, Homo sapiens
atgggtatttgttct

SEQ ID NO: 456692 - DNA, 15 bp, Homo sapiens
tgggtatttgttcta

SEQ ID NO: 456693 - DNA, 15 bp, Homo sapiens
gggtatttgttctat

SEQ ID NO: 456694 - DNA, 15 bp, Homo sapiens
ggtatttgttctatt

SEQ ID NO: 456695 - DNA, 15 bp, Homo sapiens
gtatttgttctatta

SEQ ID NO: 456696 - DNA, 15 bp, Homo sapiens
tatttgttctattat

SEQ ID NO: 456697 - DNA, 15 bp, Homo sapiens
atttgttctattatt

SEQ ID NO: 456698 - DNA, 15 bp, Homo sapiens
tttgttctattattt

SEQ ID NO: 456699 - DNA, 15 bp, Homo sapiens
ttgttctattatttt

SEQ ID NO: 456700 - DNA, 15 bp, Homo sapiens
tgttctattattttc

SEQ ID NO: 456701 - DNA, 15 bp, Homo sapiens
gttctattattttct

SEQ ID NO: 456702 - DNA, 15 bp, Homo sapiens
ttctattattttctt

SEQ ID NO: 456703 - DNA, 15 bp, Homo sapiens
tctattattttcttt

SEQ ID NO: 456704 - DNA, 15 bp, Homo sapiens
ctattattttctttt

SEQ ID NO: 456705 - DNA, 15 bp, Homo sapiens
tattattttctttta

SEQ ID NO: 456706 - DNA, 15 bp, Homo sapiens
attattttcttttag

SEQ ID NO: 456707 - DNA, 15 bp, Homo sapiens
ttattttcttttaga

SEQ ID NO: 456708 - DNA, 15 bp, Homo sapiens
tattttcttttagac

SEQ ID NO: 456709 - DNA, 15 bp, Homo sapiens
attttcttttagacc

SEQ ID NO: 456710 - DNA, 15 bp, Homo sapiens
ttttcttttagacca

SEQ ID NO: 456711 - DNA, 15 bp, Homo sapiens
tttcttttagaccac

SEQ ID NO: 456712 - DNA, 15 bp, Homo sapiens
ttcttttagaccaca

SEQ ID NO: 456713 - DNA, 15 bp, Homo sapiens
tcttttagaccacac

SEQ ID NO: 456714 - DNA, 15 bp, Homo sapiens
cttttagaccacaca

SEQ ID NO: 456715 - DNA, 15 bp, Homo sapiens
ttttagaccacacat

SEQ ID NO: 456716 - DNA, 15 bp, Homo sapiens
tttagaccacacata

SEQ ID NO: 456717 - DNA, 15 bp, Homo sapiens
ttagaccacacatat

SEQ ID NO: 456718 - DNA, 15 bp, Homo sapiens
tagaccacacatatg

SEQ ID NO: 456719 - DNA, 15 bp, Homo sapiens
agaccacacatatgt

SEQ ID NO: 456720 - DNA, 15 bp, Homo sapiens
gaccacacatatgta

SEQ ID NO: 456721 - DNA, 15 bp, Homo sapiens
accacacatatgtat

SEQ ID NO: 456722 - DNA, 15 bp, Homo sapiens
ccacacatatgtatt

SEQ ID NO: 456723 - DNA, 15 bp, Homo sapiens
cacacatatgtattt

SEQ ID NO: 456724 - DNA, 15 bp, Homo sapiens
acacatatgtatttt

SEQ ID NO: 456725 - DNA, 15 bp, Homo sapiens
cacatatgtattttc

SEQ ID NO: 456726 - DNA, 15 bp, Homo sapiens
acatatgtattttct

SEQ ID NO: 456727 - DNA, 15 bp, Homo sapiens
catatgtattttctg

SEQ ID NO: 456728 - DNA, 15 bp, Homo sapiens
atatgtattttctgt

SEQ ID NO: 456729 - DNA, 15 bp, Homo sapiens
tatgtattttctgtt

SEQ ID NO: 456730 - DNA, 15 bp, Homo sapiens
atgtattttctgttt

SEQ ID NO: 456731 - DNA, 15 bp, Homo sapiens
tgtattttctgtttt

SEQ ID NO: 456732 - DNA, 15 bp, Homo sapiens
gtattttctgttttc

SEQ ID NO: 456733 - DNA, 15 bp, Homo sapiens
tattttctgttttcc

SEQ ID NO: 456734 - DNA, 15 bp, Homo sapiens
attttctgttttcct

SEQ ID NO: 456735 - DNA, 15 bp, Homo sapiens
ttttctgttttcctt

SEQ ID NO: 456736 - DNA, 15 bp, Homo sapiens
tttctgttttccttt

SEQ ID NO: 456737 - DNA, 15 bp, Homo sapiens
ttctgttttcctttg

SEQ ID NO: 456738 - DNA, 15 bp, Homo sapiens
tctgttttcctttgt

SEQ ID NO: 456739 - DNA, 15 bp, Homo sapiens
ctgttttcctttgta

SEQ ID NO: 456740 - DNA, 15 bp, Homo sapiens
tgttttcctttgtat

SEQ ID NO: 456741 - DNA, 15 bp, Homo sapiens
gttttcctttgtatt

SEQ ID NO: 456742 - DNA, 15 bp, Homo sapiens
ttcctttgtattttg

SEQ ID NO: 456743 - DNA, 15 bp, Homo sapiens
tcctttgtattttga

SEQ ID NO: 456744 - DNA, 15 bp, Homo sapiens
cctttgtattttgat

SEQ ID NO: 456745 - DNA, 15 bp, Homo sapiens
ctttgtattttgatt

SEQ ID NO: 456746 - DNA, 15 bp, Homo sapiens
tttgtattttgattt

SEQ ID NO: 456747 - DNA, 15 bp, Homo sapiens
ttgtattttgatttt

SEQ ID NO: 456748 - DNA, 15 bp, Homo sapiens
tgtattttgattttg

SEQ ID NO: 456749 - DNA, 15 bp, Homo sapiens
gtattttgattttga

SEQ ID NO: 456750 - DNA, 15 bp, Homo sapiens
tattttgattttgaa

SEQ ID NO: 456751 - DNA, 15 bp, Homo sapiens
attttgattttgaaa

SEQ ID NO: 456752 - DNA, 15 bp, Homo sapiens
ttttgattttgaaac

SEQ ID NO: 456753 - DNA, 15 bp, Homo sapiens
tttgattttgaaact

SEQ ID NO: 456754 - DNA, 15 bp, Homo sapiens
ttgattttgaaactt

SEQ ID NO: 456755 - DNA, 15 bp, Homo sapiens
tgattttgaaacttt

SEQ ID NO: 456756 - DNA, 15 bp, Homo sapiens
gattttgaaacttta

SEQ ID NO: 456757 - DNA, 15 bp, Homo sapiens
attttgaaactttat

SEQ ID NO: 456758 - DNA, 15 bp, Homo sapiens
ttttgaaactttatg

SEQ ID NO: 456759 - DNA, 15 bp, Homo sapiens
tttgaaactttatgt

SEQ ID NO: 456760 - DNA, 15 bp, Homo sapiens
ttgaaactttatgtg

SEQ ID NO: 456761 - DNA, 15 bp, Homo sapiens
tgaaactttatgtga

SEQ ID NO: 456762 - DNA, 15 bp, Homo sapiens
gaaactttatgtgat

SEQ ID NO: 456763 - DNA, 15 bp, Homo sapiens
aaactttatgtgata

SEQ ID NO: 456764 - DNA, 15 bp, Homo sapiens
aactttatgtgatag

SEQ ID NO: 456765 - DNA, 15 bp, Homo sapiens
actttatgtgatagg

SEQ ID NO: 456766 - DNA, 15 bp, Homo sapiens
ctttatgtgataggt

SEQ ID NO: 456767 - DNA, 15 bp, Homo sapiens
tttatgtgataggta

SEQ ID NO: 456768 - DNA, 15 bp, Homo sapiens
ttatgtgataggtaa

SEQ ID NO: 456769 - DNA, 15 bp, Homo sapiens
tatgtgataggtaat

SEQ ID NO: 456770 - DNA, 15 bp, Homo sapiens
atgtgataggtaata

SEQ ID NO: 456771 - DNA, 15 bp, Homo sapiens
tgtgataggtaatag

SEQ ID NO: 456772 - DNA, 15 bp, Homo sapiens
gtgataggtaatagc

SEQ ID NO: 456773 - DNA, 15 bp, Homo sapiens
tgataggtaatagca

SEQ ID NO: 456774 - DNA, 15 bp, Homo sapiens
gataggtaatagcag

SEQ ID NO: 456775 - DNA, 15 bp, Homo sapiens
ataggtaatagcaga

SEQ ID NO: 456776 - DNA, 15 bp, Homo sapiens
taggtaatagcagaa

SEQ ID NO: 456777 - DNA, 15 bp, Homo sapiens
aggtaatagcagaaa

SEQ ID NO: 456778 - DNA, 15 bp, Homo sapiens
ggtaatagcagaaaa

SEQ ID NO: 456779 - DNA, 15 bp, Homo sapiens
gtaatagcagaaaag

SEQ ID NO: 456780 - DNA, 15 bp, Homo sapiens
taatagcagaaaagc

SEQ ID NO: 456781 - DNA, 15 bp, Homo sapiens
aatagcagaaaagca

SEQ ID NO: 456782 - DNA, 15 bp, Homo sapiens
atagcagaaaagcaa

SEQ ID NO: 456783 - DNA, 15 bp, Homo sapiens
tagcagaaaagcaaa

SEQ ID NO: 456784 - DNA, 15 bp, Homo sapiens
agcagaaaagcaaaa

SEQ ID NO: 456785 - DNA, 15 bp, Homo sapiens
gcagaaaagcaaaag

SEQ ID NO: 456786 - DNA, 15 bp, Homo sapiens
cagaaaagcaaaagg

SEQ ID NO: 456787 - DNA, 15 bp, Homo sapiens
agaaaagcaaaaggg

SEQ ID NO: 456788 - DNA, 15 bp, Homo sapiens
gaaaagcaaaaggga

SEQ ID NO: 456789 - DNA, 15 bp, Homo sapiens
aaaagcaaaagggaa

SEQ ID NO: 456790 - DNA, 15 bp, Homo sapiens
aaagcaaaagggaag

SEQ ID NO: 456791 - DNA, 15 bp, Homo sapiens
aagcaaaagggaagt

SEQ ID NO: 456792 - DNA, 15 bp, Homo sapiens
agcaaaagggaagta

SEQ ID NO: 456793 - DNA, 15 bp, Homo sapiens
gcaaaagggaagtat

SEQ ID NO: 456794 - DNA, 15 bp, Homo sapiens
caaaagggaagtatg

SEQ ID NO: 456795 - DNA, 15 bp, Homo sapiens
aaaagggaagtatgt

SEQ ID NO: 456796 - DNA, 15 bp, Homo sapiens
aaagggaagtatgtt

SEQ ID NO: 456797 - DNA, 15 bp, Homo sapiens
aagggaagtatgttc

SEQ ID NO: 456798 - DNA, 15 bp, Homo sapiens
agggaagtatgttcc

SEQ ID NO: 456799 - DNA, 15 bp, Homo sapiens
gggaagtatgttccg

SEQ ID NO: 456800 - DNA, 15 bp, Homo sapiens
ggaagtatgttccga

SEQ ID NO: 456801 - DNA, 15 bp, Homo sapiens
gaagtatgttccgag

SEQ ID NO: 456802 - DNA, 15 bp, Homo sapiens
aagtatgttccgagg

SEQ ID NO: 456803 - DNA, 15 bp, Homo sapiens
agtatgttccgagga

SEQ ID NO: 456804 - DNA, 15 bp, Homo sapiens
gtatgttccgaggag

SEQ ID NO: 456805 - DNA, 15 bp, Homo sapiens
tatgttccgaggagg

SEQ ID NO: 456806 - DNA, 15 bp, Homo sapiens
atgttccgaggaggg

SEQ ID NO: 456807 - DNA, 15 bp, Homo sapiens
tgttccgaggagggg

SEQ ID NO: 456808 - DNA, 15 bp, Homo sapiens
gttccgaggaggggg

SEQ ID NO: 456809 - DNA, 15 bp, Homo sapiens
ttccgaggaggggga

SEQ ID NO: 456810 - DNA, 15 bp, Homo sapiens
tccgaggagggggag

SEQ ID NO: 456811 - DNA, 15 bp, Homo sapiens
ccgaggagggggaga

SEQ ID NO: 456812 - DNA, 15 bp, Homo sapiens
cgaggagggggagag

SEQ ID NO: 456813 - DNA, 15 bp, Homo sapiens
gaggagggggagagt

SEQ ID NO: 456814 - DNA, 15 bp, Homo sapiens
aggagggggagagtc

SEQ ID NO: 456815 - DNA, 15 bp, Homo sapiens
ggagggggagagtcc

SEQ ID NO: 456816 - DNA, 15 bp, Homo sapiens
gagggggagagtcct

SEQ ID NO: 456817 - DNA, 15 bp, Homo sapiens
agggggagagtcctc

SEQ ID NO: 456818 - DNA, 15 bp, Homo sapiens
gggggagagtcctct

SEQ ID NO: 456819 - DNA, 15 bp, Homo sapiens
ggggagagtcctctc

SEQ ID NO: 456820 - DNA, 15 bp, Homo sapiens
gggagagtcctctca

SEQ ID NO: 456821 - DNA, 15 bp, Homo sapiens
ggagagtcctctcat

SEQ ID NO: 456822 - DNA, 15 bp, Homo sapiens
gagagtcctctcatt

SEQ ID NO: 456823 - DNA, 15 bp, Homo sapiens
agagtcctctcatta

SEQ ID NO: 456824 - DNA, 15 bp, Homo sapiens
gagtcctctcattat

SEQ ID NO: 456825 - DNA, 15 bp, Homo sapiens
agtcctctcattatg

SEQ ID NO: 456826 - DNA, 15 bp, Homo sapiens
gtcctctcattatga

SEQ ID NO: 456827 - DNA, 15 bp, Homo sapiens
tcctctcattatgaa

SEQ ID NO: 456828 - DNA, 15 bp, Homo sapiens
cctctcattatgaag

SEQ ID NO: 456829 - DNA, 15 bp, Homo sapiens
ctctcattatgaaga

SEQ ID NO: 456830 - DNA, 15 bp, Homo sapiens
tctcattatgaagaa

SEQ ID NO: 456831 - DNA, 15 bp, Homo sapiens
ctcattatgaagaag

SEQ ID NO: 456832 - DNA, 15 bp, Homo sapiens
tcattatgaagaaga

SEQ ID NO: 456833 - DNA, 15 bp, Homo sapiens
cattatgaagaagaa

SEQ ID NO: 456834 - DNA, 15 bp, Homo sapiens
attatgaagaagaag

SEQ ID NO: 456835 - DNA, 15 bp, Homo sapiens
ttatgaagaagaagg

SEQ ID NO: 456836 - DNA, 15 bp, Homo sapiens
tatgaagaagaaggc

SEQ ID NO: 456837 - DNA, 15 bp, Homo sapiens
atgaagaagaaggca

SEQ ID NO: 456838 - DNA, 15 bp, Homo sapiens
tgaagaagaaggcag

SEQ ID NO: 456839 - DNA, 15 bp, Homo sapiens
gaagaagaaggcagg

SEQ ID NO: 456840 - DNA, 15 bp, Homo sapiens
aagaagaaggcaggc

SEQ ID NO: 456841 - DNA, 15 bp, Homo sapiens
agaagaaggcaggct

SEQ ID NO: 456842 - DNA, 15 bp, Homo sapiens
gaagaaggcaggctt

SEQ ID NO: 456843 - DNA, 15 bp, Homo sapiens
aagaaggcaggcttc

SEQ ID NO: 456844 - DNA, 15 bp, Homo sapiens
agaaggcaggcttcc

SEQ ID NO: 456845 - DNA, 15 bp, Homo sapiens
gaaggcaggcttcct

SEQ ID NO: 456846 - DNA, 15 bp, Homo sapiens
aaggcaggcttcctt

SEQ ID NO: 456847 - DNA, 15 bp, Homo sapiens
aggcaggcttccttg

SEQ ID NO: 456848 - DNA, 15 bp, Homo sapiens
ggcaggcttccttga

SEQ ID NO: 456849 - DNA, 15 bp, Homo sapiens
gcaggcttccttgat

SEQ ID NO: 456850 - DNA, 15 bp, Homo sapiens
caggcttccttgatt

SEQ ID NO: 456851 - DNA, 15 bp, Homo sapiens
aggcttccttgatta

SEQ ID NO: 456852 - DNA, 15 bp, Homo sapiens
ggcttccttgattag

SEQ ID NO: 456853 - DNA, 15 bp, Homo sapiens
gcttccttgattagt

SEQ ID NO: 456854 - DNA, 15 bp, Homo sapiens
cttccttgattagtg

SEQ ID NO: 456855 - DNA, 15 bp, Homo sapiens
ttccttgattagtgg

SEQ ID NO: 456856 - DNA, 15 bp, Homo sapiens
tccttgattagtggg

SEQ ID NO: 456857 - DNA, 15 bp, Homo sapiens
ccttgattagtgggc

SEQ ID NO: 456858 - DNA, 15 bp, Homo sapiens
cttgattagtgggca

SEQ ID NO: 456859 - DNA, 15 bp, Homo sapiens
ttgattagtgggcat

SEQ ID NO: 456860 - DNA, 15 bp, Homo sapiens
tgattagtgggcata

SEQ ID NO: 456861 - DNA, 15 bp, Homo sapiens
gattagtgggcatat

SEQ ID NO: 456862 - DNA, 15 bp, Homo sapiens
attagtgggcatatg

SEQ ID NO: 456863 - DNA, 15 bp, Homo sapiens
ttagtgggcatatga

SEQ ID NO: 456864 - DNA, 15 bp, Homo sapiens
tagtgggcatatgag

SEQ ID NO: 456865 - DNA, 15 bp, Homo sapiens
agtgggcatatgagc

SEQ ID NO: 456866 - DNA, 15 bp, Homo sapiens
gtgggcatatgagcc

SEQ ID NO: 456867 - DNA, 15 bp, Homo sapiens
tgggcatatgagcca

SEQ ID NO: 456868 - DNA, 15 bp, Homo sapiens
gggcatatgagccag

SEQ ID NO: 456869 - DNA, 15 bp, Homo sapiens
ggcatatgagccagg

SEQ ID NO: 456870 - DNA, 15 bp, Homo sapiens
gcatatgagccaggc

SEQ ID NO: 456871 - DNA, 15 bp, Homo sapiens
catatgagccaggct

SEQ ID NO: 456872 - DNA, 15 bp, Homo sapiens
atatgagccaggcta

SEQ ID NO: 456873 - DNA, 15 bp, Homo sapiens
tatgagccaggctat

SEQ ID NO: 456874 - DNA, 15 bp, Homo sapiens
atgagccaggctata

SEQ ID NO: 456875 - DNA, 15 bp, Homo sapiens
tgagccaggctataa

SEQ ID NO: 456876 - DNA, 15 bp, Homo sapiens
gagccaggctataaa

SEQ ID NO: 456877 - DNA, 15 bp, Homo sapiens
agccaggctataaaa

SEQ ID NO: 456878 - DNA, 15 bp, Homo sapiens
gccaggctataaaag

SEQ ID NO: 456879 - DNA, 15 bp, Homo sapiens
ccaggctataaaagg

SEQ ID NO: 456880 - DNA, 15 bp, Homo sapiens
caggctataaaaggc

SEQ ID NO: 456881 - DNA, 15 bp, Homo sapiens
aggctataaaaggca

SEQ ID NO: 456882 - DNA, 15 bp, Homo sapiens
ggctataaaaggcac

SEQ ID NO: 456883 - DNA, 15 bp, Homo sapiens
gctataaaaggcacc

SEQ ID NO: 456884 - DNA, 15 bp, Homo sapiens
ctataaaaggcacct

SEQ ID NO: 456885 - DNA, 15 bp, Homo sapiens
tataaaaggcacctg

SEQ ID NO: 456886 - DNA, 15 bp, Homo sapiens
ataaaaggcacctgg

SEQ ID NO: 456887 - DNA, 15 bp, Homo sapiens
taaaaggcacctggg

SEQ ID NO: 456888 - DNA, 15 bp, Homo sapiens
aaaaggcacctggga

SEQ ID NO: 456889 - DNA, 15 bp, Homo sapiens
aaaggcacctgggat

SEQ ID NO: 456890 - DNA, 15 bp, Homo sapiens
aaggcacctgggatt

SEQ ID NO: 456891 - DNA, 15 bp, Homo sapiens
aggcacctgggattt

SEQ ID NO: 456892 - DNA, 15 bp, Homo sapiens
ggcacctgggattta

SEQ ID NO: 456893 - DNA, 15 bp, Homo sapiens
gcacctgggatttag

SEQ ID NO: 456894 - DNA, 15 bp, Homo sapiens
cacctgggatttagg

SEQ ID NO: 456895 - DNA, 15 bp, Homo sapiens
acctgggatttaggc

SEQ ID NO: 456896 - DNA, 15 bp, Homo sapiens
cctgggatttaggca

SEQ ID NO: 456897 - DNA, 15 bp, Homo sapiens
ctgggatttaggcat

SEQ ID NO: 456898 - DNA, 15 bp, Homo sapiens
tgggatttaggcatg

SEQ ID NO: 456899 - DNA, 15 bp, Homo sapiens
gggatttaggcatgg

SEQ ID NO: 456900 - DNA, 15 bp, Homo sapiens
ggatttaggcatggg

SEQ ID NO: 456901 - DNA, 15 bp, Homo sapiens
gatttaggcatgggg

SEQ ID NO: 456902 - DNA, 15 bp, Homo sapiens
atttaggcatggggc

SEQ ID NO: 456903 - DNA, 15 bp, Homo sapiens
tttaggcatggggca

SEQ ID NO: 456904 - DNA, 15 bp, Homo sapiens
ttaggcatggggcag

SEQ ID NO: 456905 - DNA, 15 bp, Homo sapiens
taggcatggggcagt

SEQ ID NO: 456906 - DNA, 15 bp, Homo sapiens
aggcatggggcagtt

SEQ ID NO: 456907 - DNA, 15 bp, Homo sapiens
ggcatggggcagtta

SEQ ID NO: 456908 - DNA, 15 bp, Homo sapiens
gcatggggcagttaa

SEQ ID NO: 456909 - DNA, 15 bp, Homo sapiens
catggggcagttaat

SEQ ID NO: 456910 - DNA, 15 bp, Homo sapiens
atggggcagttaatt

SEQ ID NO: 456911 - DNA, 15 bp, Homo sapiens
tggggcagttaattg

SEQ ID NO: 456912 - DNA, 15 bp, Homo sapiens
ggggcagttaattgg

SEQ ID NO: 456913 - DNA, 15 bp, Homo sapiens
gggcagttaattggg

SEQ ID NO: 456914 - DNA, 15 bp, Homo sapiens
ggcagttaattgggg

SEQ ID NO: 456915 - DNA, 15 bp, Homo sapiens
gcagttaattgggga

SEQ ID NO: 456916 - DNA, 15 bp, Homo sapiens
cagttaattggggat

SEQ ID NO: 456917 - DNA, 15 bp, Homo sapiens
agttaattggggata

SEQ ID NO: 456918 - DNA, 15 bp, Homo sapiens
gttaattggggataa

SEQ ID NO: 456919 - DNA, 15 bp, Homo sapiens
ttaattggggataag

SEQ ID NO: 456920 - DNA, 15 bp, Homo sapiens
taattggggataaga

SEQ ID NO: 456921 - DNA, 15 bp, Homo sapiens
aattggggataagaa

SEQ ID NO: 456922 - DNA, 15 bp, Homo sapiens
attggggataagaag

SEQ ID NO: 456923 - DNA, 15 bp, Homo sapiens
ttggggataagaagg

SEQ ID NO: 456924 - DNA, 15 bp, Homo sapiens
tggggataagaaggg

SEQ ID NO: 456925 - DNA, 15 bp, Homo sapiens
ggggataagaaggga

SEQ ID NO: 456926 - DNA, 15 bp, Homo sapiens
gggataagaagggaa

SEQ ID NO: 456927 - DNA, 15 bp, Homo sapiens
ggataagaagggaag

SEQ ID NO: 456928 - DNA, 15 bp, Homo sapiens
gataagaagggaagg

SEQ ID NO: 456929 - DNA, 15 bp, Homo sapiens
ataagaagggaagga

SEQ ID NO: 456930 - DNA, 15 bp, Homo sapiens
taagaagggaaggag

SEQ ID NO: 456931 - DNA, 15 bp, Homo sapiens
aagaagggaaggagt

SEQ ID NO: 456932 - DNA, 15 bp, Homo sapiens
agaagggaaggagtt

SEQ ID NO: 456933 - DNA, 15 bp, Homo sapiens
gaagggaaggagtta

SEQ ID NO: 456934 - DNA, 15 bp, Homo sapiens
aagggaaggagttat

SEQ ID NO: 456935 - DNA, 15 bp, Homo sapiens
agggaaggagttatc

SEQ ID NO: 456936 - DNA, 15 bp, Homo sapiens
gggaaggagttatct

SEQ ID NO: 456937 - DNA, 15 bp, Homo sapiens
ggaaggagttatctg

SEQ ID NO: 456938 - DNA, 15 bp, Homo sapiens
gaaggagttatctgt

SEQ ID NO: 456939 - DNA, 15 bp, Homo sapiens
aaggagttatctgtg

SEQ ID NO: 456940 - DNA, 15 bp, Homo sapiens
aggagttatctgtgt

SEQ ID NO: 456941 - DNA, 15 bp, Homo sapiens
ggagttatctgtgtg

SEQ ID NO: 456942 - DNA, 15 bp, Homo sapiens
gagttatctgtgtga

SEQ ID NO: 456943 - DNA, 15 bp, Homo sapiens
agttatctgtgtgag

SEQ ID NO: 456944 - DNA, 15 bp, Homo sapiens
gttatctgtgtgaga

SEQ ID NO: 456945 - DNA, 15 bp, Homo sapiens
ttatctgtgtgagaa

SEQ ID NO: 456946 - DNA, 15 bp, Homo sapiens
tatctgtgtgagaat

SEQ ID NO: 456947 - DNA, 15 bp, Homo sapiens
atctgtgtgagaatt

SEQ ID NO: 456948 - DNA, 15 bp, Homo sapiens
tctgtgtgagaatta

SEQ ID NO: 456949 - DNA, 15 bp, Homo sapiens
ctgtgtgagaattaa

SEQ ID NO: 456950 - DNA, 15 bp, Homo sapiens
tgtgtgagaattaag

SEQ ID NO: 456951 - DNA, 15 bp, Homo sapiens
gtgtgagaattaagg

SEQ ID NO: 456952 - DNA, 15 bp, Homo sapiens
tgtgagaattaaggt

SEQ ID NO: 456953 - DNA, 15 bp, Homo sapiens
gtgagaattaaggtg

SEQ ID NO: 456954 - DNA, 15 bp, Homo sapiens
tgagaattaaggtgt

SEQ ID NO: 456955 - DNA, 15 bp, Homo sapiens
gagaattaaggtgta

SEQ ID NO: 456956 - DNA, 15 bp, Homo sapiens
agaattaaggtgtag

SEQ ID NO: 456957 - DNA, 15 bp, Homo sapiens
gaattaaggtgtaga

SEQ ID NO: 456958 - DNA, 15 bp, Homo sapiens
aattaaggtgtagat

SEQ ID NO: 456959 - DNA, 15 bp, Homo sapiens
attaaggtgtagatg

SEQ ID NO: 456960 - DNA, 15 bp, Homo sapiens
ttaaggtgtagatgg

SEQ ID NO: 456961 - DNA, 15 bp, Homo sapiens
taaggtgtagatggt

SEQ ID NO: 456962 - DNA, 15 bp, Homo sapiens
aaggtgtagatggtg

SEQ ID NO: 456963 - DNA, 15 bp, Homo sapiens
aggtgtagatggtgt

SEQ ID NO: 456964 - DNA, 15 bp, Homo sapiens
ggtgtagatggtgtt

SEQ ID NO: 456965 - DNA, 15 bp, Homo sapiens
gtgtagatggtgttc

SEQ ID NO: 456966 - DNA, 15 bp, Homo sapiens
tgtagatggtgttca

SEQ ID NO: 456967 - DNA, 15 bp, Homo sapiens
gtagatggtgttcaa

SEQ ID NO: 456968 - DNA, 15 bp, Homo sapiens
tagatggtgttcaag

SEQ ID NO: 456969 - DNA, 15 bp, Homo sapiens
agatggtgttcaagg

SEQ ID NO: 456970 - DNA, 15 bp, Homo sapiens
gatggtgttcaagga

SEQ ID NO: 456971 - DNA, 15 bp, Homo sapiens
atggtgttcaaggaa

SEQ ID NO: 456972 - DNA, 15 bp, Homo sapiens
tggtgttcaaggaac

SEQ ID NO: 456973 - DNA, 15 bp, Homo sapiens
ggtgttcaaggaaca

SEQ ID NO: 456974 - DNA, 15 bp, Homo sapiens
gtgttcaaggaacat

SEQ ID NO: 456975 - DNA, 15 bp, Homo sapiens
tgttcaaggaacatt

SEQ ID NO: 456976 - DNA, 15 bp, Homo sapiens
gttcaaggaacatta

SEQ ID NO: 456977 - DNA, 15 bp, Homo sapiens
ttcaaggaacattaa

SEQ ID NO: 456978 - DNA, 15 bp, Homo sapiens
tcaaggaacattaag

SEQ ID NO: 456979 - DNA, 15 bp, Homo sapiens
caaggaacattaagt

SEQ ID NO: 456980 - DNA, 15 bp, Homo sapiens
aaggaacattaagtt

SEQ ID NO: 456981 - DNA, 15 bp, Homo sapiens
aggaacattaagtta

SEQ ID NO: 456982 - DNA, 15 bp, Homo sapiens
ggaacattaagttat

SEQ ID NO: 456983 - DNA, 15 bp, Homo sapiens
gaacattaagttata

SEQ ID NO: 456984 - DNA, 15 bp, Homo sapiens
aacattaagttatag

SEQ ID NO: 456985 - DNA, 15 bp, Homo sapiens
acattaagttataga

SEQ ID NO: 456986 - DNA, 15 bp, Homo sapiens
cattaagttatagag

SEQ ID NO: 456987 - DNA, 15 bp, Homo sapiens
attaagttatagagt

SEQ ID NO: 456988 - DNA, 15 bp, Homo sapiens
ttaagttatagagtc

SEQ ID NO: 456989 - DNA, 15 bp, Homo sapiens
taagttatagagtct

SEQ ID NO: 456990 - DNA, 15 bp, Homo sapiens
aagttatagagtctg

SEQ ID NO: 456991 - DNA, 15 bp, Homo sapiens
agttatagagtctga

SEQ ID NO: 456992 - DNA, 15 bp, Homo sapiens
gttatagagtctgaa

SEQ ID NO: 456993 - DNA, 15 bp, Homo sapiens
ttatagagtctgaat

SEQ ID NO: 456994 - DNA, 15 bp, Homo sapiens
tatagagtctgaatg

SEQ ID NO: 456995 - DNA, 15 bp, Homo sapiens
atagagtctgaatgg

SEQ ID NO: 456996 - DNA, 15 bp, Homo sapiens
tagagtctgaatgga

SEQ ID NO: 456997 - DNA, 15 bp, Homo sapiens
agagtctgaatggaa

SEQ ID NO: 456998 - DNA, 15 bp, Homo sapiens
gagtctgaatggaat

SEQ ID NO: 456999 - DNA, 15 bp, Homo sapiens
agtctgaatggaata

SEQ ID NO: 457000 - DNA, 15 bp, Homo sapiens
gtctgaatggaatag

SEQ ID NO: 457001 - DNA, 15 bp, Homo sapiens
tctgaatggaatagc

SEQ ID NO: 457002 - DNA, 15 bp, Homo sapiens
ctgaatggaatagct

SEQ ID NO: 457003 - DNA, 15 bp, Homo sapiens
tgaatggaatagctt

SEQ ID NO: 457004 - DNA, 15 bp, Homo sapiens
gaatggaatagctta

SEQ ID NO: 457005 - DNA, 15 bp, Homo sapiens
aatggaatagcttag

SEQ ID NO: 457006 - DNA, 15 bp, Homo sapiens
atggaatagcttagc

SEQ ID NO: 457007 - DNA, 15 bp, Homo sapiens
tggaatagcttagct

SEQ ID NO: 457008 - DNA, 15 bp, Homo sapiens
ggaatagcttagcta

SEQ ID NO: 457009 - DNA, 15 bp, Homo sapiens
gaatagcttagctat

SEQ ID NO: 457010 - DNA, 15 bp, Homo sapiens
aatagcttagctatt

SEQ ID NO: 457011 - DNA, 15 bp, Homo sapiens
atagcttagctattt

SEQ ID NO: 457012 - DNA, 15 bp, Homo sapiens
tagcttagctatttt

SEQ ID NO: 457013 - DNA, 15 bp, Homo sapiens
agcttagctattttg

SEQ ID NO: 457014 - DNA, 15 bp, Homo sapiens
gcttagctattttgt

SEQ ID NO: 457015 - DNA, 15 bp, Homo sapiens
cttagctattttgtc

SEQ ID NO: 457016 - DNA, 15 bp, Homo sapiens
ttagctattttgtcc

SEQ ID NO: 457017 - DNA, 15 bp, Homo sapiens
tagctattttgtcca

SEQ ID NO: 457018 - DNA, 15 bp, Homo sapiens
agctattttgtccaa

SEQ ID NO: 457019 - DNA, 15 bp, Homo sapiens
gctattttgtccaat

SEQ ID NO: 457020 - DNA, 15 bp, Homo sapiens
ctattttgtccaata

SEQ ID NO: 457021 - DNA, 15 bp, Homo sapiens
tattttgtccaatat

SEQ ID NO: 457022 - DNA, 15 bp, Homo sapiens
attttgtccaatatc

SEQ ID NO: 457023 - DNA, 15 bp, Homo sapiens
ttttgtccaatatcc

SEQ ID NO: 457024 - DNA, 15 bp, Homo sapiens
tttgtccaatatcca

SEQ ID NO: 457025 - DNA, 15 bp, Homo sapiens
ttgtccaatatccag

SEQ ID NO: 457026 - DNA, 15 bp, Homo sapiens
tgtccaatatccaga

SEQ ID NO: 457027 - DNA, 15 bp, Homo sapiens
gtccaatatccagaa

SEQ ID NO: 457028 - DNA, 15 bp, Homo sapiens
tccaatatccagaaa

SEQ ID NO: 457029 - DNA, 15 bp, Homo sapiens
ccaatatccagaaat

SEQ ID NO: 457030 - DNA, 15 bp, Homo sapiens
caatatccagaaatt

SEQ ID NO: 457031 - DNA, 15 bp, Homo sapiens
aatatccagaaattt

SEQ ID NO: 457032 - DNA, 15 bp, Homo sapiens
atatccagaaatttc

SEQ ID NO: 457033 - DNA, 15 bp, Homo sapiens
tatccagaaatttcc

SEQ ID NO: 457034 - DNA, 15 bp, Homo sapiens
atccagaaatttcct

SEQ ID NO: 457035 - DNA, 15 bp, Homo sapiens
tccagaaatttcctt

SEQ ID NO: 457036 - DNA, 15 bp, Homo sapiens
ccagaaatttcctta

SEQ ID NO: 457037 - DNA, 15 bp, Homo sapiens
cagaaatttccttaa

SEQ ID NO: 457038 - DNA, 15 bp, Homo sapiens
agaaatttccttaaa

SEQ ID NO: 457039 - DNA, 15 bp, Homo sapiens
gaaatttccttaaag

SEQ ID NO: 457040 - DNA, 15 bp, Homo sapiens
aaatttccttaaagt

SEQ ID NO: 457041 - DNA, 15 bp, Homo sapiens
aatttccttaaagtt

SEQ ID NO: 457042 - DNA, 15 bp, Homo sapiens
atttccttaaagtta

SEQ ID NO: 457043 - DNA, 15 bp, Homo sapiens
ttccttaaagttaat

SEQ ID NO: 457044 - DNA, 15 bp, Homo sapiens
tccttaaagttaatt

SEQ ID NO: 457045 - DNA, 15 bp, Homo sapiens
ccttaaagttaattt

SEQ ID NO: 457046 - DNA, 15 bp, Homo sapiens
cttaaagttaattta

SEQ ID NO: 457047 - DNA, 15 bp, Homo sapiens
ttaaagttaatttag

SEQ ID NO: 457048 - DNA, 15 bp, Homo sapiens
taaagttaatttagg

SEQ ID NO: 457049 - DNA, 15 bp, Homo sapiens
aaagttaatttaggt

SEQ ID NO: 457050 - DNA, 15 bp, Homo sapiens
aagttaatttaggtc

SEQ ID NO: 457051 - DNA, 15 bp, Homo sapiens
agttaatttaggtca

SEQ ID NO: 457052 - DNA, 15 bp, Homo sapiens
gttaatttaggtcaa

SEQ ID NO: 457053 - DNA, 15 bp, Homo sapiens
ttaatttaggtcaat

SEQ ID NO: 457054 - DNA, 15 bp, Homo sapiens
taatttaggtcaatt

SEQ ID NO: 457055 - DNA, 15 bp, Homo sapiens
aatttaggtcaattt

SEQ ID NO: 457056 - DNA, 15 bp, Homo sapiens
atttaggtcaatttg

SEQ ID NO: 457057 - DNA, 15 bp, Homo sapiens
tttaggtcaatttga

SEQ ID NO: 457058 - DNA, 15 bp, Homo sapiens
ttaggtcaatttgaa

SEQ ID NO: 457059 - DNA, 15 bp, Homo sapiens
taggtcaatttgaac

SEQ ID NO: 457060 - DNA, 15 bp, Homo sapiens
aggtcaatttgaacg

SEQ ID NO: 457061 - DNA, 15 bp, Homo sapiens
ggtcaatttgaacgt

SEQ ID NO: 457062 - DNA, 15 bp, Homo sapiens
gtcaatttgaacgtc

SEQ ID NO: 457063 - DNA, 15 bp, Homo sapiens
tcaatttgaacgtca

SEQ ID NO: 457064 - DNA, 15 bp, Homo sapiens
caatttgaacgtcat

SEQ ID NO: 457065 - DNA, 15 bp, Homo sapiens
aatttgaacgtcata

SEQ ID NO: 457066 - DNA, 15 bp, Homo sapiens
atttgaacgtcatat

SEQ ID NO: 457067 - DNA, 15 bp, Homo sapiens
tttgaacgtcatatt

SEQ ID NO: 457068 - DNA, 15 bp, Homo sapiens
ttgaacgtcatattt

SEQ ID NO: 457069 - DNA, 15 bp, Homo sapiens
tgaacgtcatatttt

SEQ ID NO: 457070 - DNA, 15 bp, Homo sapiens
gaacgtcatattttt

SEQ ID NO: 457071 - DNA, 15 bp, Homo sapiens
aacgtcatatttttc

SEQ ID NO: 457072 - DNA, 15 bp, Homo sapiens
acgtcatatttttcc

SEQ ID NO: 457073 - DNA, 15 bp, Homo sapiens
cgtcatatttttcct

SEQ ID NO: 457074 - DNA, 15 bp, Homo sapiens
gtcatatttttcctg

SEQ ID NO: 457075 - DNA, 15 bp, Homo sapiens
tcatatttttcctga

SEQ ID NO: 457076 - DNA, 15 bp, Homo sapiens
catatttttcctgaa

SEQ ID NO: 457077 - DNA, 15 bp, Homo sapiens
atatttttcctgaaa

SEQ ID NO: 457078 - DNA, 15 bp, Homo sapiens
tatttttcctgaaat

SEQ ID NO: 457079 - DNA, 15 bp, Homo sapiens
atttttcctgaaatt

SEQ ID NO: 457080 - DNA, 15 bp, Homo sapiens
tttttcctgaaattc

SEQ ID NO: 457081 - DNA, 15 bp, Homo sapiens
ttttcctgaaattcc

SEQ ID NO: 457082 - DNA, 15 bp, Homo sapiens
tttcctgaaattcct

SEQ ID NO: 457083 - DNA, 15 bp, Homo sapiens
ttcctgaaattcctt

SEQ ID NO: 457084 - DNA, 15 bp, Homo sapiens
tcctgaaattccttt

SEQ ID NO: 457085 - DNA, 15 bp, Homo sapiens
cctgaaattcctttc

SEQ ID NO: 457086 - DNA, 15 bp, Homo sapiens
ctgaaattcctttcg

SEQ ID NO: 457087 - DNA, 15 bp, Homo sapiens
tgaaattcctttcgg

SEQ ID NO: 457088 - DNA, 15 bp, Homo sapiens
gaaattcctttcggt

SEQ ID NO: 457089 - DNA, 15 bp, Homo sapiens
aaattcctttcggtt

SEQ ID NO: 457090 - DNA, 15 bp, Homo sapiens
aattcctttcggttt

SEQ ID NO: 457091 - DNA, 15 bp, Homo sapiens
attcctttcggtttt

SEQ ID NO: 457092 - DNA, 15 bp, Homo sapiens
ttcctttcggttttt

SEQ ID NO: 457093 - DNA, 15 bp, Homo sapiens
tcctttcggtttttt

SEQ ID NO: 457094 - DNA, 15 bp, Homo sapiens
cctttcggttttttt

SEQ ID NO: 457095 - DNA, 15 bp, Homo sapiens
ctttcggtttttttc

SEQ ID NO: 457096 - DNA, 15 bp, Homo sapiens
tttcggtttttttcc

SEQ ID NO: 457097 - DNA, 15 bp, Homo sapiens
ttcggtttttttcct

SEQ ID NO: 457098 - DNA, 15 bp, Homo sapiens
tcggtttttttcctc

SEQ ID NO: 457099 - DNA, 15 bp, Homo sapiens
cggtttttttcctca

SEQ ID NO: 457100 - DNA, 15 bp, Homo sapiens
ggtttttttcctcaa

SEQ ID NO: 457101 - DNA, 15 bp, Homo sapiens
gtttttttcctcaag

SEQ ID NO: 457102 - DNA, 15 bp, Homo sapiens
tttttttcctcaagt

SEQ ID NO: 457103 - DNA, 15 bp, Homo sapiens
ttttttcctcaagtt

SEQ ID NO: 457104 - DNA, 15 bp, Homo sapiens
tttttcctcaagttc

SEQ ID NO: 457105 - DNA, 15 bp, Homo sapiens
ttttcctcaagttct

SEQ ID NO: 457106 - DNA, 15 bp, Homo sapiens
tttcctcaagttctt

SEQ ID NO: 457107 - DNA, 15 bp, Homo sapiens
ttcctcaagttctta

SEQ ID NO: 457108 - DNA, 15 bp, Homo sapiens
tcctcaagttcttat

SEQ ID NO: 457109 - DNA, 15 bp, Homo sapiens
cctcaagttcttatt

SEQ ID NO: 457110 - DNA, 15 bp, Homo sapiens
ctcaagttcttattg

SEQ ID NO: 457111 - DNA, 15 bp, Homo sapiens
tcaagttcttattgt

SEQ ID NO: 457112 - DNA, 15 bp, Homo sapiens
caagttcttattgtg

SEQ ID NO: 457113 - DNA, 15 bp, Homo sapiens
aagttcttattgtgt

SEQ ID NO: 457114 - DNA, 15 bp, Homo sapiens
agttcttattgtgtt

SEQ ID NO: 457115 - DNA, 15 bp, Homo sapiens
gttcttattgtgttg

SEQ ID NO: 457116 - DNA, 15 bp, Homo sapiens
ttcttattgtgttgt

SEQ ID NO: 457117 - DNA, 15 bp, Homo sapiens
tcttattgtgttgta

SEQ ID NO: 457118 - DNA, 15 bp, Homo sapiens
cttattgtgttgtat

SEQ ID NO: 457119 - DNA, 15 bp, Homo sapiens
ttattgtgttgtatt

SEQ ID NO: 457120 - DNA, 15 bp, Homo sapiens
tattgtgttgtattt

SEQ ID NO: 457121 - DNA, 15 bp, Homo sapiens
attgtgttgtatttc

SEQ ID NO: 457122 - DNA, 15 bp, Homo sapiens
ttgtgttgtatttca

SEQ ID NO: 457123 - DNA, 15 bp, Homo sapiens
tgtgttgtatttcat

SEQ ID NO: 457124 - DNA, 15 bp, Homo sapiens
gtgttgtatttcatg

SEQ ID NO: 457125 - DNA, 15 bp, Homo sapiens
tgttgtatttcatgt

SEQ ID NO: 457126 - DNA, 15 bp, Homo sapiens
gttgtatttcatgtt

SEQ ID NO: 457127 - DNA, 15 bp, Homo sapiens
ttgtatttcatgttt

SEQ ID NO: 457128 - DNA, 15 bp, Homo sapiens
tgtatttcatgtttg

SEQ ID NO: 457129 - DNA, 15 bp, Homo sapiens
gtatttcatgtttgg

SEQ ID NO: 457130 - DNA, 15 bp, Homo sapiens
tatttcatgtttgga

SEQ ID NO: 457131 - DNA, 15 bp, Homo sapiens
atttcatgtttggat

SEQ ID NO: 457132 - DNA, 15 bp, Homo sapiens
tttcatgtttggata

SEQ ID NO: 457133 - DNA, 15 bp, Homo sapiens
ttcatgtttggatat

SEQ ID NO: 457134 - DNA, 15 bp, Homo sapiens
tcatgtttggatatt

SEQ ID NO: 457135 - DNA, 15 bp, Homo sapiens
catgtttggatattt

SEQ ID NO: 457136 - DNA, 15 bp, Homo sapiens
atgtttggatatttt

SEQ ID NO: 457137 - DNA, 15 bp, Homo sapiens
tgtttggatattttt

SEQ ID NO: 457138 - DNA, 15 bp, Homo sapiens
gtttggatatttttc

SEQ ID NO: 457139 - DNA, 15 bp, Homo sapiens
tttggatatttttcg

SEQ ID NO: 457140 - DNA, 15 bp, Homo sapiens
ttggatatttttcgt

SEQ ID NO: 457141 - DNA, 15 bp, Homo sapiens
tggatatttttcgtt

SEQ ID NO: 457142 - DNA, 15 bp, Homo sapiens
ggatatttttcgtta

SEQ ID NO: 457143 - DNA, 15 bp, Homo sapiens
gatatttttcgttat

SEQ ID NO: 457144 - DNA, 15 bp, Homo sapiens
atatttttcgttata

SEQ ID NO: 457145 - DNA, 15 bp, Homo sapiens
tatttttcgttatag

SEQ ID NO: 457146 - DNA, 15 bp, Homo sapiens
atttttcgttataga

SEQ ID NO: 457147 - DNA, 15 bp, Homo sapiens
tttttcgttatagaa

SEQ ID NO: 457148 - DNA, 15 bp, Homo sapiens
ttttcgttatagaat

SEQ ID NO: 457149 - DNA, 15 bp, Homo sapiens
tttcgttatagaatg

SEQ ID NO: 457150 - DNA, 15 bp, Homo sapiens
ttcgttatagaatgg

SEQ ID NO: 457151 - DNA, 15 bp, Homo sapiens
tcgttatagaatggg

SEQ ID NO: 457152 - DNA, 15 bp, Homo sapiens
cgttatagaatgggg

SEQ ID NO: 457153 - DNA, 15 bp, Homo sapiens
gttatagaatgggga

SEQ ID NO: 457154 - DNA, 15 bp, Homo sapiens
ttatagaatggggag

SEQ ID NO: 457155 - DNA, 15 bp, Homo sapiens
tatagaatggggagc

SEQ ID NO: 457156 - DNA, 15 bp, Homo sapiens
atagaatggggagcc

SEQ ID NO: 457157 - DNA, 15 bp, Homo sapiens
tagaatggggagcca

SEQ ID NO: 457158 - DNA, 15 bp, Homo sapiens
agaatggggagccat

SEQ ID NO: 457159 - DNA, 15 bp, Homo sapiens
gaatggggagccatg

SEQ ID NO: 457160 - DNA, 15 bp, Homo sapiens
aatggggagccatga

SEQ ID NO: 457161 - DNA, 15 bp, Homo sapiens
atggggagccatgag

SEQ ID NO: 457162 - DNA, 15 bp, Homo sapiens
tggggagccatgagg

SEQ ID NO: 457163 - DNA, 15 bp, Homo sapiens
ggggagccatgaggc

SEQ ID NO: 457164 - DNA, 15 bp, Homo sapiens
gggagccatgaggca

SEQ ID NO: 457165 - DNA, 15 bp, Homo sapiens
ggagccatgaggcat

SEQ ID NO: 457166 - DNA, 15 bp, Homo sapiens
gagccatgaggcatt

SEQ ID NO: 457167 - DNA, 15 bp, Homo sapiens
agccatgaggcattt

SEQ ID NO: 457168 - DNA, 15 bp, Homo sapiens
gccatgaggcatttt

SEQ ID NO: 457169 - DNA, 15 bp, Homo sapiens
ccatgaggcattttc

SEQ ID NO: 457170 - DNA, 15 bp, Homo sapiens
catgaggcattttct

SEQ ID NO: 457171 - DNA, 15 bp, Homo sapiens
atgaggcattttctg

SEQ ID NO: 457172 - DNA, 15 bp, Homo sapiens
tgaggcattttctgt

SEQ ID NO: 457173 - DNA, 15 bp, Homo sapiens
gaggcattttctgta

SEQ ID NO: 457174 - DNA, 15 bp, Homo sapiens
aggcattttctgtat

SEQ ID NO: 457175 - DNA, 15 bp, Homo sapiens
ggcattttctgtatt

SEQ ID NO: 457176 - DNA, 15 bp, Homo sapiens
gcattttctgtattg

SEQ ID NO: 457177 - DNA, 15 bp, Homo sapiens
cattttctgtattgt

SEQ ID NO: 457178 - DNA, 15 bp, Homo sapiens
attttctgtattgtg

SEQ ID NO: 457179 - DNA, 15 bp, Homo sapiens
ttttctgtattgtgg

SEQ ID NO: 457180 - DNA, 15 bp, Homo sapiens
tttctgtattgtggg

SEQ ID NO: 457181 - DNA, 15 bp, Homo sapiens
ttctgtattgtggga

SEQ ID NO: 457182 - DNA, 15 bp, Homo sapiens
tctgtattgtgggag

SEQ ID NO: 457183 - DNA, 15 bp, Homo sapiens
ctgtattgtgggagt

SEQ ID NO: 457184 - DNA, 15 bp, Homo sapiens
tgtattgtgggagtt

SEQ ID NO: 457185 - DNA, 15 bp, Homo sapiens
gtattgtgggagttt

SEQ ID NO: 457186 - DNA, 15 bp, Homo sapiens
tattgtgggagttta

SEQ ID NO: 457187 - DNA, 15 bp, Homo sapiens
attgtgggagtttag

SEQ ID NO: 457188 - DNA, 15 bp, Homo sapiens
ttgtgggagtttaga

SEQ ID NO: 457189 - DNA, 15 bp, Homo sapiens
tgtgggagtttagag

SEQ ID NO: 457190 - DNA, 15 bp, Homo sapiens
gtgggagtttagaga

SEQ ID NO: 457191 - DNA, 15 bp, Homo sapiens
tgggagtttagagat

SEQ ID NO: 457192 - DNA, 15 bp, Homo sapiens
gggagtttagagata

SEQ ID NO: 457193 - DNA, 15 bp, Homo sapiens
ggagtttagagatag

SEQ ID NO: 457194 - DNA, 15 bp, Homo sapiens
gagtttagagatagg

SEQ ID NO: 457195 - DNA, 15 bp, Homo sapiens
agtttagagataggg

SEQ ID NO: 457196 - DNA, 15 bp, Homo sapiens
gtttagagatagggc

SEQ ID NO: 457197 - DNA, 15 bp, Homo sapiens
tttagagatagggcc

SEQ ID NO: 457198 - DNA, 15 bp, Homo sapiens
ttagagatagggcca

SEQ ID NO: 457199 - DNA, 15 bp, Homo sapiens
tagagatagggccag

SEQ ID NO: 457200 - DNA, 15 bp, Homo sapiens
agagatagggccaga

SEQ ID NO: 457201 - DNA, 15 bp, Homo sapiens
gagatagggccagaa

SEQ ID NO: 457202 - DNA, 15 bp, Homo sapiens
agatagggccagaag

SEQ ID NO: 457203 - DNA, 15 bp, Homo sapiens
gatagggccagaagt

SEQ ID NO: 457204 - DNA, 15 bp, Homo sapiens
atagggccagaagtg

SEQ ID NO: 457205 - DNA, 15 bp, Homo sapiens
tagggccagaagtgg

SEQ ID NO: 457206 - DNA, 15 bp, Homo sapiens
agggccagaagtgga

SEQ ID NO: 457207 - DNA, 15 bp, Homo sapiens
gggccagaagtggaa

SEQ ID NO: 457208 - DNA, 15 bp, Homo sapiens
ggccagaagtggaag

SEQ ID NO: 457209 - DNA, 15 bp, Homo sapiens
gccagaagtggaagt

SEQ ID NO: 457210 - DNA, 15 bp, Homo sapiens
ccagaagtggaagta

SEQ ID NO: 457211 - DNA, 15 bp, Homo sapiens
cagaagtggaagtat

SEQ ID NO: 457212 - DNA, 15 bp, Homo sapiens
agaagtggaagtatg

SEQ ID NO: 457213 - DNA, 15 bp, Homo sapiens
gaagtggaagtatgc

SEQ ID NO: 457214 - DNA, 15 bp, Homo sapiens
aagtggaagtatgct

SEQ ID NO: 457215 - DNA, 15 bp, Homo sapiens
agtggaagtatgctt

SEQ ID NO: 457216 - DNA, 15 bp, Homo sapiens
gtggaagtatgcttt

SEQ ID NO: 457217 - DNA, 15 bp, Homo sapiens
tggaagtatgcttta

SEQ ID NO: 457218 - DNA, 15 bp, Homo sapiens
ggaagtatgctttag

SEQ ID NO: 457219 - DNA, 15 bp, Homo sapiens
gaagtatgctttagg

SEQ ID NO: 457220 - DNA, 15 bp, Homo sapiens
aagtatgctttaggg

SEQ ID NO: 457221 - DNA, 15 bp, Homo sapiens
agtatgctttaggga

SEQ ID NO: 457222 - DNA, 15 bp, Homo sapiens
gtatgctttagggaa

SEQ ID NO: 457223 - DNA, 15 bp, Homo sapiens
tatgctttagggaat

SEQ ID NO: 457224 - DNA, 15 bp, Homo sapiens
atgctttagggaata

SEQ ID NO: 457225 - DNA, 15 bp, Homo sapiens
tgctttagggaatat

SEQ ID NO: 457226 - DNA, 15 bp, Homo sapiens
gctttagggaatatc

SEQ ID NO: 457227 - DNA, 15 bp, Homo sapiens
ctttagggaatatct

SEQ ID NO: 457228 - DNA, 15 bp, Homo sapiens
tttagggaatatcta

SEQ ID NO: 457229 - DNA, 15 bp, Homo sapiens
ttagggaatatctaa

SEQ ID NO: 457230 - DNA, 15 bp, Homo sapiens
tagggaatatctaag

SEQ ID NO: 457231 - DNA, 15 bp, Homo sapiens
agggaatatctaaga

SEQ ID NO: 457232 - DNA, 15 bp, Homo sapiens
gggaatatctaagaa

SEQ ID NO: 457233 - DNA, 15 bp, Homo sapiens
ggaatatctaagaaa

SEQ ID NO: 457234 - DNA, 15 bp, Homo sapiens
gaatatctaagaaag

SEQ ID NO: 457235 - DNA, 15 bp, Homo sapiens
aatatctaagaaaga

SEQ ID NO: 457236 - DNA, 15 bp, Homo sapiens
atatctaagaaagac

SEQ ID NO: 457237 - DNA, 15 bp, Homo sapiens
tatctaagaaagacc

SEQ ID NO: 457238 - DNA, 15 bp, Homo sapiens
atctaagaaagacca

SEQ ID NO: 457239 - DNA, 15 bp, Homo sapiens
tctaagaaagaccaa

SEQ ID NO: 457240 - DNA, 15 bp, Homo sapiens
ctaagaaagaccaaa

SEQ ID NO: 457241 - DNA, 15 bp, Homo sapiens
taagaaagaccaaag

SEQ ID NO: 457242 - DNA, 15 bp, Homo sapiens
aagaaagaccaaagg

SEQ ID NO: 457243 - DNA, 15 bp, Homo sapiens
agaaagaccaaaggg

SEQ ID NO: 457244 - DNA, 15 bp, Homo sapiens
gaaagaccaaagggc

SEQ ID NO: 457245 - DNA, 15 bp, Homo sapiens
aaagaccaaagggca

SEQ ID NO: 457246 - DNA, 15 bp, Homo sapiens
aagaccaaagggcag

SEQ ID NO: 457247 - DNA, 15 bp, Homo sapiens
agaccaaagggcaga

SEQ ID NO: 457248 - DNA, 15 bp, Homo sapiens
gaccaaagggcagag

SEQ ID NO: 457249 - DNA, 15 bp, Homo sapiens
accaaagggcagaga

SEQ ID NO: 457250 - DNA, 15 bp, Homo sapiens
ccaaagggcagagaa

SEQ ID NO: 457251 - DNA, 15 bp, Homo sapiens
caaagggcagagaac

SEQ ID NO: 457252 - DNA, 15 bp, Homo sapiens
aaagggcagagaaca

SEQ ID NO: 457253 - DNA, 15 bp, Homo sapiens
aagggcagagaacag

SEQ ID NO: 457254 - DNA, 15 bp, Homo sapiens
agggcagagaacaga

SEQ ID NO: 457255 - DNA, 15 bp, Homo sapiens
gggcagagaacagag

SEQ ID NO: 457256 - DNA, 15 bp, Homo sapiens
ggcagagaacagaga

SEQ ID NO: 457257 - DNA, 15 bp, Homo sapiens
gcagagaacagagaa

SEQ ID NO: 457258 - DNA, 15 bp, Homo sapiens
cagagaacagagaat

SEQ ID NO: 457259 - DNA, 15 bp, Homo sapiens
agagaacagagaatg

SEQ ID NO: 457260 - DNA, 15 bp, Homo sapiens
gagaacagagaatgg

SEQ ID NO: 457261 - DNA, 15 bp, Homo sapiens
agaacagagaatggg

SEQ ID NO: 457262 - DNA, 15 bp, Homo sapiens
gaacagagaatgggt

SEQ ID NO: 457263 - DNA, 15 bp, Homo sapiens
aacagagaatgggta

SEQ ID NO: 457264 - DNA, 15 bp, Homo sapiens
acagagaatgggtaa

SEQ ID NO: 457265 - DNA, 15 bp, Homo sapiens
cagagaatgggtaaa

SEQ ID NO: 457266 - DNA, 15 bp, Homo sapiens
agagaatgggtaaat

SEQ ID NO: 457267 - DNA, 15 bp, Homo sapiens
gagaatgggtaaata

SEQ ID NO: 457268 - DNA, 15 bp, Homo sapiens
agaatgggtaaatag

SEQ ID NO: 457269 - DNA, 15 bp, Homo sapiens
gaatgggtaaatagt

SEQ ID NO: 457270 - DNA, 15 bp, Homo sapiens
aatgggtaaatagtt

SEQ ID NO: 457271 - DNA, 15 bp, Homo sapiens
atgggtaaatagttc

SEQ ID NO: 457272 - DNA, 15 bp, Homo sapiens
tgggtaaatagttca

SEQ ID NO: 457273 - DNA, 15 bp, Homo sapiens
gggtaaatagttcag

SEQ ID NO: 457274 - DNA, 15 bp, Homo sapiens
ggtaaatagttcagg

SEQ ID NO: 457275 - DNA, 15 bp, Homo sapiens
gtaaatagttcaggt

SEQ ID NO: 457276 - DNA, 15 bp, Homo sapiens
taaatagttcaggtg

SEQ ID NO: 457277 - DNA, 15 bp, Homo sapiens
aaatagttcaggtga

SEQ ID NO: 457278 - DNA, 15 bp, Homo sapiens
aatagttcaggtgaa

SEQ ID NO: 457279 - DNA, 15 bp, Homo sapiens
atagttcaggtgaag

SEQ ID NO: 457280 - DNA, 15 bp, Homo sapiens
tagttcaggtgaagg

SEQ ID NO: 457281 - DNA, 15 bp, Homo sapiens
agttcaggtgaagga

SEQ ID NO: 457282 - DNA, 15 bp, Homo sapiens
gttcaggtgaaggat

SEQ ID NO: 457283 - DNA, 15 bp, Homo sapiens
ttcaggtgaaggatg

SEQ ID NO: 457284 - DNA, 15 bp, Homo sapiens
tcaggtgaaggatga

SEQ ID NO: 457285 - DNA, 15 bp, Homo sapiens
caggtgaaggatgat

SEQ ID NO: 457286 - DNA, 15 bp, Homo sapiens
aggtgaaggatgatc

SEQ ID NO: 457287 - DNA, 15 bp, Homo sapiens
ggtgaaggatgatca

SEQ ID NO: 457288 - DNA, 15 bp, Homo sapiens
gtgaaggatgatcaa

SEQ ID NO: 457289 - DNA, 15 bp, Homo sapiens
tgaaggatgatcaaa

SEQ ID NO: 457290 - DNA, 15 bp, Homo sapiens
gaaggatgatcaaag

SEQ ID NO: 457291 - DNA, 15 bp, Homo sapiens
aaggatgatcaaagc

SEQ ID NO: 457292 - DNA, 15 bp, Homo sapiens
aggatgatcaaagct

SEQ ID NO: 457293 - DNA, 15 bp, Homo sapiens
ggatgatcaaagctg

SEQ ID NO: 457294 - DNA, 15 bp, Homo sapiens
gatgatcaaagctga

SEQ ID NO: 457295 - DNA, 15 bp, Homo sapiens
atgatcaaagctgag

SEQ ID NO: 457296 - DNA, 15 bp, Homo sapiens
tgatcaaagctgagc

SEQ ID NO: 457297 - DNA, 15 bp, Homo sapiens
gatcaaagctgagct

SEQ ID NO: 457298 - DNA, 15 bp, Homo sapiens
atcaaagctgagctg

SEQ ID NO: 457299 - DNA, 15 bp, Homo sapiens
tcaaagctgagctgg

SEQ ID NO: 457300 - DNA, 15 bp, Homo sapiens
caaagctgagctggc

SEQ ID NO: 457301 - DNA, 15 bp, Homo sapiens
aaagctgagctggct

SEQ ID NO: 457302 - DNA, 15 bp, Homo sapiens
aagctgagctggctg

SEQ ID NO: 457303 - DNA, 15 bp, Homo sapiens
agctgagctggctgg

SEQ ID NO: 457304 - DNA, 15 bp, Homo sapiens
gctgagctggctggg

SEQ ID NO: 457305 - DNA, 15 bp, Homo sapiens
ctgagctggctggga

SEQ ID NO: 457306 - DNA, 15 bp, Homo sapiens
tgagctggctgggag

SEQ ID NO: 457307 - DNA, 15 bp, Homo sapiens
gagctggctgggagt

SEQ ID NO: 457308 - DNA, 15 bp, Homo sapiens
agctggctgggagtt

SEQ ID NO: 457309 - DNA, 15 bp, Homo sapiens
gctggctgggagttg

SEQ ID NO: 457310 - DNA, 15 bp, Homo sapiens
ctggctgggagttgt

SEQ ID NO: 457311 - DNA, 15 bp, Homo sapiens
tggctgggagttgta

SEQ ID NO: 457312 - DNA, 15 bp, Homo sapiens
ggctgggagttgtag

SEQ ID NO: 457313 - DNA, 15 bp, Homo sapiens
gctgggagttgtagg

SEQ ID NO: 457314 - DNA, 15 bp, Homo sapiens
ctgggagttgtagga

SEQ ID NO: 457315 - DNA, 15 bp, Homo sapiens
tgggagttgtaggag

SEQ ID NO: 457316 - DNA, 15 bp, Homo sapiens
gggagttgtaggagg

SEQ ID NO: 457317 - DNA, 15 bp, Homo sapiens
ggagttgtaggaggg

SEQ ID NO: 457318 - DNA, 15 bp, Homo sapiens
gagttgtaggagggg

SEQ ID NO: 457319 - DNA, 15 bp, Homo sapiens
agttgtaggagggga

SEQ ID NO: 457320 - DNA, 15 bp, Homo sapiens
gttgtaggaggggag

SEQ ID NO: 457321 - DNA, 15 bp, Homo sapiens
ttgtaggaggggaga

SEQ ID NO: 457322 - DNA, 15 bp, Homo sapiens
tgtaggaggggagat

SEQ ID NO: 457323 - DNA, 15 bp, Homo sapiens
gtaggaggggagatc

SEQ ID NO: 457324 - DNA, 15 bp, Homo sapiens
taggaggggagatca

SEQ ID NO: 457325 - DNA, 15 bp, Homo sapiens
aggaggggagatcag

SEQ ID NO: 457326 - DNA, 15 bp, Homo sapiens
ggaggggagatcagg

SEQ ID NO: 457327 - DNA, 15 bp, Homo sapiens
gaggggagatcaggg

SEQ ID NO: 457328 - DNA, 15 bp, Homo sapiens
aggggagatcagggt

SEQ ID NO: 457329 - DNA, 15 bp, Homo sapiens
ggggagatcagggtc

SEQ ID NO: 457330 - DNA, 15 bp, Homo sapiens
gggagatcagggtct

SEQ ID NO: 457331 - DNA, 15 bp, Homo sapiens
ggagatcagggtctg

SEQ ID NO: 457332 - DNA, 15 bp, Homo sapiens
gagatcagggtctgg

SEQ ID NO: 457333 - DNA, 15 bp, Homo sapiens
agatcagggtctgga

SEQ ID NO: 457334 - DNA, 15 bp, Homo sapiens
gatcagggtctggat

SEQ ID NO: 457335 - DNA, 15 bp, Homo sapiens
atcagggtctggatt

SEQ ID NO: 457336 - DNA, 15 bp, Homo sapiens
tcagggtctggattt

SEQ ID NO: 457337 - DNA, 15 bp, Homo sapiens
cagggtctggatttt

SEQ ID NO: 457338 - DNA, 15 bp, Homo sapiens
agggtctggattttt

SEQ ID NO: 457339 - DNA, 15 bp, Homo sapiens
gggtctggattttta

SEQ ID NO: 457340 - DNA, 15 bp, Homo sapiens
ggtctggatttttaa

SEQ ID NO: 457341 - DNA, 15 bp, Homo sapiens
gtctggatttttaag

SEQ ID NO: 457342 - DNA, 15 bp, Homo sapiens
tctggatttttaagg

SEQ ID NO: 457343 - DNA, 15 bp, Homo sapiens
ctggatttttaaggc

SEQ ID NO: 457344 - DNA, 15 bp, Homo sapiens
tggatttttaaggct

SEQ ID NO: 457345 - DNA, 15 bp, Homo sapiens
ggatttttaaggctg

SEQ ID NO: 457346 - DNA, 15 bp, Homo sapiens
gatttttaaggctgc

SEQ ID NO: 457347 - DNA, 15 bp, Homo sapiens
atttttaaggctgcc

SEQ ID NO: 457348 - DNA, 15 bp, Homo sapiens
tttttaaggctgcct

SEQ ID NO: 457349 - DNA, 15 bp, Homo sapiens
ttttaaggctgcctg

SEQ ID NO: 457350 - DNA, 15 bp, Homo sapiens
tttaaggctgcctga

SEQ ID NO: 457351 - DNA, 15 bp, Homo sapiens
ttaaggctgcctgag

SEQ ID NO: 457352 - DNA, 15 bp, Homo sapiens
taaggctgcctgagg

SEQ ID NO: 457353 - DNA, 15 bp, Homo sapiens
aaggctgcctgagga

SEQ ID NO: 457354 - DNA, 15 bp, Homo sapiens
aggctgcctgaggaa

SEQ ID NO: 457355 - DNA, 15 bp, Homo sapiens
ggctgcctgaggaag

SEQ ID NO: 457356 - DNA, 15 bp, Homo sapiens
gctgcctgaggaaga

SEQ ID NO: 457357 - DNA, 15 bp, Homo sapiens
ctgcctgaggaagaa

SEQ ID NO: 457358 - DNA, 15 bp, Homo sapiens
tgcctgaggaagaac

SEQ ID NO: 457359 - DNA, 15 bp, Homo sapiens
gcctgaggaagaact

SEQ ID NO: 457360 - DNA, 15 bp, Homo sapiens
cctgaggaagaactg

SEQ ID NO: 457361 - DNA, 15 bp, Homo sapiens
ctgaggaagaactga

SEQ ID NO: 457362 - DNA, 15 bp, Homo sapiens
tgaggaagaactgat

SEQ ID NO: 457363 - DNA, 15 bp, Homo sapiens
gaggaagaactgatg

SEQ ID NO: 457364 - DNA, 15 bp, Homo sapiens
ggaagaactgatgac

SEQ ID NO: 457365 - DNA, 15 bp, Homo sapiens
gaagaactgatgact

SEQ ID NO: 457366 - DNA, 15 bp, Homo sapiens
aagaactgatgactc

SEQ ID NO: 457367 - DNA, 15 bp, Homo sapiens
agaactgatgactcg

SEQ ID NO: 457368 - DNA, 15 bp, Homo sapiens
gaactgatgactcgg

SEQ ID NO: 457369 - DNA, 15 bp, Homo sapiens
aactgatgactcggg

SEQ ID NO: 457370 - DNA, 15 bp, Homo sapiens
actgatgactcgggg

SEQ ID NO: 457371 - DNA, 15 bp, Homo sapiens
ctgatgactcggggt

SEQ ID NO: 457372 - DNA, 15 bp, Homo sapiens
tgatgactcggggta

SEQ ID NO: 457373 - DNA, 15 bp, Homo sapiens
gatgactcggggtat

SEQ ID NO: 457374 - DNA, 15 bp, Homo sapiens
atgactcggggtatt

SEQ ID NO: 457375 - DNA, 15 bp, Homo sapiens
tgactcggggtattg

SEQ ID NO: 457376 - DNA, 15 bp, Homo sapiens
gactcggggtattgg

SEQ ID NO: 457377 - DNA, 15 bp, Homo sapiens
actcggggtattggg

SEQ ID NO: 457378 - DNA, 15 bp, Homo sapiens
ctcggggtattgggt

SEQ ID NO: 457379 - DNA, 15 bp, Homo sapiens
tcggggtattgggta

SEQ ID NO: 457380 - DNA, 15 bp, Homo sapiens
cggggtattgggtag

SEQ ID NO: 457381 - DNA, 15 bp, Homo sapiens
ggggtattgggtagt

SEQ ID NO: 457382 - DNA, 15 bp, Homo sapiens
gggtattgggtagtt

SEQ ID NO: 457383 - DNA, 15 bp, Homo sapiens
ggtattgggtagttg

SEQ ID NO: 457384 - DNA, 15 bp, Homo sapiens
gtattgggtagttgg

SEQ ID NO: 457385 - DNA, 15 bp, Homo sapiens
tattgggtagttggt

SEQ ID NO: 457386 - DNA, 15 bp, Homo sapiens
attgggtagttggta

SEQ ID NO: 457387 - DNA, 15 bp, Homo sapiens
ttgggtagttggtaa

SEQ ID NO: 457388 - DNA, 15 bp, Homo sapiens
tgggtagttggtaaa

SEQ ID NO: 457389 - DNA, 15 bp, Homo sapiens
gggtagttggtaaat

SEQ ID NO: 457390 - DNA, 15 bp, Homo sapiens
ggtagttggtaaatt

SEQ ID NO: 457391 - DNA, 15 bp, Homo sapiens
gtagttggtaaattg

SEQ ID NO: 457392 - DNA, 15 bp, Homo sapiens
tagttggtaaattgt

SEQ ID NO: 457393 - DNA, 15 bp, Homo sapiens
agttggtaaattgtg

SEQ ID NO: 457394 - DNA, 15 bp, Homo sapiens
gttggtaaattgtgg

SEQ ID NO: 457395 - DNA, 15 bp, Homo sapiens
ttggtaaattgtggc

SEQ ID NO: 457396 - DNA, 15 bp, Homo sapiens
tggtaaattgtggca

SEQ ID NO: 457397 - DNA, 15 bp, Homo sapiens
ggtaaattgtggcag

SEQ ID NO: 457398 - DNA, 15 bp, Homo sapiens
gtaaattgtggcagg

SEQ ID NO: 457399 - DNA, 15 bp, Homo sapiens
taaattgtggcaggt

SEQ ID NO: 457400 - DNA, 15 bp, Homo sapiens
aaattgtggcaggta

SEQ ID NO: 457401 - DNA, 15 bp, Homo sapiens
aattgtggcaggtag

SEQ ID NO: 457402 - DNA, 15 bp, Homo sapiens
attgtggcaggtaga

SEQ ID NO: 457403 - DNA, 15 bp, Homo sapiens
ttgtggcaggtagaa

SEQ ID NO: 457404 - DNA, 15 bp, Homo sapiens
tgtggcaggtagaag

SEQ ID NO: 457405 - DNA, 15 bp, Homo sapiens
gtggcaggtagaaga

SEQ ID NO: 457406 - DNA, 15 bp, Homo sapiens
tggcaggtagaagaa

SEQ ID NO: 457407 - DNA, 15 bp, Homo sapiens
ggcaggtagaagaag

SEQ ID NO: 457408 - DNA, 15 bp, Homo sapiens
gcaggtagaagaagg

SEQ ID NO: 457409 - DNA, 15 bp, Homo sapiens
caggtagaagaagga

SEQ ID NO: 457410 - DNA, 15 bp, Homo sapiens
aggtagaagaaggaa

SEQ ID NO: 457411 - DNA, 15 bp, Homo sapiens
ggtagaagaaggaag

SEQ ID NO: 457412 - DNA, 15 bp, Homo sapiens
gtagaagaaggaagg

SEQ ID NO: 457413 - DNA, 15 bp, Homo sapiens
tagaagaaggaagga

SEQ ID NO: 457414 - DNA, 15 bp, Homo sapiens
agaagaaggaaggat

SEQ ID NO: 457415 - DNA, 15 bp, Homo sapiens
gaagaaggaaggatg

SEQ ID NO: 457416 - DNA, 15 bp, Homo sapiens
aagaaggaaggatgt

SEQ ID NO: 457417 - DNA, 15 bp, Homo sapiens
agaaggaaggatgtt

SEQ ID NO: 457418 - DNA, 15 bp, Homo sapiens
gaaggaaggatgtta

SEQ ID NO: 457419 - DNA, 15 bp, Homo sapiens
aaggaaggatgttag

SEQ ID NO: 457420 - DNA, 15 bp, Homo sapiens
aggaaggatgttagg

SEQ ID NO: 457421 - DNA, 15 bp, Homo sapiens
ggaaggatgttagga

SEQ ID NO: 457422 - DNA, 15 bp, Homo sapiens
gaaggatgttaggat

SEQ ID NO: 457423 - DNA, 15 bp, Homo sapiens
aaggatgttaggata

SEQ ID NO: 457424 - DNA, 15 bp, Homo sapiens
aggatgttaggatat

SEQ ID NO: 457425 - DNA, 15 bp, Homo sapiens
ggatgttaggatatt

SEQ ID NO: 457426 - DNA, 15 bp, Homo sapiens
gatgttaggatattt

SEQ ID NO: 457427 - DNA, 15 bp, Homo sapiens
atgttaggatatttc

SEQ ID NO: 457428 - DNA, 15 bp, Homo sapiens
tgttaggatatttca

SEQ ID NO: 457429 - DNA, 15 bp, Homo sapiens
gttaggatatttcac

SEQ ID NO: 457430 - DNA, 15 bp, Homo sapiens
ttaggatatttcacg

SEQ ID NO: 457431 - DNA, 15 bp, Homo sapiens
taggatatttcacgg

SEQ ID NO: 457432 - DNA, 15 bp, Homo sapiens
aggatatttcacggt

SEQ ID NO: 457433 - DNA, 15 bp, Homo sapiens
ggatatttcacggtt

SEQ ID NO: 457434 - DNA, 15 bp, Homo sapiens
gatatttcacggttt

SEQ ID NO: 457435 - DNA, 15 bp, Homo sapiens
atatttcacggtttg

SEQ ID NO: 457436 - DNA, 15 bp, Homo sapiens
tatttcacggtttgc

SEQ ID NO: 457437 - DNA, 15 bp, Homo sapiens
atttcacggtttgca

SEQ ID NO: 457438 - DNA, 15 bp, Homo sapiens
tttcacggtttgcag

SEQ ID NO: 457439 - DNA, 15 bp, Homo sapiens
ttcacggtttgcaga

SEQ ID NO: 457440 - DNA, 15 bp, Homo sapiens
tcacggtttgcagac

SEQ ID NO: 457441 - DNA, 15 bp, Homo sapiens
cacggtttgcagact

SEQ ID NO: 457442 - DNA, 15 bp, Homo sapiens
acggtttgcagactg

SEQ ID NO: 457443 - DNA, 15 bp, Homo sapiens
cggtttgcagactgg

SEQ ID NO: 457444 - DNA, 15 bp, Homo sapiens
ggtttgcagactgga

SEQ ID NO: 457445 - DNA, 15 bp, Homo sapiens
gtttgcagactggat

SEQ ID NO: 457446 - DNA, 15 bp, Homo sapiens
tttgcagactggatt

SEQ ID NO: 457447 - DNA, 15 bp, Homo sapiens
ttgcagactggattt

SEQ ID NO: 457448 - DNA, 15 bp, Homo sapiens
tgcagactggatttc

SEQ ID NO: 457449 - DNA, 15 bp, Homo sapiens
gcagactggatttca

SEQ ID NO: 457450 - DNA, 15 bp, Homo sapiens
cagactggatttcat

SEQ ID NO: 457451 - DNA, 15 bp, Homo sapiens
agactggatttcatc

SEQ ID NO: 457452 - DNA, 15 bp, Homo sapiens
gactggatttcatca

SEQ ID NO: 457453 - DNA, 15 bp, Homo sapiens
actggatttcatcat

SEQ ID NO: 457454 - DNA, 15 bp, Homo sapiens
ctggatttcatcatg

SEQ ID NO: 457455 - DNA, 15 bp, Homo sapiens
tggatttcatcatga

SEQ ID NO: 457456 - DNA, 15 bp, Homo sapiens
ggatttcatcatgac

SEQ ID NO: 457457 - DNA, 15 bp, Homo sapiens
gatttcatcatgaca

SEQ ID NO: 457458 - DNA, 15 bp, Homo sapiens
atttcatcatgacaa

SEQ ID NO: 457459 - DNA, 15 bp, Homo sapiens
tttcatcatgacaag

SEQ ID NO: 457460 - DNA, 15 bp, Homo sapiens
ttcatcatgacaaga

SEQ ID NO: 457461 - DNA, 15 bp, Homo sapiens
tcatcatgacaagaa

SEQ ID NO: 457462 - DNA, 15 bp, Homo sapiens
catcatgacaagaag

SEQ ID NO: 457463 - DNA, 15 bp, Homo sapiens
atcatgacaagaagg

SEQ ID NO: 457464 - DNA, 15 bp, Homo sapiens
tcatgacaagaaggc

SEQ ID NO: 457465 - DNA, 15 bp, Homo sapiens
catgacaagaaggcc

SEQ ID NO: 457466 - DNA, 15 bp, Homo sapiens
atgacaagaaggcca

SEQ ID NO: 457467 - DNA, 15 bp, Homo sapiens
tgacaagaaggccag

SEQ ID NO: 457468 - DNA, 15 bp, Homo sapiens
gacaagaaggccagg

SEQ ID NO: 457469 - DNA, 15 bp, Homo sapiens
acaagaaggccaggc

SEQ ID NO: 457470 - DNA, 15 bp, Homo sapiens
caagaaggccaggcc

SEQ ID NO: 457471 - DNA, 15 bp, Homo sapiens
aagaaggccaggcct

SEQ ID NO: 457472 - DNA, 15 bp, Homo sapiens
agaaggccaggcctt

SEQ ID NO: 457473 - DNA, 15 bp, Homo sapiens
gaaggccaggccttt

SEQ ID NO: 457474 - DNA, 15 bp, Homo sapiens
aaggccaggccttta

SEQ ID NO: 457475 - DNA, 15 bp, Homo sapiens
aggccaggcctttat

SEQ ID NO: 457476 - DNA, 15 bp, Homo sapiens
ggccaggcctttatg

SEQ ID NO: 457477 - DNA, 15 bp, Homo sapiens
gccaggcctttatgg

SEQ ID NO: 457478 - DNA, 15 bp, Homo sapiens
ccaggcctttatggg

SEQ ID NO: 457479 - DNA, 15 bp, Homo sapiens
caggcctttatgggg

SEQ ID NO: 457480 - DNA, 15 bp, Homo sapiens
aggcctttatgggga

SEQ ID NO: 457481 - DNA, 15 bp, Homo sapiens
ggcctttatggggag

SEQ ID NO: 457482 - DNA, 15 bp, Homo sapiens
gcctttatggggaga

SEQ ID NO: 457483 - DNA, 15 bp, Homo sapiens
cctttatggggagag

SEQ ID NO: 457484 - DNA, 15 bp, Homo sapiens
ctttatggggagagg

SEQ ID NO: 457485 - DNA, 15 bp, Homo sapiens
tttatggggagaggt

SEQ ID NO: 457486 - DNA, 15 bp, Homo sapiens
ttatggggagaggtt

SEQ ID NO: 457487 - DNA, 15 bp, Homo sapiens
tatggggagaggttc

SEQ ID NO: 457488 - DNA, 15 bp, Homo sapiens
atggggagaggttcc

SEQ ID NO: 457489 - DNA, 15 bp, Homo sapiens
tggggagaggttcct

SEQ ID NO: 457490 - DNA, 15 bp, Homo sapiens
ggggagaggttcctg

SEQ ID NO: 457491 - DNA, 15 bp, Homo sapiens
gggagaggttcctga

SEQ ID NO: 457492 - DNA, 15 bp, Homo sapiens
ggagaggttcctgaa

SEQ ID NO: 457493 - DNA, 15 bp, Homo sapiens
gagaggttcctgaaa

SEQ ID NO: 457494 - DNA, 15 bp, Homo sapiens
agaggttcctgaaag

SEQ ID NO: 457495 - DNA, 15 bp, Homo sapiens
gaggttcctgaaaga

SEQ ID NO: 457496 - DNA, 15 bp, Homo sapiens
aggttcctgaaagag

SEQ ID NO: 457497 - DNA, 15 bp, Homo sapiens
ggttcctgaaagaga

SEQ ID NO: 457498 - DNA, 15 bp, Homo sapiens
gttcctgaaagagaa

SEQ ID NO: 457499 - DNA, 15 bp, Homo sapiens
ttcctgaaagagaat

SEQ ID NO: 457500 - DNA, 15 bp, Homo sapiens
tcctgaaagagaatt

SEQ ID NO: 457501 - DNA, 15 bp, Homo sapiens
cctgaaagagaatta

SEQ ID NO: 457502 - DNA, 15 bp, Homo sapiens
ctgaaagagaattat

SEQ ID NO: 457503 - DNA, 15 bp, Homo sapiens
tgaaagagaattata

SEQ ID NO: 457504 - DNA, 15 bp, Homo sapiens
gaaagagaattatat

SEQ ID NO: 457505 - DNA, 15 bp, Homo sapiens
aaagagaattatata

SEQ ID NO: 457506 - DNA, 15 bp, Homo sapiens
aagagaattatatag

SEQ ID NO: 457507 - DNA, 15 bp, Homo sapiens
agagaattatatagc

SEQ ID NO: 457508 - DNA, 15 bp, Homo sapiens
gagaattatatagct

SEQ ID NO: 457509 - DNA, 15 bp, Homo sapiens
agaattatatagctc

SEQ ID NO: 457510 - DNA, 15 bp, Homo sapiens
gaattatatagctct

SEQ ID NO: 457511 - DNA, 15 bp, Homo sapiens
aattatatagctctt

SEQ ID NO: 457512 - DNA, 15 bp, Homo sapiens
attatatagctcttg

SEQ ID NO: 457513 - DNA, 15 bp, Homo sapiens
ttatatagctcttgt

SEQ ID NO: 457514 - DNA, 15 bp, Homo sapiens
tatatagctcttgta

SEQ ID NO: 457515 - DNA, 15 bp, Homo sapiens
atatagctcttgtag

SEQ ID NO: 457516 - DNA, 15 bp, Homo sapiens
tatagctcttgtagg

SEQ ID NO: 457517 - DNA, 15 bp, Homo sapiens
atagctcttgtaggg

SEQ ID NO: 457518 - DNA, 15 bp, Homo sapiens
tagctcttgtaggga

SEQ ID NO: 457519 - DNA, 15 bp, Homo sapiens
agctcttgtagggat

SEQ ID NO: 457520 - DNA, 15 bp, Homo sapiens
gctcttgtagggatc

SEQ ID NO: 457521 - DNA, 15 bp, Homo sapiens
ctcttgtagggatca

SEQ ID NO: 457522 - DNA, 15 bp, Homo sapiens
tcttgtagggatcag

SEQ ID NO: 457523 - DNA, 15 bp, Homo sapiens
cttgtagggatcaga

SEQ ID NO: 457524 - DNA, 15 bp, Homo sapiens
ttgtagggatcagag

SEQ ID NO: 457525 - DNA, 15 bp, Homo sapiens
tgtagggatcagagc

SEQ ID NO: 457526 - DNA, 15 bp, Homo sapiens
gtagggatcagagca

SEQ ID NO: 457527 - DNA, 15 bp, Homo sapiens
tagggatcagagcaa

SEQ ID NO: 457528 - DNA, 15 bp, Homo sapiens
agggatcagagcaat

SEQ ID NO: 457529 - DNA, 15 bp, Homo sapiens
gggatcagagcaatg

SEQ ID NO: 457530 - DNA, 15 bp, Homo sapiens
ggatcagagcaatgg

SEQ ID NO: 457531 - DNA, 15 bp, Homo sapiens
gatcagagcaatggg

SEQ ID NO: 457532 - DNA, 15 bp, Homo sapiens
atcagagcaatggga

SEQ ID NO: 457533 - DNA, 15 bp, Homo sapiens
tcagagcaatgggac

SEQ ID NO: 457534 - DNA, 15 bp, Homo sapiens
cagagcaatgggaca

SEQ ID NO: 457535 - DNA, 15 bp, Homo sapiens
agagcaatgggacat

SEQ ID NO: 457536 - DNA, 15 bp, Homo sapiens
gagcaatgggacatg

SEQ ID NO: 457537 - DNA, 15 bp, Homo sapiens
agcaatgggacatgg

SEQ ID NO: 457538 - DNA, 15 bp, Homo sapiens
gcaatgggacatggg

SEQ ID NO: 457539 - DNA, 15 bp, Homo sapiens
caatgggacatgggt

SEQ ID NO: 457540 - DNA, 15 bp, Homo sapiens
aatgggacatgggtc

SEQ ID NO: 457541 - DNA, 15 bp, Homo sapiens
atgggacatgggtca

SEQ ID NO: 457542 - DNA, 15 bp, Homo sapiens
tgggacatgggtcaa

SEQ ID NO: 457543 - DNA, 15 bp, Homo sapiens
gggacatgggtcaag

SEQ ID NO: 457544 - DNA, 15 bp, Homo sapiens
ggacatgggtcaagt

SEQ ID NO: 457545 - DNA, 15 bp, Homo sapiens
gacatgggtcaagtg

SEQ ID NO: 457546 - DNA, 15 bp, Homo sapiens
acatgggtcaagtgt

SEQ ID NO: 457547 - DNA, 15 bp, Homo sapiens
catgggtcaagtgtt

SEQ ID NO: 457548 - DNA, 15 bp, Homo sapiens
atgggtcaagtgttg

SEQ ID NO: 457549 - DNA, 15 bp, Homo sapiens
tgggtcaagtgttga

SEQ ID NO: 457550 - DNA, 15 bp, Homo sapiens
gggtcaagtgttgag

SEQ ID NO: 457551 - DNA, 15 bp, Homo sapiens
ggtcaagtgttgagg

SEQ ID NO: 457552 - DNA, 15 bp, Homo sapiens
gtcaagtgttgaggc

SEQ ID NO: 457553 - DNA, 15 bp, Homo sapiens
tcaagtgttgaggca

SEQ ID NO: 457554 - DNA, 15 bp, Homo sapiens
caagtgttgaggcag

SEQ ID NO: 457555 - DNA, 15 bp, Homo sapiens
aagtgttgaggcagg

SEQ ID NO: 457556 - DNA, 15 bp, Homo sapiens
agtgttgaggcagga

SEQ ID NO: 457557 - DNA, 15 bp, Homo sapiens
gtgttgaggcaggag

SEQ ID NO: 457558 - DNA, 15 bp, Homo sapiens
tgttgaggcaggaga

SEQ ID NO: 457559 - DNA, 15 bp, Homo sapiens
gttgaggcaggagat

SEQ ID NO: 457560 - DNA, 15 bp, Homo sapiens
ttgaggcaggagatc

SEQ ID NO: 457561 - DNA, 15 bp, Homo sapiens
tgaggcaggagatca

SEQ ID NO: 457562 - DNA, 15 bp, Homo sapiens
gaggcaggagatcag

SEQ ID NO: 457563 - DNA, 15 bp, Homo sapiens
aggcaggagatcagc

SEQ ID NO: 457564 - DNA, 15 bp, Homo sapiens
ggcaggagatcagca

SEQ ID NO: 457565 - DNA, 15 bp, Homo sapiens
gcaggagatcagcag

SEQ ID NO: 457566 - DNA, 15 bp, Homo sapiens
caggagatcagcagg

SEQ ID NO: 457567 - DNA, 15 bp, Homo sapiens
aggagatcagcagga

SEQ ID NO: 457568 - DNA, 15 bp, Homo sapiens
ggagatcagcaggag

SEQ ID NO: 457569 - DNA, 15 bp, Homo sapiens
gagatcagcaggaga

SEQ ID NO: 457570 - DNA, 15 bp, Homo sapiens
agatcagcaggagaa

SEQ ID NO: 457571 - DNA, 15 bp, Homo sapiens
gatcagcaggagaaa

SEQ ID NO: 457572 - DNA, 15 bp, Homo sapiens
atcagcaggagaaaa

SEQ ID NO: 457573 - DNA, 15 bp, Homo sapiens
tcagcaggagaaaag

SEQ ID NO: 457574 - DNA, 15 bp, Homo sapiens
cagcaggagaaaaga

SEQ ID NO: 457575 - DNA, 15 bp, Homo sapiens
agcaggagaaaagag

SEQ ID NO: 457576 - DNA, 15 bp, Homo sapiens
gcaggagaaaagaga

SEQ ID NO: 457577 - DNA, 15 bp, Homo sapiens
caggagaaaagagaa

SEQ ID NO: 457578 - DNA, 15 bp, Homo sapiens
aggagaaaagagaat

SEQ ID NO: 457579 - DNA, 15 bp, Homo sapiens
ggagaaaagagaatc

SEQ ID NO: 457580 - DNA, 15 bp, Homo sapiens
gagaaaagagaatct

SEQ ID NO: 457581 - DNA, 15 bp, Homo sapiens
agaaaagagaatctg

SEQ ID NO: 457582 - DNA, 15 bp, Homo sapiens
gaaaagagaatctgg

SEQ ID NO: 457583 - DNA, 15 bp, Homo sapiens
aaaagagaatctgga

SEQ ID NO: 457584 - DNA, 15 bp, Homo sapiens
aaagagaatctggag

SEQ ID NO: 457585 - DNA, 15 bp, Homo sapiens
aagagaatctggagc

SEQ ID NO: 457586 - DNA, 15 bp, Homo sapiens
agagaatctggagcc

SEQ ID NO: 457587 - DNA, 15 bp, Homo sapiens
gagaatctggagcca

SEQ ID NO: 457588 - DNA, 15 bp, Homo sapiens
agaatctggagccat

SEQ ID NO: 457589 - DNA, 15 bp, Homo sapiens
gaatctggagccatc

SEQ ID NO: 457590 - DNA, 15 bp, Homo sapiens
aatctggagccatcc

SEQ ID NO: 457591 - DNA, 15 bp, Homo sapiens
atctggagccatcca

SEQ ID NO: 457592 - DNA, 15 bp, Homo sapiens
tctggagccatccaa

SEQ ID NO: 457593 - DNA, 15 bp, Homo sapiens
ctggagccatccaaa

SEQ ID NO: 457594 - DNA, 15 bp, Homo sapiens
tggagccatccaaag

SEQ ID NO: 457595 - DNA, 15 bp, Homo sapiens
ggagccatccaaaga

SEQ ID NO: 457596 - DNA, 15 bp, Homo sapiens
gagccatccaaagag

SEQ ID NO: 457597 - DNA, 15 bp, Homo sapiens
agccatccaaagaga

SEQ ID NO: 457598 - DNA, 15 bp, Homo sapiens
gccatccaaagagaa

SEQ ID NO: 457599 - DNA, 15 bp, Homo sapiens
ccatccaaagagaag

SEQ ID NO: 457600 - DNA, 15 bp, Homo sapiens
catccaaagagaagc

SEQ ID NO: 457601 - DNA, 15 bp, Homo sapiens
atccaaagagaagca

SEQ ID NO: 457602 - DNA, 15 bp, Homo sapiens
tccaaagagaagcaa

SEQ ID NO: 457603 - DNA, 15 bp, Homo sapiens
ccaaagagaagcaat

SEQ ID NO: 457604 - DNA, 15 bp, Homo sapiens
caaagagaagcaata

SEQ ID NO: 457605 - DNA, 15 bp, Homo sapiens
aaagagaagcaataa

SEQ ID NO: 457606 - DNA, 15 bp, Homo sapiens
aagagaagcaataat

SEQ ID NO: 457607 - DNA, 15 bp, Homo sapiens
agagaagcaataata

SEQ ID NO: 457608 - DNA, 15 bp, Homo sapiens
gagaagcaataatag

SEQ ID NO: 457609 - DNA, 15 bp, Homo sapiens
agaagcaataataga

SEQ ID NO: 457610 - DNA, 15 bp, Homo sapiens
gaagcaataatagaa

SEQ ID NO: 457611 - DNA, 15 bp, Homo sapiens
aagcaataatagaag

SEQ ID NO: 457612 - DNA, 15 bp, Homo sapiens
agcaataatagaagt

SEQ ID NO: 457613 - DNA, 15 bp, Homo sapiens
gcaataatagaagta

SEQ ID NO: 457614 - DNA, 15 bp, Homo sapiens
caataatagaagtaa

SEQ ID NO: 457615 - DNA, 15 bp, Homo sapiens
aataatagaagtaag

SEQ ID NO: 457616 - DNA, 15 bp, Homo sapiens
ataatagaagtaaga

SEQ ID NO: 457617 - DNA, 15 bp, Homo sapiens
taatagaagtaagag

SEQ ID NO: 457618 - DNA, 15 bp, Homo sapiens
aatagaagtaagagg

SEQ ID NO: 457619 - DNA, 15 bp, Homo sapiens
atagaagtaagagga

SEQ ID NO: 457620 - DNA, 15 bp, Homo sapiens
tagaagtaagaggag

SEQ ID NO: 457621 - DNA, 15 bp, Homo sapiens
agaagtaagaggagt

SEQ ID NO: 457622 - DNA, 15 bp, Homo sapiens
gaagtaagaggagtg

SEQ ID NO: 457623 - DNA, 15 bp, Homo sapiens
aagtaagaggagtga

SEQ ID NO: 457624 - DNA, 15 bp, Homo sapiens
agtaagaggagtgag

SEQ ID NO: 457625 - DNA, 15 bp, Homo sapiens
gtaagaggagtgagt

SEQ ID NO: 457626 - DNA, 15 bp, Homo sapiens
taagaggagtgagtg

SEQ ID NO: 457627 - DNA, 15 bp, Homo sapiens
aagaggagtgagtga

SEQ ID NO: 457628 - DNA, 15 bp, Homo sapiens
agaggagtgagtgag

SEQ ID NO: 457629 - DNA, 15 bp, Homo sapiens
gaggagtgagtgagg

SEQ ID NO: 457630 - DNA, 15 bp, Homo sapiens
aggagtgagtgaggg

SEQ ID NO: 457631 - DNA, 15 bp, Homo sapiens
ggagtgagtgagggc

SEQ ID NO: 457632 - DNA, 15 bp, Homo sapiens
gagtgagtgagggcc

SEQ ID NO: 457633 - DNA, 15 bp, Homo sapiens
agtgagtgagggcct

SEQ ID NO: 457634 - DNA, 15 bp, Homo sapiens
gtgagtgagggcctc

SEQ ID NO: 457635 - DNA, 15 bp, Homo sapiens
tgagtgagggcctca

SEQ ID NO: 457636 - DNA, 15 bp, Homo sapiens
gagtgagggcctcag

SEQ ID NO: 457637 - DNA, 15 bp, Homo sapiens
agtgagggcctcagg

SEQ ID NO: 457638 - DNA, 15 bp, Homo sapiens
gtgagggcctcaggc

SEQ ID NO: 457639 - DNA, 15 bp, Homo sapiens
tgagggcctcaggct

SEQ ID NO: 457640 - DNA, 15 bp, Homo sapiens
gagggcctcaggctc

SEQ ID NO: 457641 - DNA, 15 bp, Homo sapiens
agggcctcaggctca

SEQ ID NO: 457642 - DNA, 15 bp, Homo sapiens
gggcctcaggctcac

SEQ ID NO: 457643 - DNA, 15 bp, Homo sapiens
ggcctcaggctcaca

SEQ ID NO: 457644 - DNA, 15 bp, Homo sapiens
gcctcaggctcacag

SEQ ID NO: 457645 - DNA, 15 bp, Homo sapiens
cctcaggctcacaga

SEQ ID NO: 457646 - DNA, 15 bp, Homo sapiens
ctcaggctcacagaa

SEQ ID NO: 457647 - DNA, 15 bp, Homo sapiens
tcaggctcacagaat

SEQ ID NO: 457648 - DNA, 15 bp, Homo sapiens
caggctcacagaatg

SEQ ID NO: 457649 - DNA, 15 bp, Homo sapiens
aggctcacagaatga

SEQ ID NO: 457650 - DNA, 15 bp, Homo sapiens
ggctcacagaatgaa

SEQ ID NO: 457651 - DNA, 15 bp, Homo sapiens
gctcacagaatgaaa

SEQ ID NO: 457652 - DNA, 15 bp, Homo sapiens
ctcacagaatgaaat

SEQ ID NO: 457653 - DNA, 15 bp, Homo sapiens
tcacagaatgaaatg

SEQ ID NO: 457654 - DNA, 15 bp, Homo sapiens
cacagaatgaaatgc

SEQ ID NO: 457655 - DNA, 15 bp, Homo sapiens
acagaatgaaatgcc

SEQ ID NO: 457656 - DNA, 15 bp, Homo sapiens
cagaatgaaatgcca

SEQ ID NO: 457657 - DNA, 15 bp, Homo sapiens
agaatgaaatgccag

SEQ ID NO: 457658 - DNA, 15 bp, Homo sapiens
gaatgaaatgccaga

SEQ ID NO: 457659 - DNA, 15 bp, Homo sapiens
aatgaaatgccagat

SEQ ID NO: 457660 - DNA, 15 bp, Homo sapiens
atgaaatgccagatg

SEQ ID NO: 457661 - DNA, 15 bp, Homo sapiens
tgaaatgccagatgt

SEQ ID NO: 457662 - DNA, 15 bp, Homo sapiens
gaaatgccagatgtg

SEQ ID NO: 457663 - DNA, 15 bp, Homo sapiens
aaatgccagatgtga

SEQ ID NO: 457664 - DNA, 15 bp, Homo sapiens
aatgccagatgtgaa

SEQ ID NO: 457665 - DNA, 15 bp, Homo sapiens
atgccagatgtgaaa

SEQ ID NO: 457666 - DNA, 15 bp, Homo sapiens
tgccagatgtgaaac

SEQ ID NO: 457667 - DNA, 15 bp, Homo sapiens
gccagatgtgaaacc

SEQ ID NO: 457668 - DNA, 15 bp, Homo sapiens
ccagatgtgaaacct

SEQ ID NO: 457669 - DNA, 15 bp, Homo sapiens
cagatgtgaaacctt

SEQ ID NO: 457670 - DNA, 15 bp, Homo sapiens
agatgtgaaaccttg

SEQ ID NO: 457671 - DNA, 15 bp, Homo sapiens
gatgtgaaaccttga

SEQ ID NO: 457672 - DNA, 15 bp, Homo sapiens
atgtgaaaccttgag

SEQ ID NO: 457673 - DNA, 15 bp, Homo sapiens
tgtgaaaccttgagc

SEQ ID NO: 457674 - DNA, 15 bp, Homo sapiens
gtgaaaccttgagct

SEQ ID NO: 457675 - DNA, 15 bp, Homo sapiens
tgaaaccttgagctc

SEQ ID NO: 457676 - DNA, 15 bp, Homo sapiens
gaaaccttgagctct

SEQ ID NO: 457677 - DNA, 15 bp, Homo sapiens
aaaccttgagctctg

SEQ ID NO: 457678 - DNA, 15 bp, Homo sapiens
aaccttgagctctgc

SEQ ID NO: 457679 - DNA, 15 bp, Homo sapiens
accttgagctctgcc

SEQ ID NO: 457680 - DNA, 15 bp, Homo sapiens
ccttgagctctgcct

SEQ ID NO: 457681 - DNA, 15 bp, Homo sapiens
cttgagctctgccta

SEQ ID NO: 457682 - DNA, 15 bp, Homo sapiens
ttgagctctgcctat

SEQ ID NO: 457683 - DNA, 15 bp, Homo sapiens
tgagctctgcctata

SEQ ID NO: 457684 - DNA, 15 bp, Homo sapiens
gagctctgcctatat

SEQ ID NO: 457685 - DNA, 15 bp, Homo sapiens
agctctgcctatatt

SEQ ID NO: 457686 - DNA, 15 bp, Homo sapiens
gctctgcctatattt

SEQ ID NO: 457687 - DNA, 15 bp, Homo sapiens
ctctgcctatatttc

SEQ ID NO: 457688 - DNA, 15 bp, Homo sapiens
tctgcctatatttct

SEQ ID NO: 457689 - DNA, 15 bp, Homo sapiens
ctgcctatatttctg

SEQ ID NO: 457690 - DNA, 15 bp, Homo sapiens
tgcctatatttctgg

SEQ ID NO: 457691 - DNA, 15 bp, Homo sapiens
gcctatatttctggg

SEQ ID NO: 457692 - DNA, 15 bp, Homo sapiens
cctatatttctgggg

SEQ ID NO: 457693 - DNA, 15 bp, Homo sapiens
ctatatttctgggga

SEQ ID NO: 457694 - DNA, 15 bp, Homo sapiens
tatatttctggggaa

SEQ ID NO: 457695 - DNA, 15 bp, Homo sapiens
atatttctggggaag

SEQ ID NO: 457696 - DNA, 15 bp, Homo sapiens
tatttctggggaaga

SEQ ID NO: 457697 - DNA, 15 bp, Homo sapiens
atttctggggaagag

SEQ ID NO: 457698 - DNA, 15 bp, Homo sapiens
tttctggggaagaga

SEQ ID NO: 457699 - DNA, 15 bp, Homo sapiens
ttctggggaagagaa

SEQ ID NO: 457700 - DNA, 15 bp, Homo sapiens
tctggggaagagaag

SEQ ID NO: 457701 - DNA, 15 bp, Homo sapiens
ctggggaagagaaga

SEQ ID NO: 457702 - DNA, 15 bp, Homo sapiens
tggggaagagaagat

SEQ ID NO: 457703 - DNA, 15 bp, Homo sapiens
ggggaagagaagata

SEQ ID NO: 457704 - DNA, 15 bp, Homo sapiens
gggaagagaagatag

SEQ ID NO: 457705 - DNA, 15 bp, Homo sapiens
ggaagagaagatagg

SEQ ID NO: 457706 - DNA, 15 bp, Homo sapiens
gaagagaagataggg

SEQ ID NO: 457707 - DNA, 15 bp, Homo sapiens
aagagaagatagggg

SEQ ID NO: 457708 - DNA, 15 bp, Homo sapiens
agagaagatagggga

SEQ ID NO: 457709 - DNA, 15 bp, Homo sapiens
gagaagataggggaa

SEQ ID NO: 457710 - DNA, 15 bp, Homo sapiens
agaagataggggaaa

SEQ ID NO: 457711 - DNA, 15 bp, Homo sapiens
gaagataggggaaat

SEQ ID NO: 457712 - DNA, 15 bp, Homo sapiens
aagataggggaaatg

SEQ ID NO: 457713 - DNA, 15 bp, Homo sapiens
agataggggaaatgc

SEQ ID NO: 457714 - DNA, 15 bp, Homo sapiens
gataggggaaatgct

SEQ ID NO: 457715 - DNA, 15 bp, Homo sapiens
ataggggaaatgcta

SEQ ID NO: 457716 - DNA, 15 bp, Homo sapiens
taggggaaatgctaa

SEQ ID NO: 457717 - DNA, 15 bp, Homo sapiens
aggggaaatgctaat

SEQ ID NO: 457718 - DNA, 15 bp, Homo sapiens
ggggaaatgctaata

SEQ ID NO: 457719 - DNA, 15 bp, Homo sapiens
gggaaatgctaataa

SEQ ID NO: 457720 - DNA, 15 bp, Homo sapiens
ggaaatgctaataat

SEQ ID NO: 457721 - DNA, 15 bp, Homo sapiens
gaaatgctaataata

SEQ ID NO: 457722 - DNA, 15 bp, Homo sapiens
aaatgctaataataa

SEQ ID NO: 457723 - DNA, 15 bp, Homo sapiens
aatgctaataataat

SEQ ID NO: 457724 - DNA, 15 bp, Homo sapiens
atgctaataataata

SEQ ID NO: 457725 - DNA, 15 bp, Homo sapiens
tgctaataataataa

SEQ ID NO: 457726 - DNA, 15 bp, Homo sapiens
gctaataataataat

SEQ ID NO: 457727 - DNA, 15 bp, Homo sapiens
ctaataataataata

SEQ ID NO: 457728 - DNA, 15 bp, Homo sapiens
taataataataaaat

SEQ ID NO: 457729 - DNA, 15 bp, Homo sapiens
aataataataaaata

SEQ ID NO: 457730 - DNA, 15 bp, Homo sapiens
ataataataaaataa

SEQ ID NO: 457731 - DNA, 15 bp, Homo sapiens
taataataaaataaa

SEQ ID NO: 457732 - DNA, 15 bp, Homo sapiens
ataataaaataaaaa

SEQ ID NO: 457733 - DNA, 15 bp, Homo sapiens
taataaaataaaaaa

SEQ ID NO: 457734 - DNA, 15 bp, Homo sapiens
aataaaataaaaaaa

SEQ ID NO: 457735 - DNA, 15 bp, Homo sapiens
ataaaataaaaaaat

SEQ ID NO: 457736 - DNA, 15 bp, Homo sapiens
taaaataaaaaaata

SEQ ID NO: 457737 - DNA, 15 bp, Homo sapiens
aataaaaaaataaag

SEQ ID NO: 457738 - DNA, 15 bp, Homo sapiens
ataaaaaaataaaga

SEQ ID NO: 457739 - DNA, 15 bp, Homo sapiens
taaaaaaataaagaa

SEQ ID NO: 457740 - DNA, 15 bp, Homo sapiens
aaaaaaataaagaat

SEQ ID NO: 457741 - DNA, 15 bp, Homo sapiens
aaaaaataaagaatg

SEQ ID NO: 457742 - DNA, 15 bp, Homo sapiens
aaaaataaagaatgg

SEQ ID NO: 457743 - DNA, 15 bp, Homo sapiens
aaaataaagaatggc

SEQ ID NO: 457744 - DNA, 15 bp, Homo sapiens
aaataaagaatggcc

SEQ ID NO: 457745 - DNA, 15 bp, Homo sapiens
aataaagaatggcca

SEQ ID NO: 457746 - DNA, 15 bp, Homo sapiens
ataaagaatggccac

SEQ ID NO: 457747 - DNA, 15 bp, Homo sapiens
taaagaatggccaca

SEQ ID NO: 457748 - DNA, 15 bp, Homo sapiens
aaagaatggccacat

SEQ ID NO: 457749 - DNA, 15 bp, Homo sapiens
aagaatggccacata

SEQ ID NO: 457750 - DNA, 15 bp, Homo sapiens
agaatggccacatag

SEQ ID NO: 457751 - DNA, 15 bp, Homo sapiens
gaatggccacatagc

SEQ ID NO: 457752 - DNA, 15 bp, Homo sapiens
aatggccacatagct

SEQ ID NO: 457753 - DNA, 15 bp, Homo sapiens
atggccacatagctt

SEQ ID NO: 457754 - DNA, 15 bp, Homo sapiens
tggccacatagcttg

SEQ ID NO: 457755 - DNA, 15 bp, Homo sapiens
ggccacatagcttga

SEQ ID NO: 457756 - DNA, 15 bp, Homo sapiens
gccacatagcttgac

SEQ ID NO: 457757 - DNA, 15 bp, Homo sapiens
ccacatagcttgaca

SEQ ID NO: 457758 - DNA, 15 bp, Homo sapiens
cacatagcttgacac

SEQ ID NO: 457759 - DNA, 15 bp, Homo sapiens
acatagcttgacacc

SEQ ID NO: 457760 - DNA, 15 bp, Homo sapiens
catagcttgacacct

SEQ ID NO: 457761 - DNA, 15 bp, Homo sapiens
atagcttgacacctg

SEQ ID NO: 457762 - DNA, 15 bp, Homo sapiens
tagcttgacacctgg

SEQ ID NO: 457763 - DNA, 15 bp, Homo sapiens
agcttgacacctgga

SEQ ID NO: 457764 - DNA, 15 bp, Homo sapiens
gcttgacacctggag

SEQ ID NO: 457765 - DNA, 15 bp, Homo sapiens
cttgacacctggaga

SEQ ID NO: 457766 - DNA, 15 bp, Homo sapiens
ttgacacctggagaa

SEQ ID NO: 457767 - DNA, 15 bp, Homo sapiens
tgacacctggagaag

SEQ ID NO: 457768 - DNA, 15 bp, Homo sapiens
gacacctggagaagt

SEQ ID NO: 457769 - DNA, 15 bp, Homo sapiens
acacctggagaagtg

SEQ ID NO: 457770 - DNA, 15 bp, Homo sapiens
cacctggagaagtgt

SEQ ID NO: 457771 - DNA, 15 bp, Homo sapiens
acctggagaagtgtc

SEQ ID NO: 457772 - DNA, 15 bp, Homo sapiens
cctggagaagtgtca

SEQ ID NO: 457773 - DNA, 15 bp, Homo sapiens
ctggagaagtgtcac

SEQ ID NO: 457774 - DNA, 15 bp, Homo sapiens
tggagaagtgtcact

SEQ ID NO: 457775 - DNA, 15 bp, Homo sapiens
ggagaagtgtcactg

SEQ ID NO: 457776 - DNA, 15 bp, Homo sapiens
gagaagtgtcactga

SEQ ID NO: 457777 - DNA, 15 bp, Homo sapiens
agaagtgtcactgaa

SEQ ID NO: 457778 - DNA, 15 bp, Homo sapiens
gaagtgtcactgaag

SEQ ID NO: 457779 - DNA, 15 bp, Homo sapiens
aagtgtcactgaagc

SEQ ID NO: 457780 - DNA, 15 bp, Homo sapiens
agtgtcactgaagcc

SEQ ID NO: 457781 - DNA, 15 bp, Homo sapiens
gtgtcactgaagccc

SEQ ID NO: 457782 - DNA, 15 bp, Homo sapiens
tgtcactgaagccca

SEQ ID NO: 457783 - DNA, 15 bp, Homo sapiens
gtcactgaagcccaa

SEQ ID NO: 457784 - DNA, 15 bp, Homo sapiens
tcactgaagcccaag

SEQ ID NO: 457785 - DNA, 15 bp, Homo sapiens
cactgaagcccaaga

SEQ ID NO: 457786 - DNA, 15 bp, Homo sapiens
actgaagcccaagat

SEQ ID NO: 457787 - DNA, 15 bp, Homo sapiens
ctgaagcccaagatt

SEQ ID NO: 457788 - DNA, 15 bp, Homo sapiens
tgaagcccaagattg

SEQ ID NO: 457789 - DNA, 15 bp, Homo sapiens
gaagcccaagattgg

SEQ ID NO: 457790 - DNA, 15 bp, Homo sapiens
aagcccaagattgga

SEQ ID NO: 457791 - DNA, 15 bp, Homo sapiens
agcccaagattggat

SEQ ID NO: 457792 - DNA, 15 bp, Homo sapiens
gcccaagattggatg

SEQ ID NO: 457793 - DNA, 15 bp, Homo sapiens
cccaagattggatgc

SEQ ID NO: 457794 - DNA, 15 bp, Homo sapiens
ccaagattggatgct

SEQ ID NO: 457795 - DNA, 15 bp, Homo sapiens
caagattggatgctt

SEQ ID NO: 457796 - DNA, 15 bp, Homo sapiens
aagattggatgctta

SEQ ID NO: 457797 - DNA, 15 bp, Homo sapiens
agattggatgcttaa

SEQ ID NO: 457798 - DNA, 15 bp, Homo sapiens
gattggatgcttaac

SEQ ID NO: 457799 - DNA, 15 bp, Homo sapiens
attggatgcttaaca

SEQ ID NO: 457800 - DNA, 15 bp, Homo sapiens
ttggatgcttaacag

SEQ ID NO: 457801 - DNA, 15 bp, Homo sapiens
tggatgcttaacagt

SEQ ID NO: 457802 - DNA, 15 bp, Homo sapiens
ggatgcttaacagtg

SEQ ID NO: 457803 - DNA, 15 bp, Homo sapiens
gatgcttaacagtgt

SEQ ID NO: 457804 - DNA, 15 bp, Homo sapiens
atgcttaacagtgtt

SEQ ID NO: 457805 - DNA, 15 bp, Homo sapiens
tgcttaacagtgttc

SEQ ID NO: 457806 - DNA, 15 bp, Homo sapiens
gcttaacagtgttca

SEQ ID NO: 457807 - DNA, 15 bp, Homo sapiens
cttaacagtgttcat

SEQ ID NO: 457808 - DNA, 15 bp, Homo sapiens
ttaacagtgttcatt

SEQ ID NO: 457809 - DNA, 15 bp, Homo sapiens
taacagtgttcattg

SEQ ID NO: 457810 - DNA, 15 bp, Homo sapiens
aacagtgttcattgt

SEQ ID NO: 457811 - DNA, 15 bp, Homo sapiens
acagtgttcattgtt

SEQ ID NO: 457812 - DNA, 15 bp, Homo sapiens
cagtgttcattgttt

SEQ ID NO: 457813 - DNA, 15 bp, Homo sapiens
agtgttcattgtttt

SEQ ID NO: 457814 - DNA, 15 bp, Homo sapiens
gtgttcattgttttg

SEQ ID NO: 457815 - DNA, 15 bp, Homo sapiens
tgttcattgttttgc

SEQ ID NO: 457816 - DNA, 15 bp, Homo sapiens
gttcattgttttgca

SEQ ID NO: 457817 - DNA, 15 bp, Homo sapiens
cattgttttgcagaa

SEQ ID NO: 457818 - DNA, 15 bp, Homo sapiens
attgttttgcagaac

SEQ ID NO: 457819 - DNA, 15 bp, Homo sapiens
ttgttttgcagaaca

SEQ ID NO: 457820 - DNA, 15 bp, Homo sapiens
tgttttgcagaacag

SEQ ID NO: 457821 - DNA, 15 bp, Homo sapiens
gttttgcagaacagg

SEQ ID NO: 457822 - DNA, 15 bp, Homo sapiens
ttttgcagaacagga

SEQ ID NO: 457823 - DNA, 15 bp, Homo sapiens
tttgcagaacaggag

SEQ ID NO: 457824 - DNA, 15 bp, Homo sapiens
ttgcagaacaggaga

SEQ ID NO: 457825 - DNA, 15 bp, Homo sapiens
tgcagaacaggagaa

SEQ ID NO: 457826 - DNA, 15 bp, Homo sapiens
gcagaacaggagaat

SEQ ID NO: 457827 - DNA, 15 bp, Homo sapiens
cagaacaggagaatg

SEQ ID NO: 457828 - DNA, 15 bp, Homo sapiens
agaacaggagaatga

SEQ ID NO: 457829 - DNA, 15 bp, Homo sapiens
gaacaggagaatgat

SEQ ID NO: 457830 - DNA, 15 bp, Homo sapiens
aacaggagaatgatg

SEQ ID NO: 457831 - DNA, 15 bp, Homo sapiens
acaggagaatgatga

SEQ ID NO: 457832 - DNA, 15 bp, Homo sapiens
caggagaatgatgat

SEQ ID NO: 457833 - DNA, 15 bp, Homo sapiens
aggagaatgatgatg

SEQ ID NO: 457834 - DNA, 15 bp, Homo sapiens
ggagaatgatgatgc

SEQ ID NO: 457835 - DNA, 15 bp, Homo sapiens
gagaatgatgatgca

SEQ ID NO: 457836 - DNA, 15 bp, Homo sapiens
agaatgatgatgcat

SEQ ID NO: 457837 - DNA, 15 bp, Homo sapiens
gaatgatgatgcatt

SEQ ID NO: 457838 - DNA, 15 bp, Homo sapiens
aatgatgatgcattt

SEQ ID NO: 457839 - DNA, 15 bp, Homo sapiens
atgatgatgcatttc

SEQ ID NO: 457840 - DNA, 15 bp, Homo sapiens
tgatgatgcatttct

SEQ ID NO: 457841 - DNA, 15 bp, Homo sapiens
gatgatgcatttcta

SEQ ID NO: 457842 - DNA, 15 bp, Homo sapiens
atgatgcatttctat

SEQ ID NO: 457843 - DNA, 15 bp, Homo sapiens
tgatgcatttctatt

SEQ ID NO: 457844 - DNA, 15 bp, Homo sapiens
gatgcatttctattc

SEQ ID NO: 457845 - DNA, 15 bp, Homo sapiens
atgcatttctattcc

SEQ ID NO: 457846 - DNA, 15 bp, Homo sapiens
tgcatttctattcca

SEQ ID NO: 457847 - DNA, 15 bp, Homo sapiens
gcatttctattccat

SEQ ID NO: 457848 - DNA, 15 bp, Homo sapiens
catttctattccatc

SEQ ID NO: 457849 - DNA, 15 bp, Homo sapiens
atttctattccatcc

SEQ ID NO: 457850 - DNA, 15 bp, Homo sapiens
tttctattccatccc

SEQ ID NO: 457851 - DNA, 15 bp, Homo sapiens
ttctattccatcccc

SEQ ID NO: 457852 - DNA, 15 bp, Homo sapiens
tctattccatcccct

SEQ ID NO: 457853 - DNA, 15 bp, Homo sapiens
ctattccatcccctg

SEQ ID NO: 457854 - DNA, 15 bp, Homo sapiens
tattccatcccctgt

SEQ ID NO: 457855 - DNA, 15 bp, Homo sapiens
attccatcccctgtg

SEQ ID NO: 457856 - DNA, 15 bp, Homo sapiens
ttccatcccctgtgc

SEQ ID NO: 457857 - DNA, 15 bp, Homo sapiens
tccatcccctgtgcc

SEQ ID NO: 457858 - DNA, 15 bp, Homo sapiens
ccatcccctgtgcct

SEQ ID NO: 457859 - DNA, 15 bp, Homo sapiens
catcccctgtgcctt

SEQ ID NO: 457860 - DNA, 15 bp, Homo sapiens
atcccctgtgccttg

SEQ ID NO: 457861 - DNA, 15 bp, Homo sapiens
tcccctgtgccttgt

SEQ ID NO: 457862 - DNA, 15 bp, Homo sapiens
cccctgtgccttgta

SEQ ID NO: 457863 - DNA, 15 bp, Homo sapiens
ccctgtgccttgtat

SEQ ID NO: 457864 - DNA, 15 bp, Homo sapiens
cctgtgccttgtatg

SEQ ID NO: 457865 - DNA, 15 bp, Homo sapiens
ctgtgccttgtatgt

SEQ ID NO: 457866 - DNA, 15 bp, Homo sapiens
tgtgccttgtatgtg

SEQ ID NO: 457867 - DNA, 15 bp, Homo sapiens
gtgccttgtatgtgg

SEQ ID NO: 457868 - DNA, 15 bp, Homo sapiens
tgccttgtatgtggg

SEQ ID NO: 457869 - DNA, 15 bp, Homo sapiens
gccttgtatgtggga

SEQ ID NO: 457870 - DNA, 15 bp, Homo sapiens
ccttgtatgtgggat

SEQ ID NO: 457871 - DNA, 15 bp, Homo sapiens
cttgtatgtgggatt

SEQ ID NO: 457872 - DNA, 15 bp, Homo sapiens
ttgtatgtgggatta

SEQ ID NO: 457873 - DNA, 15 bp, Homo sapiens
tgtatgtgggattaa

SEQ ID NO: 457874 - DNA, 15 bp, Homo sapiens
gtatgtgggattaaa

SEQ ID NO: 457875 - DNA, 15 bp, Homo sapiens
tatgtgggattaaag

SEQ ID NO: 457876 - DNA, 15 bp, Homo sapiens
atgtgggattaaaga

SEQ ID NO: 457877 - DNA, 15 bp, Homo sapiens
tgtgggattaaagaa

SEQ ID NO: 457878 - DNA, 15 bp, Homo sapiens
gtgggattaaagaaa

SEQ ID NO: 457879 - DNA, 15 bp, Homo sapiens
tgggattaaagaaaa

SEQ ID NO: 457880 - DNA, 15 bp, Homo sapiens
gggattaaagaaaaa

SEQ ID NO: 457881 - DNA, 15 bp, Homo sapiens
attaaagaaaaagtc

SEQ ID NO: 457882 - DNA, 15 bp, Homo sapiens
ttaaagaaaaagtca

SEQ ID NO: 457883 - DNA, 15 bp, Homo sapiens
taaagaaaaagtcag

SEQ ID NO: 457884 - DNA, 15 bp, Homo sapiens
aaagaaaaagtcaga

SEQ ID NO: 457885 - DNA, 15 bp, Homo sapiens
aagaaaaagtcagaa

SEQ ID NO: 457886 - DNA, 15 bp, Homo sapiens
agaaaaagtcagaaa

SEQ ID NO: 457887 - DNA, 15 bp, Homo sapiens
gaaaaagtcagaaag

SEQ ID NO: 457888 - DNA, 15 bp, Homo sapiens
aaaaagtcagaaagt

SEQ ID NO: 457889 - DNA, 15 bp, Homo sapiens
aaaagtcagaaagtt

SEQ ID NO: 457890 - DNA, 15 bp, Homo sapiens
aaagtcagaaagttg

SEQ ID NO: 457891 - DNA, 15 bp, Homo sapiens
aagtcagaaagttgg

SEQ ID NO: 457892 - DNA, 15 bp, Homo sapiens
agtcagaaagttgga

SEQ ID NO: 457893 - DNA, 15 bp, Homo sapiens
gtcagaaagttggat

SEQ ID NO: 457894 - DNA, 15 bp, Homo sapiens
tcagaaagttggata

SEQ ID NO: 457895 - DNA, 15 bp, Homo sapiens
cagaaagttggatag

SEQ ID NO: 457896 - DNA, 15 bp, Homo sapiens
agaaagttggataga

SEQ ID NO: 457897 - DNA, 15 bp, Homo sapiens
gaaagttggatagaa

SEQ ID NO: 457898 - DNA, 15 bp, Homo sapiens
aaagttggatagaaa

SEQ ID NO: 457899 - DNA, 15 bp, Homo sapiens
aagttggatagaaaa

SEQ ID NO: 457900 - DNA, 15 bp, Homo sapiens
agttggatagaaaat

SEQ ID NO: 457901 - DNA, 15 bp, Homo sapiens
gttggatagaaaatg

SEQ ID NO: 457902 - DNA, 15 bp, Homo sapiens
ttggatagaaaatga

SEQ ID NO: 457903 - DNA, 15 bp, Homo sapiens
tggatagaaaatgat

SEQ ID NO: 457904 - DNA, 15 bp, Homo sapiens
ggatagaaaatgatt

SEQ ID NO: 457905 - DNA, 15 bp, Homo sapiens
gatagaaaatgatta

SEQ ID NO: 457906 - DNA, 15 bp, Homo sapiens
atagaaaatgattat

SEQ ID NO: 457907 - DNA, 15 bp, Homo sapiens
tagaaaatgattatg

SEQ ID NO: 457908 - DNA, 15 bp, Homo sapiens
agaaaatgattatgc

SEQ ID NO: 457909 - DNA, 15 bp, Homo sapiens
gaaaatgattatgct

SEQ ID NO: 457910 - DNA, 15 bp, Homo sapiens
aaaatgattatgctg

SEQ ID NO: 457911 - DNA, 15 bp, Homo sapiens
aaatgattatgctgt

SEQ ID NO: 457912 - DNA, 15 bp, Homo sapiens
aatgattatgctgtt

SEQ ID NO: 457913 - DNA, 15 bp, Homo sapiens
atgattatgctgttt

SEQ ID NO: 457914 - DNA, 15 bp, Homo sapiens
tgattatgctgtttg

SEQ ID NO: 457915 - DNA, 15 bp, Homo sapiens
gattatgctgtttgt

SEQ ID NO: 457916 - DNA, 15 bp, Homo sapiens
attatgctgtttgtt

SEQ ID NO: 457917 - DNA, 15 bp, Homo sapiens
ttatgctgtttgttt

SEQ ID NO: 457918 - DNA, 15 bp, Homo sapiens
tatgctgtttgtttc

SEQ ID NO: 457919 - DNA, 15 bp, Homo sapiens
atgctgtttgtttca

SEQ ID NO: 457920 - DNA, 15 bp, Homo sapiens
tgctgtttgtttcat

SEQ ID NO: 457921 - DNA, 15 bp, Homo sapiens
gctgtttgtttcatt

SEQ ID NO: 457922 - DNA, 15 bp, Homo sapiens
ctgtttgtttcattt

SEQ ID NO: 457923 - DNA, 15 bp, Homo sapiens
tgtttgtttcattta

SEQ ID NO: 457924 - DNA, 15 bp, Homo sapiens
gtttgtttcatttac

SEQ ID NO: 457925 - DNA, 15 bp, Homo sapiens
tttgtttcatttacc

SEQ ID NO: 457926 - DNA, 15 bp, Homo sapiens
ttgtttcatttacca

SEQ ID NO: 457927 - DNA, 15 bp, Homo sapiens
tgtttcatttaccac

SEQ ID NO: 457928 - DNA, 15 bp, Homo sapiens
gtttcatttaccaca

SEQ ID NO: 457929 - DNA, 15 bp, Homo sapiens
tttcatttaccacat

SEQ ID NO: 457930 - DNA, 15 bp, Homo sapiens
ttcatttaccacatg

SEQ ID NO: 457931 - DNA, 15 bp, Homo sapiens
tcatttaccacatga

SEQ ID NO: 457932 - DNA, 15 bp, Homo sapiens
catttaccacatgac

SEQ ID NO: 457933 - DNA, 15 bp, Homo sapiens
atttaccacatgact

SEQ ID NO: 457934 - DNA, 15 bp, Homo sapiens
tttaccacatgactg

SEQ ID NO: 457935 - DNA, 15 bp, Homo sapiens
ttaccacatgactga

SEQ ID NO: 457936 - DNA, 15 bp, Homo sapiens
taccacatgactgag

SEQ ID NO: 457937 - DNA, 15 bp, Homo sapiens
accacatgactgagc

SEQ ID NO: 457938 - DNA, 15 bp, Homo sapiens
ccacatgactgagct

SEQ ID NO: 457939 - DNA, 15 bp, Homo sapiens
cacatgactgagctg

SEQ ID NO: 457940 - DNA, 15 bp, Homo sapiens
acatgactgagctgt

SEQ ID NO: 457941 - DNA, 15 bp, Homo sapiens
catgactgagctgtc

SEQ ID NO: 457942 - DNA, 15 bp, Homo sapiens
atgactgagctgtca

SEQ ID NO: 457943 - DNA, 15 bp, Homo sapiens
tgactgagctgtcat

SEQ ID NO: 457944 - DNA, 15 bp, Homo sapiens
gactgagctgtcatt

SEQ ID NO: 457945 - DNA, 15 bp, Homo sapiens
actgagctgtcattt

SEQ ID NO: 457946 - DNA, 15 bp, Homo sapiens
ctgagctgtcatttg

SEQ ID NO: 457947 - DNA, 15 bp, Homo sapiens
tgagctgtcatttgt

SEQ ID NO: 457948 - DNA, 15 bp, Homo sapiens
gagctgtcatttgtc

SEQ ID NO: 457949 - DNA, 15 bp, Homo sapiens
agctgtcatttgtct

SEQ ID NO: 457950 - DNA, 15 bp, Homo sapiens
gctgtcatttgtctc

SEQ ID NO: 457951 - DNA, 15 bp, Homo sapiens
ctgtcatttgtctcc

SEQ ID NO: 457952 - DNA, 15 bp, Homo sapiens
tgtcatttgtctccc

SEQ ID NO: 457953 - DNA, 15 bp, Homo sapiens
gtcatttgtctccct

SEQ ID NO: 457954 - DNA, 15 bp, Homo sapiens
tcatttgtctccctt

SEQ ID NO: 457955 - DNA, 15 bp, Homo sapiens
catttgtctcccttt

SEQ ID NO: 457956 - DNA, 15 bp, Homo sapiens
atttgtctccctttg

SEQ ID NO: 457957 - DNA, 15 bp, Homo sapiens
tttgtctccctttga

SEQ ID NO: 457958 - DNA, 15 bp, Homo sapiens
ttgtctccctttgaa

SEQ ID NO: 457959 - DNA, 15 bp, Homo sapiens
tgtctccctttgaaa

SEQ ID NO: 457960 - DNA, 15 bp, Homo sapiens
gtctccctttgaaat

SEQ ID NO: 457961 - DNA, 15 bp, Homo sapiens
tctccctttgaaatg

SEQ ID NO: 457962 - DNA, 15 bp, Homo sapiens
ctccctttgaaatga

SEQ ID NO: 457963 - DNA, 15 bp, Homo sapiens
tccctttgaaatgag

SEQ ID NO: 457964 - DNA, 15 bp, Homo sapiens
ccctttgaaatgaga

SEQ ID NO: 457965 - DNA, 15 bp, Homo sapiens
cctttgaaatgagaa

SEQ ID NO: 457966 - DNA, 15 bp, Homo sapiens
ctttgaaatgagaaa

SEQ ID NO: 457967 - DNA, 15 bp, Homo sapiens
tttgaaatgagaaaa

SEQ ID NO: 457968 - DNA, 15 bp, Homo sapiens
ttgaaatgagaaaat

SEQ ID NO: 457969 - DNA, 15 bp, Homo sapiens
tgaaatgagaaaatc

SEQ ID NO: 457970 - DNA, 15 bp, Homo sapiens
gaaatgagaaaatct

SEQ ID NO: 457971 - DNA, 15 bp, Homo sapiens
aaatgagaaaatctt

SEQ ID NO: 457972 - DNA, 15 bp, Homo sapiens
aatgagaaaatctta

SEQ ID NO: 457973 - DNA, 15 bp, Homo sapiens
atgagaaaatcttaa

SEQ ID NO: 457974 - DNA, 15 bp, Homo sapiens
tgagaaaatcttaat

SEQ ID NO: 457975 - DNA, 15 bp, Homo sapiens
gagaaaatcttaatc

SEQ ID NO: 457976 - DNA, 15 bp, Homo sapiens
agaaaatcttaatca

SEQ ID NO: 457977 - DNA, 15 bp, Homo sapiens
gaaaatcttaatcat

SEQ ID NO: 457978 - DNA, 15 bp, Homo sapiens
aaaatcttaatcata

SEQ ID NO: 457979 - DNA, 15 bp, Homo sapiens
aaatcttaatcataa

SEQ ID NO: 457980 - DNA, 15 bp, Homo sapiens
aatcttaatcataat

SEQ ID NO: 457981 - DNA, 15 bp, Homo sapiens
atcttaatcataatt

SEQ ID NO: 457982 - DNA, 15 bp, Homo sapiens
tcttaatcataattt

SEQ ID NO: 457983 - DNA, 15 bp, Homo sapiens
cttaatcataatttt

SEQ ID NO: 457984 - DNA, 15 bp, Homo sapiens
ttaatcataattttc

SEQ ID NO: 457985 - DNA, 15 bp, Homo sapiens
taatcataattttct

SEQ ID NO: 457986 - DNA, 15 bp, Homo sapiens
aatcataattttctg

SEQ ID NO: 457987 - DNA, 15 bp, Homo sapiens
atcataattttctgt

SEQ ID NO: 457988 - DNA, 15 bp, Homo sapiens
tcataattttctgtg

SEQ ID NO: 457989 - DNA, 15 bp, Homo sapiens
cataattttctgtga

SEQ ID NO: 457990 - DNA, 15 bp, Homo sapiens
ataattttctgtgat

SEQ ID NO: 457991 - DNA, 15 bp, Homo sapiens
taattttctgtgatt

SEQ ID NO: 457992 - DNA, 15 bp, Homo sapiens
aattttctgtgattt

SEQ ID NO: 457993 - DNA, 15 bp, Homo sapiens
attttctgtgattta

SEQ ID NO: 457994 - DNA, 15 bp, Homo sapiens
ttttctgtgatttaa

SEQ ID NO: 457995 - DNA, 15 bp, Homo sapiens
tttctgtgatttaaa

SEQ ID NO: 457996 - DNA, 15 bp, Homo sapiens
tctgtgatttaaatg

SEQ ID NO: 457997 - DNA, 15 bp, Homo sapiens
ctgtgatttaaatgt

SEQ ID NO: 457998 - DNA, 15 bp, Homo sapiens
tgtgatttaaatgta

SEQ ID NO: 457999 - DNA, 15 bp, Homo sapiens
gtgatttaaatgtag

SEQ ID NO: 458000 - DNA, 15 bp, Homo sapiens
tgatttaaatgtagt

SEQ ID NO: 458001 - DNA, 15 bp, Homo sapiens
gatttaaatgtagtc

SEQ ID NO: 458002 - DNA, 15 bp, Homo sapiens
atttaaatgtagtca

SEQ ID NO: 458003 - DNA, 15 bp, Homo sapiens
tttaaatgtagtcag

SEQ ID NO: 458004 - DNA, 15 bp, Homo sapiens
ttaaatgtagtcagt

SEQ ID NO: 458005 - DNA, 15 bp, Homo sapiens
taaatgtagtcagtt

SEQ ID NO: 458006 - DNA, 15 bp, Homo sapiens
aaatgtagtcagttc

SEQ ID NO: 458007 - DNA, 15 bp, Homo sapiens
aatgtagtcagttct

SEQ ID NO: 458008 - DNA, 15 bp, Homo sapiens
atgtagtcagttctt

SEQ ID NO: 458009 - DNA, 15 bp, Homo sapiens
tgtagtcagttcttt

SEQ ID NO: 458010 - DNA, 15 bp, Homo sapiens
gtagtcagttcttta

SEQ ID NO: 458011 - DNA, 15 bp, Homo sapiens
tagtcagttctttaa

SEQ ID NO: 458012 - DNA, 15 bp, Homo sapiens
agtcagttctttaaa

SEQ ID NO: 458013 - DNA, 15 bp, Homo sapiens
gtcagttctttaaag

SEQ ID NO: 458014 - DNA, 15 bp, Homo sapiens
tcagttctttaaagg

SEQ ID NO: 458015 - DNA, 15 bp, Homo sapiens
cagttctttaaaggt

SEQ ID NO: 458016 - DNA, 15 bp, Homo sapiens
agttctttaaaggta

SEQ ID NO: 458017 - DNA, 15 bp, Homo sapiens
gttctttaaaggtac

SEQ ID NO: 458018 - DNA, 15 bp, Homo sapiens
ttctttaaaggtacc

SEQ ID NO: 458019 - DNA, 15 bp, Homo sapiens
tctttaaaggtacct

SEQ ID NO: 458020 - DNA, 15 bp, Homo sapiens
ctttaaaggtaccta

SEQ ID NO: 458021 - DNA, 15 bp, Homo sapiens
tttaaaggtacctaa

SEQ ID NO: 458022 - DNA, 15 bp, Homo sapiens
ttaaaggtacctaaa

SEQ ID NO: 458023 - DNA, 15 bp, Homo sapiens
taaaggtacctaaat

SEQ ID NO: 458024 - DNA, 15 bp, Homo sapiens
aaaggtacctaaatg

SEQ ID NO: 458025 - DNA, 15 bp, Homo sapiens
aaggtacctaaatgt

SEQ ID NO: 458026 - DNA, 15 bp, Homo sapiens
aggtacctaaatgtg

SEQ ID NO: 458027 - DNA, 15 bp, Homo sapiens
ggtacctaaatgtga

SEQ ID NO: 458028 - DNA, 15 bp, Homo sapiens
gtacctaaatgtgac

SEQ ID NO: 458029 - DNA, 15 bp, Homo sapiens
tacctaaatgtgaca

SEQ ID NO: 458030 - DNA, 15 bp, Homo sapiens
acctaaatgtgacac

SEQ ID NO: 458031 - DNA, 15 bp, Homo sapiens
cctaaatgtgacaca

SEQ ID NO: 458032 - DNA, 15 bp, Homo sapiens
ctaaatgtgacacac

SEQ ID NO: 458033 - DNA, 15 bp, Homo sapiens
taaatgtgacacact

SEQ ID NO: 458034 - DNA, 15 bp, Homo sapiens
aaatgtgacacactt

SEQ ID NO: 458035 - DNA, 15 bp, Homo sapiens
aatgtgacacacttc

SEQ ID NO: 458036 - DNA, 15 bp, Homo sapiens
atgtgacacacttca

SEQ ID NO: 458037 - DNA, 15 bp, Homo sapiens
tgtgacacacttcag

SEQ ID NO: 458038 - DNA, 15 bp, Homo sapiens
gtgacacacttcagg

SEQ ID NO: 458039 - DNA, 15 bp, Homo sapiens
tgacacacttcagga

SEQ ID NO: 458040 - DNA, 15 bp, Homo sapiens
gacacacttcaggaa

SEQ ID NO: 458041 - DNA, 15 bp, Homo sapiens
acacacttcaggaag

SEQ ID NO: 458042 - DNA, 15 bp, Homo sapiens
cacacttcaggaaga

SEQ ID NO: 458043 - DNA, 15 bp, Homo sapiens
acacttcaggaagat

SEQ ID NO: 458044 - DNA, 15 bp, Homo sapiens
cacttcaggaagatt

SEQ ID NO: 458045 - DNA, 15 bp, Homo sapiens
acttcaggaagattt

SEQ ID NO: 458046 - DNA, 15 bp, Homo sapiens
cttcaggaagattta

SEQ ID NO: 458047 - DNA, 15 bp, Homo sapiens
ttcaggaagatttac

SEQ ID NO: 458048 - DNA, 15 bp, Homo sapiens
tcaggaagatttacg

SEQ ID NO: 458049 - DNA, 15 bp, Homo sapiens
caggaagatttacgc

SEQ ID NO: 458050 - DNA, 15 bp, Homo sapiens
aggaagatttacgct

SEQ ID NO: 458051 - DNA, 15 bp, Homo sapiens
ggaagatttacgctt

SEQ ID NO: 458052 - DNA, 15 bp, Homo sapiens
gaagatttacgcttg

SEQ ID NO: 458053 - DNA, 15 bp, Homo sapiens
aagatttacgcttga

SEQ ID NO: 458054 - DNA, 15 bp, Homo sapiens
agatttacgcttgac

SEQ ID NO: 458055 - DNA, 15 bp, Homo sapiens
gatttacgcttgact

SEQ ID NO: 458056 - DNA, 15 bp, Homo sapiens
atttacgcttgactt

SEQ ID NO: 458057 - DNA, 15 bp, Homo sapiens
tttacgcttgactta

SEQ ID NO: 458058 - DNA, 15 bp, Homo sapiens
ttacgcttgacttag

SEQ ID NO: 458059 - DNA, 15 bp, Homo sapiens
tacgcttgacttagg

SEQ ID NO: 458060 - DNA, 15 bp, Homo sapiens
acgcttgacttaggc

SEQ ID NO: 458061 - DNA, 15 bp, Homo sapiens
cgcttgacttaggca

SEQ ID NO: 458062 - DNA, 15 bp, Homo sapiens
gcttgacttaggcac

SEQ ID NO: 458063 - DNA, 15 bp, Homo sapiens
cttgacttaggcact

SEQ ID NO: 458064 - DNA, 15 bp, Homo sapiens
ttgacttaggcacta

SEQ ID NO: 458065 - DNA, 15 bp, Homo sapiens
tgacttaggcactaa

SEQ ID NO: 458066 - DNA, 15 bp, Homo sapiens
gacttaggcactaag

SEQ ID NO: 458067 - DNA, 15 bp, Homo sapiens
acttaggcactaaga

SEQ ID NO: 458068 - DNA, 15 bp, Homo sapiens
cttaggcactaagac

SEQ ID NO: 458069 - DNA, 15 bp, Homo sapiens
ttaggcactaagaca

SEQ ID NO: 458070 - DNA, 15 bp, Homo sapiens
taggcactaagacaa

SEQ ID NO: 458071 - DNA, 15 bp, Homo sapiens
aggcactaagacaaa

SEQ ID NO: 458072 - DNA, 15 bp, Homo sapiens
ggcactaagacaaag

SEQ ID NO: 458073 - DNA, 15 bp, Homo sapiens
gcactaagacaaagt

SEQ ID NO: 458074 - DNA, 15 bp, Homo sapiens
cactaagacaaagtg

SEQ ID NO: 458075 - DNA, 15 bp, Homo sapiens
actaagacaaagtgt

SEQ ID NO: 458076 - DNA, 15 bp, Homo sapiens
ctaagacaaagtgtc

SEQ ID NO: 458077 - DNA, 15 bp, Homo sapiens
taagacaaagtgtca

SEQ ID NO: 458078 - DNA, 15 bp, Homo sapiens
aagacaaagtgtcag

SEQ ID NO: 458079 - DNA, 15 bp, Homo sapiens
agacaaagtgtcaga

SEQ ID NO: 458080 - DNA, 15 bp, Homo sapiens
gacaaagtgtcagag

SEQ ID NO: 458081 - DNA, 15 bp, Homo sapiens
acaaagtgtcagagt

SEQ ID NO: 458082 - DNA, 15 bp, Homo sapiens
caaagtgtcagagta

SEQ ID NO: 458083 - DNA, 15 bp, Homo sapiens
aaagtgtcagagtaa

SEQ ID NO: 458084 - DNA, 15 bp, Homo sapiens
aagtgtcagagtaaa

SEQ ID NO: 458085 - DNA, 15 bp, Homo sapiens
agtgtcagagtaaat

SEQ ID NO: 458086 - DNA, 15 bp, Homo sapiens
gtgtcagagtaaatc

SEQ ID NO: 458087 - DNA, 15 bp, Homo sapiens
tgtcagagtaaatca

SEQ ID NO: 458088 - DNA, 15 bp, Homo sapiens
gtcagagtaaatcac

SEQ ID NO: 458089 - DNA, 15 bp, Homo sapiens
tcagagtaaatcact

SEQ ID NO: 458090 - DNA, 15 bp, Homo sapiens
cagagtaaatcacta

SEQ ID NO: 458091 - DNA, 15 bp, Homo sapiens
agagtaaatcactaa

SEQ ID NO: 458092 - DNA, 15 bp, Homo sapiens
gagtaaatcactaaa

SEQ ID NO: 458093 - DNA, 15 bp, Homo sapiens
agtaaatcactaaaa

SEQ ID NO: 458094 - DNA, 15 bp, Homo sapiens
gtaaatcactaaaaa

SEQ ID NO: 458095 - DNA, 15 bp, Homo sapiens
taaatcactaaaaat

SEQ ID NO: 458096 - DNA, 15 bp, Homo sapiens
aaatcactaaaaatt

SEQ ID NO: 458097 - DNA, 15 bp, Homo sapiens
aatcactaaaaattg

SEQ ID NO: 458098 - DNA, 15 bp, Homo sapiens
atcactaaaaattga

SEQ ID NO: 458099 - DNA, 15 bp, Homo sapiens
tcactaaaaattgaa

SEQ ID NO: 458100 - DNA, 15 bp, Homo sapiens
cactaaaaattgaag

SEQ ID NO: 458101 - DNA, 15 bp, Homo sapiens
actaaaaattgaaga

SEQ ID NO: 458102 - DNA, 15 bp, Homo sapiens
ctaaaaattgaagac

SEQ ID NO: 458103 - DNA, 15 bp, Homo sapiens
taaaaattgaagaca

SEQ ID NO: 458104 - DNA, 15 bp, Homo sapiens
aaaaattgaagacat

SEQ ID NO: 458105 - DNA, 15 bp, Homo sapiens
aaaattgaagacatg

SEQ ID NO: 458106 - DNA, 15 bp, Homo sapiens
aaattgaagacatga

SEQ ID NO: 458107 - DNA, 15 bp, Homo sapiens
aattgaagacatgat

SEQ ID NO: 458108 - DNA, 15 bp, Homo sapiens
attgaagacatgata

SEQ ID NO: 458109 - DNA, 15 bp, Homo sapiens
ttgaagacatgatag

SEQ ID NO: 458110 - DNA, 15 bp, Homo sapiens
tgaagacatgatagt

SEQ ID NO: 458111 - DNA, 15 bp, Homo sapiens
gaagacatgatagtc

SEQ ID NO: 458112 - DNA, 15 bp, Homo sapiens
aagacatgatagtct

SEQ ID NO: 458113 - DNA, 15 bp, Homo sapiens
agacatgatagtctg

SEQ ID NO: 458114 - DNA, 15 bp, Homo sapiens
gacatgatagtctgt

SEQ ID NO: 458115 - DNA, 15 bp, Homo sapiens
acatgatagtctgtg

SEQ ID NO: 458116 - DNA, 15 bp, Homo sapiens
catgatagtctgtgg

SEQ ID NO: 458117 - DNA, 15 bp, Homo sapiens
atgatagtctgtggg

SEQ ID NO: 458118 - DNA, 15 bp, Homo sapiens
tgatagtctgtggga

SEQ ID NO: 458119 - DNA, 15 bp, Homo sapiens
gatagtctgtgggat

SEQ ID NO: 458120 - DNA, 15 bp, Homo sapiens
atagtctgtgggatg

SEQ ID NO: 458121 - DNA, 15 bp, Homo sapiens
tagtctgtgggatgt

SEQ ID NO: 458122 - DNA, 15 bp, Homo sapiens
agtctgtgggatgtg

SEQ ID NO: 458123 - DNA, 15 bp, Homo sapiens
gtctgtgggatgtgg

SEQ ID NO: 458124 - DNA, 15 bp, Homo sapiens
tctgtgggatgtggc

SEQ ID NO: 458125 - DNA, 15 bp, Homo sapiens
ctgtgggatgtggca

SEQ ID NO: 458126 - DNA, 15 bp, Homo sapiens
tgtgggatgtggcaa

SEQ ID NO: 458127 - DNA, 15 bp, Homo sapiens
gtgggatgtggcaaa

SEQ ID NO: 458128 - DNA, 15 bp, Homo sapiens
tgggatgtggcaaat

SEQ ID NO: 458129 - DNA, 15 bp, Homo sapiens
gggatgtggcaaatt

SEQ ID NO: 458130 - DNA, 15 bp, Homo sapiens
ggatgtggcaaatta

SEQ ID NO: 458131 - DNA, 15 bp, Homo sapiens
gatgtggcaaattag

SEQ ID NO: 458132 - DNA, 15 bp, Homo sapiens
atgtggcaaattagt

SEQ ID NO: 458133 - DNA, 15 bp, Homo sapiens
tgtggcaaattagtg

SEQ ID NO: 458134 - DNA, 15 bp, Homo sapiens
gtggcaaattagtgt

SEQ ID NO: 458135 - DNA, 15 bp, Homo sapiens
tggcaaattagtgtc

SEQ ID NO: 458136 - DNA, 15 bp, Homo sapiens
ggcaaattagtgtca

SEQ ID NO: 458137 - DNA, 15 bp, Homo sapiens
gcaaattagtgtcac

SEQ ID NO: 458138 - DNA, 15 bp, Homo sapiens
caaattagtgtcaca

SEQ ID NO: 458139 - DNA, 15 bp, Homo sapiens
aaattagtgtcacag

SEQ ID NO: 458140 - DNA, 15 bp, Homo sapiens
aattagtgtcacagc

SEQ ID NO: 458141 - DNA, 15 bp, Homo sapiens
attagtgtcacagct

SEQ ID NO: 458142 - DNA, 15 bp, Homo sapiens
ttagtgtcacagcta

SEQ ID NO: 458143 - DNA, 15 bp, Homo sapiens
tagtgtcacagctac

SEQ ID NO: 458144 - DNA, 15 bp, Homo sapiens
agtgtcacagctaca

SEQ ID NO: 458145 - DNA, 15 bp, Homo sapiens
gtgtcacagctacag

SEQ ID NO: 458146 - DNA, 15 bp, Homo sapiens
tgtcacagctacaga

SEQ ID NO: 458147 - DNA, 15 bp, Homo sapiens
gtcacagctacagag

SEQ ID NO: 458148 - DNA, 15 bp, Homo sapiens
tcacagctacagagt

SEQ ID NO: 458149 - DNA, 15 bp, Homo sapiens
cacagctacagagtg

SEQ ID NO: 458150 - DNA, 15 bp, Homo sapiens
acagctacagagtgt

SEQ ID NO: 458151 - DNA, 15 bp, Homo sapiens
cagctacagagtgta

SEQ ID NO: 458152 - DNA, 15 bp, Homo sapiens
agctacagagtgtat

SEQ ID NO: 458153 - DNA, 15 bp, Homo sapiens
gctacagagtgtata

SEQ ID NO: 458154 - DNA, 15 bp, Homo sapiens
ctacagagtgtataa

SEQ ID NO: 458155 - DNA, 15 bp, Homo sapiens
tacagagtgtataac

SEQ ID NO: 458156 - DNA, 15 bp, Homo sapiens
acagagtgtataacc

SEQ ID NO: 458157 - DNA, 15 bp, Homo sapiens
cagagtgtataacca

SEQ ID NO: 458158 - DNA, 15 bp, Homo sapiens
agagtgtataaccag

SEQ ID NO: 458159 - DNA, 15 bp, Homo sapiens
gagtgtataaccagg

SEQ ID NO: 458160 - DNA, 15 bp, Homo sapiens
agtgtataaccaggg

SEQ ID NO: 458161 - DNA, 15 bp, Homo sapiens
gtgtataaccaggga

SEQ ID NO: 458162 - DNA, 15 bp, Homo sapiens
tgtataaccagggag

SEQ ID NO: 458163 - DNA, 15 bp, Homo sapiens
gtataaccagggaga

SEQ ID NO: 458164 - DNA, 15 bp, Homo sapiens
tataaccagggagac

SEQ ID NO: 458165 - DNA, 15 bp, Homo sapiens
ataaccagggagact

SEQ ID NO: 458166 - DNA, 15 bp, Homo sapiens
taaccagggagactt

SEQ ID NO: 458167 - DNA, 15 bp, Homo sapiens
aaccagggagacttc

SEQ ID NO: 458168 - DNA, 15 bp, Homo sapiens
accagggagacttca

SEQ ID NO: 458169 - DNA, 15 bp, Homo sapiens
ccagggagacttcag

SEQ ID NO: 458170 - DNA, 15 bp, Homo sapiens
cagggagacttcaga

SEQ ID NO: 458171 - DNA, 15 bp, Homo sapiens
agggagacttcagaa

SEQ ID NO: 458172 - DNA, 15 bp, Homo sapiens
gggagacttcagaaa

SEQ ID NO: 458173 - DNA, 15 bp, Homo sapiens
ggagacttcagaaag

SEQ ID NO: 458174 - DNA, 15 bp, Homo sapiens
gagacttcagaaaga

SEQ ID NO: 458175 - DNA, 15 bp, Homo sapiens
agacttcagaaagaa

SEQ ID NO: 458176 - DNA, 15 bp, Homo sapiens
gacttcagaaagaaa

SEQ ID NO: 458177 - DNA, 15 bp, Homo sapiens
acttcagaaagaaat

SEQ ID NO: 458178 - DNA, 15 bp, Homo sapiens
cttcagaaagaaatg

SEQ ID NO: 458179 - DNA, 15 bp, Homo sapiens
ttcagaaagaaatgc

SEQ ID NO: 458180 - DNA, 15 bp, Homo sapiens
tcagaaagaaatgca

SEQ ID NO: 458181 - DNA, 15 bp, Homo sapiens
cagaaagaaatgcaa

SEQ ID NO: 458182 - DNA, 15 bp, Homo sapiens
agaaagaaatgcaag

SEQ ID NO: 458183 - DNA, 15 bp, Homo sapiens
gaaagaaatgcaagg

SEQ ID NO: 458184 - DNA, 15 bp, Homo sapiens
aaagaaatgcaagga

SEQ ID NO: 458185 - DNA, 15 bp, Homo sapiens
aagaaatgcaaggac

SEQ ID NO: 458186 - DNA, 15 bp, Homo sapiens
agaaatgcaaggaca

SEQ ID NO: 458187 - DNA, 15 bp, Homo sapiens
gaaatgcaaggacag

SEQ ID NO: 458188 - DNA, 15 bp, Homo sapiens
aaatgcaaggacagc

SEQ ID NO: 458189 - DNA, 15 bp, Homo sapiens
aatgcaaggacagcc

SEQ ID NO: 458190 - DNA, 15 bp, Homo sapiens
atgcaaggacagcct

SEQ ID NO: 458191 - DNA, 15 bp, Homo sapiens
tgcaaggacagcctg

SEQ ID NO: 458192 - DNA, 15 bp, Homo sapiens
gcaaggacagcctga

SEQ ID NO: 458193 - DNA, 15 bp, Homo sapiens
caaggacagcctgat

SEQ ID NO: 458194 - DNA, 15 bp, Homo sapiens
aaggacagcctgatg

SEQ ID NO: 458195 - DNA, 15 bp, Homo sapiens
aggacagcctgatgc

SEQ ID NO: 458196 - DNA, 15 bp, Homo sapiens
ggacagcctgatgca

SEQ ID NO: 458197 - DNA, 15 bp, Homo sapiens
gacagcctgatgcag

SEQ ID NO: 458198 - DNA, 15 bp, Homo sapiens
acagcctgatgcagg

SEQ ID NO: 458199 - DNA, 15 bp, Homo sapiens
cagcctgatgcagga

SEQ ID NO: 458200 - DNA, 15 bp, Homo sapiens
agcctgatgcaggaa

SEQ ID NO: 458201 - DNA, 15 bp, Homo sapiens
gcctgatgcaggaaa

SEQ ID NO: 458202 - DNA, 15 bp, Homo sapiens
cctgatgcaggaaat

SEQ ID NO: 458203 - DNA, 15 bp, Homo sapiens
ctgatgcaggaaatg

SEQ ID NO: 458204 - DNA, 15 bp, Homo sapiens
tgatgcaggaaatgg

SEQ ID NO: 458205 - DNA, 15 bp, Homo sapiens
gatgcaggaaatggg

SEQ ID NO: 458206 - DNA, 15 bp, Homo sapiens
atgcaggaaatgggc

SEQ ID NO: 458207 - DNA, 15 bp, Homo sapiens
tgcaggaaatgggct

SEQ ID NO: 458208 - DNA, 15 bp, Homo sapiens
gcaggaaatgggctt

SEQ ID NO: 458209 - DNA, 15 bp, Homo sapiens
caggaaatgggcttt

SEQ ID NO: 458210 - DNA, 15 bp, Homo sapiens
aggaaatgggctttt

SEQ ID NO: 458211 - DNA, 15 bp, Homo sapiens
ggaaatgggcttttt

SEQ ID NO: 458212 - DNA, 15 bp, Homo sapiens
gaaatgggctttttg

SEQ ID NO: 458213 - DNA, 15 bp, Homo sapiens
aaatgggctttttgg

SEQ ID NO: 458214 - DNA, 15 bp, Homo sapiens
aatgggctttttgga

SEQ ID NO: 458215 - DNA, 15 bp, Homo sapiens
atgggctttttggaa

SEQ ID NO: 458216 - DNA, 15 bp, Homo sapiens
tgggctttttggaat

SEQ ID NO: 458217 - DNA, 15 bp, Homo sapiens
gggctttttggaatt

SEQ ID NO: 458218 - DNA, 15 bp, Homo sapiens
ggctttttggaattt

SEQ ID NO: 458219 - DNA, 15 bp, Homo sapiens
gctttttggaatttg

SEQ ID NO: 458220 - DNA, 15 bp, Homo sapiens
ctttttggaatttgg

SEQ ID NO: 458221 - DNA, 15 bp, Homo sapiens
tttttggaatttggt

SEQ ID NO: 458222 - DNA, 15 bp, Homo sapiens
ttttggaatttggtc

SEQ ID NO: 458223 - DNA, 15 bp, Homo sapiens
tttggaatttggtct

SEQ ID NO: 458224 - DNA, 15 bp, Homo sapiens
ttggaatttggtctg

SEQ ID NO: 458225 - DNA, 15 bp, Homo sapiens
tggaatttggtctgt

SEQ ID NO: 458226 - DNA, 15 bp, Homo sapiens
ggaatttggtctgtt

SEQ ID NO: 458227 - DNA, 15 bp, Homo sapiens
gaatttggtctgttg

SEQ ID NO: 458228 - DNA, 15 bp, Homo sapiens
aatttggtctgttgt

SEQ ID NO: 458229 - DNA, 15 bp, Homo sapiens
atttggtctgttgtc

SEQ ID NO: 458230 - DNA, 15 bp, Homo sapiens
tttggtctgttgtca

SEQ ID NO: 458231 - DNA, 15 bp, Homo sapiens
ttggtctgttgtcac

SEQ ID NO: 458232 - DNA, 15 bp, Homo sapiens
tggtctgttgtcacc

SEQ ID NO: 458233 - DNA, 15 bp, Homo sapiens
ggtctgttgtcacct

SEQ ID NO: 458234 - DNA, 15 bp, Homo sapiens
gtctgttgtcacctg

SEQ ID NO: 458235 - DNA, 15 bp, Homo sapiens
tctgttgtcacctga

SEQ ID NO: 458236 - DNA, 15 bp, Homo sapiens
ctgttgtcacctgat

SEQ ID NO: 458237 - DNA, 15 bp, Homo sapiens
tgttgtcacctgatg

SEQ ID NO: 458238 - DNA, 15 bp, Homo sapiens
gttgtcacctgatgc

SEQ ID NO: 458239 - DNA, 15 bp, Homo sapiens
ttgtcacctgatgcc

SEQ ID NO: 458240 - DNA, 15 bp, Homo sapiens
tgtcacctgatgcca

SEQ ID NO: 458241 - DNA, 15 bp, Homo sapiens
gtcacctgatgccat

SEQ ID NO: 458242 - DNA, 15 bp, Homo sapiens
tcacctgatgccatg

SEQ ID NO: 458243 - DNA, 15 bp, Homo sapiens
cacctgatgccatgt

SEQ ID NO: 458244 - DNA, 15 bp, Homo sapiens
acctgatgccatgtg

SEQ ID NO: 458245 - DNA, 15 bp, Homo sapiens
cctgatgccatgtgg

SEQ ID NO: 458246 - DNA, 15 bp, Homo sapiens
ctgatgccatgtggg

SEQ ID NO: 458247 - DNA, 15 bp, Homo sapiens
tgatgccatgtgggg

SEQ ID NO: 458248 - DNA, 15 bp, Homo sapiens
gatgccatgtgggga

SEQ ID NO: 458249 - DNA, 15 bp, Homo sapiens
atgccatgtggggat

SEQ ID NO: 458250 - DNA, 15 bp, Homo sapiens
tgccatgtggggatc

SEQ ID NO: 458251 - DNA, 15 bp, Homo sapiens
gccatgtggggatcc

SEQ ID NO: 458252 - DNA, 15 bp, Homo sapiens
ccatgtggggatcca

SEQ ID NO: 458253 - DNA, 15 bp, Homo sapiens
catgtggggatccaa

SEQ ID NO: 458254 - DNA, 15 bp, Homo sapiens
atgtggggatccaat

SEQ ID NO: 458255 - DNA, 15 bp, Homo sapiens
tgtggggatccaata

SEQ ID NO: 458256 - DNA, 15 bp, Homo sapiens
gtggggatccaatag

SEQ ID NO: 458257 - DNA, 15 bp, Homo sapiens
tggggatccaatagc

SEQ ID NO: 458258 - DNA, 15 bp, Homo sapiens
ggggatccaatagca

SEQ ID NO: 458259 - DNA, 15 bp, Homo sapiens
gggatccaatagcag

SEQ ID NO: 458260 - DNA, 15 bp, Homo sapiens
ggatccaatagcagt

SEQ ID NO: 458261 - DNA, 15 bp, Homo sapiens
gatccaatagcagtg

SEQ ID NO: 458262 - DNA, 15 bp, Homo sapiens
atccaatagcagtgc

SEQ ID NO: 458263 - DNA, 15 bp, Homo sapiens
tccaatagcagtgct

SEQ ID NO: 458264 - DNA, 15 bp, Homo sapiens
ccaatagcagtgctg

SEQ ID NO: 458265 - DNA, 15 bp, Homo sapiens
caatagcagtgctgt

SEQ ID NO: 458266 - DNA, 15 bp, Homo sapiens
aatagcagtgctgtg

SEQ ID NO: 458267 - DNA, 15 bp, Homo sapiens
atagcagtgctgtgt

SEQ ID NO: 458268 - DNA, 15 bp, Homo sapiens
tagcagtgctgtgtt

SEQ ID NO: 458269 - DNA, 15 bp, Homo sapiens
agcagtgctgtgtta

SEQ ID NO: 458270 - DNA, 15 bp, Homo sapiens
gcagtgctgtgttac

SEQ ID NO: 458271 - DNA, 15 bp, Homo sapiens
cagtgctgtgttact

SEQ ID NO: 458272 - DNA, 15 bp, Homo sapiens
agtgctgtgttactg

SEQ ID NO: 458273 - DNA, 15 bp, Homo sapiens
gtgctgtgttactgg

SEQ ID NO: 458274 - DNA, 15 bp, Homo sapiens
tgctgtgttactggc

SEQ ID NO: 458275 - DNA, 15 bp, Homo sapiens
gctgtgttactggca

SEQ ID NO: 458276 - DNA, 15 bp, Homo sapiens
ctgtgttactggcat

SEQ ID NO: 458277 - DNA, 15 bp, Homo sapiens
tgtgttactggcata

SEQ ID NO: 458278 - DNA, 15 bp, Homo sapiens
gtgttactggcataa

SEQ ID NO: 458279 - DNA, 15 bp, Homo sapiens
tgttactggcataat

SEQ ID NO: 458280 - DNA, 15 bp, Homo sapiens
gttactggcataatt

SEQ ID NO: 458281 - DNA, 15 bp, Homo sapiens
ttactggcataatta

SEQ ID NO: 458282 - DNA, 15 bp, Homo sapiens
tactggcataattaa

SEQ ID NO: 458283 - DNA, 15 bp, Homo sapiens
actggcataattaat

SEQ ID NO: 458284 - DNA, 15 bp, Homo sapiens
ctggcataattaatg

SEQ ID NO: 458285 - DNA, 15 bp, Homo sapiens
tggcataattaatgt

SEQ ID NO: 458286 - DNA, 15 bp, Homo sapiens
ggcataattaatgtt

SEQ ID NO: 458287 - DNA, 15 bp, Homo sapiens
gcataattaatgttg

SEQ ID NO: 458288 - DNA, 15 bp, Homo sapiens
cataattaatgttgg

SEQ ID NO: 458289 - DNA, 15 bp, Homo sapiens
ataattaatgttgga

SEQ ID NO: 458290 - DNA, 15 bp, Homo sapiens
taattaatgttggaa

SEQ ID NO: 458291 - DNA, 15 bp, Homo sapiens
aattaatgttggaat

SEQ ID NO: 458292 - DNA, 15 bp, Homo sapiens
attaatgttggaatt

SEQ ID NO: 458293 - DNA, 15 bp, Homo sapiens
ttaatgttggaattc

SEQ ID NO: 458294 - DNA, 15 bp, Homo sapiens
taatgttggaattca

SEQ ID NO: 458295 - DNA, 15 bp, Homo sapiens
aatgttggaattcag

SEQ ID NO: 458296 - DNA, 15 bp, Homo sapiens
atgttggaattcaga

SEQ ID NO: 458297 - DNA, 15 bp, Homo sapiens
tgttggaattcagaa

SEQ ID NO: 458298 - DNA, 15 bp, Homo sapiens
gttggaattcagaaa

SEQ ID NO: 458299 - DNA, 15 bp, Homo sapiens
ttggaattcagaaaa

SEQ ID NO: 458300 - DNA, 15 bp, Homo sapiens
tggaattcagaaaac

SEQ ID NO: 458301 - DNA, 15 bp, Homo sapiens
ggaattcagaaaact

SEQ ID NO: 458302 - DNA, 15 bp, Homo sapiens
gaattcagaaaactt

SEQ ID NO: 458303 - DNA, 15 bp, Homo sapiens
aattcagaaaactta

SEQ ID NO: 458304 - DNA, 15 bp, Homo sapiens
attcagaaaacttac

SEQ ID NO: 458305 - DNA, 15 bp, Homo sapiens
ttcagaaaacttaca

SEQ ID NO: 458306 - DNA, 15 bp, Homo sapiens
tcagaaaacttacag

SEQ ID NO: 458307 - DNA, 15 bp, Homo sapiens
cagaaaacttacagc

SEQ ID NO: 458308 - DNA, 15 bp, Homo sapiens
agaaaacttacagcc

SEQ ID NO: 458309 - DNA, 15 bp, Homo sapiens
gaaaacttacagcct

SEQ ID NO: 458310 - DNA, 15 bp, Homo sapiens
aaaacttacagcctt

SEQ ID NO: 458311 - DNA, 15 bp, Homo sapiens
aaacttacagccttt

SEQ ID NO: 458312 - DNA, 15 bp, Homo sapiens
aacttacagcctttt

SEQ ID NO: 458313 - DNA, 15 bp, Homo sapiens
acttacagccttttg

SEQ ID NO: 458314 - DNA, 15 bp, Homo sapiens
cttacagccttttgg

SEQ ID NO: 458315 - DNA, 15 bp, Homo sapiens
ttacagccttttggc

SEQ ID NO: 458316 - DNA, 15 bp, Homo sapiens
tacagccttttggcc

SEQ ID NO: 458317 - DNA, 15 bp, Homo sapiens
acagccttttggcca

SEQ ID NO: 458318 - DNA, 15 bp, Homo sapiens
cagccttttggccat

SEQ ID NO: 458319 - DNA, 15 bp, Homo sapiens
agccttttggccata

SEQ ID NO: 458320 - DNA, 15 bp, Homo sapiens
gccttttggccatat

SEQ ID NO: 458321 - DNA, 15 bp, Homo sapiens
ccttttggccatatt

SEQ ID NO: 458322 - DNA, 15 bp, Homo sapiens
cttttggccatattt

SEQ ID NO: 458323 - DNA, 15 bp, Homo sapiens
ttttggccatatttg

SEQ ID NO: 458324 - DNA, 15 bp, Homo sapiens
tttggccatatttga

SEQ ID NO: 458325 - DNA, 15 bp, Homo sapiens
ttggccatatttgaa

SEQ ID NO: 458326 - DNA, 15 bp, Homo sapiens
tggccatatttgaat

SEQ ID NO: 458327 - DNA, 15 bp, Homo sapiens
ggccatatttgaata

SEQ ID NO: 458328 - DNA, 15 bp, Homo sapiens
gccatatttgaatat

SEQ ID NO: 458329 - DNA, 15 bp, Homo sapiens
ccatatttgaatatg

SEQ ID NO: 458330 - DNA, 15 bp, Homo sapiens
catatttgaatatgt

SEQ ID NO: 458331 - DNA, 15 bp, Homo sapiens
atatttgaatatgtt

SEQ ID NO: 458332 - DNA, 15 bp, Homo sapiens
tatttgaatatgttc

SEQ ID NO: 458333 - DNA, 15 bp, Homo sapiens
atttgaatatgttcc

SEQ ID NO: 458334 - DNA, 15 bp, Homo sapiens
tttgaatatgttcct

SEQ ID NO: 458335 - DNA, 15 bp, Homo sapiens
ttgaatatgttcctt

SEQ ID NO: 458336 - DNA, 15 bp, Homo sapiens
tgaatatgttccttg

SEQ ID NO: 458337 - DNA, 15 bp, Homo sapiens
gaatatgttccttgg

SEQ ID NO: 458338 - DNA, 15 bp, Homo sapiens
aatatgttccttggt

SEQ ID NO: 458339 - DNA, 15 bp, Homo sapiens
atatgttccttggtg

SEQ ID NO: 458340 - DNA, 15 bp, Homo sapiens
tatgttccttggtgt

SEQ ID NO: 458341 - DNA, 15 bp, Homo sapiens
atgttccttggtgtc

SEQ ID NO: 458342 - DNA, 15 bp, Homo sapiens
tgttccttggtgtct

SEQ ID NO: 458343 - DNA, 15 bp, Homo sapiens
gttccttggtgtctg

SEQ ID NO: 458344 - DNA, 15 bp, Homo sapiens
ttccttggtgtctgt

SEQ ID NO: 458345 - DNA, 15 bp, Homo sapiens
tccttggtgtctgtg

SEQ ID NO: 458346 - DNA, 15 bp, Homo sapiens
ccttggtgtctgtgg

SEQ ID NO: 458347 - DNA, 15 bp, Homo sapiens
cttggtgtctgtggg

SEQ ID NO: 458348 - DNA, 15 bp, Homo sapiens
ttggtgtctgtgggg

SEQ ID NO: 458349 - DNA, 15 bp, Homo sapiens
tggtgtctgtgggga

SEQ ID NO: 458350 - DNA, 15 bp, Homo sapiens
ggtgtctgtggggag

SEQ ID NO: 458351 - DNA, 15 bp, Homo sapiens
gtgtctgtggggagc

SEQ ID NO: 458352 - DNA, 15 bp, Homo sapiens
tgtctgtggggagct

SEQ ID NO: 458353 - DNA, 15 bp, Homo sapiens
gtctgtggggagctg

SEQ ID NO: 458354 - DNA, 15 bp, Homo sapiens
tctgtggggagctgt

SEQ ID NO: 458355 - DNA, 15 bp, Homo sapiens
ctgtggggagctgta

SEQ ID NO: 458356 - DNA, 15 bp, Homo sapiens
tgtggggagctgtag

SEQ ID NO: 458357 - DNA, 15 bp, Homo sapiens
gtggggagctgtagt

SEQ ID NO: 458358 - DNA, 15 bp, Homo sapiens
tggggagctgtagtt

SEQ ID NO: 458359 - DNA, 15 bp, Homo sapiens
ggggagctgtagttc

SEQ ID NO: 458360 - DNA, 15 bp, Homo sapiens
gggagctgtagttcc

SEQ ID NO: 458361 - DNA, 15 bp, Homo sapiens
ggagctgtagttccc

SEQ ID NO: 458362 - DNA, 15 bp, Homo sapiens
gagctgtagttccct

SEQ ID NO: 458363 - DNA, 15 bp, Homo sapiens
agctgtagttcccta

SEQ ID NO: 458364 - DNA, 15 bp, Homo sapiens
gctgtagttccctag

SEQ ID NO: 458365 - DNA, 15 bp, Homo sapiens
ctgtagttccctagc

SEQ ID NO: 458366 - DNA, 15 bp, Homo sapiens
tgtagttccctagct

SEQ ID NO: 458367 - DNA, 15 bp, Homo sapiens
gtagttccctagcta

SEQ ID NO: 458368 - DNA, 15 bp, Homo sapiens
tagttccctagctac

SEQ ID NO: 458369 - DNA, 15 bp, Homo sapiens
agttccctagctact

SEQ ID NO: 458370 - DNA, 15 bp, Homo sapiens
gttccctagctactg

SEQ ID NO: 458371 - DNA, 15 bp, Homo sapiens
ttccctagctactgc

SEQ ID NO: 458372 - DNA, 15 bp, Homo sapiens
tccctagctactgcc

SEQ ID NO: 458373 - DNA, 15 bp, Homo sapiens
ccctagctactgccc

SEQ ID NO: 458374 - DNA, 15 bp, Homo sapiens
cctagctactgccct

SEQ ID NO: 458375 - DNA, 15 bp, Homo sapiens
ctagctactgccctt

SEQ ID NO: 458376 - DNA, 15 bp, Homo sapiens
tagctactgcccttt

SEQ ID NO: 458377 - DNA, 15 bp, Homo sapiens
agctactgcccttta

SEQ ID NO: 458378 - DNA, 15 bp, Homo sapiens
gctactgccctttat

SEQ ID NO: 458379 - DNA, 15 bp, Homo sapiens
ctactgccctttatt

SEQ ID NO: 458380 - DNA, 15 bp, Homo sapiens
tactgccctttatta

SEQ ID NO: 458381 - DNA, 15 bp, Homo sapiens
actgccctttattaa

SEQ ID NO: 458382 - DNA, 15 bp, Homo sapiens
ctgccctttattaaa

SEQ ID NO: 458383 - DNA, 15 bp, Homo sapiens
tgccctttattaaac

SEQ ID NO: 458384 - DNA, 15 bp, Homo sapiens
gccctttattaaaca

SEQ ID NO: 458385 - DNA, 15 bp, Homo sapiens
ccctttattaaacac

SEQ ID NO: 458386 - DNA, 15 bp, Homo sapiens
cctttattaaacact

SEQ ID NO: 458387 - DNA, 15 bp, Homo sapiens
ctttattaaacactt

SEQ ID NO: 458388 - DNA, 15 bp, Homo sapiens
tattaaacactttcc

SEQ ID NO: 458389 - DNA, 15 bp, Homo sapiens
attaaacactttcct

SEQ ID NO: 458390 - DNA, 15 bp, Homo sapiens
ttaaacactttcctt

SEQ ID NO: 458391 - DNA, 15 bp, Homo sapiens
taaacactttccttt

SEQ ID NO: 458392 - DNA, 15 bp, Homo sapiens
aaacactttcctttg

SEQ ID NO: 458393 - DNA, 15 bp, Homo sapiens
aacactttcctttgt

SEQ ID NO: 458394 - DNA, 15 bp, Homo sapiens
acactttcctttgtc

SEQ ID NO: 458395 - DNA, 15 bp, Homo sapiens
cactttcctttgtca

SEQ ID NO: 458396 - DNA, 15 bp, Homo sapiens
actttcctttgtcag

SEQ ID NO: 458397 - DNA, 15 bp, Homo sapiens
ctttcctttgtcagg

SEQ ID NO: 458398 - DNA, 15 bp, Homo sapiens
tttcctttgtcaggc

SEQ ID NO: 458399 - DNA, 15 bp, Homo sapiens
ttcctttgtcaggca

SEQ ID NO: 458400 - DNA, 15 bp, Homo sapiens
tcctttgtcaggcac

SEQ ID NO: 458401 - DNA, 15 bp, Homo sapiens
cctttgtcaggcact

SEQ ID NO: 458402 - DNA, 15 bp, Homo sapiens
ctttgtcaggcactt

SEQ ID NO: 458403 - DNA, 15 bp, Homo sapiens
tttgtcaggcacttt

SEQ ID NO: 458404 - DNA, 15 bp, Homo sapiens
ttgtcaggcactttg

SEQ ID NO: 458405 - DNA, 15 bp, Homo sapiens
tgtcaggcactttgc

SEQ ID NO: 458406 - DNA, 15 bp, Homo sapiens
gtcaggcactttgct

SEQ ID NO: 458407 - DNA, 15 bp, Homo sapiens
tcaggcactttgctt

SEQ ID NO: 458408 - DNA, 15 bp, Homo sapiens
caggcactttgcttc

SEQ ID NO: 458409 - DNA, 15 bp, Homo sapiens
aggcactttgcttct

SEQ ID NO: 458410 - DNA, 15 bp, Homo sapiens
ggcactttgcttctg

SEQ ID NO: 458411 - DNA, 15 bp, Homo sapiens
gcactttgcttctgc

SEQ ID NO: 458412 - DNA, 15 bp, Homo sapiens
cactttgcttctgcc

SEQ ID NO: 458413 - DNA, 15 bp, Homo sapiens
actttgcttctgccc

SEQ ID NO: 458414 - DNA, 15 bp, Homo sapiens
ctttgcttctgccct

SEQ ID NO: 458415 - DNA, 15 bp, Homo sapiens
tttgcttctgccctc

SEQ ID NO: 458416 - DNA, 15 bp, Homo sapiens
ttgcttctgccctct

SEQ ID NO: 458417 - DNA, 15 bp, Homo sapiens
tgcttctgccctcta

SEQ ID NO: 458418 - DNA, 15 bp, Homo sapiens
gcttctgccctctag

SEQ ID NO: 458419 - DNA, 15 bp, Homo sapiens
cttctgccctctaga

SEQ ID NO: 458420 - DNA, 15 bp, Homo sapiens
ttctgccctctagag

SEQ ID NO: 458421 - DNA, 15 bp, Homo sapiens
tctgccctctagagg

SEQ ID NO: 458422 - DNA, 15 bp, Homo sapiens
ctgccctctagaggt

SEQ ID NO: 458423 - DNA, 15 bp, Homo sapiens
tgccctctagaggtt

SEQ ID NO: 458424 - DNA, 15 bp, Homo sapiens
gccctctagaggttt

SEQ ID NO: 458425 - DNA, 15 bp, Homo sapiens
ccctctagaggttta

SEQ ID NO: 458426 - DNA, 15 bp, Homo sapiens
cctctagaggtttac

SEQ ID NO: 458427 - DNA, 15 bp, Homo sapiens
ctctagaggtttaca

SEQ ID NO: 458428 - DNA, 15 bp, Homo sapiens
tctagaggtttacaa

SEQ ID NO: 458429 - DNA, 15 bp, Homo sapiens
ctagaggtttacaat

SEQ ID NO: 458430 - DNA, 15 bp, Homo sapiens
tagaggtttacaatt

SEQ ID NO: 458431 - DNA, 15 bp, Homo sapiens
agaggtttacaattg

SEQ ID NO: 458432 - DNA, 15 bp, Homo sapiens
gaggtttacaattga

SEQ ID NO: 458433 - DNA, 15 bp, Homo sapiens
aggtttacaattgaa

SEQ ID NO: 458434 - DNA, 15 bp, Homo sapiens
ggtttacaattgaaa

SEQ ID NO: 458435 - DNA, 15 bp, Homo sapiens
gtttacaattgaaaa

SEQ ID NO: 458436 - DNA, 15 bp, Homo sapiens
tttacaattgaaaac

SEQ ID NO: 458437 - DNA, 15 bp, Homo sapiens
ttacaattgaaaact

SEQ ID NO: 458438 - DNA, 15 bp, Homo sapiens
tacaattgaaaactg

SEQ ID NO: 458439 - DNA, 15 bp, Homo sapiens
acaattgaaaactgt

SEQ ID NO: 458440 - DNA, 15 bp, Homo sapiens
caattgaaaactgtg

SEQ ID NO: 458441 - DNA, 15 bp, Homo sapiens
aattgaaaactgtgt

SEQ ID NO: 458442 - DNA, 15 bp, Homo sapiens
attgaaaactgtgta

SEQ ID NO: 458443 - DNA, 15 bp, Homo sapiens
ttgaaaactgtgtac

SEQ ID NO: 458444 - DNA, 15 bp, Homo sapiens
tgaaaactgtgtaca

SEQ ID NO: 458445 - DNA, 15 bp, Homo sapiens
gaaaactgtgtacag

SEQ ID NO: 458446 - DNA, 15 bp, Homo sapiens
aaaactgtgtacagt

SEQ ID NO: 458447 - DNA, 15 bp, Homo sapiens
aaactgtgtacagtt

SEQ ID NO: 458448 - DNA, 15 bp, Homo sapiens
aactgtgtacagttg

SEQ ID NO: 458449 - DNA, 15 bp, Homo sapiens
actgtgtacagttga

SEQ ID NO: 458450 - DNA, 15 bp, Homo sapiens
ctgtgtacagttgac

SEQ ID NO: 458451 - DNA, 15 bp, Homo sapiens
tgtgtacagttgacc

SEQ ID NO: 458452 - DNA, 15 bp, Homo sapiens
gtgtacagttgaccc

SEQ ID NO: 458453 - DNA, 15 bp, Homo sapiens
tgtacagttgaccct

SEQ ID NO: 458454 - DNA, 15 bp, Homo sapiens
gtacagttgaccctt

SEQ ID NO: 458455 - DNA, 15 bp, Homo sapiens
tacagttgacccttg

SEQ ID NO: 458456 - DNA, 15 bp, Homo sapiens
acagttgacccttga

SEQ ID NO: 458457 - DNA, 15 bp, Homo sapiens
cagttgacccttgac

SEQ ID NO: 458458 - DNA, 15 bp, Homo sapiens
agttgacccttgaca

SEQ ID NO: 458459 - DNA, 15 bp, Homo sapiens
gttgacccttgacac

SEQ ID NO: 458460 - DNA, 15 bp, Homo sapiens
ttgacccttgacacc

SEQ ID NO: 458461 - DNA, 15 bp, Homo sapiens
tgacccttgacaccc

SEQ ID NO: 458462 - DNA, 15 bp, Homo sapiens
gacccttgacaccca

SEQ ID NO: 458463 - DNA, 15 bp, Homo sapiens
acccttgacacccaa

SEQ ID NO: 458464 - DNA, 15 bp, Homo sapiens
cccttgacacccaaa

SEQ ID NO: 458465 - DNA, 15 bp, Homo sapiens
ccttgacacccaaaa

SEQ ID NO: 458466 - DNA, 15 bp, Homo sapiens
cttgacacccaaaac

SEQ ID NO: 458467 - DNA, 15 bp, Homo sapiens
ttgacacccaaaact

SEQ ID NO: 458468 - DNA, 15 bp, Homo sapiens
tgacacccaaaactt

SEQ ID NO: 458469 - DNA, 15 bp, Homo sapiens
gacacccaaaactta

SEQ ID NO: 458470 - DNA, 15 bp, Homo sapiens
acacccaaaacttaa

SEQ ID NO: 458471 - DNA, 15 bp, Homo sapiens
cacccaaaacttaac

SEQ ID NO: 458472 - DNA, 15 bp, Homo sapiens
acccaaaacttaaca

SEQ ID NO: 458473 - DNA, 15 bp, Homo sapiens
cccaaaacttaacat

SEQ ID NO: 458474 - DNA, 15 bp, Homo sapiens
ccaaaacttaacatg

SEQ ID NO: 458475 - DNA, 15 bp, Homo sapiens
caaaacttaacatgt

SEQ ID NO: 458476 - DNA, 15 bp, Homo sapiens
aaaacttaacatgtt

SEQ ID NO: 458477 - DNA, 15 bp, Homo sapiens
aaacttaacatgtta

SEQ ID NO: 458478 - DNA, 15 bp, Homo sapiens
aacttaacatgttaa

SEQ ID NO: 458479 - DNA, 15 bp, Homo sapiens
acttaacatgttaac

SEQ ID NO: 458480 - DNA, 15 bp, Homo sapiens
cttaacatgttaaca

SEQ ID NO: 458481 - DNA, 15 bp, Homo sapiens
ttaacatgttaacag

SEQ ID NO: 458482 - DNA, 15 bp, Homo sapiens
taacatgttaacagt

SEQ ID NO: 458483 - DNA, 15 bp, Homo sapiens
aacatgttaacagtc

SEQ ID NO: 458484 - DNA, 15 bp, Homo sapiens
acatgttaacagtca

SEQ ID NO: 458485 - DNA, 15 bp, Homo sapiens
catgttaacagtcaa

SEQ ID NO: 458486 - DNA, 15 bp, Homo sapiens
atgttaacagtcaat

SEQ ID NO: 458487 - DNA, 15 bp, Homo sapiens
tgttaacagtcaatt

SEQ ID NO: 458488 - DNA, 15 bp, Homo sapiens
gttaacagtcaatta

SEQ ID NO: 458489 - DNA, 15 bp, Homo sapiens
ttaacagtcaattaa

SEQ ID NO: 458490 - DNA, 15 bp, Homo sapiens
taacagtcaattaac

SEQ ID NO: 458491 - DNA, 15 bp, Homo sapiens
aacagtcaattaaca

SEQ ID NO: 458492 - DNA, 15 bp, Homo sapiens
acagtcaattaacac

SEQ ID NO: 458493 - DNA, 15 bp, Homo sapiens
cagtcaattaacaca

SEQ ID NO: 458494 - DNA, 15 bp, Homo sapiens
agtcaattaacacat

SEQ ID NO: 458495 - DNA, 15 bp, Homo sapiens
gtcaattaacacata

SEQ ID NO: 458496 - DNA, 15 bp, Homo sapiens
tcaattaacacatat

SEQ ID NO: 458497 - DNA, 15 bp, Homo sapiens
caattaacacatatt

SEQ ID NO: 458498 - DNA, 15 bp, Homo sapiens
aattaacacatattt

SEQ ID NO: 458499 - DNA, 15 bp, Homo sapiens
attaacacatatttg

SEQ ID NO: 458500 - DNA, 15 bp, Homo sapiens
ttaacacatatttga

SEQ ID NO: 458501 - DNA, 15 bp, Homo sapiens
taacacatatttgat

SEQ ID NO: 458502 - DNA, 15 bp, Homo sapiens
aacacatatttgata

SEQ ID NO: 458503 - DNA, 15 bp, Homo sapiens
acacatatttgatat

SEQ ID NO: 458504 - DNA, 15 bp, Homo sapiens
cacatatttgatatg

SEQ ID NO: 458505 - DNA, 15 bp, Homo sapiens
acatatttgatatgc

SEQ ID NO: 458506 - DNA, 15 bp, Homo sapiens
catatttgatatgct

SEQ ID NO: 458507 - DNA, 15 bp, Homo sapiens
atatttgatatgcta

SEQ ID NO: 458508 - DNA, 15 bp, Homo sapiens
tatttgatatgctat

SEQ ID NO: 458509 - DNA, 15 bp, Homo sapiens
atttgatatgctatg

SEQ ID NO: 458510 - DNA, 15 bp, Homo sapiens
tttgatatgctatgt

SEQ ID NO: 458511 - DNA, 15 bp, Homo sapiens
ttgatatgctatgta

SEQ ID NO: 458512 - DNA, 15 bp, Homo sapiens
tgatatgctatgtaa

SEQ ID NO: 458513 - DNA, 15 bp, Homo sapiens
gatatgctatgtaat

SEQ ID NO: 458514 - DNA, 15 bp, Homo sapiens
atatgctatgtaata

SEQ ID NO: 458515 - DNA, 15 bp, Homo sapiens
tatgctatgtaatat

SEQ ID NO: 458516 - DNA, 15 bp, Homo sapiens
atgctatgtaatata

SEQ ID NO: 458517 - DNA, 15 bp, Homo sapiens
tgctatgtaatatat

SEQ ID NO: 458518 - DNA, 15 bp, Homo sapiens
gctatgtaatatata

SEQ ID NO: 458519 - DNA, 15 bp, Homo sapiens
ctatgtaatatatac

SEQ ID NO: 458520 - DNA, 15 bp, Homo sapiens
tatgtaatatatact

SEQ ID NO: 458521 - DNA, 15 bp, Homo sapiens
atgtaatatatactc

SEQ ID NO: 458522 - DNA, 15 bp, Homo sapiens
tgtaatatatactct

SEQ ID NO: 458523 - DNA, 15 bp, Homo sapiens
gtaatatatactctt

SEQ ID NO: 458524 - DNA, 15 bp, Homo sapiens
taatatatactctta

SEQ ID NO: 458525 - DNA, 15 bp, Homo sapiens
aatatatactcttat

SEQ ID NO: 458526 - DNA, 15 bp, Homo sapiens
atatatactcttatt

SEQ ID NO: 458527 - DNA, 15 bp, Homo sapiens
tatatactcttattc

SEQ ID NO: 458528 - DNA, 15 bp, Homo sapiens
atatactcttattct

SEQ ID NO: 458529 - DNA, 15 bp, Homo sapiens
tatactcttattcta

SEQ ID NO: 458530 - DNA, 15 bp, Homo sapiens
atactcttattctac

SEQ ID NO: 458531 - DNA, 15 bp, Homo sapiens
tactcttattctaca

SEQ ID NO: 458532 - DNA, 15 bp, Homo sapiens
actcttattctacaa

SEQ ID NO: 458533 - DNA, 15 bp, Homo sapiens
ctcttattctacaac

SEQ ID NO: 458534 - DNA, 15 bp, Homo sapiens
tcttattctacaaca

SEQ ID NO: 458535 - DNA, 15 bp, Homo sapiens
cttattctacaacaa

SEQ ID NO: 458536 - DNA, 15 bp, Homo sapiens
ttattctacaacaaa

SEQ ID NO: 458537 - DNA, 15 bp, Homo sapiens
tattctacaacaaag

SEQ ID NO: 458538 - DNA, 15 bp, Homo sapiens
attctacaacaaagt

SEQ ID NO: 458539 - DNA, 15 bp, Homo sapiens
ttctacaacaaagta

SEQ ID NO: 458540 - DNA, 15 bp, Homo sapiens
tctacaacaaagtaa

SEQ ID NO: 458541 - DNA, 15 bp, Homo sapiens
ctacaacaaagtaag

SEQ ID NO: 458542 - DNA, 15 bp, Homo sapiens
tacaacaaagtaagc

SEQ ID NO: 458543 - DNA, 15 bp, Homo sapiens
acaacaaagtaagct

SEQ ID NO: 458544 - DNA, 15 bp, Homo sapiens
caacaaagtaagcta

SEQ ID NO: 458545 - DNA, 15 bp, Homo sapiens
aacaaagtaagctag

SEQ ID NO: 458546 - DNA, 15 bp, Homo sapiens
acaaagtaagctaga

SEQ ID NO: 458547 - DNA, 15 bp, Homo sapiens
caaagtaagctagag

SEQ ID NO: 458548 - DNA, 15 bp, Homo sapiens
aaagtaagctagaga

SEQ ID NO: 458549 - DNA, 15 bp, Homo sapiens
aagtaagctagagaa

SEQ ID NO: 458550 - DNA, 15 bp, Homo sapiens
agtaagctagagaaa

SEQ ID NO: 458551 - DNA, 15 bp, Homo sapiens
gtaagctagagaaaa

SEQ ID NO: 458552 - DNA, 15 bp, Homo sapiens
taagctagagaaaag

SEQ ID NO: 458553 - DNA, 15 bp, Homo sapiens
aagctagagaaaaga

SEQ ID NO: 458554 - DNA, 15 bp, Homo sapiens
agctagagaaaagaa

SEQ ID NO: 458555 - DNA, 15 bp, Homo sapiens
gctagagaaaagaaa

SEQ ID NO: 458556 - DNA, 15 bp, Homo sapiens
ctagagaaaagaaaa

SEQ ID NO: 458557 - DNA, 15 bp, Homo sapiens
tagagaaaagaaaat

SEQ ID NO: 458558 - DNA, 15 bp, Homo sapiens
agagaaaagaaaatt

SEQ ID NO: 458559 - DNA, 15 bp, Homo sapiens
gagaaaagaaaattt

SEQ ID NO: 458560 - DNA, 15 bp, Homo sapiens
agaaaagaaaatttt

SEQ ID NO: 458561 - DNA, 15 bp, Homo sapiens
gaaaagaaaatttta

SEQ ID NO: 458562 - DNA, 15 bp, Homo sapiens
aaaagaaaattttaa

SEQ ID NO: 458563 - DNA, 15 bp, Homo sapiens
aaagaaaattttaag

SEQ ID NO: 458564 - DNA, 15 bp, Homo sapiens
aagaaaattttaaga

SEQ ID NO: 458565 - DNA, 15 bp, Homo sapiens
aaattttaagaaaat

SEQ ID NO: 458566 - DNA, 15 bp, Homo sapiens
aattttaagaaaata

SEQ ID NO: 458567 - DNA, 15 bp, Homo sapiens
attttaagaaaatag

SEQ ID NO: 458568 - DNA, 15 bp, Homo sapiens
ttttaagaaaatagt

SEQ ID NO: 458569 - DNA, 15 bp, Homo sapiens
tttaagaaaatagta

SEQ ID NO: 458570 - DNA, 15 bp, Homo sapiens
ttaagaaaatagtaa

SEQ ID NO: 458571 - DNA, 15 bp, Homo sapiens
taagaaaatagtaaa

SEQ ID NO: 458572 - DNA, 15 bp, Homo sapiens
aagaaaatagtaaaa

SEQ ID NO: 458573 - DNA, 15 bp, Homo sapiens
agaaaatagtaaaag

SEQ ID NO: 458574 - DNA, 15 bp, Homo sapiens
gaaaatagtaaaaga

SEQ ID NO: 458575 - DNA, 15 bp, Homo sapiens
aaaatagtaaaagac

SEQ ID NO: 458576 - DNA, 15 bp, Homo sapiens
aaatagtaaaagaca

SEQ ID NO: 458577 - DNA, 15 bp, Homo sapiens
aatagtaaaagacaa

SEQ ID NO: 458578 - DNA, 15 bp, Homo sapiens
atagtaaaagacaaa

SEQ ID NO: 458579 - DNA, 15 bp, Homo sapiens
tagtaaaagacaaaa

SEQ ID NO: 458580 - DNA, 15 bp, Homo sapiens
agtaaaagacaaaat

SEQ ID NO: 458581 - DNA, 15 bp, Homo sapiens
gtaaaagacaaaata

SEQ ID NO: 458582 - DNA, 15 bp, Homo sapiens
taaaagacaaaatat

SEQ ID NO: 458583 - DNA, 15 bp, Homo sapiens
aaaagacaaaatata

SEQ ID NO: 458584 - DNA, 15 bp, Homo sapiens
aaagacaaaatatat

SEQ ID NO: 458585 - DNA, 15 bp, Homo sapiens
aagacaaaatatatt

SEQ ID NO: 458586 - DNA, 15 bp, Homo sapiens
agacaaaatatattt

SEQ ID NO: 458587 - DNA, 15 bp, Homo sapiens
gacaaaatatattta

SEQ ID NO: 458588 - DNA, 15 bp, Homo sapiens
acaaaatatatttaa

SEQ ID NO: 458589 - DNA, 15 bp, Homo sapiens
caaaatatatttaat

SEQ ID NO: 458590 - DNA, 15 bp, Homo sapiens
aaaatatatttaata

SEQ ID NO: 458591 - DNA, 15 bp, Homo sapiens
aaatatatttaatat

SEQ ID NO: 458592 - DNA, 15 bp, Homo sapiens
aatatatttaatatt

SEQ ID NO: 458593 - DNA, 15 bp, Homo sapiens
atatatttaatattc

SEQ ID NO: 458594 - DNA, 15 bp, Homo sapiens
tatatttaatattca

SEQ ID NO: 458595 - DNA, 15 bp, Homo sapiens
atatttaatattcac

SEQ ID NO: 458596 - DNA, 15 bp, Homo sapiens
tatttaatattcact

SEQ ID NO: 458597 - DNA, 15 bp, Homo sapiens
atttaatattcacta

SEQ ID NO: 458598 - DNA, 15 bp, Homo sapiens
tttaatattcactaa

SEQ ID NO: 458599 - DNA, 15 bp, Homo sapiens
ttaatattcactaat

SEQ ID NO: 458600 - DNA, 15 bp, Homo sapiens
taatattcactaatt

SEQ ID NO: 458601 - DNA, 15 bp, Homo sapiens
aatattcactaattg

SEQ ID NO: 458602 - DNA, 15 bp, Homo sapiens
atattcactaattgg

SEQ ID NO: 458603 - DNA, 15 bp, Homo sapiens
tattcactaattgga

SEQ ID NO: 458604 - DNA, 15 bp, Homo sapiens
attcactaattggaa

SEQ ID NO: 458605 - DNA, 15 bp, Homo sapiens
ttcactaattggaag

SEQ ID NO: 458606 - DNA, 15 bp, Homo sapiens
tcactaattggaagt

SEQ ID NO: 458607 - DNA, 15 bp, Homo sapiens
cactaattggaagtg

SEQ ID NO: 458608 - DNA, 15 bp, Homo sapiens
actaattggaagtga

SEQ ID NO: 458609 - DNA, 15 bp, Homo sapiens
ctaattggaagtgat

SEQ ID NO: 458610 - DNA, 15 bp, Homo sapiens
taattggaagtgatc

SEQ ID NO: 458611 - DNA, 15 bp, Homo sapiens
aattggaagtgatca

SEQ ID NO: 458612 - DNA, 15 bp, Homo sapiens
attggaagtgatcat

SEQ ID NO: 458613 - DNA, 15 bp, Homo sapiens
ttggaagtgatcatc

SEQ ID NO: 458614 - DNA, 15 bp, Homo sapiens
tggaagtgatcatca

SEQ ID NO: 458615 - DNA, 15 bp, Homo sapiens
ggaagtgatcatcat

SEQ ID NO: 458616 - DNA, 15 bp, Homo sapiens
gaagtgatcatcata

SEQ ID NO: 458617 - DNA, 15 bp, Homo sapiens
aagtgatcatcataa

SEQ ID NO: 458618 - DNA, 15 bp, Homo sapiens
agtgatcatcataaa

SEQ ID NO: 458619 - DNA, 15 bp, Homo sapiens
gtgatcatcataaag

SEQ ID NO: 458620 - DNA, 15 bp, Homo sapiens
tgatcatcataaagg

SEQ ID NO: 458621 - DNA, 15 bp, Homo sapiens
gatcatcataaaggg

SEQ ID NO: 458622 - DNA, 15 bp, Homo sapiens
atcatcataaagggt

SEQ ID NO: 458623 - DNA, 15 bp, Homo sapiens
tcatcataaagggtc

SEQ ID NO: 458624 - DNA, 15 bp, Homo sapiens
catcataaagggtct

SEQ ID NO: 458625 - DNA, 15 bp, Homo sapiens
atcataaagggtctt

SEQ ID NO: 458626 - DNA, 15 bp, Homo sapiens
tcataaagggtcttc

SEQ ID NO: 458627 - DNA, 15 bp, Homo sapiens
cataaagggtcttca

SEQ ID NO: 458628 - DNA, 15 bp, Homo sapiens
ataaagggtcttcat

SEQ ID NO: 458629 - DNA, 15 bp, Homo sapiens
taaagggtcttcatc

SEQ ID NO: 458630 - DNA, 15 bp, Homo sapiens
aaagggtcttcatcc

SEQ ID NO: 458631 - DNA, 15 bp, Homo sapiens
aagggtcttcatcct

SEQ ID NO: 458632 - DNA, 15 bp, Homo sapiens
agggtcttcatcctt

SEQ ID NO: 458633 - DNA, 15 bp, Homo sapiens
gggtcttcatccttg

SEQ ID NO: 458634 - DNA, 15 bp, Homo sapiens
ggtcttcatccttgt

SEQ ID NO: 458635 - DNA, 15 bp, Homo sapiens
gtcttcatccttgtt

SEQ ID NO: 458636 - DNA, 15 bp, Homo sapiens
tcttcatccttgttg

SEQ ID NO: 458637 - DNA, 15 bp, Homo sapiens
cttcatccttgttga

SEQ ID NO: 458638 - DNA, 15 bp, Homo sapiens
ttcatccttgttgac

SEQ ID NO: 458639 - DNA, 15 bp, Homo sapiens
tcatccttgttgact

SEQ ID NO: 458640 - DNA, 15 bp, Homo sapiens
catccttgttgactt

SEQ ID NO: 458641 - DNA, 15 bp, Homo sapiens
atccttgttgacttc

SEQ ID NO: 458642 - DNA, 15 bp, Homo sapiens
tccttgttgacttca

SEQ ID NO: 458643 - DNA, 15 bp, Homo sapiens
ccttgttgacttcat

SEQ ID NO: 458644 - DNA, 15 bp, Homo sapiens
cttgttgacttcatg

SEQ ID NO: 458645 - DNA, 15 bp, Homo sapiens
ttgttgacttcatgt

SEQ ID NO: 458646 - DNA, 15 bp, Homo sapiens
tgttgacttcatgtt

SEQ ID NO: 458647 - DNA, 15 bp, Homo sapiens
gttgacttcatgttg

SEQ ID NO: 458648 - DNA, 15 bp, Homo sapiens
ttgacttcatgttga

SEQ ID NO: 458649 - DNA, 15 bp, Homo sapiens
tgacttcatgttgat

SEQ ID NO: 458650 - DNA, 15 bp, Homo sapiens
gacttcatgttgatt

SEQ ID NO: 458651 - DNA, 15 bp, Homo sapiens
acttcatgttgatta

SEQ ID NO: 458652 - DNA, 15 bp, Homo sapiens
cttcatgttgattaa

SEQ ID NO: 458653 - DNA, 15 bp, Homo sapiens
ttcatgttgattaat

SEQ ID NO: 458654 - DNA, 15 bp, Homo sapiens
tcatgttgattaatc

SEQ ID NO: 458655 - DNA, 15 bp, Homo sapiens
catgttgattaatct

SEQ ID NO: 458656 - DNA, 15 bp, Homo sapiens
atgttgattaatctg

SEQ ID NO: 458657 - DNA, 15 bp, Homo sapiens
tgttgattaatctga

SEQ ID NO: 458658 - DNA, 15 bp, Homo sapiens
gttgattaatctgag

SEQ ID NO: 458659 - DNA, 15 bp, Homo sapiens
ttgattaatctgagg

SEQ ID NO: 458660 - DNA, 15 bp, Homo sapiens
tgattaatctgaggg

SEQ ID NO: 458661 - DNA, 15 bp, Homo sapiens
gattaatctgagggg

SEQ ID NO: 458662 - DNA, 15 bp, Homo sapiens
attaatctgaggggg

SEQ ID NO: 458663 - DNA, 15 bp, Homo sapiens
ttaatctgaggggga

SEQ ID NO: 458664 - DNA, 15 bp, Homo sapiens
taatctgagggggag

SEQ ID NO: 458665 - DNA, 15 bp, Homo sapiens
aatctgagggggagg

SEQ ID NO: 458666 - DNA, 15 bp, Homo sapiens
atctgagggggagga

SEQ ID NO: 458667 - DNA, 15 bp, Homo sapiens
tctgagggggaggaa

SEQ ID NO: 458668 - DNA, 15 bp, Homo sapiens
ctgagggggaggaag

SEQ ID NO: 458669 - DNA, 15 bp, Homo sapiens
tgagggggaggaaga

SEQ ID NO: 458670 - DNA, 15 bp, Homo sapiens
gagggggaggaagaa

SEQ ID NO: 458671 - DNA, 15 bp, Homo sapiens
agggggaggaagaag

SEQ ID NO: 458672 - DNA, 15 bp, Homo sapiens
gggggaggaagaaga

SEQ ID NO: 458673 - DNA, 15 bp, Homo sapiens
ggggaggaagaagag

SEQ ID NO: 458674 - DNA, 15 bp, Homo sapiens
gggaggaagaagagg

SEQ ID NO: 458675 - DNA, 15 bp, Homo sapiens
ggaggaagaagagga

SEQ ID NO: 458676 - DNA, 15 bp, Homo sapiens
gaggaagaagaggag

SEQ ID NO: 458677 - DNA, 15 bp, Homo sapiens
aggaagaagaggagc

SEQ ID NO: 458678 - DNA, 15 bp, Homo sapiens
ggaagaagaggagca

SEQ ID NO: 458679 - DNA, 15 bp, Homo sapiens
gaagaagaggagcag

SEQ ID NO: 458680 - DNA, 15 bp, Homo sapiens
aagaagaggagcagt

SEQ ID NO: 458681 - DNA, 15 bp, Homo sapiens
agaagaggagcagtt

SEQ ID NO: 458682 - DNA, 15 bp, Homo sapiens
gaagaggagcagttg

SEQ ID NO: 458683 - DNA, 15 bp, Homo sapiens
aagaggagcagttgg

SEQ ID NO: 458684 - DNA, 15 bp, Homo sapiens
agaggagcagttggt

SEQ ID NO: 458685 - DNA, 15 bp, Homo sapiens
gaggagcagttggtg

SEQ ID NO: 458686 - DNA, 15 bp, Homo sapiens
aggagcagttggtgt

SEQ ID NO: 458687 - DNA, 15 bp, Homo sapiens
ggagcagttggtgtt

SEQ ID NO: 458688 - DNA, 15 bp, Homo sapiens
gagcagttggtgttg

SEQ ID NO: 458689 - DNA, 15 bp, Homo sapiens
agcagttggtgttgc

SEQ ID NO: 458690 - DNA, 15 bp, Homo sapiens
gcagttggtgttgct

SEQ ID NO: 458691 - DNA, 15 bp, Homo sapiens
cagttggtgttgctg

SEQ ID NO: 458692 - DNA, 15 bp, Homo sapiens
agttggtgttgctgt

SEQ ID NO: 458693 - DNA, 15 bp, Homo sapiens
gttggtgttgctgtc

SEQ ID NO: 458694 - DNA, 15 bp, Homo sapiens
ttggtgttgctgtct

SEQ ID NO: 458695 - DNA, 15 bp, Homo sapiens
tggtgttgctgtctc

SEQ ID NO: 458696 - DNA, 15 bp, Homo sapiens
ggtgttgctgtctca

SEQ ID NO: 458697 - DNA, 15 bp, Homo sapiens
gtgttgctgtctcag

SEQ ID NO: 458698 - DNA, 15 bp, Homo sapiens
tgttgctgtctcagg

SEQ ID NO: 458699 - DNA, 15 bp, Homo sapiens
gttgctgtctcaggg

SEQ ID NO: 458700 - DNA, 15 bp, Homo sapiens
ttgctgtctcagggg

SEQ ID NO: 458701 - DNA, 15 bp, Homo sapiens
tgctgtctcaggggt

SEQ ID NO: 458702 - DNA, 15 bp, Homo sapiens
gctgtctcaggggta

SEQ ID NO: 458703 - DNA, 15 bp, Homo sapiens
ctgtctcaggggtaa

SEQ ID NO: 458704 - DNA, 15 bp, Homo sapiens
tgtctcaggggtaac

SEQ ID NO: 458705 - DNA, 15 bp, Homo sapiens
gtctcaggggtaaca

SEQ ID NO: 458706 - DNA, 15 bp, Homo sapiens
tctcaggggtaacag

SEQ ID NO: 458707 - DNA, 15 bp, Homo sapiens
ctcaggggtaacaga

SEQ ID NO: 458708 - DNA, 15 bp, Homo sapiens
tcaggggtaacagag

SEQ ID NO: 458709 - DNA, 15 bp, Homo sapiens
caggggtaacagagg

SEQ ID NO: 458710 - DNA, 15 bp, Homo sapiens
aggggtaacagaggc

SEQ ID NO: 458711 - DNA, 15 bp, Homo sapiens
ggggtaacagaggca

SEQ ID NO: 458712 - DNA, 15 bp, Homo sapiens
gggtaacagaggcag

SEQ ID NO: 458713 - DNA, 15 bp, Homo sapiens
ggtaacagaggcaga

SEQ ID NO: 458714 - DNA, 15 bp, Homo sapiens
gtaacagaggcagaa

SEQ ID NO: 458715 - DNA, 15 bp, Homo sapiens
taacagaggcagaaa

SEQ ID NO: 458716 - DNA, 15 bp, Homo sapiens
aacagaggcagaaag

SEQ ID NO: 458717 - DNA, 15 bp, Homo sapiens
acagaggcagaaagg

SEQ ID NO: 458718 - DNA, 15 bp, Homo sapiens
cagaggcagaaaggg

SEQ ID NO: 458719 - DNA, 15 bp, Homo sapiens
agaggcagaaagggt

SEQ ID NO: 458720 - DNA, 15 bp, Homo sapiens
gaggcagaaagggta

SEQ ID NO: 458721 - DNA, 15 bp, Homo sapiens
aggcagaaagggtag

SEQ ID NO: 458722 - DNA, 15 bp, Homo sapiens
ggcagaaagggtaga

SEQ ID NO: 458723 - DNA, 15 bp, Homo sapiens
gcagaaagggtagag

SEQ ID NO: 458724 - DNA, 15 bp, Homo sapiens
cagaaagggtagagg

SEQ ID NO: 458725 - DNA, 15 bp, Homo sapiens
agaaagggtagagga

SEQ ID NO: 458726 - DNA, 15 bp, Homo sapiens
gaaagggtagaggag

SEQ ID NO: 458727 - DNA, 15 bp, Homo sapiens
aaagggtagaggaga

SEQ ID NO: 458728 - DNA, 15 bp, Homo sapiens
aagggtagaggagaa

SEQ ID NO: 458729 - DNA, 15 bp, Homo sapiens
agggtagaggagaaa

SEQ ID NO: 458730 - DNA, 15 bp, Homo sapiens
gggtagaggagaaaa

SEQ ID NO: 458731 - DNA, 15 bp, Homo sapiens
ggtagaggagaaaag

SEQ ID NO: 458732 - DNA, 15 bp, Homo sapiens
gtagaggagaaaaga

SEQ ID NO: 458733 - DNA, 15 bp, Homo sapiens
tagaggagaaaagag

SEQ ID NO: 458734 - DNA, 15 bp, Homo sapiens
agaggagaaaagaga

SEQ ID NO: 458735 - DNA, 15 bp, Homo sapiens
gaggagaaaagagag

SEQ ID NO: 458736 - DNA, 15 bp, Homo sapiens
aggagaaaagagagg

SEQ ID NO: 458737 - DNA, 15 bp, Homo sapiens
ggagaaaagagaggc

SEQ ID NO: 458738 - DNA, 15 bp, Homo sapiens
gagaaaagagaggca

SEQ ID NO: 458739 - DNA, 15 bp, Homo sapiens
agaaaagagaggcag

SEQ ID NO: 458740 - DNA, 15 bp, Homo sapiens
gaaaagagaggcagg

SEQ ID NO: 458741 - DNA, 15 bp, Homo sapiens
aaaagagaggcaggc

SEQ ID NO: 458742 - DNA, 15 bp, Homo sapiens
aaagagaggcaggca

SEQ ID NO: 458743 - DNA, 15 bp, Homo sapiens
aagagaggcaggcac

SEQ ID NO: 458744 - DNA, 15 bp, Homo sapiens
agagaggcaggcacg

SEQ ID NO: 458745 - DNA, 15 bp, Homo sapiens
gagaggcaggcacgt

SEQ ID NO: 458746 - DNA, 15 bp, Homo sapiens
agaggcaggcacgtt

SEQ ID NO: 458747 - DNA, 15 bp, Homo sapiens
gaggcaggcacgttc

SEQ ID NO: 458748 - DNA, 15 bp, Homo sapiens
aggcaggcacgttca

SEQ ID NO: 458749 - DNA, 15 bp, Homo sapiens
ggcaggcacgttcag

SEQ ID NO: 458750 - DNA, 15 bp, Homo sapiens
gcaggcacgttcagt

SEQ ID NO: 458751 - DNA, 15 bp, Homo sapiens
caggcacgttcagtg

SEQ ID NO: 458752 - DNA, 15 bp, Homo sapiens
aggcacgttcagtgc

SEQ ID NO: 458753 - DNA, 15 bp, Homo sapiens
ggcacgttcagtgct

SEQ ID NO: 458754 - DNA, 15 bp, Homo sapiens
gcacgttcagtgctt

SEQ ID NO: 458755 - DNA, 15 bp, Homo sapiens
cacgttcagtgctta

SEQ ID NO: 458756 - DNA, 15 bp, Homo sapiens
acgttcagtgcttaa

SEQ ID NO: 458757 - DNA, 15 bp, Homo sapiens
cgttcagtgcttaac

SEQ ID NO: 458758 - DNA, 15 bp, Homo sapiens
gttcagtgcttaact

SEQ ID NO: 458759 - DNA, 15 bp, Homo sapiens
ttcagtgcttaactt

SEQ ID NO: 458760 - DNA, 15 bp, Homo sapiens
tcagtgcttaacttt

SEQ ID NO: 458761 - DNA, 15 bp, Homo sapiens
cagtgcttaacttta

SEQ ID NO: 458762 - DNA, 15 bp, Homo sapiens
agtgcttaactttaa

SEQ ID NO: 458763 - DNA, 15 bp, Homo sapiens
gtgcttaactttaat

SEQ ID NO: 458764 - DNA, 15 bp, Homo sapiens
tgcttaactttaatt

SEQ ID NO: 458765 - DNA, 15 bp, Homo sapiens
gcttaactttaattg

SEQ ID NO: 458766 - DNA, 15 bp, Homo sapiens
cttaactttaattga

SEQ ID NO: 458767 - DNA, 15 bp, Homo sapiens
ttaactttaattgaa

SEQ ID NO: 458768 - DNA, 15 bp, Homo sapiens
taactttaattgaaa

SEQ ID NO: 458769 - DNA, 15 bp, Homo sapiens
aactttaattgaaaa

SEQ ID NO: 458770 - DNA, 15 bp, Homo sapiens
actttaattgaaaaa

SEQ ID NO: 458771 - DNA, 15 bp, Homo sapiens
ctttaattgaaaaaa

SEQ ID NO: 458772 - DNA, 15 bp, Homo sapiens
tttaattgaaaaaac

SEQ ID NO: 458773 - DNA, 15 bp, Homo sapiens
ttaattgaaaaaact

SEQ ID NO: 458774 - DNA, 15 bp, Homo sapiens
taattgaaaaaactc

SEQ ID NO: 458775 - DNA, 15 bp, Homo sapiens
aattgaaaaaactcc

SEQ ID NO: 458776 - DNA, 15 bp, Homo sapiens
attgaaaaaactcca

SEQ ID NO: 458777 - DNA, 15 bp, Homo sapiens
ttgaaaaaactccac

SEQ ID NO: 458778 - DNA, 15 bp, Homo sapiens
tgaaaaaactccacg

SEQ ID NO: 458779 - DNA, 15 bp, Homo sapiens
gaaaaaactccacgt

SEQ ID NO: 458780 - DNA, 15 bp, Homo sapiens
aaaaaactccacgtg

SEQ ID NO: 458781 - DNA, 15 bp, Homo sapiens
aaaaactccacgtgt

SEQ ID NO: 458782 - DNA, 15 bp, Homo sapiens
aaaactccacgtgta

SEQ ID NO: 458783 - DNA, 15 bp, Homo sapiens
aaactccacgtgtag

SEQ ID NO: 458784 - DNA, 15 bp, Homo sapiens
aactccacgtgtagg

SEQ ID NO: 458785 - DNA, 15 bp, Homo sapiens
actccacgtgtaggt

SEQ ID NO: 458786 - DNA, 15 bp, Homo sapiens
ctccacgtgtaggtg

SEQ ID NO: 458787 - DNA, 15 bp, Homo sapiens
tccacgtgtaggtgg

SEQ ID NO: 458788 - DNA, 15 bp, Homo sapiens
ccacgtgtaggtgga

SEQ ID NO: 458789 - DNA, 15 bp, Homo sapiens
cacgtgtaggtggac

SEQ ID NO: 458790 - DNA, 15 bp, Homo sapiens
acgtgtaggtggacc

SEQ ID NO: 458791 - DNA, 15 bp, Homo sapiens
cgtgtaggtggaccc

SEQ ID NO: 458792 - DNA, 15 bp, Homo sapiens
gtgtaggtggaccct

SEQ ID NO: 458793 - DNA, 15 bp, Homo sapiens
tgtaggtggaccctc

SEQ ID NO: 458794 - DNA, 15 bp, Homo sapiens
gtaggtggaccctca

SEQ ID NO: 458795 - DNA, 15 bp, Homo sapiens
taggtggaccctcac

SEQ ID NO: 458796 - DNA, 15 bp, Homo sapiens
aggtggaccctcaca

SEQ ID NO: 458797 - DNA, 15 bp, Homo sapiens
ggtggaccctcacag

SEQ ID NO: 458798 - DNA, 15 bp, Homo sapiens
gtggaccctcacagt

SEQ ID NO: 458799 - DNA, 15 bp, Homo sapiens
tggaccctcacagtt

SEQ ID NO: 458800 - DNA, 15 bp, Homo sapiens
ggaccctcacagttc

SEQ ID NO: 458801 - DNA, 15 bp, Homo sapiens
gaccctcacagttca

SEQ ID NO: 458802 - DNA, 15 bp, Homo sapiens
accctcacagttcaa

SEQ ID NO: 458803 - DNA, 15 bp, Homo sapiens
ccctcacagttcaaa

SEQ ID NO: 458804 - DNA, 15 bp, Homo sapiens
cctcacagttcaaac

SEQ ID NO: 458805 - DNA, 15 bp, Homo sapiens
ctcacagttcaaact

SEQ ID NO: 458806 - DNA, 15 bp, Homo sapiens
tcacagttcaaactg

SEQ ID NO: 458807 - DNA, 15 bp, Homo sapiens
cacagttcaaactgg

SEQ ID NO: 458808 - DNA, 15 bp, Homo sapiens
acagttcaaactggc

SEQ ID NO: 458809 - DNA, 15 bp, Homo sapiens
cagttcaaactggcg

SEQ ID NO: 458810 - DNA, 15 bp, Homo sapiens
agttcaaactggcgc

SEQ ID NO: 458811 - DNA, 15 bp, Homo sapiens
gttcaaactggcgct

SEQ ID NO: 458812 - DNA, 15 bp, Homo sapiens
ttcaaactggcgctg

SEQ ID NO: 458813 - DNA, 15 bp, Homo sapiens
tcaaactggcgctgt

SEQ ID NO: 458814 - DNA, 15 bp, Homo sapiens
caaactggcgctgtt

SEQ ID NO: 458815 - DNA, 15 bp, Homo sapiens
aaactggcgctgttc

SEQ ID NO: 458816 - DNA, 15 bp, Homo sapiens
aactggcgctgttca

SEQ ID NO: 458817 - DNA, 15 bp, Homo sapiens
actggcgctgttcaa

SEQ ID NO: 458818 - DNA, 15 bp, Homo sapiens
ctggcgctgttcaag

SEQ ID NO: 458819 - DNA, 15 bp, Homo sapiens
tggcgctgttcaagc

SEQ ID NO: 458820 - DNA, 15 bp, Homo sapiens
ggcgctgttcaagcg

SEQ ID NO: 458821 - DNA, 15 bp, Homo sapiens
gcgctgttcaagcgt

SEQ ID NO: 458822 - DNA, 15 bp, Homo sapiens
cgctgttcaagcgtc

SEQ ID NO: 458823 - DNA, 15 bp, Homo sapiens
gctgttcaagcgtca

SEQ ID NO: 458824 - DNA, 15 bp, Homo sapiens
ctgttcaagcgtcaa

SEQ ID NO: 458825 - DNA, 15 bp, Homo sapiens
tgttcaagcgtcaac

SEQ ID NO: 458826 - DNA, 15 bp, Homo sapiens
gttcaagcgtcaact

SEQ ID NO: 458827 - DNA, 15 bp, Homo sapiens
ttcaagcgtcaactg

SEQ ID NO: 458828 - DNA, 15 bp, Homo sapiens
tcaagcgtcaactgt

SEQ ID NO: 458829 - DNA, 15 bp, Homo sapiens
caagcgtcaactgta

SEQ ID NO: 458830 - DNA, 15 bp, Homo sapiens
aagcgtcaactgtac

SEQ ID NO: 458831 - DNA, 15 bp, Homo sapiens
agcgtcaactgtaca

SEQ ID NO: 458832 - DNA, 15 bp, Homo sapiens
gcgtcaactgtacag

SEQ ID NO: 458833 - DNA, 15 bp, Homo sapiens
cgtcaactgtacagg

SEQ ID NO: 458834 - DNA, 15 bp, Homo sapiens
gtcaactgtacaggg

SEQ ID NO: 458835 - DNA, 15 bp, Homo sapiens
tcaactgtacagggc

SEQ ID NO: 458836 - DNA, 15 bp, Homo sapiens
caactgtacagggca

SEQ ID NO: 458837 - DNA, 15 bp, Homo sapiens
aactgtacagggcaa

SEQ ID NO: 458838 - DNA, 15 bp, Homo sapiens
actgtacagggcaaa

SEQ ID NO: 458839 - DNA, 15 bp, Homo sapiens
ctgtacagggcaaag

SEQ ID NO: 458840 - DNA, 15 bp, Homo sapiens
tgtacagggcaaaga

SEQ ID NO: 458841 - DNA, 15 bp, Homo sapiens
gtacagggcaaagaa

SEQ ID NO: 458842 - DNA, 15 bp, Homo sapiens
tacagggcaaagaaa

SEQ ID NO: 458843 - DNA, 15 bp, Homo sapiens
acagggcaaagaaat

SEQ ID NO: 458844 - DNA, 15 bp, Homo sapiens
cagggcaaagaaatg

SEQ ID NO: 458845 - DNA, 15 bp, Homo sapiens
agggcaaagaaatga

SEQ ID NO: 458846 - DNA, 15 bp, Homo sapiens
ggcaaagaaatgagg

SEQ ID NO: 458847 - DNA, 15 bp, Homo sapiens
gcaaagaaatgaggt

SEQ ID NO: 458848 - DNA, 15 bp, Homo sapiens
caaagaaatgaggta

SEQ ID NO: 458849 - DNA, 15 bp, Homo sapiens
aaagaaatgaggtaa

SEQ ID NO: 458850 - DNA, 15 bp, Homo sapiens
aagaaatgaggtaag

SEQ ID NO: 458851 - DNA, 15 bp, Homo sapiens
agaaatgaggtaaga

SEQ ID NO: 458852 - DNA, 15 bp, Homo sapiens
gaaatgaggtaagaa

SEQ ID NO: 458853 - DNA, 15 bp, Homo sapiens
aaatgaggtaagaat

SEQ ID NO: 458854 - DNA, 15 bp, Homo sapiens
aatgaggtaagaatt

SEQ ID NO: 458855 - DNA, 15 bp, Homo sapiens
atgaggtaagaatta

SEQ ID NO: 458856 - DNA, 15 bp, Homo sapiens
tgaggtaagaattac

SEQ ID NO: 458857 - DNA, 15 bp, Homo sapiens
gaggtaagaattaca

SEQ ID NO: 458858 - DNA, 15 bp, Homo sapiens
aggtaagaattacag

SEQ ID NO: 458859 - DNA, 15 bp, Homo sapiens
ggtaagaattacagt

SEQ ID NO: 458860 - DNA, 15 bp, Homo sapiens
gtaagaattacagtg

SEQ ID NO: 458861 - DNA, 15 bp, Homo sapiens
agaattacagtgaaa

SEQ ID NO: 458862 - DNA, 15 bp, Homo sapiens
gaattacagtgaaaa

SEQ ID NO: 458863 - DNA, 15 bp, Homo sapiens
aattacagtgaaaat

SEQ ID NO: 458864 - DNA, 15 bp, Homo sapiens
attacagtgaaaatt

SEQ ID NO: 458865 - DNA, 15 bp, Homo sapiens
ttacagtgaaaattc

SEQ ID NO: 458866 - DNA, 15 bp, Homo sapiens
tacagtgaaaattcc

SEQ ID NO: 458867 - DNA, 15 bp, Homo sapiens
acagtgaaaattcca

SEQ ID NO: 458868 - DNA, 15 bp, Homo sapiens
cagtgaaaattccag

SEQ ID NO: 458869 - DNA, 15 bp, Homo sapiens
agtgaaaattccaga

SEQ ID NO: 458870 - DNA, 15 bp, Homo sapiens
gtgaaaattccagat

SEQ ID NO: 458871 - DNA, 15 bp, Homo sapiens
tgaaaattccagatg

SEQ ID NO: 458872 - DNA, 15 bp, Homo sapiens
gaaaattccagatgg

SEQ ID NO: 458873 - DNA, 15 bp, Homo sapiens
aaaattccagatggt

SEQ ID NO: 458874 - DNA, 15 bp, Homo sapiens
aaattccagatggtt

SEQ ID NO: 458875 - DNA, 15 bp, Homo sapiens
aattccagatggttc

SEQ ID NO: 458876 - DNA, 15 bp, Homo sapiens
attccagatggttct

SEQ ID NO: 458877 - DNA, 15 bp, Homo sapiens
ttccagatggttctt

SEQ ID NO: 458878 - DNA, 15 bp, Homo sapiens
tccagatggttctta

SEQ ID NO: 458879 - DNA, 15 bp, Homo sapiens
ccagatggttcttag

SEQ ID NO: 458880 - DNA, 15 bp, Homo sapiens
cagatggttcttagt

SEQ ID NO: 458881 - DNA, 15 bp, Homo sapiens
agatggttcttagtt

SEQ ID NO: 458882 - DNA, 15 bp, Homo sapiens
gatggttcttagttt

SEQ ID NO: 458883 - DNA, 15 bp, Homo sapiens
atggttcttagtttt

SEQ ID NO: 458884 - DNA, 15 bp, Homo sapiens
tggttcttagttttt

SEQ ID NO: 458885 - DNA, 15 bp, Homo sapiens
ggttcttagtttttt

SEQ ID NO: 458886 - DNA, 15 bp, Homo sapiens
gttcttagttttttt

SEQ ID NO: 458887 - DNA, 15 bp, Homo sapiens
ttcttagtttttttc

SEQ ID NO: 458888 - DNA, 15 bp, Homo sapiens
tcttagtttttttct

SEQ ID NO: 458889 - DNA, 15 bp, Homo sapiens
cttagtttttttctg

SEQ ID NO: 458890 - DNA, 15 bp, Homo sapiens
ttagtttttttctga

SEQ ID NO: 458891 - DNA, 15 bp, Homo sapiens
tagtttttttctgac

SEQ ID NO: 458892 - DNA, 15 bp, Homo sapiens
agtttttttctgaca

SEQ ID NO: 458893 - DNA, 15 bp, Homo sapiens
gtttttttctgacac

SEQ ID NO: 458894 - DNA, 15 bp, Homo sapiens
tttttttctgacacc

SEQ ID NO: 458895 - DNA, 15 bp, Homo sapiens
ttttttctgacacct

SEQ ID NO: 458896 - DNA, 15 bp, Homo sapiens
tttttctgacacctt

SEQ ID NO: 458897 - DNA, 15 bp, Homo sapiens
ttttctgacaccttc

SEQ ID NO: 458898 - DNA, 15 bp, Homo sapiens
tttctgacaccttct

SEQ ID NO: 458899 - DNA, 15 bp, Homo sapiens
ttctgacaccttctc

SEQ ID NO: 458900 - DNA, 15 bp, Homo sapiens
tctgacaccttctct

SEQ ID NO: 458901 - DNA, 15 bp, Homo sapiens
ctgacaccttctcta

SEQ ID NO: 458902 - DNA, 15 bp, Homo sapiens
tgacaccttctctaa

SEQ ID NO: 458903 - DNA, 15 bp, Homo sapiens
gacaccttctctaac

SEQ ID NO: 458904 - DNA, 15 bp, Homo sapiens
acaccttctctaact

SEQ ID NO: 458905 - DNA, 15 bp, Homo sapiens
caccttctctaactc

SEQ ID NO: 458906 - DNA, 15 bp, Homo sapiens
accttctctaactca

SEQ ID NO: 458907 - DNA, 15 bp, Homo sapiens
ccttctctaactcat

SEQ ID NO: 458908 - DNA, 15 bp, Homo sapiens
cttctctaactcata

SEQ ID NO: 458909 - DNA, 15 bp, Homo sapiens
ttctctaactcatat

SEQ ID NO: 458910 - DNA, 15 bp, Homo sapiens
tctctaactcatatg

SEQ ID NO: 458911 - DNA, 15 bp, Homo sapiens
ctctaactcatatga

SEQ ID NO: 458912 - DNA, 15 bp, Homo sapiens
tctaactcatatgaa

SEQ ID NO: 458913 - DNA, 15 bp, Homo sapiens
ctaactcatatgaag

SEQ ID NO: 458914 - DNA, 15 bp, Homo sapiens
taactcatatgaagc

SEQ ID NO: 458915 - DNA, 15 bp, Homo sapiens
aactcatatgaagct

SEQ ID NO: 458916 - DNA, 15 bp, Homo sapiens
actcatatgaagctt

SEQ ID NO: 458917 - DNA, 15 bp, Homo sapiens
ctcatatgaagctta

SEQ ID NO: 458918 - DNA, 15 bp, Homo sapiens
tcatatgaagcttat

SEQ ID NO: 458919 - DNA, 15 bp, Homo sapiens
catatgaagcttatt

SEQ ID NO: 458920 - DNA, 15 bp, Homo sapiens
atatgaagcttattt

SEQ ID NO: 458921 - DNA, 15 bp, Homo sapiens
tatgaagcttatttg

SEQ ID NO: 458922 - DNA, 15 bp, Homo sapiens
atgaagcttatttga

SEQ ID NO: 458923 - DNA, 15 bp, Homo sapiens
tgaagcttatttgac

SEQ ID NO: 458924 - DNA, 15 bp, Homo sapiens
gaagcttatttgact

SEQ ID NO: 458925 - DNA, 15 bp, Homo sapiens
aagcttatttgactt

SEQ ID NO: 458926 - DNA, 15 bp, Homo sapiens
agcttatttgactta

SEQ ID NO: 458927 - DNA, 15 bp, Homo sapiens
gcttatttgacttat

SEQ ID NO: 458928 - DNA, 15 bp, Homo sapiens
cttatttgacttatt

SEQ ID NO: 458929 - DNA, 15 bp, Homo sapiens
ttatttgacttattt

SEQ ID NO: 458930 - DNA, 15 bp, Homo sapiens
tatttgacttatttt

SEQ ID NO: 458931 - DNA, 15 bp, Homo sapiens
atttgacttattttt

SEQ ID NO: 458932 - DNA, 15 bp, Homo sapiens
tttgacttatttttg

SEQ ID NO: 458933 - DNA, 15 bp, Homo sapiens
ttgacttatttttgt

SEQ ID NO: 458934 - DNA, 15 bp, Homo sapiens
tgacttatttttgtt

SEQ ID NO: 458935 - DNA, 15 bp, Homo sapiens
gacttatttttgtta

SEQ ID NO: 458936 - DNA, 15 bp, Homo sapiens
acttatttttgttat

SEQ ID NO: 458937 - DNA, 15 bp, Homo sapiens
cttatttttgttatt

SEQ ID NO: 458938 - DNA, 15 bp, Homo sapiens
tatttttgttattag

SEQ ID NO: 458939 - DNA, 15 bp, Homo sapiens
atttttgttattagc

SEQ ID NO: 458940 - DNA, 15 bp, Homo sapiens
tttttgttattagct

SEQ ID NO: 458941 - DNA, 15 bp, Homo sapiens
ttttgttattagctt

SEQ ID NO: 458942 - DNA, 15 bp, Homo sapiens
tttgttattagctta

SEQ ID NO: 458943 - DNA, 15 bp, Homo sapiens
ttgttattagcttaa

SEQ ID NO: 458944 - DNA, 15 bp, Homo sapiens
tgttattagcttaag

SEQ ID NO: 458945 - DNA, 15 bp, Homo sapiens
gttattagcttaagt

SEQ ID NO: 458946 - DNA, 15 bp, Homo sapiens
ttattagcttaagtt

SEQ ID NO: 458947 - DNA, 15 bp, Homo sapiens
tattagcttaagttt

SEQ ID NO: 458948 - DNA, 15 bp, Homo sapiens
attagcttaagttta

SEQ ID NO: 458949 - DNA, 15 bp, Homo sapiens
ttagcttaagtttac

SEQ ID NO: 458950 - DNA, 15 bp, Homo sapiens
tagcttaagtttacc

SEQ ID NO: 458951 - DNA, 15 bp, Homo sapiens
agcttaagtttacca

SEQ ID NO: 458952 - DNA, 15 bp, Homo sapiens
gcttaagtttaccaa

SEQ ID NO: 458953 - DNA, 15 bp, Homo sapiens
cttaagtttaccaat

SEQ ID NO: 458954 - DNA, 15 bp, Homo sapiens
ttaagtttaccaatg

SEQ ID NO: 458955 - DNA, 15 bp, Homo sapiens
taagtttaccaatga

SEQ ID NO: 458956 - DNA, 15 bp, Homo sapiens
aagtttaccaatgat

SEQ ID NO: 458957 - DNA, 15 bp, Homo sapiens
agtttaccaatgata

SEQ ID NO: 458958 - DNA, 15 bp, Homo sapiens
gtttaccaatgatac

SEQ ID NO: 458959 - DNA, 15 bp, Homo sapiens
tttaccaatgataca

SEQ ID NO: 458960 - DNA, 15 bp, Homo sapiens
taagaaacctgctga

SEQ ID NO: 458961 - DNA, 15 bp, Homo sapiens
aagaaacctgctgaa

SEQ ID NO: 458962 - DNA, 15 bp, Homo sapiens
agaaacctgctgaag

SEQ ID NO: 458963 - DNA, 15 bp, Homo sapiens
gaaacctgctgaagc

SEQ ID NO: 458964 - DNA, 15 bp, Homo sapiens
aaacctgctgaagca

SEQ ID NO: 458965 - DNA, 15 bp, Homo sapiens
aacctgctgaagcat

SEQ ID NO: 458966 - DNA, 15 bp, Homo sapiens
acctgctgaagcatg

SEQ ID NO: 458967 - DNA, 15 bp, Homo sapiens
cctgctgaagcatga

SEQ ID NO: 458968 - DNA, 15 bp, Homo sapiens
ctgctgaagcatgag

SEQ ID NO: 458969 - DNA, 15 bp, Homo sapiens
tgctgaagcatgagt

SEQ ID NO: 458970 - DNA, 15 bp, Homo sapiens
gctgaagcatgagtc

SEQ ID NO: 458971 - DNA, 15 bp, Homo sapiens
ctgaagcatgagtct

SEQ ID NO: 458972 - DNA, 15 bp, Homo sapiens
tgaagcatgagtctc

SEQ ID NO: 458973 - DNA, 15 bp, Homo sapiens
gaagcatgagtctca

SEQ ID NO: 458974 - DNA, 15 bp, Homo sapiens
aagcatgagtctcag

SEQ ID NO: 458975 - DNA, 15 bp, Homo sapiens
agcatgagtctcagt

SEQ ID NO: 458976 - DNA, 15 bp, Homo sapiens
gcatgagtctcagtt

SEQ ID NO: 458977 - DNA, 15 bp, Homo sapiens
catgagtctcagtta

SEQ ID NO: 458978 - DNA, 15 bp, Homo sapiens
atgagtctcagttac

SEQ ID NO: 458979 - DNA, 15 bp, Homo sapiens
tgagtctcagttacc

SEQ ID NO: 458980 - DNA, 15 bp, Homo sapiens
gagtctcagttacca

SEQ ID NO: 458981 - DNA, 15 bp, Homo sapiens
agtctcagttaccat

SEQ ID NO: 458982 - DNA, 15 bp, Homo sapiens
gtctcagttaccata

SEQ ID NO: 458983 - DNA, 15 bp, Homo sapiens
tctcagttaccataa

SEQ ID NO: 458984 - DNA, 15 bp, Homo sapiens
ctcagttaccataat

SEQ ID NO: 458985 - DNA, 15 bp, Homo sapiens
tcagttaccataatg

SEQ ID NO: 458986 - DNA, 15 bp, Homo sapiens
cagttaccataatga

SEQ ID NO: 458987 - DNA, 15 bp, Homo sapiens
agttaccataatgaa

SEQ ID NO: 458988 - DNA, 15 bp, Homo sapiens
gttaccataatgaat

SEQ ID NO: 458989 - DNA, 15 bp, Homo sapiens
ttaccataatgaata

SEQ ID NO: 458990 - DNA, 15 bp, Homo sapiens
taccataatgaatac

SEQ ID NO: 458991 - DNA, 15 bp, Homo sapiens
accataatgaatacg

SEQ ID NO: 458992 - DNA, 15 bp, Homo sapiens
ccataatgaatacgg

SEQ ID NO: 458993 - DNA, 15 bp, Homo sapiens
cataatgaatacggg

SEQ ID NO: 458994 - DNA, 15 bp, Homo sapiens
ataatgaatacggga

SEQ ID NO: 458995 - DNA, 15 bp, Homo sapiens
taatgaatacgggat

SEQ ID NO: 458996 - DNA, 15 bp, Homo sapiens
aatgaatacgggatt

SEQ ID NO: 458997 - DNA, 15 bp, Homo sapiens
atgaatacgggattt

SEQ ID NO: 458998 - DNA, 15 bp, Homo sapiens
tgaatacgggatttg

SEQ ID NO: 458999 - DNA, 15 bp, Homo sapiens
gaatacgggatttgc

SEQ ID NO: 459000 - DNA, 15 bp, Homo sapiens
aatacgggatttgcg

SEQ ID NO: 459001 - DNA, 15 bp, Homo sapiens
atacgggatttgcga

SEQ ID NO: 459002 - DNA, 15 bp, Homo sapiens
tacgggatttgcgat

SEQ ID NO: 459003 - DNA, 15 bp, Homo sapiens
acgggatttgcgata

SEQ ID NO: 459004 - DNA, 15 bp, Homo sapiens
cgggatttgcgatat

SEQ ID NO: 459005 - DNA, 15 bp, Homo sapiens
gggatttgcgatatc

SEQ ID NO: 459006 - DNA, 15 bp, Homo sapiens
ggatttgcgatatct

SEQ ID NO: 459007 - DNA, 15 bp, Homo sapiens
gatttgcgatatctc

SEQ ID NO: 459008 - DNA, 15 bp, Homo sapiens
atttgcgatatctct

SEQ ID NO: 459009 - DNA, 15 bp, Homo sapiens
tttgcgatatctctg

SEQ ID NO: 459010 - DNA, 15 bp, Homo sapiens
ttgcgatatctctgt

SEQ ID NO: 459011 - DNA, 15 bp, Homo sapiens
tgcgatatctctgtc

SEQ ID NO: 459012 - DNA, 15 bp, Homo sapiens
gcgatatctctgtct

SEQ ID NO: 459013 - DNA, 15 bp, Homo sapiens
cgatatctctgtctg

SEQ ID NO: 459014 - DNA, 15 bp, Homo sapiens
gatatctctgtctga

SEQ ID NO: 459015 - DNA, 15 bp, Homo sapiens
atatctctgtctgat

SEQ ID NO: 459016 - DNA, 15 bp, Homo sapiens
tatctctgtctgata

SEQ ID NO: 459017 - DNA, 15 bp, Homo sapiens
atctctgtctgatat

SEQ ID NO: 459018 - DNA, 15 bp, Homo sapiens
tctctgtctgatatt

SEQ ID NO: 459019 - DNA, 15 bp, Homo sapiens
ctctgtctgatattt

SEQ ID NO: 459020 - DNA, 15 bp, Homo sapiens
tctgtctgatatttt

SEQ ID NO: 459021 - DNA, 15 bp, Homo sapiens
ctgtctgatattttt

SEQ ID NO: 459022 - DNA, 15 bp, Homo sapiens
tgtctgatatttttt

SEQ ID NO: 459023 - DNA, 15 bp, Homo sapiens
gtctgatatttttta

SEQ ID NO: 459024 - DNA, 15 bp, Homo sapiens
tctgatattttttaa

SEQ ID NO: 459025 - DNA, 15 bp, Homo sapiens
ctgatattttttaat

SEQ ID NO: 459026 - DNA, 15 bp, Homo sapiens
tgatattttttaata

SEQ ID NO: 459027 - DNA, 15 bp, Homo sapiens
gatattttttaatac

SEQ ID NO: 459028 - DNA, 15 bp, Homo sapiens
atattttttaataca

SEQ ID NO: 459029 - DNA, 15 bp, Homo sapiens
tattttttaatacat

SEQ ID NO: 459030 - DNA, 15 bp, Homo sapiens
attttttaatacatt

SEQ ID NO: 459031 - DNA, 15 bp, Homo sapiens
ttttttaatacattt

SEQ ID NO: 459032 - DNA, 15 bp, Homo sapiens
tttttaatacatttc

SEQ ID NO: 459033 - DNA, 15 bp, Homo sapiens
ttttaatacatttca

SEQ ID NO: 459034 - DNA, 15 bp, Homo sapiens
tttaatacatttcat

SEQ ID NO: 459035 - DNA, 15 bp, Homo sapiens
ttaatacatttcatt

SEQ ID NO: 459036 - DNA, 15 bp, Homo sapiens
taatacatttcattt

SEQ ID NO: 459037 - DNA, 15 bp, Homo sapiens
aatacatttcatttt

SEQ ID NO: 459038 - DNA, 15 bp, Homo sapiens
atacatttcatttta

SEQ ID NO: 459039 - DNA, 15 bp, Homo sapiens
tacatttcattttaa

SEQ ID NO: 459040 - DNA, 15 bp, Homo sapiens
acatttcattttaat

SEQ ID NO: 459041 - DNA, 15 bp, Homo sapiens
catttcattttaatg

SEQ ID NO: 459042 - DNA, 15 bp, Homo sapiens
atttcattttaatgc

SEQ ID NO: 459043 - DNA, 15 bp, Homo sapiens
tttcattttaatgca

SEQ ID NO: 459044 - DNA, 15 bp, Homo sapiens
ttcattttaatgcac

SEQ ID NO: 459045 - DNA, 15 bp, Homo sapiens
tcattttaatgcaca

SEQ ID NO: 459046 - DNA, 15 bp, Homo sapiens
cattttaatgcacat

SEQ ID NO: 459047 - DNA, 15 bp, Homo sapiens
attttaatgcacatt

SEQ ID NO: 459048 - DNA, 15 bp, Homo sapiens
ttttaatgcacattt

SEQ ID NO: 459049 - DNA, 15 bp, Homo sapiens
tttaatgcacatttt

SEQ ID NO: 459050 - DNA, 15 bp, Homo sapiens
ttaatgcacatttta

SEQ ID NO: 459051 - DNA, 15 bp, Homo sapiens
taatgcacattttaa

SEQ ID NO: 459052 - DNA, 15 bp, Homo sapiens
aatgcacattttaag

SEQ ID NO: 459053 - DNA, 15 bp, Homo sapiens
atgcacattttaagt

SEQ ID NO: 459054 - DNA, 15 bp, Homo sapiens
tgcacattttaagtt

SEQ ID NO: 459055 - DNA, 15 bp, Homo sapiens
gcacattttaagttc

SEQ ID NO: 459056 - DNA, 15 bp, Homo sapiens
cacattttaagttct

SEQ ID NO: 459057 - DNA, 15 bp, Homo sapiens
acattttaagttctc

SEQ ID NO: 459058 - DNA, 15 bp, Homo sapiens
cattttaagttctcc

SEQ ID NO: 459059 - DNA, 15 bp, Homo sapiens
attttaagttctcct

SEQ ID NO: 459060 - DNA, 15 bp, Homo sapiens
ttttaagttctccta

SEQ ID NO: 459061 - DNA, 15 bp, Homo sapiens
tttaagttctcctag

SEQ ID NO: 459062 - DNA, 15 bp, Homo sapiens
ttaagttctcctagg

SEQ ID NO: 459063 - DNA, 15 bp, Homo sapiens
taagttctcctaggg

SEQ ID NO: 459064 - DNA, 15 bp, Homo sapiens
aagttctcctagggt

SEQ ID NO: 459065 - DNA, 15 bp, Homo sapiens
agttctcctagggta

SEQ ID NO: 459066 - DNA, 15 bp, Homo sapiens
gttctcctagggtaa

SEQ ID NO: 459067 - DNA, 15 bp, Homo sapiens
ttctcctagggtaaa

SEQ ID NO: 459068 - DNA, 15 bp, Homo sapiens
tctcctagggtaaaa

SEQ ID NO: 459069 - DNA, 15 bp, Homo sapiens
ctcctagggtaaaat

SEQ ID NO: 459070 - DNA, 15 bp, Homo sapiens
tcctagggtaaaata

SEQ ID NO: 459071 - DNA, 15 bp, Homo sapiens
cctagggtaaaatat

SEQ ID NO: 459072 - DNA, 15 bp, Homo sapiens
ctagggtaaaatatt

SEQ ID NO: 459073 - DNA, 15 bp, Homo sapiens
tagggtaaaatatta

SEQ ID NO: 459074 - DNA, 15 bp, Homo sapiens
agggtaaaatattac

SEQ ID NO: 459075 - DNA, 15 bp, Homo sapiens
gggtaaaatattacc

SEQ ID NO: 459076 - DNA, 15 bp, Homo sapiens
ggtaaaatattacca

SEQ ID NO: 459077 - DNA, 15 bp, Homo sapiens
gtaaaatattaccat

SEQ ID NO: 459078 - DNA, 15 bp, Homo sapiens
taaaatattaccatt

SEQ ID NO: 459079 - DNA, 15 bp, Homo sapiens
aaaatattaccatta

SEQ ID NO: 459080 - DNA, 15 bp, Homo sapiens
aaatattaccattag

SEQ ID NO: 459081 - DNA, 15 bp, Homo sapiens
aatattaccattagc

SEQ ID NO: 459082 - DNA, 15 bp, Homo sapiens
atattaccattagcc

SEQ ID NO: 459083 - DNA, 15 bp, Homo sapiens
tattaccattagcct

SEQ ID NO: 459084 - DNA, 15 bp, Homo sapiens
attaccattagcctt

SEQ ID NO: 459085 - DNA, 15 bp, Homo sapiens
ttaccattagcctta

SEQ ID NO: 459086 - DNA, 15 bp, Homo sapiens
taccattagccttaa

SEQ ID NO: 459087 - DNA, 15 bp, Homo sapiens
accattagccttaat

SEQ ID NO: 459088 - DNA, 15 bp, Homo sapiens
ccattagccttaatc

SEQ ID NO: 459089 - DNA, 15 bp, Homo sapiens
cattagccttaatcc

SEQ ID NO: 459090 - DNA, 15 bp, Homo sapiens
attagccttaatcca

SEQ ID NO: 459091 - DNA, 15 bp, Homo sapiens
ttagccttaatccac

SEQ ID NO: 459092 - DNA, 15 bp, Homo sapiens
tagccttaatccacc

SEQ ID NO: 459093 - DNA, 15 bp, Homo sapiens
agccttaatccacca

SEQ ID NO: 459094 - DNA, 15 bp, Homo sapiens
gccttaatccaccat

SEQ ID NO: 459095 - DNA, 15 bp, Homo sapiens
ccttaatccaccatt

SEQ ID NO: 459096 - DNA, 15 bp, Homo sapiens
cttaatccaccatta

SEQ ID NO: 459097 - DNA, 15 bp, Homo sapiens
ttaatccaccattaa

SEQ ID NO: 459098 - DNA, 15 bp, Homo sapiens
taatccaccattaag

SEQ ID NO: 459099 - DNA, 15 bp, Homo sapiens
aatccaccattaagt

SEQ ID NO: 459100 - DNA, 15 bp, Homo sapiens
atccaccattaagtt

SEQ ID NO: 459101 - DNA, 15 bp, Homo sapiens
tccaccattaagttg

SEQ ID NO: 459102 - DNA, 15 bp, Homo sapiens
ccaccattaagttgc

SEQ ID NO: 459103 - DNA, 15 bp, Homo sapiens
caccattaagttgct

SEQ ID NO: 459104 - DNA, 15 bp, Homo sapiens
accattaagttgctc

SEQ ID NO: 459105 - DNA, 15 bp, Homo sapiens
ccattaagttgctct

SEQ ID NO: 459106 - DNA, 15 bp, Homo sapiens
cattaagttgctctt

SEQ ID NO: 459107 - DNA, 15 bp, Homo sapiens
attaagttgctcttc

SEQ ID NO: 459108 - DNA, 15 bp, Homo sapiens
ttaagttgctcttca

SEQ ID NO: 459109 - DNA, 15 bp, Homo sapiens
taagttgctcttcaa

SEQ ID NO: 459110 - DNA, 15 bp, Homo sapiens
aagttgctcttcaat

SEQ ID NO: 459111 - DNA, 15 bp, Homo sapiens
agttgctcttcaata

SEQ ID NO: 459112 - DNA, 15 bp, Homo sapiens
gttgctcttcaataa

SEQ ID NO: 459113 - DNA, 15 bp, Homo sapiens
ttgctcttcaataat

SEQ ID NO: 459114 - DNA, 15 bp, Homo sapiens
tgctcttcaataatt

SEQ ID NO: 459115 - DNA, 15 bp, Homo sapiens
gctcttcaataattt

SEQ ID NO: 459116 - DNA, 15 bp, Homo sapiens
ctcttcaataatttg

SEQ ID NO: 459117 - DNA, 15 bp, Homo sapiens
tcttcaataatttga

SEQ ID NO: 459118 - DNA, 15 bp, Homo sapiens
cttcaataatttgaa

SEQ ID NO: 459119 - DNA, 15 bp, Homo sapiens
ttcaataatttgaat

SEQ ID NO: 459120 - DNA, 15 bp, Homo sapiens
tcaataatttgaatc

SEQ ID NO: 459121 - DNA, 15 bp, Homo sapiens
caataatttgaatcc

SEQ ID NO: 459122 - DNA, 15 bp, Homo sapiens
aataatttgaatcct

SEQ ID NO: 459123 - DNA, 15 bp, Homo sapiens
ataatttgaatcctc

SEQ ID NO: 459124 - DNA, 15 bp, Homo sapiens
taatttgaatcctca

SEQ ID NO: 459125 - DNA, 15 bp, Homo sapiens
aatttgaatcctcag

SEQ ID NO: 459126 - DNA, 15 bp, Homo sapiens
atttgaatcctcaga

SEQ ID NO: 459127 - DNA, 15 bp, Homo sapiens
tttgaatcctcagaa

SEQ ID NO: 459128 - DNA, 15 bp, Homo sapiens
ttgaatcctcagaag

SEQ ID NO: 459129 - DNA, 15 bp, Homo sapiens
tgaatcctcagaaga

SEQ ID NO: 459130 - DNA, 15 bp, Homo sapiens
gaatcctcagaagat

SEQ ID NO: 459131 - DNA, 15 bp, Homo sapiens
aatcctcagaagatg

SEQ ID NO: 459132 - DNA, 15 bp, Homo sapiens
atcctcagaagatgc

SEQ ID NO: 459133 - DNA, 15 bp, Homo sapiens
tcctcagaagatgct

SEQ ID NO: 459134 - DNA, 15 bp, Homo sapiens
cctcagaagatgctt

SEQ ID NO: 459135 - DNA, 15 bp, Homo sapiens
ctcagaagatgcttt

SEQ ID NO: 459136 - DNA, 15 bp, Homo sapiens
tcagaagatgctttt

SEQ ID NO: 459137 - DNA, 15 bp, Homo sapiens
cagaagatgcttttt

SEQ ID NO: 459138 - DNA, 15 bp, Homo sapiens
agaagatgctttttc

SEQ ID NO: 459139 - DNA, 15 bp, Homo sapiens
gaagatgctttttca

SEQ ID NO: 459140 - DNA, 15 bp, Homo sapiens
aagatgctttttcat

SEQ ID NO: 459141 - DNA, 15 bp, Homo sapiens
agatgctttttcata

SEQ ID NO: 459142 - DNA, 15 bp, Homo sapiens
gatgctttttcatag

SEQ ID NO: 459143 - DNA, 15 bp, Homo sapiens
atgctttttcatagt

SEQ ID NO: 459144 - DNA, 15 bp, Homo sapiens
tgctttttcatagta

SEQ ID NO: 459145 - DNA, 15 bp, Homo sapiens
gctttttcatagtaa

SEQ ID NO: 459146 - DNA, 15 bp, Homo sapiens
ctttttcatagtaaa

SEQ ID NO: 459147 - DNA, 15 bp, Homo sapiens
tttttcatagtaaat

SEQ ID NO: 459148 - DNA, 15 bp, Homo sapiens
ttttcatagtaaatt

SEQ ID NO: 459149 - DNA, 15 bp, Homo sapiens
tttcatagtaaattc

SEQ ID NO: 459150 - DNA, 15 bp, Homo sapiens
ttcatagtaaattca

SEQ ID NO: 459151 - DNA, 15 bp, Homo sapiens
tcatagtaaattcac

SEQ ID NO: 459152 - DNA, 15 bp, Homo sapiens
catagtaaattcacc

SEQ ID NO: 459153 - DNA, 15 bp, Homo sapiens
atagtaaattcacca

SEQ ID NO: 459154 - DNA, 15 bp, Homo sapiens
tagtaaattcaccaa

SEQ ID NO: 459155 - DNA, 15 bp, Homo sapiens
agtaaattcaccaaa

SEQ ID NO: 459156 - DNA, 15 bp, Homo sapiens
gtaaattcaccaaaa

SEQ ID NO: 459157 - DNA, 15 bp, Homo sapiens
taaattcaccaaaat

SEQ ID NO: 459158 - DNA, 15 bp, Homo sapiens
aaattcaccaaaata

SEQ ID NO: 459159 - DNA, 15 bp, Homo sapiens
aattcaccaaaatag

SEQ ID NO: 459160 - DNA, 15 bp, Homo sapiens
attcaccaaaatagt

SEQ ID NO: 459161 - DNA, 15 bp, Homo sapiens
ttcaccaaaatagtt

SEQ ID NO: 459162 - DNA, 15 bp, Homo sapiens
tcaccaaaatagttg

SEQ ID NO: 459163 - DNA, 15 bp, Homo sapiens
caccaaaatagttgg

SEQ ID NO: 459164 - DNA, 15 bp, Homo sapiens
accaaaatagttggt

SEQ ID NO: 459165 - DNA, 15 bp, Homo sapiens
ccaaaatagttggtc

SEQ ID NO: 459166 - DNA, 15 bp, Homo sapiens
caaaatagttggtca

SEQ ID NO: 459167 - DNA, 15 bp, Homo sapiens
aaaatagttggtcaa

SEQ ID NO: 459168 - DNA, 15 bp, Homo sapiens
aaatagttggtcaaa

SEQ ID NO: 459169 - DNA, 15 bp, Homo sapiens
aatagttggtcaaag

SEQ ID NO: 459170 - DNA, 15 bp, Homo sapiens
atagttggtcaaagg

SEQ ID NO: 459171 - DNA, 15 bp, Homo sapiens
tagttggtcaaaggt

SEQ ID NO: 459172 - DNA, 15 bp, Homo sapiens
agttggtcaaaggtg

SEQ ID NO: 459173 - DNA, 15 bp, Homo sapiens
gttggtcaaaggtgt

SEQ ID NO: 459174 - DNA, 15 bp, Homo sapiens
ttggtcaaaggtgtt

SEQ ID NO: 459175 - DNA, 15 bp, Homo sapiens
tggtcaaaggtgttt

SEQ ID NO: 459176 - DNA, 15 bp, Homo sapiens
ggtcaaaggtgtttt

SEQ ID NO: 459177 - DNA, 15 bp, Homo sapiens
gtcaaaggtgtttta

SEQ ID NO: 459178 - DNA, 15 bp, Homo sapiens
tcaaaggtgttttaa

SEQ ID NO: 459179 - DNA, 15 bp, Homo sapiens
caaaggtgttttaac

SEQ ID NO: 459180 - DNA, 15 bp, Homo sapiens
aaaggtgttttaact

SEQ ID NO: 459181 - DNA, 15 bp, Homo sapiens
aaggtgttttaacta

SEQ ID NO: 459182 - DNA, 15 bp, Homo sapiens
aggtgttttaactac

SEQ ID NO: 459183 - DNA, 15 bp, Homo sapiens
ggtgttttaactaca

SEQ ID NO: 459184 - DNA, 15 bp, Homo sapiens
gtgttttaactacaa

SEQ ID NO: 459185 - DNA, 15 bp, Homo sapiens
tgttttaactacaaa

SEQ ID NO: 459186 - DNA, 15 bp, Homo sapiens
gttttaactacaaaa

SEQ ID NO: 459187 - DNA, 15 bp, Homo sapiens
ttttaactacaaaac

SEQ ID NO: 459188 - DNA, 15 bp, Homo sapiens
tttaactacaaaacc

SEQ ID NO: 459189 - DNA, 15 bp, Homo sapiens
ttaactacaaaacct

SEQ ID NO: 459190 - DNA, 15 bp, Homo sapiens
taactacaaaacctg

SEQ ID NO: 459191 - DNA, 15 bp, Homo sapiens
aactacaaaacctgt

SEQ ID NO: 459192 - DNA, 15 bp, Homo sapiens
actacaaaacctgta

SEQ ID NO: 459193 - DNA, 15 bp, Homo sapiens
ctacaaaacctgtaa

SEQ ID NO: 459194 - DNA, 15 bp, Homo sapiens
tacaaaacctgtaac

SEQ ID NO: 459195 - DNA, 15 bp, Homo sapiens
acaaaacctgtaact

SEQ ID NO: 459196 - DNA, 15 bp, Homo sapiens
caaaacctgtaactt

SEQ ID NO: 459197 - DNA, 15 bp, Homo sapiens
aaaacctgtaactta

SEQ ID NO: 459198 - DNA, 15 bp, Homo sapiens
aaacctgtaacttaa

SEQ ID NO: 459199 - DNA, 15 bp, Homo sapiens
aacctgtaacttaac

SEQ ID NO: 459200 - DNA, 15 bp, Homo sapiens
acctgtaacttaact

SEQ ID NO: 459201 - DNA, 15 bp, Homo sapiens
cctgtaacttaactt

SEQ ID NO: 459202 - DNA, 15 bp, Homo sapiens
ctgtaacttaacttt

SEQ ID NO: 459203 - DNA, 15 bp, Homo sapiens
tgtaacttaactttt

SEQ ID NO: 459204 - DNA, 15 bp, Homo sapiens
gtaacttaactttta

SEQ ID NO: 459205 - DNA, 15 bp, Homo sapiens
taacttaacttttac

SEQ ID NO: 459206 - DNA, 15 bp, Homo sapiens
aacttaacttttaca

SEQ ID NO: 459207 - DNA, 15 bp, Homo sapiens
acttaacttttacat

SEQ ID NO: 459208 - DNA, 15 bp, Homo sapiens
cttaacttttacatc

SEQ ID NO: 459209 - DNA, 15 bp, Homo sapiens
ttaacttttacatcc

SEQ ID NO: 459210 - DNA, 15 bp, Homo sapiens
taacttttacatccc

SEQ ID NO: 459211 - DNA, 15 bp, Homo sapiens
aacttttacatccca

SEQ ID NO: 459212 - DNA, 15 bp, Homo sapiens
acttttacatcccag

SEQ ID NO: 459213 - DNA, 15 bp, Homo sapiens
cttttacatcccagg

SEQ ID NO: 459214 - DNA, 15 bp, Homo sapiens
ttttacatcccagga

SEQ ID NO: 459215 - DNA, 15 bp, Homo sapiens
tttacatcccaggaa

SEQ ID NO: 459216 - DNA, 15 bp, Homo sapiens
ttacatcccaggaaa

SEQ ID NO: 459217 - DNA, 15 bp, Homo sapiens
tacatcccaggaaaa

SEQ ID NO: 459218 - DNA, 15 bp, Homo sapiens
acatcccaggaaaat

SEQ ID NO: 459219 - DNA, 15 bp, Homo sapiens
catcccaggaaaatt

SEQ ID NO: 459220 - DNA, 15 bp, Homo sapiens
atcccaggaaaattg

SEQ ID NO: 459221 - DNA, 15 bp, Homo sapiens
tcccaggaaaattgc

SEQ ID NO: 459222 - DNA, 15 bp, Homo sapiens
cccaggaaaattgct

SEQ ID NO: 459223 - DNA, 15 bp, Homo sapiens
ccaggaaaattgcta

SEQ ID NO: 459224 - DNA, 15 bp, Homo sapiens
caggaaaattgctaa

SEQ ID NO: 459225 - DNA, 15 bp, Homo sapiens
aggaaaattgctaaa

SEQ ID NO: 459226 - DNA, 15 bp, Homo sapiens
ggaaaattgctaaat

SEQ ID NO: 459227 - DNA, 15 bp, Homo sapiens
gaaaattgctaaatt

SEQ ID NO: 459228 - DNA, 15 bp, Homo sapiens
aaaattgctaaattc

SEQ ID NO: 459229 - DNA, 15 bp, Homo sapiens
aaattgctaaattca

SEQ ID NO: 459230 - DNA, 15 bp, Homo sapiens
aattgctaaattcat

SEQ ID NO: 459231 - DNA, 15 bp, Homo sapiens
attgctaaattcata

SEQ ID NO: 459232 - DNA, 15 bp, Homo sapiens
ttgctaaattcatag

SEQ ID NO: 459233 - DNA, 15 bp, Homo sapiens
tgctaaattcataga

SEQ ID NO: 459234 - DNA, 15 bp, Homo sapiens
gctaaattcatagaa

SEQ ID NO: 459235 - DNA, 15 bp, Homo sapiens
ctaaattcatagaat

SEQ ID NO: 459236 - DNA, 15 bp, Homo sapiens
taaattcatagaata

SEQ ID NO: 459237 - DNA, 15 bp, Homo sapiens
aaattcatagaatac

SEQ ID NO: 459238 - DNA, 15 bp, Homo sapiens
aattcatagaatact

SEQ ID NO: 459239 - DNA, 15 bp, Homo sapiens
attcatagaatactt

SEQ ID NO: 459240 - DNA, 15 bp, Homo sapiens
ttcatagaatactta

SEQ ID NO: 459241 - DNA, 15 bp, Homo sapiens
tcatagaatacttag

SEQ ID NO: 459242 - DNA, 15 bp, Homo sapiens
catagaatacttagg

SEQ ID NO: 459243 - DNA, 15 bp, Homo sapiens
atagaatacttagga

SEQ ID NO: 459244 - DNA, 15 bp, Homo sapiens
tagaatacttaggaa

SEQ ID NO: 459245 - DNA, 15 bp, Homo sapiens
agaatacttaggaac

SEQ ID NO: 459246 - DNA, 15 bp, Homo sapiens
gaatacttaggaact

SEQ ID NO: 459247 - DNA, 15 bp, Homo sapiens
aatacttaggaactc

SEQ ID NO: 459248 - DNA, 15 bp, Homo sapiens
atacttaggaactcc

SEQ ID NO: 459249 - DNA, 15 bp, Homo sapiens
tacttaggaactcca

SEQ ID NO: 459250 - DNA, 15 bp, Homo sapiens
acttaggaactccat

SEQ ID NO: 459251 - DNA, 15 bp, Homo sapiens
cttaggaactccatt

SEQ ID NO: 459252 - DNA, 15 bp, Homo sapiens
ttaggaactccattc

SEQ ID NO: 459253 - DNA, 15 bp, Homo sapiens
taggaactccattca

SEQ ID NO: 459254 - DNA, 15 bp, Homo sapiens
aggaactccattcag

SEQ ID NO: 459255 - DNA, 15 bp, Homo sapiens
ggaactccattcagt

SEQ ID NO: 459256 - DNA, 15 bp, Homo sapiens
gaactccattcagtc

SEQ ID NO: 459257 - DNA, 15 bp, Homo sapiens
aactccattcagtcc

SEQ ID NO: 459258 - DNA, 15 bp, Homo sapiens
actccattcagtcct

SEQ ID NO: 459259 - DNA, 15 bp, Homo sapiens
ctccattcagtccta

SEQ ID NO: 459260 - DNA, 15 bp, Homo sapiens
tccattcagtcctat

SEQ ID NO: 459261 - DNA, 15 bp, Homo sapiens
ccattcagtcctata

SEQ ID NO: 459262 - DNA, 15 bp, Homo sapiens
cattcagtcctatag

SEQ ID NO: 459263 - DNA, 15 bp, Homo sapiens
attcagtcctataga

SEQ ID NO: 459264 - DNA, 15 bp, Homo sapiens
ttcagtcctatagaa

SEQ ID NO: 459265 - DNA, 15 bp, Homo sapiens
tcagtcctatagaat

SEQ ID NO: 459266 - DNA, 15 bp, Homo sapiens
cagtcctatagaata

SEQ ID NO: 459267 - DNA, 15 bp, Homo sapiens
agtcctatagaatat

SEQ ID NO: 459268 - DNA, 15 bp, Homo sapiens
gtcctatagaatatg

SEQ ID NO: 459269 - DNA, 15 bp, Homo sapiens
tcctatagaatatgg

SEQ ID NO: 459270 - DNA, 15 bp, Homo sapiens
cctatagaatatggt

SEQ ID NO: 459271 - DNA, 15 bp, Homo sapiens
ctatagaatatggta

SEQ ID NO: 459272 - DNA, 15 bp, Homo sapiens
tatagaatatggtag

SEQ ID NO: 459273 - DNA, 15 bp, Homo sapiens
atagaatatggtaga

SEQ ID NO: 459274 - DNA, 15 bp, Homo sapiens
tagaatatggtagag

SEQ ID NO: 459275 - DNA, 15 bp, Homo sapiens
agaatatggtagagg

SEQ ID NO: 459276 - DNA, 15 bp, Homo sapiens
gaatatggtagaggt

SEQ ID NO: 459277 - DNA, 15 bp, Homo sapiens
aatatggtagaggta

SEQ ID NO: 459278 - DNA, 15 bp, Homo sapiens
atatggtagaggtat

SEQ ID NO: 459279 - DNA, 15 bp, Homo sapiens
tatggtagaggtata

SEQ ID NO: 459280 - DNA, 15 bp, Homo sapiens
atggtagaggtatac

SEQ ID NO: 459281 - DNA, 15 bp, Homo sapiens
tggtagaggtataca

SEQ ID NO: 459282 - DNA, 15 bp, Homo sapiens
ggtagaggtatacat

SEQ ID NO: 459283 - DNA, 15 bp, Homo sapiens
gtagaggtatacatc

SEQ ID NO: 459284 - DNA, 15 bp, Homo sapiens
tagaggtatacatct

SEQ ID NO: 459285 - DNA, 15 bp, Homo sapiens
agaggtatacatctt

SEQ ID NO: 459286 - DNA, 15 bp, Homo sapiens
gaggtatacatcttg

SEQ ID NO: 459287 - DNA, 15 bp, Homo sapiens
aggtatacatcttga

SEQ ID NO: 459288 - DNA, 15 bp, Homo sapiens
ggtatacatcttgaa

SEQ ID NO: 459289 - DNA, 15 bp, Homo sapiens
gtatacatcttgaac

SEQ ID NO: 459290 - DNA, 15 bp, Homo sapiens
tatacatcttgaact

SEQ ID NO: 459291 - DNA, 15 bp, Homo sapiens
atacatcttgaacta

SEQ ID NO: 459292 - DNA, 15 bp, Homo sapiens
tacatcttgaactac

SEQ ID NO: 459293 - DNA, 15 bp, Homo sapiens
acatcttgaactaca

SEQ ID NO: 459294 - DNA, 15 bp, Homo sapiens
catcttgaactacat

SEQ ID NO: 459295 - DNA, 15 bp, Homo sapiens
atcttgaactacatt

SEQ ID NO: 459296 - DNA, 15 bp, Homo sapiens
tcttgaactacattt

SEQ ID NO: 459297 - DNA, 15 bp, Homo sapiens
cttgaactacatttt

SEQ ID NO: 459298 - DNA, 15 bp, Homo sapiens
ttgaactacatttta

SEQ ID NO: 459299 - DNA, 15 bp, Homo sapiens
tgaactacattttaa

SEQ ID NO: 459300 - DNA, 15 bp, Homo sapiens
gaactacattttaag

SEQ ID NO: 459301 - DNA, 15 bp, Homo sapiens
aactacattttaagg

SEQ ID NO: 459302 - DNA, 15 bp, Homo sapiens
actacattttaagga

SEQ ID NO: 459303 - DNA, 15 bp, Homo sapiens
ctacattttaaggaa

SEQ ID NO: 459304 - DNA, 15 bp, Homo sapiens
tacattttaaggaag

SEQ ID NO: 459305 - DNA, 15 bp, Homo sapiens
acattttaaggaaga

SEQ ID NO: 459306 - DNA, 15 bp, Homo sapiens
cattttaaggaagaa

SEQ ID NO: 459307 - DNA, 15 bp, Homo sapiens
attttaaggaagaac

SEQ ID NO: 459308 - DNA, 15 bp, Homo sapiens
ttttaaggaagaact

SEQ ID NO: 459309 - DNA, 15 bp, Homo sapiens
tttaaggaagaactg

SEQ ID NO: 459310 - DNA, 15 bp, Homo sapiens
ttaaggaagaactgg

SEQ ID NO: 459311 - DNA, 15 bp, Homo sapiens
taaggaagaactgga

SEQ ID NO: 459312 - DNA, 15 bp, Homo sapiens
aaggaagaactggag

SEQ ID NO: 459313 - DNA, 15 bp, Homo sapiens
aggaagaactggaga

SEQ ID NO: 459314 - DNA, 15 bp, Homo sapiens
ggaagaactggagaa

SEQ ID NO: 459315 - DNA, 15 bp, Homo sapiens
gaagaactggagaag

SEQ ID NO: 459316 - DNA, 15 bp, Homo sapiens
aagaactggagaaga

SEQ ID NO: 459317 - DNA, 15 bp, Homo sapiens
agaactggagaagag

SEQ ID NO: 459318 - DNA, 15 bp, Homo sapiens
gaactggagaagagg

SEQ ID NO: 459319 - DNA, 15 bp, Homo sapiens
aactggagaagaggt

SEQ ID NO: 459320 - DNA, 15 bp, Homo sapiens
actggagaagaggtt

SEQ ID NO: 459321 - DNA, 15 bp, Homo sapiens
ctggagaagaggttc

SEQ ID NO: 459322 - DNA, 15 bp, Homo sapiens
tggagaagaggttca

SEQ ID NO: 459323 - DNA, 15 bp, Homo sapiens
ggagaagaggttcag

SEQ ID NO: 459324 - DNA, 15 bp, Homo sapiens
gagaagaggttcagt

SEQ ID NO: 459325 - DNA, 15 bp, Homo sapiens
agaagaggttcagtt

SEQ ID NO: 459326 - DNA, 15 bp, Homo sapiens
gaagaggttcagttg

SEQ ID NO: 459327 - DNA, 15 bp, Homo sapiens
aagaggttcagttgc

SEQ ID NO: 459328 - DNA, 15 bp, Homo sapiens
agaggttcagttgcc

SEQ ID NO: 459329 - DNA, 15 bp, Homo sapiens
gaggttcagttgcct

SEQ ID NO: 459330 - DNA, 15 bp, Homo sapiens
aggttcagttgcctt

SEQ ID NO: 459331 - DNA, 15 bp, Homo sapiens
ggttcagttgcctta

SEQ ID NO: 459332 - DNA, 15 bp, Homo sapiens
gttcagttgccttat

SEQ ID NO: 459333 - DNA, 15 bp, Homo sapiens
ttcagttgccttata

SEQ ID NO: 459334 - DNA, 15 bp, Homo sapiens
tcagttgccttatat

SEQ ID NO: 459335 - DNA, 15 bp, Homo sapiens
cagttgccttatatt

SEQ ID NO: 459336 - DNA, 15 bp, Homo sapiens
agttgccttatattg

SEQ ID NO: 459337 - DNA, 15 bp, Homo sapiens
gttgccttatattgt

SEQ ID NO: 459338 - DNA, 15 bp, Homo sapiens
ttgccttatattgtc

SEQ ID NO: 459339 - DNA, 15 bp, Homo sapiens
tgccttatattgtcc

SEQ ID NO: 459340 - DNA, 15 bp, Homo sapiens
gccttatattgtcca

SEQ ID NO: 459341 - DNA, 15 bp, Homo sapiens
ccttatattgtccat

SEQ ID NO: 459342 - DNA, 15 bp, Homo sapiens
cttatattgtccatg

SEQ ID NO: 459343 - DNA, 15 bp, Homo sapiens
ttatattgtccatgg

SEQ ID NO: 459344 - DNA, 15 bp, Homo sapiens
tatattgtccatggc

SEQ ID NO: 459345 - DNA, 15 bp, Homo sapiens
atattgtccatggct

SEQ ID NO: 459346 - DNA, 15 bp, Homo sapiens
tattgtccatggctc

SEQ ID NO: 459347 - DNA, 15 bp, Homo sapiens
attgtccatggctct

SEQ ID NO: 459348 - DNA, 15 bp, Homo sapiens
ttgtccatggctctg

SEQ ID NO: 459349 - DNA, 15 bp, Homo sapiens
tgtccatggctctga

SEQ ID NO: 459350 - DNA, 15 bp, Homo sapiens
gtccatggctctgac

SEQ ID NO: 459351 - DNA, 15 bp, Homo sapiens
tccatggctctgaca

SEQ ID NO: 459352 - DNA, 15 bp, Homo sapiens
ccatggctctgacac

SEQ ID NO: 459353 - DNA, 15 bp, Homo sapiens
catggctctgacaca

SEQ ID NO: 459354 - DNA, 15 bp, Homo sapiens
atggctctgacacac

SEQ ID NO: 459355 - DNA, 15 bp, Homo sapiens
tggctctgacacact

SEQ ID NO: 459356 - DNA, 15 bp, Homo sapiens
ggctctgacacactg

SEQ ID NO: 459357 - DNA, 15 bp, Homo sapiens
gctctgacacactgt

SEQ ID NO: 459358 - DNA, 15 bp, Homo sapiens
ctctgacacactgtt

SEQ ID NO: 459359 - DNA, 15 bp, Homo sapiens
tctgacacactgttt

SEQ ID NO: 459360 - DNA, 15 bp, Homo sapiens
ctgacacactgtttt

SEQ ID NO: 459361 - DNA, 15 bp, Homo sapiens
tgacacactgttttg

SEQ ID NO: 459362 - DNA, 15 bp, Homo sapiens
gacacactgttttgg

SEQ ID NO: 459363 - DNA, 15 bp, Homo sapiens
acacactgttttggt

SEQ ID NO: 459364 - DNA, 15 bp, Homo sapiens
cacactgttttggtt

SEQ ID NO: 459365 - DNA, 15 bp, Homo sapiens
acactgttttggttt

SEQ ID NO: 459366 - DNA, 15 bp, Homo sapiens
cactgttttggtttt

SEQ ID NO: 459367 - DNA, 15 bp, Homo sapiens
actgttttggttttc

SEQ ID NO: 459368 - DNA, 15 bp, Homo sapiens
ctgttttggttttct

SEQ ID NO: 459369 - DNA, 15 bp, Homo sapiens
tgttttggttttctg

SEQ ID NO: 459370 - DNA, 15 bp, Homo sapiens
gttttggttttctgg

SEQ ID NO: 459371 - DNA, 15 bp, Homo sapiens
ttttggttttctggg

SEQ ID NO: 459372 - DNA, 15 bp, Homo sapiens
tttggttttctgggg

SEQ ID NO: 459373 - DNA, 15 bp, Homo sapiens
ttggttttctggggc

SEQ ID NO: 459374 - DNA, 15 bp, Homo sapiens
tggttttctggggct

SEQ ID NO: 459375 - DNA, 15 bp, Homo sapiens
ggttttctggggctg

SEQ ID NO: 459376 - DNA, 15 bp, Homo sapiens
gttttctggggctgc

SEQ ID NO: 459377 - DNA, 15 bp, Homo sapiens
ttttctggggctgcc

SEQ ID NO: 459378 - DNA, 15 bp, Homo sapiens
tttctggggctgcca

SEQ ID NO: 459379 - DNA, 15 bp, Homo sapiens
ttctggggctgccat

SEQ ID NO: 459380 - DNA, 15 bp, Homo sapiens
tctggggctgccata

SEQ ID NO: 459381 - DNA, 15 bp, Homo sapiens
ctggggctgccataa

SEQ ID NO: 459382 - DNA, 15 bp, Homo sapiens
tggggctgccataac

SEQ ID NO: 459383 - DNA, 15 bp, Homo sapiens
ggggctgccataaca

SEQ ID NO: 459384 - DNA, 15 bp, Homo sapiens
gggctgccataacaa

SEQ ID NO: 459385 - DNA, 15 bp, Homo sapiens
ggctgccataacaaa

SEQ ID NO: 459386 - DNA, 15 bp, Homo sapiens
gctgccataacaaag

SEQ ID NO: 459387 - DNA, 15 bp, Homo sapiens
ctgccataacaaaga

SEQ ID NO: 459388 - DNA, 15 bp, Homo sapiens
tgccataacaaagaa

SEQ ID NO: 459389 - DNA, 15 bp, Homo sapiens
gccataacaaagaat

SEQ ID NO: 459390 - DNA, 15 bp, Homo sapiens
ccataacaaagaatg

SEQ ID NO: 459391 - DNA, 15 bp, Homo sapiens
cataacaaagaatga

SEQ ID NO: 459392 - DNA, 15 bp, Homo sapiens
ataacaaagaatgat

SEQ ID NO: 459393 - DNA, 15 bp, Homo sapiens
taacaaagaatgata

SEQ ID NO: 459394 - DNA, 15 bp, Homo sapiens
aacaaagaatgatag

SEQ ID NO: 459395 - DNA, 15 bp, Homo sapiens
acaaagaatgataga

SEQ ID NO: 459396 - DNA, 15 bp, Homo sapiens
caaagaatgatagac

SEQ ID NO: 459397 - DNA, 15 bp, Homo sapiens
aaagaatgatagact

SEQ ID NO: 459398 - DNA, 15 bp, Homo sapiens
aagaatgatagactg

SEQ ID NO: 459399 - DNA, 15 bp, Homo sapiens
agaatgatagactga

SEQ ID NO: 459400 - DNA, 15 bp, Homo sapiens
gaatgatagactgaa

SEQ ID NO: 459401 - DNA, 15 bp, Homo sapiens
aatgatagactgaat

SEQ ID NO: 459402 - DNA, 15 bp, Homo sapiens
atgatagactgaatg

SEQ ID NO: 459403 - DNA, 15 bp, Homo sapiens
tgatagactgaatgg

SEQ ID NO: 459404 - DNA, 15 bp, Homo sapiens
gatagactgaatggc

SEQ ID NO: 459405 - DNA, 15 bp, Homo sapiens
atagactgaatggct

SEQ ID NO: 459406 - DNA, 15 bp, Homo sapiens
tagactgaatggctt

SEQ ID NO: 459407 - DNA, 15 bp, Homo sapiens
agactgaatggcttc

SEQ ID NO: 459408 - DNA, 15 bp, Homo sapiens
gactgaatggcttca

SEQ ID NO: 459409 - DNA, 15 bp, Homo sapiens
actgaatggcttcaa

SEQ ID NO: 459410 - DNA, 15 bp, Homo sapiens
ctgaatggcttcaac

SEQ ID NO: 459411 - DNA, 15 bp, Homo sapiens
tgaatggcttcaaca

SEQ ID NO: 459412 - DNA, 15 bp, Homo sapiens
gaatggcttcaacaa

SEQ ID NO: 459413 - DNA, 15 bp, Homo sapiens
aatggcttcaacaag

SEQ ID NO: 459414 - DNA, 15 bp, Homo sapiens
atggcttcaacaaga

SEQ ID NO: 459415 - DNA, 15 bp, Homo sapiens
tggcttcaacaagag

SEQ ID NO: 459416 - DNA, 15 bp, Homo sapiens
ggcttcaacaagaga

SEQ ID NO: 459417 - DNA, 15 bp, Homo sapiens
gcttcaacaagagaa

SEQ ID NO: 459418 - DNA, 15 bp, Homo sapiens
cttcaacaagagaaa

SEQ ID NO: 459419 - DNA, 15 bp, Homo sapiens
ttcaacaagagaaat

SEQ ID NO: 459420 - DNA, 15 bp, Homo sapiens
tcaacaagagaaatt

SEQ ID NO: 459421 - DNA, 15 bp, Homo sapiens
caacaagagaaattt

SEQ ID NO: 459422 - DNA, 15 bp, Homo sapiens
aacaagagaaattta

SEQ ID NO: 459423 - DNA, 15 bp, Homo sapiens
acaagagaaatttat

SEQ ID NO: 459424 - DNA, 15 bp, Homo sapiens
caagagaaatttatt

SEQ ID NO: 459425 - DNA, 15 bp, Homo sapiens
aagagaaatttattt

SEQ ID NO: 459426 - DNA, 15 bp, Homo sapiens
agagaaatttatttc

SEQ ID NO: 459427 - DNA, 15 bp, Homo sapiens
gagaaatttatttcc

SEQ ID NO: 459428 - DNA, 15 bp, Homo sapiens
agaaatttatttcct

SEQ ID NO: 459429 - DNA, 15 bp, Homo sapiens
gaaatttatttccta

SEQ ID NO: 459430 - DNA, 15 bp, Homo sapiens
aaatttatttcctaa

SEQ ID NO: 459431 - DNA, 15 bp, Homo sapiens
aatttatttcctaac

SEQ ID NO: 459432 - DNA, 15 bp, Homo sapiens
atttatttcctaaca

SEQ ID NO: 459433 - DNA, 15 bp, Homo sapiens
tttatttcctaacag

SEQ ID NO: 459434 - DNA, 15 bp, Homo sapiens
ttatttcctaacagt

SEQ ID NO: 459435 - DNA, 15 bp, Homo sapiens
tatttcctaacagtt

SEQ ID NO: 459436 - DNA, 15 bp, Homo sapiens
atttcctaacagttc

SEQ ID NO: 459437 - DNA, 15 bp, Homo sapiens
tttcctaacagttct

SEQ ID NO: 459438 - DNA, 15 bp, Homo sapiens
ttcctaacagttcta

SEQ ID NO: 459439 - DNA, 15 bp, Homo sapiens
tcctaacagttctag

SEQ ID NO: 459440 - DNA, 15 bp, Homo sapiens
cctaacagttctaga

SEQ ID NO: 459441 - DNA, 15 bp, Homo sapiens
ctaacagttctagac

SEQ ID NO: 459442 - DNA, 15 bp, Homo sapiens
taacagttctagaca

SEQ ID NO: 459443 - DNA, 15 bp, Homo sapiens
aacagttctagacac

SEQ ID NO: 459444 - DNA, 15 bp, Homo sapiens
acagttctagacact

SEQ ID NO: 459445 - DNA, 15 bp, Homo sapiens
cagttctagacactg

SEQ ID NO: 459446 - DNA, 15 bp, Homo sapiens
agttctagacactga

SEQ ID NO: 459447 - DNA, 15 bp, Homo sapiens
gttctagacactgag

SEQ ID NO: 459448 - DNA, 15 bp, Homo sapiens
ttctagacactgaga

SEQ ID NO: 459449 - DNA, 15 bp, Homo sapiens
tctagacactgagag

SEQ ID NO: 459450 - DNA, 15 bp, Homo sapiens
ctagacactgagagt

SEQ ID NO: 459451 - DNA, 15 bp, Homo sapiens
tagacactgagagtg

SEQ ID NO: 459452 - DNA, 15 bp, Homo sapiens
agacactgagagtgt

SEQ ID NO: 459453 - DNA, 15 bp, Homo sapiens
gacactgagagtgtg

SEQ ID NO: 459454 - DNA, 15 bp, Homo sapiens
acactgagagtgtga

SEQ ID NO: 459455 - DNA, 15 bp, Homo sapiens
cactgagagtgtgag

SEQ ID NO: 459456 - DNA, 15 bp, Homo sapiens
actgagagtgtgaga

SEQ ID NO: 459457 - DNA, 15 bp, Homo sapiens
ctgagagtgtgagat

SEQ ID NO: 459458 - DNA, 15 bp, Homo sapiens
tgagagtgtgagatg

SEQ ID NO: 459459 - DNA, 15 bp, Homo sapiens
gagagtgtgagatga

SEQ ID NO: 459460 - DNA, 15 bp, Homo sapiens
agagtgtgagatgaa

SEQ ID NO: 459461 - DNA, 15 bp, Homo sapiens
gagtgtgagatgaag

SEQ ID NO: 459462 - DNA, 15 bp, Homo sapiens
agtgtgagatgaagg

SEQ ID NO: 459463 - DNA, 15 bp, Homo sapiens
gtgtgagatgaaggt

SEQ ID NO: 459464 - DNA, 15 bp, Homo sapiens
tgtgagatgaaggtg

SEQ ID NO: 459465 - DNA, 15 bp, Homo sapiens
gtgagatgaaggtgt

SEQ ID NO: 459466 - DNA, 15 bp, Homo sapiens
tgagatgaaggtgtc

SEQ ID NO: 459467 - DNA, 15 bp, Homo sapiens
gagatgaaggtgtcg

SEQ ID NO: 459468 - DNA, 15 bp, Homo sapiens
agatgaaggtgtcgg

SEQ ID NO: 459469 - DNA, 15 bp, Homo sapiens
gatgaaggtgtcggc

SEQ ID NO: 459470 - DNA, 15 bp, Homo sapiens
atgaaggtgtcggct

SEQ ID NO: 459471 - DNA, 15 bp, Homo sapiens
tgaaggtgtcggctg

SEQ ID NO: 459472 - DNA, 15 bp, Homo sapiens
gaaggtgtcggctgg

SEQ ID NO: 459473 - DNA, 15 bp, Homo sapiens
aaggtgtcggctggg

SEQ ID NO: 459474 - DNA, 15 bp, Homo sapiens
aggtgtcggctgggt

SEQ ID NO: 459475 - DNA, 15 bp, Homo sapiens
ggtgtcggctgggtt

SEQ ID NO: 459476 - DNA, 15 bp, Homo sapiens
gtgtcggctgggttg

SEQ ID NO: 459477 - DNA, 15 bp, Homo sapiens
tgtcggctgggttga

SEQ ID NO: 459478 - DNA, 15 bp, Homo sapiens
gtcggctgggttgag

SEQ ID NO: 459479 - DNA, 15 bp, Homo sapiens
tcggctgggttgagt

SEQ ID NO: 459480 - DNA, 15 bp, Homo sapiens
cggctgggttgagtc

SEQ ID NO: 459481 - DNA, 15 bp, Homo sapiens
ggctgggttgagtct

SEQ ID NO: 459482 - DNA, 15 bp, Homo sapiens
gctgggttgagtctt

SEQ ID NO: 459483 - DNA, 15 bp, Homo sapiens
ctgggttgagtcttt

SEQ ID NO: 459484 - DNA, 15 bp, Homo sapiens
tgggttgagtcttta

SEQ ID NO: 459485 - DNA, 15 bp, Homo sapiens
gggttgagtctttat

SEQ ID NO: 459486 - DNA, 15 bp, Homo sapiens
ggttgagtctttatg

SEQ ID NO: 459487 - DNA, 15 bp, Homo sapiens
gttgagtctttatgg

SEQ ID NO: 459488 - DNA, 15 bp, Homo sapiens
ttgagtctttatgga

SEQ ID NO: 459489 - DNA, 15 bp, Homo sapiens
tgagtctttatggaa

SEQ ID NO: 459490 - DNA, 15 bp, Homo sapiens
gagtctttatggaag

SEQ ID NO: 459491 - DNA, 15 bp, Homo sapiens
agtctttatggaagc

SEQ ID NO: 459492 - DNA, 15 bp, Homo sapiens
gtctttatggaagcc

SEQ ID NO: 459493 - DNA, 15 bp, Homo sapiens
tctttatggaagcca

SEQ ID NO: 459494 - DNA, 15 bp, Homo sapiens
ctttatggaagccac

SEQ ID NO: 459495 - DNA, 15 bp, Homo sapiens
tttatggaagccact

SEQ ID NO: 459496 - DNA, 15 bp, Homo sapiens
ttatggaagccactc

SEQ ID NO: 459497 - DNA, 15 bp, Homo sapiens
tatggaagccactct

SEQ ID NO: 459498 - DNA, 15 bp, Homo sapiens
atggaagccactctt

SEQ ID NO: 459499 - DNA, 15 bp, Homo sapiens
tggaagccactcttt

SEQ ID NO: 459500 - DNA, 15 bp, Homo sapiens
ggaagccactctttc

SEQ ID NO: 459501 - DNA, 15 bp, Homo sapiens
gaagccactctttct

SEQ ID NO: 459502 - DNA, 15 bp, Homo sapiens
aagccactctttctg

SEQ ID NO: 459503 - DNA, 15 bp, Homo sapiens
agccactctttctgg

SEQ ID NO: 459504 - DNA, 15 bp, Homo sapiens
gccactctttctggt

SEQ ID NO: 459505 - DNA, 15 bp, Homo sapiens
ccactctttctggtc

SEQ ID NO: 459506 - DNA, 15 bp, Homo sapiens
cactctttctggtct

SEQ ID NO: 459507 - DNA, 15 bp, Homo sapiens
actctttctggtctg

SEQ ID NO: 459508 - DNA, 15 bp, Homo sapiens
ctctttctggtctgc

SEQ ID NO: 459509 - DNA, 15 bp, Homo sapiens
tctttctggtctgca

SEQ ID NO: 459510 - DNA, 15 bp, Homo sapiens
ctttctggtctgcag

SEQ ID NO: 459511 - DNA, 15 bp, Homo sapiens
tttctggtctgcaga

SEQ ID NO: 459512 - DNA, 15 bp, Homo sapiens
ttctggtctgcagat

SEQ ID NO: 459513 - DNA, 15 bp, Homo sapiens
tctggtctgcagatg

SEQ ID NO: 459514 - DNA, 15 bp, Homo sapiens
ctggtctgcagatga

SEQ ID NO: 459515 - DNA, 15 bp, Homo sapiens
tggtctgcagatgat

SEQ ID NO: 459516 - DNA, 15 bp, Homo sapiens
ggtctgcagatgatc

SEQ ID NO: 459517 - DNA, 15 bp, Homo sapiens
gtctgcagatgatcg

SEQ ID NO: 459518 - DNA, 15 bp, Homo sapiens
tctgcagatgatcgt

SEQ ID NO: 459519 - DNA, 15 bp, Homo sapiens
ctgcagatgatcgtc

SEQ ID NO: 459520 - DNA, 15 bp, Homo sapiens
tgcagatgatcgtct

SEQ ID NO: 459521 - DNA, 15 bp, Homo sapiens
gcagatgatcgtctt

SEQ ID NO: 459522 - DNA, 15 bp, Homo sapiens
cagatgatcgtcttc

SEQ ID NO: 459523 - DNA, 15 bp, Homo sapiens
agatgatcgtcttct

SEQ ID NO: 459524 - DNA, 15 bp, Homo sapiens
gatgatcgtcttctc

SEQ ID NO: 459525 - DNA, 15 bp, Homo sapiens
atgatcgtcttctcc

SEQ ID NO: 459526 - DNA, 15 bp, Homo sapiens
tgatcgtcttctccc

SEQ ID NO: 459527 - DNA, 15 bp, Homo sapiens
gatcgtcttctccct

SEQ ID NO: 459528 - DNA, 15 bp, Homo sapiens
atcgtcttctccctg

SEQ ID NO: 459529 - DNA, 15 bp, Homo sapiens
tcgtcttctccctgt

SEQ ID NO: 459530 - DNA, 15 bp, Homo sapiens
cgtcttctccctgtg

SEQ ID NO: 459531 - DNA, 15 bp, Homo sapiens
gtcttctccctgtgt

SEQ ID NO: 459532 - DNA, 15 bp, Homo sapiens
tcttctccctgtgtc

SEQ ID NO: 459533 - DNA, 15 bp, Homo sapiens
cttctccctgtgtct

SEQ ID NO: 459534 - DNA, 15 bp, Homo sapiens
ttctccctgtgtctt

SEQ ID NO: 459535 - DNA, 15 bp, Homo sapiens
tctccctgtgtcttc

SEQ ID NO: 459536 - DNA, 15 bp, Homo sapiens
ctccctgtgtcttca

SEQ ID NO: 459537 - DNA, 15 bp, Homo sapiens
tccctgtgtcttcac

SEQ ID NO: 459538 - DNA, 15 bp, Homo sapiens
ccctgtgtcttcaca

SEQ ID NO: 459539 - DNA, 15 bp, Homo sapiens
cctgtgtcttcacat

SEQ ID NO: 459540 - DNA, 15 bp, Homo sapiens
ctgtgtcttcacatg

SEQ ID NO: 459541 - DNA, 15 bp, Homo sapiens
tgtgtcttcacatgg

SEQ ID NO: 459542 - DNA, 15 bp, Homo sapiens
gtgtcttcacatggt

SEQ ID NO: 459543 - DNA, 15 bp, Homo sapiens
tgtcttcacatggtt

SEQ ID NO: 459544 - DNA, 15 bp, Homo sapiens
gtcttcacatggttt

SEQ ID NO: 459545 - DNA, 15 bp, Homo sapiens
tcttcacatggtttt

SEQ ID NO: 459546 - DNA, 15 bp, Homo sapiens
cttcacatggttttt

SEQ ID NO: 459547 - DNA, 15 bp, Homo sapiens
ttcacatggtttttc

SEQ ID NO: 459548 - DNA, 15 bp, Homo sapiens
tcacatggtttttcc

SEQ ID NO: 459549 - DNA, 15 bp, Homo sapiens
cacatggtttttcct

SEQ ID NO: 459550 - DNA, 15 bp, Homo sapiens
acatggtttttcctt

SEQ ID NO: 459551 - DNA, 15 bp, Homo sapiens
catggtttttccttg

SEQ ID NO: 459552 - DNA, 15 bp, Homo sapiens
atggtttttccttgt

SEQ ID NO: 459553 - DNA, 15 bp, Homo sapiens
tggtttttccttgtc

SEQ ID NO: 459554 - DNA, 15 bp, Homo sapiens
ggtttttccttgtct

SEQ ID NO: 459555 - DNA, 15 bp, Homo sapiens
gtttttccttgtctg

SEQ ID NO: 459556 - DNA, 15 bp, Homo sapiens
tttttccttgtctga

SEQ ID NO: 459557 - DNA, 15 bp, Homo sapiens
ttttccttgtctgat

SEQ ID NO: 459558 - DNA, 15 bp, Homo sapiens
tttccttgtctgatg

SEQ ID NO: 459559 - DNA, 15 bp, Homo sapiens
ttccttgtctgatgt

SEQ ID NO: 459560 - DNA, 15 bp, Homo sapiens
tccttgtctgatgtg

SEQ ID NO: 459561 - DNA, 15 bp, Homo sapiens
ccttgtctgatgtgt

SEQ ID NO: 459562 - DNA, 15 bp, Homo sapiens
cttgtctgatgtgtg

SEQ ID NO: 459563 - DNA, 15 bp, Homo sapiens
ttgtctgatgtgtgc

SEQ ID NO: 459564 - DNA, 15 bp, Homo sapiens
tgtctgatgtgtgct

SEQ ID NO: 459565 - DNA, 15 bp, Homo sapiens
gtctgatgtgtgctc

SEQ ID NO: 459566 - DNA, 15 bp, Homo sapiens
tctgatgtgtgctca

SEQ ID NO: 459567 - DNA, 15 bp, Homo sapiens
ctgatgtgtgctcat

SEQ ID NO: 459568 - DNA, 15 bp, Homo sapiens
tgatgtgtgctcatc

SEQ ID NO: 459569 - DNA, 15 bp, Homo sapiens
gatgtgtgctcatct

SEQ ID NO: 459570 - DNA, 15 bp, Homo sapiens
atgtgtgctcatctc

SEQ ID NO: 459571 - DNA, 15 bp, Homo sapiens
tgtgtgctcatctcc

SEQ ID NO: 459572 - DNA, 15 bp, Homo sapiens
gtgtgctcatctcct

SEQ ID NO: 459573 - DNA, 15 bp, Homo sapiens
tgtgctcatctcctc

SEQ ID NO: 459574 - DNA, 15 bp, Homo sapiens
gtgctcatctcctct

SEQ ID NO: 459575 - DNA, 15 bp, Homo sapiens
tgctcatctcctctt

SEQ ID NO: 459576 - DNA, 15 bp, Homo sapiens
gctcatctcctcttc

SEQ ID NO: 459577 - DNA, 15 bp, Homo sapiens
ctcatctcctcttcc

SEQ ID NO: 459578 - DNA, 15 bp, Homo sapiens
tcatctcctcttcct

SEQ ID NO: 459579 - DNA, 15 bp, Homo sapiens
catctcctcttcctc

SEQ ID NO: 459580 - DNA, 15 bp, Homo sapiens
atctcctcttcctct

SEQ ID NO: 459581 - DNA, 15 bp, Homo sapiens
tctcctcttcctcta

SEQ ID NO: 459582 - DNA, 15 bp, Homo sapiens
ctcctcttcctctaa

SEQ ID NO: 459583 - DNA, 15 bp, Homo sapiens
tcctcttcctctaag

SEQ ID NO: 459584 - DNA, 15 bp, Homo sapiens
cctcttcctctaagg

SEQ ID NO: 459585 - DNA, 15 bp, Homo sapiens
ctcttcctctaagga

SEQ ID NO: 459586 - DNA, 15 bp, Homo sapiens
tcttcctctaaggac

SEQ ID NO: 459587 - DNA, 15 bp, Homo sapiens
cttcctctaaggaca

SEQ ID NO: 459588 - DNA, 15 bp, Homo sapiens
ttcctctaaggacac

SEQ ID NO: 459589 - DNA, 15 bp, Homo sapiens
tcctctaaggacacc

SEQ ID NO: 459590 - DNA, 15 bp, Homo sapiens
cctctaaggacacca

SEQ ID NO: 459591 - DNA, 15 bp, Homo sapiens
ctctaaggacaccag

SEQ ID NO: 459592 - DNA, 15 bp, Homo sapiens
tctaaggacaccagt

SEQ ID NO: 459593 - DNA, 15 bp, Homo sapiens
ctaaggacaccagtc

SEQ ID NO: 459594 - DNA, 15 bp, Homo sapiens
taaggacaccagtca

SEQ ID NO: 459595 - DNA, 15 bp, Homo sapiens
aaggacaccagtcat

SEQ ID NO: 459596 - DNA, 15 bp, Homo sapiens
aggacaccagtcata

SEQ ID NO: 459597 - DNA, 15 bp, Homo sapiens
ggacaccagtcatat

SEQ ID NO: 459598 - DNA, 15 bp, Homo sapiens
gacaccagtcatatc

SEQ ID NO: 459599 - DNA, 15 bp, Homo sapiens
acaccagtcatatca

SEQ ID NO: 459600 - DNA, 15 bp, Homo sapiens
caccagtcatatcag

SEQ ID NO: 459601 - DNA, 15 bp, Homo sapiens
accagtcatatcaga

SEQ ID NO: 459602 - DNA, 15 bp, Homo sapiens
ccagtcatatcagat

SEQ ID NO: 459603 - DNA, 15 bp, Homo sapiens
cagtcatatcagatt

SEQ ID NO: 459604 - DNA, 15 bp, Homo sapiens
agtcatatcagatta

SEQ ID NO: 459605 - DNA, 15 bp, Homo sapiens
gtcatatcagattat

SEQ ID NO: 459606 - DNA, 15 bp, Homo sapiens
tcatatcagattatg

SEQ ID NO: 459607 - DNA, 15 bp, Homo sapiens
catatcagattatga

SEQ ID NO: 459608 - DNA, 15 bp, Homo sapiens
atatcagattatgac

SEQ ID NO: 459609 - DNA, 15 bp, Homo sapiens
tatcagattatgacc

SEQ ID NO: 459610 - DNA, 15 bp, Homo sapiens
atcagattatgaccc

SEQ ID NO: 459611 - DNA, 15 bp, Homo sapiens
tcagattatgaccca

SEQ ID NO: 459612 - DNA, 15 bp, Homo sapiens
cagattatgacccac

SEQ ID NO: 459613 - DNA, 15 bp, Homo sapiens
agattatgacccact

SEQ ID NO: 459614 - DNA, 15 bp, Homo sapiens
gattatgacccactc

SEQ ID NO: 459615 - DNA, 15 bp, Homo sapiens
attatgacccactct

SEQ ID NO: 459616 - DNA, 15 bp, Homo sapiens
ttatgacccactcta

SEQ ID NO: 459617 - DNA, 15 bp, Homo sapiens
tatgacccactctaa

SEQ ID NO: 459618 - DNA, 15 bp, Homo sapiens
atgacccactctaat

SEQ ID NO: 459619 - DNA, 15 bp, Homo sapiens
tgacccactctaatg

SEQ ID NO: 459620 - DNA, 15 bp, Homo sapiens
gacccactctaatga

SEQ ID NO: 459621 - DNA, 15 bp, Homo sapiens
acccactctaatgac

SEQ ID NO: 459622 - DNA, 15 bp, Homo sapiens
cccactctaatgacc

SEQ ID NO: 459623 - DNA, 15 bp, Homo sapiens
ccactctaatgacct

SEQ ID NO: 459624 - DNA, 15 bp, Homo sapiens
cactctaatgacctc

SEQ ID NO: 459625 - DNA, 15 bp, Homo sapiens
actctaatgacctca

SEQ ID NO: 459626 - DNA, 15 bp, Homo sapiens
ctctaatgacctcat

SEQ ID NO: 459627 - DNA, 15 bp, Homo sapiens
tctaatgacctcatt

SEQ ID NO: 459628 - DNA, 15 bp, Homo sapiens
ctaatgacctcattt

SEQ ID NO: 459629 - DNA, 15 bp, Homo sapiens
taatgacctcatttt

SEQ ID NO: 459630 - DNA, 15 bp, Homo sapiens
aatgacctcatttta

SEQ ID NO: 459631 - DNA, 15 bp, Homo sapiens
atgacctcattttaa

SEQ ID NO: 459632 - DNA, 15 bp, Homo sapiens
tgacctcattttaac

SEQ ID NO: 459633 - DNA, 15 bp, Homo sapiens
gacctcattttaact

SEQ ID NO: 459634 - DNA, 15 bp, Homo sapiens
acctcattttaactt

SEQ ID NO: 459635 - DNA, 15 bp, Homo sapiens
cctcattttaactta

SEQ ID NO: 459636 - DNA, 15 bp, Homo sapiens
ctcattttaacttaa

SEQ ID NO: 459637 - DNA, 15 bp, Homo sapiens
tcattttaacttaat

SEQ ID NO: 459638 - DNA, 15 bp, Homo sapiens
cattttaacttaatt

SEQ ID NO: 459639 - DNA, 15 bp, Homo sapiens
attttaacttaatta

SEQ ID NO: 459640 - DNA, 15 bp, Homo sapiens
ttttaacttaattac

SEQ ID NO: 459641 - DNA, 15 bp, Homo sapiens
tttaacttaattaca

SEQ ID NO: 459642 - DNA, 15 bp, Homo sapiens
ttaacttaattacat

SEQ ID NO: 459643 - DNA, 15 bp, Homo sapiens
taacttaattacatc

SEQ ID NO: 459644 - DNA, 15 bp, Homo sapiens
aacttaattacatct

SEQ ID NO: 459645 - DNA, 15 bp, Homo sapiens
acttaattacatctt

SEQ ID NO: 459646 - DNA, 15 bp, Homo sapiens
cttaattacatcttt

SEQ ID NO: 459647 - DNA, 15 bp, Homo sapiens
ttaattacatcttta

SEQ ID NO: 459648 - DNA, 15 bp, Homo sapiens
taattacatctttaa

SEQ ID NO: 459649 - DNA, 15 bp, Homo sapiens
aattacatctttaaa

SEQ ID NO: 459650 - DNA, 15 bp, Homo sapiens
attacatctttaaag

SEQ ID NO: 459651 - DNA, 15 bp, Homo sapiens
ttacatctttaaaga

SEQ ID NO: 459652 - DNA, 15 bp, Homo sapiens
tacatctttaaagac

SEQ ID NO: 459653 - DNA, 15 bp, Homo sapiens
acatctttaaagacc

SEQ ID NO: 459654 - DNA, 15 bp, Homo sapiens
catctttaaagaccc

SEQ ID NO: 459655 - DNA, 15 bp, Homo sapiens
atctttaaagaccct

SEQ ID NO: 459656 - DNA, 15 bp, Homo sapiens
tctttaaagacccta

SEQ ID NO: 459657 - DNA, 15 bp, Homo sapiens
ctttaaagaccctat

SEQ ID NO: 459658 - DNA, 15 bp, Homo sapiens
tttaaagaccctatc

SEQ ID NO: 459659 - DNA, 15 bp, Homo sapiens
ttaaagaccctatct

SEQ ID NO: 459660 - DNA, 15 bp, Homo sapiens
taaagaccctatctc

SEQ ID NO: 459661 - DNA, 15 bp, Homo sapiens
aaagaccctatctcc

SEQ ID NO: 459662 - DNA, 15 bp, Homo sapiens
aagaccctatctcca

SEQ ID NO: 459663 - DNA, 15 bp, Homo sapiens
agaccctatctccaa

SEQ ID NO: 459664 - DNA, 15 bp, Homo sapiens
gaccctatctccaaa

SEQ ID NO: 459665 - DNA, 15 bp, Homo sapiens
accctatctccaaat

SEQ ID NO: 459666 - DNA, 15 bp, Homo sapiens
ccctatctccaaata

SEQ ID NO: 459667 - DNA, 15 bp, Homo sapiens
cctatctccaaatac

SEQ ID NO: 459668 - DNA, 15 bp, Homo sapiens
ctatctccaaataca

SEQ ID NO: 459669 - DNA, 15 bp, Homo sapiens
tatctccaaatacag

SEQ ID NO: 459670 - DNA, 15 bp, Homo sapiens
atctccaaatacagt

SEQ ID NO: 459671 - DNA, 15 bp, Homo sapiens
tctccaaatacagtc

SEQ ID NO: 459672 - DNA, 15 bp, Homo sapiens
ctccaaatacagtcc

SEQ ID NO: 459673 - DNA, 15 bp, Homo sapiens
tccaaatacagtccc

SEQ ID NO: 459674 - DNA, 15 bp, Homo sapiens
ccaaatacagtccca

SEQ ID NO: 459675 - DNA, 15 bp, Homo sapiens
caaatacagtcccat

SEQ ID NO: 459676 - DNA, 15 bp, Homo sapiens
aaatacagtcccatt

SEQ ID NO: 459677 - DNA, 15 bp, Homo sapiens
aatacagtcccattc

SEQ ID NO: 459678 - DNA, 15 bp, Homo sapiens
atacagtcccattct

SEQ ID NO: 459679 - DNA, 15 bp, Homo sapiens
tacagtcccattctg

SEQ ID NO: 459680 - DNA, 15 bp, Homo sapiens
acagtcccattctga

SEQ ID NO: 459681 - DNA, 15 bp, Homo sapiens
cagtcccattctgag

SEQ ID NO: 459682 - DNA, 15 bp, Homo sapiens
agtcccattctgagg

SEQ ID NO: 459683 - DNA, 15 bp, Homo sapiens
gtcccattctgaggt

SEQ ID NO: 459684 - DNA, 15 bp, Homo sapiens
tcccattctgaggta

SEQ ID NO: 459685 - DNA, 15 bp, Homo sapiens
cccattctgaggtac

SEQ ID NO: 459686 - DNA, 15 bp, Homo sapiens
ccattctgaggtact

SEQ ID NO: 459687 - DNA, 15 bp, Homo sapiens
cattctgaggtacta

SEQ ID NO: 459688 - DNA, 15 bp, Homo sapiens
attctgaggtactag

SEQ ID NO: 459689 - DNA, 15 bp, Homo sapiens
ttctgaggtactagg

SEQ ID NO: 459690 - DNA, 15 bp, Homo sapiens
tctgaggtactagga

SEQ ID NO: 459691 - DNA, 15 bp, Homo sapiens
ctgaggtactaggag

SEQ ID NO: 459692 - DNA, 15 bp, Homo sapiens
tgaggtactaggagt

SEQ ID NO: 459693 - DNA, 15 bp, Homo sapiens
gaggtactaggagtt

SEQ ID NO: 459694 - DNA, 15 bp, Homo sapiens
aggtactaggagtta

SEQ ID NO: 459695 - DNA, 15 bp, Homo sapiens
ggtactaggagttag

SEQ ID NO: 459696 - DNA, 15 bp, Homo sapiens
gtactaggagttagg

SEQ ID NO: 459697 - DNA, 15 bp, Homo sapiens
tactaggagttagga

SEQ ID NO: 459698 - DNA, 15 bp, Homo sapiens
actaggagttaggac

SEQ ID NO: 459699 - DNA, 15 bp, Homo sapiens
ctaggagttaggacc

SEQ ID NO: 459700 - DNA, 15 bp, Homo sapiens
taggagttaggacct

SEQ ID NO: 459701 - DNA, 15 bp, Homo sapiens
aggagttaggacctt

SEQ ID NO: 459702 - DNA, 15 bp, Homo sapiens
ggagttaggacctta

SEQ ID NO: 459703 - DNA, 15 bp, Homo sapiens
gagttaggaccttaa

SEQ ID NO: 459704 - DNA, 15 bp, Homo sapiens
agttaggaccttaac

SEQ ID NO: 459705 - DNA, 15 bp, Homo sapiens
gttaggaccttaacc

SEQ ID NO: 459706 - DNA, 15 bp, Homo sapiens
ttaggaccttaacct

SEQ ID NO: 459707 - DNA, 15 bp, Homo sapiens
taggaccttaacctg

SEQ ID NO: 459708 - DNA, 15 bp, Homo sapiens
aggaccttaacctgt

SEQ ID NO: 459709 - DNA, 15 bp, Homo sapiens
ggaccttaacctgta

SEQ ID NO: 459710 - DNA, 15 bp, Homo sapiens
gaccttaacctgtaa

SEQ ID NO: 459711 - DNA, 15 bp, Homo sapiens
accttaacctgtaaa

SEQ ID NO: 459712 - DNA, 15 bp, Homo sapiens
ccttaacctgtaaat

SEQ ID NO: 459713 - DNA, 15 bp, Homo sapiens
cttaacctgtaaatt

SEQ ID NO: 459714 - DNA, 15 bp, Homo sapiens
ttaacctgtaaattt

SEQ ID NO: 459715 - DNA, 15 bp, Homo sapiens
taacctgtaaatttt

SEQ ID NO: 459716 - DNA, 15 bp, Homo sapiens
aacctgtaaatttta

SEQ ID NO: 459717 - DNA, 15 bp, Homo sapiens
acctgtaaattttag

SEQ ID NO: 459718 - DNA, 15 bp, Homo sapiens
cctgtaaattttagg

SEQ ID NO: 459719 - DNA, 15 bp, Homo sapiens
ctgtaaattttaggg

SEQ ID NO: 459720 - DNA, 15 bp, Homo sapiens
tgtaaattttagggg

SEQ ID NO: 459721 - DNA, 15 bp, Homo sapiens
gtaaattttagggga

SEQ ID NO: 459722 - DNA, 15 bp, Homo sapiens
taaattttaggggac

SEQ ID NO: 459723 - DNA, 15 bp, Homo sapiens
aaattttaggggaca

SEQ ID NO: 459724 - DNA, 15 bp, Homo sapiens
aattttaggggacac

SEQ ID NO: 459725 - DNA, 15 bp, Homo sapiens
attttaggggacaca

SEQ ID NO: 459726 - DNA, 15 bp, Homo sapiens
ttttaggggacacag

SEQ ID NO: 459727 - DNA, 15 bp, Homo sapiens
tttaggggacacagt

SEQ ID NO: 459728 - DNA, 15 bp, Homo sapiens
ttaggggacacagtt

SEQ ID NO: 459729 - DNA, 15 bp, Homo sapiens
taggggacacagttc

SEQ ID NO: 459730 - DNA, 15 bp, Homo sapiens
aggggacacagttca

SEQ ID NO: 459731 - DNA, 15 bp, Homo sapiens
ggggacacagttcag

SEQ ID NO: 459732 - DNA, 15 bp, Homo sapiens
gggacacagttcagt

SEQ ID NO: 459733 - DNA, 15 bp, Homo sapiens
ggacacagttcagtg

SEQ ID NO: 459734 - DNA, 15 bp, Homo sapiens
gacacagttcagtgc

SEQ ID NO: 459735 - DNA, 15 bp, Homo sapiens
acacagttcagtgca

SEQ ID NO: 459736 - DNA, 15 bp, Homo sapiens
cacagttcagtgcat

SEQ ID NO: 459737 - DNA, 15 bp, Homo sapiens
acagttcagtgcata

SEQ ID NO: 459738 - DNA, 15 bp, Homo sapiens
cagttcagtgcataa

SEQ ID NO: 459739 - DNA, 15 bp, Homo sapiens
agttcagtgcataat

SEQ ID NO: 459740 - DNA, 15 bp, Homo sapiens
gttcagtgcataatg

SEQ ID NO: 459741 - DNA, 15 bp, Homo sapiens
ttcagtgcataatgc

SEQ ID NO: 459742 - DNA, 15 bp, Homo sapiens
tcagtgcataatgca

SEQ ID NO: 459743 - DNA, 15 bp, Homo sapiens
cagtgcataatgcac

SEQ ID NO: 459744 - DNA, 15 bp, Homo sapiens
agtgcataatgcaca

SEQ ID NO: 459745 - DNA, 15 bp, Homo sapiens
gtgcataatgcacac

SEQ ID NO: 459746 - DNA, 15 bp, Homo sapiens
tgcataatgcacaca

SEQ ID NO: 459747 - DNA, 15 bp, Homo sapiens
gcataatgcacacat

SEQ ID NO: 459748 - DNA, 15 bp, Homo sapiens
cataatgcacacata

SEQ ID NO: 459749 - DNA, 15 bp, Homo sapiens
ataatgcacacatat

SEQ ID NO: 459750 - DNA, 15 bp, Homo sapiens
taatgcacacatatg

SEQ ID NO: 459751 - DNA, 15 bp, Homo sapiens
aatgcacacatatgc

SEQ ID NO: 459752 - DNA, 15 bp, Homo sapiens
atgcacacatatgct

SEQ ID NO: 459753 - DNA, 15 bp, Homo sapiens
tgcacacatatgctc

SEQ ID NO: 459754 - DNA, 15 bp, Homo sapiens
gcacacatatgctct

SEQ ID NO: 459755 - DNA, 15 bp, Homo sapiens
cacacatatgctctt

SEQ ID NO: 459756 - DNA, 15 bp, Homo sapiens
acacatatgctcttt

SEQ ID NO: 459757 - DNA, 15 bp, Homo sapiens
cacatatgctctttt

SEQ ID NO: 459758 - DNA, 15 bp, Homo sapiens
acatatgctcttttc

SEQ ID NO: 459759 - DNA, 15 bp, Homo sapiens
catatgctcttttca

SEQ ID NO: 459760 - DNA, 15 bp, Homo sapiens
atatgctcttttcac

SEQ ID NO: 459761 - DNA, 15 bp, Homo sapiens
tatgctcttttcact

SEQ ID NO: 459762 - DNA, 15 bp, Homo sapiens
atgctcttttcactg

SEQ ID NO: 459763 - DNA, 15 bp, Homo sapiens
tgctcttttcactgg

SEQ ID NO: 459764 - DNA, 15 bp, Homo sapiens
gctcttttcactgga

SEQ ID NO: 459765 - DNA, 15 bp, Homo sapiens
ctcttttcactggac

SEQ ID NO: 459766 - DNA, 15 bp, Homo sapiens
tcttttcactggaca

SEQ ID NO: 459767 - DNA, 15 bp, Homo sapiens
cttttcactggacag

SEQ ID NO: 459768 - DNA, 15 bp, Homo sapiens
ttttcactggacagc

SEQ ID NO: 459769 - DNA, 15 bp, Homo sapiens
tttcactggacagcc

SEQ ID NO: 459770 - DNA, 15 bp, Homo sapiens
ttcactggacagccc

SEQ ID NO: 459771 - DNA, 15 bp, Homo sapiens
tcactggacagccca

SEQ ID NO: 459772 - DNA, 15 bp, Homo sapiens
cactggacagcccaa

SEQ ID NO: 459773 - DNA, 15 bp, Homo sapiens
actggacagcccaaa

SEQ ID NO: 459774 - DNA, 15 bp, Homo sapiens
ctggacagcccaaag

SEQ ID NO: 459775 - DNA, 15 bp, Homo sapiens
tggacagcccaaagg

SEQ ID NO: 459776 - DNA, 15 bp, Homo sapiens
ggacagcccaaaggg

SEQ ID NO: 459777 - DNA, 15 bp, Homo sapiens
gacagcccaaaggga

SEQ ID NO: 459778 - DNA, 15 bp, Homo sapiens
acagcccaaagggaa

SEQ ID NO: 459779 - DNA, 15 bp, Homo sapiens
cagcccaaagggaat

SEQ ID NO: 459780 - DNA, 15 bp, Homo sapiens
agcccaaagggaata

SEQ ID NO: 459781 - DNA, 15 bp, Homo sapiens
gcccaaagggaatag

SEQ ID NO: 459782 - DNA, 15 bp, Homo sapiens
cccaaagggaatagt

SEQ ID NO: 459783 - DNA, 15 bp, Homo sapiens
ccaaagggaatagtg

SEQ ID NO: 459784 - DNA, 15 bp, Homo sapiens
caaagggaatagtgc

SEQ ID NO: 459785 - DNA, 15 bp, Homo sapiens
aaagggaatagtgcc

SEQ ID NO: 459786 - DNA, 15 bp, Homo sapiens
aagggaatagtgcca

SEQ ID NO: 459787 - DNA, 15 bp, Homo sapiens
agggaatagtgccac

SEQ ID NO: 459788 - DNA, 15 bp, Homo sapiens
gggaatagtgccact

SEQ ID NO: 459789 - DNA, 15 bp, Homo sapiens
ggaatagtgccactt

SEQ ID NO: 459790 - DNA, 15 bp, Homo sapiens
gaatagtgccacttg

SEQ ID NO: 459791 - DNA, 15 bp, Homo sapiens
aatagtgccacttgg

SEQ ID NO: 459792 - DNA, 15 bp, Homo sapiens
atagtgccacttggt

SEQ ID NO: 459793 - DNA, 15 bp, Homo sapiens
tagtgccacttggtt

SEQ ID NO: 459794 - DNA, 15 bp, Homo sapiens
agtgccacttggttg

SEQ ID NO: 459795 - DNA, 15 bp, Homo sapiens
gtgccacttggttgg

SEQ ID NO: 459796 - DNA, 15 bp, Homo sapiens
tgccacttggttggg

SEQ ID NO: 459797 - DNA, 15 bp, Homo sapiens
gccacttggttggga

SEQ ID NO: 459798 - DNA, 15 bp, Homo sapiens
ccacttggttgggag

SEQ ID NO: 459799 - DNA, 15 bp, Homo sapiens
cacttggttgggagg

SEQ ID NO: 459800 - DNA, 15 bp, Homo sapiens
acttggttgggagga

SEQ ID NO: 459801 - DNA, 15 bp, Homo sapiens
cttggttgggaggaa

SEQ ID NO: 459802 - DNA, 15 bp, Homo sapiens
ttggttgggaggaag

SEQ ID NO: 459803 - DNA, 15 bp, Homo sapiens
tggttgggaggaagc

SEQ ID NO: 459804 - DNA, 15 bp, Homo sapiens
ggttgggaggaagca

SEQ ID NO: 459805 - DNA, 15 bp, Homo sapiens
gttgggaggaagcag

SEQ ID NO: 459806 - DNA, 15 bp, Homo sapiens
ttgggaggaagcagt

SEQ ID NO: 459807 - DNA, 15 bp, Homo sapiens
tgggaggaagcagtg

SEQ ID NO: 459808 - DNA, 15 bp, Homo sapiens
gggaggaagcagtgt

SEQ ID NO: 459809 - DNA, 15 bp, Homo sapiens
ggaggaagcagtgtg

SEQ ID NO: 459810 - DNA, 15 bp, Homo sapiens
gaggaagcagtgtgt

SEQ ID NO: 459811 - DNA, 15 bp, Homo sapiens
aggaagcagtgtgtg

SEQ ID NO: 459812 - DNA, 15 bp, Homo sapiens
ggaagcagtgtgtga

SEQ ID NO: 459813 - DNA, 15 bp, Homo sapiens
gaagcagtgtgtgaa

SEQ ID NO: 459814 - DNA, 15 bp, Homo sapiens
aagcagtgtgtgaaa

SEQ ID NO: 459815 - DNA, 15 bp, Homo sapiens
agcagtgtgtgaaat

SEQ ID NO: 459816 - DNA, 15 bp, Homo sapiens
gcagtgtgtgaaatg

SEQ ID NO: 459817 - DNA, 15 bp, Homo sapiens
cagtgtgtgaaatgc

SEQ ID NO: 459818 - DNA, 15 bp, Homo sapiens
agtgtgtgaaatgcc

SEQ ID NO: 459819 - DNA, 15 bp, Homo sapiens
gtgtgtgaaatgccg

SEQ ID NO: 459820 - DNA, 15 bp, Homo sapiens
tgtgtgaaatgccgt

SEQ ID NO: 459821 - DNA, 15 bp, Homo sapiens
gtgtgaaatgccgtg

SEQ ID NO: 459822 - DNA, 15 bp, Homo sapiens
tgtgaaatgccgtga

SEQ ID NO: 459823 - DNA, 15 bp, Homo sapiens
gtgaaatgccgtgat

SEQ ID NO: 459824 - DNA, 15 bp, Homo sapiens
tgaaatgccgtgatt

SEQ ID NO: 459825 - DNA, 15 bp, Homo sapiens
gaaatgccgtgattc

SEQ ID NO: 459826 - DNA, 15 bp, Homo sapiens
aaatgccgtgattca

SEQ ID NO: 459827 - DNA, 15 bp, Homo sapiens
aatgccgtgattcat

SEQ ID NO: 459828 - DNA, 15 bp, Homo sapiens
atgccgtgattcata

SEQ ID NO: 459829 - DNA, 15 bp, Homo sapiens
tgccgtgattcatat

SEQ ID NO: 459830 - DNA, 15 bp, Homo sapiens
gccgtgattcatatt

SEQ ID NO: 459831 - DNA, 15 bp, Homo sapiens
ccgtgattcatattc

SEQ ID NO: 459832 - DNA, 15 bp, Homo sapiens
cgtgattcatattct

SEQ ID NO: 459833 - DNA, 15 bp, Homo sapiens
gtgattcatattcta

SEQ ID NO: 459834 - DNA, 15 bp, Homo sapiens
tgattcatattctag

SEQ ID NO: 459835 - DNA, 15 bp, Homo sapiens
gattcatattctagg

SEQ ID NO: 459836 - DNA, 15 bp, Homo sapiens
attcatattctaggg

SEQ ID NO: 459837 - DNA, 15 bp, Homo sapiens
ttcatattctaggga

SEQ ID NO: 459838 - DNA, 15 bp, Homo sapiens
tcatattctagggag

SEQ ID NO: 459839 - DNA, 15 bp, Homo sapiens
catattctagggagt

SEQ ID NO: 459840 - DNA, 15 bp, Homo sapiens
atattctagggagtt

SEQ ID NO: 459841 - DNA, 15 bp, Homo sapiens
tattctagggagtta

SEQ ID NO: 459842 - DNA, 15 bp, Homo sapiens
attctagggagttaa

SEQ ID NO: 459843 - DNA, 15 bp, Homo sapiens
ttctagggagttaaa

SEQ ID NO: 459844 - DNA, 15 bp, Homo sapiens
tctagggagttaaat

SEQ ID NO: 459845 - DNA, 15 bp, Homo sapiens
ctagggagttaaatg

SEQ ID NO: 459846 - DNA, 15 bp, Homo sapiens
tagggagttaaatgt

SEQ ID NO: 459847 - DNA, 15 bp, Homo sapiens
agggagttaaatgtt

SEQ ID NO: 459848 - DNA, 15 bp, Homo sapiens
gggagttaaatgttg

SEQ ID NO: 459849 - DNA, 15 bp, Homo sapiens
ggagttaaatgttgg

SEQ ID NO: 459850 - DNA, 15 bp, Homo sapiens
gagttaaatgttggc

SEQ ID NO: 459851 - DNA, 15 bp, Homo sapiens
agttaaatgttggca

SEQ ID NO: 459852 - DNA, 15 bp, Homo sapiens
gttaaatgttggcac

SEQ ID NO: 459853 - DNA, 15 bp, Homo sapiens
ttaaatgttggcaca

SEQ ID NO: 459854 - DNA, 15 bp, Homo sapiens
taaatgttggcacag

SEQ ID NO: 459855 - DNA, 15 bp, Homo sapiens
aaatgttggcacagt

SEQ ID NO: 459856 - DNA, 15 bp, Homo sapiens
aatgttggcacagtt

SEQ ID NO: 459857 - DNA, 15 bp, Homo sapiens
atgttggcacagttc

SEQ ID NO: 459858 - DNA, 15 bp, Homo sapiens
tgttggcacagttcc

SEQ ID NO: 459859 - DNA, 15 bp, Homo sapiens
gttggcacagttcca

SEQ ID NO: 459860 - DNA, 15 bp, Homo sapiens
ttggcacagttccac

SEQ ID NO: 459861 - DNA, 15 bp, Homo sapiens
tggcacagttccact

SEQ ID NO: 459862 - DNA, 15 bp, Homo sapiens
ggcacagttccactt

SEQ ID NO: 459863 - DNA, 15 bp, Homo sapiens
gcacagttccacttg

SEQ ID NO: 459864 - DNA, 15 bp, Homo sapiens
cacagttccacttgc

SEQ ID NO: 459865 - DNA, 15 bp, Homo sapiens
acagttccacttgcc

SEQ ID NO: 459866 - DNA, 15 bp, Homo sapiens
cagttccacttgcct

SEQ ID NO: 459867 - DNA, 15 bp, Homo sapiens
agttccacttgcctc

SEQ ID NO: 459868 - DNA, 15 bp, Homo sapiens
gttccacttgcctcc

SEQ ID NO: 459869 - DNA, 15 bp, Homo sapiens
ttccacttgcctcca

SEQ ID NO: 459870 - DNA, 15 bp, Homo sapiens
tccacttgcctccat

SEQ ID NO: 459871 - DNA, 15 bp, Homo sapiens
ccacttgcctccatc

SEQ ID NO: 459872 - DNA, 15 bp, Homo sapiens
cacttgcctccatca

SEQ ID NO: 459873 - DNA, 15 bp, Homo sapiens
acttgcctccatcaa

SEQ ID NO: 459874 - DNA, 15 bp, Homo sapiens
cttgcctccatcaaa

SEQ ID NO: 459875 - DNA, 15 bp, Homo sapiens
ttgcctccatcaaat

SEQ ID NO: 459876 - DNA, 15 bp, Homo sapiens
tgcctccatcaaatg

SEQ ID NO: 459877 - DNA, 15 bp, Homo sapiens
gcctccatcaaatgg

SEQ ID NO: 459878 - DNA, 15 bp, Homo sapiens
cctccatcaaatggg

SEQ ID NO: 459879 - DNA, 15 bp, Homo sapiens
ctccatcaaatggga

SEQ ID NO: 459880 - DNA, 15 bp, Homo sapiens
tccatcaaatgggaa

SEQ ID NO: 459881 - DNA, 15 bp, Homo sapiens
ccatcaaatgggaat

SEQ ID NO: 459882 - DNA, 15 bp, Homo sapiens
catcaaatgggaata

SEQ ID NO: 459883 - DNA, 15 bp, Homo sapiens
atcaaatgggaatat

SEQ ID NO: 459884 - DNA, 15 bp, Homo sapiens
tcaaatgggaatatg

SEQ ID NO: 459885 - DNA, 15 bp, Homo sapiens
caaatgggaatatgt

SEQ ID NO: 459886 - DNA, 15 bp, Homo sapiens
aaatgggaatatgtg

SEQ ID NO: 459887 - DNA, 15 bp, Homo sapiens
aatgggaatatgtgg

SEQ ID NO: 459888 - DNA, 15 bp, Homo sapiens
atgggaatatgtggg

SEQ ID NO: 459889 - DNA, 15 bp, Homo sapiens
tgggaatatgtggga

SEQ ID NO: 459890 - DNA, 15 bp, Homo sapiens
gggaatatgtgggaa

SEQ ID NO: 459891 - DNA, 15 bp, Homo sapiens
ggaatatgtgggaaa

SEQ ID NO: 459892 - DNA, 15 bp, Homo sapiens
gaatatgtgggaaat

SEQ ID NO: 459893 - DNA, 15 bp, Homo sapiens
aatatgtgggaaatg

SEQ ID NO: 459894 - DNA, 15 bp, Homo sapiens
atatgtgggaaatgc

SEQ ID NO: 459895 - DNA, 15 bp, Homo sapiens
tatgtgggaaatgct

SEQ ID NO: 459896 - DNA, 15 bp, Homo sapiens
atgtgggaaatgcta

SEQ ID NO: 459897 - DNA, 15 bp, Homo sapiens
tgtgggaaatgctac

SEQ ID NO: 459898 - DNA, 15 bp, Homo sapiens
gtgggaaatgctaca

SEQ ID NO: 459899 - DNA, 15 bp, Homo sapiens
tgggaaatgctacaa

SEQ ID NO: 459900 - DNA, 15 bp, Homo sapiens
gggaaatgctacaat

SEQ ID NO: 459901 - DNA, 15 bp, Homo sapiens
ggaaatgctacaatt

SEQ ID NO: 459902 - DNA, 15 bp, Homo sapiens
gaaatgctacaattt

SEQ ID NO: 459903 - DNA, 15 bp, Homo sapiens
aaatgctacaatttg

SEQ ID NO: 459904 - DNA, 15 bp, Homo sapiens
aatgctacaatttgc

SEQ ID NO: 459905 - DNA, 15 bp, Homo sapiens
atgctacaatttgcc

SEQ ID NO: 459906 - DNA, 15 bp, Homo sapiens
tgctacaatttgcca

SEQ ID NO: 459907 - DNA, 15 bp, Homo sapiens
gctacaatttgccac

SEQ ID NO: 459908 - DNA, 15 bp, Homo sapiens
ctacaatttgccact

SEQ ID NO: 459909 - DNA, 15 bp, Homo sapiens
tacaatttgccactg

SEQ ID NO: 459910 - DNA, 15 bp, Homo sapiens
acaatttgccactgt

SEQ ID NO: 459911 - DNA, 15 bp, Homo sapiens
caatttgccactgtt

SEQ ID NO: 459912 - DNA, 15 bp, Homo sapiens
aatttgccactgttt

SEQ ID NO: 459913 - DNA, 15 bp, Homo sapiens
atttgccactgtttc

SEQ ID NO: 459914 - DNA, 15 bp, Homo sapiens
tttgccactgtttct

SEQ ID NO: 459915 - DNA, 15 bp, Homo sapiens
ttgccactgtttctc

SEQ ID NO: 459916 - DNA, 15 bp, Homo sapiens
tgccactgtttctca

SEQ ID NO: 459917 - DNA, 15 bp, Homo sapiens
gccactgtttctcat

SEQ ID NO: 459918 - DNA, 15 bp, Homo sapiens
ccactgtttctcatt

SEQ ID NO: 459919 - DNA, 15 bp, Homo sapiens
cactgtttctcattt

SEQ ID NO: 459920 - DNA, 15 bp, Homo sapiens
actgtttctcattta

SEQ ID NO: 459921 - DNA, 15 bp, Homo sapiens
ctgtttctcatttag

SEQ ID NO: 459922 - DNA, 15 bp, Homo sapiens
tgtttctcatttaga

SEQ ID NO: 459923 - DNA, 15 bp, Homo sapiens
gtttctcatttagaa

SEQ ID NO: 459924 - DNA, 15 bp, Homo sapiens
tttctcatttagaaa

SEQ ID NO: 459925 - DNA, 15 bp, Homo sapiens
ttctcatttagaaag

SEQ ID NO: 459926 - DNA, 15 bp, Homo sapiens
tctcatttagaaaga

SEQ ID NO: 459927 - DNA, 15 bp, Homo sapiens
ctcatttagaaagac

SEQ ID NO: 459928 - DNA, 15 bp, Homo sapiens
tcatttagaaagaca

SEQ ID NO: 459929 - DNA, 15 bp, Homo sapiens
catttagaaagacag

SEQ ID NO: 459930 - DNA, 15 bp, Homo sapiens
atttagaaagacagt

SEQ ID NO: 459931 - DNA, 15 bp, Homo sapiens
tttagaaagacagta

SEQ ID NO: 459932 - DNA, 15 bp, Homo sapiens
ttagaaagacagtat

SEQ ID NO: 459933 - DNA, 15 bp, Homo sapiens
tagaaagacagtatc

SEQ ID NO: 459934 - DNA, 15 bp, Homo sapiens
agaaagacagtatct

SEQ ID NO: 459935 - DNA, 15 bp, Homo sapiens
gaaagacagtatctt

SEQ ID NO: 459936 - DNA, 15 bp, Homo sapiens
aaagacagtatcttg

SEQ ID NO: 459937 - DNA, 15 bp, Homo sapiens
aagacagtatcttga

SEQ ID NO: 459938 - DNA, 15 bp, Homo sapiens
agacagtatcttgaa

SEQ ID NO: 459939 - DNA, 15 bp, Homo sapiens
gacagtatcttgaaa

SEQ ID NO: 459940 - DNA, 15 bp, Homo sapiens
acagtatcttgaaat

SEQ ID NO: 459941 - DNA, 15 bp, Homo sapiens
cagtatcttgaaatt

SEQ ID NO: 459942 - DNA, 15 bp, Homo sapiens
agtatcttgaaattt

SEQ ID NO: 459943 - DNA, 15 bp, Homo sapiens
gtatcttgaaatttc

SEQ ID NO: 459944 - DNA, 15 bp, Homo sapiens
tatcttgaaatttct

SEQ ID NO: 459945 - DNA, 15 bp, Homo sapiens
atcttgaaatttctc

SEQ ID NO: 459946 - DNA, 15 bp, Homo sapiens
tcttgaaatttctca

SEQ ID NO: 459947 - DNA, 15 bp, Homo sapiens
cttgaaatttctcat

SEQ ID NO: 459948 - DNA, 15 bp, Homo sapiens
ttgaaatttctcatt

SEQ ID NO: 459949 - DNA, 15 bp, Homo sapiens
tgaaatttctcattt

SEQ ID NO: 459950 - DNA, 15 bp, Homo sapiens
gaaatttctcatttt

SEQ ID NO: 459951 - DNA, 15 bp, Homo sapiens
aaatttctcattttt

SEQ ID NO: 459952 - DNA, 15 bp, Homo sapiens
aatttctcatttttc

SEQ ID NO: 459953 - DNA, 15 bp, Homo sapiens
atttctcatttttca

SEQ ID NO: 459954 - DNA, 15 bp, Homo sapiens
tttctcatttttcat

SEQ ID NO: 459955 - DNA, 15 bp, Homo sapiens
ttctcatttttcatt

SEQ ID NO: 459956 - DNA, 15 bp, Homo sapiens
tctcatttttcattt

SEQ ID NO: 459957 - DNA, 15 bp, Homo sapiens
ctcatttttcatttt

SEQ ID NO: 459958 - DNA, 15 bp, Homo sapiens
tcatttttcatttta

SEQ ID NO: 459959 - DNA, 15 bp, Homo sapiens
catttttcattttaa

SEQ ID NO: 459960 - DNA, 15 bp, Homo sapiens
atttttcattttaaa

SEQ ID NO: 459961 - DNA, 15 bp, Homo sapiens
tttttcattttaaag

SEQ ID NO: 459962 - DNA, 15 bp, Homo sapiens
ttttcattttaaagg

SEQ ID NO: 459963 - DNA, 15 bp, Homo sapiens
tttcattttaaagga

SEQ ID NO: 459964 - DNA, 15 bp, Homo sapiens
ttcattttaaaggaa

SEQ ID NO: 459965 - DNA, 15 bp, Homo sapiens
tcattttaaaggaaa

SEQ ID NO: 459966 - DNA, 15 bp, Homo sapiens
cattttaaaggaaaa

SEQ ID NO: 459967 - DNA, 15 bp, Homo sapiens
attttaaaggaaaaa

SEQ ID NO: 459968 - DNA, 15 bp, Homo sapiens
ttttaaaggaaaaaa

SEQ ID NO: 459969 - DNA, 15 bp, Homo sapiens
tttaaaggaaaaaaa

SEQ ID NO: 459970 - DNA, 15 bp, Homo sapiens
ttaaaggaaaaaaat

SEQ ID NO: 459971 - DNA, 15 bp, Homo sapiens
taaaggaaaaaaatc

SEQ ID NO: 459972 - DNA, 15 bp, Homo sapiens
ggaaaaaaatctttc

SEQ ID NO: 459973 - DNA, 15 bp, Homo sapiens
gaaaaaaatctttca

SEQ ID NO: 459974 - DNA, 15 bp, Homo sapiens
aaaaaaatctttcag

SEQ ID NO: 459975 - DNA, 15 bp, Homo sapiens
aaaaaatctttcagg

SEQ ID NO: 459976 - DNA, 15 bp, Homo sapiens
aaaaatctttcagga

SEQ ID NO: 459977 - DNA, 15 bp, Homo sapiens
aaaatctttcaggac

SEQ ID NO: 459978 - DNA, 15 bp, Homo sapiens
aaatctttcaggact

SEQ ID NO: 459979 - DNA, 15 bp, Homo sapiens
aatctttcaggacta

SEQ ID NO: 459980 - DNA, 15 bp, Homo sapiens
atctttcaggactaa

SEQ ID NO: 459981 - DNA, 15 bp, Homo sapiens
tctttcaggactaac

SEQ ID NO: 459982 - DNA, 15 bp, Homo sapiens
ctttcaggactaacc

SEQ ID NO: 459983 - DNA, 15 bp, Homo sapiens
tttcaggactaacct

SEQ ID NO: 459984 - DNA, 15 bp, Homo sapiens
ttcaggactaacctc

SEQ ID NO: 459985 - DNA, 15 bp, Homo sapiens
tcaggactaacctcc

SEQ ID NO: 459986 - DNA, 15 bp, Homo sapiens
caggactaacctccc

SEQ ID NO: 459987 - DNA, 15 bp, Homo sapiens
aggactaacctccct

SEQ ID NO: 459988 - DNA, 15 bp, Homo sapiens
ggactaacctccctt

SEQ ID NO: 459989 - DNA, 15 bp, Homo sapiens
gactaacctcccttc

SEQ ID NO: 459990 - DNA, 15 bp, Homo sapiens
actaacctcccttct

SEQ ID NO: 459991 - DNA, 15 bp, Homo sapiens
ctaacctcccttcta

SEQ ID NO: 459992 - DNA, 15 bp, Homo sapiens
taacctcccttctat

SEQ ID NO: 459993 - DNA, 15 bp, Homo sapiens
aacctcccttctatg

SEQ ID NO: 459994 - DNA, 15 bp, Homo sapiens
acctcccttctatga

SEQ ID NO: 459995 - DNA, 15 bp, Homo sapiens
cctcccttctatgaa

SEQ ID NO: 459996 - DNA, 15 bp, Homo sapiens
ctcccttctatgaaa

SEQ ID NO: 459997 - DNA, 15 bp, Homo sapiens
tcccttctatgaaaa

SEQ ID NO: 459998 - DNA, 15 bp, Homo sapiens
cccttctatgaaaaa

SEQ ID NO: 459999 - DNA, 15 bp, Homo sapiens
ccttctatgaaaaag

SEQ ID NO: 460000 - DNA, 15 bp, Homo sapiens
cttctatgaaaaaga

SEQ ID NO: 460001 - DNA, 15 bp, Homo sapiens
ttctatgaaaaagaa

SEQ ID NO: 460002 - DNA, 15 bp, Homo sapiens
tctatgaaaaagaaa

SEQ ID NO: 460003 - DNA, 15 bp, Homo sapiens
ctatgaaaaagaaag

SEQ ID NO: 460004 - DNA, 15 bp, Homo sapiens
tatgaaaaagaaaga

SEQ ID NO: 460005 - DNA, 15 bp, Homo sapiens
atgaaaaagaaagat

SEQ ID NO: 460006 - DNA, 15 bp, Homo sapiens
tgaaaaagaaagatg

SEQ ID NO: 460007 - DNA, 15 bp, Homo sapiens
gaaaaagaaagatgg

SEQ ID NO: 460008 - DNA, 15 bp, Homo sapiens
aaaaagaaagatggc

SEQ ID NO: 460009 - DNA, 15 bp, Homo sapiens
aaaagaaagatggca

SEQ ID NO: 460010 - DNA, 15 bp, Homo sapiens
aaagaaagatggcaa

SEQ ID NO: 460011 - DNA, 15 bp, Homo sapiens
aagaaagatggcaaa

SEQ ID NO: 460012 - DNA, 15 bp, Homo sapiens
agaaagatggcaaag

SEQ ID NO: 460013 - DNA, 15 bp, Homo sapiens
gaaagatggcaaaga

SEQ ID NO: 460014 - DNA, 15 bp, Homo sapiens
aaagatggcaaagac

SEQ ID NO: 460015 - DNA, 15 bp, Homo sapiens
aagatggcaaagacc

SEQ ID NO: 460016 - DNA, 15 bp, Homo sapiens
agatggcaaagacca

SEQ ID NO: 460017 - DNA, 15 bp, Homo sapiens
gatggcaaagaccat

SEQ ID NO: 460018 - DNA, 15 bp, Homo sapiens
atggcaaagaccatg

SEQ ID NO: 460019 - DNA, 15 bp, Homo sapiens
tggcaaagaccatgc

SEQ ID NO: 460020 - DNA, 15 bp, Homo sapiens
ggcaaagaccatgct

SEQ ID NO: 460021 - DNA, 15 bp, Homo sapiens
gcaaagaccatgctg

SEQ ID NO: 460022 - DNA, 15 bp, Homo sapiens
caaagaccatgctgg

SEQ ID NO: 460023 - DNA, 15 bp, Homo sapiens
aaagaccatgctgga

SEQ ID NO: 460024 - DNA, 15 bp, Homo sapiens
aagaccatgctggat

SEQ ID NO: 460025 - DNA, 15 bp, Homo sapiens
agaccatgctggatc

SEQ ID NO: 460026 - DNA, 15 bp, Homo sapiens
gaccatgctggatca

SEQ ID NO: 460027 - DNA, 15 bp, Homo sapiens
accatgctggatcag

SEQ ID NO: 460028 - DNA, 15 bp, Homo sapiens
ccatgctggatcaga

SEQ ID NO: 460029 - DNA, 15 bp, Homo sapiens
catgctggatcagaa

SEQ ID NO: 460030 - DNA, 15 bp, Homo sapiens
atgctggatcagaat

SEQ ID NO: 460031 - DNA, 15 bp, Homo sapiens
tgctggatcagaatg

SEQ ID NO: 460032 - DNA, 15 bp, Homo sapiens
gctggatcagaatgg

SEQ ID NO: 460033 - DNA, 15 bp, Homo sapiens
ctggatcagaatggt

SEQ ID NO: 460034 - DNA, 15 bp, Homo sapiens
tggatcagaatggtg

SEQ ID NO: 460035 - DNA, 15 bp, Homo sapiens
ggatcagaatggtgc

SEQ ID NO: 460036 - DNA, 15 bp, Homo sapiens
gatcagaatggtgcc

SEQ ID NO: 460037 - DNA, 15 bp, Homo sapiens
atcagaatggtgccc

SEQ ID NO: 460038 - DNA, 15 bp, Homo sapiens
tcagaatggtgccca

SEQ ID NO: 460039 - DNA, 15 bp, Homo sapiens
cagaatggtgcccat

SEQ ID NO: 460040 - DNA, 15 bp, Homo sapiens
agaatggtgcccatg

SEQ ID NO: 460041 - DNA, 15 bp, Homo sapiens
gaatggtgcccatgc

SEQ ID NO: 460042 - DNA, 15 bp, Homo sapiens
aatggtgcccatgca

SEQ ID NO: 460043 - DNA, 15 bp, Homo sapiens
atggtgcccatgcag

SEQ ID NO: 460044 - DNA, 15 bp, Homo sapiens
tggtgcccatgcagt

SEQ ID NO: 460045 - DNA, 15 bp, Homo sapiens
ggtgcccatgcagtg

SEQ ID NO: 460046 - DNA, 15 bp, Homo sapiens
gtgcccatgcagtgt

SEQ ID NO: 460047 - DNA, 15 bp, Homo sapiens
tgcccatgcagtgta

SEQ ID NO: 460048 - DNA, 15 bp, Homo sapiens
gcccatgcagtgtag

SEQ ID NO: 460049 - DNA, 15 bp, Homo sapiens
cccatgcagtgtagc

SEQ ID NO: 460050 - DNA, 15 bp, Homo sapiens
ccatgcagtgtagct

SEQ ID NO: 460051 - DNA, 15 bp, Homo sapiens
catgcagtgtagctt

SEQ ID NO: 460052 - DNA, 15 bp, Homo sapiens
atgcagtgtagcttt

SEQ ID NO: 460053 - DNA, 15 bp, Homo sapiens
tgcagtgtagctttc

SEQ ID NO: 460054 - DNA, 15 bp, Homo sapiens
gcagtgtagctttct

SEQ ID NO: 460055 - DNA, 15 bp, Homo sapiens
cagtgtagctttcta

SEQ ID NO: 460056 - DNA, 15 bp, Homo sapiens
agtgtagctttctat

SEQ ID NO: 460057 - DNA, 15 bp, Homo sapiens
gtgtagctttctatc

SEQ ID NO: 460058 - DNA, 15 bp, Homo sapiens
tgtagctttctatct

SEQ ID NO: 460059 - DNA, 15 bp, Homo sapiens
gtagctttctatctt

SEQ ID NO: 460060 - DNA, 15 bp, Homo sapiens
tagctttctatcttg

SEQ ID NO: 460061 - DNA, 15 bp, Homo sapiens
agctttctatcttgg

SEQ ID NO: 460062 - DNA, 15 bp, Homo sapiens
gctttctatcttgga

SEQ ID NO: 460063 - DNA, 15 bp, Homo sapiens
ctttctatcttggag

SEQ ID NO: 460064 - DNA, 15 bp, Homo sapiens
tttctatcttggaga

SEQ ID NO: 460065 - DNA, 15 bp, Homo sapiens
ttctatcttggagag

SEQ ID NO: 460066 - DNA, 15 bp, Homo sapiens
tctatcttggagaga

SEQ ID NO: 460067 - DNA, 15 bp, Homo sapiens
ctatcttggagagag

SEQ ID NO: 460068 - DNA, 15 bp, Homo sapiens
tatcttggagagagt

SEQ ID NO: 460069 - DNA, 15 bp, Homo sapiens
atcttggagagagta

SEQ ID NO: 460070 - DNA, 15 bp, Homo sapiens
tcttggagagagtat

SEQ ID NO: 460071 - DNA, 15 bp, Homo sapiens
cttggagagagtatt

SEQ ID NO: 460072 - DNA, 15 bp, Homo sapiens
ttggagagagtattg

SEQ ID NO: 460073 - DNA, 15 bp, Homo sapiens
tggagagagtattgg

SEQ ID NO: 460074 - DNA, 15 bp, Homo sapiens
ggagagagtattggg

SEQ ID NO: 460075 - DNA, 15 bp, Homo sapiens
gagagagtattgggg

SEQ ID NO: 460076 - DNA, 15 bp, Homo sapiens
agagagtattgggga

SEQ ID NO: 460077 - DNA, 15 bp, Homo sapiens
gagagtattggggat

SEQ ID NO: 460078 - DNA, 15 bp, Homo sapiens
agagtattggggatt

SEQ ID NO: 460079 - DNA, 15 bp, Homo sapiens
gagtattggggatta

SEQ ID NO: 460080 - DNA, 15 bp, Homo sapiens
agtattggggattaa

SEQ ID NO: 460081 - DNA, 15 bp, Homo sapiens
gtattggggattaat

SEQ ID NO: 460082 - DNA, 15 bp, Homo sapiens
tattggggattaatc

SEQ ID NO: 460083 - DNA, 15 bp, Homo sapiens
attggggattaatct

SEQ ID NO: 460084 - DNA, 15 bp, Homo sapiens
ttggggattaatcta

SEQ ID NO: 460085 - DNA, 15 bp, Homo sapiens
tggggattaatctat

SEQ ID NO: 460086 - DNA, 15 bp, Homo sapiens
ggggattaatctatg

SEQ ID NO: 460087 - DNA, 15 bp, Homo sapiens
gggattaatctatgg

SEQ ID NO: 460088 - DNA, 15 bp, Homo sapiens
ggattaatctatgga

SEQ ID NO: 460089 - DNA, 15 bp, Homo sapiens
gattaatctatggaa

SEQ ID NO: 460090 - DNA, 15 bp, Homo sapiens
attaatctatggaaa

SEQ ID NO: 460091 - DNA, 15 bp, Homo sapiens
ttaatctatggaaaa

SEQ ID NO: 460092 - DNA, 15 bp, Homo sapiens
taatctatggaaaaa

SEQ ID NO: 460093 - DNA, 15 bp, Homo sapiens
aatctatggaaaaaa

SEQ ID NO: 460094 - DNA, 15 bp, Homo sapiens
atctatggaaaaaac

SEQ ID NO: 460095 - DNA, 15 bp, Homo sapiens
tctatggaaaaaaca

SEQ ID NO: 460096 - DNA, 15 bp, Homo sapiens
ctatggaaaaaacag

SEQ ID NO: 460097 - DNA, 15 bp, Homo sapiens
tatggaaaaaacagt

SEQ ID NO: 460098 - DNA, 15 bp, Homo sapiens
atggaaaaaacagtt

SEQ ID NO: 460099 - DNA, 15 bp, Homo sapiens
tggaaaaaacagtta

SEQ ID NO: 460100 - DNA, 15 bp, Homo sapiens
ggaaaaaacagttat

SEQ ID NO: 460101 - DNA, 15 bp, Homo sapiens
gaaaaaacagttatt

SEQ ID NO: 460102 - DNA, 15 bp, Homo sapiens
aaaaaacagttattc

SEQ ID NO: 460103 - DNA, 15 bp, Homo sapiens
aaaaacagttattct

SEQ ID NO: 460104 - DNA, 15 bp, Homo sapiens
aaaacagttattctt

SEQ ID NO: 460105 - DNA, 15 bp, Homo sapiens
aaacagttattctta

SEQ ID NO: 460106 - DNA, 15 bp, Homo sapiens
aacagttattcttat

SEQ ID NO: 460107 - DNA, 15 bp, Homo sapiens
acagttattcttatg

SEQ ID NO: 460108 - DNA, 15 bp, Homo sapiens
cagttattcttatga

SEQ ID NO: 460109 - DNA, 15 bp, Homo sapiens
agttattcttatgac

SEQ ID NO: 460110 - DNA, 15 bp, Homo sapiens
gttattcttatgaca

SEQ ID NO: 460111 - DNA, 15 bp, Homo sapiens
ttattcttatgacag

SEQ ID NO: 460112 - DNA, 15 bp, Homo sapiens
tattcttatgacagt

SEQ ID NO: 460113 - DNA, 15 bp, Homo sapiens
attcttatgacagta

SEQ ID NO: 460114 - DNA, 15 bp, Homo sapiens
ttcttatgacagtaa

SEQ ID NO: 460115 - DNA, 15 bp, Homo sapiens
tcttatgacagtaat

SEQ ID NO: 460116 - DNA, 15 bp, Homo sapiens
cttatgacagtaatg

SEQ ID NO: 460117 - DNA, 15 bp, Homo sapiens
ttatgacagtaatgt

SEQ ID NO: 460118 - DNA, 15 bp, Homo sapiens
tatgacagtaatgtc

SEQ ID NO: 460119 - DNA, 15 bp, Homo sapiens
atgacagtaatgtca

SEQ ID NO: 460120 - DNA, 15 bp, Homo sapiens
tgacagtaatgtcag

SEQ ID NO: 460121 - DNA, 15 bp, Homo sapiens
gacagtaatgtcaga

SEQ ID NO: 460122 - DNA, 15 bp, Homo sapiens
acagtaatgtcagac

SEQ ID NO: 460123 - DNA, 15 bp, Homo sapiens
cagtaatgtcagacg

SEQ ID NO: 460124 - DNA, 15 bp, Homo sapiens
agtaatgtcagacgg

SEQ ID NO: 460125 - DNA, 15 bp, Homo sapiens
gtaatgtcagacggc

SEQ ID NO: 460126 - DNA, 15 bp, Homo sapiens
taatgtcagacggcc

SEQ ID NO: 460127 - DNA, 15 bp, Homo sapiens
aatgtcagacggcca

SEQ ID NO: 460128 - DNA, 15 bp, Homo sapiens
atgtcagacggccag

SEQ ID NO: 460129 - DNA, 15 bp, Homo sapiens
tgtcagacggccaga

SEQ ID NO: 460130 - DNA, 15 bp, Homo sapiens
gtcagacggccagag

SEQ ID NO: 460131 - DNA, 15 bp, Homo sapiens
tcagacggccagagc

SEQ ID NO: 460132 - DNA, 15 bp, Homo sapiens
cagacggccagagct

SEQ ID NO: 460133 - DNA, 15 bp, Homo sapiens
agacggccagagctg

SEQ ID NO: 460134 - DNA, 15 bp, Homo sapiens
gacggccagagctgg

SEQ ID NO: 460135 - DNA, 15 bp, Homo sapiens
acggccagagctggt

SEQ ID NO: 460136 - DNA, 15 bp, Homo sapiens
cggccagagctggtt

SEQ ID NO: 460137 - DNA, 15 bp, Homo sapiens
ggccagagctggttg

SEQ ID NO: 460138 - DNA, 15 bp, Homo sapiens
gccagagctggttgc

SEQ ID NO: 460139 - DNA, 15 bp, Homo sapiens
ccagagctggttgcc

SEQ ID NO: 460140 - DNA, 15 bp, Homo sapiens
cagagctggttgccc

SEQ ID NO: 460141 - DNA, 15 bp, Homo sapiens
agagctggttgccca

SEQ ID NO: 460142 - DNA, 15 bp, Homo sapiens
gagctggttgcccag

SEQ ID NO: 460143 - DNA, 15 bp, Homo sapiens
agctggttgcccagg

SEQ ID NO: 460144 - DNA, 15 bp, Homo sapiens
gctggttgcccaggt

SEQ ID NO: 460145 - DNA, 15 bp, Homo sapiens
ctggttgcccaggtt

SEQ ID NO: 460146 - DNA, 15 bp, Homo sapiens
tggttgcccaggttt

SEQ ID NO: 460147 - DNA, 15 bp, Homo sapiens
ggttgcccaggtttc

SEQ ID NO: 460148 - DNA, 15 bp, Homo sapiens
gttgcccaggtttct

SEQ ID NO: 460149 - DNA, 15 bp, Homo sapiens
ttgcccaggtttctc

SEQ ID NO: 460150 - DNA, 15 bp, Homo sapiens
tgcccaggtttctct

SEQ ID NO: 460151 - DNA, 15 bp, Homo sapiens
gcccaggtttctcta

SEQ ID NO: 460152 - DNA, 15 bp, Homo sapiens
cccaggtttctctaa

SEQ ID NO: 460153 - DNA, 15 bp, Homo sapiens
ccaggtttctctaac

SEQ ID NO: 460154 - DNA, 15 bp, Homo sapiens
caggtttctctaaca

SEQ ID NO: 460155 - DNA, 15 bp, Homo sapiens
aggtttctctaacaa

SEQ ID NO: 460156 - DNA, 15 bp, Homo sapiens
ggtttctctaacaac

SEQ ID NO: 460157 - DNA, 15 bp, Homo sapiens
gtttctctaacaacc

SEQ ID NO: 460158 - DNA, 15 bp, Homo sapiens
tttctctaacaacca

SEQ ID NO: 460159 - DNA, 15 bp, Homo sapiens
ttctctaacaaccat

SEQ ID NO: 460160 - DNA, 15 bp, Homo sapiens
tctctaacaaccatg

SEQ ID NO: 460161 - DNA, 15 bp, Homo sapiens
ctctaacaaccatga

SEQ ID NO: 460162 - DNA, 15 bp, Homo sapiens
tctaacaaccatgat

SEQ ID NO: 460163 - DNA, 15 bp, Homo sapiens
ctaacaaccatgatt

SEQ ID NO: 460164 - DNA, 15 bp, Homo sapiens
taacaaccatgattt

SEQ ID NO: 460165 - DNA, 15 bp, Homo sapiens
aacaaccatgattta

SEQ ID NO: 460166 - DNA, 15 bp, Homo sapiens
acaaccatgatttat

SEQ ID NO: 460167 - DNA, 15 bp, Homo sapiens
caaccatgatttatt

SEQ ID NO: 460168 - DNA, 15 bp, Homo sapiens
aaccatgatttattt

SEQ ID NO: 460169 - DNA, 15 bp, Homo sapiens
accatgatttattta

SEQ ID NO: 460170 - DNA, 15 bp, Homo sapiens
ccatgatttatttat

SEQ ID NO: 460171 - DNA, 15 bp, Homo sapiens
catgatttatttatt

SEQ ID NO: 460172 - DNA, 15 bp, Homo sapiens
atgatttatttatta

SEQ ID NO: 460173 - DNA, 15 bp, Homo sapiens
tgatttatttattaa

SEQ ID NO: 460174 - DNA, 15 bp, Homo sapiens
gatttatttattaat

SEQ ID NO: 460175 - DNA, 15 bp, Homo sapiens
atttatttattaatc

SEQ ID NO: 460176 - DNA, 15 bp, Homo sapiens
tttatttattaatct

SEQ ID NO: 460177 - DNA, 15 bp, Homo sapiens
ttatttattaatcta

SEQ ID NO: 460178 - DNA, 15 bp, Homo sapiens
tatttattaatctaa

SEQ ID NO: 460179 - DNA, 15 bp, Homo sapiens
atttattaatctaaa

SEQ ID NO: 460180 - DNA, 15 bp, Homo sapiens
tttattaatctaaat

SEQ ID NO: 460181 - DNA, 15 bp, Homo sapiens
ttattaatctaaata

SEQ ID NO: 460182 - DNA, 15 bp, Homo sapiens
tattaatctaaataa

SEQ ID NO: 460183 - DNA, 15 bp, Homo sapiens
attaatctaaataat

SEQ ID NO: 460184 - DNA, 15 bp, Homo sapiens
ttaatctaaataata

SEQ ID NO: 460185 - DNA, 15 bp, Homo sapiens
taatctaaataatag

SEQ ID NO: 460186 - DNA, 15 bp, Homo sapiens
aatctaaataatagt

SEQ ID NO: 460187 - DNA, 15 bp, Homo sapiens
atctaaataatagtt

SEQ ID NO: 460188 - DNA, 15 bp, Homo sapiens
tctaaataatagtta

SEQ ID NO: 460189 - DNA, 15 bp, Homo sapiens
ctaaataatagttat

SEQ ID NO: 460190 - DNA, 15 bp, Homo sapiens
taaataatagttatt

SEQ ID NO: 460191 - DNA, 15 bp, Homo sapiens
aaataatagttatta

SEQ ID NO: 460192 - DNA, 15 bp, Homo sapiens
aataatagttattaa

SEQ ID NO: 460193 - DNA, 15 bp, Homo sapiens
ataatagttattaac

SEQ ID NO: 460194 - DNA, 15 bp, Homo sapiens
taatagttattaact

SEQ ID NO: 460195 - DNA, 15 bp, Homo sapiens
aatagttattaactc

SEQ ID NO: 460196 - DNA, 15 bp, Homo sapiens
atagttattaactct

SEQ ID NO: 460197 - DNA, 15 bp, Homo sapiens
tagttattaactctt

SEQ ID NO: 460198 - DNA, 15 bp, Homo sapiens
agttattaactcttt

SEQ ID NO: 460199 - DNA, 15 bp, Homo sapiens
gttattaactctttt

SEQ ID NO: 460200 - DNA, 15 bp, Homo sapiens
ttattaactcttttc

SEQ ID NO: 460201 - DNA, 15 bp, Homo sapiens
tattaactcttttca

SEQ ID NO: 460202 - DNA, 15 bp, Homo sapiens
attaactcttttcaa

SEQ ID NO: 460203 - DNA, 15 bp, Homo sapiens
ttaactcttttcaac

SEQ ID NO: 460204 - DNA, 15 bp, Homo sapiens
taactcttttcaacc

SEQ ID NO: 460205 - DNA, 15 bp, Homo sapiens
aactcttttcaacca

SEQ ID NO: 460206 - DNA, 15 bp, Homo sapiens
actcttttcaaccaa

SEQ ID NO: 460207 - DNA, 15 bp, Homo sapiens
ctcttttcaaccaat

SEQ ID NO: 460208 - DNA, 15 bp, Homo sapiens
tcttttcaaccaata

SEQ ID NO: 460209 - DNA, 15 bp, Homo sapiens
cttttcaaccaataa

SEQ ID NO: 460210 - DNA, 15 bp, Homo sapiens
ttttcaaccaataat

SEQ ID NO: 460211 - DNA, 15 bp, Homo sapiens
tttcaaccaataatt

SEQ ID NO: 460212 - DNA, 15 bp, Homo sapiens
ttcaaccaataattt

SEQ ID NO: 460213 - DNA, 15 bp, Homo sapiens
tcaaccaataatttt

SEQ ID NO: 460214 - DNA, 15 bp, Homo sapiens
caaccaataattttc

SEQ ID NO: 460215 - DNA, 15 bp, Homo sapiens
aaccaataattttct

SEQ ID NO: 460216 - DNA, 15 bp, Homo sapiens
accaataattttctt

SEQ ID NO: 460217 - DNA, 15 bp, Homo sapiens
ccaataattttcttt

SEQ ID NO: 460218 - DNA, 15 bp, Homo sapiens
caataattttctttg

SEQ ID NO: 460219 - DNA, 15 bp, Homo sapiens
aataattttctttga

SEQ ID NO: 460220 - DNA, 15 bp, Homo sapiens
ataattttctttgag

SEQ ID NO: 460221 - DNA, 15 bp, Homo sapiens
taattttctttgaga

SEQ ID NO: 460222 - DNA, 15 bp, Homo sapiens
aattttctttgagaa

SEQ ID NO: 460223 - DNA, 15 bp, Homo sapiens
attttctttgagaat

SEQ ID NO: 460224 - DNA, 15 bp, Homo sapiens
ttttctttgagaatc

SEQ ID NO: 460225 - DNA, 15 bp, Homo sapiens
tttctttgagaatca

SEQ ID NO: 460226 - DNA, 15 bp, Homo sapiens
ttctttgagaatcag

SEQ ID NO: 460227 - DNA, 15 bp, Homo sapiens
tctttgagaatcaga

SEQ ID NO: 460228 - DNA, 15 bp, Homo sapiens
ctttgagaatcagat

SEQ ID NO: 460229 - DNA, 15 bp, Homo sapiens
tttgagaatcagata

SEQ ID NO: 460230 - DNA, 15 bp, Homo sapiens
ttgagaatcagatag

SEQ ID NO: 460231 - DNA, 15 bp, Homo sapiens
tgagaatcagataga

SEQ ID NO: 460232 - DNA, 15 bp, Homo sapiens
gagaatcagatagaa

SEQ ID NO: 460233 - DNA, 15 bp, Homo sapiens
agaatcagatagaaa

SEQ ID NO: 460234 - DNA, 15 bp, Homo sapiens
gaatcagatagaaat

SEQ ID NO: 460235 - DNA, 15 bp, Homo sapiens
aatcagatagaaatt

SEQ ID NO: 460236 - DNA, 15 bp, Homo sapiens
atcagatagaaatta

SEQ ID NO: 460237 - DNA, 15 bp, Homo sapiens
tcagatagaaattac

SEQ ID NO: 460238 - DNA, 15 bp, Homo sapiens
cagatagaaattact

SEQ ID NO: 460239 - DNA, 15 bp, Homo sapiens
agatagaaattacta

SEQ ID NO: 460240 - DNA, 15 bp, Homo sapiens
gatagaaattactat

SEQ ID NO: 460241 - DNA, 15 bp, Homo sapiens
atagaaattactatc

SEQ ID NO: 460242 - DNA, 15 bp, Homo sapiens
tagaaattactatct

SEQ ID NO: 460243 - DNA, 15 bp, Homo sapiens
agaaattactatcta

SEQ ID NO: 460244 - DNA, 15 bp, Homo sapiens
gaaattactatctac

SEQ ID NO: 460245 - DNA, 15 bp, Homo sapiens
aaattactatctacc

SEQ ID NO: 460246 - DNA, 15 bp, Homo sapiens
aattactatctaccc

SEQ ID NO: 460247 - DNA, 15 bp, Homo sapiens
attactatctaccct

SEQ ID NO: 460248 - DNA, 15 bp, Homo sapiens
ttactatctaccctc

SEQ ID NO: 460249 - DNA, 15 bp, Homo sapiens
tactatctaccctcc

SEQ ID NO: 460250 - DNA, 15 bp, Homo sapiens
actatctaccctcca

SEQ ID NO: 460251 - DNA, 15 bp, Homo sapiens
ctatctaccctccaa

SEQ ID NO: 460252 - DNA, 15 bp, Homo sapiens
tatctaccctccaat

SEQ ID NO: 460253 - DNA, 15 bp, Homo sapiens
atctaccctccaatt

SEQ ID NO: 460254 - DNA, 15 bp, Homo sapiens
tctaccctccaatta

SEQ ID NO: 460255 - DNA, 15 bp, Homo sapiens
ctaccctccaattag

SEQ ID NO: 460256 - DNA, 15 bp, Homo sapiens
taccctccaattagg

SEQ ID NO: 460257 - DNA, 15 bp, Homo sapiens
accctccaattagga

SEQ ID NO: 460258 - DNA, 15 bp, Homo sapiens
ccctccaattaggac

SEQ ID NO: 460259 - DNA, 15 bp, Homo sapiens
cctccaattaggaca

SEQ ID NO: 460260 - DNA, 15 bp, Homo sapiens
ctccaattaggacat

SEQ ID NO: 460261 - DNA, 15 bp, Homo sapiens
tccaattaggacatt

SEQ ID NO: 460262 - DNA, 15 bp, Homo sapiens
ccaattaggacatta

SEQ ID NO: 460263 - DNA, 15 bp, Homo sapiens
caattaggacattac

SEQ ID NO: 460264 - DNA, 15 bp, Homo sapiens
aattaggacattaca

SEQ ID NO: 460265 - DNA, 15 bp, Homo sapiens
attaggacattacag

SEQ ID NO: 460266 - DNA, 15 bp, Homo sapiens
ttaggacattacaga

SEQ ID NO: 460267 - DNA, 15 bp, Homo sapiens
taggacattacagac

SEQ ID NO: 460268 - DNA, 15 bp, Homo sapiens
aggacattacagact

SEQ ID NO: 460269 - DNA, 15 bp, Homo sapiens
ggacattacagactc

SEQ ID NO: 460270 - DNA, 15 bp, Homo sapiens
gacattacagactca

SEQ ID NO: 460271 - DNA, 15 bp, Homo sapiens
acattacagactcat

SEQ ID NO: 460272 - DNA, 15 bp, Homo sapiens
cattacagactcata

SEQ ID NO: 460273 - DNA, 15 bp, Homo sapiens
attacagactcatac

SEQ ID NO: 460274 - DNA, 15 bp, Homo sapiens
ttacagactcataca

SEQ ID NO: 460275 - DNA, 15 bp, Homo sapiens
tacagactcatacat

SEQ ID NO: 460276 - DNA, 15 bp, Homo sapiens
acagactcatacatc

SEQ ID NO: 460277 - DNA, 15 bp, Homo sapiens
cagactcatacatct

SEQ ID NO: 460278 - DNA, 15 bp, Homo sapiens
agactcatacatctg

SEQ ID NO: 460279 - DNA, 15 bp, Homo sapiens
gactcatacatctgt

SEQ ID NO: 460280 - DNA, 15 bp, Homo sapiens
actcatacatctgtg

SEQ ID NO: 460281 - DNA, 15 bp, Homo sapiens
ctcatacatctgtga

SEQ ID NO: 460282 - DNA, 15 bp, Homo sapiens
tcatacatctgtgaa

SEQ ID NO: 460283 - DNA, 15 bp, Homo sapiens
catacatctgtgaat

SEQ ID NO: 460284 - DNA, 15 bp, Homo sapiens
atacatctgtgaatc

SEQ ID NO: 460285 - DNA, 15 bp, Homo sapiens
tacatctgtgaatct

SEQ ID NO: 460286 - DNA, 15 bp, Homo sapiens
acatctgtgaatctg

SEQ ID NO: 460287 - DNA, 15 bp, Homo sapiens
catctgtgaatctga

SEQ ID NO: 460288 - DNA, 15 bp, Homo sapiens
atctgtgaatctgag

SEQ ID NO: 460289 - DNA, 15 bp, Homo sapiens
tctgtgaatctgagg

SEQ ID NO: 460290 - DNA, 15 bp, Homo sapiens
ctgtgaatctgagga

SEQ ID NO: 460291 - DNA, 15 bp, Homo sapiens
tgtgaatctgaggaa

SEQ ID NO: 460292 - DNA, 15 bp, Homo sapiens
gtgaatctgaggaat

SEQ ID NO: 460293 - DNA, 15 bp, Homo sapiens
tgaatctgaggaatg

SEQ ID NO: 460294 - DNA, 15 bp, Homo sapiens
gaatctgaggaatgg

SEQ ID NO: 460295 - DNA, 15 bp, Homo sapiens
aatctgaggaatggt

SEQ ID NO: 460296 - DNA, 15 bp, Homo sapiens
atctgaggaatggta

SEQ ID NO: 460297 - DNA, 15 bp, Homo sapiens
tctgaggaatggtac

SEQ ID NO: 460298 - DNA, 15 bp, Homo sapiens
ctgaggaatggtacc

SEQ ID NO: 460299 - DNA, 15 bp, Homo sapiens
tgaggaatggtacct

SEQ ID NO: 460300 - DNA, 15 bp, Homo sapiens
gaggaatggtacctt

SEQ ID NO: 460301 - DNA, 15 bp, Homo sapiens
aggaatggtaccttg

SEQ ID NO: 460302 - DNA, 15 bp, Homo sapiens
ggaatggtaccttgt

SEQ ID NO: 460303 - DNA, 15 bp, Homo sapiens
gaatggtaccttgtt

SEQ ID NO: 460304 - DNA, 15 bp, Homo sapiens
aatggtaccttgttc

SEQ ID NO: 460305 - DNA, 15 bp, Homo sapiens
atggtaccttgttct

SEQ ID NO: 460306 - DNA, 15 bp, Homo sapiens
tggtaccttgttcta

SEQ ID NO: 460307 - DNA, 15 bp, Homo sapiens
ggtaccttgttctaa

SEQ ID NO: 460308 - DNA, 15 bp, Homo sapiens
gtaccttgttctaac

SEQ ID NO: 460309 - DNA, 15 bp, Homo sapiens
taccttgttctaaca

SEQ ID NO: 460310 - DNA, 15 bp, Homo sapiens
accttgttctaacac

SEQ ID NO: 460311 - DNA, 15 bp, Homo sapiens
ccttgttctaacact

SEQ ID NO: 460312 - DNA, 15 bp, Homo sapiens
cttgttctaacactt

SEQ ID NO: 460313 - DNA, 15 bp, Homo sapiens
ttgttctaacacttc

SEQ ID NO: 460314 - DNA, 15 bp, Homo sapiens
tgttctaacacttct

SEQ ID NO: 460315 - DNA, 15 bp, Homo sapiens
gttctaacacttcta

SEQ ID NO: 460316 - DNA, 15 bp, Homo sapiens
ttctaacacttctat

SEQ ID NO: 460317 - DNA, 15 bp, Homo sapiens
tctaacacttctatt

SEQ ID NO: 460318 - DNA, 15 bp, Homo sapiens
ctaacacttctattc

SEQ ID NO: 460319 - DNA, 15 bp, Homo sapiens
taacacttctattca

SEQ ID NO: 460320 - DNA, 15 bp, Homo sapiens
aacacttctattcat

SEQ ID NO: 460321 - DNA, 15 bp, Homo sapiens
acacttctattcatt

SEQ ID NO: 460322 - DNA, 15 bp, Homo sapiens
cacttctattcattc

SEQ ID NO: 460323 - DNA, 15 bp, Homo sapiens
acttctattcattca

SEQ ID NO: 460324 - DNA, 15 bp, Homo sapiens
cttctattcattcag

SEQ ID NO: 460325 - DNA, 15 bp, Homo sapiens
ttctattcattcagc

SEQ ID NO: 460326 - DNA, 15 bp, Homo sapiens
tctattcattcagcc

SEQ ID NO: 460327 - DNA, 15 bp, Homo sapiens
ctattcattcagccg

SEQ ID NO: 460328 - DNA, 15 bp, Homo sapiens
tattcattcagccgt

SEQ ID NO: 460329 - DNA, 15 bp, Homo sapiens
attcattcagccgtc

SEQ ID NO: 460330 - DNA, 15 bp, Homo sapiens
ttcattcagccgtcc

SEQ ID NO: 460331 - DNA, 15 bp, Homo sapiens
tcattcagccgtcct

SEQ ID NO: 460332 - DNA, 15 bp, Homo sapiens
cattcagccgtcctg

SEQ ID NO: 460333 - DNA, 15 bp, Homo sapiens
attcagccgtcctga

SEQ ID NO: 460334 - DNA, 15 bp, Homo sapiens
ttcagccgtcctgac

SEQ ID NO: 460335 - DNA, 15 bp, Homo sapiens
tcagccgtcctgaca

SEQ ID NO: 460336 - DNA, 15 bp, Homo sapiens
cagccgtcctgacat

SEQ ID NO: 460337 - DNA, 15 bp, Homo sapiens
agccgtcctgacatt

SEQ ID NO: 460338 - DNA, 15 bp, Homo sapiens
gccgtcctgacattc

SEQ ID NO: 460339 - DNA, 15 bp, Homo sapiens
ccgtcctgacattca

SEQ ID NO: 460340 - DNA, 15 bp, Homo sapiens
cgtcctgacattcac

SEQ ID NO: 460341 - DNA, 15 bp, Homo sapiens
gtcctgacattcact

SEQ ID NO: 460342 - DNA, 15 bp, Homo sapiens
tcctgacattcactc

SEQ ID NO: 460343 - DNA, 15 bp, Homo sapiens
cctgacattcactca

SEQ ID NO: 460344 - DNA, 15 bp, Homo sapiens
ctgacattcactcac

SEQ ID NO: 460345 - DNA, 15 bp, Homo sapiens
tgacattcactcact

SEQ ID NO: 460346 - DNA, 15 bp, Homo sapiens
gacattcactcacta

SEQ ID NO: 460347 - DNA, 15 bp, Homo sapiens
acattcactcactaa

SEQ ID NO: 460348 - DNA, 15 bp, Homo sapiens
cattcactcactaat

SEQ ID NO: 460349 - DNA, 15 bp, Homo sapiens
attcactcactaatc

SEQ ID NO: 460350 - DNA, 15 bp, Homo sapiens
ttcactcactaatca

SEQ ID NO: 460351 - DNA, 15 bp, Homo sapiens
tcactcactaatcat

SEQ ID NO: 460352 - DNA, 15 bp, Homo sapiens
cactcactaatcata

SEQ ID NO: 460353 - DNA, 15 bp, Homo sapiens
actcactaatcatat

SEQ ID NO: 460354 - DNA, 15 bp, Homo sapiens
ctcactaatcatata

SEQ ID NO: 460355 - DNA, 15 bp, Homo sapiens
tcactaatcatatac

SEQ ID NO: 460356 - DNA, 15 bp, Homo sapiens
cactaatcatatacc

SEQ ID NO: 460357 - DNA, 15 bp, Homo sapiens
actaatcatataccc

SEQ ID NO: 460358 - DNA, 15 bp, Homo sapiens
ctaatcatatacccg

SEQ ID NO: 460359 - DNA, 15 bp, Homo sapiens
taatcatatacccgt

SEQ ID NO: 460360 - DNA, 15 bp, Homo sapiens
aatcatatacccgtg

SEQ ID NO: 460361 - DNA, 15 bp, Homo sapiens
atcatatacccgtga

SEQ ID NO: 460362 - DNA, 15 bp, Homo sapiens
tcatatacccgtgac

SEQ ID NO: 460363 - DNA, 15 bp, Homo sapiens
catatacccgtgact

SEQ ID NO: 460364 - DNA, 15 bp, Homo sapiens
atatacccgtgactg

SEQ ID NO: 460365 - DNA, 15 bp, Homo sapiens
tatacccgtgactgc

SEQ ID NO: 460366 - DNA, 15 bp, Homo sapiens
atacccgtgactgcc

SEQ ID NO: 460367 - DNA, 15 bp, Homo sapiens
tacccgtgactgcct

SEQ ID NO: 460368 - DNA, 15 bp, Homo sapiens
acccgtgactgcctt

SEQ ID NO: 460369 - DNA, 15 bp, Homo sapiens
cccgtgactgccttc

SEQ ID NO: 460370 - DNA, 15 bp, Homo sapiens
ccgtgactgccttct

SEQ ID NO: 460371 - DNA, 15 bp, Homo sapiens
cgtgactgccttctt

SEQ ID NO: 460372 - DNA, 15 bp, Homo sapiens
gtgactgccttcttt

SEQ ID NO: 460373 - DNA, 15 bp, Homo sapiens
tgactgccttctttc

SEQ ID NO: 460374 - DNA, 15 bp, Homo sapiens
gactgccttctttcc

SEQ ID NO: 460375 - DNA, 15 bp, Homo sapiens
actgccttctttcct

SEQ ID NO: 460376 - DNA, 15 bp, Homo sapiens
ctgccttctttcctg

SEQ ID NO: 460377 - DNA, 15 bp, Homo sapiens
tgccttctttcctgg

SEQ ID NO: 460378 - DNA, 15 bp, Homo sapiens
gccttctttcctggc

SEQ ID NO: 460379 - DNA, 15 bp, Homo sapiens
ccttctttcctggca

SEQ ID NO: 460380 - DNA, 15 bp, Homo sapiens
cttctttcctggcat

SEQ ID NO: 460381 - DNA, 15 bp, Homo sapiens
ttctttcctggcatg

SEQ ID NO: 460382 - DNA, 15 bp, Homo sapiens
tctttcctggcatgt

SEQ ID NO: 460383 - DNA, 15 bp, Homo sapiens
ctttcctggcatgtg

SEQ ID NO: 460384 - DNA, 15 bp, Homo sapiens
tttcctggcatgtga

SEQ ID NO: 460385 - DNA, 15 bp, Homo sapiens
ttcctggcatgtgat

SEQ ID NO: 460386 - DNA, 15 bp, Homo sapiens
tcctggcatgtgata

SEQ ID NO: 460387 - DNA, 15 bp, Homo sapiens
cctggcatgtgatac

SEQ ID NO: 460388 - DNA, 15 bp, Homo sapiens
ctggcatgtgataca

SEQ ID NO: 460389 - DNA, 15 bp, Homo sapiens
tggcatgtgatacag

SEQ ID NO: 460390 - DNA, 15 bp, Homo sapiens
ggcatgtgatacagc

SEQ ID NO: 460391 - DNA, 15 bp, Homo sapiens
gcatgtgatacagcc

SEQ ID NO: 460392 - DNA, 15 bp, Homo sapiens
catgtgatacagcca

SEQ ID NO: 460393 - DNA, 15 bp, Homo sapiens
atgtgatacagccag

SEQ ID NO: 460394 - DNA, 15 bp, Homo sapiens
tgtgatacagccaga

SEQ ID NO: 460395 - DNA, 15 bp, Homo sapiens
gtgatacagccagaa

SEQ ID NO: 460396 - DNA, 15 bp, Homo sapiens
tgatacagccagaac

SEQ ID NO: 460397 - DNA, 15 bp, Homo sapiens
gatacagccagaact

SEQ ID NO: 460398 - DNA, 15 bp, Homo sapiens
atacagccagaactg

SEQ ID NO: 460399 - DNA, 15 bp, Homo sapiens
tacagccagaactgg

SEQ ID NO: 460400 - DNA, 15 bp, Homo sapiens
acagccagaactggt

SEQ ID NO: 460401 - DNA, 15 bp, Homo sapiens
cagccagaactggtg

SEQ ID NO: 460402 - DNA, 15 bp, Homo sapiens
agccagaactggtgt

SEQ ID NO: 460403 - DNA, 15 bp, Homo sapiens
gccagaactggtgtt

SEQ ID NO: 460404 - DNA, 15 bp, Homo sapiens
ccagaactggtgttt

SEQ ID NO: 460405 - DNA, 15 bp, Homo sapiens
cagaactggtgtttt

SEQ ID NO: 460406 - DNA, 15 bp, Homo sapiens
agaactggtgttttc

SEQ ID NO: 460407 - DNA, 15 bp, Homo sapiens
gaactggtgttttca

SEQ ID NO: 460408 - DNA, 15 bp, Homo sapiens
aactggtgttttcag

SEQ ID NO: 460409 - DNA, 15 bp, Homo sapiens
actggtgttttcagc

SEQ ID NO: 460410 - DNA, 15 bp, Homo sapiens
ctggtgttttcagct

SEQ ID NO: 460411 - DNA, 15 bp, Homo sapiens
tggtgttttcagctt

SEQ ID NO: 460412 - DNA, 15 bp, Homo sapiens
ggtgttttcagcttc

SEQ ID NO: 460413 - DNA, 15 bp, Homo sapiens
tgttttcagcttcag

SEQ ID NO: 460414 - DNA, 15 bp, Homo sapiens
gttttcagcttcagc

SEQ ID NO: 460415 - DNA, 15 bp, Homo sapiens
ttttcagcttcagcc

SEQ ID NO: 460416 - DNA, 15 bp, Homo sapiens
tttcagcttcagcca

SEQ ID NO: 460417 - DNA, 15 bp, Homo sapiens
ttcagcttcagccag

SEQ ID NO: 460418 - DNA, 15 bp, Homo sapiens
tcagcttcagccagc

SEQ ID NO: 460419 - DNA, 15 bp, Homo sapiens
cagcttcagccagct

SEQ ID NO: 460420 - DNA, 15 bp, Homo sapiens
agcttcagccagctc

SEQ ID NO: 460421 - DNA, 15 bp, Homo sapiens
gcttcagccagctct

SEQ ID NO: 460422 - DNA, 15 bp, Homo sapiens
cttcagccagctctt

SEQ ID NO: 460423 - DNA, 15 bp, Homo sapiens
ttcagccagctcttg

SEQ ID NO: 460424 - DNA, 15 bp, Homo sapiens
tcagccagctcttga

SEQ ID NO: 460425 - DNA, 15 bp, Homo sapiens
cagccagctcttgat

SEQ ID NO: 460426 - DNA, 15 bp, Homo sapiens
agccagctcttgata

SEQ ID NO: 460427 - DNA, 15 bp, Homo sapiens
gccagctcttgataa

SEQ ID NO: 460428 - DNA, 15 bp, Homo sapiens
ccagctcttgataat

SEQ ID NO: 460429 - DNA, 15 bp, Homo sapiens
cagctcttgataatg

SEQ ID NO: 460430 - DNA, 15 bp, Homo sapiens
agctcttgataatga

SEQ ID NO: 460431 - DNA, 15 bp, Homo sapiens
gctcttgataatgag

SEQ ID NO: 460432 - DNA, 15 bp, Homo sapiens
ctcttgataatgagt

SEQ ID NO: 460433 - DNA, 15 bp, Homo sapiens
tcttgataatgagtg

SEQ ID NO: 460434 - DNA, 15 bp, Homo sapiens
cttgataatgagtga

SEQ ID NO: 460435 - DNA, 15 bp, Homo sapiens
ttgataatgagtgat

SEQ ID NO: 460436 - DNA, 15 bp, Homo sapiens
tgataatgagtgatg

SEQ ID NO: 460437 - DNA, 15 bp, Homo sapiens
gataatgagtgatgc

SEQ ID NO: 460438 - DNA, 15 bp, Homo sapiens
ataatgagtgatgca

SEQ ID NO: 460439 - DNA, 15 bp, Homo sapiens
taatgagtgatgcac

SEQ ID NO: 460440 - DNA, 15 bp, Homo sapiens
aatgagtgatgcaca

SEQ ID NO: 460441 - DNA, 15 bp, Homo sapiens
atgagtgatgcacac

SEQ ID NO: 460442 - DNA, 15 bp, Homo sapiens
tgagtgatgcacaca

SEQ ID NO: 460443 - DNA, 15 bp, Homo sapiens
gagtgatgcacacac

SEQ ID NO: 460444 - DNA, 15 bp, Homo sapiens
agtgatgcacacaca

SEQ ID NO: 460445 - DNA, 15 bp, Homo sapiens
gtgatgcacacacag

SEQ ID NO: 460446 - DNA, 15 bp, Homo sapiens
tgatgcacacacaga

SEQ ID NO: 460447 - DNA, 15 bp, Homo sapiens
gatgcacacacagat

SEQ ID NO: 460448 - DNA, 15 bp, Homo sapiens
atgcacacacagatc

SEQ ID NO: 460449 - DNA, 15 bp, Homo sapiens
tgcacacacagatca

SEQ ID NO: 460450 - DNA, 15 bp, Homo sapiens
gcacacacagatcac

SEQ ID NO: 460451 - DNA, 15 bp, Homo sapiens
cacacacagatcaca

SEQ ID NO: 460452 - DNA, 15 bp, Homo sapiens
acacacagatcacag

SEQ ID NO: 460453 - DNA, 15 bp, Homo sapiens
cacacagatcacaga

SEQ ID NO: 460454 - DNA, 15 bp, Homo sapiens
acacagatcacagaa

SEQ ID NO: 460455 - DNA, 15 bp, Homo sapiens
cacagatcacagaat

SEQ ID NO: 460456 - DNA, 15 bp, Homo sapiens
acagatcacagaatt

SEQ ID NO: 460457 - DNA, 15 bp, Homo sapiens
cagatcacagaattc

SEQ ID NO: 460458 - DNA, 15 bp, Homo sapiens
agatcacagaattct

SEQ ID NO: 460459 - DNA, 15 bp, Homo sapiens
gatcacagaattctc

SEQ ID NO: 460460 - DNA, 15 bp, Homo sapiens
atcacagaattctca

SEQ ID NO: 460461 - DNA, 15 bp, Homo sapiens
tcacagaattctcaa

SEQ ID NO: 460462 - DNA, 15 bp, Homo sapiens
cacagaattctcaaa

SEQ ID NO: 460463 - DNA, 15 bp, Homo sapiens
acagaattctcaaag

SEQ ID NO: 460464 - DNA, 15 bp, Homo sapiens
cagaattctcaaagt

SEQ ID NO: 460465 - DNA, 15 bp, Homo sapiens
agaattctcaaagta

SEQ ID NO: 460466 - DNA, 15 bp, Homo sapiens
gaattctcaaagtag

SEQ ID NO: 460467 - DNA, 15 bp, Homo sapiens
aattctcaaagtaga

SEQ ID NO: 460468 - DNA, 15 bp, Homo sapiens
attctcaaagtagaa

SEQ ID NO: 460469 - DNA, 15 bp, Homo sapiens
ttctcaaagtagaag

SEQ ID NO: 460470 - DNA, 15 bp, Homo sapiens
tctcaaagtagaagg

SEQ ID NO: 460471 - DNA, 15 bp, Homo sapiens
ctcaaagtagaagga

SEQ ID NO: 460472 - DNA, 15 bp, Homo sapiens
tcaaagtagaaggat

SEQ ID NO: 460473 - DNA, 15 bp, Homo sapiens
caaagtagaaggatt

SEQ ID NO: 460474 - DNA, 15 bp, Homo sapiens
aaagtagaaggattt

SEQ ID NO: 460475 - DNA, 15 bp, Homo sapiens
aagtagaaggatttg

SEQ ID NO: 460476 - DNA, 15 bp, Homo sapiens
agtagaaggatttgg

SEQ ID NO: 460477 - DNA, 15 bp, Homo sapiens
gtagaaggatttggg

SEQ ID NO: 460478 - DNA, 15 bp, Homo sapiens
tagaaggatttgggg

SEQ ID NO: 460479 - DNA, 15 bp, Homo sapiens
agaaggatttgggga

SEQ ID NO: 460480 - DNA, 15 bp, Homo sapiens
gaaggatttggggat

SEQ ID NO: 460481 - DNA, 15 bp, Homo sapiens
aaggatttggggatc

SEQ ID NO: 460482 - DNA, 15 bp, Homo sapiens
aggatttggggatct

SEQ ID NO: 460483 - DNA, 15 bp, Homo sapiens
ggatttggggatctt

SEQ ID NO: 460484 - DNA, 15 bp, Homo sapiens
gatttggggatcttt

SEQ ID NO: 460485 - DNA, 15 bp, Homo sapiens
atttggggatcttta

SEQ ID NO: 460486 - DNA, 15 bp, Homo sapiens
tttggggatctttaa

SEQ ID NO: 460487 - DNA, 15 bp, Homo sapiens
ttggggatctttaat

SEQ ID NO: 460488 - DNA, 15 bp, Homo sapiens
tggggatctttaatt

SEQ ID NO: 460489 - DNA, 15 bp, Homo sapiens
ggggatctttaattc

SEQ ID NO: 460490 - DNA, 15 bp, Homo sapiens
gggatctttaattct

SEQ ID NO: 460491 - DNA, 15 bp, Homo sapiens
ggatctttaattctg

SEQ ID NO: 460492 - DNA, 15 bp, Homo sapiens
gatctttaattctgc

SEQ ID NO: 460493 - DNA, 15 bp, Homo sapiens
atctttaattctgcc

SEQ ID NO: 460494 - DNA, 15 bp, Homo sapiens
tctttaattctgccc

SEQ ID NO: 460495 - DNA, 15 bp, Homo sapiens
ctttaattctgccct

SEQ ID NO: 460496 - DNA, 15 bp, Homo sapiens
tttaattctgccctt

SEQ ID NO: 460497 - DNA, 15 bp, Homo sapiens
ttaattctgcccttt

SEQ ID NO: 460498 - DNA, 15 bp, Homo sapiens
taattctgccctttt

SEQ ID NO: 460499 - DNA, 15 bp, Homo sapiens
aattctgcccttttc

SEQ ID NO: 460500 - DNA, 15 bp, Homo sapiens
attctgcccttttct

SEQ ID NO: 460501 - DNA, 15 bp, Homo sapiens
ttctgcccttttctc

SEQ ID NO: 460502 - DNA, 15 bp, Homo sapiens
tctgcccttttctct

SEQ ID NO: 460503 - DNA, 15 bp, Homo sapiens
ctgcccttttctctt

SEQ ID NO: 460504 - DNA, 15 bp, Homo sapiens
tgcccttttctcttt

SEQ ID NO: 460505 - DNA, 15 bp, Homo sapiens
gcccttttctcttta

SEQ ID NO: 460506 - DNA, 15 bp, Homo sapiens
cccttttctctttac

SEQ ID NO: 460507 - DNA, 15 bp, Homo sapiens
ccttttctctttact

SEQ ID NO: 460508 - DNA, 15 bp, Homo sapiens
cttttctctttacta

SEQ ID NO: 460509 - DNA, 15 bp, Homo sapiens
ttttctctttactaa

SEQ ID NO: 460510 - DNA, 15 bp, Homo sapiens
tttctctttactaat

SEQ ID NO: 460511 - DNA, 15 bp, Homo sapiens
ttctctttactaatt

SEQ ID NO: 460512 - DNA, 15 bp, Homo sapiens
tctctttactaattg

SEQ ID NO: 460513 - DNA, 15 bp, Homo sapiens
ctctttactaattga

SEQ ID NO: 460514 - DNA, 15 bp, Homo sapiens
tctttactaattgaa

SEQ ID NO: 460515 - DNA, 15 bp, Homo sapiens
ctttactaattgaaa

SEQ ID NO: 460516 - DNA, 15 bp, Homo sapiens
tttactaattgaaaa

SEQ ID NO: 460517 - DNA, 15 bp, Homo sapiens
ttactaattgaaaac

SEQ ID NO: 460518 - DNA, 15 bp, Homo sapiens
tactaattgaaaacc

SEQ ID NO: 460519 - DNA, 15 bp, Homo sapiens
actaattgaaaacct

SEQ ID NO: 460520 - DNA, 15 bp, Homo sapiens
ctaattgaaaacctt

SEQ ID NO: 460521 - DNA, 15 bp, Homo sapiens
taattgaaaaccttg

SEQ ID NO: 460522 - DNA, 15 bp, Homo sapiens
aattgaaaaccttgc

SEQ ID NO: 460523 - DNA, 15 bp, Homo sapiens
attgaaaaccttgcc

SEQ ID NO: 460524 - DNA, 15 bp, Homo sapiens
ttgaaaaccttgccc

SEQ ID NO: 460525 - DNA, 15 bp, Homo sapiens
tgaaaaccttgcccg

SEQ ID NO: 460526 - DNA, 15 bp, Homo sapiens
gaaaaccttgcccgt

SEQ ID NO: 460527 - DNA, 15 bp, Homo sapiens
aaaaccttgcccgtt

SEQ ID NO: 460528 - DNA, 15 bp, Homo sapiens
aaaccttgcccgttg

SEQ ID NO: 460529 - DNA, 15 bp, Homo sapiens
aaccttgcccgttga

SEQ ID NO: 460530 - DNA, 15 bp, Homo sapiens
accttgcccgttgag

SEQ ID NO: 460531 - DNA, 15 bp, Homo sapiens
ccttgcccgttgaga

SEQ ID NO: 460532 - DNA, 15 bp, Homo sapiens
cttgcccgttgagac

SEQ ID NO: 460533 - DNA, 15 bp, Homo sapiens
ttgcccgttgagaca

SEQ ID NO: 460534 - DNA, 15 bp, Homo sapiens
tgcccgttgagacag

SEQ ID NO: 460535 - DNA, 15 bp, Homo sapiens
gcccgttgagacagg

SEQ ID NO: 460536 - DNA, 15 bp, Homo sapiens
cccgttgagacagga

SEQ ID NO: 460537 - DNA, 15 bp, Homo sapiens
ccgttgagacaggag

SEQ ID NO: 460538 - DNA, 15 bp, Homo sapiens
cgttgagacaggaga

SEQ ID NO: 460539 - DNA, 15 bp, Homo sapiens
gttgagacaggagaa

SEQ ID NO: 460540 - DNA, 15 bp, Homo sapiens
ttgagacaggagaat

SEQ ID NO: 460541 - DNA, 15 bp, Homo sapiens
tgagacaggagaatt

SEQ ID NO: 460542 - DNA, 15 bp, Homo sapiens
gagacaggagaattt

SEQ ID NO: 460543 - DNA, 15 bp, Homo sapiens
agacaggagaattta

SEQ ID NO: 460544 - DNA, 15 bp, Homo sapiens
gacaggagaatttat

SEQ ID NO: 460545 - DNA, 15 bp, Homo sapiens
acaggagaatttatc

SEQ ID NO: 460546 - DNA, 15 bp, Homo sapiens
caggagaatttatct

SEQ ID NO: 460547 - DNA, 15 bp, Homo sapiens
aggagaatttatcta

SEQ ID NO: 460548 - DNA, 15 bp, Homo sapiens
ggagaatttatctac

SEQ ID NO: 460549 - DNA, 15 bp, Homo sapiens
gagaatttatctacc

SEQ ID NO: 460550 - DNA, 15 bp, Homo sapiens
agaatttatctacct

SEQ ID NO: 460551 - DNA, 15 bp, Homo sapiens
gaatttatctaccta

SEQ ID NO: 460552 - DNA, 15 bp, Homo sapiens
aatttatctacctat

SEQ ID NO: 460553 - DNA, 15 bp, Homo sapiens
atttatctacctatt

SEQ ID NO: 460554 - DNA, 15 bp, Homo sapiens
tttatctacctattg

SEQ ID NO: 460555 - DNA, 15 bp, Homo sapiens
ttatctacctattgc

SEQ ID NO: 460556 - DNA, 15 bp, Homo sapiens
tatctacctattgca

SEQ ID NO: 460557 - DNA, 15 bp, Homo sapiens
atctacctattgcat

SEQ ID NO: 460558 - DNA, 15 bp, Homo sapiens
tctacctattgcata

SEQ ID NO: 460559 - DNA, 15 bp, Homo sapiens
ctacctattgcatat

SEQ ID NO: 460560 - DNA, 15 bp, Homo sapiens
tacctattgcatatt

SEQ ID NO: 460561 - DNA, 15 bp, Homo sapiens
acctattgcatatta

SEQ ID NO: 460562 - DNA, 15 bp, Homo sapiens
cctattgcatattag

SEQ ID NO: 460563 - DNA, 15 bp, Homo sapiens
ctattgcatattagt

SEQ ID NO: 460564 - DNA, 15 bp, Homo sapiens
tattgcatattagtc

SEQ ID NO: 460565 - DNA, 15 bp, Homo sapiens
attgcatattagtca

SEQ ID NO: 460566 - DNA, 15 bp, Homo sapiens
ttgcatattagtcat

SEQ ID NO: 460567 - DNA, 15 bp, Homo sapiens
tgcatattagtcata

SEQ ID NO: 460568 - DNA, 15 bp, Homo sapiens
gcatattagtcataa

SEQ ID NO: 460569 - DNA, 15 bp, Homo sapiens
catattagtcataat

SEQ ID NO: 460570 - DNA, 15 bp, Homo sapiens
atattagtcataatt

SEQ ID NO: 460571 - DNA, 15 bp, Homo sapiens
tattagtcataatta

SEQ ID NO: 460572 - DNA, 15 bp, Homo sapiens
attagtcataattaa

SEQ ID NO: 460573 - DNA, 15 bp, Homo sapiens
ttagtcataattaaa

SEQ ID NO: 460574 - DNA, 15 bp, Homo sapiens
tagtcataattaaag

SEQ ID NO: 460575 - DNA, 15 bp, Homo sapiens
agtcataattaaaga

SEQ ID NO: 460576 - DNA, 15 bp, Homo sapiens
gtcataattaaagaa

SEQ ID NO: 460577 - DNA, 15 bp, Homo sapiens
tcataattaaagaac

SEQ ID NO: 460578 - DNA, 15 bp, Homo sapiens
cataattaaagaact

SEQ ID NO: 460579 - DNA, 15 bp, Homo sapiens
ataattaaagaacta

SEQ ID NO: 460580 - DNA, 15 bp, Homo sapiens
taattaaagaactag

SEQ ID NO: 460581 - DNA, 15 bp, Homo sapiens
aattaaagaactagt

SEQ ID NO: 460582 - DNA, 15 bp, Homo sapiens
attaaagaactagtg

SEQ ID NO: 460583 - DNA, 15 bp, Homo sapiens
ttaaagaactagtgt

SEQ ID NO: 460584 - DNA, 15 bp, Homo sapiens
taaagaactagtgtt

SEQ ID NO: 460585 - DNA, 15 bp, Homo sapiens
aaagaactagtgttc

SEQ ID NO: 460586 - DNA, 15 bp, Homo sapiens
aagaactagtgttca

SEQ ID NO: 460587 - DNA, 15 bp, Homo sapiens
agaactagtgttcag

SEQ ID NO: 460588 - DNA, 15 bp, Homo sapiens
gaactagtgttcagt

SEQ ID NO: 460589 - DNA, 15 bp, Homo sapiens
aactagtgttcagtc

SEQ ID NO: 460590 - DNA, 15 bp, Homo sapiens
actagtgttcagtct

SEQ ID NO: 460591 - DNA, 15 bp, Homo sapiens
ctagtgttcagtctt

SEQ ID NO: 460592 - DNA, 15 bp, Homo sapiens
tagtgttcagtcttt

SEQ ID NO: 460593 - DNA, 15 bp, Homo sapiens
agtgttcagtctttt

SEQ ID NO: 460594 - DNA, 15 bp, Homo sapiens
gtgttcagtcttttg

SEQ ID NO: 460595 - DNA, 15 bp, Homo sapiens
tgttcagtcttttga

SEQ ID NO: 460596 - DNA, 15 bp, Homo sapiens
gttcagtcttttgat

SEQ ID NO: 460597 - DNA, 15 bp, Homo sapiens
ttcagtcttttgata

SEQ ID NO: 460598 - DNA, 15 bp, Homo sapiens
tcagtcttttgataa

SEQ ID NO: 460599 - DNA, 15 bp, Homo sapiens
cagtcttttgataat

SEQ ID NO: 460600 - DNA, 15 bp, Homo sapiens
agtcttttgataatc

SEQ ID NO: 460601 - DNA, 15 bp, Homo sapiens
gtcttttgataatca

SEQ ID NO: 460602 - DNA, 15 bp, Homo sapiens
tcttttgataatcat

SEQ ID NO: 460603 - DNA, 15 bp, Homo sapiens
cttttgataatcatt

SEQ ID NO: 460604 - DNA, 15 bp, Homo sapiens
ttttgataatcattt

SEQ ID NO: 460605 - DNA, 15 bp, Homo sapiens
tttgataatcatttg

SEQ ID NO: 460606 - DNA, 15 bp, Homo sapiens
ttgataatcatttga

SEQ ID NO: 460607 - DNA, 15 bp, Homo sapiens
tgataatcatttgat

SEQ ID NO: 460608 - DNA, 15 bp, Homo sapiens
gataatcatttgatt

SEQ ID NO: 460609 - DNA, 15 bp, Homo sapiens
ataatcatttgatta

SEQ ID NO: 460610 - DNA, 15 bp, Homo sapiens
taatcatttgattat

SEQ ID NO: 460611 - DNA, 15 bp, Homo sapiens
aatcatttgattatt

SEQ ID NO: 460612 - DNA, 15 bp, Homo sapiens
atcatttgattattc

SEQ ID NO: 460613 - DNA, 15 bp, Homo sapiens
tcatttgattattct

SEQ ID NO: 460614 - DNA, 15 bp, Homo sapiens
catttgattattctt

SEQ ID NO: 460615 - DNA, 15 bp, Homo sapiens
atttgattattctta

SEQ ID NO: 460616 - DNA, 15 bp, Homo sapiens
tttgattattcttac

SEQ ID NO: 460617 - DNA, 15 bp, Homo sapiens
ttgattattcttact

SEQ ID NO: 460618 - DNA, 15 bp, Homo sapiens
tgattattcttacta

SEQ ID NO: 460619 - DNA, 15 bp, Homo sapiens
gattattcttactat

SEQ ID NO: 460620 - DNA, 15 bp, Homo sapiens
attattcttactata

SEQ ID NO: 460621 - DNA, 15 bp, Homo sapiens
ttattcttactatat

SEQ ID NO: 460622 - DNA, 15 bp, Homo sapiens
tattcttactatatt

SEQ ID NO: 460623 - DNA, 15 bp, Homo sapiens
attcttactatattt

SEQ ID NO: 460624 - DNA, 15 bp, Homo sapiens
ttcttactatatttc

SEQ ID NO: 460625 - DNA, 15 bp, Homo sapiens
tcttactatatttct

SEQ ID NO: 460626 - DNA, 15 bp, Homo sapiens
cttactatatttcta

SEQ ID NO: 460627 - DNA, 15 bp, Homo sapiens
ttactatatttctat

SEQ ID NO: 460628 - DNA, 15 bp, Homo sapiens
tactatatttctata

SEQ ID NO: 460629 - DNA, 15 bp, Homo sapiens
actatatttctatat

SEQ ID NO: 460630 - DNA, 15 bp, Homo sapiens
ctatatttctatatc

SEQ ID NO: 460631 - DNA, 15 bp, Homo sapiens
tatatttctatatct

SEQ ID NO: 460632 - DNA, 15 bp, Homo sapiens
atatttctatatcta

SEQ ID NO: 460633 - DNA, 15 bp, Homo sapiens
tatttctatatctag

SEQ ID NO: 460634 - DNA, 15 bp, Homo sapiens
atttctatatctagg

SEQ ID NO: 460635 - DNA, 15 bp, Homo sapiens
tttctatatctagga

SEQ ID NO: 460636 - DNA, 15 bp, Homo sapiens
ttctatatctaggaa

SEQ ID NO: 460637 - DNA, 15 bp, Homo sapiens
tctatatctaggaaa

SEQ ID NO: 460638 - DNA, 15 bp, Homo sapiens
ctatatctaggaaac

SEQ ID NO: 460639 - DNA, 15 bp, Homo sapiens
tatatctaggaaaca

SEQ ID NO: 460640 - DNA, 15 bp, Homo sapiens
atatctaggaaacat

SEQ ID NO: 460641 - DNA, 15 bp, Homo sapiens
tatctaggaaacata

SEQ ID NO: 460642 - DNA, 15 bp, Homo sapiens
atctaggaaacatag

SEQ ID NO: 460643 - DNA, 15 bp, Homo sapiens
tctaggaaacatagt

SEQ ID NO: 460644 - DNA, 15 bp, Homo sapiens
ctaggaaacatagta

SEQ ID NO: 460645 - DNA, 15 bp, Homo sapiens
taggaaacatagtac

SEQ ID NO: 460646 - DNA, 15 bp, Homo sapiens
aggaaacatagtact

SEQ ID NO: 460647 - DNA, 15 bp, Homo sapiens
ggaaacatagtactt

SEQ ID NO: 460648 - DNA, 15 bp, Homo sapiens
gaaacatagtacttt

SEQ ID NO: 460649 - DNA, 15 bp, Homo sapiens
aaacatagtacttta

SEQ ID NO: 460650 - DNA, 15 bp, Homo sapiens
aacatagtactttat

SEQ ID NO: 460651 - DNA, 15 bp, Homo sapiens
acatagtactttatt

SEQ ID NO: 460652 - DNA, 15 bp, Homo sapiens
catagtactttattt

SEQ ID NO: 460653 - DNA, 15 bp, Homo sapiens
atagtactttatttt

SEQ ID NO: 460654 - DNA, 15 bp, Homo sapiens
tagtactttatttta

SEQ ID NO: 460655 - DNA, 15 bp, Homo sapiens
agtactttattttaa

SEQ ID NO: 460656 - DNA, 15 bp, Homo sapiens
gtactttattttaag

SEQ ID NO: 460657 - DNA, 15 bp, Homo sapiens
tactttattttaagt

SEQ ID NO: 460658 - DNA, 15 bp, Homo sapiens
actttattttaagtg

SEQ ID NO: 460659 - DNA, 15 bp, Homo sapiens
ctttattttaagtga

SEQ ID NO: 460660 - DNA, 15 bp, Homo sapiens
tttattttaagtgaa

SEQ ID NO: 460661 - DNA, 15 bp, Homo sapiens
ttattttaagtgaac

SEQ ID NO: 460662 - DNA, 15 bp, Homo sapiens
tattttaagtgaaca

SEQ ID NO: 460663 - DNA, 15 bp, Homo sapiens
attttaagtgaacag

SEQ ID NO: 460664 - DNA, 15 bp, Homo sapiens
ttttaagtgaacagt

SEQ ID NO: 460665 - DNA, 15 bp, Homo sapiens
tttaagtgaacagtt

SEQ ID NO: 460666 - DNA, 15 bp, Homo sapiens
ttaagtgaacagttt

SEQ ID NO: 460667 - DNA, 15 bp, Homo sapiens
taagtgaacagtttt

SEQ ID NO: 460668 - DNA, 15 bp, Homo sapiens
aagtgaacagttttt

SEQ ID NO: 460669 - DNA, 15 bp, Homo sapiens
agtgaacagtttttt

SEQ ID NO: 460670 - DNA, 15 bp, Homo sapiens
gtgaacagttttttt

SEQ ID NO: 460671 - DNA, 15 bp, Homo sapiens
tgaacagtttttttc

SEQ ID NO: 460672 - DNA, 15 bp, Homo sapiens
gaacagtttttttcc

SEQ ID NO: 460673 - DNA, 15 bp, Homo sapiens
aacagtttttttcca

SEQ ID NO: 460674 - DNA, 15 bp, Homo sapiens
acagtttttttccaa

SEQ ID NO: 460675 - DNA, 15 bp, Homo sapiens
cagtttttttccaat

SEQ ID NO: 460676 - DNA, 15 bp, Homo sapiens
agtttttttccaatt

SEQ ID NO: 460677 - DNA, 15 bp, Homo sapiens
gtttttttccaattt

SEQ ID NO: 460678 - DNA, 15 bp, Homo sapiens
tttttttccaatttt

SEQ ID NO: 460679 - DNA, 15 bp, Homo sapiens
ttttttccaatttta

SEQ ID NO: 460680 - DNA, 15 bp, Homo sapiens
tttttccaattttaa

SEQ ID NO: 460681 - DNA, 15 bp, Homo sapiens
ttttccaattttaac

SEQ ID NO: 460682 - DNA, 15 bp, Homo sapiens
tttccaattttaaca

SEQ ID NO: 460683 - DNA, 15 bp, Homo sapiens
ttccaattttaacat

SEQ ID NO: 460684 - DNA, 15 bp, Homo sapiens
tccaattttaacatg

SEQ ID NO: 460685 - DNA, 15 bp, Homo sapiens
ccaattttaacatgt

SEQ ID NO: 460686 - DNA, 15 bp, Homo sapiens
caattttaacatgta

SEQ ID NO: 460687 - DNA, 15 bp, Homo sapiens
aattttaacatgtac

SEQ ID NO: 460688 - DNA, 15 bp, Homo sapiens
attttaacatgtacc

SEQ ID NO: 460689 - DNA, 15 bp, Homo sapiens
ttttaacatgtaccc

SEQ ID NO: 460690 - DNA, 15 bp, Homo sapiens
tttaacatgtaccca

SEQ ID NO: 460691 - DNA, 15 bp, Homo sapiens
ttaacatgtacccac

SEQ ID NO: 460692 - DNA, 15 bp, Homo sapiens
taacatgtacccacc

SEQ ID NO: 460693 - DNA, 15 bp, Homo sapiens
aacatgtacccacct

SEQ ID NO: 460694 - DNA, 15 bp, Homo sapiens
acatgtacccacctc

SEQ ID NO: 460695 - DNA, 15 bp, Homo sapiens
catgtacccacctcc

SEQ ID NO: 460696 - DNA, 15 bp, Homo sapiens
atgtacccacctcct

SEQ ID NO: 460697 - DNA, 15 bp, Homo sapiens
tgtacccacctcctg

SEQ ID NO: 460698 - DNA, 15 bp, Homo sapiens
gtacccacctcctga

SEQ ID NO: 460699 - DNA, 15 bp, Homo sapiens
tacccacctcctgat

SEQ ID NO: 460700 - DNA, 15 bp, Homo sapiens
acccacctcctgata

SEQ ID NO: 460701 - DNA, 15 bp, Homo sapiens
cccacctcctgatat

SEQ ID NO: 460702 - DNA, 15 bp, Homo sapiens
ccacctcctgatatt

SEQ ID NO: 460703 - DNA, 15 bp, Homo sapiens
cacctcctgatattc

SEQ ID NO: 460704 - DNA, 15 bp, Homo sapiens
acctcctgatattct

SEQ ID NO: 460705 - DNA, 15 bp, Homo sapiens
cctcctgatattctg

SEQ ID NO: 460706 - DNA, 15 bp, Homo sapiens
ctcctgatattctga

SEQ ID NO: 460707 - DNA, 15 bp, Homo sapiens
tcctgatattctgaa

SEQ ID NO: 460708 - DNA, 15 bp, Homo sapiens
cctgatattctgaac

SEQ ID NO: 460709 - DNA, 15 bp, Homo sapiens
ctgatattctgaact

SEQ ID NO: 460710 - DNA, 15 bp, Homo sapiens
tgatattctgaactt

SEQ ID NO: 460711 - DNA, 15 bp, Homo sapiens
gatattctgaacttt

SEQ ID NO: 460712 - DNA, 15 bp, Homo sapiens
atattctgaactttg

SEQ ID NO: 460713 - DNA, 15 bp, Homo sapiens
tattctgaactttgt

SEQ ID NO: 460714 - DNA, 15 bp, Homo sapiens
attctgaactttgta

SEQ ID NO: 460715 - DNA, 15 bp, Homo sapiens
ttctgaactttgtaa

SEQ ID NO: 460716 - DNA, 15 bp, Homo sapiens
tctgaactttgtaaa

SEQ ID NO: 460717 - DNA, 15 bp, Homo sapiens
ctgaactttgtaaaa

SEQ ID NO: 460718 - DNA, 15 bp, Homo sapiens
tgaactttgtaaaaa

SEQ ID NO: 460719 - DNA, 15 bp, Homo sapiens
gaactttgtaaaaaa

SEQ ID NO: 460720 - DNA, 15 bp, Homo sapiens
aactttgtaaaaaaa

SEQ ID NO: 460721 - DNA, 15 bp, Homo sapiens
actttgtaaaaaaaa

SEQ ID NO: 460722 - DNA, 15 bp, Homo sapiens
ctttgtaaaaaaaat

SEQ ID NO: 460723 - DNA, 15 bp, Homo sapiens
tttgtaaaaaaaatt

SEQ ID NO: 460724 - DNA, 15 bp, Homo sapiens
ttgtaaaaaaaattt

SEQ ID NO: 460725 - DNA, 15 bp, Homo sapiens
tgtaaaaaaaattta

SEQ ID NO: 460726 - DNA, 15 bp, Homo sapiens
gtaaaaaaaatttat

SEQ ID NO: 460727 - DNA, 15 bp, Homo sapiens
aaaaaatttattttc

SEQ ID NO: 460728 - DNA, 15 bp, Homo sapiens
aaaaatttattttca

SEQ ID NO: 460729 - DNA, 15 bp, Homo sapiens
aaaatttattttcat

SEQ ID NO: 460730 - DNA, 15 bp, Homo sapiens
aaatttattttcatc

SEQ ID NO: 460731 - DNA, 15 bp, Homo sapiens
aatttattttcatct

SEQ ID NO: 460732 - DNA, 15 bp, Homo sapiens
atttattttcatctg

SEQ ID NO: 460733 - DNA, 15 bp, Homo sapiens
tttattttcatctgt

SEQ ID NO: 460734 - DNA, 15 bp, Homo sapiens
ttattttcatctgtc

SEQ ID NO: 460735 - DNA, 15 bp, Homo sapiens
tattttcatctgtca

SEQ ID NO: 460736 - DNA, 15 bp, Homo sapiens
attttcatctgtcat

SEQ ID NO: 460737 - DNA, 15 bp, Homo sapiens
ttttcatctgtcatg

SEQ ID NO: 460738 - DNA, 15 bp, Homo sapiens
tttcatctgtcatgg

SEQ ID NO: 460739 - DNA, 15 bp, Homo sapiens
ttcatctgtcatgga

SEQ ID NO: 460740 - DNA, 15 bp, Homo sapiens
tcatctgtcatggat

SEQ ID NO: 460741 - DNA, 15 bp, Homo sapiens
catctgtcatggatg

SEQ ID NO: 460742 - DNA, 15 bp, Homo sapiens
atctgtcatggatga

SEQ ID NO: 460743 - DNA, 15 bp, Homo sapiens
tctgtcatggatgac

SEQ ID NO: 460744 - DNA, 15 bp, Homo sapiens
ctgtcatggatgaca

SEQ ID NO: 460745 - DNA, 15 bp, Homo sapiens
tgtcatggatgacaa

SEQ ID NO: 460746 - DNA, 15 bp, Homo sapiens
gtcatggatgacaag

SEQ ID NO: 460747 - DNA, 15 bp, Homo sapiens
tcatggatgacaaga

SEQ ID NO: 460748 - DNA, 15 bp, Homo sapiens
catggatgacaagaa

SEQ ID NO: 460749 - DNA, 15 bp, Homo sapiens
atggatgacaagaat

SEQ ID NO: 460750 - DNA, 15 bp, Homo sapiens
tggatgacaagaatt

SEQ ID NO: 460751 - DNA, 15 bp, Homo sapiens
ggatgacaagaattc

SEQ ID NO: 460752 - DNA, 15 bp, Homo sapiens
gatgacaagaattca

SEQ ID NO: 460753 - DNA, 15 bp, Homo sapiens
atgacaagaattcaa

SEQ ID NO: 460754 - DNA, 15 bp, Homo sapiens
tgacaagaattcaaa

SEQ ID NO: 460755 - DNA, 15 bp, Homo sapiens
gacaagaattcaaat

SEQ ID NO: 460756 - DNA, 15 bp, Homo sapiens
acaagaattcaaatt

SEQ ID NO: 460757 - DNA, 15 bp, Homo sapiens
caagaattcaaattt

SEQ ID NO: 460758 - DNA, 15 bp, Homo sapiens
aagaattcaaatttt

SEQ ID NO: 460759 - DNA, 15 bp, Homo sapiens
agaattcaaattttt

SEQ ID NO: 460760 - DNA, 15 bp, Homo sapiens
gaattcaaatttttg

SEQ ID NO: 460761 - DNA, 15 bp, Homo sapiens
aattcaaatttttgg

SEQ ID NO: 460762 - DNA, 15 bp, Homo sapiens
attcaaatttttggt

SEQ ID NO: 460763 - DNA, 15 bp, Homo sapiens
ttcaaatttttggtt

SEQ ID NO: 460764 - DNA, 15 bp, Homo sapiens
tcaaatttttggttc

SEQ ID NO: 460765 - DNA, 15 bp, Homo sapiens
caaatttttggttct

SEQ ID NO: 460766 - DNA, 15 bp, Homo sapiens
aaatttttggttctg

SEQ ID NO: 460767 - DNA, 15 bp, Homo sapiens
aatttttggttctgg

SEQ ID NO: 460768 - DNA, 15 bp, Homo sapiens
atttttggttctggt

SEQ ID NO: 460769 - DNA, 15 bp, Homo sapiens
tttttggttctggtt

SEQ ID NO: 460770 - DNA, 15 bp, Homo sapiens
ttttggttctggttg

SEQ ID NO: 460771 - DNA, 15 bp, Homo sapiens
tttggttctggttgc

SEQ ID NO: 460772 - DNA, 15 bp, Homo sapiens
ttggttctggttgct

SEQ ID NO: 460773 - DNA, 15 bp, Homo sapiens
tggttctggttgctg

SEQ ID NO: 460774 - DNA, 15 bp, Homo sapiens
ggttctggttgctgt

SEQ ID NO: 460775 - DNA, 15 bp, Homo sapiens
gttctggttgctgtg

SEQ ID NO: 460776 - DNA, 15 bp, Homo sapiens
ttctggttgctgtgt

SEQ ID NO: 460777 - DNA, 15 bp, Homo sapiens
tctggttgctgtgtg

SEQ ID NO: 460778 - DNA, 15 bp, Homo sapiens
ctggttgctgtgtga

SEQ ID NO: 460779 - DNA, 15 bp, Homo sapiens
tggttgctgtgtgag

SEQ ID NO: 460780 - DNA, 15 bp, Homo sapiens
ggttgctgtgtgagt

SEQ ID NO: 460781 - DNA, 15 bp, Homo sapiens
gttgctgtgtgagtt

SEQ ID NO: 460782 - DNA, 15 bp, Homo sapiens
ttgctgtgtgagttg

SEQ ID NO: 460783 - DNA, 15 bp, Homo sapiens
tgctgtgtgagttgg

SEQ ID NO: 460784 - DNA, 15 bp, Homo sapiens
gctgtgtgagttggc

SEQ ID NO: 460785 - DNA, 15 bp, Homo sapiens
ctgtgtgagttggca

SEQ ID NO: 460786 - DNA, 15 bp, Homo sapiens
tgtgtgagttggcag

SEQ ID NO: 460787 - DNA, 15 bp, Homo sapiens
gtgtgagttggcagc

SEQ ID NO: 460788 - DNA, 15 bp, Homo sapiens
tgtgagttggcagct

SEQ ID NO: 460789 - DNA, 15 bp, Homo sapiens
gtgagttggcagcta

SEQ ID NO: 460790 - DNA, 15 bp, Homo sapiens
tgagttggcagctac

SEQ ID NO: 460791 - DNA, 15 bp, Homo sapiens
gagttggcagctact

SEQ ID NO: 460792 - DNA, 15 bp, Homo sapiens
agttggcagctactt

SEQ ID NO: 460793 - DNA, 15 bp, Homo sapiens
gttggcagctactta

SEQ ID NO: 460794 - DNA, 15 bp, Homo sapiens
ttggcagctacttaa

SEQ ID NO: 460795 - DNA, 15 bp, Homo sapiens
tggcagctacttaac

SEQ ID NO: 460796 - DNA, 15 bp, Homo sapiens
ggcagctacttaaca

SEQ ID NO: 460797 - DNA, 15 bp, Homo sapiens
gcagctacttaacat

SEQ ID NO: 460798 - DNA, 15 bp, Homo sapiens
cagctacttaacatt

SEQ ID NO: 460799 - DNA, 15 bp, Homo sapiens
agctacttaacattg

SEQ ID NO: 460800 - DNA, 15 bp, Homo sapiens
gctacttaacattgg

SEQ ID NO: 460801 - DNA, 15 bp, Homo sapiens
ctacttaacattggc

SEQ ID NO: 460802 - DNA, 15 bp, Homo sapiens
tacttaacattggca

SEQ ID NO: 460803 - DNA, 15 bp, Homo sapiens
acttaacattggcat

SEQ ID NO: 460804 - DNA, 15 bp, Homo sapiens
cttaacattggcatc

SEQ ID NO: 460805 - DNA, 15 bp, Homo sapiens
ttaacattggcatct

SEQ ID NO: 460806 - DNA, 15 bp, Homo sapiens
taacattggcatctt

SEQ ID NO: 460807 - DNA, 15 bp, Homo sapiens
aacattggcatctta

SEQ ID NO: 460808 - DNA, 15 bp, Homo sapiens
acattggcatcttaa

SEQ ID NO: 460809 - DNA, 15 bp, Homo sapiens
cattggcatcttaat

SEQ ID NO: 460810 - DNA, 15 bp, Homo sapiens
attggcatcttaatt

SEQ ID NO: 460811 - DNA, 15 bp, Homo sapiens
ttggcatcttaattt

SEQ ID NO: 460812 - DNA, 15 bp, Homo sapiens
tggcatcttaatttt

SEQ ID NO: 460813 - DNA, 15 bp, Homo sapiens
ggcatcttaattttt

SEQ ID NO: 460814 - DNA, 15 bp, Homo sapiens
gcatcttaatttttc

SEQ ID NO: 460815 - DNA, 15 bp, Homo sapiens
catcttaatttttca

SEQ ID NO: 460816 - DNA, 15 bp, Homo sapiens
atcttaatttttcat

SEQ ID NO: 460817 - DNA, 15 bp, Homo sapiens
tcttaatttttcatc

SEQ ID NO: 460818 - DNA, 15 bp, Homo sapiens
cttaatttttcatct

SEQ ID NO: 460819 - DNA, 15 bp, Homo sapiens
ttaatttttcatctg

SEQ ID NO: 460820 - DNA, 15 bp, Homo sapiens
taatttttcatctga

SEQ ID NO: 460821 - DNA, 15 bp, Homo sapiens
aatttttcatctgaa

SEQ ID NO: 460822 - DNA, 15 bp, Homo sapiens
atttttcatctgaaa

SEQ ID NO: 460823 - DNA, 15 bp, Homo sapiens
tcatctgaaaaattg

SEQ ID NO: 460824 - DNA, 15 bp, Homo sapiens
catctgaaaaattga

SEQ ID NO: 460825 - DNA, 15 bp, Homo sapiens
atctgaaaaattgaa

SEQ ID NO: 460826 - DNA, 15 bp, Homo sapiens
tctgaaaaattgaaa

SEQ ID NO: 460827 - DNA, 15 bp, Homo sapiens
ctgaaaaattgaaat

SEQ ID NO: 460828 - DNA, 15 bp, Homo sapiens
tgaaaaattgaaata

SEQ ID NO: 460829 - DNA, 15 bp, Homo sapiens
gaaaaattgaaataa

SEQ ID NO: 460830 - DNA, 15 bp, Homo sapiens
aaaaattgaaataaa

SEQ ID NO: 460831 - DNA, 15 bp, Homo sapiens
aaaattgaaataaaa

SEQ ID NO: 460832 - DNA, 15 bp, Homo sapiens
aaattgaaataaaaa

SEQ ID NO: 460833 - DNA, 15 bp, Homo sapiens
aattgaaataaaaat

SEQ ID NO: 460834 - DNA, 15 bp, Homo sapiens
attgaaataaaaata

SEQ ID NO: 460835 - DNA, 15 bp, Homo sapiens
ttgaaataaaaatat

SEQ ID NO: 460836 - DNA, 15 bp, Homo sapiens
tgaaataaaaatatc

SEQ ID NO: 460837 - DNA, 15 bp, Homo sapiens
gaaataaaaatatcc

SEQ ID NO: 460838 - DNA, 15 bp, Homo sapiens
aaataaaaatatcca

SEQ ID NO: 460839 - DNA, 15 bp, Homo sapiens
aataaaaatatccac

SEQ ID NO: 460840 - DNA, 15 bp, Homo sapiens
ataaaaatatccact

SEQ ID NO: 460841 - DNA, 15 bp, Homo sapiens
taaaaatatccactc

SEQ ID NO: 460842 - DNA, 15 bp, Homo sapiens
aaaaatatccactct

SEQ ID NO: 460843 - DNA, 15 bp, Homo sapiens
aaaatatccactctg

SEQ ID NO: 460844 - DNA, 15 bp, Homo sapiens
aaatatccactctgc

SEQ ID NO: 460845 - DNA, 15 bp, Homo sapiens
aatatccactctgct

SEQ ID NO: 460846 - DNA, 15 bp, Homo sapiens
atatccactctgctt

SEQ ID NO: 460847 - DNA, 15 bp, Homo sapiens
tatccactctgctta

SEQ ID NO: 460848 - DNA, 15 bp, Homo sapiens
atccactctgcttac

SEQ ID NO: 460849 - DNA, 15 bp, Homo sapiens
tccactctgcttacc

SEQ ID NO: 460850 - DNA, 15 bp, Homo sapiens
ccactctgcttacca

SEQ ID NO: 460851 - DNA, 15 bp, Homo sapiens
cactctgcttaccac

SEQ ID NO: 460852 - DNA, 15 bp, Homo sapiens
actctgcttaccaca

SEQ ID NO: 460853 - DNA, 15 bp, Homo sapiens
ctctgcttaccacac

SEQ ID NO: 460854 - DNA, 15 bp, Homo sapiens
tctgcttaccacaca

SEQ ID NO: 460855 - DNA, 15 bp, Homo sapiens
ctgcttaccacacaa

SEQ ID NO: 460856 - DNA, 15 bp, Homo sapiens
tgcttaccacacaaa

SEQ ID NO: 460857 - DNA, 15 bp, Homo sapiens
gcttaccacacaaaa

SEQ ID NO: 460858 - DNA, 15 bp, Homo sapiens
cttaccacacaaaag

SEQ ID NO: 460859 - DNA, 15 bp, Homo sapiens
ttaccacacaaaagg

SEQ ID NO: 460860 - DNA, 15 bp, Homo sapiens
taccacacaaaaggt

SEQ ID NO: 460861 - DNA, 15 bp, Homo sapiens
accacacaaaaggtg

SEQ ID NO: 460862 - DNA, 15 bp, Homo sapiens
ccacacaaaaggtga

SEQ ID NO: 460863 - DNA, 15 bp, Homo sapiens
cacacaaaaggtgat

SEQ ID NO: 460864 - DNA, 15 bp, Homo sapiens
acacaaaaggtgatt

SEQ ID NO: 460865 - DNA, 15 bp, Homo sapiens
cacaaaaggtgatta

SEQ ID NO: 460866 - DNA, 15 bp, Homo sapiens
acaaaaggtgattat

SEQ ID NO: 460867 - DNA, 15 bp, Homo sapiens
caaaaggtgattatg

SEQ ID NO: 460868 - DNA, 15 bp, Homo sapiens
aaaaggtgattatga

SEQ ID NO: 460869 - DNA, 15 bp, Homo sapiens
aaaggtgattatgaa

SEQ ID NO: 460870 - DNA, 15 bp, Homo sapiens
aaggtgattatgaag

SEQ ID NO: 460871 - DNA, 15 bp, Homo sapiens
aggtgattatgaagg

SEQ ID NO: 460872 - DNA, 15 bp, Homo sapiens
ggtgattatgaaggg

SEQ ID NO: 460873 - DNA, 15 bp, Homo sapiens
gtgattatgaagggc

SEQ ID NO: 460874 - DNA, 15 bp, Homo sapiens
tgattatgaagggca

SEQ ID NO: 460875 - DNA, 15 bp, Homo sapiens
gattatgaagggcaa

SEQ ID NO: 460876 - DNA, 15 bp, Homo sapiens
attatgaagggcaaa

SEQ ID NO: 460877 - DNA, 15 bp, Homo sapiens
ttatgaagggcaaat

SEQ ID NO: 460878 - DNA, 15 bp, Homo sapiens
tatgaagggcaaatg

SEQ ID NO: 460879 - DNA, 15 bp, Homo sapiens
atgaagggcaaatga

SEQ ID NO: 460880 - DNA, 15 bp, Homo sapiens
tgaagggcaaatgaa

SEQ ID NO: 460881 - DNA, 15 bp, Homo sapiens
gaagggcaaatgaac

SEQ ID NO: 460882 - DNA, 15 bp, Homo sapiens
aagggcaaatgaact

SEQ ID NO: 460883 - DNA, 15 bp, Homo sapiens
agggcaaatgaacta

SEQ ID NO: 460884 - DNA, 15 bp, Homo sapiens
gggcaaatgaactaa

SEQ ID NO: 460885 - DNA, 15 bp, Homo sapiens
ggcaaatgaactaat

SEQ ID NO: 460886 - DNA, 15 bp, Homo sapiens
gcaaatgaactaata

SEQ ID NO: 460887 - DNA, 15 bp, Homo sapiens
caaatgaactaatat

SEQ ID NO: 460888 - DNA, 15 bp, Homo sapiens
aaatgaactaatata

SEQ ID NO: 460889 - DNA, 15 bp, Homo sapiens
aatgaactaatatat

SEQ ID NO: 460890 - DNA, 15 bp, Homo sapiens
atgaactaatatatg

SEQ ID NO: 460891 - DNA, 15 bp, Homo sapiens
tgaactaatatatgt

SEQ ID NO: 460892 - DNA, 15 bp, Homo sapiens
gaactaatatatgta

SEQ ID NO: 460893 - DNA, 15 bp, Homo sapiens
aactaatatatgtaa

SEQ ID NO: 460894 - DNA, 15 bp, Homo sapiens
actaatatatgtaaa

SEQ ID NO: 460895 - DNA, 15 bp, Homo sapiens
ctaatatatgtaaaa

SEQ ID NO: 460896 - DNA, 15 bp, Homo sapiens
taatatatgtaaaaa

SEQ ID NO: 460897 - DNA, 15 bp, Homo sapiens
aatatatgtaaaaag

SEQ ID NO: 460898 - DNA, 15 bp, Homo sapiens
atatatgtaaaaagt

SEQ ID NO: 460899 - DNA, 15 bp, Homo sapiens
tatatgtaaaaagta

SEQ ID NO: 460900 - DNA, 15 bp, Homo sapiens
atatgtaaaaagtac

SEQ ID NO: 460901 - DNA, 15 bp, Homo sapiens
tatgtaaaaagtact

SEQ ID NO: 460902 - DNA, 15 bp, Homo sapiens
atgtaaaaagtactt

SEQ ID NO: 460903 - DNA, 15 bp, Homo sapiens
tgtaaaaagtacttt

SEQ ID NO: 460904 - DNA, 15 bp, Homo sapiens
gtaaaaagtacttta

SEQ ID NO: 460905 - DNA, 15 bp, Homo sapiens
taaaaagtactttat

SEQ ID NO: 460906 - DNA, 15 bp, Homo sapiens
aaaaagtactttata

SEQ ID NO: 460907 - DNA, 15 bp, Homo sapiens
aaaagtactttataa

SEQ ID NO: 460908 - DNA, 15 bp, Homo sapiens
aaagtactttataaa

SEQ ID NO: 460909 - DNA, 15 bp, Homo sapiens
aagtactttataaag

SEQ ID NO: 460910 - DNA, 15 bp, Homo sapiens
agtactttataaaga

SEQ ID NO: 460911 - DNA, 15 bp, Homo sapiens
gtactttataaagat

SEQ ID NO: 460912 - DNA, 15 bp, Homo sapiens
tactttataaagata

SEQ ID NO: 460913 - DNA, 15 bp, Homo sapiens
actttataaagataa

SEQ ID NO: 460914 - DNA, 15 bp, Homo sapiens
ctttataaagataaa

SEQ ID NO: 460915 - DNA, 15 bp, Homo sapiens
tttataaagataaaa

SEQ ID NO: 460916 - DNA, 15 bp, Homo sapiens
ttataaagataaaat

SEQ ID NO: 460917 - DNA, 15 bp, Homo sapiens
tataaagataaaatt

SEQ ID NO: 460918 - DNA, 15 bp, Homo sapiens
ataaagataaaattg

SEQ ID NO: 460919 - DNA, 15 bp, Homo sapiens
taaagataaaattga

SEQ ID NO: 460920 - DNA, 15 bp, Homo sapiens
aaagataaaattgat

SEQ ID NO: 460921 - DNA, 15 bp, Homo sapiens
aagataaaattgatt

SEQ ID NO: 460922 - DNA, 15 bp, Homo sapiens
agataaaattgattt

SEQ ID NO: 460923 - DNA, 15 bp, Homo sapiens
gataaaattgatttc

SEQ ID NO: 460924 - DNA, 15 bp, Homo sapiens
ataaaattgatttca

SEQ ID NO: 460925 - DNA, 15 bp, Homo sapiens
taaaattgatttcat

SEQ ID NO: 460926 - DNA, 15 bp, Homo sapiens
aaaattgatttcatt

SEQ ID NO: 460927 - DNA, 15 bp, Homo sapiens
aaattgatttcattt

SEQ ID NO: 460928 - DNA, 15 bp, Homo sapiens
aattgatttcattta

SEQ ID NO: 460929 - DNA, 15 bp, Homo sapiens
attgatttcatttat

SEQ ID NO: 460930 - DNA, 15 bp, Homo sapiens
ttgatttcatttatg

SEQ ID NO: 460931 - DNA, 15 bp, Homo sapiens
tgatttcatttatga

SEQ ID NO: 460932 - DNA, 15 bp, Homo sapiens
gatttcatttatgaa

SEQ ID NO: 460933 - DNA, 15 bp, Homo sapiens
atttcatttatgaat

SEQ ID NO: 460934 - DNA, 15 bp, Homo sapiens
tttcatttatgaatt

SEQ ID NO: 460935 - DNA, 15 bp, Homo sapiens
ttcatttatgaattt

SEQ ID NO: 460936 - DNA, 15 bp, Homo sapiens
tcatttatgaatttg

SEQ ID NO: 460937 - DNA, 15 bp, Homo sapiens
catttatgaatttgc

SEQ ID NO: 460938 - DNA, 15 bp, Homo sapiens
atttatgaatttgca

SEQ ID NO: 460939 - DNA, 15 bp, Homo sapiens
tttatgaatttgcag

SEQ ID NO: 460940 - DNA, 15 bp, Homo sapiens
ttatgaatttgcagc

SEQ ID NO: 460941 - DNA, 15 bp, Homo sapiens
tatgaatttgcagcc

SEQ ID NO: 460942 - DNA, 15 bp, Homo sapiens
atgaatttgcagcct

SEQ ID NO: 460943 - DNA, 15 bp, Homo sapiens
tgaatttgcagcctc

SEQ ID NO: 460944 - DNA, 15 bp, Homo sapiens
gaatttgcagcctca

SEQ ID NO: 460945 - DNA, 15 bp, Homo sapiens
aatttgcagcctcag

SEQ ID NO: 460946 - DNA, 15 bp, Homo sapiens
atttgcagcctcagt

SEQ ID NO: 460947 - DNA, 15 bp, Homo sapiens
tttgcagcctcagtc

SEQ ID NO: 460948 - DNA, 15 bp, Homo sapiens
ttgcagcctcagtca

SEQ ID NO: 460949 - DNA, 15 bp, Homo sapiens
tgcagcctcagtcat

SEQ ID NO: 460950 - DNA, 15 bp, Homo sapiens
gcagcctcagtcatc

SEQ ID NO: 460951 - DNA, 15 bp, Homo sapiens
cagcctcagtcatct

SEQ ID NO: 460952 - DNA, 15 bp, Homo sapiens
agcctcagtcatctt

SEQ ID NO: 460953 - DNA, 15 bp, Homo sapiens
gcctcagtcatctta

SEQ ID NO: 460954 - DNA, 15 bp, Homo sapiens
cctcagtcatcttac

SEQ ID NO: 460955 - DNA, 15 bp, Homo sapiens
ctcagtcatcttacc

SEQ ID NO: 460956 - DNA, 15 bp, Homo sapiens
tcagtcatcttacca

SEQ ID NO: 460957 - DNA, 15 bp, Homo sapiens
cagtcatcttaccag

SEQ ID NO: 460958 - DNA, 15 bp, Homo sapiens
agtcatcttaccaga

SEQ ID NO: 460959 - DNA, 15 bp, Homo sapiens
gtcatcttaccagat

SEQ ID NO: 460960 - DNA, 15 bp, Homo sapiens
tcatcttaccagatt

SEQ ID NO: 460961 - DNA, 15 bp, Homo sapiens
catcttaccagatta

SEQ ID NO: 460962 - DNA, 15 bp, Homo sapiens
atcttaccagattaa

SEQ ID NO: 460963 - DNA, 15 bp, Homo sapiens
tcttaccagattaaa

SEQ ID NO: 460964 - DNA, 15 bp, Homo sapiens
cttaccagattaaaa

SEQ ID NO: 460965 - DNA, 15 bp, Homo sapiens
ttaccagattaaaag

SEQ ID NO: 460966 - DNA, 15 bp, Homo sapiens
taccagattaaaagg

SEQ ID NO: 460967 - DNA, 15 bp, Homo sapiens
accagattaaaaggt

SEQ ID NO: 460968 - DNA, 15 bp, Homo sapiens
ccagattaaaaggtc

SEQ ID NO: 460969 - DNA, 15 bp, Homo sapiens
cagattaaaaggtct

SEQ ID NO: 460970 - DNA, 15 bp, Homo sapiens
agattaaaaggtctt

SEQ ID NO: 460971 - DNA, 15 bp, Homo sapiens
gattaaaaggtctta

SEQ ID NO: 460972 - DNA, 15 bp, Homo sapiens
attaaaaggtcttaa

SEQ ID NO: 460973 - DNA, 15 bp, Homo sapiens
ttaaaaggtcttaat

SEQ ID NO: 460974 - DNA, 15 bp, Homo sapiens
taaaaggtcttaatt

SEQ ID NO: 460975 - DNA, 15 bp, Homo sapiens
aaaaggtcttaattt

SEQ ID NO: 460976 - DNA, 15 bp, Homo sapiens
aaaggtcttaatttc

SEQ ID NO: 460977 - DNA, 15 bp, Homo sapiens
aaggtcttaatttca

SEQ ID NO: 460978 - DNA, 15 bp, Homo sapiens
aggtcttaatttcac

SEQ ID NO: 460979 - DNA, 15 bp, Homo sapiens
ggtcttaatttcaca

SEQ ID NO: 460980 - DNA, 15 bp, Homo sapiens
gtcttaatttcacaa

SEQ ID NO: 460981 - DNA, 15 bp, Homo sapiens
tcttaatttcacaat

SEQ ID NO: 460982 - DNA, 15 bp, Homo sapiens
cttaatttcacaatc

SEQ ID NO: 460983 - DNA, 15 bp, Homo sapiens
ttaatttcacaatct

SEQ ID NO: 460984 - DNA, 15 bp, Homo sapiens
taatttcacaatctt

SEQ ID NO: 460985 - DNA, 15 bp, Homo sapiens
aatttcacaatcttc

SEQ ID NO: 460986 - DNA, 15 bp, Homo sapiens
atttcacaatcttcc

SEQ ID NO: 460987 - DNA, 15 bp, Homo sapiens
tttcacaatcttcct

SEQ ID NO: 460988 - DNA, 15 bp, Homo sapiens
ttcacaatcttcctt

SEQ ID NO: 460989 - DNA, 15 bp, Homo sapiens
tcacaatcttccttc

SEQ ID NO: 460990 - DNA, 15 bp, Homo sapiens
cacaatcttccttct

SEQ ID NO: 460991 - DNA, 15 bp, Homo sapiens
acaatcttccttctg

SEQ ID NO: 460992 - DNA, 15 bp, Homo sapiens
caatcttccttctgg

SEQ ID NO: 460993 - DNA, 15 bp, Homo sapiens
aatcttccttctgga

SEQ ID NO: 460994 - DNA, 15 bp, Homo sapiens
atcttccttctggat

SEQ ID NO: 460995 - DNA, 15 bp, Homo sapiens
tcttccttctggatt

SEQ ID NO: 460996 - DNA, 15 bp, Homo sapiens
cttccttctggattt

SEQ ID NO: 460997 - DNA, 15 bp, Homo sapiens
ttccttctggattta

SEQ ID NO: 460998 - DNA, 15 bp, Homo sapiens
tccttctggatttaa

SEQ ID NO: 460999 - DNA, 15 bp, Homo sapiens
ccttctggatttaat

SEQ ID NO: 461000 - DNA, 15 bp, Homo sapiens
cttctggatttaatg

SEQ ID NO: 461001 - DNA, 15 bp, Homo sapiens
ttctggatttaatgg

SEQ ID NO: 461002 - DNA, 15 bp, Homo sapiens
tctggatttaatgga

SEQ ID NO: 461003 - DNA, 15 bp, Homo sapiens
ctggatttaatggaa

SEQ ID NO: 461004 - DNA, 15 bp, Homo sapiens
tggatttaatggaaa

SEQ ID NO: 461005 - DNA, 15 bp, Homo sapiens
ggatttaatggaaat

SEQ ID NO: 461006 - DNA, 15 bp, Homo sapiens
gatttaatggaaatc

SEQ ID NO: 461007 - DNA, 15 bp, Homo sapiens
atttaatggaaatca

SEQ ID NO: 461008 - DNA, 15 bp, Homo sapiens
tttaatggaaatcaa

SEQ ID NO: 461009 - DNA, 15 bp, Homo sapiens
ttaatggaaatcaaa

SEQ ID NO: 461010 - DNA, 15 bp, Homo sapiens
taatggaaatcaaaa

SEQ ID NO: 461011 - DNA, 15 bp, Homo sapiens
aatggaaatcaaaag

SEQ ID NO: 461012 - DNA, 15 bp, Homo sapiens
atggaaatcaaaagt

SEQ ID NO: 461013 - DNA, 15 bp, Homo sapiens
tggaaatcaaaagtg

SEQ ID NO: 461014 - DNA, 15 bp, Homo sapiens
ggaaatcaaaagtgt

SEQ ID NO: 461015 - DNA, 15 bp, Homo sapiens
gaaatcaaaagtgtt

SEQ ID NO: 461016 - DNA, 15 bp, Homo sapiens
aaatcaaaagtgttt

SEQ ID NO: 461017 - DNA, 15 bp, Homo sapiens
aatcaaaagtgttta

SEQ ID NO: 461018 - DNA, 15 bp, Homo sapiens
atcaaaagtgtttaa

SEQ ID NO: 461019 - DNA, 15 bp, Homo sapiens
tcaaaagtgtttaaa

SEQ ID NO: 461020 - DNA, 15 bp, Homo sapiens
caaaagtgtttaaat

SEQ ID NO: 461021 - DNA, 15 bp, Homo sapiens
aaaagtgtttaaatc

SEQ ID NO: 461022 - DNA, 15 bp, Homo sapiens
aaagtgtttaaatca

SEQ ID NO: 461023 - DNA, 15 bp, Homo sapiens
aagtgtttaaatcat

SEQ ID NO: 461024 - DNA, 15 bp, Homo sapiens
agtgtttaaatcatg

SEQ ID NO: 461025 - DNA, 15 bp, Homo sapiens
gtgtttaaatcatga

SEQ ID NO: 461026 - DNA, 15 bp, Homo sapiens
tgtttaaatcatgat

SEQ ID NO: 461027 - DNA, 15 bp, Homo sapiens
gtttaaatcatgata

SEQ ID NO: 461028 - DNA, 15 bp, Homo sapiens
tttaaatcatgatat

SEQ ID NO: 461029 - DNA, 15 bp, Homo sapiens
ttaaatcatgatata

SEQ ID NO: 461030 - DNA, 15 bp, Homo sapiens
taaatcatgatataa

SEQ ID NO: 461031 - DNA, 15 bp, Homo sapiens
aaatcatgatataaa

SEQ ID NO: 461032 - DNA, 15 bp, Homo sapiens
aatcatgatataaag

SEQ ID NO: 461033 - DNA, 15 bp, Homo sapiens
atcatgatataaagc

SEQ ID NO: 461034 - DNA, 15 bp, Homo sapiens
tcatgatataaagca

SEQ ID NO: 461035 - DNA, 15 bp, Homo sapiens
catgatataaagcaa

SEQ ID NO: 461036 - DNA, 15 bp, Homo sapiens
atgatataaagcaat

SEQ ID NO: 461037 - DNA, 15 bp, Homo sapiens
tgatataaagcaata

SEQ ID NO: 461038 - DNA, 15 bp, Homo sapiens
gatataaagcaatag

SEQ ID NO: 461039 - DNA, 15 bp, Homo sapiens
atataaagcaatagt

SEQ ID NO: 461040 - DNA, 15 bp, Homo sapiens
tataaagcaatagtc

SEQ ID NO: 461041 - DNA, 15 bp, Homo sapiens
ataaagcaatagtct

SEQ ID NO: 461042 - DNA, 15 bp, Homo sapiens
taaagcaatagtctg

SEQ ID NO: 461043 - DNA, 15 bp, Homo sapiens
aaagcaatagtctgt

SEQ ID NO: 461044 - DNA, 15 bp, Homo sapiens
aagcaatagtctgta

SEQ ID NO: 461045 - DNA, 15 bp, Homo sapiens
agcaatagtctgtag

SEQ ID NO: 461046 - DNA, 15 bp, Homo sapiens
gcaatagtctgtagt

SEQ ID NO: 461047 - DNA, 15 bp, Homo sapiens
caatagtctgtagta

SEQ ID NO: 461048 - DNA, 15 bp, Homo sapiens
aatagtctgtagtac

SEQ ID NO: 461049 - DNA, 15 bp, Homo sapiens
atagtctgtagtact

SEQ ID NO: 461050 - DNA, 15 bp, Homo sapiens
tagtctgtagtactt

SEQ ID NO: 461051 - DNA, 15 bp, Homo sapiens
agtctgtagtacttg

SEQ ID NO: 461052 - DNA, 15 bp, Homo sapiens
gtctgtagtacttgg

SEQ ID NO: 461053 - DNA, 15 bp, Homo sapiens
tctgtagtacttggt

SEQ ID NO: 461054 - DNA, 15 bp, Homo sapiens
ctgtagtacttggtt

SEQ ID NO: 461055 - DNA, 15 bp, Homo sapiens
tgtagtacttggttt

SEQ ID NO: 461056 - DNA, 15 bp, Homo sapiens
gtagtacttggttta

SEQ ID NO: 461057 - DNA, 15 bp, Homo sapiens
tagtacttggtttaa

SEQ ID NO: 461058 - DNA, 15 bp, Homo sapiens
agtacttggtttaaa

SEQ ID NO: 461059 - DNA, 15 bp, Homo sapiens
gtacttggtttaaat

SEQ ID NO: 461060 - DNA, 15 bp, Homo sapiens
tacttggtttaaatg

SEQ ID NO: 461061 - DNA, 15 bp, Homo sapiens
acttggtttaaatgt

SEQ ID NO: 461062 - DNA, 15 bp, Homo sapiens
cttggtttaaatgtg

SEQ ID NO: 461063 - DNA, 15 bp, Homo sapiens
ttggtttaaatgtgt

SEQ ID NO: 461064 - DNA, 15 bp, Homo sapiens
tggtttaaatgtgtt

SEQ ID NO: 461065 - DNA, 15 bp, Homo sapiens
ggtttaaatgtgttt

SEQ ID NO: 461066 - DNA, 15 bp, Homo sapiens
gtttaaatgtgtttt

SEQ ID NO: 461067 - DNA, 15 bp, Homo sapiens
tttaaatgtgttttt

SEQ ID NO: 461068 - DNA, 15 bp, Homo sapiens
ttaaatgtgtttttt

SEQ ID NO: 461069 - DNA, 15 bp, Homo sapiens
taaatgtgttttttt

SEQ ID NO: 461070 - DNA, 15 bp, Homo sapiens
aaatgtgtttttttc

SEQ ID NO: 461071 - DNA, 15 bp, Homo sapiens
aatgtgtttttttct

SEQ ID NO: 461072 - DNA, 15 bp, Homo sapiens
atgtgtttttttcta

SEQ ID NO: 461073 - DNA, 15 bp, Homo sapiens
tgtgtttttttctac

SEQ ID NO: 461074 - DNA, 15 bp, Homo sapiens
gtgtttttttctacc

SEQ ID NO: 461075 - DNA, 15 bp, Homo sapiens
tgtttttttctacca

SEQ ID NO: 461076 - DNA, 15 bp, Homo sapiens
gtttttttctaccaa

SEQ ID NO: 461077 - DNA, 15 bp, Homo sapiens
tttttttctaccaaa

SEQ ID NO: 461078 - DNA, 15 bp, Homo sapiens
ttttttctaccaaaa

SEQ ID NO: 461079 - DNA, 15 bp, Homo sapiens
tttttctaccaaaaa

SEQ ID NO: 461080 - DNA, 15 bp, Homo sapiens
ttttctaccaaaaat

SEQ ID NO: 461081 - DNA, 15 bp, Homo sapiens
tttctaccaaaaata

SEQ ID NO: 461082 - DNA, 15 bp, Homo sapiens
ttctaccaaaaatat

SEQ ID NO: 461083 - DNA, 15 bp, Homo sapiens
tctaccaaaaatatt

SEQ ID NO: 461084 - DNA, 15 bp, Homo sapiens
ctaccaaaaatatta

SEQ ID NO: 461085 - DNA, 15 bp, Homo sapiens
taccaaaaatattaa

SEQ ID NO: 461086 - DNA, 15 bp, Homo sapiens
accaaaaatattaac

SEQ ID NO: 461087 - DNA, 15 bp, Homo sapiens
ccaaaaatattaacc

SEQ ID NO: 461088 - DNA, 15 bp, Homo sapiens
caaaaatattaacct

SEQ ID NO: 461089 - DNA, 15 bp, Homo sapiens
aaaaatattaacctc

SEQ ID NO: 461090 - DNA, 15 bp, Homo sapiens
aaaatattaacctca

SEQ ID NO: 461091 - DNA, 15 bp, Homo sapiens
aaatattaacctcat

SEQ ID NO: 461092 - DNA, 15 bp, Homo sapiens
aatattaacctcatt

SEQ ID NO: 461093 - DNA, 15 bp, Homo sapiens
atattaacctcattt

SEQ ID NO: 461094 - DNA, 15 bp, Homo sapiens
tattaacctcatttg

SEQ ID NO: 461095 - DNA, 15 bp, Homo sapiens
attaacctcatttgc

SEQ ID NO: 461096 - DNA, 15 bp, Homo sapiens
ttaacctcatttgca

SEQ ID NO: 461097 - DNA, 15 bp, Homo sapiens
taacctcatttgcag

SEQ ID NO: 461098 - DNA, 15 bp, Homo sapiens
aacctcatttgcagt

SEQ ID NO: 461099 - DNA, 15 bp, Homo sapiens
acctcatttgcagta

SEQ ID NO: 461100 - DNA, 15 bp, Homo sapiens
cctcatttgcagtag

SEQ ID NO: 461101 - DNA, 15 bp, Homo sapiens
ctcatttgcagtagt

SEQ ID NO: 461102 - DNA, 15 bp, Homo sapiens
tcatttgcagtagtg

SEQ ID NO: 461103 - DNA, 15 bp, Homo sapiens
catttgcagtagtgt

SEQ ID NO: 461104 - DNA, 15 bp, Homo sapiens
atttgcagtagtgtc

SEQ ID NO: 461105 - DNA, 15 bp, Homo sapiens
tttgcagtagtgtca

SEQ ID NO: 461106 - DNA, 15 bp, Homo sapiens
ttgcagtagtgtcat

SEQ ID NO: 461107 - DNA, 15 bp, Homo sapiens
tgcagtagtgtcatt

SEQ ID NO: 461108 - DNA, 15 bp, Homo sapiens
gcagtagtgtcattt

SEQ ID NO: 461109 - DNA, 15 bp, Homo sapiens
cagtagtgtcatttg

SEQ ID NO: 461110 - DNA, 15 bp, Homo sapiens
agtagtgtcatttgt

SEQ ID NO: 461111 - DNA, 15 bp, Homo sapiens
gtagtgtcatttgtt

SEQ ID NO: 461112 - DNA, 15 bp, Homo sapiens
tagtgtcatttgttc

SEQ ID NO: 461113 - DNA, 15 bp, Homo sapiens
agtgtcatttgttcc

SEQ ID NO: 461114 - DNA, 15 bp, Homo sapiens
gtgtcatttgttcca

SEQ ID NO: 461115 - DNA, 15 bp, Homo sapiens
tgtcatttgttccac

SEQ ID NO: 461116 - DNA, 15 bp, Homo sapiens
gtcatttgttccact

SEQ ID NO: 461117 - DNA, 15 bp, Homo sapiens
tcatttgttccacta

SEQ ID NO: 461118 - DNA, 15 bp, Homo sapiens
catttgttccactat

SEQ ID NO: 461119 - DNA, 15 bp, Homo sapiens
atttgttccactatt

SEQ ID NO: 461120 - DNA, 15 bp, Homo sapiens
tttgttccactattc

SEQ ID NO: 461121 - DNA, 15 bp, Homo sapiens
ttgttccactattcc

SEQ ID NO: 461122 - DNA, 15 bp, Homo sapiens
tgttccactattcca

SEQ ID NO: 461123 - DNA, 15 bp, Homo sapiens
gttccactattccaa

SEQ ID NO: 461124 - DNA, 15 bp, Homo sapiens
ttccactattccaaa

SEQ ID NO: 461125 - DNA, 15 bp, Homo sapiens
tccactattccaaag

SEQ ID NO: 461126 - DNA, 15 bp, Homo sapiens
ccactattccaaaga

SEQ ID NO: 461127 - DNA, 15 bp, Homo sapiens
cactattccaaagat

SEQ ID NO: 461128 - DNA, 15 bp, Homo sapiens
actattccaaagatg

SEQ ID NO: 461129 - DNA, 15 bp, Homo sapiens
ctattccaaagatgg

SEQ ID NO: 461130 - DNA, 15 bp, Homo sapiens
tattccaaagatggt

SEQ ID NO: 461131 - DNA, 15 bp, Homo sapiens
attccaaagatggta

SEQ ID NO: 461132 - DNA, 15 bp, Homo sapiens
ttccaaagatggtat

SEQ ID NO: 461133 - DNA, 15 bp, Homo sapiens
tccaaagatggtata

SEQ ID NO: 461134 - DNA, 15 bp, Homo sapiens
ccaaagatggtataa

SEQ ID NO: 461135 - DNA, 15 bp, Homo sapiens
caaagatggtataat

SEQ ID NO: 461136 - DNA, 15 bp, Homo sapiens
aaagatggtataatt

SEQ ID NO: 461137 - DNA, 15 bp, Homo sapiens
aagatggtataattt

SEQ ID NO: 461138 - DNA, 15 bp, Homo sapiens
agatggtataatttt

SEQ ID NO: 461139 - DNA, 15 bp, Homo sapiens
gatggtataatttta

SEQ ID NO: 461140 - DNA, 15 bp, Homo sapiens
atggtataattttat

SEQ ID NO: 461141 - DNA, 15 bp, Homo sapiens
tggtataattttata

SEQ ID NO: 461142 - DNA, 15 bp, Homo sapiens
ggtataattttataa

SEQ ID NO: 461143 - DNA, 15 bp, Homo sapiens
gtataattttataaa

SEQ ID NO: 461144 - DNA, 15 bp, Homo sapiens
tataattttataaag

SEQ ID NO: 461145 - DNA, 15 bp, Homo sapiens
ataattttataaagt

SEQ ID NO: 461146 - DNA, 15 bp, Homo sapiens
taattttataaagta

SEQ ID NO: 461147 - DNA, 15 bp, Homo sapiens
aattttataaagtaa

SEQ ID NO: 461148 - DNA, 15 bp, Homo sapiens
attttataaagtaaa

SEQ ID NO: 461149 - DNA, 15 bp, Homo sapiens
ttttataaagtaaat

SEQ ID NO: 461150 - DNA, 15 bp, Homo sapiens
tttataaagtaaatg

SEQ ID NO: 461151 - DNA, 15 bp, Homo sapiens
ttataaagtaaatgt

SEQ ID NO: 461152 - DNA, 15 bp, Homo sapiens
tataaagtaaatgtc

SEQ ID NO: 461153 - DNA, 15 bp, Homo sapiens
ataaagtaaatgtct

SEQ ID NO: 461154 - DNA, 15 bp, Homo sapiens
taaagtaaatgtctt

SEQ ID NO: 461155 - DNA, 15 bp, Homo sapiens
aaagtaaatgtcttt

SEQ ID NO: 461156 - DNA, 15 bp, Homo sapiens
aagtaaatgtcttta

SEQ ID NO: 461157 - DNA, 15 bp, Homo sapiens
agtaaatgtctttat

SEQ ID NO: 461158 - DNA, 15 bp, Homo sapiens
gtaaatgtctttata

SEQ ID NO: 461159 - DNA, 15 bp, Homo sapiens
taaatgtctttatag

SEQ ID NO: 461160 - DNA, 15 bp, Homo sapiens
aaatgtctttatagt

SEQ ID NO: 461161 - DNA, 15 bp, Homo sapiens
aatgtctttatagtt

SEQ ID NO: 461162 - DNA, 15 bp, Homo sapiens
atgtctttatagtta

SEQ ID NO: 461163 - DNA, 15 bp, Homo sapiens
tgtctttatagttaa

SEQ ID NO: 461164 - DNA, 15 bp, Homo sapiens
gtctttatagttaaa

SEQ ID NO: 461165 - DNA, 15 bp, Homo sapiens
tctttatagttaaac

SEQ ID NO: 461166 - DNA, 15 bp, Homo sapiens
ctttatagttaaacc

SEQ ID NO: 461167 - DNA, 15 bp, Homo sapiens
tttatagttaaacca

SEQ ID NO: 461168 - DNA, 15 bp, Homo sapiens
ttatagttaaaccag

SEQ ID NO: 461169 - DNA, 15 bp, Homo sapiens
tatagttaaaccagt

SEQ ID NO: 461170 - DNA, 15 bp, Homo sapiens
atagttaaaccagtt

SEQ ID NO: 461171 - DNA, 15 bp, Homo sapiens
tagttaaaccagttt

SEQ ID NO: 461172 - DNA, 15 bp, Homo sapiens
agttaaaccagttta

SEQ ID NO: 461173 - DNA, 15 bp, Homo sapiens
gttaaaccagtttaa

SEQ ID NO: 461174 - DNA, 15 bp, Homo sapiens
ttaaaccagtttaaa

SEQ ID NO: 461175 - DNA, 15 bp, Homo sapiens
taaaccagtttaaag

SEQ ID NO: 461176 - DNA, 15 bp, Homo sapiens
aaaccagtttaaaga

SEQ ID NO: 461177 - DNA, 15 bp, Homo sapiens
aaccagtttaaagag

SEQ ID NO: 461178 - DNA, 15 bp, Homo sapiens
accagtttaaagagt

SEQ ID NO: 461179 - DNA, 15 bp, Homo sapiens
ccagtttaaagagtt

SEQ ID NO: 461180 - DNA, 15 bp, Homo sapiens
cagtttaaagagttg

SEQ ID NO: 461181 - DNA, 15 bp, Homo sapiens
agtttaaagagttgc

SEQ ID NO: 461182 - DNA, 15 bp, Homo sapiens
gtttaaagagttgcc

SEQ ID NO: 461183 - DNA, 15 bp, Homo sapiens
tttaaagagttgcct

SEQ ID NO: 461184 - DNA, 15 bp, Homo sapiens
ttaaagagttgccta

SEQ ID NO: 461185 - DNA, 15 bp, Homo sapiens
taaagagttgcctat

SEQ ID NO: 461186 - DNA, 15 bp, Homo sapiens
aaagagttgcctatg

SEQ ID NO: 461187 - DNA, 15 bp, Homo sapiens
aagagttgcctatga

SEQ ID NO: 461188 - DNA, 15 bp, Homo sapiens
agagttgcctatgaa

SEQ ID NO: 461189 - DNA, 15 bp, Homo sapiens
gagttgcctatgaaa

SEQ ID NO: 461190 - DNA, 15 bp, Homo sapiens
agttgcctatgaaaa

SEQ ID NO: 461191 - DNA, 15 bp, Homo sapiens
gttgcctatgaaaac

SEQ ID NO: 461192 - DNA, 15 bp, Homo sapiens
ttgcctatgaaaact

SEQ ID NO: 461193 - DNA, 15 bp, Homo sapiens
tgcctatgaaaacta

SEQ ID NO: 461194 - DNA, 15 bp, Homo sapiens
gcctatgaaaactat

SEQ ID NO: 461195 - DNA, 15 bp, Homo sapiens
cctatgaaaactatc

SEQ ID NO: 461196 - DNA, 15 bp, Homo sapiens
ctatgaaaactatca

SEQ ID NO: 461197 - DNA, 15 bp, Homo sapiens
tatgaaaactatcag

SEQ ID NO: 461198 - DNA, 15 bp, Homo sapiens
atgaaaactatcagg

SEQ ID NO: 461199 - DNA, 15 bp, Homo sapiens
tgaaaactatcagga

SEQ ID NO: 461200 - DNA, 15 bp, Homo sapiens
gaaaactatcaggag

SEQ ID NO: 461201 - DNA, 15 bp, Homo sapiens
aaaactatcaggaga

SEQ ID NO: 461202 - DNA, 15 bp, Homo sapiens
aaactatcaggagac

SEQ ID NO: 461203 - DNA, 15 bp, Homo sapiens
aactatcaggagact

SEQ ID NO: 461204 - DNA, 15 bp, Homo sapiens
actatcaggagacta

SEQ ID NO: 461205 - DNA, 15 bp, Homo sapiens
ctatcaggagactaa

SEQ ID NO: 461206 - DNA, 15 bp, Homo sapiens
tatcaggagactaaa

SEQ ID NO: 461207 - DNA, 15 bp, Homo sapiens
atcaggagactaaat

SEQ ID NO: 461208 - DNA, 15 bp, Homo sapiens
tcaggagactaaata

SEQ ID NO: 461209 - DNA, 15 bp, Homo sapiens
caggagactaaatat

SEQ ID NO: 461210 - DNA, 15 bp, Homo sapiens
aggagactaaatatg

SEQ ID NO: 461211 - DNA, 15 bp, Homo sapiens
ggagactaaatatgt

SEQ ID NO: 461212 - DNA, 15 bp, Homo sapiens
gagactaaatatgtc

SEQ ID NO: 461213 - DNA, 15 bp, Homo sapiens
agactaaatatgtca

SEQ ID NO: 461214 - DNA, 15 bp, Homo sapiens
gactaaatatgtcaa

SEQ ID NO: 461215 - DNA, 15 bp, Homo sapiens
actaaatatgtcaac

SEQ ID NO: 461216 - DNA, 15 bp, Homo sapiens
ctaaatatgtcaaca

SEQ ID NO: 461217 - DNA, 15 bp, Homo sapiens
taaatatgtcaacac

SEQ ID NO: 461218 - DNA, 15 bp, Homo sapiens
aaatatgtcaacact

SEQ ID NO: 461219 - DNA, 15 bp, Homo sapiens
aatatgtcaacactg

SEQ ID NO: 461220 - DNA, 15 bp, Homo sapiens
atatgtcaacactgg

SEQ ID NO: 461221 - DNA, 15 bp, Homo sapiens
tatgtcaacactggg

SEQ ID NO: 461222 - DNA, 15 bp, Homo sapiens
atgtcaacactgggc

SEQ ID NO: 461223 - DNA, 15 bp, Homo sapiens
tgtcaacactgggct

SEQ ID NO: 461224 - DNA, 15 bp, Homo sapiens
gtcaacactgggcta

SEQ ID NO: 461225 - DNA, 15 bp, Homo sapiens
tcaacactgggctat

SEQ ID NO: 461226 - DNA, 15 bp, Homo sapiens
caacactgggctatg

SEQ ID NO: 461227 - DNA, 15 bp, Homo sapiens
aacactgggctatgt

SEQ ID NO: 461228 - DNA, 15 bp, Homo sapiens
acactgggctatgtc

SEQ ID NO: 461229 - DNA, 15 bp, Homo sapiens
cactgggctatgtca

SEQ ID NO: 461230 - DNA, 15 bp, Homo sapiens
actgggctatgtcac

SEQ ID NO: 461231 - DNA, 15 bp, Homo sapiens
ctgggctatgtcact

SEQ ID NO: 461232 - DNA, 15 bp, Homo sapiens
tgggctatgtcactc

SEQ ID NO: 461233 - DNA, 15 bp, Homo sapiens
gggctatgtcactca

SEQ ID NO: 461234 - DNA, 15 bp, Homo sapiens
ggctatgtcactcac

SEQ ID NO: 461235 - DNA, 15 bp, Homo sapiens
gctatgtcactcact

SEQ ID NO: 461236 - DNA, 15 bp, Homo sapiens
ctatgtcactcacta

SEQ ID NO: 461237 - DNA, 15 bp, Homo sapiens
tatgtcactcactaa

SEQ ID NO: 461238 - DNA, 15 bp, Homo sapiens
atgtcactcactaat

SEQ ID NO: 461239 - DNA, 15 bp, Homo sapiens
tgtcactcactaata

SEQ ID NO: 461240 - DNA, 15 bp, Homo sapiens
gtcactcactaatat

SEQ ID NO: 461241 - DNA, 15 bp, Homo sapiens
tcactcactaatata

SEQ ID NO: 461242 - DNA, 15 bp, Homo sapiens
cactcactaatatat

SEQ ID NO: 461243 - DNA, 15 bp, Homo sapiens
actcactaatatatt

SEQ ID NO: 461244 - DNA, 15 bp, Homo sapiens
ctcactaatatattt

SEQ ID NO: 461245 - DNA, 15 bp, Homo sapiens
tcactaatatatttt

SEQ ID NO: 461246 - DNA, 15 bp, Homo sapiens
cactaatatatttta

SEQ ID NO: 461247 - DNA, 15 bp, Homo sapiens
actaatatattttac

SEQ ID NO: 461248 - DNA, 15 bp, Homo sapiens
ctaatatattttact

SEQ ID NO: 461249 - DNA, 15 bp, Homo sapiens
taatatattttactg

SEQ ID NO: 461250 - DNA, 15 bp, Homo sapiens
aatatattttactgt

SEQ ID NO: 461251 - DNA, 15 bp, Homo sapiens
atatattttactgtc

SEQ ID NO: 461252 - DNA, 15 bp, Homo sapiens
tatattttactgtct

SEQ ID NO: 461253 - DNA, 15 bp, Homo sapiens
atattttactgtctc

SEQ ID NO: 461254 - DNA, 15 bp, Homo sapiens
tattttactgtctcc

SEQ ID NO: 461255 - DNA, 15 bp, Homo sapiens
attttactgtctccc

SEQ ID NO: 461256 - DNA, 15 bp, Homo sapiens
ttttactgtctccct

SEQ ID NO: 461257 - DNA, 15 bp, Homo sapiens
tttactgtctccctc

SEQ ID NO: 461258 - DNA, 15 bp, Homo sapiens
ttactgtctccctct

SEQ ID NO: 461259 - DNA, 15 bp, Homo sapiens
tactgtctccctctt

SEQ ID NO: 461260 - DNA, 15 bp, Homo sapiens
actgtctccctcttg

SEQ ID NO: 461261 - DNA, 15 bp, Homo sapiens
ctgtctccctcttgt

SEQ ID NO: 461262 - DNA, 15 bp, Homo sapiens
tgtctccctcttgtc

SEQ ID NO: 461263 - DNA, 15 bp, Homo sapiens
gtctccctcttgtct

SEQ ID NO: 461264 - DNA, 15 bp, Homo sapiens
tctccctcttgtctc

SEQ ID NO: 461265 - DNA, 15 bp, Homo sapiens
ctccctcttgtctct

SEQ ID NO: 461266 - DNA, 15 bp, Homo sapiens
tccctcttgtctctc

SEQ ID NO: 461267 - DNA, 15 bp, Homo sapiens
ccctcttgtctctca

SEQ ID NO: 461268 - DNA, 15 bp, Homo sapiens
cctcttgtctctcac

SEQ ID NO: 461269 - DNA, 15 bp, Homo sapiens
ctcttgtctctcaca

SEQ ID NO: 461270 - DNA, 15 bp, Homo sapiens
tcttgtctctcacat

SEQ ID NO: 461271 - DNA, 15 bp, Homo sapiens
cttgtctctcacatc

SEQ ID NO: 461272 - DNA, 15 bp, Homo sapiens
ttgtctctcacatcc

SEQ ID NO: 461273 - DNA, 15 bp, Homo sapiens
tgtctctcacatcca

SEQ ID NO: 461274 - DNA, 15 bp, Homo sapiens
gtctctcacatccat

SEQ ID NO: 461275 - DNA, 15 bp, Homo sapiens
tctctcacatccatg

SEQ ID NO: 461276 - DNA, 15 bp, Homo sapiens
ctctcacatccatgt

SEQ ID NO: 461277 - DNA, 15 bp, Homo sapiens
tctcacatccatgta

SEQ ID NO: 461278 - DNA, 15 bp, Homo sapiens
ctcacatccatgtag

SEQ ID NO: 461279 - DNA, 15 bp, Homo sapiens
tcacatccatgtagc

SEQ ID NO: 461280 - DNA, 15 bp, Homo sapiens
cacatccatgtagct

SEQ ID NO: 461281 - DNA, 15 bp, Homo sapiens
acatccatgtagctt

SEQ ID NO: 461282 - DNA, 15 bp, Homo sapiens
catccatgtagctta

SEQ ID NO: 461283 - DNA, 15 bp, Homo sapiens
atccatgtagcttat

SEQ ID NO: 461284 - DNA, 15 bp, Homo sapiens
tccatgtagcttatt

SEQ ID NO: 461285 - DNA, 15 bp, Homo sapiens
ccatgtagcttattt

SEQ ID NO: 461286 - DNA, 15 bp, Homo sapiens
catgtagcttattta

SEQ ID NO: 461287 - DNA, 15 bp, Homo sapiens
atgtagcttatttac

SEQ ID NO: 461288 - DNA, 15 bp, Homo sapiens
tgtagcttatttaca

SEQ ID NO: 461289 - DNA, 15 bp, Homo sapiens
gtagcttatttacat

SEQ ID NO: 461290 - DNA, 15 bp, Homo sapiens
tagcttatttacatc

SEQ ID NO: 461291 - DNA, 15 bp, Homo sapiens
agcttatttacatca

SEQ ID NO: 461292 - DNA, 15 bp, Homo sapiens
gcttatttacatcag

SEQ ID NO: 461293 - DNA, 15 bp, Homo sapiens
cttatttacatcagt

SEQ ID NO: 461294 - DNA, 15 bp, Homo sapiens
ttatttacatcagtg

SEQ ID NO: 461295 - DNA, 15 bp, Homo sapiens
tatttacatcagtgt

SEQ ID NO: 461296 - DNA, 15 bp, Homo sapiens
atttacatcagtgtc

SEQ ID NO: 461297 - DNA, 15 bp, Homo sapiens
tttacatcagtgtcc

SEQ ID NO: 461298 - DNA, 15 bp, Homo sapiens
ttacatcagtgtcct

SEQ ID NO: 461299 - DNA, 15 bp, Homo sapiens
tacatcagtgtcctt

SEQ ID NO: 461300 - DNA, 15 bp, Homo sapiens
acatcagtgtccttt

SEQ ID NO: 461301 - DNA, 15 bp, Homo sapiens
catcagtgtccttta

SEQ ID NO: 461302 - DNA, 15 bp, Homo sapiens
atcagtgtcctttat

SEQ ID NO: 461303 - DNA, 15 bp, Homo sapiens
tcagtgtcctttatt

SEQ ID NO: 461304 - DNA, 15 bp, Homo sapiens
cagtgtcctttattg

SEQ ID NO: 461305 - DNA, 15 bp, Homo sapiens
agtgtcctttattgt

SEQ ID NO: 461306 - DNA, 15 bp, Homo sapiens
gtgtcctttattgtc

SEQ ID NO: 461307 - DNA, 15 bp, Homo sapiens
tgtcctttattgtct

SEQ ID NO: 461308 - DNA, 15 bp, Homo sapiens
gtcctttattgtctg

SEQ ID NO: 461309 - DNA, 15 bp, Homo sapiens
tcctttattgtctgg

SEQ ID NO: 461310 - DNA, 15 bp, Homo sapiens
cctttattgtctggt

SEQ ID NO: 461311 - DNA, 15 bp, Homo sapiens
ctttattgtctggtc

SEQ ID NO: 461312 - DNA, 15 bp, Homo sapiens
tttattgtctggtcc

SEQ ID NO: 461313 - DNA, 15 bp, Homo sapiens
ttattgtctggtccc

SEQ ID NO: 461314 - DNA, 15 bp, Homo sapiens
tattgtctggtccca

SEQ ID NO: 461315 - DNA, 15 bp, Homo sapiens
attgtctggtcccac

SEQ ID NO: 461316 - DNA, 15 bp, Homo sapiens
ttgtctggtcccacg

SEQ ID NO: 461317 - DNA, 15 bp, Homo sapiens
tgtctggtcccacgt

SEQ ID NO: 461318 - DNA, 15 bp, Homo sapiens
gtctggtcccacgta

SEQ ID NO: 461319 - DNA, 15 bp, Homo sapiens
tctggtcccacgtaa

SEQ ID NO: 461320 - DNA, 15 bp, Homo sapiens
ctggtcccacgtaac

SEQ ID NO: 461321 - DNA, 15 bp, Homo sapiens
tggtcccacgtaacc

SEQ ID NO: 461322 - DNA, 15 bp, Homo sapiens
ggtcccacgtaacct

SEQ ID NO: 461323 - DNA, 15 bp, Homo sapiens
gtcccacgtaacctg

SEQ ID NO: 461324 - DNA, 15 bp, Homo sapiens
tcccacgtaacctgt

SEQ ID NO: 461325 - DNA, 15 bp, Homo sapiens
cccacgtaacctgta

SEQ ID NO: 461326 - DNA, 15 bp, Homo sapiens
ccacgtaacctgtac

SEQ ID NO: 461327 - DNA, 15 bp, Homo sapiens
cacgtaacctgtaca

SEQ ID NO: 461328 - DNA, 15 bp, Homo sapiens
acgtaacctgtacag

SEQ ID NO: 461329 - DNA, 15 bp, Homo sapiens
cgtaacctgtacagt

SEQ ID NO: 461330 - DNA, 15 bp, Homo sapiens
gtaacctgtacagtt

SEQ ID NO: 461331 - DNA, 15 bp, Homo sapiens
taacctgtacagttc

SEQ ID NO: 461332 - DNA, 15 bp, Homo sapiens
aacctgtacagttca

SEQ ID NO: 461333 - DNA, 15 bp, Homo sapiens
acctgtacagttcag

SEQ ID NO: 461334 - DNA, 15 bp, Homo sapiens
cctgtacagttcagt

SEQ ID NO: 461335 - DNA, 15 bp, Homo sapiens
ctgtacagttcagtc

SEQ ID NO: 461336 - DNA, 15 bp, Homo sapiens
tgtacagttcagtca

SEQ ID NO: 461337 - DNA, 15 bp, Homo sapiens
gtacagttcagtcaa

SEQ ID NO: 461338 - DNA, 15 bp, Homo sapiens
tacagttcagtcaac

SEQ ID NO: 461339 - DNA, 15 bp, Homo sapiens
acagttcagtcaacc

SEQ ID NO: 461340 - DNA, 15 bp, Homo sapiens
cagttcagtcaacca

SEQ ID NO: 461341 - DNA, 15 bp, Homo sapiens
agttcagtcaaccag

SEQ ID NO: 461342 - DNA, 15 bp, Homo sapiens
gttcagtcaaccagt

SEQ ID NO: 461343 - DNA, 15 bp, Homo sapiens
ttcagtcaaccagtt

SEQ ID NO: 461344 - DNA, 15 bp, Homo sapiens
tcagtcaaccagtta

SEQ ID NO: 461345 - DNA, 15 bp, Homo sapiens
cagtcaaccagttaa

SEQ ID NO: 461346 - DNA, 15 bp, Homo sapiens
agtcaaccagttaac

SEQ ID NO: 461347 - DNA, 15 bp, Homo sapiens
gtcaaccagttaacc

SEQ ID NO: 461348 - DNA, 15 bp, Homo sapiens
tcaaccagttaacct

SEQ ID NO: 461349 - DNA, 15 bp, Homo sapiens
caaccagttaacctt

SEQ ID NO: 461350 - DNA, 15 bp, Homo sapiens
aaccagttaaccttg

SEQ ID NO: 461351 - DNA, 15 bp, Homo sapiens
accagttaaccttga

SEQ ID NO: 461352 - DNA, 15 bp, Homo sapiens
ccagttaaccttgat

SEQ ID NO: 461353 - DNA, 15 bp, Homo sapiens
cagttaaccttgatg

SEQ ID NO: 461354 - DNA, 15 bp, Homo sapiens
agttaaccttgatgc

SEQ ID NO: 461355 - DNA, 15 bp, Homo sapiens
gttaaccttgatgca

SEQ ID NO: 461356 - DNA, 15 bp, Homo sapiens
ttaaccttgatgcaa

SEQ ID NO: 461357 - DNA, 15 bp, Homo sapiens
taaccttgatgcaag

SEQ ID NO: 461358 - DNA, 15 bp, Homo sapiens
aaccttgatgcaagt

SEQ ID NO: 461359 - DNA, 15 bp, Homo sapiens
accttgatgcaagtc

SEQ ID NO: 461360 - DNA, 15 bp, Homo sapiens
ccttgatgcaagtct

SEQ ID NO: 461361 - DNA, 15 bp, Homo sapiens
cttgatgcaagtctc

SEQ ID NO: 461362 - DNA, 15 bp, Homo sapiens
ttgatgcaagtctct

SEQ ID NO: 461363 - DNA, 15 bp, Homo sapiens
tgatgcaagtctctg

SEQ ID NO: 461364 - DNA, 15 bp, Homo sapiens
gatgcaagtctctga

SEQ ID NO: 461365 - DNA, 15 bp, Homo sapiens
atgcaagtctctgac

SEQ ID NO: 461366 - DNA, 15 bp, Homo sapiens
tgcaagtctctgacc

SEQ ID NO: 461367 - DNA, 15 bp, Homo sapiens
gcaagtctctgaccc

SEQ ID NO: 461368 - DNA, 15 bp, Homo sapiens
caagtctctgaccca

SEQ ID NO: 461369 - DNA, 15 bp, Homo sapiens
aagtctctgacccac

SEQ ID NO: 461370 - DNA, 15 bp, Homo sapiens
agtctctgacccacc

SEQ ID NO: 461371 - DNA, 15 bp, Homo sapiens
gtctctgacccacct

SEQ ID NO: 461372 - DNA, 15 bp, Homo sapiens
tctctgacccacctg

SEQ ID NO: 461373 - DNA, 15 bp, Homo sapiens
ctctgacccacctga

SEQ ID NO: 461374 - DNA, 15 bp, Homo sapiens
tctgacccacctgaa

SEQ ID NO: 461375 - DNA, 15 bp, Homo sapiens
ctgacccacctgaat

SEQ ID NO: 461376 - DNA, 15 bp, Homo sapiens
tgacccacctgaatg

SEQ ID NO: 461377 - DNA, 15 bp, Homo sapiens
gacccacctgaatgc

SEQ ID NO: 461378 - DNA, 15 bp, Homo sapiens
acccacctgaatgca

SEQ ID NO: 461379 - DNA, 15 bp, Homo sapiens
cccacctgaatgcat

SEQ ID NO: 461380 - DNA, 15 bp, Homo sapiens
ccacctgaatgcatc

SEQ ID NO: 461381 - DNA, 15 bp, Homo sapiens
cacctgaatgcatct

SEQ ID NO: 461382 - DNA, 15 bp, Homo sapiens
acctgaatgcatctt

SEQ ID NO: 461383 - DNA, 15 bp, Homo sapiens
cctgaatgcatctta

SEQ ID NO: 461384 - DNA, 15 bp, Homo sapiens
ctgaatgcatcttat

SEQ ID NO: 461385 - DNA, 15 bp, Homo sapiens
tgaatgcatcttatt

SEQ ID NO: 461386 - DNA, 15 bp, Homo sapiens
gaatgcatcttattt

SEQ ID NO: 461387 - DNA, 15 bp, Homo sapiens
aatgcatcttatttg

SEQ ID NO: 461388 - DNA, 15 bp, Homo sapiens
atgcatcttatttgt

SEQ ID NO: 461389 - DNA, 15 bp, Homo sapiens
tgcatcttatttgtt

SEQ ID NO: 461390 - DNA, 15 bp, Homo sapiens
gcatcttatttgttt

SEQ ID NO: 461391 - DNA, 15 bp, Homo sapiens
catcttatttgtttg

SEQ ID NO: 461392 - DNA, 15 bp, Homo sapiens
atcttatttgtttgt

SEQ ID NO: 461393 - DNA, 15 bp, Homo sapiens
tcttatttgtttgtt

SEQ ID NO: 461394 - DNA, 15 bp, Homo sapiens
cttatttgtttgttt

SEQ ID NO: 461395 - DNA, 15 bp, Homo sapiens
ttatttgtttgtttt

SEQ ID NO: 461396 - DNA, 15 bp, Homo sapiens
tatttgtttgttttt

SEQ ID NO: 461397 - DNA, 15 bp, Homo sapiens
atttgtttgtttttg

SEQ ID NO: 461398 - DNA, 15 bp, Homo sapiens
tttgtttgtttttgt

SEQ ID NO: 461399 - DNA, 15 bp, Homo sapiens
ttgtttgtttttgtt

SEQ ID NO: 461400 - DNA, 15 bp, Homo sapiens
tgtttgtttttgttt

SEQ ID NO: 461401 - DNA, 15 bp, Homo sapiens
gtttgtttttgtttt

SEQ ID NO: 461402 - DNA, 15 bp, Homo sapiens
ttgtttttgtttttg

SEQ ID NO: 461403 - DNA, 15 bp, Homo sapiens
tgtttttgtttttgt

SEQ ID NO: 461404 - DNA, 15 bp, Homo sapiens
ttttgtttttgtttg

SEQ ID NO: 461405 - DNA, 15 bp, Homo sapiens
tttgtttttgtttga

SEQ ID NO: 461406 - DNA, 15 bp, Homo sapiens
ttgtttttgtttgag

SEQ ID NO: 461407 - DNA, 15 bp, Homo sapiens
tgtttttgtttgaga

SEQ ID NO: 461408 - DNA, 15 bp, Homo sapiens
gtttttgtttgagac

SEQ ID NO: 461409 - DNA, 15 bp, Homo sapiens
tttttgtttgagaca

SEQ ID NO: 461410 - DNA, 15 bp, Homo sapiens
agtctcactctgtcg

SEQ ID NO: 461411 - DNA, 15 bp, Homo sapiens
gtctcactctgtcgc

SEQ ID NO: 461412 - DNA, 15 bp, Homo sapiens
tctcactctgtcgcc

SEQ ID NO: 461413 - DNA, 15 bp, Homo sapiens
ctcactctgtcgcca

SEQ ID NO: 461414 - DNA, 15 bp, Homo sapiens
tcactctgtcgccag

SEQ ID NO: 461415 - DNA, 15 bp, Homo sapiens
cactctgtcgccagg

SEQ ID NO: 461416 - DNA, 15 bp, Homo sapiens
actctgtcgccaggc

SEQ ID NO: 461417 - DNA, 15 bp, Homo sapiens
gccaggctggagtgc

SEQ ID NO: 461418 - DNA, 15 bp, Homo sapiens
tgcagtggcatgatg

SEQ ID NO: 461419 - DNA, 15 bp, Homo sapiens
gcagtggcatgatgt

SEQ ID NO: 461420 - DNA, 15 bp, Homo sapiens
cagtggcatgatgtc

SEQ ID NO: 461421 - DNA, 15 bp, Homo sapiens
agtggcatgatgtca

SEQ ID NO: 461422 - DNA, 15 bp, Homo sapiens
gtggcatgatgtcag

SEQ ID NO: 461423 - DNA, 15 bp, Homo sapiens
tggcatgatgtcagc

SEQ ID NO: 461424 - DNA, 15 bp, Homo sapiens
ggcatgatgtcagct

SEQ ID NO: 461425 - DNA, 15 bp, Homo sapiens
gcatgatgtcagctc

SEQ ID NO: 461426 - DNA, 15 bp, Homo sapiens
catgatgtcagctca

SEQ ID NO: 461427 - DNA, 15 bp, Homo sapiens
atgatgtcagctcac

SEQ ID NO: 461428 - DNA, 15 bp, Homo sapiens
tgatgtcagctcact

SEQ ID NO: 461429 - DNA, 15 bp, Homo sapiens
gatgtcagctcactg

SEQ ID NO: 461430 - DNA, 15 bp, Homo sapiens
atgtcagctcactgc

SEQ ID NO: 461431 - DNA, 15 bp, Homo sapiens
tgtcagctcactgca

SEQ ID NO: 461432 - DNA, 15 bp, Homo sapiens
gtcagctcactgcaa

SEQ ID NO: 461433 - DNA, 15 bp, Homo sapiens
cactgcaacctctga

SEQ ID NO: 461434 - DNA, 15 bp, Homo sapiens
actgcaacctctgac

SEQ ID NO: 461435 - DNA, 15 bp, Homo sapiens
ctgcaacctctgact

SEQ ID NO: 461436 - DNA, 15 bp, Homo sapiens
tgcaacctctgactc

SEQ ID NO: 461437 - DNA, 15 bp, Homo sapiens
gcaacctctgactcc

SEQ ID NO: 461438 - DNA, 15 bp, Homo sapiens
caacctctgactccc

SEQ ID NO: 461439 - DNA, 15 bp, Homo sapiens
aacctctgactccct

SEQ ID NO: 461440 - DNA, 15 bp, Homo sapiens
acctctgactccctg

SEQ ID NO: 461441 - DNA, 15 bp, Homo sapiens
cctctgactccctgg

SEQ ID NO: 461442 - DNA, 15 bp, Homo sapiens
ctctgactccctggt

SEQ ID NO: 461443 - DNA, 15 bp, Homo sapiens
tctgactccctggtt

SEQ ID NO: 461444 - DNA, 15 bp, Homo sapiens
ctgactccctggttc

SEQ ID NO: 461445 - DNA, 15 bp, Homo sapiens
tgactccctggttca

SEQ ID NO: 461446 - DNA, 15 bp, Homo sapiens
gactccctggttcaa

SEQ ID NO: 461447 - DNA, 15 bp, Homo sapiens
actccctggttcaag

SEQ ID NO: 461448 - DNA, 15 bp, Homo sapiens
ctccctggttcaagc

SEQ ID NO: 461449 - DNA, 15 bp, Homo sapiens
tccctggttcaagcg

SEQ ID NO: 461450 - DNA, 15 bp, Homo sapiens
ccctggttcaagcga

SEQ ID NO: 461451 - DNA, 15 bp, Homo sapiens
cctggttcaagcgat

SEQ ID NO: 461452 - DNA, 15 bp, Homo sapiens
ctggttcaagcgatt

SEQ ID NO: 461453 - DNA, 15 bp, Homo sapiens
tggttcaagcgattt

SEQ ID NO: 461454 - DNA, 15 bp, Homo sapiens
gattacaggcacgcg

SEQ ID NO: 461455 - DNA, 15 bp, Homo sapiens
attacaggcacgcgc

SEQ ID NO: 461456 - DNA, 15 bp, Homo sapiens
ttacaggcacgcgcc

SEQ ID NO: 461457 - DNA, 15 bp, Homo sapiens
tacaggcacgcgcca

SEQ ID NO: 461458 - DNA, 15 bp, Homo sapiens
acaggcacgcgccac

SEQ ID NO: 461459 - DNA, 15 bp, Homo sapiens
caggcacgcgccacc

SEQ ID NO: 461460 - DNA, 15 bp, Homo sapiens
aggcacgcgccacca

SEQ ID NO: 461461 - DNA, 15 bp, Homo sapiens
ggcacgcgccaccac

SEQ ID NO: 461462 - DNA, 15 bp, Homo sapiens
cgccaccacgcccag

SEQ ID NO: 461463 - DNA, 15 bp, Homo sapiens
gctaatttttgtatg

SEQ ID NO: 461464 - DNA, 15 bp, Homo sapiens
ctaatttttgtatgt

SEQ ID NO: 461465 - DNA, 15 bp, Homo sapiens
taatttttgtatgtt

SEQ ID NO: 461466 - DNA, 15 bp, Homo sapiens
aatttttgtatgttt

SEQ ID NO: 461467 - DNA, 15 bp, Homo sapiens
atttttgtatgttta

SEQ ID NO: 461468 - DNA, 15 bp, Homo sapiens
tttttgtatgtttag

SEQ ID NO: 461469 - DNA, 15 bp, Homo sapiens
ttttgtatgtttagt

SEQ ID NO: 461470 - DNA, 15 bp, Homo sapiens
tttgtatgtttagta

SEQ ID NO: 461471 - DNA, 15 bp, Homo sapiens
ttgtatgtttagtag

SEQ ID NO: 461472 - DNA, 15 bp, Homo sapiens
tgtatgtttagtaga

SEQ ID NO: 461473 - DNA, 15 bp, Homo sapiens
gtatgtttagtagag

SEQ ID NO: 461474 - DNA, 15 bp, Homo sapiens
tatgtttagtagaga

SEQ ID NO: 461475 - DNA, 15 bp, Homo sapiens
atgtttagtagagac

SEQ ID NO: 461476 - DNA, 15 bp, Homo sapiens
tgtttagtagagaca

SEQ ID NO: 461477 - DNA, 15 bp, Homo sapiens
gtttagtagagacag

SEQ ID NO: 461478 - DNA, 15 bp, Homo sapiens
aggatggtctcaatt

SEQ ID NO: 461479 - DNA, 15 bp, Homo sapiens
ggatggtctcaattt

SEQ ID NO: 461480 - DNA, 15 bp, Homo sapiens
gatggtctcaatttc

SEQ ID NO: 461481 - DNA, 15 bp, Homo sapiens
atggtctcaatttcc

SEQ ID NO: 461482 - DNA, 15 bp, Homo sapiens
tggtctcaatttcct

SEQ ID NO: 461483 - DNA, 15 bp, Homo sapiens
ggtctcaatttcctg

SEQ ID NO: 461484 - DNA, 15 bp, Homo sapiens
gtctcaatttcctga

SEQ ID NO: 461485 - DNA, 15 bp, Homo sapiens
tctcaatttcctgac

SEQ ID NO: 461486 - DNA, 15 bp, Homo sapiens
ctcaatttcctgacc

SEQ ID NO: 461487 - DNA, 15 bp, Homo sapiens
tcaatttcctgacct

SEQ ID NO: 461488 - DNA, 15 bp, Homo sapiens
caatttcctgacctc

SEQ ID NO: 461489 - DNA, 15 bp, Homo sapiens
aatttcctgacctcg

SEQ ID NO: 461490 - DNA, 15 bp, Homo sapiens
atttcctgacctcgt

SEQ ID NO: 461491 - DNA, 15 bp, Homo sapiens
tttcctgacctcgtg

SEQ ID NO: 461492 - DNA, 15 bp, Homo sapiens
ttcctgacctcgtga

SEQ ID NO: 461493 - DNA, 15 bp, Homo sapiens
ctgagattacaggcg

SEQ ID NO: 461494 - DNA, 15 bp, Homo sapiens
tgagattacaggcgt

SEQ ID NO: 461495 - DNA, 15 bp, Homo sapiens
gagattacaggcgtg

SEQ ID NO: 461496 - DNA, 15 bp, Homo sapiens
agattacaggcgtga

SEQ ID NO: 461497 - DNA, 15 bp, Homo sapiens
tgagccaccgcgccg

SEQ ID NO: 461498 - DNA, 15 bp, Homo sapiens
gagccaccgcgccgg

SEQ ID NO: 461499 - DNA, 15 bp, Homo sapiens
agccaccgcgccggg

SEQ ID NO: 461500 - DNA, 15 bp, Homo sapiens
gccaccgcgccgggc

SEQ ID NO: 461501 - DNA, 15 bp, Homo sapiens
ccaccgcgccgggcc

SEQ ID NO: 461502 - DNA, 15 bp, Homo sapiens
caccgcgccgggcct

SEQ ID NO: 461503 - DNA, 15 bp, Homo sapiens
accgcgccgggcctg

SEQ ID NO: 461504 - DNA, 15 bp, Homo sapiens
ccgcgccgggcctga

SEQ ID NO: 461505 - DNA, 15 bp, Homo sapiens
cgcgccgggcctgaa

SEQ ID NO: 461506 - DNA, 15 bp, Homo sapiens
gcgccgggcctgaat

SEQ ID NO: 461507 - DNA, 15 bp, Homo sapiens
cgccgggcctgaatg

SEQ ID NO: 461508 - DNA, 15 bp, Homo sapiens
gccgggcctgaatgt

SEQ ID NO: 461509 - DNA, 15 bp, Homo sapiens
ccgggcctgaatgtg

SEQ ID NO: 461510 - DNA, 15 bp, Homo sapiens
cgggcctgaatgtgt

SEQ ID NO: 461511 - DNA, 15 bp, Homo sapiens
gggcctgaatgtgtc

SEQ ID NO: 461512 - DNA, 15 bp, Homo sapiens
ggcctgaatgtgtct

SEQ ID NO: 461513 - DNA, 15 bp, Homo sapiens
gcctgaatgtgtctt

SEQ ID NO: 461514 - DNA, 15 bp, Homo sapiens
cctgaatgtgtctta

SEQ ID NO: 461515 - DNA, 15 bp, Homo sapiens
ctgaatgtgtcttat

SEQ ID NO: 461516 - DNA, 15 bp, Homo sapiens
tgaatgtgtcttatc

SEQ ID NO: 461517 - DNA, 15 bp, Homo sapiens
gaatgtgtcttatct

SEQ ID NO: 461518 - DNA, 15 bp, Homo sapiens
aatgtgtcttatctc

SEQ ID NO: 461519 - DNA, 15 bp, Homo sapiens
atgtgtcttatctcc

SEQ ID NO: 461520 - DNA, 15 bp, Homo sapiens
tgtgtcttatctccg

SEQ ID NO: 461521 - DNA, 15 bp, Homo sapiens
gtgtcttatctccga

SEQ ID NO: 461522 - DNA, 15 bp, Homo sapiens
tgtcttatctccgat

SEQ ID NO: 461523 - DNA, 15 bp, Homo sapiens
gtcttatctccgatg

SEQ ID NO: 461524 - DNA, 15 bp, Homo sapiens
tcttatctccgatgc

SEQ ID NO: 461525 - DNA, 15 bp, Homo sapiens
cttatctccgatgct

SEQ ID NO: 461526 - DNA, 15 bp, Homo sapiens
ttatctccgatgctc

SEQ ID NO: 461527 - DNA, 15 bp, Homo sapiens
tatctccgatgctca

SEQ ID NO: 461528 - DNA, 15 bp, Homo sapiens
atctccgatgctcac

SEQ ID NO: 461529 - DNA, 15 bp, Homo sapiens
tctccgatgctcaca

SEQ ID NO: 461530 - DNA, 15 bp, Homo sapiens
ctccgatgctcacac

SEQ ID NO: 461531 - DNA, 15 bp, Homo sapiens
tccgatgctcacacc

SEQ ID NO: 461532 - DNA, 15 bp, Homo sapiens
ccgatgctcacaccc

SEQ ID NO: 461533 - DNA, 15 bp, Homo sapiens
cgatgctcacacccc

SEQ ID NO: 461534 - DNA, 15 bp, Homo sapiens
gatgctcacacccct

SEQ ID NO: 461535 - DNA, 15 bp, Homo sapiens
atgctcacacccctg

SEQ ID NO: 461536 - DNA, 15 bp, Homo sapiens
tgctcacacccctgc

SEQ ID NO: 461537 - DNA, 15 bp, Homo sapiens
gctcacacccctgcc

SEQ ID NO: 461538 - DNA, 15 bp, Homo sapiens
ctcacacccctgcct

SEQ ID NO: 461539 - DNA, 15 bp, Homo sapiens
tcacacccctgcctc

SEQ ID NO: 461540 - DNA, 15 bp, Homo sapiens
cacacccctgcctct

SEQ ID NO: 461541 - DNA, 15 bp, Homo sapiens
acacccctgcctctg

SEQ ID NO: 461542 - DNA, 15 bp, Homo sapiens
cacccctgcctctgt

SEQ ID NO: 461543 - DNA, 15 bp, Homo sapiens
acccctgcctctgtg

SEQ ID NO: 461544 - DNA, 15 bp, Homo sapiens
cccctgcctctgtgc

SEQ ID NO: 461545 - DNA, 15 bp, Homo sapiens
ccctgcctctgtgcc

SEQ ID NO: 461546 - DNA, 15 bp, Homo sapiens
cctgcctctgtgcct

SEQ ID NO: 461547 - DNA, 15 bp, Homo sapiens
ctgcctctgtgcctt

SEQ ID NO: 461548 - DNA, 15 bp, Homo sapiens
tgcctctgtgccttt

SEQ ID NO: 461549 - DNA, 15 bp, Homo sapiens
gcctctgtgcctttg

SEQ ID NO: 461550 - DNA, 15 bp, Homo sapiens
cctctgtgcctttgc

SEQ ID NO: 461551 - DNA, 15 bp, Homo sapiens
ctctgtgcctttgct

SEQ ID NO: 461552 - DNA, 15 bp, Homo sapiens
tctgtgcctttgctc

SEQ ID NO: 461553 - DNA, 15 bp, Homo sapiens
ctgtgcctttgctca

SEQ ID NO: 461554 - DNA, 15 bp, Homo sapiens
tgtgcctttgctcag

SEQ ID NO: 461555 - DNA, 15 bp, Homo sapiens
gtgcctttgctcagg

SEQ ID NO: 461556 - DNA, 15 bp, Homo sapiens
tgcctttgctcaggc

SEQ ID NO: 461557 - DNA, 15 bp, Homo sapiens
gcctttgctcaggct

SEQ ID NO: 461558 - DNA, 15 bp, Homo sapiens
cctttgctcaggctt

SEQ ID NO: 461559 - DNA, 15 bp, Homo sapiens
ctttgctcaggcttt

SEQ ID NO: 461560 - DNA, 15 bp, Homo sapiens
tttgctcaggctttc

SEQ ID NO: 461561 - DNA, 15 bp, Homo sapiens
ttgctcaggctttct

SEQ ID NO: 461562 - DNA, 15 bp, Homo sapiens
tgctcaggctttctc

SEQ ID NO: 461563 - DNA, 15 bp, Homo sapiens
gctcaggctttctct

SEQ ID NO: 461564 - DNA, 15 bp, Homo sapiens
ctcaggctttctctg

SEQ ID NO: 461565 - DNA, 15 bp, Homo sapiens
tcaggctttctctgt

SEQ ID NO: 461566 - DNA, 15 bp, Homo sapiens
caggctttctctgtg

SEQ ID NO: 461567 - DNA, 15 bp, Homo sapiens
aggctttctctgtga

SEQ ID NO: 461568 - DNA, 15 bp, Homo sapiens
ggctttctctgtgat

SEQ ID NO: 461569 - DNA, 15 bp, Homo sapiens
gctttctctgtgata

SEQ ID NO: 461570 - DNA, 15 bp, Homo sapiens
ctttctctgtgatac

SEQ ID NO: 461571 - DNA, 15 bp, Homo sapiens
tttctctgtgatact

SEQ ID NO: 461572 - DNA, 15 bp, Homo sapiens
ttctctgtgatactc

SEQ ID NO: 461573 - DNA, 15 bp, Homo sapiens
tctctgtgatactct

SEQ ID NO: 461574 - DNA, 15 bp, Homo sapiens
ctctgtgatactcta

SEQ ID NO: 461575 - DNA, 15 bp, Homo sapiens
tctgtgatactctat

SEQ ID NO: 461576 - DNA, 15 bp, Homo sapiens
ctgtgatactctatg

SEQ ID NO: 461577 - DNA, 15 bp, Homo sapiens
tgtgatactctatgt

SEQ ID NO: 461578 - DNA, 15 bp, Homo sapiens
gtgatactctatgtt

SEQ ID NO: 461579 - DNA, 15 bp, Homo sapiens
tgatactctatgttc

SEQ ID NO: 461580 - DNA, 15 bp, Homo sapiens
gatactctatgttct

SEQ ID NO: 461581 - DNA, 15 bp, Homo sapiens
atactctatgttctc

SEQ ID NO: 461582 - DNA, 15 bp, Homo sapiens
tactctatgttctcc

SEQ ID NO: 461583 - DNA, 15 bp, Homo sapiens
actctatgttctcct

SEQ ID NO: 461584 - DNA, 15 bp, Homo sapiens
ctctatgttctccta

SEQ ID NO: 461585 - DNA, 15 bp, Homo sapiens
tctatgttctcctac

SEQ ID NO: 461586 - DNA, 15 bp, Homo sapiens
ctatgttctcctact

SEQ ID NO: 461587 - DNA, 15 bp, Homo sapiens
tatgttctcctactt

SEQ ID NO: 461588 - DNA, 15 bp, Homo sapiens
atgttctcctacttg

SEQ ID NO: 461589 - DNA, 15 bp, Homo sapiens
tgttctcctacttgg

SEQ ID NO: 461590 - DNA, 15 bp, Homo sapiens
gttctcctacttggg

SEQ ID NO: 461591 - DNA, 15 bp, Homo sapiens
ttctcctacttggga

SEQ ID NO: 461592 - DNA, 15 bp, Homo sapiens
tctcctacttgggac

SEQ ID NO: 461593 - DNA, 15 bp, Homo sapiens
ctcctacttgggact

SEQ ID NO: 461594 - DNA, 15 bp, Homo sapiens
tcctacttgggactg

SEQ ID NO: 461595 - DNA, 15 bp, Homo sapiens
cctacttgggactgt

SEQ ID NO: 461596 - DNA, 15 bp, Homo sapiens
ctacttgggactgtc

SEQ ID NO: 461597 - DNA, 15 bp, Homo sapiens
tacttgggactgtca

SEQ ID NO: 461598 - DNA, 15 bp, Homo sapiens
acttgggactgtcat

SEQ ID NO: 461599 - DNA, 15 bp, Homo sapiens
cttgggactgtcatg

SEQ ID NO: 461600 - DNA, 15 bp, Homo sapiens
ttgggactgtcatgg

SEQ ID NO: 461601 - DNA, 15 bp, Homo sapiens
tgggactgtcatggc

SEQ ID NO: 461602 - DNA, 15 bp, Homo sapiens
gggactgtcatggca

SEQ ID NO: 461603 - DNA, 15 bp, Homo sapiens
ggactgtcatggcat

SEQ ID NO: 461604 - DNA, 15 bp, Homo sapiens
gactgtcatggcatg

SEQ ID NO: 461605 - DNA, 15 bp, Homo sapiens
actgtcatggcatga

SEQ ID NO: 461606 - DNA, 15 bp, Homo sapiens
ctgtcatggcatgac

SEQ ID NO: 461607 - DNA, 15 bp, Homo sapiens
tgtcatggcatgaca

SEQ ID NO: 461608 - DNA, 15 bp, Homo sapiens
gtcatggcatgacat

SEQ ID NO: 461609 - DNA, 15 bp, Homo sapiens
tcatggcatgacata

SEQ ID NO: 461610 - DNA, 15 bp, Homo sapiens
catggcatgacatac

SEQ ID NO: 461611 - DNA, 15 bp, Homo sapiens
atggcatgacatacc

SEQ ID NO: 461612 - DNA, 15 bp, Homo sapiens
tggcatgacatacct

SEQ ID NO: 461613 - DNA, 15 bp, Homo sapiens
ggcatgacatacctt

SEQ ID NO: 461614 - DNA, 15 bp, Homo sapiens
gcatgacataccttc

SEQ ID NO: 461615 - DNA, 15 bp, Homo sapiens
catgacataccttct

SEQ ID NO: 461616 - DNA, 15 bp, Homo sapiens
atgacataccttcta

SEQ ID NO: 461617 - DNA, 15 bp, Homo sapiens
tgacataccttctat

SEQ ID NO: 461618 - DNA, 15 bp, Homo sapiens
gacataccttctatg

SEQ ID NO: 461619 - DNA, 15 bp, Homo sapiens
acataccttctatgt

SEQ ID NO: 461620 - DNA, 15 bp, Homo sapiens
cataccttctatgtc

SEQ ID NO: 461621 - DNA, 15 bp, Homo sapiens
ataccttctatgtct

SEQ ID NO: 461622 - DNA, 15 bp, Homo sapiens
taccttctatgtctg

SEQ ID NO: 461623 - DNA, 15 bp, Homo sapiens
accttctatgtctga

SEQ ID NO: 461624 - DNA, 15 bp, Homo sapiens
ccttctatgtctgat

SEQ ID NO: 461625 - DNA, 15 bp, Homo sapiens
cttctatgtctgatt

SEQ ID NO: 461626 - DNA, 15 bp, Homo sapiens
ttctatgtctgattt

SEQ ID NO: 461627 - DNA, 15 bp, Homo sapiens
tctatgtctgatttt

SEQ ID NO: 461628 - DNA, 15 bp, Homo sapiens
ctatgtctgattttg

SEQ ID NO: 461629 - DNA, 15 bp, Homo sapiens
tatgtctgattttgg

SEQ ID NO: 461630 - DNA, 15 bp, Homo sapiens
atgtctgattttggg

SEQ ID NO: 461631 - DNA, 15 bp, Homo sapiens
tgtctgattttgggt

SEQ ID NO: 461632 - DNA, 15 bp, Homo sapiens
gtctgattttgggtt

SEQ ID NO: 461633 - DNA, 15 bp, Homo sapiens
tctgattttgggttt

SEQ ID NO: 461634 - DNA, 15 bp, Homo sapiens
ctgattttgggttta

SEQ ID NO: 461635 - DNA, 15 bp, Homo sapiens
tgattttgggtttat

SEQ ID NO: 461636 - DNA, 15 bp, Homo sapiens
gattttgggtttatc

SEQ ID NO: 461637 - DNA, 15 bp, Homo sapiens
attttgggtttatct

SEQ ID NO: 461638 - DNA, 15 bp, Homo sapiens
ttttgggtttatctt

SEQ ID NO: 461639 - DNA, 15 bp, Homo sapiens
tttgggtttatcttc

SEQ ID NO: 461640 - DNA, 15 bp, Homo sapiens
ttgggtttatcttct

SEQ ID NO: 461641 - DNA, 15 bp, Homo sapiens
tgggtttatcttctc

SEQ ID NO: 461642 - DNA, 15 bp, Homo sapiens
gggtttatcttctct

SEQ ID NO: 461643 - DNA, 15 bp, Homo sapiens
ggtttatcttctctg

SEQ ID NO: 461644 - DNA, 15 bp, Homo sapiens
gtttatcttctctgt

SEQ ID NO: 461645 - DNA, 15 bp, Homo sapiens
tttatcttctctgtc

SEQ ID NO: 461646 - DNA, 15 bp, Homo sapiens
ttatcttctctgtca

SEQ ID NO: 461647 - DNA, 15 bp, Homo sapiens
tatcttctctgtcac

SEQ ID NO: 461648 - DNA, 15 bp, Homo sapiens
atcttctctgtcaca

SEQ ID NO: 461649 - DNA, 15 bp, Homo sapiens
tcttctctgtcacat

SEQ ID NO: 461650 - DNA, 15 bp, Homo sapiens
cttctctgtcacatg

SEQ ID NO: 461651 - DNA, 15 bp, Homo sapiens
ttctctgtcacatgt

SEQ ID NO: 461652 - DNA, 15 bp, Homo sapiens
tctctgtcacatgtt

SEQ ID NO: 461653 - DNA, 15 bp, Homo sapiens
ctctgtcacatgttg

SEQ ID NO: 461654 - DNA, 15 bp, Homo sapiens
tctgtcacatgttgt

SEQ ID NO: 461655 - DNA, 15 bp, Homo sapiens
ctgtcacatgttgtg

SEQ ID NO: 461656 - DNA, 15 bp, Homo sapiens
tgtcacatgttgtga

SEQ ID NO: 461657 - DNA, 15 bp, Homo sapiens
gtcacatgttgtgaa

SEQ ID NO: 461658 - DNA, 15 bp, Homo sapiens
tcacatgttgtgaaa

SEQ ID NO: 461659 - DNA, 15 bp, Homo sapiens
cacatgttgtgaaac

SEQ ID NO: 461660 - DNA, 15 bp, Homo sapiens
acatgttgtgaaact

SEQ ID NO: 461661 - DNA, 15 bp, Homo sapiens
catgttgtgaaacta

SEQ ID NO: 461662 - DNA, 15 bp, Homo sapiens
atgttgtgaaactaa

SEQ ID NO: 461663 - DNA, 15 bp, Homo sapiens
tgttgtgaaactaat

SEQ ID NO: 461664 - DNA, 15 bp, Homo sapiens
gttgtgaaactaatg

SEQ ID NO: 461665 - DNA, 15 bp, Homo sapiens
ttgtgaaactaatga

SEQ ID NO: 461666 - DNA, 15 bp, Homo sapiens
tgtgaaactaatgac

SEQ ID NO: 461667 - DNA, 15 bp, Homo sapiens
gtgaaactaatgact

SEQ ID NO: 461668 - DNA, 15 bp, Homo sapiens
tgaaactaatgacta

SEQ ID NO: 461669 - DNA, 15 bp, Homo sapiens
gaaactaatgactac

SEQ ID NO: 461670 - DNA, 15 bp, Homo sapiens
aaactaatgactacc

SEQ ID NO: 461671 - DNA, 15 bp, Homo sapiens
aactaatgactacct

SEQ ID NO: 461672 - DNA, 15 bp, Homo sapiens
actaatgactaccta

SEQ ID NO: 461673 - DNA, 15 bp, Homo sapiens
ctaatgactacctag

SEQ ID NO: 461674 - DNA, 15 bp, Homo sapiens
taatgactacctaga

SEQ ID NO: 461675 - DNA, 15 bp, Homo sapiens
aatgactacctagac

SEQ ID NO: 461676 - DNA, 15 bp, Homo sapiens
atgactacctagact

SEQ ID NO: 461677 - DNA, 15 bp, Homo sapiens
tgactacctagacta

SEQ ID NO: 461678 - DNA, 15 bp, Homo sapiens
gactacctagactaa

SEQ ID NO: 461679 - DNA, 15 bp, Homo sapiens
actacctagactaaa

SEQ ID NO: 461680 - DNA, 15 bp, Homo sapiens
ctacctagactaaat

SEQ ID NO: 461681 - DNA, 15 bp, Homo sapiens
tacctagactaaatc

SEQ ID NO: 461682 - DNA, 15 bp, Homo sapiens
acctagactaaatca

SEQ ID NO: 461683 - DNA, 15 bp, Homo sapiens
cctagactaaatcac

SEQ ID NO: 461684 - DNA, 15 bp, Homo sapiens
ctagactaaatcact

SEQ ID NO: 461685 - DNA, 15 bp, Homo sapiens
tagactaaatcacta

SEQ ID NO: 461686 - DNA, 15 bp, Homo sapiens
agactaaatcactaa

SEQ ID NO: 461687 - DNA, 15 bp, Homo sapiens
gactaaatcactaat

SEQ ID NO: 461688 - DNA, 15 bp, Homo sapiens
actaaatcactaatg

SEQ ID NO: 461689 - DNA, 15 bp, Homo sapiens
ctaaatcactaatga

SEQ ID NO: 461690 - DNA, 15 bp, Homo sapiens
taaatcactaatgat

SEQ ID NO: 461691 - DNA, 15 bp, Homo sapiens
aaatcactaatgata

SEQ ID NO: 461692 - DNA, 15 bp, Homo sapiens
aatcactaatgatag

SEQ ID NO: 461693 - DNA, 15 bp, Homo sapiens
atcactaatgatagg

SEQ ID NO: 461694 - DNA, 15 bp, Homo sapiens
tcactaatgataggc

SEQ ID NO: 461695 - DNA, 15 bp, Homo sapiens
cactaatgataggca

SEQ ID NO: 461696 - DNA, 15 bp, Homo sapiens
actaatgataggcag

SEQ ID NO: 461697 - DNA, 15 bp, Homo sapiens
ctaatgataggcagc

SEQ ID NO: 461698 - DNA, 15 bp, Homo sapiens
taatgataggcagcc

SEQ ID NO: 461699 - DNA, 15 bp, Homo sapiens
aatgataggcagcca

SEQ ID NO: 461700 - DNA, 15 bp, Homo sapiens
atgataggcagccac

SEQ ID NO: 461701 - DNA, 15 bp, Homo sapiens
tgataggcagccaca

SEQ ID NO: 461702 - DNA, 15 bp, Homo sapiens
gataggcagccacaa

SEQ ID NO: 461703 - DNA, 15 bp, Homo sapiens
ataggcagccacaat

SEQ ID NO: 461704 - DNA, 15 bp, Homo sapiens
taggcagccacaatg

SEQ ID NO: 461705 - DNA, 15 bp, Homo sapiens
aggcagccacaatga

SEQ ID NO: 461706 - DNA, 15 bp, Homo sapiens
ggcagccacaatgat

SEQ ID NO: 461707 - DNA, 15 bp, Homo sapiens
gcagccacaatgatc

SEQ ID NO: 461708 - DNA, 15 bp, Homo sapiens
cagccacaatgatct

SEQ ID NO: 461709 - DNA, 15 bp, Homo sapiens
agccacaatgatctt

SEQ ID NO: 461710 - DNA, 15 bp, Homo sapiens
gccacaatgatcttg

SEQ ID NO: 461711 - DNA, 15 bp, Homo sapiens
ccacaatgatcttgt

SEQ ID NO: 461712 - DNA, 15 bp, Homo sapiens
cacaatgatcttgta

SEQ ID NO: 461713 - DNA, 15 bp, Homo sapiens
acaatgatcttgtac

SEQ ID NO: 461714 - DNA, 15 bp, Homo sapiens
caatgatcttgtact

SEQ ID NO: 461715 - DNA, 15 bp, Homo sapiens
aatgatcttgtactt

SEQ ID NO: 461716 - DNA, 15 bp, Homo sapiens
atgatcttgtacttg

SEQ ID NO: 461717 - DNA, 15 bp, Homo sapiens
tgatcttgtacttga

SEQ ID NO: 461718 - DNA, 15 bp, Homo sapiens
gatcttgtacttgat

SEQ ID NO: 461719 - DNA, 15 bp, Homo sapiens
atcttgtacttgatg

SEQ ID NO: 461720 - DNA, 15 bp, Homo sapiens
tcttgtacttgatgt

SEQ ID NO: 461721 - DNA, 15 bp, Homo sapiens
cttgtacttgatgtt

SEQ ID NO: 461722 - DNA, 15 bp, Homo sapiens
ttgtacttgatgttt

SEQ ID NO: 461723 - DNA, 15 bp, Homo sapiens
tgtacttgatgtttg

SEQ ID NO: 461724 - DNA, 15 bp, Homo sapiens
gtacttgatgtttga

SEQ ID NO: 461725 - DNA, 15 bp, Homo sapiens
tacttgatgtttgat

SEQ ID NO: 461726 - DNA, 15 bp, Homo sapiens
acttgatgtttgatt

SEQ ID NO: 461727 - DNA, 15 bp, Homo sapiens
cttgatgtttgattt

SEQ ID NO: 461728 - DNA, 15 bp, Homo sapiens
ttgatgtttgatttc

SEQ ID NO: 461729 - DNA, 15 bp, Homo sapiens
tgatgtttgatttcc

SEQ ID NO: 461730 - DNA, 15 bp, Homo sapiens
gatgtttgatttcca

SEQ ID NO: 461731 - DNA, 15 bp, Homo sapiens
atgtttgatttccat

SEQ ID NO: 461732 - DNA, 15 bp, Homo sapiens
tgtttgatttccata

SEQ ID NO: 461733 - DNA, 15 bp, Homo sapiens
gtttgatttccatac

SEQ ID NO: 461734 - DNA, 15 bp, Homo sapiens
tttgatttccataca

SEQ ID NO: 461735 - DNA, 15 bp, Homo sapiens
ttgatttccatacat

SEQ ID NO: 461736 - DNA, 15 bp, Homo sapiens
tgatttccatacata

SEQ ID NO: 461737 - DNA, 15 bp, Homo sapiens
gatttccatacataa

SEQ ID NO: 461738 - DNA, 15 bp, Homo sapiens
atttccatacataaa

SEQ ID NO: 461739 - DNA, 15 bp, Homo sapiens
tttccatacataaag

SEQ ID NO: 461740 - DNA, 15 bp, Homo sapiens
ttccatacataaagg

SEQ ID NO: 461741 - DNA, 15 bp, Homo sapiens
tccatacataaagga

SEQ ID NO: 461742 - DNA, 15 bp, Homo sapiens
ccatacataaaggat

SEQ ID NO: 461743 - DNA, 15 bp, Homo sapiens
catacataaaggatt

SEQ ID NO: 461744 - DNA, 15 bp, Homo sapiens
atacataaaggattg

SEQ ID NO: 461745 - DNA, 15 bp, Homo sapiens
tacataaaggattgt

SEQ ID NO: 461746 - DNA, 15 bp, Homo sapiens
acataaaggattgtc

SEQ ID NO: 461747 - DNA, 15 bp, Homo sapiens
cataaaggattgtct

SEQ ID NO: 461748 - DNA, 15 bp, Homo sapiens
ataaaggattgtctc

SEQ ID NO: 461749 - DNA, 15 bp, Homo sapiens
taaaggattgtctca

SEQ ID NO: 461750 - DNA, 15 bp, Homo sapiens
aaaggattgtctcat

SEQ ID NO: 461751 - DNA, 15 bp, Homo sapiens
aaggattgtctcata

SEQ ID NO: 461752 - DNA, 15 bp, Homo sapiens
aggattgtctcatat

SEQ ID NO: 461753 - DNA, 15 bp, Homo sapiens
ggattgtctcatatg

SEQ ID NO: 461754 - DNA, 15 bp, Homo sapiens
gattgtctcatatgt

SEQ ID NO: 461755 - DNA, 15 bp, Homo sapiens
attgtctcatatgtt

SEQ ID NO: 461756 - DNA, 15 bp, Homo sapiens
ttgtctcatatgttt

SEQ ID NO: 461757 - DNA, 15 bp, Homo sapiens
tgtctcatatgtttt

SEQ ID NO: 461758 - DNA, 15 bp, Homo sapiens
gtctcatatgttttc

SEQ ID NO: 461759 - DNA, 15 bp, Homo sapiens
tctcatatgttttct

SEQ ID NO: 461760 - DNA, 15 bp, Homo sapiens
ctcatatgttttcta

SEQ ID NO: 461761 - DNA, 15 bp, Homo sapiens
tcatatgttttctag

SEQ ID NO: 461762 - DNA, 15 bp, Homo sapiens
catatgttttctagt

SEQ ID NO: 461763 - DNA, 15 bp, Homo sapiens
atatgttttctagtt

SEQ ID NO: 461764 - DNA, 15 bp, Homo sapiens
tatgttttctagttg

SEQ ID NO: 461765 - DNA, 15 bp, Homo sapiens
atgttttctagttgt

SEQ ID NO: 461766 - DNA, 15 bp, Homo sapiens
tgttttctagttgta

SEQ ID NO: 461767 - DNA, 15 bp, Homo sapiens
gttttctagttgtat

SEQ ID NO: 461768 - DNA, 15 bp, Homo sapiens
ttttctagttgtatt

SEQ ID NO: 461769 - DNA, 15 bp, Homo sapiens
tttctagttgtattc

SEQ ID NO: 461770 - DNA, 15 bp, Homo sapiens
ttctagttgtattcc

SEQ ID NO: 461771 - DNA, 15 bp, Homo sapiens
tctagttgtattcct

SEQ ID NO: 461772 - DNA, 15 bp, Homo sapiens
ctagttgtattccta

SEQ ID NO: 461773 - DNA, 15 bp, Homo sapiens
tagttgtattcctat

SEQ ID NO: 461774 - DNA, 15 bp, Homo sapiens
agttgtattcctatc

SEQ ID NO: 461775 - DNA, 15 bp, Homo sapiens
gttgtattcctatct

SEQ ID NO: 461776 - DNA, 15 bp, Homo sapiens
ttgtattcctatctt

SEQ ID NO: 461777 - DNA, 15 bp, Homo sapiens
tgtattcctatctta

SEQ ID NO: 461778 - DNA, 15 bp, Homo sapiens
gtattcctatcttac

SEQ ID NO: 461779 - DNA, 15 bp, Homo sapiens
tattcctatcttacc

SEQ ID NO: 461780 - DNA, 15 bp, Homo sapiens
attcctatcttacct

SEQ ID NO: 461781 - DNA, 15 bp, Homo sapiens
ttcctatcttacctt

SEQ ID NO: 461782 - DNA, 15 bp, Homo sapiens
tcctatcttaccttc

SEQ ID NO: 461783 - DNA, 15 bp, Homo sapiens
cctatcttaccttcc

SEQ ID NO: 461784 - DNA, 15 bp, Homo sapiens
ctatcttaccttcct

SEQ ID NO: 461785 - DNA, 15 bp, Homo sapiens
tatcttaccttcctc

SEQ ID NO: 461786 - DNA, 15 bp, Homo sapiens
atcttaccttcctca

SEQ ID NO: 461787 - DNA, 15 bp, Homo sapiens
tcttaccttcctcag

SEQ ID NO: 461788 - DNA, 15 bp, Homo sapiens
cttaccttcctcagc

SEQ ID NO: 461789 - DNA, 15 bp, Homo sapiens
ttaccttcctcagct

SEQ ID NO: 461790 - DNA, 15 bp, Homo sapiens
taccttcctcagcta

SEQ ID NO: 461791 - DNA, 15 bp, Homo sapiens
accttcctcagctag

SEQ ID NO: 461792 - DNA, 15 bp, Homo sapiens
ccttcctcagctagt

SEQ ID NO: 461793 - DNA, 15 bp, Homo sapiens
cttcctcagctagtg

SEQ ID NO: 461794 - DNA, 15 bp, Homo sapiens
ttcctcagctagtgt

SEQ ID NO: 461795 - DNA, 15 bp, Homo sapiens
tcctcagctagtgtg

SEQ ID NO: 461796 - DNA, 15 bp, Homo sapiens
cctcagctagtgtgt

SEQ ID NO: 461797 - DNA, 15 bp, Homo sapiens
ctcagctagtgtgtg

SEQ ID NO: 461798 - DNA, 15 bp, Homo sapiens
tcagctagtgtgtga

SEQ ID NO: 461799 - DNA, 15 bp, Homo sapiens
cagctagtgtgtgag

SEQ ID NO: 461800 - DNA, 15 bp, Homo sapiens
agctagtgtgtgagt

SEQ ID NO: 461801 - DNA, 15 bp, Homo sapiens
gctagtgtgtgagtt

SEQ ID NO: 461802 - DNA, 15 bp, Homo sapiens
ctagtgtgtgagttc

SEQ ID NO: 461803 - DNA, 15 bp, Homo sapiens
tagtgtgtgagttca

SEQ ID NO: 461804 - DNA, 15 bp, Homo sapiens
agtgtgtgagttcat

SEQ ID NO: 461805 - DNA, 15 bp, Homo sapiens
gtgtgtgagttcatc

SEQ ID NO: 461806 - DNA, 15 bp, Homo sapiens
tgtgtgagttcatcg

SEQ ID NO: 461807 - DNA, 15 bp, Homo sapiens
gtgtgagttcatcgg

SEQ ID NO: 461808 - DNA, 15 bp, Homo sapiens
tgtgagttcatcggg

SEQ ID NO: 461809 - DNA, 15 bp, Homo sapiens
gtgagttcatcgggg

SEQ ID NO: 461810 - DNA, 15 bp, Homo sapiens
tgagttcatcggggt

SEQ ID NO: 461811 - DNA, 15 bp, Homo sapiens
gagttcatcggggta

SEQ ID NO: 461812 - DNA, 15 bp, Homo sapiens
agttcatcggggtag

SEQ ID NO: 461813 - DNA, 15 bp, Homo sapiens
gttcatcggggtagg

SEQ ID NO: 461814 - DNA, 15 bp, Homo sapiens
ttcatcggggtagga

SEQ ID NO: 461815 - DNA, 15 bp, Homo sapiens
tcatcggggtaggaa

SEQ ID NO: 461816 - DNA, 15 bp, Homo sapiens
catcggggtaggaat

SEQ ID NO: 461817 - DNA, 15 bp, Homo sapiens
atcggggtaggaatc

SEQ ID NO: 461818 - DNA, 15 bp, Homo sapiens
tcggggtaggaatca

SEQ ID NO: 461819 - DNA, 15 bp, Homo sapiens
cggggtaggaatcat

SEQ ID NO: 461820 - DNA, 15 bp, Homo sapiens
ggggtaggaatcatg

SEQ ID NO: 461821 - DNA, 15 bp, Homo sapiens
gggtaggaatcatgt

SEQ ID NO: 461822 - DNA, 15 bp, Homo sapiens
ggtaggaatcatgtc

SEQ ID NO: 461823 - DNA, 15 bp, Homo sapiens
gtaggaatcatgtct

SEQ ID NO: 461824 - DNA, 15 bp, Homo sapiens
taggaatcatgtctt

SEQ ID NO: 461825 - DNA, 15 bp, Homo sapiens
aggaatcatgtcttc

SEQ ID NO: 461826 - DNA, 15 bp, Homo sapiens
ggaatcatgtcttct

SEQ ID NO: 461827 - DNA, 15 bp, Homo sapiens
gaatcatgtcttctg

SEQ ID NO: 461828 - DNA, 15 bp, Homo sapiens
aatcatgtcttctgc

SEQ ID NO: 461829 - DNA, 15 bp, Homo sapiens
atcatgtcttctgct

SEQ ID NO: 461830 - DNA, 15 bp, Homo sapiens
tcatgtcttctgctt

SEQ ID NO: 461831 - DNA, 15 bp, Homo sapiens
catgtcttctgcttt

SEQ ID NO: 461832 - DNA, 15 bp, Homo sapiens
atgtcttctgctttt

SEQ ID NO: 461833 - DNA, 15 bp, Homo sapiens
tgtcttctgcttttc

SEQ ID NO: 461834 - DNA, 15 bp, Homo sapiens
gtcttctgcttttct

SEQ ID NO: 461835 - DNA, 15 bp, Homo sapiens
tcttctgcttttctc

SEQ ID NO: 461836 - DNA, 15 bp, Homo sapiens
cttctgcttttctct

SEQ ID NO: 461837 - DNA, 15 bp, Homo sapiens
ttctgcttttctctt

SEQ ID NO: 461838 - DNA, 15 bp, Homo sapiens
tctgcttttctcttg

SEQ ID NO: 461839 - DNA, 15 bp, Homo sapiens
ctgcttttctcttgg

SEQ ID NO: 461840 - DNA, 15 bp, Homo sapiens
tgcttttctcttggt

SEQ ID NO: 461841 - DNA, 15 bp, Homo sapiens
gcttttctcttggtc

SEQ ID NO: 461842 - DNA, 15 bp, Homo sapiens
cttttctcttggtcc

SEQ ID NO: 461843 - DNA, 15 bp, Homo sapiens
ttttctcttggtccc

SEQ ID NO: 461844 - DNA, 15 bp, Homo sapiens
tttctcttggtccca

SEQ ID NO: 461845 - DNA, 15 bp, Homo sapiens
ttctcttggtcccaa

SEQ ID NO: 461846 - DNA, 15 bp, Homo sapiens
tctcttggtcccaac

SEQ ID NO: 461847 - DNA, 15 bp, Homo sapiens
ctcttggtcccaaca

SEQ ID NO: 461848 - DNA, 15 bp, Homo sapiens
tcttggtcccaacag

SEQ ID NO: 461849 - DNA, 15 bp, Homo sapiens
cttggtcccaacagt

SEQ ID NO: 461850 - DNA, 15 bp, Homo sapiens
ttggtcccaacagta

SEQ ID NO: 461851 - DNA, 15 bp, Homo sapiens
tggtcccaacagtac

SEQ ID NO: 461852 - DNA, 15 bp, Homo sapiens
ggtcccaacagtaca

SEQ ID NO: 461853 - DNA, 15 bp, Homo sapiens
gtcccaacagtacac

SEQ ID NO: 461854 - DNA, 15 bp, Homo sapiens
tcccaacagtacaca

SEQ ID NO: 461855 - DNA, 15 bp, Homo sapiens
cccaacagtacacag

SEQ ID NO: 461856 - DNA, 15 bp, Homo sapiens
ccaacagtacacaga

SEQ ID NO: 461857 - DNA, 15 bp, Homo sapiens
caacagtacacagag

SEQ ID NO: 461858 - DNA, 15 bp, Homo sapiens
aacagtacacagagc

SEQ ID NO: 461859 - DNA, 15 bp, Homo sapiens
acagtacacagagca

SEQ ID NO: 461860 - DNA, 15 bp, Homo sapiens
cagtacacagagcaa

SEQ ID NO: 461861 - DNA, 15 bp, Homo sapiens
agtacacagagcaat

SEQ ID NO: 461862 - DNA, 15 bp, Homo sapiens
gtacacagagcaatg

SEQ ID NO: 461863 - DNA, 15 bp, Homo sapiens
tacacagagcaatgt

SEQ ID NO: 461864 - DNA, 15 bp, Homo sapiens
acacagagcaatgtc

SEQ ID NO: 461865 - DNA, 15 bp, Homo sapiens
cacagagcaatgtca

SEQ ID NO: 461866 - DNA, 15 bp, Homo sapiens
acagagcaatgtcag

SEQ ID NO: 461867 - DNA, 15 bp, Homo sapiens
cagagcaatgtcagg

SEQ ID NO: 461868 - DNA, 15 bp, Homo sapiens
agagcaatgtcagga

SEQ ID NO: 461869 - DNA, 15 bp, Homo sapiens
gagcaatgtcaggat

SEQ ID NO: 461870 - DNA, 15 bp, Homo sapiens
agcaatgtcaggatc

SEQ ID NO: 461871 - DNA, 15 bp, Homo sapiens
gcaatgtcaggatca

SEQ ID NO: 461872 - DNA, 15 bp, Homo sapiens
caatgtcaggatcac

SEQ ID NO: 461873 - DNA, 15 bp, Homo sapiens
aatgtcaggatcaca

SEQ ID NO: 461874 - DNA, 15 bp, Homo sapiens
atgtcaggatcacag

SEQ ID NO: 461875 - DNA, 15 bp, Homo sapiens
tgtcaggatcacagt

SEQ ID NO: 461876 - DNA, 15 bp, Homo sapiens
gtcaggatcacagta

SEQ ID NO: 461877 - DNA, 15 bp, Homo sapiens
tcaggatcacagtaa

SEQ ID NO: 461878 - DNA, 15 bp, Homo sapiens
caggatcacagtaag

SEQ ID NO: 461879 - DNA, 15 bp, Homo sapiens
aggatcacagtaagc

SEQ ID NO: 461880 - DNA, 15 bp, Homo sapiens
ggatcacagtaagcc

SEQ ID NO: 461881 - DNA, 15 bp, Homo sapiens
gatcacagtaagcct

SEQ ID NO: 461882 - DNA, 15 bp, Homo sapiens
atcacagtaagcctt

SEQ ID NO: 461883 - DNA, 15 bp, Homo sapiens
tcacagtaagccttt

SEQ ID NO: 461884 - DNA, 15 bp, Homo sapiens
cacagtaagcctttg

SEQ ID NO: 461885 - DNA, 15 bp, Homo sapiens
acagtaagcctttgt

SEQ ID NO: 461886 - DNA, 15 bp, Homo sapiens
cagtaagcctttgta

SEQ ID NO: 461887 - DNA, 15 bp, Homo sapiens
agtaagcctttgtaa

SEQ ID NO: 461888 - DNA, 15 bp, Homo sapiens
gtaagcctttgtaac

SEQ ID NO: 461889 - DNA, 15 bp, Homo sapiens
taagcctttgtaact

SEQ ID NO: 461890 - DNA, 15 bp, Homo sapiens
aagcctttgtaactg

SEQ ID NO: 461891 - DNA, 15 bp, Homo sapiens
agcctttgtaactgg

SEQ ID NO: 461892 - DNA, 15 bp, Homo sapiens
gcctttgtaactggt

SEQ ID NO: 461893 - DNA, 15 bp, Homo sapiens
cctttgtaactggtg

SEQ ID NO: 461894 - DNA, 15 bp, Homo sapiens
ctttgtaactggtga

SEQ ID NO: 461895 - DNA, 15 bp, Homo sapiens
tttgtaactggtgat

SEQ ID NO: 461896 - DNA, 15 bp, Homo sapiens
ttgtaactggtgatg

SEQ ID NO: 461897 - DNA, 15 bp, Homo sapiens
tgtaactggtgatgg

SEQ ID NO: 461898 - DNA, 15 bp, Homo sapiens
gtaactggtgatggt

SEQ ID NO: 461899 - DNA, 15 bp, Homo sapiens
taactggtgatggtg

SEQ ID NO: 461900 - DNA, 15 bp, Homo sapiens
aactggtgatggtgt

SEQ ID NO: 461901 - DNA, 15 bp, Homo sapiens
actggtgatggtgtg

SEQ ID NO: 461902 - DNA, 15 bp, Homo sapiens
ctggtgatggtgtga

SEQ ID NO: 461903 - DNA, 15 bp, Homo sapiens
tggtgatggtgtgat

SEQ ID NO: 461904 - DNA, 15 bp, Homo sapiens
ggtgatggtgtgatg

SEQ ID NO: 461905 - DNA, 15 bp, Homo sapiens
gtgatggtgtgatga

SEQ ID NO: 461906 - DNA, 15 bp, Homo sapiens
tgatggtgtgatgaa

SEQ ID NO: 461907 - DNA, 15 bp, Homo sapiens
gatggtgtgatgaat

SEQ ID NO: 461908 - DNA, 15 bp, Homo sapiens
atggtgtgatgaatg

SEQ ID NO: 461909 - DNA, 15 bp, Homo sapiens
tggtgtgatgaatgg

SEQ ID NO: 461910 - DNA, 15 bp, Homo sapiens
ggtgtgatgaatggg

SEQ ID NO: 461911 - DNA, 15 bp, Homo sapiens
gtgtgatgaatgggt

SEQ ID NO: 461912 - DNA, 15 bp, Homo sapiens
tgtgatgaatgggtg

SEQ ID NO: 461913 - DNA, 15 bp, Homo sapiens
gtgatgaatgggtga

SEQ ID NO: 461914 - DNA, 15 bp, Homo sapiens
tgatgaatgggtgat

SEQ ID NO: 461915 - DNA, 15 bp, Homo sapiens
gatgaatgggtgatt

SEQ ID NO: 461916 - DNA, 15 bp, Homo sapiens
atgaatgggtgattg

SEQ ID NO: 461917 - DNA, 15 bp, Homo sapiens
tgaatgggtgattga

SEQ ID NO: 461918 - DNA, 15 bp, Homo sapiens
gaatgggtgattgac

SEQ ID NO: 461919 - DNA, 15 bp, Homo sapiens
aatgggtgattgaca

SEQ ID NO: 461920 - DNA, 15 bp, Homo sapiens
atgggtgattgacag

SEQ ID NO: 461921 - DNA, 15 bp, Homo sapiens
tgggtgattgacagc

SEQ ID NO: 461922 - DNA, 15 bp, Homo sapiens
gggtgattgacagca

SEQ ID NO: 461923 - DNA, 15 bp, Homo sapiens
ggtgattgacagcat

SEQ ID NO: 461924 - DNA, 15 bp, Homo sapiens
gtgattgacagcatc

SEQ ID NO: 461925 - DNA, 15 bp, Homo sapiens
tgattgacagcatca

SEQ ID NO: 461926 - DNA, 15 bp, Homo sapiens
gattgacagcatcag

SEQ ID NO: 461927 - DNA, 15 bp, Homo sapiens
attgacagcatcagt

SEQ ID NO: 461928 - DNA, 15 bp, Homo sapiens
ttgacagcatcagtt

SEQ ID NO: 461929 - DNA, 15 bp, Homo sapiens
tgacagcatcagttg

SEQ ID NO: 461930 - DNA, 15 bp, Homo sapiens
gacagcatcagttgt

SEQ ID NO: 461931 - DNA, 15 bp, Homo sapiens
acagcatcagttgtc

SEQ ID NO: 461932 - DNA, 15 bp, Homo sapiens
cagcatcagttgtct

SEQ ID NO: 461933 - DNA, 15 bp, Homo sapiens
agcatcagttgtctt

SEQ ID NO: 461934 - DNA, 15 bp, Homo sapiens
gcatcagttgtcttc

SEQ ID NO: 461935 - DNA, 15 bp, Homo sapiens
catcagttgtcttcc

SEQ ID NO: 461936 - DNA, 15 bp, Homo sapiens
atcagttgtcttcct

SEQ ID NO: 461937 - DNA, 15 bp, Homo sapiens
tcagttgtcttcctg

SEQ ID NO: 461938 - DNA, 15 bp, Homo sapiens
cagttgtcttcctga

SEQ ID NO: 461939 - DNA, 15 bp, Homo sapiens
agttgtcttcctgat

SEQ ID NO: 461940 - DNA, 15 bp, Homo sapiens
gttgtcttcctgatg

SEQ ID NO: 461941 - DNA, 15 bp, Homo sapiens
ttgtcttcctgatga

SEQ ID NO: 461942 - DNA, 15 bp, Homo sapiens
tgtcttcctgatgat

SEQ ID NO: 461943 - DNA, 15 bp, Homo sapiens
gtcttcctgatgata

SEQ ID NO: 461944 - DNA, 15 bp, Homo sapiens
tcttcctgatgatat

SEQ ID NO: 461945 - DNA, 15 bp, Homo sapiens
cttcctgatgatatt

SEQ ID NO: 461946 - DNA, 15 bp, Homo sapiens
ttcctgatgatattc

SEQ ID NO: 461947 - DNA, 15 bp, Homo sapiens
tcctgatgatattcc

SEQ ID NO: 461948 - DNA, 15 bp, Homo sapiens
cctgatgatattcct

SEQ ID NO: 461949 - DNA, 15 bp, Homo sapiens
ctgatgatattcctt

SEQ ID NO: 461950 - DNA, 15 bp, Homo sapiens
tgatgatattccttt

SEQ ID NO: 461951 - DNA, 15 bp, Homo sapiens
gatgatattcctttc

SEQ ID NO: 461952 - DNA, 15 bp, Homo sapiens
atgatattcctttct

SEQ ID NO: 461953 - DNA, 15 bp, Homo sapiens
tgatattcctttctt

SEQ ID NO: 461954 - DNA, 15 bp, Homo sapiens
gatattcctttcttg

SEQ ID NO: 461955 - DNA, 15 bp, Homo sapiens
atattcctttcttgt

SEQ ID NO: 461956 - DNA, 15 bp, Homo sapiens
tattcctttcttgtg

SEQ ID NO: 461957 - DNA, 15 bp, Homo sapiens
attcctttcttgtgt

SEQ ID NO: 461958 - DNA, 15 bp, Homo sapiens
ttcctttcttgtgtt

SEQ ID NO: 461959 - DNA, 15 bp, Homo sapiens
tcctttcttgtgttg

SEQ ID NO: 461960 - DNA, 15 bp, Homo sapiens
cctttcttgtgttgt

SEQ ID NO: 461961 - DNA, 15 bp, Homo sapiens
ctttcttgtgttgtg

SEQ ID NO: 461962 - DNA, 15 bp, Homo sapiens
tttcttgtgttgtga

SEQ ID NO: 461963 - DNA, 15 bp, Homo sapiens
ttcttgtgttgtgac

SEQ ID NO: 461964 - DNA, 15 bp, Homo sapiens
tcttgtgttgtgaca

SEQ ID NO: 461965 - DNA, 15 bp, Homo sapiens
cttgtgttgtgacag

SEQ ID NO: 461966 - DNA, 15 bp, Homo sapiens
ttgtgttgtgacagt

SEQ ID NO: 461967 - DNA, 15 bp, Homo sapiens
tgtgttgtgacagta

SEQ ID NO: 461968 - DNA, 15 bp, Homo sapiens
gtgttgtgacagtaa

SEQ ID NO: 461969 - DNA, 15 bp, Homo sapiens
tgttgtgacagtaaa

SEQ ID NO: 461970 - DNA, 15 bp, Homo sapiens
gttgtgacagtaaag

SEQ ID NO: 461971 - DNA, 15 bp, Homo sapiens
ttgtgacagtaaagt

SEQ ID NO: 461972 - DNA, 15 bp, Homo sapiens
tgtgacagtaaagtg

SEQ ID NO: 461973 - DNA, 15 bp, Homo sapiens
gtgacagtaaagtgg

SEQ ID NO: 461974 - DNA, 15 bp, Homo sapiens
tgacagtaaagtggg

SEQ ID NO: 461975 - DNA, 15 bp, Homo sapiens
gacagtaaagtggga

SEQ ID NO: 461976 - DNA, 15 bp, Homo sapiens
acagtaaagtgggag

SEQ ID NO: 461977 - DNA, 15 bp, Homo sapiens
cagtaaagtgggagt

SEQ ID NO: 461978 - DNA, 15 bp, Homo sapiens
agtaaagtgggagtc

SEQ ID NO: 461979 - DNA, 15 bp, Homo sapiens
gtaaagtgggagtca

SEQ ID NO: 461980 - DNA, 15 bp, Homo sapiens
taaagtgggagtcat

SEQ ID NO: 461981 - DNA, 15 bp, Homo sapiens
aaagtgggagtcatg

SEQ ID NO: 461982 - DNA, 15 bp, Homo sapiens
aagtgggagtcatgc

SEQ ID NO: 461983 - DNA, 15 bp, Homo sapiens
agtgggagtcatgct

SEQ ID NO: 461984 - DNA, 15 bp, Homo sapiens
gtgggagtcatgctt

SEQ ID NO: 461985 - DNA, 15 bp, Homo sapiens
tgggagtcatgcttt

SEQ ID NO: 461986 - DNA, 15 bp, Homo sapiens
gggagtcatgcttta

SEQ ID NO: 461987 - DNA, 15 bp, Homo sapiens
ggagtcatgctttaa

SEQ ID NO: 461988 - DNA, 15 bp, Homo sapiens
gagtcatgctttaat

SEQ ID NO: 461989 - DNA, 15 bp, Homo sapiens
agtcatgctttaatg

SEQ ID NO: 461990 - DNA, 15 bp, Homo sapiens
gtcatgctttaatgc

SEQ ID NO: 461991 - DNA, 15 bp, Homo sapiens
tcatgctttaatgca

SEQ ID NO: 461992 - DNA, 15 bp, Homo sapiens
catgctttaatgcat

SEQ ID NO: 461993 - DNA, 15 bp, Homo sapiens
atgctttaatgcata

SEQ ID NO: 461994 - DNA, 15 bp, Homo sapiens
tgctttaatgcatat

SEQ ID NO: 461995 - DNA, 15 bp, Homo sapiens
gctttaatgcatatt

SEQ ID NO: 461996 - DNA, 15 bp, Homo sapiens
ctttaatgcatatta

SEQ ID NO: 461997 - DNA, 15 bp, Homo sapiens
tttaatgcatattat

SEQ ID NO: 461998 - DNA, 15 bp, Homo sapiens
taatgcatattattt

SEQ ID NO: 461999 - DNA, 15 bp, Homo sapiens
aatgcatattatttt

SEQ ID NO: 462000 - DNA, 15 bp, Homo sapiens
atgcatattattttg

SEQ ID NO: 462001 - DNA, 15 bp, Homo sapiens
tgcatattattttga

SEQ ID NO: 462002 - DNA, 15 bp, Homo sapiens
gcatattattttgac

SEQ ID NO: 462003 - DNA, 15 bp, Homo sapiens
catattattttgacc

SEQ ID NO: 462004 - DNA, 15 bp, Homo sapiens
atattattttgacca

SEQ ID NO: 462005 - DNA, 15 bp, Homo sapiens
tattattttgaccat

SEQ ID NO: 462006 - DNA, 15 bp, Homo sapiens
ttttgaccatttttc

SEQ ID NO: 462007 - DNA, 15 bp, Homo sapiens
tttgaccatttttcc

SEQ ID NO: 462008 - DNA, 15 bp, Homo sapiens
ttgaccatttttccc

SEQ ID NO: 462009 - DNA, 15 bp, Homo sapiens
tgaccatttttccct

SEQ ID NO: 462010 - DNA, 15 bp, Homo sapiens
gaccatttttccctg

SEQ ID NO: 462011 - DNA, 15 bp, Homo sapiens
accatttttccctgt

SEQ ID NO: 462012 - DNA, 15 bp, Homo sapiens
ccatttttccctgta

SEQ ID NO: 462013 - DNA, 15 bp, Homo sapiens
catttttccctgtag

SEQ ID NO: 462014 - DNA, 15 bp, Homo sapiens
atttttccctgtagg

SEQ ID NO: 462015 - DNA, 15 bp, Homo sapiens
tttttccctgtaggg

SEQ ID NO: 462016 - DNA, 15 bp, Homo sapiens
ttttccctgtaggga

SEQ ID NO: 462017 - DNA, 15 bp, Homo sapiens
tttccctgtagggat

SEQ ID NO: 462018 - DNA, 15 bp, Homo sapiens
ttccctgtagggatc

SEQ ID NO: 462019 - DNA, 15 bp, Homo sapiens
tccctgtagggatca

SEQ ID NO: 462020 - DNA, 15 bp, Homo sapiens
ccctgtagggatcac

SEQ ID NO: 462021 - DNA, 15 bp, Homo sapiens
cctgtagggatcact

SEQ ID NO: 462022 - DNA, 15 bp, Homo sapiens
ctgtagggatcactt

SEQ ID NO: 462023 - DNA, 15 bp, Homo sapiens
tgtagggatcacttt

SEQ ID NO: 462024 - DNA, 15 bp, Homo sapiens
gtagggatcacttta

SEQ ID NO: 462025 - DNA, 15 bp, Homo sapiens
tagggatcactttat

SEQ ID NO: 462026 - DNA, 15 bp, Homo sapiens
agggatcactttatc

SEQ ID NO: 462027 - DNA, 15 bp, Homo sapiens
gggatcactttatcc

SEQ ID NO: 462028 - DNA, 15 bp, Homo sapiens
ggatcactttatcct

SEQ ID NO: 462029 - DNA, 15 bp, Homo sapiens
gatcactttatcctt

SEQ ID NO: 462030 - DNA, 15 bp, Homo sapiens
atcactttatcctta

SEQ ID NO: 462031 - DNA, 15 bp, Homo sapiens
tcactttatccttag

SEQ ID NO: 462032 - DNA, 15 bp, Homo sapiens
cactttatccttagc

SEQ ID NO: 462033 - DNA, 15 bp, Homo sapiens
actttatccttagcc

SEQ ID NO: 462034 - DNA, 15 bp, Homo sapiens
ctttatccttagcca

SEQ ID NO: 462035 - DNA, 15 bp, Homo sapiens
tttatccttagccac

SEQ ID NO: 462036 - DNA, 15 bp, Homo sapiens
ttatccttagccaca

SEQ ID NO: 462037 - DNA, 15 bp, Homo sapiens
tatccttagccacat

SEQ ID NO: 462038 - DNA, 15 bp, Homo sapiens
atccttagccacatt

SEQ ID NO: 462039 - DNA, 15 bp, Homo sapiens
tccttagccacattc

SEQ ID NO: 462040 - DNA, 15 bp, Homo sapiens
ccttagccacattca

SEQ ID NO: 462041 - DNA, 15 bp, Homo sapiens
cttagccacattcat

SEQ ID NO: 462042 - DNA, 15 bp, Homo sapiens
ttagccacattcatg

SEQ ID NO: 462043 - DNA, 15 bp, Homo sapiens
tagccacattcatgt

SEQ ID NO: 462044 - DNA, 15 bp, Homo sapiens
agccacattcatgta

SEQ ID NO: 462045 - DNA, 15 bp, Homo sapiens
gccacattcatgtac

SEQ ID NO: 462046 - DNA, 15 bp, Homo sapiens
ccacattcatgtact

SEQ ID NO: 462047 - DNA, 15 bp, Homo sapiens
cacattcatgtactt

SEQ ID NO: 462048 - DNA, 15 bp, Homo sapiens
acattcatgtacttg

SEQ ID NO: 462049 - DNA, 15 bp, Homo sapiens
cattcatgtacttgt

SEQ ID NO: 462050 - DNA, 15 bp, Homo sapiens
attcatgtacttgtc

SEQ ID NO: 462051 - DNA, 15 bp, Homo sapiens
ttcatgtacttgtct

SEQ ID NO: 462052 - DNA, 15 bp, Homo sapiens
tcatgtacttgtctc

SEQ ID NO: 462053 - DNA, 15 bp, Homo sapiens
catgtacttgtctca

SEQ ID NO: 462054 - DNA, 15 bp, Homo sapiens
atgtacttgtctcag

SEQ ID NO: 462055 - DNA, 15 bp, Homo sapiens
tgtacttgtctcagc

SEQ ID NO: 462056 - DNA, 15 bp, Homo sapiens
gtacttgtctcagcc

SEQ ID NO: 462057 - DNA, 15 bp, Homo sapiens
tacttgtctcagccc

SEQ ID NO: 462058 - DNA, 15 bp, Homo sapiens
acttgtctcagcccg

SEQ ID NO: 462059 - DNA, 15 bp, Homo sapiens
cttgtctcagcccgt

SEQ ID NO: 462060 - DNA, 15 bp, Homo sapiens
ttgtctcagcccgtt

SEQ ID NO: 462061 - DNA, 15 bp, Homo sapiens
tgtctcagcccgttc

SEQ ID NO: 462062 - DNA, 15 bp, Homo sapiens
gtctcagcccgttca

SEQ ID NO: 462063 - DNA, 15 bp, Homo sapiens
tctcagcccgttcac

SEQ ID NO: 462064 - DNA, 15 bp, Homo sapiens
ctcagcccgttcaca

SEQ ID NO: 462065 - DNA, 15 bp, Homo sapiens
tcagcccgttcacaa

SEQ ID NO: 462066 - DNA, 15 bp, Homo sapiens
cagcccgttcacaaa

SEQ ID NO: 462067 - DNA, 15 bp, Homo sapiens
agcccgttcacaaag

SEQ ID NO: 462068 - DNA, 15 bp, Homo sapiens
gcccgttcacaaagc

SEQ ID NO: 462069 - DNA, 15 bp, Homo sapiens
cccgttcacaaagcc

SEQ ID NO: 462070 - DNA, 15 bp, Homo sapiens
ccgttcacaaagcct

SEQ ID NO: 462071 - DNA, 15 bp, Homo sapiens
cgttcacaaagcctt

SEQ ID NO: 462072 - DNA, 15 bp, Homo sapiens
gttcacaaagccttc

SEQ ID NO: 462073 - DNA, 15 bp, Homo sapiens
ttcacaaagccttct

SEQ ID NO: 462074 - DNA, 15 bp, Homo sapiens
tcacaaagccttctg

SEQ ID NO: 462075 - DNA, 15 bp, Homo sapiens
cacaaagccttctgt

SEQ ID NO: 462076 - DNA, 15 bp, Homo sapiens
acaaagccttctgtt

SEQ ID NO: 462077 - DNA, 15 bp, Homo sapiens
caaagccttctgtta

SEQ ID NO: 462078 - DNA, 15 bp, Homo sapiens
aaagccttctgttat

SEQ ID NO: 462079 - DNA, 15 bp, Homo sapiens
aagccttctgttatc

SEQ ID NO: 462080 - DNA, 15 bp, Homo sapiens
agccttctgttatcc

SEQ ID NO: 462081 - DNA, 15 bp, Homo sapiens
gccttctgttatcct

SEQ ID NO: 462082 - DNA, 15 bp, Homo sapiens
ccttctgttatcctc

SEQ ID NO: 462083 - DNA, 15 bp, Homo sapiens
cttctgttatcctct

SEQ ID NO: 462084 - DNA, 15 bp, Homo sapiens
ttctgttatcctctg

SEQ ID NO: 462085 - DNA, 15 bp, Homo sapiens
tctgttatcctctgc

SEQ ID NO: 462086 - DNA, 15 bp, Homo sapiens
ctgttatcctctgca

SEQ ID NO: 462087 - DNA, 15 bp, Homo sapiens
tgttatcctctgcaa

SEQ ID NO: 462088 - DNA, 15 bp, Homo sapiens
gttatcctctgcaag

SEQ ID NO: 462089 - DNA, 15 bp, Homo sapiens
ttatcctctgcaagt

SEQ ID NO: 462090 - DNA, 15 bp, Homo sapiens
tatcctctgcaagtc

SEQ ID NO: 462091 - DNA, 15 bp, Homo sapiens
atcctctgcaagtct

SEQ ID NO: 462092 - DNA, 15 bp, Homo sapiens
tcctctgcaagtcta

SEQ ID NO: 462093 - DNA, 15 bp, Homo sapiens
cctctgcaagtctat

SEQ ID NO: 462094 - DNA, 15 bp, Homo sapiens
ctctgcaagtctatt

SEQ ID NO: 462095 - DNA, 15 bp, Homo sapiens
tctgcaagtctattg

SEQ ID NO: 462096 - DNA, 15 bp, Homo sapiens
ctgcaagtctattgt

SEQ ID NO: 462097 - DNA, 15 bp, Homo sapiens
tgcaagtctattgtc

SEQ ID NO: 462098 - DNA, 15 bp, Homo sapiens
gcaagtctattgtct

SEQ ID NO: 462099 - DNA, 15 bp, Homo sapiens
caagtctattgtctg

SEQ ID NO: 462100 - DNA, 15 bp, Homo sapiens
aagtctattgtctga

SEQ ID NO: 462101 - DNA, 15 bp, Homo sapiens
agtctattgtctgac

SEQ ID NO: 462102 - DNA, 15 bp, Homo sapiens
gtctattgtctgact

SEQ ID NO: 462103 - DNA, 15 bp, Homo sapiens
tctattgtctgactg

SEQ ID NO: 462104 - DNA, 15 bp, Homo sapiens
ctattgtctgactgg

SEQ ID NO: 462105 - DNA, 15 bp, Homo sapiens
tattgtctgactggg

SEQ ID NO: 462106 - DNA, 15 bp, Homo sapiens
attgtctgactgggt

SEQ ID NO: 462107 - DNA, 15 bp, Homo sapiens
ttgtctgactgggtc

SEQ ID NO: 462108 - DNA, 15 bp, Homo sapiens
tgtctgactgggtcc

SEQ ID NO: 462109 - DNA, 15 bp, Homo sapiens
gtctgactgggtcca

SEQ ID NO: 462110 - DNA, 15 bp, Homo sapiens
tctgactgggtccag

SEQ ID NO: 462111 - DNA, 15 bp, Homo sapiens
ctgactgggtccaga

SEQ ID NO: 462112 - DNA, 15 bp, Homo sapiens
tgactgggtccagag

SEQ ID NO: 462113 - DNA, 15 bp, Homo sapiens
gactgggtccagaga

SEQ ID NO: 462114 - DNA, 15 bp, Homo sapiens
actgggtccagagag

SEQ ID NO: 462115 - DNA, 15 bp, Homo sapiens
ctgggtccagagagt

SEQ ID NO: 462116 - DNA, 15 bp, Homo sapiens
tgggtccagagagta

SEQ ID NO: 462117 - DNA, 15 bp, Homo sapiens
gggtccagagagtaa

SEQ ID NO: 462118 - DNA, 15 bp, Homo sapiens
ggtccagagagtaaa

SEQ ID NO: 462119 - DNA, 15 bp, Homo sapiens
gtccagagagtaaaa

SEQ ID NO: 462120 - DNA, 15 bp, Homo sapiens
tccagagagtaaaaa

SEQ ID NO: 462121 - DNA, 15 bp, Homo sapiens
ccagagagtaaaaat

SEQ ID NO: 462122 - DNA, 15 bp, Homo sapiens
cagagagtaaaaatt

SEQ ID NO: 462123 - DNA, 15 bp, Homo sapiens
agagagtaaaaattt

SEQ ID NO: 462124 - DNA, 15 bp, Homo sapiens
gagagtaaaaatttc

SEQ ID NO: 462125 - DNA, 15 bp, Homo sapiens
agagtaaaaatttcc

SEQ ID NO: 462126 - DNA, 15 bp, Homo sapiens
gagtaaaaatttcct

SEQ ID NO: 462127 - DNA, 15 bp, Homo sapiens
agtaaaaatttcctg

SEQ ID NO: 462128 - DNA, 15 bp, Homo sapiens
gtaaaaatttcctgc

SEQ ID NO: 462129 - DNA, 15 bp, Homo sapiens
taaaaatttcctgct

SEQ ID NO: 462130 - DNA, 15 bp, Homo sapiens
aaaaatttcctgctt

SEQ ID NO: 462131 - DNA, 15 bp, Homo sapiens
aaaatttcctgcttt

SEQ ID NO: 462132 - DNA, 15 bp, Homo sapiens
aaatttcctgctttt

SEQ ID NO: 462133 - DNA, 15 bp, Homo sapiens
aatttcctgcttttg

SEQ ID NO: 462134 - DNA, 15 bp, Homo sapiens
atttcctgcttttga

SEQ ID NO: 462135 - DNA, 15 bp, Homo sapiens
tttcctgcttttgaa

SEQ ID NO: 462136 - DNA, 15 bp, Homo sapiens
ttcctgcttttgaaa

SEQ ID NO: 462137 - DNA, 15 bp, Homo sapiens
tcctgcttttgaaag

SEQ ID NO: 462138 - DNA, 15 bp, Homo sapiens
cctgcttttgaaagg

SEQ ID NO: 462139 - DNA, 15 bp, Homo sapiens
ctgcttttgaaagga

SEQ ID NO: 462140 - DNA, 15 bp, Homo sapiens
tgcttttgaaaggaa

SEQ ID NO: 462141 - DNA, 15 bp, Homo sapiens
gcttttgaaaggaag

SEQ ID NO: 462142 - DNA, 15 bp, Homo sapiens
cttttgaaaggaagc

SEQ ID NO: 462143 - DNA, 15 bp, Homo sapiens
ttttgaaaggaagca

SEQ ID NO: 462144 - DNA, 15 bp, Homo sapiens
tttgaaaggaagcaa

SEQ ID NO: 462145 - DNA, 15 bp, Homo sapiens
ttgaaaggaagcaaa

SEQ ID NO: 462146 - DNA, 15 bp, Homo sapiens
tgaaaggaagcaaac

SEQ ID NO: 462147 - DNA, 15 bp, Homo sapiens
gaaaggaagcaaaca

SEQ ID NO: 462148 - DNA, 15 bp, Homo sapiens
aaaggaagcaaacat

SEQ ID NO: 462149 - DNA, 15 bp, Homo sapiens
aaggaagcaaacatt

SEQ ID NO: 462150 - DNA, 15 bp, Homo sapiens
aggaagcaaacattg

SEQ ID NO: 462151 - DNA, 15 bp, Homo sapiens
ggaagcaaacattgt

SEQ ID NO: 462152 - DNA, 15 bp, Homo sapiens
gaagcaaacattgtc

SEQ ID NO: 462153 - DNA, 15 bp, Homo sapiens
aagcaaacattgtct

SEQ ID NO: 462154 - DNA, 15 bp, Homo sapiens
agcaaacattgtctg

SEQ ID NO: 462155 - DNA, 15 bp, Homo sapiens
gcaaacattgtctgt

SEQ ID NO: 462156 - DNA, 15 bp, Homo sapiens
caaacattgtctgtt

SEQ ID NO: 462157 - DNA, 15 bp, Homo sapiens
aaacattgtctgttt

SEQ ID NO: 462158 - DNA, 15 bp, Homo sapiens
aacattgtctgtttc

SEQ ID NO: 462159 - DNA, 15 bp, Homo sapiens
acattgtctgtttca

SEQ ID NO: 462160 - DNA, 15 bp, Homo sapiens
cattgtctgtttcat

SEQ ID NO: 462161 - DNA, 15 bp, Homo sapiens
attgtctgtttcatg

SEQ ID NO: 462162 - DNA, 15 bp, Homo sapiens
ttgtctgtttcatgt

SEQ ID NO: 462163 - DNA, 15 bp, Homo sapiens
tgtctgtttcatgtg

SEQ ID NO: 462164 - DNA, 15 bp, Homo sapiens
gtctgtttcatgtga

SEQ ID NO: 462165 - DNA, 15 bp, Homo sapiens
tctgtttcatgtgat

SEQ ID NO: 462166 - DNA, 15 bp, Homo sapiens
ctgtttcatgtgata

SEQ ID NO: 462167 - DNA, 15 bp, Homo sapiens
tgtttcatgtgataa

SEQ ID NO: 462168 - DNA, 15 bp, Homo sapiens
gtttcatgtgataat

SEQ ID NO: 462169 - DNA, 15 bp, Homo sapiens
tttcatgtgataatt

SEQ ID NO: 462170 - DNA, 15 bp, Homo sapiens
ttcatgtgataatta

SEQ ID NO: 462171 - DNA, 15 bp, Homo sapiens
tcatgtgataattag

SEQ ID NO: 462172 - DNA, 15 bp, Homo sapiens
catgtgataattagg

SEQ ID NO: 462173 - DNA, 15 bp, Homo sapiens
atgtgataattagga

SEQ ID NO: 462174 - DNA, 15 bp, Homo sapiens
tgtgataattaggaa

SEQ ID NO: 462175 - DNA, 15 bp, Homo sapiens
gtgataattaggaaa

SEQ ID NO: 462176 - DNA, 15 bp, Homo sapiens
tgataattaggaaac

SEQ ID NO: 462177 - DNA, 15 bp, Homo sapiens
gataattaggaaact

SEQ ID NO: 462178 - DNA, 15 bp, Homo sapiens
ataattaggaaactt

SEQ ID NO: 462179 - DNA, 15 bp, Homo sapiens
taattaggaaacttc

SEQ ID NO: 462180 - DNA, 15 bp, Homo sapiens
aattaggaaacttct

SEQ ID NO: 462181 - DNA, 15 bp, Homo sapiens
attaggaaacttcta

SEQ ID NO: 462182 - DNA, 15 bp, Homo sapiens
ttaggaaacttctaa

SEQ ID NO: 462183 - DNA, 15 bp, Homo sapiens
taggaaacttctaaa

SEQ ID NO: 462184 - DNA, 15 bp, Homo sapiens
aggaaacttctaaaa

SEQ ID NO: 462185 - DNA, 15 bp, Homo sapiens
ggaaacttctaaaaa

SEQ ID NO: 462186 - DNA, 15 bp, Homo sapiens
gaaacttctaaaaaa

SEQ ID NO: 462187 - DNA, 15 bp, Homo sapiens
aaacttctaaaaaat

SEQ ID NO: 462188 - DNA, 15 bp, Homo sapiens
aacttctaaaaaata

SEQ ID NO: 462189 - DNA, 15 bp, Homo sapiens
acttctaaaaaatat

SEQ ID NO: 462190 - DNA, 15 bp, Homo sapiens
cttctaaaaaatata

SEQ ID NO: 462191 - DNA, 15 bp, Homo sapiens
ttctaaaaaatataa

SEQ ID NO: 462192 - DNA, 15 bp, Homo sapiens
tctaaaaaatataaa

SEQ ID NO: 462193 - DNA, 15 bp, Homo sapiens
ctaaaaaatataaag

SEQ ID NO: 462194 - DNA, 15 bp, Homo sapiens
taaaaaatataaagt

SEQ ID NO: 462195 - DNA, 15 bp, Homo sapiens
aaaaaatataaagta

SEQ ID NO: 462196 - DNA, 15 bp, Homo sapiens
aaaaatataaagtag

SEQ ID NO: 462197 - DNA, 15 bp, Homo sapiens
aaaatataaagtaga

SEQ ID NO: 462198 - DNA, 15 bp, Homo sapiens
aaatataaagtagaa

SEQ ID NO: 462199 - DNA, 15 bp, Homo sapiens
aatataaagtagaaa

SEQ ID NO: 462200 - DNA, 15 bp, Homo sapiens
atataaagtagaaac

SEQ ID NO: 462201 - DNA, 15 bp, Homo sapiens
tataaagtagaaaca

SEQ ID NO: 462202 - DNA, 15 bp, Homo sapiens
ataaagtagaaacac

SEQ ID NO: 462203 - DNA, 15 bp, Homo sapiens
taaagtagaaacaca

SEQ ID NO: 462204 - DNA, 15 bp, Homo sapiens
aaagtagaaacacag

SEQ ID NO: 462205 - DNA, 15 bp, Homo sapiens
aagtagaaacacagt

SEQ ID NO: 462206 - DNA, 15 bp, Homo sapiens
agtagaaacacagtt

SEQ ID NO: 462207 - DNA, 15 bp, Homo sapiens
gtagaaacacagttt

SEQ ID NO: 462208 - DNA, 15 bp, Homo sapiens
tagaaacacagtttg

SEQ ID NO: 462209 - DNA, 15 bp, Homo sapiens
agaaacacagtttgt

SEQ ID NO: 462210 - DNA, 15 bp, Homo sapiens
gaaacacagtttgta

SEQ ID NO: 462211 - DNA, 15 bp, Homo sapiens
aaacacagtttgtag

SEQ ID NO: 462212 - DNA, 15 bp, Homo sapiens
aacacagtttgtagc

SEQ ID NO: 462213 - DNA, 15 bp, Homo sapiens
acacagtttgtagca

SEQ ID NO: 462214 - DNA, 15 bp, Homo sapiens
cacagtttgtagcat

SEQ ID NO: 462215 - DNA, 15 bp, Homo sapiens
acagtttgtagcatg

SEQ ID NO: 462216 - DNA, 15 bp, Homo sapiens
cagtttgtagcatgg

SEQ ID NO: 462217 - DNA, 15 bp, Homo sapiens
agtttgtagcatggc

SEQ ID NO: 462218 - DNA, 15 bp, Homo sapiens
gtttgtagcatggct

SEQ ID NO: 462219 - DNA, 15 bp, Homo sapiens
tttgtagcatggctg

SEQ ID NO: 462220 - DNA, 15 bp, Homo sapiens
ttgtagcatggctgt

SEQ ID NO: 462221 - DNA, 15 bp, Homo sapiens
tgtagcatggctgtc

SEQ ID NO: 462222 - DNA, 15 bp, Homo sapiens
gtagcatggctgtct

SEQ ID NO: 462223 - DNA, 15 bp, Homo sapiens
tagcatggctgtctg

SEQ ID NO: 462224 - DNA, 15 bp, Homo sapiens
agcatggctgtctgt

SEQ ID NO: 462225 - DNA, 15 bp, Homo sapiens
gcatggctgtctgta

SEQ ID NO: 462226 - DNA, 15 bp, Homo sapiens
catggctgtctgtag

SEQ ID NO: 462227 - DNA, 15 bp, Homo sapiens
atggctgtctgtagg

SEQ ID NO: 462228 - DNA, 15 bp, Homo sapiens
tggctgtctgtaggg

SEQ ID NO: 462229 - DNA, 15 bp, Homo sapiens
ggctgtctgtagggt

SEQ ID NO: 462230 - DNA, 15 bp, Homo sapiens
gctgtctgtagggtt

SEQ ID NO: 462231 - DNA, 15 bp, Homo sapiens
ctgtctgtagggtta

SEQ ID NO: 462232 - DNA, 15 bp, Homo sapiens
tgtctgtagggttaa

SEQ ID NO: 462233 - DNA, 15 bp, Homo sapiens
gtctgtagggttaat

SEQ ID NO: 462234 - DNA, 15 bp, Homo sapiens
tctgtagggttaatg

SEQ ID NO: 462235 - DNA, 15 bp, Homo sapiens
ctgtagggttaatgt

SEQ ID NO: 462236 - DNA, 15 bp, Homo sapiens
tgtagggttaatgtg

SEQ ID NO: 462237 - DNA, 15 bp, Homo sapiens
gtagggttaatgtga

SEQ ID NO: 462238 - DNA, 15 bp, Homo sapiens
tagggttaatgtgaa

SEQ ID NO: 462239 - DNA, 15 bp, Homo sapiens
agggttaatgtgaaa

SEQ ID NO: 462240 - DNA, 15 bp, Homo sapiens
gggttaatgtgaaac

SEQ ID NO: 462241 - DNA, 15 bp, Homo sapiens
ggttaatgtgaaact

SEQ ID NO: 462242 - DNA, 15 bp, Homo sapiens
gttaatgtgaaactg

SEQ ID NO: 462243 - DNA, 15 bp, Homo sapiens
ttaatgtgaaactgg

SEQ ID NO: 462244 - DNA, 15 bp, Homo sapiens
taatgtgaaactggt

SEQ ID NO: 462245 - DNA, 15 bp, Homo sapiens
aatgtgaaactggtg

SEQ ID NO: 462246 - DNA, 15 bp, Homo sapiens
atgtgaaactggtgt

SEQ ID NO: 462247 - DNA, 15 bp, Homo sapiens
tgtgaaactggtgtt

SEQ ID NO: 462248 - DNA, 15 bp, Homo sapiens
gtgaaactggtgttt

SEQ ID NO: 462249 - DNA, 15 bp, Homo sapiens
tgaaactggtgtttc

SEQ ID NO: 462250 - DNA, 15 bp, Homo sapiens
gaaactggtgtttct

SEQ ID NO: 462251 - DNA, 15 bp, Homo sapiens
aaactggtgtttctg

SEQ ID NO: 462252 - DNA, 15 bp, Homo sapiens
aactggtgtttctgt

SEQ ID NO: 462253 - DNA, 15 bp, Homo sapiens
actggtgtttctgta

SEQ ID NO: 462254 - DNA, 15 bp, Homo sapiens
ctggtgtttctgtaa

SEQ ID NO: 462255 - DNA, 15 bp, Homo sapiens
tggtgtttctgtaat

SEQ ID NO: 462256 - DNA, 15 bp, Homo sapiens
ggtgtttctgtaatt

SEQ ID NO: 462257 - DNA, 15 bp, Homo sapiens
gtgtttctgtaattg

SEQ ID NO: 462258 - DNA, 15 bp, Homo sapiens
tgtttctgtaattgt

SEQ ID NO: 462259 - DNA, 15 bp, Homo sapiens
gtttctgtaattgtg

SEQ ID NO: 462260 - DNA, 15 bp, Homo sapiens
tttctgtaattgtga

SEQ ID NO: 462261 - DNA, 15 bp, Homo sapiens
ttctgtaattgtgag

SEQ ID NO: 462262 - DNA, 15 bp, Homo sapiens
tctgtaattgtgaga

SEQ ID NO: 462263 - DNA, 15 bp, Homo sapiens
ctgtaattgtgagaa

SEQ ID NO: 462264 - DNA, 15 bp, Homo sapiens
tgtaattgtgagaaa

SEQ ID NO: 462265 - DNA, 15 bp, Homo sapiens
gtaattgtgagaaat

SEQ ID NO: 462266 - DNA, 15 bp, Homo sapiens
taattgtgagaaatg

SEQ ID NO: 462267 - DNA, 15 bp, Homo sapiens
aattgtgagaaatga

SEQ ID NO: 462268 - DNA, 15 bp, Homo sapiens
attgtgagaaatgat

SEQ ID NO: 462269 - DNA, 15 bp, Homo sapiens
ttgtgagaaatgatt

SEQ ID NO: 462270 - DNA, 15 bp, Homo sapiens
tgtgagaaatgatta

SEQ ID NO: 462271 - DNA, 15 bp, Homo sapiens
gtgagaaatgattat

SEQ ID NO: 462272 - DNA, 15 bp, Homo sapiens
tgagaaatgattata

SEQ ID NO: 462273 - DNA, 15 bp, Homo sapiens
gagaaatgattatat

SEQ ID NO: 462274 - DNA, 15 bp, Homo sapiens
agaaatgattatatt

SEQ ID NO: 462275 - DNA, 15 bp, Homo sapiens
gaaatgattatatta

SEQ ID NO: 462276 - DNA, 15 bp, Homo sapiens
aaatgattatattaa

SEQ ID NO: 462277 - DNA, 15 bp, Homo sapiens
aatgattatattaat

SEQ ID NO: 462278 - DNA, 15 bp, Homo sapiens
atgattatattaatt

SEQ ID NO: 462279 - DNA, 15 bp, Homo sapiens
tgattatattaattt

SEQ ID NO: 462280 - DNA, 15 bp, Homo sapiens
gattatattaattta

SEQ ID NO: 462281 - DNA, 15 bp, Homo sapiens
attatattaatttag

SEQ ID NO: 462282 - DNA, 15 bp, Homo sapiens
ttatattaatttaga

SEQ ID NO: 462283 - DNA, 15 bp, Homo sapiens
tatattaatttagaa

SEQ ID NO: 462284 - DNA, 15 bp, Homo sapiens
atattaatttagaaa

SEQ ID NO: 462285 - DNA, 15 bp, Homo sapiens
tattaatttagaaat

SEQ ID NO: 462286 - DNA, 15 bp, Homo sapiens
attaatttagaaatt

SEQ ID NO: 462287 - DNA, 15 bp, Homo sapiens
ttaatttagaaattc

SEQ ID NO: 462288 - DNA, 15 bp, Homo sapiens
taatttagaaattct

SEQ ID NO: 462289 - DNA, 15 bp, Homo sapiens
aatttagaaattctg

SEQ ID NO: 462290 - DNA, 15 bp, Homo sapiens
atttagaaattctgc

SEQ ID NO: 462291 - DNA, 15 bp, Homo sapiens
tttagaaattctgct

SEQ ID NO: 462292 - DNA, 15 bp, Homo sapiens
ttagaaattctgctt

SEQ ID NO: 462293 - DNA, 15 bp, Homo sapiens
tagaaattctgctta

SEQ ID NO: 462294 - DNA, 15 bp, Homo sapiens
agaaattctgcttag

SEQ ID NO: 462295 - DNA, 15 bp, Homo sapiens
gaaattctgcttaga

SEQ ID NO: 462296 - DNA, 15 bp, Homo sapiens
aaattctgcttagaa

SEQ ID NO: 462297 - DNA, 15 bp, Homo sapiens
aattctgcttagaag

SEQ ID NO: 462298 - DNA, 15 bp, Homo sapiens
attctgcttagaagg

SEQ ID NO: 462299 - DNA, 15 bp, Homo sapiens
ttctgcttagaaggg

SEQ ID NO: 462300 - DNA, 15 bp, Homo sapiens
tctgcttagaagggc

SEQ ID NO: 462301 - DNA, 15 bp, Homo sapiens
ctgcttagaagggct

SEQ ID NO: 462302 - DNA, 15 bp, Homo sapiens
tgcttagaagggcta

SEQ ID NO: 462303 - DNA, 15 bp, Homo sapiens
gcttagaagggctat

SEQ ID NO: 462304 - DNA, 15 bp, Homo sapiens
cttagaagggctatg

SEQ ID NO: 462305 - DNA, 15 bp, Homo sapiens
ttagaagggctatgt

SEQ ID NO: 462306 - DNA, 15 bp, Homo sapiens
tagaagggctatgtt

SEQ ID NO: 462307 - DNA, 15 bp, Homo sapiens
agaagggctatgttt

SEQ ID NO: 462308 - DNA, 15 bp, Homo sapiens
gaagggctatgttta

SEQ ID NO: 462309 - DNA, 15 bp, Homo sapiens
aagggctatgtttat

SEQ ID NO: 462310 - DNA, 15 bp, Homo sapiens
agggctatgtttatt

SEQ ID NO: 462311 - DNA, 15 bp, Homo sapiens
gggctatgtttattt

SEQ ID NO: 462312 - DNA, 15 bp, Homo sapiens
ggctatgtttatttt

SEQ ID NO: 462313 - DNA, 15 bp, Homo sapiens
gctatgtttatttta

SEQ ID NO: 462314 - DNA, 15 bp, Homo sapiens
ctatgtttattttaa

SEQ ID NO: 462315 - DNA, 15 bp, Homo sapiens
tatgtttattttaat

SEQ ID NO: 462316 - DNA, 15 bp, Homo sapiens
atgtttattttaata

SEQ ID NO: 462317 - DNA, 15 bp, Homo sapiens
tgtttattttaatat

SEQ ID NO: 462318 - DNA, 15 bp, Homo sapiens
gtttattttaatatt

SEQ ID NO: 462319 - DNA, 15 bp, Homo sapiens
tttattttaatatta

SEQ ID NO: 462320 - DNA, 15 bp, Homo sapiens
ttattttaatattaa

SEQ ID NO: 462321 - DNA, 15 bp, Homo sapiens
tattttaatattaag

SEQ ID NO: 462322 - DNA, 15 bp, Homo sapiens
attttaatattaagt

SEQ ID NO: 462323 - DNA, 15 bp, Homo sapiens
ttttaatattaagta

SEQ ID NO: 462324 - DNA, 15 bp, Homo sapiens
tttaatattaagtat

SEQ ID NO: 462325 - DNA, 15 bp, Homo sapiens
ttaatattaagtatt

SEQ ID NO: 462326 - DNA, 15 bp, Homo sapiens
taatattaagtatta

SEQ ID NO: 462327 - DNA, 15 bp, Homo sapiens
aatattaagtattag

SEQ ID NO: 462328 - DNA, 15 bp, Homo sapiens
atattaagtattagt

SEQ ID NO: 462329 - DNA, 15 bp, Homo sapiens
tattaagtattagtc

SEQ ID NO: 462330 - DNA, 15 bp, Homo sapiens
attaagtattagtca

SEQ ID NO: 462331 - DNA, 15 bp, Homo sapiens
ttaagtattagtcac

SEQ ID NO: 462332 - DNA, 15 bp, Homo sapiens
taagtattagtcact

SEQ ID NO: 462333 - DNA, 15 bp, Homo sapiens
aagtattagtcactt

SEQ ID NO: 462334 - DNA, 15 bp, Homo sapiens
agtattagtcacttc

SEQ ID NO: 462335 - DNA, 15 bp, Homo sapiens
gtattagtcacttca

SEQ ID NO: 462336 - DNA, 15 bp, Homo sapiens
tattagtcacttcat

SEQ ID NO: 462337 - DNA, 15 bp, Homo sapiens
attagtcacttcata

SEQ ID NO: 462338 - DNA, 15 bp, Homo sapiens
ttagtcacttcatag

SEQ ID NO: 462339 - DNA, 15 bp, Homo sapiens
tagtcacttcatagg

SEQ ID NO: 462340 - DNA, 15 bp, Homo sapiens
agtcacttcataggt

SEQ ID NO: 462341 - DNA, 15 bp, Homo sapiens
gtcacttcataggtt

SEQ ID NO: 462342 - DNA, 15 bp, Homo sapiens
tcacttcataggtta

SEQ ID NO: 462343 - DNA, 15 bp, Homo sapiens
cacttcataggttaa

SEQ ID NO: 462344 - DNA, 15 bp, Homo sapiens
acttcataggttaat

SEQ ID NO: 462345 - DNA, 15 bp, Homo sapiens
cttcataggttaatt

SEQ ID NO: 462346 - DNA, 15 bp, Homo sapiens
ttcataggttaattc

SEQ ID NO: 462347 - DNA, 15 bp, Homo sapiens
tcataggttaattct

SEQ ID NO: 462348 - DNA, 15 bp, Homo sapiens
cataggttaattctg

SEQ ID NO: 462349 - DNA, 15 bp, Homo sapiens
ataggttaattctga

SEQ ID NO: 462350 - DNA, 15 bp, Homo sapiens
taggttaattctgaa

SEQ ID NO: 462351 - DNA, 15 bp, Homo sapiens
aggttaattctgaat

SEQ ID NO: 462352 - DNA, 15 bp, Homo sapiens
ggttaattctgaatg

SEQ ID NO: 462353 - DNA, 15 bp, Homo sapiens
gttaattctgaatgt

SEQ ID NO: 462354 - DNA, 15 bp, Homo sapiens
ttaattctgaatgtc

SEQ ID NO: 462355 - DNA, 15 bp, Homo sapiens
taattctgaatgtca

SEQ ID NO: 462356 - DNA, 15 bp, Homo sapiens
aattctgaatgtcat

SEQ ID NO: 462357 - DNA, 15 bp, Homo sapiens
attctgaatgtcata

SEQ ID NO: 462358 - DNA, 15 bp, Homo sapiens
ttctgaatgtcatat

SEQ ID NO: 462359 - DNA, 15 bp, Homo sapiens
tctgaatgtcatata

SEQ ID NO: 462360 - DNA, 15 bp, Homo sapiens
ctgaatgtcatatac

SEQ ID NO: 462361 - DNA, 15 bp, Homo sapiens
tgaatgtcatatacc

SEQ ID NO: 462362 - DNA, 15 bp, Homo sapiens
gaatgtcatatacct

SEQ ID NO: 462363 - DNA, 15 bp, Homo sapiens
aatgtcatataccta

SEQ ID NO: 462364 - DNA, 15 bp, Homo sapiens
atgtcatatacctac

SEQ ID NO: 462365 - DNA, 15 bp, Homo sapiens
tgtcatatacctaca

SEQ ID NO: 462366 - DNA, 15 bp, Homo sapiens
gtcatatacctacat

SEQ ID NO: 462367 - DNA, 15 bp, Homo sapiens
tcatatacctacata

SEQ ID NO: 462368 - DNA, 15 bp, Homo sapiens
catatacctacatac

SEQ ID NO: 462369 - DNA, 15 bp, Homo sapiens
atatacctacatact

SEQ ID NO: 462370 - DNA, 15 bp, Homo sapiens
tatacctacatacta

SEQ ID NO: 462371 - DNA, 15 bp, Homo sapiens
atacctacatactaa

SEQ ID NO: 462372 - DNA, 15 bp, Homo sapiens
tacctacatactaag

SEQ ID NO: 462373 - DNA, 15 bp, Homo sapiens
acctacatactaagg

SEQ ID NO: 462374 - DNA, 15 bp, Homo sapiens
cctacatactaaggg

SEQ ID NO: 462375 - DNA, 15 bp, Homo sapiens
ctacatactaagggt

SEQ ID NO: 462376 - DNA, 15 bp, Homo sapiens
tacatactaagggtt

SEQ ID NO: 462377 - DNA, 15 bp, Homo sapiens
acatactaagggttc

SEQ ID NO: 462378 - DNA, 15 bp, Homo sapiens
catactaagggttca

SEQ ID NO: 462379 - DNA, 15 bp, Homo sapiens
atactaagggttcag

SEQ ID NO: 462380 - DNA, 15 bp, Homo sapiens
tactaagggttcagt

SEQ ID NO: 462381 - DNA, 15 bp, Homo sapiens
actaagggttcagta

SEQ ID NO: 462382 - DNA, 15 bp, Homo sapiens
ctaagggttcagtaa

SEQ ID NO: 462383 - DNA, 15 bp, Homo sapiens
taagggttcagtaag

SEQ ID NO: 462384 - DNA, 15 bp, Homo sapiens
aagggttcagtaagt

SEQ ID NO: 462385 - DNA, 15 bp, Homo sapiens
agggttcagtaagtt

SEQ ID NO: 462386 - DNA, 15 bp, Homo sapiens
gggttcagtaagttt

SEQ ID NO: 462387 - DNA, 15 bp, Homo sapiens
ggttcagtaagttta

SEQ ID NO: 462388 - DNA, 15 bp, Homo sapiens
gttcagtaagtttat

SEQ ID NO: 462389 - DNA, 15 bp, Homo sapiens
ttcagtaagtttatt

SEQ ID NO: 462390 - DNA, 15 bp, Homo sapiens
tcagtaagtttatta

SEQ ID NO: 462391 - DNA, 15 bp, Homo sapiens
cagtaagtttattag

SEQ ID NO: 462392 - DNA, 15 bp, Homo sapiens
agtaagtttattaga

SEQ ID NO: 462393 - DNA, 15 bp, Homo sapiens
gtaagtttattagat

SEQ ID NO: 462394 - DNA, 15 bp, Homo sapiens
taagtttattagata

SEQ ID NO: 462395 - DNA, 15 bp, Homo sapiens
aagtttattagatat

SEQ ID NO: 462396 - DNA, 15 bp, Homo sapiens
agtttattagatatg

SEQ ID NO: 462397 - DNA, 15 bp, Homo sapiens
gtttattagatatga

SEQ ID NO: 462398 - DNA, 15 bp, Homo sapiens
tttattagatatgat

SEQ ID NO: 462399 - DNA, 15 bp, Homo sapiens
ttattagatatgatt

SEQ ID NO: 462400 - DNA, 15 bp, Homo sapiens
tattagatatgattt

SEQ ID NO: 462401 - DNA, 15 bp, Homo sapiens
attagatatgattta

SEQ ID NO: 462402 - DNA, 15 bp, Homo sapiens
ttagatatgatttaa

SEQ ID NO: 462403 - DNA, 15 bp, Homo sapiens
tagatatgatttaat

SEQ ID NO: 462404 - DNA, 15 bp, Homo sapiens
agatatgatttaata

SEQ ID NO: 462405 - DNA, 15 bp, Homo sapiens
gatatgatttaatat

SEQ ID NO: 462406 - DNA, 15 bp, Homo sapiens
atatgatttaatata

SEQ ID NO: 462407 - DNA, 15 bp, Homo sapiens
tatgatttaatataa

SEQ ID NO: 462408 - DNA, 15 bp, Homo sapiens
atgatttaatataaa

SEQ ID NO: 462409 - DNA, 15 bp, Homo sapiens
tgatttaatataaat

SEQ ID NO: 462410 - DNA, 15 bp, Homo sapiens
gatttaatataaatt

SEQ ID NO: 462411 - DNA, 15 bp, Homo sapiens
atttaatataaatta

SEQ ID NO: 462412 - DNA, 15 bp, Homo sapiens
tttaatataaattat

SEQ ID NO: 462413 - DNA, 15 bp, Homo sapiens
ttaatataaattata

SEQ ID NO: 462414 - DNA, 15 bp, Homo sapiens
taatataaattataa

SEQ ID NO: 462415 - DNA, 15 bp, Homo sapiens
aatataaattataaa

SEQ ID NO: 462416 - DNA, 15 bp, Homo sapiens
atataaattataaac

SEQ ID NO: 462417 - DNA, 15 bp, Homo sapiens
tataaattataaact

SEQ ID NO: 462418 - DNA, 15 bp, Homo sapiens
ataaattataaactc

SEQ ID NO: 462419 - DNA, 15 bp, Homo sapiens
taaattataaactct

SEQ ID NO: 462420 - DNA, 15 bp, Homo sapiens
aaattataaactcta

SEQ ID NO: 462421 - DNA, 15 bp, Homo sapiens
aattataaactctat

SEQ ID NO: 462422 - DNA, 15 bp, Homo sapiens
attataaactctatc

SEQ ID NO: 462423 - DNA, 15 bp, Homo sapiens
ttataaactctatcc

SEQ ID NO: 462424 - DNA, 15 bp, Homo sapiens
tataaactctatcct

SEQ ID NO: 462425 - DNA, 15 bp, Homo sapiens
ataaactctatccta

SEQ ID NO: 462426 - DNA, 15 bp, Homo sapiens
taaactctatcctat

SEQ ID NO: 462427 - DNA, 15 bp, Homo sapiens
aaactctatcctatt

SEQ ID NO: 462428 - DNA, 15 bp, Homo sapiens
aactctatcctattg

SEQ ID NO: 462429 - DNA, 15 bp, Homo sapiens
actctatcctattga

SEQ ID NO: 462430 - DNA, 15 bp, Homo sapiens
ctctatcctattgag

SEQ ID NO: 462431 - DNA, 15 bp, Homo sapiens
tctatcctattgagg

SEQ ID NO: 462432 - DNA, 15 bp, Homo sapiens
ctatcctattgaggg

SEQ ID NO: 462433 - DNA, 15 bp, Homo sapiens
tatcctattgaggga

SEQ ID NO: 462434 - DNA, 15 bp, Homo sapiens
atcctattgagggag

SEQ ID NO: 462435 - DNA, 15 bp, Homo sapiens
tcctattgagggagt

SEQ ID NO: 462436 - DNA, 15 bp, Homo sapiens
cctattgagggagta

SEQ ID NO: 462437 - DNA, 15 bp, Homo sapiens
ctattgagggagtac

SEQ ID NO: 462438 - DNA, 15 bp, Homo sapiens
tattgagggagtact

SEQ ID NO: 462439 - DNA, 15 bp, Homo sapiens
attgagggagtactt

SEQ ID NO: 462440 - DNA, 15 bp, Homo sapiens
ttgagggagtacttt

SEQ ID NO: 462441 - DNA, 15 bp, Homo sapiens
tgagggagtactttg

SEQ ID NO: 462442 - DNA, 15 bp, Homo sapiens
gagggagtactttga

SEQ ID NO: 462443 - DNA, 15 bp, Homo sapiens
agggagtactttgaa

SEQ ID NO: 462444 - DNA, 15 bp, Homo sapiens
gggagtactttgaaa

SEQ ID NO: 462445 - DNA, 15 bp, Homo sapiens
ggagtactttgaaaa

SEQ ID NO: 462446 - DNA, 15 bp, Homo sapiens
gagtactttgaaaat

SEQ ID NO: 462447 - DNA, 15 bp, Homo sapiens
agtactttgaaaata

SEQ ID NO: 462448 - DNA, 15 bp, Homo sapiens
gtactttgaaaatac

SEQ ID NO: 462449 - DNA, 15 bp, Homo sapiens
tactttgaaaataca

SEQ ID NO: 462450 - DNA, 15 bp, Homo sapiens
actttgaaaatacat

SEQ ID NO: 462451 - DNA, 15 bp, Homo sapiens
ctttgaaaatacatt

SEQ ID NO: 462452 - DNA, 15 bp, Homo sapiens
tttgaaaatacattg

SEQ ID NO: 462453 - DNA, 15 bp, Homo sapiens
ttgaaaatacattgc

SEQ ID NO: 462454 - DNA, 15 bp, Homo sapiens
tgaaaatacattgca

SEQ ID NO: 462455 - DNA, 15 bp, Homo sapiens
gaaaatacattgcac

SEQ ID NO: 462456 - DNA, 15 bp, Homo sapiens
aaaatacattgcacc

SEQ ID NO: 462457 - DNA, 15 bp, Homo sapiens
aaatacattgcacca

SEQ ID NO: 462458 - DNA, 15 bp, Homo sapiens
aatacattgcaccaa

SEQ ID NO: 462459 - DNA, 15 bp, Homo sapiens
atacattgcaccaat

SEQ ID NO: 462460 - DNA, 15 bp, Homo sapiens
tacattgcaccaatc

SEQ ID NO: 462461 - DNA, 15 bp, Homo sapiens
acattgcaccaatcc

SEQ ID NO: 462462 - DNA, 15 bp, Homo sapiens
cattgcaccaatccc

SEQ ID NO: 462463 - DNA, 15 bp, Homo sapiens
attgcaccaatccct

SEQ ID NO: 462464 - DNA, 15 bp, Homo sapiens
ttgcaccaatcccta

SEQ ID NO: 462465 - DNA, 15 bp, Homo sapiens
tgcaccaatccctaa

SEQ ID NO: 462466 - DNA, 15 bp, Homo sapiens
gcaccaatccctaag

SEQ ID NO: 462467 - DNA, 15 bp, Homo sapiens
caccaatccctaagc

SEQ ID NO: 462468 - DNA, 15 bp, Homo sapiens
accaatccctaagca

SEQ ID NO: 462469 - DNA, 15 bp, Homo sapiens
ccaatccctaagcac

SEQ ID NO: 462470 - DNA, 15 bp, Homo sapiens
caatccctaagcacg

SEQ ID NO: 462471 - DNA, 15 bp, Homo sapiens
aatccctaagcacga

SEQ ID NO: 462472 - DNA, 15 bp, Homo sapiens
atccctaagcacgat

SEQ ID NO: 462473 - DNA, 15 bp, Homo sapiens
tccctaagcacgatt

SEQ ID NO: 462474 - DNA, 15 bp, Homo sapiens
ccctaagcacgattt

SEQ ID NO: 462475 - DNA, 15 bp, Homo sapiens
cctaagcacgatttc

SEQ ID NO: 462476 - DNA, 15 bp, Homo sapiens
ctaagcacgatttcc

SEQ ID NO: 462477 - DNA, 15 bp, Homo sapiens
taagcacgatttcct

SEQ ID NO: 462478 - DNA, 15 bp, Homo sapiens
aagcacgatttcctt

SEQ ID NO: 462479 - DNA, 15 bp, Homo sapiens
agcacgatttccttt

SEQ ID NO: 462480 - DNA, 15 bp, Homo sapiens
gcacgatttcctttc

SEQ ID NO: 462481 - DNA, 15 bp, Homo sapiens
cacgatttcctttct

SEQ ID NO: 462482 - DNA, 15 bp, Homo sapiens
acgatttcctttctt

SEQ ID NO: 462483 - DNA, 15 bp, Homo sapiens
cgatttcctttctta

SEQ ID NO: 462484 - DNA, 15 bp, Homo sapiens
gatttcctttcttat

SEQ ID NO: 462485 - DNA, 15 bp, Homo sapiens
atttcctttcttatt

SEQ ID NO: 462486 - DNA, 15 bp, Homo sapiens
tttcctttcttattt

SEQ ID NO: 462487 - DNA, 15 bp, Homo sapiens
ttcctttcttattta

SEQ ID NO: 462488 - DNA, 15 bp, Homo sapiens
tcctttcttatttat

SEQ ID NO: 462489 - DNA, 15 bp, Homo sapiens
cctttcttatttatt

SEQ ID NO: 462490 - DNA, 15 bp, Homo sapiens
ctttcttatttattg

SEQ ID NO: 462491 - DNA, 15 bp, Homo sapiens
tttcttatttattgc

SEQ ID NO: 462492 - DNA, 15 bp, Homo sapiens
ttcttatttattgca

SEQ ID NO: 462493 - DNA, 15 bp, Homo sapiens
tcttatttattgcat

SEQ ID NO: 462494 - DNA, 15 bp, Homo sapiens
cttatttattgcata

SEQ ID NO: 462495 - DNA, 15 bp, Homo sapiens
ttatttattgcatac

SEQ ID NO: 462496 - DNA, 15 bp, Homo sapiens
tatttattgcatact

SEQ ID NO: 462497 - DNA, 15 bp, Homo sapiens
atttattgcatactt

SEQ ID NO: 462498 - DNA, 15 bp, Homo sapiens
tttattgcatacttt

SEQ ID NO: 462499 - DNA, 15 bp, Homo sapiens
ttattgcatacttta

SEQ ID NO: 462500 - DNA, 15 bp, Homo sapiens
tattgcatactttat

SEQ ID NO: 462501 - DNA, 15 bp, Homo sapiens
attgcatactttata

SEQ ID NO: 462502 - DNA, 15 bp, Homo sapiens
ttgcatactttatat

SEQ ID NO: 462503 - DNA, 15 bp, Homo sapiens
tgcatactttatatg

SEQ ID NO: 462504 - DNA, 15 bp, Homo sapiens
gcatactttatatgt

SEQ ID NO: 462505 - DNA, 15 bp, Homo sapiens
catactttatatgtc

SEQ ID NO: 462506 - DNA, 15 bp, Homo sapiens
atactttatatgtca

SEQ ID NO: 462507 - DNA, 15 bp, Homo sapiens
tactttatatgtcat

SEQ ID NO: 462508 - DNA, 15 bp, Homo sapiens
actttatatgtcata

SEQ ID NO: 462509 - DNA, 15 bp, Homo sapiens
ctttatatgtcataa

SEQ ID NO: 462510 - DNA, 15 bp, Homo sapiens
tttatatgtcataat

SEQ ID NO: 462511 - DNA, 15 bp, Homo sapiens
ttatatgtcataata

SEQ ID NO: 462512 - DNA, 15 bp, Homo sapiens
tatatgtcataatat

SEQ ID NO: 462513 - DNA, 15 bp, Homo sapiens
atatgtcataatatg

SEQ ID NO: 462514 - DNA, 15 bp, Homo sapiens
tatgtcataatatgc

SEQ ID NO: 462515 - DNA, 15 bp, Homo sapiens
atgtcataatatgcg

SEQ ID NO: 462516 - DNA, 15 bp, Homo sapiens
tgtcataatatgcgt

SEQ ID NO: 462517 - DNA, 15 bp, Homo sapiens
gtcataatatgcgta

SEQ ID NO: 462518 - DNA, 15 bp, Homo sapiens
tcataatatgcgtac

SEQ ID NO: 462519 - DNA, 15 bp, Homo sapiens
cataatatgcgtaca

SEQ ID NO: 462520 - DNA, 15 bp, Homo sapiens
ataatatgcgtacag

SEQ ID NO: 462521 - DNA, 15 bp, Homo sapiens
taatatgcgtacaga

SEQ ID NO: 462522 - DNA, 15 bp, Homo sapiens
aatatgcgtacagaa

SEQ ID NO: 462523 - DNA, 15 bp, Homo sapiens
atatgcgtacagaaa

SEQ ID NO: 462524 - DNA, 15 bp, Homo sapiens
tatgcgtacagaaac

SEQ ID NO: 462525 - DNA, 15 bp, Homo sapiens
atgcgtacagaaact

SEQ ID NO: 462526 - DNA, 15 bp, Homo sapiens
tgcgtacagaaactt

SEQ ID NO: 462527 - DNA, 15 bp, Homo sapiens
gcgtacagaaacttc

SEQ ID NO: 462528 - DNA, 15 bp, Homo sapiens
cgtacagaaacttcc

SEQ ID NO: 462529 - DNA, 15 bp, Homo sapiens
gtacagaaacttcct

SEQ ID NO: 462530 - DNA, 15 bp, Homo sapiens
tacagaaacttcctt

SEQ ID NO: 462531 - DNA, 15 bp, Homo sapiens
acagaaacttccttc

SEQ ID NO: 462532 - DNA, 15 bp, Homo sapiens
cagaaacttccttca

SEQ ID NO: 462533 - DNA, 15 bp, Homo sapiens
agaaacttccttcag

SEQ ID NO: 462534 - DNA, 15 bp, Homo sapiens
gaaacttccttcagt

SEQ ID NO: 462535 - DNA, 15 bp, Homo sapiens
aaacttccttcagta

SEQ ID NO: 462536 - DNA, 15 bp, Homo sapiens
aacttccttcagtac

SEQ ID NO: 462537 - DNA, 15 bp, Homo sapiens
acttccttcagtaca

SEQ ID NO: 462538 - DNA, 15 bp, Homo sapiens
cttccttcagtacat

SEQ ID NO: 462539 - DNA, 15 bp, Homo sapiens
ttccttcagtacata

SEQ ID NO: 462540 - DNA, 15 bp, Homo sapiens
tccttcagtacatat

SEQ ID NO: 462541 - DNA, 15 bp, Homo sapiens
ccttcagtacatata

SEQ ID NO: 462542 - DNA, 15 bp, Homo sapiens
cttcagtacatatag

SEQ ID NO: 462543 - DNA, 15 bp, Homo sapiens
ttcagtacatatagt

SEQ ID NO: 462544 - DNA, 15 bp, Homo sapiens
tcagtacatatagtt

SEQ ID NO: 462545 - DNA, 15 bp, Homo sapiens
cagtacatatagttg

SEQ ID NO: 462546 - DNA, 15 bp, Homo sapiens
agtacatatagttga

SEQ ID NO: 462547 - DNA, 15 bp, Homo sapiens
gtacatatagttgag

SEQ ID NO: 462548 - DNA, 15 bp, Homo sapiens
tacatatagttgaga

SEQ ID NO: 462549 - DNA, 15 bp, Homo sapiens
acatatagttgagaa

SEQ ID NO: 462550 - DNA, 15 bp, Homo sapiens
catatagttgagaat

SEQ ID NO: 462551 - DNA, 15 bp, Homo sapiens
atatagttgagaatg

SEQ ID NO: 462552 - DNA, 15 bp, Homo sapiens
tatagttgagaatgg

SEQ ID NO: 462553 - DNA, 15 bp, Homo sapiens
atagttgagaatgga

SEQ ID NO: 462554 - DNA, 15 bp, Homo sapiens
tagttgagaatggaa

SEQ ID NO: 462555 - DNA, 15 bp, Homo sapiens
agttgagaatggaag

SEQ ID NO: 462556 - DNA, 15 bp, Homo sapiens
gttgagaatggaaga

SEQ ID NO: 462557 - DNA, 15 bp, Homo sapiens
ttgagaatggaagaa

SEQ ID NO: 462558 - DNA, 15 bp, Homo sapiens
tgagaatggaagaat

SEQ ID NO: 462559 - DNA, 15 bp, Homo sapiens
gagaatggaagaata

SEQ ID NO: 462560 - DNA, 15 bp, Homo sapiens
agaatggaagaatat

SEQ ID NO: 462561 - DNA, 15 bp, Homo sapiens
gaatggaagaatatc

SEQ ID NO: 462562 - DNA, 15 bp, Homo sapiens
aatggaagaatatca

SEQ ID NO: 462563 - DNA, 15 bp, Homo sapiens
atggaagaatatcaa

SEQ ID NO: 462564 - DNA, 15 bp, Homo sapiens
tggaagaatatcaat

SEQ ID NO: 462565 - DNA, 15 bp, Homo sapiens
ggaagaatatcaatt

SEQ ID NO: 462566 - DNA, 15 bp, Homo sapiens
gaagaatatcaatta

SEQ ID NO: 462567 - DNA, 15 bp, Homo sapiens
aagaatatcaattag

SEQ ID NO: 462568 - DNA, 15 bp, Homo sapiens
agaatatcaattagt

SEQ ID NO: 462569 - DNA, 15 bp, Homo sapiens
gaatatcaattagtg

SEQ ID NO: 462570 - DNA, 15 bp, Homo sapiens
aatatcaattagtgt

SEQ ID NO: 462571 - DNA, 15 bp, Homo sapiens
atatcaattagtgta

SEQ ID NO: 462572 - DNA, 15 bp, Homo sapiens
tatcaattagtgtaa

SEQ ID NO: 462573 - DNA, 15 bp, Homo sapiens
atcaattagtgtaag

SEQ ID NO: 462574 - DNA, 15 bp, Homo sapiens
caattagtgtaagta

SEQ ID NO: 462575 - DNA, 15 bp, Homo sapiens
aattagtgtaagtag

SEQ ID NO: 462576 - DNA, 15 bp, Homo sapiens
attagtgtaagtagt

SEQ ID NO: 462577 - DNA, 15 bp, Homo sapiens
ttagtgtaagtagta

SEQ ID NO: 462578 - DNA, 15 bp, Homo sapiens
tagtgtaagtagtaa

SEQ ID NO: 462579 - DNA, 15 bp, Homo sapiens
agtgtaagtagtaaa

SEQ ID NO: 462580 - DNA, 15 bp, Homo sapiens
gtgtaagtagtaaaa

SEQ ID NO: 462581 - DNA, 15 bp, Homo sapiens
tgtaagtagtaaaaa

SEQ ID NO: 462582 - DNA, 15 bp, Homo sapiens
gtaagtagtaaaaat

SEQ ID NO: 462583 - DNA, 15 bp, Homo sapiens
taagtagtaaaaata

SEQ ID NO: 462584 - DNA, 15 bp, Homo sapiens
aagtagtaaaaatat

SEQ ID NO: 462585 - DNA, 15 bp, Homo sapiens
agtagtaaaaatatc

SEQ ID NO: 462586 - DNA, 15 bp, Homo sapiens
gtagtaaaaatatca

SEQ ID NO: 462587 - DNA, 15 bp, Homo sapiens
tagtaaaaatatcaa

SEQ ID NO: 462588 - DNA, 15 bp, Homo sapiens
agtaaaaatatcaat

SEQ ID NO: 462589 - DNA, 15 bp, Homo sapiens
gtaaaaatatcaata

SEQ ID NO: 462590 - DNA, 15 bp, Homo sapiens
taaaaatatcaataa

SEQ ID NO: 462591 - DNA, 15 bp, Homo sapiens
aaaaatatcaataaa

SEQ ID NO: 462592 - DNA, 15 bp, Homo sapiens
aaaatatcaataaaa

SEQ ID NO: 462593 - DNA, 15 bp, Homo sapiens
aaatatcaataaaat

SEQ ID NO: 462594 - DNA, 15 bp, Homo sapiens
aatatcaataaaatc

SEQ ID NO: 462595 - DNA, 15 bp, Homo sapiens
atatcaataaaatca

SEQ ID NO: 462596 - DNA, 15 bp, Homo sapiens
tatcaataaaatcaa

SEQ ID NO: 462597 - DNA, 15 bp, Homo sapiens
atcaataaaatcaat

SEQ ID NO: 462598 - DNA, 15 bp, Homo sapiens
tcaataaaatcaatg

SEQ ID NO: 462599 - DNA, 15 bp, Homo sapiens
caataaaatcaatga

SEQ ID NO: 462600 - DNA, 15 bp, Homo sapiens
aataaaatcaatgat

SEQ ID NO: 462601 - DNA, 15 bp, Homo sapiens
ataaaatcaatgatt

SEQ ID NO: 462602 - DNA, 15 bp, Homo sapiens
taaaatcaatgatta

SEQ ID NO: 462603 - DNA, 15 bp, Homo sapiens
aaaatcaatgattaa

SEQ ID NO: 462604 - DNA, 15 bp, Homo sapiens
aaatcaatgattaaa

SEQ ID NO: 462605 - DNA, 15 bp, Homo sapiens
aatcaatgattaaat

SEQ ID NO: 462606 - DNA, 15 bp, Homo sapiens
atcaatgattaaata

SEQ ID NO: 462607 - DNA, 15 bp, Homo sapiens
tcaatgattaaatat

SEQ ID NO: 462608 - DNA, 15 bp, Homo sapiens
caatgattaaatata

SEQ ID NO: 462609 - DNA, 15 bp, Homo sapiens
aatgattaaatatag

SEQ ID NO: 462610 - DNA, 15 bp, Homo sapiens
atgattaaatatagt

SEQ ID NO: 462611 - DNA, 15 bp, Homo sapiens
tgattaaatatagtt

SEQ ID NO: 462612 - DNA, 15 bp, Homo sapiens
gattaaatatagttt

SEQ ID NO: 462613 - DNA, 15 bp, Homo sapiens
attaaatatagtttg

SEQ ID NO: 462614 - DNA, 15 bp, Homo sapiens
ttaaatatagtttgg

SEQ ID NO: 462615 - DNA, 15 bp, Homo sapiens
taaatatagtttggc

SEQ ID NO: 462616 - DNA, 15 bp, Homo sapiens
aaatatagtttggca

SEQ ID NO: 462617 - DNA, 15 bp, Homo sapiens
aatatagtttggcaa

SEQ ID NO: 462618 - DNA, 15 bp, Homo sapiens
atatagtttggcaag

SEQ ID NO: 462619 - DNA, 15 bp, Homo sapiens
tatagtttggcaaga

SEQ ID NO: 462620 - DNA, 15 bp, Homo sapiens
atagtttggcaagaa

SEQ ID NO: 462621 - DNA, 15 bp, Homo sapiens
tagtttggcaagaag

SEQ ID NO: 462622 - DNA, 15 bp, Homo sapiens
agtttggcaagaaga

SEQ ID NO: 462623 - DNA, 15 bp, Homo sapiens
gtttggcaagaagac

SEQ ID NO: 462624 - DNA, 15 bp, Homo sapiens
tttggcaagaagact

SEQ ID NO: 462625 - DNA, 15 bp, Homo sapiens
ttggcaagaagactg

SEQ ID NO: 462626 - DNA, 15 bp, Homo sapiens
tggcaagaagactgc

SEQ ID NO: 462627 - DNA, 15 bp, Homo sapiens
ggcaagaagactgct

SEQ ID NO: 462628 - DNA, 15 bp, Homo sapiens
gcaagaagactgctt

SEQ ID NO: 462629 - DNA, 15 bp, Homo sapiens
caagaagactgctta

SEQ ID NO: 462630 - DNA, 15 bp, Homo sapiens
aagaagactgcttaa

SEQ ID NO: 462631 - DNA, 15 bp, Homo sapiens
agaagactgcttaaa

SEQ ID NO: 462632 - DNA, 15 bp, Homo sapiens
gaagactgcttaaaa

SEQ ID NO: 462633 - DNA, 15 bp, Homo sapiens
aagactgcttaaaat

SEQ ID NO: 462634 - DNA, 15 bp, Homo sapiens
agactgcttaaaatt

SEQ ID NO: 462635 - DNA, 15 bp, Homo sapiens
gactgcttaaaatta

SEQ ID NO: 462636 - DNA, 15 bp, Homo sapiens
actgcttaaaattaa

SEQ ID NO: 462637 - DNA, 15 bp, Homo sapiens
ctgcttaaaattaaa

SEQ ID NO: 462638 - DNA, 15 bp, Homo sapiens
tgcttaaaattaaag

SEQ ID NO: 462639 - DNA, 15 bp, Homo sapiens
gcttaaaattaaagt

SEQ ID NO: 462640 - DNA, 15 bp, Homo sapiens
cttaaaattaaagtt

SEQ ID NO: 462641 - DNA, 15 bp, Homo sapiens
ttaaaattaaagtta

SEQ ID NO: 462642 - DNA, 15 bp, Homo sapiens
taaaattaaagttac

SEQ ID NO: 462643 - DNA, 15 bp, Homo sapiens
aaaattaaagttacg

SEQ ID NO: 462644 - DNA, 15 bp, Homo sapiens
aaattaaagttacgt

SEQ ID NO: 462645 - DNA, 15 bp, Homo sapiens
aattaaagttacgtg

SEQ ID NO: 462646 - DNA, 15 bp, Homo sapiens
attaaagttacgtga

SEQ ID NO: 462647 - DNA, 15 bp, Homo sapiens
ttaaagttacgtgat

SEQ ID NO: 462648 - DNA, 15 bp, Homo sapiens
taaagttacgtgata

SEQ ID NO: 462649 - DNA, 15 bp, Homo sapiens
aaagttacgtgatac

SEQ ID NO: 462650 - DNA, 15 bp, Homo sapiens
aagttacgtgataca

SEQ ID NO: 462651 - DNA, 15 bp, Homo sapiens
agttacgtgatacaa

SEQ ID NO: 462652 - DNA, 15 bp, Homo sapiens
gttacgtgatacaaa

SEQ ID NO: 462653 - DNA, 15 bp, Homo sapiens
ttacgtgatacaaat

SEQ ID NO: 462654 - DNA, 15 bp, Homo sapiens
tacgtgatacaaata

SEQ ID NO: 462655 - DNA, 15 bp, Homo sapiens
acgtgatacaaatat

SEQ ID NO: 462656 - DNA, 15 bp, Homo sapiens
cgtgatacaaatatt

SEQ ID NO: 462657 - DNA, 15 bp, Homo sapiens
gtgatacaaatattt

SEQ ID NO: 462658 - DNA, 15 bp, Homo sapiens
tgatacaaatattta

SEQ ID NO: 462659 - DNA, 15 bp, Homo sapiens
gatacaaatatttat

SEQ ID NO: 462660 - DNA, 15 bp, Homo sapiens
atacaaatatttatg

SEQ ID NO: 462661 - DNA, 15 bp, Homo sapiens
tacaaatatttatgt

SEQ ID NO: 462662 - DNA, 15 bp, Homo sapiens
acaaatatttatgtt

SEQ ID NO: 462663 - DNA, 15 bp, Homo sapiens
caaatatttatgttt

SEQ ID NO: 462664 - DNA, 15 bp, Homo sapiens
aaatatttatgtttt

SEQ ID NO: 462665 - DNA, 15 bp, Homo sapiens
aatatttatgttttt

SEQ ID NO: 462666 - DNA, 15 bp, Homo sapiens
atatttatgttttta

SEQ ID NO: 462667 - DNA, 15 bp, Homo sapiens
tatttatgtttttaa

SEQ ID NO: 462668 - DNA, 15 bp, Homo sapiens
atttatgtttttaaa

SEQ ID NO: 462669 - DNA, 15 bp, Homo sapiens
ttatgtttttaaaat

SEQ ID NO: 462670 - DNA, 15 bp, Homo sapiens
tatgtttttaaaata

SEQ ID NO: 462671 - DNA, 15 bp, Homo sapiens
atgtttttaaaatag

SEQ ID NO: 462672 - DNA, 15 bp, Homo sapiens
tgtttttaaaatagc

SEQ ID NO: 462673 - DNA, 15 bp, Homo sapiens
gtttttaaaatagca

SEQ ID NO: 462674 - DNA, 15 bp, Homo sapiens
tttttaaaatagcac

SEQ ID NO: 462675 - DNA, 15 bp, Homo sapiens
ttttaaaatagcaca

SEQ ID NO: 462676 - DNA, 15 bp, Homo sapiens
tttaaaatagcacaa

SEQ ID NO: 462677 - DNA, 15 bp, Homo sapiens
ttaaaatagcacaaa

SEQ ID NO: 462678 - DNA, 15 bp, Homo sapiens
taaaatagcacaaat

SEQ ID NO: 462679 - DNA, 15 bp, Homo sapiens
aaaatagcacaaatt

SEQ ID NO: 462680 - DNA, 15 bp, Homo sapiens
aaatagcacaaattg

SEQ ID NO: 462681 - DNA, 15 bp, Homo sapiens
aatagcacaaattgt

SEQ ID NO: 462682 - DNA, 15 bp, Homo sapiens
atagcacaaattgtt

SEQ ID NO: 462683 - DNA, 15 bp, Homo sapiens
tagcacaaattgtta

SEQ ID NO: 462684 - DNA, 15 bp, Homo sapiens
agcacaaattgttaa

SEQ ID NO: 462685 - DNA, 15 bp, Homo sapiens
gcacaaattgttaac

SEQ ID NO: 462686 - DNA, 15 bp, Homo sapiens
cacaaattgttaact

SEQ ID NO: 462687 - DNA, 15 bp, Homo sapiens
acaaattgttaactt

SEQ ID NO: 462688 - DNA, 15 bp, Homo sapiens
caaattgttaacttt

SEQ ID NO: 462689 - DNA, 15 bp, Homo sapiens
aaattgttaactttt

SEQ ID NO: 462690 - DNA, 15 bp, Homo sapiens
aattgttaactttta

SEQ ID NO: 462691 - DNA, 15 bp, Homo sapiens
attgttaacttttat

SEQ ID NO: 462692 - DNA, 15 bp, Homo sapiens
ttgttaacttttata

SEQ ID NO: 462693 - DNA, 15 bp, Homo sapiens
tgttaacttttatac

SEQ ID NO: 462694 - DNA, 15 bp, Homo sapiens
gttaacttttataca

SEQ ID NO: 462695 - DNA, 15 bp, Homo sapiens
ttaacttttatacat

SEQ ID NO: 462696 - DNA, 15 bp, Homo sapiens
taacttttatacatt

SEQ ID NO: 462697 - DNA, 15 bp, Homo sapiens
aacttttatacattc

SEQ ID NO: 462698 - DNA, 15 bp, Homo sapiens
acttttatacattca

SEQ ID NO: 462699 - DNA, 15 bp, Homo sapiens
cttttatacattcat

SEQ ID NO: 462700 - DNA, 15 bp, Homo sapiens
ttttatacattcata

SEQ ID NO: 462701 - DNA, 15 bp, Homo sapiens
tttatacattcatat

SEQ ID NO: 462702 - DNA, 15 bp, Homo sapiens
ttatacattcatata

SEQ ID NO: 462703 - DNA, 15 bp, Homo sapiens
tatacattcatatat

SEQ ID NO: 462704 - DNA, 15 bp, Homo sapiens
atacattcatatatt

SEQ ID NO: 462705 - DNA, 15 bp, Homo sapiens
tacattcatatattt

SEQ ID NO: 462706 - DNA, 15 bp, Homo sapiens
acattcatatattta

SEQ ID NO: 462707 - DNA, 15 bp, Homo sapiens
cattcatatatttat

SEQ ID NO: 462708 - DNA, 15 bp, Homo sapiens
attcatatatttatg

SEQ ID NO: 462709 - DNA, 15 bp, Homo sapiens
ttcatatatttatgt

SEQ ID NO: 462710 - DNA, 15 bp, Homo sapiens
tcatatatttatgta

SEQ ID NO: 462711 - DNA, 15 bp, Homo sapiens
catatatttatgtaa

SEQ ID NO: 462712 - DNA, 15 bp, Homo sapiens
atatatttatgtaaa

SEQ ID NO: 462713 - DNA, 15 bp, Homo sapiens
tatatttatgtaaac

SEQ ID NO: 462714 - DNA, 15 bp, Homo sapiens
atatttatgtaaact

SEQ ID NO: 462715 - DNA, 15 bp, Homo sapiens
tatttatgtaaactt

SEQ ID NO: 462716 - DNA, 15 bp, Homo sapiens
atttatgtaaacttt

SEQ ID NO: 462717 - DNA, 15 bp, Homo sapiens
tttatgtaaactttt

SEQ ID NO: 462718 - DNA, 15 bp, Homo sapiens
ttatgtaaactttta

SEQ ID NO: 462719 - DNA, 15 bp, Homo sapiens
tatgtaaacttttag

SEQ ID NO: 462720 - DNA, 15 bp, Homo sapiens
atgtaaacttttagt

SEQ ID NO: 462721 - DNA, 15 bp, Homo sapiens
tgtaaacttttagtt

SEQ ID NO: 462722 - DNA, 15 bp, Homo sapiens
gtaaacttttagtta

SEQ ID NO: 462723 - DNA, 15 bp, Homo sapiens
taaacttttagttat

SEQ ID NO: 462724 - DNA, 15 bp, Homo sapiens
aaacttttagttata

SEQ ID NO: 462725 - DNA, 15 bp, Homo sapiens
aacttttagttatag

SEQ ID NO: 462726 - DNA, 15 bp, Homo sapiens
acttttagttatagg

SEQ ID NO: 462727 - DNA, 15 bp, Homo sapiens
cttttagttataggt

SEQ ID NO: 462728 - DNA, 15 bp, Homo sapiens
ttttagttataggtt

SEQ ID NO: 462729 - DNA, 15 bp, Homo sapiens
tttagttataggttt

SEQ ID NO: 462730 - DNA, 15 bp, Homo sapiens
ttagttataggtttt

SEQ ID NO: 462731 - DNA, 15 bp, Homo sapiens
tagttataggtttta

SEQ ID NO: 462732 - DNA, 15 bp, Homo sapiens
agttataggttttaa

SEQ ID NO: 462733 - DNA, 15 bp, Homo sapiens
gttataggttttaag

SEQ ID NO: 462734 - DNA, 15 bp, Homo sapiens
ttataggttttaagt

SEQ ID NO: 462735 - DNA, 15 bp, Homo sapiens
tataggttttaagtg

SEQ ID NO: 462736 - DNA, 15 bp, Homo sapiens
ataggttttaagtgt

SEQ ID NO: 462737 - DNA, 15 bp, Homo sapiens
taggttttaagtgtg

SEQ ID NO: 462738 - DNA, 15 bp, Homo sapiens
aggttttaagtgtgc

SEQ ID NO: 462739 - DNA, 15 bp, Homo sapiens
ggttttaagtgtgct

SEQ ID NO: 462740 - DNA, 15 bp, Homo sapiens
gttttaagtgtgctg

SEQ ID NO: 462741 - DNA, 15 bp, Homo sapiens
tttaagtgtgctgta

SEQ ID NO: 462742 - DNA, 15 bp, Homo sapiens
ttaagtgtgctgtac

SEQ ID NO: 462743 - DNA, 15 bp, Homo sapiens
taagtgtgctgtact

SEQ ID NO: 462744 - DNA, 15 bp, Homo sapiens
aagtgtgctgtactt

SEQ ID NO: 462745 - DNA, 15 bp, Homo sapiens
agtgtgctgtacttg

SEQ ID NO: 462746 - DNA, 15 bp, Homo sapiens
gtgtgctgtacttgt

SEQ ID NO: 462747 - DNA, 15 bp, Homo sapiens
tgtgctgtacttgtg

SEQ ID NO: 462748 - DNA, 15 bp, Homo sapiens
gtgctgtacttgtgt

SEQ ID NO: 462749 - DNA, 15 bp, Homo sapiens
tgctgtacttgtgta

SEQ ID NO: 462750 - DNA, 15 bp, Homo sapiens
gctgtacttgtgtat

SEQ ID NO: 462751 - DNA, 15 bp, Homo sapiens
ctgtacttgtgtatt

SEQ ID NO: 462752 - DNA, 15 bp, Homo sapiens
tgtacttgtgtatta

SEQ ID NO: 462753 - DNA, 15 bp, Homo sapiens
gtacttgtgtattaa

SEQ ID NO: 462754 - DNA, 15 bp, Homo sapiens
tacttgtgtattaaa

SEQ ID NO: 462755 - DNA, 15 bp, Homo sapiens
acttgtgtattaaaa

SEQ ID NO: 462756 - DNA, 15 bp, Homo sapiens
cttgtgtattaaaaa

SEQ ID NO: 462757 - DNA, 15 bp, Homo sapiens
ttgtgtattaaaaac

SEQ ID NO: 462758 - DNA, 15 bp, Homo sapiens
tgtgtattaaaaaca

SEQ ID NO: 462759 - DNA, 15 bp, Homo sapiens
gtgtattaaaaacat

SEQ ID NO: 462760 - DNA, 15 bp, Homo sapiens
tgtattaaaaacata

SEQ ID NO: 462761 - DNA, 15 bp, Homo sapiens
gtattaaaaacatat

SEQ ID NO: 462762 - DNA, 15 bp, Homo sapiens
tattaaaaacatata

SEQ ID NO: 462763 - DNA, 15 bp, Homo sapiens
attaaaaacatataa

SEQ ID NO: 462764 - DNA, 15 bp, Homo sapiens
ttaaaaacatataag

SEQ ID NO: 462765 - DNA, 15 bp, Homo sapiens
taaaaacatataaga

SEQ ID NO: 462766 - DNA, 15 bp, Homo sapiens
aaaaacatataagaa

SEQ ID NO: 462767 - DNA, 15 bp, Homo sapiens
aaaacatataagaaa

SEQ ID NO: 462768 - DNA, 15 bp, Homo sapiens
aaacatataagaaaa

SEQ ID NO: 462769 - DNA, 15 bp, Homo sapiens
aacatataagaaaat

SEQ ID NO: 462770 - DNA, 15 bp, Homo sapiens
acatataagaaaatg

SEQ ID NO: 462771 - DNA, 15 bp, Homo sapiens
catataagaaaatgg

SEQ ID NO: 462772 - DNA, 15 bp, Homo sapiens
atataagaaaatgga

SEQ ID NO: 462773 - DNA, 15 bp, Homo sapiens
tataagaaaatggac

SEQ ID NO: 462774 - DNA, 15 bp, Homo sapiens
ataagaaaatggaca

SEQ ID NO: 462775 - DNA, 15 bp, Homo sapiens
taagaaaatggacaa

SEQ ID NO: 462776 - DNA, 15 bp, Homo sapiens
aagaaaatggacaat

SEQ ID NO: 462777 - DNA, 15 bp, Homo sapiens
agaaaatggacaata

SEQ ID NO: 462778 - DNA, 15 bp, Homo sapiens
gaaaatggacaataa

SEQ ID NO: 462779 - DNA, 15 bp, Homo sapiens
aaatggacaataaaa

SEQ ID NO: 462780 - DNA, 15 bp, Homo sapiens
aatggacaataaaaa

SEQ ID NO: 462781 - DNA, 15 bp, Homo sapiens
atggacaataaaaac

SEQ ID NO: 462782 - DNA, 15 bp, Homo sapiens
tggacaataaaaacc

SEQ ID NO: 462783 - DNA, 15 bp, Homo sapiens
ggacaataaaaacct

SEQ ID NO: 462784 - DNA, 15 bp, Homo sapiens
gacaataaaaaccta

SEQ ID NO: 462785 - DNA, 15 bp, Homo sapiens
acaataaaaacctaa

SEQ ID NO: 462786 - DNA, 15 bp, Homo sapiens
caataaaaacctaaa

SEQ ID NO: 462787 - DNA, 15 bp, Homo sapiens
aataaaaacctaaaa

SEQ ID NO: 462788 - DNA, 15 bp, Homo sapiens
ataaaaacctaaaat

SEQ ID NO: 462789 - DNA, 15 bp, Homo sapiens
taaaaacctaaaatg

SEQ ID NO: 462790 - DNA, 15 bp, Homo sapiens
aaaaacctaaaatga

SEQ ID NO: 462791 - DNA, 15 bp, Homo sapiens
aaaacctaaaatgaa

SEQ ID NO: 462792 - DNA, 15 bp, Homo sapiens
aaacctaaaatgaaa

SEQ ID NO: 462793 - DNA, 15 bp, Homo sapiens
aacctaaaatgaaaa

SEQ ID NO: 462794 - DNA, 15 bp, Homo sapiens
acctaaaatgaaaat

SEQ ID NO: 462795 - DNA, 15 bp, Homo sapiens
cctaaaatgaaaatg

SEQ ID NO: 462796 - DNA, 15 bp, Homo sapiens
ctaaaatgaaaatgg

SEQ ID NO: 462797 - DNA, 15 bp, Homo sapiens
taaaatgaaaatgga

SEQ ID NO: 462798 - DNA, 15 bp, Homo sapiens
aaaatgaaaatggat

SEQ ID NO: 462799 - DNA, 15 bp, Homo sapiens
aaatgaaaatggatc

SEQ ID NO: 462800 - DNA, 15 bp, Homo sapiens
aatgaaaatggatcc

SEQ ID NO: 462801 - DNA, 15 bp, Homo sapiens
tgaaaatggatccta

SEQ ID NO: 462802 - DNA, 15 bp, Homo sapiens
gaaaatggatcctaa

SEQ ID NO: 462803 - DNA, 15 bp, Homo sapiens
aaaatggatcctaaa

SEQ ID NO: 462804 - DNA, 15 bp, Homo sapiens
aaatggatcctaaat

SEQ ID NO: 462805 - DNA, 15 bp, Homo sapiens
aatggatcctaaatg

SEQ ID NO: 462806 - DNA, 15 bp, Homo sapiens
atggatcctaaatgt

SEQ ID NO: 462807 - DNA, 15 bp, Homo sapiens
tggatcctaaatgtg

SEQ ID NO: 462808 - DNA, 15 bp, Homo sapiens
ggatcctaaatgtgt

SEQ ID NO: 462809 - DNA, 15 bp, Homo sapiens
gatcctaaatgtgta

SEQ ID NO: 462810 - DNA, 15 bp, Homo sapiens
atcctaaatgtgtaa

SEQ ID NO: 462811 - DNA, 15 bp, Homo sapiens
caggaaaatacatag

SEQ ID NO: 462812 - DNA, 15 bp, Homo sapiens
aggaaaatacatagg

SEQ ID NO: 462813 - DNA, 15 bp, Homo sapiens
ggaaaatacataggc

SEQ ID NO: 462814 - DNA, 15 bp, Homo sapiens
gaaaatacataggcg

SEQ ID NO: 462815 - DNA, 15 bp, Homo sapiens
aaaatacataggcga

SEQ ID NO: 462816 - DNA, 15 bp, Homo sapiens
aaatacataggcgaa

SEQ ID NO: 462817 - DNA, 15 bp, Homo sapiens
aatacataggcgaat

SEQ ID NO: 462818 - DNA, 15 bp, Homo sapiens
atacataggcgaata

SEQ ID NO: 462819 - DNA, 15 bp, Homo sapiens
tacataggcgaatat

SEQ ID NO: 462820 - DNA, 15 bp, Homo sapiens
acataggcgaatatg

SEQ ID NO: 462821 - DNA, 15 bp, Homo sapiens
cataggcgaatatgt

SEQ ID NO: 462822 - DNA, 15 bp, Homo sapiens
ataggcgaatatgtg

SEQ ID NO: 462823 - DNA, 15 bp, Homo sapiens
taggcgaatatgtgc

SEQ ID NO: 462824 - DNA, 15 bp, Homo sapiens
aggcgaatatgtgca

SEQ ID NO: 462825 - DNA, 15 bp, Homo sapiens
ggcgaatatgtgcaa

SEQ ID NO: 462826 - DNA, 15 bp, Homo sapiens
gcgaatatgtgcaaa

SEQ ID NO: 462827 - DNA, 15 bp, Homo sapiens
cgaatatgtgcaaac

SEQ ID NO: 462828 - DNA, 15 bp, Homo sapiens
gaatatgtgcaaaca

SEQ ID NO: 462829 - DNA, 15 bp, Homo sapiens
aatatgtgcaaacaa

SEQ ID NO: 462830 - DNA, 15 bp, Homo sapiens
atatgtgcaaacaac

SEQ ID NO: 462831 - DNA, 15 bp, Homo sapiens
tatgtgcaaacaact

SEQ ID NO: 462832 - DNA, 15 bp, Homo sapiens
atgtgcaaacaactt

SEQ ID NO: 462833 - DNA, 15 bp, Homo sapiens
tgtgcaaacaacttg

SEQ ID NO: 462834 - DNA, 15 bp, Homo sapiens
gtgcaaacaacttgt

SEQ ID NO: 462835 - DNA, 15 bp, Homo sapiens
tgcaaacaacttgtt

SEQ ID NO: 462836 - DNA, 15 bp, Homo sapiens
gcaaacaacttgttt

SEQ ID NO: 462837 - DNA, 15 bp, Homo sapiens
caaacaacttgttta

SEQ ID NO: 462838 - DNA, 15 bp, Homo sapiens
aaacaacttgtttaa

SEQ ID NO: 462839 - DNA, 15 bp, Homo sapiens
aacaacttgtttaag

SEQ ID NO: 462840 - DNA, 15 bp, Homo sapiens
acaacttgtttaaga

SEQ ID NO: 462841 - DNA, 15 bp, Homo sapiens
caacttgtttaagaa

SEQ ID NO: 462842 - DNA, 15 bp, Homo sapiens
aacttgtttaagaaa

SEQ ID NO: 462843 - DNA, 15 bp, Homo sapiens
acttgtttaagaaat

SEQ ID NO: 462844 - DNA, 15 bp, Homo sapiens
cttgtttaagaaatc

SEQ ID NO: 462845 - DNA, 15 bp, Homo sapiens
ttgtttaagaaatct

SEQ ID NO: 462846 - DNA, 15 bp, Homo sapiens
tgtttaagaaatcta

SEQ ID NO: 462847 - DNA, 15 bp, Homo sapiens
gtttaagaaatctag

SEQ ID NO: 462848 - DNA, 15 bp, Homo sapiens
tttaagaaatctagc

SEQ ID NO: 462849 - DNA, 15 bp, Homo sapiens
ttaagaaatctagct

SEQ ID NO: 462850 - DNA, 15 bp, Homo sapiens
taagaaatctagcta

SEQ ID NO: 462851 - DNA, 15 bp, Homo sapiens
aagaaatctagctat

SEQ ID NO: 462852 - DNA, 15 bp, Homo sapiens
agaaatctagctata

SEQ ID NO: 462853 - DNA, 15 bp, Homo sapiens
gaaatctagctataa

SEQ ID NO: 462854 - DNA, 15 bp, Homo sapiens
aaatctagctataac

SEQ ID NO: 462855 - DNA, 15 bp, Homo sapiens
aatctagctataact

SEQ ID NO: 462856 - DNA, 15 bp, Homo sapiens
atctagctataactt

SEQ ID NO: 462857 - DNA, 15 bp, Homo sapiens
tctagctataactta

SEQ ID NO: 462858 - DNA, 15 bp, Homo sapiens
ctagctataacttaa

SEQ ID NO: 462859 - DNA, 15 bp, Homo sapiens
tagctataacttaaa

SEQ ID NO: 462860 - DNA, 15 bp, Homo sapiens
agctataacttaaaa

SEQ ID NO: 462861 - DNA, 15 bp, Homo sapiens
gctataacttaaaat

SEQ ID NO: 462862 - DNA, 15 bp, Homo sapiens
ctataacttaaaata

SEQ ID NO: 462863 - DNA, 15 bp, Homo sapiens
tataacttaaaatat

SEQ ID NO: 462864 - DNA, 15 bp, Homo sapiens
ataacttaaaatatg

SEQ ID NO: 462865 - DNA, 15 bp, Homo sapiens
taacttaaaatatgt

SEQ ID NO: 462866 - DNA, 15 bp, Homo sapiens
aacttaaaatatgtc

SEQ ID NO: 462867 - DNA, 15 bp, Homo sapiens
acttaaaatatgtca

SEQ ID NO: 462868 - DNA, 15 bp, Homo sapiens
cttaaaatatgtcag

SEQ ID NO: 462869 - DNA, 15 bp, Homo sapiens
ttaaaatatgtcagg

SEQ ID NO: 462870 - DNA, 15 bp, Homo sapiens
taaaatatgtcagga

SEQ ID NO: 462871 - DNA, 15 bp, Homo sapiens
aaaatatgtcaggat

SEQ ID NO: 462872 - DNA, 15 bp, Homo sapiens
aaatatgtcaggata

SEQ ID NO: 462873 - DNA, 15 bp, Homo sapiens
aatatgtcaggatat

SEQ ID NO: 462874 - DNA, 15 bp, Homo sapiens
atatgtcaggatatt

SEQ ID NO: 462875 - DNA, 15 bp, Homo sapiens
tatgtcaggatattg

SEQ ID NO: 462876 - DNA, 15 bp, Homo sapiens
atgtcaggatattga

SEQ ID NO: 462877 - DNA, 15 bp, Homo sapiens
tgtcaggatattgaa

SEQ ID NO: 462878 - DNA, 15 bp, Homo sapiens
gtcaggatattgaaa

SEQ ID NO: 462879 - DNA, 15 bp, Homo sapiens
tcaggatattgaaaa

SEQ ID NO: 462880 - DNA, 15 bp, Homo sapiens
caggatattgaaaat

SEQ ID NO: 462881 - DNA, 15 bp, Homo sapiens
aggatattgaaaatt

SEQ ID NO: 462882 - DNA, 15 bp, Homo sapiens
ggatattgaaaattg

SEQ ID NO: 462883 - DNA, 15 bp, Homo sapiens
gatattgaaaattgg

SEQ ID NO: 462884 - DNA, 15 bp, Homo sapiens
atattgaaaattgga

SEQ ID NO: 462885 - DNA, 15 bp, Homo sapiens
tattgaaaattggaa

SEQ ID NO: 462886 - DNA, 15 bp, Homo sapiens
attgaaaattggaag

SEQ ID NO: 462887 - DNA, 15 bp, Homo sapiens
ttgaaaattggaaga

SEQ ID NO: 462888 - DNA, 15 bp, Homo sapiens
tgaaaattggaagat

SEQ ID NO: 462889 - DNA, 15 bp, Homo sapiens
gaaaattggaagatg

SEQ ID NO: 462890 - DNA, 15 bp, Homo sapiens
aaaattggaagatgg

SEQ ID NO: 462891 - DNA, 15 bp, Homo sapiens
aaattggaagatggt

SEQ ID NO: 462892 - DNA, 15 bp, Homo sapiens
aattggaagatggta

SEQ ID NO: 462893 - DNA, 15 bp, Homo sapiens
attggaagatggtaa

SEQ ID NO: 462894 - DNA, 15 bp, Homo sapiens
ttggaagatggtaag

SEQ ID NO: 462895 - DNA, 15 bp, Homo sapiens
tggaagatggtaagt

SEQ ID NO: 462896 - DNA, 15 bp, Homo sapiens
ggaagatggtaagtg

SEQ ID NO: 462897 - DNA, 15 bp, Homo sapiens
gaagatggtaagtga

SEQ ID NO: 462898 - DNA, 15 bp, Homo sapiens
aagatggtaagtgat

SEQ ID NO: 462899 - DNA, 15 bp, Homo sapiens
agatggtaagtgata

SEQ ID NO: 462900 - DNA, 15 bp, Homo sapiens
gatggtaagtgatat

SEQ ID NO: 462901 - DNA, 15 bp, Homo sapiens
atggtaagtgatata

SEQ ID NO: 462902 - DNA, 15 bp, Homo sapiens
tggtaagtgatatat

SEQ ID NO: 462903 - DNA, 15 bp, Homo sapiens
ggtaagtgatatatt

SEQ ID NO: 462904 - DNA, 15 bp, Homo sapiens
gtaagtgatatattg

SEQ ID NO: 462905 - DNA, 15 bp, Homo sapiens
taagtgatatattgt

SEQ ID NO: 462906 - DNA, 15 bp, Homo sapiens
aagtgatatattgtc

SEQ ID NO: 462907 - DNA, 15 bp, Homo sapiens
agtgatatattgtct

SEQ ID NO: 462908 - DNA, 15 bp, Homo sapiens
gtgatatattgtctt

SEQ ID NO: 462909 - DNA, 15 bp, Homo sapiens
tgatatattgtctta

SEQ ID NO: 462910 - DNA, 15 bp, Homo sapiens
gatatattgtcttac

SEQ ID NO: 462911 - DNA, 15 bp, Homo sapiens
atatattgtcttact

SEQ ID NO: 462912 - DNA, 15 bp, Homo sapiens
tatattgtcttactt

SEQ ID NO: 462913 - DNA, 15 bp, Homo sapiens
atattgtcttacttt

SEQ ID NO: 462914 - DNA, 15 bp, Homo sapiens
tattgtcttactttt

SEQ ID NO: 462915 - DNA, 15 bp, Homo sapiens
attgtcttactttta

SEQ ID NO: 462916 - DNA, 15 bp, Homo sapiens
ttgtcttacttttac

SEQ ID NO: 462917 - DNA, 15 bp, Homo sapiens
tgtcttacttttact

SEQ ID NO: 462918 - DNA, 15 bp, Homo sapiens
gtcttacttttactt

SEQ ID NO: 462919 - DNA, 15 bp, Homo sapiens
tcttacttttacttg

SEQ ID NO: 462920 - DNA, 15 bp, Homo sapiens
cttacttttacttgc

SEQ ID NO: 462921 - DNA, 15 bp, Homo sapiens
ttacttttacttgca

SEQ ID NO: 462922 - DNA, 15 bp, Homo sapiens
tacttttacttgcat

SEQ ID NO: 462923 - DNA, 15 bp, Homo sapiens
acttttacttgcatt

SEQ ID NO: 462924 - DNA, 15 bp, Homo sapiens
cttttacttgcattt

SEQ ID NO: 462925 - DNA, 15 bp, Homo sapiens
ttttacttgcattta

SEQ ID NO: 462926 - DNA, 15 bp, Homo sapiens
tttacttgcatttat

SEQ ID NO: 462927 - DNA, 15 bp, Homo sapiens
ttacttgcatttata

SEQ ID NO: 462928 - DNA, 15 bp, Homo sapiens
tgaatggaaagacaa

SEQ ID NO: 462929 - DNA, 15 bp, Homo sapiens
gaatggaaagacaag

SEQ ID NO: 462930 - DNA, 15 bp, Homo sapiens
aatggaaagacaagt

SEQ ID NO: 462931 - DNA, 15 bp, Homo sapiens
atggaaagacaagta

SEQ ID NO: 462932 - DNA, 15 bp, Homo sapiens
tggaaagacaagtac

SEQ ID NO: 462933 - DNA, 15 bp, Homo sapiens
ggaaagacaagtaca

SEQ ID NO: 462934 - DNA, 15 bp, Homo sapiens
gaaagacaagtacag

SEQ ID NO: 462935 - DNA, 15 bp, Homo sapiens
aaagacaagtacaga

SEQ ID NO: 462936 - DNA, 15 bp, Homo sapiens
aagacaagtacagaa

SEQ ID NO: 462937 - DNA, 15 bp, Homo sapiens
agacaagtacagaaa

SEQ ID NO: 462938 - DNA, 15 bp, Homo sapiens
gacaagtacagaaat

SEQ ID NO: 462939 - DNA, 15 bp, Homo sapiens
acaagtacagaaata

SEQ ID NO: 462940 - DNA, 15 bp, Homo sapiens
caagtacagaaataa

SEQ ID NO: 462941 - DNA, 15 bp, Homo sapiens
aagtacagaaataaa

SEQ ID NO: 462942 - DNA, 15 bp, Homo sapiens
agtacagaaataaag

SEQ ID NO: 462943 - DNA, 15 bp, Homo sapiens
gtacagaaataaaga

SEQ ID NO: 462944 - DNA, 15 bp, Homo sapiens
tacagaaataaagat

SEQ ID NO: 462945 - DNA, 15 bp, Homo sapiens
acagaaataaagata

SEQ ID NO: 462946 - DNA, 15 bp, Homo sapiens
cagaaataaagatag

SEQ ID NO: 462947 - DNA, 15 bp, Homo sapiens
agaaataaagataga

SEQ ID NO: 462948 - DNA, 15 bp, Homo sapiens
gaaataaagatagag

SEQ ID NO: 462949 - DNA, 15 bp, Homo sapiens
aaataaagatagagg

SEQ ID NO: 462950 - DNA, 15 bp, Homo sapiens
aataaagatagagga

SEQ ID NO: 462951 - DNA, 15 bp, Homo sapiens
ataaagatagaggaa

SEQ ID NO: 462952 - DNA, 15 bp, Homo sapiens
taaagatagaggaat

SEQ ID NO: 462953 - DNA, 15 bp, Homo sapiens
aaagatagaggaata

SEQ ID NO: 462954 - DNA, 15 bp, Homo sapiens
aagatagaggaatat

SEQ ID NO: 462955 - DNA, 15 bp, Homo sapiens
agatagaggaatatg

SEQ ID NO: 462956 - DNA, 15 bp, Homo sapiens
gatagaggaatatgt

SEQ ID NO: 462957 - DNA, 15 bp, Homo sapiens
atagaggaatatgtc

SEQ ID NO: 462958 - DNA, 15 bp, Homo sapiens
tagaggaatatgtct

SEQ ID NO: 462959 - DNA, 15 bp, Homo sapiens
agaggaatatgtcta

SEQ ID NO: 462960 - DNA, 15 bp, Homo sapiens
gaggaatatgtctat

SEQ ID NO: 462961 - DNA, 15 bp, Homo sapiens
aggaatatgtctatt

SEQ ID NO: 462962 - DNA, 15 bp, Homo sapiens
ggaatatgtctatta

SEQ ID NO: 462963 - DNA, 15 bp, Homo sapiens
gaatatgtctattat

SEQ ID NO: 462964 - DNA, 15 bp, Homo sapiens
aatatgtctattata

SEQ ID NO: 462965 - DNA, 15 bp, Homo sapiens
atatgtctattatag

SEQ ID NO: 462966 - DNA, 15 bp, Homo sapiens
tatgtctattataga

SEQ ID NO: 462967 - DNA, 15 bp, Homo sapiens
atgtctattatagaa

SEQ ID NO: 462968 - DNA, 15 bp, Homo sapiens
tgtctattatagaat

SEQ ID NO: 462969 - DNA, 15 bp, Homo sapiens
gtctattatagaata

SEQ ID NO: 462970 - DNA, 15 bp, Homo sapiens
tctattatagaataa

SEQ ID NO: 462971 - DNA, 15 bp, Homo sapiens
ctattatagaataat

SEQ ID NO: 462972 - DNA, 15 bp, Homo sapiens
tattatagaataatc

SEQ ID NO: 462973 - DNA, 15 bp, Homo sapiens
attatagaataatct

SEQ ID NO: 462974 - DNA, 15 bp, Homo sapiens
ttatagaataatctt

SEQ ID NO: 462975 - DNA, 15 bp, Homo sapiens
tatagaataatctta

SEQ ID NO: 462976 - DNA, 15 bp, Homo sapiens
atagaataatcttaa

SEQ ID NO: 462977 - DNA, 15 bp, Homo sapiens
tagaataatcttaac

SEQ ID NO: 462978 - DNA, 15 bp, Homo sapiens
agaataatcttaact

SEQ ID NO: 462979 - DNA, 15 bp, Homo sapiens
gaataatcttaactt

SEQ ID NO: 462980 - DNA, 15 bp, Homo sapiens
aataatcttaacttc

SEQ ID NO: 462981 - DNA, 15 bp, Homo sapiens
ataatcttaacttca

SEQ ID NO: 462982 - DNA, 15 bp, Homo sapiens
taatcttaacttcat

SEQ ID NO: 462983 - DNA, 15 bp, Homo sapiens
aatcttaacttcatt

SEQ ID NO: 462984 - DNA, 15 bp, Homo sapiens
atcttaacttcattc

SEQ ID NO: 462985 - DNA, 15 bp, Homo sapiens
tcttaacttcattca

SEQ ID NO: 462986 - DNA, 15 bp, Homo sapiens
cttaacttcattcag

SEQ ID NO: 462987 - DNA, 15 bp, Homo sapiens
ttaacttcattcaga

SEQ ID NO: 462988 - DNA, 15 bp, Homo sapiens
taacttcattcagac

SEQ ID NO: 462989 - DNA, 15 bp, Homo sapiens
aacttcattcagact

SEQ ID NO: 462990 - DNA, 15 bp, Homo sapiens
acttcattcagactg

SEQ ID NO: 462991 - DNA, 15 bp, Homo sapiens
cttcattcagactgt

SEQ ID NO: 462992 - DNA, 15 bp, Homo sapiens
ttcattcagactgtc

SEQ ID NO: 462993 - DNA, 15 bp, Homo sapiens
tcattcagactgtct

SEQ ID NO: 462994 - DNA, 15 bp, Homo sapiens
cattcagactgtctt

SEQ ID NO: 462995 - DNA, 15 bp, Homo sapiens
attcagactgtcttt

SEQ ID NO: 462996 - DNA, 15 bp, Homo sapiens
ttcagactgtctttc

SEQ ID NO: 462997 - DNA, 15 bp, Homo sapiens
tcagactgtctttct

SEQ ID NO: 462998 - DNA, 15 bp, Homo sapiens
cagactgtctttcta

SEQ ID NO: 462999 - DNA, 15 bp, Homo sapiens
agactgtctttctat

SEQ ID NO: 463000 - DNA, 15 bp, Homo sapiens
gactgtctttctatc

SEQ ID NO: 463001 - DNA, 15 bp, Homo sapiens
actgtctttctatca

SEQ ID NO: 463002 - DNA, 15 bp, Homo sapiens
ctgtctttctatcaa

SEQ ID NO: 463003 - DNA, 15 bp, Homo sapiens
tgtctttctatcaag

SEQ ID NO: 463004 - DNA, 15 bp, Homo sapiens
gtctttctatcaagc

SEQ ID NO: 463005 - DNA, 15 bp, Homo sapiens
tctttctatcaagct

SEQ ID NO: 463006 - DNA, 15 bp, Homo sapiens
ctttctatcaagctt

SEQ ID NO: 463007 - DNA, 15 bp, Homo sapiens
tttctatcaagcttc

SEQ ID NO: 463008 - DNA, 15 bp, Homo sapiens
ttctatcaagcttct

SEQ ID NO: 463009 - DNA, 15 bp, Homo sapiens
tctatcaagcttcta

SEQ ID NO: 463010 - DNA, 15 bp, Homo sapiens
ctatcaagcttctac

SEQ ID NO: 463011 - DNA, 15 bp, Homo sapiens
tatcaagcttctacc

SEQ ID NO: 463012 - DNA, 15 bp, Homo sapiens
atcaagcttctaccc

SEQ ID NO: 463013 - DNA, 15 bp, Homo sapiens
tcaagcttctaccca

SEQ ID NO: 463014 - DNA, 15 bp, Homo sapiens
caagcttctacccaa

SEQ ID NO: 463015 - DNA, 15 bp, Homo sapiens
aagcttctacccaag

SEQ ID NO: 463016 - DNA, 15 bp, Homo sapiens
agcttctacccaaga

SEQ ID NO: 463017 - DNA, 15 bp, Homo sapiens
gcttctacccaagat

SEQ ID NO: 463018 - DNA, 15 bp, Homo sapiens
cttctacccaagata

SEQ ID NO: 463019 - DNA, 15 bp, Homo sapiens
ttctacccaagatat

SEQ ID NO: 463020 - DNA, 15 bp, Homo sapiens
tctacccaagatata

SEQ ID NO: 463021 - DNA, 15 bp, Homo sapiens
ctacccaagatatat

SEQ ID NO: 463022 - DNA, 15 bp, Homo sapiens
tacccaagatatata

SEQ ID NO: 463023 - DNA, 15 bp, Homo sapiens
acccaagatatatat

SEQ ID NO: 463024 - DNA, 15 bp, Homo sapiens
cccaagatatatata

SEQ ID NO: 463025 - DNA, 15 bp, Homo sapiens
ccaagatatatatat

SEQ ID NO: 463026 - DNA, 15 bp, Homo sapiens
caagatatatatata

SEQ ID NO: 463027 - DNA, 15 bp, Homo sapiens
aagatatatatatat

SEQ ID NO: 463028 - DNA, 15 bp, Homo sapiens
atatatatatatttc

SEQ ID NO: 463029 - DNA, 15 bp, Homo sapiens
tatatatatatttca

SEQ ID NO: 463030 - DNA, 15 bp, Homo sapiens
atatatatatttcat

SEQ ID NO: 463031 - DNA, 15 bp, Homo sapiens
tatatatatttcatt

SEQ ID NO: 463032 - DNA, 15 bp, Homo sapiens
atatatatttcattt

SEQ ID NO: 463033 - DNA, 15 bp, Homo sapiens
tatatatttcatttt

SEQ ID NO: 463034 - DNA, 15 bp, Homo sapiens
atatatttcattttc

SEQ ID NO: 463035 - DNA, 15 bp, Homo sapiens
tatatttcattttcc

SEQ ID NO: 463036 - DNA, 15 bp, Homo sapiens
atatttcattttccc

SEQ ID NO: 463037 - DNA, 15 bp, Homo sapiens
tatttcattttcccc

SEQ ID NO: 463038 - DNA, 15 bp, Homo sapiens
atttcattttccccg

SEQ ID NO: 463039 - DNA, 15 bp, Homo sapiens
tttcattttccccga

SEQ ID NO: 463040 - DNA, 15 bp, Homo sapiens
ttcattttccccgaa

SEQ ID NO: 463041 - DNA, 15 bp, Homo sapiens
tcattttccccgaac

SEQ ID NO: 463042 - DNA, 15 bp, Homo sapiens
cattttccccgaact

SEQ ID NO: 463043 - DNA, 15 bp, Homo sapiens
attttccccgaactt

SEQ ID NO: 463044 - DNA, 15 bp, Homo sapiens
ttttccccgaacttt

SEQ ID NO: 463045 - DNA, 15 bp, Homo sapiens
tttccccgaactttt

SEQ ID NO: 463046 - DNA, 15 bp, Homo sapiens
ttccccgaactttta

SEQ ID NO: 463047 - DNA, 15 bp, Homo sapiens
tccccgaacttttat

SEQ ID NO: 463048 - DNA, 15 bp, Homo sapiens
ccccgaacttttata

SEQ ID NO: 463049 - DNA, 15 bp, Homo sapiens
cccgaacttttataa

SEQ ID NO: 463050 - DNA, 15 bp, Homo sapiens
ccgaacttttataaa

SEQ ID NO: 463051 - DNA, 15 bp, Homo sapiens
cgaacttttataaat

SEQ ID NO: 463052 - DNA, 15 bp, Homo sapiens
gaacttttataaata

SEQ ID NO: 463053 - DNA, 15 bp, Homo sapiens
aacttttataaatac

SEQ ID NO: 463054 - DNA, 15 bp, Homo sapiens
acttttataaatact

SEQ ID NO: 463055 - DNA, 15 bp, Homo sapiens
cttttataaatactg

SEQ ID NO: 463056 - DNA, 15 bp, Homo sapiens
ttttataaatactgc

SEQ ID NO: 463057 - DNA, 15 bp, Homo sapiens
tttataaatactgct

SEQ ID NO: 463058 - DNA, 15 bp, Homo sapiens
ttataaatactgcta

SEQ ID NO: 463059 - DNA, 15 bp, Homo sapiens
tataaatactgctag

SEQ ID NO: 463060 - DNA, 15 bp, Homo sapiens
ataaatactgctaga

SEQ ID NO: 463061 - DNA, 15 bp, Homo sapiens
taaatactgctagag

SEQ ID NO: 463062 - DNA, 15 bp, Homo sapiens
aaatactgctagagt

SEQ ID NO: 463063 - DNA, 15 bp, Homo sapiens
aatactgctagagtt

SEQ ID NO: 463064 - DNA, 15 bp, Homo sapiens
atactgctagagttt

SEQ ID NO: 463065 - DNA, 15 bp, Homo sapiens
tactgctagagtttt

SEQ ID NO: 463066 - DNA, 15 bp, Homo sapiens
actgctagagttttt

SEQ ID NO: 463067 - DNA, 15 bp, Homo sapiens
ctgctagagtttttc

SEQ ID NO: 463068 - DNA, 15 bp, Homo sapiens
tgctagagtttttca

SEQ ID NO: 463069 - DNA, 15 bp, Homo sapiens
gctagagtttttcac

SEQ ID NO: 463070 - DNA, 15 bp, Homo sapiens
ctagagtttttcact

SEQ ID NO: 463071 - DNA, 15 bp, Homo sapiens
tagagtttttcacta

SEQ ID NO: 463072 - DNA, 15 bp, Homo sapiens
agagtttttcactaa

SEQ ID NO: 463073 - DNA, 15 bp, Homo sapiens
gagtttttcactaat

SEQ ID NO: 463074 - DNA, 15 bp, Homo sapiens
agtttttcactaatt

SEQ ID NO: 463075 - DNA, 15 bp, Homo sapiens
gtttttcactaatta

SEQ ID NO: 463076 - DNA, 15 bp, Homo sapiens
tttttcactaattac

SEQ ID NO: 463077 - DNA, 15 bp, Homo sapiens
ttttcactaattact

SEQ ID NO: 463078 - DNA, 15 bp, Homo sapiens
tttcactaattactt

SEQ ID NO: 463079 - DNA, 15 bp, Homo sapiens
ttcactaattacttc

SEQ ID NO: 463080 - DNA, 15 bp, Homo sapiens
tcactaattacttcc

SEQ ID NO: 463081 - DNA, 15 bp, Homo sapiens
cactaattacttcca

SEQ ID NO: 463082 - DNA, 15 bp, Homo sapiens
actaattacttccaa

SEQ ID NO: 463083 - DNA, 15 bp, Homo sapiens
ctaattacttccaaa

SEQ ID NO: 463084 - DNA, 15 bp, Homo sapiens
taattacttccaaat

SEQ ID NO: 463085 - DNA, 15 bp, Homo sapiens
aattacttccaaata

SEQ ID NO: 463086 - DNA, 15 bp, Homo sapiens
attacttccaaataa

SEQ ID NO: 463087 - DNA, 15 bp, Homo sapiens
ttacttccaaataaa

SEQ ID NO: 463088 - DNA, 15 bp, Homo sapiens
tacttccaaataaaa

SEQ ID NO: 463089 - DNA, 15 bp, Homo sapiens
acttccaaataaaat

SEQ ID NO: 463090 - DNA, 15 bp, Homo sapiens
cttccaaataaaatg

SEQ ID NO: 463091 - DNA, 15 bp, Homo sapiens
ttccaaataaaatgt

SEQ ID NO: 463092 - DNA, 15 bp, Homo sapiens
tccaaataaaatgtt

SEQ ID NO: 463093 - DNA, 15 bp, Homo sapiens
ccaaataaaatgtta

SEQ ID NO: 463094 - DNA, 15 bp, Homo sapiens
caaataaaatgttaa

SEQ ID NO: 463095 - DNA, 15 bp, Homo sapiens
aaataaaatgttaat

SEQ ID NO: 463096 - DNA, 15 bp, Homo sapiens
aataaaatgttaatg

SEQ ID NO: 463097 - DNA, 15 bp, Homo sapiens
ataaaatgttaatga

SEQ ID NO: 463098 - DNA, 15 bp, Homo sapiens
taaaatgttaatgaa

SEQ ID NO: 463099 - DNA, 15 bp, Homo sapiens
aaatgttaatgaaat

SEQ ID NO: 463100 - DNA, 15 bp, Homo sapiens
aatgttaatgaaatc

SEQ ID NO: 463101 - DNA, 15 bp, Homo sapiens
atgttaatgaaatct

SEQ ID NO: 463102 - DNA, 15 bp, Homo sapiens
tgttaatgaaatctt

SEQ ID NO: 463103 - DNA, 15 bp, Homo sapiens
gttaatgaaatctta

SEQ ID NO: 463104 - DNA, 15 bp, Homo sapiens
ttaatgaaatcttag

SEQ ID NO: 463105 - DNA, 15 bp, Homo sapiens
taatgaaatcttaga

SEQ ID NO: 463106 - DNA, 15 bp, Homo sapiens
aatgaaatcttagat

SEQ ID NO: 463107 - DNA, 15 bp, Homo sapiens
atgaaatcttagatt

SEQ ID NO: 463108 - DNA, 15 bp, Homo sapiens
tgaaatcttagattt

SEQ ID NO: 463109 - DNA, 15 bp, Homo sapiens
gaaatcttagattta

SEQ ID NO: 463110 - DNA, 15 bp, Homo sapiens
aaatcttagatttac

SEQ ID NO: 463111 - DNA, 15 bp, Homo sapiens
aatcttagatttaca

SEQ ID NO: 463112 - DNA, 15 bp, Homo sapiens
atcttagatttacat

SEQ ID NO: 463113 - DNA, 15 bp, Homo sapiens
tcttagatttacata

SEQ ID NO: 463114 - DNA, 15 bp, Homo sapiens
cttagatttacataa

SEQ ID NO: 463115 - DNA, 15 bp, Homo sapiens
ttagatttacataat

SEQ ID NO: 463116 - DNA, 15 bp, Homo sapiens
tagatttacataatg

SEQ ID NO: 463117 - DNA, 15 bp, Homo sapiens
agatttacataatgt

SEQ ID NO: 463118 - DNA, 15 bp, Homo sapiens
gatttacataatgtt

SEQ ID NO: 463119 - DNA, 15 bp, Homo sapiens
atttacataatgttt

SEQ ID NO: 463120 - DNA, 15 bp, Homo sapiens
tttacataatgtttt

SEQ ID NO: 463121 - DNA, 15 bp, Homo sapiens
ttacataatgttttg

SEQ ID NO: 463122 - DNA, 15 bp, Homo sapiens
tacataatgttttgt

SEQ ID NO: 463123 - DNA, 15 bp, Homo sapiens
acataatgttttgta

SEQ ID NO: 463124 - DNA, 15 bp, Homo sapiens
cataatgttttgtaa

SEQ ID NO: 463125 - DNA, 15 bp, Homo sapiens
ataatgttttgtaag

SEQ ID NO: 463126 - DNA, 15 bp, Homo sapiens
taatgttttgtaagc

SEQ ID NO: 463127 - DNA, 15 bp, Homo sapiens
aatgttttgtaagct

SEQ ID NO: 463128 - DNA, 15 bp, Homo sapiens
atgttttgtaagctg

SEQ ID NO: 463129 - DNA, 15 bp, Homo sapiens
tgttttgtaagctgg

SEQ ID NO: 463130 - DNA, 15 bp, Homo sapiens
gttttgtaagctggg

SEQ ID NO: 463131 - DNA, 15 bp, Homo sapiens
ttttgtaagctggga

SEQ ID NO: 463132 - DNA, 15 bp, Homo sapiens
tttgtaagctgggaa

SEQ ID NO: 463133 - DNA, 15 bp, Homo sapiens
ttgtaagctgggaat

SEQ ID NO: 463134 - DNA, 15 bp, Homo sapiens
tgtaagctgggaatt

SEQ ID NO: 463135 - DNA, 15 bp, Homo sapiens
gtaagctgggaattg

SEQ ID NO: 463136 - DNA, 15 bp, Homo sapiens
taagctgggaattgt

SEQ ID NO: 463137 - DNA, 15 bp, Homo sapiens
aagctgggaattgtt

SEQ ID NO: 463138 - DNA, 15 bp, Homo sapiens
agctgggaattgttt

SEQ ID NO: 463139 - DNA, 15 bp, Homo sapiens
gctgggaattgtttc

SEQ ID NO: 463140 - DNA, 15 bp, Homo sapiens
ctgggaattgtttca

SEQ ID NO: 463141 - DNA, 15 bp, Homo sapiens
tgggaattgtttcag

SEQ ID NO: 463142 - DNA, 15 bp, Homo sapiens
gggaattgtttcagt

SEQ ID NO: 463143 - DNA, 15 bp, Homo sapiens
ggaattgtttcagtt

SEQ ID NO: 463144 - DNA, 15 bp, Homo sapiens
gaattgtttcagtta

SEQ ID NO: 463145 - DNA, 15 bp, Homo sapiens
aattgtttcagttag

SEQ ID NO: 463146 - DNA, 15 bp, Homo sapiens
attgtttcagttaga

SEQ ID NO: 463147 - DNA, 15 bp, Homo sapiens
ttgtttcagttagaa

SEQ ID NO: 463148 - DNA, 15 bp, Homo sapiens
tgtttcagttagaat

SEQ ID NO: 463149 - DNA, 15 bp, Homo sapiens
gtttcagttagaatc

SEQ ID NO: 463150 - DNA, 15 bp, Homo sapiens
tttcagttagaatca

SEQ ID NO: 463151 - DNA, 15 bp, Homo sapiens
ttcagttagaatcat

SEQ ID NO: 463152 - DNA, 15 bp, Homo sapiens
tcagttagaatcata

SEQ ID NO: 463153 - DNA, 15 bp, Homo sapiens
cagttagaatcatac

SEQ ID NO: 463154 - DNA, 15 bp, Homo sapiens
agttagaatcataca

SEQ ID NO: 463155 - DNA, 15 bp, Homo sapiens
gttagaatcatacac

SEQ ID NO: 463156 - DNA, 15 bp, Homo sapiens
ttagaatcatacaca

SEQ ID NO: 463157 - DNA, 15 bp, Homo sapiens
tagaatcatacacaa

SEQ ID NO: 463158 - DNA, 15 bp, Homo sapiens
agaatcatacacaat

SEQ ID NO: 463159 - DNA, 15 bp, Homo sapiens
gaatcatacacaatt

SEQ ID NO: 463160 - DNA, 15 bp, Homo sapiens
aatcatacacaattc

SEQ ID NO: 463161 - DNA, 15 bp, Homo sapiens
atcatacacaattcc

SEQ ID NO: 463162 - DNA, 15 bp, Homo sapiens
tcatacacaattcct

SEQ ID NO: 463163 - DNA, 15 bp, Homo sapiens
catacacaattcctt

SEQ ID NO: 463164 - DNA, 15 bp, Homo sapiens
atacacaattcctta

SEQ ID NO: 463165 - DNA, 15 bp, Homo sapiens
tacacaattccttaa

SEQ ID NO: 463166 - DNA, 15 bp, Homo sapiens
acacaattccttaat

SEQ ID NO: 463167 - DNA, 15 bp, Homo sapiens
cacaattccttaata

SEQ ID NO: 463168 - DNA, 15 bp, Homo sapiens
acaattccttaatag

SEQ ID NO: 463169 - DNA, 15 bp, Homo sapiens
caattccttaatagt

SEQ ID NO: 463170 - DNA, 15 bp, Homo sapiens
aattccttaatagta

SEQ ID NO: 463171 - DNA, 15 bp, Homo sapiens
attccttaatagtag

SEQ ID NO: 463172 - DNA, 15 bp, Homo sapiens
ttccttaatagtagt

SEQ ID NO: 463173 - DNA, 15 bp, Homo sapiens
tccttaatagtagtt

SEQ ID NO: 463174 - DNA, 15 bp, Homo sapiens
ccttaatagtagttg

SEQ ID NO: 463175 - DNA, 15 bp, Homo sapiens
cttaatagtagttgc

SEQ ID NO: 463176 - DNA, 15 bp, Homo sapiens
ttaatagtagttgca

SEQ ID NO: 463177 - DNA, 15 bp, Homo sapiens
taatagtagttgcat

SEQ ID NO: 463178 - DNA, 15 bp, Homo sapiens
aatagtagttgcata

SEQ ID NO: 463179 - DNA, 15 bp, Homo sapiens
atagtagttgcataa

SEQ ID NO: 463180 - DNA, 15 bp, Homo sapiens
tagtagttgcataaa

SEQ ID NO: 463181 - DNA, 15 bp, Homo sapiens
agtagttgcataaat

SEQ ID NO: 463182 - DNA, 15 bp, Homo sapiens
gtagttgcataaata

SEQ ID NO: 463183 - DNA, 15 bp, Homo sapiens
tagttgcataaataa

SEQ ID NO: 463184 - DNA, 15 bp, Homo sapiens
agttgcataaataaa

SEQ ID NO: 463185 - DNA, 15 bp, Homo sapiens
gttgcataaataaat

SEQ ID NO: 463186 - DNA, 15 bp, Homo sapiens
ttgcataaataaatt

SEQ ID NO: 463187 - DNA, 15 bp, Homo sapiens
tgcataaataaatta

SEQ ID NO: 463188 - DNA, 15 bp, Homo sapiens
gcataaataaattag

SEQ ID NO: 463189 - DNA, 15 bp, Homo sapiens
cataaataaattaga

SEQ ID NO: 463190 - DNA, 15 bp, Homo sapiens
ataaataaattagaa

SEQ ID NO: 463191 - DNA, 15 bp, Homo sapiens
taaataaattagaac

SEQ ID NO: 463192 - DNA, 15 bp, Homo sapiens
aaataaattagaact

SEQ ID NO: 463193 - DNA, 15 bp, Homo sapiens
aataaattagaactt

SEQ ID NO: 463194 - DNA, 15 bp, Homo sapiens
ataaattagaacttt

SEQ ID NO: 463195 - DNA, 15 bp, Homo sapiens
taaattagaacttta

SEQ ID NO: 463196 - DNA, 15 bp, Homo sapiens
aaattagaactttag

SEQ ID NO: 463197 - DNA, 15 bp, Homo sapiens
aattagaactttagt

SEQ ID NO: 463198 - DNA, 15 bp, Homo sapiens
attagaactttagtt

SEQ ID NO: 463199 - DNA, 15 bp, Homo sapiens
ttagaactttagttt

SEQ ID NO: 463200 - DNA, 15 bp, Homo sapiens
tagaactttagtttt

SEQ ID NO: 463201 - DNA, 15 bp, Homo sapiens
agaactttagttttc

SEQ ID NO: 463202 - DNA, 15 bp, Homo sapiens
gaactttagttttct

SEQ ID NO: 463203 - DNA, 15 bp, Homo sapiens
aactttagttttctt

SEQ ID NO: 463204 - DNA, 15 bp, Homo sapiens
actttagttttcttt

SEQ ID NO: 463205 - DNA, 15 bp, Homo sapiens
ctttagttttctttc

SEQ ID NO: 463206 - DNA, 15 bp, Homo sapiens
tttagttttctttct

SEQ ID NO: 463207 - DNA, 15 bp, Homo sapiens
ttagttttctttctt

SEQ ID NO: 463208 - DNA, 15 bp, Homo sapiens
tagttttctttcttg

SEQ ID NO: 463209 - DNA, 15 bp, Homo sapiens
agttttctttcttgt

SEQ ID NO: 463210 - DNA, 15 bp, Homo sapiens
gttttctttcttgta

SEQ ID NO: 463211 - DNA, 15 bp, Homo sapiens
ttttctttcttgtaa

SEQ ID NO: 463212 - DNA, 15 bp, Homo sapiens
tttctttcttgtaaa

SEQ ID NO: 463213 - DNA, 15 bp, Homo sapiens
ttctttcttgtaaac

SEQ ID NO: 463214 - DNA, 15 bp, Homo sapiens
tctttcttgtaaaca

SEQ ID NO: 463215 - DNA, 15 bp, Homo sapiens
ctttcttgtaaacag

SEQ ID NO: 463216 - DNA, 15 bp, Homo sapiens
tttcttgtaaacaga

SEQ ID NO: 463217 - DNA, 15 bp, Homo sapiens
ttcttgtaaacagag

SEQ ID NO: 463218 - DNA, 15 bp, Homo sapiens
tcttgtaaacagagt

SEQ ID NO: 463219 - DNA, 15 bp, Homo sapiens
cttgtaaacagagtg

SEQ ID NO: 463220 - DNA, 15 bp, Homo sapiens
ttgtaaacagagtga

SEQ ID NO: 463221 - DNA, 15 bp, Homo sapiens
tgtaaacagagtgaa

SEQ ID NO: 463222 - DNA, 15 bp, Homo sapiens
gtaaacagagtgaag

SEQ ID NO: 463223 - DNA, 15 bp, Homo sapiens
taaacagagtgaagg

SEQ ID NO: 463224 - DNA, 15 bp, Homo sapiens
aaacagagtgaaggt

SEQ ID NO: 463225 - DNA, 15 bp, Homo sapiens
aacagagtgaaggta

SEQ ID NO: 463226 - DNA, 15 bp, Homo sapiens
acagagtgaaggtag

SEQ ID NO: 463227 - DNA, 15 bp, Homo sapiens
cagagtgaaggtagg

SEQ ID NO: 463228 - DNA, 15 bp, Homo sapiens
agagtgaaggtaggt

SEQ ID NO: 463229 - DNA, 15 bp, Homo sapiens
gagtgaaggtaggta

SEQ ID NO: 463230 - DNA, 15 bp, Homo sapiens
agtgaaggtaggtaa

SEQ ID NO: 463231 - DNA, 15 bp, Homo sapiens
gtgaaggtaggtaat

SEQ ID NO: 463232 - DNA, 15 bp, Homo sapiens
tgaaggtaggtaatc

SEQ ID NO: 463233 - DNA, 15 bp, Homo sapiens
gaaggtaggtaatcc

SEQ ID NO: 463234 - DNA, 15 bp, Homo sapiens
aaggtaggtaatcca

SEQ ID NO: 463235 - DNA, 15 bp, Homo sapiens
aggtaggtaatccaa

SEQ ID NO: 463236 - DNA, 15 bp, Homo sapiens
ggtaggtaatccaag

SEQ ID NO: 463237 - DNA, 15 bp, Homo sapiens
gtaggtaatccaaga

SEQ ID NO: 463238 - DNA, 15 bp, Homo sapiens
taggtaatccaagac

SEQ ID NO: 463239 - DNA, 15 bp, Homo sapiens
aggtaatccaagact

SEQ ID NO: 463240 - DNA, 15 bp, Homo sapiens
ggtaatccaagactg

SEQ ID NO: 463241 - DNA, 15 bp, Homo sapiens
gtaatccaagactgt

SEQ ID NO: 463242 - DNA, 15 bp, Homo sapiens
taatccaagactgtt

SEQ ID NO: 463243 - DNA, 15 bp, Homo sapiens
aatccaagactgttc

SEQ ID NO: 463244 - DNA, 15 bp, Homo sapiens
atccaagactgttct

SEQ ID NO: 463245 - DNA, 15 bp, Homo sapiens
tccaagactgttctc

SEQ ID NO: 463246 - DNA, 15 bp, Homo sapiens
ccaagactgttctct

SEQ ID NO: 463247 - DNA, 15 bp, Homo sapiens
caagactgttctctg

SEQ ID NO: 463248 - DNA, 15 bp, Homo sapiens
aagactgttctctgt

SEQ ID NO: 463249 - DNA, 15 bp, Homo sapiens
agactgttctctgtg

SEQ ID NO: 463250 - DNA, 15 bp, Homo sapiens
gactgttctctgtga

SEQ ID NO: 463251 - DNA, 15 bp, Homo sapiens
actgttctctgtgac

SEQ ID NO: 463252 - DNA, 15 bp, Homo sapiens
ctgttctctgtgacc

SEQ ID NO: 463253 - DNA, 15 bp, Homo sapiens
tgttctctgtgacca

SEQ ID NO: 463254 - DNA, 15 bp, Homo sapiens
gttctctgtgaccac

SEQ ID NO: 463255 - DNA, 15 bp, Homo sapiens
ttctctgtgaccacc

SEQ ID NO: 463256 - DNA, 15 bp, Homo sapiens
tctctgtgaccacct

SEQ ID NO: 463257 - DNA, 15 bp, Homo sapiens
ctctgtgaccacctg

SEQ ID NO: 463258 - DNA, 15 bp, Homo sapiens
tctgtgaccacctgg

SEQ ID NO: 463259 - DNA, 15 bp, Homo sapiens
ctgtgaccacctggg

SEQ ID NO: 463260 - DNA, 15 bp, Homo sapiens
tgtgaccacctgggc

SEQ ID NO: 463261 - DNA, 15 bp, Homo sapiens
gtgaccacctgggcc

SEQ ID NO: 463262 - DNA, 15 bp, Homo sapiens
tgaccacctgggccc

SEQ ID NO: 463263 - DNA, 15 bp, Homo sapiens
gaccacctgggccct

SEQ ID NO: 463264 - DNA, 15 bp, Homo sapiens
accacctgggccctt

SEQ ID NO: 463265 - DNA, 15 bp, Homo sapiens
ccacctgggccctta

SEQ ID NO: 463266 - DNA, 15 bp, Homo sapiens
cacctgggcccttag

SEQ ID NO: 463267 - DNA, 15 bp, Homo sapiens
acctgggcccttagc

SEQ ID NO: 463268 - DNA, 15 bp, Homo sapiens
cctgggcccttagct

SEQ ID NO: 463269 - DNA, 15 bp, Homo sapiens
ctgggcccttagctc

SEQ ID NO: 463270 - DNA, 15 bp, Homo sapiens
tgggcccttagctct

SEQ ID NO: 463271 - DNA, 15 bp, Homo sapiens
gggcccttagctctg

SEQ ID NO: 463272 - DNA, 15 bp, Homo sapiens
ggcccttagctctgt

SEQ ID NO: 463273 - DNA, 15 bp, Homo sapiens
gcccttagctctgtt

SEQ ID NO: 463274 - DNA, 15 bp, Homo sapiens
cccttagctctgttt

SEQ ID NO: 463275 - DNA, 15 bp, Homo sapiens
ccttagctctgtttt

SEQ ID NO: 463276 - DNA, 15 bp, Homo sapiens
cttagctctgttttc

SEQ ID NO: 463277 - DNA, 15 bp, Homo sapiens
ttagctctgttttca

SEQ ID NO: 463278 - DNA, 15 bp, Homo sapiens
tagctctgttttcat

SEQ ID NO: 463279 - DNA, 15 bp, Homo sapiens
agctctgttttcatg

SEQ ID NO: 463280 - DNA, 15 bp, Homo sapiens
gctctgttttcatgc

SEQ ID NO: 463281 - DNA, 15 bp, Homo sapiens
ctctgttttcatgca

SEQ ID NO: 463282 - DNA, 15 bp, Homo sapiens
tctgttttcatgcac

SEQ ID NO: 463283 - DNA, 15 bp, Homo sapiens
ctgttttcatgcact

SEQ ID NO: 463284 - DNA, 15 bp, Homo sapiens
tgttttcatgcactg

SEQ ID NO: 463285 - DNA, 15 bp, Homo sapiens
gttttcatgcactgt

SEQ ID NO: 463286 - DNA, 15 bp, Homo sapiens
ttttcatgcactgtc

SEQ ID NO: 463287 - DNA, 15 bp, Homo sapiens
tttcatgcactgtca

SEQ ID NO: 463288 - DNA, 15 bp, Homo sapiens
ttcatgcactgtcat

SEQ ID NO: 463289 - DNA, 15 bp, Homo sapiens
tcatgcactgtcatc

SEQ ID NO: 463290 - DNA, 15 bp, Homo sapiens
catgcactgtcatcc

SEQ ID NO: 463291 - DNA, 15 bp, Homo sapiens
atgcactgtcatccc

SEQ ID NO: 463292 - DNA, 15 bp, Homo sapiens
tgcactgtcatccct

SEQ ID NO: 463293 - DNA, 15 bp, Homo sapiens
gcactgtcatcccta

SEQ ID NO: 463294 - DNA, 15 bp, Homo sapiens
cactgtcatccctaa

SEQ ID NO: 463295 - DNA, 15 bp, Homo sapiens
actgtcatccctaac

SEQ ID NO: 463296 - DNA, 15 bp, Homo sapiens
ctgtcatccctaaca

SEQ ID NO: 463297 - DNA, 15 bp, Homo sapiens
tgtcatccctaacat

SEQ ID NO: 463298 - DNA, 15 bp, Homo sapiens
gtcatccctaacatg

SEQ ID NO: 463299 - DNA, 15 bp, Homo sapiens
tcatccctaacatgt

SEQ ID NO: 463300 - DNA, 15 bp, Homo sapiens
catccctaacatgtg

SEQ ID NO: 463301 - DNA, 15 bp, Homo sapiens
atccctaacatgtgg

SEQ ID NO: 463302 - DNA, 15 bp, Homo sapiens
tccctaacatgtggc

SEQ ID NO: 463303 - DNA, 15 bp, Homo sapiens
ccctaacatgtggct

SEQ ID NO: 463304 - DNA, 15 bp, Homo sapiens
cctaacatgtggctt

SEQ ID NO: 463305 - DNA, 15 bp, Homo sapiens
ctaacatgtggcttc

SEQ ID NO: 463306 - DNA, 15 bp, Homo sapiens
taacatgtggcttcc

SEQ ID NO: 463307 - DNA, 15 bp, Homo sapiens
aacatgtggcttcca

SEQ ID NO: 463308 - DNA, 15 bp, Homo sapiens
acatgtggcttccat

SEQ ID NO: 463309 - DNA, 15 bp, Homo sapiens
catgtggcttccatc

SEQ ID NO: 463310 - DNA, 15 bp, Homo sapiens
atgtggcttccatct

SEQ ID NO: 463311 - DNA, 15 bp, Homo sapiens
tgtggcttccatctt

SEQ ID NO: 463312 - DNA, 15 bp, Homo sapiens
gtggcttccatcttc

SEQ ID NO: 463313 - DNA, 15 bp, Homo sapiens
tggcttccatcttca

SEQ ID NO: 463314 - DNA, 15 bp, Homo sapiens
ggcttccatcttcaa

SEQ ID NO: 463315 - DNA, 15 bp, Homo sapiens
gcttccatcttcaaa

SEQ ID NO: 463316 - DNA, 15 bp, Homo sapiens
cttccatcttcaaag

SEQ ID NO: 463317 - DNA, 15 bp, Homo sapiens
ttccatcttcaaagt

SEQ ID NO: 463318 - DNA, 15 bp, Homo sapiens
tccatcttcaaagtc

SEQ ID NO: 463319 - DNA, 15 bp, Homo sapiens
ccatcttcaaagtca

SEQ ID NO: 463320 - DNA, 15 bp, Homo sapiens
catcttcaaagtcac

SEQ ID NO: 463321 - DNA, 15 bp, Homo sapiens
atcttcaaagtcact

SEQ ID NO: 463322 - DNA, 15 bp, Homo sapiens
tcttcaaagtcactt

SEQ ID NO: 463323 - DNA, 15 bp, Homo sapiens
cttcaaagtcacttc

SEQ ID NO: 463324 - DNA, 15 bp, Homo sapiens
ttcaaagtcacttca

SEQ ID NO: 463325 - DNA, 15 bp, Homo sapiens
tcaaagtcacttcat

SEQ ID NO: 463326 - DNA, 15 bp, Homo sapiens
caaagtcacttcatg

SEQ ID NO: 463327 - DNA, 15 bp, Homo sapiens
aaagtcacttcatgc

SEQ ID NO: 463328 - DNA, 15 bp, Homo sapiens
aagtcacttcatgct

SEQ ID NO: 463329 - DNA, 15 bp, Homo sapiens
agtcacttcatgcta

SEQ ID NO: 463330 - DNA, 15 bp, Homo sapiens
gtcacttcatgctaa

SEQ ID NO: 463331 - DNA, 15 bp, Homo sapiens
tcacttcatgctaac

SEQ ID NO: 463332 - DNA, 15 bp, Homo sapiens
cacttcatgctaaca

SEQ ID NO: 463333 - DNA, 15 bp, Homo sapiens
acttcatgctaacaa

SEQ ID NO: 463334 - DNA, 15 bp, Homo sapiens
cttcatgctaacaaa

SEQ ID NO: 463335 - DNA, 15 bp, Homo sapiens
ttcatgctaacaaag

SEQ ID NO: 463336 - DNA, 15 bp, Homo sapiens
tcatgctaacaaagt

SEQ ID NO: 463337 - DNA, 15 bp, Homo sapiens
catgctaacaaagtg

SEQ ID NO: 463338 - DNA, 15 bp, Homo sapiens
atgctaacaaagtga

SEQ ID NO: 463339 - DNA, 15 bp, Homo sapiens
tgctaacaaagtgac

SEQ ID NO: 463340 - DNA, 15 bp, Homo sapiens
gctaacaaagtgact

SEQ ID NO: 463341 - DNA, 15 bp, Homo sapiens
ctaacaaagtgactc

SEQ ID NO: 463342 - DNA, 15 bp, Homo sapiens
taacaaagtgactct

SEQ ID NO: 463343 - DNA, 15 bp, Homo sapiens
aacaaagtgactctt

SEQ ID NO: 463344 - DNA, 15 bp, Homo sapiens
acaaagtgactcttc

SEQ ID NO: 463345 - DNA, 15 bp, Homo sapiens
caaagtgactcttct

SEQ ID NO: 463346 - DNA, 15 bp, Homo sapiens
aaagtgactcttctg

SEQ ID NO: 463347 - DNA, 15 bp, Homo sapiens
aagtgactcttctgg

SEQ ID NO: 463348 - DNA, 15 bp, Homo sapiens
agtgactcttctgga

SEQ ID NO: 463349 - DNA, 15 bp, Homo sapiens
gtgactcttctggat

SEQ ID NO: 463350 - DNA, 15 bp, Homo sapiens
tgactcttctggatg

SEQ ID NO: 463351 - DNA, 15 bp, Homo sapiens
gactcttctggatgt

SEQ ID NO: 463352 - DNA, 15 bp, Homo sapiens
actcttctggatgtc

SEQ ID NO: 463353 - DNA, 15 bp, Homo sapiens
ctcttctggatgtca

SEQ ID NO: 463354 - DNA, 15 bp, Homo sapiens
tcttctggatgtcag

SEQ ID NO: 463355 - DNA, 15 bp, Homo sapiens
cttctggatgtcaga

SEQ ID NO: 463356 - DNA, 15 bp, Homo sapiens
ttctggatgtcagat

SEQ ID NO: 463357 - DNA, 15 bp, Homo sapiens
tctggatgtcagatc

SEQ ID NO: 463358 - DNA, 15 bp, Homo sapiens
ctggatgtcagatcc

SEQ ID NO: 463359 - DNA, 15 bp, Homo sapiens
tggatgtcagatcca

SEQ ID NO: 463360 - DNA, 15 bp, Homo sapiens
ggatgtcagatccat

SEQ ID NO: 463361 - DNA, 15 bp, Homo sapiens
gatgtcagatccatt

SEQ ID NO: 463362 - DNA, 15 bp, Homo sapiens
atgtcagatccattt

SEQ ID NO: 463363 - DNA, 15 bp, Homo sapiens
tgtcagatccatttt

SEQ ID NO: 463364 - DNA, 15 bp, Homo sapiens
gtcagatccattttc

SEQ ID NO: 463365 - DNA, 15 bp, Homo sapiens
tcagatccattttcc

SEQ ID NO: 463366 - DNA, 15 bp, Homo sapiens
cagatccattttcca

SEQ ID NO: 463367 - DNA, 15 bp, Homo sapiens
agatccattttccag

SEQ ID NO: 463368 - DNA, 15 bp, Homo sapiens
gatccattttccagt

SEQ ID NO: 463369 - DNA, 15 bp, Homo sapiens
atccattttccagtg

SEQ ID NO: 463370 - DNA, 15 bp, Homo sapiens
tccattttccagtgg

SEQ ID NO: 463371 - DNA, 15 bp, Homo sapiens
ccattttccagtggg

SEQ ID NO: 463372 - DNA, 15 bp, Homo sapiens
cattttccagtgggg

SEQ ID NO: 463373 - DNA, 15 bp, Homo sapiens
attttccagtgggga

SEQ ID NO: 463374 - DNA, 15 bp, Homo sapiens
ttttccagtggggag

SEQ ID NO: 463375 - DNA, 15 bp, Homo sapiens
tttccagtggggagg

SEQ ID NO: 463376 - DNA, 15 bp, Homo sapiens
ttccagtggggagga

SEQ ID NO: 463377 - DNA, 15 bp, Homo sapiens
tccagtggggaggaa

SEQ ID NO: 463378 - DNA, 15 bp, Homo sapiens
ccagtggggaggaag

SEQ ID NO: 463379 - DNA, 15 bp, Homo sapiens
cagtggggaggaaga

SEQ ID NO: 463380 - DNA, 15 bp, Homo sapiens
agtggggaggaagag

SEQ ID NO: 463381 - DNA, 15 bp, Homo sapiens
gtggggaggaagagg

SEQ ID NO: 463382 - DNA, 15 bp, Homo sapiens
tggggaggaagaggc

SEQ ID NO: 463383 - DNA, 15 bp, Homo sapiens
ggggaggaagaggca

SEQ ID NO: 463384 - DNA, 15 bp, Homo sapiens
gggaggaagaggcag

SEQ ID NO: 463385 - DNA, 15 bp, Homo sapiens
ggaggaagaggcagc

SEQ ID NO: 463386 - DNA, 15 bp, Homo sapiens
gaggaagaggcagca

SEQ ID NO: 463387 - DNA, 15 bp, Homo sapiens
aggaagaggcagcat

SEQ ID NO: 463388 - DNA, 15 bp, Homo sapiens
ggaagaggcagcatg

SEQ ID NO: 463389 - DNA, 15 bp, Homo sapiens
gaagaggcagcatgc

SEQ ID NO: 463390 - DNA, 15 bp, Homo sapiens
aagaggcagcatgcc

SEQ ID NO: 463391 - DNA, 15 bp, Homo sapiens
agaggcagcatgcct

SEQ ID NO: 463392 - DNA, 15 bp, Homo sapiens
gaggcagcatgcctc

SEQ ID NO: 463393 - DNA, 15 bp, Homo sapiens
aggcagcatgcctct

SEQ ID NO: 463394 - DNA, 15 bp, Homo sapiens
ggcagcatgcctctt

SEQ ID NO: 463395 - DNA, 15 bp, Homo sapiens
gcagcatgcctcttc

SEQ ID NO: 463396 - DNA, 15 bp, Homo sapiens
cagcatgcctcttcc

SEQ ID NO: 463397 - DNA, 15 bp, Homo sapiens
agcatgcctcttccc

SEQ ID NO: 463398 - DNA, 15 bp, Homo sapiens
gcatgcctcttccca

SEQ ID NO: 463399 - DNA, 15 bp, Homo sapiens
catgcctcttcccag

SEQ ID NO: 463400 - DNA, 15 bp, Homo sapiens
atgcctcttcccagc

SEQ ID NO: 463401 - DNA, 15 bp, Homo sapiens
tgcctcttcccagct

SEQ ID NO: 463402 - DNA, 15 bp, Homo sapiens
gcctcttcccagcta

SEQ ID NO: 463403 - DNA, 15 bp, Homo sapiens
cctcttcccagctaa

SEQ ID NO: 463404 - DNA, 15 bp, Homo sapiens
ctcttcccagctaac

SEQ ID NO: 463405 - DNA, 15 bp, Homo sapiens
tcttcccagctaact

SEQ ID NO: 463406 - DNA, 15 bp, Homo sapiens
cttcccagctaactc

SEQ ID NO: 463407 - DNA, 15 bp, Homo sapiens
ttcccagctaactca

SEQ ID NO: 463408 - DNA, 15 bp, Homo sapiens
tcccagctaactcag

SEQ ID NO: 463409 - DNA, 15 bp, Homo sapiens
cccagctaactcagt

SEQ ID NO: 463410 - DNA, 15 bp, Homo sapiens
ccagctaactcagtc

SEQ ID NO: 463411 - DNA, 15 bp, Homo sapiens
cagctaactcagtcc

SEQ ID NO: 463412 - DNA, 15 bp, Homo sapiens
agctaactcagtccc

SEQ ID NO: 463413 - DNA, 15 bp, Homo sapiens
gctaactcagtccct

SEQ ID NO: 463414 - DNA, 15 bp, Homo sapiens
ctaactcagtccctt

SEQ ID NO: 463415 - DNA, 15 bp, Homo sapiens
taactcagtcccttg

SEQ ID NO: 463416 - DNA, 15 bp, Homo sapiens
aactcagtcccttga

SEQ ID NO: 463417 - DNA, 15 bp, Homo sapiens
actcagtcccttgaa

SEQ ID NO: 463418 - DNA, 15 bp, Homo sapiens
ctcagtcccttgaaa

SEQ ID NO: 463419 - DNA, 15 bp, Homo sapiens
tcagtcccttgaaat

SEQ ID NO: 463420 - DNA, 15 bp, Homo sapiens
cagtcccttgaaatt

SEQ ID NO: 463421 - DNA, 15 bp, Homo sapiens
agtcccttgaaattc

SEQ ID NO: 463422 - DNA, 15 bp, Homo sapiens
gtcccttgaaattcc

SEQ ID NO: 463423 - DNA, 15 bp, Homo sapiens
tcccttgaaattcca

SEQ ID NO: 463424 - DNA, 15 bp, Homo sapiens
cccttgaaattccaa

SEQ ID NO: 463425 - DNA, 15 bp, Homo sapiens
ccttgaaattccaat

SEQ ID NO: 463426 - DNA, 15 bp, Homo sapiens
cttgaaattccaatt

SEQ ID NO: 463427 - DNA, 15 bp, Homo sapiens
ttgaaattccaatta

SEQ ID NO: 463428 - DNA, 15 bp, Homo sapiens
tgaaattccaattag

SEQ ID NO: 463429 - DNA, 15 bp, Homo sapiens
gaaattccaattaga

SEQ ID NO: 463430 - DNA, 15 bp, Homo sapiens
aaattccaattagaa

SEQ ID NO: 463431 - DNA, 15 bp, Homo sapiens
aattccaattagaac

SEQ ID NO: 463432 - DNA, 15 bp, Homo sapiens
attccaattagaacc

SEQ ID NO: 463433 - DNA, 15 bp, Homo sapiens
ttccaattagaaccc

SEQ ID NO: 463434 - DNA, 15 bp, Homo sapiens
tccaattagaacccc

SEQ ID NO: 463435 - DNA, 15 bp, Homo sapiens
ccaattagaaccccc

SEQ ID NO: 463436 - DNA, 15 bp, Homo sapiens
caattagaaccccca

SEQ ID NO: 463437 - DNA, 15 bp, Homo sapiens
aattagaacccccac

SEQ ID NO: 463438 - DNA, 15 bp, Homo sapiens
attagaacccccacc

SEQ ID NO: 463439 - DNA, 15 bp, Homo sapiens
ttagaacccccaccc

SEQ ID NO: 463440 - DNA, 15 bp, Homo sapiens
tagaacccccaccca

SEQ ID NO: 463441 - DNA, 15 bp, Homo sapiens
agaacccccacccaa

SEQ ID NO: 463442 - DNA, 15 bp, Homo sapiens
gaacccccacccaat

SEQ ID NO: 463443 - DNA, 15 bp, Homo sapiens
aacccccacccaata

SEQ ID NO: 463444 - DNA, 15 bp, Homo sapiens
acccccacccaataa

SEQ ID NO: 463445 - DNA, 15 bp, Homo sapiens
cccccacccaataac

SEQ ID NO: 463446 - DNA, 15 bp, Homo sapiens
ccccacccaataact

SEQ ID NO: 463447 - DNA, 15 bp, Homo sapiens
cccacccaataactt

SEQ ID NO: 463448 - DNA, 15 bp, Homo sapiens
ccacccaataacttt

SEQ ID NO: 463449 - DNA, 15 bp, Homo sapiens
cacccaataactttg

SEQ ID NO: 463450 - DNA, 15 bp, Homo sapiens
acccaataactttgg

SEQ ID NO: 463451 - DNA, 15 bp, Homo sapiens
cccaataactttggt

SEQ ID NO: 463452 - DNA, 15 bp, Homo sapiens
ccaataactttggtt

SEQ ID NO: 463453 - DNA, 15 bp, Homo sapiens
caataactttggttt

SEQ ID NO: 463454 - DNA, 15 bp, Homo sapiens
aataactttggtttt

SEQ ID NO: 463455 - DNA, 15 bp, Homo sapiens
ataactttggttttt

SEQ ID NO: 463456 - DNA, 15 bp, Homo sapiens
taactttggttttta

SEQ ID NO: 463457 - DNA, 15 bp, Homo sapiens
aactttggtttttat

SEQ ID NO: 463458 - DNA, 15 bp, Homo sapiens
actttggtttttatt

SEQ ID NO: 463459 - DNA, 15 bp, Homo sapiens
ctttggtttttattg

SEQ ID NO: 463460 - DNA, 15 bp, Homo sapiens
tttggtttttattgc

SEQ ID NO: 463461 - DNA, 15 bp, Homo sapiens
ttggtttttattgca

SEQ ID NO: 463462 - DNA, 15 bp, Homo sapiens
tggtttttattgcac

SEQ ID NO: 463463 - DNA, 15 bp, Homo sapiens
ggtttttattgcact

SEQ ID NO: 463464 - DNA, 15 bp, Homo sapiens
gtttttattgcactg

SEQ ID NO: 463465 - DNA, 15 bp, Homo sapiens
tttttattgcactgg

SEQ ID NO: 463466 - DNA, 15 bp, Homo sapiens
ttttattgcactggt

SEQ ID NO: 463467 - DNA, 15 bp, Homo sapiens
tttattgcactggtc

SEQ ID NO: 463468 - DNA, 15 bp, Homo sapiens
ttattgcactggtca

SEQ ID NO: 463469 - DNA, 15 bp, Homo sapiens
tattgcactggtcac

SEQ ID NO: 463470 - DNA, 15 bp, Homo sapiens
attgcactggtcacc

SEQ ID NO: 463471 - DNA, 15 bp, Homo sapiens
ttgcactggtcacca

SEQ ID NO: 463472 - DNA, 15 bp, Homo sapiens
tgcactggtcaccaa

SEQ ID NO: 463473 - DNA, 15 bp, Homo sapiens
gcactggtcaccaac

SEQ ID NO: 463474 - DNA, 15 bp, Homo sapiens
cactggtcaccaaca

SEQ ID NO: 463475 - DNA, 15 bp, Homo sapiens
actggtcaccaacat

SEQ ID NO: 463476 - DNA, 15 bp, Homo sapiens
ctggtcaccaacatc

SEQ ID NO: 463477 - DNA, 15 bp, Homo sapiens
tggtcaccaacatca

SEQ ID NO: 463478 - DNA, 15 bp, Homo sapiens
ggtcaccaacatcag

SEQ ID NO: 463479 - DNA, 15 bp, Homo sapiens
gtcaccaacatcagc

SEQ ID NO: 463480 - DNA, 15 bp, Homo sapiens
tcaccaacatcagca

SEQ ID NO: 463481 - DNA, 15 bp, Homo sapiens
caccaacatcagcaa

SEQ ID NO: 463482 - DNA, 15 bp, Homo sapiens
accaacatcagcaag

SEQ ID NO: 463483 - DNA, 15 bp, Homo sapiens
ccaacatcagcaaga

SEQ ID NO: 463484 - DNA, 15 bp, Homo sapiens
caacatcagcaagag

SEQ ID NO: 463485 - DNA, 15 bp, Homo sapiens
aacatcagcaagaga

SEQ ID NO: 463486 - DNA, 15 bp, Homo sapiens
acatcagcaagagag

SEQ ID NO: 463487 - DNA, 15 bp, Homo sapiens
catcagcaagagagg

SEQ ID NO: 463488 - DNA, 15 bp, Homo sapiens
atcagcaagagaggc

SEQ ID NO: 463489 - DNA, 15 bp, Homo sapiens
tcagcaagagaggct

SEQ ID NO: 463490 - DNA, 15 bp, Homo sapiens
cagcaagagaggcta

SEQ ID NO: 463491 - DNA, 15 bp, Homo sapiens
agcaagagaggctaa

SEQ ID NO: 463492 - DNA, 15 bp, Homo sapiens
gcaagagaggctaag

SEQ ID NO: 463493 - DNA, 15 bp, Homo sapiens
caagagaggctaaga

SEQ ID NO: 463494 - DNA, 15 bp, Homo sapiens
aagagaggctaagaa

SEQ ID NO: 463495 - DNA, 15 bp, Homo sapiens
agagaggctaagaaa

SEQ ID NO: 463496 - DNA, 15 bp, Homo sapiens
gagaggctaagaaac

SEQ ID NO: 463497 - DNA, 15 bp, Homo sapiens
agaggctaagaaaca

SEQ ID NO: 463498 - DNA, 15 bp, Homo sapiens
gaggctaagaaacag

SEQ ID NO: 463499 - DNA, 15 bp, Homo sapiens
aggctaagaaacagt

SEQ ID NO: 463500 - DNA, 15 bp, Homo sapiens
ggctaagaaacagta

SEQ ID NO: 463501 - DNA, 15 bp, Homo sapiens
gctaagaaacagtaa

SEQ ID NO: 463502 - DNA, 15 bp, Homo sapiens
ctaagaaacagtaat

SEQ ID NO: 463503 - DNA, 15 bp, Homo sapiens
taagaaacagtaatt

SEQ ID NO: 463504 - DNA, 15 bp, Homo sapiens
aagaaacagtaattt

SEQ ID NO: 463505 - DNA, 15 bp, Homo sapiens
agaaacagtaatttt

SEQ ID NO: 463506 - DNA, 15 bp, Homo sapiens
gaaacagtaattttc

SEQ ID NO: 463507 - DNA, 15 bp, Homo sapiens
aaacagtaattttct

SEQ ID NO: 463508 - DNA, 15 bp, Homo sapiens
aacagtaattttctc

SEQ ID NO: 463509 - DNA, 15 bp, Homo sapiens
acagtaattttctca

SEQ ID NO: 463510 - DNA, 15 bp, Homo sapiens
cagtaattttctcaa

SEQ ID NO: 463511 - DNA, 15 bp, Homo sapiens
agtaattttctcaag

SEQ ID NO: 463512 - DNA, 15 bp, Homo sapiens
gtaattttctcaagg

SEQ ID NO: 463513 - DNA, 15 bp, Homo sapiens
taattttctcaaggc

SEQ ID NO: 463514 - DNA, 15 bp, Homo sapiens
aattttctcaaggct

SEQ ID NO: 463515 - DNA, 15 bp, Homo sapiens
attttctcaaggctc

SEQ ID NO: 463516 - DNA, 15 bp, Homo sapiens
ttttctcaaggctca

SEQ ID NO: 463517 - DNA, 15 bp, Homo sapiens
tttctcaaggctcat

SEQ ID NO: 463518 - DNA, 15 bp, Homo sapiens
ttctcaaggctcatt

SEQ ID NO: 463519 - DNA, 15 bp, Homo sapiens
tctcaaggctcattg

SEQ ID NO: 463520 - DNA, 15 bp, Homo sapiens
ctcaaggctcattgc

SEQ ID NO: 463521 - DNA, 15 bp, Homo sapiens
tcaaggctcattgct

SEQ ID NO: 463522 - DNA, 15 bp, Homo sapiens
caaggctcattgcta

SEQ ID NO: 463523 - DNA, 15 bp, Homo sapiens
aaggctcattgctaa

SEQ ID NO: 463524 - DNA, 15 bp, Homo sapiens
aggctcattgctaaa

SEQ ID NO: 463525 - DNA, 15 bp, Homo sapiens
ggctcattgctaaaa

SEQ ID NO: 463526 - DNA, 15 bp, Homo sapiens
gctcattgctaaaat

SEQ ID NO: 463527 - DNA, 15 bp, Homo sapiens
ctcattgctaaaatg

SEQ ID NO: 463528 - DNA, 15 bp, Homo sapiens
tcattgctaaaatgt

SEQ ID NO: 463529 - DNA, 15 bp, Homo sapiens
cattgctaaaatgtg

SEQ ID NO: 463530 - DNA, 15 bp, Homo sapiens
attgctaaaatgtgc

SEQ ID NO: 463531 - DNA, 15 bp, Homo sapiens
ttgctaaaatgtgct

SEQ ID NO: 463532 - DNA, 15 bp, Homo sapiens
tgctaaaatgtgcta

SEQ ID NO: 463533 - DNA, 15 bp, Homo sapiens
gctaaaatgtgctaa

SEQ ID NO: 463534 - DNA, 15 bp, Homo sapiens
ctaaaatgtgctaac

SEQ ID NO: 463535 - DNA, 15 bp, Homo sapiens
taaaatgtgctaaca

SEQ ID NO: 463536 - DNA, 15 bp, Homo sapiens
aaaatgtgctaacag

SEQ ID NO: 463537 - DNA, 15 bp, Homo sapiens
aaatgtgctaacagt

SEQ ID NO: 463538 - DNA, 15 bp, Homo sapiens
aatgtgctaacagta

SEQ ID NO: 463539 - DNA, 15 bp, Homo sapiens
atgtgctaacagtac

SEQ ID NO: 463540 - DNA, 15 bp, Homo sapiens
tgtgctaacagtaca

SEQ ID NO: 463541 - DNA, 15 bp, Homo sapiens
gtgctaacagtacaa

SEQ ID NO: 463542 - DNA, 15 bp, Homo sapiens
tgctaacagtacaag

SEQ ID NO: 463543 - DNA, 15 bp, Homo sapiens
gctaacagtacaagg

SEQ ID NO: 463544 - DNA, 15 bp, Homo sapiens
ctaacagtacaaggg

SEQ ID NO: 463545 - DNA, 15 bp, Homo sapiens
taacagtacaagggt

SEQ ID NO: 463546 - DNA, 15 bp, Homo sapiens
aacagtacaagggta

SEQ ID NO: 463547 - DNA, 15 bp, Homo sapiens
acagtacaagggtat

SEQ ID NO: 463548 - DNA, 15 bp, Homo sapiens
cagtacaagggtatg

SEQ ID NO: 463549 - DNA, 15 bp, Homo sapiens
agtacaagggtatgt

SEQ ID NO: 463550 - DNA, 15 bp, Homo sapiens
gtacaagggtatgtt

SEQ ID NO: 463551 - DNA, 15 bp, Homo sapiens
tacaagggtatgtta

SEQ ID NO: 463552 - DNA, 15 bp, Homo sapiens
acaagggtatgttac

SEQ ID NO: 463553 - DNA, 15 bp, Homo sapiens
caagggtatgttacc

SEQ ID NO: 463554 - DNA, 15 bp, Homo sapiens
aagggtatgttacca

SEQ ID NO: 463555 - DNA, 15 bp, Homo sapiens
agggtatgttaccaa

SEQ ID NO: 463556 - DNA, 15 bp, Homo sapiens
gggtatgttaccaat

SEQ ID NO: 463557 - DNA, 15 bp, Homo sapiens
ggtatgttaccaatg

SEQ ID NO: 463558 - DNA, 15 bp, Homo sapiens
gtatgttaccaatga

SEQ ID NO: 463559 - DNA, 15 bp, Homo sapiens
tatgttaccaatgaa

SEQ ID NO: 463560 - DNA, 15 bp, Homo sapiens
atgttaccaatgaaa

SEQ ID NO: 463561 - DNA, 15 bp, Homo sapiens
tgttaccaatgaaaa

SEQ ID NO: 463562 - DNA, 15 bp, Homo sapiens
gttaccaatgaaaaa

SEQ ID NO: 463563 - DNA, 15 bp, Homo sapiens
ttaccaatgaaaaag

SEQ ID NO: 463564 - DNA, 15 bp, Homo sapiens
taccaatgaaaaaga

SEQ ID NO: 463565 - DNA, 15 bp, Homo sapiens
accaatgaaaaagag

SEQ ID NO: 463566 - DNA, 15 bp, Homo sapiens
ccaatgaaaaagaga

SEQ ID NO: 463567 - DNA, 15 bp, Homo sapiens
caatgaaaaagagag

SEQ ID NO: 463568 - DNA, 15 bp, Homo sapiens
aatgaaaaagagaga

SEQ ID NO: 463569 - DNA, 15 bp, Homo sapiens
atgaaaaagagagaa

SEQ ID NO: 463570 - DNA, 15 bp, Homo sapiens
tgaaaaagagagaat

SEQ ID NO: 463571 - DNA, 15 bp, Homo sapiens
gaaaaagagagaatg

SEQ ID NO: 463572 - DNA, 15 bp, Homo sapiens
aaaagagagaatggc

SEQ ID NO: 463573 - DNA, 15 bp, Homo sapiens
aaagagagaatggct

SEQ ID NO: 463574 - DNA, 15 bp, Homo sapiens
aagagagaatggcta

SEQ ID NO: 463575 - DNA, 15 bp, Homo sapiens
agagagaatggctat

SEQ ID NO: 463576 - DNA, 15 bp, Homo sapiens
gagagaatggctatc

SEQ ID NO: 463577 - DNA, 15 bp, Homo sapiens
agagaatggctatct

SEQ ID NO: 463578 - DNA, 15 bp, Homo sapiens
gagaatggctatctg

SEQ ID NO: 463579 - DNA, 15 bp, Homo sapiens
agaatggctatctgc

SEQ ID NO: 463580 - DNA, 15 bp, Homo sapiens
gaatggctatctgcc

SEQ ID NO: 463581 - DNA, 15 bp, Homo sapiens
aatggctatctgcca

SEQ ID NO: 463582 - DNA, 15 bp, Homo sapiens
atggctatctgccaa

SEQ ID NO: 463583 - DNA, 15 bp, Homo sapiens
tggctatctgccaag

SEQ ID NO: 463584 - DNA, 15 bp, Homo sapiens
ggctatctgccaagg

SEQ ID NO: 463585 - DNA, 15 bp, Homo sapiens
gctatctgccaaggg

SEQ ID NO: 463586 - DNA, 15 bp, Homo sapiens
ctatctgccaaggga

SEQ ID NO: 463587 - DNA, 15 bp, Homo sapiens
tatctgccaagggag

SEQ ID NO: 463588 - DNA, 15 bp, Homo sapiens
atctgccaagggagt

SEQ ID NO: 463589 - DNA, 15 bp, Homo sapiens
tctgccaagggagta

SEQ ID NO: 463590 - DNA, 15 bp, Homo sapiens
ctgccaagggagtat

SEQ ID NO: 463591 - DNA, 15 bp, Homo sapiens
tgccaagggagtatt

SEQ ID NO: 463592 - DNA, 15 bp, Homo sapiens
gccaagggagtattc

SEQ ID NO: 463593 - DNA, 15 bp, Homo sapiens
ccaagggagtattca

SEQ ID NO: 463594 - DNA, 15 bp, Homo sapiens
caagggagtattcag

SEQ ID NO: 463595 - DNA, 15 bp, Homo sapiens
aagggagtattcagc

SEQ ID NO: 463596 - DNA, 15 bp, Homo sapiens
agggagtattcagca

SEQ ID NO: 463597 - DNA, 15 bp, Homo sapiens
gggagtattcagcag

SEQ ID NO: 463598 - DNA, 15 bp, Homo sapiens
ggagtattcagcaga

SEQ ID NO: 463599 - DNA, 15 bp, Homo sapiens
gagtattcagcagaa

SEQ ID NO: 463600 - DNA, 15 bp, Homo sapiens
agtattcagcagaaa

SEQ ID NO: 463601 - DNA, 15 bp, Homo sapiens
gtattcagcagaaaa

SEQ ID NO: 463602 - DNA, 15 bp, Homo sapiens
tattcagcagaaaac

SEQ ID NO: 463603 - DNA, 15 bp, Homo sapiens
attcagcagaaaaca

SEQ ID NO: 463604 - DNA, 15 bp, Homo sapiens
ttcagcagaaaacaa

SEQ ID NO: 463605 - DNA, 15 bp, Homo sapiens
tcagcagaaaacaaa

SEQ ID NO: 463606 - DNA, 15 bp, Homo sapiens
agcagaaaacaaaat

SEQ ID NO: 463607 - DNA, 15 bp, Homo sapiens
gcagaaaacaaaatt

SEQ ID NO: 463608 - DNA, 15 bp, Homo sapiens
cagaaaacaaaattt

SEQ ID NO: 463609 - DNA, 15 bp, Homo sapiens
agaaaacaaaatttc

SEQ ID NO: 463610 - DNA, 15 bp, Homo sapiens
gaaaacaaaatttca

SEQ ID NO: 463611 - DNA, 15 bp, Homo sapiens
aaaacaaaatttcat

SEQ ID NO: 463612 - DNA, 15 bp, Homo sapiens
aaacaaaatttcatt

SEQ ID NO: 463613 - DNA, 15 bp, Homo sapiens
aacaaaatttcattt

SEQ ID NO: 463614 - DNA, 15 bp, Homo sapiens
acaaaatttcattta

SEQ ID NO: 463615 - DNA, 15 bp, Homo sapiens
caaaatttcatttag

SEQ ID NO: 463616 - DNA, 15 bp, Homo sapiens
aaaatttcatttaga

SEQ ID NO: 463617 - DNA, 15 bp, Homo sapiens
aaatttcatttagaa

SEQ ID NO: 463618 - DNA, 15 bp, Homo sapiens
aatttcatttagaaa

SEQ ID NO: 463619 - DNA, 15 bp, Homo sapiens
atttcatttagaaag

SEQ ID NO: 463620 - DNA, 15 bp, Homo sapiens
tttcatttagaaaga

SEQ ID NO: 463621 - DNA, 15 bp, Homo sapiens
ttcatttagaaagaa

SEQ ID NO: 463622 - DNA, 15 bp, Homo sapiens
tcatttagaaagaag

SEQ ID NO: 463623 - DNA, 15 bp, Homo sapiens
catttagaaagaaga

SEQ ID NO: 463624 - DNA, 15 bp, Homo sapiens
atttagaaagaagat

SEQ ID NO: 463625 - DNA, 15 bp, Homo sapiens
tttagaaagaagatg

SEQ ID NO: 463626 - DNA, 15 bp, Homo sapiens
ttagaaagaagatgt

SEQ ID NO: 463627 - DNA, 15 bp, Homo sapiens
tagaaagaagatgtc

SEQ ID NO: 463628 - DNA, 15 bp, Homo sapiens
agaaagaagatgtca

SEQ ID NO: 463629 - DNA, 15 bp, Homo sapiens
gaaagaagatgtcag

SEQ ID NO: 463630 - DNA, 15 bp, Homo sapiens
aaagaagatgtcagt

SEQ ID NO: 463631 - DNA, 15 bp, Homo sapiens
aagaagatgtcagtc

SEQ ID NO: 463632 - DNA, 15 bp, Homo sapiens
agaagatgtcagtca

SEQ ID NO: 463633 - DNA, 15 bp, Homo sapiens
gaagatgtcagtcat

SEQ ID NO: 463634 - DNA, 15 bp, Homo sapiens
aagatgtcagtcata

SEQ ID NO: 463635 - DNA, 15 bp, Homo sapiens
agatgtcagtcatac

SEQ ID NO: 463636 - DNA, 15 bp, Homo sapiens
gatgtcagtcatacc

SEQ ID NO: 463637 - DNA, 15 bp, Homo sapiens
atgtcagtcatacct

SEQ ID NO: 463638 - DNA, 15 bp, Homo sapiens
tgtcagtcatacctg

SEQ ID NO: 463639 - DNA, 15 bp, Homo sapiens
gtcagtcatacctgt

SEQ ID NO: 463640 - DNA, 15 bp, Homo sapiens
tcagtcatacctgtc

SEQ ID NO: 463641 - DNA, 15 bp, Homo sapiens
cagtcatacctgtca

SEQ ID NO: 463642 - DNA, 15 bp, Homo sapiens
agtcatacctgtcaa

SEQ ID NO: 463643 - DNA, 15 bp, Homo sapiens
gtcatacctgtcaag

SEQ ID NO: 463644 - DNA, 15 bp, Homo sapiens
tcatacctgtcaagc

SEQ ID NO: 463645 - DNA, 15 bp, Homo sapiens
catacctgtcaagcc

SEQ ID NO: 463646 - DNA, 15 bp, Homo sapiens
atacctgtcaagcca

SEQ ID NO: 463647 - DNA, 15 bp, Homo sapiens
tacctgtcaagccat

SEQ ID NO: 463648 - DNA, 15 bp, Homo sapiens
acctgtcaagccatg

SEQ ID NO: 463649 - DNA, 15 bp, Homo sapiens
cctgtcaagccatgc

SEQ ID NO: 463650 - DNA, 15 bp, Homo sapiens
ctgtcaagccatgct

SEQ ID NO: 463651 - DNA, 15 bp, Homo sapiens
tgtcaagccatgctg

SEQ ID NO: 463652 - DNA, 15 bp, Homo sapiens
gtcaagccatgctga

SEQ ID NO: 463653 - DNA, 15 bp, Homo sapiens
tcaagccatgctgat

SEQ ID NO: 463654 - DNA, 15 bp, Homo sapiens
caagccatgctgata

SEQ ID NO: 463655 - DNA, 15 bp, Homo sapiens
aagccatgctgataa

SEQ ID NO: 463656 - DNA, 15 bp, Homo sapiens
agccatgctgataag

SEQ ID NO: 463657 - DNA, 15 bp, Homo sapiens
gccatgctgataagc

SEQ ID NO: 463658 - DNA, 15 bp, Homo sapiens
ccatgctgataagcc

SEQ ID NO: 463659 - DNA, 15 bp, Homo sapiens
catgctgataagcca

SEQ ID NO: 463660 - DNA, 15 bp, Homo sapiens
atgctgataagccaa

SEQ ID NO: 463661 - DNA, 15 bp, Homo sapiens
tgctgataagccaag

SEQ ID NO: 463662 - DNA, 15 bp, Homo sapiens
gctgataagccaaga

SEQ ID NO: 463663 - DNA, 15 bp, Homo sapiens
ctgataagccaagag

SEQ ID NO: 463664 - DNA, 15 bp, Homo sapiens
tgataagccaagaga

SEQ ID NO: 463665 - DNA, 15 bp, Homo sapiens
gataagccaagagat

SEQ ID NO: 463666 - DNA, 15 bp, Homo sapiens
ataagccaagagatg

SEQ ID NO: 463667 - DNA, 15 bp, Homo sapiens
taagccaagagatgt

SEQ ID NO: 463668 - DNA, 15 bp, Homo sapiens
aagccaagagatgtc

SEQ ID NO: 463669 - DNA, 15 bp, Homo sapiens
agccaagagatgtcg

SEQ ID NO: 463670 - DNA, 15 bp, Homo sapiens
gccaagagatgtcgt

SEQ ID NO: 463671 - DNA, 15 bp, Homo sapiens
ccaagagatgtcgtt

SEQ ID NO: 463672 - DNA, 15 bp, Homo sapiens
caagagatgtcgtta

SEQ ID NO: 463673 - DNA, 15 bp, Homo sapiens
aagagatgtcgttag

SEQ ID NO: 463674 - DNA, 15 bp, Homo sapiens
agagatgtcgttagt

SEQ ID NO: 463675 - DNA, 15 bp, Homo sapiens
gagatgtcgttagtg

SEQ ID NO: 463676 - DNA, 15 bp, Homo sapiens
agatgtcgttagtgt

SEQ ID NO: 463677 - DNA, 15 bp, Homo sapiens
gatgtcgttagtgta

SEQ ID NO: 463678 - DNA, 15 bp, Homo sapiens
atgtcgttagtgtat

SEQ ID NO: 463679 - DNA, 15 bp, Homo sapiens
tgtcgttagtgtatg

SEQ ID NO: 463680 - DNA, 15 bp, Homo sapiens
gtcgttagtgtatgt

SEQ ID NO: 463681 - DNA, 15 bp, Homo sapiens
tcgttagtgtatgtg

SEQ ID NO: 463682 - DNA, 15 bp, Homo sapiens
cgttagtgtatgtga

SEQ ID NO: 463683 - DNA, 15 bp, Homo sapiens
gttagtgtatgtgat

SEQ ID NO: 463684 - DNA, 15 bp, Homo sapiens
ttagtgtatgtgatt

SEQ ID NO: 463685 - DNA, 15 bp, Homo sapiens
tagtgtatgtgattg

SEQ ID NO: 463686 - DNA, 15 bp, Homo sapiens
agtgtatgtgattgt

SEQ ID NO: 463687 - DNA, 15 bp, Homo sapiens
gtgtatgtgattgtt

SEQ ID NO: 463688 - DNA, 15 bp, Homo sapiens
tgtatgtgattgttt

SEQ ID NO: 463689 - DNA, 15 bp, Homo sapiens
gtatgtgattgtttc

SEQ ID NO: 463690 - DNA, 15 bp, Homo sapiens
tatgtgattgtttca

SEQ ID NO: 463691 - DNA, 15 bp, Homo sapiens
atgtgattgtttcaa

SEQ ID NO: 463692 - DNA, 15 bp, Homo sapiens
gtgattgtttcaaac

SEQ ID NO: 463693 - DNA, 15 bp, Homo sapiens
tgattgtttcaaacc

SEQ ID NO: 463694 - DNA, 15 bp, Homo sapiens
gattgtttcaaacca

SEQ ID NO: 463695 - DNA, 15 bp, Homo sapiens
attgtttcaaaccaa

SEQ ID NO: 463696 - DNA, 15 bp, Homo sapiens
ttgtttcaaaccaat

SEQ ID NO: 463697 - DNA, 15 bp, Homo sapiens
tgtttcaaaccaata

SEQ ID NO: 463698 - DNA, 15 bp, Homo sapiens
gtttcaaaccaatag

SEQ ID NO: 463699 - DNA, 15 bp, Homo sapiens
tttcaaaccaatagc

SEQ ID NO: 463700 - DNA, 15 bp, Homo sapiens
ttcaaaccaatagcc

SEQ ID NO: 463701 - DNA, 15 bp, Homo sapiens
tcaaaccaatagcct

SEQ ID NO: 463702 - DNA, 15 bp, Homo sapiens
caaaccaatagcctc

SEQ ID NO: 463703 - DNA, 15 bp, Homo sapiens
aaaccaatagcctcc

SEQ ID NO: 463704 - DNA, 15 bp, Homo sapiens
aaccaatagcctcct

SEQ ID NO: 463705 - DNA, 15 bp, Homo sapiens
accaatagcctcctt

SEQ ID NO: 463706 - DNA, 15 bp, Homo sapiens
ccaatagcctccttg

SEQ ID NO: 463707 - DNA, 15 bp, Homo sapiens
caatagcctccttgg

SEQ ID NO: 463708 - DNA, 15 bp, Homo sapiens
aatagcctccttggc

SEQ ID NO: 463709 - DNA, 15 bp, Homo sapiens
atagcctccttggca

SEQ ID NO: 463710 - DNA, 15 bp, Homo sapiens
tagcctccttggcaa

SEQ ID NO: 463711 - DNA, 15 bp, Homo sapiens
agcctccttggcaaa

SEQ ID NO: 463712 - DNA, 15 bp, Homo sapiens
gcctccttggcaaaa

SEQ ID NO: 463713 - DNA, 15 bp, Homo sapiens
cctccttggcaaaag

SEQ ID NO: 463714 - DNA, 15 bp, Homo sapiens
ctccttggcaaaagt

SEQ ID NO: 463715 - DNA, 15 bp, Homo sapiens
tccttggcaaaagta

SEQ ID NO: 463716 - DNA, 15 bp, Homo sapiens
ccttggcaaaagtaa

SEQ ID NO: 463717 - DNA, 15 bp, Homo sapiens
cttggcaaaagtaag

SEQ ID NO: 463718 - DNA, 15 bp, Homo sapiens
ttggcaaaagtaagc

SEQ ID NO: 463719 - DNA, 15 bp, Homo sapiens
tggcaaaagtaagct

SEQ ID NO: 463720 - DNA, 15 bp, Homo sapiens
ggcaaaagtaagctg

SEQ ID NO: 463721 - DNA, 15 bp, Homo sapiens
gcaaaagtaagctgg

SEQ ID NO: 463722 - DNA, 15 bp, Homo sapiens
caaaagtaagctggc

SEQ ID NO: 463723 - DNA, 15 bp, Homo sapiens
aaaagtaagctggct

SEQ ID NO: 463724 - DNA, 15 bp, Homo sapiens
aaagtaagctggctg

SEQ ID NO: 463725 - DNA, 15 bp, Homo sapiens
aagtaagctggctgt

SEQ ID NO: 463726 - DNA, 15 bp, Homo sapiens
agtaagctggctgta

SEQ ID NO: 463727 - DNA, 15 bp, Homo sapiens
gtaagctggctgtag

SEQ ID NO: 463728 - DNA, 15 bp, Homo sapiens
taagctggctgtagt

SEQ ID NO: 463729 - DNA, 15 bp, Homo sapiens
aagctggctgtagta

SEQ ID NO: 463730 - DNA, 15 bp, Homo sapiens
agctggctgtagtat

SEQ ID NO: 463731 - DNA, 15 bp, Homo sapiens
gctggctgtagtata

SEQ ID NO: 463732 - DNA, 15 bp, Homo sapiens
ctggctgtagtatat

SEQ ID NO: 463733 - DNA, 15 bp, Homo sapiens
tggctgtagtatatg

SEQ ID NO: 463734 - DNA, 15 bp, Homo sapiens
ggctgtagtatatgc

SEQ ID NO: 463735 - DNA, 15 bp, Homo sapiens
gctgtagtatatgca

SEQ ID NO: 463736 - DNA, 15 bp, Homo sapiens
ctgtagtatatgcag

SEQ ID NO: 463737 - DNA, 15 bp, Homo sapiens
tgtagtatatgcaga

SEQ ID NO: 463738 - DNA, 15 bp, Homo sapiens
gtagtatatgcagaa

SEQ ID NO: 463739 - DNA, 15 bp, Homo sapiens
tagtatatgcagaat

SEQ ID NO: 463740 - DNA, 15 bp, Homo sapiens
agtatatgcagaatg

SEQ ID NO: 463741 - DNA, 15 bp, Homo sapiens
gtatatgcagaatga

SEQ ID NO: 463742 - DNA, 15 bp, Homo sapiens
tatatgcagaatgat

SEQ ID NO: 463743 - DNA, 15 bp, Homo sapiens
atatgcagaatgatt

SEQ ID NO: 463744 - DNA, 15 bp, Homo sapiens
tatgcagaatgattt

SEQ ID NO: 463745 - DNA, 15 bp, Homo sapiens
atgcagaatgatttc

SEQ ID NO: 463746 - DNA, 15 bp, Homo sapiens
tgcagaatgatttcc

SEQ ID NO: 463747 - DNA, 15 bp, Homo sapiens
gcagaatgatttcct

SEQ ID NO: 463748 - DNA, 15 bp, Homo sapiens
cagaatgatttcctt

SEQ ID NO: 463749 - DNA, 15 bp, Homo sapiens
agaatgatttcctta

SEQ ID NO: 463750 - DNA, 15 bp, Homo sapiens
gaatgatttccttaa

SEQ ID NO: 463751 - DNA, 15 bp, Homo sapiens
aatgatttccttaag

SEQ ID NO: 463752 - DNA, 15 bp, Homo sapiens
atgatttccttaaga

SEQ ID NO: 463753 - DNA, 15 bp, Homo sapiens
tgatttccttaagat

SEQ ID NO: 463754 - DNA, 15 bp, Homo sapiens
gatttccttaagatt

SEQ ID NO: 463755 - DNA, 15 bp, Homo sapiens
atttccttaagattg

SEQ ID NO: 463756 - DNA, 15 bp, Homo sapiens
tttccttaagattga

SEQ ID NO: 463757 - DNA, 15 bp, Homo sapiens
ttccttaagattgat

SEQ ID NO: 463758 - DNA, 15 bp, Homo sapiens
tccttaagattgatt

SEQ ID NO: 463759 - DNA, 15 bp, Homo sapiens
ccttaagattgattt

SEQ ID NO: 463760 - DNA, 15 bp, Homo sapiens
cttaagattgatttg

SEQ ID NO: 463761 - DNA, 15 bp, Homo sapiens
ttaagattgatttgc

SEQ ID NO: 463762 - DNA, 15 bp, Homo sapiens
taagattgatttgca

SEQ ID NO: 463763 - DNA, 15 bp, Homo sapiens
aagattgatttgcaa

SEQ ID NO: 463764 - DNA, 15 bp, Homo sapiens
agattgatttgcaag

SEQ ID NO: 463765 - DNA, 15 bp, Homo sapiens
gattgatttgcaagt

SEQ ID NO: 463766 - DNA, 15 bp, Homo sapiens
attgatttgcaagtg

SEQ ID NO: 463767 - DNA, 15 bp, Homo sapiens
ttgatttgcaagtga

SEQ ID NO: 463768 - DNA, 15 bp, Homo sapiens
tgatttgcaagtgat

SEQ ID NO: 463769 - DNA, 15 bp, Homo sapiens
gatttgcaagtgatt

SEQ ID NO: 463770 - DNA, 15 bp, Homo sapiens
atttgcaagtgattt

SEQ ID NO: 463771 - DNA, 15 bp, Homo sapiens
tttgcaagtgatttt

SEQ ID NO: 463772 - DNA, 15 bp, Homo sapiens
ttgcaagtgattttt

SEQ ID NO: 463773 - DNA, 15 bp, Homo sapiens
tgcaagtgatttttc

SEQ ID NO: 463774 - DNA, 15 bp, Homo sapiens
gcaagtgatttttca

SEQ ID NO: 463775 - DNA, 15 bp, Homo sapiens
caagtgatttttcag

SEQ ID NO: 463776 - DNA, 15 bp, Homo sapiens
aagtgatttttcagg

SEQ ID NO: 463777 - DNA, 15 bp, Homo sapiens
agtgatttttcaggt

SEQ ID NO: 463778 - DNA, 15 bp, Homo sapiens
gtgatttttcaggtc

SEQ ID NO: 463779 - DNA, 15 bp, Homo sapiens
tgatttttcaggtca

SEQ ID NO: 463780 - DNA, 15 bp, Homo sapiens
gatttttcaggtcat

SEQ ID NO: 463781 - DNA, 15 bp, Homo sapiens
atttttcaggtcatt

SEQ ID NO: 463782 - DNA, 15 bp, Homo sapiens
tttttcaggtcattt

SEQ ID NO: 463783 - DNA, 15 bp, Homo sapiens
ttttcaggtcatttt

SEQ ID NO: 463784 - DNA, 15 bp, Homo sapiens
tttcaggtcatttta

SEQ ID NO: 463785 - DNA, 15 bp, Homo sapiens
ttcaggtcattttag

SEQ ID NO: 463786 - DNA, 15 bp, Homo sapiens
tcaggtcattttaga

SEQ ID NO: 463787 - DNA, 15 bp, Homo sapiens
caggtcattttagaa

SEQ ID NO: 463788 - DNA, 15 bp, Homo sapiens
aggtcattttagaag

SEQ ID NO: 463789 - DNA, 15 bp, Homo sapiens
ggtcattttagaagc

SEQ ID NO: 463790 - DNA, 15 bp, Homo sapiens
gtcattttagaagct

SEQ ID NO: 463791 - DNA, 15 bp, Homo sapiens
tcattttagaagcta

SEQ ID NO: 463792 - DNA, 15 bp, Homo sapiens
cattttagaagctac

SEQ ID NO: 463793 - DNA, 15 bp, Homo sapiens
attttagaagctact

SEQ ID NO: 463794 - DNA, 15 bp, Homo sapiens
ttttagaagctactc

SEQ ID NO: 463795 - DNA, 15 bp, Homo sapiens
tttagaagctactca

SEQ ID NO: 463796 - DNA, 15 bp, Homo sapiens
ttagaagctactcag

SEQ ID NO: 463797 - DNA, 15 bp, Homo sapiens
tagaagctactcagt

SEQ ID NO: 463798 - DNA, 15 bp, Homo sapiens
agaagctactcagta

SEQ ID NO: 463799 - DNA, 15 bp, Homo sapiens
gaagctactcagtac

SEQ ID NO: 463800 - DNA, 15 bp, Homo sapiens
aagctactcagtact

SEQ ID NO: 463801 - DNA, 15 bp, Homo sapiens
agctactcagtactt

SEQ ID NO: 463802 - DNA, 15 bp, Homo sapiens
gctactcagtactta

SEQ ID NO: 463803 - DNA, 15 bp, Homo sapiens
ctactcagtacttag

SEQ ID NO: 463804 - DNA, 15 bp, Homo sapiens
tactcagtacttagt

SEQ ID NO: 463805 - DNA, 15 bp, Homo sapiens
actcagtacttagta

SEQ ID NO: 463806 - DNA, 15 bp, Homo sapiens
ctcagtacttagtag

SEQ ID NO: 463807 - DNA, 15 bp, Homo sapiens
tcagtacttagtagt

SEQ ID NO: 463808 - DNA, 15 bp, Homo sapiens
cagtacttagtagtt

SEQ ID NO: 463809 - DNA, 15 bp, Homo sapiens
agtacttagtagttt

SEQ ID NO: 463810 - DNA, 15 bp, Homo sapiens
gtacttagtagttta

SEQ ID NO: 463811 - DNA, 15 bp, Homo sapiens
tacttagtagtttac

SEQ ID NO: 463812 - DNA, 15 bp, Homo sapiens
acttagtagtttaca

SEQ ID NO: 463813 - DNA, 15 bp, Homo sapiens
cttagtagtttacag

SEQ ID NO: 463814 - DNA, 15 bp, Homo sapiens
ttagtagtttacagc

SEQ ID NO: 463815 - DNA, 15 bp, Homo sapiens
tagtagtttacagcc

SEQ ID NO: 463816 - DNA, 15 bp, Homo sapiens
agtagtttacagcca

SEQ ID NO: 463817 - DNA, 15 bp, Homo sapiens
gtagtttacagccac

SEQ ID NO: 463818 - DNA, 15 bp, Homo sapiens
tagtttacagccaca

SEQ ID NO: 463819 - DNA, 15 bp, Homo sapiens
agtttacagccacac

SEQ ID NO: 463820 - DNA, 15 bp, Homo sapiens
gtttacagccacaca

SEQ ID NO: 463821 - DNA, 15 bp, Homo sapiens
tttacagccacacaa

SEQ ID NO: 463822 - DNA, 15 bp, Homo sapiens
ttacagccacacaac

SEQ ID NO: 463823 - DNA, 15 bp, Homo sapiens
tacagccacacaact

SEQ ID NO: 463824 - DNA, 15 bp, Homo sapiens
acagccacacaactt

SEQ ID NO: 463825 - DNA, 15 bp, Homo sapiens
cagccacacaacttt

SEQ ID NO: 463826 - DNA, 15 bp, Homo sapiens
agccacacaactttt

SEQ ID NO: 463827 - DNA, 15 bp, Homo sapiens
gccacacaactttta

SEQ ID NO: 463828 - DNA, 15 bp, Homo sapiens
ccacacaacttttaa

SEQ ID NO: 463829 - DNA, 15 bp, Homo sapiens
cacacaacttttaaa

SEQ ID NO: 463830 - DNA, 15 bp, Homo sapiens
acacaacttttaaat

SEQ ID NO: 463831 - DNA, 15 bp, Homo sapiens
cacaacttttaaatt

SEQ ID NO: 463832 - DNA, 15 bp, Homo sapiens
acaacttttaaattt

SEQ ID NO: 463833 - DNA, 15 bp, Homo sapiens
caacttttaaatttt

SEQ ID NO: 463834 - DNA, 15 bp, Homo sapiens
aacttttaaattttg

SEQ ID NO: 463835 - DNA, 15 bp, Homo sapiens
acttttaaattttgc

SEQ ID NO: 463836 - DNA, 15 bp, Homo sapiens
cttttaaattttgct

SEQ ID NO: 463837 - DNA, 15 bp, Homo sapiens
ttttaaattttgctt

SEQ ID NO: 463838 - DNA, 15 bp, Homo sapiens
tttaaattttgcttc

SEQ ID NO: 463839 - DNA, 15 bp, Homo sapiens
ttaaattttgcttcc

SEQ ID NO: 463840 - DNA, 15 bp, Homo sapiens
taaattttgcttcca

SEQ ID NO: 463841 - DNA, 15 bp, Homo sapiens
aaattttgcttccat

SEQ ID NO: 463842 - DNA, 15 bp, Homo sapiens
aattttgcttccatt

SEQ ID NO: 463843 - DNA, 15 bp, Homo sapiens
attttgcttccattt

SEQ ID NO: 463844 - DNA, 15 bp, Homo sapiens
ttttgcttccatttt

SEQ ID NO: 463845 - DNA, 15 bp, Homo sapiens
tttgcttccattttc

SEQ ID NO: 463846 - DNA, 15 bp, Homo sapiens
ttgcttccattttca

SEQ ID NO: 463847 - DNA, 15 bp, Homo sapiens
tgcttccattttcat

SEQ ID NO: 463848 - DNA, 15 bp, Homo sapiens
gcttccattttcatt

SEQ ID NO: 463849 - DNA, 15 bp, Homo sapiens
cttccattttcattc

SEQ ID NO: 463850 - DNA, 15 bp, Homo sapiens
ttccattttcattct

SEQ ID NO: 463851 - DNA, 15 bp, Homo sapiens
tccattttcattctg

SEQ ID NO: 463852 - DNA, 15 bp, Homo sapiens
ccattttcattctgt

SEQ ID NO: 463853 - DNA, 15 bp, Homo sapiens
cattttcattctgtt

SEQ ID NO: 463854 - DNA, 15 bp, Homo sapiens
attttcattctgttg

SEQ ID NO: 463855 - DNA, 15 bp, Homo sapiens
ttttcattctgttgg

SEQ ID NO: 463856 - DNA, 15 bp, Homo sapiens
tttcattctgttggt

SEQ ID NO: 463857 - DNA, 15 bp, Homo sapiens
ttcattctgttggtt

SEQ ID NO: 463858 - DNA, 15 bp, Homo sapiens
tcattctgttggttc

SEQ ID NO: 463859 - DNA, 15 bp, Homo sapiens
cattctgttggttct

SEQ ID NO: 463860 - DNA, 15 bp, Homo sapiens
attctgttggttcta

SEQ ID NO: 463861 - DNA, 15 bp, Homo sapiens
ttctgttggttctat

SEQ ID NO: 463862 - DNA, 15 bp, Homo sapiens
tctgttggttctatc

SEQ ID NO: 463863 - DNA, 15 bp, Homo sapiens
ctgttggttctatca

SEQ ID NO: 463864 - DNA, 15 bp, Homo sapiens
tgttggttctatcat

SEQ ID NO: 463865 - DNA, 15 bp, Homo sapiens
gttggttctatcatt

SEQ ID NO: 463866 - DNA, 15 bp, Homo sapiens
ttggttctatcattt

SEQ ID NO: 463867 - DNA, 15 bp, Homo sapiens
tggttctatcattta

SEQ ID NO: 463868 - DNA, 15 bp, Homo sapiens
ggttctatcatttaa

SEQ ID NO: 463869 - DNA, 15 bp, Homo sapiens
gttctatcatttaat

SEQ ID NO: 463870 - DNA, 15 bp, Homo sapiens
ttctatcatttaatt

SEQ ID NO: 463871 - DNA, 15 bp, Homo sapiens
tctatcatttaattt

SEQ ID NO: 463872 - DNA, 15 bp, Homo sapiens
ctatcatttaatttt

SEQ ID NO: 463873 - DNA, 15 bp, Homo sapiens
tatcatttaattttt

SEQ ID NO: 463874 - DNA, 15 bp, Homo sapiens
atcatttaatttttt

SEQ ID NO: 463875 - DNA, 15 bp, Homo sapiens
tcatttaattttttt

SEQ ID NO: 463876 - DNA, 15 bp, Homo sapiens
catttaatttttttt

SEQ ID NO: 463877 - DNA, 15 bp, Homo sapiens
atttaattttttttc

SEQ ID NO: 463878 - DNA, 15 bp, Homo sapiens
tttaattttttttct

SEQ ID NO: 463879 - DNA, 15 bp, Homo sapiens
ttaattttttttctg

SEQ ID NO: 463880 - DNA, 15 bp, Homo sapiens
taattttttttctgt

SEQ ID NO: 463881 - DNA, 15 bp, Homo sapiens
aattttttttctgta

SEQ ID NO: 463882 - DNA, 15 bp, Homo sapiens
attttttttctgtag

SEQ ID NO: 463883 - DNA, 15 bp, Homo sapiens
ttttttttctgtaga

SEQ ID NO: 463884 - DNA, 15 bp, Homo sapiens
tttttttctgtagat

SEQ ID NO: 463885 - DNA, 15 bp, Homo sapiens
ttttttctgtagatg

SEQ ID NO: 463886 - DNA, 15 bp, Homo sapiens
tttttctgtagatgt

SEQ ID NO: 463887 - DNA, 15 bp, Homo sapiens
ttttctgtagatgtg

SEQ ID NO: 463888 - DNA, 15 bp, Homo sapiens
tttctgtagatgtgg

SEQ ID NO: 463889 - DNA, 15 bp, Homo sapiens
ttctgtagatgtggg

SEQ ID NO: 463890 - DNA, 15 bp, Homo sapiens
tctgtagatgtgggt

SEQ ID NO: 463891 - DNA, 15 bp, Homo sapiens
ctgtagatgtgggta

SEQ ID NO: 463892 - DNA, 15 bp, Homo sapiens
tgtagatgtgggtat

SEQ ID NO: 463893 - DNA, 15 bp, Homo sapiens
gtagatgtgggtata

SEQ ID NO: 463894 - DNA, 15 bp, Homo sapiens
tagatgtgggtataa

SEQ ID NO: 463895 - DNA, 15 bp, Homo sapiens
agatgtgggtataat

SEQ ID NO: 463896 - DNA, 15 bp, Homo sapiens
gatgtgggtataatt

SEQ ID NO: 463897 - DNA, 15 bp, Homo sapiens
atgtgggtataattt

SEQ ID NO: 463898 - DNA, 15 bp, Homo sapiens
tgtgggtataattta

SEQ ID NO: 463899 - DNA, 15 bp, Homo sapiens
gtgggtataatttat

SEQ ID NO: 463900 - DNA, 15 bp, Homo sapiens
tgggtataatttatg

SEQ ID NO: 463901 - DNA, 15 bp, Homo sapiens
gggtataatttatgt

SEQ ID NO: 463902 - DNA, 15 bp, Homo sapiens
ggtataatttatgtt

SEQ ID NO: 463903 - DNA, 15 bp, Homo sapiens
gtataatttatgttc

SEQ ID NO: 463904 - DNA, 15 bp, Homo sapiens
tataatttatgttct

SEQ ID NO: 463905 - DNA, 15 bp, Homo sapiens
ataatttatgttctt

SEQ ID NO: 463906 - DNA, 15 bp, Homo sapiens
taatttatgttctta

SEQ ID NO: 463907 - DNA, 15 bp, Homo sapiens
aatttatgttcttag

SEQ ID NO: 463908 - DNA, 15 bp, Homo sapiens
atttatgttcttagt

SEQ ID NO: 463909 - DNA, 15 bp, Homo sapiens
tttatgttcttagtt

SEQ ID NO: 463910 - DNA, 15 bp, Homo sapiens
ttatgttcttagttc

SEQ ID NO: 463911 - DNA, 15 bp, Homo sapiens
tatgttcttagttct

SEQ ID NO: 463912 - DNA, 15 bp, Homo sapiens
atgttcttagttcta

SEQ ID NO: 463913 - DNA, 15 bp, Homo sapiens
tgttcttagttctac

SEQ ID NO: 463914 - DNA, 15 bp, Homo sapiens
gttcttagttctacc

SEQ ID NO: 463915 - DNA, 15 bp, Homo sapiens
ttcttagttctacca

SEQ ID NO: 463916 - DNA, 15 bp, Homo sapiens
tcttagttctaccag

SEQ ID NO: 463917 - DNA, 15 bp, Homo sapiens
cttagttctaccagc

SEQ ID NO: 463918 - DNA, 15 bp, Homo sapiens
ttagttctaccagca

SEQ ID NO: 463919 - DNA, 15 bp, Homo sapiens
tagttctaccagcaa

SEQ ID NO: 463920 - DNA, 15 bp, Homo sapiens
agttctaccagcaat

SEQ ID NO: 463921 - DNA, 15 bp, Homo sapiens
gttctaccagcaatt

SEQ ID NO: 463922 - DNA, 15 bp, Homo sapiens
ttctaccagcaattc

SEQ ID NO: 463923 - DNA, 15 bp, Homo sapiens
tctaccagcaattct

SEQ ID NO: 463924 - DNA, 15 bp, Homo sapiens
ctaccagcaattctg

SEQ ID NO: 463925 - DNA, 15 bp, Homo sapiens
taccagcaattctga

SEQ ID NO: 463926 - DNA, 15 bp, Homo sapiens
accagcaattctgac

SEQ ID NO: 463927 - DNA, 15 bp, Homo sapiens
ccagcaattctgaca

SEQ ID NO: 463928 - DNA, 15 bp, Homo sapiens
cagcaattctgacag

SEQ ID NO: 463929 - DNA, 15 bp, Homo sapiens
agcaattctgacaga

SEQ ID NO: 463930 - DNA, 15 bp, Homo sapiens
gcaattctgacagaa

SEQ ID NO: 463931 - DNA, 15 bp, Homo sapiens
caattctgacagaac

SEQ ID NO: 463932 - DNA, 15 bp, Homo sapiens
aattctgacagaaca

SEQ ID NO: 463933 - DNA, 15 bp, Homo sapiens
attctgacagaacag

SEQ ID NO: 463934 - DNA, 15 bp, Homo sapiens
ttctgacagaacaga

SEQ ID NO: 463935 - DNA, 15 bp, Homo sapiens
tctgacagaacagat

SEQ ID NO: 463936 - DNA, 15 bp, Homo sapiens
ctgacagaacagatt

SEQ ID NO: 463937 - DNA, 15 bp, Homo sapiens
gacagaacagatttc

SEQ ID NO: 463938 - DNA, 15 bp, Homo sapiens
acagaacagatttcg

SEQ ID NO: 463939 - DNA, 15 bp, Homo sapiens
cagaacagatttcgg

SEQ ID NO: 463940 - DNA, 15 bp, Homo sapiens
agaacagatttcgga

SEQ ID NO: 463941 - DNA, 15 bp, Homo sapiens
gaacagatttcggag

SEQ ID NO: 463942 - DNA, 15 bp, Homo sapiens
aacagatttcggaga

SEQ ID NO: 463943 - DNA, 15 bp, Homo sapiens
acagatttcggagaa

SEQ ID NO: 463944 - DNA, 15 bp, Homo sapiens
cagatttcggagaag

SEQ ID NO: 463945 - DNA, 15 bp, Homo sapiens
agatttcggagaaga

SEQ ID NO: 463946 - DNA, 15 bp, Homo sapiens
gatttcggagaagat

SEQ ID NO: 463947 - DNA, 15 bp, Homo sapiens
atttcggagaagatg

SEQ ID NO: 463948 - DNA, 15 bp, Homo sapiens
tttcggagaagatgt

SEQ ID NO: 463949 - DNA, 15 bp, Homo sapiens
ttcggagaagatgtt

SEQ ID NO: 463950 - DNA, 15 bp, Homo sapiens
tcggagaagatgttt

SEQ ID NO: 463951 - DNA, 15 bp, Homo sapiens
cggagaagatgtttt

SEQ ID NO: 463952 - DNA, 15 bp, Homo sapiens
ggagaagatgttttc

SEQ ID NO: 463953 - DNA, 15 bp, Homo sapiens
gagaagatgttttcc

SEQ ID NO: 463954 - DNA, 15 bp, Homo sapiens
agaagatgttttcca

SEQ ID NO: 463955 - DNA, 15 bp, Homo sapiens
gaagatgttttccac

SEQ ID NO: 463956 - DNA, 15 bp, Homo sapiens
aagatgttttccact

SEQ ID NO: 463957 - DNA, 15 bp, Homo sapiens
agatgttttccactc

SEQ ID NO: 463958 - DNA, 15 bp, Homo sapiens
gatgttttccactca

SEQ ID NO: 463959 - DNA, 15 bp, Homo sapiens
atgttttccactcag

SEQ ID NO: 463960 - DNA, 15 bp, Homo sapiens
tgttttccactcaga

SEQ ID NO: 463961 - DNA, 15 bp, Homo sapiens
gttttccactcagac

SEQ ID NO: 463962 - DNA, 15 bp, Homo sapiens
ttttccactcagacc

SEQ ID NO: 463963 - DNA, 15 bp, Homo sapiens
tttccactcagaccc

SEQ ID NO: 463964 - DNA, 15 bp, Homo sapiens
ttccactcagaccca

SEQ ID NO: 463965 - DNA, 15 bp, Homo sapiens
tccactcagacccat

SEQ ID NO: 463966 - DNA, 15 bp, Homo sapiens
ccactcagacccata

SEQ ID NO: 463967 - DNA, 15 bp, Homo sapiens
cactcagacccatag

SEQ ID NO: 463968 - DNA, 15 bp, Homo sapiens
actcagacccataga

SEQ ID NO: 463969 - DNA, 15 bp, Homo sapiens
ctcagacccatagaa

SEQ ID NO: 463970 - DNA, 15 bp, Homo sapiens
tcagacccatagaaa

SEQ ID NO: 463971 - DNA, 15 bp, Homo sapiens
cagacccatagaaac

SEQ ID NO: 463972 - DNA, 15 bp, Homo sapiens
agacccatagaaact

SEQ ID NO: 463973 - DNA, 15 bp, Homo sapiens
gacccatagaaactt

SEQ ID NO: 463974 - DNA, 15 bp, Homo sapiens
acccatagaaactta

SEQ ID NO: 463975 - DNA, 15 bp, Homo sapiens
cccatagaaacttat

SEQ ID NO: 463976 - DNA, 15 bp, Homo sapiens
ccatagaaacttatc

SEQ ID NO: 463977 - DNA, 15 bp, Homo sapiens
catagaaacttatcg

SEQ ID NO: 463978 - DNA, 15 bp, Homo sapiens
atagaaacttatcgt

SEQ ID NO: 463979 - DNA, 15 bp, Homo sapiens
tagaaacttatcgtc

SEQ ID NO: 463980 - DNA, 15 bp, Homo sapiens
agaaacttatcgtct

SEQ ID NO: 463981 - DNA, 15 bp, Homo sapiens
gaaacttatcgtcta

SEQ ID NO: 463982 - DNA, 15 bp, Homo sapiens
aaacttatcgtctaa

SEQ ID NO: 463983 - DNA, 15 bp, Homo sapiens
aacttatcgtctaag

SEQ ID NO: 463984 - DNA, 15 bp, Homo sapiens
acttatcgtctaagg

SEQ ID NO: 463985 - DNA, 15 bp, Homo sapiens
cttatcgtctaaggt

SEQ ID NO: 463986 - DNA, 15 bp, Homo sapiens
ttatcgtctaaggtt

SEQ ID NO: 463987 - DNA, 15 bp, Homo sapiens
tatcgtctaaggttt

SEQ ID NO: 463988 - DNA, 15 bp, Homo sapiens
atcgtctaaggtttt

SEQ ID NO: 463989 - DNA, 15 bp, Homo sapiens
tcgtctaaggttttg

SEQ ID NO: 463990 - DNA, 15 bp, Homo sapiens
cgtctaaggttttgc

SEQ ID NO: 463991 - DNA, 15 bp, Homo sapiens
gtctaaggttttgct

SEQ ID NO: 463992 - DNA, 15 bp, Homo sapiens
tctaaggttttgctt

SEQ ID NO: 463993 - DNA, 15 bp, Homo sapiens
ctaaggttttgcttt

SEQ ID NO: 463994 - DNA, 15 bp, Homo sapiens
taaggttttgctttt

SEQ ID NO: 463995 - DNA, 15 bp, Homo sapiens
aaggttttgcttttg

SEQ ID NO: 463996 - DNA, 15 bp, Homo sapiens
aggttttgcttttgt

SEQ ID NO: 463997 - DNA, 15 bp, Homo sapiens
ggttttgcttttgta

SEQ ID NO: 463998 - DNA, 15 bp, Homo sapiens
gttttgcttttgtaa

SEQ ID NO: 463999 - DNA, 15 bp, Homo sapiens
ttttgcttttgtaaa

SEQ ID NO: 464000 - DNA, 15 bp, Homo sapiens
tttgcttttgtaaat

SEQ ID NO: 464001 - DNA, 15 bp, Homo sapiens
ttgcttttgtaaata

SEQ ID NO: 464002 - DNA, 15 bp, Homo sapiens
tgcttttgtaaataa

SEQ ID NO: 464003 - DNA, 15 bp, Homo sapiens
gcttttgtaaataag

SEQ ID NO: 464004 - DNA, 15 bp, Homo sapiens
cttttgtaaataaga

SEQ ID NO: 464005 - DNA, 15 bp, Homo sapiens
ttttgtaaataagat

SEQ ID NO: 464006 - DNA, 15 bp, Homo sapiens
tttgtaaataagatt

SEQ ID NO: 464007 - DNA, 15 bp, Homo sapiens
ttgtaaataagattc

SEQ ID NO: 464008 - DNA, 15 bp, Homo sapiens
tgtaaataagattct

SEQ ID NO: 464009 - DNA, 15 bp, Homo sapiens
gtaaataagattctg

SEQ ID NO: 464010 - DNA, 15 bp, Homo sapiens
taaataagattctgc

SEQ ID NO: 464011 - DNA, 15 bp, Homo sapiens
aaataagattctgca

SEQ ID NO: 464012 - DNA, 15 bp, Homo sapiens
aataagattctgcaa

SEQ ID NO: 464013 - DNA, 15 bp, Homo sapiens
ataagattctgcaag

SEQ ID NO: 464014 - DNA, 15 bp, Homo sapiens
taagattctgcaagt

SEQ ID NO: 464015 - DNA, 15 bp, Homo sapiens
aagattctgcaagta

SEQ ID NO: 464016 - DNA, 15 bp, Homo sapiens
agattctgcaagtac

SEQ ID NO: 464017 - DNA, 15 bp, Homo sapiens
gattctgcaagtaca

SEQ ID NO: 464018 - DNA, 15 bp, Homo sapiens
attctgcaagtacaa

SEQ ID NO: 464019 - DNA, 15 bp, Homo sapiens
ttctgcaagtacaag

SEQ ID NO: 464020 - DNA, 15 bp, Homo sapiens
tctgcaagtacaagt

SEQ ID NO: 464021 - DNA, 15 bp, Homo sapiens
ctgcaagtacaagtc

SEQ ID NO: 464022 - DNA, 15 bp, Homo sapiens
tgcaagtacaagtca

SEQ ID NO: 464023 - DNA, 15 bp, Homo sapiens
gcaagtacaagtcaa

SEQ ID NO: 464024 - DNA, 15 bp, Homo sapiens
caagtacaagtcaat

SEQ ID NO: 464025 - DNA, 15 bp, Homo sapiens
aagtacaagtcaatg

SEQ ID NO: 464026 - DNA, 15 bp, Homo sapiens
agtacaagtcaatgt

SEQ ID NO: 464027 - DNA, 15 bp, Homo sapiens
gtacaagtcaatgtg

SEQ ID NO: 464028 - DNA, 15 bp, Homo sapiens
tacaagtcaatgtgc

SEQ ID NO: 464029 - DNA, 15 bp, Homo sapiens
acaagtcaatgtgca

SEQ ID NO: 464030 - DNA, 15 bp, Homo sapiens
caagtcaatgtgcag

SEQ ID NO: 464031 - DNA, 15 bp, Homo sapiens
aagtcaatgtgcagt

SEQ ID NO: 464032 - DNA, 15 bp, Homo sapiens
agtcaatgtgcagtg

SEQ ID NO: 464033 - DNA, 15 bp, Homo sapiens
gtcaatgtgcagtgt

SEQ ID NO: 464034 - DNA, 15 bp, Homo sapiens
tcaatgtgcagtgtc

SEQ ID NO: 464035 - DNA, 15 bp, Homo sapiens
caatgtgcagtgtca

SEQ ID NO: 464036 - DNA, 15 bp, Homo sapiens
aatgtgcagtgtcat

SEQ ID NO: 464037 - DNA, 15 bp, Homo sapiens
atgtgcagtgtcatt

SEQ ID NO: 464038 - DNA, 15 bp, Homo sapiens
tgtgcagtgtcattc

SEQ ID NO: 464039 - DNA, 15 bp, Homo sapiens
gtgcagtgtcattct

SEQ ID NO: 464040 - DNA, 15 bp, Homo sapiens
tgcagtgtcattctt

SEQ ID NO: 464041 - DNA, 15 bp, Homo sapiens
gcagtgtcattctta

SEQ ID NO: 464042 - DNA, 15 bp, Homo sapiens
cagtgtcattcttac

SEQ ID NO: 464043 - DNA, 15 bp, Homo sapiens
agtgtcattcttacg

SEQ ID NO: 464044 - DNA, 15 bp, Homo sapiens
gtgtcattcttacgc

SEQ ID NO: 464045 - DNA, 15 bp, Homo sapiens
tgtcattcttacgcc

SEQ ID NO: 464046 - DNA, 15 bp, Homo sapiens
gtcattcttacgcca

SEQ ID NO: 464047 - DNA, 15 bp, Homo sapiens
tcattcttacgccag

SEQ ID NO: 464048 - DNA, 15 bp, Homo sapiens
cattcttacgccaga

SEQ ID NO: 464049 - DNA, 15 bp, Homo sapiens
attcttacgccagag

SEQ ID NO: 464050 - DNA, 15 bp, Homo sapiens
ttcttacgccagaga

SEQ ID NO: 464051 - DNA, 15 bp, Homo sapiens
tcttacgccagagat

SEQ ID NO: 464052 - DNA, 15 bp, Homo sapiens
cttacgccagagatt

SEQ ID NO: 464053 - DNA, 15 bp, Homo sapiens
ttacgccagagattt

SEQ ID NO: 464054 - DNA, 15 bp, Homo sapiens
tacgccagagatttt

SEQ ID NO: 464055 - DNA, 15 bp, Homo sapiens
acgccagagatttta

SEQ ID NO: 464056 - DNA, 15 bp, Homo sapiens
cgccagagattttaa

SEQ ID NO: 464057 - DNA, 15 bp, Homo sapiens
gccagagattttaaa

SEQ ID NO: 464058 - DNA, 15 bp, Homo sapiens
ccagagattttaaaa

SEQ ID NO: 464059 - DNA, 15 bp, Homo sapiens
cagagattttaaaac

SEQ ID NO: 464060 - DNA, 15 bp, Homo sapiens
agagattttaaaaca

SEQ ID NO: 464061 - DNA, 15 bp, Homo sapiens
gagattttaaaacac

SEQ ID NO: 464062 - DNA, 15 bp, Homo sapiens
agattttaaaacacc

SEQ ID NO: 464063 - DNA, 15 bp, Homo sapiens
gattttaaaacacca

SEQ ID NO: 464064 - DNA, 15 bp, Homo sapiens
attttaaaacaccat

SEQ ID NO: 464065 - DNA, 15 bp, Homo sapiens
ttttaaaacaccatt

SEQ ID NO: 464066 - DNA, 15 bp, Homo sapiens
tttaaaacaccattt

SEQ ID NO: 464067 - DNA, 15 bp, Homo sapiens
ttaaaacaccatttc

SEQ ID NO: 464068 - DNA, 15 bp, Homo sapiens
taaaacaccatttcc

SEQ ID NO: 464069 - DNA, 15 bp, Homo sapiens
aaaacaccatttcca

SEQ ID NO: 464070 - DNA, 15 bp, Homo sapiens
aaacaccatttccat

SEQ ID NO: 464071 - DNA, 15 bp, Homo sapiens
aacaccatttccatt

SEQ ID NO: 464072 - DNA, 15 bp, Homo sapiens
acaccatttccattc

SEQ ID NO: 464073 - DNA, 15 bp, Homo sapiens
caccatttccattca

SEQ ID NO: 464074 - DNA, 15 bp, Homo sapiens
accatttccattcaa

SEQ ID NO: 464075 - DNA, 15 bp, Homo sapiens
ccatttccattcaag

SEQ ID NO: 464076 - DNA, 15 bp, Homo sapiens
catttccattcaagg

SEQ ID NO: 464077 - DNA, 15 bp, Homo sapiens
atttccattcaagga

SEQ ID NO: 464078 - DNA, 15 bp, Homo sapiens
tttccattcaaggat

SEQ ID NO: 464079 - DNA, 15 bp, Homo sapiens
ttccattcaaggatg

SEQ ID NO: 464080 - DNA, 15 bp, Homo sapiens
tccattcaaggatgc

SEQ ID NO: 464081 - DNA, 15 bp, Homo sapiens
ccattcaaggatgca

SEQ ID NO: 464082 - DNA, 15 bp, Homo sapiens
cattcaaggatgcat

SEQ ID NO: 464083 - DNA, 15 bp, Homo sapiens
attcaaggatgcatt

SEQ ID NO: 464084 - DNA, 15 bp, Homo sapiens
ttcaaggatgcattg

SEQ ID NO: 464085 - DNA, 15 bp, Homo sapiens
tcaaggatgcattgt

SEQ ID NO: 464086 - DNA, 15 bp, Homo sapiens
caaggatgcattgtg

SEQ ID NO: 464087 - DNA, 15 bp, Homo sapiens
aaggatgcattgtga

SEQ ID NO: 464088 - DNA, 15 bp, Homo sapiens
aggatgcattgtgat

SEQ ID NO: 464089 - DNA, 15 bp, Homo sapiens
ggatgcattgtgatc

SEQ ID NO: 464090 - DNA, 15 bp, Homo sapiens
gatgcattgtgatca

SEQ ID NO: 464091 - DNA, 15 bp, Homo sapiens
atgcattgtgatcaa

SEQ ID NO: 464092 - DNA, 15 bp, Homo sapiens
tgcattgtgatcaag

SEQ ID NO: 464093 - DNA, 15 bp, Homo sapiens
gcattgtgatcaagg

SEQ ID NO: 464094 - DNA, 15 bp, Homo sapiens
cattgtgatcaaggc

SEQ ID NO: 464095 - DNA, 15 bp, Homo sapiens
attgtgatcaaggct

SEQ ID NO: 464096 - DNA, 15 bp, Homo sapiens
ttgtgatcaaggctt

SEQ ID NO: 464097 - DNA, 15 bp, Homo sapiens
tgtgatcaaggcttt

SEQ ID NO: 464098 - DNA, 15 bp, Homo sapiens
gtgatcaaggcttta

SEQ ID NO: 464099 - DNA, 15 bp, Homo sapiens
tgatcaaggctttat

SEQ ID NO: 464100 - DNA, 15 bp, Homo sapiens
gatcaaggctttatt

SEQ ID NO: 464101 - DNA, 15 bp, Homo sapiens
atcaaggctttattt

SEQ ID NO: 464102 - DNA, 15 bp, Homo sapiens
tcaaggctttattta

SEQ ID NO: 464103 - DNA, 15 bp, Homo sapiens
caaggctttatttag

SEQ ID NO: 464104 - DNA, 15 bp, Homo sapiens
aaggctttatttagt

SEQ ID NO: 464105 - DNA, 15 bp, Homo sapiens
aggctttatttagtt

SEQ ID NO: 464106 - DNA, 15 bp, Homo sapiens
ggctttatttagttt

SEQ ID NO: 464107 - DNA, 15 bp, Homo sapiens
gctttatttagtttt

SEQ ID NO: 464108 - DNA, 15 bp, Homo sapiens
ctttatttagttttt

SEQ ID NO: 464109 - DNA, 15 bp, Homo sapiens
tttatttagtttttc

SEQ ID NO: 464110 - DNA, 15 bp, Homo sapiens
ttatttagtttttcc

SEQ ID NO: 464111 - DNA, 15 bp, Homo sapiens
tatttagtttttcct

SEQ ID NO: 464112 - DNA, 15 bp, Homo sapiens
atttagtttttcctt

SEQ ID NO: 464113 - DNA, 15 bp, Homo sapiens
tttagtttttccttt

SEQ ID NO: 464114 - DNA, 15 bp, Homo sapiens
ttagtttttcctttg

SEQ ID NO: 464115 - DNA, 15 bp, Homo sapiens
tagtttttcctttgt

SEQ ID NO: 464116 - DNA, 15 bp, Homo sapiens
agtttttcctttgtt

SEQ ID NO: 464117 - DNA, 15 bp, Homo sapiens
gtttttcctttgtta

SEQ ID NO: 464118 - DNA, 15 bp, Homo sapiens
tttttcctttgttac

SEQ ID NO: 464119 - DNA, 15 bp, Homo sapiens
ttttcctttgttaca

SEQ ID NO: 464120 - DNA, 15 bp, Homo sapiens
tttcctttgttacac

SEQ ID NO: 464121 - DNA, 15 bp, Homo sapiens
ttcctttgttacaca

SEQ ID NO: 464122 - DNA, 15 bp, Homo sapiens
tcctttgttacacag

SEQ ID NO: 464123 - DNA, 15 bp, Homo sapiens
cctttgttacacagt

SEQ ID NO: 464124 - DNA, 15 bp, Homo sapiens
ctttgttacacagta

SEQ ID NO: 464125 - DNA, 15 bp, Homo sapiens
tttgttacacagtat

SEQ ID NO: 464126 - DNA, 15 bp, Homo sapiens
ttgttacacagtatt

SEQ ID NO: 464127 - DNA, 15 bp, Homo sapiens
tgttacacagtattt

SEQ ID NO: 464128 - DNA, 15 bp, Homo sapiens
gttacacagtatttc

SEQ ID NO: 464129 - DNA, 15 bp, Homo sapiens
tacacagtatttctt

SEQ ID NO: 464130 - DNA, 15 bp, Homo sapiens
acacagtatttcttg

SEQ ID NO: 464131 - DNA, 15 bp, Homo sapiens
cacagtatttcttga

SEQ ID NO: 464132 - DNA, 15 bp, Homo sapiens
acagtatttcttgat

SEQ ID NO: 464133 - DNA, 15 bp, Homo sapiens
cagtatttcttgatt

SEQ ID NO: 464134 - DNA, 15 bp, Homo sapiens
agtatttcttgattt

SEQ ID NO: 464135 - DNA, 15 bp, Homo sapiens
gtatttcttgatttc

SEQ ID NO: 464136 - DNA, 15 bp, Homo sapiens
tatttcttgatttct

SEQ ID NO: 464137 - DNA, 15 bp, Homo sapiens
atttcttgatttctt

SEQ ID NO: 464138 - DNA, 15 bp, Homo sapiens
tttcttgatttcttt

SEQ ID NO: 464139 - DNA, 15 bp, Homo sapiens
ttcttgatttctttt

SEQ ID NO: 464140 - DNA, 15 bp, Homo sapiens
tcttgatttcttttt

SEQ ID NO: 464141 - DNA, 15 bp, Homo sapiens
cttgatttctttttt

SEQ ID NO: 464142 - DNA, 15 bp, Homo sapiens
ttgatttcttttttt

SEQ ID NO: 464143 - DNA, 15 bp, Homo sapiens
tgatttctttttttt

SEQ ID NO: 464144 - DNA, 15 bp, Homo sapiens
gatttcttttttttc

SEQ ID NO: 464145 - DNA, 15 bp, Homo sapiens
atttcttttttttct

SEQ ID NO: 464146 - DNA, 15 bp, Homo sapiens
tttcttttttttcta

SEQ ID NO: 464147 - DNA, 15 bp, Homo sapiens
ttcttttttttctag

SEQ ID NO: 464148 - DNA, 15 bp, Homo sapiens
tcttttttttctagt

SEQ ID NO: 464149 - DNA, 15 bp, Homo sapiens
cttttttttctagtg

SEQ ID NO: 464150 - DNA, 15 bp, Homo sapiens
ttttttttctagtga

SEQ ID NO: 464151 - DNA, 15 bp, Homo sapiens
tttttttctagtgac

SEQ ID NO: 464152 - DNA, 15 bp, Homo sapiens
ttttttctagtgact

SEQ ID NO: 464153 - DNA, 15 bp, Homo sapiens
tttttctagtgacta

SEQ ID NO: 464154 - DNA, 15 bp, Homo sapiens
ttttctagtgactaa

SEQ ID NO: 464155 - DNA, 15 bp, Homo sapiens
tttctagtgactaat

SEQ ID NO: 464156 - DNA, 15 bp, Homo sapiens
ttctagtgactaatt

SEQ ID NO: 464157 - DNA, 15 bp, Homo sapiens
tctagtgactaattt

SEQ ID NO: 464158 - DNA, 15 bp, Homo sapiens
ctagtgactaattta

SEQ ID NO: 464159 - DNA, 15 bp, Homo sapiens
tagtgactaatttaa

SEQ ID NO: 464160 - DNA, 15 bp, Homo sapiens
agtgactaatttaaa

SEQ ID NO: 464161 - DNA, 15 bp, Homo sapiens
gtgactaatttaaac

SEQ ID NO: 464162 - DNA, 15 bp, Homo sapiens
tgactaatttaaacc

SEQ ID NO: 464163 - DNA, 15 bp, Homo sapiens
gactaatttaaacca

SEQ ID NO: 464164 - DNA, 15 bp, Homo sapiens
actaatttaaaccaa

SEQ ID NO: 464165 - DNA, 15 bp, Homo sapiens
ctaatttaaaccaaa

SEQ ID NO: 464166 - DNA, 15 bp, Homo sapiens
taatttaaaccaaat

SEQ ID NO: 464167 - DNA, 15 bp, Homo sapiens
aatttaaaccaaata

SEQ ID NO: 464168 - DNA, 15 bp, Homo sapiens
atttaaaccaaatat

SEQ ID NO: 464169 - DNA, 15 bp, Homo sapiens
tttaaaccaaatata

SEQ ID NO: 464170 - DNA, 15 bp, Homo sapiens
ttaaaccaaatataa

SEQ ID NO: 464171 - DNA, 15 bp, Homo sapiens
taaaccaaatataaa

SEQ ID NO: 464172 - DNA, 15 bp, Homo sapiens
aaaccaaatataaaa

SEQ ID NO: 464173 - DNA, 15 bp, Homo sapiens
aaccaaatataaaag

SEQ ID NO: 464174 - DNA, 15 bp, Homo sapiens
accaaatataaaagt

SEQ ID NO: 464175 - DNA, 15 bp, Homo sapiens
ccaaatataaaagtg

SEQ ID NO: 464176 - DNA, 15 bp, Homo sapiens
caaatataaaagtgc

SEQ ID NO: 464177 - DNA, 15 bp, Homo sapiens
aaatataaaagtgct

SEQ ID NO: 464178 - DNA, 15 bp, Homo sapiens
aatataaaagtgctc

SEQ ID NO: 464179 - DNA, 15 bp, Homo sapiens
atataaaagtgctca

SEQ ID NO: 464180 - DNA, 15 bp, Homo sapiens
tataaaagtgctcat

SEQ ID NO: 464181 - DNA, 15 bp, Homo sapiens
ataaaagtgctcatt

SEQ ID NO: 464182 - DNA, 15 bp, Homo sapiens
taaaagtgctcattg

SEQ ID NO: 464183 - DNA, 15 bp, Homo sapiens
aaaagtgctcattgt

SEQ ID NO: 464184 - DNA, 15 bp, Homo sapiens
aaagtgctcattgtt

SEQ ID NO: 464185 - DNA, 15 bp, Homo sapiens
aagtgctcattgttg

SEQ ID NO: 464186 - DNA, 15 bp, Homo sapiens
agtgctcattgttga

SEQ ID NO: 464187 - DNA, 15 bp, Homo sapiens
gtgctcattgttgaa

SEQ ID NO: 464188 - DNA, 15 bp, Homo sapiens
tgctcattgttgaaa

SEQ ID NO: 464189 - DNA, 15 bp, Homo sapiens
gctcattgttgaaaa

SEQ ID NO: 464190 - DNA, 15 bp, Homo sapiens
ctcattgttgaaaac

SEQ ID NO: 464191 - DNA, 15 bp, Homo sapiens
tcattgttgaaaact

SEQ ID NO: 464192 - DNA, 15 bp, Homo sapiens
cattgttgaaaactg

SEQ ID NO: 464193 - DNA, 15 bp, Homo sapiens
attgttgaaaactgt

SEQ ID NO: 464194 - DNA, 15 bp, Homo sapiens
ttgttgaaaactgta

SEQ ID NO: 464195 - DNA, 15 bp, Homo sapiens
tgttgaaaactgtat

SEQ ID NO: 464196 - DNA, 15 bp, Homo sapiens
gttgaaaactgtatc

SEQ ID NO: 464197 - DNA, 15 bp, Homo sapiens
ttgaaaactgtatct

SEQ ID NO: 464198 - DNA, 15 bp, Homo sapiens
tgaaaactgtatctt

SEQ ID NO: 464199 - DNA, 15 bp, Homo sapiens
gaaaactgtatcttt

SEQ ID NO: 464200 - DNA, 15 bp, Homo sapiens
aaaactgtatctttg

SEQ ID NO: 464201 - DNA, 15 bp, Homo sapiens
aaactgtatctttgt

SEQ ID NO: 464202 - DNA, 15 bp, Homo sapiens
aactgtatctttgtg

SEQ ID NO: 464203 - DNA, 15 bp, Homo sapiens
actgtatctttgtga

SEQ ID NO: 464204 - DNA, 15 bp, Homo sapiens
ctgtatctttgtgag

SEQ ID NO: 464205 - DNA, 15 bp, Homo sapiens
tgtatctttgtgagg

SEQ ID NO: 464206 - DNA, 15 bp, Homo sapiens
gtatctttgtgaggg

SEQ ID NO: 464207 - DNA, 15 bp, Homo sapiens
tatctttgtgaggga

SEQ ID NO: 464208 - DNA, 15 bp, Homo sapiens
atctttgtgagggaa

SEQ ID NO: 464209 - DNA, 15 bp, Homo sapiens
tctttgtgagggaat

SEQ ID NO: 464210 - DNA, 15 bp, Homo sapiens
ctttgtgagggaatt

SEQ ID NO: 464211 - DNA, 15 bp, Homo sapiens
tttgtgagggaattt

SEQ ID NO: 464212 - DNA, 15 bp, Homo sapiens
ttgtgagggaatttt

SEQ ID NO: 464213 - DNA, 15 bp, Homo sapiens
tgtgagggaatttta

SEQ ID NO: 464214 - DNA, 15 bp, Homo sapiens
gtgagggaattttaa

SEQ ID NO: 464215 - DNA, 15 bp, Homo sapiens
tgagggaattttaaa

SEQ ID NO: 464216 - DNA, 15 bp, Homo sapiens
gagggaattttaaaa

SEQ ID NO: 464217 - DNA, 15 bp, Homo sapiens
agggaattttaaaat

SEQ ID NO: 464218 - DNA, 15 bp, Homo sapiens
gggaattttaaaatt

SEQ ID NO: 464219 - DNA, 15 bp, Homo sapiens
ggaattttaaaattc

SEQ ID NO: 464220 - DNA, 15 bp, Homo sapiens
gaattttaaaattca

SEQ ID NO: 464221 - DNA, 15 bp, Homo sapiens
aattttaaaattcat

SEQ ID NO: 464222 - DNA, 15 bp, Homo sapiens
attttaaaattcatt

SEQ ID NO: 464223 - DNA, 15 bp, Homo sapiens
ttttaaaattcattt

SEQ ID NO: 464224 - DNA, 15 bp, Homo sapiens
tttaaaattcatttc

SEQ ID NO: 464225 - DNA, 15 bp, Homo sapiens
ttaaaattcatttct

SEQ ID NO: 464226 - DNA, 15 bp, Homo sapiens
taaaattcatttctt

SEQ ID NO: 464227 - DNA, 15 bp, Homo sapiens
aaaattcatttctta

SEQ ID NO: 464228 - DNA, 15 bp, Homo sapiens
aaattcatttcttat

SEQ ID NO: 464229 - DNA, 15 bp, Homo sapiens
aattcatttcttatt

SEQ ID NO: 464230 - DNA, 15 bp, Homo sapiens
attcatttcttattg

SEQ ID NO: 464231 - DNA, 15 bp, Homo sapiens
ttcatttcttattgg

SEQ ID NO: 464232 - DNA, 15 bp, Homo sapiens
tcatttcttattggt

SEQ ID NO: 464233 - DNA, 15 bp, Homo sapiens
catttcttattggtg

SEQ ID NO: 464234 - DNA, 15 bp, Homo sapiens
tttcttattggtggt

SEQ ID NO: 464235 - DNA, 15 bp, Homo sapiens
ttcttattggtggta

SEQ ID NO: 464236 - DNA, 15 bp, Homo sapiens
tcttattggtggtat

SEQ ID NO: 464237 - DNA, 15 bp, Homo sapiens
cttattggtggtata

SEQ ID NO: 464238 - DNA, 15 bp, Homo sapiens
ttattggtggtataa

SEQ ID NO: 464239 - DNA, 15 bp, Homo sapiens
tattggtggtataat

SEQ ID NO: 464240 - DNA, 15 bp, Homo sapiens
attggtggtataatt

SEQ ID NO: 464241 - DNA, 15 bp, Homo sapiens
ttggtggtataattg

SEQ ID NO: 464242 - DNA, 15 bp, Homo sapiens
tggtggtataattga

SEQ ID NO: 464243 - DNA, 15 bp, Homo sapiens
ggtggtataattgat

SEQ ID NO: 464244 - DNA, 15 bp, Homo sapiens
gtggtataattgata

SEQ ID NO: 464245 - DNA, 15 bp, Homo sapiens
tggtataattgatat

SEQ ID NO: 464246 - DNA, 15 bp, Homo sapiens
ggtataattgatatt

SEQ ID NO: 464247 - DNA, 15 bp, Homo sapiens
gtataattgatattt

SEQ ID NO: 464248 - DNA, 15 bp, Homo sapiens
tataattgatatttt

SEQ ID NO: 464249 - DNA, 15 bp, Homo sapiens
ataattgatatttta

SEQ ID NO: 464250 - DNA, 15 bp, Homo sapiens
taattgatattttaa

SEQ ID NO: 464251 - DNA, 15 bp, Homo sapiens
aattgatattttaaa

SEQ ID NO: 464252 - DNA, 15 bp, Homo sapiens
attgatattttaaaa

SEQ ID NO: 464253 - DNA, 15 bp, Homo sapiens
ttgatattttaaaat

SEQ ID NO: 464254 - DNA, 15 bp, Homo sapiens
tgatattttaaaatt

SEQ ID NO: 464255 - DNA, 15 bp, Homo sapiens
gatattttaaaattt

SEQ ID NO: 464256 - DNA, 15 bp, Homo sapiens
attttaaaatttgat

SEQ ID NO: 464257 - DNA, 15 bp, Homo sapiens
ttttaaaatttgatg

SEQ ID NO: 464258 - DNA, 15 bp, Homo sapiens
tttaaaatttgatgt

SEQ ID NO: 464259 - DNA, 15 bp, Homo sapiens
ttaaaatttgatgtt

SEQ ID NO: 464260 - DNA, 15 bp, Homo sapiens
taaaatttgatgttt

SEQ ID NO: 464261 - DNA, 15 bp, Homo sapiens
aaaatttgatgtttc

SEQ ID NO: 464262 - DNA, 15 bp, Homo sapiens
aaatttgatgtttca

SEQ ID NO: 464263 - DNA, 15 bp, Homo sapiens
aatttgatgtttcaa

SEQ ID NO: 464264 - DNA, 15 bp, Homo sapiens
atttgatgtttcaac

SEQ ID NO: 464265 - DNA, 15 bp, Homo sapiens
tttgatgtttcaact

SEQ ID NO: 464266 - DNA, 15 bp, Homo sapiens
ttgatgtttcaactt

SEQ ID NO: 464267 - DNA, 15 bp, Homo sapiens
tgatgtttcaactta

SEQ ID NO: 464268 - DNA, 15 bp, Homo sapiens
gatgtttcaacttaa

SEQ ID NO: 464269 - DNA, 15 bp, Homo sapiens
atgtttcaacttaat

SEQ ID NO: 464270 - DNA, 15 bp, Homo sapiens
tgtttcaacttaata

SEQ ID NO: 464271 - DNA, 15 bp, Homo sapiens
gtttcaacttaatag

SEQ ID NO: 464272 - DNA, 15 bp, Homo sapiens
tttcaacttaataga

SEQ ID NO: 464273 - DNA, 15 bp, Homo sapiens
ttcaacttaatagat

SEQ ID NO: 464274 - DNA, 15 bp, Homo sapiens
tcaacttaatagata

SEQ ID NO: 464275 - DNA, 15 bp, Homo sapiens
caacttaatagatat

SEQ ID NO: 464276 - DNA, 15 bp, Homo sapiens
aacttaatagatata

SEQ ID NO: 464277 - DNA, 15 bp, Homo sapiens
acttaatagatataa

SEQ ID NO: 464278 - DNA, 15 bp, Homo sapiens
cttaatagatataat

SEQ ID NO: 464279 - DNA, 15 bp, Homo sapiens
ttaatagatataatt

SEQ ID NO: 464280 - DNA, 15 bp, Homo sapiens
taatagatataattc

SEQ ID NO: 464281 - DNA, 15 bp, Homo sapiens
aatagatataattct

SEQ ID NO: 464282 - DNA, 15 bp, Homo sapiens
atagatataattctt

SEQ ID NO: 464283 - DNA, 15 bp, Homo sapiens
tagatataattcttt

SEQ ID NO: 464284 - DNA, 15 bp, Homo sapiens
agatataattctttt

SEQ ID NO: 464285 - DNA, 15 bp, Homo sapiens
gatataattcttttc

SEQ ID NO: 464286 - DNA, 15 bp, Homo sapiens
atataattcttttct

SEQ ID NO: 464287 - DNA, 15 bp, Homo sapiens
tataattcttttctt

SEQ ID NO: 464288 - DNA, 15 bp, Homo sapiens
ataattcttttcttg

SEQ ID NO: 464289 - DNA, 15 bp, Homo sapiens
taattcttttcttgc

SEQ ID NO: 464290 - DNA, 15 bp, Homo sapiens
aattcttttcttgcc

SEQ ID NO: 464291 - DNA, 15 bp, Homo sapiens
attcttttcttgcct

SEQ ID NO: 464292 - DNA, 15 bp, Homo sapiens
ttcttttcttgccta

SEQ ID NO: 464293 - DNA, 15 bp, Homo sapiens
tcttttcttgcctat

SEQ ID NO: 464294 - DNA, 15 bp, Homo sapiens
cttttcttgcctatc

SEQ ID NO: 464295 - DNA, 15 bp, Homo sapiens
ttttcttgcctatca

SEQ ID NO: 464296 - DNA, 15 bp, Homo sapiens
tttcttgcctatcat

SEQ ID NO: 464297 - DNA, 15 bp, Homo sapiens
ttcttgcctatcatt

SEQ ID NO: 464298 - DNA, 15 bp, Homo sapiens
tcttgcctatcattt

SEQ ID NO: 464299 - DNA, 15 bp, Homo sapiens
cttgcctatcatttt

SEQ ID NO: 464300 - DNA, 15 bp, Homo sapiens
ttgcctatcattttc

SEQ ID NO: 464301 - DNA, 15 bp, Homo sapiens
tgcctatcattttcc

SEQ ID NO: 464302 - DNA, 15 bp, Homo sapiens
gcctatcattttcca

SEQ ID NO: 464303 - DNA, 15 bp, Homo sapiens
cctatcattttccat

SEQ ID NO: 464304 - DNA, 15 bp, Homo sapiens
ctatcattttccatt

SEQ ID NO: 464305 - DNA, 15 bp, Homo sapiens
tatcattttccattc

SEQ ID NO: 464306 - DNA, 15 bp, Homo sapiens
atcattttccattcg

SEQ ID NO: 464307 - DNA, 15 bp, Homo sapiens
tcattttccattcgt

SEQ ID NO: 464308 - DNA, 15 bp, Homo sapiens
cattttccattcgta

SEQ ID NO: 464309 - DNA, 15 bp, Homo sapiens
attttccattcgtat

SEQ ID NO: 464310 - DNA, 15 bp, Homo sapiens
ttttccattcgtatt

SEQ ID NO: 464311 - DNA, 15 bp, Homo sapiens
tttccattcgtattc

SEQ ID NO: 464312 - DNA, 15 bp, Homo sapiens
ttccattcgtattca

SEQ ID NO: 464313 - DNA, 15 bp, Homo sapiens
tccattcgtattcaa

SEQ ID NO: 464314 - DNA, 15 bp, Homo sapiens
ccattcgtattcaaa

SEQ ID NO: 464315 - DNA, 15 bp, Homo sapiens
cattcgtattcaaac

SEQ ID NO: 464316 - DNA, 15 bp, Homo sapiens
attcgtattcaaaca

SEQ ID NO: 464317 - DNA, 15 bp, Homo sapiens
ttcgtattcaaacat

SEQ ID NO: 464318 - DNA, 15 bp, Homo sapiens
tcgtattcaaacatt

SEQ ID NO: 464319 - DNA, 15 bp, Homo sapiens
cgtattcaaacatta

SEQ ID NO: 464320 - DNA, 15 bp, Homo sapiens
gtattcaaacattaa

SEQ ID NO: 464321 - DNA, 15 bp, Homo sapiens
tattcaaacattaaa

SEQ ID NO: 464322 - DNA, 15 bp, Homo sapiens
attcaaacattaaaa

SEQ ID NO: 464323 - DNA, 15 bp, Homo sapiens
ttcaaacattaaaag

SEQ ID NO: 464324 - DNA, 15 bp, Homo sapiens
tcaaacattaaaaga

SEQ ID NO: 464325 - DNA, 15 bp, Homo sapiens
caaacattaaaagaa

SEQ ID NO: 464326 - DNA, 15 bp, Homo sapiens
aaacattaaaagaaa

SEQ ID NO: 464327 - DNA, 15 bp, Homo sapiens
aacattaaaagaaat

SEQ ID NO: 464328 - DNA, 15 bp, Homo sapiens
acattaaaagaaatc

SEQ ID NO: 464329 - DNA, 15 bp, Homo sapiens
cattaaaagaaatct

SEQ ID NO: 464330 - DNA, 15 bp, Homo sapiens
attaaaagaaatctt

SEQ ID NO: 464331 - DNA, 15 bp, Homo sapiens
ttaaaagaaatcttc

SEQ ID NO: 464332 - DNA, 15 bp, Homo sapiens
taaaagaaatcttct

SEQ ID NO: 464333 - DNA, 15 bp, Homo sapiens
aaaagaaatcttctg

SEQ ID NO: 464334 - DNA, 15 bp, Homo sapiens
aaagaaatcttctga

SEQ ID NO: 464335 - DNA, 15 bp, Homo sapiens
aagaaatcttctgac

SEQ ID NO: 464336 - DNA, 15 bp, Homo sapiens
agaaatcttctgaca

SEQ ID NO: 464337 - DNA, 15 bp, Homo sapiens
gaaatcttctgacat

SEQ ID NO: 464338 - DNA, 15 bp, Homo sapiens
aaatcttctgacatg

SEQ ID NO: 464339 - DNA, 15 bp, Homo sapiens
aatcttctgacatgc

SEQ ID NO: 464340 - DNA, 15 bp, Homo sapiens
atcttctgacatgca

SEQ ID NO: 464341 - DNA, 15 bp, Homo sapiens
tcttctgacatgcat

SEQ ID NO: 464342 - DNA, 15 bp, Homo sapiens
cttctgacatgcata

SEQ ID NO: 464343 - DNA, 15 bp, Homo sapiens
ttctgacatgcatat

SEQ ID NO: 464344 - DNA, 15 bp, Homo sapiens
tctgacatgcatatt

SEQ ID NO: 464345 - DNA, 15 bp, Homo sapiens
ctgacatgcatattt

SEQ ID NO: 464346 - DNA, 15 bp, Homo sapiens
tgacatgcatatttg

SEQ ID NO: 464347 - DNA, 15 bp, Homo sapiens
gacatgcatatttgt

SEQ ID NO: 464348 - DNA, 15 bp, Homo sapiens
acatgcatatttgtc

SEQ ID NO: 464349 - DNA, 15 bp, Homo sapiens
catgcatatttgtct

SEQ ID NO: 464350 - DNA, 15 bp, Homo sapiens
tgcatatttgtctcc

SEQ ID NO: 464351 - DNA, 15 bp, Homo sapiens
gcatatttgtctccc

SEQ ID NO: 464352 - DNA, 15 bp, Homo sapiens
catatttgtctccct

SEQ ID NO: 464353 - DNA, 15 bp, Homo sapiens
atatttgtctccctc

SEQ ID NO: 464354 - DNA, 15 bp, Homo sapiens
tatttgtctccctct

SEQ ID NO: 464355 - DNA, 15 bp, Homo sapiens
atttgtctccctctc

SEQ ID NO: 464356 - DNA, 15 bp, Homo sapiens
tttgtctccctctca

SEQ ID NO: 464357 - DNA, 15 bp, Homo sapiens
ttgtctccctctcat

SEQ ID NO: 464358 - DNA, 15 bp, Homo sapiens
tgtctccctctcatg

SEQ ID NO: 464359 - DNA, 15 bp, Homo sapiens
gtctccctctcatgt

SEQ ID NO: 464360 - DNA, 15 bp, Homo sapiens
tctccctctcatgta

SEQ ID NO: 464361 - DNA, 15 bp, Homo sapiens
ctccctctcatgtat

SEQ ID NO: 464362 - DNA, 15 bp, Homo sapiens
tccctctcatgtata

SEQ ID NO: 464363 - DNA, 15 bp, Homo sapiens
ccctctcatgtataa

SEQ ID NO: 464364 - DNA, 15 bp, Homo sapiens
cctctcatgtataaa

SEQ ID NO: 464365 - DNA, 15 bp, Homo sapiens
ctctcatgtataaac

SEQ ID NO: 464366 - DNA, 15 bp, Homo sapiens
tctcatgtataaaca

SEQ ID NO: 464367 - DNA, 15 bp, Homo sapiens
ctcatgtataaacag

SEQ ID NO: 464368 - DNA, 15 bp, Homo sapiens
tcatgtataaacaga

SEQ ID NO: 464369 - DNA, 15 bp, Homo sapiens
catgtataaacagat

SEQ ID NO: 464370 - DNA, 15 bp, Homo sapiens
atgtataaacagata

SEQ ID NO: 464371 - DNA, 15 bp, Homo sapiens
tgtataaacagatag

SEQ ID NO: 464372 - DNA, 15 bp, Homo sapiens
gtataaacagataga

SEQ ID NO: 464373 - DNA, 15 bp, Homo sapiens
tataaacagatagaa

SEQ ID NO: 464374 - DNA, 15 bp, Homo sapiens
ataaacagatagaag

SEQ ID NO: 464375 - DNA, 15 bp, Homo sapiens
taaacagatagaagc

SEQ ID NO: 464376 - DNA, 15 bp, Homo sapiens
aaacagatagaagca

SEQ ID NO: 464377 - DNA, 15 bp, Homo sapiens
aacagatagaagcat

SEQ ID NO: 464378 - DNA, 15 bp, Homo sapiens
acagatagaagcatg

SEQ ID NO: 464379 - DNA, 15 bp, Homo sapiens
cagatagaagcatgt

SEQ ID NO: 464380 - DNA, 15 bp, Homo sapiens
agatagaagcatgtt

SEQ ID NO: 464381 - DNA, 15 bp, Homo sapiens
gatagaagcatgttt

SEQ ID NO: 464382 - DNA, 15 bp, Homo sapiens
atagaagcatgtttc

SEQ ID NO: 464383 - DNA, 15 bp, Homo sapiens
tagaagcatgtttca

SEQ ID NO: 464384 - DNA, 15 bp, Homo sapiens
agaagcatgtttcag

SEQ ID NO: 464385 - DNA, 15 bp, Homo sapiens
gaagcatgtttcaga

SEQ ID NO: 464386 - DNA, 15 bp, Homo sapiens
aagcatgtttcagag

SEQ ID NO: 464387 - DNA, 15 bp, Homo sapiens
agcatgtttcagaga

SEQ ID NO: 464388 - DNA, 15 bp, Homo sapiens
gcatgtttcagagac

SEQ ID NO: 464389 - DNA, 15 bp, Homo sapiens
catgtttcagagact

SEQ ID NO: 464390 - DNA, 15 bp, Homo sapiens
atgtttcagagactt

SEQ ID NO: 464391 - DNA, 15 bp, Homo sapiens
tgtttcagagacttg

SEQ ID NO: 464392 - DNA, 15 bp, Homo sapiens
gtttcagagacttga

SEQ ID NO: 464393 - DNA, 15 bp, Homo sapiens
tttcagagacttgaa

SEQ ID NO: 464394 - DNA, 15 bp, Homo sapiens
ttcagagacttgaac

SEQ ID NO: 464395 - DNA, 15 bp, Homo sapiens
tcagagacttgaact

SEQ ID NO: 464396 - DNA, 15 bp, Homo sapiens
cagagacttgaactc

SEQ ID NO: 464397 - DNA, 15 bp, Homo sapiens
agagacttgaactcc

SEQ ID NO: 464398 - DNA, 15 bp, Homo sapiens
gagacttgaactcca

SEQ ID NO: 464399 - DNA, 15 bp, Homo sapiens
agacttgaactccaa

SEQ ID NO: 464400 - DNA, 15 bp, Homo sapiens
gacttgaactccaaa

SEQ ID NO: 464401 - DNA, 15 bp, Homo sapiens
acttgaactccaaaa

SEQ ID NO: 464402 - DNA, 15 bp, Homo sapiens
cttgaactccaaaat

SEQ ID NO: 464403 - DNA, 15 bp, Homo sapiens
ttgaactccaaaatt

SEQ ID NO: 464404 - DNA, 15 bp, Homo sapiens
tgaactccaaaattt

SEQ ID NO: 464405 - DNA, 15 bp, Homo sapiens
gaactccaaaatttt

SEQ ID NO: 464406 - DNA, 15 bp, Homo sapiens
aactccaaaatttta

SEQ ID NO: 464407 - DNA, 15 bp, Homo sapiens
actccaaaattttat

SEQ ID NO: 464408 - DNA, 15 bp, Homo sapiens
ctccaaaattttata

SEQ ID NO: 464409 - DNA, 15 bp, Homo sapiens
tccaaaattttatat

SEQ ID NO: 464410 - DNA, 15 bp, Homo sapiens
ccaaaattttatatt

SEQ ID NO: 464411 - DNA, 15 bp, Homo sapiens
caaaattttatattt

SEQ ID NO: 464412 - DNA, 15 bp, Homo sapiens
aaaattttatatttt

SEQ ID NO: 464413 - DNA, 15 bp, Homo sapiens
aaattttatatttta

SEQ ID NO: 464414 - DNA, 15 bp, Homo sapiens
aattttatattttat

SEQ ID NO: 464415 - DNA, 15 bp, Homo sapiens
attttatattttatt

SEQ ID NO: 464416 - DNA, 15 bp, Homo sapiens
ttttatattttattt

SEQ ID NO: 464417 - DNA, 15 bp, Homo sapiens
ttatattttattttt

SEQ ID NO: 464418 - DNA, 15 bp, Homo sapiens
tatattttatttttt

SEQ ID NO: 464419 - DNA, 15 bp, Homo sapiens
atattttattttttg

SEQ ID NO: 464420 - DNA, 15 bp, Homo sapiens
tattttattttttgg

SEQ ID NO: 464421 - DNA, 15 bp, Homo sapiens
attttattttttggt

SEQ ID NO: 464422 - DNA, 15 bp, Homo sapiens
ttttattttttggta

SEQ ID NO: 464423 - DNA, 15 bp, Homo sapiens
tttattttttggtaa

SEQ ID NO: 464424 - DNA, 15 bp, Homo sapiens
ttattttttggtaat

SEQ ID NO: 464425 - DNA, 15 bp, Homo sapiens
tattttttggtaatt

SEQ ID NO: 464426 - DNA, 15 bp, Homo sapiens
attttttggtaattc

SEQ ID NO: 464427 - DNA, 15 bp, Homo sapiens
ttttttggtaattcg

SEQ ID NO: 464428 - DNA, 15 bp, Homo sapiens
tttttggtaattcgg

SEQ ID NO: 464429 - DNA, 15 bp, Homo sapiens
ttttggtaattcgga

SEQ ID NO: 464430 - DNA, 15 bp, Homo sapiens
tttggtaattcggat

SEQ ID NO: 464431 - DNA, 15 bp, Homo sapiens
ttggtaattcggatg

SEQ ID NO: 464432 - DNA, 15 bp, Homo sapiens
tggtaattcggatga

SEQ ID NO: 464433 - DNA, 15 bp, Homo sapiens
ggtaattcggatgaa

SEQ ID NO: 464434 - DNA, 15 bp, Homo sapiens
gtaattcggatgaat

SEQ ID NO: 464435 - DNA, 15 bp, Homo sapiens
taattcggatgaatg

SEQ ID NO: 464436 - DNA, 15 bp, Homo sapiens
aattcggatgaatga

SEQ ID NO: 464437 - DNA, 15 bp, Homo sapiens
attcggatgaatgaa

SEQ ID NO: 464438 - DNA, 15 bp, Homo sapiens
ttcggatgaatgaaa

SEQ ID NO: 464439 - DNA, 15 bp, Homo sapiens
tcggatgaatgaaat

SEQ ID NO: 464440 - DNA, 15 bp, Homo sapiens
cggatgaatgaaatt

SEQ ID NO: 464441 - DNA, 15 bp, Homo sapiens
ggatgaatgaaattt

SEQ ID NO: 464442 - DNA, 15 bp, Homo sapiens
gatgaatgaaatttc

SEQ ID NO: 464443 - DNA, 15 bp, Homo sapiens
atgaatgaaatttct

SEQ ID NO: 464444 - DNA, 15 bp, Homo sapiens
tgaatgaaatttctt

SEQ ID NO: 464445 - DNA, 15 bp, Homo sapiens
gaatgaaatttctta

SEQ ID NO: 464446 - DNA, 15 bp, Homo sapiens
aatgaaatttcttac

SEQ ID NO: 464447 - DNA, 15 bp, Homo sapiens
atgaaatttcttacc

SEQ ID NO: 464448 - DNA, 15 bp, Homo sapiens
tgaaatttcttacca

SEQ ID NO: 464449 - DNA, 15 bp, Homo sapiens
gaaatttcttaccac

SEQ ID NO: 464450 - DNA, 15 bp, Homo sapiens
aaatttcttaccaca

SEQ ID NO: 464451 - DNA, 15 bp, Homo sapiens
aatttcttaccacaa

SEQ ID NO: 464452 - DNA, 15 bp, Homo sapiens
atttcttaccacaaa

SEQ ID NO: 464453 - DNA, 15 bp, Homo sapiens
tttcttaccacaaat

SEQ ID NO: 464454 - DNA, 15 bp, Homo sapiens
ttcttaccacaaatt

SEQ ID NO: 464455 - DNA, 15 bp, Homo sapiens
tcttaccacaaattt

SEQ ID NO: 464456 - DNA, 15 bp, Homo sapiens
cttaccacaaattta

SEQ ID NO: 464457 - DNA, 15 bp, Homo sapiens
ttaccacaaatttag

SEQ ID NO: 464458 - DNA, 15 bp, Homo sapiens
taccacaaatttaga

SEQ ID NO: 464459 - DNA, 15 bp, Homo sapiens
accacaaatttagac

SEQ ID NO: 464460 - DNA, 15 bp, Homo sapiens
ccacaaatttagact

SEQ ID NO: 464461 - DNA, 15 bp, Homo sapiens
cacaaatttagacta

SEQ ID NO: 464462 - DNA, 15 bp, Homo sapiens
acaaatttagactaa

SEQ ID NO: 464463 - DNA, 15 bp, Homo sapiens
caaatttagactaaa

SEQ ID NO: 464464 - DNA, 15 bp, Homo sapiens
aaatttagactaaat

SEQ ID NO: 464465 - DNA, 15 bp, Homo sapiens
aatttagactaaatg

SEQ ID NO: 464466 - DNA, 15 bp, Homo sapiens
atttagactaaatga

SEQ ID NO: 464467 - DNA, 15 bp, Homo sapiens
tttagactaaatgat

SEQ ID NO: 464468 - DNA, 15 bp, Homo sapiens
ttagactaaatgata

SEQ ID NO: 464469 - DNA, 15 bp, Homo sapiens
tagactaaatgatag

SEQ ID NO: 464470 - DNA, 15 bp, Homo sapiens
agactaaatgatagt

SEQ ID NO: 464471 - DNA, 15 bp, Homo sapiens
gactaaatgatagta

SEQ ID NO: 464472 - DNA, 15 bp, Homo sapiens
actaaatgatagtaa

SEQ ID NO: 464473 - DNA, 15 bp, Homo sapiens
ctaaatgatagtaat

SEQ ID NO: 464474 - DNA, 15 bp, Homo sapiens
taaatgatagtaatg

SEQ ID NO: 464475 - DNA, 15 bp, Homo sapiens
aaatgatagtaatgc

SEQ ID NO: 464476 - DNA, 15 bp, Homo sapiens
aatgatagtaatgca

SEQ ID NO: 464477 - DNA, 15 bp, Homo sapiens
atgatagtaatgcaa

SEQ ID NO: 464478 - DNA, 15 bp, Homo sapiens
tgatagtaatgcaag

SEQ ID NO: 464479 - DNA, 15 bp, Homo sapiens
gatagtaatgcaagc

SEQ ID NO: 464480 - DNA, 15 bp, Homo sapiens
atagtaatgcaagcc

SEQ ID NO: 464481 - DNA, 15 bp, Homo sapiens
tagtaatgcaagcca

SEQ ID NO: 464482 - DNA, 15 bp, Homo sapiens
agtaatgcaagccaa

SEQ ID NO: 464483 - DNA, 15 bp, Homo sapiens
gtaatgcaagccaat

SEQ ID NO: 464484 - DNA, 15 bp, Homo sapiens
taatgcaagccaata

SEQ ID NO: 464485 - DNA, 15 bp, Homo sapiens
aatgcaagccaataa

SEQ ID NO: 464486 - DNA, 15 bp, Homo sapiens
atgcaagccaataaa

SEQ ID NO: 464487 - DNA, 15 bp, Homo sapiens
tgcaagccaataaat

SEQ ID NO: 464488 - DNA, 15 bp, Homo sapiens
gcaagccaataaatt

SEQ ID NO: 464489 - DNA, 15 bp, Homo sapiens
caagccaataaattt

SEQ ID NO: 464490 - DNA, 15 bp, Homo sapiens
agccaataaattttc

SEQ ID NO: 464491 - DNA, 15 bp, Homo sapiens
gccaataaattttct

SEQ ID NO: 464492 - DNA, 15 bp, Homo sapiens
ccaataaattttctt

SEQ ID NO: 464493 - DNA, 15 bp, Homo sapiens
caataaattttcttt

SEQ ID NO: 464494 - DNA, 15 bp, Homo sapiens
aataaattttctttt

SEQ ID NO: 464495 - DNA, 15 bp, Homo sapiens
ataaattttcttttg

SEQ ID NO: 464496 - DNA, 15 bp, Homo sapiens
taaattttcttttgt

SEQ ID NO: 464497 - DNA, 15 bp, Homo sapiens
aaattttcttttgtt

SEQ ID NO: 464498 - DNA, 15 bp, Homo sapiens
aattttcttttgttt

SEQ ID NO: 464499 - DNA, 15 bp, Homo sapiens
attttcttttgtttt

SEQ ID NO: 464500 - DNA, 15 bp, Homo sapiens
ttttcttttgttttc

SEQ ID NO: 464501 - DNA, 15 bp, Homo sapiens
tttcttttgttttct

SEQ ID NO: 464502 - DNA, 15 bp, Homo sapiens
ttcttttgttttctc

SEQ ID NO: 464503 - DNA, 15 bp, Homo sapiens
tcttttgttttctct

SEQ ID NO: 464504 - DNA, 15 bp, Homo sapiens
cttttgttttctcta

SEQ ID NO: 464505 - DNA, 15 bp, Homo sapiens
ttttgttttctctag

SEQ ID NO: 464506 - DNA, 15 bp, Homo sapiens
tttgttttctctagg

SEQ ID NO: 464507 - DNA, 15 bp, Homo sapiens
ttgttttctctaggt

SEQ ID NO: 464508 - DNA, 15 bp, Homo sapiens
tgttttctctaggta

SEQ ID NO: 464509 - DNA, 15 bp, Homo sapiens
gttttctctaggtat

SEQ ID NO: 464510 - DNA, 15 bp, Homo sapiens
ttttctctaggtata

SEQ ID NO: 464511 - DNA, 15 bp, Homo sapiens
tttctctaggtatag

SEQ ID NO: 464512 - DNA, 15 bp, Homo sapiens
ttctctaggtataga

SEQ ID NO: 464513 - DNA, 15 bp, Homo sapiens
tctctaggtatagaa

SEQ ID NO: 464514 - DNA, 15 bp, Homo sapiens
ctctaggtatagaag

SEQ ID NO: 464515 - DNA, 15 bp, Homo sapiens
tctaggtatagaagc

SEQ ID NO: 464516 - DNA, 15 bp, Homo sapiens
ctaggtatagaagcc

SEQ ID NO: 464517 - DNA, 15 bp, Homo sapiens
taggtatagaagcct

SEQ ID NO: 464518 - DNA, 15 bp, Homo sapiens
aggtatagaagcctt

SEQ ID NO: 464519 - DNA, 15 bp, Homo sapiens
ggtatagaagcctta

SEQ ID NO: 464520 - DNA, 15 bp, Homo sapiens
gtatagaagccttaa

SEQ ID NO: 464521 - DNA, 15 bp, Homo sapiens
tatagaagccttaag

SEQ ID NO: 464522 - DNA, 15 bp, Homo sapiens
atagaagccttaagc

SEQ ID NO: 464523 - DNA, 15 bp, Homo sapiens
tagaagccttaagca

SEQ ID NO: 464524 - DNA, 15 bp, Homo sapiens
agaagccttaagcat

SEQ ID NO: 464525 - DNA, 15 bp, Homo sapiens
gaagccttaagcatt

SEQ ID NO: 464526 - DNA, 15 bp, Homo sapiens
aagccttaagcattt

SEQ ID NO: 464527 - DNA, 15 bp, Homo sapiens
agccttaagcatttt

SEQ ID NO: 464528 - DNA, 15 bp, Homo sapiens
gccttaagcatttta

SEQ ID NO: 464529 - DNA, 15 bp, Homo sapiens
ccttaagcattttaa

SEQ ID NO: 464530 - DNA, 15 bp, Homo sapiens
cttaagcattttaac

SEQ ID NO: 464531 - DNA, 15 bp, Homo sapiens
ttaagcattttaact

SEQ ID NO: 464532 - DNA, 15 bp, Homo sapiens
taagcattttaacta

SEQ ID NO: 464533 - DNA, 15 bp, Homo sapiens
aagcattttaactat

SEQ ID NO: 464534 - DNA, 15 bp, Homo sapiens
agcattttaactatg

SEQ ID NO: 464535 - DNA, 15 bp, Homo sapiens
gcattttaactatga

SEQ ID NO: 464536 - DNA, 15 bp, Homo sapiens
cattttaactatgat

SEQ ID NO: 464537 - DNA, 15 bp, Homo sapiens
attttaactatgatg

SEQ ID NO: 464538 - DNA, 15 bp, Homo sapiens
ttttaactatgatgt

SEQ ID NO: 464539 - DNA, 15 bp, Homo sapiens
tttaactatgatgtc

SEQ ID NO: 464540 - DNA, 15 bp, Homo sapiens
ttaactatgatgtct

SEQ ID NO: 464541 - DNA, 15 bp, Homo sapiens
taactatgatgtctg

SEQ ID NO: 464542 - DNA, 15 bp, Homo sapiens
aactatgatgtctgc

SEQ ID NO: 464543 - DNA, 15 bp, Homo sapiens
actatgatgtctgcc

SEQ ID NO: 464544 - DNA, 15 bp, Homo sapiens
ctatgatgtctgcca

SEQ ID NO: 464545 - DNA, 15 bp, Homo sapiens
tatgatgtctgccag

SEQ ID NO: 464546 - DNA, 15 bp, Homo sapiens
atgatgtctgccaga

SEQ ID NO: 464547 - DNA, 15 bp, Homo sapiens
tgatgtctgccagag

SEQ ID NO: 464548 - DNA, 15 bp, Homo sapiens
gatgtctgccagagt

SEQ ID NO: 464549 - DNA, 15 bp, Homo sapiens
atgtctgccagagtt

SEQ ID NO: 464550 - DNA, 15 bp, Homo sapiens
tgtctgccagagttg

SEQ ID NO: 464551 - DNA, 15 bp, Homo sapiens
gtctgccagagttgt

SEQ ID NO: 464552 - DNA, 15 bp, Homo sapiens
tctgccagagttgtt

SEQ ID NO: 464553 - DNA, 15 bp, Homo sapiens
ctgccagagttgttt

SEQ ID NO: 464554 - DNA, 15 bp, Homo sapiens
tgccagagttgtttc

SEQ ID NO: 464555 - DNA, 15 bp, Homo sapiens
gccagagttgtttct

SEQ ID NO: 464556 - DNA, 15 bp, Homo sapiens
ccagagttgtttctt

SEQ ID NO: 464557 - DNA, 15 bp, Homo sapiens
cagagttgtttcttt

SEQ ID NO: 464558 - DNA, 15 bp, Homo sapiens
agagttgtttctttt

SEQ ID NO: 464559 - DNA, 15 bp, Homo sapiens
gagttgtttcttttc

SEQ ID NO: 464560 - DNA, 15 bp, Homo sapiens
agttgtttcttttcg

SEQ ID NO: 464561 - DNA, 15 bp, Homo sapiens
gttgtttcttttcgg

SEQ ID NO: 464562 - DNA, 15 bp, Homo sapiens
ttgtttcttttcggg

SEQ ID NO: 464563 - DNA, 15 bp, Homo sapiens
tgtttcttttcgggt

SEQ ID NO: 464564 - DNA, 15 bp, Homo sapiens
gtttcttttcgggtc

SEQ ID NO: 464565 - DNA, 15 bp, Homo sapiens
tttcttttcgggtcg

SEQ ID NO: 464566 - DNA, 15 bp, Homo sapiens
ttcttttcgggtcga

SEQ ID NO: 464567 - DNA, 15 bp, Homo sapiens
tcttttcgggtcgaa

SEQ ID NO: 464568 - DNA, 15 bp, Homo sapiens
cttttcgggtcgaac

SEQ ID NO: 464569 - DNA, 15 bp, Homo sapiens
ttttcgggtcgaaca

SEQ ID NO: 464570 - DNA, 15 bp, Homo sapiens
tttcgggtcgaacag

SEQ ID NO: 464571 - DNA, 15 bp, Homo sapiens
ttcgggtcgaacagc

SEQ ID NO: 464572 - DNA, 15 bp, Homo sapiens
tcgggtcgaacagca

SEQ ID NO: 464573 - DNA, 15 bp, Homo sapiens
cgggtcgaacagcaa

SEQ ID NO: 464574 - DNA, 15 bp, Homo sapiens
gggtcgaacagcaaa

SEQ ID NO: 464575 - DNA, 15 bp, Homo sapiens
ggtcgaacagcaaaa

SEQ ID NO: 464576 - DNA, 15 bp, Homo sapiens
gtcgaacagcaaaag

SEQ ID NO: 464577 - DNA, 15 bp, Homo sapiens
tcgaacagcaaaagg

SEQ ID NO: 464578 - DNA, 15 bp, Homo sapiens
cgaacagcaaaaggt

SEQ ID NO: 464579 - DNA, 15 bp, Homo sapiens
gaacagcaaaaggtc

SEQ ID NO: 464580 - DNA, 15 bp, Homo sapiens
aacagcaaaaggtca

SEQ ID NO: 464581 - DNA, 15 bp, Homo sapiens
acagcaaaaggtcac

SEQ ID NO: 464582 - DNA, 15 bp, Homo sapiens
cagcaaaaggtcaca

SEQ ID NO: 464583 - DNA, 15 bp, Homo sapiens
agcaaaaggtcacaa

SEQ ID NO: 464584 - DNA, 15 bp, Homo sapiens
gcaaaaggtcacaaa

SEQ ID NO: 464585 - DNA, 15 bp, Homo sapiens
caaaaggtcacaaat

SEQ ID NO: 464586 - DNA, 15 bp, Homo sapiens
aaaaggtcacaaatt

SEQ ID NO: 464587 - DNA, 15 bp, Homo sapiens
aaaggtcacaaatta

SEQ ID NO: 464588 - DNA, 15 bp, Homo sapiens
aaggtcacaaattac

SEQ ID NO: 464589 - DNA, 15 bp, Homo sapiens
aggtcacaaattaca

SEQ ID NO: 464590 - DNA, 15 bp, Homo sapiens
ggtcacaaattacat

SEQ ID NO: 464591 - DNA, 15 bp, Homo sapiens
gtcacaaattacatt

SEQ ID NO: 464592 - DNA, 15 bp, Homo sapiens
tcacaaattacatta

SEQ ID NO: 464593 - DNA, 15 bp, Homo sapiens
cacaaattacattac

SEQ ID NO: 464594 - DNA, 15 bp, Homo sapiens
acaaattacattacc

SEQ ID NO: 464595 - DNA, 15 bp, Homo sapiens
caaattacattaccc

SEQ ID NO: 464596 - DNA, 15 bp, Homo sapiens
aaattacattaccca

SEQ ID NO: 464597 - DNA, 15 bp, Homo sapiens
aattacattacccaa

SEQ ID NO: 464598 - DNA, 15 bp, Homo sapiens
attacattacccaat

SEQ ID NO: 464599 - DNA, 15 bp, Homo sapiens
ttacattacccaatg

SEQ ID NO: 464600 - DNA, 15 bp, Homo sapiens
tacattacccaatgg

SEQ ID NO: 464601 - DNA, 15 bp, Homo sapiens
acattacccaatggt

SEQ ID NO: 464602 - DNA, 15 bp, Homo sapiens
cattacccaatggtg

SEQ ID NO: 464603 - DNA, 15 bp, Homo sapiens
attacccaatggtgg

SEQ ID NO: 464604 - DNA, 15 bp, Homo sapiens
ttacccaatggtgga

SEQ ID NO: 464605 - DNA, 15 bp, Homo sapiens
tacccaatggtggaa

SEQ ID NO: 464606 - DNA, 15 bp, Homo sapiens
acccaatggtggaat

SEQ ID NO: 464607 - DNA, 15 bp, Homo sapiens
cccaatggtggaata

SEQ ID NO: 464608 - DNA, 15 bp, Homo sapiens
ccaatggtggaatat

SEQ ID NO: 464609 - DNA, 15 bp, Homo sapiens
caatggtggaatatt

SEQ ID NO: 464610 - DNA, 15 bp, Homo sapiens
aatggtggaatattg

SEQ ID NO: 464611 - DNA, 15 bp, Homo sapiens
atggtggaatattgt

SEQ ID NO: 464612 - DNA, 15 bp, Homo sapiens
tggtggaatattgta

SEQ ID NO: 464613 - DNA, 15 bp, Homo sapiens
ggtggaatattgtat

SEQ ID NO: 464614 - DNA, 15 bp, Homo sapiens
gtggaatattgtata

SEQ ID NO: 464615 - DNA, 15 bp, Homo sapiens
tggaatattgtatac

SEQ ID NO: 464616 - DNA, 15 bp, Homo sapiens
ggaatattgtatacc

SEQ ID NO: 464617 - DNA, 15 bp, Homo sapiens
gaatattgtatacct

SEQ ID NO: 464618 - DNA, 15 bp, Homo sapiens
aatattgtatacctg

SEQ ID NO: 464619 - DNA, 15 bp, Homo sapiens
atattgtatacctgt

SEQ ID NO: 464620 - DNA, 15 bp, Homo sapiens
tattgtatacctgtg

SEQ ID NO: 464621 - DNA, 15 bp, Homo sapiens
attgtatacctgtga

SEQ ID NO: 464622 - DNA, 15 bp, Homo sapiens
ttgtatacctgtgag

SEQ ID NO: 464623 - DNA, 15 bp, Homo sapiens
tgtatacctgtgagt

SEQ ID NO: 464624 - DNA, 15 bp, Homo sapiens
gtatacctgtgagta

SEQ ID NO: 464625 - DNA, 15 bp, Homo sapiens
tatacctgtgagtac

SEQ ID NO: 464626 - DNA, 15 bp, Homo sapiens
atacctgtgagtact

SEQ ID NO: 464627 - DNA, 15 bp, Homo sapiens
tacctgtgagtacta

SEQ ID NO: 464628 - DNA, 15 bp, Homo sapiens
acctgtgagtactaa

SEQ ID NO: 464629 - DNA, 15 bp, Homo sapiens
cctgtgagtactaac

SEQ ID NO: 464630 - DNA, 15 bp, Homo sapiens
ctgtgagtactaacc

SEQ ID NO: 464631 - DNA, 15 bp, Homo sapiens
tgtgagtactaaccc

SEQ ID NO: 464632 - DNA, 15 bp, Homo sapiens
gtgagtactaaccca

SEQ ID NO: 464633 - DNA, 15 bp, Homo sapiens
tgagtactaacccac

SEQ ID NO: 464634 - DNA, 15 bp, Homo sapiens
gagtactaacccact

SEQ ID NO: 464635 - DNA, 15 bp, Homo sapiens
agtactaacccactg

SEQ ID NO: 464636 - DNA, 15 bp, Homo sapiens
gtactaacccactgt

SEQ ID NO: 464637 - DNA, 15 bp, Homo sapiens
tactaacccactgtt

SEQ ID NO: 464638 - DNA, 15 bp, Homo sapiens
actaacccactgttt

SEQ ID NO: 464639 - DNA, 15 bp, Homo sapiens
ctaacccactgtttt

SEQ ID NO: 464640 - DNA, 15 bp, Homo sapiens
taacccactgttttg

SEQ ID NO: 464641 - DNA, 15 bp, Homo sapiens
aacccactgttttgt

SEQ ID NO: 464642 - DNA, 15 bp, Homo sapiens
acccactgttttgtt

SEQ ID NO: 464643 - DNA, 15 bp, Homo sapiens
cccactgttttgttt

SEQ ID NO: 464644 - DNA, 15 bp, Homo sapiens
ccactgttttgtttt

SEQ ID NO: 464645 - DNA, 15 bp, Homo sapiens
cactgttttgttttt

SEQ ID NO: 464646 - DNA, 15 bp, Homo sapiens
actgttttgttttta

SEQ ID NO: 464647 - DNA, 15 bp, Homo sapiens
ctgttttgtttttaa

SEQ ID NO: 464648 - DNA, 15 bp, Homo sapiens
tgttttgtttttaat

SEQ ID NO: 464649 - DNA, 15 bp, Homo sapiens
gttttgtttttaata

SEQ ID NO: 464650 - DNA, 15 bp, Homo sapiens
ttttgtttttaatac

SEQ ID NO: 464651 - DNA, 15 bp, Homo sapiens
tttgtttttaataca

SEQ ID NO: 464652 - DNA, 15 bp, Homo sapiens
ttgtttttaatacat

SEQ ID NO: 464653 - DNA, 15 bp, Homo sapiens
tgtttttaatacatt

SEQ ID NO: 464654 - DNA, 15 bp, Homo sapiens
gtttttaatacattg

SEQ ID NO: 464655 - DNA, 15 bp, Homo sapiens
tttttaatacattgc

SEQ ID NO: 464656 - DNA, 15 bp, Homo sapiens
ttttaatacattgcc

SEQ ID NO: 464657 - DNA, 15 bp, Homo sapiens
tttaatacattgcca

SEQ ID NO: 464658 - DNA, 15 bp, Homo sapiens
ttaatacattgccat

SEQ ID NO: 464659 - DNA, 15 bp, Homo sapiens
taatacattgccatt

SEQ ID NO: 464660 - DNA, 15 bp, Homo sapiens
aatacattgccattg

SEQ ID NO: 464661 - DNA, 15 bp, Homo sapiens
atacattgccattga

SEQ ID NO: 464662 - DNA, 15 bp, Homo sapiens
tacattgccattgaa

SEQ ID NO: 464663 - DNA, 15 bp, Homo sapiens
acattgccattgaat

SEQ ID NO: 464664 - DNA, 15 bp, Homo sapiens
cattgccattgaatt

SEQ ID NO: 464665 - DNA, 15 bp, Homo sapiens
attgccattgaatta

SEQ ID NO: 464666 - DNA, 15 bp, Homo sapiens
ttgccattgaattaa

SEQ ID NO: 464667 - DNA, 15 bp, Homo sapiens
tgccattgaattaac

SEQ ID NO: 464668 - DNA, 15 bp, Homo sapiens
gccattgaattaact

SEQ ID NO: 464669 - DNA, 15 bp, Homo sapiens
ccattgaattaacta

SEQ ID NO: 464670 - DNA, 15 bp, Homo sapiens
cattgaattaactag

SEQ ID NO: 464671 - DNA, 15 bp, Homo sapiens
attgaattaactagt

SEQ ID NO: 464672 - DNA, 15 bp, Homo sapiens
ttgaattaactagta

SEQ ID NO: 464673 - DNA, 15 bp, Homo sapiens
tgaattaactagtat

SEQ ID NO: 464674 - DNA, 15 bp, Homo sapiens
gaattaactagtatc

SEQ ID NO: 464675 - DNA, 15 bp, Homo sapiens
aattaactagtatct

SEQ ID NO: 464676 - DNA, 15 bp, Homo sapiens
attaactagtatcta

SEQ ID NO: 464677 - DNA, 15 bp, Homo sapiens
ttaactagtatctaa

SEQ ID NO: 464678 - DNA, 15 bp, Homo sapiens
taactagtatctaaa

SEQ ID NO: 464679 - DNA, 15 bp, Homo sapiens
aactagtatctaaaa

SEQ ID NO: 464680 - DNA, 15 bp, Homo sapiens
actagtatctaaaat

SEQ ID NO: 464681 - DNA, 15 bp, Homo sapiens
ctagtatctaaaatt

SEQ ID NO: 464682 - DNA, 15 bp, Homo sapiens
tagtatctaaaattt

SEQ ID NO: 464683 - DNA, 15 bp, Homo sapiens
agtatctaaaatttt

SEQ ID NO: 464684 - DNA, 15 bp, Homo sapiens
gtatctaaaatttta

SEQ ID NO: 464685 - DNA, 15 bp, Homo sapiens
tatctaaaattttat

SEQ ID NO: 464686 - DNA, 15 bp, Homo sapiens
atctaaaattttatt

SEQ ID NO: 464687 - DNA, 15 bp, Homo sapiens
ctaaaattttattat

SEQ ID NO: 464688 - DNA, 15 bp, Homo sapiens
taaaattttattatt

SEQ ID NO: 464689 - DNA, 15 bp, Homo sapiens
aaaattttattattt

SEQ ID NO: 464690 - DNA, 15 bp, Homo sapiens
aaattttattattta

SEQ ID NO: 464691 - DNA, 15 bp, Homo sapiens
aattttattatttat

SEQ ID NO: 464692 - DNA, 15 bp, Homo sapiens
ttttattatttattt

SEQ ID NO: 464693 - DNA, 15 bp, Homo sapiens
tttattatttattta

SEQ ID NO: 464694 - DNA, 15 bp, Homo sapiens
ttattatttatttag

SEQ ID NO: 464695 - DNA, 15 bp, Homo sapiens
tattatttatttaga

SEQ ID NO: 464696 - DNA, 15 bp, Homo sapiens
attatttatttagac

SEQ ID NO: 464697 - DNA, 15 bp, Homo sapiens
ttatttatttagact

SEQ ID NO: 464698 - DNA, 15 bp, Homo sapiens
tatttatttagactt

SEQ ID NO: 464699 - DNA, 15 bp, Homo sapiens
atttatttagactta

SEQ ID NO: 464700 - DNA, 15 bp, Homo sapiens
tttatttagacttaa

SEQ ID NO: 464701 - DNA, 15 bp, Homo sapiens
ttatttagacttaat

SEQ ID NO: 464702 - DNA, 15 bp, Homo sapiens
tatttagacttaatc

SEQ ID NO: 464703 - DNA, 15 bp, Homo sapiens
atttagacttaatct

SEQ ID NO: 464704 - DNA, 15 bp, Homo sapiens
tttagacttaatctt

SEQ ID NO: 464705 - DNA, 15 bp, Homo sapiens
ttagacttaatcttt

SEQ ID NO: 464706 - DNA, 15 bp, Homo sapiens
tagacttaatctttt

SEQ ID NO: 464707 - DNA, 15 bp, Homo sapiens
agacttaatcttttt

SEQ ID NO: 464708 - DNA, 15 bp, Homo sapiens
gacttaatctttttt

SEQ ID NO: 464709 - DNA, 15 bp, Homo sapiens
acttaatcttttttg

SEQ ID NO: 464710 - DNA, 15 bp, Homo sapiens
cttaatcttttttga

SEQ ID NO: 464711 - DNA, 15 bp, Homo sapiens
ttaatcttttttgaa

SEQ ID NO: 464712 - DNA, 15 bp, Homo sapiens
taatcttttttgaaa

SEQ ID NO: 464713 - DNA, 15 bp, Homo sapiens
aatcttttttgaaaa

SEQ ID NO: 464714 - DNA, 15 bp, Homo sapiens
atcttttttgaaaaa

SEQ ID NO: 464715 - DNA, 15 bp, Homo sapiens
cttttttgaaaaaat

SEQ ID NO: 464716 - DNA, 15 bp, Homo sapiens
ttttttgaaaaaata

SEQ ID NO: 464717 - DNA, 15 bp, Homo sapiens
tttttgaaaaaatat

SEQ ID NO: 464718 - DNA, 15 bp, Homo sapiens
ttttgaaaaaatatc

SEQ ID NO: 464719 - DNA, 15 bp, Homo sapiens
tttgaaaaaatatca

SEQ ID NO: 464720 - DNA, 15 bp, Homo sapiens
ttgaaaaaatatcac

SEQ ID NO: 464721 - DNA, 15 bp, Homo sapiens
tgaaaaaatatcact

SEQ ID NO: 464722 - DNA, 15 bp, Homo sapiens
gaaaaaatatcactt

SEQ ID NO: 464723 - DNA, 15 bp, Homo sapiens
aaaaaatatcacttt

SEQ ID NO: 464724 - DNA, 15 bp, Homo sapiens
aaaaatatcactttg

SEQ ID NO: 464725 - DNA, 15 bp, Homo sapiens
aaaatatcactttga

SEQ ID NO: 464726 - DNA, 15 bp, Homo sapiens
aaatatcactttgaa

SEQ ID NO: 464727 - DNA, 15 bp, Homo sapiens
aatatcactttgaag

SEQ ID NO: 464728 - DNA, 15 bp, Homo sapiens
atatcactttgaaga

SEQ ID NO: 464729 - DNA, 15 bp, Homo sapiens
tatcactttgaagat

SEQ ID NO: 464730 - DNA, 15 bp, Homo sapiens
atcactttgaagatt

SEQ ID NO: 464731 - DNA, 15 bp, Homo sapiens
tcactttgaagattt

SEQ ID NO: 464732 - DNA, 15 bp, Homo sapiens
cactttgaagatttt

SEQ ID NO: 464733 - DNA, 15 bp, Homo sapiens
actttgaagattttt

SEQ ID NO: 464734 - DNA, 15 bp, Homo sapiens
ctttgaagatttttt

SEQ ID NO: 464735 - DNA, 15 bp, Homo sapiens
tttgaagattttttt

SEQ ID NO: 464736 - DNA, 15 bp, Homo sapiens
ttgaagatttttttt

SEQ ID NO: 464737 - DNA, 15 bp, Homo sapiens
tgaagattttttttt

SEQ ID NO: 464738 - DNA, 15 bp, Homo sapiens
gaagatttttttttt

SEQ ID NO: 464739 - DNA, 15 bp, Homo sapiens
aagattttttttttc

SEQ ID NO: 464740 - DNA, 15 bp, Homo sapiens
agattttttttttct

SEQ ID NO: 464741 - DNA, 15 bp, Homo sapiens
gattttttttttctt

SEQ ID NO: 464742 - DNA, 15 bp, Homo sapiens
attttttttttcttt

SEQ ID NO: 464743 - DNA, 15 bp, Homo sapiens
ttttttcttttaagt

SEQ ID NO: 464744 - DNA, 15 bp, Homo sapiens
tttttcttttaagta

SEQ ID NO: 464745 - DNA, 15 bp, Homo sapiens
ttttcttttaagtaa

SEQ ID NO: 464746 - DNA, 15 bp, Homo sapiens
tttcttttaagtaaa

SEQ ID NO: 464747 - DNA, 15 bp, Homo sapiens
ttcttttaagtaaac

SEQ ID NO: 464748 - DNA, 15 bp, Homo sapiens
tcttttaagtaaact

SEQ ID NO: 464749 - DNA, 15 bp, Homo sapiens
cttttaagtaaactc

SEQ ID NO: 464750 - DNA, 15 bp, Homo sapiens
ttttaagtaaactca

SEQ ID NO: 464751 - DNA, 15 bp, Homo sapiens
tttaagtaaactcat

SEQ ID NO: 464752 - DNA, 15 bp, Homo sapiens
ttaagtaaactcatt

SEQ ID NO: 464753 - DNA, 15 bp, Homo sapiens
taagtaaactcattt

SEQ ID NO: 464754 - DNA, 15 bp, Homo sapiens
aagtaaactcattta

SEQ ID NO: 464755 - DNA, 15 bp, Homo sapiens
agtaaactcatttat

SEQ ID NO: 464756 - DNA, 15 bp, Homo sapiens
gtaaactcatttatg

SEQ ID NO: 464757 - DNA, 15 bp, Homo sapiens
taaactcatttatgt

SEQ ID NO: 464758 - DNA, 15 bp, Homo sapiens
aaactcatttatgtt

SEQ ID NO: 464759 - DNA, 15 bp, Homo sapiens
aactcatttatgttg

SEQ ID NO: 464760 - DNA, 15 bp, Homo sapiens
actcatttatgttga

SEQ ID NO: 464761 - DNA, 15 bp, Homo sapiens
ctcatttatgttgaa

SEQ ID NO: 464762 - DNA, 15 bp, Homo sapiens
tcatttatgttgaat

SEQ ID NO: 464763 - DNA, 15 bp, Homo sapiens
catttatgttgaatt

SEQ ID NO: 464764 - DNA, 15 bp, Homo sapiens
atttatgttgaatta

SEQ ID NO: 464765 - DNA, 15 bp, Homo sapiens
tttatgttgaattaa

SEQ ID NO: 464766 - DNA, 15 bp, Homo sapiens
ttatgttgaattaat

SEQ ID NO: 464767 - DNA, 15 bp, Homo sapiens
tatgttgaattaatt

SEQ ID NO: 464768 - DNA, 15 bp, Homo sapiens
atgttgaattaatta

SEQ ID NO: 464769 - DNA, 15 bp, Homo sapiens
tgttgaattaattag

SEQ ID NO: 464770 - DNA, 15 bp, Homo sapiens
gttgaattaattagt

SEQ ID NO: 464771 - DNA, 15 bp, Homo sapiens
ttgaattaattagtg

SEQ ID NO: 464772 - DNA, 15 bp, Homo sapiens
tgaattaattagtgc

SEQ ID NO: 464773 - DNA, 15 bp, Homo sapiens
gaattaattagtgca

SEQ ID NO: 464774 - DNA, 15 bp, Homo sapiens
aattaattagtgcag

SEQ ID NO: 464775 - DNA, 15 bp, Homo sapiens
attaattagtgcaga

SEQ ID NO: 464776 - DNA, 15 bp, Homo sapiens
ttaattagtgcagaa

SEQ ID NO: 464777 - DNA, 15 bp, Homo sapiens
taattagtgcagaaa

SEQ ID NO: 464778 - DNA, 15 bp, Homo sapiens
aattagtgcagaaaa

SEQ ID NO: 464779 - DNA, 15 bp, Homo sapiens
attagtgcagaaaaa

SEQ ID NO: 464780 - DNA, 15 bp, Homo sapiens
ttagtgcagaaaaaa

SEQ ID NO: 464781 - DNA, 15 bp, Homo sapiens
tagtgcagaaaaaaa

SEQ ID NO: 464782 - DNA, 15 bp, Homo sapiens
agtgcagaaaaaaat

SEQ ID NO: 464783 - DNA, 15 bp, Homo sapiens
gtgcagaaaaaaata

SEQ ID NO: 464784 - DNA, 15 bp, Homo sapiens
tgcagaaaaaaatat

SEQ ID NO: 464785 - DNA, 15 bp, Homo sapiens
gcagaaaaaaatatt

SEQ ID NO: 464786 - DNA, 15 bp, Homo sapiens
cagaaaaaaatatta

SEQ ID NO: 464787 - DNA, 15 bp, Homo sapiens
agaaaaaaatattaa

SEQ ID NO: 464788 - DNA, 15 bp, Homo sapiens
gaaaaaaatattaac

SEQ ID NO: 464789 - DNA, 15 bp, Homo sapiens
aaaaaaatattaact

SEQ ID NO: 464790 - DNA, 15 bp, Homo sapiens
aaaaaatattaactt

SEQ ID NO: 464791 - DNA, 15 bp, Homo sapiens
aaaaatattaacttt

SEQ ID NO: 464792 - DNA, 15 bp, Homo sapiens
aaaatattaactttt

SEQ ID NO: 464793 - DNA, 15 bp, Homo sapiens
aaatattaacttttt

SEQ ID NO: 464794 - DNA, 15 bp, Homo sapiens
aatattaactttttt

SEQ ID NO: 464795 - DNA, 15 bp, Homo sapiens
atattaactttttta

SEQ ID NO: 464796 - DNA, 15 bp, Homo sapiens
tattaacttttttaa

SEQ ID NO: 464797 - DNA, 15 bp, Homo sapiens
attaacttttttaaa

SEQ ID NO: 464798 - DNA, 15 bp, Homo sapiens
ttaacttttttaaat

SEQ ID NO: 464799 - DNA, 15 bp, Homo sapiens
taacttttttaaata

SEQ ID NO: 464800 - DNA, 15 bp, Homo sapiens
aacttttttaaatat

SEQ ID NO: 464801 - DNA, 15 bp, Homo sapiens
acttttttaaatatc

SEQ ID NO: 464802 - DNA, 15 bp, Homo sapiens
cttttttaaatatct

SEQ ID NO: 464803 - DNA, 15 bp, Homo sapiens
ttttttaaatatctg

SEQ ID NO: 464804 - DNA, 15 bp, Homo sapiens
tttttaaatatctgt

SEQ ID NO: 464805 - DNA, 15 bp, Homo sapiens
ttttaaatatctgtg

SEQ ID NO: 464806 - DNA, 15 bp, Homo sapiens
tttaaatatctgtgt

SEQ ID NO: 464807 - DNA, 15 bp, Homo sapiens
ttaaatatctgtgtt

SEQ ID NO: 464808 - DNA, 15 bp, Homo sapiens
taaatatctgtgttt

SEQ ID NO: 464809 - DNA, 15 bp, Homo sapiens
aaatatctgtgtttt

SEQ ID NO: 464810 - DNA, 15 bp, Homo sapiens
aatatctgtgttttg

SEQ ID NO: 464811 - DNA, 15 bp, Homo sapiens
atatctgtgttttga

SEQ ID NO: 464812 - DNA, 15 bp, Homo sapiens
tatctgtgttttgat

SEQ ID NO: 464813 - DNA, 15 bp, Homo sapiens
atctgtgttttgatt

SEQ ID NO: 464814 - DNA, 15 bp, Homo sapiens
tctgtgttttgattt

SEQ ID NO: 464815 - DNA, 15 bp, Homo sapiens
ctgtgttttgatttt

SEQ ID NO: 464816 - DNA, 15 bp, Homo sapiens
tgtgttttgatttta

SEQ ID NO: 464817 - DNA, 15 bp, Homo sapiens
gtgttttgattttaa

SEQ ID NO: 464818 - DNA, 15 bp, Homo sapiens
tgttttgattttaaa

SEQ ID NO: 464819 - DNA, 15 bp, Homo sapiens
gttttgattttaaac

SEQ ID NO: 464820 - DNA, 15 bp, Homo sapiens
ttttgattttaaact

SEQ ID NO: 464821 - DNA, 15 bp, Homo sapiens
tttgattttaaactt

SEQ ID NO: 464822 - DNA, 15 bp, Homo sapiens
ttgattttaaacttt

SEQ ID NO: 464823 - DNA, 15 bp, Homo sapiens
tgattttaaactttt

SEQ ID NO: 464824 - DNA, 15 bp, Homo sapiens
gattttaaacttttt

SEQ ID NO: 464825 - DNA, 15 bp, Homo sapiens
attttaaactttttt

SEQ ID NO: 464826 - DNA, 15 bp, Homo sapiens
ttttaaacttttttg

SEQ ID NO: 464827 - DNA, 15 bp, Homo sapiens
tttaaacttttttgg

SEQ ID NO: 464828 - DNA, 15 bp, Homo sapiens
ttaaacttttttggt

SEQ ID NO: 464829 - DNA, 15 bp, Homo sapiens
taaacttttttggta

SEQ ID NO: 464830 - DNA, 15 bp, Homo sapiens
aaacttttttggtag

SEQ ID NO: 464831 - DNA, 15 bp, Homo sapiens
aacttttttggtagc

SEQ ID NO: 464832 - DNA, 15 bp, Homo sapiens
acttttttggtagca

SEQ ID NO: 464833 - DNA, 15 bp, Homo sapiens
cttttttggtagcaa

SEQ ID NO: 464834 - DNA, 15 bp, Homo sapiens
ttttttggtagcaaa

SEQ ID NO: 464835 - DNA, 15 bp, Homo sapiens
tttttggtagcaaat

SEQ ID NO: 464836 - DNA, 15 bp, Homo sapiens
ttttggtagcaaatt

SEQ ID NO: 464837 - DNA, 15 bp, Homo sapiens
tttggtagcaaattc

SEQ ID NO: 464838 - DNA, 15 bp, Homo sapiens
ttggtagcaaattct

SEQ ID NO: 464839 - DNA, 15 bp, Homo sapiens
tggtagcaaattctt

SEQ ID NO: 464840 - DNA, 15 bp, Homo sapiens
ggtagcaaattcttt

SEQ ID NO: 464841 - DNA, 15 bp, Homo sapiens
gtagcaaattctttt

SEQ ID NO: 464842 - DNA, 15 bp, Homo sapiens
tagcaaattctttta

SEQ ID NO: 464843 - DNA, 15 bp, Homo sapiens
agcaaattcttttaa

SEQ ID NO: 464844 - DNA, 15 bp, Homo sapiens
gcaaattcttttaag

SEQ ID NO: 464845 - DNA, 15 bp, Homo sapiens
caaattcttttaaga

SEQ ID NO: 464846 - DNA, 15 bp, Homo sapiens
aaattcttttaagag

SEQ ID NO: 464847 - DNA, 15 bp, Homo sapiens
aattcttttaagagc

SEQ ID NO: 464848 - DNA, 15 bp, Homo sapiens
attcttttaagagct

SEQ ID NO: 464849 - DNA, 15 bp, Homo sapiens
ttcttttaagagctg

SEQ ID NO: 464850 - DNA, 15 bp, Homo sapiens
tcttttaagagctga

SEQ ID NO: 464851 - DNA, 15 bp, Homo sapiens
cttttaagagctgat

SEQ ID NO: 464852 - DNA, 15 bp, Homo sapiens
ttttaagagctgata

SEQ ID NO: 464853 - DNA, 15 bp, Homo sapiens
tttaagagctgatac

SEQ ID NO: 464854 - DNA, 15 bp, Homo sapiens
ttaagagctgatact

SEQ ID NO: 464855 - DNA, 15 bp, Homo sapiens
taagagctgatactg

SEQ ID NO: 464856 - DNA, 15 bp, Homo sapiens
aagagctgatactga

SEQ ID NO: 464857 - DNA, 15 bp, Homo sapiens
agagctgatactgac

SEQ ID NO: 464858 - DNA, 15 bp, Homo sapiens
gagctgatactgacc

SEQ ID NO: 464859 - DNA, 15 bp, Homo sapiens
agctgatactgacct

SEQ ID NO: 464860 - DNA, 15 bp, Homo sapiens
gctgatactgaccta

SEQ ID NO: 464861 - DNA, 15 bp, Homo sapiens
ctgatactgacctac

SEQ ID NO: 464862 - DNA, 15 bp, Homo sapiens
tgatactgacctaca

SEQ ID NO: 464863 - DNA, 15 bp, Homo sapiens
gatactgacctacac

SEQ ID NO: 464864 - DNA, 15 bp, Homo sapiens
atactgacctacact

SEQ ID NO: 464865 - DNA, 15 bp, Homo sapiens
tactgacctacactg

SEQ ID NO: 464866 - DNA, 15 bp, Homo sapiens
actgacctacactga

SEQ ID NO: 464867 - DNA, 15 bp, Homo sapiens
ctgacctacactgaa

SEQ ID NO: 464868 - DNA, 15 bp, Homo sapiens
tgacctacactgaaa

SEQ ID NO: 464869 - DNA, 15 bp, Homo sapiens
gacctacactgaaaa

SEQ ID NO: 464870 - DNA, 15 bp, Homo sapiens
acctacactgaaaat

SEQ ID NO: 464871 - DNA, 15 bp, Homo sapiens
cctacactgaaaatg

SEQ ID NO: 464872 - DNA, 15 bp, Homo sapiens
ctacactgaaaatga

SEQ ID NO: 464873 - DNA, 15 bp, Homo sapiens
tacactgaaaatgat

SEQ ID NO: 464874 - DNA, 15 bp, Homo sapiens
acactgaaaatgata

SEQ ID NO: 464875 - DNA, 15 bp, Homo sapiens
cactgaaaatgatac

SEQ ID NO: 464876 - DNA, 15 bp, Homo sapiens
actgaaaatgatact

SEQ ID NO: 464877 - DNA, 15 bp, Homo sapiens
ctgaaaatgatacta

SEQ ID NO: 464878 - DNA, 15 bp, Homo sapiens
tgaaaatgatactat

SEQ ID NO: 464879 - DNA, 15 bp, Homo sapiens
gaaaatgatactatg

SEQ ID NO: 464880 - DNA, 15 bp, Homo sapiens
aaaatgatactatgt

SEQ ID NO: 464881 - DNA, 15 bp, Homo sapiens
aaatgatactatgta

SEQ ID NO: 464882 - DNA, 15 bp, Homo sapiens
aatgatactatgtaa

SEQ ID NO: 464883 - DNA, 15 bp, Homo sapiens
atgatactatgtaac

SEQ ID NO: 464884 - DNA, 15 bp, Homo sapiens
tgatactatgtaacg

SEQ ID NO: 464885 - DNA, 15 bp, Homo sapiens
gatactatgtaacga

SEQ ID NO: 464886 - DNA, 15 bp, Homo sapiens
atactatgtaacgaa

SEQ ID NO: 464887 - DNA, 15 bp, Homo sapiens
tactatgtaacgaaa

SEQ ID NO: 464888 - DNA, 15 bp, Homo sapiens
actatgtaacgaaaa

SEQ ID NO: 464889 - DNA, 15 bp, Homo sapiens
ctatgtaacgaaaaa

SEQ ID NO: 464890 - DNA, 15 bp, Homo sapiens
tatgtaacgaaaaat

SEQ ID NO: 464891 - DNA, 15 bp, Homo sapiens
atgtaacgaaaaatc

SEQ ID NO: 464892 - DNA, 15 bp, Homo sapiens
tgtaacgaaaaatca

SEQ ID NO: 464893 - DNA, 15 bp, Homo sapiens
gtaacgaaaaatcat

SEQ ID NO: 464894 - DNA, 15 bp, Homo sapiens
taacgaaaaatcatg

SEQ ID NO: 464895 - DNA, 15 bp, Homo sapiens
aacgaaaaatcatgt

SEQ ID NO: 464896 - DNA, 15 bp, Homo sapiens
acgaaaaatcatgtt

SEQ ID NO: 464897 - DNA, 15 bp, Homo sapiens
cgaaaaatcatgttt

SEQ ID NO: 464898 - DNA, 15 bp, Homo sapiens
gaaaaatcatgtttc

SEQ ID NO: 464899 - DNA, 15 bp, Homo sapiens
aaaaatcatgtttct

SEQ ID NO: 464900 - DNA, 15 bp, Homo sapiens
aaaatcatgtttctt

SEQ ID NO: 464901 - DNA, 15 bp, Homo sapiens
aaatcatgtttcttt

SEQ ID NO: 464902 - DNA, 15 bp, Homo sapiens
aatcatgtttctttt

SEQ ID NO: 464903 - DNA, 15 bp, Homo sapiens
atcatgtttctttta

SEQ ID NO: 464904 - DNA, 15 bp, Homo sapiens
tcatgtttcttttag

SEQ ID NO: 464905 - DNA, 15 bp, Homo sapiens
catgtttcttttaga

SEQ ID NO: 464906 - DNA, 15 bp, Homo sapiens
atgtttcttttagac

SEQ ID NO: 464907 - DNA, 15 bp, Homo sapiens
tgtttcttttagaca

SEQ ID NO: 464908 - DNA, 15 bp, Homo sapiens
gtttcttttagacat

SEQ ID NO: 464909 - DNA, 15 bp, Homo sapiens
tttcttttagacata

SEQ ID NO: 464910 - DNA, 15 bp, Homo sapiens
ttcttttagacatat

SEQ ID NO: 464911 - DNA, 15 bp, Homo sapiens
tcttttagacatatt

SEQ ID NO: 464912 - DNA, 15 bp, Homo sapiens
cttttagacatattt

SEQ ID NO: 464913 - DNA, 15 bp, Homo sapiens
ttttagacatattta

SEQ ID NO: 464914 - DNA, 15 bp, Homo sapiens
tttagacatatttat

SEQ ID NO: 464915 - DNA, 15 bp, Homo sapiens
ttagacatatttatg

SEQ ID NO: 464916 - DNA, 15 bp, Homo sapiens
tagacatatttatgc

SEQ ID NO: 464917 - DNA, 15 bp, Homo sapiens
agacatatttatgct

SEQ ID NO: 464918 - DNA, 15 bp, Homo sapiens
gacatatttatgctt

SEQ ID NO: 464919 - DNA, 15 bp, Homo sapiens
acatatttatgcttt

SEQ ID NO: 464920 - DNA, 15 bp, Homo sapiens
catatttatgctttc

SEQ ID NO: 464921 - DNA, 15 bp, Homo sapiens
atatttatgctttca

SEQ ID NO: 464922 - DNA, 15 bp, Homo sapiens
tatttatgctttcat

SEQ ID NO: 464923 - DNA, 15 bp, Homo sapiens
atttatgctttcata

SEQ ID NO: 464924 - DNA, 15 bp, Homo sapiens
tttatgctttcatag

SEQ ID NO: 464925 - DNA, 15 bp, Homo sapiens
ttatgctttcatagt

SEQ ID NO: 464926 - DNA, 15 bp, Homo sapiens
tatgctttcatagtt

SEQ ID NO: 464927 - DNA, 15 bp, Homo sapiens
atgctttcatagtta

SEQ ID NO: 464928 - DNA, 15 bp, Homo sapiens
tgctttcatagttaa

SEQ ID NO: 464929 - DNA, 15 bp, Homo sapiens
gctttcatagttaaa

SEQ ID NO: 464930 - DNA, 15 bp, Homo sapiens
ctttcatagttaaat

SEQ ID NO: 464931 - DNA, 15 bp, Homo sapiens
tttcatagttaaata

SEQ ID NO: 464932 - DNA, 15 bp, Homo sapiens
ttcatagttaaatac

SEQ ID NO: 464933 - DNA, 15 bp, Homo sapiens
tcatagttaaatacc

SEQ ID NO: 464934 - DNA, 15 bp, Homo sapiens
catagttaaatacca

SEQ ID NO: 464935 - DNA, 15 bp, Homo sapiens
atagttaaataccat

SEQ ID NO: 464936 - DNA, 15 bp, Homo sapiens
tagttaaataccata

SEQ ID NO: 464937 - DNA, 15 bp, Homo sapiens
agttaaataccatat

SEQ ID NO: 464938 - DNA, 15 bp, Homo sapiens
gttaaataccatatt

SEQ ID NO: 464939 - DNA, 15 bp, Homo sapiens
ttaaataccatattc

SEQ ID NO: 464940 - DNA, 15 bp, Homo sapiens
taaataccatattca

SEQ ID NO: 464941 - DNA, 15 bp, Homo sapiens
aaataccatattcat

SEQ ID NO: 464942 - DNA, 15 bp, Homo sapiens
aataccatattcata

SEQ ID NO: 464943 - DNA, 15 bp, Homo sapiens
ataccatattcatat

SEQ ID NO: 464944 - DNA, 15 bp, Homo sapiens
taccatattcatatt

SEQ ID NO: 464945 - DNA, 15 bp, Homo sapiens
accatattcatatta

SEQ ID NO: 464946 - DNA, 15 bp, Homo sapiens
ccatattcatattag

SEQ ID NO: 464947 - DNA, 15 bp, Homo sapiens
catattcatattagc

SEQ ID NO: 464948 - DNA, 15 bp, Homo sapiens
atattcatattagca

SEQ ID NO: 464949 - DNA, 15 bp, Homo sapiens
tattcatattagcaa

SEQ ID NO: 464950 - DNA, 15 bp, Homo sapiens
attcatattagcaaa

SEQ ID NO: 464951 - DNA, 15 bp, Homo sapiens
ttcatattagcaaaa

SEQ ID NO: 464952 - DNA, 15 bp, Homo sapiens
tcatattagcaaaat

SEQ ID NO: 464953 - DNA, 15 bp, Homo sapiens
catattagcaaaata

SEQ ID NO: 464954 - DNA, 15 bp, Homo sapiens
atattagcaaaatac

SEQ ID NO: 464955 - DNA, 15 bp, Homo sapiens
tattagcaaaataca

SEQ ID NO: 464956 - DNA, 15 bp, Homo sapiens
attagcaaaatacag

SEQ ID NO: 464957 - DNA, 15 bp, Homo sapiens
ttagcaaaatacaga

SEQ ID NO: 464958 - DNA, 15 bp, Homo sapiens
tagcaaaatacagaa

SEQ ID NO: 464959 - DNA, 15 bp, Homo sapiens
agcaaaatacagaaa

SEQ ID NO: 464960 - DNA, 15 bp, Homo sapiens
caaaatacagaaaat

SEQ ID NO: 464961 - DNA, 15 bp, Homo sapiens
aaaatacagaaaatg

SEQ ID NO: 464962 - DNA, 15 bp, Homo sapiens
aaatacagaaaatgg

SEQ ID NO: 464963 - DNA, 15 bp, Homo sapiens
aatacagaaaatgga

SEQ ID NO: 464964 - DNA, 15 bp, Homo sapiens
atacagaaaatggag

SEQ ID NO: 464965 - DNA, 15 bp, Homo sapiens
tacagaaaatggaga

SEQ ID NO: 464966 - DNA, 15 bp, Homo sapiens
acagaaaatggagat

SEQ ID NO: 464967 - DNA, 15 bp, Homo sapiens
cagaaaatggagata

SEQ ID NO: 464968 - DNA, 15 bp, Homo sapiens
agaaaatggagatat

SEQ ID NO: 464969 - DNA, 15 bp, Homo sapiens
gaaaatggagatatt

SEQ ID NO: 464970 - DNA, 15 bp, Homo sapiens
aaaatggagatatta

SEQ ID NO: 464971 - DNA, 15 bp, Homo sapiens
aaatggagatattaa

SEQ ID NO: 464972 - DNA, 15 bp, Homo sapiens
aatggagatattaaa

SEQ ID NO: 464973 - DNA, 15 bp, Homo sapiens
atggagatattaaaa

SEQ ID NO: 464974 - DNA, 15 bp, Homo sapiens
tggagatattaaaaa

SEQ ID NO: 464975 - DNA, 15 bp, Homo sapiens
ggagatattaaaaat

SEQ ID NO: 464976 - DNA, 15 bp, Homo sapiens
gagatattaaaaata

SEQ ID NO: 464977 - DNA, 15 bp, Homo sapiens
agatattaaaaatat

SEQ ID NO: 464978 - DNA, 15 bp, Homo sapiens
gatattaaaaatata

SEQ ID NO: 464979 - DNA, 15 bp, Homo sapiens
atattaaaaatatag

SEQ ID NO: 464980 - DNA, 15 bp, Homo sapiens
tattaaaaatatagt

SEQ ID NO: 464981 - DNA, 15 bp, Homo sapiens
attaaaaatatagtt

SEQ ID NO: 464982 - DNA, 15 bp, Homo sapiens
ttaaaaatatagttc

SEQ ID NO: 464983 - DNA, 15 bp, Homo sapiens
taaaaatatagttcc

SEQ ID NO: 464984 - DNA, 15 bp, Homo sapiens
aaaaatatagttcct

SEQ ID NO: 464985 - DNA, 15 bp, Homo sapiens
aaaatatagttccta

SEQ ID NO: 464986 - DNA, 15 bp, Homo sapiens
aaatatagttcctaa

SEQ ID NO: 464987 - DNA, 15 bp, Homo sapiens
aatatagttcctaac

SEQ ID NO: 464988 - DNA, 15 bp, Homo sapiens
atatagttcctaact

SEQ ID NO: 464989 - DNA, 15 bp, Homo sapiens
tatagttcctaactc

SEQ ID NO: 464990 - DNA, 15 bp, Homo sapiens
atagttcctaactct

SEQ ID NO: 464991 - DNA, 15 bp, Homo sapiens
tagttcctaactcta

SEQ ID NO: 464992 - DNA, 15 bp, Homo sapiens
agttcctaactctag

SEQ ID NO: 464993 - DNA, 15 bp, Homo sapiens
gttcctaactctagc

SEQ ID NO: 464994 - DNA, 15 bp, Homo sapiens
ttcctaactctagct

SEQ ID NO: 464995 - DNA, 15 bp, Homo sapiens
tcctaactctagctc

SEQ ID NO: 464996 - DNA, 15 bp, Homo sapiens
cctaactctagctcc

SEQ ID NO: 464997 - DNA, 15 bp, Homo sapiens
ctaactctagctcct

SEQ ID NO: 464998 - DNA, 15 bp, Homo sapiens
taactctagctcctg

SEQ ID NO: 464999 - DNA, 15 bp, Homo sapiens
aactctagctcctga

SEQ ID NO: 465000 - DNA, 15 bp, Homo sapiens
actctagctcctgaa

SEQ ID NO: 465001 - DNA, 15 bp, Homo sapiens
ctctagctcctgaat

SEQ ID NO: 465002 - DNA, 15 bp, Homo sapiens
tctagctcctgaata

SEQ ID NO: 465003 - DNA, 15 bp, Homo sapiens
ctagctcctgaataa

SEQ ID NO: 465004 - DNA, 15 bp, Homo sapiens
tagctcctgaataaa

SEQ ID NO: 465005 - DNA, 15 bp, Homo sapiens
agctcctgaataaac

SEQ ID NO: 465006 - DNA, 15 bp, Homo sapiens
gctcctgaataaact

SEQ ID NO: 465007 - DNA, 15 bp, Homo sapiens
ctcctgaataaacta

SEQ ID NO: 465008 - DNA, 15 bp, Homo sapiens
tcctgaataaactac

SEQ ID NO: 465009 - DNA, 15 bp, Homo sapiens
cctgaataaactacc

SEQ ID NO: 465010 - DNA, 15 bp, Homo sapiens
ctgaataaactacct

SEQ ID NO: 465011 - DNA, 15 bp, Homo sapiens
tgaataaactacctt

SEQ ID NO: 465012 - DNA, 15 bp, Homo sapiens
gaataaactaccttc

SEQ ID NO: 465013 - DNA, 15 bp, Homo sapiens
aataaactaccttct

SEQ ID NO: 465014 - DNA, 15 bp, Homo sapiens
ataaactaccttcta

SEQ ID NO: 465015 - DNA, 15 bp, Homo sapiens
taaactaccttctaa

SEQ ID NO: 465016 - DNA, 15 bp, Homo sapiens
aaactaccttctaat

SEQ ID NO: 465017 - DNA, 15 bp, Homo sapiens
aactaccttctaatt

SEQ ID NO: 465018 - DNA, 15 bp, Homo sapiens
actaccttctaattt

SEQ ID NO: 465019 - DNA, 15 bp, Homo sapiens
ctaccttctaatttt

SEQ ID NO: 465020 - DNA, 15 bp, Homo sapiens
taccttctaattttt

SEQ ID NO: 465021 - DNA, 15 bp, Homo sapiens
accttctaatttttc

SEQ ID NO: 465022 - DNA, 15 bp, Homo sapiens
ccttctaatttttcc

SEQ ID NO: 465023 - DNA, 15 bp, Homo sapiens
cttctaatttttcca

SEQ ID NO: 465024 - DNA, 15 bp, Homo sapiens
ttctaatttttccat

SEQ ID NO: 465025 - DNA, 15 bp, Homo sapiens
tctaatttttccata

SEQ ID NO: 465026 - DNA, 15 bp, Homo sapiens
ctaatttttccatat

SEQ ID NO: 465027 - DNA, 15 bp, Homo sapiens
taatttttccatatc

SEQ ID NO: 465028 - DNA, 15 bp, Homo sapiens
aatttttccatatct

SEQ ID NO: 465029 - DNA, 15 bp, Homo sapiens
atttttccatatctc

SEQ ID NO: 465030 - DNA, 15 bp, Homo sapiens
tttttccatatctct

SEQ ID NO: 465031 - DNA, 15 bp, Homo sapiens
ttttccatatctctg

SEQ ID NO: 465032 - DNA, 15 bp, Homo sapiens
tttccatatctctgg

SEQ ID NO: 465033 - DNA, 15 bp, Homo sapiens
ttccatatctctggt

SEQ ID NO: 465034 - DNA, 15 bp, Homo sapiens
tccatatctctggtt

SEQ ID NO: 465035 - DNA, 15 bp, Homo sapiens
ccatatctctggttt

SEQ ID NO: 465036 - DNA, 15 bp, Homo sapiens
catatctctggtttt

SEQ ID NO: 465037 - DNA, 15 bp, Homo sapiens
atatctctggtttta

SEQ ID NO: 465038 - DNA, 15 bp, Homo sapiens
tatctctggttttaa

SEQ ID NO: 465039 - DNA, 15 bp, Homo sapiens
atctctggttttaag

SEQ ID NO: 465040 - DNA, 15 bp, Homo sapiens
tctctggttttaaga

SEQ ID NO: 465041 - DNA, 15 bp, Homo sapiens
ctctggttttaagat

SEQ ID NO: 465042 - DNA, 15 bp, Homo sapiens
tctggttttaagatt

SEQ ID NO: 465043 - DNA, 15 bp, Homo sapiens
ctggttttaagattc

SEQ ID NO: 465044 - DNA, 15 bp, Homo sapiens
tggttttaagattct

SEQ ID NO: 465045 - DNA, 15 bp, Homo sapiens
ggttttaagattcta

SEQ ID NO: 465046 - DNA, 15 bp, Homo sapiens
gttttaagattctat

SEQ ID NO: 465047 - DNA, 15 bp, Homo sapiens
ttttaagattctatt

SEQ ID NO: 465048 - DNA, 15 bp, Homo sapiens
ttaagattctattta

SEQ ID NO: 465049 - DNA, 15 bp, Homo sapiens
taagattctatttat

SEQ ID NO: 465050 - DNA, 15 bp, Homo sapiens
aagattctatttata

SEQ ID NO: 465051 - DNA, 15 bp, Homo sapiens
agattctatttatat

SEQ ID NO: 465052 - DNA, 15 bp, Homo sapiens
gattctatttatatt

SEQ ID NO: 465053 - DNA, 15 bp, Homo sapiens
attctatttatattt

SEQ ID NO: 465054 - DNA, 15 bp, Homo sapiens
ttctatttatattta

SEQ ID NO: 465055 - DNA, 15 bp, Homo sapiens
tctatttatatttat

SEQ ID NO: 465056 - DNA, 15 bp, Homo sapiens
ctatttatatttata

SEQ ID NO: 465057 - DNA, 15 bp, Homo sapiens
tatttatatttatat

SEQ ID NO: 465058 - DNA, 15 bp, Homo sapiens
atttatatttatatt

SEQ ID NO: 465059 - DNA, 15 bp, Homo sapiens
tttatatttatattt

SEQ ID NO: 465060 - DNA, 15 bp, Homo sapiens
ttatatttatattta

SEQ ID NO: 465061 - DNA, 15 bp, Homo sapiens
tatatttatatttat

SEQ ID NO: 465062 - DNA, 15 bp, Homo sapiens
atatttatatttatg

SEQ ID NO: 465063 - DNA, 15 bp, Homo sapiens
tatttatatttatgt

SEQ ID NO: 465064 - DNA, 15 bp, Homo sapiens
atttatatttatgta

SEQ ID NO: 465065 - DNA, 15 bp, Homo sapiens
tttatatttatgtat

SEQ ID NO: 465066 - DNA, 15 bp, Homo sapiens
ttatatttatgtatc

SEQ ID NO: 465067 - DNA, 15 bp, Homo sapiens
tatatttatgtatct

SEQ ID NO: 465068 - DNA, 15 bp, Homo sapiens
atatttatgtatctt

SEQ ID NO: 465069 - DNA, 15 bp, Homo sapiens
tatttatgtatcttt

SEQ ID NO: 465070 - DNA, 15 bp, Homo sapiens
atttatgtatctttt

SEQ ID NO: 465071 - DNA, 15 bp, Homo sapiens
tttatgtatcttttt

SEQ ID NO: 465072 - DNA, 15 bp, Homo sapiens
ttatgtatctttttc

SEQ ID NO: 465073 - DNA, 15 bp, Homo sapiens
tatgtatctttttcc

SEQ ID NO: 465074 - DNA, 15 bp, Homo sapiens
atgtatctttttccc

SEQ ID NO: 465075 - DNA, 15 bp, Homo sapiens
tgtatctttttccct

SEQ ID NO: 465076 - DNA, 15 bp, Homo sapiens
gtatctttttccctg

SEQ ID NO: 465077 - DNA, 15 bp, Homo sapiens
tatctttttccctga

SEQ ID NO: 465078 - DNA, 15 bp, Homo sapiens
atctttttccctgat

SEQ ID NO: 465079 - DNA, 15 bp, Homo sapiens
tctttttccctgata

SEQ ID NO: 465080 - DNA, 15 bp, Homo sapiens
ctttttccctgatat

SEQ ID NO: 465081 - DNA, 15 bp, Homo sapiens
tttttccctgatatt

SEQ ID NO: 465082 - DNA, 15 bp, Homo sapiens
ttttccctgatattt

SEQ ID NO: 465083 - DNA, 15 bp, Homo sapiens
tttccctgatatttt

SEQ ID NO: 465084 - DNA, 15 bp, Homo sapiens
ttccctgatattttt

SEQ ID NO: 465085 - DNA, 15 bp, Homo sapiens
tccctgatatttttc

SEQ ID NO: 465086 - DNA, 15 bp, Homo sapiens
ccctgatatttttca

SEQ ID NO: 465087 - DNA, 15 bp, Homo sapiens
cctgatatttttcac

SEQ ID NO: 465088 - DNA, 15 bp, Homo sapiens
ctgatatttttcact

SEQ ID NO: 465089 - DNA, 15 bp, Homo sapiens
tgatatttttcactc

SEQ ID NO: 465090 - DNA, 15 bp, Homo sapiens
gatatttttcactcg

SEQ ID NO: 465091 - DNA, 15 bp, Homo sapiens
atatttttcactcga

SEQ ID NO: 465092 - DNA, 15 bp, Homo sapiens
tatttttcactcgac

SEQ ID NO: 465093 - DNA, 15 bp, Homo sapiens
atttttcactcgaca

SEQ ID NO: 465094 - DNA, 15 bp, Homo sapiens
tttttcactcgacat

SEQ ID NO: 465095 - DNA, 15 bp, Homo sapiens
ttttcactcgacatt

SEQ ID NO: 465096 - DNA, 15 bp, Homo sapiens
tttcactcgacattc

SEQ ID NO: 465097 - DNA, 15 bp, Homo sapiens
ttcactcgacattcc

SEQ ID NO: 465098 - DNA, 15 bp, Homo sapiens
tcactcgacattcca

SEQ ID NO: 465099 - DNA, 15 bp, Homo sapiens
cactcgacattccat

SEQ ID NO: 465100 - DNA, 15 bp, Homo sapiens
actcgacattccatt

SEQ ID NO: 465101 - DNA, 15 bp, Homo sapiens
ctcgacattccattt

SEQ ID NO: 465102 - DNA, 15 bp, Homo sapiens
tcgacattccatttc

SEQ ID NO: 465103 - DNA, 15 bp, Homo sapiens
cgacattccatttcg

SEQ ID NO: 465104 - DNA, 15 bp, Homo sapiens
gacattccatttcgt

SEQ ID NO: 465105 - DNA, 15 bp, Homo sapiens
acattccatttcgtc

SEQ ID NO: 465106 - DNA, 15 bp, Homo sapiens
cattccatttcgtca

SEQ ID NO: 465107 - DNA, 15 bp, Homo sapiens
attccatttcgtcac

SEQ ID NO: 465108 - DNA, 15 bp, Homo sapiens
ttccatttcgtcaca

SEQ ID NO: 465109 - DNA, 15 bp, Homo sapiens
tccatttcgtcacac

SEQ ID NO: 465110 - DNA, 15 bp, Homo sapiens
ccatttcgtcacaca

SEQ ID NO: 465111 - DNA, 15 bp, Homo sapiens
catttcgtcacacag

SEQ ID NO: 465112 - DNA, 15 bp, Homo sapiens
atttcgtcacacagt

SEQ ID NO: 465113 - DNA, 15 bp, Homo sapiens
tttcgtcacacagtg

SEQ ID NO: 465114 - DNA, 15 bp, Homo sapiens
ttcgtcacacagtgt

SEQ ID NO: 465115 - DNA, 15 bp, Homo sapiens
tcgtcacacagtgta

SEQ ID NO: 465116 - DNA, 15 bp, Homo sapiens
cgtcacacagtgtaa

SEQ ID NO: 465117 - DNA, 15 bp, Homo sapiens
gtcacacagtgtaat

SEQ ID NO: 465118 - DNA, 15 bp, Homo sapiens
tcacacagtgtaatt

SEQ ID NO: 465119 - DNA, 15 bp, Homo sapiens
cacacagtgtaattt

SEQ ID NO: 465120 - DNA, 15 bp, Homo sapiens
acacagtgtaatttt

SEQ ID NO: 465121 - DNA, 15 bp, Homo sapiens
cacagtgtaattttt

SEQ ID NO: 465122 - DNA, 15 bp, Homo sapiens
acagtgtaatttttt

SEQ ID NO: 465123 - DNA, 15 bp, Homo sapiens
cagtgtaattttttt

SEQ ID NO: 465124 - DNA, 15 bp, Homo sapiens
agtgtaatttttttt

SEQ ID NO: 465125 - DNA, 15 bp, Homo sapiens
gtgtaatttttttta

SEQ ID NO: 465126 - DNA, 15 bp, Homo sapiens
tgtaattttttttag

SEQ ID NO: 465127 - DNA, 15 bp, Homo sapiens
gtaattttttttagt

SEQ ID NO: 465128 - DNA, 15 bp, Homo sapiens
taattttttttagtc

SEQ ID NO: 465129 - DNA, 15 bp, Homo sapiens
aattttttttagtca

SEQ ID NO: 465130 - DNA, 15 bp, Homo sapiens
attttttttagtcac

SEQ ID NO: 465131 - DNA, 15 bp, Homo sapiens
ttttttttagtcaca

SEQ ID NO: 465132 - DNA, 15 bp, Homo sapiens
tttttttagtcacaa

SEQ ID NO: 465133 - DNA, 15 bp, Homo sapiens
ttttttagtcacaaa

SEQ ID NO: 465134 - DNA, 15 bp, Homo sapiens
tttttagtcacaaaa

SEQ ID NO: 465135 - DNA, 15 bp, Homo sapiens
ttttagtcacaaaat

SEQ ID NO: 465136 - DNA, 15 bp, Homo sapiens
tttagtcacaaaatt

SEQ ID NO: 465137 - DNA, 15 bp, Homo sapiens
ttagtcacaaaattt

SEQ ID NO: 465138 - DNA, 15 bp, Homo sapiens
tagtcacaaaatttt

SEQ ID NO: 465139 - DNA, 15 bp, Homo sapiens
agtcacaaaattttt

SEQ ID NO: 465140 - DNA, 15 bp, Homo sapiens
gtcacaaaattttta

SEQ ID NO: 465141 - DNA, 15 bp, Homo sapiens
tcacaaaatttttaa

SEQ ID NO: 465142 - DNA, 15 bp, Homo sapiens
cacaaaatttttaat

SEQ ID NO: 465143 - DNA, 15 bp, Homo sapiens
acaaaatttttaatt

SEQ ID NO: 465144 - DNA, 15 bp, Homo sapiens
caaaatttttaattg

SEQ ID NO: 465145 - DNA, 15 bp, Homo sapiens
aaaatttttaattga

SEQ ID NO: 465146 - DNA, 15 bp, Homo sapiens
aaatttttaattgag

SEQ ID NO: 465147 - DNA, 15 bp, Homo sapiens
aatttttaattgagt

SEQ ID NO: 465148 - DNA, 15 bp, Homo sapiens
atttttaattgagtg

SEQ ID NO: 465149 - DNA, 15 bp, Homo sapiens
tttttaattgagtga

SEQ ID NO: 465150 - DNA, 15 bp, Homo sapiens
ttttaattgagtgaa

SEQ ID NO: 465151 - DNA, 15 bp, Homo sapiens
tttaattgagtgaat

SEQ ID NO: 465152 - DNA, 15 bp, Homo sapiens
ttaattgagtgaatt

SEQ ID NO: 465153 - DNA, 15 bp, Homo sapiens
taattgagtgaatta

SEQ ID NO: 465154 - DNA, 15 bp, Homo sapiens
aattgagtgaattac

SEQ ID NO: 465155 - DNA, 15 bp, Homo sapiens
attgagtgaattact

SEQ ID NO: 465156 - DNA, 15 bp, Homo sapiens
ttgagtgaattacta

SEQ ID NO: 465157 - DNA, 15 bp, Homo sapiens
tgagtgaattactac

SEQ ID NO: 465158 - DNA, 15 bp, Homo sapiens
gagtgaattactaca

SEQ ID NO: 465159 - DNA, 15 bp, Homo sapiens
agtgaattactacag

SEQ ID NO: 465160 - DNA, 15 bp, Homo sapiens
gtgaattactacagt

SEQ ID NO: 465161 - DNA, 15 bp, Homo sapiens
tgaattactacagtt

SEQ ID NO: 465162 - DNA, 15 bp, Homo sapiens
gaattactacagttt

SEQ ID NO: 465163 - DNA, 15 bp, Homo sapiens
aattactacagttta

SEQ ID NO: 465164 - DNA, 15 bp, Homo sapiens
attactacagtttac

SEQ ID NO: 465165 - DNA, 15 bp, Homo sapiens
ttactacagtttacc

SEQ ID NO: 465166 - DNA, 15 bp, Homo sapiens
tactacagtttacct

SEQ ID NO: 465167 - DNA, 15 bp, Homo sapiens
actacagtttaccta

SEQ ID NO: 465168 - DNA, 15 bp, Homo sapiens
ctacagtttacctaa

SEQ ID NO: 465169 - DNA, 15 bp, Homo sapiens
tacagtttacctaac

SEQ ID NO: 465170 - DNA, 15 bp, Homo sapiens
acagtttacctaacc

SEQ ID NO: 465171 - DNA, 15 bp, Homo sapiens
cagtttacctaacca

SEQ ID NO: 465172 - DNA, 15 bp, Homo sapiens
agtttacctaaccat

SEQ ID NO: 465173 - DNA, 15 bp, Homo sapiens
gtttacctaaccatt

SEQ ID NO: 465174 - DNA, 15 bp, Homo sapiens
tttacctaaccattc

SEQ ID NO: 465175 - DNA, 15 bp, Homo sapiens
ttacctaaccattcc

SEQ ID NO: 465176 - DNA, 15 bp, Homo sapiens
tacctaaccattccc

SEQ ID NO: 465177 - DNA, 15 bp, Homo sapiens
acctaaccattccct

SEQ ID NO: 465178 - DNA, 15 bp, Homo sapiens
cctaaccattccctg

SEQ ID NO: 465179 - DNA, 15 bp, Homo sapiens
ctaaccattccctga

SEQ ID NO: 465180 - DNA, 15 bp, Homo sapiens
taaccattccctgaa

SEQ ID NO: 465181 - DNA, 15 bp, Homo sapiens
aaccattccctgaaa

SEQ ID NO: 465182 - DNA, 15 bp, Homo sapiens
accattccctgaaat

SEQ ID NO: 465183 - DNA, 15 bp, Homo sapiens
ccattccctgaaatt

SEQ ID NO: 465184 - DNA, 15 bp, Homo sapiens
cattccctgaaattt

SEQ ID NO: 465185 - DNA, 15 bp, Homo sapiens
attccctgaaatttg

SEQ ID NO: 465186 - DNA, 15 bp, Homo sapiens
ttccctgaaatttgg

SEQ ID NO: 465187 - DNA, 15 bp, Homo sapiens
tccctgaaatttgga

SEQ ID NO: 465188 - DNA, 15 bp, Homo sapiens
ccctgaaatttggac

SEQ ID NO: 465189 - DNA, 15 bp, Homo sapiens
cctgaaatttggaca

SEQ ID NO: 465190 - DNA, 15 bp, Homo sapiens
ctgaaatttggacat

SEQ ID NO: 465191 - DNA, 15 bp, Homo sapiens
tgaaatttggacata

SEQ ID NO: 465192 - DNA, 15 bp, Homo sapiens
gaaatttggacatat

SEQ ID NO: 465193 - DNA, 15 bp, Homo sapiens
aaatttggacatata

SEQ ID NO: 465194 - DNA, 15 bp, Homo sapiens
aatttggacatatag

SEQ ID NO: 465195 - DNA, 15 bp, Homo sapiens
atttggacatatagt

SEQ ID NO: 465196 - DNA, 15 bp, Homo sapiens
tttggacatatagtt

SEQ ID NO: 465197 - DNA, 15 bp, Homo sapiens
ttggacatatagttt

SEQ ID NO: 465198 - DNA, 15 bp, Homo sapiens
tggacatatagttta

SEQ ID NO: 465199 - DNA, 15 bp, Homo sapiens
ggacatatagtttat

SEQ ID NO: 465200 - DNA, 15 bp, Homo sapiens
gacatatagtttatt

SEQ ID NO: 465201 - DNA, 15 bp, Homo sapiens
acatatagtttattt

SEQ ID NO: 465202 - DNA, 15 bp, Homo sapiens
catatagtttatttt

SEQ ID NO: 465203 - DNA, 15 bp, Homo sapiens
atatagtttattttc

SEQ ID NO: 465204 - DNA, 15 bp, Homo sapiens
tatagtttattttca

SEQ ID NO: 465205 - DNA, 15 bp, Homo sapiens
atagtttattttcaa

SEQ ID NO: 465206 - DNA, 15 bp, Homo sapiens
tagtttattttcaat

SEQ ID NO: 465207 - DNA, 15 bp, Homo sapiens
agtttattttcaatt

SEQ ID NO: 465208 - DNA, 15 bp, Homo sapiens
gtttattttcaattt

SEQ ID NO: 465209 - DNA, 15 bp, Homo sapiens
tttattttcaatttt

SEQ ID NO: 465210 - DNA, 15 bp, Homo sapiens
ttattttcaattttc

SEQ ID NO: 465211 - DNA, 15 bp, Homo sapiens
tattttcaattttct

SEQ ID NO: 465212 - DNA, 15 bp, Homo sapiens
attttcaattttctg

SEQ ID NO: 465213 - DNA, 15 bp, Homo sapiens
ttttcaattttctga

SEQ ID NO: 465214 - DNA, 15 bp, Homo sapiens
tttcaattttctgat

SEQ ID NO: 465215 - DNA, 15 bp, Homo sapiens
ttcaattttctgatg

SEQ ID NO: 465216 - DNA, 15 bp, Homo sapiens
tcaattttctgatgt

SEQ ID NO: 465217 - DNA, 15 bp, Homo sapiens
caattttctgatgtt

SEQ ID NO: 465218 - DNA, 15 bp, Homo sapiens
aattttctgatgtta

SEQ ID NO: 465219 - DNA, 15 bp, Homo sapiens
attttctgatgttat

SEQ ID NO: 465220 - DNA, 15 bp, Homo sapiens
ttttctgatgttata

SEQ ID NO: 465221 - DNA, 15 bp, Homo sapiens
tttctgatgttataa

SEQ ID NO: 465222 - DNA, 15 bp, Homo sapiens
ttctgatgttataaa

SEQ ID NO: 465223 - DNA, 15 bp, Homo sapiens
tctgatgttataaat

SEQ ID NO: 465224 - DNA, 15 bp, Homo sapiens
ctgatgttataaata

SEQ ID NO: 465225 - DNA, 15 bp, Homo sapiens
tgatgttataaataa

SEQ ID NO: 465226 - DNA, 15 bp, Homo sapiens
gatgttataaataac

SEQ ID NO: 465227 - DNA, 15 bp, Homo sapiens
atgttataaataaca

SEQ ID NO: 465228 - DNA, 15 bp, Homo sapiens
tgttataaataacac

SEQ ID NO: 465229 - DNA, 15 bp, Homo sapiens
gttataaataacact

SEQ ID NO: 465230 - DNA, 15 bp, Homo sapiens
ttataaataacactc

SEQ ID NO: 465231 - DNA, 15 bp, Homo sapiens
tataaataacactct

SEQ ID NO: 465232 - DNA, 15 bp, Homo sapiens
ataaataacactctt

SEQ ID NO: 465233 - DNA, 15 bp, Homo sapiens
taaataacactctta

SEQ ID NO: 465234 - DNA, 15 bp, Homo sapiens
aaataacactcttac

SEQ ID NO: 465235 - DNA, 15 bp, Homo sapiens
aataacactcttaca

SEQ ID NO: 465236 - DNA, 15 bp, Homo sapiens
ataacactcttacaa

SEQ ID NO: 465237 - DNA, 15 bp, Homo sapiens
taacactcttacaag

SEQ ID NO: 465238 - DNA, 15 bp, Homo sapiens
aacactcttacaagt

SEQ ID NO: 465239 - DNA, 15 bp, Homo sapiens
acactcttacaagta

SEQ ID NO: 465240 - DNA, 15 bp, Homo sapiens
cactcttacaagtat

SEQ ID NO: 465241 - DNA, 15 bp, Homo sapiens
actcttacaagtatc

SEQ ID NO: 465242 - DNA, 15 bp, Homo sapiens
ctcttacaagtatct

SEQ ID NO: 465243 - DNA, 15 bp, Homo sapiens
tcttacaagtatctt

SEQ ID NO: 465244 - DNA, 15 bp, Homo sapiens
cttacaagtatcttt

SEQ ID NO: 465245 - DNA, 15 bp, Homo sapiens
ttacaagtatctttg

SEQ ID NO: 465246 - DNA, 15 bp, Homo sapiens
tacaagtatctttgt

SEQ ID NO: 465247 - DNA, 15 bp, Homo sapiens
acaagtatctttgtg

SEQ ID NO: 465248 - DNA, 15 bp, Homo sapiens
caagtatctttgtga

SEQ ID NO: 465249 - DNA, 15 bp, Homo sapiens
aagtatctttgtgag

SEQ ID NO: 465250 - DNA, 15 bp, Homo sapiens
agtatctttgtgagg

SEQ ID NO: 465251 - DNA, 15 bp, Homo sapiens
tatctttgtgagggt

SEQ ID NO: 465252 - DNA, 15 bp, Homo sapiens
atctttgtgagggta

SEQ ID NO: 465253 - DNA, 15 bp, Homo sapiens
tctttgtgagggtag

SEQ ID NO: 465254 - DNA, 15 bp, Homo sapiens
ctttgtgagggtagc

SEQ ID NO: 465255 - DNA, 15 bp, Homo sapiens
tttgtgagggtagct

SEQ ID NO: 465256 - DNA, 15 bp, Homo sapiens
ttgtgagggtagctc

SEQ ID NO: 465257 - DNA, 15 bp, Homo sapiens
tgtgagggtagctca

SEQ ID NO: 465258 - DNA, 15 bp, Homo sapiens
gtgagggtagctcat

SEQ ID NO: 465259 - DNA, 15 bp, Homo sapiens
tgagggtagctcatt

SEQ ID NO: 465260 - DNA, 15 bp, Homo sapiens
gagggtagctcattc

SEQ ID NO: 465261 - DNA, 15 bp, Homo sapiens
agggtagctcattcc

SEQ ID NO: 465262 - DNA, 15 bp, Homo sapiens
gggtagctcattcca

SEQ ID NO: 465263 - DNA, 15 bp, Homo sapiens
ggtagctcattccag

SEQ ID NO: 465264 - DNA, 15 bp, Homo sapiens
gtagctcattccaga

SEQ ID NO: 465265 - DNA, 15 bp, Homo sapiens
tagctcattccagat

SEQ ID NO: 465266 - DNA, 15 bp, Homo sapiens
agctcattccagata

SEQ ID NO: 465267 - DNA, 15 bp, Homo sapiens
gctcattccagatat

SEQ ID NO: 465268 - DNA, 15 bp, Homo sapiens
ctcattccagatatt

SEQ ID NO: 465269 - DNA, 15 bp, Homo sapiens
tcattccagatatta

SEQ ID NO: 465270 - DNA, 15 bp, Homo sapiens
cattccagatattat

SEQ ID NO: 465271 - DNA, 15 bp, Homo sapiens
attccagatattatg

SEQ ID NO: 465272 - DNA, 15 bp, Homo sapiens
ttccagatattatgt

SEQ ID NO: 465273 - DNA, 15 bp, Homo sapiens
tccagatattatgta

SEQ ID NO: 465274 - DNA, 15 bp, Homo sapiens
ccagatattatgtaa

SEQ ID NO: 465275 - DNA, 15 bp, Homo sapiens
cagatattatgtaaa

SEQ ID NO: 465276 - DNA, 15 bp, Homo sapiens
agatattatgtaaac

SEQ ID NO: 465277 - DNA, 15 bp, Homo sapiens
gatattatgtaaact

SEQ ID NO: 465278 - DNA, 15 bp, Homo sapiens
atattatgtaaacta

SEQ ID NO: 465279 - DNA, 15 bp, Homo sapiens
tattatgtaaactac

SEQ ID NO: 465280 - DNA, 15 bp, Homo sapiens
attatgtaaactaca

SEQ ID NO: 465281 - DNA, 15 bp, Homo sapiens
ttatgtaaactacat

SEQ ID NO: 465282 - DNA, 15 bp, Homo sapiens
tatgtaaactacatt

SEQ ID NO: 465283 - DNA, 15 bp, Homo sapiens
atgtaaactacattg

SEQ ID NO: 465284 - DNA, 15 bp, Homo sapiens
tgtaaactacattgc

SEQ ID NO: 465285 - DNA, 15 bp, Homo sapiens
gtaaactacattgca

SEQ ID NO: 465286 - DNA, 15 bp, Homo sapiens
taaactacattgcaa

SEQ ID NO: 465287 - DNA, 15 bp, Homo sapiens
aaactacattgcaat

SEQ ID NO: 465288 - DNA, 15 bp, Homo sapiens
aactacattgcaata

SEQ ID NO: 465289 - DNA, 15 bp, Homo sapiens
actacattgcaatag

SEQ ID NO: 465290 - DNA, 15 bp, Homo sapiens
ctacattgcaataga

SEQ ID NO: 465291 - DNA, 15 bp, Homo sapiens
tacattgcaatagaa

SEQ ID NO: 465292 - DNA, 15 bp, Homo sapiens
acattgcaatagaat

SEQ ID NO: 465293 - DNA, 15 bp, Homo sapiens
cattgcaatagaata

SEQ ID NO: 465294 - DNA, 15 bp, Homo sapiens
attgcaatagaataa

SEQ ID NO: 465295 - DNA, 15 bp, Homo sapiens
ttgcaatagaataaa

SEQ ID NO: 465296 - DNA, 15 bp, Homo sapiens
tgcaatagaataaag

SEQ ID NO: 465297 - DNA, 15 bp, Homo sapiens
gcaatagaataaagc

SEQ ID NO: 465298 - DNA, 15 bp, Homo sapiens
caatagaataaagca

SEQ ID NO: 465299 - DNA, 15 bp, Homo sapiens
aatagaataaagcac

SEQ ID NO: 465300 - DNA, 15 bp, Homo sapiens
atagaataaagcact

SEQ ID NO: 465301 - DNA, 15 bp, Homo sapiens
tagaataaagcacta

SEQ ID NO: 465302 - DNA, 15 bp, Homo sapiens
agaataaagcactat

SEQ ID NO: 465303 - DNA, 15 bp, Homo sapiens
gaataaagcactata

SEQ ID NO: 465304 - DNA, 15 bp, Homo sapiens
aataaagcactataa

SEQ ID NO: 465305 - DNA, 15 bp, Homo sapiens
ataaagcactataag

SEQ ID NO: 465306 - DNA, 15 bp, Homo sapiens
taaagcactataagt

SEQ ID NO: 465307 - DNA, 15 bp, Homo sapiens
aaagcactataagta

SEQ ID NO: 465308 - DNA, 15 bp, Homo sapiens
aagcactataagtag

SEQ ID NO: 465309 - DNA, 15 bp, Homo sapiens
agcactataagtagg

SEQ ID NO: 465310 - DNA, 15 bp, Homo sapiens
gcactataagtaggt

SEQ ID NO: 465311 - DNA, 15 bp, Homo sapiens
cactataagtaggtt

SEQ ID NO: 465312 - DNA, 15 bp, Homo sapiens
actataagtaggtta

SEQ ID NO: 465313 - DNA, 15 bp, Homo sapiens
ctataagtaggttat

SEQ ID NO: 465314 - DNA, 15 bp, Homo sapiens
tataagtaggttatt

SEQ ID NO: 465315 - DNA, 15 bp, Homo sapiens
ataagtaggttattt

SEQ ID NO: 465316 - DNA, 15 bp, Homo sapiens
taagtaggttatttc

SEQ ID NO: 465317 - DNA, 15 bp, Homo sapiens
aagtaggttatttca

SEQ ID NO: 465318 - DNA, 15 bp, Homo sapiens
agtaggttatttcag

SEQ ID NO: 465319 - DNA, 15 bp, Homo sapiens
gtaggttatttcagt

SEQ ID NO: 465320 - DNA, 15 bp, Homo sapiens
taggttatttcagtc

SEQ ID NO: 465321 - DNA, 15 bp, Homo sapiens
aggttatttcagtca

SEQ ID NO: 465322 - DNA, 15 bp, Homo sapiens
ggttatttcagtcaa

SEQ ID NO: 465323 - DNA, 15 bp, Homo sapiens
gttatttcagtcaat

SEQ ID NO: 465324 - DNA, 15 bp, Homo sapiens
ttatttcagtcaatg

SEQ ID NO: 465325 - DNA, 15 bp, Homo sapiens
tatttcagtcaatga

SEQ ID NO: 465326 - DNA, 15 bp, Homo sapiens
atttcagtcaatgaa

SEQ ID NO: 465327 - DNA, 15 bp, Homo sapiens
tttcagtcaatgaat

SEQ ID NO: 465328 - DNA, 15 bp, Homo sapiens
ttcagtcaatgaata

SEQ ID NO: 465329 - DNA, 15 bp, Homo sapiens
tcagtcaatgaatat

SEQ ID NO: 465330 - DNA, 15 bp, Homo sapiens
cagtcaatgaatatg

SEQ ID NO: 465331 - DNA, 15 bp, Homo sapiens
agtcaatgaatatgg

SEQ ID NO: 465332 - DNA, 15 bp, Homo sapiens
gtcaatgaatatggg

SEQ ID NO: 465333 - DNA, 15 bp, Homo sapiens
tcaatgaatatgggt

SEQ ID NO: 465334 - DNA, 15 bp, Homo sapiens
caatgaatatgggta

SEQ ID NO: 465335 - DNA, 15 bp, Homo sapiens
aatgaatatgggtat

SEQ ID NO: 465336 - DNA, 15 bp, Homo sapiens
atgaatatgggtatt

SEQ ID NO: 465337 - DNA, 15 bp, Homo sapiens
tgaatatgggtattt

SEQ ID NO: 465338 - DNA, 15 bp, Homo sapiens
gaatatgggtatttt

SEQ ID NO: 465339 - DNA, 15 bp, Homo sapiens
aatatgggtattttt

SEQ ID NO: 465340 - DNA, 15 bp, Homo sapiens
atatgggtatttttt

SEQ ID NO: 465341 - DNA, 15 bp, Homo sapiens
tatgggtatttttta

SEQ ID NO: 465342 - DNA, 15 bp, Homo sapiens
atgggtattttttat

SEQ ID NO: 465343 - DNA, 15 bp, Homo sapiens
tgggtattttttatg

SEQ ID NO: 465344 - DNA, 15 bp, Homo sapiens
gggtattttttatgg

SEQ ID NO: 465345 - DNA, 15 bp, Homo sapiens
ggtattttttatggt

SEQ ID NO: 465346 - DNA, 15 bp, Homo sapiens
gtattttttatggtc

SEQ ID NO: 465347 - DNA, 15 bp, Homo sapiens
tattttttatggtca

SEQ ID NO: 465348 - DNA, 15 bp, Homo sapiens
attttttatggtcaa

SEQ ID NO: 465349 - DNA, 15 bp, Homo sapiens
ttttttatggtcaaa

SEQ ID NO: 465350 - DNA, 15 bp, Homo sapiens
tttttatggtcaaaa

SEQ ID NO: 465351 - DNA, 15 bp, Homo sapiens
ttttatggtcaaaat

SEQ ID NO: 465352 - DNA, 15 bp, Homo sapiens
tttatggtcaaaata

SEQ ID NO: 465353 - DNA, 15 bp, Homo sapiens
ttatggtcaaaatac

SEQ ID NO: 465354 - DNA, 15 bp, Homo sapiens
tatggtcaaaatact

SEQ ID NO: 465355 - DNA, 15 bp, Homo sapiens
atggtcaaaatactt

SEQ ID NO: 465356 - DNA, 15 bp, Homo sapiens
tggtcaaaatacttg

SEQ ID NO: 465357 - DNA, 15 bp, Homo sapiens
ggtcaaaatacttga

SEQ ID NO: 465358 - DNA, 15 bp, Homo sapiens
gtcaaaatacttgat

SEQ ID NO: 465359 - DNA, 15 bp, Homo sapiens
tcaaaatacttgatg

SEQ ID NO: 465360 - DNA, 15 bp, Homo sapiens
caaaatacttgatgt

SEQ ID NO: 465361 - DNA, 15 bp, Homo sapiens
aaaatacttgatgtc

SEQ ID NO: 465362 - DNA, 15 bp, Homo sapiens
aaatacttgatgtca

SEQ ID NO: 465363 - DNA, 15 bp, Homo sapiens
aatacttgatgtcaa

SEQ ID NO: 465364 - DNA, 15 bp, Homo sapiens
atacttgatgtcaac

SEQ ID NO: 465365 - DNA, 15 bp, Homo sapiens
tacttgatgtcaacg

SEQ ID NO: 465366 - DNA, 15 bp, Homo sapiens
acttgatgtcaacgt

SEQ ID NO: 465367 - DNA, 15 bp, Homo sapiens
cttgatgtcaacgtt

SEQ ID NO: 465368 - DNA, 15 bp, Homo sapiens
ttgatgtcaacgttt

SEQ ID NO: 465369 - DNA, 15 bp, Homo sapiens
tgatgtcaacgtttt

SEQ ID NO: 465370 - DNA, 15 bp, Homo sapiens
gatgtcaacgttttt

SEQ ID NO: 465371 - DNA, 15 bp, Homo sapiens
atgtcaacgtttttt

SEQ ID NO: 465372 - DNA, 15 bp, Homo sapiens
tgtcaacgttttttt

SEQ ID NO: 465373 - DNA, 15 bp, Homo sapiens
gtcaacgtttttttc

SEQ ID NO: 465374 - DNA, 15 bp, Homo sapiens
tcaacgtttttttca

SEQ ID NO: 465375 - DNA, 15 bp, Homo sapiens
caacgtttttttcaa

SEQ ID NO: 465376 - DNA, 15 bp, Homo sapiens
aacgtttttttcaaa

SEQ ID NO: 465377 - DNA, 15 bp, Homo sapiens
acgtttttttcaaaa

SEQ ID NO: 465378 - DNA, 15 bp, Homo sapiens
cgtttttttcaaaat

SEQ ID NO: 465379 - DNA, 15 bp, Homo sapiens
gtttttttcaaaata

SEQ ID NO: 465380 - DNA, 15 bp, Homo sapiens
tttttttcaaaatag

SEQ ID NO: 465381 - DNA, 15 bp, Homo sapiens
ttttttcaaaatagg

SEQ ID NO: 465382 - DNA, 15 bp, Homo sapiens
tttttcaaaataggt

SEQ ID NO: 465383 - DNA, 15 bp, Homo sapiens
ttttcaaaataggtt

SEQ ID NO: 465384 - DNA, 15 bp, Homo sapiens
tttcaaaataggttt

SEQ ID NO: 465385 - DNA, 15 bp, Homo sapiens
ttcaaaataggttta

SEQ ID NO: 465386 - DNA, 15 bp, Homo sapiens
tcaaaataggtttat

SEQ ID NO: 465387 - DNA, 15 bp, Homo sapiens
caaaataggtttatc

SEQ ID NO: 465388 - DNA, 15 bp, Homo sapiens
aaaataggtttatcc

SEQ ID NO: 465389 - DNA, 15 bp, Homo sapiens
aaataggtttatccc

SEQ ID NO: 465390 - DNA, 15 bp, Homo sapiens
aataggtttatccca

SEQ ID NO: 465391 - DNA, 15 bp, Homo sapiens
ataggtttatcccaa

SEQ ID NO: 465392 - DNA, 15 bp, Homo sapiens
taggtttatcccaat

SEQ ID NO: 465393 - DNA, 15 bp, Homo sapiens
aggtttatcccaatt

SEQ ID NO: 465394 - DNA, 15 bp, Homo sapiens
ggtttatcccaattt

SEQ ID NO: 465395 - DNA, 15 bp, Homo sapiens
gtttatcccaattta

SEQ ID NO: 465396 - DNA, 15 bp, Homo sapiens
tttatcccaatttac

SEQ ID NO: 465397 - DNA, 15 bp, Homo sapiens
ttatcccaatttaca

SEQ ID NO: 465398 - DNA, 15 bp, Homo sapiens
tatcccaatttacat

SEQ ID NO: 465399 - DNA, 15 bp, Homo sapiens
atcccaatttacatt

SEQ ID NO: 465400 - DNA, 15 bp, Homo sapiens
tcccaatttacatta

SEQ ID NO: 465401 - DNA, 15 bp, Homo sapiens
cccaatttacattat

SEQ ID NO: 465402 - DNA, 15 bp, Homo sapiens
ccaatttacattatt

SEQ ID NO: 465403 - DNA, 15 bp, Homo sapiens
caatttacattatta

SEQ ID NO: 465404 - DNA, 15 bp, Homo sapiens
aatttacattattat

SEQ ID NO: 465405 - DNA, 15 bp, Homo sapiens
atttacattattatc

SEQ ID NO: 465406 - DNA, 15 bp, Homo sapiens
tttacattattatca

SEQ ID NO: 465407 - DNA, 15 bp, Homo sapiens
ttacattattatcac

SEQ ID NO: 465408 - DNA, 15 bp, Homo sapiens
tacattattatcaca

SEQ ID NO: 465409 - DNA, 15 bp, Homo sapiens
acattattatcacac

SEQ ID NO: 465410 - DNA, 15 bp, Homo sapiens
cattattatcacact

SEQ ID NO: 465411 - DNA, 15 bp, Homo sapiens
attattatcacactt

SEQ ID NO: 465412 - DNA, 15 bp, Homo sapiens
ttattatcacacttt

SEQ ID NO: 465413 - DNA, 15 bp, Homo sapiens
tattatcacactttg

SEQ ID NO: 465414 - DNA, 15 bp, Homo sapiens
attatcacactttgt

SEQ ID NO: 465415 - DNA, 15 bp, Homo sapiens
ttatcacactttgtt

SEQ ID NO: 465416 - DNA, 15 bp, Homo sapiens
tatcacactttgtta

SEQ ID NO: 465417 - DNA, 15 bp, Homo sapiens
atcacactttgttaa

SEQ ID NO: 465418 - DNA, 15 bp, Homo sapiens
tcacactttgttaaa

SEQ ID NO: 465419 - DNA, 15 bp, Homo sapiens
cacactttgttaaag

SEQ ID NO: 465420 - DNA, 15 bp, Homo sapiens
acactttgttaaagt

SEQ ID NO: 465421 - DNA, 15 bp, Homo sapiens
cactttgttaaagtt

SEQ ID NO: 465422 - DNA, 15 bp, Homo sapiens
actttgttaaagttt

SEQ ID NO: 465423 - DNA, 15 bp, Homo sapiens
ctttgttaaagtttc

SEQ ID NO: 465424 - DNA, 15 bp, Homo sapiens
tttgttaaagtttca

SEQ ID NO: 465425 - DNA, 15 bp, Homo sapiens
ttgttaaagtttcaa

SEQ ID NO: 465426 - DNA, 15 bp, Homo sapiens
tgttaaagtttcaat

SEQ ID NO: 465427 - DNA, 15 bp, Homo sapiens
gttaaagtttcaatt

SEQ ID NO: 465428 - DNA, 15 bp, Homo sapiens
ttaaagtttcaattt

SEQ ID NO: 465429 - DNA, 15 bp, Homo sapiens
taaagtttcaatttt

SEQ ID NO: 465430 - DNA, 15 bp, Homo sapiens
aaagtttcaatttta

SEQ ID NO: 465431 - DNA, 15 bp, Homo sapiens
aagtttcaattttac

SEQ ID NO: 465432 - DNA, 15 bp, Homo sapiens
agtttcaattttact

SEQ ID NO: 465433 - DNA, 15 bp, Homo sapiens
gtttcaattttacta

SEQ ID NO: 465434 - DNA, 15 bp, Homo sapiens
tttcaattttactaa

SEQ ID NO: 465435 - DNA, 15 bp, Homo sapiens
ttcaattttactaag

SEQ ID NO: 465436 - DNA, 15 bp, Homo sapiens
tcaattttactaagc

SEQ ID NO: 465437 - DNA, 15 bp, Homo sapiens
caattttactaagcc

SEQ ID NO: 465438 - DNA, 15 bp, Homo sapiens
aattttactaagccc

SEQ ID NO: 465439 - DNA, 15 bp, Homo sapiens
attttactaagcccc

SEQ ID NO: 465440 - DNA, 15 bp, Homo sapiens
ttttactaagcccca

SEQ ID NO: 465441 - DNA, 15 bp, Homo sapiens
tttactaagccccac

SEQ ID NO: 465442 - DNA, 15 bp, Homo sapiens
ttactaagccccacc

SEQ ID NO: 465443 - DNA, 15 bp, Homo sapiens
tactaagccccacca

SEQ ID NO: 465444 - DNA, 15 bp, Homo sapiens
actaagccccaccag

SEQ ID NO: 465445 - DNA, 15 bp, Homo sapiens
ctaagccccaccagt

SEQ ID NO: 465446 - DNA, 15 bp, Homo sapiens
taagccccaccagta

SEQ ID NO: 465447 - DNA, 15 bp, Homo sapiens
aagccccaccagtat

SEQ ID NO: 465448 - DNA, 15 bp, Homo sapiens
agccccaccagtatt

SEQ ID NO: 465449 - DNA, 15 bp, Homo sapiens
gccccaccagtattg

SEQ ID NO: 465450 - DNA, 15 bp, Homo sapiens
ccccaccagtattgg

SEQ ID NO: 465451 - DNA, 15 bp, Homo sapiens
cccaccagtattgga

SEQ ID NO: 465452 - DNA, 15 bp, Homo sapiens
ccaccagtattggac

SEQ ID NO: 465453 - DNA, 15 bp, Homo sapiens
caccagtattggaca

SEQ ID NO: 465454 - DNA, 15 bp, Homo sapiens
accagtattggacat

SEQ ID NO: 465455 - DNA, 15 bp, Homo sapiens
ccagtattggacata

SEQ ID NO: 465456 - DNA, 15 bp, Homo sapiens
cagtattggacataa

SEQ ID NO: 465457 - DNA, 15 bp, Homo sapiens
agtattggacataag

SEQ ID NO: 465458 - DNA, 15 bp, Homo sapiens
gtattggacataagt

SEQ ID NO: 465459 - DNA, 15 bp, Homo sapiens
tattggacataagtt

SEQ ID NO: 465460 - DNA, 15 bp, Homo sapiens
attggacataagttc

SEQ ID NO: 465461 - DNA, 15 bp, Homo sapiens
ttggacataagttct

SEQ ID NO: 465462 - DNA, 15 bp, Homo sapiens
tggacataagttctt

SEQ ID NO: 465463 - DNA, 15 bp, Homo sapiens
ggacataagttcttg

SEQ ID NO: 465464 - DNA, 15 bp, Homo sapiens
gacataagttcttgt

SEQ ID NO: 465465 - DNA, 15 bp, Homo sapiens
acataagttcttgtt

SEQ ID NO: 465466 - DNA, 15 bp, Homo sapiens
cataagttcttgttt

SEQ ID NO: 465467 - DNA, 15 bp, Homo sapiens
ataagttcttgtttt

SEQ ID NO: 465468 - DNA, 15 bp, Homo sapiens
taagttcttgttttt

SEQ ID NO: 465469 - DNA, 15 bp, Homo sapiens
aagttcttgtttttc

SEQ ID NO: 465470 - DNA, 15 bp, Homo sapiens
agttcttgtttttcc

SEQ ID NO: 465471 - DNA, 15 bp, Homo sapiens
gttcttgtttttcct

SEQ ID NO: 465472 - DNA, 15 bp, Homo sapiens
ttcttgtttttcctt

SEQ ID NO: 465473 - DNA, 15 bp, Homo sapiens
tcttgtttttccttt

SEQ ID NO: 465474 - DNA, 15 bp, Homo sapiens
cttgtttttcctttg

SEQ ID NO: 465475 - DNA, 15 bp, Homo sapiens
ttgtttttcctttga

SEQ ID NO: 465476 - DNA, 15 bp, Homo sapiens
tgtttttcctttgat

SEQ ID NO: 465477 - DNA, 15 bp, Homo sapiens
gtttttcctttgatt

SEQ ID NO: 465478 - DNA, 15 bp, Homo sapiens
tttttcctttgattt

SEQ ID NO: 465479 - DNA, 15 bp, Homo sapiens
ttttcctttgattta

SEQ ID NO: 465480 - DNA, 15 bp, Homo sapiens
tttcctttgatttac

SEQ ID NO: 465481 - DNA, 15 bp, Homo sapiens
ttcctttgatttaca

SEQ ID NO: 465482 - DNA, 15 bp, Homo sapiens
tcctttgatttacag

SEQ ID NO: 465483 - DNA, 15 bp, Homo sapiens
cctttgatttacagc

SEQ ID NO: 465484 - DNA, 15 bp, Homo sapiens
ctttgatttacagct

SEQ ID NO: 465485 - DNA, 15 bp, Homo sapiens
tttgatttacagcta

SEQ ID NO: 465486 - DNA, 15 bp, Homo sapiens
ttgatttacagctat

SEQ ID NO: 465487 - DNA, 15 bp, Homo sapiens
tgatttacagctatt

SEQ ID NO: 465488 - DNA, 15 bp, Homo sapiens
gatttacagctattt

SEQ ID NO: 465489 - DNA, 15 bp, Homo sapiens
atttacagctatttt

SEQ ID NO: 465490 - DNA, 15 bp, Homo sapiens
tttacagctattttt

SEQ ID NO: 465491 - DNA, 15 bp, Homo sapiens
ttacagctatttttt

SEQ ID NO: 465492 - DNA, 15 bp, Homo sapiens
tacagctattttttc

SEQ ID NO: 465493 - DNA, 15 bp, Homo sapiens
acagctattttttcc

SEQ ID NO: 465494 - DNA, 15 bp, Homo sapiens
cagctattttttcct

SEQ ID NO: 465495 - DNA, 15 bp, Homo sapiens
agctattttttcctg

SEQ ID NO: 465496 - DNA, 15 bp, Homo sapiens
gctattttttcctga

SEQ ID NO: 465497 - DNA, 15 bp, Homo sapiens
ctattttttcctgaa

SEQ ID NO: 465498 - DNA, 15 bp, Homo sapiens
tattttttcctgaag

SEQ ID NO: 465499 - DNA, 15 bp, Homo sapiens
attttttcctgaagt

SEQ ID NO: 465500 - DNA, 15 bp, Homo sapiens
ttttttcctgaagtt

SEQ ID NO: 465501 - DNA, 15 bp, Homo sapiens
tttttcctgaagtta

SEQ ID NO: 465502 - DNA, 15 bp, Homo sapiens
ttttcctgaagttat

SEQ ID NO: 465503 - DNA, 15 bp, Homo sapiens
tttcctgaagttatc

SEQ ID NO: 465504 - DNA, 15 bp, Homo sapiens
ttcctgaagttatcc

SEQ ID NO: 465505 - DNA, 15 bp, Homo sapiens
tcctgaagttatcct

SEQ ID NO: 465506 - DNA, 15 bp, Homo sapiens
cctgaagttatcctc

SEQ ID NO: 465507 - DNA, 15 bp, Homo sapiens
ctgaagttatcctca

SEQ ID NO: 465508 - DNA, 15 bp, Homo sapiens
tgaagttatcctcat

SEQ ID NO: 465509 - DNA, 15 bp, Homo sapiens
gaagttatcctcatg

SEQ ID NO: 465510 - DNA, 15 bp, Homo sapiens
aagttatcctcatgt

SEQ ID NO: 465511 - DNA, 15 bp, Homo sapiens
agttatcctcatgtt

SEQ ID NO: 465512 - DNA, 15 bp, Homo sapiens
gttatcctcatgttc

SEQ ID NO: 465513 - DNA, 15 bp, Homo sapiens
ttatcctcatgttct

SEQ ID NO: 465514 - DNA, 15 bp, Homo sapiens
tatcctcatgttcta

SEQ ID NO: 465515 - DNA, 15 bp, Homo sapiens
atcctcatgttctat

SEQ ID NO: 465516 - DNA, 15 bp, Homo sapiens
tcctcatgttctatt

SEQ ID NO: 465517 - DNA, 15 bp, Homo sapiens
cctcatgttctatta

SEQ ID NO: 465518 - DNA, 15 bp, Homo sapiens
ctcatgttctattaa

SEQ ID NO: 465519 - DNA, 15 bp, Homo sapiens
tcatgttctattaat

SEQ ID NO: 465520 - DNA, 15 bp, Homo sapiens
catgttctattaata

SEQ ID NO: 465521 - DNA, 15 bp, Homo sapiens
atgttctattaatag

SEQ ID NO: 465522 - DNA, 15 bp, Homo sapiens
tgttctattaatagc

SEQ ID NO: 465523 - DNA, 15 bp, Homo sapiens
gttctattaatagct

SEQ ID NO: 465524 - DNA, 15 bp, Homo sapiens
ttctattaatagcta

SEQ ID NO: 465525 - DNA, 15 bp, Homo sapiens
tctattaatagctat

SEQ ID NO: 465526 - DNA, 15 bp, Homo sapiens
ctattaatagctatt

SEQ ID NO: 465527 - DNA, 15 bp, Homo sapiens
tattaatagctattc

SEQ ID NO: 465528 - DNA, 15 bp, Homo sapiens
attaatagctattct

SEQ ID NO: 465529 - DNA, 15 bp, Homo sapiens
ttaatagctattctt

SEQ ID NO: 465530 - DNA, 15 bp, Homo sapiens
taatagctattcttt

SEQ ID NO: 465531 - DNA, 15 bp, Homo sapiens
aatagctattctttt

SEQ ID NO: 465532 - DNA, 15 bp, Homo sapiens
atagctattctttta

SEQ ID NO: 465533 - DNA, 15 bp, Homo sapiens
tagctattcttttac

SEQ ID NO: 465534 - DNA, 15 bp, Homo sapiens
agctattcttttact

SEQ ID NO: 465535 - DNA, 15 bp, Homo sapiens
gctattcttttactt

SEQ ID NO: 465536 - DNA, 15 bp, Homo sapiens
ctattcttttacttc

SEQ ID NO: 465537 - DNA, 15 bp, Homo sapiens
tattcttttacttcc

SEQ ID NO: 465538 - DNA, 15 bp, Homo sapiens
attcttttacttcct

SEQ ID NO: 465539 - DNA, 15 bp, Homo sapiens
ttcttttacttcctt

SEQ ID NO: 465540 - DNA, 15 bp, Homo sapiens
tcttttacttccttc

SEQ ID NO: 465541 - DNA, 15 bp, Homo sapiens
cttttacttccttcc

SEQ ID NO: 465542 - DNA, 15 bp, Homo sapiens
ttttacttccttcca

SEQ ID NO: 465543 - DNA, 15 bp, Homo sapiens
tttacttccttccaa

SEQ ID NO: 465544 - DNA, 15 bp, Homo sapiens
ttacttccttccaaa

SEQ ID NO: 465545 - DNA, 15 bp, Homo sapiens
tacttccttccaaat

SEQ ID NO: 465546 - DNA, 15 bp, Homo sapiens
acttccttccaaata

SEQ ID NO: 465547 - DNA, 15 bp, Homo sapiens
cttccttccaaataa

SEQ ID NO: 465548 - DNA, 15 bp, Homo sapiens
ttccttccaaataat

SEQ ID NO: 465549 - DNA, 15 bp, Homo sapiens
tccttccaaataatg

SEQ ID NO: 465550 - DNA, 15 bp, Homo sapiens
ccttccaaataatgc

SEQ ID NO: 465551 - DNA, 15 bp, Homo sapiens
cttccaaataatgcc

SEQ ID NO: 465552 - DNA, 15 bp, Homo sapiens
ttccaaataatgccc

SEQ ID NO: 465553 - DNA, 15 bp, Homo sapiens
tccaaataatgccca

SEQ ID NO: 465554 - DNA, 15 bp, Homo sapiens
ccaaataatgcccaa

SEQ ID NO: 465555 - DNA, 15 bp, Homo sapiens
caaataatgcccaaa

SEQ ID NO: 465556 - DNA, 15 bp, Homo sapiens
aaataatgcccaaat

SEQ ID NO: 465557 - DNA, 15 bp, Homo sapiens
aataatgcccaaatg

SEQ ID NO: 465558 - DNA, 15 bp, Homo sapiens
ataatgcccaaatgt

SEQ ID NO: 465559 - DNA, 15 bp, Homo sapiens
taatgcccaaatgta

SEQ ID NO: 465560 - DNA, 15 bp, Homo sapiens
aatgcccaaatgtat

SEQ ID NO: 465561 - DNA, 15 bp, Homo sapiens
atgcccaaatgtatt

SEQ ID NO: 465562 - DNA, 15 bp, Homo sapiens
tgcccaaatgtattc

SEQ ID NO: 465563 - DNA, 15 bp, Homo sapiens
gcccaaatgtattca

SEQ ID NO: 465564 - DNA, 15 bp, Homo sapiens
cccaaatgtattcat

SEQ ID NO: 465565 - DNA, 15 bp, Homo sapiens
ccaaatgtattcatc

SEQ ID NO: 465566 - DNA, 15 bp, Homo sapiens
caaatgtattcatca

SEQ ID NO: 465567 - DNA, 15 bp, Homo sapiens
aaatgtattcatcaa

SEQ ID NO: 465568 - DNA, 15 bp, Homo sapiens
aatgtattcatcaag

SEQ ID NO: 465569 - DNA, 15 bp, Homo sapiens
atgtattcatcaagc

SEQ ID NO: 465570 - DNA, 15 bp, Homo sapiens
tgtattcatcaagct

SEQ ID NO: 465571 - DNA, 15 bp, Homo sapiens
gtattcatcaagctg

SEQ ID NO: 465572 - DNA, 15 bp, Homo sapiens
tattcatcaagctgt

SEQ ID NO: 465573 - DNA, 15 bp, Homo sapiens
attcatcaagctgtc

SEQ ID NO: 465574 - DNA, 15 bp, Homo sapiens
ttcatcaagctgtct

SEQ ID NO: 465575 - DNA, 15 bp, Homo sapiens
tcatcaagctgtcta

SEQ ID NO: 465576 - DNA, 15 bp, Homo sapiens
catcaagctgtctat

SEQ ID NO: 465577 - DNA, 15 bp, Homo sapiens
atcaagctgtctatt

SEQ ID NO: 465578 - DNA, 15 bp, Homo sapiens
tcaagctgtctattt

SEQ ID NO: 465579 - DNA, 15 bp, Homo sapiens
caagctgtctatttt

SEQ ID NO: 465580 - DNA, 15 bp, Homo sapiens
aagctgtctattttc

SEQ ID NO: 465581 - DNA, 15 bp, Homo sapiens
agctgtctattttct

SEQ ID NO: 465582 - DNA, 15 bp, Homo sapiens
gctgtctattttctt

SEQ ID NO: 465583 - DNA, 15 bp, Homo sapiens
ctgtctattttcttt

SEQ ID NO: 465584 - DNA, 15 bp, Homo sapiens
tgtctattttctttg

SEQ ID NO: 465585 - DNA, 15 bp, Homo sapiens
gtctattttctttgg

SEQ ID NO: 465586 - DNA, 15 bp, Homo sapiens
tctattttctttggt

SEQ ID NO: 465587 - DNA, 15 bp, Homo sapiens
ctattttctttggtt

SEQ ID NO: 465588 - DNA, 15 bp, Homo sapiens
tattttctttggttt

SEQ ID NO: 465589 - DNA, 15 bp, Homo sapiens
attttctttggttta

SEQ ID NO: 465590 - DNA, 15 bp, Homo sapiens
ttttctttggtttag

SEQ ID NO: 465591 - DNA, 15 bp, Homo sapiens
tttctttggtttagg

SEQ ID NO: 465592 - DNA, 15 bp, Homo sapiens
ttctttggtttaggg

SEQ ID NO: 465593 - DNA, 15 bp, Homo sapiens
tctttggtttaggga

SEQ ID NO: 465594 - DNA, 15 bp, Homo sapiens
ctttggtttagggaa

SEQ ID NO: 465595 - DNA, 15 bp, Homo sapiens
tttggtttagggaat

SEQ ID NO: 465596 - DNA, 15 bp, Homo sapiens
ttggtttagggaatt

SEQ ID NO: 465597 - DNA, 15 bp, Homo sapiens
tggtttagggaattg

SEQ ID NO: 465598 - DNA, 15 bp, Homo sapiens
ggtttagggaattga

SEQ ID NO: 465599 - DNA, 15 bp, Homo sapiens
gtttagggaattgag

SEQ ID NO: 465600 - DNA, 15 bp, Homo sapiens
tttagggaattgagt

SEQ ID NO: 465601 - DNA, 15 bp, Homo sapiens
ttagggaattgagtt

SEQ ID NO: 465602 - DNA, 15 bp, Homo sapiens
tagggaattgagtta

SEQ ID NO: 465603 - DNA, 15 bp, Homo sapiens
agggaattgagttac

SEQ ID NO: 465604 - DNA, 15 bp, Homo sapiens
gggaattgagttact

SEQ ID NO: 465605 - DNA, 15 bp, Homo sapiens
ggaattgagttactt

SEQ ID NO: 465606 - DNA, 15 bp, Homo sapiens
gaattgagttacttt

SEQ ID NO: 465607 - DNA, 15 bp, Homo sapiens
aattgagttactttt

SEQ ID NO: 465608 - DNA, 15 bp, Homo sapiens
attgagttacttttt

SEQ ID NO: 465609 - DNA, 15 bp, Homo sapiens
ttgagttactttttt

SEQ ID NO: 465610 - DNA, 15 bp, Homo sapiens
tgagttacttttttg

SEQ ID NO: 465611 - DNA, 15 bp, Homo sapiens
gagttacttttttgg

SEQ ID NO: 465612 - DNA, 15 bp, Homo sapiens
agttacttttttgga

SEQ ID NO: 465613 - DNA, 15 bp, Homo sapiens
gttacttttttggat

SEQ ID NO: 465614 - DNA, 15 bp, Homo sapiens
ttacttttttggatc

SEQ ID NO: 465615 - DNA, 15 bp, Homo sapiens
tacttttttggatca

SEQ ID NO: 465616 - DNA, 15 bp, Homo sapiens
acttttttggatcat

SEQ ID NO: 465617 - DNA, 15 bp, Homo sapiens
cttttttggatcata

SEQ ID NO: 465618 - DNA, 15 bp, Homo sapiens
ttttttggatcataa

SEQ ID NO: 465619 - DNA, 15 bp, Homo sapiens
tttttggatcataaa

SEQ ID NO: 465620 - DNA, 15 bp, Homo sapiens
ttttggatcataaat

SEQ ID NO: 465621 - DNA, 15 bp, Homo sapiens
tttggatcataaatt

SEQ ID NO: 465622 - DNA, 15 bp, Homo sapiens
ttggatcataaattg

SEQ ID NO: 465623 - DNA, 15 bp, Homo sapiens
tggatcataaattga

SEQ ID NO: 465624 - DNA, 15 bp, Homo sapiens
ggatcataaattgac

SEQ ID NO: 465625 - DNA, 15 bp, Homo sapiens
gatcataaattgaca

SEQ ID NO: 465626 - DNA, 15 bp, Homo sapiens
atcataaattgacag

SEQ ID NO: 465627 - DNA, 15 bp, Homo sapiens
tcataaattgacaga

SEQ ID NO: 465628 - DNA, 15 bp, Homo sapiens
cataaattgacagaa

SEQ ID NO: 465629 - DNA, 15 bp, Homo sapiens
ataaattgacagaaa

SEQ ID NO: 465630 - DNA, 15 bp, Homo sapiens
taaattgacagaaag

SEQ ID NO: 465631 - DNA, 15 bp, Homo sapiens
aaattgacagaaagg

SEQ ID NO: 465632 - DNA, 15 bp, Homo sapiens
aattgacagaaaggc

SEQ ID NO: 465633 - DNA, 15 bp, Homo sapiens
attgacagaaaggct

SEQ ID NO: 465634 - DNA, 15 bp, Homo sapiens
ttgacagaaaggctg

SEQ ID NO: 465635 - DNA, 15 bp, Homo sapiens
tgacagaaaggctgt

SEQ ID NO: 465636 - DNA, 15 bp, Homo sapiens
gacagaaaggctgta

SEQ ID NO: 465637 - DNA, 15 bp, Homo sapiens
acagaaaggctgtaa

SEQ ID NO: 465638 - DNA, 15 bp, Homo sapiens
cagaaaggctgtaat

SEQ ID NO: 465639 - DNA, 15 bp, Homo sapiens
agaaaggctgtaata

SEQ ID NO: 465640 - DNA, 15 bp, Homo sapiens
gaaaggctgtaatac

SEQ ID NO: 465641 - DNA, 15 bp, Homo sapiens
aaaggctgtaatact

SEQ ID NO: 465642 - DNA, 15 bp, Homo sapiens
aaggctgtaatactt

SEQ ID NO: 465643 - DNA, 15 bp, Homo sapiens
aggctgtaatactta

SEQ ID NO: 465644 - DNA, 15 bp, Homo sapiens
ggctgtaatacttat

SEQ ID NO: 465645 - DNA, 15 bp, Homo sapiens
gctgtaatacttata

SEQ ID NO: 465646 - DNA, 15 bp, Homo sapiens
ctgtaatacttataa

SEQ ID NO: 465647 - DNA, 15 bp, Homo sapiens
tgtaatacttataaa

SEQ ID NO: 465648 - DNA, 15 bp, Homo sapiens
gtaatacttataaaa

SEQ ID NO: 465649 - DNA, 15 bp, Homo sapiens
taatacttataaaat

SEQ ID NO: 465650 - DNA, 15 bp, Homo sapiens
aatacttataaaata

SEQ ID NO: 465651 - DNA, 15 bp, Homo sapiens
atacttataaaatat

SEQ ID NO: 465652 - DNA, 15 bp, Homo sapiens
tacttataaaatata

SEQ ID NO: 465653 - DNA, 15 bp, Homo sapiens
acttataaaatatac

SEQ ID NO: 465654 - DNA, 15 bp, Homo sapiens
cttataaaatataca

SEQ ID NO: 465655 - DNA, 15 bp, Homo sapiens
ttataaaatatacac

SEQ ID NO: 465656 - DNA, 15 bp, Homo sapiens
tataaaatatacaca

SEQ ID NO: 465657 - DNA, 15 bp, Homo sapiens
ataaaatatacacat

SEQ ID NO: 465658 - DNA, 15 bp, Homo sapiens
taaaatatacacata

SEQ ID NO: 465659 - DNA, 15 bp, Homo sapiens
aaaatatacacatat

SEQ ID NO: 465660 - DNA, 15 bp, Homo sapiens
aaatatacacatata

SEQ ID NO: 465661 - DNA, 15 bp, Homo sapiens
aatatacacatataa

SEQ ID NO: 465662 - DNA, 15 bp, Homo sapiens
atatacacatataaa

SEQ ID NO: 465663 - DNA, 15 bp, Homo sapiens
tatacacatataaat

SEQ ID NO: 465664 - DNA, 15 bp, Homo sapiens
atacacatataaatc

SEQ ID NO: 465665 - DNA, 15 bp, Homo sapiens
tacacatataaatct

SEQ ID NO: 465666 - DNA, 15 bp, Homo sapiens
acacatataaatctc

SEQ ID NO: 465667 - DNA, 15 bp, Homo sapiens
cacatataaatctca

SEQ ID NO: 465668 - DNA, 15 bp, Homo sapiens
acatataaatctcac

SEQ ID NO: 465669 - DNA, 15 bp, Homo sapiens
catataaatctcaca

SEQ ID NO: 465670 - DNA, 15 bp, Homo sapiens
atataaatctcacac

SEQ ID NO: 465671 - DNA, 15 bp, Homo sapiens
tataaatctcacact

SEQ ID NO: 465672 - DNA, 15 bp, Homo sapiens
ataaatctcacactc

SEQ ID NO: 465673 - DNA, 15 bp, Homo sapiens
taaatctcacactca

SEQ ID NO: 465674 - DNA, 15 bp, Homo sapiens
aaatctcacactcat

SEQ ID NO: 465675 - DNA, 15 bp, Homo sapiens
aatctcacactcata

SEQ ID NO: 465676 - DNA, 15 bp, Homo sapiens
atctcacactcatag

SEQ ID NO: 465677 - DNA, 15 bp, Homo sapiens
tctcacactcatagg

SEQ ID NO: 465678 - DNA, 15 bp, Homo sapiens
ctcacactcataggt

SEQ ID NO: 465679 - DNA, 15 bp, Homo sapiens
tcacactcataggta

SEQ ID NO: 465680 - DNA, 15 bp, Homo sapiens
cacactcataggtat

SEQ ID NO: 465681 - DNA, 15 bp, Homo sapiens
acactcataggtatc

SEQ ID NO: 465682 - DNA, 15 bp, Homo sapiens
cactcataggtatct

SEQ ID NO: 465683 - DNA, 15 bp, Homo sapiens
actcataggtatctt

SEQ ID NO: 465684 - DNA, 15 bp, Homo sapiens
ctcataggtatctta

SEQ ID NO: 465685 - DNA, 15 bp, Homo sapiens
tcataggtatcttat

SEQ ID NO: 465686 - DNA, 15 bp, Homo sapiens
cataggtatcttatc

SEQ ID NO: 465687 - DNA, 15 bp, Homo sapiens
ataggtatcttatct

SEQ ID NO: 465688 - DNA, 15 bp, Homo sapiens
taggtatcttatctc

SEQ ID NO: 465689 - DNA, 15 bp, Homo sapiens
aggtatcttatctca

SEQ ID NO: 465690 - DNA, 15 bp, Homo sapiens
ggtatcttatctcaa

SEQ ID NO: 465691 - DNA, 15 bp, Homo sapiens
gtatcttatctcaaa

SEQ ID NO: 465692 - DNA, 15 bp, Homo sapiens
tatcttatctcaaat

SEQ ID NO: 465693 - DNA, 15 bp, Homo sapiens
atcttatctcaaata

SEQ ID NO: 465694 - DNA, 15 bp, Homo sapiens
tcttatctcaaataa

SEQ ID NO: 465695 - DNA, 15 bp, Homo sapiens
cttatctcaaataaa

SEQ ID NO: 465696 - DNA, 15 bp, Homo sapiens
ttatctcaaataaat

SEQ ID NO: 465697 - DNA, 15 bp, Homo sapiens
tatctcaaataaata

SEQ ID NO: 465698 - DNA, 15 bp, Homo sapiens
atctcaaataaataa

SEQ ID NO: 465699 - DNA, 15 bp, Homo sapiens
tctcaaataaataag

SEQ ID NO: 465700 - DNA, 15 bp, Homo sapiens
ctcaaataaataagt

SEQ ID NO: 465701 - DNA, 15 bp, Homo sapiens
tcaaataaataagtg

SEQ ID NO: 465702 - DNA, 15 bp, Homo sapiens
caaataaataagtgc

SEQ ID NO: 465703 - DNA, 15 bp, Homo sapiens
aaataaataagtgcc

SEQ ID NO: 465704 - DNA, 15 bp, Homo sapiens
aataaataagtgccc

SEQ ID NO: 465705 - DNA, 15 bp, Homo sapiens
ataaataagtgccct

SEQ ID NO: 465706 - DNA, 15 bp, Homo sapiens
taaataagtgccctg

SEQ ID NO: 465707 - DNA, 15 bp, Homo sapiens
aaataagtgccctgt

SEQ ID NO: 465708 - DNA, 15 bp, Homo sapiens
aataagtgccctgtg

SEQ ID NO: 465709 - DNA, 15 bp, Homo sapiens
ataagtgccctgtgt

SEQ ID NO: 465710 - DNA, 15 bp, Homo sapiens
taagtgccctgtgta

SEQ ID NO: 465711 - DNA, 15 bp, Homo sapiens
aagtgccctgtgtat

SEQ ID NO: 465712 - DNA, 15 bp, Homo sapiens
agtgccctgtgtatg

SEQ ID NO: 465713 - DNA, 15 bp, Homo sapiens
gtgccctgtgtatgg

SEQ ID NO: 465714 - DNA, 15 bp, Homo sapiens
tgccctgtgtatgga

SEQ ID NO: 465715 - DNA, 15 bp, Homo sapiens
gccctgtgtatggag

SEQ ID NO: 465716 - DNA, 15 bp, Homo sapiens
ccctgtgtatggaga

SEQ ID NO: 465717 - DNA, 15 bp, Homo sapiens
cctgtgtatggagag

SEQ ID NO: 465718 - DNA, 15 bp, Homo sapiens
ctgtgtatggagagg

SEQ ID NO: 465719 - DNA, 15 bp, Homo sapiens
tgtgtatggagagga

SEQ ID NO: 465720 - DNA, 15 bp, Homo sapiens
gtgtatggagaggaa

SEQ ID NO: 465721 - DNA, 15 bp, Homo sapiens
tgtatggagaggaaa

SEQ ID NO: 465722 - DNA, 15 bp, Homo sapiens
gtatggagaggaaat

SEQ ID NO: 465723 - DNA, 15 bp, Homo sapiens
tatggagaggaaatc

SEQ ID NO: 465724 - DNA, 15 bp, Homo sapiens
atggagaggaaatct

SEQ ID NO: 465725 - DNA, 15 bp, Homo sapiens
tggagaggaaatctg

SEQ ID NO: 465726 - DNA, 15 bp, Homo sapiens
ggagaggaaatctgt

SEQ ID NO: 465727 - DNA, 15 bp, Homo sapiens
gagaggaaatctgta

SEQ ID NO: 465728 - DNA, 15 bp, Homo sapiens
agaggaaatctgtag

SEQ ID NO: 465729 - DNA, 15 bp, Homo sapiens
gaggaaatctgtaga

SEQ ID NO: 465730 - DNA, 15 bp, Homo sapiens
aggaaatctgtagaa

SEQ ID NO: 465731 - DNA, 15 bp, Homo sapiens
ggaaatctgtagaaa

SEQ ID NO: 465732 - DNA, 15 bp, Homo sapiens
gaaatctgtagaaaa

SEQ ID NO: 465733 - DNA, 15 bp, Homo sapiens
aaatctgtagaaaat

SEQ ID NO: 465734 - DNA, 15 bp, Homo sapiens
aatctgtagaaaata

SEQ ID NO: 465735 - DNA, 15 bp, Homo sapiens
atctgtagaaaatat

SEQ ID NO: 465736 - DNA, 15 bp, Homo sapiens
tctgtagaaaatatt

SEQ ID NO: 465737 - DNA, 15 bp, Homo sapiens
ctgtagaaaatattg

SEQ ID NO: 465738 - DNA, 15 bp, Homo sapiens
tgtagaaaatattgc

SEQ ID NO: 465739 - DNA, 15 bp, Homo sapiens
gtagaaaatattgct

SEQ ID NO: 465740 - DNA, 15 bp, Homo sapiens
tagaaaatattgctg

SEQ ID NO: 465741 - DNA, 15 bp, Homo sapiens
agaaaatattgctga

SEQ ID NO: 465742 - DNA, 15 bp, Homo sapiens
gaaaatattgctgaa

SEQ ID NO: 465743 - DNA, 15 bp, Homo sapiens
aaaatattgctgaat

SEQ ID NO: 465744 - DNA, 15 bp, Homo sapiens
aaatattgctgaatt

SEQ ID NO: 465745 - DNA, 15 bp, Homo sapiens
aatattgctgaatta

SEQ ID NO: 465746 - DNA, 15 bp, Homo sapiens
atattgctgaattat

SEQ ID NO: 465747 - DNA, 15 bp, Homo sapiens
tattgctgaattata

SEQ ID NO: 465748 - DNA, 15 bp, Homo sapiens
attgctgaattataa

SEQ ID NO: 465749 - DNA, 15 bp, Homo sapiens
ttgctgaattataat

SEQ ID NO: 465750 - DNA, 15 bp, Homo sapiens
tgctgaattataatg

SEQ ID NO: 465751 - DNA, 15 bp, Homo sapiens
gctgaattataatgg

SEQ ID NO: 465752 - DNA, 15 bp, Homo sapiens
ctgaattataatgga

SEQ ID NO: 465753 - DNA, 15 bp, Homo sapiens
tgaattataatggag

SEQ ID NO: 465754 - DNA, 15 bp, Homo sapiens
gaattataatggagg

SEQ ID NO: 465755 - DNA, 15 bp, Homo sapiens
aattataatggagga

SEQ ID NO: 465756 - DNA, 15 bp, Homo sapiens
attataatggaggaa

SEQ ID NO: 465757 - DNA, 15 bp, Homo sapiens
ttataatggaggaag

SEQ ID NO: 465758 - DNA, 15 bp, Homo sapiens
tataatggaggaagt

SEQ ID NO: 465759 - DNA, 15 bp, Homo sapiens
ataatggaggaagtg

SEQ ID NO: 465760 - DNA, 15 bp, Homo sapiens
taatggaggaagtgc

SEQ ID NO: 465761 - DNA, 15 bp, Homo sapiens
aatggaggaagtgcc

SEQ ID NO: 465762 - DNA, 15 bp, Homo sapiens
atggaggaagtgccc

SEQ ID NO: 465763 - DNA, 15 bp, Homo sapiens
tggaggaagtgccca

SEQ ID NO: 465764 - DNA, 15 bp, Homo sapiens
ggaggaagtgcccac

SEQ ID NO: 465765 - DNA, 15 bp, Homo sapiens
gaggaagtgcccaca

SEQ ID NO: 465766 - DNA, 15 bp, Homo sapiens
aggaagtgcccacat

SEQ ID NO: 465767 - DNA, 15 bp, Homo sapiens
ggaagtgcccacatc

SEQ ID NO: 465768 - DNA, 15 bp, Homo sapiens
gaagtgcccacatca

SEQ ID NO: 465769 - DNA, 15 bp, Homo sapiens
aagtgcccacatcac

SEQ ID NO: 465770 - DNA, 15 bp, Homo sapiens
agtgcccacatcaca

SEQ ID NO: 465771 - DNA, 15 bp, Homo sapiens
gtgcccacatcacat

SEQ ID NO: 465772 - DNA, 15 bp, Homo sapiens
tgcccacatcacatt

SEQ ID NO: 465773 - DNA, 15 bp, Homo sapiens
gcccacatcacatta

SEQ ID NO: 465774 - DNA, 15 bp, Homo sapiens
cccacatcacattat

SEQ ID NO: 465775 - DNA, 15 bp, Homo sapiens
ccacatcacattata

SEQ ID NO: 465776 - DNA, 15 bp, Homo sapiens
cacatcacattatag

SEQ ID NO: 465777 - DNA, 15 bp, Homo sapiens
acatcacattatagc

SEQ ID NO: 465778 - DNA, 15 bp, Homo sapiens
catcacattatagct

SEQ ID NO: 465779 - DNA, 15 bp, Homo sapiens
atcacattatagctt

SEQ ID NO: 465780 - DNA, 15 bp, Homo sapiens
tcacattatagcttt

SEQ ID NO: 465781 - DNA, 15 bp, Homo sapiens
cacattatagcttta

SEQ ID NO: 465782 - DNA, 15 bp, Homo sapiens
acattatagctttaa

SEQ ID NO: 465783 - DNA, 15 bp, Homo sapiens
cattatagctttaac

SEQ ID NO: 465784 - DNA, 15 bp, Homo sapiens
attatagctttaacc

SEQ ID NO: 465785 - DNA, 15 bp, Homo sapiens
ttatagctttaacca

SEQ ID NO: 465786 - DNA, 15 bp, Homo sapiens
tatagctttaaccag

SEQ ID NO: 465787 - DNA, 15 bp, Homo sapiens
atagctttaaccagg

SEQ ID NO: 465788 - DNA, 15 bp, Homo sapiens
tagctttaaccagga

SEQ ID NO: 465789 - DNA, 15 bp, Homo sapiens
agctttaaccaggaa

SEQ ID NO: 465790 - DNA, 15 bp, Homo sapiens
gctttaaccaggaaa

SEQ ID NO: 465791 - DNA, 15 bp, Homo sapiens
ctttaaccaggaaaa

SEQ ID NO: 465792 - DNA, 15 bp, Homo sapiens
tttaaccaggaaaaa

SEQ ID NO: 465793 - DNA, 15 bp, Homo sapiens
ttaaccaggaaaaag

SEQ ID NO: 465794 - DNA, 15 bp, Homo sapiens
taaccaggaaaaaga

SEQ ID NO: 465795 - DNA, 15 bp, Homo sapiens
aaccaggaaaaagaa

SEQ ID NO: 465796 - DNA, 15 bp, Homo sapiens
accaggaaaaagaaa

SEQ ID NO: 465797 - DNA, 15 bp, Homo sapiens
ccaggaaaaagaaat

SEQ ID NO: 465798 - DNA, 15 bp, Homo sapiens
caggaaaaagaaatc

SEQ ID NO: 465799 - DNA, 15 bp, Homo sapiens
aggaaaaagaaatct

SEQ ID NO: 465800 - DNA, 15 bp, Homo sapiens
ggaaaaagaaatctc

SEQ ID NO: 465801 - DNA, 15 bp, Homo sapiens
gaaaaagaaatctcc

SEQ ID NO: 465802 - DNA, 15 bp, Homo sapiens
aaaaagaaatctccc

SEQ ID NO: 465803 - DNA, 15 bp, Homo sapiens
aaaagaaatctcccc

SEQ ID NO: 465804 - DNA, 15 bp, Homo sapiens
aaagaaatctcccca

SEQ ID NO: 465805 - DNA, 15 bp, Homo sapiens
aagaaatctccccaa

SEQ ID NO: 465806 - DNA, 15 bp, Homo sapiens
agaaatctccccaag

SEQ ID NO: 465807 - DNA, 15 bp, Homo sapiens
gaaatctccccaaga

SEQ ID NO: 465808 - DNA, 15 bp, Homo sapiens
aaatctccccaagaa

SEQ ID NO: 465809 - DNA, 15 bp, Homo sapiens
aatctccccaagaaa

SEQ ID NO: 465810 - DNA, 15 bp, Homo sapiens
atctccccaagaaaa

SEQ ID NO: 465811 - DNA, 15 bp, Homo sapiens
tctccccaagaaaat

SEQ ID NO: 465812 - DNA, 15 bp, Homo sapiens
ctccccaagaaaatt

SEQ ID NO: 465813 - DNA, 15 bp, Homo sapiens
tccccaagaaaattt

SEQ ID NO: 465814 - DNA, 15 bp, Homo sapiens
ccccaagaaaatttg

SEQ ID NO: 465815 - DNA, 15 bp, Homo sapiens
cccaagaaaatttgt

SEQ ID NO: 465816 - DNA, 15 bp, Homo sapiens
ccaagaaaatttgtg

SEQ ID NO: 465817 - DNA, 15 bp, Homo sapiens
caagaaaatttgtga

SEQ ID NO: 465818 - DNA, 15 bp, Homo sapiens
aagaaaatttgtgag

SEQ ID NO: 465819 - DNA, 15 bp, Homo sapiens
agaaaatttgtgaga

SEQ ID NO: 465820 - DNA, 15 bp, Homo sapiens
gaaaatttgtgagac

SEQ ID NO: 465821 - DNA, 15 bp, Homo sapiens
aaaatttgtgagaca

SEQ ID NO: 465822 - DNA, 15 bp, Homo sapiens
aaatttgtgagacat

SEQ ID NO: 465823 - DNA, 15 bp, Homo sapiens
aatttgtgagacatc

SEQ ID NO: 465824 - DNA, 15 bp, Homo sapiens
atttgtgagacatca

SEQ ID NO: 465825 - DNA, 15 bp, Homo sapiens
tttgtgagacatcat

SEQ ID NO: 465826 - DNA, 15 bp, Homo sapiens
ttgtgagacatcatt

SEQ ID NO: 465827 - DNA, 15 bp, Homo sapiens
tgtgagacatcattt

SEQ ID NO: 465828 - DNA, 15 bp, Homo sapiens
gtgagacatcattta

SEQ ID NO: 465829 - DNA, 15 bp, Homo sapiens
tgagacatcatttat

SEQ ID NO: 465830 - DNA, 15 bp, Homo sapiens
gagacatcatttatt

SEQ ID NO: 465831 - DNA, 15 bp, Homo sapiens
agacatcatttatta

SEQ ID NO: 465832 - DNA, 15 bp, Homo sapiens
gacatcatttattac

SEQ ID NO: 465833 - DNA, 15 bp, Homo sapiens
acatcatttattact

SEQ ID NO: 465834 - DNA, 15 bp, Homo sapiens
catcatttattacta

SEQ ID NO: 465835 - DNA, 15 bp, Homo sapiens
atcatttattactat

SEQ ID NO: 465836 - DNA, 15 bp, Homo sapiens
tcatttattactatt

SEQ ID NO: 465837 - DNA, 15 bp, Homo sapiens
catttattactatta

SEQ ID NO: 465838 - DNA, 15 bp, Homo sapiens
atttattactattat

SEQ ID NO: 465839 - DNA, 15 bp, Homo sapiens
tttattactattatc

SEQ ID NO: 465840 - DNA, 15 bp, Homo sapiens
ttattactattatca

SEQ ID NO: 465841 - DNA, 15 bp, Homo sapiens
tattactattatcaa

SEQ ID NO: 465842 - DNA, 15 bp, Homo sapiens
attactattatcaac

SEQ ID NO: 465843 - DNA, 15 bp, Homo sapiens
ttactattatcaact

SEQ ID NO: 465844 - DNA, 15 bp, Homo sapiens
tactattatcaactt

SEQ ID NO: 465845 - DNA, 15 bp, Homo sapiens
actattatcaactta

SEQ ID NO: 465846 - DNA, 15 bp, Homo sapiens
ctattatcaacttat

SEQ ID NO: 465847 - DNA, 15 bp, Homo sapiens
tattatcaacttatt

SEQ ID NO: 465848 - DNA, 15 bp, Homo sapiens
attatcaacttattc

SEQ ID NO: 465849 - DNA, 15 bp, Homo sapiens
ttatcaacttattca

SEQ ID NO: 465850 - DNA, 15 bp, Homo sapiens
tatcaacttattcac

SEQ ID NO: 465851 - DNA, 15 bp, Homo sapiens
atcaacttattcact

SEQ ID NO: 465852 - DNA, 15 bp, Homo sapiens
tcaacttattcactc

SEQ ID NO: 465853 - DNA, 15 bp, Homo sapiens
caacttattcactca

SEQ ID NO: 465854 - DNA, 15 bp, Homo sapiens
aacttattcactcaa

SEQ ID NO: 465855 - DNA, 15 bp, Homo sapiens
acttattcactcaac

SEQ ID NO: 465856 - DNA, 15 bp, Homo sapiens
cttattcactcaaca

SEQ ID NO: 465857 - DNA, 15 bp, Homo sapiens
ttattcactcaacaa

SEQ ID NO: 465858 - DNA, 15 bp, Homo sapiens
tattcactcaacaaa

SEQ ID NO: 465859 - DNA, 15 bp, Homo sapiens
attcactcaacaaat

SEQ ID NO: 465860 - DNA, 15 bp, Homo sapiens
ttcactcaacaaatt

SEQ ID NO: 465861 - DNA, 15 bp, Homo sapiens
tcactcaacaaatta

SEQ ID NO: 465862 - DNA, 15 bp, Homo sapiens
cactcaacaaattaa

SEQ ID NO: 465863 - DNA, 15 bp, Homo sapiens
actcaacaaattaat

SEQ ID NO: 465864 - DNA, 15 bp, Homo sapiens
ctcaacaaattaata

SEQ ID NO: 465865 - DNA, 15 bp, Homo sapiens
tcaacaaattaatat

SEQ ID NO: 465866 - DNA, 15 bp, Homo sapiens
caacaaattaatatt

SEQ ID NO: 465867 - DNA, 15 bp, Homo sapiens
aacaaattaatattg

SEQ ID NO: 465868 - DNA, 15 bp, Homo sapiens
acaaattaatattga

SEQ ID NO: 465869 - DNA, 15 bp, Homo sapiens
caaattaatattgaa

SEQ ID NO: 465870 - DNA, 15 bp, Homo sapiens
aaattaatattgaac

SEQ ID NO: 465871 - DNA, 15 bp, Homo sapiens
aattaatattgaaca

SEQ ID NO: 465872 - DNA, 15 bp, Homo sapiens
attaatattgaacat

SEQ ID NO: 465873 - DNA, 15 bp, Homo sapiens
ttaatattgaacatt

SEQ ID NO: 465874 - DNA, 15 bp, Homo sapiens
taatattgaacattt

SEQ ID NO: 465875 - DNA, 15 bp, Homo sapiens
aatattgaacatttt

SEQ ID NO: 465876 - DNA, 15 bp, Homo sapiens
atattgaacattttg

SEQ ID NO: 465877 - DNA, 15 bp, Homo sapiens
tattgaacattttgc

SEQ ID NO: 465878 - DNA, 15 bp, Homo sapiens
attgaacattttgca

SEQ ID NO: 465879 - DNA, 15 bp, Homo sapiens
ttgaacattttgcag

SEQ ID NO: 465880 - DNA, 15 bp, Homo sapiens
tgaacattttgcagg

SEQ ID NO: 465881 - DNA, 15 bp, Homo sapiens
gaacattttgcaggt

SEQ ID NO: 465882 - DNA, 15 bp, Homo sapiens
aacattttgcaggtg

SEQ ID NO: 465883 - DNA, 15 bp, Homo sapiens
acattttgcaggtgt

SEQ ID NO: 465884 - DNA, 15 bp, Homo sapiens
cattttgcaggtgtc

SEQ ID NO: 465885 - DNA, 15 bp, Homo sapiens
attttgcaggtgtca

SEQ ID NO: 465886 - DNA, 15 bp, Homo sapiens
ttttgcaggtgtcag

SEQ ID NO: 465887 - DNA, 15 bp, Homo sapiens
tttgcaggtgtcagg

SEQ ID NO: 465888 - DNA, 15 bp, Homo sapiens
ttgcaggtgtcaggc

SEQ ID NO: 465889 - DNA, 15 bp, Homo sapiens
tgcaggtgtcaggcc

SEQ ID NO: 465890 - DNA, 15 bp, Homo sapiens
gcaggtgtcaggccc

SEQ ID NO: 465891 - DNA, 15 bp, Homo sapiens
caggtgtcaggccct

SEQ ID NO: 465892 - DNA, 15 bp, Homo sapiens
aggtgtcaggccctc

SEQ ID NO: 465893 - DNA, 15 bp, Homo sapiens
ggtgtcaggccctct

SEQ ID NO: 465894 - DNA, 15 bp, Homo sapiens
gtgtcaggccctctt

SEQ ID NO: 465895 - DNA, 15 bp, Homo sapiens
tgtcaggccctcttg

SEQ ID NO: 465896 - DNA, 15 bp, Homo sapiens
gtcaggccctcttgt

SEQ ID NO: 465897 - DNA, 15 bp, Homo sapiens
tcaggccctcttgtc

SEQ ID NO: 465898 - DNA, 15 bp, Homo sapiens
caggccctcttgtca

SEQ ID NO: 465899 - DNA, 15 bp, Homo sapiens
aggccctcttgtcaa

SEQ ID NO: 465900 - DNA, 15 bp, Homo sapiens
ggccctcttgtcaaa

SEQ ID NO: 465901 - DNA, 15 bp, Homo sapiens
gccctcttgtcaaag

SEQ ID NO: 465902 - DNA, 15 bp, Homo sapiens
ccctcttgtcaaaga

SEQ ID NO: 465903 - DNA, 15 bp, Homo sapiens
cctcttgtcaaagat

SEQ ID NO: 465904 - DNA, 15 bp, Homo sapiens
ctcttgtcaaagata

SEQ ID NO: 465905 - DNA, 15 bp, Homo sapiens
tcttgtcaaagataa

SEQ ID NO: 465906 - DNA, 15 bp, Homo sapiens
cttgtcaaagataag

SEQ ID NO: 465907 - DNA, 15 bp, Homo sapiens
ttgtcaaagataagc

SEQ ID NO: 465908 - DNA, 15 bp, Homo sapiens
tgtcaaagataagca

SEQ ID NO: 465909 - DNA, 15 bp, Homo sapiens
gtcaaagataagcaa

SEQ ID NO: 465910 - DNA, 15 bp, Homo sapiens
tcaaagataagcaaa

SEQ ID NO: 465911 - DNA, 15 bp, Homo sapiens
caaagataagcaaaa

SEQ ID NO: 465912 - DNA, 15 bp, Homo sapiens
aaagataagcaaaac

SEQ ID NO: 465913 - DNA, 15 bp, Homo sapiens
aagataagcaaaacc

SEQ ID NO: 465914 - DNA, 15 bp, Homo sapiens
agataagcaaaacca

SEQ ID NO: 465915 - DNA, 15 bp, Homo sapiens
gataagcaaaaccag

SEQ ID NO: 465916 - DNA, 15 bp, Homo sapiens
ataagcaaaaccaga

SEQ ID NO: 465917 - DNA, 15 bp, Homo sapiens
taagcaaaaccagac

SEQ ID NO: 465918 - DNA, 15 bp, Homo sapiens
aagcaaaaccagaca

SEQ ID NO: 465919 - DNA, 15 bp, Homo sapiens
agcaaaaccagacac

SEQ ID NO: 465920 - DNA, 15 bp, Homo sapiens
gcaaaaccagacact

SEQ ID NO: 465921 - DNA, 15 bp, Homo sapiens
caaaaccagacacta

SEQ ID NO: 465922 - DNA, 15 bp, Homo sapiens
aaaaccagacactag

SEQ ID NO: 465923 - DNA, 15 bp, Homo sapiens
aaaccagacactagt

SEQ ID NO: 465924 - DNA, 15 bp, Homo sapiens
aaccagacactagtt

SEQ ID NO: 465925 - DNA, 15 bp, Homo sapiens
accagacactagtta

SEQ ID NO: 465926 - DNA, 15 bp, Homo sapiens
ccagacactagttaa

SEQ ID NO: 465927 - DNA, 15 bp, Homo sapiens
cagacactagttaaa

SEQ ID NO: 465928 - DNA, 15 bp, Homo sapiens
agacactagttaaag

SEQ ID NO: 465929 - DNA, 15 bp, Homo sapiens
gacactagttaaagt

SEQ ID NO: 465930 - DNA, 15 bp, Homo sapiens
acactagttaaagtg

SEQ ID NO: 465931 - DNA, 15 bp, Homo sapiens
cactagttaaagtgg

SEQ ID NO: 465932 - DNA, 15 bp, Homo sapiens
actagttaaagtggt

SEQ ID NO: 465933 - DNA, 15 bp, Homo sapiens
ctagttaaagtggta

SEQ ID NO: 465934 - DNA, 15 bp, Homo sapiens
tagttaaagtggtaa

SEQ ID NO: 465935 - DNA, 15 bp, Homo sapiens
agttaaagtggtaag

SEQ ID NO: 465936 - DNA, 15 bp, Homo sapiens
gttaaagtggtaagg

SEQ ID NO: 465937 - DNA, 15 bp, Homo sapiens
ttaaagtggtaagga

SEQ ID NO: 465938 - DNA, 15 bp, Homo sapiens
taaagtggtaaggac

SEQ ID NO: 465939 - DNA, 15 bp, Homo sapiens
aaagtggtaaggaca

SEQ ID NO: 465940 - DNA, 15 bp, Homo sapiens
aagtggtaaggacag

SEQ ID NO: 465941 - DNA, 15 bp, Homo sapiens
agtggtaaggacaga

SEQ ID NO: 465942 - DNA, 15 bp, Homo sapiens
gtggtaaggacagat

SEQ ID NO: 465943 - DNA, 15 bp, Homo sapiens
tggtaaggacagatt

SEQ ID NO: 465944 - DNA, 15 bp, Homo sapiens
ggtaaggacagattt

SEQ ID NO: 465945 - DNA, 15 bp, Homo sapiens
gtaaggacagatttt

SEQ ID NO: 465946 - DNA, 15 bp, Homo sapiens
taaggacagatttta

SEQ ID NO: 465947 - DNA, 15 bp, Homo sapiens
aaggacagattttaa

SEQ ID NO: 465948 - DNA, 15 bp, Homo sapiens
aggacagattttaat

SEQ ID NO: 465949 - DNA, 15 bp, Homo sapiens
ggacagattttaatc

SEQ ID NO: 465950 - DNA, 15 bp, Homo sapiens
gacagattttaatca

SEQ ID NO: 465951 - DNA, 15 bp, Homo sapiens
acagattttaatcaa

SEQ ID NO: 465952 - DNA, 15 bp, Homo sapiens
cagattttaatcaat

SEQ ID NO: 465953 - DNA, 15 bp, Homo sapiens
agattttaatcaata

SEQ ID NO: 465954 - DNA, 15 bp, Homo sapiens
gattttaatcaataa

SEQ ID NO: 465955 - DNA, 15 bp, Homo sapiens
attttaatcaataat

SEQ ID NO: 465956 - DNA, 15 bp, Homo sapiens
ttttaatcaataata

SEQ ID NO: 465957 - DNA, 15 bp, Homo sapiens
tttaatcaataatat

SEQ ID NO: 465958 - DNA, 15 bp, Homo sapiens
ttaatcaataatata

SEQ ID NO: 465959 - DNA, 15 bp, Homo sapiens
taatcaataatatac

SEQ ID NO: 465960 - DNA, 15 bp, Homo sapiens
aatcaataatatact

SEQ ID NO: 465961 - DNA, 15 bp, Homo sapiens
atcaataatatactg

SEQ ID NO: 465962 - DNA, 15 bp, Homo sapiens
tcaataatatactga

SEQ ID NO: 465963 - DNA, 15 bp, Homo sapiens
caataatatactgat

SEQ ID NO: 465964 - DNA, 15 bp, Homo sapiens
aataatatactgatt

SEQ ID NO: 465965 - DNA, 15 bp, Homo sapiens
ataatatactgatta

SEQ ID NO: 465966 - DNA, 15 bp, Homo sapiens
taatatactgattat

SEQ ID NO: 465967 - DNA, 15 bp, Homo sapiens
aatatactgattatg

SEQ ID NO: 465968 - DNA, 15 bp, Homo sapiens
atatactgattatgc

SEQ ID NO: 465969 - DNA, 15 bp, Homo sapiens
tatactgattatgca

SEQ ID NO: 465970 - DNA, 15 bp, Homo sapiens
atactgattatgcac

SEQ ID NO: 465971 - DNA, 15 bp, Homo sapiens
tactgattatgcaca

SEQ ID NO: 465972 - DNA, 15 bp, Homo sapiens
actgattatgcacat

SEQ ID NO: 465973 - DNA, 15 bp, Homo sapiens
ctgattatgcacatg

SEQ ID NO: 465974 - DNA, 15 bp, Homo sapiens
tgattatgcacatgt

SEQ ID NO: 465975 - DNA, 15 bp, Homo sapiens
gattatgcacatgta

SEQ ID NO: 465976 - DNA, 15 bp, Homo sapiens
attatgcacatgtat

SEQ ID NO: 465977 - DNA, 15 bp, Homo sapiens
ttatgcacatgtatt

SEQ ID NO: 465978 - DNA, 15 bp, Homo sapiens
tatgcacatgtattt

SEQ ID NO: 465979 - DNA, 15 bp, Homo sapiens
atgcacatgtatttc

SEQ ID NO: 465980 - DNA, 15 bp, Homo sapiens
tgcacatgtatttct

SEQ ID NO: 465981 - DNA, 15 bp, Homo sapiens
gcacatgtatttctg

SEQ ID NO: 465982 - DNA, 15 bp, Homo sapiens
cacatgtatttctgt

SEQ ID NO: 465983 - DNA, 15 bp, Homo sapiens
acatgtatttctgtt

SEQ ID NO: 465984 - DNA, 15 bp, Homo sapiens
catgtatttctgttt

SEQ ID NO: 465985 - DNA, 15 bp, Homo sapiens
atgtatttctgtttg

SEQ ID NO: 465986 - DNA, 15 bp, Homo sapiens
tgtatttctgtttgt

SEQ ID NO: 465987 - DNA, 15 bp, Homo sapiens
gtatttctgtttgta

SEQ ID NO: 465988 - DNA, 15 bp, Homo sapiens
tatttctgtttgtac

SEQ ID NO: 465989 - DNA, 15 bp, Homo sapiens
atttctgtttgtaca

SEQ ID NO: 465990 - DNA, 15 bp, Homo sapiens
tttctgtttgtacag

SEQ ID NO: 465991 - DNA, 15 bp, Homo sapiens
ttctgtttgtacaga

SEQ ID NO: 465992 - DNA, 15 bp, Homo sapiens
tctgtttgtacagag

SEQ ID NO: 465993 - DNA, 15 bp, Homo sapiens
ctgtttgtacagagg

SEQ ID NO: 465994 - DNA, 15 bp, Homo sapiens
tgtttgtacagaggt

SEQ ID NO: 465995 - DNA, 15 bp, Homo sapiens
gtttgtacagaggtg

SEQ ID NO: 465996 - DNA, 15 bp, Homo sapiens
tttgtacagaggtga

SEQ ID NO: 465997 - DNA, 15 bp, Homo sapiens
ttgtacagaggtgac

SEQ ID NO: 465998 - DNA, 15 bp, Homo sapiens
tgtacagaggtgact

SEQ ID NO: 465999 - DNA, 15 bp, Homo sapiens
gtacagaggtgactg

SEQ ID NO: 466000 - DNA, 15 bp, Homo sapiens
tacagaggtgactgg

SEQ ID NO: 466001 - DNA, 15 bp, Homo sapiens
acagaggtgactggg

SEQ ID NO: 466002 - DNA, 15 bp, Homo sapiens
cagaggtgactgggt

SEQ ID NO: 466003 - DNA, 15 bp, Homo sapiens
agaggtgactgggtg

SEQ ID NO: 466004 - DNA, 15 bp, Homo sapiens
gaggtgactgggtgt

SEQ ID NO: 466005 - DNA, 15 bp, Homo sapiens
aggtgactgggtgtt

SEQ ID NO: 466006 - DNA, 15 bp, Homo sapiens
ggtgactgggtgttt

SEQ ID NO: 466007 - DNA, 15 bp, Homo sapiens
gtgactgggtgtttt

SEQ ID NO: 466008 - DNA, 15 bp, Homo sapiens
tgactgggtgttttc

SEQ ID NO: 466009 - DNA, 15 bp, Homo sapiens
gactgggtgttttca

SEQ ID NO: 466010 - DNA, 15 bp, Homo sapiens
actgggtgttttcag

SEQ ID NO: 466011 - DNA, 15 bp, Homo sapiens
ctgggtgttttcaga

SEQ ID NO: 466012 - DNA, 15 bp, Homo sapiens
tgggtgttttcagaa

SEQ ID NO: 466013 - DNA, 15 bp, Homo sapiens
gggtgttttcagaag

SEQ ID NO: 466014 - DNA, 15 bp, Homo sapiens
ggtgttttcagaagg

SEQ ID NO: 466015 - DNA, 15 bp, Homo sapiens
gtgttttcagaaggg

SEQ ID NO: 466016 - DNA, 15 bp, Homo sapiens
tgttttcagaaggga

SEQ ID NO: 466017 - DNA, 15 bp, Homo sapiens
gttttcagaagggaa

SEQ ID NO: 466018 - DNA, 15 bp, Homo sapiens
ttttcagaagggaat

SEQ ID NO: 466019 - DNA, 15 bp, Homo sapiens
tttcagaagggaata

SEQ ID NO: 466020 - DNA, 15 bp, Homo sapiens
ttcagaagggaatag

SEQ ID NO: 466021 - DNA, 15 bp, Homo sapiens
tcagaagggaataga

SEQ ID NO: 466022 - DNA, 15 bp, Homo sapiens
cagaagggaatagac

SEQ ID NO: 466023 - DNA, 15 bp, Homo sapiens
agaagggaatagact

SEQ ID NO: 466024 - DNA, 15 bp, Homo sapiens
gaagggaatagactg

SEQ ID NO: 466025 - DNA, 15 bp, Homo sapiens
aagggaatagactgg

SEQ ID NO: 466026 - DNA, 15 bp, Homo sapiens
agggaatagactggg

SEQ ID NO: 466027 - DNA, 15 bp, Homo sapiens
gggaatagactgggg

SEQ ID NO: 466028 - DNA, 15 bp, Homo sapiens
ggaatagactgggga

SEQ ID NO: 466029 - DNA, 15 bp, Homo sapiens
gaatagactggggaa

SEQ ID NO: 466030 - DNA, 15 bp, Homo sapiens
aatagactggggaaa

SEQ ID NO: 466031 - DNA, 15 bp, Homo sapiens
atagactggggaaac

SEQ ID NO: 466032 - DNA, 15 bp, Homo sapiens
tagactggggaaaca

SEQ ID NO: 466033 - DNA, 15 bp, Homo sapiens
agactggggaaacaa

SEQ ID NO: 466034 - DNA, 15 bp, Homo sapiens
gactggggaaacaaa

SEQ ID NO: 466035 - DNA, 15 bp, Homo sapiens
actggggaaacaaaa

SEQ ID NO: 466036 - DNA, 15 bp, Homo sapiens
ctggggaaacaaaag

SEQ ID NO: 466037 - DNA, 15 bp, Homo sapiens
tggggaaacaaaaga

SEQ ID NO: 466038 - DNA, 15 bp, Homo sapiens
ggggaaacaaaagag

SEQ ID NO: 466039 - DNA, 15 bp, Homo sapiens
gggaaacaaaagagg

SEQ ID NO: 466040 - DNA, 15 bp, Homo sapiens
ggaaacaaaagaggg

SEQ ID NO: 466041 - DNA, 15 bp, Homo sapiens
gaaacaaaagaggga

SEQ ID NO: 466042 - DNA, 15 bp, Homo sapiens
aaacaaaagagggac

SEQ ID NO: 466043 - DNA, 15 bp, Homo sapiens
aacaaaagagggact

SEQ ID NO: 466044 - DNA, 15 bp, Homo sapiens
acaaaagagggactt

SEQ ID NO: 466045 - DNA, 15 bp, Homo sapiens
caaaagagggacttg

SEQ ID NO: 466046 - DNA, 15 bp, Homo sapiens
aaaagagggacttga

SEQ ID NO: 466047 - DNA, 15 bp, Homo sapiens
aaagagggacttgag

SEQ ID NO: 466048 - DNA, 15 bp, Homo sapiens
aagagggacttgagc

SEQ ID NO: 466049 - DNA, 15 bp, Homo sapiens
agagggacttgagca

SEQ ID NO: 466050 - DNA, 15 bp, Homo sapiens
gagggacttgagcag

SEQ ID NO: 466051 - DNA, 15 bp, Homo sapiens
agggacttgagcaga

SEQ ID NO: 466052 - DNA, 15 bp, Homo sapiens
gggacttgagcagag

SEQ ID NO: 466053 - DNA, 15 bp, Homo sapiens
ggacttgagcagagg

SEQ ID NO: 466054 - DNA, 15 bp, Homo sapiens
gacttgagcagaggc

SEQ ID NO: 466055 - DNA, 15 bp, Homo sapiens
acttgagcagaggca

SEQ ID NO: 466056 - DNA, 15 bp, Homo sapiens
cttgagcagaggcaa

SEQ ID NO: 466057 - DNA, 15 bp, Homo sapiens
ttgagcagaggcaag

SEQ ID NO: 466058 - DNA, 15 bp, Homo sapiens
tgagcagaggcaagg

SEQ ID NO: 466059 - DNA, 15 bp, Homo sapiens
gagcagaggcaagga

SEQ ID NO: 466060 - DNA, 15 bp, Homo sapiens
agcagaggcaaggaa

SEQ ID NO: 466061 - DNA, 15 bp, Homo sapiens
gcagaggcaaggaag

SEQ ID NO: 466062 - DNA, 15 bp, Homo sapiens
cagaggcaaggaagt

SEQ ID NO: 466063 - DNA, 15 bp, Homo sapiens
agaggcaaggaagtg

SEQ ID NO: 466064 - DNA, 15 bp, Homo sapiens
gaggcaaggaagtga

SEQ ID NO: 466065 - DNA, 15 bp, Homo sapiens
aggcaaggaagtgaa

SEQ ID NO: 466066 - DNA, 15 bp, Homo sapiens
ggcaaggaagtgaaa

SEQ ID NO: 466067 - DNA, 15 bp, Homo sapiens
gcaaggaagtgaaaa

SEQ ID NO: 466068 - DNA, 15 bp, Homo sapiens
caaggaagtgaaaaa

SEQ ID NO: 466069 - DNA, 15 bp, Homo sapiens
aaggaagtgaaaaat

SEQ ID NO: 466070 - DNA, 15 bp, Homo sapiens
aggaagtgaaaaatg

SEQ ID NO: 466071 - DNA, 15 bp, Homo sapiens
ggaagtgaaaaatga

SEQ ID NO: 466072 - DNA, 15 bp, Homo sapiens
gaagtgaaaaatgac

SEQ ID NO: 466073 - DNA, 15 bp, Homo sapiens
aagtgaaaaatgaca

SEQ ID NO: 466074 - DNA, 15 bp, Homo sapiens
agtgaaaaatgacaa

SEQ ID NO: 466075 - DNA, 15 bp, Homo sapiens
gtgaaaaatgacaaa

SEQ ID NO: 466076 - DNA, 15 bp, Homo sapiens
tgaaaaatgacaaag

SEQ ID NO: 466077 - DNA, 15 bp, Homo sapiens
gaaaaatgacaaagc

SEQ ID NO: 466078 - DNA, 15 bp, Homo sapiens
aaaaatgacaaagca

SEQ ID NO: 466079 - DNA, 15 bp, Homo sapiens
aaaatgacaaagcat

SEQ ID NO: 466080 - DNA, 15 bp, Homo sapiens
aaatgacaaagcatt

SEQ ID NO: 466081 - DNA, 15 bp, Homo sapiens
aatgacaaagcattg

SEQ ID NO: 466082 - DNA, 15 bp, Homo sapiens
atgacaaagcattgg

SEQ ID NO: 466083 - DNA, 15 bp, Homo sapiens
tgacaaagcattggt

SEQ ID NO: 466084 - DNA, 15 bp, Homo sapiens
gacaaagcattggtc

SEQ ID NO: 466085 - DNA, 15 bp, Homo sapiens
acaaagcattggtca

SEQ ID NO: 466086 - DNA, 15 bp, Homo sapiens
caaagcattggtcag

SEQ ID NO: 466087 - DNA, 15 bp, Homo sapiens
aaagcattggtcagc

SEQ ID NO: 466088 - DNA, 15 bp, Homo sapiens
aagcattggtcagca

SEQ ID NO: 466089 - DNA, 15 bp, Homo sapiens
agcattggtcagcat

SEQ ID NO: 466090 - DNA, 15 bp, Homo sapiens
gcattggtcagcatc

SEQ ID NO: 466091 - DNA, 15 bp, Homo sapiens
cattggtcagcatca

SEQ ID NO: 466092 - DNA, 15 bp, Homo sapiens
attggtcagcatcag

SEQ ID NO: 466093 - DNA, 15 bp, Homo sapiens
ttggtcagcatcagt

SEQ ID NO: 466094 - DNA, 15 bp, Homo sapiens
tggtcagcatcagtt

SEQ ID NO: 466095 - DNA, 15 bp, Homo sapiens
ggtcagcatcagttc

SEQ ID NO: 466096 - DNA, 15 bp, Homo sapiens
gtcagcatcagttcc

SEQ ID NO: 466097 - DNA, 15 bp, Homo sapiens
tcagcatcagttcca

SEQ ID NO: 466098 - DNA, 15 bp, Homo sapiens
cagcatcagttccat

SEQ ID NO: 466099 - DNA, 15 bp, Homo sapiens
agcatcagttccatc

SEQ ID NO: 466100 - DNA, 15 bp, Homo sapiens
gcatcagttccatca

SEQ ID NO: 466101 - DNA, 15 bp, Homo sapiens
catcagttccatcag

SEQ ID NO: 466102 - DNA, 15 bp, Homo sapiens
atcagttccatcaga

SEQ ID NO: 466103 - DNA, 15 bp, Homo sapiens
tcagttccatcagac

SEQ ID NO: 466104 - DNA, 15 bp, Homo sapiens
cagttccatcagacc

SEQ ID NO: 466105 - DNA, 15 bp, Homo sapiens
agttccatcagacca

SEQ ID NO: 466106 - DNA, 15 bp, Homo sapiens
gttccatcagaccag

SEQ ID NO: 466107 - DNA, 15 bp, Homo sapiens
ttccatcagaccagc

SEQ ID NO: 466108 - DNA, 15 bp, Homo sapiens
tccatcagaccagct

SEQ ID NO: 466109 - DNA, 15 bp, Homo sapiens
ccatcagaccagctg

SEQ ID NO: 466110 - DNA, 15 bp, Homo sapiens
catcagaccagctgt

SEQ ID NO: 466111 - DNA, 15 bp, Homo sapiens
atcagaccagctgtg

SEQ ID NO: 466112 - DNA, 15 bp, Homo sapiens
tcagaccagctgtgt

SEQ ID NO: 466113 - DNA, 15 bp, Homo sapiens
cagaccagctgtgtc

SEQ ID NO: 466114 - DNA, 15 bp, Homo sapiens
agaccagctgtgtct

SEQ ID NO: 466115 - DNA, 15 bp, Homo sapiens
gaccagctgtgtctg

SEQ ID NO: 466116 - DNA, 15 bp, Homo sapiens
accagctgtgtctgt

SEQ ID NO: 466117 - DNA, 15 bp, Homo sapiens
ccagctgtgtctgtg

SEQ ID NO: 466118 - DNA, 15 bp, Homo sapiens
cagctgtgtctgtga

SEQ ID NO: 466119 - DNA, 15 bp, Homo sapiens
agctgtgtctgtgag

SEQ ID NO: 466120 - DNA, 15 bp, Homo sapiens
gctgtgtctgtgagc

SEQ ID NO: 466121 - DNA, 15 bp, Homo sapiens
ctgtgtctgtgagct

SEQ ID NO: 466122 - DNA, 15 bp, Homo sapiens
tgtgtctgtgagctg

SEQ ID NO: 466123 - DNA, 15 bp, Homo sapiens
gtgtctgtgagctgg

SEQ ID NO: 466124 - DNA, 15 bp, Homo sapiens
tgtctgtgagctggc

SEQ ID NO: 466125 - DNA, 15 bp, Homo sapiens
gtctgtgagctggca

SEQ ID NO: 466126 - DNA, 15 bp, Homo sapiens
tctgtgagctggcaa

SEQ ID NO: 466127 - DNA, 15 bp, Homo sapiens
ctgtgagctggcaat

SEQ ID NO: 466128 - DNA, 15 bp, Homo sapiens
tgtgagctggcaatt

SEQ ID NO: 466129 - DNA, 15 bp, Homo sapiens
gtgagctggcaattg

SEQ ID NO: 466130 - DNA, 15 bp, Homo sapiens
tgagctggcaattgt

SEQ ID NO: 466131 - DNA, 15 bp, Homo sapiens
gagctggcaattgtc

SEQ ID NO: 466132 - DNA, 15 bp, Homo sapiens
agctggcaattgtca

SEQ ID NO: 466133 - DNA, 15 bp, Homo sapiens
gctggcaattgtcag

SEQ ID NO: 466134 - DNA, 15 bp, Homo sapiens
ctggcaattgtcaga

SEQ ID NO: 466135 - DNA, 15 bp, Homo sapiens
tggcaattgtcagag

SEQ ID NO: 466136 - DNA, 15 bp, Homo sapiens
ggcaattgtcagagt

SEQ ID NO: 466137 - DNA, 15 bp, Homo sapiens
gcaattgtcagagtt

SEQ ID NO: 466138 - DNA, 15 bp, Homo sapiens
caattgtcagagtta

SEQ ID NO: 466139 - DNA, 15 bp, Homo sapiens
aattgtcagagttag

SEQ ID NO: 466140 - DNA, 15 bp, Homo sapiens
attgtcagagttagg

SEQ ID NO: 466141 - DNA, 15 bp, Homo sapiens
ttgtcagagttagga

SEQ ID NO: 466142 - DNA, 15 bp, Homo sapiens
tgtcagagttaggat

SEQ ID NO: 466143 - DNA, 15 bp, Homo sapiens
gtcagagttaggatt

SEQ ID NO: 466144 - DNA, 15 bp, Homo sapiens
tcagagttaggattc

SEQ ID NO: 466145 - DNA, 15 bp, Homo sapiens
cagagttaggattct

SEQ ID NO: 466146 - DNA, 15 bp, Homo sapiens
agagttaggattcta

SEQ ID NO: 466147 - DNA, 15 bp, Homo sapiens
gagttaggattctac

SEQ ID NO: 466148 - DNA, 15 bp, Homo sapiens
agttaggattctacc

SEQ ID NO: 466149 - DNA, 15 bp, Homo sapiens
gttaggattctacca

SEQ ID NO: 466150 - DNA, 15 bp, Homo sapiens
ttaggattctaccat

SEQ ID NO: 466151 - DNA, 15 bp, Homo sapiens
taggattctaccatt

SEQ ID NO: 466152 - DNA, 15 bp, Homo sapiens
aggattctaccattc

SEQ ID NO: 466153 - DNA, 15 bp, Homo sapiens
ggattctaccattcc

SEQ ID NO: 466154 - DNA, 15 bp, Homo sapiens
gattctaccattcca

SEQ ID NO: 466155 - DNA, 15 bp, Homo sapiens
attctaccattccag

SEQ ID NO: 466156 - DNA, 15 bp, Homo sapiens
ttctaccattccaga

SEQ ID NO: 466157 - DNA, 15 bp, Homo sapiens
tctaccattccagag

SEQ ID NO: 466158 - DNA, 15 bp, Homo sapiens
ctaccattccagaga

SEQ ID NO: 466159 - DNA, 15 bp, Homo sapiens
taccattccagagag

SEQ ID NO: 466160 - DNA, 15 bp, Homo sapiens
accattccagagaga

SEQ ID NO: 466161 - DNA, 15 bp, Homo sapiens
ccattccagagagag

SEQ ID NO: 466162 - DNA, 15 bp, Homo sapiens
cattccagagagaga

SEQ ID NO: 466163 - DNA, 15 bp, Homo sapiens
attccagagagagac

SEQ ID NO: 466164 - DNA, 15 bp, Homo sapiens
ttccagagagagact

SEQ ID NO: 466165 - DNA, 15 bp, Homo sapiens
tccagagagagactg

SEQ ID NO: 466166 - DNA, 15 bp, Homo sapiens
ccagagagagactgg

SEQ ID NO: 466167 - DNA, 15 bp, Homo sapiens
cagagagagactggg

SEQ ID NO: 466168 - DNA, 15 bp, Homo sapiens
agagagagactggga

SEQ ID NO: 466169 - DNA, 15 bp, Homo sapiens
gagagagactgggag

SEQ ID NO: 466170 - DNA, 15 bp, Homo sapiens
agagagactgggaga

SEQ ID NO: 466171 - DNA, 15 bp, Homo sapiens
gagagactgggagac

SEQ ID NO: 466172 - DNA, 15 bp, Homo sapiens
agagactgggagaca

SEQ ID NO: 466173 - DNA, 15 bp, Homo sapiens
gagactgggagacag

SEQ ID NO: 466174 - DNA, 15 bp, Homo sapiens
agactgggagacagg

SEQ ID NO: 466175 - DNA, 15 bp, Homo sapiens
gactgggagacaggg

SEQ ID NO: 466176 - DNA, 15 bp, Homo sapiens
actgggagacagggg

SEQ ID NO: 466177 - DNA, 15 bp, Homo sapiens
ctgggagacaggggt

SEQ ID NO: 466178 - DNA, 15 bp, Homo sapiens
tgggagacaggggtc

SEQ ID NO: 466179 - DNA, 15 bp, Homo sapiens
gggagacaggggtcc

SEQ ID NO: 466180 - DNA, 15 bp, Homo sapiens
ggagacaggggtcct

SEQ ID NO: 466181 - DNA, 15 bp, Homo sapiens
gagacaggggtccta

SEQ ID NO: 466182 - DNA, 15 bp, Homo sapiens
agacaggggtcctat

SEQ ID NO: 466183 - DNA, 15 bp, Homo sapiens
gacaggggtcctatc

SEQ ID NO: 466184 - DNA, 15 bp, Homo sapiens
acaggggtcctatcc

SEQ ID NO: 466185 - DNA, 15 bp, Homo sapiens
caggggtcctatcct

SEQ ID NO: 466186 - DNA, 15 bp, Homo sapiens
aggggtcctatcctt

SEQ ID NO: 466187 - DNA, 15 bp, Homo sapiens
ggggtcctatccttc

SEQ ID NO: 466188 - DNA, 15 bp, Homo sapiens
gggtcctatccttcc

SEQ ID NO: 466189 - DNA, 15 bp, Homo sapiens
ggtcctatccttcct

SEQ ID NO: 466190 - DNA, 15 bp, Homo sapiens
gtcctatccttcctg

SEQ ID NO: 466191 - DNA, 15 bp, Homo sapiens
tcctatccttcctga

SEQ ID NO: 466192 - DNA, 15 bp, Homo sapiens
cctatccttcctgat

SEQ ID NO: 466193 - DNA, 15 bp, Homo sapiens
ctatccttcctgatg

SEQ ID NO: 466194 - DNA, 15 bp, Homo sapiens
tatccttcctgatga

SEQ ID NO: 466195 - DNA, 15 bp, Homo sapiens
atccttcctgatgat

SEQ ID NO: 466196 - DNA, 15 bp, Homo sapiens
tccttcctgatgatt

SEQ ID NO: 466197 - DNA, 15 bp, Homo sapiens
ccttcctgatgatta

SEQ ID NO: 466198 - DNA, 15 bp, Homo sapiens
cttcctgatgattac

SEQ ID NO: 466199 - DNA, 15 bp, Homo sapiens
ttcctgatgattaca

SEQ ID NO: 466200 - DNA, 15 bp, Homo sapiens
tcctgatgattacat

SEQ ID NO: 466201 - DNA, 15 bp, Homo sapiens
cctgatgattacatt

SEQ ID NO: 466202 - DNA, 15 bp, Homo sapiens
ctgatgattacattt

SEQ ID NO: 466203 - DNA, 15 bp, Homo sapiens
tgatgattacatttc

SEQ ID NO: 466204 - DNA, 15 bp, Homo sapiens
gatgattacatttca

SEQ ID NO: 466205 - DNA, 15 bp, Homo sapiens
atgattacatttcaa

SEQ ID NO: 466206 - DNA, 15 bp, Homo sapiens
tgattacatttcaaa

SEQ ID NO: 466207 - DNA, 15 bp, Homo sapiens
gattacatttcaaag

SEQ ID NO: 466208 - DNA, 15 bp, Homo sapiens
attacatttcaaaga

SEQ ID NO: 466209 - DNA, 15 bp, Homo sapiens
ttacatttcaaagaa

SEQ ID NO: 466210 - DNA, 15 bp, Homo sapiens
tacatttcaaagaaa

SEQ ID NO: 466211 - DNA, 15 bp, Homo sapiens
acatttcaaagaaat

SEQ ID NO: 466212 - DNA, 15 bp, Homo sapiens
catttcaaagaaatg

SEQ ID NO: 466213 - DNA, 15 bp, Homo sapiens
atttcaaagaaatgg

SEQ ID NO: 466214 - DNA, 15 bp, Homo sapiens
tttcaaagaaatggt

SEQ ID NO: 466215 - DNA, 15 bp, Homo sapiens
ttcaaagaaatggtt

SEQ ID NO: 466216 - DNA, 15 bp, Homo sapiens
tcaaagaaatggttt

SEQ ID NO: 466217 - DNA, 15 bp, Homo sapiens
caaagaaatggtttt

SEQ ID NO: 466218 - DNA, 15 bp, Homo sapiens
aaagaaatggttttc

SEQ ID NO: 466219 - DNA, 15 bp, Homo sapiens
aagaaatggttttca

SEQ ID NO: 466220 - DNA, 15 bp, Homo sapiens
agaaatggttttcag

SEQ ID NO: 466221 - DNA, 15 bp, Homo sapiens
gaaatggttttcaga

SEQ ID NO: 466222 - DNA, 15 bp, Homo sapiens
aaatggttttcagat

SEQ ID NO: 466223 - DNA, 15 bp, Homo sapiens
aatggttttcagatc

SEQ ID NO: 466224 - DNA, 15 bp, Homo sapiens
atggttttcagatcc

SEQ ID NO: 466225 - DNA, 15 bp, Homo sapiens
tggttttcagatcct

SEQ ID NO: 466226 - DNA, 15 bp, Homo sapiens
ggttttcagatcctt

SEQ ID NO: 466227 - DNA, 15 bp, Homo sapiens
gttttcagatccttg

SEQ ID NO: 466228 - DNA, 15 bp, Homo sapiens
ttttcagatccttga

SEQ ID NO: 466229 - DNA, 15 bp, Homo sapiens
tttcagatccttgag

SEQ ID NO: 466230 - DNA, 15 bp, Homo sapiens
ttcagatccttgaga

SEQ ID NO: 466231 - DNA, 15 bp, Homo sapiens
tcagatccttgagaa

SEQ ID NO: 466232 - DNA, 15 bp, Homo sapiens
cagatccttgagaaa

SEQ ID NO: 466233 - DNA, 15 bp, Homo sapiens
agatccttgagaaag

SEQ ID NO: 466234 - DNA, 15 bp, Homo sapiens
gatccttgagaaaga

SEQ ID NO: 466235 - DNA, 15 bp, Homo sapiens
atccttgagaaagac

SEQ ID NO: 466236 - DNA, 15 bp, Homo sapiens
tccttgagaaagaca

SEQ ID NO: 466237 - DNA, 15 bp, Homo sapiens
ccttgagaaagacac

SEQ ID NO: 466238 - DNA, 15 bp, Homo sapiens
cttgagaaagacact

SEQ ID NO: 466239 - DNA, 15 bp, Homo sapiens
ttgagaaagacactc

SEQ ID NO: 466240 - DNA, 15 bp, Homo sapiens
tgagaaagacactcc

SEQ ID NO: 466241 - DNA, 15 bp, Homo sapiens
gagaaagacactcct

SEQ ID NO: 466242 - DNA, 15 bp, Homo sapiens
agaaagacactcctg

SEQ ID NO: 466243 - DNA, 15 bp, Homo sapiens
gaaagacactcctga

SEQ ID NO: 466244 - DNA, 15 bp, Homo sapiens
aaagacactcctgag

SEQ ID NO: 466245 - DNA, 15 bp, Homo sapiens
aagacactcctgagt

SEQ ID NO: 466246 - DNA, 15 bp, Homo sapiens
agacactcctgagtt

SEQ ID NO: 466247 - DNA, 15 bp, Homo sapiens
gacactcctgagttg

SEQ ID NO: 466248 - DNA, 15 bp, Homo sapiens
acactcctgagttgt

SEQ ID NO: 466249 - DNA, 15 bp, Homo sapiens
cactcctgagttgtt

SEQ ID NO: 466250 - DNA, 15 bp, Homo sapiens
actcctgagttgttg

SEQ ID NO: 466251 - DNA, 15 bp, Homo sapiens
ctcctgagttgttgg

SEQ ID NO: 466252 - DNA, 15 bp, Homo sapiens
tcctgagttgttgga

SEQ ID NO: 466253 - DNA, 15 bp, Homo sapiens
cctgagttgttggag

SEQ ID NO: 466254 - DNA, 15 bp, Homo sapiens
ctgagttgttggaga

SEQ ID NO: 466255 - DNA, 15 bp, Homo sapiens
tgagttgttggagat

SEQ ID NO: 466256 - DNA, 15 bp, Homo sapiens
gagttgttggagata

SEQ ID NO: 466257 - DNA, 15 bp, Homo sapiens
agttgttggagatac

SEQ ID NO: 466258 - DNA, 15 bp, Homo sapiens
gttgttggagataca

SEQ ID NO: 466259 - DNA, 15 bp, Homo sapiens
ttgttggagatacat

SEQ ID NO: 466260 - DNA, 15 bp, Homo sapiens
tgttggagatacatc

SEQ ID NO: 466261 - DNA, 15 bp, Homo sapiens
gttggagatacatcc

SEQ ID NO: 466262 - DNA, 15 bp, Homo sapiens
ttggagatacatcca

SEQ ID NO: 466263 - DNA, 15 bp, Homo sapiens
tggagatacatccac

SEQ ID NO: 466264 - DNA, 15 bp, Homo sapiens
ggagatacatccaca

SEQ ID NO: 466265 - DNA, 15 bp, Homo sapiens
gagatacatccacat

SEQ ID NO: 466266 - DNA, 15 bp, Homo sapiens
agatacatccacatc

SEQ ID NO: 466267 - DNA, 15 bp, Homo sapiens
gatacatccacatct

SEQ ID NO: 466268 - DNA, 15 bp, Homo sapiens
atacatccacatctc

SEQ ID NO: 466269 - DNA, 15 bp, Homo sapiens
tacatccacatctca

SEQ ID NO: 466270 - DNA, 15 bp, Homo sapiens
acatccacatctcaa

SEQ ID NO: 466271 - DNA, 15 bp, Homo sapiens
catccacatctcaaa

SEQ ID NO: 466272 - DNA, 15 bp, Homo sapiens
atccacatctcaaag

SEQ ID NO: 466273 - DNA, 15 bp, Homo sapiens
tccacatctcaaagg

SEQ ID NO: 466274 - DNA, 15 bp, Homo sapiens
ccacatctcaaaggg

SEQ ID NO: 466275 - DNA, 15 bp, Homo sapiens
cacatctcaaaggga

SEQ ID NO: 466276 - DNA, 15 bp, Homo sapiens
acatctcaaagggac

SEQ ID NO: 466277 - DNA, 15 bp, Homo sapiens
catctcaaagggaca

SEQ ID NO: 466278 - DNA, 15 bp, Homo sapiens
atctcaaagggacag

SEQ ID NO: 466279 - DNA, 15 bp, Homo sapiens
tctcaaagggacaga

SEQ ID NO: 466280 - DNA, 15 bp, Homo sapiens
ctcaaagggacagag

SEQ ID NO: 466281 - DNA, 15 bp, Homo sapiens
tcaaagggacagagg

SEQ ID NO: 466282 - DNA, 15 bp, Homo sapiens
caaagggacagagga

SEQ ID NO: 466283 - DNA, 15 bp, Homo sapiens
aaagggacagaggaa

SEQ ID NO: 466284 - DNA, 15 bp, Homo sapiens
aagggacagaggaag

SEQ ID NO: 466285 - DNA, 15 bp, Homo sapiens
agggacagaggaagg

SEQ ID NO: 466286 - DNA, 15 bp, Homo sapiens
gggacagaggaagga

SEQ ID NO: 466287 - DNA, 15 bp, Homo sapiens
ggacagaggaaggat

SEQ ID NO: 466288 - DNA, 15 bp, Homo sapiens
gacagaggaaggatt

SEQ ID NO: 466289 - DNA, 15 bp, Homo sapiens
acagaggaaggattc

SEQ ID NO: 466290 - DNA, 15 bp, Homo sapiens
cagaggaaggattcc

SEQ ID NO: 466291 - DNA, 15 bp, Homo sapiens
agaggaaggattccc

SEQ ID NO: 466292 - DNA, 15 bp, Homo sapiens
gaggaaggattcccc

SEQ ID NO: 466293 - DNA, 15 bp, Homo sapiens
aggaaggattcccca

SEQ ID NO: 466294 - DNA, 15 bp, Homo sapiens
ggaaggattccccat

SEQ ID NO: 466295 - DNA, 15 bp, Homo sapiens
gaaggattccccatt

SEQ ID NO: 466296 - DNA, 15 bp, Homo sapiens
aaggattccccattg

SEQ ID NO: 466297 - DNA, 15 bp, Homo sapiens
aggattccccattgt

SEQ ID NO: 466298 - DNA, 15 bp, Homo sapiens
ggattccccattgta

SEQ ID NO: 466299 - DNA, 15 bp, Homo sapiens
gattccccattgtaa

SEQ ID NO: 466300 - DNA, 15 bp, Homo sapiens
attccccattgtaaa

SEQ ID NO: 466301 - DNA, 15 bp, Homo sapiens
ttccccattgtaaac

SEQ ID NO: 466302 - DNA, 15 bp, Homo sapiens
tccccattgtaaacc

SEQ ID NO: 466303 - DNA, 15 bp, Homo sapiens
ccccattgtaaaccc

SEQ ID NO: 466304 - DNA, 15 bp, Homo sapiens
cccattgtaaaccct

SEQ ID NO: 466305 - DNA, 15 bp, Homo sapiens
ccattgtaaaccctt

SEQ ID NO: 466306 - DNA, 15 bp, Homo sapiens
cattgtaaacccttt

SEQ ID NO: 466307 - DNA, 15 bp, Homo sapiens
attgtaaaccctttc

SEQ ID NO: 466308 - DNA, 15 bp, Homo sapiens
ttgtaaaccctttcc

SEQ ID NO: 466309 - DNA, 15 bp, Homo sapiens
tgtaaaccctttcca

SEQ ID NO: 466310 - DNA, 15 bp, Homo sapiens
gtaaaccctttccag

SEQ ID NO: 466311 - DNA, 15 bp, Homo sapiens
taaaccctttccagt

SEQ ID NO: 466312 - DNA, 15 bp, Homo sapiens
aaaccctttccagta

SEQ ID NO: 466313 - DNA, 15 bp, Homo sapiens
aaccctttccagtaa

SEQ ID NO: 466314 - DNA, 15 bp, Homo sapiens
accctttccagtaaa

SEQ ID NO: 466315 - DNA, 15 bp, Homo sapiens
ccctttccagtaaat

SEQ ID NO: 466316 - DNA, 15 bp, Homo sapiens
cctttccagtaaatg

SEQ ID NO: 466317 - DNA, 15 bp, Homo sapiens
ctttccagtaaatgc

SEQ ID NO: 466318 - DNA, 15 bp, Homo sapiens
tttccagtaaatgcc

SEQ ID NO: 466319 - DNA, 15 bp, Homo sapiens
ttccagtaaatgccc

SEQ ID NO: 466320 - DNA, 15 bp, Homo sapiens
tccagtaaatgccct

SEQ ID NO: 466321 - DNA, 15 bp, Homo sapiens
ccagtaaatgcccta

SEQ ID NO: 466322 - DNA, 15 bp, Homo sapiens
cagtaaatgccctaa

SEQ ID NO: 466323 - DNA, 15 bp, Homo sapiens
agtaaatgccctaag

SEQ ID NO: 466324 - DNA, 15 bp, Homo sapiens
gtaaatgccctaaga

SEQ ID NO: 466325 - DNA, 15 bp, Homo sapiens
taaatgccctaagaa

SEQ ID NO: 466326 - DNA, 15 bp, Homo sapiens
aaatgccctaagaaa

SEQ ID NO: 466327 - DNA, 15 bp, Homo sapiens
aatgccctaagaaag

SEQ ID NO: 466328 - DNA, 15 bp, Homo sapiens
atgccctaagaaaga

SEQ ID NO: 466329 - DNA, 15 bp, Homo sapiens
tgccctaagaaagag

SEQ ID NO: 466330 - DNA, 15 bp, Homo sapiens
gccctaagaaagagt

SEQ ID NO: 466331 - DNA, 15 bp, Homo sapiens
ccctaagaaagagtg

SEQ ID NO: 466332 - DNA, 15 bp, Homo sapiens
cctaagaaagagtga

SEQ ID NO: 466333 - DNA, 15 bp, Homo sapiens
ctaagaaagagtgag

SEQ ID NO: 466334 - DNA, 15 bp, Homo sapiens
taagaaagagtgagc

SEQ ID NO: 466335 - DNA, 15 bp, Homo sapiens
aagaaagagtgagca

SEQ ID NO: 466336 - DNA, 15 bp, Homo sapiens
agaaagagtgagcag

SEQ ID NO: 466337 - DNA, 15 bp, Homo sapiens
gaaagagtgagcagg

SEQ ID NO: 466338 - DNA, 15 bp, Homo sapiens
aaagagtgagcaggg

SEQ ID NO: 466339 - DNA, 15 bp, Homo sapiens
aagagtgagcaggga

SEQ ID NO: 466340 - DNA, 15 bp, Homo sapiens
agagtgagcagggac

SEQ ID NO: 466341 - DNA, 15 bp, Homo sapiens
gagtgagcagggacc

SEQ ID NO: 466342 - DNA, 15 bp, Homo sapiens
agtgagcagggacct

SEQ ID NO: 466343 - DNA, 15 bp, Homo sapiens
gtgagcagggacctg

SEQ ID NO: 466344 - DNA, 15 bp, Homo sapiens
tgagcagggacctgt

SEQ ID NO: 466345 - DNA, 15 bp, Homo sapiens
gagcagggacctgtc

SEQ ID NO: 466346 - DNA, 15 bp, Homo sapiens
agcagggacctgtct

SEQ ID NO: 466347 - DNA, 15 bp, Homo sapiens
gcagggacctgtctt

SEQ ID NO: 466348 - DNA, 15 bp, Homo sapiens
cagggacctgtcttc

SEQ ID NO: 466349 - DNA, 15 bp, Homo sapiens
agggacctgtcttca

SEQ ID NO: 466350 - DNA, 15 bp, Homo sapiens
gggacctgtcttcag

SEQ ID NO: 466351 - DNA, 15 bp, Homo sapiens
ggacctgtcttcagg

SEQ ID NO: 466352 - DNA, 15 bp, Homo sapiens
gacctgtcttcaggt

SEQ ID NO: 466353 - DNA, 15 bp, Homo sapiens
acctgtcttcaggtg

SEQ ID NO: 466354 - DNA, 15 bp, Homo sapiens
cctgtcttcaggtgt

SEQ ID NO: 466355 - DNA, 15 bp, Homo sapiens
ctgtcttcaggtgtt

SEQ ID NO: 466356 - DNA, 15 bp, Homo sapiens
tgtcttcaggtgttg

SEQ ID NO: 466357 - DNA, 15 bp, Homo sapiens
gtcttcaggtgttgg

SEQ ID NO: 466358 - DNA, 15 bp, Homo sapiens
tcttcaggtgttggc

SEQ ID NO: 466359 - DNA, 15 bp, Homo sapiens
cttcaggtgttggct

SEQ ID NO: 466360 - DNA, 15 bp, Homo sapiens
ttcaggtgttggcta

SEQ ID NO: 466361 - DNA, 15 bp, Homo sapiens
tcaggtgttggctag

SEQ ID NO: 466362 - DNA, 15 bp, Homo sapiens
caggtgttggctaga

SEQ ID NO: 466363 - DNA, 15 bp, Homo sapiens
aggtgttggctagag

SEQ ID NO: 466364 - DNA, 15 bp, Homo sapiens
ggtgttggctagagt

SEQ ID NO: 466365 - DNA, 15 bp, Homo sapiens
gtgttggctagagtg

SEQ ID NO: 466366 - DNA, 15 bp, Homo sapiens
tgttggctagagtga

SEQ ID NO: 466367 - DNA, 15 bp, Homo sapiens
gttggctagagtgaa

SEQ ID NO: 466368 - DNA, 15 bp, Homo sapiens
ttggctagagtgaac

SEQ ID NO: 466369 - DNA, 15 bp, Homo sapiens
tggctagagtgaaca

SEQ ID NO: 466370 - DNA, 15 bp, Homo sapiens
ggctagagtgaacag

SEQ ID NO: 466371 - DNA, 15 bp, Homo sapiens
gctagagtgaacagt

SEQ ID NO: 466372 - DNA, 15 bp, Homo sapiens
ctagagtgaacagta

SEQ ID NO: 466373 - DNA, 15 bp, Homo sapiens
tagagtgaacagtaa

SEQ ID NO: 466374 - DNA, 15 bp, Homo sapiens
agagtgaacagtaaa

SEQ ID NO: 466375 - DNA, 15 bp, Homo sapiens
gagtgaacagtaaat

SEQ ID NO: 466376 - DNA, 15 bp, Homo sapiens
agtgaacagtaaatt

SEQ ID NO: 466377 - DNA, 15 bp, Homo sapiens
gtgaacagtaaattc

SEQ ID NO: 466378 - DNA, 15 bp, Homo sapiens
aacagtaaattcttt

SEQ ID NO: 466379 - DNA, 15 bp, Homo sapiens
acagtaaattctttt

SEQ ID NO: 466380 - DNA, 15 bp, Homo sapiens
cagtaaattcttttg

SEQ ID NO: 466381 - DNA, 15 bp, Homo sapiens
agtaaattcttttgg

SEQ ID NO: 466382 - DNA, 15 bp, Homo sapiens
gtaaattcttttggc

SEQ ID NO: 466383 - DNA, 15 bp, Homo sapiens
taaattcttttggca

SEQ ID NO: 466384 - DNA, 15 bp, Homo sapiens
aaattcttttggcag

SEQ ID NO: 466385 - DNA, 15 bp, Homo sapiens
aattcttttggcagt

SEQ ID NO: 466386 - DNA, 15 bp, Homo sapiens
attcttttggcagtc

SEQ ID NO: 466387 - DNA, 15 bp, Homo sapiens
ttcttttggcagtct

SEQ ID NO: 466388 - DNA, 15 bp, Homo sapiens
tcttttggcagtctg

SEQ ID NO: 466389 - DNA, 15 bp, Homo sapiens
cttttggcagtctgg

SEQ ID NO: 466390 - DNA, 15 bp, Homo sapiens
ttttggcagtctgga

SEQ ID NO: 466391 - DNA, 15 bp, Homo sapiens
tttggcagtctggag

SEQ ID NO: 466392 - DNA, 15 bp, Homo sapiens
ttggcagtctggagt

SEQ ID NO: 466393 - DNA, 15 bp, Homo sapiens
tggcagtctggagtt

SEQ ID NO: 466394 - DNA, 15 bp, Homo sapiens
ggcagtctggagttt

SEQ ID NO: 466395 - DNA, 15 bp, Homo sapiens
gcagtctggagtttg

SEQ ID NO: 466396 - DNA, 15 bp, Homo sapiens
cagtctggagtttgt

SEQ ID NO: 466397 - DNA, 15 bp, Homo sapiens
agtctggagtttgtt

SEQ ID NO: 466398 - DNA, 15 bp, Homo sapiens
gtctggagtttgttt

SEQ ID NO: 466399 - DNA, 15 bp, Homo sapiens
tctggagtttgtttt

SEQ ID NO: 466400 - DNA, 15 bp, Homo sapiens
ctggagtttgttttt

SEQ ID NO: 466401 - DNA, 15 bp, Homo sapiens
tggagtttgtttttc

SEQ ID NO: 466402 - DNA, 15 bp, Homo sapiens
ggagtttgtttttca

SEQ ID NO: 466403 - DNA, 15 bp, Homo sapiens
gagtttgtttttcag

SEQ ID NO: 466404 - DNA, 15 bp, Homo sapiens
agtttgtttttcagg

SEQ ID NO: 466405 - DNA, 15 bp, Homo sapiens
gtttgtttttcaggc

SEQ ID NO: 466406 - DNA, 15 bp, Homo sapiens
tttgtttttcaggca

SEQ ID NO: 466407 - DNA, 15 bp, Homo sapiens
ttgtttttcaggcag

SEQ ID NO: 466408 - DNA, 15 bp, Homo sapiens
tgtttttcaggcaga

SEQ ID NO: 466409 - DNA, 15 bp, Homo sapiens
gtttttcaggcagac

SEQ ID NO: 466410 - DNA, 15 bp, Homo sapiens
tttttcaggcagacg

SEQ ID NO: 466411 - DNA, 15 bp, Homo sapiens
ttttcaggcagacgc

SEQ ID NO: 466412 - DNA, 15 bp, Homo sapiens
tttcaggcagacgct

SEQ ID NO: 466413 - DNA, 15 bp, Homo sapiens
ttcaggcagacgctt

SEQ ID NO: 466414 - DNA, 15 bp, Homo sapiens
tcaggcagacgcttt

SEQ ID NO: 466415 - DNA, 15 bp, Homo sapiens
caggcagacgcttta

SEQ ID NO: 466416 - DNA, 15 bp, Homo sapiens
aggcagacgctttaa

SEQ ID NO: 466417 - DNA, 15 bp, Homo sapiens
ggcagacgctttaag

SEQ ID NO: 466418 - DNA, 15 bp, Homo sapiens
gcagacgctttaagg

SEQ ID NO: 466419 - DNA, 15 bp, Homo sapiens
cagacgctttaaggg

SEQ ID NO: 466420 - DNA, 15 bp, Homo sapiens
agacgctttaagggg

SEQ ID NO: 466421 - DNA, 15 bp, Homo sapiens
gacgctttaaggggt

SEQ ID NO: 466422 - DNA, 15 bp, Homo sapiens
acgctttaaggggtc

SEQ ID NO: 466423 - DNA, 15 bp, Homo sapiens
cgctttaaggggtca

SEQ ID NO: 466424 - DNA, 15 bp, Homo sapiens
gctttaaggggtcag

SEQ ID NO: 466425 - DNA, 15 bp, Homo sapiens
ctttaaggggtcaga

SEQ ID NO: 466426 - DNA, 15 bp, Homo sapiens
tttaaggggtcagac

SEQ ID NO: 466427 - DNA, 15 bp, Homo sapiens
ttaaggggtcagacg

SEQ ID NO: 466428 - DNA, 15 bp, Homo sapiens
taaggggtcagacgc

SEQ ID NO: 466429 - DNA, 15 bp, Homo sapiens
aaggggtcagacgcc

SEQ ID NO: 466430 - DNA, 15 bp, Homo sapiens
aggggtcagacgcct

SEQ ID NO: 466431 - DNA, 15 bp, Homo sapiens
ggggtcagacgcctt

SEQ ID NO: 466432 - DNA, 15 bp, Homo sapiens
gggtcagacgcctta

SEQ ID NO: 466433 - DNA, 15 bp, Homo sapiens
ggtcagacgccttaa

SEQ ID NO: 466434 - DNA, 15 bp, Homo sapiens
gtcagacgccttaat

SEQ ID NO: 466435 - DNA, 15 bp, Homo sapiens
tcagacgccttaata

SEQ ID NO: 466436 - DNA, 15 bp, Homo sapiens
cagacgccttaataa

SEQ ID NO: 466437 - DNA, 15 bp, Homo sapiens
agacgccttaataat

SEQ ID NO: 466438 - DNA, 15 bp, Homo sapiens
gacgccttaataatc

SEQ ID NO: 466439 - DNA, 15 bp, Homo sapiens
acgccttaataatcc

SEQ ID NO: 466440 - DNA, 15 bp, Homo sapiens
cgccttaataatccc

SEQ ID NO: 466441 - DNA, 15 bp, Homo sapiens
gccttaataatccct

SEQ ID NO: 466442 - DNA, 15 bp, Homo sapiens
ccttaataatccctt

SEQ ID NO: 466443 - DNA, 15 bp, Homo sapiens
cttaataatcccttt

SEQ ID NO: 466444 - DNA, 15 bp, Homo sapiens
ttaataatccctttt

SEQ ID NO: 466445 - DNA, 15 bp, Homo sapiens
taataatcccttttt

SEQ ID NO: 466446 - DNA, 15 bp, Homo sapiens
aataatccctttttt

SEQ ID NO: 466447 - DNA, 15 bp, Homo sapiens
ataatccctttttta

SEQ ID NO: 466448 - DNA, 15 bp, Homo sapiens
taatcccttttttaa

SEQ ID NO: 466449 - DNA, 15 bp, Homo sapiens
aatcccttttttaag

SEQ ID NO: 466450 - DNA, 15 bp, Homo sapiens
atcccttttttaagg

SEQ ID NO: 466451 - DNA, 15 bp, Homo sapiens
tcccttttttaaggg

SEQ ID NO: 466452 - DNA, 15 bp, Homo sapiens
cccttttttaagggt

SEQ ID NO: 466453 - DNA, 15 bp, Homo sapiens
ccttttttaagggtc

SEQ ID NO: 466454 - DNA, 15 bp, Homo sapiens
cttttttaagggtca

SEQ ID NO: 466455 - DNA, 15 bp, Homo sapiens
ttttttaagggtcat

SEQ ID NO: 466456 - DNA, 15 bp, Homo sapiens
tttttaagggtcatc

SEQ ID NO: 466457 - DNA, 15 bp, Homo sapiens
ttttaagggtcatcc

SEQ ID NO: 466458 - DNA, 15 bp, Homo sapiens
tttaagggtcatcct

SEQ ID NO: 466459 - DNA, 15 bp, Homo sapiens
ttaagggtcatccta

SEQ ID NO: 466460 - DNA, 15 bp, Homo sapiens
taagggtcatcctag

SEQ ID NO: 466461 - DNA, 15 bp, Homo sapiens
aagggtcatcctagg

SEQ ID NO: 466462 - DNA, 15 bp, Homo sapiens
agggtcatcctaggg

SEQ ID NO: 466463 - DNA, 15 bp, Homo sapiens
gggtcatcctaggga

SEQ ID NO: 466464 - DNA, 15 bp, Homo sapiens
ggtcatcctagggat

SEQ ID NO: 466465 - DNA, 15 bp, Homo sapiens
gtcatcctagggatg

SEQ ID NO: 466466 - DNA, 15 bp, Homo sapiens
tcatcctagggatgt

SEQ ID NO: 466467 - DNA, 15 bp, Homo sapiens
catcctagggatgtg

SEQ ID NO: 466468 - DNA, 15 bp, Homo sapiens
atcctagggatgtgg

SEQ ID NO: 466469 - DNA, 15 bp, Homo sapiens
tcctagggatgtggt

SEQ ID NO: 466470 - DNA, 15 bp, Homo sapiens
cctagggatgtggtc

SEQ ID NO: 466471 - DNA, 15 bp, Homo sapiens
ctagggatgtggtct

SEQ ID NO: 466472 - DNA, 15 bp, Homo sapiens
tagggatgtggtctt

SEQ ID NO: 466473 - DNA, 15 bp, Homo sapiens
agggatgtggtcttg

SEQ ID NO: 466474 - DNA, 15 bp, Homo sapiens
gggatgtggtcttga

SEQ ID NO: 466475 - DNA, 15 bp, Homo sapiens
ggatgtggtcttgaa

SEQ ID NO: 466476 - DNA, 15 bp, Homo sapiens
gatgtggtcttgaac

SEQ ID NO: 466477 - DNA, 15 bp, Homo sapiens
atgtggtcttgaact

SEQ ID NO: 466478 - DNA, 15 bp, Homo sapiens
tgtggtcttgaactg

SEQ ID NO: 466479 - DNA, 15 bp, Homo sapiens
gtggtcttgaactgt

SEQ ID NO: 466480 - DNA, 15 bp, Homo sapiens
tggtcttgaactgtt

SEQ ID NO: 466481 - DNA, 15 bp, Homo sapiens
ggtcttgaactgtta

SEQ ID NO: 466482 - DNA, 15 bp, Homo sapiens
gtcttgaactgttat

SEQ ID NO: 466483 - DNA, 15 bp, Homo sapiens
tcttgaactgttata

SEQ ID NO: 466484 - DNA, 15 bp, Homo sapiens
cttgaactgttataa

SEQ ID NO: 466485 - DNA, 15 bp, Homo sapiens
ttgaactgttataaa

SEQ ID NO: 466486 - DNA, 15 bp, Homo sapiens
tgaactgttataaat

SEQ ID NO: 466487 - DNA, 15 bp, Homo sapiens
gaactgttataaatt

SEQ ID NO: 466488 - DNA, 15 bp, Homo sapiens
aactgttataaatta

SEQ ID NO: 466489 - DNA, 15 bp, Homo sapiens
actgttataaattat

SEQ ID NO: 466490 - DNA, 15 bp, Homo sapiens
ctgttataaattatg

SEQ ID NO: 466491 - DNA, 15 bp, Homo sapiens
tgttataaattatgt

SEQ ID NO: 466492 - DNA, 15 bp, Homo sapiens
gttataaattatgtt

SEQ ID NO: 466493 - DNA, 15 bp, Homo sapiens
ttataaattatgttc

SEQ ID NO: 466494 - DNA, 15 bp, Homo sapiens
tataaattatgttca

SEQ ID NO: 466495 - DNA, 15 bp, Homo sapiens
ataaattatgttcat

SEQ ID NO: 466496 - DNA, 15 bp, Homo sapiens
taaattatgttcatg

SEQ ID NO: 466497 - DNA, 15 bp, Homo sapiens
aaattatgttcatgt

SEQ ID NO: 466498 - DNA, 15 bp, Homo sapiens
aattatgttcatgtt

SEQ ID NO: 466499 - DNA, 15 bp, Homo sapiens
attatgttcatgttt

SEQ ID NO: 466500 - DNA, 15 bp, Homo sapiens
ttatgttcatgtttg

SEQ ID NO: 466501 - DNA, 15 bp, Homo sapiens
tatgttcatgtttgt

SEQ ID NO: 466502 - DNA, 15 bp, Homo sapiens
atgttcatgtttgtt

SEQ ID NO: 466503 - DNA, 15 bp, Homo sapiens
tgttcatgtttgttt

SEQ ID NO: 466504 - DNA, 15 bp, Homo sapiens
gttcatgtttgttta

SEQ ID NO: 466505 - DNA, 15 bp, Homo sapiens
ttcatgtttgtttaa

SEQ ID NO: 466506 - DNA, 15 bp, Homo sapiens
tcatgtttgtttaag

SEQ ID NO: 466507 - DNA, 15 bp, Homo sapiens
catgtttgtttaagt

SEQ ID NO: 466508 - DNA, 15 bp, Homo sapiens
atgtttgtttaagtc

SEQ ID NO: 466509 - DNA, 15 bp, Homo sapiens
tgtttgtttaagtct

SEQ ID NO: 466510 - DNA, 15 bp, Homo sapiens
gtttgtttaagtctt

SEQ ID NO: 466511 - DNA, 15 bp, Homo sapiens
tttgtttaagtcttt

SEQ ID NO: 466512 - DNA, 15 bp, Homo sapiens
ttgtttaagtctttt

SEQ ID NO: 466513 - DNA, 15 bp, Homo sapiens
tgtttaagtctttta

SEQ ID NO: 466514 - DNA, 15 bp, Homo sapiens
gtttaagtcttttaa

SEQ ID NO: 466515 - DNA, 15 bp, Homo sapiens
tttaagtcttttaat

SEQ ID NO: 466516 - DNA, 15 bp, Homo sapiens
ttaagtcttttaatg

SEQ ID NO: 466517 - DNA, 15 bp, Homo sapiens
taagtcttttaatgg

SEQ ID NO: 466518 - DNA, 15 bp, Homo sapiens
aagtcttttaatgga

SEQ ID NO: 466519 - DNA, 15 bp, Homo sapiens
agtcttttaatggag

SEQ ID NO: 466520 - DNA, 15 bp, Homo sapiens
gtcttttaatggaga

SEQ ID NO: 466521 - DNA, 15 bp, Homo sapiens
tcttttaatggagaa

SEQ ID NO: 466522 - DNA, 15 bp, Homo sapiens
cttttaatggagaag

SEQ ID NO: 466523 - DNA, 15 bp, Homo sapiens
ttttaatggagaagt

SEQ ID NO: 466524 - DNA, 15 bp, Homo sapiens
tttaatggagaagtg

SEQ ID NO: 466525 - DNA, 15 bp, Homo sapiens
ttaatggagaagtgg

SEQ ID NO: 466526 - DNA, 15 bp, Homo sapiens
taatggagaagtggg

SEQ ID NO: 466527 - DNA, 15 bp, Homo sapiens
aatggagaagtgggt

SEQ ID NO: 466528 - DNA, 15 bp, Homo sapiens
atggagaagtgggtg

SEQ ID NO: 466529 - DNA, 15 bp, Homo sapiens
tggagaagtgggtgg

SEQ ID NO: 466530 - DNA, 15 bp, Homo sapiens
ggagaagtgggtgga

SEQ ID NO: 466531 - DNA, 15 bp, Homo sapiens
gagaagtgggtggac

SEQ ID NO: 466532 - DNA, 15 bp, Homo sapiens
agaagtgggtggaca

SEQ ID NO: 466533 - DNA, 15 bp, Homo sapiens
gaagtgggtggacag

SEQ ID NO: 466534 - DNA, 15 bp, Homo sapiens
aagtgggtggacagg

SEQ ID NO: 466535 - DNA, 15 bp, Homo sapiens
agtgggtggacaggg

SEQ ID NO: 466536 - DNA, 15 bp, Homo sapiens
gtgggtggacaggga

SEQ ID NO: 466537 - DNA, 15 bp, Homo sapiens
tgggtggacagggat

SEQ ID NO: 466538 - DNA, 15 bp, Homo sapiens
gggtggacagggatg

SEQ ID NO: 466539 - DNA, 15 bp, Homo sapiens
ggtggacagggatgg

SEQ ID NO: 466540 - DNA, 15 bp, Homo sapiens
gtggacagggatgga

SEQ ID NO: 466541 - DNA, 15 bp, Homo sapiens
tggacagggatggac

SEQ ID NO: 466542 - DNA, 15 bp, Homo sapiens
ggacagggatggaca

SEQ ID NO: 466543 - DNA, 15 bp, Homo sapiens
gacagggatggacaa

SEQ ID NO: 466544 - DNA, 15 bp, Homo sapiens
acagggatggacaaa

SEQ ID NO: 466545 - DNA, 15 bp, Homo sapiens
cagggatggacaaaa

SEQ ID NO: 466546 - DNA, 15 bp, Homo sapiens
agggatggacaaaat

SEQ ID NO: 466547 - DNA, 15 bp, Homo sapiens
gggatggacaaaatg

SEQ ID NO: 466548 - DNA, 15 bp, Homo sapiens
ggatggacaaaatga

SEQ ID NO: 466549 - DNA, 15 bp, Homo sapiens
gatggacaaaatgat

SEQ ID NO: 466550 - DNA, 15 bp, Homo sapiens
atggacaaaatgatt

SEQ ID NO: 466551 - DNA, 15 bp, Homo sapiens
tggacaaaatgattt

SEQ ID NO: 466552 - DNA, 15 bp, Homo sapiens
ggacaaaatgatttg

SEQ ID NO: 466553 - DNA, 15 bp, Homo sapiens
gacaaaatgatttgt

SEQ ID NO: 466554 - DNA, 15 bp, Homo sapiens
acaaaatgatttgtg

SEQ ID NO: 466555 - DNA, 15 bp, Homo sapiens
caaaatgatttgtgc

SEQ ID NO: 466556 - DNA, 15 bp, Homo sapiens
aaaatgatttgtgct

SEQ ID NO: 466557 - DNA, 15 bp, Homo sapiens
ttcagtagacaacag

SEQ ID NO: 466558 - DNA, 15 bp, Homo sapiens
tcagtagacaacaga

SEQ ID NO: 466559 - DNA, 15 bp, Homo sapiens
cagtagacaacagag

SEQ ID NO: 466560 - DNA, 15 bp, Homo sapiens
agtagacaacagagc

SEQ ID NO: 466561 - DNA, 15 bp, Homo sapiens
gtagacaacagagct

SEQ ID NO: 466562 - DNA, 15 bp, Homo sapiens
tagacaacagagctt

SEQ ID NO: 466563 - DNA, 15 bp, Homo sapiens
agacaacagagctta

SEQ ID NO: 466564 - DNA, 15 bp, Homo sapiens
gacaacagagcttac

SEQ ID NO: 466565 - DNA, 15 bp, Homo sapiens
acaacagagcttaca

SEQ ID NO: 466566 - DNA, 15 bp, Homo sapiens
caacagagcttacag

SEQ ID NO: 466567 - DNA, 15 bp, Homo sapiens
aacagagcttacagg

SEQ ID NO: 466568 - DNA, 15 bp, Homo sapiens
acagagcttacagga

SEQ ID NO: 466569 - DNA, 15 bp, Homo sapiens
cagagcttacaggag

SEQ ID NO: 466570 - DNA, 15 bp, Homo sapiens
agagcttacaggagg

SEQ ID NO: 466571 - DNA, 15 bp, Homo sapiens
gagcttacaggaggc

SEQ ID NO: 466572 - DNA, 15 bp, Homo sapiens
agcttacaggaggcc

SEQ ID NO: 466573 - DNA, 15 bp, Homo sapiens
gcttacaggaggcca

SEQ ID NO: 466574 - DNA, 15 bp, Homo sapiens
cttacaggaggccaa

SEQ ID NO: 466575 - DNA, 15 bp, Homo sapiens
ttacaggaggccaac

SEQ ID NO: 466576 - DNA, 15 bp, Homo sapiens
tacaggaggccaact

SEQ ID NO: 466577 - DNA, 15 bp, Homo sapiens
acaggaggccaactc

SEQ ID NO: 466578 - DNA, 15 bp, Homo sapiens
caggaggccaactca

SEQ ID NO: 466579 - DNA, 15 bp, Homo sapiens
aggaggccaactcaa

SEQ ID NO: 466580 - DNA, 15 bp, Homo sapiens
ggaggccaactcaaa

SEQ ID NO: 466581 - DNA, 15 bp, Homo sapiens
gaggccaactcaaat

SEQ ID NO: 466582 - DNA, 15 bp, Homo sapiens
aggccaactcaaatt

SEQ ID NO: 466583 - DNA, 15 bp, Homo sapiens
ggccaactcaaattt

SEQ ID NO: 466584 - DNA, 15 bp, Homo sapiens
gccaactcaaatttg

SEQ ID NO: 466585 - DNA, 15 bp, Homo sapiens
ccaactcaaatttgg

SEQ ID NO: 466586 - DNA, 15 bp, Homo sapiens
caactcaaatttggt

SEQ ID NO: 466587 - DNA, 15 bp, Homo sapiens
aactcaaatttggtc

SEQ ID NO: 466588 - DNA, 15 bp, Homo sapiens
actcaaatttggtca

SEQ ID NO: 466589 - DNA, 15 bp, Homo sapiens
ctcaaatttggtcaa

SEQ ID NO: 466590 - DNA, 15 bp, Homo sapiens
tcaaatttggtcaag

SEQ ID NO: 466591 - DNA, 15 bp, Homo sapiens
caaatttggtcaagg

SEQ ID NO: 466592 - DNA, 15 bp, Homo sapiens
aaatttggtcaagga

SEQ ID NO: 466593 - DNA, 15 bp, Homo sapiens
aatttggtcaaggag

SEQ ID NO: 466594 - DNA, 15 bp, Homo sapiens
atttggtcaaggaga

SEQ ID NO: 466595 - DNA, 15 bp, Homo sapiens
tttggtcaaggagag

SEQ ID NO: 466596 - DNA, 15 bp, Homo sapiens
ttggtcaaggagaga

SEQ ID NO: 466597 - DNA, 15 bp, Homo sapiens
tggtcaaggagagaa

SEQ ID NO: 466598 - DNA, 15 bp, Homo sapiens
ggtcaaggagagaat

SEQ ID NO: 466599 - DNA, 15 bp, Homo sapiens
gtcaaggagagaatc

SEQ ID NO: 466600 - DNA, 15 bp, Homo sapiens
tcaaggagagaatcc

SEQ ID NO: 466601 - DNA, 15 bp, Homo sapiens
caaggagagaatcct

SEQ ID NO: 466602 - DNA, 15 bp, Homo sapiens
aaggagagaatcctt

SEQ ID NO: 466603 - DNA, 15 bp, Homo sapiens
aggagagaatccttg

SEQ ID NO: 466604 - DNA, 15 bp, Homo sapiens
ggagagaatccttgt

SEQ ID NO: 466605 - DNA, 15 bp, Homo sapiens
gagagaatccttgtc

SEQ ID NO: 466606 - DNA, 15 bp, Homo sapiens
agagaatccttgtca

SEQ ID NO: 466607 - DNA, 15 bp, Homo sapiens
gagaatccttgtcag

SEQ ID NO: 466608 - DNA, 15 bp, Homo sapiens
agaatccttgtcagt

SEQ ID NO: 466609 - DNA, 15 bp, Homo sapiens
gaatccttgtcagta

SEQ ID NO: 466610 - DNA, 15 bp, Homo sapiens
aatccttgtcagtaa

SEQ ID NO: 466611 - DNA, 15 bp, Homo sapiens
atccttgtcagtaat

SEQ ID NO: 466612 - DNA, 15 bp, Homo sapiens
tccttgtcagtaatt

SEQ ID NO: 466613 - DNA, 15 bp, Homo sapiens
ccttgtcagtaattt

SEQ ID NO: 466614 - DNA, 15 bp, Homo sapiens
cttgtcagtaatttc

SEQ ID NO: 466615 - DNA, 15 bp, Homo sapiens
ttgtcagtaatttca

SEQ ID NO: 466616 - DNA, 15 bp, Homo sapiens
tgtcagtaatttcag

SEQ ID NO: 466617 - DNA, 15 bp, Homo sapiens
gtcagtaatttcagc

SEQ ID NO: 466618 - DNA, 15 bp, Homo sapiens
tcagtaatttcagct

SEQ ID NO: 466619 - DNA, 15 bp, Homo sapiens
cagtaatttcagctc

SEQ ID NO: 466620 - DNA, 15 bp, Homo sapiens
agtaatttcagctct

SEQ ID NO: 466621 - DNA, 15 bp, Homo sapiens
gtaatttcagctctg

SEQ ID NO: 466622 - DNA, 15 bp, Homo sapiens
taatttcagctctga

SEQ ID NO: 466623 - DNA, 15 bp, Homo sapiens
aatttcagctctgat

SEQ ID NO: 466624 - DNA, 15 bp, Homo sapiens
atttcagctctgata

SEQ ID NO: 466625 - DNA, 15 bp, Homo sapiens
tttcagctctgatag

SEQ ID NO: 466626 - DNA, 15 bp, Homo sapiens
ttcagctctgatagt

SEQ ID NO: 466627 - DNA, 15 bp, Homo sapiens
tcagctctgatagtg

SEQ ID NO: 466628 - DNA, 15 bp, Homo sapiens
cagctctgatagtgt

SEQ ID NO: 466629 - DNA, 15 bp, Homo sapiens
agctctgatagtgta

SEQ ID NO: 466630 - DNA, 15 bp, Homo sapiens
gctctgatagtgtat

SEQ ID NO: 466631 - DNA, 15 bp, Homo sapiens
ctctgatagtgtatc

SEQ ID NO: 466632 - DNA, 15 bp, Homo sapiens
tctgatagtgtatca

SEQ ID NO: 466633 - DNA, 15 bp, Homo sapiens
ctgatagtgtatcag

SEQ ID NO: 466634 - DNA, 15 bp, Homo sapiens
tgatagtgtatcaga

SEQ ID NO: 466635 - DNA, 15 bp, Homo sapiens
gatagtgtatcagag

SEQ ID NO: 466636 - DNA, 15 bp, Homo sapiens
atagtgtatcagagt

SEQ ID NO: 466637 - DNA, 15 bp, Homo sapiens
tagtgtatcagagta

SEQ ID NO: 466638 - DNA, 15 bp, Homo sapiens
agtgtatcagagtat

SEQ ID NO: 466639 - DNA, 15 bp, Homo sapiens
gtgtatcagagtata

SEQ ID NO: 466640 - DNA, 15 bp, Homo sapiens
tgtatcagagtatac

SEQ ID NO: 466641 - DNA, 15 bp, Homo sapiens
gtatcagagtatacc

SEQ ID NO: 466642 - DNA, 15 bp, Homo sapiens
tatcagagtataccc

SEQ ID NO: 466643 - DNA, 15 bp, Homo sapiens
atcagagtataccca

SEQ ID NO: 466644 - DNA, 15 bp, Homo sapiens
tcagagtatacccag

SEQ ID NO: 466645 - DNA, 15 bp, Homo sapiens
cagagtatacccaga

SEQ ID NO: 466646 - DNA, 15 bp, Homo sapiens
agagtatacccagaa

SEQ ID NO: 466647 - DNA, 15 bp, Homo sapiens
gagtatacccagaaa

SEQ ID NO: 466648 - DNA, 15 bp, Homo sapiens
agtatacccagaaag

SEQ ID NO: 466649 - DNA, 15 bp, Homo sapiens
gtatacccagaaaga

SEQ ID NO: 466650 - DNA, 15 bp, Homo sapiens
tatacccagaaagat

SEQ ID NO: 466651 - DNA, 15 bp, Homo sapiens
atacccagaaagata

SEQ ID NO: 466652 - DNA, 15 bp, Homo sapiens
tacccagaaagataa

SEQ ID NO: 466653 - DNA, 15 bp, Homo sapiens
acccagaaagataag

SEQ ID NO: 466654 - DNA, 15 bp, Homo sapiens
cccagaaagataaga

SEQ ID NO: 466655 - DNA, 15 bp, Homo sapiens
ccagaaagataagat

SEQ ID NO: 466656 - DNA, 15 bp, Homo sapiens
cagaaagataagatt

SEQ ID NO: 466657 - DNA, 15 bp, Homo sapiens
agaaagataagattg

SEQ ID NO: 466658 - DNA, 15 bp, Homo sapiens
gaaagataagattgt

SEQ ID NO: 466659 - DNA, 15 bp, Homo sapiens
aaagataagattgtg

SEQ ID NO: 466660 - DNA, 15 bp, Homo sapiens
aagataagattgtgg

SEQ ID NO: 466661 - DNA, 15 bp, Homo sapiens
agataagattgtgga

SEQ ID NO: 466662 - DNA, 15 bp, Homo sapiens
gataagattgtggac

SEQ ID NO: 466663 - DNA, 15 bp, Homo sapiens
ataagattgtggact

SEQ ID NO: 466664 - DNA, 15 bp, Homo sapiens
taagattgtggactt

SEQ ID NO: 466665 - DNA, 15 bp, Homo sapiens
aagattgtggacttc

SEQ ID NO: 466666 - DNA, 15 bp, Homo sapiens
agattgtggacttcc

SEQ ID NO: 466667 - DNA, 15 bp, Homo sapiens
gattgtggacttcct

SEQ ID NO: 466668 - DNA, 15 bp, Homo sapiens
attgtggacttcctg

SEQ ID NO: 466669 - DNA, 15 bp, Homo sapiens
ttgtggacttcctgc

SEQ ID NO: 466670 - DNA, 15 bp, Homo sapiens
tgtggacttcctgct

SEQ ID NO: 466671 - DNA, 15 bp, Homo sapiens
gtggacttcctgcta

SEQ ID NO: 466672 - DNA, 15 bp, Homo sapiens
tggacttcctgctac

SEQ ID NO: 466673 - DNA, 15 bp, Homo sapiens
ggacttcctgctact

SEQ ID NO: 466674 - DNA, 15 bp, Homo sapiens
gacttcctgctactc

SEQ ID NO: 466675 - DNA, 15 bp, Homo sapiens
acttcctgctactct

SEQ ID NO: 466676 - DNA, 15 bp, Homo sapiens
cttcctgctactctc

SEQ ID NO: 466677 - DNA, 15 bp, Homo sapiens
ttcctgctactctcc

SEQ ID NO: 466678 - DNA, 15 bp, Homo sapiens
tcctgctactctccc

SEQ ID NO: 466679 - DNA, 15 bp, Homo sapiens
cctgctactctccct

SEQ ID NO: 466680 - DNA, 15 bp, Homo sapiens
ctgctactctccctt

SEQ ID NO: 466681 - DNA, 15 bp, Homo sapiens
tgctactctcccttt

SEQ ID NO: 466682 - DNA, 15 bp, Homo sapiens
gctactctcccttta

SEQ ID NO: 466683 - DNA, 15 bp, Homo sapiens
ctactctccctttag

SEQ ID NO: 466684 - DNA, 15 bp, Homo sapiens
tactctccctttagg

SEQ ID NO: 466685 - DNA, 15 bp, Homo sapiens
actctccctttagga

SEQ ID NO: 466686 - DNA, 15 bp, Homo sapiens
ctctccctttaggag

SEQ ID NO: 466687 - DNA, 15 bp, Homo sapiens
tctccctttaggagg

SEQ ID NO: 466688 - DNA, 15 bp, Homo sapiens
ctccctttaggagga

SEQ ID NO: 466689 - DNA, 15 bp, Homo sapiens
tccctttaggaggaa

SEQ ID NO: 466690 - DNA, 15 bp, Homo sapiens
ccctttaggaggaag

SEQ ID NO: 466691 - DNA, 15 bp, Homo sapiens
cctttaggaggaaga

SEQ ID NO: 466692 - DNA, 15 bp, Homo sapiens
ctttaggaggaagaa

SEQ ID NO: 466693 - DNA, 15 bp, Homo sapiens
tttaggaggaagaat

SEQ ID NO: 466694 - DNA, 15 bp, Homo sapiens
ttaggaggaagaatg

SEQ ID NO: 466695 - DNA, 15 bp, Homo sapiens
taggaggaagaatgt

SEQ ID NO: 466696 - DNA, 15 bp, Homo sapiens
aggaggaagaatgtg

SEQ ID NO: 466697 - DNA, 15 bp, Homo sapiens
ggaggaagaatgtgt

SEQ ID NO: 466698 - DNA, 15 bp, Homo sapiens
gaggaagaatgtgtg

SEQ ID NO: 466699 - DNA, 15 bp, Homo sapiens
aggaagaatgtgtga

SEQ ID NO: 466700 - DNA, 15 bp, Homo sapiens
ggaagaatgtgtgag

SEQ ID NO: 466701 - DNA, 15 bp, Homo sapiens
gaagaatgtgtgaga

SEQ ID NO: 466702 - DNA, 15 bp, Homo sapiens
aagaatgtgtgagaa

SEQ ID NO: 466703 - DNA, 15 bp, Homo sapiens
agaatgtgtgagaat

SEQ ID NO: 466704 - DNA, 15 bp, Homo sapiens
gaatgtgtgagaatg

SEQ ID NO: 466705 - DNA, 15 bp, Homo sapiens
aatgtgtgagaatga

SEQ ID NO: 466706 - DNA, 15 bp, Homo sapiens
atgtgtgagaatgaa

SEQ ID NO: 466707 - DNA, 15 bp, Homo sapiens
tgtgtgagaatgaac

SEQ ID NO: 466708 - DNA, 15 bp, Homo sapiens
gtgtgagaatgaaca

SEQ ID NO: 466709 - DNA, 15 bp, Homo sapiens
tgtgagaatgaacaa

SEQ ID NO: 466710 - DNA, 15 bp, Homo sapiens
gtgagaatgaacaag

SEQ ID NO: 466711 - DNA, 15 bp, Homo sapiens
tgagaatgaacaagg

SEQ ID NO: 466712 - DNA, 15 bp, Homo sapiens
gagaatgaacaagga

SEQ ID NO: 466713 - DNA, 15 bp, Homo sapiens
agaatgaacaaggaa

SEQ ID NO: 466714 - DNA, 15 bp, Homo sapiens
gaatgaacaaggaaa

SEQ ID NO: 466715 - DNA, 15 bp, Homo sapiens
aatgaacaaggaaac

SEQ ID NO: 466716 - DNA, 15 bp, Homo sapiens
atgaacaaggaaacg

SEQ ID NO: 466717 - DNA, 15 bp, Homo sapiens
tgaacaaggaaacga

SEQ ID NO: 466718 - DNA, 15 bp, Homo sapiens
gaacaaggaaacgaa

SEQ ID NO: 466719 - DNA, 15 bp, Homo sapiens
aacaaggaaacgaat

SEQ ID NO: 466720 - DNA, 15 bp, Homo sapiens
acaaggaaacgaata

SEQ ID NO: 466721 - DNA, 15 bp, Homo sapiens
caaggaaacgaataa

SEQ ID NO: 466722 - DNA, 15 bp, Homo sapiens
aaggaaacgaataaa

SEQ ID NO: 466723 - DNA, 15 bp, Homo sapiens
aggaaacgaataaat

SEQ ID NO: 466724 - DNA, 15 bp, Homo sapiens
ggaaacgaataaatg

SEQ ID NO: 466725 - DNA, 15 bp, Homo sapiens
gaaacgaataaatgg

SEQ ID NO: 466726 - DNA, 15 bp, Homo sapiens
aaacgaataaatggg

SEQ ID NO: 466727 - DNA, 15 bp, Homo sapiens
aacgaataaatgggg

SEQ ID NO: 466728 - DNA, 15 bp, Homo sapiens
acgaataaatggggt

SEQ ID NO: 466729 - DNA, 15 bp, Homo sapiens
cgaataaatggggtt

SEQ ID NO: 466730 - DNA, 15 bp, Homo sapiens
gaataaatggggttg

SEQ ID NO: 466731 - DNA, 15 bp, Homo sapiens
aataaatggggttgt

SEQ ID NO: 466732 - DNA, 15 bp, Homo sapiens
ataaatggggttgtt

SEQ ID NO: 466733 - DNA, 15 bp, Homo sapiens
taaatggggttgtta

SEQ ID NO: 466734 - DNA, 15 bp, Homo sapiens
aaatggggttgttat

SEQ ID NO: 466735 - DNA, 15 bp, Homo sapiens
aatggggttgttata

SEQ ID NO: 466736 - DNA, 15 bp, Homo sapiens
atggggttgttatac

SEQ ID NO: 466737 - DNA, 15 bp, Homo sapiens
tggggttgttataca

SEQ ID NO: 466738 - DNA, 15 bp, Homo sapiens
ggggttgttatacat

SEQ ID NO: 466739 - DNA, 15 bp, Homo sapiens
gggttgttatacatt

SEQ ID NO: 466740 - DNA, 15 bp, Homo sapiens
ggttgttatacattg

SEQ ID NO: 466741 - DNA, 15 bp, Homo sapiens
gttgttatacattgc

SEQ ID NO: 466742 - DNA, 15 bp, Homo sapiens
ttgttatacattgca

SEQ ID NO: 466743 - DNA, 15 bp, Homo sapiens
tgttatacattgcag

SEQ ID NO: 466744 - DNA, 15 bp, Homo sapiens
gttatacattgcagt

SEQ ID NO: 466745 - DNA, 15 bp, Homo sapiens
ttatacattgcagta

SEQ ID NO: 466746 - DNA, 15 bp, Homo sapiens
tatacattgcagtaa

SEQ ID NO: 466747 - DNA, 15 bp, Homo sapiens
atacattgcagtaag

SEQ ID NO: 466748 - DNA, 15 bp, Homo sapiens
tacattgcagtaagt

SEQ ID NO: 466749 - DNA, 15 bp, Homo sapiens
acattgcagtaagtg

SEQ ID NO: 466750 - DNA, 15 bp, Homo sapiens
cattgcagtaagtgc

SEQ ID NO: 466751 - DNA, 15 bp, Homo sapiens
attgcagtaagtgcc

SEQ ID NO: 466752 - DNA, 15 bp, Homo sapiens
ttgcagtaagtgcct

SEQ ID NO: 466753 - DNA, 15 bp, Homo sapiens
tgcagtaagtgcctt

SEQ ID NO: 466754 - DNA, 15 bp, Homo sapiens
gcagtaagtgccttt

SEQ ID NO: 466755 - DNA, 15 bp, Homo sapiens
cagtaagtgccttta

SEQ ID NO: 466756 - DNA, 15 bp, Homo sapiens
agtaagtgcctttaa

SEQ ID NO: 466757 - DNA, 15 bp, Homo sapiens
gtaagtgcctttaag

SEQ ID NO: 466758 - DNA, 15 bp, Homo sapiens
taagtgcctttaagg

SEQ ID NO: 466759 - DNA, 15 bp, Homo sapiens
aagtgcctttaagga

SEQ ID NO: 466760 - DNA, 15 bp, Homo sapiens
agtgcctttaaggaa

SEQ ID NO: 466761 - DNA, 15 bp, Homo sapiens
gtgcctttaaggaaa

SEQ ID NO: 466762 - DNA, 15 bp, Homo sapiens
tgcctttaaggaaat

SEQ ID NO: 466763 - DNA, 15 bp, Homo sapiens
gcctttaaggaaatg

SEQ ID NO: 466764 - DNA, 15 bp, Homo sapiens
cctttaaggaaatga

SEQ ID NO: 466765 - DNA, 15 bp, Homo sapiens
ctttaaggaaatgaa

SEQ ID NO: 466766 - DNA, 15 bp, Homo sapiens
tttaaggaaatgaat

SEQ ID NO: 466767 - DNA, 15 bp, Homo sapiens
ttaaggaaatgaatg

SEQ ID NO: 466768 - DNA, 15 bp, Homo sapiens
taaggaaatgaatgg

SEQ ID NO: 466769 - DNA, 15 bp, Homo sapiens
aaggaaatgaatgga

SEQ ID NO: 466770 - DNA, 15 bp, Homo sapiens
aggaaatgaatggat

SEQ ID NO: 466771 - DNA, 15 bp, Homo sapiens
ggaaatgaatggata

SEQ ID NO: 466772 - DNA, 15 bp, Homo sapiens
gaaatgaatggataa

SEQ ID NO: 466773 - DNA, 15 bp, Homo sapiens
aaatgaatggataat

SEQ ID NO: 466774 - DNA, 15 bp, Homo sapiens
aatgaatggataatg

SEQ ID NO: 466775 - DNA, 15 bp, Homo sapiens
atgaatggataatga

SEQ ID NO: 466776 - DNA, 15 bp, Homo sapiens
tgaatggataatgag

SEQ ID NO: 466777 - DNA, 15 bp, Homo sapiens
gaatggataatgaga

SEQ ID NO: 466778 - DNA, 15 bp, Homo sapiens
aatggataatgagat

SEQ ID NO: 466779 - DNA, 15 bp, Homo sapiens
atggataatgagata

SEQ ID NO: 466780 - DNA, 15 bp, Homo sapiens
tggataatgagatag

SEQ ID NO: 466781 - DNA, 15 bp, Homo sapiens
ggataatgagataga

SEQ ID NO: 466782 - DNA, 15 bp, Homo sapiens
gataatgagatagaa

SEQ ID NO: 466783 - DNA, 15 bp, Homo sapiens
ataatgagatagaat

SEQ ID NO: 466784 - DNA, 15 bp, Homo sapiens
taatgagatagaatg

SEQ ID NO: 466785 - DNA, 15 bp, Homo sapiens
aatgagatagaatga

SEQ ID NO: 466786 - DNA, 15 bp, Homo sapiens
atgagatagaatgat

SEQ ID NO: 466787 - DNA, 15 bp, Homo sapiens
tgagatagaatgatt

SEQ ID NO: 466788 - DNA, 15 bp, Homo sapiens
gagatagaatgatta

SEQ ID NO: 466789 - DNA, 15 bp, Homo sapiens
agatagaatgattag

SEQ ID NO: 466790 - DNA, 15 bp, Homo sapiens
gatagaatgattaga

SEQ ID NO: 466791 - DNA, 15 bp, Homo sapiens
atagaatgattagaa

SEQ ID NO: 466792 - DNA, 15 bp, Homo sapiens
tagaatgattagaag

SEQ ID NO: 466793 - DNA, 15 bp, Homo sapiens
agaatgattagaaga

SEQ ID NO: 466794 - DNA, 15 bp, Homo sapiens
gaatgattagaagag

SEQ ID NO: 466795 - DNA, 15 bp, Homo sapiens
aatgattagaagaga

SEQ ID NO: 466796 - DNA, 15 bp, Homo sapiens
atgattagaagagac

SEQ ID NO: 466797 - DNA, 15 bp, Homo sapiens
tgattagaagagaca

SEQ ID NO: 466798 - DNA, 15 bp, Homo sapiens
gattagaagagacat

SEQ ID NO: 466799 - DNA, 15 bp, Homo sapiens
attagaagagacatt

SEQ ID NO: 466800 - DNA, 15 bp, Homo sapiens
ttagaagagacattt

SEQ ID NO: 466801 - DNA, 15 bp, Homo sapiens
tagaagagacatttt

SEQ ID NO: 466802 - DNA, 15 bp, Homo sapiens
agaagagacatttta

SEQ ID NO: 466803 - DNA, 15 bp, Homo sapiens
gaagagacattttag

SEQ ID NO: 466804 - DNA, 15 bp, Homo sapiens
aagagacattttaga

SEQ ID NO: 466805 - DNA, 15 bp, Homo sapiens
agagacattttagat

SEQ ID NO: 466806 - DNA, 15 bp, Homo sapiens
gagacattttagata

SEQ ID NO: 466807 - DNA, 15 bp, Homo sapiens
agacattttagataa

SEQ ID NO: 466808 - DNA, 15 bp, Homo sapiens
gacattttagataaa

SEQ ID NO: 466809 - DNA, 15 bp, Homo sapiens
acattttagataaag

SEQ ID NO: 466810 - DNA, 15 bp, Homo sapiens
cattttagataaaga

SEQ ID NO: 466811 - DNA, 15 bp, Homo sapiens
attttagataaagaa

SEQ ID NO: 466812 - DNA, 15 bp, Homo sapiens
ttttagataaagaaa

SEQ ID NO: 466813 - DNA, 15 bp, Homo sapiens
tttagataaagaaat

SEQ ID NO: 466814 - DNA, 15 bp, Homo sapiens
ttagataaagaaatc

SEQ ID NO: 466815 - DNA, 15 bp, Homo sapiens
tagataaagaaatca

SEQ ID NO: 466816 - DNA, 15 bp, Homo sapiens
agataaagaaatcag

SEQ ID NO: 466817 - DNA, 15 bp, Homo sapiens
gataaagaaatcagt

SEQ ID NO: 466818 - DNA, 15 bp, Homo sapiens
ataaagaaatcagta

SEQ ID NO: 466819 - DNA, 15 bp, Homo sapiens
taaagaaatcagtaa

SEQ ID NO: 466820 - DNA, 15 bp, Homo sapiens
aaagaaatcagtaag

SEQ ID NO: 466821 - DNA, 15 bp, Homo sapiens
aagaaatcagtaagg

SEQ ID NO: 466822 - DNA, 15 bp, Homo sapiens
agaaatcagtaaggt

SEQ ID NO: 466823 - DNA, 15 bp, Homo sapiens
gaaatcagtaaggtt

SEQ ID NO: 466824 - DNA, 15 bp, Homo sapiens
aaatcagtaaggttt

SEQ ID NO: 466825 - DNA, 15 bp, Homo sapiens
aatcagtaaggtttg

SEQ ID NO: 466826 - DNA, 15 bp, Homo sapiens
atcagtaaggtttgt

SEQ ID NO: 466827 - DNA, 15 bp, Homo sapiens
tcagtaaggtttgtc

SEQ ID NO: 466828 - DNA, 15 bp, Homo sapiens
cagtaaggtttgtct

SEQ ID NO: 466829 - DNA, 15 bp, Homo sapiens
agtaaggtttgtctg

SEQ ID NO: 466830 - DNA, 15 bp, Homo sapiens
gtaaggtttgtctga

SEQ ID NO: 466831 - DNA, 15 bp, Homo sapiens
taaggtttgtctgag

SEQ ID NO: 466832 - DNA, 15 bp, Homo sapiens
aaggtttgtctgagt

SEQ ID NO: 466833 - DNA, 15 bp, Homo sapiens
aggtttgtctgagtt

SEQ ID NO: 466834 - DNA, 15 bp, Homo sapiens
ggtttgtctgagttg

SEQ ID NO: 466835 - DNA, 15 bp, Homo sapiens
gtttgtctgagttga

SEQ ID NO: 466836 - DNA, 15 bp, Homo sapiens
tttgtctgagttgac

SEQ ID NO: 466837 - DNA, 15 bp, Homo sapiens
ttgtctgagttgaca

SEQ ID NO: 466838 - DNA, 15 bp, Homo sapiens
tgtctgagttgacat

SEQ ID NO: 466839 - DNA, 15 bp, Homo sapiens
gtctgagttgacatt

SEQ ID NO: 466840 - DNA, 15 bp, Homo sapiens
tctgagttgacattt

SEQ ID NO: 466841 - DNA, 15 bp, Homo sapiens
ctgagttgacatttg

SEQ ID NO: 466842 - DNA, 15 bp, Homo sapiens
tgagttgacatttga

SEQ ID NO: 466843 - DNA, 15 bp, Homo sapiens
gagttgacatttgag

SEQ ID NO: 466844 - DNA, 15 bp, Homo sapiens
agttgacatttgagt

SEQ ID NO: 466845 - DNA, 15 bp, Homo sapiens
gttgacatttgagtt

SEQ ID NO: 466846 - DNA, 15 bp, Homo sapiens
ttgacatttgagttg

SEQ ID NO: 466847 - DNA, 15 bp, Homo sapiens
tgacatttgagttga

SEQ ID NO: 466848 - DNA, 15 bp, Homo sapiens
gacatttgagttgag

SEQ ID NO: 466849 - DNA, 15 bp, Homo sapiens
acatttgagttgaga

SEQ ID NO: 466850 - DNA, 15 bp, Homo sapiens
catttgagttgagac

SEQ ID NO: 466851 - DNA, 15 bp, Homo sapiens
atttgagttgagacc

SEQ ID NO: 466852 - DNA, 15 bp, Homo sapiens
tttgagttgagacca

SEQ ID NO: 466853 - DNA, 15 bp, Homo sapiens
ttgagttgagaccaa

SEQ ID NO: 466854 - DNA, 15 bp, Homo sapiens
tgagttgagaccaaa

SEQ ID NO: 466855 - DNA, 15 bp, Homo sapiens
gagttgagaccaaag

SEQ ID NO: 466856 - DNA, 15 bp, Homo sapiens
agttgagaccaaagt

SEQ ID NO: 466857 - DNA, 15 bp, Homo sapiens
gttgagaccaaagtt

SEQ ID NO: 466858 - DNA, 15 bp, Homo sapiens
ttgagaccaaagttt

SEQ ID NO: 466859 - DNA, 15 bp, Homo sapiens
tgagaccaaagtttg

SEQ ID NO: 466860 - DNA, 15 bp, Homo sapiens
gagaccaaagtttga

SEQ ID NO: 466861 - DNA, 15 bp, Homo sapiens
agaccaaagtttgag

SEQ ID NO: 466862 - DNA, 15 bp, Homo sapiens
gaccaaagtttgaga

SEQ ID NO: 466863 - DNA, 15 bp, Homo sapiens
accaaagtttgagaa

SEQ ID NO: 466864 - DNA, 15 bp, Homo sapiens
ccaaagtttgagaaa

SEQ ID NO: 466865 - DNA, 15 bp, Homo sapiens
caaagtttgagaaag

SEQ ID NO: 466866 - DNA, 15 bp, Homo sapiens
aaagtttgagaaaga

SEQ ID NO: 466867 - DNA, 15 bp, Homo sapiens
aagtttgagaaagat

SEQ ID NO: 466868 - DNA, 15 bp, Homo sapiens
agtttgagaaagatt

SEQ ID NO: 466869 - DNA, 15 bp, Homo sapiens
gtttgagaaagattc

SEQ ID NO: 466870 - DNA, 15 bp, Homo sapiens
tttgagaaagattca

SEQ ID NO: 466871 - DNA, 15 bp, Homo sapiens
ttgagaaagattcag

SEQ ID NO: 466872 - DNA, 15 bp, Homo sapiens
tgagaaagattcagc

SEQ ID NO: 466873 - DNA, 15 bp, Homo sapiens
gagaaagattcagcc

SEQ ID NO: 466874 - DNA, 15 bp, Homo sapiens
agaaagattcagccc

SEQ ID NO: 466875 - DNA, 15 bp, Homo sapiens
gaaagattcagccct

SEQ ID NO: 466876 - DNA, 15 bp, Homo sapiens
aaagattcagccctg

SEQ ID NO: 466877 - DNA, 15 bp, Homo sapiens
aagattcagccctgt

SEQ ID NO: 466878 - DNA, 15 bp, Homo sapiens
agattcagccctgta

SEQ ID NO: 466879 - DNA, 15 bp, Homo sapiens
gattcagccctgtaa

SEQ ID NO: 466880 - DNA, 15 bp, Homo sapiens
attcagccctgtaaa

SEQ ID NO: 466881 - DNA, 15 bp, Homo sapiens
ttcagccctgtaaag

SEQ ID NO: 466882 - DNA, 15 bp, Homo sapiens
tcagccctgtaaaga

SEQ ID NO: 466883 - DNA, 15 bp, Homo sapiens
cagccctgtaaagaa

SEQ ID NO: 466884 - DNA, 15 bp, Homo sapiens
agccctgtaaagaac

SEQ ID NO: 466885 - DNA, 15 bp, Homo sapiens
gccctgtaaagaact

SEQ ID NO: 466886 - DNA, 15 bp, Homo sapiens
ccctgtaaagaacta

SEQ ID NO: 466887 - DNA, 15 bp, Homo sapiens
cctgtaaagaactag

SEQ ID NO: 466888 - DNA, 15 bp, Homo sapiens
ctgtaaagaactagt

SEQ ID NO: 466889 - DNA, 15 bp, Homo sapiens
tgtaaagaactagta

SEQ ID NO: 466890 - DNA, 15 bp, Homo sapiens
gtaaagaactagtag

SEQ ID NO: 466891 - DNA, 15 bp, Homo sapiens
taaagaactagtaga

SEQ ID NO: 466892 - DNA, 15 bp, Homo sapiens
aaagaactagtagaa

SEQ ID NO: 466893 - DNA, 15 bp, Homo sapiens
aagaactagtagaag

SEQ ID NO: 466894 - DNA, 15 bp, Homo sapiens
agaactagtagaagc

SEQ ID NO: 466895 - DNA, 15 bp, Homo sapiens
gaactagtagaagca

SEQ ID NO: 466896 - DNA, 15 bp, Homo sapiens
aactagtagaagcat

SEQ ID NO: 466897 - DNA, 15 bp, Homo sapiens
actagtagaagcatg

SEQ ID NO: 466898 - DNA, 15 bp, Homo sapiens
ctagtagaagcatgt

SEQ ID NO: 466899 - DNA, 15 bp, Homo sapiens
tagtagaagcatgtt

SEQ ID NO: 466900 - DNA, 15 bp, Homo sapiens
agtagaagcatgttt

SEQ ID NO: 466901 - DNA, 15 bp, Homo sapiens
gtagaagcatgtttc

SEQ ID NO: 466902 - DNA, 15 bp, Homo sapiens
aagcatgtttcagaa

SEQ ID NO: 466903 - DNA, 15 bp, Homo sapiens
agcatgtttcagaaa

SEQ ID NO: 466904 - DNA, 15 bp, Homo sapiens
gcatgtttcagaaag

SEQ ID NO: 466905 - DNA, 15 bp, Homo sapiens
catgtttcagaaaga

SEQ ID NO: 466906 - DNA, 15 bp, Homo sapiens
atgtttcagaaagaa

SEQ ID NO: 466907 - DNA, 15 bp, Homo sapiens
tgtttcagaaagaag

SEQ ID NO: 466908 - DNA, 15 bp, Homo sapiens
gtttcagaaagaaga

SEQ ID NO: 466909 - DNA, 15 bp, Homo sapiens
tttcagaaagaagaa

SEQ ID NO: 466910 - DNA, 15 bp, Homo sapiens
ttcagaaagaagaaa

SEQ ID NO: 466911 - DNA, 15 bp, Homo sapiens
tcagaaagaagaaac

SEQ ID NO: 466912 - DNA, 15 bp, Homo sapiens
cagaaagaagaaaca

SEQ ID NO: 466913 - DNA, 15 bp, Homo sapiens
gaaagaagaaacaga

SEQ ID NO: 466914 - DNA, 15 bp, Homo sapiens
aaagaagaaacagaa

SEQ ID NO: 466915 - DNA, 15 bp, Homo sapiens
aagaagaaacagaac

SEQ ID NO: 466916 - DNA, 15 bp, Homo sapiens
agaagaaacagaaca

SEQ ID NO: 466917 - DNA, 15 bp, Homo sapiens
gaagaaacagaacat

SEQ ID NO: 466918 - DNA, 15 bp, Homo sapiens
aagaaacagaacata

SEQ ID NO: 466919 - DNA, 15 bp, Homo sapiens
agaaacagaacatat

SEQ ID NO: 466920 - DNA, 15 bp, Homo sapiens
gaaacagaacatata

SEQ ID NO: 466921 - DNA, 15 bp, Homo sapiens
aaacagaacatatag

SEQ ID NO: 466922 - DNA, 15 bp, Homo sapiens
aacagaacatatagt

SEQ ID NO: 466923 - DNA, 15 bp, Homo sapiens
acagaacatatagtg

SEQ ID NO: 466924 - DNA, 15 bp, Homo sapiens
cagaacatatagtgg

SEQ ID NO: 466925 - DNA, 15 bp, Homo sapiens
agaacatatagtggt

SEQ ID NO: 466926 - DNA, 15 bp, Homo sapiens
gaacatatagtggtc

SEQ ID NO: 466927 - DNA, 15 bp, Homo sapiens
aacatatagtggtct

SEQ ID NO: 466928 - DNA, 15 bp, Homo sapiens
acatatagtggtctg

SEQ ID NO: 466929 - DNA, 15 bp, Homo sapiens
catatagtggtctga

SEQ ID NO: 466930 - DNA, 15 bp, Homo sapiens
atatagtggtctgag

SEQ ID NO: 466931 - DNA, 15 bp, Homo sapiens
tatagtggtctgagt

SEQ ID NO: 466932 - DNA, 15 bp, Homo sapiens
atagtggtctgagtt

SEQ ID NO: 466933 - DNA, 15 bp, Homo sapiens
tagtggtctgagttg

SEQ ID NO: 466934 - DNA, 15 bp, Homo sapiens
agtggtctgagttgg

SEQ ID NO: 466935 - DNA, 15 bp, Homo sapiens
gtggtctgagttggg

SEQ ID NO: 466936 - DNA, 15 bp, Homo sapiens
tggtctgagttggga

SEQ ID NO: 466937 - DNA, 15 bp, Homo sapiens
ggtctgagttgggaa

SEQ ID NO: 466938 - DNA, 15 bp, Homo sapiens
gtctgagttgggaaa

SEQ ID NO: 466939 - DNA, 15 bp, Homo sapiens
tctgagttgggaaaa

SEQ ID NO: 466940 - DNA, 15 bp, Homo sapiens
ctgagttgggaaaaa

SEQ ID NO: 466941 - DNA, 15 bp, Homo sapiens
tgagttgggaaaaag

SEQ ID NO: 466942 - DNA, 15 bp, Homo sapiens
gagttgggaaaaagg

SEQ ID NO: 466943 - DNA, 15 bp, Homo sapiens
agttgggaaaaaggt

SEQ ID NO: 466944 - DNA, 15 bp, Homo sapiens
gttgggaaaaaggtt

SEQ ID NO: 466945 - DNA, 15 bp, Homo sapiens
ttgggaaaaaggtta

SEQ ID NO: 466946 - DNA, 15 bp, Homo sapiens
tgggaaaaaggttag

SEQ ID NO: 466947 - DNA, 15 bp, Homo sapiens
gggaaaaaggttagc

SEQ ID NO: 466948 - DNA, 15 bp, Homo sapiens
ggaaaaaggttagcg

SEQ ID NO: 466949 - DNA, 15 bp, Homo sapiens
gaaaaaggttagcgt

SEQ ID NO: 466950 - DNA, 15 bp, Homo sapiens
aaaaaggttagcgtg

SEQ ID NO: 466951 - DNA, 15 bp, Homo sapiens
aaaaggttagcgtga

SEQ ID NO: 466952 - DNA, 15 bp, Homo sapiens
aaaggttagcgtgat

SEQ ID NO: 466953 - DNA, 15 bp, Homo sapiens
aaggttagcgtgatt

SEQ ID NO: 466954 - DNA, 15 bp, Homo sapiens
aggttagcgtgattg

SEQ ID NO: 466955 - DNA, 15 bp, Homo sapiens
ggttagcgtgattgg

SEQ ID NO: 466956 - DNA, 15 bp, Homo sapiens
gttagcgtgattggg

SEQ ID NO: 466957 - DNA, 15 bp, Homo sapiens
ttagcgtgattgggc

SEQ ID NO: 466958 - DNA, 15 bp, Homo sapiens
tagcgtgattgggct

SEQ ID NO: 466959 - DNA, 15 bp, Homo sapiens
agcgtgattgggctg

SEQ ID NO: 466960 - DNA, 15 bp, Homo sapiens
gcgtgattgggctgc

SEQ ID NO: 466961 - DNA, 15 bp, Homo sapiens
cgtgattgggctgca

SEQ ID NO: 466962 - DNA, 15 bp, Homo sapiens
gtgattgggctgcag

SEQ ID NO: 466963 - DNA, 15 bp, Homo sapiens
tgattgggctgcaga

SEQ ID NO: 466964 - DNA, 15 bp, Homo sapiens
gattgggctgcagaa

SEQ ID NO: 466965 - DNA, 15 bp, Homo sapiens
attgggctgcagaaa

SEQ ID NO: 466966 - DNA, 15 bp, Homo sapiens
ttgggctgcagaaag

SEQ ID NO: 466967 - DNA, 15 bp, Homo sapiens
tgggctgcagaaagt

SEQ ID NO: 466968 - DNA, 15 bp, Homo sapiens
gggctgcagaaagtg

SEQ ID NO: 466969 - DNA, 15 bp, Homo sapiens
ggctgcagaaagtga

SEQ ID NO: 466970 - DNA, 15 bp, Homo sapiens
gctgcagaaagtgaa

SEQ ID NO: 466971 - DNA, 15 bp, Homo sapiens
ctgcagaaagtgaag

SEQ ID NO: 466972 - DNA, 15 bp, Homo sapiens
tgcagaaagtgaagc

SEQ ID NO: 466973 - DNA, 15 bp, Homo sapiens
gcagaaagtgaagcc

SEQ ID NO: 466974 - DNA, 15 bp, Homo sapiens
cagaaagtgaagcct

SEQ ID NO: 466975 - DNA, 15 bp, Homo sapiens
agaaagtgaagcctg

SEQ ID NO: 466976 - DNA, 15 bp, Homo sapiens
gaaagtgaagcctgt

SEQ ID NO: 466977 - DNA, 15 bp, Homo sapiens
aaagtgaagcctgtt

SEQ ID NO: 466978 - DNA, 15 bp, Homo sapiens
aagtgaagcctgttc

SEQ ID NO: 466979 - DNA, 15 bp, Homo sapiens
agtgaagcctgttcc

SEQ ID NO: 466980 - DNA, 15 bp, Homo sapiens
gtgaagcctgttccc

SEQ ID NO: 466981 - DNA, 15 bp, Homo sapiens
tgaagcctgttcccc

SEQ ID NO: 466982 - DNA, 15 bp, Homo sapiens
gaagcctgttcccca

SEQ ID NO: 466983 - DNA, 15 bp, Homo sapiens
aagcctgttccccaa

SEQ ID NO: 466984 - DNA, 15 bp, Homo sapiens
agcctgttccccaag

SEQ ID NO: 466985 - DNA, 15 bp, Homo sapiens
gcctgttccccaagg

SEQ ID NO: 466986 - DNA, 15 bp, Homo sapiens
cctgttccccaaggg

SEQ ID NO: 466987 - DNA, 15 bp, Homo sapiens
ctgttccccaagggg

SEQ ID NO: 466988 - DNA, 15 bp, Homo sapiens
tgttccccaaggggc

SEQ ID NO: 466989 - DNA, 15 bp, Homo sapiens
gttccccaaggggcg

SEQ ID NO: 466990 - DNA, 15 bp, Homo sapiens
ttccccaaggggcgc

SEQ ID NO: 466991 - DNA, 15 bp, Homo sapiens
tccccaaggggcgca

SEQ ID NO: 466992 - DNA, 15 bp, Homo sapiens
ccccaaggggcgcat

SEQ ID NO: 466993 - DNA, 15 bp, Homo sapiens
cccaaggggcgcatg

SEQ ID NO: 466994 - DNA, 15 bp, Homo sapiens
ccaaggggcgcatgg

SEQ ID NO: 466995 - DNA, 15 bp, Homo sapiens
caaggggcgcatgga

SEQ ID NO: 466996 - DNA, 15 bp, Homo sapiens
aaggggcgcatggaa

SEQ ID NO: 466997 - DNA, 15 bp, Homo sapiens
aggggcgcatggaaa

SEQ ID NO: 466998 - DNA, 15 bp, Homo sapiens
ggggcgcatggaaag

SEQ ID NO: 466999 - DNA, 15 bp, Homo sapiens
gggcgcatggaaagg

SEQ ID NO: 467000 - DNA, 15 bp, Homo sapiens
ggcgcatggaaagga

SEQ ID NO: 467001 - DNA, 15 bp, Homo sapiens
gcgcatggaaaggag

SEQ ID NO: 467002 - DNA, 15 bp, Homo sapiens
cgcatggaaaggagc

SEQ ID NO: 467003 - DNA, 15 bp, Homo sapiens
gcatggaaaggagca

SEQ ID NO: 467004 - DNA, 15 bp, Homo sapiens
catggaaaggagcac

SEQ ID NO: 467005 - DNA, 15 bp, Homo sapiens
atggaaaggagcact

SEQ ID NO: 467006 - DNA, 15 bp, Homo sapiens
tggaaaggagcactg

SEQ ID NO: 467007 - DNA, 15 bp, Homo sapiens
ggaaaggagcactgg

SEQ ID NO: 467008 - DNA, 15 bp, Homo sapiens
gaaaggagcactggt

SEQ ID NO: 467009 - DNA, 15 bp, Homo sapiens
aaaggagcactggtt

SEQ ID NO: 467010 - DNA, 15 bp, Homo sapiens
aaggagcactggtta

SEQ ID NO: 467011 - DNA, 15 bp, Homo sapiens
aggagcactggttac

SEQ ID NO: 467012 - DNA, 15 bp, Homo sapiens
ggagcactggttaca

SEQ ID NO: 467013 - DNA, 15 bp, Homo sapiens
gagcactggttacac

SEQ ID NO: 467014 - DNA, 15 bp, Homo sapiens
agcactggttacaca

SEQ ID NO: 467015 - DNA, 15 bp, Homo sapiens
gcactggttacacaa

SEQ ID NO: 467016 - DNA, 15 bp, Homo sapiens
cactggttacacaac

SEQ ID NO: 467017 - DNA, 15 bp, Homo sapiens
actggttacacaact

SEQ ID NO: 467018 - DNA, 15 bp, Homo sapiens
ctggttacacaactg

SEQ ID NO: 467019 - DNA, 15 bp, Homo sapiens
tggttacacaactgg

SEQ ID NO: 467020 - DNA, 15 bp, Homo sapiens
ggttacacaactgga

SEQ ID NO: 467021 - DNA, 15 bp, Homo sapiens
gttacacaactggaa

SEQ ID NO: 467022 - DNA, 15 bp, Homo sapiens
ttacacaactggaag

SEQ ID NO: 467023 - DNA, 15 bp, Homo sapiens
tacacaactggaagt

SEQ ID NO: 467024 - DNA, 15 bp, Homo sapiens
acacaactggaagtg

SEQ ID NO: 467025 - DNA, 15 bp, Homo sapiens
cacaactggaagtgc

SEQ ID NO: 467026 - DNA, 15 bp, Homo sapiens
acaactggaagtgcc

SEQ ID NO: 467027 - DNA, 15 bp, Homo sapiens
caactggaagtgccc

SEQ ID NO: 467028 - DNA, 15 bp, Homo sapiens
aactggaagtgccca

SEQ ID NO: 467029 - DNA, 15 bp, Homo sapiens
actggaagtgcccag

SEQ ID NO: 467030 - DNA, 15 bp, Homo sapiens
ctggaagtgcccagt

SEQ ID NO: 467031 - DNA, 15 bp, Homo sapiens
tggaagtgcccagtg

SEQ ID NO: 467032 - DNA, 15 bp, Homo sapiens
ggaagtgcccagtgc

SEQ ID NO: 467033 - DNA, 15 bp, Homo sapiens
gaagtgcccagtgca

SEQ ID NO: 467034 - DNA, 15 bp, Homo sapiens
aagtgcccagtgcaa

SEQ ID NO: 467035 - DNA, 15 bp, Homo sapiens
agtgcccagtgcaaa

SEQ ID NO: 467036 - DNA, 15 bp, Homo sapiens
gtgcccagtgcaaaa

SEQ ID NO: 467037 - DNA, 15 bp, Homo sapiens
tgcccagtgcaaaat

SEQ ID NO: 467038 - DNA, 15 bp, Homo sapiens
gcccagtgcaaaatg

SEQ ID NO: 467039 - DNA, 15 bp, Homo sapiens
cccagtgcaaaatga

SEQ ID NO: 467040 - DNA, 15 bp, Homo sapiens
ccagtgcaaaatgaa

SEQ ID NO: 467041 - DNA, 15 bp, Homo sapiens
cagtgcaaaatgaaa

SEQ ID NO: 467042 - DNA, 15 bp, Homo sapiens
agtgcaaaatgaaac

SEQ ID NO: 467043 - DNA, 15 bp, Homo sapiens
gtgcaaaatgaaact

SEQ ID NO: 467044 - DNA, 15 bp, Homo sapiens
tgcaaaatgaaactg

SEQ ID NO: 467045 - DNA, 15 bp, Homo sapiens
gcaaaatgaaactgg

SEQ ID NO: 467046 - DNA, 15 bp, Homo sapiens
caaaatgaaactggg

SEQ ID NO: 467047 - DNA, 15 bp, Homo sapiens
aaaatgaaactgggg

SEQ ID NO: 467048 - DNA, 15 bp, Homo sapiens
aaatgaaactggggg

SEQ ID NO: 467049 - DNA, 15 bp, Homo sapiens
aatgaaactgggggg

SEQ ID NO: 467050 - DNA, 15 bp, Homo sapiens
atgaaactggggggc

SEQ ID NO: 467051 - DNA, 15 bp, Homo sapiens
tgaaactggggggcc

SEQ ID NO: 467052 - DNA, 15 bp, Homo sapiens
gaaactggggggccc

SEQ ID NO: 467053 - DNA, 15 bp, Homo sapiens
aaactggggggcccc

SEQ ID NO: 467054 - DNA, 15 bp, Homo sapiens
aactggggggcccct

SEQ ID NO: 467055 - DNA, 15 bp, Homo sapiens
actggggggcccctt

SEQ ID NO: 467056 - DNA, 15 bp, Homo sapiens
ctggggggccccttg

SEQ ID NO: 467057 - DNA, 15 bp, Homo sapiens
tggggggccccttgt

SEQ ID NO: 467058 - DNA, 15 bp, Homo sapiens
ggggggccccttgtt

SEQ ID NO: 467059 - DNA, 15 bp, Homo sapiens
gggggccccttgttt

SEQ ID NO: 467060 - DNA, 15 bp, Homo sapiens
ggggccccttgttta

SEQ ID NO: 467061 - DNA, 15 bp, Homo sapiens
gggccccttgtttaa

SEQ ID NO: 467062 - DNA, 15 bp, Homo sapiens
ggccccttgtttaac

SEQ ID NO: 467063 - DNA, 15 bp, Homo sapiens
gccccttgtttaaca

SEQ ID NO: 467064 - DNA, 15 bp, Homo sapiens
ccccttgtttaacaa

SEQ ID NO: 467065 - DNA, 15 bp, Homo sapiens
cccttgtttaacaat

SEQ ID NO: 467066 - DNA, 15 bp, Homo sapiens
ccttgtttaacaatt

SEQ ID NO: 467067 - DNA, 15 bp, Homo sapiens
cttgtttaacaatta

SEQ ID NO: 467068 - DNA, 15 bp, Homo sapiens
ttgtttaacaattat

SEQ ID NO: 467069 - DNA, 15 bp, Homo sapiens
tgtttaacaattatt

SEQ ID NO: 467070 - DNA, 15 bp, Homo sapiens
gtttaacaattatta

SEQ ID NO: 467071 - DNA, 15 bp, Homo sapiens
tttaacaattattaa

SEQ ID NO: 467072 - DNA, 15 bp, Homo sapiens
ttaacaattattaag

SEQ ID NO: 467073 - DNA, 15 bp, Homo sapiens
taacaattattaaga

SEQ ID NO: 467074 - DNA, 15 bp, Homo sapiens
aacaattattaagac

SEQ ID NO: 467075 - DNA, 15 bp, Homo sapiens
acaattattaagact

SEQ ID NO: 467076 - DNA, 15 bp, Homo sapiens
caattattaagactt

SEQ ID NO: 467077 - DNA, 15 bp, Homo sapiens
aattattaagacttc

SEQ ID NO: 467078 - DNA, 15 bp, Homo sapiens
attattaagacttcc

SEQ ID NO: 467079 - DNA, 15 bp, Homo sapiens
ttattaagacttccg

SEQ ID NO: 467080 - DNA, 15 bp, Homo sapiens
tattaagacttccga

SEQ ID NO: 467081 - DNA, 15 bp, Homo sapiens
attaagacttccgag

SEQ ID NO: 467082 - DNA, 15 bp, Homo sapiens
ttaagacttccgagt

SEQ ID NO: 467083 - DNA, 15 bp, Homo sapiens
taagacttccgagtt

SEQ ID NO: 467084 - DNA, 15 bp, Homo sapiens
aagacttccgagttg

SEQ ID NO: 467085 - DNA, 15 bp, Homo sapiens
agacttccgagttgg

SEQ ID NO: 467086 - DNA, 15 bp, Homo sapiens
gacttccgagttggc

SEQ ID NO: 467087 - DNA, 15 bp, Homo sapiens
acttccgagttggca

SEQ ID NO: 467088 - DNA, 15 bp, Homo sapiens
cttccgagttggcaa

SEQ ID NO: 467089 - DNA, 15 bp, Homo sapiens
ttccgagttggcaac

SEQ ID NO: 467090 - DNA, 15 bp, Homo sapiens
tccgagttggcaaca

SEQ ID NO: 467091 - DNA, 15 bp, Homo sapiens
ccgagttggcaacat

SEQ ID NO: 467092 - DNA, 15 bp, Homo sapiens
cgagttggcaacatc

SEQ ID NO: 467093 - DNA, 15 bp, Homo sapiens
gagttggcaacatca

SEQ ID NO: 467094 - DNA, 15 bp, Homo sapiens
agttggcaacatcag

SEQ ID NO: 467095 - DNA, 15 bp, Homo sapiens
gttggcaacatcaga

SEQ ID NO: 467096 - DNA, 15 bp, Homo sapiens
ttggcaacatcagag

SEQ ID NO: 467097 - DNA, 15 bp, Homo sapiens
tggcaacatcagagg

SEQ ID NO: 467098 - DNA, 15 bp, Homo sapiens
ggcaacatcagagga

SEQ ID NO: 467099 - DNA, 15 bp, Homo sapiens
gcaacatcagaggag

SEQ ID NO: 467100 - DNA, 15 bp, Homo sapiens
caacatcagaggagt

SEQ ID NO: 467101 - DNA, 15 bp, Homo sapiens
aacatcagaggagta

SEQ ID NO: 467102 - DNA, 15 bp, Homo sapiens
acatcagaggagtaa

SEQ ID NO: 467103 - DNA, 15 bp, Homo sapiens
catcagaggagtaaa

SEQ ID NO: 467104 - DNA, 15 bp, Homo sapiens
atcagaggagtaaat

SEQ ID NO: 467105 - DNA, 15 bp, Homo sapiens
tcagaggagtaaatg

SEQ ID NO: 467106 - DNA, 15 bp, Homo sapiens
cagaggagtaaatga

SEQ ID NO: 467107 - DNA, 15 bp, Homo sapiens
agaggagtaaatgaa

SEQ ID NO: 467108 - DNA, 15 bp, Homo sapiens
gaggagtaaatgaag

SEQ ID NO: 467109 - DNA, 15 bp, Homo sapiens
aggagtaaatgaagt

SEQ ID NO: 467110 - DNA, 15 bp, Homo sapiens
ggagtaaatgaagtt

SEQ ID NO: 467111 - DNA, 15 bp, Homo sapiens
gagtaaatgaagttc

SEQ ID NO: 467112 - DNA, 15 bp, Homo sapiens
agtaaatgaagttca

SEQ ID NO: 467113 - DNA, 15 bp, Homo sapiens
gtaaatgaagttcaa

SEQ ID NO: 467114 - DNA, 15 bp, Homo sapiens
taaatgaagttcaaa

SEQ ID NO: 467115 - DNA, 15 bp, Homo sapiens
aaatgaagttcaaag

SEQ ID NO: 467116 - DNA, 15 bp, Homo sapiens
aatgaagttcaaagc

SEQ ID NO: 467117 - DNA, 15 bp, Homo sapiens
atgaagttcaaagcc

SEQ ID NO: 467118 - DNA, 15 bp, Homo sapiens
tgaagttcaaagccc

SEQ ID NO: 467119 - DNA, 15 bp, Homo sapiens
gaagttcaaagccct

SEQ ID NO: 467120 - DNA, 15 bp, Homo sapiens
aagttcaaagccctt

SEQ ID NO: 467121 - DNA, 15 bp, Homo sapiens
agttcaaagcccttc

SEQ ID NO: 467122 - DNA, 15 bp, Homo sapiens
gttcaaagcccttct

SEQ ID NO: 467123 - DNA, 15 bp, Homo sapiens
ttcaaagcccttctg

SEQ ID NO: 467124 - DNA, 15 bp, Homo sapiens
tcaaagcccttctga

SEQ ID NO: 467125 - DNA, 15 bp, Homo sapiens
caaagcccttctgat

SEQ ID NO: 467126 - DNA, 15 bp, Homo sapiens
aaagcccttctgatt

SEQ ID NO: 467127 - DNA, 15 bp, Homo sapiens
aagcccttctgattg

SEQ ID NO: 467128 - DNA, 15 bp, Homo sapiens
agcccttctgattgt

SEQ ID NO: 467129 - DNA, 15 bp, Homo sapiens
gcccttctgattgta

SEQ ID NO: 467130 - DNA, 15 bp, Homo sapiens
cccttctgattgtag

SEQ ID NO: 467131 - DNA, 15 bp, Homo sapiens
ccttctgattgtagg

SEQ ID NO: 467132 - DNA, 15 bp, Homo sapiens
cttctgattgtaggg

SEQ ID NO: 467133 - DNA, 15 bp, Homo sapiens
ttctgattgtagggc

SEQ ID NO: 467134 - DNA, 15 bp, Homo sapiens
tctgattgtagggcc

SEQ ID NO: 467135 - DNA, 15 bp, Homo sapiens
ctgattgtagggccc

SEQ ID NO: 467136 - DNA, 15 bp, Homo sapiens
tgattgtagggccct

SEQ ID NO: 467137 - DNA, 15 bp, Homo sapiens
gattgtagggccctg

SEQ ID NO: 467138 - DNA, 15 bp, Homo sapiens
attgtagggccctgt

SEQ ID NO: 467139 - DNA, 15 bp, Homo sapiens
ttgtagggccctgta

SEQ ID NO: 467140 - DNA, 15 bp, Homo sapiens
tgtagggccctgtac

SEQ ID NO: 467141 - DNA, 15 bp, Homo sapiens
gtagggccctgtaca

SEQ ID NO: 467142 - DNA, 15 bp, Homo sapiens
tagggccctgtacaa

SEQ ID NO: 467143 - DNA, 15 bp, Homo sapiens
agggccctgtacaac

SEQ ID NO: 467144 - DNA, 15 bp, Homo sapiens
gggccctgtacaact

SEQ ID NO: 467145 - DNA, 15 bp, Homo sapiens
ggccctgtacaactg

SEQ ID NO: 467146 - DNA, 15 bp, Homo sapiens
gccctgtacaactgc

SEQ ID NO: 467147 - DNA, 15 bp, Homo sapiens
ccctgtacaactgca

SEQ ID NO: 467148 - DNA, 15 bp, Homo sapiens
cctgtacaactgcat

SEQ ID NO: 467149 - DNA, 15 bp, Homo sapiens
ctgtacaactgcata

SEQ ID NO: 467150 - DNA, 15 bp, Homo sapiens
tgtacaactgcataa

SEQ ID NO: 467151 - DNA, 15 bp, Homo sapiens
gtacaactgcataag

SEQ ID NO: 467152 - DNA, 15 bp, Homo sapiens
tacaactgcataagt

SEQ ID NO: 467153 - DNA, 15 bp, Homo sapiens
acaactgcataagtg

SEQ ID NO: 467154 - DNA, 15 bp, Homo sapiens
caactgcataagtgc

SEQ ID NO: 467155 - DNA, 15 bp, Homo sapiens
aactgcataagtgca

SEQ ID NO: 467156 - DNA, 15 bp, Homo sapiens
actgcataagtgcaa

SEQ ID NO: 467157 - DNA, 15 bp, Homo sapiens
ctgcataagtgcaat

SEQ ID NO: 467158 - DNA, 15 bp, Homo sapiens
tgcataagtgcaata

SEQ ID NO: 467159 - DNA, 15 bp, Homo sapiens
gcataagtgcaatag

SEQ ID NO: 467160 - DNA, 15 bp, Homo sapiens
cataagtgcaatagt

SEQ ID NO: 467161 - DNA, 15 bp, Homo sapiens
ataagtgcaatagtt

SEQ ID NO: 467162 - DNA, 15 bp, Homo sapiens
taagtgcaatagttc

SEQ ID NO: 467163 - DNA, 15 bp, Homo sapiens
aagtgcaatagttca

SEQ ID NO: 467164 - DNA, 15 bp, Homo sapiens
agtgcaatagttcaa

SEQ ID NO: 467165 - DNA, 15 bp, Homo sapiens
gtgcaatagttcaaa

SEQ ID NO: 467166 - DNA, 15 bp, Homo sapiens
tgcaatagttcaaag

SEQ ID NO: 467167 - DNA, 15 bp, Homo sapiens
gcaatagttcaaagc

SEQ ID NO: 467168 - DNA, 15 bp, Homo sapiens
caatagttcaaagcc

SEQ ID NO: 467169 - DNA, 15 bp, Homo sapiens
aatagttcaaagccc

SEQ ID NO: 467170 - DNA, 15 bp, Homo sapiens
atagttcaaagccct

SEQ ID NO: 467171 - DNA, 15 bp, Homo sapiens
tagttcaaagccctt

SEQ ID NO: 467172 - DNA, 15 bp, Homo sapiens
gcataagtgcaatat

SEQ ID NO: 467173 - DNA, 15 bp, Homo sapiens
cataagtgcaatatc

SEQ ID NO: 467174 - DNA, 15 bp, Homo sapiens
ataagtgcaatatct

SEQ ID NO: 467175 - DNA, 15 bp, Homo sapiens
taagtgcaatatctt

SEQ ID NO: 467176 - DNA, 15 bp, Homo sapiens
aagtgcaatatcttt

SEQ ID NO: 467177 - DNA, 15 bp, Homo sapiens
agtgcaatatctttg

SEQ ID NO: 467178 - DNA, 15 bp, Homo sapiens
gtgcaatatctttga

SEQ ID NO: 467179 - DNA, 15 bp, Homo sapiens
tgcaatatctttgaa

SEQ ID NO: 467180 - DNA, 15 bp, Homo sapiens
gcaatatctttgaag

SEQ ID NO: 467181 - DNA, 15 bp, Homo sapiens
caatatctttgaagc

SEQ ID NO: 467182 - DNA, 15 bp, Homo sapiens
aatatctttgaagct

SEQ ID NO: 467183 - DNA, 15 bp, Homo sapiens
atatctttgaagctc

SEQ ID NO: 467184 - DNA, 15 bp, Homo sapiens
tatctttgaagctca

SEQ ID NO: 467185 - DNA, 15 bp, Homo sapiens
atctttgaagctcac

SEQ ID NO: 467186 - DNA, 15 bp, Homo sapiens
tctttgaagctcacc

SEQ ID NO: 467187 - DNA, 15 bp, Homo sapiens
ctttgaagctcaccc

SEQ ID NO: 467188 - DNA, 15 bp, Homo sapiens
tttgaagctcaccct

SEQ ID NO: 467189 - DNA, 15 bp, Homo sapiens
ttgaagctcaccctg

SEQ ID NO: 467190 - DNA, 15 bp, Homo sapiens
tgaagctcaccctga

SEQ ID NO: 467191 - DNA, 15 bp, Homo sapiens
gaagctcaccctgag

SEQ ID NO: 467192 - DNA, 15 bp, Homo sapiens
aagctcaccctgagg

SEQ ID NO: 467193 - DNA, 15 bp, Homo sapiens
agctcaccctgaggc

SEQ ID NO: 467194 - DNA, 15 bp, Homo sapiens
gctcaccctgaggct

SEQ ID NO: 467195 - DNA, 15 bp, Homo sapiens
ctcaccctgaggctg

SEQ ID NO: 467196 - DNA, 15 bp, Homo sapiens
tcaccctgaggctgg

SEQ ID NO: 467197 - DNA, 15 bp, Homo sapiens
caccctgaggctggg

SEQ ID NO: 467198 - DNA, 15 bp, Homo sapiens
accctgaggctggga

SEQ ID NO: 467199 - DNA, 15 bp, Homo sapiens
ccctgaggctgggaa

SEQ ID NO: 467200 - DNA, 15 bp, Homo sapiens
cctgaggctgggaaa

SEQ ID NO: 467201 - DNA, 15 bp, Homo sapiens
ctgaggctgggaaag

SEQ ID NO: 467202 - DNA, 15 bp, Homo sapiens
tgaggctgggaaaga

SEQ ID NO: 467203 - DNA, 15 bp, Homo sapiens
gaggctgggaaagag

SEQ ID NO: 467204 - DNA, 15 bp, Homo sapiens
aggctgggaaagagg

SEQ ID NO: 467205 - DNA, 15 bp, Homo sapiens
ggctgggaaagaggt

SEQ ID NO: 467206 - DNA, 15 bp, Homo sapiens
gctgggaaagaggtg

SEQ ID NO: 467207 - DNA, 15 bp, Homo sapiens
ctgggaaagaggtgg

SEQ ID NO: 467208 - DNA, 15 bp, Homo sapiens
tgggaaagaggtggg

SEQ ID NO: 467209 - DNA, 15 bp, Homo sapiens
gggaaagaggtgggt

SEQ ID NO: 467210 - DNA, 15 bp, Homo sapiens
ggaaagaggtgggtg

SEQ ID NO: 467211 - DNA, 15 bp, Homo sapiens
gaaagaggtgggtgt

SEQ ID NO: 467212 - DNA, 15 bp, Homo sapiens
aaagaggtgggtgta

SEQ ID NO: 467213 - DNA, 15 bp, Homo sapiens
aagaggtgggtgtaa

SEQ ID NO: 467214 - DNA, 15 bp, Homo sapiens
agaggtgggtgtaac

SEQ ID NO: 467215 - DNA, 15 bp, Homo sapiens
gaggtgggtgtaacc

SEQ ID NO: 467216 - DNA, 15 bp, Homo sapiens
aggtgggtgtaacca

SEQ ID NO: 467217 - DNA, 15 bp, Homo sapiens
ggtgggtgtaaccag

SEQ ID NO: 467218 - DNA, 15 bp, Homo sapiens
gtgggtgtaaccagg

SEQ ID NO: 467219 - DNA, 15 bp, Homo sapiens
tgggtgtaaccaggg

SEQ ID NO: 467220 - DNA, 15 bp, Homo sapiens
gggtgtaaccaggga

SEQ ID NO: 467221 - DNA, 15 bp, Homo sapiens
ggtgtaaccagggaa

SEQ ID NO: 467222 - DNA, 15 bp, Homo sapiens
gtgtaaccagggaac

SEQ ID NO: 467223 - DNA, 15 bp, Homo sapiens
tgtaaccagggaaca

SEQ ID NO: 467224 - DNA, 15 bp, Homo sapiens
gtaaccagggaacag

SEQ ID NO: 467225 - DNA, 15 bp, Homo sapiens
taaccagggaacaga

SEQ ID NO: 467226 - DNA, 15 bp, Homo sapiens
aaccagggaacagaa

SEQ ID NO: 467227 - DNA, 15 bp, Homo sapiens
accagggaacagaaa

SEQ ID NO: 467228 - DNA, 15 bp, Homo sapiens
ccagggaacagaaag

SEQ ID NO: 467229 - DNA, 15 bp, Homo sapiens
cagggaacagaaaga

SEQ ID NO: 467230 - DNA, 15 bp, Homo sapiens
agggaacagaaagaa

SEQ ID NO: 467231 - DNA, 15 bp, Homo sapiens
gggaacagaaagaaa

SEQ ID NO: 467232 - DNA, 15 bp, Homo sapiens
ggaacagaaagaaac

SEQ ID NO: 467233 - DNA, 15 bp, Homo sapiens
gaacagaaagaaacc

SEQ ID NO: 467234 - DNA, 15 bp, Homo sapiens
aacagaaagaaacca

SEQ ID NO: 467235 - DNA, 15 bp, Homo sapiens
acagaaagaaaccag

SEQ ID NO: 467236 - DNA, 15 bp, Homo sapiens
cagaaagaaaccagg

SEQ ID NO: 467237 - DNA, 15 bp, Homo sapiens
agaaagaaaccagga

SEQ ID NO: 467238 - DNA, 15 bp, Homo sapiens
gaaagaaaccaggac

SEQ ID NO: 467239 - DNA, 15 bp, Homo sapiens
aaagaaaccaggaca

SEQ ID NO: 467240 - DNA, 15 bp, Homo sapiens
aagaaaccaggacaa

SEQ ID NO: 467241 - DNA, 15 bp, Homo sapiens
agaaaccaggacaaa

SEQ ID NO: 467242 - DNA, 15 bp, Homo sapiens
gaaaccaggacaaat

SEQ ID NO: 467243 - DNA, 15 bp, Homo sapiens
aaaccaggacaaatt

SEQ ID NO: 467244 - DNA, 15 bp, Homo sapiens
aaccaggacaaattt

SEQ ID NO: 467245 - DNA, 15 bp, Homo sapiens
accaggacaaatttg

SEQ ID NO: 467246 - DNA, 15 bp, Homo sapiens
ccaggacaaatttga

SEQ ID NO: 467247 - DNA, 15 bp, Homo sapiens
caggacaaatttgac

SEQ ID NO: 467248 - DNA, 15 bp, Homo sapiens
aggacaaatttgaca

SEQ ID NO: 467249 - DNA, 15 bp, Homo sapiens
ggacaaatttgacaa

SEQ ID NO: 467250 - DNA, 15 bp, Homo sapiens
gacaaatttgacaaa

SEQ ID NO: 467251 - DNA, 15 bp, Homo sapiens
acaaatttgacaaaa

SEQ ID NO: 467252 - DNA, 15 bp, Homo sapiens
caaatttgacaaaag

SEQ ID NO: 467253 - DNA, 15 bp, Homo sapiens
aaatttgacaaaaga

SEQ ID NO: 467254 - DNA, 15 bp, Homo sapiens
aatttgacaaaagag

SEQ ID NO: 467255 - DNA, 15 bp, Homo sapiens
atttgacaaaagaga

SEQ ID NO: 467256 - DNA, 15 bp, Homo sapiens
tttgacaaaagagag

SEQ ID NO: 467257 - DNA, 15 bp, Homo sapiens
ttgacaaaagagaga

SEQ ID NO: 467258 - DNA, 15 bp, Homo sapiens
tgacaaaagagagac

SEQ ID NO: 467259 - DNA, 15 bp, Homo sapiens
gacaaaagagagaca

SEQ ID NO: 467260 - DNA, 15 bp, Homo sapiens
acaaaagagagacaa

SEQ ID NO: 467261 - DNA, 15 bp, Homo sapiens
caaaagagagacaat

SEQ ID NO: 467262 - DNA, 15 bp, Homo sapiens
aaaagagagacaata

SEQ ID NO: 467263 - DNA, 15 bp, Homo sapiens
aaagagagacaatag

SEQ ID NO: 467264 - DNA, 15 bp, Homo sapiens
aagagagacaatagt

SEQ ID NO: 467265 - DNA, 15 bp, Homo sapiens
agagagacaatagta

SEQ ID NO: 467266 - DNA, 15 bp, Homo sapiens
gagagacaatagtag

SEQ ID NO: 467267 - DNA, 15 bp, Homo sapiens
agagacaatagtagg

SEQ ID NO: 467268 - DNA, 15 bp, Homo sapiens
gagacaatagtagga

SEQ ID NO: 467269 - DNA, 15 bp, Homo sapiens
agacaatagtaggag

SEQ ID NO: 467270 - DNA, 15 bp, Homo sapiens
gacaatagtaggaga

SEQ ID NO: 467271 - DNA, 15 bp, Homo sapiens
acaatagtaggagat

SEQ ID NO: 467272 - DNA, 15 bp, Homo sapiens
caatagtaggagatg

SEQ ID NO: 467273 - DNA, 15 bp, Homo sapiens
aatagtaggagatgg

SEQ ID NO: 467274 - DNA, 15 bp, Homo sapiens
atagtaggagatgga

SEQ ID NO: 467275 - DNA, 15 bp, Homo sapiens
tagtaggagatggaa

SEQ ID NO: 467276 - DNA, 15 bp, Homo sapiens
agtaggagatggaat

SEQ ID NO: 467277 - DNA, 15 bp, Homo sapiens
gtaggagatggaatt

SEQ ID NO: 467278 - DNA, 15 bp, Homo sapiens
taggagatggaatta

SEQ ID NO: 467279 - DNA, 15 bp, Homo sapiens
aggagatggaattaa

SEQ ID NO: 467280 - DNA, 15 bp, Homo sapiens
ggagatggaattaaa

SEQ ID NO: 467281 - DNA, 15 bp, Homo sapiens
gagatggaattaaaa

SEQ ID NO: 467282 - DNA, 15 bp, Homo sapiens
agatggaattaaaaa

SEQ ID NO: 467283 - DNA, 15 bp, Homo sapiens
gatggaattaaaaag

SEQ ID NO: 467284 - DNA, 15 bp, Homo sapiens
atggaattaaaaaga

SEQ ID NO: 467285 - DNA, 15 bp, Homo sapiens
tggaattaaaaagaa

SEQ ID NO: 467286 - DNA, 15 bp, Homo sapiens
ggaattaaaaagaaa

SEQ ID NO: 467287 - DNA, 15 bp, Homo sapiens
gaattaaaaagaaag

SEQ ID NO: 467288 - DNA, 15 bp, Homo sapiens
aattaaaaagaaagg

SEQ ID NO: 467289 - DNA, 15 bp, Homo sapiens
attaaaaagaaaggc

SEQ ID NO: 467290 - DNA, 15 bp, Homo sapiens
ttaaaaagaaaggca

SEQ ID NO: 467291 - DNA, 15 bp, Homo sapiens
taaaaagaaaggcaa

SEQ ID NO: 467292 - DNA, 15 bp, Homo sapiens
aaaaagaaaggcaac

SEQ ID NO: 467293 - DNA, 15 bp, Homo sapiens
aaaagaaaggcaact

SEQ ID NO: 467294 - DNA, 15 bp, Homo sapiens
aaagaaaggcaacta

SEQ ID NO: 467295 - DNA, 15 bp, Homo sapiens
aagaaaggcaactat

SEQ ID NO: 467296 - DNA, 15 bp, Homo sapiens
agaaaggcaactatc

SEQ ID NO: 467297 - DNA, 15 bp, Homo sapiens
gaaaggcaactatca

SEQ ID NO: 467298 - DNA, 15 bp, Homo sapiens
aaaggcaactatcag

SEQ ID NO: 467299 - DNA, 15 bp, Homo sapiens
aaggcaactatcaga

SEQ ID NO: 467300 - DNA, 15 bp, Homo sapiens
aggcaactatcagat

SEQ ID NO: 467301 - DNA, 15 bp, Homo sapiens
ggcaactatcagatt

SEQ ID NO: 467302 - DNA, 15 bp, Homo sapiens
gcaactatcagattg

SEQ ID NO: 467303 - DNA, 15 bp, Homo sapiens
caactatcagattgt

SEQ ID NO: 467304 - DNA, 15 bp, Homo sapiens
aactatcagattgta

SEQ ID NO: 467305 - DNA, 15 bp, Homo sapiens
actatcagattgtat

SEQ ID NO: 467306 - DNA, 15 bp, Homo sapiens
ctatcagattgtata

SEQ ID NO: 467307 - DNA, 15 bp, Homo sapiens
tatcagattgtatag

SEQ ID NO: 467308 - DNA, 15 bp, Homo sapiens
atcagattgtataga

SEQ ID NO: 467309 - DNA, 15 bp, Homo sapiens
tcagattgtatagaa

SEQ ID NO: 467310 - DNA, 15 bp, Homo sapiens
cagattgtatagaac

SEQ ID NO: 467311 - DNA, 15 bp, Homo sapiens
agattgtatagaacc

SEQ ID NO: 467312 - DNA, 15 bp, Homo sapiens
gattgtatagaaccc

SEQ ID NO: 467313 - DNA, 15 bp, Homo sapiens
attgtatagaaccct

SEQ ID NO: 467314 - DNA, 15 bp, Homo sapiens
ttgtatagaaccctg

SEQ ID NO: 467315 - DNA, 15 bp, Homo sapiens
tgtatagaaccctgg

SEQ ID NO: 467316 - DNA, 15 bp, Homo sapiens
gtatagaaccctggg

SEQ ID NO: 467317 - DNA, 15 bp, Homo sapiens
tatagaaccctgggg

SEQ ID NO: 467318 - DNA, 15 bp, Homo sapiens
atagaaccctgggga

SEQ ID NO: 467319 - DNA, 15 bp, Homo sapiens
tagaaccctggggat

SEQ ID NO: 467320 - DNA, 15 bp, Homo sapiens
agaaccctggggatc

SEQ ID NO: 467321 - DNA, 15 bp, Homo sapiens
gaaccctggggatca

SEQ ID NO: 467322 - DNA, 15 bp, Homo sapiens
aaccctggggatcat

SEQ ID NO: 467323 - DNA, 15 bp, Homo sapiens
accctggggatcatt

SEQ ID NO: 467324 - DNA, 15 bp, Homo sapiens
ccctggggatcattg

SEQ ID NO: 467325 - DNA, 15 bp, Homo sapiens
cctggggatcattgt

SEQ ID NO: 467326 - DNA, 15 bp, Homo sapiens
ctggggatcattgta

SEQ ID NO: 467327 - DNA, 15 bp, Homo sapiens
tggggatcattgtaa

SEQ ID NO: 467328 - DNA, 15 bp, Homo sapiens
ggggatcattgtaag

SEQ ID NO: 467329 - DNA, 15 bp, Homo sapiens
gggatcattgtaagg

SEQ ID NO: 467330 - DNA, 15 bp, Homo sapiens
ggatcattgtaagga

SEQ ID NO: 467331 - DNA, 15 bp, Homo sapiens
gatcattgtaaggaa

SEQ ID NO: 467332 - DNA, 15 bp, Homo sapiens
atcattgtaaggaat

SEQ ID NO: 467333 - DNA, 15 bp, Homo sapiens
tcattgtaaggaatt

SEQ ID NO: 467334 - DNA, 15 bp, Homo sapiens
cattgtaaggaattt

SEQ ID NO: 467335 - DNA, 15 bp, Homo sapiens
attgtaaggaatttg

SEQ ID NO: 467336 - DNA, 15 bp, Homo sapiens
ttgtaaggaatttgg

SEQ ID NO: 467337 - DNA, 15 bp, Homo sapiens
tgtaaggaatttgga

SEQ ID NO: 467338 - DNA, 15 bp, Homo sapiens
gtaaggaatttggat

SEQ ID NO: 467339 - DNA, 15 bp, Homo sapiens
taaggaatttggatt

SEQ ID NO: 467340 - DNA, 15 bp, Homo sapiens
aaggaatttggattg

SEQ ID NO: 467341 - DNA, 15 bp, Homo sapiens
aggaatttggattgg

SEQ ID NO: 467342 - DNA, 15 bp, Homo sapiens
ggaatttggattggg

SEQ ID NO: 467343 - DNA, 15 bp, Homo sapiens
gaatttggattgggg

SEQ ID NO: 467344 - DNA, 15 bp, Homo sapiens
aatttggattggggg

SEQ ID NO: 467345 - DNA, 15 bp, Homo sapiens
atttggattggggga

SEQ ID NO: 467346 - DNA, 15 bp, Homo sapiens
tttggattgggggaa

SEQ ID NO: 467347 - DNA, 15 bp, Homo sapiens
ttggattgggggaaa

SEQ ID NO: 467348 - DNA, 15 bp, Homo sapiens
tggattgggggaaaa

SEQ ID NO: 467349 - DNA, 15 bp, Homo sapiens
ggattgggggaaaat

SEQ ID NO: 467350 - DNA, 15 bp, Homo sapiens
gattgggggaaaata

SEQ ID NO: 467351 - DNA, 15 bp, Homo sapiens
attgggggaaaatat

SEQ ID NO: 467352 - DNA, 15 bp, Homo sapiens
ttgggggaaaatatc

SEQ ID NO: 467353 - DNA, 15 bp, Homo sapiens
tgggggaaaatatca

SEQ ID NO: 467354 - DNA, 15 bp, Homo sapiens
gggggaaaatatcat

SEQ ID NO: 467355 - DNA, 15 bp, Homo sapiens
ggggaaaatatcata

SEQ ID NO: 467356 - DNA, 15 bp, Homo sapiens
gggaaaatatcatag

SEQ ID NO: 467357 - DNA, 15 bp, Homo sapiens
ggaaaatatcatagt

SEQ ID NO: 467358 - DNA, 15 bp, Homo sapiens
gaaaatatcatagta

SEQ ID NO: 467359 - DNA, 15 bp, Homo sapiens
aaaatatcatagtaa

SEQ ID NO: 467360 - DNA, 15 bp, Homo sapiens
aaatatcatagtaat

SEQ ID NO: 467361 - DNA, 15 bp, Homo sapiens
aatatcatagtaata

SEQ ID NO: 467362 - DNA, 15 bp, Homo sapiens
atatcatagtaatat

SEQ ID NO: 467363 - DNA, 15 bp, Homo sapiens
tatcatagtaatatt

SEQ ID NO: 467364 - DNA, 15 bp, Homo sapiens
atcatagtaatattt

SEQ ID NO: 467365 - DNA, 15 bp, Homo sapiens
tcatagtaatattta

SEQ ID NO: 467366 - DNA, 15 bp, Homo sapiens
catagtaatatttac

SEQ ID NO: 467367 - DNA, 15 bp, Homo sapiens
atagtaatatttaca

SEQ ID NO: 467368 - DNA, 15 bp, Homo sapiens
tagtaatatttacat

SEQ ID NO: 467369 - DNA, 15 bp, Homo sapiens
agtaatatttacatg

SEQ ID NO: 467370 - DNA, 15 bp, Homo sapiens
gtaatatttacatga

SEQ ID NO: 467371 - DNA, 15 bp, Homo sapiens
taatatttacatgaa

SEQ ID NO: 467372 - DNA, 15 bp, Homo sapiens
aatatttacatgaat

SEQ ID NO: 467373 - DNA, 15 bp, Homo sapiens
tatttacatgaatag

SEQ ID NO: 467374 - DNA, 15 bp, Homo sapiens
atttacatgaatagc

SEQ ID NO: 467375 - DNA, 15 bp, Homo sapiens
tttacatgaatagct

SEQ ID NO: 467376 - DNA, 15 bp, Homo sapiens
ttacatgaatagcta

SEQ ID NO: 467377 - DNA, 15 bp, Homo sapiens
tacatgaatagctat

SEQ ID NO: 467378 - DNA, 15 bp, Homo sapiens
acatgaatagctatt

SEQ ID NO: 467379 - DNA, 15 bp, Homo sapiens
catgaatagctatta

SEQ ID NO: 467380 - DNA, 15 bp, Homo sapiens
atgaatagctattat

SEQ ID NO: 467381 - DNA, 15 bp, Homo sapiens
tgaatagctattata

SEQ ID NO: 467382 - DNA, 15 bp, Homo sapiens
gaatagctattatag

SEQ ID NO: 467383 - DNA, 15 bp, Homo sapiens
aatagctattataga

SEQ ID NO: 467384 - DNA, 15 bp, Homo sapiens
atagctattatagaa

SEQ ID NO: 467385 - DNA, 15 bp, Homo sapiens
tagctattatagaag

SEQ ID NO: 467386 - DNA, 15 bp, Homo sapiens
agctattatagaagt

SEQ ID NO: 467387 - DNA, 15 bp, Homo sapiens
gctattatagaagtt

SEQ ID NO: 467388 - DNA, 15 bp, Homo sapiens
ctattatagaagttt

SEQ ID NO: 467389 - DNA, 15 bp, Homo sapiens
tattatagaagttta

SEQ ID NO: 467390 - DNA, 15 bp, Homo sapiens
attatagaagtttag

SEQ ID NO: 467391 - DNA, 15 bp, Homo sapiens
ttatagaagtttaga

SEQ ID NO: 467392 - DNA, 15 bp, Homo sapiens
tatagaagtttagaa

SEQ ID NO: 467393 - DNA, 15 bp, Homo sapiens
atagaagtttagaaa

SEQ ID NO: 467394 - DNA, 15 bp, Homo sapiens
tagaagtttagaaaa

SEQ ID NO: 467395 - DNA, 15 bp, Homo sapiens
agaagtttagaaaac

SEQ ID NO: 467396 - DNA, 15 bp, Homo sapiens
gaagtttagaaaact

SEQ ID NO: 467397 - DNA, 15 bp, Homo sapiens
aagtttagaaaactg

SEQ ID NO: 467398 - DNA, 15 bp, Homo sapiens
agtttagaaaactga

SEQ ID NO: 467399 - DNA, 15 bp, Homo sapiens
gtttagaaaactgat

SEQ ID NO: 467400 - DNA, 15 bp, Homo sapiens
tttagaaaactgatt

SEQ ID NO: 467401 - DNA, 15 bp, Homo sapiens
ttagaaaactgatta

SEQ ID NO: 467402 - DNA, 15 bp, Homo sapiens
tagaaaactgattat

SEQ ID NO: 467403 - DNA, 15 bp, Homo sapiens
agaaaactgattata

SEQ ID NO: 467404 - DNA, 15 bp, Homo sapiens
gaaaactgattataa

SEQ ID NO: 467405 - DNA, 15 bp, Homo sapiens
aaaactgattataaa

SEQ ID NO: 467406 - DNA, 15 bp, Homo sapiens
aaactgattataaaa

SEQ ID NO: 467407 - DNA, 15 bp, Homo sapiens
aactgattataaaat

SEQ ID NO: 467408 - DNA, 15 bp, Homo sapiens
actgattataaaatg

SEQ ID NO: 467409 - DNA, 15 bp, Homo sapiens
ctgattataaaatgc

SEQ ID NO: 467410 - DNA, 15 bp, Homo sapiens
tgattataaaatgct

SEQ ID NO: 467411 - DNA, 15 bp, Homo sapiens
gattataaaatgcta

SEQ ID NO: 467412 - DNA, 15 bp, Homo sapiens
attataaaatgctag

SEQ ID NO: 467413 - DNA, 15 bp, Homo sapiens
ttataaaatgctagt

SEQ ID NO: 467414 - DNA, 15 bp, Homo sapiens
tataaaatgctagta

SEQ ID NO: 467415 - DNA, 15 bp, Homo sapiens
ataaaatgctagtat

SEQ ID NO: 467416 - DNA, 15 bp, Homo sapiens
taaaatgctagtatc

SEQ ID NO: 467417 - DNA, 15 bp, Homo sapiens
aaaatgctagtatca

SEQ ID NO: 467418 - DNA, 15 bp, Homo sapiens
aaatgctagtatcaa

SEQ ID NO: 467419 - DNA, 15 bp, Homo sapiens
aatgctagtatcaaa

SEQ ID NO: 467420 - DNA, 15 bp, Homo sapiens
atgctagtatcaaaa

SEQ ID NO: 467421 - DNA, 15 bp, Homo sapiens
tgctagtatcaaaat

SEQ ID NO: 467422 - DNA, 15 bp, Homo sapiens
gctagtatcaaaata

SEQ ID NO: 467423 - DNA, 15 bp, Homo sapiens
ctagtatcaaaatat

SEQ ID NO: 467424 - DNA, 15 bp, Homo sapiens
tagtatcaaaatatc

SEQ ID NO: 467425 - DNA, 15 bp, Homo sapiens
agtatcaaaatatca

SEQ ID NO: 467426 - DNA, 15 bp, Homo sapiens
gtatcaaaatatcat

SEQ ID NO: 467427 - DNA, 15 bp, Homo sapiens
tatcaaaatatcata

SEQ ID NO: 467428 - DNA, 15 bp, Homo sapiens
atcaaaatatcataa

SEQ ID NO: 467429 - DNA, 15 bp, Homo sapiens
tcaaaatatcataaa

SEQ ID NO: 467430 - DNA, 15 bp, Homo sapiens
caaaatatcataaag

SEQ ID NO: 467431 - DNA, 15 bp, Homo sapiens
aaaatatcataaagt

SEQ ID NO: 467432 - DNA, 15 bp, Homo sapiens
aaatatcataaagta

SEQ ID NO: 467433 - DNA, 15 bp, Homo sapiens
aatatcataaagtaa

SEQ ID NO: 467434 - DNA, 15 bp, Homo sapiens
atatcataaagtaaa

SEQ ID NO: 467435 - DNA, 15 bp, Homo sapiens
atcataaagtaaata

SEQ ID NO: 467436 - DNA, 15 bp, Homo sapiens
tcataaagtaaatat

SEQ ID NO: 467437 - DNA, 15 bp, Homo sapiens
cataaagtaaatata

SEQ ID NO: 467438 - DNA, 15 bp, Homo sapiens
ataaagtaaatatat

SEQ ID NO: 467439 - DNA, 15 bp, Homo sapiens
taaagtaaatatatg

SEQ ID NO: 467440 - DNA, 15 bp, Homo sapiens
aaagtaaatatatgt

SEQ ID NO: 467441 - DNA, 15 bp, Homo sapiens
aagtaaatatatgtt

SEQ ID NO: 467442 - DNA, 15 bp, Homo sapiens
agtaaatatatgttg

SEQ ID NO: 467443 - DNA, 15 bp, Homo sapiens
gtaaatatatgttgt

SEQ ID NO: 467444 - DNA, 15 bp, Homo sapiens
taaatatatgttgtt

SEQ ID NO: 467445 - DNA, 15 bp, Homo sapiens
aaatatatgttgtta

SEQ ID NO: 467446 - DNA, 15 bp, Homo sapiens
aatatatgttgttat

SEQ ID NO: 467447 - DNA, 15 bp, Homo sapiens
atatatgttgttata

SEQ ID NO: 467448 - DNA, 15 bp, Homo sapiens
tatatgttgttatag

SEQ ID NO: 467449 - DNA, 15 bp, Homo sapiens
atatgttgttatagt

SEQ ID NO: 467450 - DNA, 15 bp, Homo sapiens
tatgttgttatagta

SEQ ID NO: 467451 - DNA, 15 bp, Homo sapiens
atgttgttatagtaa

SEQ ID NO: 467452 - DNA, 15 bp, Homo sapiens
tgttgttatagtaaa

SEQ ID NO: 467453 - DNA, 15 bp, Homo sapiens
gttgttatagtaaag

SEQ ID NO: 467454 - DNA, 15 bp, Homo sapiens
ttgttatagtaaaga

SEQ ID NO: 467455 - DNA, 15 bp, Homo sapiens
tgttatagtaaagat

SEQ ID NO: 467456 - DNA, 15 bp, Homo sapiens
gttatagtaaagata

SEQ ID NO: 467457 - DNA, 15 bp, Homo sapiens
ttatagtaaagatat

SEQ ID NO: 467458 - DNA, 15 bp, Homo sapiens
tatagtaaagatata

SEQ ID NO: 467459 - DNA, 15 bp, Homo sapiens
atagtaaagatatat

SEQ ID NO: 467460 - DNA, 15 bp, Homo sapiens
tagtaaagatatata

SEQ ID NO: 467461 - DNA, 15 bp, Homo sapiens
agtaaagatatataa

SEQ ID NO: 467462 - DNA, 15 bp, Homo sapiens
gtaaagatatataaa

SEQ ID NO: 467463 - DNA, 15 bp, Homo sapiens
taaagatatataaaa

SEQ ID NO: 467464 - DNA, 15 bp, Homo sapiens
aaagatatataaaat

SEQ ID NO: 467465 - DNA, 15 bp, Homo sapiens
aagatatataaaatt

SEQ ID NO: 467466 - DNA, 15 bp, Homo sapiens
agatatataaaatta

SEQ ID NO: 467467 - DNA, 15 bp, Homo sapiens
gatatataaaattac

SEQ ID NO: 467468 - DNA, 15 bp, Homo sapiens
atatataaaattact

SEQ ID NO: 467469 - DNA, 15 bp, Homo sapiens
tatataaaattacta

SEQ ID NO: 467470 - DNA, 15 bp, Homo sapiens
atataaaattactat

SEQ ID NO: 467471 - DNA, 15 bp, Homo sapiens
tataaaattactatt

SEQ ID NO: 467472 - DNA, 15 bp, Homo sapiens
ataaaattactattt

SEQ ID NO: 467473 - DNA, 15 bp, Homo sapiens
taaaattactatttt

SEQ ID NO: 467474 - DNA, 15 bp, Homo sapiens
aaaattactattttt

SEQ ID NO: 467475 - DNA, 15 bp, Homo sapiens
aaattactatttttc

SEQ ID NO: 467476 - DNA, 15 bp, Homo sapiens
ttactatttttcttg

SEQ ID NO: 467477 - DNA, 15 bp, Homo sapiens
tactatttttcttgg

SEQ ID NO: 467478 - DNA, 15 bp, Homo sapiens
actatttttcttggt

SEQ ID NO: 467479 - DNA, 15 bp, Homo sapiens
ctatttttcttggtc

SEQ ID NO: 467480 - DNA, 15 bp, Homo sapiens
tatttttcttggtct

SEQ ID NO: 467481 - DNA, 15 bp, Homo sapiens
atttttcttggtctt

SEQ ID NO: 467482 - DNA, 15 bp, Homo sapiens
tttttcttggtcttg

SEQ ID NO: 467483 - DNA, 15 bp, Homo sapiens
ttttcttggtcttga

SEQ ID NO: 467484 - DNA, 15 bp, Homo sapiens
tttcttggtcttgaa

SEQ ID NO: 467485 - DNA, 15 bp, Homo sapiens
ttcttggtcttgaac

SEQ ID NO: 467486 - DNA, 15 bp, Homo sapiens
tcttggtcttgaaca

SEQ ID NO: 467487 - DNA, 15 bp, Homo sapiens
cttggtcttgaacat

SEQ ID NO: 467488 - DNA, 15 bp, Homo sapiens
ttggtcttgaacata

SEQ ID NO: 467489 - DNA, 15 bp, Homo sapiens
tggtcttgaacatat

SEQ ID NO: 467490 - DNA, 15 bp, Homo sapiens
ggtcttgaacatata

SEQ ID NO: 467491 - DNA, 15 bp, Homo sapiens
gtcttgaacatataa

SEQ ID NO: 467492 - DNA, 15 bp, Homo sapiens
tcttgaacatataat

SEQ ID NO: 467493 - DNA, 15 bp, Homo sapiens
cttgaacatataata

SEQ ID NO: 467494 - DNA, 15 bp, Homo sapiens
ttgaacatataataa

SEQ ID NO: 467495 - DNA, 15 bp, Homo sapiens
tgaacatataataat

SEQ ID NO: 467496 - DNA, 15 bp, Homo sapiens
gaacatataataatt

SEQ ID NO: 467497 - DNA, 15 bp, Homo sapiens
aacatataataattc

SEQ ID NO: 467498 - DNA, 15 bp, Homo sapiens
acatataataattct

SEQ ID NO: 467499 - DNA, 15 bp, Homo sapiens
catataataattctt

SEQ ID NO: 467500 - DNA, 15 bp, Homo sapiens
atataataattctta

SEQ ID NO: 467501 - DNA, 15 bp, Homo sapiens
tataataattcttaa

SEQ ID NO: 467502 - DNA, 15 bp, Homo sapiens
ataataattcttaat

SEQ ID NO: 467503 - DNA, 15 bp, Homo sapiens
taataattcttaatg

SEQ ID NO: 467504 - DNA, 15 bp, Homo sapiens
aataattcttaatgg

SEQ ID NO: 467505 - DNA, 15 bp, Homo sapiens
ataattcttaatggc

SEQ ID NO: 467506 - DNA, 15 bp, Homo sapiens
taattcttaatggct

SEQ ID NO: 467507 - DNA, 15 bp, Homo sapiens
aattcttaatggctt

SEQ ID NO: 467508 - DNA, 15 bp, Homo sapiens
attcttaatggcttt

SEQ ID NO: 467509 - DNA, 15 bp, Homo sapiens
ttcttaatggcttta

SEQ ID NO: 467510 - DNA, 15 bp, Homo sapiens
tcttaatggctttac

SEQ ID NO: 467511 - DNA, 15 bp, Homo sapiens
cttaatggctttaca

SEQ ID NO: 467512 - DNA, 15 bp, Homo sapiens
ttaatggctttacaa

SEQ ID NO: 467513 - DNA, 15 bp, Homo sapiens
taatggctttacaaa

SEQ ID NO: 467514 - DNA, 15 bp, Homo sapiens
aatggctttacaaaa

SEQ ID NO: 467515 - DNA, 15 bp, Homo sapiens
atggctttacaaaat

SEQ ID NO: 467516 - DNA, 15 bp, Homo sapiens
tggctttacaaaata

SEQ ID NO: 467517 - DNA, 15 bp, Homo sapiens
ggctttacaaaatac

SEQ ID NO: 467518 - DNA, 15 bp, Homo sapiens
gctttacaaaatacc

SEQ ID NO: 467519 - DNA, 15 bp, Homo sapiens
ctttacaaaatacct

SEQ ID NO: 467520 - DNA, 15 bp, Homo sapiens
tttacaaaataccta

SEQ ID NO: 467521 - DNA, 15 bp, Homo sapiens
ttacaaaatacctaa

SEQ ID NO: 467522 - DNA, 15 bp, Homo sapiens
tacaaaatacctaaa

SEQ ID NO: 467523 - DNA, 15 bp, Homo sapiens
acaaaatacctaaac

SEQ ID NO: 467524 - DNA, 15 bp, Homo sapiens
caaaatacctaaaca

SEQ ID NO: 467525 - DNA, 15 bp, Homo sapiens
aaaatacctaaacaa

SEQ ID NO: 467526 - DNA, 15 bp, Homo sapiens
aaatacctaaacaat

SEQ ID NO: 467527 - DNA, 15 bp, Homo sapiens
aatacctaaacaatt

SEQ ID NO: 467528 - DNA, 15 bp, Homo sapiens
atacctaaacaattt

SEQ ID NO: 467529 - DNA, 15 bp, Homo sapiens
tacctaaacaatttg

SEQ ID NO: 467530 - DNA, 15 bp, Homo sapiens
acctaaacaatttga

SEQ ID NO: 467531 - DNA, 15 bp, Homo sapiens
cctaaacaatttgaa

SEQ ID NO: 467532 - DNA, 15 bp, Homo sapiens
ctaaacaatttgaaa

SEQ ID NO: 467533 - DNA, 15 bp, Homo sapiens
taaacaatttgaaac

SEQ ID NO: 467534 - DNA, 15 bp, Homo sapiens
aaacaatttgaaacc

SEQ ID NO: 467535 - DNA, 15 bp, Homo sapiens
aacaatttgaaaccc

SEQ ID NO: 467536 - DNA, 15 bp, Homo sapiens
acaatttgaaaccca

SEQ ID NO: 467537 - DNA, 15 bp, Homo sapiens
caatttgaaacccac

SEQ ID NO: 467538 - DNA, 15 bp, Homo sapiens
aatttgaaacccaca

SEQ ID NO: 467539 - DNA, 15 bp, Homo sapiens
atttgaaacccacat

SEQ ID NO: 467540 - DNA, 15 bp, Homo sapiens
tttgaaacccacata

SEQ ID NO: 467541 - DNA, 15 bp, Homo sapiens
ttgaaacccacatat

SEQ ID NO: 467542 - DNA, 15 bp, Homo sapiens
tgaaacccacatatc

SEQ ID NO: 467543 - DNA, 15 bp, Homo sapiens
gaaacccacatatct

SEQ ID NO: 467544 - DNA, 15 bp, Homo sapiens
aaacccacatatctt

SEQ ID NO: 467545 - DNA, 15 bp, Homo sapiens
aacccacatatcttc

SEQ ID NO: 467546 - DNA, 15 bp, Homo sapiens
acccacatatcttca

SEQ ID NO: 467547 - DNA, 15 bp, Homo sapiens
cccacatatcttcaa

SEQ ID NO: 467548 - DNA, 15 bp, Homo sapiens
ccacatatcttcaac

SEQ ID NO: 467549 - DNA, 15 bp, Homo sapiens
cacatatcttcaaca

SEQ ID NO: 467550 - DNA, 15 bp, Homo sapiens
acatatcttcaacag

SEQ ID NO: 467551 - DNA, 15 bp, Homo sapiens
catatcttcaacagt

SEQ ID NO: 467552 - DNA, 15 bp, Homo sapiens
atatcttcaacagtt

SEQ ID NO: 467553 - DNA, 15 bp, Homo sapiens
tatcttcaacagttg

SEQ ID NO: 467554 - DNA, 15 bp, Homo sapiens
atcttcaacagttgt

SEQ ID NO: 467555 - DNA, 15 bp, Homo sapiens
tcttcaacagttgtc

SEQ ID NO: 467556 - DNA, 15 bp, Homo sapiens
cttcaacagttgtca

SEQ ID NO: 467557 - DNA, 15 bp, Homo sapiens
ttcaacagttgtcat

SEQ ID NO: 467558 - DNA, 15 bp, Homo sapiens
tcaacagttgtcatg

SEQ ID NO: 467559 - DNA, 15 bp, Homo sapiens
caacagttgtcatgc

SEQ ID NO: 467560 - DNA, 15 bp, Homo sapiens
aacagttgtcatgca

SEQ ID NO: 467561 - DNA, 15 bp, Homo sapiens
acagttgtcatgcag

SEQ ID NO: 467562 - DNA, 15 bp, Homo sapiens
cagttgtcatgcagt

SEQ ID NO: 467563 - DNA, 15 bp, Homo sapiens
agttgtcatgcagta

SEQ ID NO: 467564 - DNA, 15 bp, Homo sapiens
gttgtcatgcagtag

SEQ ID NO: 467565 - DNA, 15 bp, Homo sapiens
ttgtcatgcagtagg

SEQ ID NO: 467566 - DNA, 15 bp, Homo sapiens
tgtcatgcagtaggt

SEQ ID NO: 467567 - DNA, 15 bp, Homo sapiens
gtcatgcagtaggtg

SEQ ID NO: 467568 - DNA, 15 bp, Homo sapiens
tcatgcagtaggtgc

SEQ ID NO: 467569 - DNA, 15 bp, Homo sapiens
catgcagtaggtgca

SEQ ID NO: 467570 - DNA, 15 bp, Homo sapiens
atgcagtaggtgcat

SEQ ID NO: 467571 - DNA, 15 bp, Homo sapiens
tgcagtaggtgcata

SEQ ID NO: 467572 - DNA, 15 bp, Homo sapiens
gcagtaggtgcatac

SEQ ID NO: 467573 - DNA, 15 bp, Homo sapiens
cagtaggtgcatact

SEQ ID NO: 467574 - DNA, 15 bp, Homo sapiens
agtaggtgcatactt

SEQ ID NO: 467575 - DNA, 15 bp, Homo sapiens
gtaggtgcatactta

SEQ ID NO: 467576 - DNA, 15 bp, Homo sapiens
taggtgcatacttaa

SEQ ID NO: 467577 - DNA, 15 bp, Homo sapiens
aggtgcatacttaag

SEQ ID NO: 467578 - DNA, 15 bp, Homo sapiens
ggtgcatacttaaga

SEQ ID NO: 467579 - DNA, 15 bp, Homo sapiens
gtgcatacttaagaa

SEQ ID NO: 467580 - DNA, 15 bp, Homo sapiens
tgcatacttaagaat

SEQ ID NO: 467581 - DNA, 15 bp, Homo sapiens
gcatacttaagaatc

SEQ ID NO: 467582 - DNA, 15 bp, Homo sapiens
catacttaagaatca

SEQ ID NO: 467583 - DNA, 15 bp, Homo sapiens
atacttaagaatcac

SEQ ID NO: 467584 - DNA, 15 bp, Homo sapiens
tacttaagaatcact

SEQ ID NO: 467585 - DNA, 15 bp, Homo sapiens
acttaagaatcactg

SEQ ID NO: 467586 - DNA, 15 bp, Homo sapiens
cttaagaatcactga

SEQ ID NO: 467587 - DNA, 15 bp, Homo sapiens
ttaagaatcactgat

SEQ ID NO: 467588 - DNA, 15 bp, Homo sapiens
taagaatcactgata

SEQ ID NO: 467589 - DNA, 15 bp, Homo sapiens
aagaatcactgatac

SEQ ID NO: 467590 - DNA, 15 bp, Homo sapiens
agaatcactgataca

SEQ ID NO: 467591 - DNA, 15 bp, Homo sapiens
gaatcactgatacac

SEQ ID NO: 467592 - DNA, 15 bp, Homo sapiens
aatcactgatacaca

SEQ ID NO: 467593 - DNA, 15 bp, Homo sapiens
atcactgatacacat

SEQ ID NO: 467594 - DNA, 15 bp, Homo sapiens
tcactgatacacata

SEQ ID NO: 467595 - DNA, 15 bp, Homo sapiens
cactgatacacatat

SEQ ID NO: 467596 - DNA, 15 bp, Homo sapiens
actgatacacatatg

SEQ ID NO: 467597 - DNA, 15 bp, Homo sapiens
ctgatacacatatga

SEQ ID NO: 467598 - DNA, 15 bp, Homo sapiens
tgatacacatatgaa

SEQ ID NO: 467599 - DNA, 15 bp, Homo sapiens
gatacacatatgaat

SEQ ID NO: 467600 - DNA, 15 bp, Homo sapiens
atacacatatgaatt

SEQ ID NO: 467601 - DNA, 15 bp, Homo sapiens
tacacatatgaattc

SEQ ID NO: 467602 - DNA, 15 bp, Homo sapiens
acacatatgaattcc

SEQ ID NO: 467603 - DNA, 15 bp, Homo sapiens
cacatatgaattcca

SEQ ID NO: 467604 - DNA, 15 bp, Homo sapiens
acatatgaattccac

SEQ ID NO: 467605 - DNA, 15 bp, Homo sapiens
catatgaattccact

SEQ ID NO: 467606 - DNA, 15 bp, Homo sapiens
atatgaattccactc

SEQ ID NO: 467607 - DNA, 15 bp, Homo sapiens
tatgaattccactct

SEQ ID NO: 467608 - DNA, 15 bp, Homo sapiens
atgaattccactctc

SEQ ID NO: 467609 - DNA, 15 bp, Homo sapiens
tgaattccactctcc

SEQ ID NO: 467610 - DNA, 15 bp, Homo sapiens
gaattccactctcca

SEQ ID NO: 467611 - DNA, 15 bp, Homo sapiens
aattccactctccaa

SEQ ID NO: 467612 - DNA, 15 bp, Homo sapiens
attccactctccaac

SEQ ID NO: 467613 - DNA, 15 bp, Homo sapiens
ttccactctccaact

SEQ ID NO: 467614 - DNA, 15 bp, Homo sapiens
tccactctccaacta

SEQ ID NO: 467615 - DNA, 15 bp, Homo sapiens
ccactctccaactac

SEQ ID NO: 467616 - DNA, 15 bp, Homo sapiens
cactctccaactacc

SEQ ID NO: 467617 - DNA, 15 bp, Homo sapiens
actctccaactacca

SEQ ID NO: 467618 - DNA, 15 bp, Homo sapiens
ctctccaactaccaa

SEQ ID NO: 467619 - DNA, 15 bp, Homo sapiens
tctccaactaccaat

SEQ ID NO: 467620 - DNA, 15 bp, Homo sapiens
ctccaactaccaatt

SEQ ID NO: 467621 - DNA, 15 bp, Homo sapiens
tccaactaccaattt

SEQ ID NO: 467622 - DNA, 15 bp, Homo sapiens
ccaactaccaatttt

SEQ ID NO: 467623 - DNA, 15 bp, Homo sapiens
caactaccaatttta

SEQ ID NO: 467624 - DNA, 15 bp, Homo sapiens
aactaccaattttaa

SEQ ID NO: 467625 - DNA, 15 bp, Homo sapiens
actaccaattttaaa

SEQ ID NO: 467626 - DNA, 15 bp, Homo sapiens
ctaccaattttaaat

SEQ ID NO: 467627 - DNA, 15 bp, Homo sapiens
taccaattttaaatg

SEQ ID NO: 467628 - DNA, 15 bp, Homo sapiens
accaattttaaatga

SEQ ID NO: 467629 - DNA, 15 bp, Homo sapiens
ccaattttaaatgaa

SEQ ID NO: 467630 - DNA, 15 bp, Homo sapiens
caattttaaatgaaa

SEQ ID NO: 467631 - DNA, 15 bp, Homo sapiens
aattttaaatgaaat

SEQ ID NO: 467632 - DNA, 15 bp, Homo sapiens
attttaaatgaaatc

SEQ ID NO: 467633 - DNA, 15 bp, Homo sapiens
ttttaaatgaaatct

SEQ ID NO: 467634 - DNA, 15 bp, Homo sapiens
tttaaatgaaatctg

SEQ ID NO: 467635 - DNA, 15 bp, Homo sapiens
ttaaatgaaatctgt

SEQ ID NO: 467636 - DNA, 15 bp, Homo sapiens
taaatgaaatctgta

SEQ ID NO: 467637 - DNA, 15 bp, Homo sapiens
aaatgaaatctgtaa

SEQ ID NO: 467638 - DNA, 15 bp, Homo sapiens
aatgaaatctgtaag

SEQ ID NO: 467639 - DNA, 15 bp, Homo sapiens
atgaaatctgtaagt

SEQ ID NO: 467640 - DNA, 15 bp, Homo sapiens
tgaaatctgtaagtt

SEQ ID NO: 467641 - DNA, 15 bp, Homo sapiens
gaaatctgtaagtta

SEQ ID NO: 467642 - DNA, 15 bp, Homo sapiens
aaatctgtaagttac

SEQ ID NO: 467643 - DNA, 15 bp, Homo sapiens
aatctgtaagttacc

SEQ ID NO: 467644 - DNA, 15 bp, Homo sapiens
atctgtaagttaccc

SEQ ID NO: 467645 - DNA, 15 bp, Homo sapiens
tctgtaagttaccca

SEQ ID NO: 467646 - DNA, 15 bp, Homo sapiens
ctgtaagttacccaa

SEQ ID NO: 467647 - DNA, 15 bp, Homo sapiens
tgtaagttacccaaa

SEQ ID NO: 467648 - DNA, 15 bp, Homo sapiens
gtaagttacccaaaa

SEQ ID NO: 467649 - DNA, 15 bp, Homo sapiens
taagttacccaaaac

SEQ ID NO: 467650 - DNA, 15 bp, Homo sapiens
aagttacccaaaact

SEQ ID NO: 467651 - DNA, 15 bp, Homo sapiens
agttacccaaaactg

SEQ ID NO: 467652 - DNA, 15 bp, Homo sapiens
gttacccaaaactgt

SEQ ID NO: 467653 - DNA, 15 bp, Homo sapiens
ttacccaaaactgtt

SEQ ID NO: 467654 - DNA, 15 bp, Homo sapiens
tacccaaaactgttc

SEQ ID NO: 467655 - DNA, 15 bp, Homo sapiens
acccaaaactgttct

SEQ ID NO: 467656 - DNA, 15 bp, Homo sapiens
cccaaaactgttctt

SEQ ID NO: 467657 - DNA, 15 bp, Homo sapiens
ccaaaactgttcttg

SEQ ID NO: 467658 - DNA, 15 bp, Homo sapiens
caaaactgttcttgt

SEQ ID NO: 467659 - DNA, 15 bp, Homo sapiens
aaaactgttcttgtt

SEQ ID NO: 467660 - DNA, 15 bp, Homo sapiens
aaactgttcttgttg

SEQ ID NO: 467661 - DNA, 15 bp, Homo sapiens
aactgttcttgttgc

SEQ ID NO: 467662 - DNA, 15 bp, Homo sapiens
actgttcttgttgca

SEQ ID NO: 467663 - DNA, 15 bp, Homo sapiens
ctgttcttgttgcat

SEQ ID NO: 467664 - DNA, 15 bp, Homo sapiens
tgttcttgttgcata

SEQ ID NO: 467665 - DNA, 15 bp, Homo sapiens
gttcttgttgcatag

SEQ ID NO: 467666 - DNA, 15 bp, Homo sapiens
ttcttgttgcatagt

SEQ ID NO: 467667 - DNA, 15 bp, Homo sapiens
tcttgttgcatagtc

SEQ ID NO: 467668 - DNA, 15 bp, Homo sapiens
cttgttgcatagtct

SEQ ID NO: 467669 - DNA, 15 bp, Homo sapiens
ttgttgcatagtctt

SEQ ID NO: 467670 - DNA, 15 bp, Homo sapiens
tgttgcatagtcttt

SEQ ID NO: 467671 - DNA, 15 bp, Homo sapiens
gttgcatagtctttc

SEQ ID NO: 467672 - DNA, 15 bp, Homo sapiens
ttgcatagtctttca

SEQ ID NO: 467673 - DNA, 15 bp, Homo sapiens
tgcatagtctttcaa

SEQ ID NO: 467674 - DNA, 15 bp, Homo sapiens
gcatagtctttcaaa

SEQ ID NO: 467675 - DNA, 15 bp, Homo sapiens
catagtctttcaaaa

SEQ ID NO: 467676 - DNA, 15 bp, Homo sapiens
atagtctttcaaaag

SEQ ID NO: 467677 - DNA, 15 bp, Homo sapiens
tagtctttcaaaagt

SEQ ID NO: 467678 - DNA, 15 bp, Homo sapiens
agtctttcaaaagtc

SEQ ID NO: 467679 - DNA, 15 bp, Homo sapiens
gtctttcaaaagtca

SEQ ID NO: 467680 - DNA, 15 bp, Homo sapiens
tctttcaaaagtcac

SEQ ID NO: 467681 - DNA, 15 bp, Homo sapiens
ctttcaaaagtcact

SEQ ID NO: 467682 - DNA, 15 bp, Homo sapiens
tttcaaaagtcactg

SEQ ID NO: 467683 - DNA, 15 bp, Homo sapiens
ttcaaaagtcactgt

SEQ ID NO: 467684 - DNA, 15 bp, Homo sapiens
tcaaaagtcactgtt

SEQ ID NO: 467685 - DNA, 15 bp, Homo sapiens
caaaagtcactgttt

SEQ ID NO: 467686 - DNA, 15 bp, Homo sapiens
aaaagtcactgttta

SEQ ID NO: 467687 - DNA, 15 bp, Homo sapiens
aaagtcactgtttat

SEQ ID NO: 467688 - DNA, 15 bp, Homo sapiens
aagtcactgtttatc

SEQ ID NO: 467689 - DNA, 15 bp, Homo sapiens
agtcactgtttatca

SEQ ID NO: 467690 - DNA, 15 bp, Homo sapiens
gtcactgtttatcat

SEQ ID NO: 467691 - DNA, 15 bp, Homo sapiens
tcactgtttatcatt

SEQ ID NO: 467692 - DNA, 15 bp, Homo sapiens
cactgtttatcattt

SEQ ID NO: 467693 - DNA, 15 bp, Homo sapiens
actgtttatcatttc

SEQ ID NO: 467694 - DNA, 15 bp, Homo sapiens
ctgtttatcatttcc

SEQ ID NO: 467695 - DNA, 15 bp, Homo sapiens
tgtttatcatttcca

SEQ ID NO: 467696 - DNA, 15 bp, Homo sapiens
gtttatcatttccaa

SEQ ID NO: 467697 - DNA, 15 bp, Homo sapiens
tttatcatttccaag

SEQ ID NO: 467698 - DNA, 15 bp, Homo sapiens
ttatcatttccaaga

SEQ ID NO: 467699 - DNA, 15 bp, Homo sapiens
tatcatttccaagat

SEQ ID NO: 467700 - DNA, 15 bp, Homo sapiens
atcatttccaagatt

SEQ ID NO: 467701 - DNA, 15 bp, Homo sapiens
tcatttccaagattg

SEQ ID NO: 467702 - DNA, 15 bp, Homo sapiens
catttccaagattgc

SEQ ID NO: 467703 - DNA, 15 bp, Homo sapiens
atttccaagattgca

SEQ ID NO: 467704 - DNA, 15 bp, Homo sapiens
tttccaagattgcag

SEQ ID NO: 467705 - DNA, 15 bp, Homo sapiens
ttccaagattgcagc

SEQ ID NO: 467706 - DNA, 15 bp, Homo sapiens
tccaagattgcagct

SEQ ID NO: 467707 - DNA, 15 bp, Homo sapiens
ccaagattgcagctt

SEQ ID NO: 467708 - DNA, 15 bp, Homo sapiens
caagattgcagctta

SEQ ID NO: 467709 - DNA, 15 bp, Homo sapiens
aagattgcagcttat

SEQ ID NO: 467710 - DNA, 15 bp, Homo sapiens
agattgcagcttatc

SEQ ID NO: 467711 - DNA, 15 bp, Homo sapiens
gattgcagcttatcc

SEQ ID NO: 467712 - DNA, 15 bp, Homo sapiens
attgcagcttatcct

SEQ ID NO: 467713 - DNA, 15 bp, Homo sapiens
ttgcagcttatcctg

SEQ ID NO: 467714 - DNA, 15 bp, Homo sapiens
tgcagcttatcctgc

SEQ ID NO: 467715 - DNA, 15 bp, Homo sapiens
gcagcttatcctgca

SEQ ID NO: 467716 - DNA, 15 bp, Homo sapiens
cagcttatcctgcat

SEQ ID NO: 467717 - DNA, 15 bp, Homo sapiens
agcttatcctgcatt

SEQ ID NO: 467718 - DNA, 15 bp, Homo sapiens
gcttatcctgcatta

SEQ ID NO: 467719 - DNA, 15 bp, Homo sapiens
cttatcctgcattat

SEQ ID NO: 467720 - DNA, 15 bp, Homo sapiens
ttatcctgcattata

SEQ ID NO: 467721 - DNA, 15 bp, Homo sapiens
tatcctgcattatac

SEQ ID NO: 467722 - DNA, 15 bp, Homo sapiens
atcctgcattataca

SEQ ID NO: 467723 - DNA, 15 bp, Homo sapiens
tcctgcattatacaa

SEQ ID NO: 467724 - DNA, 15 bp, Homo sapiens
cctgcattatacaag

SEQ ID NO: 467725 - DNA, 15 bp, Homo sapiens
ctgcattatacaagg

SEQ ID NO: 467726 - DNA, 15 bp, Homo sapiens
tgcattatacaagga

SEQ ID NO: 467727 - DNA, 15 bp, Homo sapiens
gcattatacaaggat

SEQ ID NO: 467728 - DNA, 15 bp, Homo sapiens
cattatacaaggata

SEQ ID NO: 467729 - DNA, 15 bp, Homo sapiens
attatacaaggatag

SEQ ID NO: 467730 - DNA, 15 bp, Homo sapiens
ttatacaaggatagc

SEQ ID NO: 467731 - DNA, 15 bp, Homo sapiens
tatacaaggatagct

SEQ ID NO: 467732 - DNA, 15 bp, Homo sapiens
atacaaggatagctt

SEQ ID NO: 467733 - DNA, 15 bp, Homo sapiens
tacaaggatagcttc

SEQ ID NO: 467734 - DNA, 15 bp, Homo sapiens
acaaggatagcttca

SEQ ID NO: 467735 - DNA, 15 bp, Homo sapiens
caaggatagcttcat

SEQ ID NO: 467736 - DNA, 15 bp, Homo sapiens
aaggatagcttcatt

SEQ ID NO: 467737 - DNA, 15 bp, Homo sapiens
aggatagcttcattt

SEQ ID NO: 467738 - DNA, 15 bp, Homo sapiens
ggatagcttcatttt

SEQ ID NO: 467739 - DNA, 15 bp, Homo sapiens
gatagcttcattttt

SEQ ID NO: 467740 - DNA, 15 bp, Homo sapiens
atagcttcatttttc

SEQ ID NO: 467741 - DNA, 15 bp, Homo sapiens
tagcttcatttttca

SEQ ID NO: 467742 - DNA, 15 bp, Homo sapiens
agcttcatttttcaa

SEQ ID NO: 467743 - DNA, 15 bp, Homo sapiens
gcttcatttttcaag

SEQ ID NO: 467744 - DNA, 15 bp, Homo sapiens
cttcatttttcaaga

SEQ ID NO: 467745 - DNA, 15 bp, Homo sapiens
ttcatttttcaagac

SEQ ID NO: 467746 - DNA, 15 bp, Homo sapiens
tcatttttcaagaca

SEQ ID NO: 467747 - DNA, 15 bp, Homo sapiens
catttttcaagacat

SEQ ID NO: 467748 - DNA, 15 bp, Homo sapiens
atttttcaagacatc

SEQ ID NO: 467749 - DNA, 15 bp, Homo sapiens
tttttcaagacatcc

SEQ ID NO: 467750 - DNA, 15 bp, Homo sapiens
ttttcaagacatcct

SEQ ID NO: 467751 - DNA, 15 bp, Homo sapiens
tttcaagacatcctt

SEQ ID NO: 467752 - DNA, 15 bp, Homo sapiens
ttcaagacatccttt

SEQ ID NO: 467753 - DNA, 15 bp, Homo sapiens
tcaagacatcctttg

SEQ ID NO: 467754 - DNA, 15 bp, Homo sapiens
caagacatcctttgc

SEQ ID NO: 467755 - DNA, 15 bp, Homo sapiens
aagacatcctttgcc

SEQ ID NO: 467756 - DNA, 15 bp, Homo sapiens
agacatcctttgccc

SEQ ID NO: 467757 - DNA, 15 bp, Homo sapiens
gacatcctttgccca

SEQ ID NO: 467758 - DNA, 15 bp, Homo sapiens
acatcctttgcccat

SEQ ID NO: 467759 - DNA, 15 bp, Homo sapiens
catcctttgcccatt

SEQ ID NO: 467760 - DNA, 15 bp, Homo sapiens
atcctttgcccattt

SEQ ID NO: 467761 - DNA, 15 bp, Homo sapiens
tcctttgcccatttc

SEQ ID NO: 467762 - DNA, 15 bp, Homo sapiens
cctttgcccatttct

SEQ ID NO: 467763 - DNA, 15 bp, Homo sapiens
ctttgcccatttctg

SEQ ID NO: 467764 - DNA, 15 bp, Homo sapiens
tttgcccatttctga

SEQ ID NO: 467765 - DNA, 15 bp, Homo sapiens
ttgcccatttctgag

SEQ ID NO: 467766 - DNA, 15 bp, Homo sapiens
tgcccatttctgagg

SEQ ID NO: 467767 - DNA, 15 bp, Homo sapiens
gcccatttctgaggc

SEQ ID NO: 467768 - DNA, 15 bp, Homo sapiens
cccatttctgaggct

SEQ ID NO: 467769 - DNA, 15 bp, Homo sapiens
ccatttctgaggctt

SEQ ID NO: 467770 - DNA, 15 bp, Homo sapiens
catttctgaggcttt

SEQ ID NO: 467771 - DNA, 15 bp, Homo sapiens
atttctgaggctttg

SEQ ID NO: 467772 - DNA, 15 bp, Homo sapiens
tttctgaggctttgt

SEQ ID NO: 467773 - DNA, 15 bp, Homo sapiens
ttctgaggctttgta

SEQ ID NO: 467774 - DNA, 15 bp, Homo sapiens
tctgaggctttgtag

SEQ ID NO: 467775 - DNA, 15 bp, Homo sapiens
ctgaggctttgtagt

SEQ ID NO: 467776 - DNA, 15 bp, Homo sapiens
tgaggctttgtagtg

SEQ ID NO: 467777 - DNA, 15 bp, Homo sapiens
gaggctttgtagtga

SEQ ID NO: 467778 - DNA, 15 bp, Homo sapiens
aggctttgtagtgat

SEQ ID NO: 467779 - DNA, 15 bp, Homo sapiens
ggctttgtagtgatc

SEQ ID NO: 467780 - DNA, 15 bp, Homo sapiens
gctttgtagtgatct

SEQ ID NO: 467781 - DNA, 15 bp, Homo sapiens
ctttgtagtgatctt

SEQ ID NO: 467782 - DNA, 15 bp, Homo sapiens
tttgtagtgatctta

SEQ ID NO: 467783 - DNA, 15 bp, Homo sapiens
ttgtagtgatcttat

SEQ ID NO: 467784 - DNA, 15 bp, Homo sapiens
tgtagtgatcttatc

SEQ ID NO: 467785 - DNA, 15 bp, Homo sapiens
gtagtgatcttatca

SEQ ID NO: 467786 - DNA, 15 bp, Homo sapiens
tagtgatcttatcaa

SEQ ID NO: 467787 - DNA, 15 bp, Homo sapiens
agtgatcttatcaac

SEQ ID NO: 467788 - DNA, 15 bp, Homo sapiens
gtgatcttatcaaca

SEQ ID NO: 467789 - DNA, 15 bp, Homo sapiens
tgatcttatcaacag

SEQ ID NO: 467790 - DNA, 15 bp, Homo sapiens
gatcttatcaacagc

SEQ ID NO: 467791 - DNA, 15 bp, Homo sapiens
atcttatcaacagcc

SEQ ID NO: 467792 - DNA, 15 bp, Homo sapiens
tcttatcaacagcct

SEQ ID NO: 467793 - DNA, 15 bp, Homo sapiens
cttatcaacagccta

SEQ ID NO: 467794 - DNA, 15 bp, Homo sapiens
ttatcaacagcctac

SEQ ID NO: 467795 - DNA, 15 bp, Homo sapiens
tatcaacagcctact

SEQ ID NO: 467796 - DNA, 15 bp, Homo sapiens
atcaacagcctactt

SEQ ID NO: 467797 - DNA, 15 bp, Homo sapiens
tcaacagcctactta

SEQ ID NO: 467798 - DNA, 15 bp, Homo sapiens
caacagcctacttat

SEQ ID NO: 467799 - DNA, 15 bp, Homo sapiens
aacagcctacttata

SEQ ID NO: 467800 - DNA, 15 bp, Homo sapiens
acagcctacttataa

SEQ ID NO: 467801 - DNA, 15 bp, Homo sapiens
cagcctacttataaa

SEQ ID NO: 467802 - DNA, 15 bp, Homo sapiens
agcctacttataaat

SEQ ID NO: 467803 - DNA, 15 bp, Homo sapiens
gcctacttataaatc

SEQ ID NO: 467804 - DNA, 15 bp, Homo sapiens
cctacttataaatca

SEQ ID NO: 467805 - DNA, 15 bp, Homo sapiens
ctacttataaatcat

SEQ ID NO: 467806 - DNA, 15 bp, Homo sapiens
tacttataaatcatc

SEQ ID NO: 467807 - DNA, 15 bp, Homo sapiens
acttataaatcatct

SEQ ID NO: 467808 - DNA, 15 bp, Homo sapiens
cttataaatcatctg

SEQ ID NO: 467809 - DNA, 15 bp, Homo sapiens
ttataaatcatctgt

SEQ ID NO: 467810 - DNA, 15 bp, Homo sapiens
tataaatcatctgta

SEQ ID NO: 467811 - DNA, 15 bp, Homo sapiens
ataaatcatctgtat

SEQ ID NO: 467812 - DNA, 15 bp, Homo sapiens
taaatcatctgtatg

SEQ ID NO: 467813 - DNA, 15 bp, Homo sapiens
aaatcatctgtatga

SEQ ID NO: 467814 - DNA, 15 bp, Homo sapiens
aatcatctgtatgac

SEQ ID NO: 467815 - DNA, 15 bp, Homo sapiens
atcatctgtatgaca

SEQ ID NO: 467816 - DNA, 15 bp, Homo sapiens
tcatctgtatgacag

SEQ ID NO: 467817 - DNA, 15 bp, Homo sapiens
catctgtatgacagg

SEQ ID NO: 467818 - DNA, 15 bp, Homo sapiens
atctgtatgacaggt

SEQ ID NO: 467819 - DNA, 15 bp, Homo sapiens
tctgtatgacaggtc

SEQ ID NO: 467820 - DNA, 15 bp, Homo sapiens
ctgtatgacaggtca

SEQ ID NO: 467821 - DNA, 15 bp, Homo sapiens
tgtatgacaggtcac

SEQ ID NO: 467822 - DNA, 15 bp, Homo sapiens
gtatgacaggtcact

SEQ ID NO: 467823 - DNA, 15 bp, Homo sapiens
tatgacaggtcactt

SEQ ID NO: 467824 - DNA, 15 bp, Homo sapiens
atgacaggtcacttt

SEQ ID NO: 467825 - DNA, 15 bp, Homo sapiens
tgacaggtcactttc

SEQ ID NO: 467826 - DNA, 15 bp, Homo sapiens
gacaggtcactttct

SEQ ID NO: 467827 - DNA, 15 bp, Homo sapiens
acaggtcactttctg

SEQ ID NO: 467828 - DNA, 15 bp, Homo sapiens
caggtcactttctgc

SEQ ID NO: 467829 - DNA, 15 bp, Homo sapiens
aggtcactttctgca

SEQ ID NO: 467830 - DNA, 15 bp, Homo sapiens
ggtcactttctgcat

SEQ ID NO: 467831 - DNA, 15 bp, Homo sapiens
gtcactttctgcatt

SEQ ID NO: 467832 - DNA, 15 bp, Homo sapiens
tcactttctgcattt

SEQ ID NO: 467833 - DNA, 15 bp, Homo sapiens
cactttctgcatttg

SEQ ID NO: 467834 - DNA, 15 bp, Homo sapiens
actttctgcatttga

SEQ ID NO: 467835 - DNA, 15 bp, Homo sapiens
ctttctgcatttgac

SEQ ID NO: 467836 - DNA, 15 bp, Homo sapiens
tttctgcatttgacc

SEQ ID NO: 467837 - DNA, 15 bp, Homo sapiens
ttctgcatttgaccc

SEQ ID NO: 467838 - DNA, 15 bp, Homo sapiens
tctgcatttgaccct

SEQ ID NO: 467839 - DNA, 15 bp, Homo sapiens
ctgcatttgacccta

SEQ ID NO: 467840 - DNA, 15 bp, Homo sapiens
tgcatttgaccctac

SEQ ID NO: 467841 - DNA, 15 bp, Homo sapiens
gcatttgaccctaca

SEQ ID NO: 467842 - DNA, 15 bp, Homo sapiens
catttgaccctacaa

SEQ ID NO: 467843 - DNA, 15 bp, Homo sapiens
atttgaccctacaac

SEQ ID NO: 467844 - DNA, 15 bp, Homo sapiens
tttgaccctacaact

SEQ ID NO: 467845 - DNA, 15 bp, Homo sapiens
ttgaccctacaactt

SEQ ID NO: 467846 - DNA, 15 bp, Homo sapiens
tgaccctacaacttt

SEQ ID NO: 467847 - DNA, 15 bp, Homo sapiens
gaccctacaactttt

SEQ ID NO: 467848 - DNA, 15 bp, Homo sapiens
accctacaacttttt

SEQ ID NO: 467849 - DNA, 15 bp, Homo sapiens
ccctacaactttttg

SEQ ID NO: 467850 - DNA, 15 bp, Homo sapiens
cctacaactttttgt

SEQ ID NO: 467851 - DNA, 15 bp, Homo sapiens
ctacaactttttgta

SEQ ID NO: 467852 - DNA, 15 bp, Homo sapiens
tacaactttttgtaa

SEQ ID NO: 467853 - DNA, 15 bp, Homo sapiens
acaactttttgtaaa

SEQ ID NO: 467854 - DNA, 15 bp, Homo sapiens
caactttttgtaaaa

SEQ ID NO: 467855 - DNA, 15 bp, Homo sapiens
aactttttgtaaaat

SEQ ID NO: 467856 - DNA, 15 bp, Homo sapiens
actttttgtaaaata

SEQ ID NO: 467857 - DNA, 15 bp, Homo sapiens
ctttttgtaaaataa

SEQ ID NO: 467858 - DNA, 15 bp, Homo sapiens
tttttgtaaaataac

SEQ ID NO: 467859 - DNA, 15 bp, Homo sapiens
ttttgtaaaataact

SEQ ID NO: 467860 - DNA, 15 bp, Homo sapiens
tttgtaaaataacta

SEQ ID NO: 467861 - DNA, 15 bp, Homo sapiens
ttgtaaaataactag

SEQ ID NO: 467862 - DNA, 15 bp, Homo sapiens
tgtaaaataactaga

SEQ ID NO: 467863 - DNA, 15 bp, Homo sapiens
gtaaaataactagaa

SEQ ID NO: 467864 - DNA, 15 bp, Homo sapiens
taaaataactagaaa

SEQ ID NO: 467865 - DNA, 15 bp, Homo sapiens
aaaataactagaaat

SEQ ID NO: 467866 - DNA, 15 bp, Homo sapiens
aaataactagaaata

SEQ ID NO: 467867 - DNA, 15 bp, Homo sapiens
aataactagaaatat

SEQ ID NO: 467868 - DNA, 15 bp, Homo sapiens
ataactagaaatata

SEQ ID NO: 467869 - DNA, 15 bp, Homo sapiens
taactagaaatatat

SEQ ID NO: 467870 - DNA, 15 bp, Homo sapiens
aactagaaatatatg

SEQ ID NO: 467871 - DNA, 15 bp, Homo sapiens
actagaaatatatgt

SEQ ID NO: 467872 - DNA, 15 bp, Homo sapiens
ctagaaatatatgta

SEQ ID NO: 467873 - DNA, 15 bp, Homo sapiens
tagaaatatatgtaa

SEQ ID NO: 467874 - DNA, 15 bp, Homo sapiens
agaaatatatgtaaa

SEQ ID NO: 467875 - DNA, 15 bp, Homo sapiens
gaaatatatgtaaat

SEQ ID NO: 467876 - DNA, 15 bp, Homo sapiens
aaatatatgtaaatt

SEQ ID NO: 467877 - DNA, 15 bp, Homo sapiens
aatatatgtaaattg

SEQ ID NO: 467878 - DNA, 15 bp, Homo sapiens
atatatgtaaattga

SEQ ID NO: 467879 - DNA, 15 bp, Homo sapiens
tatatgtaaattgaa

SEQ ID NO: 467880 - DNA, 15 bp, Homo sapiens
atatgtaaattgaat

SEQ ID NO: 467881 - DNA, 15 bp, Homo sapiens
tatgtaaattgaatc

SEQ ID NO: 467882 - DNA, 15 bp, Homo sapiens
atgtaaattgaatct

SEQ ID NO: 467883 - DNA, 15 bp, Homo sapiens
tgtaaattgaatctt

SEQ ID NO: 467884 - DNA, 15 bp, Homo sapiens
gtaaattgaatcttt

SEQ ID NO: 467885 - DNA, 15 bp, Homo sapiens
taaattgaatcttta

SEQ ID NO: 467886 - DNA, 15 bp, Homo sapiens
aaattgaatctttaa

SEQ ID NO: 467887 - DNA, 15 bp, Homo sapiens
aattgaatctttaaa

SEQ ID NO: 467888 - DNA, 15 bp, Homo sapiens
attgaatctttaaaa

SEQ ID NO: 467889 - DNA, 15 bp, Homo sapiens
ttgaatctttaaaaa

SEQ ID NO: 467890 - DNA, 15 bp, Homo sapiens
tgaatctttaaaaag

SEQ ID NO: 467891 - DNA, 15 bp, Homo sapiens
gaatctttaaaaaga

SEQ ID NO: 467892 - DNA, 15 bp, Homo sapiens
aatctttaaaaagat

SEQ ID NO: 467893 - DNA, 15 bp, Homo sapiens
atctttaaaaagata

SEQ ID NO: 467894 - DNA, 15 bp, Homo sapiens
tctttaaaaagatac

SEQ ID NO: 467895 - DNA, 15 bp, Homo sapiens
ctttaaaaagatact

SEQ ID NO: 467896 - DNA, 15 bp, Homo sapiens
tttaaaaagatactt

SEQ ID NO: 467897 - DNA, 15 bp, Homo sapiens
ttaaaaagatacttg

SEQ ID NO: 467898 - DNA, 15 bp, Homo sapiens
taaaaagatacttgc

SEQ ID NO: 467899 - DNA, 15 bp, Homo sapiens
aaaaagatacttgca

SEQ ID NO: 467900 - DNA, 15 bp, Homo sapiens
aaaagatacttgcat

SEQ ID NO: 467901 - DNA, 15 bp, Homo sapiens
aaagatacttgcatt

SEQ ID NO: 467902 - DNA, 15 bp, Homo sapiens
aagatacttgcattt

SEQ ID NO: 467903 - DNA, 15 bp, Homo sapiens
agatacttgcattta

SEQ ID NO: 467904 - DNA, 15 bp, Homo sapiens
gatacttgcatttaa

SEQ ID NO: 467905 - DNA, 15 bp, Homo sapiens
atacttgcatttaat

SEQ ID NO: 467906 - DNA, 15 bp, Homo sapiens
tacttgcatttaata

SEQ ID NO: 467907 - DNA, 15 bp, Homo sapiens
acttgcatttaatag

SEQ ID NO: 467908 - DNA, 15 bp, Homo sapiens
cttgcatttaatagc

SEQ ID NO: 467909 - DNA, 15 bp, Homo sapiens
ttgcatttaatagca

SEQ ID NO: 467910 - DNA, 15 bp, Homo sapiens
tgcatttaatagcaa

SEQ ID NO: 467911 - DNA, 15 bp, Homo sapiens
gcatttaatagcaat

SEQ ID NO: 467912 - DNA, 15 bp, Homo sapiens
catttaatagcaatg

SEQ ID NO: 467913 - DNA, 15 bp, Homo sapiens
atttaatagcaatga

SEQ ID NO: 467914 - DNA, 15 bp, Homo sapiens
tttaatagcaatgaa

SEQ ID NO: 467915 - DNA, 15 bp, Homo sapiens
ttaatagcaatgaat

SEQ ID NO: 467916 - DNA, 15 bp, Homo sapiens
taatagcaatgaatg

SEQ ID NO: 467917 - DNA, 15 bp, Homo sapiens
aatagcaatgaatga

SEQ ID NO: 467918 - DNA, 15 bp, Homo sapiens
atagcaatgaatgat

SEQ ID NO: 467919 - DNA, 15 bp, Homo sapiens
tagcaatgaatgatc

SEQ ID NO: 467920 - DNA, 15 bp, Homo sapiens
agcaatgaatgatct

SEQ ID NO: 467921 - DNA, 15 bp, Homo sapiens
gcaatgaatgatctg

SEQ ID NO: 467922 - DNA, 15 bp, Homo sapiens
caatgaatgatctga

SEQ ID NO: 467923 - DNA, 15 bp, Homo sapiens
aatgaatgatctgat

SEQ ID NO: 467924 - DNA, 15 bp, Homo sapiens
atgaatgatctgatt

SEQ ID NO: 467925 - DNA, 15 bp, Homo sapiens
tgaatgatctgattg

SEQ ID NO: 467926 - DNA, 15 bp, Homo sapiens
gaatgatctgattgc

SEQ ID NO: 467927 - DNA, 15 bp, Homo sapiens
aatgatctgattgct

SEQ ID NO: 467928 - DNA, 15 bp, Homo sapiens
atgatctgattgcta

SEQ ID NO: 467929 - DNA, 15 bp, Homo sapiens
tgatctgattgctat

SEQ ID NO: 467930 - DNA, 15 bp, Homo sapiens
gatctgattgctatt

SEQ ID NO: 467931 - DNA, 15 bp, Homo sapiens
atctgattgctatta

SEQ ID NO: 467932 - DNA, 15 bp, Homo sapiens
tctgattgctattat

SEQ ID NO: 467933 - DNA, 15 bp, Homo sapiens
ctgattgctattatt

SEQ ID NO: 467934 - DNA, 15 bp, Homo sapiens
tgattgctattattg

SEQ ID NO: 467935 - DNA, 15 bp, Homo sapiens
gattgctattattgt

SEQ ID NO: 467936 - DNA, 15 bp, Homo sapiens
attgctattattgta

SEQ ID NO: 467937 - DNA, 15 bp, Homo sapiens
ttgctattattgtag

SEQ ID NO: 467938 - DNA, 15 bp, Homo sapiens
tgctattattgtagc

SEQ ID NO: 467939 - DNA, 15 bp, Homo sapiens
gctattattgtagca

SEQ ID NO: 467940 - DNA, 15 bp, Homo sapiens
ctattattgtagcat

SEQ ID NO: 467941 - DNA, 15 bp, Homo sapiens
tattattgtagcatt

SEQ ID NO: 467942 - DNA, 15 bp, Homo sapiens
attattgtagcatta

SEQ ID NO: 467943 - DNA, 15 bp, Homo sapiens
ttattgtagcattaa

SEQ ID NO: 467944 - DNA, 15 bp, Homo sapiens
tattgtagcattaat

SEQ ID NO: 467945 - DNA, 15 bp, Homo sapiens
attgtagcattaatg

SEQ ID NO: 467946 - DNA, 15 bp, Homo sapiens
ttgtagcattaatgt

SEQ ID NO: 467947 - DNA, 15 bp, Homo sapiens
tgtagcattaatgtc

SEQ ID NO: 467948 - DNA, 15 bp, Homo sapiens
gtagcattaatgtct

SEQ ID NO: 467949 - DNA, 15 bp, Homo sapiens
tagcattaatgtctt

SEQ ID NO: 467950 - DNA, 15 bp, Homo sapiens
agcattaatgtcttt

SEQ ID NO: 467951 - DNA, 15 bp, Homo sapiens
gcattaatgtctttc

SEQ ID NO: 467952 - DNA, 15 bp, Homo sapiens
cattaatgtctttcc

SEQ ID NO: 467953 - DNA, 15 bp, Homo sapiens
attaatgtctttcca

SEQ ID NO: 467954 - DNA, 15 bp, Homo sapiens
ttaatgtctttccat

SEQ ID NO: 467955 - DNA, 15 bp, Homo sapiens
taatgtctttccatt

SEQ ID NO: 467956 - DNA, 15 bp, Homo sapiens
aatgtctttccattc

SEQ ID NO: 467957 - DNA, 15 bp, Homo sapiens
atgtctttccattca

SEQ ID NO: 467958 - DNA, 15 bp, Homo sapiens
tgtctttccattcat

SEQ ID NO: 467959 - DNA, 15 bp, Homo sapiens
gtctttccattcatt

SEQ ID NO: 467960 - DNA, 15 bp, Homo sapiens
tctttccattcattc

SEQ ID NO: 467961 - DNA, 15 bp, Homo sapiens
ctttccattcattct

SEQ ID NO: 467962 - DNA, 15 bp, Homo sapiens
tttccattcattctc

SEQ ID NO: 467963 - DNA, 15 bp, Homo sapiens
ttccattcattctct

SEQ ID NO: 467964 - DNA, 15 bp, Homo sapiens
tccattcattctctg

SEQ ID NO: 467965 - DNA, 15 bp, Homo sapiens
ccattcattctctga

SEQ ID NO: 467966 - DNA, 15 bp, Homo sapiens
cattcattctctgaa

SEQ ID NO: 467967 - DNA, 15 bp, Homo sapiens
attcattctctgaag

SEQ ID NO: 467968 - DNA, 15 bp, Homo sapiens
ttcattctctgaagc

SEQ ID NO: 467969 - DNA, 15 bp, Homo sapiens
tcattctctgaagcc

SEQ ID NO: 467970 - DNA, 15 bp, Homo sapiens
cattctctgaagcca

SEQ ID NO: 467971 - DNA, 15 bp, Homo sapiens
attctctgaagccac

SEQ ID NO: 467972 - DNA, 15 bp, Homo sapiens
ttctctgaagccaca

SEQ ID NO: 467973 - DNA, 15 bp, Homo sapiens
tctctgaagccacag

SEQ ID NO: 467974 - DNA, 15 bp, Homo sapiens
ctctgaagccacaga

SEQ ID NO: 467975 - DNA, 15 bp, Homo sapiens
tctgaagccacagag

SEQ ID NO: 467976 - DNA, 15 bp, Homo sapiens
ctgaagccacagaga

SEQ ID NO: 467977 - DNA, 15 bp, Homo sapiens
tgaagccacagagaa

SEQ ID NO: 467978 - DNA, 15 bp, Homo sapiens
gaagccacagagaaa

SEQ ID NO: 467979 - DNA, 15 bp, Homo sapiens
aagccacagagaaag

SEQ ID NO: 467980 - DNA, 15 bp, Homo sapiens
agccacagagaaaga

SEQ ID NO: 467981 - DNA, 15 bp, Homo sapiens
gccacagagaaagat

SEQ ID NO: 467982 - DNA, 15 bp, Homo sapiens
ccacagagaaagatg

SEQ ID NO: 467983 - DNA, 15 bp, Homo sapiens
cacagagaaagatgc

SEQ ID NO: 467984 - DNA, 15 bp, Homo sapiens
acagagaaagatgca

SEQ ID NO: 467985 - DNA, 15 bp, Homo sapiens
cagagaaagatgcat

SEQ ID NO: 467986 - DNA, 15 bp, Homo sapiens
agagaaagatgcatc

SEQ ID NO: 467987 - DNA, 15 bp, Homo sapiens
gagaaagatgcatct

SEQ ID NO: 467988 - DNA, 15 bp, Homo sapiens
agaaagatgcatctc

SEQ ID NO: 467989 - DNA, 15 bp, Homo sapiens
gaaagatgcatctct

SEQ ID NO: 467990 - DNA, 15 bp, Homo sapiens
aaagatgcatctctt

SEQ ID NO: 467991 - DNA, 15 bp, Homo sapiens
aagatgcatctcttt

SEQ ID NO: 467992 - DNA, 15 bp, Homo sapiens
agatgcatctcttta

SEQ ID NO: 467993 - DNA, 15 bp, Homo sapiens
gatgcatctctttac

SEQ ID NO: 467994 - DNA, 15 bp, Homo sapiens
atgcatctctttaca

SEQ ID NO: 467995 - DNA, 15 bp, Homo sapiens
tgcatctctttacaa

SEQ ID NO: 467996 - DNA, 15 bp, Homo sapiens
gcatctctttacaac

SEQ ID NO: 467997 - DNA, 15 bp, Homo sapiens
catctctttacaact

SEQ ID NO: 467998 - DNA, 15 bp, Homo sapiens
atctctttacaacta

SEQ ID NO: 467999 - DNA, 15 bp, Homo sapiens
tctctttacaactaa

SEQ ID NO: 468000 - DNA, 15 bp, Homo sapiens
ctctttacaactaaa

SEQ ID NO: 468001 - DNA, 15 bp, Homo sapiens
tctttacaactaaac

SEQ ID NO: 468002 - DNA, 15 bp, Homo sapiens
ctttacaactaaact

SEQ ID NO: 468003 - DNA, 15 bp, Homo sapiens
tttacaactaaacta

SEQ ID NO: 468004 - DNA, 15 bp, Homo sapiens
ttacaactaaactaa

SEQ ID NO: 468005 - DNA, 15 bp, Homo sapiens
tacaactaaactaat

SEQ ID NO: 468006 - DNA, 15 bp, Homo sapiens
acaactaaactaatc

SEQ ID NO: 468007 - DNA, 15 bp, Homo sapiens
caactaaactaatca

SEQ ID NO: 468008 - DNA, 15 bp, Homo sapiens
aactaaactaatcag

SEQ ID NO: 468009 - DNA, 15 bp, Homo sapiens
actaaactaatcaga

SEQ ID NO: 468010 - DNA, 15 bp, Homo sapiens
ctaaactaatcagac

SEQ ID NO: 468011 - DNA, 15 bp, Homo sapiens
taaactaatcagacc

SEQ ID NO: 468012 - DNA, 15 bp, Homo sapiens
aaactaatcagacct

SEQ ID NO: 468013 - DNA, 15 bp, Homo sapiens
aactaatcagaccta

SEQ ID NO: 468014 - DNA, 15 bp, Homo sapiens
actaatcagacctat

SEQ ID NO: 468015 - DNA, 15 bp, Homo sapiens
ctaatcagacctatt

SEQ ID NO: 468016 - DNA, 15 bp, Homo sapiens
taatcagacctattc

SEQ ID NO: 468017 - DNA, 15 bp, Homo sapiens
aatcagacctattcc

SEQ ID NO: 468018 - DNA, 15 bp, Homo sapiens
atcagacctattcca

SEQ ID NO: 468019 - DNA, 15 bp, Homo sapiens
tcagacctattccaa

SEQ ID NO: 468020 - DNA, 15 bp, Homo sapiens
cagacctattccaac

SEQ ID NO: 468021 - DNA, 15 bp, Homo sapiens
agacctattccaact

SEQ ID NO: 468022 - DNA, 15 bp, Homo sapiens
gacctattccaactg

SEQ ID NO: 468023 - DNA, 15 bp, Homo sapiens
acctattccaactgg

SEQ ID NO: 468024 - DNA, 15 bp, Homo sapiens
cctattccaactgga

SEQ ID NO: 468025 - DNA, 15 bp, Homo sapiens
ctattccaactggac

SEQ ID NO: 468026 - DNA, 15 bp, Homo sapiens
tattccaactggacc

SEQ ID NO: 468027 - DNA, 15 bp, Homo sapiens
attccaactggaccc

SEQ ID NO: 468028 - DNA, 15 bp, Homo sapiens
ttccaactggacccc

SEQ ID NO: 468029 - DNA, 15 bp, Homo sapiens
tccaactggacccca

SEQ ID NO: 468030 - DNA, 15 bp, Homo sapiens
ccaactggaccccat

SEQ ID NO: 468031 - DNA, 15 bp, Homo sapiens
caactggaccccatt

SEQ ID NO: 468032 - DNA, 15 bp, Homo sapiens
aactggaccccattt

SEQ ID NO: 468033 - DNA, 15 bp, Homo sapiens
actggaccccatttt

SEQ ID NO: 468034 - DNA, 15 bp, Homo sapiens
ctggaccccatttta

SEQ ID NO: 468035 - DNA, 15 bp, Homo sapiens
tggaccccattttac

SEQ ID NO: 468036 - DNA, 15 bp, Homo sapiens
ggaccccattttact

SEQ ID NO: 468037 - DNA, 15 bp, Homo sapiens
gaccccattttacta

SEQ ID NO: 468038 - DNA, 15 bp, Homo sapiens
accccattttactat

SEQ ID NO: 468039 - DNA, 15 bp, Homo sapiens
ccccattttactatt

SEQ ID NO: 468040 - DNA, 15 bp, Homo sapiens
cccattttactattg

SEQ ID NO: 468041 - DNA, 15 bp, Homo sapiens
ccattttactattgg

SEQ ID NO: 468042 - DNA, 15 bp, Homo sapiens
cattttactattgga

SEQ ID NO: 468043 - DNA, 15 bp, Homo sapiens
attttactattggaa

SEQ ID NO: 468044 - DNA, 15 bp, Homo sapiens
ttttactattggaat

SEQ ID NO: 468045 - DNA, 15 bp, Homo sapiens
tttactattggaatt

SEQ ID NO: 468046 - DNA, 15 bp, Homo sapiens
ttactattggaattg

SEQ ID NO: 468047 - DNA, 15 bp, Homo sapiens
tactattggaattgt

SEQ ID NO: 468048 - DNA, 15 bp, Homo sapiens
actattggaattgtt

SEQ ID NO: 468049 - DNA, 15 bp, Homo sapiens
ctattggaattgttc

SEQ ID NO: 468050 - DNA, 15 bp, Homo sapiens
tattggaattgttct

SEQ ID NO: 468051 - DNA, 15 bp, Homo sapiens
attggaattgttctt

SEQ ID NO: 468052 - DNA, 15 bp, Homo sapiens
ttggaattgttctta

SEQ ID NO: 468053 - DNA, 15 bp, Homo sapiens
tggaattgttcttat

SEQ ID NO: 468054 - DNA, 15 bp, Homo sapiens
ggaattgttcttata

SEQ ID NO: 468055 - DNA, 15 bp, Homo sapiens
gaattgttcttatat

SEQ ID NO: 468056 - DNA, 15 bp, Homo sapiens
aattgttcttatatt

SEQ ID NO: 468057 - DNA, 15 bp, Homo sapiens
attgttcttatattc

SEQ ID NO: 468058 - DNA, 15 bp, Homo sapiens
ttgttcttatattca

SEQ ID NO: 468059 - DNA, 15 bp, Homo sapiens
tgttcttatattcat

SEQ ID NO: 468060 - DNA, 15 bp, Homo sapiens
gttcttatattcatt

SEQ ID NO: 468061 - DNA, 15 bp, Homo sapiens
ttcttatattcattc

SEQ ID NO: 468062 - DNA, 15 bp, Homo sapiens
tcttatattcattcc

SEQ ID NO: 468063 - DNA, 15 bp, Homo sapiens
cttatattcattccc

SEQ ID NO: 468064 - DNA, 15 bp, Homo sapiens
ttatattcattccct

SEQ ID NO: 468065 - DNA, 15 bp, Homo sapiens
tatattcattccctt

SEQ ID NO: 468066 - DNA, 15 bp, Homo sapiens
atattcattcccttc

SEQ ID NO: 468067 - DNA, 15 bp, Homo sapiens
tattcattcccttca

SEQ ID NO: 468068 - DNA, 15 bp, Homo sapiens
attcattcccttcat

SEQ ID NO: 468069 - DNA, 15 bp, Homo sapiens
ttcattcccttcatg

SEQ ID NO: 468070 - DNA, 15 bp, Homo sapiens
tcattcccttcatgt

SEQ ID NO: 468071 - DNA, 15 bp, Homo sapiens
cattcccttcatgtg

SEQ ID NO: 468072 - DNA, 15 bp, Homo sapiens
attcccttcatgtgt

SEQ ID NO: 468073 - DNA, 15 bp, Homo sapiens
ttcccttcatgtgta

SEQ ID NO: 468074 - DNA, 15 bp, Homo sapiens
tcccttcatgtgtaa

SEQ ID NO: 468075 - DNA, 15 bp, Homo sapiens
cccttcatgtgtaat

SEQ ID NO: 468076 - DNA, 15 bp, Homo sapiens
ccttcatgtgtaatc

SEQ ID NO: 468077 - DNA, 15 bp, Homo sapiens
cttcatgtgtaatct

SEQ ID NO: 468078 - DNA, 15 bp, Homo sapiens
ttcatgtgtaatctt

SEQ ID NO: 468079 - DNA, 15 bp, Homo sapiens
tcatgtgtaatcttt

SEQ ID NO: 468080 - DNA, 15 bp, Homo sapiens
catgtgtaatctttg

SEQ ID NO: 468081 - DNA, 15 bp, Homo sapiens
atgtgtaatctttgt

SEQ ID NO: 468082 - DNA, 15 bp, Homo sapiens
tgtgtaatctttgtg

SEQ ID NO: 468083 - DNA, 15 bp, Homo sapiens
gtgtaatctttgtgc

SEQ ID NO: 468084 - DNA, 15 bp, Homo sapiens
tgtaatctttgtgca

SEQ ID NO: 468085 - DNA, 15 bp, Homo sapiens
gtaatctttgtgcaa

SEQ ID NO: 468086 - DNA, 15 bp, Homo sapiens
taatctttgtgcaat

SEQ ID NO: 468087 - DNA, 15 bp, Homo sapiens
aatctttgtgcaata

SEQ ID NO: 468088 - DNA, 15 bp, Homo sapiens
atctttgtgcaataa

SEQ ID NO: 468089 - DNA, 15 bp, Homo sapiens
tctttgtgcaataat

SEQ ID NO: 468090 - DNA, 15 bp, Homo sapiens
ctttgtgcaataatt

SEQ ID NO: 468091 - DNA, 15 bp, Homo sapiens
tttgtgcaataatta

SEQ ID NO: 468092 - DNA, 15 bp, Homo sapiens
ttgtgcaataattaa

SEQ ID NO: 468093 - DNA, 15 bp, Homo sapiens
tgtgcaataattaag

SEQ ID NO: 468094 - DNA, 15 bp, Homo sapiens
gtgcaataattaagt

SEQ ID NO: 468095 - DNA, 15 bp, Homo sapiens
tgcaataattaagtc

SEQ ID NO: 468096 - DNA, 15 bp, Homo sapiens
gcaataattaagtca

SEQ ID NO: 468097 - DNA, 15 bp, Homo sapiens
caataattaagtcac

SEQ ID NO: 468098 - DNA, 15 bp, Homo sapiens
aataattaagtcacc

SEQ ID NO: 468099 - DNA, 15 bp, Homo sapiens
ataattaagtcacca

SEQ ID NO: 468100 - DNA, 15 bp, Homo sapiens
taattaagtcaccat

SEQ ID NO: 468101 - DNA, 15 bp, Homo sapiens
aattaagtcaccatt

SEQ ID NO: 468102 - DNA, 15 bp, Homo sapiens
attaagtcaccatta

SEQ ID NO: 468103 - DNA, 15 bp, Homo sapiens
ttaagtcaccattag

SEQ ID NO: 468104 - DNA, 15 bp, Homo sapiens
taagtcaccattagc

SEQ ID NO: 468105 - DNA, 15 bp, Homo sapiens
aagtcaccattagct

SEQ ID NO: 468106 - DNA, 15 bp, Homo sapiens
agtcaccattagctt

SEQ ID NO: 468107 - DNA, 15 bp, Homo sapiens
gtcaccattagcttg

SEQ ID NO: 468108 - DNA, 15 bp, Homo sapiens
tcaccattagcttga

SEQ ID NO: 468109 - DNA, 15 bp, Homo sapiens
caccattagcttgaa

SEQ ID NO: 468110 - DNA, 15 bp, Homo sapiens
accattagcttgaag

SEQ ID NO: 468111 - DNA, 15 bp, Homo sapiens
ccattagcttgaaga

SEQ ID NO: 468112 - DNA, 15 bp, Homo sapiens
cattagcttgaagaa

SEQ ID NO: 468113 - DNA, 15 bp, Homo sapiens
attagcttgaagaaa

SEQ ID NO: 468114 - DNA, 15 bp, Homo sapiens
ttagcttgaagaaac

SEQ ID NO: 468115 - DNA, 15 bp, Homo sapiens
tagcttgaagaaacc

SEQ ID NO: 468116 - DNA, 15 bp, Homo sapiens
agcttgaagaaacct

SEQ ID NO: 468117 - DNA, 15 bp, Homo sapiens
gcttgaagaaacctt

SEQ ID NO: 468118 - DNA, 15 bp, Homo sapiens
cttgaagaaaccttt

SEQ ID NO: 468119 - DNA, 15 bp, Homo sapiens
ttgaagaaacctttg

SEQ ID NO: 468120 - DNA, 15 bp, Homo sapiens
tgaagaaacctttgc

SEQ ID NO: 468121 - DNA, 15 bp, Homo sapiens
gaagaaacctttgct

SEQ ID NO: 468122 - DNA, 15 bp, Homo sapiens
aagaaacctttgctt

SEQ ID NO: 468123 - DNA, 15 bp, Homo sapiens
agaaacctttgcttg

SEQ ID NO: 468124 - DNA, 15 bp, Homo sapiens
gaaacctttgcttgc

SEQ ID NO: 468125 - DNA, 15 bp, Homo sapiens
aaacctttgcttgct

SEQ ID NO: 468126 - DNA, 15 bp, Homo sapiens
aacctttgcttgctc

SEQ ID NO: 468127 - DNA, 15 bp, Homo sapiens
acctttgcttgctca

SEQ ID NO: 468128 - DNA, 15 bp, Homo sapiens
cctttgcttgctcac

SEQ ID NO: 468129 - DNA, 15 bp, Homo sapiens
ctttgcttgctcact

SEQ ID NO: 468130 - DNA, 15 bp, Homo sapiens
tttgcttgctcactc

SEQ ID NO: 468131 - DNA, 15 bp, Homo sapiens
ttgcttgctcactct

SEQ ID NO: 468132 - DNA, 15 bp, Homo sapiens
tgcttgctcactctt

SEQ ID NO: 468133 - DNA, 15 bp, Homo sapiens
gcttgctcactcttg

SEQ ID NO: 468134 - DNA, 15 bp, Homo sapiens
cttgctcactcttgt

SEQ ID NO: 468135 - DNA, 15 bp, Homo sapiens
ttgctcactcttgtg

SEQ ID NO: 468136 - DNA, 15 bp, Homo sapiens
tgctcactcttgtgc

SEQ ID NO: 468137 - DNA, 15 bp, Homo sapiens
gctcactcttgtgcc

SEQ ID NO: 468138 - DNA, 15 bp, Homo sapiens
ctcactcttgtgcct

SEQ ID NO: 468139 - DNA, 15 bp, Homo sapiens
tcactcttgtgccta

SEQ ID NO: 468140 - DNA, 15 bp, Homo sapiens
cactcttgtgcctaa

SEQ ID NO: 468141 - DNA, 15 bp, Homo sapiens
actcttgtgcctaaa

SEQ ID NO: 468142 - DNA, 15 bp, Homo sapiens
ctcttgtgcctaaac

SEQ ID NO: 468143 - DNA, 15 bp, Homo sapiens
tcttgtgcctaaacc

SEQ ID NO: 468144 - DNA, 15 bp, Homo sapiens
cttgtgcctaaacca

SEQ ID NO: 468145 - DNA, 15 bp, Homo sapiens
ttgtgcctaaaccag

SEQ ID NO: 468146 - DNA, 15 bp, Homo sapiens
tgtgcctaaaccagg

SEQ ID NO: 468147 - DNA, 15 bp, Homo sapiens
gtgcctaaaccaggt

SEQ ID NO: 468148 - DNA, 15 bp, Homo sapiens
tgcctaaaccaggta

SEQ ID NO: 468149 - DNA, 15 bp, Homo sapiens
gcctaaaccaggtat

SEQ ID NO: 468150 - DNA, 15 bp, Homo sapiens
cctaaaccaggtatc

SEQ ID NO: 468151 - DNA, 15 bp, Homo sapiens
ctaaaccaggtatca

SEQ ID NO: 468152 - DNA, 15 bp, Homo sapiens
taaaccaggtatcaa

SEQ ID NO: 468153 - DNA, 15 bp, Homo sapiens
aaaccaggtatcaag

SEQ ID NO: 468154 - DNA, 15 bp, Homo sapiens
aaccaggtatcaagt

SEQ ID NO: 468155 - DNA, 15 bp, Homo sapiens
accaggtatcaagtc

SEQ ID NO: 468156 - DNA, 15 bp, Homo sapiens
ccaggtatcaagtct

SEQ ID NO: 468157 - DNA, 15 bp, Homo sapiens
caggtatcaagtctg

SEQ ID NO: 468158 - DNA, 15 bp, Homo sapiens
aggtatcaagtctgg

SEQ ID NO: 468159 - DNA, 15 bp, Homo sapiens
ggtatcaagtctgga

SEQ ID NO: 468160 - DNA, 15 bp, Homo sapiens
gtatcaagtctggac

SEQ ID NO: 468161 - DNA, 15 bp, Homo sapiens
tatcaagtctggaca

SEQ ID NO: 468162 - DNA, 15 bp, Homo sapiens
atcaagtctggacat

SEQ ID NO: 468163 - DNA, 15 bp, Homo sapiens
tcaagtctggacata

SEQ ID NO: 468164 - DNA, 15 bp, Homo sapiens
caagtctggacatat

SEQ ID NO: 468165 - DNA, 15 bp, Homo sapiens
aagtctggacatatt

SEQ ID NO: 468166 - DNA, 15 bp, Homo sapiens
agtctggacatattt

SEQ ID NO: 468167 - DNA, 15 bp, Homo sapiens
gtctggacatatttc

SEQ ID NO: 468168 - DNA, 15 bp, Homo sapiens
tctggacatatttct

SEQ ID NO: 468169 - DNA, 15 bp, Homo sapiens
ctggacatatttctc

SEQ ID NO: 468170 - DNA, 15 bp, Homo sapiens
tggacatatttctct

SEQ ID NO: 468171 - DNA, 15 bp, Homo sapiens
ggacatatttctctc

SEQ ID NO: 468172 - DNA, 15 bp, Homo sapiens
gacatatttctctct

SEQ ID NO: 468173 - DNA, 15 bp, Homo sapiens
acatatttctctctc

SEQ ID NO: 468174 - DNA, 15 bp, Homo sapiens
catatttctctctca

SEQ ID NO: 468175 - DNA, 15 bp, Homo sapiens
atatttctctctcat

SEQ ID NO: 468176 - DNA, 15 bp, Homo sapiens
tatttctctctcatt

SEQ ID NO: 468177 - DNA, 15 bp, Homo sapiens
atttctctctcattc

SEQ ID NO: 468178 - DNA, 15 bp, Homo sapiens
tttctctctcattcg

SEQ ID NO: 468179 - DNA, 15 bp, Homo sapiens
ttctctctcattcga

SEQ ID NO: 468180 - DNA, 15 bp, Homo sapiens
tctctctcattcgaa

SEQ ID NO: 468181 - DNA, 15 bp, Homo sapiens
ctctctcattcgaaa

SEQ ID NO: 468182 - DNA, 15 bp, Homo sapiens
tctctcattcgaaat

SEQ ID NO: 468183 - DNA, 15 bp, Homo sapiens
ctctcattcgaaata

SEQ ID NO: 468184 - DNA, 15 bp, Homo sapiens
tctcattcgaaatac

SEQ ID NO: 468185 - DNA, 15 bp, Homo sapiens
ctcattcgaaataca

SEQ ID NO: 468186 - DNA, 15 bp, Homo sapiens
tcattcgaaatacaa

SEQ ID NO: 468187 - DNA, 15 bp, Homo sapiens
cattcgaaatacaaa

SEQ ID NO: 468188 - DNA, 15 bp, Homo sapiens
attcgaaatacaaat

SEQ ID NO: 468189 - DNA, 15 bp, Homo sapiens
ttcgaaatacaaatt

SEQ ID NO: 468190 - DNA, 15 bp, Homo sapiens
tcgaaatacaaattt

SEQ ID NO: 468191 - DNA, 15 bp, Homo sapiens
cgaaatacaaatttt

SEQ ID NO: 468192 - DNA, 15 bp, Homo sapiens
gaaatacaaatttta

SEQ ID NO: 468193 - DNA, 15 bp, Homo sapiens
aaatacaaattttag

SEQ ID NO: 468194 - DNA, 15 bp, Homo sapiens
aatacaaattttaga

SEQ ID NO: 468195 - DNA, 15 bp, Homo sapiens
atacaaattttagat

SEQ ID NO: 468196 - DNA, 15 bp, Homo sapiens
tacaaattttagatg

SEQ ID NO: 468197 - DNA, 15 bp, Homo sapiens
acaaattttagatgt

SEQ ID NO: 468198 - DNA, 15 bp, Homo sapiens
caaattttagatgta

SEQ ID NO: 468199 - DNA, 15 bp, Homo sapiens
aaattttagatgtac

SEQ ID NO: 468200 - DNA, 15 bp, Homo sapiens
aattttagatgtact

SEQ ID NO: 468201 - DNA, 15 bp, Homo sapiens
attttagatgtacta

SEQ ID NO: 468202 - DNA, 15 bp, Homo sapiens
ttttagatgtactat

SEQ ID NO: 468203 - DNA, 15 bp, Homo sapiens
tttagatgtactata

SEQ ID NO: 468204 - DNA, 15 bp, Homo sapiens
ttagatgtactatat

SEQ ID NO: 468205 - DNA, 15 bp, Homo sapiens
tagatgtactatatt

SEQ ID NO: 468206 - DNA, 15 bp, Homo sapiens
agatgtactatattc

SEQ ID NO: 468207 - DNA, 15 bp, Homo sapiens
gatgtactatattct

SEQ ID NO: 468208 - DNA, 15 bp, Homo sapiens
atgtactatattctc

SEQ ID NO: 468209 - DNA, 15 bp, Homo sapiens
tgtactatattctca

SEQ ID NO: 468210 - DNA, 15 bp, Homo sapiens
gtactatattctcaa

SEQ ID NO: 468211 - DNA, 15 bp, Homo sapiens
tactatattctcaat

SEQ ID NO: 468212 - DNA, 15 bp, Homo sapiens
actatattctcaatg

SEQ ID NO: 468213 - DNA, 15 bp, Homo sapiens
ctatattctcaatgt

SEQ ID NO: 468214 - DNA, 15 bp, Homo sapiens
tatattctcaatgta

SEQ ID NO: 468215 - DNA, 15 bp, Homo sapiens
atattctcaatgtag

SEQ ID NO: 468216 - DNA, 15 bp, Homo sapiens
tattctcaatgtaga

SEQ ID NO: 468217 - DNA, 15 bp, Homo sapiens
attctcaatgtagaa

SEQ ID NO: 468218 - DNA, 15 bp, Homo sapiens
ttctcaatgtagaaa

SEQ ID NO: 468219 - DNA, 15 bp, Homo sapiens
tctcaatgtagaaaa

SEQ ID NO: 468220 - DNA, 15 bp, Homo sapiens
ctcaatgtagaaaac

SEQ ID NO: 468221 - DNA, 15 bp, Homo sapiens
tcaatgtagaaaaca

SEQ ID NO: 468222 - DNA, 15 bp, Homo sapiens
caatgtagaaaacag

SEQ ID NO: 468223 - DNA, 15 bp, Homo sapiens
aatgtagaaaacagg

SEQ ID NO: 468224 - DNA, 15 bp, Homo sapiens
atgtagaaaacagga

SEQ ID NO: 468225 - DNA, 15 bp, Homo sapiens
tgtagaaaacaggaa

SEQ ID NO: 468226 - DNA, 15 bp, Homo sapiens
gtagaaaacaggaaa

SEQ ID NO: 468227 - DNA, 15 bp, Homo sapiens
tagaaaacaggaaaa

SEQ ID NO: 468228 - DNA, 15 bp, Homo sapiens
agaaaacaggaaaaa

SEQ ID NO: 468229 - DNA, 15 bp, Homo sapiens
gaaaacaggaaaaat

SEQ ID NO: 468230 - DNA, 15 bp, Homo sapiens
aaaacaggaaaaata

SEQ ID NO: 468231 - DNA, 15 bp, Homo sapiens
aaacaggaaaaatat

SEQ ID NO: 468232 - DNA, 15 bp, Homo sapiens
aacaggaaaaatata

SEQ ID NO: 468233 - DNA, 15 bp, Homo sapiens
acaggaaaaatataa

SEQ ID NO: 468234 - DNA, 15 bp, Homo sapiens
caggaaaaatataaa

SEQ ID NO: 468235 - DNA, 15 bp, Homo sapiens
aggaaaaatataaat

SEQ ID NO: 468236 - DNA, 15 bp, Homo sapiens
ggaaaaatataaatg

SEQ ID NO: 468237 - DNA, 15 bp, Homo sapiens
gaaaaatataaatgc

SEQ ID NO: 468238 - DNA, 15 bp, Homo sapiens
aaaaatataaatgca

SEQ ID NO: 468239 - DNA, 15 bp, Homo sapiens
aaaatataaatgcaa

SEQ ID NO: 468240 - DNA, 15 bp, Homo sapiens
aaatataaatgcaag

SEQ ID NO: 468241 - DNA, 15 bp, Homo sapiens
aatataaatgcaagt

SEQ ID NO: 468242 - DNA, 15 bp, Homo sapiens
atataaatgcaagta

SEQ ID NO: 468243 - DNA, 15 bp, Homo sapiens
tataaatgcaagtat

SEQ ID NO: 468244 - DNA, 15 bp, Homo sapiens
ataaatgcaagtatt

SEQ ID NO: 468245 - DNA, 15 bp, Homo sapiens
taaatgcaagtattc

SEQ ID NO: 468246 - DNA, 15 bp, Homo sapiens
aaatgcaagtattca

SEQ ID NO: 468247 - DNA, 15 bp, Homo sapiens
aatgcaagtattcag

SEQ ID NO: 468248 - DNA, 15 bp, Homo sapiens
atgcaagtattcaga

SEQ ID NO: 468249 - DNA, 15 bp, Homo sapiens
tgcaagtattcagaa

SEQ ID NO: 468250 - DNA, 15 bp, Homo sapiens
gcaagtattcagaaa

SEQ ID NO: 468251 - DNA, 15 bp, Homo sapiens
caagtattcagaaat

SEQ ID NO: 468252 - DNA, 15 bp, Homo sapiens
aagtattcagaaatc

SEQ ID NO: 468253 - DNA, 15 bp, Homo sapiens
agtattcagaaatca

SEQ ID NO: 468254 - DNA, 15 bp, Homo sapiens
gtattcagaaatcat

SEQ ID NO: 468255 - DNA, 15 bp, Homo sapiens
tattcagaaatcatt

SEQ ID NO: 468256 - DNA, 15 bp, Homo sapiens
attcagaaatcattg

SEQ ID NO: 468257 - DNA, 15 bp, Homo sapiens
ttcagaaatcattgc

SEQ ID NO: 468258 - DNA, 15 bp, Homo sapiens
tcagaaatcattgct

SEQ ID NO: 468259 - DNA, 15 bp, Homo sapiens
cagaaatcattgctt

SEQ ID NO: 468260 - DNA, 15 bp, Homo sapiens
gaaatcattgctttc

SEQ ID NO: 468261 - DNA, 15 bp, Homo sapiens
aaatcattgctttct

SEQ ID NO: 468262 - DNA, 15 bp, Homo sapiens
aatcattgctttctg

SEQ ID NO: 468263 - DNA, 15 bp, Homo sapiens
atcattgctttctga

SEQ ID NO: 468264 - DNA, 15 bp, Homo sapiens
tcattgctttctgaa

SEQ ID NO: 468265 - DNA, 15 bp, Homo sapiens
cattgctttctgaaa

SEQ ID NO: 468266 - DNA, 15 bp, Homo sapiens
attgctttctgaaat

SEQ ID NO: 468267 - DNA, 15 bp, Homo sapiens
ttgctttctgaaatt

SEQ ID NO: 468268 - DNA, 15 bp, Homo sapiens
tgctttctgaaattt

SEQ ID NO: 468269 - DNA, 15 bp, Homo sapiens
gctttctgaaatttc

SEQ ID NO: 468270 - DNA, 15 bp, Homo sapiens
ctttctgaaatttct

SEQ ID NO: 468271 - DNA, 15 bp, Homo sapiens
tttctgaaatttctt

SEQ ID NO: 468272 - DNA, 15 bp, Homo sapiens
ttctgaaatttcttt

SEQ ID NO: 468273 - DNA, 15 bp, Homo sapiens
tctgaaatttctttc

SEQ ID NO: 468274 - DNA, 15 bp, Homo sapiens
ctgaaatttctttct

SEQ ID NO: 468275 - DNA, 15 bp, Homo sapiens
tgaaatttctttctg

SEQ ID NO: 468276 - DNA, 15 bp, Homo sapiens
gaaatttctttctgt

SEQ ID NO: 468277 - DNA, 15 bp, Homo sapiens
aaatttctttctgtt

SEQ ID NO: 468278 - DNA, 15 bp, Homo sapiens
aatttctttctgttc

SEQ ID NO: 468279 - DNA, 15 bp, Homo sapiens
atttctttctgttca

SEQ ID NO: 468280 - DNA, 15 bp, Homo sapiens
tttctttctgttcac

SEQ ID NO: 468281 - DNA, 15 bp, Homo sapiens
ttctttctgttcacc

SEQ ID NO: 468282 - DNA, 15 bp, Homo sapiens
tctttctgttcaccc

SEQ ID NO: 468283 - DNA, 15 bp, Homo sapiens
ctttctgttcaccca

SEQ ID NO: 468284 - DNA, 15 bp, Homo sapiens
tttctgttcacccac

SEQ ID NO: 468285 - DNA, 15 bp, Homo sapiens
ttctgttcacccaca

SEQ ID NO: 468286 - DNA, 15 bp, Homo sapiens
tctgttcacccacat

SEQ ID NO: 468287 - DNA, 15 bp, Homo sapiens
ctgttcacccacatt

SEQ ID NO: 468288 - DNA, 15 bp, Homo sapiens
tgttcacccacattc

SEQ ID NO: 468289 - DNA, 15 bp, Homo sapiens
gttcacccacattct

SEQ ID NO: 468290 - DNA, 15 bp, Homo sapiens
ttcacccacattctt

SEQ ID NO: 468291 - DNA, 15 bp, Homo sapiens
tcacccacattcttt

SEQ ID NO: 468292 - DNA, 15 bp, Homo sapiens
cacccacattcttta

SEQ ID NO: 468293 - DNA, 15 bp, Homo sapiens
acccacattctttac

SEQ ID NO: 468294 - DNA, 15 bp, Homo sapiens
cccacattctttaca

SEQ ID NO: 468295 - DNA, 15 bp, Homo sapiens
ccacattctttacat

SEQ ID NO: 468296 - DNA, 15 bp, Homo sapiens
cacattctttacatt

SEQ ID NO: 468297 - DNA, 15 bp, Homo sapiens
acattctttacattt

SEQ ID NO: 468298 - DNA, 15 bp, Homo sapiens
cattctttacatttg

SEQ ID NO: 468299 - DNA, 15 bp, Homo sapiens
attctttacatttgc

SEQ ID NO: 468300 - DNA, 15 bp, Homo sapiens
ttctttacatttgct

SEQ ID NO: 468301 - DNA, 15 bp, Homo sapiens
tctttacatttgctc

SEQ ID NO: 468302 - DNA, 15 bp, Homo sapiens
ctttacatttgctct

SEQ ID NO: 468303 - DNA, 15 bp, Homo sapiens
tttacatttgctcta

SEQ ID NO: 468304 - DNA, 15 bp, Homo sapiens
ttacatttgctctac

SEQ ID NO: 468305 - DNA, 15 bp, Homo sapiens
tacatttgctctact

SEQ ID NO: 468306 - DNA, 15 bp, Homo sapiens
acatttgctctactc

SEQ ID NO: 468307 - DNA, 15 bp, Homo sapiens
catttgctctactct

SEQ ID NO: 468308 - DNA, 15 bp, Homo sapiens
atttgctctactctt

SEQ ID NO: 468309 - DNA, 15 bp, Homo sapiens
tttgctctactcttt

SEQ ID NO: 468310 - DNA, 15 bp, Homo sapiens
ttgctctactctttt

SEQ ID NO: 468311 - DNA, 15 bp, Homo sapiens
tgctctactctttta

SEQ ID NO: 468312 - DNA, 15 bp, Homo sapiens
gctctactcttttaa

SEQ ID NO: 468313 - DNA, 15 bp, Homo sapiens
ctctactcttttaag

SEQ ID NO: 468314 - DNA, 15 bp, Homo sapiens
tctactcttttaagt

SEQ ID NO: 468315 - DNA, 15 bp, Homo sapiens
ctactcttttaagtt

SEQ ID NO: 468316 - DNA, 15 bp, Homo sapiens
tactcttttaagttt

SEQ ID NO: 468317 - DNA, 15 bp, Homo sapiens
actcttttaagtttt

SEQ ID NO: 468318 - DNA, 15 bp, Homo sapiens
ctcttttaagtttta

SEQ ID NO: 468319 - DNA, 15 bp, Homo sapiens
tcttttaagttttat

SEQ ID NO: 468320 - DNA, 15 bp, Homo sapiens
cttttaagttttatt

SEQ ID NO: 468321 - DNA, 15 bp, Homo sapiens
tttaagttttattta

SEQ ID NO: 468322 - DNA, 15 bp, Homo sapiens
ttaagttttatttat

SEQ ID NO: 468323 - DNA, 15 bp, Homo sapiens
taagttttatttatg

SEQ ID NO: 468324 - DNA, 15 bp, Homo sapiens
aagttttatttatgg

SEQ ID NO: 468325 - DNA, 15 bp, Homo sapiens
agttttatttatggt

SEQ ID NO: 468326 - DNA, 15 bp, Homo sapiens
gttttatttatggtt

SEQ ID NO: 468327 - DNA, 15 bp, Homo sapiens
ttttatttatggttc

SEQ ID NO: 468328 - DNA, 15 bp, Homo sapiens
tttatttatggttca

SEQ ID NO: 468329 - DNA, 15 bp, Homo sapiens
ttatttatggttcat

SEQ ID NO: 468330 - DNA, 15 bp, Homo sapiens
tatttatggttcatc

SEQ ID NO: 468331 - DNA, 15 bp, Homo sapiens
atttatggttcatcc

SEQ ID NO: 468332 - DNA, 15 bp, Homo sapiens
tttatggttcatcca

SEQ ID NO: 468333 - DNA, 15 bp, Homo sapiens
ttatggttcatccat

SEQ ID NO: 468334 - DNA, 15 bp, Homo sapiens
tatggttcatccatc

SEQ ID NO: 468335 - DNA, 15 bp, Homo sapiens
atggttcatccatct

SEQ ID NO: 468336 - DNA, 15 bp, Homo sapiens
tggttcatccatctt

SEQ ID NO: 468337 - DNA, 15 bp, Homo sapiens
ggttcatccatcttt

SEQ ID NO: 468338 - DNA, 15 bp, Homo sapiens
gttcatccatctttt

SEQ ID NO: 468339 - DNA, 15 bp, Homo sapiens
ttcatccatctttta

SEQ ID NO: 468340 - DNA, 15 bp, Homo sapiens
tcatccatcttttac

SEQ ID NO: 468341 - DNA, 15 bp, Homo sapiens
catccatcttttact

SEQ ID NO: 468342 - DNA, 15 bp, Homo sapiens
atccatcttttactc

SEQ ID NO: 468343 - DNA, 15 bp, Homo sapiens
tccatcttttactca

SEQ ID NO: 468344 - DNA, 15 bp, Homo sapiens
ccatcttttactcaa

SEQ ID NO: 468345 - DNA, 15 bp, Homo sapiens
catcttttactcaac

SEQ ID NO: 468346 - DNA, 15 bp, Homo sapiens
atcttttactcaaca

SEQ ID NO: 468347 - DNA, 15 bp, Homo sapiens
tcttttactcaacat

SEQ ID NO: 468348 - DNA, 15 bp, Homo sapiens
cttttactcaacatt

SEQ ID NO: 468349 - DNA, 15 bp, Homo sapiens
ttttactcaacattt

SEQ ID NO: 468350 - DNA, 15 bp, Homo sapiens
tttactcaacatttc

SEQ ID NO: 468351 - DNA, 15 bp, Homo sapiens
ttactcaacatttcc

SEQ ID NO: 468352 - DNA, 15 bp, Homo sapiens
tactcaacatttcct

SEQ ID NO: 468353 - DNA, 15 bp, Homo sapiens
actcaacatttccta

SEQ ID NO: 468354 - DNA, 15 bp, Homo sapiens
ctcaacatttcctaa

SEQ ID NO: 468355 - DNA, 15 bp, Homo sapiens
tcaacatttcctaaa

SEQ ID NO: 468356 - DNA, 15 bp, Homo sapiens
caacatttcctaaag

SEQ ID NO: 468357 - DNA, 15 bp, Homo sapiens
aacatttcctaaagt

SEQ ID NO: 468358 - DNA, 15 bp, Homo sapiens
acatttcctaaagtc

SEQ ID NO: 468359 - DNA, 15 bp, Homo sapiens
catttcctaaagtcg

SEQ ID NO: 468360 - DNA, 15 bp, Homo sapiens
atttcctaaagtcgt

SEQ ID NO: 468361 - DNA, 15 bp, Homo sapiens
tttcctaaagtcgtt

SEQ ID NO: 468362 - DNA, 15 bp, Homo sapiens
ttcctaaagtcgttt

SEQ ID NO: 468363 - DNA, 15 bp, Homo sapiens
tcctaaagtcgtttc

SEQ ID NO: 468364 - DNA, 15 bp, Homo sapiens
cctaaagtcgtttca

SEQ ID NO: 468365 - DNA, 15 bp, Homo sapiens
ctaaagtcgtttcat

SEQ ID NO: 468366 - DNA, 15 bp, Homo sapiens
taaagtcgtttcatg

SEQ ID NO: 468367 - DNA, 15 bp, Homo sapiens
aaagtcgtttcatgt

SEQ ID NO: 468368 - DNA, 15 bp, Homo sapiens
aagtcgtttcatgtc

SEQ ID NO: 468369 - DNA, 15 bp, Homo sapiens
agtcgtttcatgtct

SEQ ID NO: 468370 - DNA, 15 bp, Homo sapiens
gtcgtttcatgtctg

SEQ ID NO: 468371 - DNA, 15 bp, Homo sapiens
tcgtttcatgtctgc

SEQ ID NO: 468372 - DNA, 15 bp, Homo sapiens
cgtttcatgtctgcc

SEQ ID NO: 468373 - DNA, 15 bp, Homo sapiens
gtttcatgtctgcct

SEQ ID NO: 468374 - DNA, 15 bp, Homo sapiens
tttcatgtctgcctt

SEQ ID NO: 468375 - DNA, 15 bp, Homo sapiens
ttcatgtctgcctta

SEQ ID NO: 468376 - DNA, 15 bp, Homo sapiens
tcatgtctgccttag

SEQ ID NO: 468377 - DNA, 15 bp, Homo sapiens
catgtctgccttaga

SEQ ID NO: 468378 - DNA, 15 bp, Homo sapiens
atgtctgccttagaa

SEQ ID NO: 468379 - DNA, 15 bp, Homo sapiens
tgtctgccttagaaa

SEQ ID NO: 468380 - DNA, 15 bp, Homo sapiens
gtctgccttagaaaa

SEQ ID NO: 468381 - DNA, 15 bp, Homo sapiens
tctgccttagaaaat

SEQ ID NO: 468382 - DNA, 15 bp, Homo sapiens
ctgccttagaaaatg

SEQ ID NO: 468383 - DNA, 15 bp, Homo sapiens
tgccttagaaaatga

SEQ ID NO: 468384 - DNA, 15 bp, Homo sapiens
gccttagaaaatgaa

SEQ ID NO: 468385 - DNA, 15 bp, Homo sapiens
ccttagaaaatgaac

SEQ ID NO: 468386 - DNA, 15 bp, Homo sapiens
cttagaaaatgaact

SEQ ID NO: 468387 - DNA, 15 bp, Homo sapiens
ttagaaaatgaactc

SEQ ID NO: 468388 - DNA, 15 bp, Homo sapiens
tagaaaatgaactca

SEQ ID NO: 468389 - DNA, 15 bp, Homo sapiens
agaaaatgaactcaa

SEQ ID NO: 468390 - DNA, 15 bp, Homo sapiens
gaaaatgaactcaag

SEQ ID NO: 468391 - DNA, 15 bp, Homo sapiens
aaaatgaactcaagt

SEQ ID NO: 468392 - DNA, 15 bp, Homo sapiens
aaatgaactcaagtg

SEQ ID NO: 468393 - DNA, 15 bp, Homo sapiens
aatgaactcaagtgt

SEQ ID NO: 468394 - DNA, 15 bp, Homo sapiens
atgaactcaagtgtg

SEQ ID NO: 468395 - DNA, 15 bp, Homo sapiens
tgaactcaagtgtga

SEQ ID NO: 468396 - DNA, 15 bp, Homo sapiens
gaactcaagtgtgaa

SEQ ID NO: 468397 - DNA, 15 bp, Homo sapiens
aactcaagtgtgaat

SEQ ID NO: 468398 - DNA, 15 bp, Homo sapiens
actcaagtgtgaatt

SEQ ID NO: 468399 - DNA, 15 bp, Homo sapiens
ctcaagtgtgaattt

SEQ ID NO: 468400 - DNA, 15 bp, Homo sapiens
tcaagtgtgaatttg

SEQ ID NO: 468401 - DNA, 15 bp, Homo sapiens
caagtgtgaatttgt

SEQ ID NO: 468402 - DNA, 15 bp, Homo sapiens
aagtgtgaatttgtt

SEQ ID NO: 468403 - DNA, 15 bp, Homo sapiens
agtgtgaatttgttt

SEQ ID NO: 468404 - DNA, 15 bp, Homo sapiens
gtgtgaatttgtttg

SEQ ID NO: 468405 - DNA, 15 bp, Homo sapiens
tgtgaatttgtttgg

SEQ ID NO: 468406 - DNA, 15 bp, Homo sapiens
gtgaatttgtttggt

SEQ ID NO: 468407 - DNA, 15 bp, Homo sapiens
tgaatttgtttggta

SEQ ID NO: 468408 - DNA, 15 bp, Homo sapiens
gaatttgtttggtac

SEQ ID NO: 468409 - DNA, 15 bp, Homo sapiens
aatttgtttggtaca

SEQ ID NO: 468410 - DNA, 15 bp, Homo sapiens
atttgtttggtacag

SEQ ID NO: 468411 - DNA, 15 bp, Homo sapiens
tttgtttggtacagt

SEQ ID NO: 468412 - DNA, 15 bp, Homo sapiens
ttgtttggtacagtg

SEQ ID NO: 468413 - DNA, 15 bp, Homo sapiens
tgtttggtacagtga

SEQ ID NO: 468414 - DNA, 15 bp, Homo sapiens
gtttggtacagtgat

SEQ ID NO: 468415 - DNA, 15 bp, Homo sapiens
tttggtacagtgata

SEQ ID NO: 468416 - DNA, 15 bp, Homo sapiens
ttggtacagtgataa

SEQ ID NO: 468417 - DNA, 15 bp, Homo sapiens
tggtacagtgataat

SEQ ID NO: 468418 - DNA, 15 bp, Homo sapiens
ggtacagtgataata

SEQ ID NO: 468419 - DNA, 15 bp, Homo sapiens
gtacagtgataataa

SEQ ID NO: 468420 - DNA, 15 bp, Homo sapiens
tacagtgataataag

SEQ ID NO: 468421 - DNA, 15 bp, Homo sapiens
acagtgataataagc

SEQ ID NO: 468422 - DNA, 15 bp, Homo sapiens
cagtgataataagca

SEQ ID NO: 468423 - DNA, 15 bp, Homo sapiens
agtgataataagcaa

SEQ ID NO: 468424 - DNA, 15 bp, Homo sapiens
gtgataataagcaac

SEQ ID NO: 468425 - DNA, 15 bp, Homo sapiens
tgataataagcaaca

SEQ ID NO: 468426 - DNA, 15 bp, Homo sapiens
gataataagcaacac

SEQ ID NO: 468427 - DNA, 15 bp, Homo sapiens
ataataagcaacact

SEQ ID NO: 468428 - DNA, 15 bp, Homo sapiens
taataagcaacactt

SEQ ID NO: 468429 - DNA, 15 bp, Homo sapiens
aataagcaacacttg

SEQ ID NO: 468430 - DNA, 15 bp, Homo sapiens
ataagcaacacttga

SEQ ID NO: 468431 - DNA, 15 bp, Homo sapiens
taagcaacacttgag

SEQ ID NO: 468432 - DNA, 15 bp, Homo sapiens
aagcaacacttgagt

SEQ ID NO: 468433 - DNA, 15 bp, Homo sapiens
agcaacacttgagtg

SEQ ID NO: 468434 - DNA, 15 bp, Homo sapiens
gcaacacttgagtgt

SEQ ID NO: 468435 - DNA, 15 bp, Homo sapiens
caacacttgagtgtt

SEQ ID NO: 468436 - DNA, 15 bp, Homo sapiens
aacacttgagtgtta

SEQ ID NO: 468437 - DNA, 15 bp, Homo sapiens
acacttgagtgttaa

SEQ ID NO: 468438 - DNA, 15 bp, Homo sapiens
cacttgagtgttaaa

SEQ ID NO: 468439 - DNA, 15 bp, Homo sapiens
acttgagtgttaaat

SEQ ID NO: 468440 - DNA, 15 bp, Homo sapiens
cttgagtgttaaatg

SEQ ID NO: 468441 - DNA, 15 bp, Homo sapiens
ttgagtgttaaatgg

SEQ ID NO: 468442 - DNA, 15 bp, Homo sapiens
tgagtgttaaatgga

SEQ ID NO: 468443 - DNA, 15 bp, Homo sapiens
gagtgttaaatggat

SEQ ID NO: 468444 - DNA, 15 bp, Homo sapiens
agtgttaaatggatc

SEQ ID NO: 468445 - DNA, 15 bp, Homo sapiens
gtgttaaatggatca

SEQ ID NO: 468446 - DNA, 15 bp, Homo sapiens
tgttaaatggatcag

SEQ ID NO: 468447 - DNA, 15 bp, Homo sapiens
gttaaatggatcaga

SEQ ID NO: 468448 - DNA, 15 bp, Homo sapiens
ttaaatggatcagac

SEQ ID NO: 468449 - DNA, 15 bp, Homo sapiens
taaatggatcagacc

SEQ ID NO: 468450 - DNA, 15 bp, Homo sapiens
aaatggatcagacct

SEQ ID NO: 468451 - DNA, 15 bp, Homo sapiens
aatggatcagacctt

SEQ ID NO: 468452 - DNA, 15 bp, Homo sapiens
atggatcagaccttc

SEQ ID NO: 468453 - DNA, 15 bp, Homo sapiens
tggatcagaccttcc

SEQ ID NO: 468454 - DNA, 15 bp, Homo sapiens
ggatcagaccttccc

SEQ ID NO: 468455 - DNA, 15 bp, Homo sapiens
gatcagaccttccca

SEQ ID NO: 468456 - DNA, 15 bp, Homo sapiens
atcagaccttcccat

SEQ ID NO: 468457 - DNA, 15 bp, Homo sapiens
tcagaccttcccata

SEQ ID NO: 468458 - DNA, 15 bp, Homo sapiens
cagaccttcccatat

SEQ ID NO: 468459 - DNA, 15 bp, Homo sapiens
agaccttcccatatg

SEQ ID NO: 468460 - DNA, 15 bp, Homo sapiens
gaccttcccatatgg

SEQ ID NO: 468461 - DNA, 15 bp, Homo sapiens
accttcccatatgga

SEQ ID NO: 468462 - DNA, 15 bp, Homo sapiens
ccttcccatatggac

SEQ ID NO: 468463 - DNA, 15 bp, Homo sapiens
cttcccatatggacc

SEQ ID NO: 468464 - DNA, 15 bp, Homo sapiens
ttcccatatggacct

SEQ ID NO: 468465 - DNA, 15 bp, Homo sapiens
tcccatatggacctt

SEQ ID NO: 468466 - DNA, 15 bp, Homo sapiens
cccatatggaccttg

SEQ ID NO: 468467 - DNA, 15 bp, Homo sapiens
ccatatggaccttga

SEQ ID NO: 468468 - DNA, 15 bp, Homo sapiens
catatggaccttgat

SEQ ID NO: 468469 - DNA, 15 bp, Homo sapiens
atatggaccttgatg

SEQ ID NO: 468470 - DNA, 15 bp, Homo sapiens
tatggaccttgatgt

SEQ ID NO: 468471 - DNA, 15 bp, Homo sapiens
atggaccttgatgtt

SEQ ID NO: 468472 - DNA, 15 bp, Homo sapiens
tggaccttgatgttt

SEQ ID NO: 468473 - DNA, 15 bp, Homo sapiens
ggaccttgatgtttg

SEQ ID NO: 468474 - DNA, 15 bp, Homo sapiens
gaccttgatgtttgc

SEQ ID NO: 468475 - DNA, 15 bp, Homo sapiens
accttgatgtttgca

SEQ ID NO: 468476 - DNA, 15 bp, Homo sapiens
ccttgatgtttgcat

SEQ ID NO: 468477 - DNA, 15 bp, Homo sapiens
cttgatgtttgcatt

SEQ ID NO: 468478 - DNA, 15 bp, Homo sapiens
ttgatgtttgcattc

SEQ ID NO: 468479 - DNA, 15 bp, Homo sapiens
tgatgtttgcattcc

SEQ ID NO: 468480 - DNA, 15 bp, Homo sapiens
gatgtttgcattcct

SEQ ID NO: 468481 - DNA, 15 bp, Homo sapiens
atgtttgcattcctc

SEQ ID NO: 468482 - DNA, 15 bp, Homo sapiens
tgtttgcattcctca

SEQ ID NO: 468483 - DNA, 15 bp, Homo sapiens
gtttgcattcctcag

SEQ ID NO: 468484 - DNA, 15 bp, Homo sapiens
tttgcattcctcaga

SEQ ID NO: 468485 - DNA, 15 bp, Homo sapiens
ttgcattcctcagac

SEQ ID NO: 468486 - DNA, 15 bp, Homo sapiens
tgcattcctcagact

SEQ ID NO: 468487 - DNA, 15 bp, Homo sapiens
gcattcctcagactg

SEQ ID NO: 468488 - DNA, 15 bp, Homo sapiens
cattcctcagactgc

SEQ ID NO: 468489 - DNA, 15 bp, Homo sapiens
attcctcagactgca

SEQ ID NO: 468490 - DNA, 15 bp, Homo sapiens
ttcctcagactgcat

SEQ ID NO: 468491 - DNA, 15 bp, Homo sapiens
tcctcagactgcatc

SEQ ID NO: 468492 - DNA, 15 bp, Homo sapiens
cctcagactgcatct

SEQ ID NO: 468493 - DNA, 15 bp, Homo sapiens
ctcagactgcatctc

SEQ ID NO: 468494 - DNA, 15 bp, Homo sapiens
tcagactgcatctcc

SEQ ID NO: 468495 - DNA, 15 bp, Homo sapiens
cagactgcatctccc

SEQ ID NO: 468496 - DNA, 15 bp, Homo sapiens
agactgcatctccct

SEQ ID NO: 468497 - DNA, 15 bp, Homo sapiens
gactgcatctccctt

SEQ ID NO: 468498 - DNA, 15 bp, Homo sapiens
actgcatctcccttt

SEQ ID NO: 468499 - DNA, 15 bp, Homo sapiens
ctgcatctccctttt

SEQ ID NO: 468500 - DNA, 15 bp, Homo sapiens
tgcatctcccttttt

SEQ ID NO: 468501 - DNA, 15 bp, Homo sapiens
gcatctcccttttta

SEQ ID NO: 468502 - DNA, 15 bp, Homo sapiens
catctccctttttag

SEQ ID NO: 468503 - DNA, 15 bp, Homo sapiens
atctccctttttagt

SEQ ID NO: 468504 - DNA, 15 bp, Homo sapiens
tctccctttttagtt

SEQ ID NO: 468505 - DNA, 15 bp, Homo sapiens
ctccctttttagtta

SEQ ID NO: 468506 - DNA, 15 bp, Homo sapiens
tccctttttagttaa

SEQ ID NO: 468507 - DNA, 15 bp, Homo sapiens
ccctttttagttaag

SEQ ID NO: 468508 - DNA, 15 bp, Homo sapiens
cctttttagttaaga

SEQ ID NO: 468509 - DNA, 15 bp, Homo sapiens
ctttttagttaagaa

SEQ ID NO: 468510 - DNA, 15 bp, Homo sapiens
tttttagttaagaag

SEQ ID NO: 468511 - DNA, 15 bp, Homo sapiens
ttttagttaagaaga

SEQ ID NO: 468512 - DNA, 15 bp, Homo sapiens
tttagttaagaagat

SEQ ID NO: 468513 - DNA, 15 bp, Homo sapiens
ttagttaagaagatg

SEQ ID NO: 468514 - DNA, 15 bp, Homo sapiens
tagttaagaagatgc

SEQ ID NO: 468515 - DNA, 15 bp, Homo sapiens
agttaagaagatgct

SEQ ID NO: 468516 - DNA, 15 bp, Homo sapiens
gttaagaagatgctc

SEQ ID NO: 468517 - DNA, 15 bp, Homo sapiens
ttaagaagatgctcc

SEQ ID NO: 468518 - DNA, 15 bp, Homo sapiens
taagaagatgctcca

SEQ ID NO: 468519 - DNA, 15 bp, Homo sapiens
aagaagatgctccag

SEQ ID NO: 468520 - DNA, 15 bp, Homo sapiens
agaagatgctccagt

SEQ ID NO: 468521 - DNA, 15 bp, Homo sapiens
gaagatgctccagtc

SEQ ID NO: 468522 - DNA, 15 bp, Homo sapiens
aagatgctccagtca

SEQ ID NO: 468523 - DNA, 15 bp, Homo sapiens
agatgctccagtcac

SEQ ID NO: 468524 - DNA, 15 bp, Homo sapiens
gatgctccagtcacc

SEQ ID NO: 468525 - DNA, 15 bp, Homo sapiens
atgctccagtcacct

SEQ ID NO: 468526 - DNA, 15 bp, Homo sapiens
tgctccagtcacctt

SEQ ID NO: 468527 - DNA, 15 bp, Homo sapiens
gctccagtcacctta

SEQ ID NO: 468528 - DNA, 15 bp, Homo sapiens
ctccagtcaccttac

SEQ ID NO: 468529 - DNA, 15 bp, Homo sapiens
tccagtcaccttact

SEQ ID NO: 468530 - DNA, 15 bp, Homo sapiens
ccagtcaccttactg

SEQ ID NO: 468531 - DNA, 15 bp, Homo sapiens
cagtcaccttactga

SEQ ID NO: 468532 - DNA, 15 bp, Homo sapiens
agtcaccttactgac

SEQ ID NO: 468533 - DNA, 15 bp, Homo sapiens
gtcaccttactgact

SEQ ID NO: 468534 - DNA, 15 bp, Homo sapiens
tcaccttactgactt

SEQ ID NO: 468535 - DNA, 15 bp, Homo sapiens
caccttactgacttc

SEQ ID NO: 468536 - DNA, 15 bp, Homo sapiens
accttactgacttca

SEQ ID NO: 468537 - DNA, 15 bp, Homo sapiens
ccttactgacttcat

SEQ ID NO: 468538 - DNA, 15 bp, Homo sapiens
cttactgacttcatc

SEQ ID NO: 468539 - DNA, 15 bp, Homo sapiens
ttactgacttcatct

SEQ ID NO: 468540 - DNA, 15 bp, Homo sapiens
tactgacttcatctc

SEQ ID NO: 468541 - DNA, 15 bp, Homo sapiens
actgacttcatctct

SEQ ID NO: 468542 - DNA, 15 bp, Homo sapiens
ctgacttcatctctt

SEQ ID NO: 468543 - DNA, 15 bp, Homo sapiens
tgacttcatctcttt

SEQ ID NO: 468544 - DNA, 15 bp, Homo sapiens
gacttcatctctttc

SEQ ID NO: 468545 - DNA, 15 bp, Homo sapiens
acttcatctctttcc

SEQ ID NO: 468546 - DNA, 15 bp, Homo sapiens
cttcatctctttcct

SEQ ID NO: 468547 - DNA, 15 bp, Homo sapiens
ttcatctctttcctt

SEQ ID NO: 468548 - DNA, 15 bp, Homo sapiens
tcatctctttccttt

SEQ ID NO: 468549 - DNA, 15 bp, Homo sapiens
catctctttcctttt

SEQ ID NO: 468550 - DNA, 15 bp, Homo sapiens
atctctttccttttc

SEQ ID NO: 468551 - DNA, 15 bp, Homo sapiens
tctctttccttttca

SEQ ID NO: 468552 - DNA, 15 bp, Homo sapiens
ctctttccttttcaa

SEQ ID NO: 468553 - DNA, 15 bp, Homo sapiens
tctttccttttcaaa

SEQ ID NO: 468554 - DNA, 15 bp, Homo sapiens
ctttccttttcaaag

SEQ ID NO: 468555 - DNA, 15 bp, Homo sapiens
tttccttttcaaagt

SEQ ID NO: 468556 - DNA, 15 bp, Homo sapiens
ttccttttcaaagtc

SEQ ID NO: 468557 - DNA, 15 bp, Homo sapiens
tccttttcaaagtcc

SEQ ID NO: 468558 - DNA, 15 bp, Homo sapiens
ccttttcaaagtcct

SEQ ID NO: 468559 - DNA, 15 bp, Homo sapiens
cttttcaaagtcctt

SEQ ID NO: 468560 - DNA, 15 bp, Homo sapiens
ttttcaaagtccttt

SEQ ID NO: 468561 - DNA, 15 bp, Homo sapiens
tttcaaagtccttta

SEQ ID NO: 468562 - DNA, 15 bp, Homo sapiens
ttcaaagtcctttac

SEQ ID NO: 468563 - DNA, 15 bp, Homo sapiens
tcaaagtcctttaca

SEQ ID NO: 468564 - DNA, 15 bp, Homo sapiens
caaagtcctttacag

SEQ ID NO: 468565 - DNA, 15 bp, Homo sapiens
aaagtcctttacagc

SEQ ID NO: 468566 - DNA, 15 bp, Homo sapiens
aagtcctttacagct

SEQ ID NO: 468567 - DNA, 15 bp, Homo sapiens
agtcctttacagctg

SEQ ID NO: 468568 - DNA, 15 bp, Homo sapiens
gtcctttacagctga

SEQ ID NO: 468569 - DNA, 15 bp, Homo sapiens
tcctttacagctgac

SEQ ID NO: 468570 - DNA, 15 bp, Homo sapiens
cctttacagctgact

SEQ ID NO: 468571 - DNA, 15 bp, Homo sapiens
ctttacagctgactc

SEQ ID NO: 468572 - DNA, 15 bp, Homo sapiens
tttacagctgactct

SEQ ID NO: 468573 - DNA, 15 bp, Homo sapiens
ttacagctgactctg

SEQ ID NO: 468574 - DNA, 15 bp, Homo sapiens
tacagctgactctga

SEQ ID NO: 468575 - DNA, 15 bp, Homo sapiens
acagctgactctgaa

SEQ ID NO: 468576 - DNA, 15 bp, Homo sapiens
cagctgactctgaat

SEQ ID NO: 468577 - DNA, 15 bp, Homo sapiens
agctgactctgaatg

SEQ ID NO: 468578 - DNA, 15 bp, Homo sapiens
gctgactctgaatgt

SEQ ID NO: 468579 - DNA, 15 bp, Homo sapiens
ctgactctgaatgtt

SEQ ID NO: 468580 - DNA, 15 bp, Homo sapiens
tgactctgaatgttt

SEQ ID NO: 468581 - DNA, 15 bp, Homo sapiens
gactctgaatgtttc

SEQ ID NO: 468582 - DNA, 15 bp, Homo sapiens
actctgaatgtttct

SEQ ID NO: 468583 - DNA, 15 bp, Homo sapiens
ctctgaatgtttcta

SEQ ID NO: 468584 - DNA, 15 bp, Homo sapiens
tctgaatgtttctat

SEQ ID NO: 468585 - DNA, 15 bp, Homo sapiens
ctgaatgtttctatt

SEQ ID NO: 468586 - DNA, 15 bp, Homo sapiens
tgaatgtttctattt

SEQ ID NO: 468587 - DNA, 15 bp, Homo sapiens
gaatgtttctatttt

SEQ ID NO: 468588 - DNA, 15 bp, Homo sapiens
aatgtttctattttt

SEQ ID NO: 468589 - DNA, 15 bp, Homo sapiens
atgtttctattttta

SEQ ID NO: 468590 - DNA, 15 bp, Homo sapiens
tgtttctatttttaa

SEQ ID NO: 468591 - DNA, 15 bp, Homo sapiens
gtttctatttttaag

SEQ ID NO: 468592 - DNA, 15 bp, Homo sapiens
tttctatttttaaga

SEQ ID NO: 468593 - DNA, 15 bp, Homo sapiens
ttctatttttaagag

SEQ ID NO: 468594 - DNA, 15 bp, Homo sapiens
tctatttttaagagc

SEQ ID NO: 468595 - DNA, 15 bp, Homo sapiens
ctatttttaagagct

SEQ ID NO: 468596 - DNA, 15 bp, Homo sapiens
tatttttaagagctt

SEQ ID NO: 468597 - DNA, 15 bp, Homo sapiens
atttttaagagcttt

SEQ ID NO: 468598 - DNA, 15 bp, Homo sapiens
tttttaagagctttc

SEQ ID NO: 468599 - DNA, 15 bp, Homo sapiens
ttttaagagctttct

SEQ ID NO: 468600 - DNA, 15 bp, Homo sapiens
tttaagagctttctg

SEQ ID NO: 468601 - DNA, 15 bp, Homo sapiens
ttaagagctttctgc

SEQ ID NO: 468602 - DNA, 15 bp, Homo sapiens
taagagctttctgca

SEQ ID NO: 468603 - DNA, 15 bp, Homo sapiens
aagagctttctgcaa

SEQ ID NO: 468604 - DNA, 15 bp, Homo sapiens
agagctttctgcaat

SEQ ID NO: 468605 - DNA, 15 bp, Homo sapiens
gagctttctgcaatt

SEQ ID NO: 468606 - DNA, 15 bp, Homo sapiens
agctttctgcaattt

SEQ ID NO: 468607 - DNA, 15 bp, Homo sapiens
gctttctgcaattta

SEQ ID NO: 468608 - DNA, 15 bp, Homo sapiens
ctttctgcaatttag

SEQ ID NO: 468609 - DNA, 15 bp, Homo sapiens
tttctgcaatttaga

SEQ ID NO: 468610 - DNA, 15 bp, Homo sapiens
ttctgcaatttagaa

SEQ ID NO: 468611 - DNA, 15 bp, Homo sapiens
tctgcaatttagaaa

SEQ ID NO: 468612 - DNA, 15 bp, Homo sapiens
ctgcaatttagaaac

SEQ ID NO: 468613 - DNA, 15 bp, Homo sapiens
tgcaatttagaaacc

SEQ ID NO: 468614 - DNA, 15 bp, Homo sapiens
gcaatttagaaacct

SEQ ID NO: 468615 - DNA, 15 bp, Homo sapiens
caatttagaaacctt

SEQ ID NO: 468616 - DNA, 15 bp, Homo sapiens
aatttagaaacctta

SEQ ID NO: 468617 - DNA, 15 bp, Homo sapiens
atttagaaaccttat

SEQ ID NO: 468618 - DNA, 15 bp, Homo sapiens
tttagaaaccttatt

SEQ ID NO: 468619 - DNA, 15 bp, Homo sapiens
ttagaaaccttattt

SEQ ID NO: 468620 - DNA, 15 bp, Homo sapiens
tagaaaccttatttt

SEQ ID NO: 468621 - DNA, 15 bp, Homo sapiens
agaaaccttatttta

SEQ ID NO: 468622 - DNA, 15 bp, Homo sapiens
gaaaccttattttaa

SEQ ID NO: 468623 - DNA, 15 bp, Homo sapiens
aaaccttattttaaa

SEQ ID NO: 468624 - DNA, 15 bp, Homo sapiens
aaccttattttaaat

SEQ ID NO: 468625 - DNA, 15 bp, Homo sapiens
accttattttaaatc

SEQ ID NO: 468626 - DNA, 15 bp, Homo sapiens
ccttattttaaatcc

SEQ ID NO: 468627 - DNA, 15 bp, Homo sapiens
cttattttaaatcca

SEQ ID NO: 468628 - DNA, 15 bp, Homo sapiens
ttattttaaatccac

SEQ ID NO: 468629 - DNA, 15 bp, Homo sapiens
tattttaaatccaca

SEQ ID NO: 468630 - DNA, 15 bp, Homo sapiens
attttaaatccacaa

SEQ ID NO: 468631 - DNA, 15 bp, Homo sapiens
ttttaaatccacaaa

SEQ ID NO: 468632 - DNA, 15 bp, Homo sapiens
tttaaatccacaaag

SEQ ID NO: 468633 - DNA, 15 bp, Homo sapiens
ttaaatccacaaagc

SEQ ID NO: 468634 - DNA, 15 bp, Homo sapiens
taaatccacaaagca

SEQ ID NO: 468635 - DNA, 15 bp, Homo sapiens
aaatccacaaagcac

SEQ ID NO: 468636 - DNA, 15 bp, Homo sapiens
aatccacaaagcacc

SEQ ID NO: 468637 - DNA, 15 bp, Homo sapiens
atccacaaagcaccc

SEQ ID NO: 468638 - DNA, 15 bp, Homo sapiens
tccacaaagcaccct

SEQ ID NO: 468639 - DNA, 15 bp, Homo sapiens
ccacaaagcacccta

SEQ ID NO: 468640 - DNA, 15 bp, Homo sapiens
cacaaagcaccctaa

SEQ ID NO: 468641 - DNA, 15 bp, Homo sapiens
acaaagcaccctaaa

SEQ ID NO: 468642 - DNA, 15 bp, Homo sapiens
caaagcaccctaaat

SEQ ID NO: 468643 - DNA, 15 bp, Homo sapiens
aaagcaccctaaata

SEQ ID NO: 468644 - DNA, 15 bp, Homo sapiens
aagcaccctaaatat

SEQ ID NO: 468645 - DNA, 15 bp, Homo sapiens
agcaccctaaatatt

SEQ ID NO: 468646 - DNA, 15 bp, Homo sapiens
gcaccctaaatattt

SEQ ID NO: 468647 - DNA, 15 bp, Homo sapiens
caccctaaatatttt

SEQ ID NO: 468648 - DNA, 15 bp, Homo sapiens
accctaaatattttg

SEQ ID NO: 468649 - DNA, 15 bp, Homo sapiens
ccctaaatattttgc

SEQ ID NO: 468650 - DNA, 15 bp, Homo sapiens
cctaaatattttgcc

SEQ ID NO: 468651 - DNA, 15 bp, Homo sapiens
ctaaatattttgcca

SEQ ID NO: 468652 - DNA, 15 bp, Homo sapiens
taaatattttgccaa

SEQ ID NO: 468653 - DNA, 15 bp, Homo sapiens
aaatattttgccaat

SEQ ID NO: 468654 - DNA, 15 bp, Homo sapiens
aatattttgccaata

SEQ ID NO: 468655 - DNA, 15 bp, Homo sapiens
atattttgccaatat

SEQ ID NO: 468656 - DNA, 15 bp, Homo sapiens
tattttgccaatata

SEQ ID NO: 468657 - DNA, 15 bp, Homo sapiens
attttgccaatatat

SEQ ID NO: 468658 - DNA, 15 bp, Homo sapiens
ttttgccaatatatc

SEQ ID NO: 468659 - DNA, 15 bp, Homo sapiens
tttgccaatatatct

SEQ ID NO: 468660 - DNA, 15 bp, Homo sapiens
ttgccaatatatctg

SEQ ID NO: 468661 - DNA, 15 bp, Homo sapiens
tgccaatatatctgc

SEQ ID NO: 468662 - DNA, 15 bp, Homo sapiens
gccaatatatctgct

SEQ ID NO: 468663 - DNA, 15 bp, Homo sapiens
ccaatatatctgctt

SEQ ID NO: 468664 - DNA, 15 bp, Homo sapiens
caatatatctgctta

SEQ ID NO: 468665 - DNA, 15 bp, Homo sapiens
aatatatctgcttat

SEQ ID NO: 468666 - DNA, 15 bp, Homo sapiens
atatatctgcttatg

SEQ ID NO: 468667 - DNA, 15 bp, Homo sapiens
tatatctgcttatga

SEQ ID NO: 468668 - DNA, 15 bp, Homo sapiens
atatctgcttatgat

SEQ ID NO: 468669 - DNA, 15 bp, Homo sapiens
tatctgcttatgatt

SEQ ID NO: 468670 - DNA, 15 bp, Homo sapiens
atctgcttatgattt

SEQ ID NO: 468671 - DNA, 15 bp, Homo sapiens
tctgcttatgattta

SEQ ID NO: 468672 - DNA, 15 bp, Homo sapiens
ctgcttatgatttat

SEQ ID NO: 468673 - DNA, 15 bp, Homo sapiens
tgcttatgatttatg

SEQ ID NO: 468674 - DNA, 15 bp, Homo sapiens
gcttatgatttatgg

SEQ ID NO: 468675 - DNA, 15 bp, Homo sapiens
cttatgatttatggt

SEQ ID NO: 468676 - DNA, 15 bp, Homo sapiens
ttatgatttatggta

SEQ ID NO: 468677 - DNA, 15 bp, Homo sapiens
tatgatttatggtaa

SEQ ID NO: 468678 - DNA, 15 bp, Homo sapiens
atgatttatggtaat

SEQ ID NO: 468679 - DNA, 15 bp, Homo sapiens
tgatttatggtaatg

SEQ ID NO: 468680 - DNA, 15 bp, Homo sapiens
gatttatggtaatgt

SEQ ID NO: 468681 - DNA, 15 bp, Homo sapiens
atttatggtaatgtt

SEQ ID NO: 468682 - DNA, 15 bp, Homo sapiens
tttatggtaatgttt

SEQ ID NO: 468683 - DNA, 15 bp, Homo sapiens
ttatggtaatgtttt

SEQ ID NO: 468684 - DNA, 15 bp, Homo sapiens
tatggtaatgttttc

SEQ ID NO: 468685 - DNA, 15 bp, Homo sapiens
atggtaatgttttcc

SEQ ID NO: 468686 - DNA, 15 bp, Homo sapiens
tggtaatgttttcct

SEQ ID NO: 468687 - DNA, 15 bp, Homo sapiens
ggtaatgttttcctt

SEQ ID NO: 468688 - DNA, 15 bp, Homo sapiens
gtaatgttttccttt

SEQ ID NO: 468689 - DNA, 15 bp, Homo sapiens
taatgttttccttta

SEQ ID NO: 468690 - DNA, 15 bp, Homo sapiens
aatgttttcctttag

SEQ ID NO: 468691 - DNA, 15 bp, Homo sapiens
atgttttcctttagc

SEQ ID NO: 468692 - DNA, 15 bp, Homo sapiens
tgttttcctttagct

SEQ ID NO: 468693 - DNA, 15 bp, Homo sapiens
gttttcctttagctg

SEQ ID NO: 468694 - DNA, 15 bp, Homo sapiens
ttttcctttagctgt

SEQ ID NO: 468695 - DNA, 15 bp, Homo sapiens
tttcctttagctgta

SEQ ID NO: 468696 - DNA, 15 bp, Homo sapiens
ttcctttagctgtaa

SEQ ID NO: 468697 - DNA, 15 bp, Homo sapiens
tcctttagctgtaag

SEQ ID NO: 468698 - DNA, 15 bp, Homo sapiens
cctttagctgtaaga

SEQ ID NO: 468699 - DNA, 15 bp, Homo sapiens
ctttagctgtaagaa

SEQ ID NO: 468700 - DNA, 15 bp, Homo sapiens
tttagctgtaagaag

SEQ ID NO: 468701 - DNA, 15 bp, Homo sapiens
ttagctgtaagaaga

SEQ ID NO: 468702 - DNA, 15 bp, Homo sapiens
tagctgtaagaagac

SEQ ID NO: 468703 - DNA, 15 bp, Homo sapiens
agctgtaagaagact

SEQ ID NO: 468704 - DNA, 15 bp, Homo sapiens
gctgtaagaagacta

SEQ ID NO: 468705 - DNA, 15 bp, Homo sapiens
ctgtaagaagactaa

SEQ ID NO: 468706 - DNA, 15 bp, Homo sapiens
tgtaagaagactaat

SEQ ID NO: 468707 - DNA, 15 bp, Homo sapiens
gtaagaagactaatg

SEQ ID NO: 468708 - DNA, 15 bp, Homo sapiens
taagaagactaatgg

SEQ ID NO: 468709 - DNA, 15 bp, Homo sapiens
aagaagactaatggt

SEQ ID NO: 468710 - DNA, 15 bp, Homo sapiens
agaagactaatggta

SEQ ID NO: 468711 - DNA, 15 bp, Homo sapiens
gaagactaatggtat

SEQ ID NO: 468712 - DNA, 15 bp, Homo sapiens
aagactaatggtata

SEQ ID NO: 468713 - DNA, 15 bp, Homo sapiens
agactaatggtatat

SEQ ID NO: 468714 - DNA, 15 bp, Homo sapiens
gactaatggtatatg

SEQ ID NO: 468715 - DNA, 15 bp, Homo sapiens
actaatggtatatga

SEQ ID NO: 468716 - DNA, 15 bp, Homo sapiens
ctaatggtatatgaa

SEQ ID NO: 468717 - DNA, 15 bp, Homo sapiens
taatggtatatgaat

SEQ ID NO: 468718 - DNA, 15 bp, Homo sapiens
aatggtatatgaatg

SEQ ID NO: 468719 - DNA, 15 bp, Homo sapiens
atggtatatgaatga

SEQ ID NO: 468720 - DNA, 15 bp, Homo sapiens
tggtatatgaatgaa

SEQ ID NO: 468721 - DNA, 15 bp, Homo sapiens
ggtatatgaatgaac

SEQ ID NO: 468722 - DNA, 15 bp, Homo sapiens
gtatatgaatgaact

SEQ ID NO: 468723 - DNA, 15 bp, Homo sapiens
tatatgaatgaacta

SEQ ID NO: 468724 - DNA, 15 bp, Homo sapiens
atatgaatgaactat

SEQ ID NO: 468725 - DNA, 15 bp, Homo sapiens
tatgaatgaactatc

SEQ ID NO: 468726 - DNA, 15 bp, Homo sapiens
atgaatgaactatca

SEQ ID NO: 468727 - DNA, 15 bp, Homo sapiens
tgaatgaactatcat

SEQ ID NO: 468728 - DNA, 15 bp, Homo sapiens
gaatgaactatcatg

SEQ ID NO: 468729 - DNA, 15 bp, Homo sapiens
aatgaactatcatga

SEQ ID NO: 468730 - DNA, 15 bp, Homo sapiens
atgaactatcatgac

SEQ ID NO: 468731 - DNA, 15 bp, Homo sapiens
tgaactatcatgact

SEQ ID NO: 468732 - DNA, 15 bp, Homo sapiens
gaactatcatgactc

SEQ ID NO: 468733 - DNA, 15 bp, Homo sapiens
aactatcatgactca

SEQ ID NO: 468734 - DNA, 15 bp, Homo sapiens
actatcatgactcat

SEQ ID NO: 468735 - DNA, 15 bp, Homo sapiens
ctatcatgactcatg

SEQ ID NO: 468736 - DNA, 15 bp, Homo sapiens
tatcatgactcatga

SEQ ID NO: 468737 - DNA, 15 bp, Homo sapiens
atcatgactcatgaa

SEQ ID NO: 468738 - DNA, 15 bp, Homo sapiens
tcatgactcatgaaa

SEQ ID NO: 468739 - DNA, 15 bp, Homo sapiens
catgactcatgaaag

SEQ ID NO: 468740 - DNA, 15 bp, Homo sapiens
atgactcatgaaagt

SEQ ID NO: 468741 - DNA, 15 bp, Homo sapiens
tgactcatgaaagta

SEQ ID NO: 468742 - DNA, 15 bp, Homo sapiens
gactcatgaaagtat

SEQ ID NO: 468743 - DNA, 15 bp, Homo sapiens
actcatgaaagtatt

SEQ ID NO: 468744 - DNA, 15 bp, Homo sapiens
ctcatgaaagtattt

SEQ ID NO: 468745 - DNA, 15 bp, Homo sapiens
tcatgaaagtatttt

SEQ ID NO: 468746 - DNA, 15 bp, Homo sapiens
catgaaagtatttta

SEQ ID NO: 468747 - DNA, 15 bp, Homo sapiens
atgaaagtattttat

SEQ ID NO: 468748 - DNA, 15 bp, Homo sapiens
tgaaagtattttatg

SEQ ID NO: 468749 - DNA, 15 bp, Homo sapiens
gaaagtattttatga

SEQ ID NO: 468750 - DNA, 15 bp, Homo sapiens
aaagtattttatgat

SEQ ID NO: 468751 - DNA, 15 bp, Homo sapiens
aagtattttatgata

SEQ ID NO: 468752 - DNA, 15 bp, Homo sapiens
agtattttatgatat

SEQ ID NO: 468753 - DNA, 15 bp, Homo sapiens
gtattttatgatatt

SEQ ID NO: 468754 - DNA, 15 bp, Homo sapiens
tattttatgatattg

SEQ ID NO: 468755 - DNA, 15 bp, Homo sapiens
attttatgatattga

SEQ ID NO: 468756 - DNA, 15 bp, Homo sapiens
ttttatgatattgat

SEQ ID NO: 468757 - DNA, 15 bp, Homo sapiens
tttatgatattgata

SEQ ID NO: 468758 - DNA, 15 bp, Homo sapiens
ttatgatattgataa

SEQ ID NO: 468759 - DNA, 15 bp, Homo sapiens
tatgatattgataat

SEQ ID NO: 468760 - DNA, 15 bp, Homo sapiens
atgatattgataatt

SEQ ID NO: 468761 - DNA, 15 bp, Homo sapiens
tgatattgataattt

SEQ ID NO: 468762 - DNA, 15 bp, Homo sapiens
gatattgataattta

SEQ ID NO: 468763 - DNA, 15 bp, Homo sapiens
atattgataatttat

SEQ ID NO: 468764 - DNA, 15 bp, Homo sapiens
tattgataatttata

SEQ ID NO: 468765 - DNA, 15 bp, Homo sapiens
attgataatttatat

SEQ ID NO: 468766 - DNA, 15 bp, Homo sapiens
ttgataatttatata

SEQ ID NO: 468767 - DNA, 15 bp, Homo sapiens
tgataatttatatat

SEQ ID NO: 468768 - DNA, 15 bp, Homo sapiens
gataatttatatatg

SEQ ID NO: 468769 - DNA, 15 bp, Homo sapiens
ataatttatatatgt

SEQ ID NO: 468770 - DNA, 15 bp, Homo sapiens
taatttatatatgta

SEQ ID NO: 468771 - DNA, 15 bp, Homo sapiens
aatttatatatgtat

SEQ ID NO: 468772 - DNA, 15 bp, Homo sapiens
atttatatatgtata

SEQ ID NO: 468773 - DNA, 15 bp, Homo sapiens
tttatatatgtatat

SEQ ID NO: 468774 - DNA, 15 bp, Homo sapiens
ttatatatgtatata

SEQ ID NO: 468775 - DNA, 15 bp, Homo sapiens
tatatgtatatataa

SEQ ID NO: 468776 - DNA, 15 bp, Homo sapiens
atatgtatatataaa

SEQ ID NO: 468777 - DNA, 15 bp, Homo sapiens
tatgtatatataaat

SEQ ID NO: 468778 - DNA, 15 bp, Homo sapiens
atgtatatataaatt

SEQ ID NO: 468779 - DNA, 15 bp, Homo sapiens
tgtatatataaatta

SEQ ID NO: 468780 - DNA, 15 bp, Homo sapiens
gtatatataaattat

SEQ ID NO: 468781 - DNA, 15 bp, Homo sapiens
tatatataaattatc

SEQ ID NO: 468782 - DNA, 15 bp, Homo sapiens
atatataaattatct

SEQ ID NO: 468783 - DNA, 15 bp, Homo sapiens
tatataaattatctg

SEQ ID NO: 468784 - DNA, 15 bp, Homo sapiens
atataaattatctga

SEQ ID NO: 468785 - DNA, 15 bp, Homo sapiens
tataaattatctgaa

SEQ ID NO: 468786 - DNA, 15 bp, Homo sapiens
ataaattatctgaag

SEQ ID NO: 468787 - DNA, 15 bp, Homo sapiens
taaattatctgaaga

SEQ ID NO: 468788 - DNA, 15 bp, Homo sapiens
aaattatctgaagaa

SEQ ID NO: 468789 - DNA, 15 bp, Homo sapiens
aattatctgaagaaa

SEQ ID NO: 468790 - DNA, 15 bp, Homo sapiens
attatctgaagaaat

SEQ ID NO: 468791 - DNA, 15 bp, Homo sapiens
ttatctgaagaaatg

SEQ ID NO: 468792 - DNA, 15 bp, Homo sapiens
tatctgaagaaatgt

SEQ ID NO: 468793 - DNA, 15 bp, Homo sapiens
atctgaagaaatgta

SEQ ID NO: 468794 - DNA, 15 bp, Homo sapiens
tctgaagaaatgtag

SEQ ID NO: 468795 - DNA, 15 bp, Homo sapiens
ctgaagaaatgtagc

SEQ ID NO: 468796 - DNA, 15 bp, Homo sapiens
tgaagaaatgtagca

SEQ ID NO: 468797 - DNA, 15 bp, Homo sapiens
gaagaaatgtagcag

SEQ ID NO: 468798 - DNA, 15 bp, Homo sapiens
aagaaatgtagcaga

SEQ ID NO: 468799 - DNA, 15 bp, Homo sapiens
agaaatgtagcagaa

SEQ ID NO: 468800 - DNA, 15 bp, Homo sapiens
gaaatgtagcagaat

SEQ ID NO: 468801 - DNA, 15 bp, Homo sapiens
aaatgtagcagaatt

SEQ ID NO: 468802 - DNA, 15 bp, Homo sapiens
aatgtagcagaattt

SEQ ID NO: 468803 - DNA, 15 bp, Homo sapiens
atgtagcagaatttt

SEQ ID NO: 468804 - DNA, 15 bp, Homo sapiens
tgtagcagaattttt

SEQ ID NO: 468805 - DNA, 15 bp, Homo sapiens
gtagcagaattttta

SEQ ID NO: 468806 - DNA, 15 bp, Homo sapiens
tagcagaatttttat

SEQ ID NO: 468807 - DNA, 15 bp, Homo sapiens
agcagaatttttatt

SEQ ID NO: 468808 - DNA, 15 bp, Homo sapiens
gcagaatttttattt

SEQ ID NO: 468809 - DNA, 15 bp, Homo sapiens
cagaatttttatttc

SEQ ID NO: 468810 - DNA, 15 bp, Homo sapiens
agaatttttatttct

SEQ ID NO: 468811 - DNA, 15 bp, Homo sapiens
gaatttttatttctc

SEQ ID NO: 468812 - DNA, 15 bp, Homo sapiens
aatttttatttctct

SEQ ID NO: 468813 - DNA, 15 bp, Homo sapiens
atttttatttctcta

SEQ ID NO: 468814 - DNA, 15 bp, Homo sapiens
tttttatttctctag

SEQ ID NO: 468815 - DNA, 15 bp, Homo sapiens
ttttatttctctagg

SEQ ID NO: 468816 - DNA, 15 bp, Homo sapiens
tttatttctctagga

SEQ ID NO: 468817 - DNA, 15 bp, Homo sapiens
ttatttctctaggaa

SEQ ID NO: 468818 - DNA, 15 bp, Homo sapiens
tatttctctaggaaa

SEQ ID NO: 468819 - DNA, 15 bp, Homo sapiens
atttctctaggaaat

SEQ ID NO: 468820 - DNA, 15 bp, Homo sapiens
tttctctaggaaatg

SEQ ID NO: 468821 - DNA, 15 bp, Homo sapiens
ttctctaggaaatga

SEQ ID NO: 468822 - DNA, 15 bp, Homo sapiens
tctctaggaaatgat

SEQ ID NO: 468823 - DNA, 15 bp, Homo sapiens
ctctaggaaatgatt

SEQ ID NO: 468824 - DNA, 15 bp, Homo sapiens
tctaggaaatgattt

SEQ ID NO: 468825 - DNA, 15 bp, Homo sapiens
ctaggaaatgatttt

SEQ ID NO: 468826 - DNA, 15 bp, Homo sapiens
taggaaatgattttt

SEQ ID NO: 468827 - DNA, 15 bp, Homo sapiens
aggaaatgatttttt

SEQ ID NO: 468828 - DNA, 15 bp, Homo sapiens
ggaaatgattttttg

SEQ ID NO: 468829 - DNA, 15 bp, Homo sapiens
gaaatgattttttgt

SEQ ID NO: 468830 - DNA, 15 bp, Homo sapiens
aaatgattttttgtc

SEQ ID NO: 468831 - DNA, 15 bp, Homo sapiens
aatgattttttgtct

SEQ ID NO: 468832 - DNA, 15 bp, Homo sapiens
atgattttttgtctt

SEQ ID NO: 468833 - DNA, 15 bp, Homo sapiens
tgattttttgtctta

SEQ ID NO: 468834 - DNA, 15 bp, Homo sapiens
gattttttgtcttat

SEQ ID NO: 468835 - DNA, 15 bp, Homo sapiens
attttttgtcttatt

SEQ ID NO: 468836 - DNA, 15 bp, Homo sapiens
ttttttgtcttattt

SEQ ID NO: 468837 - DNA, 15 bp, Homo sapiens
tttttgtcttatttc

SEQ ID NO: 468838 - DNA, 15 bp, Homo sapiens
ttttgtcttatttcc

SEQ ID NO: 468839 - DNA, 15 bp, Homo sapiens
tttgtcttatttccc

SEQ ID NO: 468840 - DNA, 15 bp, Homo sapiens
ttgtcttatttcccc

SEQ ID NO: 468841 - DNA, 15 bp, Homo sapiens
tgtcttatttccccc

SEQ ID NO: 468842 - DNA, 15 bp, Homo sapiens
gtcttatttccccct

SEQ ID NO: 468843 - DNA, 15 bp, Homo sapiens
tcttatttcccccta

SEQ ID NO: 468844 - DNA, 15 bp, Homo sapiens
cttatttccccctac

SEQ ID NO: 468845 - DNA, 15 bp, Homo sapiens
ttatttccccctact

SEQ ID NO: 468846 - DNA, 15 bp, Homo sapiens
tatttccccctacta

SEQ ID NO: 468847 - DNA, 15 bp, Homo sapiens
atttccccctactat

SEQ ID NO: 468848 - DNA, 15 bp, Homo sapiens
tttccccctactatt

SEQ ID NO: 468849 - DNA, 15 bp, Homo sapiens
ttccccctactattc

SEQ ID NO: 468850 - DNA, 15 bp, Homo sapiens
tccccctactattct

SEQ ID NO: 468851 - DNA, 15 bp, Homo sapiens
ccccctactattcta

SEQ ID NO: 468852 - DNA, 15 bp, Homo sapiens
cccctactattctat

SEQ ID NO: 468853 - DNA, 15 bp, Homo sapiens
ccctactattctata

SEQ ID NO: 468854 - DNA, 15 bp, Homo sapiens
cctactattctataa

SEQ ID NO: 468855 - DNA, 15 bp, Homo sapiens
ctactattctataat

SEQ ID NO: 468856 - DNA, 15 bp, Homo sapiens
tactattctataatc

SEQ ID NO: 468857 - DNA, 15 bp, Homo sapiens
actattctataatcc

SEQ ID NO: 468858 - DNA, 15 bp, Homo sapiens
ctattctataatcca

SEQ ID NO: 468859 - DNA, 15 bp, Homo sapiens
tattctataatccaa

SEQ ID NO: 468860 - DNA, 15 bp, Homo sapiens
attctataatccaaa

SEQ ID NO: 468861 - DNA, 15 bp, Homo sapiens
ttctataatccaaat

SEQ ID NO: 468862 - DNA, 15 bp, Homo sapiens
tctataatccaaatt

SEQ ID NO: 468863 - DNA, 15 bp, Homo sapiens
ctataatccaaattt

SEQ ID NO: 468864 - DNA, 15 bp, Homo sapiens
tataatccaaatttg

SEQ ID NO: 468865 - DNA, 15 bp, Homo sapiens
ataatccaaatttgt

SEQ ID NO: 468866 - DNA, 15 bp, Homo sapiens
taatccaaatttgta

SEQ ID NO: 468867 - DNA, 15 bp, Homo sapiens
aatccaaatttgtac

SEQ ID NO: 468868 - DNA, 15 bp, Homo sapiens
atccaaatttgtaca

SEQ ID NO: 468869 - DNA, 15 bp, Homo sapiens
tccaaatttgtacat

SEQ ID NO: 468870 - DNA, 15 bp, Homo sapiens
ccaaatttgtacatt

SEQ ID NO: 468871 - DNA, 15 bp, Homo sapiens
caaatttgtacattt

SEQ ID NO: 468872 - DNA, 15 bp, Homo sapiens
aaatttgtacattta

SEQ ID NO: 468873 - DNA, 15 bp, Homo sapiens
aatttgtacatttaa

SEQ ID NO: 468874 - DNA, 15 bp, Homo sapiens
atttgtacatttaag

SEQ ID NO: 468875 - DNA, 15 bp, Homo sapiens
tttgtacatttaaga

SEQ ID NO: 468876 - DNA, 15 bp, Homo sapiens
ttgtacatttaagaa

SEQ ID NO: 468877 - DNA, 15 bp, Homo sapiens
tgtacatttaagaat

SEQ ID NO: 468878 - DNA, 15 bp, Homo sapiens
gtacatttaagaatt

SEQ ID NO: 468879 - DNA, 15 bp, Homo sapiens
tacatttaagaattc

SEQ ID NO: 468880 - DNA, 15 bp, Homo sapiens
acatttaagaattct

SEQ ID NO: 468881 - DNA, 15 bp, Homo sapiens
catttaagaattctt

SEQ ID NO: 468882 - DNA, 15 bp, Homo sapiens
atttaagaattcttt

SEQ ID NO: 468883 - DNA, 15 bp, Homo sapiens
tttaagaattctttc

SEQ ID NO: 468884 - DNA, 15 bp, Homo sapiens
ttaagaattctttca

SEQ ID NO: 468885 - DNA, 15 bp, Homo sapiens
taagaattctttcat

SEQ ID NO: 468886 - DNA, 15 bp, Homo sapiens
aagaattctttcatt

SEQ ID NO: 468887 - DNA, 15 bp, Homo sapiens
agaattctttcatta

SEQ ID NO: 468888 - DNA, 15 bp, Homo sapiens
gaattctttcattag

SEQ ID NO: 468889 - DNA, 15 bp, Homo sapiens
aattctttcattagg

SEQ ID NO: 468890 - DNA, 15 bp, Homo sapiens
attctttcattaggc

SEQ ID NO: 468891 - DNA, 15 bp, Homo sapiens
ttctttcattaggct

SEQ ID NO: 468892 - DNA, 15 bp, Homo sapiens
tctttcattaggctt

SEQ ID NO: 468893 - DNA, 15 bp, Homo sapiens
ctttcattaggctta

SEQ ID NO: 468894 - DNA, 15 bp, Homo sapiens
tttcattaggcttaa

SEQ ID NO: 468895 - DNA, 15 bp, Homo sapiens
ttcattaggcttaat

SEQ ID NO: 468896 - DNA, 15 bp, Homo sapiens
tcattaggcttaata

SEQ ID NO: 468897 - DNA, 15 bp, Homo sapiens
cattaggcttaataa

SEQ ID NO: 468898 - DNA, 15 bp, Homo sapiens
attaggcttaataag

SEQ ID NO: 468899 - DNA, 15 bp, Homo sapiens
ttaggcttaataaga

SEQ ID NO: 468900 - DNA, 15 bp, Homo sapiens
taggcttaataagag

SEQ ID NO: 468901 - DNA, 15 bp, Homo sapiens
aggcttaataagagt

SEQ ID NO: 468902 - DNA, 15 bp, Homo sapiens
ggcttaataagagtt

SEQ ID NO: 468903 - DNA, 15 bp, Homo sapiens
gcttaataagagttg

SEQ ID NO: 468904 - DNA, 15 bp, Homo sapiens
cttaataagagttga

SEQ ID NO: 468905 - DNA, 15 bp, Homo sapiens
ttaataagagttgat

SEQ ID NO: 468906 - DNA, 15 bp, Homo sapiens
taataagagttgatc

SEQ ID NO: 468907 - DNA, 15 bp, Homo sapiens
aataagagttgatct

SEQ ID NO: 468908 - DNA, 15 bp, Homo sapiens
ataagagttgatctt

SEQ ID NO: 468909 - DNA, 15 bp, Homo sapiens
taagagttgatcttc

SEQ ID NO: 468910 - DNA, 15 bp, Homo sapiens
aagagttgatcttca

SEQ ID NO: 468911 - DNA, 15 bp, Homo sapiens
agagttgatcttcaa

SEQ ID NO: 468912 - DNA, 15 bp, Homo sapiens
gagttgatcttcaag

SEQ ID NO: 468913 - DNA, 15 bp, Homo sapiens
agttgatcttcaaga

SEQ ID NO: 468914 - DNA, 15 bp, Homo sapiens
gttgatcttcaagag

SEQ ID NO: 468915 - DNA, 15 bp, Homo sapiens
ttgatcttcaagaga

SEQ ID NO: 468916 - DNA, 15 bp, Homo sapiens
tgatcttcaagagac

SEQ ID NO: 468917 - DNA, 15 bp, Homo sapiens
gatcttcaagagaca

SEQ ID NO: 468918 - DNA, 15 bp, Homo sapiens
atcttcaagagacag

SEQ ID NO: 468919 - DNA, 15 bp, Homo sapiens
tcttcaagagacagc

SEQ ID NO: 468920 - DNA, 15 bp, Homo sapiens
cttcaagagacagca

SEQ ID NO: 468921 - DNA, 15 bp, Homo sapiens
ttcaagagacagcat

SEQ ID NO: 468922 - DNA, 15 bp, Homo sapiens
tcaagagacagcatg

SEQ ID NO: 468923 - DNA, 15 bp, Homo sapiens
caagagacagcatga

SEQ ID NO: 468924 - DNA, 15 bp, Homo sapiens
aagagacagcatgac

SEQ ID NO: 468925 - DNA, 15 bp, Homo sapiens
agagacagcatgaca

SEQ ID NO: 468926 - DNA, 15 bp, Homo sapiens
gagacagcatgacac

SEQ ID NO: 468927 - DNA, 15 bp, Homo sapiens
agacagcatgacaca

SEQ ID NO: 468928 - DNA, 15 bp, Homo sapiens
gacagcatgacacag

SEQ ID NO: 468929 - DNA, 15 bp, Homo sapiens
acagcatgacacaga

SEQ ID NO: 468930 - DNA, 15 bp, Homo sapiens
cagcatgacacagat

SEQ ID NO: 468931 - DNA, 15 bp, Homo sapiens
agcatgacacagatg

SEQ ID NO: 468932 - DNA, 15 bp, Homo sapiens
gcatgacacagatga

SEQ ID NO: 468933 - DNA, 15 bp, Homo sapiens
catgacacagatgat

SEQ ID NO: 468934 - DNA, 15 bp, Homo sapiens
atgacacagatgata

SEQ ID NO: 468935 - DNA, 15 bp, Homo sapiens
tgacacagatgatat

SEQ ID NO: 468936 - DNA, 15 bp, Homo sapiens
gacacagatgatatt

SEQ ID NO: 468937 - DNA, 15 bp, Homo sapiens
acacagatgatattt

SEQ ID NO: 468938 - DNA, 15 bp, Homo sapiens
cacagatgatattta

SEQ ID NO: 468939 - DNA, 15 bp, Homo sapiens
acagatgatatttaa

SEQ ID NO: 468940 - DNA, 15 bp, Homo sapiens
cagatgatatttaat

SEQ ID NO: 468941 - DNA, 15 bp, Homo sapiens
agatgatatttaatg

SEQ ID NO: 468942 - DNA, 15 bp, Homo sapiens
gatgatatttaatgc

SEQ ID NO: 468943 - DNA, 15 bp, Homo sapiens
atgatatttaatgcc

SEQ ID NO: 468944 - DNA, 15 bp, Homo sapiens
tgatatttaatgcct

SEQ ID NO: 468945 - DNA, 15 bp, Homo sapiens
gatatttaatgcctg

SEQ ID NO: 468946 - DNA, 15 bp, Homo sapiens
atatttaatgcctgt

SEQ ID NO: 468947 - DNA, 15 bp, Homo sapiens
tatttaatgcctgtc

SEQ ID NO: 468948 - DNA, 15 bp, Homo sapiens
atttaatgcctgtca

SEQ ID NO: 468949 - DNA, 15 bp, Homo sapiens
tttaatgcctgtcat

SEQ ID NO: 468950 - DNA, 15 bp, Homo sapiens
ttaatgcctgtcatc

SEQ ID NO: 468951 - DNA, 15 bp, Homo sapiens
taatgcctgtcatca

SEQ ID NO: 468952 - DNA, 15 bp, Homo sapiens
aatgcctgtcatcat

SEQ ID NO: 468953 - DNA, 15 bp, Homo sapiens
atgcctgtcatcatt

SEQ ID NO: 468954 - DNA, 15 bp, Homo sapiens
tgcctgtcatcattc

SEQ ID NO: 468955 - DNA, 15 bp, Homo sapiens
gcctgtcatcattct

SEQ ID NO: 468956 - DNA, 15 bp, Homo sapiens
cctgtcatcattctg

SEQ ID NO: 468957 - DNA, 15 bp, Homo sapiens
ctgtcatcattctgt

SEQ ID NO: 468958 - DNA, 15 bp, Homo sapiens
tgtcatcattctgtc

SEQ ID NO: 468959 - DNA, 15 bp, Homo sapiens
gtcatcattctgtct

SEQ ID NO: 468960 - DNA, 15 bp, Homo sapiens
tcatcattctgtctc

SEQ ID NO: 468961 - DNA, 15 bp, Homo sapiens
catcattctgtctcc

SEQ ID NO: 468962 - DNA, 15 bp, Homo sapiens
atcattctgtctcca

SEQ ID NO: 468963 - DNA, 15 bp, Homo sapiens
tcattctgtctccat

SEQ ID NO: 468964 - DNA, 15 bp, Homo sapiens
cattctgtctccata

SEQ ID NO: 468965 - DNA, 15 bp, Homo sapiens
attctgtctccatat

SEQ ID NO: 468966 - DNA, 15 bp, Homo sapiens
ttctgtctccatatg

SEQ ID NO: 468967 - DNA, 15 bp, Homo sapiens
tctgtctccatatgt

SEQ ID NO: 468968 - DNA, 15 bp, Homo sapiens
ctgtctccatatgtc

SEQ ID NO: 468969 - DNA, 15 bp, Homo sapiens
tgtctccatatgtcc

SEQ ID NO: 468970 - DNA, 15 bp, Homo sapiens
gtctccatatgtcca

SEQ ID NO: 468971 - DNA, 15 bp, Homo sapiens
tctccatatgtccaa

SEQ ID NO: 468972 - DNA, 15 bp, Homo sapiens
ctccatatgtccaaa

SEQ ID NO: 468973 - DNA, 15 bp, Homo sapiens
tccatatgtccaaat

SEQ ID NO: 468974 - DNA, 15 bp, Homo sapiens
ccatatgtccaaatc

SEQ ID NO: 468975 - DNA, 15 bp, Homo sapiens
catatgtccaaatcc

SEQ ID NO: 468976 - DNA, 15 bp, Homo sapiens
atatgtccaaatccc

SEQ ID NO: 468977 - DNA, 15 bp, Homo sapiens
tatgtccaaatccca

SEQ ID NO: 468978 - DNA, 15 bp, Homo sapiens
atgtccaaatcccac

SEQ ID NO: 468979 - DNA, 15 bp, Homo sapiens
tgtccaaatcccacc

SEQ ID NO: 468980 - DNA, 15 bp, Homo sapiens
gtccaaatcccacct

SEQ ID NO: 468981 - DNA, 15 bp, Homo sapiens
tccaaatcccacctt

SEQ ID NO: 468982 - DNA, 15 bp, Homo sapiens
ccaaatcccaccttc

SEQ ID NO: 468983 - DNA, 15 bp, Homo sapiens
caaatcccaccttct

SEQ ID NO: 468984 - DNA, 15 bp, Homo sapiens
aaatcccaccttctc

SEQ ID NO: 468985 - DNA, 15 bp, Homo sapiens
aatcccaccttctca

SEQ ID NO: 468986 - DNA, 15 bp, Homo sapiens
atcccaccttctcac

SEQ ID NO: 468987 - DNA, 15 bp, Homo sapiens
tcccaccttctcaca

SEQ ID NO: 468988 - DNA, 15 bp, Homo sapiens
cccaccttctcacaa

SEQ ID NO: 468989 - DNA, 15 bp, Homo sapiens
ccaccttctcacaaa

SEQ ID NO: 468990 - DNA, 15 bp, Homo sapiens
caccttctcacaaaa

SEQ ID NO: 468991 - DNA, 15 bp, Homo sapiens
accttctcacaaaaa

SEQ ID NO: 468992 - DNA, 15 bp, Homo sapiens
ccttctcacaaaaac

SEQ ID NO: 468993 - DNA, 15 bp, Homo sapiens
cttctcacaaaaaca

SEQ ID NO: 468994 - DNA, 15 bp, Homo sapiens
ttctcacaaaaacag

SEQ ID NO: 468995 - DNA, 15 bp, Homo sapiens
tctcacaaaaacagc

SEQ ID NO: 468996 - DNA, 15 bp, Homo sapiens
ctcacaaaaacagct

SEQ ID NO: 468997 - DNA, 15 bp, Homo sapiens
tcacaaaaacagctc

SEQ ID NO: 468998 - DNA, 15 bp, Homo sapiens
cacaaaaacagctca

SEQ ID NO: 468999 - DNA, 15 bp, Homo sapiens
acaaaaacagctcaa

SEQ ID NO: 469000 - DNA, 15 bp, Homo sapiens
caaaaacagctcaac

SEQ ID NO: 469001 - DNA, 15 bp, Homo sapiens
aaaaacagctcaact

SEQ ID NO: 469002 - DNA, 15 bp, Homo sapiens
aaaacagctcaactc

SEQ ID NO: 469003 - DNA, 15 bp, Homo sapiens
aaacagctcaactcc

SEQ ID NO: 469004 - DNA, 15 bp, Homo sapiens
aacagctcaactccc

SEQ ID NO: 469005 - DNA, 15 bp, Homo sapiens
acagctcaactccca

SEQ ID NO: 469006 - DNA, 15 bp, Homo sapiens
cagctcaactcccac

SEQ ID NO: 469007 - DNA, 15 bp, Homo sapiens
agctcaactcccact

SEQ ID NO: 469008 - DNA, 15 bp, Homo sapiens
gctcaactcccactt

SEQ ID NO: 469009 - DNA, 15 bp, Homo sapiens
ctcaactcccacttt

SEQ ID NO: 469010 - DNA, 15 bp, Homo sapiens
tcaactcccactttg

SEQ ID NO: 469011 - DNA, 15 bp, Homo sapiens
caactcccactttgt

SEQ ID NO: 469012 - DNA, 15 bp, Homo sapiens
aactcccactttgtg

SEQ ID NO: 469013 - DNA, 15 bp, Homo sapiens
actcccactttgtgt

SEQ ID NO: 469014 - DNA, 15 bp, Homo sapiens
ctcccactttgtgtg

SEQ ID NO: 469015 - DNA, 15 bp, Homo sapiens
tcccactttgtgtgt

SEQ ID NO: 469016 - DNA, 15 bp, Homo sapiens
cccactttgtgtgtg

SEQ ID NO: 469017 - DNA, 15 bp, Homo sapiens
ccactttgtgtgtga

SEQ ID NO: 469018 - DNA, 15 bp, Homo sapiens
cactttgtgtgtgaa

SEQ ID NO: 469019 - DNA, 15 bp, Homo sapiens
actttgtgtgtgaaa

SEQ ID NO: 469020 - DNA, 15 bp, Homo sapiens
ctttgtgtgtgaaat

SEQ ID NO: 469021 - DNA, 15 bp, Homo sapiens
tttgtgtgtgaaatc

SEQ ID NO: 469022 - DNA, 15 bp, Homo sapiens
ttgtgtgtgaaatct

SEQ ID NO: 469023 - DNA, 15 bp, Homo sapiens
tgtgtgtgaaatctc

SEQ ID NO: 469024 - DNA, 15 bp, Homo sapiens
gtgtgtgaaatctct

SEQ ID NO: 469025 - DNA, 15 bp, Homo sapiens
tgtgtgaaatctctc

SEQ ID NO: 469026 - DNA, 15 bp, Homo sapiens
gtgtgaaatctctcc

SEQ ID NO: 469027 - DNA, 15 bp, Homo sapiens
tgtgaaatctctccc

SEQ ID NO: 469028 - DNA, 15 bp, Homo sapiens
gtgaaatctctccca

SEQ ID NO: 469029 - DNA, 15 bp, Homo sapiens
tgaaatctctcccag

SEQ ID NO: 469030 - DNA, 15 bp, Homo sapiens
gaaatctctcccagc

SEQ ID NO: 469031 - DNA, 15 bp, Homo sapiens
aaatctctcccagct

SEQ ID NO: 469032 - DNA, 15 bp, Homo sapiens
aatctctcccagctc

SEQ ID NO: 469033 - DNA, 15 bp, Homo sapiens
atctctcccagctcc

SEQ ID NO: 469034 - DNA, 15 bp, Homo sapiens
tctctcccagctcct

SEQ ID NO: 469035 - DNA, 15 bp, Homo sapiens
ctctcccagctcctc

SEQ ID NO: 469036 - DNA, 15 bp, Homo sapiens
tctcccagctcctcc

SEQ ID NO: 469037 - DNA, 15 bp, Homo sapiens
ctcccagctcctcca

SEQ ID NO: 469038 - DNA, 15 bp, Homo sapiens
tcccagctcctccag

SEQ ID NO: 469039 - DNA, 15 bp, Homo sapiens
cccagctcctccagt

SEQ ID NO: 469040 - DNA, 15 bp, Homo sapiens
ccagctcctccagtt

SEQ ID NO: 469041 - DNA, 15 bp, Homo sapiens
cagctcctccagttt

SEQ ID NO: 469042 - DNA, 15 bp, Homo sapiens
agctcctccagtttt

SEQ ID NO: 469043 - DNA, 15 bp, Homo sapiens
gctcctccagtttta

SEQ ID NO: 469044 - DNA, 15 bp, Homo sapiens
ctcctccagttttac

SEQ ID NO: 469045 - DNA, 15 bp, Homo sapiens
tcctccagttttacc

SEQ ID NO: 469046 - DNA, 15 bp, Homo sapiens
cctccagttttaccc

SEQ ID NO: 469047 - DNA, 15 bp, Homo sapiens
ctccagttttaccct

SEQ ID NO: 469048 - DNA, 15 bp, Homo sapiens
tccagttttaccctc

SEQ ID NO: 469049 - DNA, 15 bp, Homo sapiens
ccagttttaccctca

SEQ ID NO: 469050 - DNA, 15 bp, Homo sapiens
cagttttaccctcat

SEQ ID NO: 469051 - DNA, 15 bp, Homo sapiens
agttttaccctcatc

SEQ ID NO: 469052 - DNA, 15 bp, Homo sapiens
gttttaccctcatca

SEQ ID NO: 469053 - DNA, 15 bp, Homo sapiens
ttttaccctcatcaa

SEQ ID NO: 469054 - DNA, 15 bp, Homo sapiens
tttaccctcatcaaa

SEQ ID NO: 469055 - DNA, 15 bp, Homo sapiens
ttaccctcatcaaag

SEQ ID NO: 469056 - DNA, 15 bp, Homo sapiens
taccctcatcaaagc

SEQ ID NO: 469057 - DNA, 15 bp, Homo sapiens
accctcatcaaagca

SEQ ID NO: 469058 - DNA, 15 bp, Homo sapiens
ccctcatcaaagcac

SEQ ID NO: 469059 - DNA, 15 bp, Homo sapiens
cctcatcaaagcact

SEQ ID NO: 469060 - DNA, 15 bp, Homo sapiens
ctcatcaaagcactt

SEQ ID NO: 469061 - DNA, 15 bp, Homo sapiens
tcatcaaagcactta

SEQ ID NO: 469062 - DNA, 15 bp, Homo sapiens
catcaaagcacttag

SEQ ID NO: 469063 - DNA, 15 bp, Homo sapiens
atcaaagcacttagt

SEQ ID NO: 469064 - DNA, 15 bp, Homo sapiens
tcaaagcacttagtt

SEQ ID NO: 469065 - DNA, 15 bp, Homo sapiens
caaagcacttagttc

SEQ ID NO: 469066 - DNA, 15 bp, Homo sapiens
aaagcacttagttca

SEQ ID NO: 469067 - DNA, 15 bp, Homo sapiens
aagcacttagttcag

SEQ ID NO: 469068 - DNA, 15 bp, Homo sapiens
agcacttagttcagg

SEQ ID NO: 469069 - DNA, 15 bp, Homo sapiens
gcacttagttcaggg

SEQ ID NO: 469070 - DNA, 15 bp, Homo sapiens
cacttagttcagggg

SEQ ID NO: 469071 - DNA, 15 bp, Homo sapiens
acttagttcaggggc

SEQ ID NO: 469072 - DNA, 15 bp, Homo sapiens
cttagttcaggggcc

SEQ ID NO: 469073 - DNA, 15 bp, Homo sapiens
ttagttcaggggcct

SEQ ID NO: 469074 - DNA, 15 bp, Homo sapiens
tagttcaggggcctc

SEQ ID NO: 469075 - DNA, 15 bp, Homo sapiens
agttcaggggcctct

SEQ ID NO: 469076 - DNA, 15 bp, Homo sapiens
gttcaggggcctctg

SEQ ID NO: 469077 - DNA, 15 bp, Homo sapiens
ttcaggggcctctgc

SEQ ID NO: 469078 - DNA, 15 bp, Homo sapiens
tcaggggcctctgcc

SEQ ID NO: 469079 - DNA, 15 bp, Homo sapiens
caggggcctctgcca

SEQ ID NO: 469080 - DNA, 15 bp, Homo sapiens
aggggcctctgccaa

SEQ ID NO: 469081 - DNA, 15 bp, Homo sapiens
ggggcctctgccaat

SEQ ID NO: 469082 - DNA, 15 bp, Homo sapiens
gggcctctgccaata

SEQ ID NO: 469083 - DNA, 15 bp, Homo sapiens
ggcctctgccaatag

SEQ ID NO: 469084 - DNA, 15 bp, Homo sapiens
gcctctgccaatagc

SEQ ID NO: 469085 - DNA, 15 bp, Homo sapiens
cctctgccaatagcc

SEQ ID NO: 469086 - DNA, 15 bp, Homo sapiens
ctctgccaatagcct

SEQ ID NO: 469087 - DNA, 15 bp, Homo sapiens
tctgccaatagcctc

SEQ ID NO: 469088 - DNA, 15 bp, Homo sapiens
ctgccaatagcctct

SEQ ID NO: 469089 - DNA, 15 bp, Homo sapiens
tgccaatagcctcta

SEQ ID NO: 469090 - DNA, 15 bp, Homo sapiens
gccaatagcctctac

SEQ ID NO: 469091 - DNA, 15 bp, Homo sapiens
ccaatagcctctact

SEQ ID NO: 469092 - DNA, 15 bp, Homo sapiens
caatagcctctactt

SEQ ID NO: 469093 - DNA, 15 bp, Homo sapiens
aatagcctctacttt

SEQ ID NO: 469094 - DNA, 15 bp, Homo sapiens
atagcctctacttta

SEQ ID NO: 469095 - DNA, 15 bp, Homo sapiens
tagcctctactttac

SEQ ID NO: 469096 - DNA, 15 bp, Homo sapiens
agcctctactttacc

SEQ ID NO: 469097 - DNA, 15 bp, Homo sapiens
gcctctactttacca

SEQ ID NO: 469098 - DNA, 15 bp, Homo sapiens
cctctactttaccaa

SEQ ID NO: 469099 - DNA, 15 bp, Homo sapiens
ctctactttaccaat

SEQ ID NO: 469100 - DNA, 15 bp, Homo sapiens
tctactttaccaatt

SEQ ID NO: 469101 - DNA, 15 bp, Homo sapiens
ctactttaccaatta

SEQ ID NO: 469102 - DNA, 15 bp, Homo sapiens
tactttaccaattag

SEQ ID NO: 469103 - DNA, 15 bp, Homo sapiens
actttaccaattagg

SEQ ID NO: 469104 - DNA, 15 bp, Homo sapiens
ctttaccaattagga

SEQ ID NO: 469105 - DNA, 15 bp, Homo sapiens
tttaccaattaggat

SEQ ID NO: 469106 - DNA, 15 bp, Homo sapiens
ttaccaattaggatt

SEQ ID NO: 469107 - DNA, 15 bp, Homo sapiens
taccaattaggattt

SEQ ID NO: 469108 - DNA, 15 bp, Homo sapiens
accaattaggatttg

SEQ ID NO: 469109 - DNA, 15 bp, Homo sapiens
ccaattaggatttga

SEQ ID NO: 469110 - DNA, 15 bp, Homo sapiens
caattaggatttgat

SEQ ID NO: 469111 - DNA, 15 bp, Homo sapiens
aattaggatttgatt

SEQ ID NO: 469112 - DNA, 15 bp, Homo sapiens
attaggatttgattc

SEQ ID NO: 469113 - DNA, 15 bp, Homo sapiens
ttaggatttgattct

SEQ ID NO: 469114 - DNA, 15 bp, Homo sapiens
taggatttgattcta

SEQ ID NO: 469115 - DNA, 15 bp, Homo sapiens
aggatttgattctat

SEQ ID NO: 469116 - DNA, 15 bp, Homo sapiens
ggatttgattctatg

SEQ ID NO: 469117 - DNA, 15 bp, Homo sapiens
gatttgattctatgt

SEQ ID NO: 469118 - DNA, 15 bp, Homo sapiens
atttgattctatgtt

SEQ ID NO: 469119 - DNA, 15 bp, Homo sapiens
tttgattctatgttc

SEQ ID NO: 469120 - DNA, 15 bp, Homo sapiens
ttgattctatgttcc

SEQ ID NO: 469121 - DNA, 15 bp, Homo sapiens
tgattctatgttccc

SEQ ID NO: 469122 - DNA, 15 bp, Homo sapiens
gattctatgttccct

SEQ ID NO: 469123 - DNA, 15 bp, Homo sapiens
attctatgttccctt

SEQ ID NO: 469124 - DNA, 15 bp, Homo sapiens
ttctatgttcccttg

SEQ ID NO: 469125 - DNA, 15 bp, Homo sapiens
tctatgttcccttgt

SEQ ID NO: 469126 - DNA, 15 bp, Homo sapiens
ctatgttcccttgta

SEQ ID NO: 469127 - DNA, 15 bp, Homo sapiens
tatgttcccttgtat

SEQ ID NO: 469128 - DNA, 15 bp, Homo sapiens
atgttcccttgtatc

SEQ ID NO: 469129 - DNA, 15 bp, Homo sapiens
tgttcccttgtatca

SEQ ID NO: 469130 - DNA, 15 bp, Homo sapiens
gttcccttgtatcat

SEQ ID NO: 469131 - DNA, 15 bp, Homo sapiens
ttcccttgtatcatt

SEQ ID NO: 469132 - DNA, 15 bp, Homo sapiens
tcccttgtatcattt

SEQ ID NO: 469133 - DNA, 15 bp, Homo sapiens
cccttgtatcatttt

SEQ ID NO: 469134 - DNA, 15 bp, Homo sapiens
ccttgtatcattttc

SEQ ID NO: 469135 - DNA, 15 bp, Homo sapiens
cttgtatcattttct

SEQ ID NO: 469136 - DNA, 15 bp, Homo sapiens
ttgtatcattttcta

SEQ ID NO: 469137 - DNA, 15 bp, Homo sapiens
tgtatcattttctaa

SEQ ID NO: 469138 - DNA, 15 bp, Homo sapiens
gtatcattttctaac

SEQ ID NO: 469139 - DNA, 15 bp, Homo sapiens
tatcattttctaact

SEQ ID NO: 469140 - DNA, 15 bp, Homo sapiens
atcattttctaactg

SEQ ID NO: 469141 - DNA, 15 bp, Homo sapiens
tcattttctaactgt

SEQ ID NO: 469142 - DNA, 15 bp, Homo sapiens
cattttctaactgtg

SEQ ID NO: 469143 - DNA, 15 bp, Homo sapiens
attttctaactgtgg

SEQ ID NO: 469144 - DNA, 15 bp, Homo sapiens
ttttctaactgtggt

SEQ ID NO: 469145 - DNA, 15 bp, Homo sapiens
tttctaactgtggtg

SEQ ID NO: 469146 - DNA, 15 bp, Homo sapiens
ttctaactgtggtgt

SEQ ID NO: 469147 - DNA, 15 bp, Homo sapiens
tctaactgtggtgtt

SEQ ID NO: 469148 - DNA, 15 bp, Homo sapiens
ctaactgtggtgttt

SEQ ID NO: 469149 - DNA, 15 bp, Homo sapiens
taactgtggtgtttt

SEQ ID NO: 469150 - DNA, 15 bp, Homo sapiens
aactgtggtgttttt

SEQ ID NO: 469151 - DNA, 15 bp, Homo sapiens
actgtggtgtttttg

SEQ ID NO: 469152 - DNA, 15 bp, Homo sapiens
ctgtggtgtttttgt

SEQ ID NO: 469153 - DNA, 15 bp, Homo sapiens
tgtggtgtttttgtc

SEQ ID NO: 469154 - DNA, 15 bp, Homo sapiens
gtggtgtttttgtct

SEQ ID NO: 469155 - DNA, 15 bp, Homo sapiens
tggtgtttttgtctt

SEQ ID NO: 469156 - DNA, 15 bp, Homo sapiens
ggtgtttttgtcttc

SEQ ID NO: 469157 - DNA, 15 bp, Homo sapiens
gtgtttttgtcttct

SEQ ID NO: 469158 - DNA, 15 bp, Homo sapiens
tgtttttgtcttctc

SEQ ID NO: 469159 - DNA, 15 bp, Homo sapiens
gtttttgtcttctca

SEQ ID NO: 469160 - DNA, 15 bp, Homo sapiens
tttttgtcttctcaa

SEQ ID NO: 469161 - DNA, 15 bp, Homo sapiens
ttttgtcttctcaat

SEQ ID NO: 469162 - DNA, 15 bp, Homo sapiens
tttgtcttctcaatt

SEQ ID NO: 469163 - DNA, 15 bp, Homo sapiens
ttgtcttctcaatta

SEQ ID NO: 469164 - DNA, 15 bp, Homo sapiens
tgtcttctcaattat

SEQ ID NO: 469165 - DNA, 15 bp, Homo sapiens
gtcttctcaattatc

SEQ ID NO: 469166 - DNA, 15 bp, Homo sapiens
tcttctcaattatct

SEQ ID NO: 469167 - DNA, 15 bp, Homo sapiens
cttctcaattatctt

SEQ ID NO: 469168 - DNA, 15 bp, Homo sapiens
ttctcaattatcttt

SEQ ID NO: 469169 - DNA, 15 bp, Homo sapiens
tctcaattatctttt

SEQ ID NO: 469170 - DNA, 15 bp, Homo sapiens
ctcaattatcttttt

SEQ ID NO: 469171 - DNA, 15 bp, Homo sapiens
tcaattatcttttta

SEQ ID NO: 469172 - DNA, 15 bp, Homo sapiens
caattatctttttac

SEQ ID NO: 469173 - DNA, 15 bp, Homo sapiens
aattatctttttacc

SEQ ID NO: 469174 - DNA, 15 bp, Homo sapiens
attatctttttacct

SEQ ID NO: 469175 - DNA, 15 bp, Homo sapiens
ttatctttttacctc

SEQ ID NO: 469176 - DNA, 15 bp, Homo sapiens
tatctttttacctcc

SEQ ID NO: 469177 - DNA, 15 bp, Homo sapiens
atctttttacctcct

SEQ ID NO: 469178 - DNA, 15 bp, Homo sapiens
tctttttacctcctt

SEQ ID NO: 469179 - DNA, 15 bp, Homo sapiens
ctttttacctccttg

SEQ ID NO: 469180 - DNA, 15 bp, Homo sapiens
tttttacctccttga

SEQ ID NO: 469181 - DNA, 15 bp, Homo sapiens
ttttacctccttgag

SEQ ID NO: 469182 - DNA, 15 bp, Homo sapiens
tttacctccttgagg

SEQ ID NO: 469183 - DNA, 15 bp, Homo sapiens
ttacctccttgagga

SEQ ID NO: 469184 - DNA, 15 bp, Homo sapiens
tacctccttgaggac

SEQ ID NO: 469185 - DNA, 15 bp, Homo sapiens
acctccttgaggact

SEQ ID NO: 469186 - DNA, 15 bp, Homo sapiens
cctccttgaggactg

SEQ ID NO: 469187 - DNA, 15 bp, Homo sapiens
ctccttgaggactgg

SEQ ID NO: 469188 - DNA, 15 bp, Homo sapiens
tccttgaggactggg

SEQ ID NO: 469189 - DNA, 15 bp, Homo sapiens
ccttgaggactggga

SEQ ID NO: 469190 - DNA, 15 bp, Homo sapiens
cttgaggactgggat

SEQ ID NO: 469191 - DNA, 15 bp, Homo sapiens
ttgaggactgggatg

SEQ ID NO: 469192 - DNA, 15 bp, Homo sapiens
tgaggactgggatga

SEQ ID NO: 469193 - DNA, 15 bp, Homo sapiens
gaggactgggatgac

SEQ ID NO: 469194 - DNA, 15 bp, Homo sapiens
aggactgggatgact

SEQ ID NO: 469195 - DNA, 15 bp, Homo sapiens
ggactgggatgactt

SEQ ID NO: 469196 - DNA, 15 bp, Homo sapiens
gactgggatgacttt

SEQ ID NO: 469197 - DNA, 15 bp, Homo sapiens
actgggatgactttt

SEQ ID NO: 469198 - DNA, 15 bp, Homo sapiens
ctgggatgactttta

SEQ ID NO: 469199 - DNA, 15 bp, Homo sapiens
tgggatgacttttat

SEQ ID NO: 469200 - DNA, 15 bp, Homo sapiens
gggatgacttttata

SEQ ID NO: 469201 - DNA, 15 bp, Homo sapiens
ggatgacttttatac

SEQ ID NO: 469202 - DNA, 15 bp, Homo sapiens
gatgacttttatact

SEQ ID NO: 469203 - DNA, 15 bp, Homo sapiens
atgacttttatactt

SEQ ID NO: 469204 - DNA, 15 bp, Homo sapiens
tgacttttatacttt

SEQ ID NO: 469205 - DNA, 15 bp, Homo sapiens
gacttttatactttt

SEQ ID NO: 469206 - DNA, 15 bp, Homo sapiens
acttttatacttttc

SEQ ID NO: 469207 - DNA, 15 bp, Homo sapiens
cttttatacttttct

SEQ ID NO: 469208 - DNA, 15 bp, Homo sapiens
ttttatacttttctc

SEQ ID NO: 469209 - DNA, 15 bp, Homo sapiens
tttatacttttctcc

SEQ ID NO: 469210 - DNA, 15 bp, Homo sapiens
ttatacttttctccc

SEQ ID NO: 469211 - DNA, 15 bp, Homo sapiens
tatacttttctccct

SEQ ID NO: 469212 - DNA, 15 bp, Homo sapiens
atacttttctccctg

SEQ ID NO: 469213 - DNA, 15 bp, Homo sapiens
tacttttctccctgt

SEQ ID NO: 469214 - DNA, 15 bp, Homo sapiens
acttttctccctgtg

SEQ ID NO: 469215 - DNA, 15 bp, Homo sapiens
cttttctccctgtgt

SEQ ID NO: 469216 - DNA, 15 bp, Homo sapiens
ttttctccctgtgtt

SEQ ID NO: 469217 - DNA, 15 bp, Homo sapiens
tttctccctgtgtta

SEQ ID NO: 469218 - DNA, 15 bp, Homo sapiens
ttctccctgtgttag

SEQ ID NO: 469219 - DNA, 15 bp, Homo sapiens
tctccctgtgttagt

SEQ ID NO: 469220 - DNA, 15 bp, Homo sapiens
ctccctgtgttagtt

SEQ ID NO: 469221 - DNA, 15 bp, Homo sapiens
tccctgtgttagtta

SEQ ID NO: 469222 - DNA, 15 bp, Homo sapiens
ccctgtgttagttaa

SEQ ID NO: 469223 - DNA, 15 bp, Homo sapiens
cctgtgttagttaaa

SEQ ID NO: 469224 - DNA, 15 bp, Homo sapiens
ctgtgttagttaaat

SEQ ID NO: 469225 - DNA, 15 bp, Homo sapiens
tgtgttagttaaatt

SEQ ID NO: 469226 - DNA, 15 bp, Homo sapiens
gtgttagttaaattt

SEQ ID NO: 469227 - DNA, 15 bp, Homo sapiens
tgttagttaaatttg

SEQ ID NO: 469228 - DNA, 15 bp, Homo sapiens
gttagttaaatttgc

SEQ ID NO: 469229 - DNA, 15 bp, Homo sapiens
ttagttaaatttgcc

SEQ ID NO: 469230 - DNA, 15 bp, Homo sapiens
tagttaaatttgcct

SEQ ID NO: 469231 - DNA, 15 bp, Homo sapiens
agttaaatttgcctc

SEQ ID NO: 469232 - DNA, 15 bp, Homo sapiens
gttaaatttgcctca

SEQ ID NO: 469233 - DNA, 15 bp, Homo sapiens
ttaaatttgcctcat

SEQ ID NO: 469234 - DNA, 15 bp, Homo sapiens
taaatttgcctcata

SEQ ID NO: 469235 - DNA, 15 bp, Homo sapiens
aaatttgcctcataa

SEQ ID NO: 469236 - DNA, 15 bp, Homo sapiens
aatttgcctcataaa

SEQ ID NO: 469237 - DNA, 15 bp, Homo sapiens
tttgcctcataaaag

SEQ ID NO: 469238 - DNA, 15 bp, Homo sapiens
ttgcctcataaaagc

SEQ ID NO: 469239 - DNA, 15 bp, Homo sapiens
tgcctcataaaagcc

SEQ ID NO: 469240 - DNA, 15 bp, Homo sapiens
gcctcataaaagcca

SEQ ID NO: 469241 - DNA, 15 bp, Homo sapiens
cctcataaaagccag

SEQ ID NO: 469242 - DNA, 15 bp, Homo sapiens
ctcataaaagccaga

SEQ ID NO: 469243 - DNA, 15 bp, Homo sapiens
tcataaaagccagat

SEQ ID NO: 469244 - DNA, 15 bp, Homo sapiens
cataaaagccagatg

SEQ ID NO: 469245 - DNA, 15 bp, Homo sapiens
ataaaagccagatga

SEQ ID NO: 469246 - DNA, 15 bp, Homo sapiens
taaaagccagatgag

SEQ ID NO: 469247 - DNA, 15 bp, Homo sapiens
aaaagccagatgagc

SEQ ID NO: 469248 - DNA, 15 bp, Homo sapiens
aaagccagatgagct

SEQ ID NO: 469249 - DNA, 15 bp, Homo sapiens
aagccagatgagctc

SEQ ID NO: 469250 - DNA, 15 bp, Homo sapiens
agccagatgagctcg

SEQ ID NO: 469251 - DNA, 15 bp, Homo sapiens
gccagatgagctcgt

SEQ ID NO: 469252 - DNA, 15 bp, Homo sapiens
ccagatgagctcgta

SEQ ID NO: 469253 - DNA, 15 bp, Homo sapiens
cagatgagctcgtat

SEQ ID NO: 469254 - DNA, 15 bp, Homo sapiens
agatgagctcgtatc

SEQ ID NO: 469255 - DNA, 15 bp, Homo sapiens
gatgagctcgtatct

SEQ ID NO: 469256 - DNA, 15 bp, Homo sapiens
atgagctcgtatctg

SEQ ID NO: 469257 - DNA, 15 bp, Homo sapiens
tgagctcgtatctga

SEQ ID NO: 469258 - DNA, 15 bp, Homo sapiens
gagctcgtatctgac

SEQ ID NO: 469259 - DNA, 15 bp, Homo sapiens
agctcgtatctgact

SEQ ID NO: 469260 - DNA, 15 bp, Homo sapiens
gctcgtatctgactt

SEQ ID NO: 469261 - DNA, 15 bp, Homo sapiens
ctcgtatctgacttt

SEQ ID NO: 469262 - DNA, 15 bp, Homo sapiens
tcgtatctgacttta

SEQ ID NO: 469263 - DNA, 15 bp, Homo sapiens
cgtatctgactttat

SEQ ID NO: 469264 - DNA, 15 bp, Homo sapiens
gtatctgactttata

SEQ ID NO: 469265 - DNA, 15 bp, Homo sapiens
tatctgactttataa

SEQ ID NO: 469266 - DNA, 15 bp, Homo sapiens
atctgactttataaa

SEQ ID NO: 469267 - DNA, 15 bp, Homo sapiens
tctgactttataaat

SEQ ID NO: 469268 - DNA, 15 bp, Homo sapiens
ctgactttataaata

SEQ ID NO: 469269 - DNA, 15 bp, Homo sapiens
tgactttataaatac

SEQ ID NO: 469270 - DNA, 15 bp, Homo sapiens
gactttataaatact

SEQ ID NO: 469271 - DNA, 15 bp, Homo sapiens
actttataaatacta

SEQ ID NO: 469272 - DNA, 15 bp, Homo sapiens
ctttataaatactag

SEQ ID NO: 469273 - DNA, 15 bp, Homo sapiens
tttataaatactagt

SEQ ID NO: 469274 - DNA, 15 bp, Homo sapiens
ttataaatactagtt

SEQ ID NO: 469275 - DNA, 15 bp, Homo sapiens
tataaatactagtta

SEQ ID NO: 469276 - DNA, 15 bp, Homo sapiens
ataaatactagttat

SEQ ID NO: 469277 - DNA, 15 bp, Homo sapiens
taaatactagttata

SEQ ID NO: 469278 - DNA, 15 bp, Homo sapiens
aaatactagttatag

SEQ ID NO: 469279 - DNA, 15 bp, Homo sapiens
aatactagttataga

SEQ ID NO: 469280 - DNA, 15 bp, Homo sapiens
atactagttatagaa

SEQ ID NO: 469281 - DNA, 15 bp, Homo sapiens
tactagttatagaat

SEQ ID NO: 469282 - DNA, 15 bp, Homo sapiens
actagttatagaata

SEQ ID NO: 469283 - DNA, 15 bp, Homo sapiens
ctagttatagaatat

SEQ ID NO: 469284 - DNA, 15 bp, Homo sapiens
tagttatagaatatt

SEQ ID NO: 469285 - DNA, 15 bp, Homo sapiens
agttatagaatatta

SEQ ID NO: 469286 - DNA, 15 bp, Homo sapiens
gttatagaatattaa

SEQ ID NO: 469287 - DNA, 15 bp, Homo sapiens
ttatagaatattaaa

SEQ ID NO: 469288 - DNA, 15 bp, Homo sapiens
tatagaatattaaag

SEQ ID NO: 469289 - DNA, 15 bp, Homo sapiens
atagaatattaaagc

SEQ ID NO: 469290 - DNA, 15 bp, Homo sapiens
tagaatattaaagct

SEQ ID NO: 469291 - DNA, 15 bp, Homo sapiens
agaatattaaagctg

SEQ ID NO: 469292 - DNA, 15 bp, Homo sapiens
gaatattaaagctgg

SEQ ID NO: 469293 - DNA, 15 bp, Homo sapiens
aatattaaagctgga

SEQ ID NO: 469294 - DNA, 15 bp, Homo sapiens
atattaaagctggaa

SEQ ID NO: 469295 - DNA, 15 bp, Homo sapiens
tattaaagctggaat

SEQ ID NO: 469296 - DNA, 15 bp, Homo sapiens
attaaagctggaatt

SEQ ID NO: 469297 - DNA, 15 bp, Homo sapiens
ttaaagctggaatta

SEQ ID NO: 469298 - DNA, 15 bp, Homo sapiens
taaagctggaattaa

SEQ ID NO: 469299 - DNA, 15 bp, Homo sapiens
aaagctggaattaaa

SEQ ID NO: 469300 - DNA, 15 bp, Homo sapiens
aagctggaattaaag

SEQ ID NO: 469301 - DNA, 15 bp, Homo sapiens
agctggaattaaagc

SEQ ID NO: 469302 - DNA, 15 bp, Homo sapiens
gctggaattaaagct

SEQ ID NO: 469303 - DNA, 15 bp, Homo sapiens
ctggaattaaagctc

SEQ ID NO: 469304 - DNA, 15 bp, Homo sapiens
tggaattaaagctct

SEQ ID NO: 469305 - DNA, 15 bp, Homo sapiens
ggaattaaagctcta

SEQ ID NO: 469306 - DNA, 15 bp, Homo sapiens
gaattaaagctctaa

SEQ ID NO: 469307 - DNA, 15 bp, Homo sapiens
aattaaagctctaag

SEQ ID NO: 469308 - DNA, 15 bp, Homo sapiens
attaaagctctaaga

SEQ ID NO: 469309 - DNA, 15 bp, Homo sapiens
ttaaagctctaagag

SEQ ID NO: 469310 - DNA, 15 bp, Homo sapiens
taaagctctaagaga

SEQ ID NO: 469311 - DNA, 15 bp, Homo sapiens
aaagctctaagagat

SEQ ID NO: 469312 - DNA, 15 bp, Homo sapiens
aagctctaagagatc

SEQ ID NO: 469313 - DNA, 15 bp, Homo sapiens
agctctaagagatca

SEQ ID NO: 469314 - DNA, 15 bp, Homo sapiens
gctctaagagatcat

SEQ ID NO: 469315 - DNA, 15 bp, Homo sapiens
ctctaagagatcatc

SEQ ID NO: 469316 - DNA, 15 bp, Homo sapiens
tctaagagatcatct

SEQ ID NO: 469317 - DNA, 15 bp, Homo sapiens
ctaagagatcatcta

SEQ ID NO: 469318 - DNA, 15 bp, Homo sapiens
taagagatcatctaa

SEQ ID NO: 469319 - DNA, 15 bp, Homo sapiens
aagagatcatctaac

SEQ ID NO: 469320 - DNA, 15 bp, Homo sapiens
agagatcatctaact

SEQ ID NO: 469321 - DNA, 15 bp, Homo sapiens
gagatcatctaactt

SEQ ID NO: 469322 - DNA, 15 bp, Homo sapiens
agatcatctaactta

SEQ ID NO: 469323 - DNA, 15 bp, Homo sapiens
gatcatctaacttat

SEQ ID NO: 469324 - DNA, 15 bp, Homo sapiens
atcatctaacttatc

SEQ ID NO: 469325 - DNA, 15 bp, Homo sapiens
tcatctaacttatct

SEQ ID NO: 469326 - DNA, 15 bp, Homo sapiens
catctaacttatctt

SEQ ID NO: 469327 - DNA, 15 bp, Homo sapiens
atctaacttatcttt

SEQ ID NO: 469328 - DNA, 15 bp, Homo sapiens
tctaacttatcttta

SEQ ID NO: 469329 - DNA, 15 bp, Homo sapiens
ctaacttatctttat

SEQ ID NO: 469330 - DNA, 15 bp, Homo sapiens
taacttatctttatt

SEQ ID NO: 469331 - DNA, 15 bp, Homo sapiens
aacttatctttattt

SEQ ID NO: 469332 - DNA, 15 bp, Homo sapiens
acttatctttatttt

SEQ ID NO: 469333 - DNA, 15 bp, Homo sapiens
cttatctttattttg

SEQ ID NO: 469334 - DNA, 15 bp, Homo sapiens
ttatctttattttga

SEQ ID NO: 469335 - DNA, 15 bp, Homo sapiens
tatctttattttgaa

SEQ ID NO: 469336 - DNA, 15 bp, Homo sapiens
atctttattttgaag

SEQ ID NO: 469337 - DNA, 15 bp, Homo sapiens
tctttattttgaaga

SEQ ID NO: 469338 - DNA, 15 bp, Homo sapiens
ctttattttgaagaa

SEQ ID NO: 469339 - DNA, 15 bp, Homo sapiens
tttattttgaagaaa

SEQ ID NO: 469340 - DNA, 15 bp, Homo sapiens
ttattttgaagaaaa

SEQ ID NO: 469341 - DNA, 15 bp, Homo sapiens
tattttgaagaaaaa

SEQ ID NO: 469342 - DNA, 15 bp, Homo sapiens
attttgaagaaaaaa

SEQ ID NO: 469343 - DNA, 15 bp, Homo sapiens
ttttgaagaaaaaac

SEQ ID NO: 469344 - DNA, 15 bp, Homo sapiens
tttgaagaaaaaact

SEQ ID NO: 469345 - DNA, 15 bp, Homo sapiens
ttgaagaaaaaacta

SEQ ID NO: 469346 - DNA, 15 bp, Homo sapiens
tgaagaaaaaactaa

SEQ ID NO: 469347 - DNA, 15 bp, Homo sapiens
gaagaaaaaactaag

SEQ ID NO: 469348 - DNA, 15 bp, Homo sapiens
aagaaaaaactaagt

SEQ ID NO: 469349 - DNA, 15 bp, Homo sapiens
agaaaaaactaagtc

SEQ ID NO: 469350 - DNA, 15 bp, Homo sapiens
gaaaaaactaagtct

SEQ ID NO: 469351 - DNA, 15 bp, Homo sapiens
aaaaaactaagtctt

SEQ ID NO: 469352 - DNA, 15 bp, Homo sapiens
aaaaactaagtctta

SEQ ID NO: 469353 - DNA, 15 bp, Homo sapiens
aaaactaagtcttag

SEQ ID NO: 469354 - DNA, 15 bp, Homo sapiens
aaactaagtcttaga

SEQ ID NO: 469355 - DNA, 15 bp, Homo sapiens
aactaagtcttagag

SEQ ID NO: 469356 - DNA, 15 bp, Homo sapiens
actaagtcttagaga

SEQ ID NO: 469357 - DNA, 15 bp, Homo sapiens
ctaagtcttagagaa

SEQ ID NO: 469358 - DNA, 15 bp, Homo sapiens
taagtcttagagaag

SEQ ID NO: 469359 - DNA, 15 bp, Homo sapiens
aagtcttagagaagg

SEQ ID NO: 469360 - DNA, 15 bp, Homo sapiens
agtcttagagaaggt

SEQ ID NO: 469361 - DNA, 15 bp, Homo sapiens
gtcttagagaaggta

SEQ ID NO: 469362 - DNA, 15 bp, Homo sapiens
tcttagagaaggtaa

SEQ ID NO: 469363 - DNA, 15 bp, Homo sapiens
cttagagaaggtaag

SEQ ID NO: 469364 - DNA, 15 bp, Homo sapiens
ttagagaaggtaagt

SEQ ID NO: 469365 - DNA, 15 bp, Homo sapiens
tagagaaggtaagtg

SEQ ID NO: 469366 - DNA, 15 bp, Homo sapiens
agagaaggtaagtga

SEQ ID NO: 469367 - DNA, 15 bp, Homo sapiens
gagaaggtaagtgat

SEQ ID NO: 469368 - DNA, 15 bp, Homo sapiens
agaaggtaagtgatt

SEQ ID NO: 469369 - DNA, 15 bp, Homo sapiens
gaaggtaagtgattt

SEQ ID NO: 469370 - DNA, 15 bp, Homo sapiens
aaggtaagtgatttg

SEQ ID NO: 469371 - DNA, 15 bp, Homo sapiens
aggtaagtgatttgt

SEQ ID NO: 469372 - DNA, 15 bp, Homo sapiens
ggtaagtgatttgtg

SEQ ID NO: 469373 - DNA, 15 bp, Homo sapiens
gtaagtgatttgtgc

SEQ ID NO: 469374 - DNA, 15 bp, Homo sapiens
taagtgatttgtgca

SEQ ID NO: 469375 - DNA, 15 bp, Homo sapiens
aagtgatttgtgcaa

SEQ ID NO: 469376 - DNA, 15 bp, Homo sapiens
agtgatttgtgcaaa

SEQ ID NO: 469377 - DNA, 15 bp, Homo sapiens
gtgatttgtgcaaag

SEQ ID NO: 469378 - DNA, 15 bp, Homo sapiens
tgatttgtgcaaagt

SEQ ID NO: 469379 - DNA, 15 bp, Homo sapiens
gatttgtgcaaagtt

SEQ ID NO: 469380 - DNA, 15 bp, Homo sapiens
atttgtgcaaagtta

SEQ ID NO: 469381 - DNA, 15 bp, Homo sapiens
tttgtgcaaagttaa

SEQ ID NO: 469382 - DNA, 15 bp, Homo sapiens
ttgtgcaaagttaat

SEQ ID NO: 469383 - DNA, 15 bp, Homo sapiens
tgtgcaaagttaatg

SEQ ID NO: 469384 - DNA, 15 bp, Homo sapiens
gtgcaaagttaatgg

SEQ ID NO: 469385 - DNA, 15 bp, Homo sapiens
tgcaaagttaatggt

SEQ ID NO: 469386 - DNA, 15 bp, Homo sapiens
gcaaagttaatggta

SEQ ID NO: 469387 - DNA, 15 bp, Homo sapiens
caaagttaatggtat

SEQ ID NO: 469388 - DNA, 15 bp, Homo sapiens
aaagttaatggtatg

SEQ ID NO: 469389 - DNA, 15 bp, Homo sapiens
aagttaatggtatgg

SEQ ID NO: 469390 - DNA, 15 bp, Homo sapiens
agttaatggtatgga

SEQ ID NO: 469391 - DNA, 15 bp, Homo sapiens
gttaatggtatggat

SEQ ID NO: 469392 - DNA, 15 bp, Homo sapiens
ttaatggtatggatt

SEQ ID NO: 469393 - DNA, 15 bp, Homo sapiens
taatggtatggattt

SEQ ID NO: 469394 - DNA, 15 bp, Homo sapiens
aatggtatggattta

SEQ ID NO: 469395 - DNA, 15 bp, Homo sapiens
atggtatggatttag

SEQ ID NO: 469396 - DNA, 15 bp, Homo sapiens
tggtatggatttagt

SEQ ID NO: 469397 - DNA, 15 bp, Homo sapiens
ggtatggatttagtg

SEQ ID NO: 469398 - DNA, 15 bp, Homo sapiens
gtatggatttagtga

SEQ ID NO: 469399 - DNA, 15 bp, Homo sapiens
tatggatttagtgac

SEQ ID NO: 469400 - DNA, 15 bp, Homo sapiens
atggatttagtgact

SEQ ID NO: 469401 - DNA, 15 bp, Homo sapiens
tggatttagtgactt

SEQ ID NO: 469402 - DNA, 15 bp, Homo sapiens
ggatttagtgactta

SEQ ID NO: 469403 - DNA, 15 bp, Homo sapiens
gatttagtgacttaa

SEQ ID NO: 469404 - DNA, 15 bp, Homo sapiens
atttagtgacttaac

SEQ ID NO: 469405 - DNA, 15 bp, Homo sapiens
tttagtgacttaact

SEQ ID NO: 469406 - DNA, 15 bp, Homo sapiens
ttagtgacttaactc

SEQ ID NO: 469407 - DNA, 15 bp, Homo sapiens
tagtgacttaactcc

SEQ ID NO: 469408 - DNA, 15 bp, Homo sapiens
agtgacttaactcca

SEQ ID NO: 469409 - DNA, 15 bp, Homo sapiens
gtgacttaactccat

SEQ ID NO: 469410 - DNA, 15 bp, Homo sapiens
tgacttaactccatt

SEQ ID NO: 469411 - DNA, 15 bp, Homo sapiens
gacttaactccatta

SEQ ID NO: 469412 - DNA, 15 bp, Homo sapiens
acttaactccattag

SEQ ID NO: 469413 - DNA, 15 bp, Homo sapiens
cttaactccattagg

SEQ ID NO: 469414 - DNA, 15 bp, Homo sapiens
ttaactccattaggg

SEQ ID NO: 469415 - DNA, 15 bp, Homo sapiens
taactccattaggga

SEQ ID NO: 469416 - DNA, 15 bp, Homo sapiens
aactccattagggaa

SEQ ID NO: 469417 - DNA, 15 bp, Homo sapiens
actccattagggaaa

SEQ ID NO: 469418 - DNA, 15 bp, Homo sapiens
ctccattagggaaat

SEQ ID NO: 469419 - DNA, 15 bp, Homo sapiens
tccattagggaaata

SEQ ID NO: 469420 - DNA, 15 bp, Homo sapiens
ccattagggaaatac

SEQ ID NO: 469421 - DNA, 15 bp, Homo sapiens
cattagggaaataca

SEQ ID NO: 469422 - DNA, 15 bp, Homo sapiens
attagggaaatacac

SEQ ID NO: 469423 - DNA, 15 bp, Homo sapiens
ttagggaaatacaca

SEQ ID NO: 469424 - DNA, 15 bp, Homo sapiens
tagggaaatacacac

SEQ ID NO: 469425 - DNA, 15 bp, Homo sapiens
agggaaatacacaca

SEQ ID NO: 469426 - DNA, 15 bp, Homo sapiens
gggaaatacacacac

SEQ ID NO: 469427 - DNA, 15 bp, Homo sapiens
ggaaatacacacaca

SEQ ID NO: 469428 - DNA, 15 bp, Homo sapiens
gaaatacacacacac

SEQ ID NO: 469429 - DNA, 15 bp, Homo sapiens
aaatacacacacaca

SEQ ID NO: 469430 - DNA, 15 bp, Homo sapiens
aatacacacacacac

SEQ ID NO: 469431 - DNA, 15 bp, Homo sapiens
cacacacacacgcag

SEQ ID NO: 469432 - DNA, 15 bp, Homo sapiens
acacacacacgcagt

SEQ ID NO: 469433 - DNA, 15 bp, Homo sapiens
cacacacacgcagtt

SEQ ID NO: 469434 - DNA, 15 bp, Homo sapiens
acacacacgcagtta

SEQ ID NO: 469435 - DNA, 15 bp, Homo sapiens
cacacacgcagttag

SEQ ID NO: 469436 - DNA, 15 bp, Homo sapiens
acacacgcagttagc

SEQ ID NO: 469437 - DNA, 15 bp, Homo sapiens
cacacgcagttagca

SEQ ID NO: 469438 - DNA, 15 bp, Homo sapiens
acacgcagttagcac

SEQ ID NO: 469439 - DNA, 15 bp, Homo sapiens
cacgcagttagcaca

SEQ ID NO: 469440 - DNA, 15 bp, Homo sapiens
acgcagttagcacat

SEQ ID NO: 469441 - DNA, 15 bp, Homo sapiens
cgcagttagcacatt

SEQ ID NO: 469442 - DNA, 15 bp, Homo sapiens
gcagttagcacattg

SEQ ID NO: 469443 - DNA, 15 bp, Homo sapiens
cagttagcacattgg

SEQ ID NO: 469444 - DNA, 15 bp, Homo sapiens
agttagcacattgga

SEQ ID NO: 469445 - DNA, 15 bp, Homo sapiens
gttagcacattggaa

SEQ ID NO: 469446 - DNA, 15 bp, Homo sapiens
ttagcacattggaaa

SEQ ID NO: 469447 - DNA, 15 bp, Homo sapiens
tagcacattggaaaa

SEQ ID NO: 469448 - DNA, 15 bp, Homo sapiens
agcacattggaaaat

SEQ ID NO: 469449 - DNA, 15 bp, Homo sapiens
gcacattggaaaata

SEQ ID NO: 469450 - DNA, 15 bp, Homo sapiens
cacattggaaaatag

SEQ ID NO: 469451 - DNA, 15 bp, Homo sapiens
acattggaaaatagg

SEQ ID NO: 469452 - DNA, 15 bp, Homo sapiens
cattggaaaataggg

SEQ ID NO: 469453 - DNA, 15 bp, Homo sapiens
attggaaaatagggg

SEQ ID NO: 469454 - DNA, 15 bp, Homo sapiens
ttggaaaataggggt

SEQ ID NO: 469455 - DNA, 15 bp, Homo sapiens
tggaaaataggggtt

SEQ ID NO: 469456 - DNA, 15 bp, Homo sapiens
ggaaaataggggttt

SEQ ID NO: 469457 - DNA, 15 bp, Homo sapiens
gaaaataggggtttg

SEQ ID NO: 469458 - DNA, 15 bp, Homo sapiens
aaaataggggtttgt

SEQ ID NO: 469459 - DNA, 15 bp, Homo sapiens
aaataggggtttgtg

SEQ ID NO: 469460 - DNA, 15 bp, Homo sapiens
aataggggtttgtgt

SEQ ID NO: 469461 - DNA, 15 bp, Homo sapiens
ataggggtttgtgta

SEQ ID NO: 469462 - DNA, 15 bp, Homo sapiens
taggggtttgtgtat

SEQ ID NO: 469463 - DNA, 15 bp, Homo sapiens
aggggtttgtgtata

SEQ ID NO: 469464 - DNA, 15 bp, Homo sapiens
ggggtttgtgtatat

SEQ ID NO: 469465 - DNA, 15 bp, Homo sapiens
gggtttgtgtatatc

SEQ ID NO: 469466 - DNA, 15 bp, Homo sapiens
ggtttgtgtatatcc

SEQ ID NO: 469467 - DNA, 15 bp, Homo sapiens
gtttgtgtatatcct

SEQ ID NO: 469468 - DNA, 15 bp, Homo sapiens
tttgtgtatatcctt

SEQ ID NO: 469469 - DNA, 15 bp, Homo sapiens
ttgtgtatatccttg

SEQ ID NO: 469470 - DNA, 15 bp, Homo sapiens
tgtgtatatccttgc

SEQ ID NO: 469471 - DNA, 15 bp, Homo sapiens
gtgtatatccttgct

SEQ ID NO: 469472 - DNA, 15 bp, Homo sapiens
tgtatatccttgctg

SEQ ID NO: 469473 - DNA, 15 bp, Homo sapiens
gtatatccttgctgg

SEQ ID NO: 469474 - DNA, 15 bp, Homo sapiens
tatatccttgctgga

SEQ ID NO: 469475 - DNA, 15 bp, Homo sapiens
atatccttgctggaa

SEQ ID NO: 469476 - DNA, 15 bp, Homo sapiens
tatccttgctggaat

SEQ ID NO: 469477 - DNA, 15 bp, Homo sapiens
atccttgctggaata

SEQ ID NO: 469478 - DNA, 15 bp, Homo sapiens
tccttgctggaatat

SEQ ID NO: 469479 - DNA, 15 bp, Homo sapiens
ccttgctggaatatt

SEQ ID NO: 469480 - DNA, 15 bp, Homo sapiens
cttgctggaatatta

SEQ ID NO: 469481 - DNA, 15 bp, Homo sapiens
ttgctggaatattat

SEQ ID NO: 469482 - DNA, 15 bp, Homo sapiens
tgctggaatattatg

SEQ ID NO: 469483 - DNA, 15 bp, Homo sapiens
gctggaatattatgt

SEQ ID NO: 469484 - DNA, 15 bp, Homo sapiens
ctggaatattatgtt

SEQ ID NO: 469485 - DNA, 15 bp, Homo sapiens
tggaatattatgttt

SEQ ID NO: 469486 - DNA, 15 bp, Homo sapiens
ggaatattatgtttg

SEQ ID NO: 469487 - DNA, 15 bp, Homo sapiens
gaatattatgtttgt

SEQ ID NO: 469488 - DNA, 15 bp, Homo sapiens
aatattatgtttgtt

SEQ ID NO: 469489 - DNA, 15 bp, Homo sapiens
atattatgtttgttg

SEQ ID NO: 469490 - DNA, 15 bp, Homo sapiens
tattatgtttgttga

SEQ ID NO: 469491 - DNA, 15 bp, Homo sapiens
attatgtttgttgaa

SEQ ID NO: 469492 - DNA, 15 bp, Homo sapiens
ttatgtttgttgaat

SEQ ID NO: 469493 - DNA, 15 bp, Homo sapiens
tatgtttgttgaata

SEQ ID NO: 469494 - DNA, 15 bp, Homo sapiens
atgtttgttgaatac

SEQ ID NO: 469495 - DNA, 15 bp, Homo sapiens
tgtttgttgaatacc

SEQ ID NO: 469496 - DNA, 15 bp, Homo sapiens
gtttgttgaataccc

SEQ ID NO: 469497 - DNA, 15 bp, Homo sapiens
tttgttgaataccct

SEQ ID NO: 469498 - DNA, 15 bp, Homo sapiens
ttgttgaataccctt

SEQ ID NO: 469499 - DNA, 15 bp, Homo sapiens
tgttgaatacccttt

SEQ ID NO: 469500 - DNA, 15 bp, Homo sapiens
gttgaataccctttt

SEQ ID NO: 469501 - DNA, 15 bp, Homo sapiens
ttgaataccctttta

SEQ ID NO: 469502 - DNA, 15 bp, Homo sapiens
tgaatacccttttac

SEQ ID NO: 469503 - DNA, 15 bp, Homo sapiens
gaatacccttttaca

SEQ ID NO: 469504 - DNA, 15 bp, Homo sapiens
aatacccttttacat

SEQ ID NO: 469505 - DNA, 15 bp, Homo sapiens
atacccttttacata

SEQ ID NO: 469506 - DNA, 15 bp, Homo sapiens
tacccttttacatac

SEQ ID NO: 469507 - DNA, 15 bp, Homo sapiens
acccttttacatacc

SEQ ID NO: 469508 - DNA, 15 bp, Homo sapiens
cccttttacatacca

SEQ ID NO: 469509 - DNA, 15 bp, Homo sapiens
ccttttacataccag

SEQ ID NO: 469510 - DNA, 15 bp, Homo sapiens
cttttacataccagg

SEQ ID NO: 469511 - DNA, 15 bp, Homo sapiens
ttttacataccaggc

SEQ ID NO: 469512 - DNA, 15 bp, Homo sapiens
tttacataccaggca

SEQ ID NO: 469513 - DNA, 15 bp, Homo sapiens
ttacataccaggcat

SEQ ID NO: 469514 - DNA, 15 bp, Homo sapiens
tacataccaggcatt

SEQ ID NO: 469515 - DNA, 15 bp, Homo sapiens
acataccaggcattt

SEQ ID NO: 469516 - DNA, 15 bp, Homo sapiens
cataccaggcatttt

SEQ ID NO: 469517 - DNA, 15 bp, Homo sapiens
ataccaggcattttg

SEQ ID NO: 469518 - DNA, 15 bp, Homo sapiens
taccaggcattttgc

SEQ ID NO: 469519 - DNA, 15 bp, Homo sapiens
accaggcattttgct

SEQ ID NO: 469520 - DNA, 15 bp, Homo sapiens
ccaggcattttgcta

SEQ ID NO: 469521 - DNA, 15 bp, Homo sapiens
caggcattttgctag

SEQ ID NO: 469522 - DNA, 15 bp, Homo sapiens
aggcattttgctagg

SEQ ID NO: 469523 - DNA, 15 bp, Homo sapiens
ggcattttgctagga

SEQ ID NO: 469524 - DNA, 15 bp, Homo sapiens
gcattttgctaggag

SEQ ID NO: 469525 - DNA, 15 bp, Homo sapiens
cattttgctaggagt

SEQ ID NO: 469526 - DNA, 15 bp, Homo sapiens
attttgctaggagtt

SEQ ID NO: 469527 - DNA, 15 bp, Homo sapiens
ttttgctaggagttg

SEQ ID NO: 469528 - DNA, 15 bp, Homo sapiens
tttgctaggagttgg

SEQ ID NO: 469529 - DNA, 15 bp, Homo sapiens
ttgctaggagttgga

SEQ ID NO: 469530 - DNA, 15 bp, Homo sapiens
tgctaggagttggaa

SEQ ID NO: 469531 - DNA, 15 bp, Homo sapiens
gctaggagttggaaa

SEQ ID NO: 469532 - DNA, 15 bp, Homo sapiens
ctaggagttggaaat

SEQ ID NO: 469533 - DNA, 15 bp, Homo sapiens
taggagttggaaata

SEQ ID NO: 469534 - DNA, 15 bp, Homo sapiens
aggagttggaaatag

SEQ ID NO: 469535 - DNA, 15 bp, Homo sapiens
ggagttggaaataga

SEQ ID NO: 469536 - DNA, 15 bp, Homo sapiens
gagttggaaatagag

SEQ ID NO: 469537 - DNA, 15 bp, Homo sapiens
agttggaaatagaga

SEQ ID NO: 469538 - DNA, 15 bp, Homo sapiens
gttggaaatagagag

SEQ ID NO: 469539 - DNA, 15 bp, Homo sapiens
ttggaaatagagaga

SEQ ID NO: 469540 - DNA, 15 bp, Homo sapiens
tggaaatagagagaa

SEQ ID NO: 469541 - DNA, 15 bp, Homo sapiens
ggaaatagagagaaa

SEQ ID NO: 469542 - DNA, 15 bp, Homo sapiens
gaaatagagagaaaa

SEQ ID NO: 469543 - DNA, 15 bp, Homo sapiens
aaatagagagaaaat

SEQ ID NO: 469544 - DNA, 15 bp, Homo sapiens
aatagagagaaaatt

SEQ ID NO: 469545 - DNA, 15 bp, Homo sapiens
atagagagaaaattt

SEQ ID NO: 469546 - DNA, 15 bp, Homo sapiens
tagagagaaaatttc

SEQ ID NO: 469547 - DNA, 15 bp, Homo sapiens
agagagaaaatttca

SEQ ID NO: 469548 - DNA, 15 bp, Homo sapiens
gagagaaaatttcat

SEQ ID NO: 469549 - DNA, 15 bp, Homo sapiens
agagaaaatttcatg

SEQ ID NO: 469550 - DNA, 15 bp, Homo sapiens
gagaaaatttcatga

SEQ ID NO: 469551 - DNA, 15 bp, Homo sapiens
agaaaatttcatgaa

SEQ ID NO: 469552 - DNA, 15 bp, Homo sapiens
gaaaatttcatgaag

SEQ ID NO: 469553 - DNA, 15 bp, Homo sapiens
aaaatttcatgaagg

SEQ ID NO: 469554 - DNA, 15 bp, Homo sapiens
aaatttcatgaagga

SEQ ID NO: 469555 - DNA, 15 bp, Homo sapiens
aatttcatgaaggag

SEQ ID NO: 469556 - DNA, 15 bp, Homo sapiens
atttcatgaaggaga

SEQ ID NO: 469557 - DNA, 15 bp, Homo sapiens
tttcatgaaggagaa

SEQ ID NO: 469558 - DNA, 15 bp, Homo sapiens
ttcatgaaggagaaa

SEQ ID NO: 469559 - DNA, 15 bp, Homo sapiens
tcatgaaggagaaaa

SEQ ID NO: 469560 - DNA, 15 bp, Homo sapiens
catgaaggagaaaaa

SEQ ID NO: 469561 - DNA, 15 bp, Homo sapiens
atgaaggagaaaaaa

SEQ ID NO: 469562 - DNA, 15 bp, Homo sapiens
tgaaggagaaaaaat

SEQ ID NO: 469563 - DNA, 15 bp, Homo sapiens
gaaggagaaaaaata

SEQ ID NO: 469564 - DNA, 15 bp, Homo sapiens
aaggagaaaaaatac

SEQ ID NO: 469565 - DNA, 15 bp, Homo sapiens
aggagaaaaaatacc

SEQ ID NO: 469566 - DNA, 15 bp, Homo sapiens
ggagaaaaaatacct

SEQ ID NO: 469567 - DNA, 15 bp, Homo sapiens
gagaaaaaatacctc

SEQ ID NO: 469568 - DNA, 15 bp, Homo sapiens
agaaaaaatacctct

SEQ ID NO: 469569 - DNA, 15 bp, Homo sapiens
gaaaaaatacctcta

SEQ ID NO: 469570 - DNA, 15 bp, Homo sapiens
aaaaaatacctctat

SEQ ID NO: 469571 - DNA, 15 bp, Homo sapiens
aaaaatacctctatg

SEQ ID NO: 469572 - DNA, 15 bp, Homo sapiens
aaaatacctctatgt

SEQ ID NO: 469573 - DNA, 15 bp, Homo sapiens
aaatacctctatgtg

SEQ ID NO: 469574 - DNA, 15 bp, Homo sapiens
aatacctctatgtgg

SEQ ID NO: 469575 - DNA, 15 bp, Homo sapiens
atacctctatgtgga

SEQ ID NO: 469576 - DNA, 15 bp, Homo sapiens
tacctctatgtggag

SEQ ID NO: 469577 - DNA, 15 bp, Homo sapiens
acctctatgtggaga

SEQ ID NO: 469578 - DNA, 15 bp, Homo sapiens
cctctatgtggagaa

SEQ ID NO: 469579 - DNA, 15 bp, Homo sapiens
ctctatgtggagaaa

SEQ ID NO: 469580 - DNA, 15 bp, Homo sapiens
tctatgtggagaaat

SEQ ID NO: 469581 - DNA, 15 bp, Homo sapiens
ctatgtggagaaatt

SEQ ID NO: 469582 - DNA, 15 bp, Homo sapiens
tatgtggagaaattc

SEQ ID NO: 469583 - DNA, 15 bp, Homo sapiens
atgtggagaaattca

SEQ ID NO: 469584 - DNA, 15 bp, Homo sapiens
tgtggagaaattcaa

SEQ ID NO: 469585 - DNA, 15 bp, Homo sapiens
gtggagaaattcaac

SEQ ID NO: 469586 - DNA, 15 bp, Homo sapiens
tggagaaattcaaca

SEQ ID NO: 469587 - DNA, 15 bp, Homo sapiens
ggagaaattcaacaa

SEQ ID NO: 469588 - DNA, 15 bp, Homo sapiens
gagaaattcaacaag

SEQ ID NO: 469589 - DNA, 15 bp, Homo sapiens
agaaattcaacaaga

SEQ ID NO: 469590 - DNA, 15 bp, Homo sapiens
gaaattcaacaagac

SEQ ID NO: 469591 - DNA, 15 bp, Homo sapiens
aaattcaacaagact

SEQ ID NO: 469592 - DNA, 15 bp, Homo sapiens
aattcaacaagactg

SEQ ID NO: 469593 - DNA, 15 bp, Homo sapiens
attcaacaagactgt

SEQ ID NO: 469594 - DNA, 15 bp, Homo sapiens
ttcaacaagactgta

SEQ ID NO: 469595 - DNA, 15 bp, Homo sapiens
tcaacaagactgtaa

SEQ ID NO: 469596 - DNA, 15 bp, Homo sapiens
caacaagactgtaat

SEQ ID NO: 469597 - DNA, 15 bp, Homo sapiens
aacaagactgtaata

SEQ ID NO: 469598 - DNA, 15 bp, Homo sapiens
acaagactgtaatat

SEQ ID NO: 469599 - DNA, 15 bp, Homo sapiens
caagactgtaatatt

SEQ ID NO: 469600 - DNA, 15 bp, Homo sapiens
aagactgtaatattt

SEQ ID NO: 469601 - DNA, 15 bp, Homo sapiens
agactgtaatatttt

SEQ ID NO: 469602 - DNA, 15 bp, Homo sapiens
gactgtaatattttt

SEQ ID NO: 469603 - DNA, 15 bp, Homo sapiens
actgtaatatttttt

SEQ ID NO: 469604 - DNA, 15 bp, Homo sapiens
ctgtaatatttttta

SEQ ID NO: 469605 - DNA, 15 bp, Homo sapiens
gtaatattttttaga

SEQ ID NO: 469606 - DNA, 15 bp, Homo sapiens
taatattttttagaa

SEQ ID NO: 469607 - DNA, 15 bp, Homo sapiens
aatattttttagaat

SEQ ID NO: 469608 - DNA, 15 bp, Homo sapiens
atattttttagaatg

SEQ ID NO: 469609 - DNA, 15 bp, Homo sapiens
tattttttagaatga

SEQ ID NO: 469610 - DNA, 15 bp, Homo sapiens
attttttagaatgat

SEQ ID NO: 469611 - DNA, 15 bp, Homo sapiens
ttttttagaatgatt

SEQ ID NO: 469612 - DNA, 15 bp, Homo sapiens
tttttagaatgatta

SEQ ID NO: 469613 - DNA, 15 bp, Homo sapiens
ttttagaatgattaa

SEQ ID NO: 469614 - DNA, 15 bp, Homo sapiens
tttagaatgattaag

SEQ ID NO: 469615 - DNA, 15 bp, Homo sapiens
ttagaatgattaagc

SEQ ID NO: 469616 - DNA, 15 bp, Homo sapiens
tagaatgattaagct

SEQ ID NO: 469617 - DNA, 15 bp, Homo sapiens
agaatgattaagctt

SEQ ID NO: 469618 - DNA, 15 bp, Homo sapiens
gaatgattaagctta

SEQ ID NO: 469619 - DNA, 15 bp, Homo sapiens
aatgattaagcttat

SEQ ID NO: 469620 - DNA, 15 bp, Homo sapiens
atgattaagcttatg

SEQ ID NO: 469621 - DNA, 15 bp, Homo sapiens
tgattaagcttatga

SEQ ID NO: 469622 - DNA, 15 bp, Homo sapiens
gattaagcttatgaa

SEQ ID NO: 469623 - DNA, 15 bp, Homo sapiens
attaagcttatgaat

SEQ ID NO: 469624 - DNA, 15 bp, Homo sapiens
ttaagcttatgaatc

SEQ ID NO: 469625 - DNA, 15 bp, Homo sapiens
taagcttatgaatca

SEQ ID NO: 469626 - DNA, 15 bp, Homo sapiens
aagcttatgaatcaa

SEQ ID NO: 469627 - DNA, 15 bp, Homo sapiens
agcttatgaatcaag

SEQ ID NO: 469628 - DNA, 15 bp, Homo sapiens
gcttatgaatcaaga

SEQ ID NO: 469629 - DNA, 15 bp, Homo sapiens
cttatgaatcaagag

SEQ ID NO: 469630 - DNA, 15 bp, Homo sapiens
ttatgaatcaagaga

SEQ ID NO: 469631 - DNA, 15 bp, Homo sapiens
tatgaatcaagagag

SEQ ID NO: 469632 - DNA, 15 bp, Homo sapiens
atgaatcaagagagt

SEQ ID NO: 469633 - DNA, 15 bp, Homo sapiens
tgaatcaagagagta

SEQ ID NO: 469634 - DNA, 15 bp, Homo sapiens
gaatcaagagagtag

SEQ ID NO: 469635 - DNA, 15 bp, Homo sapiens
aatcaagagagtagt

SEQ ID NO: 469636 - DNA, 15 bp, Homo sapiens
atcaagagagtagtc

SEQ ID NO: 469637 - DNA, 15 bp, Homo sapiens
tcaagagagtagtca

SEQ ID NO: 469638 - DNA, 15 bp, Homo sapiens
caagagagtagtcaa

SEQ ID NO: 469639 - DNA, 15 bp, Homo sapiens
aagagagtagtcaat

SEQ ID NO: 469640 - DNA, 15 bp, Homo sapiens
agagagtagtcaatt

SEQ ID NO: 469641 - DNA, 15 bp, Homo sapiens
gagagtagtcaattt

SEQ ID NO: 469642 - DNA, 15 bp, Homo sapiens
agagtagtcaatttt

SEQ ID NO: 469643 - DNA, 15 bp, Homo sapiens
gagtagtcaattttt

SEQ ID NO: 469644 - DNA, 15 bp, Homo sapiens
agtagtcaatttttt

SEQ ID NO: 469645 - DNA, 15 bp, Homo sapiens
gtagtcaattttttt

SEQ ID NO: 469646 - DNA, 15 bp, Homo sapiens
tagtcaatttttttt

SEQ ID NO: 469647 - DNA, 15 bp, Homo sapiens
agtcaattttttttt

SEQ ID NO: 469648 - DNA, 15 bp, Homo sapiens
gtcaatttttttttg

SEQ ID NO: 469649 - DNA, 15 bp, Homo sapiens
tcaatttttttttgt

SEQ ID NO: 469650 - DNA, 15 bp, Homo sapiens
caatttttttttgta

SEQ ID NO: 469651 - DNA, 15 bp, Homo sapiens
tttttttttgtatta

SEQ ID NO: 469652 - DNA, 15 bp, Homo sapiens
ttttttttgtattat

SEQ ID NO: 469653 - DNA, 15 bp, Homo sapiens
tttttttgtattatc

SEQ ID NO: 469654 - DNA, 15 bp, Homo sapiens
ttttttgtattatcc

SEQ ID NO: 469655 - DNA, 15 bp, Homo sapiens
tttttgtattatcca

SEQ ID NO: 469656 - DNA, 15 bp, Homo sapiens
ttttgtattatccat

SEQ ID NO: 469657 - DNA, 15 bp, Homo sapiens
tttgtattatccatg

SEQ ID NO: 469658 - DNA, 15 bp, Homo sapiens
ttgtattatccatgc

SEQ ID NO: 469659 - DNA, 15 bp, Homo sapiens
tgtattatccatgca

SEQ ID NO: 469660 - DNA, 15 bp, Homo sapiens
gtattatccatgcat

SEQ ID NO: 469661 - DNA, 15 bp, Homo sapiens
tattatccatgcatt

SEQ ID NO: 469662 - DNA, 15 bp, Homo sapiens
attatccatgcatta

SEQ ID NO: 469663 - DNA, 15 bp, Homo sapiens
ttatccatgcattaa

SEQ ID NO: 469664 - DNA, 15 bp, Homo sapiens
tatccatgcattaaa

SEQ ID NO: 469665 - DNA, 15 bp, Homo sapiens
atccatgcattaaac

SEQ ID NO: 469666 - DNA, 15 bp, Homo sapiens
tccatgcattaaacc

SEQ ID NO: 469667 - DNA, 15 bp, Homo sapiens
ccatgcattaaacct

SEQ ID NO: 469668 - DNA, 15 bp, Homo sapiens
catgcattaaacctt

SEQ ID NO: 469669 - DNA, 15 bp, Homo sapiens
atgcattaaaccttt

SEQ ID NO: 469670 - DNA, 15 bp, Homo sapiens
tgcattaaacctttg

SEQ ID NO: 469671 - DNA, 15 bp, Homo sapiens
gcattaaacctttga

SEQ ID NO: 469672 - DNA, 15 bp, Homo sapiens
cattaaacctttgaa

SEQ ID NO: 469673 - DNA, 15 bp, Homo sapiens
attaaacctttgaat

SEQ ID NO: 469674 - DNA, 15 bp, Homo sapiens
ttaaacctttgaatt

SEQ ID NO: 469675 - DNA, 15 bp, Homo sapiens
taaacctttgaattc

SEQ ID NO: 469676 - DNA, 15 bp, Homo sapiens
aaacctttgaattca

SEQ ID NO: 469677 - DNA, 15 bp, Homo sapiens
aacctttgaattcag

SEQ ID NO: 469678 - DNA, 15 bp, Homo sapiens
acctttgaattcagg

SEQ ID NO: 469679 - DNA, 15 bp, Homo sapiens
cctttgaattcaggg

SEQ ID NO: 469680 - DNA, 15 bp, Homo sapiens
ctttgaattcaggga

SEQ ID NO: 469681 - DNA, 15 bp, Homo sapiens
tttgaattcagggat

SEQ ID NO: 469682 - DNA, 15 bp, Homo sapiens
ttgaattcagggatt

SEQ ID NO: 469683 - DNA, 15 bp, Homo sapiens
tgaattcagggatta

SEQ ID NO: 469684 - DNA, 15 bp, Homo sapiens
gaattcagggattat

SEQ ID NO: 469685 - DNA, 15 bp, Homo sapiens
aattcagggattatc

SEQ ID NO: 469686 - DNA, 15 bp, Homo sapiens
attcagggattatca

SEQ ID NO: 469687 - DNA, 15 bp, Homo sapiens
ttcagggattatcat

SEQ ID NO: 469688 - DNA, 15 bp, Homo sapiens
tcagggattatcatt

SEQ ID NO: 469689 - DNA, 15 bp, Homo sapiens
cagggattatcattt

SEQ ID NO: 469690 - DNA, 15 bp, Homo sapiens
agggattatcatttt

SEQ ID NO: 469691 - DNA, 15 bp, Homo sapiens
gggattatcattttt

SEQ ID NO: 469692 - DNA, 15 bp, Homo sapiens
ggattatcatttttt

SEQ ID NO: 469693 - DNA, 15 bp, Homo sapiens
attatcattttttaa

SEQ ID NO: 469694 - DNA, 15 bp, Homo sapiens
ttatcattttttaaa

SEQ ID NO: 469695 - DNA, 15 bp, Homo sapiens
tatcattttttaaat

SEQ ID NO: 469696 - DNA, 15 bp, Homo sapiens
atcattttttaaata

SEQ ID NO: 469697 - DNA, 15 bp, Homo sapiens
tcattttttaaataa

SEQ ID NO: 469698 - DNA, 15 bp, Homo sapiens
cattttttaaataaa

SEQ ID NO: 469699 - DNA, 15 bp, Homo sapiens
attttttaaataaat

SEQ ID NO: 469700 - DNA, 15 bp, Homo sapiens
ttttttaaataaata

SEQ ID NO: 469701 - DNA, 15 bp, Homo sapiens
tttttaaataaatag

SEQ ID NO: 469702 - DNA, 15 bp, Homo sapiens
ttttaaataaatagt

SEQ ID NO: 469703 - DNA, 15 bp, Homo sapiens
tttaaataaatagtt

SEQ ID NO: 469704 - DNA, 15 bp, Homo sapiens
ttaaataaatagtta

SEQ ID NO: 469705 - DNA, 15 bp, Homo sapiens
taaataaatagttat

SEQ ID NO: 469706 - DNA, 15 bp, Homo sapiens
aaataaatagttata

SEQ ID NO: 469707 - DNA, 15 bp, Homo sapiens
aataaatagttatat

SEQ ID NO: 469708 - DNA, 15 bp, Homo sapiens
ataaatagttatatc

SEQ ID NO: 469709 - DNA, 15 bp, Homo sapiens
taaatagttatatct

SEQ ID NO: 469710 - DNA, 15 bp, Homo sapiens
aaatagttatatctt

SEQ ID NO: 469711 - DNA, 15 bp, Homo sapiens
aatagttatatctta

SEQ ID NO: 469712 - DNA, 15 bp, Homo sapiens
atagttatatcttat

SEQ ID NO: 469713 - DNA, 15 bp, Homo sapiens
tagttatatcttata

SEQ ID NO: 469714 - DNA, 15 bp, Homo sapiens
agttatatcttatat

SEQ ID NO: 469715 - DNA, 15 bp, Homo sapiens
gttatatcttatatt

SEQ ID NO: 469716 - DNA, 15 bp, Homo sapiens
ttatatcttatatta

SEQ ID NO: 469717 - DNA, 15 bp, Homo sapiens
tatatcttatattaa

SEQ ID NO: 469718 - DNA, 15 bp, Homo sapiens
atatcttatattaaa

SEQ ID NO: 469719 - DNA, 15 bp, Homo sapiens
tatcttatattaaag

SEQ ID NO: 469720 - DNA, 15 bp, Homo sapiens
atcttatattaaaga

SEQ ID NO: 469721 - DNA, 15 bp, Homo sapiens
tcttatattaaagat

SEQ ID NO: 469722 - DNA, 15 bp, Homo sapiens
cttatattaaagatg

SEQ ID NO: 469723 - DNA, 15 bp, Homo sapiens
ttatattaaagatgt

SEQ ID NO: 469724 - DNA, 15 bp, Homo sapiens
tatattaaagatgtt

SEQ ID NO: 469725 - DNA, 15 bp, Homo sapiens
atattaaagatgttc

SEQ ID NO: 469726 - DNA, 15 bp, Homo sapiens
tattaaagatgttca

SEQ ID NO: 469727 - DNA, 15 bp, Homo sapiens
attaaagatgttcag

SEQ ID NO: 469728 - DNA, 15 bp, Homo sapiens
ttaaagatgttcaga

SEQ ID NO: 469729 - DNA, 15 bp, Homo sapiens
taaagatgttcagat

SEQ ID NO: 469730 - DNA, 15 bp, Homo sapiens
aaagatgttcagatt

SEQ ID NO: 469731 - DNA, 15 bp, Homo sapiens
aagatgttcagattt

SEQ ID NO: 469732 - DNA, 15 bp, Homo sapiens
agatgttcagattta

SEQ ID NO: 469733 - DNA, 15 bp, Homo sapiens
gatgttcagatttaa

SEQ ID NO: 469734 - DNA, 15 bp, Homo sapiens
atgttcagatttaaa

SEQ ID NO: 469735 - DNA, 15 bp, Homo sapiens
tgttcagatttaaat

SEQ ID NO: 469736 - DNA, 15 bp, Homo sapiens
gttcagatttaaatt

SEQ ID NO: 469737 - DNA, 15 bp, Homo sapiens
ttcagatttaaattt

SEQ ID NO: 469738 - DNA, 15 bp, Homo sapiens
tcagatttaaatttc

SEQ ID NO: 469739 - DNA, 15 bp, Homo sapiens
cagatttaaatttct

SEQ ID NO: 469740 - DNA, 15 bp, Homo sapiens
agatttaaatttctt

SEQ ID NO: 469741 - DNA, 15 bp, Homo sapiens
gatttaaatttcttt

SEQ ID NO: 469742 - DNA, 15 bp, Homo sapiens
atttaaatttctttt

SEQ ID NO: 469743 - DNA, 15 bp, Homo sapiens
ttaaatttctttttt

SEQ ID NO: 469744 - DNA, 15 bp, Homo sapiens
taaatttctttttta

SEQ ID NO: 469745 - DNA, 15 bp, Homo sapiens
aaatttcttttttat

SEQ ID NO: 469746 - DNA, 15 bp, Homo sapiens
aatttcttttttatt

SEQ ID NO: 469747 - DNA, 15 bp, Homo sapiens
atttcttttttattt

SEQ ID NO: 469748 - DNA, 15 bp, Homo sapiens
tttcttttttattta

SEQ ID NO: 469749 - DNA, 15 bp, Homo sapiens
ttcttttttatttat

SEQ ID NO: 469750 - DNA, 15 bp, Homo sapiens
tcttttttatttatg

SEQ ID NO: 469751 - DNA, 15 bp, Homo sapiens
cttttttatttatga

SEQ ID NO: 469752 - DNA, 15 bp, Homo sapiens
ttttttatttatgat

SEQ ID NO: 469753 - DNA, 15 bp, Homo sapiens
tttttatttatgatg

SEQ ID NO: 469754 - DNA, 15 bp, Homo sapiens
ttttatttatgatga

SEQ ID NO: 469755 - DNA, 15 bp, Homo sapiens
tttatttatgatgat

SEQ ID NO: 469756 - DNA, 15 bp, Homo sapiens
ttatttatgatgatt

SEQ ID NO: 469757 - DNA, 15 bp, Homo sapiens
tatttatgatgattt

SEQ ID NO: 469758 - DNA, 15 bp, Homo sapiens
atttatgatgattta

SEQ ID NO: 469759 - DNA, 15 bp, Homo sapiens
tttatgatgatttaa

SEQ ID NO: 469760 - DNA, 15 bp, Homo sapiens
ttatgatgatttaat

SEQ ID NO: 469761 - DNA, 15 bp, Homo sapiens
tatgatgatttaatt

SEQ ID NO: 469762 - DNA, 15 bp, Homo sapiens
atgatgatttaattt

SEQ ID NO: 469763 - DNA, 15 bp, Homo sapiens
tgatgatttaatttc

SEQ ID NO: 469764 - DNA, 15 bp, Homo sapiens
gatgatttaatttca

SEQ ID NO: 469765 - DNA, 15 bp, Homo sapiens
atgatttaatttcat

SEQ ID NO: 469766 - DNA, 15 bp, Homo sapiens
tgatttaatttcatc

SEQ ID NO: 469767 - DNA, 15 bp, Homo sapiens
gatttaatttcatcg

SEQ ID NO: 469768 - DNA, 15 bp, Homo sapiens
atttaatttcatcgt

SEQ ID NO: 469769 - DNA, 15 bp, Homo sapiens
tttaatttcatcgtg

SEQ ID NO: 469770 - DNA, 15 bp, Homo sapiens
ttaatttcatcgtga

SEQ ID NO: 469771 - DNA, 15 bp, Homo sapiens
taatttcatcgtgaa

SEQ ID NO: 469772 - DNA, 15 bp, Homo sapiens
aatttcatcgtgaaa

SEQ ID NO: 469773 - DNA, 15 bp, Homo sapiens
atttcatcgtgaaaa

SEQ ID NO: 469774 - DNA, 15 bp, Homo sapiens
tttcatcgtgaaaat

SEQ ID NO: 469775 - DNA, 15 bp, Homo sapiens
ttcatcgtgaaaatt

SEQ ID NO: 469776 - DNA, 15 bp, Homo sapiens
tcatcgtgaaaatta

SEQ ID NO: 469777 - DNA, 15 bp, Homo sapiens
catcgtgaaaattac

SEQ ID NO: 469778 - DNA, 15 bp, Homo sapiens
atcgtgaaaattacc

SEQ ID NO: 469779 - DNA, 15 bp, Homo sapiens
tcgtgaaaattaccc

SEQ ID NO: 469780 - DNA, 15 bp, Homo sapiens
cgtgaaaattaccct

SEQ ID NO: 469781 - DNA, 15 bp, Homo sapiens
gtgaaaattacccta

SEQ ID NO: 469782 - DNA, 15 bp, Homo sapiens
tgaaaattaccctac

SEQ ID NO: 469783 - DNA, 15 bp, Homo sapiens
gaaaattaccctact

SEQ ID NO: 469784 - DNA, 15 bp, Homo sapiens
aaaattaccctactc

SEQ ID NO: 469785 - DNA, 15 bp, Homo sapiens
aaattaccctactca

SEQ ID NO: 469786 - DNA, 15 bp, Homo sapiens
aattaccctactcag

SEQ ID NO: 469787 - DNA, 15 bp, Homo sapiens
attaccctactcaga

SEQ ID NO: 469788 - DNA, 15 bp, Homo sapiens
ttaccctactcagat

SEQ ID NO: 469789 - DNA, 15 bp, Homo sapiens
taccctactcagatc

SEQ ID NO: 469790 - DNA, 15 bp, Homo sapiens
accctactcagatct

SEQ ID NO: 469791 - DNA, 15 bp, Homo sapiens
ccctactcagatctt

SEQ ID NO: 469792 - DNA, 15 bp, Homo sapiens
cctactcagatcttc

SEQ ID NO: 469793 - DNA, 15 bp, Homo sapiens
ctactcagatcttct

SEQ ID NO: 469794 - DNA, 15 bp, Homo sapiens
tactcagatcttctt

SEQ ID NO: 469795 - DNA, 15 bp, Homo sapiens
actcagatcttcttt

SEQ ID NO: 469796 - DNA, 15 bp, Homo sapiens
ctcagatcttcttta

SEQ ID NO: 469797 - DNA, 15 bp, Homo sapiens
tcagatcttctttaa

SEQ ID NO: 469798 - DNA, 15 bp, Homo sapiens
cagatcttctttaaa

SEQ ID NO: 469799 - DNA, 15 bp, Homo sapiens
agatcttctttaaaa

SEQ ID NO: 469800 - DNA, 15 bp, Homo sapiens
gatcttctttaaaat

SEQ ID NO: 469801 - DNA, 15 bp, Homo sapiens
atcttctttaaaatc

SEQ ID NO: 469802 - DNA, 15 bp, Homo sapiens
tcttctttaaaatca

SEQ ID NO: 469803 - DNA, 15 bp, Homo sapiens
cttctttaaaatcat

SEQ ID NO: 469804 - DNA, 15 bp, Homo sapiens
ttctttaaaatcatc

SEQ ID NO: 469805 - DNA, 15 bp, Homo sapiens
tctttaaaatcatct

SEQ ID NO: 469806 - DNA, 15 bp, Homo sapiens
ctttaaaatcatctt

SEQ ID NO: 469807 - DNA, 15 bp, Homo sapiens
tttaaaatcatcttt

SEQ ID NO: 469808 - DNA, 15 bp, Homo sapiens
ttaaaatcatctttg

SEQ ID NO: 469809 - DNA, 15 bp, Homo sapiens
taaaatcatctttgt

SEQ ID NO: 469810 - DNA, 15 bp, Homo sapiens
aaaatcatctttgtt

SEQ ID NO: 469811 - DNA, 15 bp, Homo sapiens
aaatcatctttgttg

SEQ ID NO: 469812 - DNA, 15 bp, Homo sapiens
aatcatctttgttgt

SEQ ID NO: 469813 - DNA, 15 bp, Homo sapiens
atcatctttgttgta

SEQ ID NO: 469814 - DNA, 15 bp, Homo sapiens
tcatctttgttgtaa

SEQ ID NO: 469815 - DNA, 15 bp, Homo sapiens
catctttgttgtaag

SEQ ID NO: 469816 - DNA, 15 bp, Homo sapiens
atctttgttgtaagt

SEQ ID NO: 469817 - DNA, 15 bp, Homo sapiens
tctttgttgtaagta

SEQ ID NO: 469818 - DNA, 15 bp, Homo sapiens
ctttgttgtaagtaa

SEQ ID NO: 469819 - DNA, 15 bp, Homo sapiens
tttgttgtaagtaac

SEQ ID NO: 469820 - DNA, 15 bp, Homo sapiens
ttgttgtaagtaacc

SEQ ID NO: 469821 - DNA, 15 bp, Homo sapiens
tgttgtaagtaacca

SEQ ID NO: 469822 - DNA, 15 bp, Homo sapiens
gttgtaagtaaccaa

SEQ ID NO: 469823 - DNA, 15 bp, Homo sapiens
ttgtaagtaaccaaa

SEQ ID NO: 469824 - DNA, 15 bp, Homo sapiens
tgtaagtaaccaaaa

SEQ ID NO: 469825 - DNA, 15 bp, Homo sapiens
gtaagtaaccaaaat

SEQ ID NO: 469826 - DNA, 15 bp, Homo sapiens
taagtaaccaaaatt

SEQ ID NO: 469827 - DNA, 15 bp, Homo sapiens
aagtaaccaaaattt

SEQ ID NO: 469828 - DNA, 15 bp, Homo sapiens
agtaaccaaaattta

SEQ ID NO: 469829 - DNA, 15 bp, Homo sapiens
gtaaccaaaatttaa

SEQ ID NO: 469830 - DNA, 15 bp, Homo sapiens
taaccaaaatttaat

SEQ ID NO: 469831 - DNA, 15 bp, Homo sapiens
aaccaaaatttaatt

SEQ ID NO: 469832 - DNA, 15 bp, Homo sapiens
accaaaatttaattc

SEQ ID NO: 469833 - DNA, 15 bp, Homo sapiens
ccaaaatttaattca

SEQ ID NO: 469834 - DNA, 15 bp, Homo sapiens
caaaatttaattcaa

SEQ ID NO: 469835 - DNA, 15 bp, Homo sapiens
aaatttaattcaaat

SEQ ID NO: 469836 - DNA, 15 bp, Homo sapiens
aatttaattcaaatt

SEQ ID NO: 469837 - DNA, 15 bp, Homo sapiens
atttaattcaaatta

SEQ ID NO: 469838 - DNA, 15 bp, Homo sapiens
tttaattcaaattag

SEQ ID NO: 469839 - DNA, 15 bp, Homo sapiens
ttaattcaaattaga

SEQ ID NO: 469840 - DNA, 15 bp, Homo sapiens
taattcaaattagaa

SEQ ID NO: 469841 - DNA, 15 bp, Homo sapiens
aattcaaattagaaa

SEQ ID NO: 469842 - DNA, 15 bp, Homo sapiens
attcaaattagaaac

SEQ ID NO: 469843 - DNA, 15 bp, Homo sapiens
ttcaaattagaaaca

SEQ ID NO: 469844 - DNA, 15 bp, Homo sapiens
tcaaattagaaacat

SEQ ID NO: 469845 - DNA, 15 bp, Homo sapiens
caaattagaaacatt

SEQ ID NO: 469846 - DNA, 15 bp, Homo sapiens
aaattagaaacattt

SEQ ID NO: 469847 - DNA, 15 bp, Homo sapiens
aattagaaacatttt

SEQ ID NO: 469848 - DNA, 15 bp, Homo sapiens
attagaaacattttc

SEQ ID NO: 469849 - DNA, 15 bp, Homo sapiens
ttagaaacattttca

SEQ ID NO: 469850 - DNA, 15 bp, Homo sapiens
tagaaacattttcat

SEQ ID NO: 469851 - DNA, 15 bp, Homo sapiens
agaaacattttcata

SEQ ID NO: 469852 - DNA, 15 bp, Homo sapiens
gaaacattttcatat

SEQ ID NO: 469853 - DNA, 15 bp, Homo sapiens
aaacattttcatatg

SEQ ID NO: 469854 - DNA, 15 bp, Homo sapiens
aacattttcatatgt

SEQ ID NO: 469855 - DNA, 15 bp, Homo sapiens
acattttcatatgtt

SEQ ID NO: 469856 - DNA, 15 bp, Homo sapiens
cattttcatatgttg

SEQ ID NO: 469857 - DNA, 15 bp, Homo sapiens
attttcatatgttgt

SEQ ID NO: 469858 - DNA, 15 bp, Homo sapiens
ttttcatatgttgtt

SEQ ID NO: 469859 - DNA, 15 bp, Homo sapiens
tttcatatgttgtta

SEQ ID NO: 469860 - DNA, 15 bp, Homo sapiens
ttcatatgttgttag

SEQ ID NO: 469861 - DNA, 15 bp, Homo sapiens
tcatatgttgttaga

SEQ ID NO: 469862 - DNA, 15 bp, Homo sapiens
catatgttgttagag

SEQ ID NO: 469863 - DNA, 15 bp, Homo sapiens
atatgttgttagagc

SEQ ID NO: 469864 - DNA, 15 bp, Homo sapiens
atgttgttagagcat

SEQ ID NO: 469865 - DNA, 15 bp, Homo sapiens
tgttgttagagcata

SEQ ID NO: 469866 - DNA, 15 bp, Homo sapiens
gttgttagagcatat

SEQ ID NO: 469867 - DNA, 15 bp, Homo sapiens
ttgttagagcatata

SEQ ID NO: 469868 - DNA, 15 bp, Homo sapiens
tgttagagcatataa

SEQ ID NO: 469869 - DNA, 15 bp, Homo sapiens
gttagagcatataaa

SEQ ID NO: 469870 - DNA, 15 bp, Homo sapiens
ttagagcatataaaa

SEQ ID NO: 469871 - DNA, 15 bp, Homo sapiens
tagagcatataaaag

SEQ ID NO: 469872 - DNA, 15 bp, Homo sapiens
agagcatataaaaga

SEQ ID NO: 469873 - DNA, 15 bp, Homo sapiens
gagcatataaaagat

SEQ ID NO: 469874 - DNA, 15 bp, Homo sapiens
agcatataaaagata

SEQ ID NO: 469875 - DNA, 15 bp, Homo sapiens
gcatataaaagatag

SEQ ID NO: 469876 - DNA, 15 bp, Homo sapiens
catataaaagatagt

SEQ ID NO: 469877 - DNA, 15 bp, Homo sapiens
atataaaagatagtg

SEQ ID NO: 469878 - DNA, 15 bp, Homo sapiens
tataaaagatagtgt

SEQ ID NO: 469879 - DNA, 15 bp, Homo sapiens
ataaaagatagtgtg

SEQ ID NO: 469880 - DNA, 15 bp, Homo sapiens
taaaagatagtgtgt

SEQ ID NO: 469881 - DNA, 15 bp, Homo sapiens
aaaagatagtgtgtg

SEQ ID NO: 469882 - DNA, 15 bp, Homo sapiens
aaagatagtgtgtgg

SEQ ID NO: 469883 - DNA, 15 bp, Homo sapiens
aagatagtgtgtggt

SEQ ID NO: 469884 - DNA, 15 bp, Homo sapiens
agatagtgtgtggtt

SEQ ID NO: 469885 - DNA, 15 bp, Homo sapiens
gatagtgtgtggttt

SEQ ID NO: 469886 - DNA, 15 bp, Homo sapiens
atagtgtgtggtttt

SEQ ID NO: 469887 - DNA, 15 bp, Homo sapiens
tagtgtgtggttttg

SEQ ID NO: 469888 - DNA, 15 bp, Homo sapiens
agtgtgtggttttgt

SEQ ID NO: 469889 - DNA, 15 bp, Homo sapiens
gtgtgtggttttgtt

SEQ ID NO: 469890 - DNA, 15 bp, Homo sapiens
tgtgtggttttgttt

SEQ ID NO: 469891 - DNA, 15 bp, Homo sapiens
gtgtggttttgtttt

SEQ ID NO: 469892 - DNA, 15 bp, Homo sapiens
tgtggttttgttttt

SEQ ID NO: 469893 - DNA, 15 bp, Homo sapiens
gtggttttgtttttt

SEQ ID NO: 469894 - DNA, 15 bp, Homo sapiens
tggttttgttttttg

SEQ ID NO: 469895 - DNA, 15 bp, Homo sapiens
ggttttgttttttga

SEQ ID NO: 469896 - DNA, 15 bp, Homo sapiens
tgttttttgagatga

SEQ ID NO: 469897 - DNA, 15 bp, Homo sapiens
gttttttgagatgag

SEQ ID NO: 469898 - DNA, 15 bp, Homo sapiens
ttttttgagatgaga

SEQ ID NO: 469899 - DNA, 15 bp, Homo sapiens
tttttgagatgagat

SEQ ID NO: 469900 - DNA, 15 bp, Homo sapiens
ttttgagatgagatc

SEQ ID NO: 469901 - DNA, 15 bp, Homo sapiens
tttgagatgagatct

SEQ ID NO: 469902 - DNA, 15 bp, Homo sapiens
ttgagatgagatcta

SEQ ID NO: 469903 - DNA, 15 bp, Homo sapiens
tgagatgagatctag

SEQ ID NO: 469904 - DNA, 15 bp, Homo sapiens
gagatgagatctagt

SEQ ID NO: 469905 - DNA, 15 bp, Homo sapiens
agatgagatctagtc

SEQ ID NO: 469906 - DNA, 15 bp, Homo sapiens
gatgagatctagtct

SEQ ID NO: 469907 - DNA, 15 bp, Homo sapiens
atgagatctagtctg

SEQ ID NO: 469908 - DNA, 15 bp, Homo sapiens
tgagatctagtctgt

SEQ ID NO: 469909 - DNA, 15 bp, Homo sapiens
gagatctagtctgtt

SEQ ID NO: 469910 - DNA, 15 bp, Homo sapiens
agatctagtctgtta

SEQ ID NO: 469911 - DNA, 15 bp, Homo sapiens
gatctagtctgttag

SEQ ID NO: 469912 - DNA, 15 bp, Homo sapiens
atctagtctgttagt

SEQ ID NO: 469913 - DNA, 15 bp, Homo sapiens
tctagtctgttagtg

SEQ ID NO: 469914 - DNA, 15 bp, Homo sapiens
ctagtctgttagtga

SEQ ID NO: 469915 - DNA, 15 bp, Homo sapiens
tagtctgttagtgaa

SEQ ID NO: 469916 - DNA, 15 bp, Homo sapiens
agtctgttagtgaat

SEQ ID NO: 469917 - DNA, 15 bp, Homo sapiens
gtctgttagtgaatt

SEQ ID NO: 469918 - DNA, 15 bp, Homo sapiens
tctgttagtgaattt

SEQ ID NO: 469919 - DNA, 15 bp, Homo sapiens
ctgttagtgaatttc

SEQ ID NO: 469920 - DNA, 15 bp, Homo sapiens
tgttagtgaatttca

SEQ ID NO: 469921 - DNA, 15 bp, Homo sapiens
gttagtgaatttcaa

SEQ ID NO: 469922 - DNA, 15 bp, Homo sapiens
ttagtgaatttcaag

SEQ ID NO: 469923 - DNA, 15 bp, Homo sapiens
tagtgaatttcaagt

SEQ ID NO: 469924 - DNA, 15 bp, Homo sapiens
agtgaatttcaagtg

SEQ ID NO: 469925 - DNA, 15 bp, Homo sapiens
gtgaatttcaagtgt

SEQ ID NO: 469926 - DNA, 15 bp, Homo sapiens
tgaatttcaagtgta

SEQ ID NO: 469927 - DNA, 15 bp, Homo sapiens
gaatttcaagtgtat

SEQ ID NO: 469928 - DNA, 15 bp, Homo sapiens
aatttcaagtgtatt

SEQ ID NO: 469929 - DNA, 15 bp, Homo sapiens
atttcaagtgtatta

SEQ ID NO: 469930 - DNA, 15 bp, Homo sapiens
tttcaagtgtattat

SEQ ID NO: 469931 - DNA, 15 bp, Homo sapiens
ttcaagtgtattatc

SEQ ID NO: 469932 - DNA, 15 bp, Homo sapiens
tcaagtgtattatct

SEQ ID NO: 469933 - DNA, 15 bp, Homo sapiens
caagtgtattatctg

SEQ ID NO: 469934 - DNA, 15 bp, Homo sapiens
aagtgtattatctgt

SEQ ID NO: 469935 - DNA, 15 bp, Homo sapiens
agtgtattatctgta

SEQ ID NO: 469936 - DNA, 15 bp, Homo sapiens
gtgtattatctgtag

SEQ ID NO: 469937 - DNA, 15 bp, Homo sapiens
tgtattatctgtagc

SEQ ID NO: 469938 - DNA, 15 bp, Homo sapiens
gtattatctgtagcc

SEQ ID NO: 469939 - DNA, 15 bp, Homo sapiens
tattatctgtagcca

SEQ ID NO: 469940 - DNA, 15 bp, Homo sapiens
attatctgtagccac

SEQ ID NO: 469941 - DNA, 15 bp, Homo sapiens
ttatctgtagccaca

SEQ ID NO: 469942 - DNA, 15 bp, Homo sapiens
tatctgtagccacaa

SEQ ID NO: 469943 - DNA, 15 bp, Homo sapiens
atctgtagccacaag

SEQ ID NO: 469944 - DNA, 15 bp, Homo sapiens
tctgtagccacaagc

SEQ ID NO: 469945 - DNA, 15 bp, Homo sapiens
ctgtagccacaagct

SEQ ID NO: 469946 - DNA, 15 bp, Homo sapiens
tgtagccacaagctg

SEQ ID NO: 469947 - DNA, 15 bp, Homo sapiens
gtagccacaagctgt

SEQ ID NO: 469948 - DNA, 15 bp, Homo sapiens
tagccacaagctgta

SEQ ID NO: 469949 - DNA, 15 bp, Homo sapiens
agccacaagctgtac

SEQ ID NO: 469950 - DNA, 15 bp, Homo sapiens
gccacaagctgtaca

SEQ ID NO: 469951 - DNA, 15 bp, Homo sapiens
ccacaagctgtacat

SEQ ID NO: 469952 - DNA, 15 bp, Homo sapiens
cacaagctgtacatt

SEQ ID NO: 469953 - DNA, 15 bp, Homo sapiens
acaagctgtacatta

SEQ ID NO: 469954 - DNA, 15 bp, Homo sapiens
caagctgtacattag

SEQ ID NO: 469955 - DNA, 15 bp, Homo sapiens
aagctgtacattagg

SEQ ID NO: 469956 - DNA, 15 bp, Homo sapiens
agctgtacattaggt

SEQ ID NO: 469957 - DNA, 15 bp, Homo sapiens
gctgtacattaggtc

SEQ ID NO: 469958 - DNA, 15 bp, Homo sapiens
ctgtacattaggtct

SEQ ID NO: 469959 - DNA, 15 bp, Homo sapiens
tgtacattaggtctc

SEQ ID NO: 469960 - DNA, 15 bp, Homo sapiens
gtacattaggtctcc

SEQ ID NO: 469961 - DNA, 15 bp, Homo sapiens
tacattaggtctcca

SEQ ID NO: 469962 - DNA, 15 bp, Homo sapiens
acattaggtctccag

SEQ ID NO: 469963 - DNA, 15 bp, Homo sapiens
cattaggtctccaga

SEQ ID NO: 469964 - DNA, 15 bp, Homo sapiens
attaggtctccagaa

SEQ ID NO: 469965 - DNA, 15 bp, Homo sapiens
ttaggtctccagaat

SEQ ID NO: 469966 - DNA, 15 bp, Homo sapiens
taggtctccagaatt

SEQ ID NO: 469967 - DNA, 15 bp, Homo sapiens
aggtctccagaattt

SEQ ID NO: 469968 - DNA, 15 bp, Homo sapiens
ggtctccagaattta

SEQ ID NO: 469969 - DNA, 15 bp, Homo sapiens
gtctccagaatttat

SEQ ID NO: 469970 - DNA, 15 bp, Homo sapiens
tctccagaatttatt

SEQ ID NO: 469971 - DNA, 15 bp, Homo sapiens
ctccagaatttattc

SEQ ID NO: 469972 - DNA, 15 bp, Homo sapiens
tccagaatttattca

SEQ ID NO: 469973 - DNA, 15 bp, Homo sapiens
ccagaatttattcat

SEQ ID NO: 469974 - DNA, 15 bp, Homo sapiens
cagaatttattcatc

SEQ ID NO: 469975 - DNA, 15 bp, Homo sapiens
agaatttattcatca

SEQ ID NO: 469976 - DNA, 15 bp, Homo sapiens
gaatttattcatcat

SEQ ID NO: 469977 - DNA, 15 bp, Homo sapiens
aatttattcatcata

SEQ ID NO: 469978 - DNA, 15 bp, Homo sapiens
atttattcatcatat

SEQ ID NO: 469979 - DNA, 15 bp, Homo sapiens
tttattcatcatata

SEQ ID NO: 469980 - DNA, 15 bp, Homo sapiens
ttattcatcatataa

SEQ ID NO: 469981 - DNA, 15 bp, Homo sapiens
tattcatcatataac

SEQ ID NO: 469982 - DNA, 15 bp, Homo sapiens
attcatcatataact

SEQ ID NO: 469983 - DNA, 15 bp, Homo sapiens
ttcatcatataactg

SEQ ID NO: 469984 - DNA, 15 bp, Homo sapiens
tcatcatataactga

SEQ ID NO: 469985 - DNA, 15 bp, Homo sapiens
catcatataactgaa

SEQ ID NO: 469986 - DNA, 15 bp, Homo sapiens
atcatataactgaaa

SEQ ID NO: 469987 - DNA, 15 bp, Homo sapiens
tcatataactgaaag

SEQ ID NO: 469988 - DNA, 15 bp, Homo sapiens
catataactgaaagt

SEQ ID NO: 469989 - DNA, 15 bp, Homo sapiens
atataactgaaagtt

SEQ ID NO: 469990 - DNA, 15 bp, Homo sapiens
tataactgaaagttt

SEQ ID NO: 469991 - DNA, 15 bp, Homo sapiens
ataactgaaagttta

SEQ ID NO: 469992 - DNA, 15 bp, Homo sapiens
taactgaaagtttat

SEQ ID NO: 469993 - DNA, 15 bp, Homo sapiens
aactgaaagtttata

SEQ ID NO: 469994 - DNA, 15 bp, Homo sapiens
actgaaagtttatac

SEQ ID NO: 469995 - DNA, 15 bp, Homo sapiens
ctgaaagtttatacc

SEQ ID NO: 469996 - DNA, 15 bp, Homo sapiens
tgaaagtttataccc

SEQ ID NO: 469997 - DNA, 15 bp, Homo sapiens
gaaagtttataccct

SEQ ID NO: 469998 - DNA, 15 bp, Homo sapiens
aaagtttataccctt

SEQ ID NO: 469999 - DNA, 15 bp, Homo sapiens
aagtttatacccttt

SEQ ID NO: 470000 - DNA, 15 bp, Homo sapiens
agtttataccctttg

SEQ ID NO: 470001 - DNA, 15 bp, Homo sapiens
gtttataccctttga

SEQ ID NO: 470002 - DNA, 15 bp, Homo sapiens
tttataccctttgac

SEQ ID NO: 470003 - DNA, 15 bp, Homo sapiens
ttataccctttgacc

SEQ ID NO: 470004 - DNA, 15 bp, Homo sapiens
tataccctttgacca

SEQ ID NO: 470005 - DNA, 15 bp, Homo sapiens
ataccctttgaccag

SEQ ID NO: 470006 - DNA, 15 bp, Homo sapiens
taccctttgaccagt

SEQ ID NO: 470007 - DNA, 15 bp, Homo sapiens
accctttgaccagtc

SEQ ID NO: 470008 - DNA, 15 bp, Homo sapiens
ccctttgaccagtct

SEQ ID NO: 470009 - DNA, 15 bp, Homo sapiens
cctttgaccagtctc

SEQ ID NO: 470010 - DNA, 15 bp, Homo sapiens
ctttgaccagtctct

SEQ ID NO: 470011 - DNA, 15 bp, Homo sapiens
tttgaccagtctctt

SEQ ID NO: 470012 - DNA, 15 bp, Homo sapiens
ttgaccagtctcttc

SEQ ID NO: 470013 - DNA, 15 bp, Homo sapiens
tgaccagtctcttct

SEQ ID NO: 470014 - DNA, 15 bp, Homo sapiens
gaccagtctcttctc

SEQ ID NO: 470015 - DNA, 15 bp, Homo sapiens
accagtctcttctct

SEQ ID NO: 470016 - DNA, 15 bp, Homo sapiens
ccagtctcttctctt

SEQ ID NO: 470017 - DNA, 15 bp, Homo sapiens
cagtctcttctcttt

SEQ ID NO: 470018 - DNA, 15 bp, Homo sapiens
agtctcttctctttt

SEQ ID NO: 470019 - DNA, 15 bp, Homo sapiens
gtctcttctcttttc

SEQ ID NO: 470020 - DNA, 15 bp, Homo sapiens
tctcttctcttttcc

SEQ ID NO: 470021 - DNA, 15 bp, Homo sapiens
ctcttctcttttcct

SEQ ID NO: 470022 - DNA, 15 bp, Homo sapiens
tcttctcttttcctc

SEQ ID NO: 470023 - DNA, 15 bp, Homo sapiens
cttctcttttcctcc

SEQ ID NO: 470024 - DNA, 15 bp, Homo sapiens
ttctcttttcctcca

SEQ ID NO: 470025 - DNA, 15 bp, Homo sapiens
tctcttttcctccac

SEQ ID NO: 470026 - DNA, 15 bp, Homo sapiens
ctcttttcctccacc

SEQ ID NO: 470027 - DNA, 15 bp, Homo sapiens
tcttttcctccaccc

SEQ ID NO: 470028 - DNA, 15 bp, Homo sapiens
cttttcctccacccc

SEQ ID NO: 470029 - DNA, 15 bp, Homo sapiens
ttttcctccaccccc

SEQ ID NO: 470030 - DNA, 15 bp, Homo sapiens
tttcctccacccccc

SEQ ID NO: 470031 - DNA, 15 bp, Homo sapiens
ttcctccacccccca

SEQ ID NO: 470032 - DNA, 15 bp, Homo sapiens
tcctccaccccccag

SEQ ID NO: 470033 - DNA, 15 bp, Homo sapiens
cctccaccccccagc

SEQ ID NO: 470034 - DNA, 15 bp, Homo sapiens
ctccaccccccagcc

SEQ ID NO: 470035 - DNA, 15 bp, Homo sapiens
tccaccccccagccc

SEQ ID NO: 470036 - DNA, 15 bp, Homo sapiens
ccaccccccagcccc

SEQ ID NO: 470037 - DNA, 15 bp, Homo sapiens
caccccccagcccct

SEQ ID NO: 470038 - DNA, 15 bp, Homo sapiens
accccccagcccctg

SEQ ID NO: 470039 - DNA, 15 bp, Homo sapiens
ccccccagcccctgg

SEQ ID NO: 470040 - DNA, 15 bp, Homo sapiens
cccccagcccctggt

SEQ ID NO: 470041 - DNA, 15 bp, Homo sapiens
ccccagcccctggta

SEQ ID NO: 470042 - DNA, 15 bp, Homo sapiens
cccagcccctggtaa

SEQ ID NO: 470043 - DNA, 15 bp, Homo sapiens
ccagcccctggtaac

SEQ ID NO: 470044 - DNA, 15 bp, Homo sapiens
cagcccctggtaact

SEQ ID NO: 470045 - DNA, 15 bp, Homo sapiens
agcccctggtaacta

SEQ ID NO: 470046 - DNA, 15 bp, Homo sapiens
gcccctggtaactac

SEQ ID NO: 470047 - DNA, 15 bp, Homo sapiens
cccctggtaactacc

SEQ ID NO: 470048 - DNA, 15 bp, Homo sapiens
ccctggtaactacca

SEQ ID NO: 470049 - DNA, 15 bp, Homo sapiens
cctggtaactaccat

SEQ ID NO: 470050 - DNA, 15 bp, Homo sapiens
ctggtaactaccatt

SEQ ID NO: 470051 - DNA, 15 bp, Homo sapiens
tggtaactaccattc

SEQ ID NO: 470052 - DNA, 15 bp, Homo sapiens
ggtaactaccattct

SEQ ID NO: 470053 - DNA, 15 bp, Homo sapiens
gtaactaccattcta

SEQ ID NO: 470054 - DNA, 15 bp, Homo sapiens
taactaccattctac

SEQ ID NO: 470055 - DNA, 15 bp, Homo sapiens
aactaccattctact

SEQ ID NO: 470056 - DNA, 15 bp, Homo sapiens
actaccattctactc

SEQ ID NO: 470057 - DNA, 15 bp, Homo sapiens
ctaccattctactct

SEQ ID NO: 470058 - DNA, 15 bp, Homo sapiens
taccattctactctg

SEQ ID NO: 470059 - DNA, 15 bp, Homo sapiens
accattctactctgt

SEQ ID NO: 470060 - DNA, 15 bp, Homo sapiens
ccattctactctgtg

SEQ ID NO: 470061 - DNA, 15 bp, Homo sapiens
cattctactctgtgc

SEQ ID NO: 470062 - DNA, 15 bp, Homo sapiens
attctactctgtgct

SEQ ID NO: 470063 - DNA, 15 bp, Homo sapiens
ttctactctgtgcta

SEQ ID NO: 470064 - DNA, 15 bp, Homo sapiens
tctactctgtgctac

SEQ ID NO: 470065 - DNA, 15 bp, Homo sapiens
ctactctgtgctact

SEQ ID NO: 470066 - DNA, 15 bp, Homo sapiens
tactctgtgctacta

SEQ ID NO: 470067 - DNA, 15 bp, Homo sapiens
actctgtgctactat

SEQ ID NO: 470068 - DNA, 15 bp, Homo sapiens
ctctgtgctactatg

SEQ ID NO: 470069 - DNA, 15 bp, Homo sapiens
tctgtgctactatga

SEQ ID NO: 470070 - DNA, 15 bp, Homo sapiens
ctgtgctactatgag

SEQ ID NO: 470071 - DNA, 15 bp, Homo sapiens
tgtgctactatgagc

SEQ ID NO: 470072 - DNA, 15 bp, Homo sapiens
gtgctactatgagct

SEQ ID NO: 470073 - DNA, 15 bp, Homo sapiens
tgctactatgagctt

SEQ ID NO: 470074 - DNA, 15 bp, Homo sapiens
gctactatgagcttg

SEQ ID NO: 470075 - DNA, 15 bp, Homo sapiens
ctactatgagcttga

SEQ ID NO: 470076 - DNA, 15 bp, Homo sapiens
tactatgagcttgac

SEQ ID NO: 470077 - DNA, 15 bp, Homo sapiens
actatgagcttgact

SEQ ID NO: 470078 - DNA, 15 bp, Homo sapiens
ctatgagcttgactt

SEQ ID NO: 470079 - DNA, 15 bp, Homo sapiens
tatgagcttgacttt

SEQ ID NO: 470080 - DNA, 15 bp, Homo sapiens
atgagcttgactttt

SEQ ID NO: 470081 - DNA, 15 bp, Homo sapiens
tgagcttgacttttt

SEQ ID NO: 470082 - DNA, 15 bp, Homo sapiens
gagcttgactttttt

SEQ ID NO: 470083 - DNA, 15 bp, Homo sapiens
agcttgacttttttt

SEQ ID NO: 470084 - DNA, 15 bp, Homo sapiens
gcttgactttttttt

SEQ ID NO: 470085 - DNA, 15 bp, Homo sapiens
cttgacttttttttt

SEQ ID NO: 470086 - DNA, 15 bp, Homo sapiens
tgactttttttttta

SEQ ID NO: 470087 - DNA, 15 bp, Homo sapiens
gacttttttttttaa

SEQ ID NO: 470088 - DNA, 15 bp, Homo sapiens
acttttttttttaaa

SEQ ID NO: 470089 - DNA, 15 bp, Homo sapiens
ttttttttttaaagg

SEQ ID NO: 470090 - DNA, 15 bp, Homo sapiens
tttttttttaaaggt

SEQ ID NO: 470091 - DNA, 15 bp, Homo sapiens
ttttttttaaaggtc

SEQ ID NO: 470092 - DNA, 15 bp, Homo sapiens
tttttttaaaggtcc

SEQ ID NO: 470093 - DNA, 15 bp, Homo sapiens
ttttttaaaggtccc

SEQ ID NO: 470094 - DNA, 15 bp, Homo sapiens
tttttaaaggtccca

SEQ ID NO: 470095 - DNA, 15 bp, Homo sapiens
ttttaaaggtcccac

SEQ ID NO: 470096 - DNA, 15 bp, Homo sapiens
tttaaaggtcccaca

SEQ ID NO: 470097 - DNA, 15 bp, Homo sapiens
ttaaaggtcccacat

SEQ ID NO: 470098 - DNA, 15 bp, Homo sapiens
taaaggtcccacata

SEQ ID NO: 470099 - DNA, 15 bp, Homo sapiens
aaaggtcccacatat

SEQ ID NO: 470100 - DNA, 15 bp, Homo sapiens
aaggtcccacatata

SEQ ID NO: 470101 - DNA, 15 bp, Homo sapiens
aggtcccacatataa

SEQ ID NO: 470102 - DNA, 15 bp, Homo sapiens
ggtcccacatataag

SEQ ID NO: 470103 - DNA, 15 bp, Homo sapiens
gtcccacatataagt

SEQ ID NO: 470104 - DNA, 15 bp, Homo sapiens
tcccacatataagtg

SEQ ID NO: 470105 - DNA, 15 bp, Homo sapiens
cccacatataagtga

SEQ ID NO: 470106 - DNA, 15 bp, Homo sapiens
ccacatataagtgag

SEQ ID NO: 470107 - DNA, 15 bp, Homo sapiens
cacatataagtgaga

SEQ ID NO: 470108 - DNA, 15 bp, Homo sapiens
acatataagtgagat

SEQ ID NO: 470109 - DNA, 15 bp, Homo sapiens
catataagtgagatc

SEQ ID NO: 470110 - DNA, 15 bp, Homo sapiens
atataagtgagatca

SEQ ID NO: 470111 - DNA, 15 bp, Homo sapiens
tataagtgagatcat

SEQ ID NO: 470112 - DNA, 15 bp, Homo sapiens
ataagtgagatcatg

SEQ ID NO: 470113 - DNA, 15 bp, Homo sapiens
taagtgagatcatgc

SEQ ID NO: 470114 - DNA, 15 bp, Homo sapiens
aagtgagatcatgca

SEQ ID NO: 470115 - DNA, 15 bp, Homo sapiens
agtgagatcatgcag

SEQ ID NO: 470116 - DNA, 15 bp, Homo sapiens
gtgagatcatgcagt

SEQ ID NO: 470117 - DNA, 15 bp, Homo sapiens
tgagatcatgcagta

SEQ ID NO: 470118 - DNA, 15 bp, Homo sapiens
gagatcatgcagtat

SEQ ID NO: 470119 - DNA, 15 bp, Homo sapiens
agatcatgcagtatt

SEQ ID NO: 470120 - DNA, 15 bp, Homo sapiens
gatcatgcagtattt

SEQ ID NO: 470121 - DNA, 15 bp, Homo sapiens
atcatgcagtatttg

SEQ ID NO: 470122 - DNA, 15 bp, Homo sapiens
tcatgcagtatttgt

SEQ ID NO: 470123 - DNA, 15 bp, Homo sapiens
catgcagtatttgtc

SEQ ID NO: 470124 - DNA, 15 bp, Homo sapiens
atgcagtatttgtct

SEQ ID NO: 470125 - DNA, 15 bp, Homo sapiens
tgcagtatttgtctt

SEQ ID NO: 470126 - DNA, 15 bp, Homo sapiens
gcagtatttgtcttt

SEQ ID NO: 470127 - DNA, 15 bp, Homo sapiens
cagtatttgtctttc

SEQ ID NO: 470128 - DNA, 15 bp, Homo sapiens
agtatttgtctttct

SEQ ID NO: 470129 - DNA, 15 bp, Homo sapiens
gtatttgtctttctg

SEQ ID NO: 470130 - DNA, 15 bp, Homo sapiens
tatttgtctttctgt

SEQ ID NO: 470131 - DNA, 15 bp, Homo sapiens
atttgtctttctgta

SEQ ID NO: 470132 - DNA, 15 bp, Homo sapiens
tttgtctttctgtat

SEQ ID NO: 470133 - DNA, 15 bp, Homo sapiens
ttgtctttctgtatc

SEQ ID NO: 470134 - DNA, 15 bp, Homo sapiens
tgtctttctgtatct

SEQ ID NO: 470135 - DNA, 15 bp, Homo sapiens
gtctttctgtatctg

SEQ ID NO: 470136 - DNA, 15 bp, Homo sapiens
tctttctgtatctgg

SEQ ID NO: 470137 - DNA, 15 bp, Homo sapiens
ctttctgtatctggg

SEQ ID NO: 470138 - DNA, 15 bp, Homo sapiens
tttctgtatctgggt

SEQ ID NO: 470139 - DNA, 15 bp, Homo sapiens
ttctgtatctgggtt

SEQ ID NO: 470140 - DNA, 15 bp, Homo sapiens
tctgtatctgggtta

SEQ ID NO: 470141 - DNA, 15 bp, Homo sapiens
ctgtatctgggttat

SEQ ID NO: 470142 - DNA, 15 bp, Homo sapiens
tgtatctgggttatt

SEQ ID NO: 470143 - DNA, 15 bp, Homo sapiens
gtatctgggttattt

SEQ ID NO: 470144 - DNA, 15 bp, Homo sapiens
tatctgggttatttc

SEQ ID NO: 470145 - DNA, 15 bp, Homo sapiens
atctgggttatttca

SEQ ID NO: 470146 - DNA, 15 bp, Homo sapiens
tctgggttatttcac

SEQ ID NO: 470147 - DNA, 15 bp, Homo sapiens
ctgggttatttcact

SEQ ID NO: 470148 - DNA, 15 bp, Homo sapiens
tgggttatttcactt

SEQ ID NO: 470149 - DNA, 15 bp, Homo sapiens
gggttatttcactta

SEQ ID NO: 470150 - DNA, 15 bp, Homo sapiens
ggttatttcacttag

SEQ ID NO: 470151 - DNA, 15 bp, Homo sapiens
gttatttcacttagt

SEQ ID NO: 470152 - DNA, 15 bp, Homo sapiens
ttatttcacttagta

SEQ ID NO: 470153 - DNA, 15 bp, Homo sapiens
tatttcacttagtat

SEQ ID NO: 470154 - DNA, 15 bp, Homo sapiens
atttcacttagtata

SEQ ID NO: 470155 - DNA, 15 bp, Homo sapiens
tttcacttagtataa

SEQ ID NO: 470156 - DNA, 15 bp, Homo sapiens
ttcacttagtataat

SEQ ID NO: 470157 - DNA, 15 bp, Homo sapiens
tcacttagtataatg

SEQ ID NO: 470158 - DNA, 15 bp, Homo sapiens
cacttagtataatgt

SEQ ID NO: 470159 - DNA, 15 bp, Homo sapiens
acttagtataatgtc

SEQ ID NO: 470160 - DNA, 15 bp, Homo sapiens
cttagtataatgtcc

SEQ ID NO: 470161 - DNA, 15 bp, Homo sapiens
ttagtataatgtcct

SEQ ID NO: 470162 - DNA, 15 bp, Homo sapiens
tagtataatgtcctc

SEQ ID NO: 470163 - DNA, 15 bp, Homo sapiens
agtataatgtcctcc

SEQ ID NO: 470164 - DNA, 15 bp, Homo sapiens
gtataatgtcctcca

SEQ ID NO: 470165 - DNA, 15 bp, Homo sapiens
tataatgtcctccag

SEQ ID NO: 470166 - DNA, 15 bp, Homo sapiens
ataatgtcctccagg

SEQ ID NO: 470167 - DNA, 15 bp, Homo sapiens
taatgtcctccaggc

SEQ ID NO: 470168 - DNA, 15 bp, Homo sapiens
aatgtcctccaggct

SEQ ID NO: 470169 - DNA, 15 bp, Homo sapiens
atgtcctccaggctc

SEQ ID NO: 470170 - DNA, 15 bp, Homo sapiens
tgtcctccaggctca

SEQ ID NO: 470171 - DNA, 15 bp, Homo sapiens
gtcctccaggctcat

SEQ ID NO: 470172 - DNA, 15 bp, Homo sapiens
tcctccaggctcatc

SEQ ID NO: 470173 - DNA, 15 bp, Homo sapiens
cctccaggctcatct

SEQ ID NO: 470174 - DNA, 15 bp, Homo sapiens
ctccaggctcatcta

SEQ ID NO: 470175 - DNA, 15 bp, Homo sapiens
tccaggctcatctaa

SEQ ID NO: 470176 - DNA, 15 bp, Homo sapiens
ccaggctcatctaag

SEQ ID NO: 470177 - DNA, 15 bp, Homo sapiens
caggctcatctaagt

SEQ ID NO: 470178 - DNA, 15 bp, Homo sapiens
aggctcatctaagtt

SEQ ID NO: 470179 - DNA, 15 bp, Homo sapiens
ggctcatctaagtta

SEQ ID NO: 470180 - DNA, 15 bp, Homo sapiens
gctcatctaagttat

SEQ ID NO: 470181 - DNA, 15 bp, Homo sapiens
ctcatctaagttatt

SEQ ID NO: 470182 - DNA, 15 bp, Homo sapiens
tcatctaagttattg

SEQ ID NO: 470183 - DNA, 15 bp, Homo sapiens
catctaagttattgc

SEQ ID NO: 470184 - DNA, 15 bp, Homo sapiens
atctaagttattgca

SEQ ID NO: 470185 - DNA, 15 bp, Homo sapiens
tctaagttattgcaa

SEQ ID NO: 470186 - DNA, 15 bp, Homo sapiens
ctaagttattgcaaa

SEQ ID NO: 470187 - DNA, 15 bp, Homo sapiens
taagttattgcaaat

SEQ ID NO: 470188 - DNA, 15 bp, Homo sapiens
aagttattgcaaatg

SEQ ID NO: 470189 - DNA, 15 bp, Homo sapiens
agttattgcaaatga

SEQ ID NO: 470190 - DNA, 15 bp, Homo sapiens
gttattgcaaatgac

SEQ ID NO: 470191 - DNA, 15 bp, Homo sapiens
ttattgcaaatgaca

SEQ ID NO: 470192 - DNA, 15 bp, Homo sapiens
tattgcaaatgacag

SEQ ID NO: 470193 - DNA, 15 bp, Homo sapiens
attgcaaatgacaga

SEQ ID NO: 470194 - DNA, 15 bp, Homo sapiens
gcaaatgacagaatt

SEQ ID NO: 470195 - DNA, 15 bp, Homo sapiens
caaatgacagaattc

SEQ ID NO: 470196 - DNA, 15 bp, Homo sapiens
aaatgacagaattcc

SEQ ID NO: 470197 - DNA, 15 bp, Homo sapiens
aatgacagaattccc

SEQ ID NO: 470198 - DNA, 15 bp, Homo sapiens
atgacagaattccct

SEQ ID NO: 470199 - DNA, 15 bp, Homo sapiens
tgacagaattccctt

SEQ ID NO: 470200 - DNA, 15 bp, Homo sapiens
gacagaattcccttc

SEQ ID NO: 470201 - DNA, 15 bp, Homo sapiens
acagaattcccttct

SEQ ID NO: 470202 - DNA, 15 bp, Homo sapiens
cagaattcccttctt

SEQ ID NO: 470203 - DNA, 15 bp, Homo sapiens
agaattcccttcttt

SEQ ID NO: 470204 - DNA, 15 bp, Homo sapiens
gaattcccttctttt

SEQ ID NO: 470205 - DNA, 15 bp, Homo sapiens
aattcccttcttttt

SEQ ID NO: 470206 - DNA, 15 bp, Homo sapiens
attcccttctttttt

SEQ ID NO: 470207 - DNA, 15 bp, Homo sapiens
ttcccttcttttttt

SEQ ID NO: 470208 - DNA, 15 bp, Homo sapiens
tcccttcttttttta

SEQ ID NO: 470209 - DNA, 15 bp, Homo sapiens
cccttctttttttat

SEQ ID NO: 470210 - DNA, 15 bp, Homo sapiens
ccttctttttttatg

SEQ ID NO: 470211 - DNA, 15 bp, Homo sapiens
cttctttttttatga

SEQ ID NO: 470212 - DNA, 15 bp, Homo sapiens
ttctttttttatgac

SEQ ID NO: 470213 - DNA, 15 bp, Homo sapiens
tctttttttatgact

SEQ ID NO: 470214 - DNA, 15 bp, Homo sapiens
ctttttttatgactg

SEQ ID NO: 470215 - DNA, 15 bp, Homo sapiens
tttttttatgactgg

SEQ ID NO: 470216 - DNA, 15 bp, Homo sapiens
ttttttatgactgga

SEQ ID NO: 470217 - DNA, 15 bp, Homo sapiens
tttttatgactggat

SEQ ID NO: 470218 - DNA, 15 bp, Homo sapiens
ttttatgactggata

SEQ ID NO: 470219 - DNA, 15 bp, Homo sapiens
tttatgactggatat

SEQ ID NO: 470220 - DNA, 15 bp, Homo sapiens
ttatgactggatata

SEQ ID NO: 470221 - DNA, 15 bp, Homo sapiens
tatgactggatatat

SEQ ID NO: 470222 - DNA, 15 bp, Homo sapiens
atgactggatatatt

SEQ ID NO: 470223 - DNA, 15 bp, Homo sapiens
tgactggatatattt

SEQ ID NO: 470224 - DNA, 15 bp, Homo sapiens
gactggatatatttc

SEQ ID NO: 470225 - DNA, 15 bp, Homo sapiens
actggatatatttca

SEQ ID NO: 470226 - DNA, 15 bp, Homo sapiens
ctggatatatttcac

SEQ ID NO: 470227 - DNA, 15 bp, Homo sapiens
tggatatatttcact

SEQ ID NO: 470228 - DNA, 15 bp, Homo sapiens
ggatatatttcactg

SEQ ID NO: 470229 - DNA, 15 bp, Homo sapiens
gatatatttcactgt

SEQ ID NO: 470230 - DNA, 15 bp, Homo sapiens
atatatttcactgtg

SEQ ID NO: 470231 - DNA, 15 bp, Homo sapiens
tatatttcactgtgt

SEQ ID NO: 470232 - DNA, 15 bp, Homo sapiens
atatttcactgtgtt

SEQ ID NO: 470233 - DNA, 15 bp, Homo sapiens
tatttcactgtgttt

SEQ ID NO: 470234 - DNA, 15 bp, Homo sapiens
atttcactgtgtttt

SEQ ID NO: 470235 - DNA, 15 bp, Homo sapiens
tttcactgtgttttc

SEQ ID NO: 470236 - DNA, 15 bp, Homo sapiens
ttcactgtgttttct

SEQ ID NO: 470237 - DNA, 15 bp, Homo sapiens
tcactgtgttttctt

SEQ ID NO: 470238 - DNA, 15 bp, Homo sapiens
cactgtgttttcttt

SEQ ID NO: 470239 - DNA, 15 bp, Homo sapiens
actgtgttttcttta

SEQ ID NO: 470240 - DNA, 15 bp, Homo sapiens
ctgtgttttctttat

SEQ ID NO: 470241 - DNA, 15 bp, Homo sapiens
tgtgttttctttatc

SEQ ID NO: 470242 - DNA, 15 bp, Homo sapiens
gtgttttctttatcc

SEQ ID NO: 470243 - DNA, 15 bp, Homo sapiens
tgttttctttatcca

SEQ ID NO: 470244 - DNA, 15 bp, Homo sapiens
ttctttatccatttt

SEQ ID NO: 470245 - DNA, 15 bp, Homo sapiens
tctttatccattttt

SEQ ID NO: 470246 - DNA, 15 bp, Homo sapiens
ctttatccatttttc

SEQ ID NO: 470247 - DNA, 15 bp, Homo sapiens
tttatccatttttct

SEQ ID NO: 470248 - DNA, 15 bp, Homo sapiens
ttatccatttttctg

SEQ ID NO: 470249 - DNA, 15 bp, Homo sapiens
tatccatttttctgt

SEQ ID NO: 470250 - DNA, 15 bp, Homo sapiens
atccatttttctgtt

SEQ ID NO: 470251 - DNA, 15 bp, Homo sapiens
tccatttttctgttg

SEQ ID NO: 470252 - DNA, 15 bp, Homo sapiens
ccatttttctgttgt

SEQ ID NO: 470253 - DNA, 15 bp, Homo sapiens
catttttctgttgta

SEQ ID NO: 470254 - DNA, 15 bp, Homo sapiens
atttttctgttgtag

SEQ ID NO: 470255 - DNA, 15 bp, Homo sapiens
tttttctgttgtagg

SEQ ID NO: 470256 - DNA, 15 bp, Homo sapiens
ttttctgttgtagga

SEQ ID NO: 470257 - DNA, 15 bp, Homo sapiens
tttctgttgtaggat

SEQ ID NO: 470258 - DNA, 15 bp, Homo sapiens
ttctgttgtaggata

SEQ ID NO: 470259 - DNA, 15 bp, Homo sapiens
tctgttgtaggatac

SEQ ID NO: 470260 - DNA, 15 bp, Homo sapiens
ctgttgtaggatact

SEQ ID NO: 470261 - DNA, 15 bp, Homo sapiens
tgttgtaggatactt

SEQ ID NO: 470262 - DNA, 15 bp, Homo sapiens
gttgtaggatactta

SEQ ID NO: 470263 - DNA, 15 bp, Homo sapiens
ttgtaggatacttag

SEQ ID NO: 470264 - DNA, 15 bp, Homo sapiens
tgtaggatacttagt

SEQ ID NO: 470265 - DNA, 15 bp, Homo sapiens
gtaggatacttagtt

SEQ ID NO: 470266 - DNA, 15 bp, Homo sapiens
taggatacttagttt

SEQ ID NO: 470267 - DNA, 15 bp, Homo sapiens
aggatacttagtttg

SEQ ID NO: 470268 - DNA, 15 bp, Homo sapiens
ggatacttagtttga

SEQ ID NO: 470269 - DNA, 15 bp, Homo sapiens
gatacttagtttgat

SEQ ID NO: 470270 - DNA, 15 bp, Homo sapiens
atacttagtttgatt

SEQ ID NO: 470271 - DNA, 15 bp, Homo sapiens
tacttagtttgattc

SEQ ID NO: 470272 - DNA, 15 bp, Homo sapiens
acttagtttgattcc

SEQ ID NO: 470273 - DNA, 15 bp, Homo sapiens
cttagtttgattcca

SEQ ID NO: 470274 - DNA, 15 bp, Homo sapiens
ttagtttgattccat

SEQ ID NO: 470275 - DNA, 15 bp, Homo sapiens
tagtttgattccata

SEQ ID NO: 470276 - DNA, 15 bp, Homo sapiens
agtttgattccatat

SEQ ID NO: 470277 - DNA, 15 bp, Homo sapiens
gtttgattccatatc

SEQ ID NO: 470278 - DNA, 15 bp, Homo sapiens
tttgattccatatct

SEQ ID NO: 470279 - DNA, 15 bp, Homo sapiens
ttgattccatatctt

SEQ ID NO: 470280 - DNA, 15 bp, Homo sapiens
tgattccatatcttg

SEQ ID NO: 470281 - DNA, 15 bp, Homo sapiens
gattccatatcttgg

SEQ ID NO: 470282 - DNA, 15 bp, Homo sapiens
attccatatcttggc

SEQ ID NO: 470283 - DNA, 15 bp, Homo sapiens
tgaataatgctacag

SEQ ID NO: 470284 - DNA, 15 bp, Homo sapiens
gaataatgctacagt

SEQ ID NO: 470285 - DNA, 15 bp, Homo sapiens
aataatgctacagtg

SEQ ID NO: 470286 - DNA, 15 bp, Homo sapiens
ataatgctacagtgc

SEQ ID NO: 470287 - DNA, 15 bp, Homo sapiens
taatgctacagtgca

SEQ ID NO: 470288 - DNA, 15 bp, Homo sapiens
aatgctacagtgcac

SEQ ID NO: 470289 - DNA, 15 bp, Homo sapiens
atgctacagtgcaca

SEQ ID NO: 470290 - DNA, 15 bp, Homo sapiens
tgctacagtgcacat

SEQ ID NO: 470291 - DNA, 15 bp, Homo sapiens
gctacagtgcacata

SEQ ID NO: 470292 - DNA, 15 bp, Homo sapiens
ctacagtgcacatag

SEQ ID NO: 470293 - DNA, 15 bp, Homo sapiens
tacagtgcacatagg

SEQ ID NO: 470294 - DNA, 15 bp, Homo sapiens
acagtgcacatagga

SEQ ID NO: 470295 - DNA, 15 bp, Homo sapiens
cagtgcacataggag

SEQ ID NO: 470296 - DNA, 15 bp, Homo sapiens
agtgcacataggagt

SEQ ID NO: 470297 - DNA, 15 bp, Homo sapiens
gtgcacataggagta

SEQ ID NO: 470298 - DNA, 15 bp, Homo sapiens
tgcacataggagtat

SEQ ID NO: 470299 - DNA, 15 bp, Homo sapiens
gcacataggagtata

SEQ ID NO: 470300 - DNA, 15 bp, Homo sapiens
cacataggagtataa

SEQ ID NO: 470301 - DNA, 15 bp, Homo sapiens
acataggagtataaa

SEQ ID NO: 470302 - DNA, 15 bp, Homo sapiens
cataggagtataaat

SEQ ID NO: 470303 - DNA, 15 bp, Homo sapiens
ataggagtataaata

SEQ ID NO: 470304 - DNA, 15 bp, Homo sapiens
taggagtataaatac

SEQ ID NO: 470305 - DNA, 15 bp, Homo sapiens
aggagtataaatacc

SEQ ID NO: 470306 - DNA, 15 bp, Homo sapiens
ggagtataaatacct

SEQ ID NO: 470307 - DNA, 15 bp, Homo sapiens
gagtataaatacctt

SEQ ID NO: 470308 - DNA, 15 bp, Homo sapiens
agtataaataccttt

SEQ ID NO: 470309 - DNA, 15 bp, Homo sapiens
gtataaatacctttt

SEQ ID NO: 470310 - DNA, 15 bp, Homo sapiens
tataaataccttttg

SEQ ID NO: 470311 - DNA, 15 bp, Homo sapiens
ataaataccttttgg

SEQ ID NO: 470312 - DNA, 15 bp, Homo sapiens
taaataccttttgga

SEQ ID NO: 470313 - DNA, 15 bp, Homo sapiens
aaataccttttggag

SEQ ID NO: 470314 - DNA, 15 bp, Homo sapiens
aataccttttggaga

SEQ ID NO: 470315 - DNA, 15 bp, Homo sapiens
ataccttttggagat

SEQ ID NO: 470316 - DNA, 15 bp, Homo sapiens
taccttttggagata

SEQ ID NO: 470317 - DNA, 15 bp, Homo sapiens
accttttggagataa

SEQ ID NO: 470318 - DNA, 15 bp, Homo sapiens
ccttttggagataat

SEQ ID NO: 470319 - DNA, 15 bp, Homo sapiens
cttttggagataatg

SEQ ID NO: 470320 - DNA, 15 bp, Homo sapiens
ttttggagataatga

SEQ ID NO: 470321 - DNA, 15 bp, Homo sapiens
tttggagataatgat

SEQ ID NO: 470322 - DNA, 15 bp, Homo sapiens
ttggagataatgatt

SEQ ID NO: 470323 - DNA, 15 bp, Homo sapiens
tggagataatgattt

SEQ ID NO: 470324 - DNA, 15 bp, Homo sapiens
ggagataatgatttt

SEQ ID NO: 470325 - DNA, 15 bp, Homo sapiens
gagataatgatttta

SEQ ID NO: 470326 - DNA, 15 bp, Homo sapiens
agataatgattttat

SEQ ID NO: 470327 - DNA, 15 bp, Homo sapiens
gataatgattttatt

SEQ ID NO: 470328 - DNA, 15 bp, Homo sapiens
ataatgattttattt

SEQ ID NO: 470329 - DNA, 15 bp, Homo sapiens
taatgattttatttt

SEQ ID NO: 470330 - DNA, 15 bp, Homo sapiens
aatgattttattttc

SEQ ID NO: 470331 - DNA, 15 bp, Homo sapiens
atgattttattttct

SEQ ID NO: 470332 - DNA, 15 bp, Homo sapiens
tgattttattttctt

SEQ ID NO: 470333 - DNA, 15 bp, Homo sapiens
gattttattttcttt

SEQ ID NO: 470334 - DNA, 15 bp, Homo sapiens
attttattttctttg

SEQ ID NO: 470335 - DNA, 15 bp, Homo sapiens
ttttattttctttgg

SEQ ID NO: 470336 - DNA, 15 bp, Homo sapiens
tttattttctttgga

SEQ ID NO: 470337 - DNA, 15 bp, Homo sapiens
ttattttctttggat

SEQ ID NO: 470338 - DNA, 15 bp, Homo sapiens
tattttctttggata

SEQ ID NO: 470339 - DNA, 15 bp, Homo sapiens
attttctttggatat

SEQ ID NO: 470340 - DNA, 15 bp, Homo sapiens
ttttctttggatatg

SEQ ID NO: 470341 - DNA, 15 bp, Homo sapiens
tttctttggatatgt

SEQ ID NO: 470342 - DNA, 15 bp, Homo sapiens
ttctttggatatgta

SEQ ID NO: 470343 - DNA, 15 bp, Homo sapiens
tctttggatatgtac

SEQ ID NO: 470344 - DNA, 15 bp, Homo sapiens
ctttggatatgtacc

SEQ ID NO: 470345 - DNA, 15 bp, Homo sapiens
tttggatatgtaccc

SEQ ID NO: 470346 - DNA, 15 bp, Homo sapiens
ttggatatgtaccca

SEQ ID NO: 470347 - DNA, 15 bp, Homo sapiens
tggatatgtacccag

SEQ ID NO: 470348 - DNA, 15 bp, Homo sapiens
ggatatgtacccaga

SEQ ID NO: 470349 - DNA, 15 bp, Homo sapiens
gatatgtacccagaa

SEQ ID NO: 470350 - DNA, 15 bp, Homo sapiens
atatgtacccagaag

SEQ ID NO: 470351 - DNA, 15 bp, Homo sapiens
tatgtacccagaagt

SEQ ID NO: 470352 - DNA, 15 bp, Homo sapiens
atgtacccagaagtg

SEQ ID NO: 470353 - DNA, 15 bp, Homo sapiens
tgtacccagaagtgg

SEQ ID NO: 470354 - DNA, 15 bp, Homo sapiens
gtacccagaagtggg

SEQ ID NO: 470355 - DNA, 15 bp, Homo sapiens
tacccagaagtggga

SEQ ID NO: 470356 - DNA, 15 bp, Homo sapiens
gaagtgggattactg

SEQ ID NO: 470357 - DNA, 15 bp, Homo sapiens
aagtgggattactgg

SEQ ID NO: 470358 - DNA, 15 bp, Homo sapiens
agtgggattactgga

SEQ ID NO: 470359 - DNA, 15 bp, Homo sapiens
gtgggattactggat

SEQ ID NO: 470360 - DNA, 15 bp, Homo sapiens
tgggattactggatg

SEQ ID NO: 470361 - DNA, 15 bp, Homo sapiens
gggattactggatga

SEQ ID NO: 470362 - DNA, 15 bp, Homo sapiens
ggattactggatgat

SEQ ID NO: 470363 - DNA, 15 bp, Homo sapiens
gattactggatgata

SEQ ID NO: 470364 - DNA, 15 bp, Homo sapiens
attactggatgatat

SEQ ID NO: 470365 - DNA, 15 bp, Homo sapiens
ttactggatgatatg

SEQ ID NO: 470366 - DNA, 15 bp, Homo sapiens
tactggatgatatga

SEQ ID NO: 470367 - DNA, 15 bp, Homo sapiens
actggatgatatgat

SEQ ID NO: 470368 - DNA, 15 bp, Homo sapiens
ctggatgatatgata

SEQ ID NO: 470369 - DNA, 15 bp, Homo sapiens
tggatgatatgatag

SEQ ID NO: 470370 - DNA, 15 bp, Homo sapiens
ggatgatatgatagt

SEQ ID NO: 470371 - DNA, 15 bp, Homo sapiens
gatgatatgatagtt

SEQ ID NO: 470372 - DNA, 15 bp, Homo sapiens
atgatatgatagttc

SEQ ID NO: 470373 - DNA, 15 bp, Homo sapiens
tgatatgatagttct

SEQ ID NO: 470374 - DNA, 15 bp, Homo sapiens
gatatgatagttcta

SEQ ID NO: 470375 - DNA, 15 bp, Homo sapiens
atatgatagttctat

SEQ ID NO: 470376 - DNA, 15 bp, Homo sapiens
tatgatagttctatt

SEQ ID NO: 470377 - DNA, 15 bp, Homo sapiens
atgatagttctattt

SEQ ID NO: 470378 - DNA, 15 bp, Homo sapiens
tgatagttctatttt

SEQ ID NO: 470379 - DNA, 15 bp, Homo sapiens
gatagttctattttt

SEQ ID NO: 470380 - DNA, 15 bp, Homo sapiens
atagttctattttta

SEQ ID NO: 470381 - DNA, 15 bp, Homo sapiens
tagttctatttttaa

SEQ ID NO: 470382 - DNA, 15 bp, Homo sapiens
agttctatttttaat

SEQ ID NO: 470383 - DNA, 15 bp, Homo sapiens
gttctatttttaatt

SEQ ID NO: 470384 - DNA, 15 bp, Homo sapiens
ttctatttttaattt

SEQ ID NO: 470385 - DNA, 15 bp, Homo sapiens
tctatttttaatttt

SEQ ID NO: 470386 - DNA, 15 bp, Homo sapiens
ctatttttaattttt

SEQ ID NO: 470387 - DNA, 15 bp, Homo sapiens
atttttaatttttta

SEQ ID NO: 470388 - DNA, 15 bp, Homo sapiens
tttttaattttttaa

SEQ ID NO: 470389 - DNA, 15 bp, Homo sapiens
tttaattttttaaag

SEQ ID NO: 470390 - DNA, 15 bp, Homo sapiens
ttaattttttaaaga

SEQ ID NO: 470391 - DNA, 15 bp, Homo sapiens
taattttttaaagaa

SEQ ID NO: 470392 - DNA, 15 bp, Homo sapiens
aattttttaaagaac

SEQ ID NO: 470393 - DNA, 15 bp, Homo sapiens
attttttaaagaacc

SEQ ID NO: 470394 - DNA, 15 bp, Homo sapiens
ttttttaaagaacct

SEQ ID NO: 470395 - DNA, 15 bp, Homo sapiens
tttttaaagaacctt

SEQ ID NO: 470396 - DNA, 15 bp, Homo sapiens
ttttaaagaaccttt

SEQ ID NO: 470397 - DNA, 15 bp, Homo sapiens
tttaaagaaccttta

SEQ ID NO: 470398 - DNA, 15 bp, Homo sapiens
ttaaagaacctttag

SEQ ID NO: 470399 - DNA, 15 bp, Homo sapiens
taaagaacctttaga

SEQ ID NO: 470400 - DNA, 15 bp, Homo sapiens
aaagaacctttagat

SEQ ID NO: 470401 - DNA, 15 bp, Homo sapiens
aagaacctttagatt

SEQ ID NO: 470402 - DNA, 15 bp, Homo sapiens
agaacctttagattg

SEQ ID NO: 470403 - DNA, 15 bp, Homo sapiens
gaacctttagattgt

SEQ ID NO: 470404 - DNA, 15 bp, Homo sapiens
aacctttagattgtt

SEQ ID NO: 470405 - DNA, 15 bp, Homo sapiens
acctttagattgttt

SEQ ID NO: 470406 - DNA, 15 bp, Homo sapiens
cctttagattgtttt

SEQ ID NO: 470407 - DNA, 15 bp, Homo sapiens
ctttagattgttttt

SEQ ID NO: 470408 - DNA, 15 bp, Homo sapiens
tttagattgtttttc

SEQ ID NO: 470409 - DNA, 15 bp, Homo sapiens
ttagattgtttttca

SEQ ID NO: 470410 - DNA, 15 bp, Homo sapiens
tagattgtttttcat

SEQ ID NO: 470411 - DNA, 15 bp, Homo sapiens
agattgtttttcata

SEQ ID NO: 470412 - DNA, 15 bp, Homo sapiens
gattgtttttcataa

SEQ ID NO: 470413 - DNA, 15 bp, Homo sapiens
attgtttttcataat

SEQ ID NO: 470414 - DNA, 15 bp, Homo sapiens
ttgtttttcataatg

SEQ ID NO: 470415 - DNA, 15 bp, Homo sapiens
tgtttttcataatga

SEQ ID NO: 470416 - DNA, 15 bp, Homo sapiens
gtttttcataatgac

SEQ ID NO: 470417 - DNA, 15 bp, Homo sapiens
tttttcataatgact

SEQ ID NO: 470418 - DNA, 15 bp, Homo sapiens
ttttcataatgactg

SEQ ID NO: 470419 - DNA, 15 bp, Homo sapiens
tttcataatgactga

SEQ ID NO: 470420 - DNA, 15 bp, Homo sapiens
ttcataatgactgaa

SEQ ID NO: 470421 - DNA, 15 bp, Homo sapiens
tcataatgactgaac

SEQ ID NO: 470422 - DNA, 15 bp, Homo sapiens
cataatgactgaacc

SEQ ID NO: 470423 - DNA, 15 bp, Homo sapiens
ataatgactgaacca

SEQ ID NO: 470424 - DNA, 15 bp, Homo sapiens
taatgactgaaccaa

SEQ ID NO: 470425 - DNA, 15 bp, Homo sapiens
aatgactgaaccaaa

SEQ ID NO: 470426 - DNA, 15 bp, Homo sapiens
atgactgaaccaaag

SEQ ID NO: 470427 - DNA, 15 bp, Homo sapiens
tgactgaaccaaaga

SEQ ID NO: 470428 - DNA, 15 bp, Homo sapiens
gactgaaccaaagat

SEQ ID NO: 470429 - DNA, 15 bp, Homo sapiens
actgaaccaaagata

SEQ ID NO: 470430 - DNA, 15 bp, Homo sapiens
ctgaaccaaagatag

SEQ ID NO: 470431 - DNA, 15 bp, Homo sapiens
tgaaccaaagatagt

SEQ ID NO: 470432 - DNA, 15 bp, Homo sapiens
gaaccaaagatagtt

SEQ ID NO: 470433 - DNA, 15 bp, Homo sapiens
aaccaaagatagttc

SEQ ID NO: 470434 - DNA, 15 bp, Homo sapiens
accaaagatagttct

SEQ ID NO: 470435 - DNA, 15 bp, Homo sapiens
ccaaagatagttctt

SEQ ID NO: 470436 - DNA, 15 bp, Homo sapiens
caaagatagttcttt

SEQ ID NO: 470437 - DNA, 15 bp, Homo sapiens
aaagatagttcttta

SEQ ID NO: 470438 - DNA, 15 bp, Homo sapiens
aagatagttctttaa

SEQ ID NO: 470439 - DNA, 15 bp, Homo sapiens
agatagttctttaag

SEQ ID NO: 470440 - DNA, 15 bp, Homo sapiens
gatagttctttaagt

SEQ ID NO: 470441 - DNA, 15 bp, Homo sapiens
atagttctttaagtt

SEQ ID NO: 470442 - DNA, 15 bp, Homo sapiens
tagttctttaagttg

SEQ ID NO: 470443 - DNA, 15 bp, Homo sapiens
agttctttaagttgg

SEQ ID NO: 470444 - DNA, 15 bp, Homo sapiens
gttctttaagttgga

SEQ ID NO: 470445 - DNA, 15 bp, Homo sapiens
ttctttaagttggag

SEQ ID NO: 470446 - DNA, 15 bp, Homo sapiens
tctttaagttggaga

SEQ ID NO: 470447 - DNA, 15 bp, Homo sapiens
ctttaagttggagag

SEQ ID NO: 470448 - DNA, 15 bp, Homo sapiens
tttaagttggagagt

SEQ ID NO: 470449 - DNA, 15 bp, Homo sapiens
ttaagttggagagtt

SEQ ID NO: 470450 - DNA, 15 bp, Homo sapiens
taagttggagagttc

SEQ ID NO: 470451 - DNA, 15 bp, Homo sapiens
aagttggagagttct

SEQ ID NO: 470452 - DNA, 15 bp, Homo sapiens
agttggagagttctt

SEQ ID NO: 470453 - DNA, 15 bp, Homo sapiens
gttggagagttcttc

SEQ ID NO: 470454 - DNA, 15 bp, Homo sapiens
ttggagagttcttct

SEQ ID NO: 470455 - DNA, 15 bp, Homo sapiens
tggagagttcttctt

SEQ ID NO: 470456 - DNA, 15 bp, Homo sapiens
ggagagttcttcttt

SEQ ID NO: 470457 - DNA, 15 bp, Homo sapiens
gagagttcttcttta

SEQ ID NO: 470458 - DNA, 15 bp, Homo sapiens
agagttcttctttaa

SEQ ID NO: 470459 - DNA, 15 bp, Homo sapiens
gagttcttctttaaa

SEQ ID NO: 470460 - DNA, 15 bp, Homo sapiens
agttcttctttaaat

SEQ ID NO: 470461 - DNA, 15 bp, Homo sapiens
gttcttctttaaatt

SEQ ID NO: 470462 - DNA, 15 bp, Homo sapiens
ttcttctttaaattt

SEQ ID NO: 470463 - DNA, 15 bp, Homo sapiens
tcttctttaaatttc

SEQ ID NO: 470464 - DNA, 15 bp, Homo sapiens
cttctttaaatttca

SEQ ID NO: 470465 - DNA, 15 bp, Homo sapiens
ttctttaaatttcac

SEQ ID NO: 470466 - DNA, 15 bp, Homo sapiens
tctttaaatttcaca

SEQ ID NO: 470467 - DNA, 15 bp, Homo sapiens
ctttaaatttcacat

SEQ ID NO: 470468 - DNA, 15 bp, Homo sapiens
tttaaatttcacatg

SEQ ID NO: 470469 - DNA, 15 bp, Homo sapiens
ttaaatttcacatga

SEQ ID NO: 470470 - DNA, 15 bp, Homo sapiens
taaatttcacatgat

SEQ ID NO: 470471 - DNA, 15 bp, Homo sapiens
aaatttcacatgatt

SEQ ID NO: 470472 - DNA, 15 bp, Homo sapiens
aatttcacatgattt

SEQ ID NO: 470473 - DNA, 15 bp, Homo sapiens
atttcacatgattta

SEQ ID NO: 470474 - DNA, 15 bp, Homo sapiens
tttcacatgatttat

SEQ ID NO: 470475 - DNA, 15 bp, Homo sapiens
ttcacatgatttata

SEQ ID NO: 470476 - DNA, 15 bp, Homo sapiens
tcacatgatttataa

SEQ ID NO: 470477 - DNA, 15 bp, Homo sapiens
cacatgatttataaa

SEQ ID NO: 470478 - DNA, 15 bp, Homo sapiens
acatgatttataaaa

SEQ ID NO: 470479 - DNA, 15 bp, Homo sapiens
catgatttataaaag

SEQ ID NO: 470480 - DNA, 15 bp, Homo sapiens
atgatttataaaagt

SEQ ID NO: 470481 - DNA, 15 bp, Homo sapiens
tgatttataaaagtt

SEQ ID NO: 470482 - DNA, 15 bp, Homo sapiens
gatttataaaagttc

SEQ ID NO: 470483 - DNA, 15 bp, Homo sapiens
atttataaaagttca

SEQ ID NO: 470484 - DNA, 15 bp, Homo sapiens
tttataaaagttcat

SEQ ID NO: 470485 - DNA, 15 bp, Homo sapiens
ttataaaagttcata

SEQ ID NO: 470486 - DNA, 15 bp, Homo sapiens
tataaaagttcatac

SEQ ID NO: 470487 - DNA, 15 bp, Homo sapiens
ataaaagttcataca

SEQ ID NO: 470488 - DNA, 15 bp, Homo sapiens
taaaagttcatacaa

SEQ ID NO: 470489 - DNA, 15 bp, Homo sapiens
aaaagttcatacaat

SEQ ID NO: 470490 - DNA, 15 bp, Homo sapiens
aaagttcatacaatt

SEQ ID NO: 470491 - DNA, 15 bp, Homo sapiens
aagttcatacaattg

SEQ ID NO: 470492 - DNA, 15 bp, Homo sapiens
agttcatacaattgc

SEQ ID NO: 470493 - DNA, 15 bp, Homo sapiens
gttcatacaattgct

SEQ ID NO: 470494 - DNA, 15 bp, Homo sapiens
ttcatacaattgctg

SEQ ID NO: 470495 - DNA, 15 bp, Homo sapiens
tcatacaattgctga

SEQ ID NO: 470496 - DNA, 15 bp, Homo sapiens
catacaattgctgac

SEQ ID NO: 470497 - DNA, 15 bp, Homo sapiens
atacaattgctgaca

SEQ ID NO: 470498 - DNA, 15 bp, Homo sapiens
tacaattgctgacag

SEQ ID NO: 470499 - DNA, 15 bp, Homo sapiens
acaattgctgacagt

SEQ ID NO: 470500 - DNA, 15 bp, Homo sapiens
caattgctgacagtg

SEQ ID NO: 470501 - DNA, 15 bp, Homo sapiens
aattgctgacagtga

SEQ ID NO: 470502 - DNA, 15 bp, Homo sapiens
attgctgacagtgag

SEQ ID NO: 470503 - DNA, 15 bp, Homo sapiens
ttgctgacagtgaga

SEQ ID NO: 470504 - DNA, 15 bp, Homo sapiens
tgctgacagtgagag

SEQ ID NO: 470505 - DNA, 15 bp, Homo sapiens
gctgacagtgagaga

SEQ ID NO: 470506 - DNA, 15 bp, Homo sapiens
ctgacagtgagagag

SEQ ID NO: 470507 - DNA, 15 bp, Homo sapiens
tgacagtgagagaga

SEQ ID NO: 470508 - DNA, 15 bp, Homo sapiens
gacagtgagagagaa

SEQ ID NO: 470509 - DNA, 15 bp, Homo sapiens
acagtgagagagaag

SEQ ID NO: 470510 - DNA, 15 bp, Homo sapiens
cagtgagagagaagt

SEQ ID NO: 470511 - DNA, 15 bp, Homo sapiens
agtgagagagaagtg

SEQ ID NO: 470512 - DNA, 15 bp, Homo sapiens
gtgagagagaagtgg

SEQ ID NO: 470513 - DNA, 15 bp, Homo sapiens
tgagagagaagtgga

SEQ ID NO: 470514 - DNA, 15 bp, Homo sapiens
gagagagaagtggat

SEQ ID NO: 470515 - DNA, 15 bp, Homo sapiens
agagagaagtggata

SEQ ID NO: 470516 - DNA, 15 bp, Homo sapiens
gagagaagtggatag

SEQ ID NO: 470517 - DNA, 15 bp, Homo sapiens
agagaagtggatagg

SEQ ID NO: 470518 - DNA, 15 bp, Homo sapiens
gagaagtggataggg

SEQ ID NO: 470519 - DNA, 15 bp, Homo sapiens
aacaacccttttttc

SEQ ID NO: 470520 - DNA, 15 bp, Homo sapiens
acaacccttttttct

SEQ ID NO: 470521 - DNA, 15 bp, Homo sapiens
caacccttttttctc

SEQ ID NO: 470522 - DNA, 15 bp, Homo sapiens
aacccttttttctcc

SEQ ID NO: 470523 - DNA, 15 bp, Homo sapiens
acccttttttctcca

SEQ ID NO: 470524 - DNA, 15 bp, Homo sapiens
cccttttttctccac

SEQ ID NO: 470525 - DNA, 15 bp, Homo sapiens
ccttttttctccaca

SEQ ID NO: 470526 - DNA, 15 bp, Homo sapiens
cttttttctccacag

SEQ ID NO: 470527 - DNA, 15 bp, Homo sapiens
ttttttctccacagg

SEQ ID NO: 470528 - DNA, 15 bp, Homo sapiens
tttttctccacaggg

SEQ ID NO: 470529 - DNA, 15 bp, Homo sapiens
ttttctccacagggt

SEQ ID NO: 470530 - DNA, 15 bp, Homo sapiens
tttctccacagggtt

SEQ ID NO: 470531 - DNA, 15 bp, Homo sapiens
ttctccacagggttt

SEQ ID NO: 470532 - DNA, 15 bp, Homo sapiens
tctccacagggtttc

SEQ ID NO: 470533 - DNA, 15 bp, Homo sapiens
ctccacagggtttcc

SEQ ID NO: 470534 - DNA, 15 bp, Homo sapiens
tccacagggtttcct

SEQ ID NO: 470535 - DNA, 15 bp, Homo sapiens
ccacagggtttcctt

SEQ ID NO: 470536 - DNA, 15 bp, Homo sapiens
cacagggtttccttg

SEQ ID NO: 470537 - DNA, 15 bp, Homo sapiens
acagggtttccttga

SEQ ID NO: 470538 - DNA, 15 bp, Homo sapiens
cagggtttccttgaa

SEQ ID NO: 470539 - DNA, 15 bp, Homo sapiens
agggtttccttgaat

SEQ ID NO: 470540 - DNA, 15 bp, Homo sapiens
gggtttccttgaatt

SEQ ID NO: 470541 - DNA, 15 bp, Homo sapiens
ggtttccttgaattc

SEQ ID NO: 470542 - DNA, 15 bp, Homo sapiens
gtttccttgaattct

SEQ ID NO: 470543 - DNA, 15 bp, Homo sapiens
tttccttgaattctt

SEQ ID NO: 470544 - DNA, 15 bp, Homo sapiens
ttccttgaattcttt

SEQ ID NO: 470545 - DNA, 15 bp, Homo sapiens
tccttgaattctttt

SEQ ID NO: 470546 - DNA, 15 bp, Homo sapiens
ccttgaattcttttt

SEQ ID NO: 470547 - DNA, 15 bp, Homo sapiens
cttgaattctttttc

SEQ ID NO: 470548 - DNA, 15 bp, Homo sapiens
ttgaattctttttct

SEQ ID NO: 470549 - DNA, 15 bp, Homo sapiens
tgaattctttttctt

SEQ ID NO: 470550 - DNA, 15 bp, Homo sapiens
gaattctttttcttt

SEQ ID NO: 470551 - DNA, 15 bp, Homo sapiens
aattctttttctttt

SEQ ID NO: 470552 - DNA, 15 bp, Homo sapiens
attctttttcttttc

SEQ ID NO: 470553 - DNA, 15 bp, Homo sapiens
ttctttttcttttca

SEQ ID NO: 470554 - DNA, 15 bp, Homo sapiens
tctttttcttttcat

SEQ ID NO: 470555 - DNA, 15 bp, Homo sapiens
ctttttcttttcatg

SEQ ID NO: 470556 - DNA, 15 bp, Homo sapiens
tttttcttttcatga

SEQ ID NO: 470557 - DNA, 15 bp, Homo sapiens
ttttcttttcatgaa

SEQ ID NO: 470558 - DNA, 15 bp, Homo sapiens
tttcttttcatgaat

SEQ ID NO: 470559 - DNA, 15 bp, Homo sapiens
ttcttttcatgaata

SEQ ID NO: 470560 - DNA, 15 bp, Homo sapiens
tcttttcatgaatac

SEQ ID NO: 470561 - DNA, 15 bp, Homo sapiens
cttttcatgaatacc

SEQ ID NO: 470562 - DNA, 15 bp, Homo sapiens
ttttcatgaatacct

SEQ ID NO: 470563 - DNA, 15 bp, Homo sapiens
tttcatgaatacctt

SEQ ID NO: 470564 - DNA, 15 bp, Homo sapiens
ttcatgaataccttt

SEQ ID NO: 470565 - DNA, 15 bp, Homo sapiens
tcatgaatacctttt

SEQ ID NO: 470566 - DNA, 15 bp, Homo sapiens
catgaataccttttt

SEQ ID NO: 470567 - DNA, 15 bp, Homo sapiens
atgaatacctttttc

SEQ ID NO: 470568 - DNA, 15 bp, Homo sapiens
gaatacctttttctt

SEQ ID NO: 470569 - DNA, 15 bp, Homo sapiens
aatacctttttcttc

SEQ ID NO: 470570 - DNA, 15 bp, Homo sapiens
atacctttttcttct

SEQ ID NO: 470571 - DNA, 15 bp, Homo sapiens
tacctttttcttctg

SEQ ID NO: 470572 - DNA, 15 bp, Homo sapiens
acctttttcttctgc

SEQ ID NO: 470573 - DNA, 15 bp, Homo sapiens
cctttttcttctgca

SEQ ID NO: 470574 - DNA, 15 bp, Homo sapiens
ctttttcttctgcac

SEQ ID NO: 470575 - DNA, 15 bp, Homo sapiens
tttttcttctgcact

SEQ ID NO: 470576 - DNA, 15 bp, Homo sapiens
ttttcttctgcactt

SEQ ID NO: 470577 - DNA, 15 bp, Homo sapiens
tttcttctgcacttt

SEQ ID NO: 470578 - DNA, 15 bp, Homo sapiens
ttcttctgcactttt

SEQ ID NO: 470579 - DNA, 15 bp, Homo sapiens
tcttctgcacttttg

SEQ ID NO: 470580 - DNA, 15 bp, Homo sapiens
cttctgcacttttgc

SEQ ID NO: 470581 - DNA, 15 bp, Homo sapiens
ttctgcacttttgct

SEQ ID NO: 470582 - DNA, 15 bp, Homo sapiens
tctgcacttttgctt

SEQ ID NO: 470583 - DNA, 15 bp, Homo sapiens
ctgcacttttgcttt

SEQ ID NO: 470584 - DNA, 15 bp, Homo sapiens
tgcacttttgctttg

SEQ ID NO: 470585 - DNA, 15 bp, Homo sapiens
gcacttttgctttgc

SEQ ID NO: 470586 - DNA, 15 bp, Homo sapiens
cacttttgctttgca

SEQ ID NO: 470587 - DNA, 15 bp, Homo sapiens
acttttgctttgcat

SEQ ID NO: 470588 - DNA, 15 bp, Homo sapiens
cttttgctttgcatt

SEQ ID NO: 470589 - DNA, 15 bp, Homo sapiens
tttgctttgcatttg

SEQ ID NO: 470590 - DNA, 15 bp, Homo sapiens
ttgctttgcatttgg

SEQ ID NO: 470591 - DNA, 15 bp, Homo sapiens
tgctttgcatttggg

SEQ ID NO: 470592 - DNA, 15 bp, Homo sapiens
gctttgcatttggga

SEQ ID NO: 470593 - DNA, 15 bp, Homo sapiens
ctttgcatttgggaa

SEQ ID NO: 470594 - DNA, 15 bp, Homo sapiens
tttgcatttgggaag

SEQ ID NO: 470595 - DNA, 15 bp, Homo sapiens
ttgcatttgggaagc

SEQ ID NO: 470596 - DNA, 15 bp, Homo sapiens
tgcatttgggaagcc

SEQ ID NO: 470597 - DNA, 15 bp, Homo sapiens
gcatttgggaagccc

SEQ ID NO: 470598 - DNA, 15 bp, Homo sapiens
catttgggaagccct

SEQ ID NO: 470599 - DNA, 15 bp, Homo sapiens
atttgggaagcccta

SEQ ID NO: 470600 - DNA, 15 bp, Homo sapiens
tttgggaagccctat

SEQ ID NO: 470601 - DNA, 15 bp, Homo sapiens
ttgggaagccctata

SEQ ID NO: 470602 - DNA, 15 bp, Homo sapiens
tgggaagccctatat

SEQ ID NO: 470603 - DNA, 15 bp, Homo sapiens
gggaagccctatatc

SEQ ID NO: 470604 - DNA, 15 bp, Homo sapiens
ggaagccctatatcc

SEQ ID NO: 470605 - DNA, 15 bp, Homo sapiens
gaagccctatatcca

SEQ ID NO: 470606 - DNA, 15 bp, Homo sapiens
aagccctatatccat

SEQ ID NO: 470607 - DNA, 15 bp, Homo sapiens
agccctatatccata

SEQ ID NO: 470608 - DNA, 15 bp, Homo sapiens
gccctatatccatat

SEQ ID NO: 470609 - DNA, 15 bp, Homo sapiens
ccctatatccatata

SEQ ID NO: 470610 - DNA, 15 bp, Homo sapiens
cctatatccatataa

SEQ ID NO: 470611 - DNA, 15 bp, Homo sapiens
ctatatccatataac

SEQ ID NO: 470612 - DNA, 15 bp, Homo sapiens
tatatccatataact

SEQ ID NO: 470613 - DNA, 15 bp, Homo sapiens
atatccatataactg

SEQ ID NO: 470614 - DNA, 15 bp, Homo sapiens
tatccatataactgc

SEQ ID NO: 470615 - DNA, 15 bp, Homo sapiens
atccatataactgca

SEQ ID NO: 470616 - DNA, 15 bp, Homo sapiens
tccatataactgcag

SEQ ID NO: 470617 - DNA, 15 bp, Homo sapiens
ccatataactgcaga

SEQ ID NO: 470618 - DNA, 15 bp, Homo sapiens
catataactgcagat

SEQ ID NO: 470619 - DNA, 15 bp, Homo sapiens
atataactgcagatc

SEQ ID NO: 470620 - DNA, 15 bp, Homo sapiens
tataactgcagatca

SEQ ID NO: 470621 - DNA, 15 bp, Homo sapiens
ataactgcagatcat

SEQ ID NO: 470622 - DNA, 15 bp, Homo sapiens
taactgcagatcatt

SEQ ID NO: 470623 - DNA, 15 bp, Homo sapiens
aactgcagatcatta

SEQ ID NO: 470624 - DNA, 15 bp, Homo sapiens
actgcagatcattat

SEQ ID NO: 470625 - DNA, 15 bp, Homo sapiens
ctgcagatcattatg

SEQ ID NO: 470626 - DNA, 15 bp, Homo sapiens
tgcagatcattatgt

SEQ ID NO: 470627 - DNA, 15 bp, Homo sapiens
gcagatcattatgta

SEQ ID NO: 470628 - DNA, 15 bp, Homo sapiens
cagatcattatgtag

SEQ ID NO: 470629 - DNA, 15 bp, Homo sapiens
agatcattatgtagt

SEQ ID NO: 470630 - DNA, 15 bp, Homo sapiens
gatcattatgtagtt

SEQ ID NO: 470631 - DNA, 15 bp, Homo sapiens
atcattatgtagtta

SEQ ID NO: 470632 - DNA, 15 bp, Homo sapiens
tcattatgtagttaa

SEQ ID NO: 470633 - DNA, 15 bp, Homo sapiens
cattatgtagttaat

SEQ ID NO: 470634 - DNA, 15 bp, Homo sapiens
attatgtagttaata

SEQ ID NO: 470635 - DNA, 15 bp, Homo sapiens
ttatgtagttaatat

SEQ ID NO: 470636 - DNA, 15 bp, Homo sapiens
tatgtagttaatatt

SEQ ID NO: 470637 - DNA, 15 bp, Homo sapiens
atgtagttaatattc

SEQ ID NO: 470638 - DNA, 15 bp, Homo sapiens
tgtagttaatattca

SEQ ID NO: 470639 - DNA, 15 bp, Homo sapiens
gtagttaatattcag

SEQ ID NO: 470640 - DNA, 15 bp, Homo sapiens
tagttaatattcagt

SEQ ID NO: 470641 - DNA, 15 bp, Homo sapiens
agttaatattcagtt

SEQ ID NO: 470642 - DNA, 15 bp, Homo sapiens
gttaatattcagtta

SEQ ID NO: 470643 - DNA, 15 bp, Homo sapiens
ttaatattcagttat

SEQ ID NO: 470644 - DNA, 15 bp, Homo sapiens
taatattcagttatt

SEQ ID NO: 470645 - DNA, 15 bp, Homo sapiens
aatattcagttattc

SEQ ID NO: 470646 - DNA, 15 bp, Homo sapiens
atattcagttattca

SEQ ID NO: 470647 - DNA, 15 bp, Homo sapiens
tattcagttattcag

SEQ ID NO: 470648 - DNA, 15 bp, Homo sapiens
attcagttattcagg

SEQ ID NO: 470649 - DNA, 15 bp, Homo sapiens
ttcagttattcagga

SEQ ID NO: 470650 - DNA, 15 bp, Homo sapiens
tcagttattcaggaa

SEQ ID NO: 470651 - DNA, 15 bp, Homo sapiens
cagttattcaggaaa

SEQ ID NO: 470652 - DNA, 15 bp, Homo sapiens
agttattcaggaaaa

SEQ ID NO: 470653 - DNA, 15 bp, Homo sapiens
gttattcaggaaaag

SEQ ID NO: 470654 - DNA, 15 bp, Homo sapiens
ttattcaggaaaaga

SEQ ID NO: 470655 - DNA, 15 bp, Homo sapiens
tattcaggaaaagat

SEQ ID NO: 470656 - DNA, 15 bp, Homo sapiens
attcaggaaaagatg

SEQ ID NO: 470657 - DNA, 15 bp, Homo sapiens
ttcaggaaaagatgg

SEQ ID NO: 470658 - DNA, 15 bp, Homo sapiens
tcaggaaaagatggg

SEQ ID NO: 470659 - DNA, 15 bp, Homo sapiens
caggaaaagatgggt

SEQ ID NO: 470660 - DNA, 15 bp, Homo sapiens
aggaaaagatgggtc

SEQ ID NO: 470661 - DNA, 15 bp, Homo sapiens
ggaaaagatgggtca

SEQ ID NO: 470662 - DNA, 15 bp, Homo sapiens
gaaaagatgggtcat

SEQ ID NO: 470663 - DNA, 15 bp, Homo sapiens
aaaagatgggtcatt

SEQ ID NO: 470664 - DNA, 15 bp, Homo sapiens
aaagatgggtcattg

SEQ ID NO: 470665 - DNA, 15 bp, Homo sapiens
aagatgggtcattgt

SEQ ID NO: 470666 - DNA, 15 bp, Homo sapiens
agatgggtcattgtg

SEQ ID NO: 470667 - DNA, 15 bp, Homo sapiens
gatgggtcattgtga

SEQ ID NO: 470668 - DNA, 15 bp, Homo sapiens
atgggtcattgtgaa

SEQ ID NO: 470669 - DNA, 15 bp, Homo sapiens
tgggtcattgtgaat

SEQ ID NO: 470670 - DNA, 15 bp, Homo sapiens
gggtcattgtgaatc

SEQ ID NO: 470671 - DNA, 15 bp, Homo sapiens
ggtcattgtgaatct

SEQ ID NO: 470672 - DNA, 15 bp, Homo sapiens
gtcattgtgaatctg

SEQ ID NO: 470673 - DNA, 15 bp, Homo sapiens
tcattgtgaatctga

SEQ ID NO: 470674 - DNA, 15 bp, Homo sapiens
cattgtgaatctgat

SEQ ID NO: 470675 - DNA, 15 bp, Homo sapiens
attgtgaatctgatg

SEQ ID NO: 470676 - DNA, 15 bp, Homo sapiens
ttgtgaatctgatgg

SEQ ID NO: 470677 - DNA, 15 bp, Homo sapiens
tgtgaatctgatggc

SEQ ID NO: 470678 - DNA, 15 bp, Homo sapiens
gtgaatctgatggca

SEQ ID NO: 470679 - DNA, 15 bp, Homo sapiens
tgaatctgatggcaa

SEQ ID NO: 470680 - DNA, 15 bp, Homo sapiens
gaatctgatggcaaa

SEQ ID NO: 470681 - DNA, 15 bp, Homo sapiens
aatctgatggcaaag

SEQ ID NO: 470682 - DNA, 15 bp, Homo sapiens
atctgatggcaaagc

SEQ ID NO: 470683 - DNA, 15 bp, Homo sapiens
tctgatggcaaagcc

SEQ ID NO: 470684 - DNA, 15 bp, Homo sapiens
ctgatggcaaagcct

SEQ ID NO: 470685 - DNA, 15 bp, Homo sapiens
tgatggcaaagcctg

SEQ ID NO: 470686 - DNA, 15 bp, Homo sapiens
gatggcaaagcctgg

SEQ ID NO: 470687 - DNA, 15 bp, Homo sapiens
atggcaaagcctggt

SEQ ID NO: 470688 - DNA, 15 bp, Homo sapiens
tggcaaagcctggtg

SEQ ID NO: 470689 - DNA, 15 bp, Homo sapiens
ggcaaagcctggtga

SEQ ID NO: 470690 - DNA, 15 bp, Homo sapiens
gcaaagcctggtgat

SEQ ID NO: 470691 - DNA, 15 bp, Homo sapiens
caaagcctggtgata

SEQ ID NO: 470692 - DNA, 15 bp, Homo sapiens
aaagcctggtgatag

SEQ ID NO: 470693 - DNA, 15 bp, Homo sapiens
aagcctggtgatagc

SEQ ID NO: 470694 - DNA, 15 bp, Homo sapiens
agcctggtgatagca

SEQ ID NO: 470695 - DNA, 15 bp, Homo sapiens
gcctggtgatagcat

SEQ ID NO: 470696 - DNA, 15 bp, Homo sapiens
cctggtgatagcatg

SEQ ID NO: 470697 - DNA, 15 bp, Homo sapiens
ctggtgatagcatgg

SEQ ID NO: 470698 - DNA, 15 bp, Homo sapiens
tggtgatagcatggg

SEQ ID NO: 470699 - DNA, 15 bp, Homo sapiens
ggtgatagcatgggg

SEQ ID NO: 470700 - DNA, 15 bp, Homo sapiens
gtgatagcatggggc

SEQ ID NO: 470701 - DNA, 15 bp, Homo sapiens
tgatagcatggggct

SEQ ID NO: 470702 - DNA, 15 bp, Homo sapiens
gatagcatggggctg

SEQ ID NO: 470703 - DNA, 15 bp, Homo sapiens
atagcatggggctgg

SEQ ID NO: 470704 - DNA, 15 bp, Homo sapiens
tagcatggggctggc

SEQ ID NO: 470705 - DNA, 15 bp, Homo sapiens
agcatggggctggca

SEQ ID NO: 470706 - DNA, 15 bp, Homo sapiens
gcatggggctggcac

SEQ ID NO: 470707 - DNA, 15 bp, Homo sapiens
catggggctggcacc

SEQ ID NO: 470708 - DNA, 15 bp, Homo sapiens
atggggctggcacct

SEQ ID NO: 470709 - DNA, 15 bp, Homo sapiens
tggggctggcacctt

SEQ ID NO: 470710 - DNA, 15 bp, Homo sapiens
ggggctggcaccttg

SEQ ID NO: 470711 - DNA, 15 bp, Homo sapiens
gggctggcaccttgt

SEQ ID NO: 470712 - DNA, 15 bp, Homo sapiens
ggctggcaccttgtt

SEQ ID NO: 470713 - DNA, 15 bp, Homo sapiens
gctggcaccttgttg

SEQ ID NO: 470714 - DNA, 15 bp, Homo sapiens
ctggcaccttgttgc

SEQ ID NO: 470715 - DNA, 15 bp, Homo sapiens
tggcaccttgttgca

SEQ ID NO: 470716 - DNA, 15 bp, Homo sapiens
ggcaccttgttgcag

SEQ ID NO: 470717 - DNA, 15 bp, Homo sapiens
gcaccttgttgcagg

SEQ ID NO: 470718 - DNA, 15 bp, Homo sapiens
caccttgttgcaggt

SEQ ID NO: 470719 - DNA, 15 bp, Homo sapiens
accttgttgcaggtt

SEQ ID NO: 470720 - DNA, 15 bp, Homo sapiens
ccttgttgcaggttg

SEQ ID NO: 470721 - DNA, 15 bp, Homo sapiens
cttgttgcaggttgt

SEQ ID NO: 470722 - DNA, 15 bp, Homo sapiens
ttgttgcaggttgtt

SEQ ID NO: 470723 - DNA, 15 bp, Homo sapiens
tgttgcaggttgttt

SEQ ID NO: 470724 - DNA, 15 bp, Homo sapiens
gttgcaggttgtttg

SEQ ID NO: 470725 - DNA, 15 bp, Homo sapiens
ttgcaggttgtttgt

SEQ ID NO: 470726 - DNA, 15 bp, Homo sapiens
tgcaggttgtttgtt

SEQ ID NO: 470727 - DNA, 15 bp, Homo sapiens
gcaggttgtttgttt

SEQ ID NO: 470728 - DNA, 15 bp, Homo sapiens
caggttgtttgtttt

SEQ ID NO: 470729 - DNA, 15 bp, Homo sapiens
aggttgtttgttttg

SEQ ID NO: 470730 - DNA, 15 bp, Homo sapiens
ggttgtttgttttgt

SEQ ID NO: 470731 - DNA, 15 bp, Homo sapiens
gttgtttgttttgtc

SEQ ID NO: 470732 - DNA, 15 bp, Homo sapiens
ttgtttgttttgtca

SEQ ID NO: 470733 - DNA, 15 bp, Homo sapiens
tgtttgttttgtcag

SEQ ID NO: 470734 - DNA, 15 bp, Homo sapiens
gtttgttttgtcagt

SEQ ID NO: 470735 - DNA, 15 bp, Homo sapiens
tttgttttgtcagtg

SEQ ID NO: 470736 - DNA, 15 bp, Homo sapiens
ttgttttgtcagtgt

SEQ ID NO: 470737 - DNA, 15 bp, Homo sapiens
tgttttgtcagtgta

SEQ ID NO: 470738 - DNA, 15 bp, Homo sapiens
gttttgtcagtgtaa

SEQ ID NO: 470739 - DNA, 15 bp, Homo sapiens
ttttgtcagtgtaaa

SEQ ID NO: 470740 - DNA, 15 bp, Homo sapiens
tttgtcagtgtaaaa

SEQ ID NO: 470741 - DNA, 15 bp, Homo sapiens
ttgtcagtgtaaaaa

SEQ ID NO: 470742 - DNA, 15 bp, Homo sapiens
tgtcagtgtaaaaac

SEQ ID NO: 470743 - DNA, 15 bp, Homo sapiens
gtcagtgtaaaaact

SEQ ID NO: 470744 - DNA, 15 bp, Homo sapiens
tcagtgtaaaaactg

SEQ ID NO: 470745 - DNA, 15 bp, Homo sapiens
cagtgtaaaaactga

SEQ ID NO: 470746 - DNA, 15 bp, Homo sapiens
agtgtaaaaactgat

SEQ ID NO: 470747 - DNA, 15 bp, Homo sapiens
gtgtaaaaactgatg

SEQ ID NO: 470748 - DNA, 15 bp, Homo sapiens
tgtaaaaactgatga

SEQ ID NO: 470749 - DNA, 15 bp, Homo sapiens
gtaaaaactgatgaa

SEQ ID NO: 470750 - DNA, 15 bp, Homo sapiens
taaaaactgatgaat

SEQ ID NO: 470751 - DNA, 15 bp, Homo sapiens
aaaaactgatgaatt

SEQ ID NO: 470752 - DNA, 15 bp, Homo sapiens
aaaactgatgaattt

SEQ ID NO: 470753 - DNA, 15 bp, Homo sapiens
aaactgatgaatttt

SEQ ID NO: 470754 - DNA, 15 bp, Homo sapiens
aactgatgaatttta

SEQ ID NO: 470755 - DNA, 15 bp, Homo sapiens
actgatgaattttaa

SEQ ID NO: 470756 - DNA, 15 bp, Homo sapiens
ctgatgaattttaaa

SEQ ID NO: 470757 - DNA, 15 bp, Homo sapiens
tgatgaattttaaat

SEQ ID NO: 470758 - DNA, 15 bp, Homo sapiens
gatgaattttaaatg

SEQ ID NO: 470759 - DNA, 15 bp, Homo sapiens
atgaattttaaatga

SEQ ID NO: 470760 - DNA, 15 bp, Homo sapiens
tgaattttaaatgat

SEQ ID NO: 470761 - DNA, 15 bp, Homo sapiens
gaattttaaatgata

SEQ ID NO: 470762 - DNA, 15 bp, Homo sapiens
aattttaaatgataa

SEQ ID NO: 470763 - DNA, 15 bp, Homo sapiens
attttaaatgataag

SEQ ID NO: 470764 - DNA, 15 bp, Homo sapiens
ttttaaatgataagt

SEQ ID NO: 470765 - DNA, 15 bp, Homo sapiens
tttaaatgataagta

SEQ ID NO: 470766 - DNA, 15 bp, Homo sapiens
ttaaatgataagtag

SEQ ID NO: 470767 - DNA, 15 bp, Homo sapiens
taaatgataagtagc

SEQ ID NO: 470768 - DNA, 15 bp, Homo sapiens
aaatgataagtagct

SEQ ID NO: 470769 - DNA, 15 bp, Homo sapiens
aatgataagtagctg

SEQ ID NO: 470770 - DNA, 15 bp, Homo sapiens
atgataagtagctgc

SEQ ID NO: 470771 - DNA, 15 bp, Homo sapiens
tgataagtagctgcg

SEQ ID NO: 470772 - DNA, 15 bp, Homo sapiens
gataagtagctgcgg

SEQ ID NO: 470773 - DNA, 15 bp, Homo sapiens
ataagtagctgcggc

SEQ ID NO: 470774 - DNA, 15 bp, Homo sapiens
taagtagctgcggct

SEQ ID NO: 470775 - DNA, 15 bp, Homo sapiens
aagtagctgcggctt

SEQ ID NO: 470776 - DNA, 15 bp, Homo sapiens
agtagctgcggctta

SEQ ID NO: 470777 - DNA, 15 bp, Homo sapiens
gtagctgcggcttaa

SEQ ID NO: 470778 - DNA, 15 bp, Homo sapiens
tagctgcggcttaat

SEQ ID NO: 470779 - DNA, 15 bp, Homo sapiens
agctgcggcttaatc

SEQ ID NO: 470780 - DNA, 15 bp, Homo sapiens
gctgcggcttaatca

SEQ ID NO: 470781 - DNA, 15 bp, Homo sapiens
ctgcggcttaatcat

SEQ ID NO: 470782 - DNA, 15 bp, Homo sapiens
tgcggcttaatcatg

SEQ ID NO: 470783 - DNA, 15 bp, Homo sapiens
gcggcttaatcatgt

SEQ ID NO: 470784 - DNA, 15 bp, Homo sapiens
cggcttaatcatgtc

SEQ ID NO: 470785 - DNA, 15 bp, Homo sapiens
ggcttaatcatgtct

SEQ ID NO: 470786 - DNA, 15 bp, Homo sapiens
gcttaatcatgtctc

SEQ ID NO: 470787 - DNA, 15 bp, Homo sapiens
cttaatcatgtctca

SEQ ID NO: 470788 - DNA, 15 bp, Homo sapiens
ttaatcatgtctcat

SEQ ID NO: 470789 - DNA, 15 bp, Homo sapiens
taatcatgtctcatc

SEQ ID NO: 470790 - DNA, 15 bp, Homo sapiens
aatcatgtctcatct

SEQ ID NO: 470791 - DNA, 15 bp, Homo sapiens
atcatgtctcatctc

SEQ ID NO: 470792 - DNA, 15 bp, Homo sapiens
tcatgtctcatctct

SEQ ID NO: 470793 - DNA, 15 bp, Homo sapiens
catgtctcatctctg

SEQ ID NO: 470794 - DNA, 15 bp, Homo sapiens
atgtctcatctctgc

SEQ ID NO: 470795 - DNA, 15 bp, Homo sapiens
tgtctcatctctgct

SEQ ID NO: 470796 - DNA, 15 bp, Homo sapiens
gtctcatctctgctt

SEQ ID NO: 470797 - DNA, 15 bp, Homo sapiens
tctcatctctgcttt

SEQ ID NO: 470798 - DNA, 15 bp, Homo sapiens
ctcatctctgctttg

SEQ ID NO: 470799 - DNA, 15 bp, Homo sapiens
tcatctctgctttgc

SEQ ID NO: 470800 - DNA, 15 bp, Homo sapiens
catctctgctttgca

SEQ ID NO: 470801 - DNA, 15 bp, Homo sapiens
atctctgctttgcaa

SEQ ID NO: 470802 - DNA, 15 bp, Homo sapiens
tctctgctttgcaag

SEQ ID NO: 470803 - DNA, 15 bp, Homo sapiens
ctctgctttgcaagc

SEQ ID NO: 470804 - DNA, 15 bp, Homo sapiens
tctgctttgcaagcc

SEQ ID NO: 470805 - DNA, 15 bp, Homo sapiens
ctgctttgcaagcca

SEQ ID NO: 470806 - DNA, 15 bp, Homo sapiens
tgctttgcaagccaa

SEQ ID NO: 470807 - DNA, 15 bp, Homo sapiens
gctttgcaagccaag

SEQ ID NO: 470808 - DNA, 15 bp, Homo sapiens
ctttgcaagccaaga

SEQ ID NO: 470809 - DNA, 15 bp, Homo sapiens
tttgcaagccaagag

SEQ ID NO: 470810 - DNA, 15 bp, Homo sapiens
ttgcaagccaagaga

SEQ ID NO: 470811 - DNA, 15 bp, Homo sapiens
tgcaagccaagagaa

SEQ ID NO: 470812 - DNA, 15 bp, Homo sapiens
gcaagccaagagaat

SEQ ID NO: 470813 - DNA, 15 bp, Homo sapiens
caagccaagagaatc

SEQ ID NO: 470814 - DNA, 15 bp, Homo sapiens
aagccaagagaatca

SEQ ID NO: 470815 - DNA, 15 bp, Homo sapiens
agccaagagaatcaa

SEQ ID NO: 470816 - DNA, 15 bp, Homo sapiens
gccaagagaatcaaa

SEQ ID NO: 470817 - DNA, 15 bp, Homo sapiens
ccaagagaatcaaaa

SEQ ID NO: 470818 - DNA, 15 bp, Homo sapiens
caagagaatcaaaag

SEQ ID NO: 470819 - DNA, 15 bp, Homo sapiens
aagagaatcaaaagt

SEQ ID NO: 470820 - DNA, 15 bp, Homo sapiens
agagaatcaaaagtt

SEQ ID NO: 470821 - DNA, 15 bp, Homo sapiens
gagaatcaaaagttc

SEQ ID NO: 470822 - DNA, 15 bp, Homo sapiens
agaatcaaaagttcc

SEQ ID NO: 470823 - DNA, 15 bp, Homo sapiens
gaatcaaaagttccc

SEQ ID NO: 470824 - DNA, 15 bp, Homo sapiens
aatcaaaagttccct

SEQ ID NO: 470825 - DNA, 15 bp, Homo sapiens
atcaaaagttccctt

SEQ ID NO: 470826 - DNA, 15 bp, Homo sapiens
tcaaaagttccctta

SEQ ID NO: 470827 - DNA, 15 bp, Homo sapiens
caaaagttcccttaa

SEQ ID NO: 470828 - DNA, 15 bp, Homo sapiens
aaaagttcccttaat

SEQ ID NO: 470829 - DNA, 15 bp, Homo sapiens
aaagttcccttaatt

SEQ ID NO: 470830 - DNA, 15 bp, Homo sapiens
aagttcccttaatta

SEQ ID NO: 470831 - DNA, 15 bp, Homo sapiens
agttcccttaattat

SEQ ID NO: 470832 - DNA, 15 bp, Homo sapiens
gttcccttaattatt

SEQ ID NO: 470833 - DNA, 15 bp, Homo sapiens
ttcccttaattattg

SEQ ID NO: 470834 - DNA, 15 bp, Homo sapiens
tcccttaattattga

SEQ ID NO: 470835 - DNA, 15 bp, Homo sapiens
cccttaattattgac

SEQ ID NO: 470836 - DNA, 15 bp, Homo sapiens
ccttaattattgact

SEQ ID NO: 470837 - DNA, 15 bp, Homo sapiens
cttaattattgacta

SEQ ID NO: 470838 - DNA, 15 bp, Homo sapiens
ttaattattgactag

SEQ ID NO: 470839 - DNA, 15 bp, Homo sapiens
taattattgactaga

SEQ ID NO: 470840 - DNA, 15 bp, Homo sapiens
aattattgactagaa

SEQ ID NO: 470841 - DNA, 15 bp, Homo sapiens
attattgactagaag

SEQ ID NO: 470842 - DNA, 15 bp, Homo sapiens
ttattgactagaagc

SEQ ID NO: 470843 - DNA, 15 bp, Homo sapiens
tattgactagaagca

SEQ ID NO: 470844 - DNA, 15 bp, Homo sapiens
attgactagaagcag

SEQ ID NO: 470845 - DNA, 15 bp, Homo sapiens
ttgactagaagcaga

SEQ ID NO: 470846 - DNA, 15 bp, Homo sapiens
tgactagaagcagac

SEQ ID NO: 470847 - DNA, 15 bp, Homo sapiens
gactagaagcagaca

SEQ ID NO: 470848 - DNA, 15 bp, Homo sapiens
actagaagcagacat

SEQ ID NO: 470849 - DNA, 15 bp, Homo sapiens
ctagaagcagacatg

SEQ ID NO: 470850 - DNA, 15 bp, Homo sapiens
tagaagcagacatgt

SEQ ID NO: 470851 - DNA, 15 bp, Homo sapiens
agaagcagacatgtt

SEQ ID NO: 470852 - DNA, 15 bp, Homo sapiens
gaagcagacatgttt

SEQ ID NO: 470853 - DNA, 15 bp, Homo sapiens
aagcagacatgtttt

SEQ ID NO: 470854 - DNA, 15 bp, Homo sapiens
agcagacatgttttg

SEQ ID NO: 470855 - DNA, 15 bp, Homo sapiens
gcagacatgttttga

SEQ ID NO: 470856 - DNA, 15 bp, Homo sapiens
cagacatgttttgat

SEQ ID NO: 470857 - DNA, 15 bp, Homo sapiens
agacatgttttgata

SEQ ID NO: 470858 - DNA, 15 bp, Homo sapiens
gacatgttttgatag

SEQ ID NO: 470859 - DNA, 15 bp, Homo sapiens
acatgttttgataga

SEQ ID NO: 470860 - DNA, 15 bp, Homo sapiens
catgttttgatagaa

SEQ ID NO: 470861 - DNA, 15 bp, Homo sapiens
atgttttgatagaag

SEQ ID NO: 470862 - DNA, 15 bp, Homo sapiens
tgttttgatagaagg

SEQ ID NO: 470863 - DNA, 15 bp, Homo sapiens
gttttgatagaaggg

SEQ ID NO: 470864 - DNA, 15 bp, Homo sapiens
ttttgatagaagggg

SEQ ID NO: 470865 - DNA, 15 bp, Homo sapiens
tttgatagaagggga

SEQ ID NO: 470866 - DNA, 15 bp, Homo sapiens
ttgatagaaggggaa

SEQ ID NO: 470867 - DNA, 15 bp, Homo sapiens
tgatagaaggggaat

SEQ ID NO: 470868 - DNA, 15 bp, Homo sapiens
gatagaaggggaatg

SEQ ID NO: 470869 - DNA, 15 bp, Homo sapiens
atagaaggggaatgg

SEQ ID NO: 470870 - DNA, 15 bp, Homo sapiens
tagaaggggaatgga

SEQ ID NO: 470871 - DNA, 15 bp, Homo sapiens
agaaggggaatggat

SEQ ID NO: 470872 - DNA, 15 bp, Homo sapiens
gaaggggaatggata

SEQ ID NO: 470873 - DNA, 15 bp, Homo sapiens
aaggggaatggatag

SEQ ID NO: 470874 - DNA, 15 bp, Homo sapiens
aggggaatggataga

SEQ ID NO: 470875 - DNA, 15 bp, Homo sapiens
ggggaatggatagaa

SEQ ID NO: 470876 - DNA, 15 bp, Homo sapiens
gggaatggatagaaa

SEQ ID NO: 470877 - DNA, 15 bp, Homo sapiens
ggaatggatagaaag

SEQ ID NO: 470878 - DNA, 15 bp, Homo sapiens
gaatggatagaaagt

SEQ ID NO: 470879 - DNA, 15 bp, Homo sapiens
aatggatagaaagtg

SEQ ID NO: 470880 - DNA, 15 bp, Homo sapiens
atggatagaaagtgg

SEQ ID NO: 470881 - DNA, 15 bp, Homo sapiens
tggatagaaagtggc

SEQ ID NO: 470882 - DNA, 15 bp, Homo sapiens
ggatagaaagtggca

SEQ ID NO: 470883 - DNA, 15 bp, Homo sapiens
gatagaaagtggcaa

SEQ ID NO: 470884 - DNA, 15 bp, Homo sapiens
atagaaagtggcaaa

SEQ ID NO: 470885 - DNA, 15 bp, Homo sapiens
tagaaagtggcaaaa

SEQ ID NO: 470886 - DNA, 15 bp, Homo sapiens
agaaagtggcaaaac

SEQ ID NO: 470887 - DNA, 15 bp, Homo sapiens
gaaagtggcaaaact

SEQ ID NO: 470888 - DNA, 15 bp, Homo sapiens
aaagtggcaaaacta

SEQ ID NO: 470889 - DNA, 15 bp, Homo sapiens
aagtggcaaaactat

SEQ ID NO: 470890 - DNA, 15 bp, Homo sapiens
agtggcaaaactata

SEQ ID NO: 470891 - DNA, 15 bp, Homo sapiens
gtggcaaaactatat

SEQ ID NO: 470892 - DNA, 15 bp, Homo sapiens
tggcaaaactatata

SEQ ID NO: 470893 - DNA, 15 bp, Homo sapiens
ggcaaaactatataa

SEQ ID NO: 470894 - DNA, 15 bp, Homo sapiens
gcaaaactatataag

SEQ ID NO: 470895 - DNA, 15 bp, Homo sapiens
caaaactatataagg

SEQ ID NO: 470896 - DNA, 15 bp, Homo sapiens
aaaactatataaggg

SEQ ID NO: 470897 - DNA, 15 bp, Homo sapiens
aaactatataagggt

SEQ ID NO: 470898 - DNA, 15 bp, Homo sapiens
aactatataagggtt

SEQ ID NO: 470899 - DNA, 15 bp, Homo sapiens
actatataagggtta

SEQ ID NO: 470900 - DNA, 15 bp, Homo sapiens
ctatataagggttaa

SEQ ID NO: 470901 - DNA, 15 bp, Homo sapiens
tatataagggttaac

SEQ ID NO: 470902 - DNA, 15 bp, Homo sapiens
atataagggttaact

SEQ ID NO: 470903 - DNA, 15 bp, Homo sapiens
tataagggttaactc

SEQ ID NO: 470904 - DNA, 15 bp, Homo sapiens
ataagggttaactca

SEQ ID NO: 470905 - DNA, 15 bp, Homo sapiens
taagggttaactcag

SEQ ID NO: 470906 - DNA, 15 bp, Homo sapiens
aagggttaactcaga

SEQ ID NO: 470907 - DNA, 15 bp, Homo sapiens
agggttaactcagaa

SEQ ID NO: 470908 - DNA, 15 bp, Homo sapiens
gggttaactcagaac

SEQ ID NO: 470909 - DNA, 15 bp, Homo sapiens
ggttaactcagaact

SEQ ID NO: 470910 - DNA, 15 bp, Homo sapiens
gttaactcagaactt

SEQ ID NO: 470911 - DNA, 15 bp, Homo sapiens
ttaactcagaactta

SEQ ID NO: 470912 - DNA, 15 bp, Homo sapiens
taactcagaacttag

SEQ ID NO: 470913 - DNA, 15 bp, Homo sapiens
aactcagaacttagt

SEQ ID NO: 470914 - DNA, 15 bp, Homo sapiens
actcagaacttagtt

SEQ ID NO: 470915 - DNA, 15 bp, Homo sapiens
ctcagaacttagttg

SEQ ID NO: 470916 - DNA, 15 bp, Homo sapiens
tcagaacttagttgt

SEQ ID NO: 470917 - DNA, 15 bp, Homo sapiens
cagaacttagttgtt

SEQ ID NO: 470918 - DNA, 15 bp, Homo sapiens
agaacttagttgttt

SEQ ID NO: 470919 - DNA, 15 bp, Homo sapiens
gaacttagttgtttt

SEQ ID NO: 470920 - DNA, 15 bp, Homo sapiens
aacttagttgttttc

SEQ ID NO: 470921 - DNA, 15 bp, Homo sapiens
acttagttgttttca

SEQ ID NO: 470922 - DNA, 15 bp, Homo sapiens
cttagttgttttcaa

SEQ ID NO: 470923 - DNA, 15 bp, Homo sapiens
ttagttgttttcaaa

SEQ ID NO: 470924 - DNA, 15 bp, Homo sapiens
tagttgttttcaaaa

SEQ ID NO: 470925 - DNA, 15 bp, Homo sapiens
agttgttttcaaaaa

SEQ ID NO: 470926 - DNA, 15 bp, Homo sapiens
gttgttttcaaaaat

SEQ ID NO: 470927 - DNA, 15 bp, Homo sapiens
ttgttttcaaaaata

SEQ ID NO: 470928 - DNA, 15 bp, Homo sapiens
tgttttcaaaaatag

SEQ ID NO: 470929 - DNA, 15 bp, Homo sapiens
gttttcaaaaatagt

SEQ ID NO: 470930 - DNA, 15 bp, Homo sapiens
ttttcaaaaatagtt

SEQ ID NO: 470931 - DNA, 15 bp, Homo sapiens
tttcaaaaatagttt

SEQ ID NO: 470932 - DNA, 15 bp, Homo sapiens
ttcaaaaatagtttg

SEQ ID NO: 470933 - DNA, 15 bp, Homo sapiens
tcaaaaatagtttgg

SEQ ID NO: 470934 - DNA, 15 bp, Homo sapiens
caaaaatagtttggt

SEQ ID NO: 470935 - DNA, 15 bp, Homo sapiens
aaaaatagtttggtt

SEQ ID NO: 470936 - DNA, 15 bp, Homo sapiens
aaaatagtttggttt

SEQ ID NO: 470937 - DNA, 15 bp, Homo sapiens
aaatagtttggtttt

SEQ ID NO: 470938 - DNA, 15 bp, Homo sapiens
aatagtttggttttt

SEQ ID NO: 470939 - DNA, 15 bp, Homo sapiens
atagtttggtttttg

SEQ ID NO: 470940 - DNA, 15 bp, Homo sapiens
tagtttggtttttgt

SEQ ID NO: 470941 - DNA, 15 bp, Homo sapiens
agtttggtttttgtt

SEQ ID NO: 470942 - DNA, 15 bp, Homo sapiens
gtttggtttttgttt

SEQ ID NO: 470943 - DNA, 15 bp, Homo sapiens
tggtttttgtttttg

SEQ ID NO: 470944 - DNA, 15 bp, Homo sapiens
ggtttttgtttttgt

SEQ ID NO: 470945 - DNA, 15 bp, Homo sapiens
tgtttttgttttttt

SEQ ID NO: 470946 - DNA, 15 bp, Homo sapiens
gtttttgtttttttc

SEQ ID NO: 470947 - DNA, 15 bp, Homo sapiens
tttttgtttttttca

SEQ ID NO: 470948 - DNA, 15 bp, Homo sapiens
ttttgtttttttcaa

SEQ ID NO: 470949 - DNA, 15 bp, Homo sapiens
tttgtttttttcaat

SEQ ID NO: 470950 - DNA, 15 bp, Homo sapiens
ttgtttttttcaatt

SEQ ID NO: 470951 - DNA, 15 bp, Homo sapiens
tgtttttttcaattt

SEQ ID NO: 470952 - DNA, 15 bp, Homo sapiens
gtttttttcaatttt

SEQ ID NO: 470953 - DNA, 15 bp, Homo sapiens
tttttttcaattttt

SEQ ID NO: 470954 - DNA, 15 bp, Homo sapiens
ttttttcaatttttg

SEQ ID NO: 470955 - DNA, 15 bp, Homo sapiens
tttttcaatttttgg

SEQ ID NO: 470956 - DNA, 15 bp, Homo sapiens
ttttcaatttttggt

SEQ ID NO: 470957 - DNA, 15 bp, Homo sapiens
tttcaatttttggtt

SEQ ID NO: 470958 - DNA, 15 bp, Homo sapiens
ttcaatttttggttg

SEQ ID NO: 470959 - DNA, 15 bp, Homo sapiens
tcaatttttggttgg

SEQ ID NO: 470960 - DNA, 15 bp, Homo sapiens
caatttttggttggg

SEQ ID NO: 470961 - DNA, 15 bp, Homo sapiens
aatttttggttgggt

SEQ ID NO: 470962 - DNA, 15 bp, Homo sapiens
atttttggttgggtg

SEQ ID NO: 470963 - DNA, 15 bp, Homo sapiens
tttttggttgggtgc

SEQ ID NO: 470964 - DNA, 15 bp, Homo sapiens
ttttggttgggtgca

SEQ ID NO: 470965 - DNA, 15 bp, Homo sapiens
tttggttgggtgcag

SEQ ID NO: 470966 - DNA, 15 bp, Homo sapiens
ttggttgggtgcagt

SEQ ID NO: 470967 - DNA, 15 bp, Homo sapiens
tggttgggtgcagtg

SEQ ID NO: 470968 - DNA, 15 bp, Homo sapiens
ggttgggtgcagtgg

SEQ ID NO: 470969 - DNA, 15 bp, Homo sapiens
gttgggtgcagtggc

SEQ ID NO: 470970 - DNA, 15 bp, Homo sapiens
ttgggtgcagtggct

SEQ ID NO: 470971 - DNA, 15 bp, Homo sapiens
gtgcagtggctcaca

SEQ ID NO: 470972 - DNA, 15 bp, Homo sapiens
tgcagtggctcacac

SEQ ID NO: 470973 - DNA, 15 bp, Homo sapiens
cagcactttgggaat

SEQ ID NO: 470974 - DNA, 15 bp, Homo sapiens
agcactttgggaatc

SEQ ID NO: 470975 - DNA, 15 bp, Homo sapiens
gcactttgggaatct

SEQ ID NO: 470976 - DNA, 15 bp, Homo sapiens
cactttgggaatctg

SEQ ID NO: 470977 - DNA, 15 bp, Homo sapiens
actttgggaatctga

SEQ ID NO: 470978 - DNA, 15 bp, Homo sapiens
ctttgggaatctgag

SEQ ID NO: 470979 - DNA, 15 bp, Homo sapiens
tttgggaatctgagg

SEQ ID NO: 470980 - DNA, 15 bp, Homo sapiens
ttgggaatctgaggc

SEQ ID NO: 470981 - DNA, 15 bp, Homo sapiens
tgggaatctgaggca

SEQ ID NO: 470982 - DNA, 15 bp, Homo sapiens
gggaatctgaggcag

SEQ ID NO: 470983 - DNA, 15 bp, Homo sapiens
ggaatctgaggcagg

SEQ ID NO: 470984 - DNA, 15 bp, Homo sapiens
gaatctgaggcaggt

SEQ ID NO: 470985 - DNA, 15 bp, Homo sapiens
aatctgaggcaggtg

SEQ ID NO: 470986 - DNA, 15 bp, Homo sapiens
atctgaggcaggtga

SEQ ID NO: 470987 - DNA, 15 bp, Homo sapiens
tctgaggcaggtgaa

SEQ ID NO: 470988 - DNA, 15 bp, Homo sapiens
gaggcaggtgaatca

SEQ ID NO: 470989 - DNA, 15 bp, Homo sapiens
aggcaggtgaatcac

SEQ ID NO: 470990 - DNA, 15 bp, Homo sapiens
ggcaggtgaatcact

SEQ ID NO: 470991 - DNA, 15 bp, Homo sapiens
gcaggtgaatcactt

SEQ ID NO: 470992 - DNA, 15 bp, Homo sapiens
caggtgaatcacttg

SEQ ID NO: 470993 - DNA, 15 bp, Homo sapiens
aggtgaatcacttga

SEQ ID NO: 470994 - DNA, 15 bp, Homo sapiens
ggtgaatcacttgag

SEQ ID NO: 470995 - DNA, 15 bp, Homo sapiens
gtgaatcacttgagg

SEQ ID NO: 470996 - DNA, 15 bp, Homo sapiens
tgaatcacttgaggt

SEQ ID NO: 470997 - DNA, 15 bp, Homo sapiens
gaatcacttgaggtc

SEQ ID NO: 470998 - DNA, 15 bp, Homo sapiens
aatcacttgaggtca

SEQ ID NO: 470999 - DNA, 15 bp, Homo sapiens
gtgaaaccccgtcta

SEQ ID NO: 471000 - DNA, 15 bp, Homo sapiens
tgaaaccccgtctac

SEQ ID NO: 471001 - DNA, 15 bp, Homo sapiens
gaaaccccgtctact

SEQ ID NO: 471002 - DNA, 15 bp, Homo sapiens
aaaccccgtctacta

SEQ ID NO: 471003 - DNA, 15 bp, Homo sapiens
aaccccgtctactaa

SEQ ID NO: 471004 - DNA, 15 bp, Homo sapiens
accccgtctactaaa

SEQ ID NO: 471005 - DNA, 15 bp, Homo sapiens
ccccgtctactaaaa

SEQ ID NO: 471006 - DNA, 15 bp, Homo sapiens
cccgtctactaaaaa

SEQ ID NO: 471007 - DNA, 15 bp, Homo sapiens
ccgtctactaaaaat

SEQ ID NO: 471008 - DNA, 15 bp, Homo sapiens
cgtctactaaaaata

SEQ ID NO: 471009 - DNA, 15 bp, Homo sapiens
gtctactaaaaatac

SEQ ID NO: 471010 - DNA, 15 bp, Homo sapiens
gggtgtggtggtgcg

SEQ ID NO: 471011 - DNA, 15 bp, Homo sapiens
ggtgtggtggtgcgc

SEQ ID NO: 471012 - DNA, 15 bp, Homo sapiens
gtgtggtggtgcgca

SEQ ID NO: 471013 - DNA, 15 bp, Homo sapiens
tgtggtggtgcgcac

SEQ ID NO: 471014 - DNA, 15 bp, Homo sapiens
aggaggctgaggcac

SEQ ID NO: 471015 - DNA, 15 bp, Homo sapiens
gaggcacgagaatcg

SEQ ID NO: 471016 - DNA, 15 bp, Homo sapiens
aggcacgagaatcgg

SEQ ID NO: 471017 - DNA, 15 bp, Homo sapiens
ggcacgagaatcggc

SEQ ID NO: 471018 - DNA, 15 bp, Homo sapiens
gcacgagaatcggct

SEQ ID NO: 471019 - DNA, 15 bp, Homo sapiens
cacgagaatcggctg

SEQ ID NO: 471020 - DNA, 15 bp, Homo sapiens
acgagaatcggctga

SEQ ID NO: 471021 - DNA, 15 bp, Homo sapiens
cgagaatcggctgaa

SEQ ID NO: 471022 - DNA, 15 bp, Homo sapiens
gagaatcggctgaac

SEQ ID NO: 471023 - DNA, 15 bp, Homo sapiens
agaatcggctgaact

SEQ ID NO: 471024 - DNA, 15 bp, Homo sapiens
gaatcggctgaactt

SEQ ID NO: 471025 - DNA, 15 bp, Homo sapiens
aatcggctgaacttg

SEQ ID NO: 471026 - DNA, 15 bp, Homo sapiens
atcggctgaacttgg

SEQ ID NO: 471027 - DNA, 15 bp, Homo sapiens
tcggctgaacttggg

SEQ ID NO: 471028 - DNA, 15 bp, Homo sapiens
cggctgaacttggga

SEQ ID NO: 471029 - DNA, 15 bp, Homo sapiens
ggctgaacttgggag

SEQ ID NO: 471030 - DNA, 15 bp, Homo sapiens
gctgaacttgggagg

SEQ ID NO: 471031 - DNA, 15 bp, Homo sapiens
ctgaacttgggaggc

SEQ ID NO: 471032 - DNA, 15 bp, Homo sapiens
tgaacttgggaggca

SEQ ID NO: 471033 - DNA, 15 bp, Homo sapiens
gaacttgggaggcag

SEQ ID NO: 471034 - DNA, 15 bp, Homo sapiens
aacttgggaggcaga

SEQ ID NO: 471035 - DNA, 15 bp, Homo sapiens
acttgggaggcagag

SEQ ID NO: 471036 - DNA, 15 bp, Homo sapiens
cttgggaggcagagg

SEQ ID NO: 471037 - DNA, 15 bp, Homo sapiens
ttgggaggcagaggt

SEQ ID NO: 471038 - DNA, 15 bp, Homo sapiens
atcgtgccattgcat

SEQ ID NO: 471039 - DNA, 15 bp, Homo sapiens
tcgtgccattgcatg

SEQ ID NO: 471040 - DNA, 15 bp, Homo sapiens
cgtgccattgcatgc

SEQ ID NO: 471041 - DNA, 15 bp, Homo sapiens
gtgccattgcatgcc

SEQ ID NO: 471042 - DNA, 15 bp, Homo sapiens
tgccattgcatgcca

SEQ ID NO: 471043 - DNA, 15 bp, Homo sapiens
gccattgcatgccag

SEQ ID NO: 471044 - DNA, 15 bp, Homo sapiens
ccattgcatgccagc

SEQ ID NO: 471045 - DNA, 15 bp, Homo sapiens
cattgcatgccagct

SEQ ID NO: 471046 - DNA, 15 bp, Homo sapiens
attgcatgccagctt

SEQ ID NO: 471047 - DNA, 15 bp, Homo sapiens
ttgcatgccagcttg

SEQ ID NO: 471048 - DNA, 15 bp, Homo sapiens
tgcatgccagcttgg

SEQ ID NO: 471049 - DNA, 15 bp, Homo sapiens
gcatgccagcttggg

SEQ ID NO: 471050 - DNA, 15 bp, Homo sapiens
catgccagcttgggc

SEQ ID NO: 471051 - DNA, 15 bp, Homo sapiens
atgccagcttgggca

SEQ ID NO: 471052 - DNA, 15 bp, Homo sapiens
tgccagcttgggcaa

SEQ ID NO: 471053 - DNA, 15 bp, Homo sapiens
gccagcttgggcaac

SEQ ID NO: 471054 - DNA, 15 bp, Homo sapiens
cttgggcaacagagc

SEQ ID NO: 471055 - DNA, 15 bp, Homo sapiens
ttgggcaacagagcg

SEQ ID NO: 471056 - DNA, 15 bp, Homo sapiens
aaaaaaataaaaaaa

SEQ ID NO: 471057 - DNA, 15 bp, Homo sapiens
aaaaaataaaaaaag

SEQ ID NO: 471058 - DNA, 15 bp, Homo sapiens
aaaaataaaaaaagt

SEQ ID NO: 471059 - DNA, 15 bp, Homo sapiens
aaaataaaaaaagtt

SEQ ID NO: 471060 - DNA, 15 bp, Homo sapiens
aaataaaaaaagttt

SEQ ID NO: 471061 - DNA, 15 bp, Homo sapiens
aataaaaaaagtttc

SEQ ID NO: 471062 - DNA, 15 bp, Homo sapiens
ataaaaaaagtttct

SEQ ID NO: 471063 - DNA, 15 bp, Homo sapiens
taaaaaaagtttctg

SEQ ID NO: 471064 - DNA, 15 bp, Homo sapiens
aaaaaaagtttctgt

SEQ ID NO: 471065 - DNA, 15 bp, Homo sapiens
aaaaaagtttctgtc

SEQ ID NO: 471066 - DNA, 15 bp, Homo sapiens
aaaaagtttctgtct

SEQ ID NO: 471067 - DNA, 15 bp, Homo sapiens
aaaagtttctgtctg

SEQ ID NO: 471068 - DNA, 15 bp, Homo sapiens
aaagtttctgtctgc

SEQ ID NO: 471069 - DNA, 15 bp, Homo sapiens
aagtttctgtctgca

SEQ ID NO: 471070 - DNA, 15 bp, Homo sapiens
agtttctgtctgcaa

SEQ ID NO: 471071 - DNA, 15 bp, Homo sapiens
gtttctgtctgcaaa

SEQ ID NO: 471072 - DNA, 15 bp, Homo sapiens
tttctgtctgcaaaa

SEQ ID NO: 471073 - DNA, 15 bp, Homo sapiens
ttctgtctgcaaaac

SEQ ID NO: 471074 - DNA, 15 bp, Homo sapiens
tctgtctgcaaaaca

SEQ ID NO: 471075 - DNA, 15 bp, Homo sapiens
ctgtctgcaaaacaa

SEQ ID NO: 471076 - DNA, 15 bp, Homo sapiens
tgtctgcaaaacaag

SEQ ID NO: 471077 - DNA, 15 bp, Homo sapiens
gtctgcaaaacaagt

SEQ ID NO: 471078 - DNA, 15 bp, Homo sapiens
tctgcaaaacaagtt

SEQ ID NO: 471079 - DNA, 15 bp, Homo sapiens
ctgcaaaacaagttt

SEQ ID NO: 471080 - DNA, 15 bp, Homo sapiens
tgcaaaacaagtttc

SEQ ID NO: 471081 - DNA, 15 bp, Homo sapiens
gcaaaacaagtttct

SEQ ID NO: 471082 - DNA, 15 bp, Homo sapiens
caaaacaagtttctg

SEQ ID NO: 471083 - DNA, 15 bp, Homo sapiens
aaaacaagtttctgt

SEQ ID NO: 471084 - DNA, 15 bp, Homo sapiens
aaacaagtttctgtg

SEQ ID NO: 471085 - DNA, 15 bp, Homo sapiens
aacaagtttctgtga

SEQ ID NO: 471086 - DNA, 15 bp, Homo sapiens
acaagtttctgtgag

SEQ ID NO: 471087 - DNA, 15 bp, Homo sapiens
caagtttctgtgagt

SEQ ID NO: 471088 - DNA, 15 bp, Homo sapiens
aagtttctgtgagtc

SEQ ID NO: 471089 - DNA, 15 bp, Homo sapiens
agtttctgtgagtcc

SEQ ID NO: 471090 - DNA, 15 bp, Homo sapiens
gtttctgtgagtcct

SEQ ID NO: 471091 - DNA, 15 bp, Homo sapiens
tttctgtgagtcctg

SEQ ID NO: 471092 - DNA, 15 bp, Homo sapiens
ttctgtgagtcctgg

SEQ ID NO: 471093 - DNA, 15 bp, Homo sapiens
tctgtgagtcctggg

SEQ ID NO: 471094 - DNA, 15 bp, Homo sapiens
ctgtgagtcctgggc

SEQ ID NO: 471095 - DNA, 15 bp, Homo sapiens
tgtgagtcctgggca

SEQ ID NO: 471096 - DNA, 15 bp, Homo sapiens
gtgagtcctgggcat

SEQ ID NO: 471097 - DNA, 15 bp, Homo sapiens
tgagtcctgggcatg

SEQ ID NO: 471098 - DNA, 15 bp, Homo sapiens
gagtcctgggcatgc

SEQ ID NO: 471099 - DNA, 15 bp, Homo sapiens
agtcctgggcatgca

SEQ ID NO: 471100 - DNA, 15 bp, Homo sapiens
gtcctgggcatgcat

SEQ ID NO: 471101 - DNA, 15 bp, Homo sapiens
tcctgggcatgcatg

SEQ ID NO: 471102 - DNA, 15 bp, Homo sapiens
cctgggcatgcatgt

SEQ ID NO: 471103 - DNA, 15 bp, Homo sapiens
ctgggcatgcatgtt

SEQ ID NO: 471104 - DNA, 15 bp, Homo sapiens
tgggcatgcatgttg

SEQ ID NO: 471105 - DNA, 15 bp, Homo sapiens
gggcatgcatgttgt

SEQ ID NO: 471106 - DNA, 15 bp, Homo sapiens
ggcatgcatgttgtg

SEQ ID NO: 471107 - DNA, 15 bp, Homo sapiens
gcatgcatgttgtga

SEQ ID NO: 471108 - DNA, 15 bp, Homo sapiens
catgcatgttgtgaa

SEQ ID NO: 471109 - DNA, 15 bp, Homo sapiens
atgcatgttgtgaag

SEQ ID NO: 471110 - DNA, 15 bp, Homo sapiens
tgcatgttgtgaagg

SEQ ID NO: 471111 - DNA, 15 bp, Homo sapiens
gcatgttgtgaagga

SEQ ID NO: 471112 - DNA, 15 bp, Homo sapiens
catgttgtgaaggaa

SEQ ID NO: 471113 - DNA, 15 bp, Homo sapiens
atgttgtgaaggaaa

SEQ ID NO: 471114 - DNA, 15 bp, Homo sapiens
tgttgtgaaggaaaa

SEQ ID NO: 471115 - DNA, 15 bp, Homo sapiens
gttgtgaaggaaaag

SEQ ID NO: 471116 - DNA, 15 bp, Homo sapiens
ttgtgaaggaaaagc

SEQ ID NO: 471117 - DNA, 15 bp, Homo sapiens
tgtgaaggaaaagct

SEQ ID NO: 471118 - DNA, 15 bp, Homo sapiens
gtgaaggaaaagctg

SEQ ID NO: 471119 - DNA, 15 bp, Homo sapiens
tgaaggaaaagctga

SEQ ID NO: 471120 - DNA, 15 bp, Homo sapiens
gaaggaaaagctgaa

SEQ ID NO: 471121 - DNA, 15 bp, Homo sapiens
aaggaaaagctgaag

SEQ ID NO: 471122 - DNA, 15 bp, Homo sapiens
aggaaaagctgaagg

SEQ ID NO: 471123 - DNA, 15 bp, Homo sapiens
ggaaaagctgaaggg

SEQ ID NO: 471124 - DNA, 15 bp, Homo sapiens
gaaaagctgaagggc

SEQ ID NO: 471125 - DNA, 15 bp, Homo sapiens
aaaagctgaagggca

SEQ ID NO: 471126 - DNA, 15 bp, Homo sapiens
aaagctgaagggcag

SEQ ID NO: 471127 - DNA, 15 bp, Homo sapiens
aagctgaagggcagg

SEQ ID NO: 471128 - DNA, 15 bp, Homo sapiens
agctgaagggcaggg

SEQ ID NO: 471129 - DNA, 15 bp, Homo sapiens
gctgaagggcaggga

SEQ ID NO: 471130 - DNA, 15 bp, Homo sapiens
ctgaagggcagggac

SEQ ID NO: 471131 - DNA, 15 bp, Homo sapiens
tgaagggcagggaca

SEQ ID NO: 471132 - DNA, 15 bp, Homo sapiens
gaagggcagggacag

SEQ ID NO: 471133 - DNA, 15 bp, Homo sapiens
aagggcagggacagg

SEQ ID NO: 471134 - DNA, 15 bp, Homo sapiens
agggcagggacaggg

SEQ ID NO: 471135 - DNA, 15 bp, Homo sapiens
gggcagggacaggga

SEQ ID NO: 471136 - DNA, 15 bp, Homo sapiens
ggcagggacagggag

SEQ ID NO: 471137 - DNA, 15 bp, Homo sapiens
gcagggacagggagc

SEQ ID NO: 471138 - DNA, 15 bp, Homo sapiens
cagggacagggagca

SEQ ID NO: 471139 - DNA, 15 bp, Homo sapiens
agggacagggagcag

SEQ ID NO: 471140 - DNA, 15 bp, Homo sapiens
gggacagggagcagg

SEQ ID NO: 471141 - DNA, 15 bp, Homo sapiens
ggacagggagcaggc

SEQ ID NO: 471142 - DNA, 15 bp, Homo sapiens
gacagggagcaggca

SEQ ID NO: 471143 - DNA, 15 bp, Homo sapiens
acagggagcaggcag

SEQ ID NO: 471144 - DNA, 15 bp, Homo sapiens
cagggagcaggcagc

SEQ ID NO: 471145 - DNA, 15 bp, Homo sapiens
agggagcaggcagca

SEQ ID NO: 471146 - DNA, 15 bp, Homo sapiens
gggagcaggcagcag

SEQ ID NO: 471147 - DNA, 15 bp, Homo sapiens
ggagcaggcagcagg

SEQ ID NO: 471148 - DNA, 15 bp, Homo sapiens
gagcaggcagcaggt

SEQ ID NO: 471149 - DNA, 15 bp, Homo sapiens
agcaggcagcaggta

SEQ ID NO: 471150 - DNA, 15 bp, Homo sapiens
gcaggcagcaggtaa

SEQ ID NO: 471151 - DNA, 15 bp, Homo sapiens
caggcagcaggtaag

SEQ ID NO: 471152 - DNA, 15 bp, Homo sapiens
aggcagcaggtaagc

SEQ ID NO: 471153 - DNA, 15 bp, Homo sapiens
ggcagcaggtaagca

SEQ ID NO: 471154 - DNA, 15 bp, Homo sapiens
gcagcaggtaagcaa

SEQ ID NO: 471155 - DNA, 15 bp, Homo sapiens
cagcaggtaagcaaa

SEQ ID NO: 471156 - DNA, 15 bp, Homo sapiens
agcaggtaagcaaat

SEQ ID NO: 471157 - DNA, 15 bp, Homo sapiens
gcaggtaagcaaata

SEQ ID NO: 471158 - DNA, 15 bp, Homo sapiens
caggtaagcaaatat

SEQ ID NO: 471159 - DNA, 15 bp, Homo sapiens
aggtaagcaaatata

SEQ ID NO: 471160 - DNA, 15 bp, Homo sapiens
ggtaagcaaatatac

SEQ ID NO: 471161 - DNA, 15 bp, Homo sapiens
gtaagcaaatatact

SEQ ID NO: 471162 - DNA, 15 bp, Homo sapiens
taagcaaatatactt

SEQ ID NO: 471163 - DNA, 15 bp, Homo sapiens
aagcaaatatactta

SEQ ID NO: 471164 - DNA, 15 bp, Homo sapiens
agcaaatatacttat

SEQ ID NO: 471165 - DNA, 15 bp, Homo sapiens
gcaaatatacttatc

SEQ ID NO: 471166 - DNA, 15 bp, Homo sapiens
caaatatacttatca

SEQ ID NO: 471167 - DNA, 15 bp, Homo sapiens
aaatatacttatcat

SEQ ID NO: 471168 - DNA, 15 bp, Homo sapiens
aatatacttatcatt

SEQ ID NO: 471169 - DNA, 15 bp, Homo sapiens
atatacttatcattc

SEQ ID NO: 471170 - DNA, 15 bp, Homo sapiens
tatacttatcattca

SEQ ID NO: 471171 - DNA, 15 bp, Homo sapiens
atacttatcattcag

SEQ ID NO: 471172 - DNA, 15 bp, Homo sapiens
tacttatcattcagt

SEQ ID NO: 471173 - DNA, 15 bp, Homo sapiens
acttatcattcagtg

SEQ ID NO: 471174 - DNA, 15 bp, Homo sapiens
cttatcattcagtgt

SEQ ID NO: 471175 - DNA, 15 bp, Homo sapiens
ttatcattcagtgtc

SEQ ID NO: 471176 - DNA, 15 bp, Homo sapiens
tatcattcagtgtct

SEQ ID NO: 471177 - DNA, 15 bp, Homo sapiens
atcattcagtgtctg

SEQ ID NO: 471178 - DNA, 15 bp, Homo sapiens
tcattcagtgtctgt

SEQ ID NO: 471179 - DNA, 15 bp, Homo sapiens
cattcagtgtctgtg

SEQ ID NO: 471180 - DNA, 15 bp, Homo sapiens
attcagtgtctgtga

SEQ ID NO: 471181 - DNA, 15 bp, Homo sapiens
ttcagtgtctgtgat

SEQ ID NO: 471182 - DNA, 15 bp, Homo sapiens
tcagtgtctgtgatt

SEQ ID NO: 471183 - DNA, 15 bp, Homo sapiens
cagtgtctgtgatta

SEQ ID NO: 471184 - DNA, 15 bp, Homo sapiens
agtgtctgtgattac

SEQ ID NO: 471185 - DNA, 15 bp, Homo sapiens
gtgtctgtgattaca

SEQ ID NO: 471186 - DNA, 15 bp, Homo sapiens
tgtctgtgattacaa

SEQ ID NO: 471187 - DNA, 15 bp, Homo sapiens
gtctgtgattacaag

SEQ ID NO: 471188 - DNA, 15 bp, Homo sapiens
tctgtgattacaaga

SEQ ID NO: 471189 - DNA, 15 bp, Homo sapiens
ctgtgattacaagaa

SEQ ID NO: 471190 - DNA, 15 bp, Homo sapiens
tgtgattacaagaaa

SEQ ID NO: 471191 - DNA, 15 bp, Homo sapiens
gtgattacaagaaag

SEQ ID NO: 471192 - DNA, 15 bp, Homo sapiens
tgattacaagaaagt

SEQ ID NO: 471193 - DNA, 15 bp, Homo sapiens
gattacaagaaagtt

SEQ ID NO: 471194 - DNA, 15 bp, Homo sapiens
attacaagaaagttt

SEQ ID NO: 471195 - DNA, 15 bp, Homo sapiens
ttacaagaaagtttc

SEQ ID NO: 471196 - DNA, 15 bp, Homo sapiens
tacaagaaagtttct

SEQ ID NO: 471197 - DNA, 15 bp, Homo sapiens
acaagaaagtttctc

SEQ ID NO: 471198 - DNA, 15 bp, Homo sapiens
caagaaagtttctct

SEQ ID NO: 471199 - DNA, 15 bp, Homo sapiens
aagaaagtttctctc

SEQ ID NO: 471200 - DNA, 15 bp, Homo sapiens
agaaagtttctctct

SEQ ID NO: 471201 - DNA, 15 bp, Homo sapiens
gaaagtttctctctc

SEQ ID NO: 471202 - DNA, 15 bp, Homo sapiens
aaagtttctctctcc

SEQ ID NO: 471203 - DNA, 15 bp, Homo sapiens
aagtttctctctcct

SEQ ID NO: 471204 - DNA, 15 bp, Homo sapiens
agtttctctctcctt

SEQ ID NO: 471205 - DNA, 15 bp, Homo sapiens
gtttctctctccttc

SEQ ID NO: 471206 - DNA, 15 bp, Homo sapiens
tttctctctccttct

SEQ ID NO: 471207 - DNA, 15 bp, Homo sapiens
ttctctctccttctc

SEQ ID NO: 471208 - DNA, 15 bp, Homo sapiens
tctctctccttctcc

SEQ ID NO: 471209 - DNA, 15 bp, Homo sapiens
ctctctccttctccc

SEQ ID NO: 471210 - DNA, 15 bp, Homo sapiens
tctctccttctcccc

SEQ ID NO: 471211 - DNA, 15 bp, Homo sapiens
ctctccttctcccct

SEQ ID NO: 471212 - DNA, 15 bp, Homo sapiens
tctccttctcccctt

SEQ ID NO: 471213 - DNA, 15 bp, Homo sapiens
ctccttctccccttc

SEQ ID NO: 471214 - DNA, 15 bp, Homo sapiens
tccttctccccttct

SEQ ID NO: 471215 - DNA, 15 bp, Homo sapiens
ccttctccccttctc

SEQ ID NO: 471216 - DNA, 15 bp, Homo sapiens
cttctccccttctcc

SEQ ID NO: 471217 - DNA, 15 bp, Homo sapiens
ttctccccttctcct

SEQ ID NO: 471218 - DNA, 15 bp, Homo sapiens
tctccccttctcctc

SEQ ID NO: 471219 - DNA, 15 bp, Homo sapiens
ctccccttctcctcc

SEQ ID NO: 471220 - DNA, 15 bp, Homo sapiens
tccccttctcctcct

SEQ ID NO: 471221 - DNA, 15 bp, Homo sapiens
ccccttctcctcctc

SEQ ID NO: 471222 - DNA, 15 bp, Homo sapiens
cccttctcctcctcc

SEQ ID NO: 471223 - DNA, 15 bp, Homo sapiens
ccttctcctcctccg

SEQ ID NO: 471224 - DNA, 15 bp, Homo sapiens
cttctcctcctccgc

SEQ ID NO: 471225 - DNA, 15 bp, Homo sapiens
ttctcctcctccgcc

SEQ ID NO: 471226 - DNA, 15 bp, Homo sapiens
tctcctcctccgccg

SEQ ID NO: 471227 - DNA, 15 bp, Homo sapiens
ctcctcctccgccgc

SEQ ID NO: 471228 - DNA, 15 bp, Homo sapiens
tcctcctccgccgcc

SEQ ID NO: 471229 - DNA, 15 bp, Homo sapiens
cctcctccgccgcct

SEQ ID NO: 471230 - DNA, 15 bp, Homo sapiens
ctcctccgccgcctc

SEQ ID NO: 471231 - DNA, 15 bp, Homo sapiens
tcctccgccgcctcc

SEQ ID NO: 471232 - DNA, 15 bp, Homo sapiens
cctccgccgcctcct

SEQ ID NO: 471233 - DNA, 15 bp, Homo sapiens
ctccgccgcctcctc

SEQ ID NO: 471234 - DNA, 15 bp, Homo sapiens
tccgccgcctcctcc

SEQ ID NO: 471235 - DNA, 15 bp, Homo sapiens
ccgccgcctcctcct

SEQ ID NO: 471236 - DNA, 15 bp, Homo sapiens
cgccgcctcctcctc

SEQ ID NO: 471237 - DNA, 15 bp, Homo sapiens
gccgcctcctcctcc

SEQ ID NO: 471238 - DNA, 15 bp, Homo sapiens
ccgcctcctcctcct

SEQ ID NO: 471239 - DNA, 15 bp, Homo sapiens
cgcctcctcctcctc

SEQ ID NO: 471240 - DNA, 15 bp, Homo sapiens
tcctcctcctcctct

SEQ ID NO: 471241 - DNA, 15 bp, Homo sapiens
cctcctcctcctctc

SEQ ID NO: 471242 - DNA, 15 bp, Homo sapiens
ctcctcctcctctct

SEQ ID NO: 471243 - DNA, 15 bp, Homo sapiens
tcctcctcctctctc

SEQ ID NO: 471244 - DNA, 15 bp, Homo sapiens
cctcctcctctctct

SEQ ID NO: 471245 - DNA, 15 bp, Homo sapiens
ctcctcctctctctc

SEQ ID NO: 471246 - DNA, 15 bp, Homo sapiens
tcctcctctctctct

SEQ ID NO: 471247 - DNA, 15 bp, Homo sapiens
cctcctctctctctc

SEQ ID NO: 471248 - DNA, 15 bp, Homo sapiens
ctcctctctctctct

SEQ ID NO: 471249 - DNA, 15 bp, Homo sapiens
cctctctctctctct

SEQ ID NO: 471250 - DNA, 15 bp, Homo sapiens
tctctctttctgtct

SEQ ID NO: 471251 - DNA, 15 bp, Homo sapiens
ctctctttctgtctc

SEQ ID NO: 471252 - DNA, 15 bp, Homo sapiens
tctctttctgtctct

SEQ ID NO: 471253 - DNA, 15 bp, Homo sapiens
ctctttctgtctcta

SEQ ID NO: 471254 - DNA, 15 bp, Homo sapiens
tctttctgtctctaa

SEQ ID NO: 471255 - DNA, 15 bp, Homo sapiens
ctttctgtctctaag

SEQ ID NO: 471256 - DNA, 15 bp, Homo sapiens
tttctgtctctaaga

SEQ ID NO: 471257 - DNA, 15 bp, Homo sapiens
ttctgtctctaagag

SEQ ID NO: 471258 - DNA, 15 bp, Homo sapiens
tctgtctctaagagg

SEQ ID NO: 471259 - DNA, 15 bp, Homo sapiens
ctgtctctaagagga

SEQ ID NO: 471260 - DNA, 15 bp, Homo sapiens
tgtctctaagaggag

SEQ ID NO: 471261 - DNA, 15 bp, Homo sapiens
gtctctaagaggagg

SEQ ID NO: 471262 - DNA, 15 bp, Homo sapiens
tctctaagaggaggg

SEQ ID NO: 471263 - DNA, 15 bp, Homo sapiens
ctctaagaggaggga

SEQ ID NO: 471264 - DNA, 15 bp, Homo sapiens
tctaagaggagggag

SEQ ID NO: 471265 - DNA, 15 bp, Homo sapiens
ctaagaggagggagt

SEQ ID NO: 471266 - DNA, 15 bp, Homo sapiens
taagaggagggagtg

SEQ ID NO: 471267 - DNA, 15 bp, Homo sapiens
aagaggagggagtga

SEQ ID NO: 471268 - DNA, 15 bp, Homo sapiens
agaggagggagtgag

SEQ ID NO: 471269 - DNA, 15 bp, Homo sapiens
gaggagggagtgagg

SEQ ID NO: 471270 - DNA, 15 bp, Homo sapiens
aggagggagtgaggt

SEQ ID NO: 471271 - DNA, 15 bp, Homo sapiens
ggagggagtgaggta

SEQ ID NO: 471272 - DNA, 15 bp, Homo sapiens
gagggagtgaggtat

SEQ ID NO: 471273 - DNA, 15 bp, Homo sapiens
agggagtgaggtata

SEQ ID NO: 471274 - DNA, 15 bp, Homo sapiens
gggagtgaggtataa

SEQ ID NO: 471275 - DNA, 15 bp, Homo sapiens
ggagtgaggtataat

SEQ ID NO: 471276 - DNA, 15 bp, Homo sapiens
gagtgaggtataatg

SEQ ID NO: 471277 - DNA, 15 bp, Homo sapiens
agtgaggtataatga

SEQ ID NO: 471278 - DNA, 15 bp, Homo sapiens
gtgaggtataatgag

SEQ ID NO: 471279 - DNA, 15 bp, Homo sapiens
tgaggtataatgagt

SEQ ID NO: 471280 - DNA, 15 bp, Homo sapiens
gaggtataatgagtg

SEQ ID NO: 471281 - DNA, 15 bp, Homo sapiens
aggtataatgagtgg

SEQ ID NO: 471282 - DNA, 15 bp, Homo sapiens
ggtataatgagtggt

SEQ ID NO: 471283 - DNA, 15 bp, Homo sapiens
gtataatgagtggta

SEQ ID NO: 471284 - DNA, 15 bp, Homo sapiens
tataatgagtggtag

SEQ ID NO: 471285 - DNA, 15 bp, Homo sapiens
ataatgagtggtagg

SEQ ID NO: 471286 - DNA, 15 bp, Homo sapiens
taatgagtggtaggt

SEQ ID NO: 471287 - DNA, 15 bp, Homo sapiens
aatgagtggtaggtt

SEQ ID NO: 471288 - DNA, 15 bp, Homo sapiens
atgagtggtaggttg

SEQ ID NO: 471289 - DNA, 15 bp, Homo sapiens
tgagtggtaggttga

SEQ ID NO: 471290 - DNA, 15 bp, Homo sapiens
gagtggtaggttgag

SEQ ID NO: 471291 - DNA, 15 bp, Homo sapiens
agtggtaggttgagc

SEQ ID NO: 471292 - DNA, 15 bp, Homo sapiens
gtggtaggttgagca

SEQ ID NO: 471293 - DNA, 15 bp, Homo sapiens
tggtaggttgagcag

SEQ ID NO: 471294 - DNA, 15 bp, Homo sapiens
ggtaggttgagcagc

SEQ ID NO: 471295 - DNA, 15 bp, Homo sapiens
gtaggttgagcagcc

SEQ ID NO: 471296 - DNA, 15 bp, Homo sapiens
taggttgagcagcca

SEQ ID NO: 471297 - DNA, 15 bp, Homo sapiens
aggttgagcagccaa

SEQ ID NO: 471298 - DNA, 15 bp, Homo sapiens
ggttgagcagccaag

SEQ ID NO: 471299 - DNA, 15 bp, Homo sapiens
gttgagcagccaagt

SEQ ID NO: 471300 - DNA, 15 bp, Homo sapiens
ttgagcagccaagtt

SEQ ID NO: 471301 - DNA, 15 bp, Homo sapiens
tgagcagccaagttg

SEQ ID NO: 471302 - DNA, 15 bp, Homo sapiens
gagcagccaagttgg

SEQ ID NO: 471303 - DNA, 15 bp, Homo sapiens
agcagccaagttgga

SEQ ID NO: 471304 - DNA, 15 bp, Homo sapiens
gcagccaagttggag

SEQ ID NO: 471305 - DNA, 15 bp, Homo sapiens
cagccaagttggagc

SEQ ID NO: 471306 - DNA, 15 bp, Homo sapiens
agccaagttggagcc

SEQ ID NO: 471307 - DNA, 15 bp, Homo sapiens
gccaagttggagcca

SEQ ID NO: 471308 - DNA, 15 bp, Homo sapiens
ccaagttggagccag

SEQ ID NO: 471309 - DNA, 15 bp, Homo sapiens
caagttggagccaga

SEQ ID NO: 471310 - DNA, 15 bp, Homo sapiens
aagttggagccagag

SEQ ID NO: 471311 - DNA, 15 bp, Homo sapiens
agttggagccagagg

SEQ ID NO: 471312 - DNA, 15 bp, Homo sapiens
gttggagccagagga

SEQ ID NO: 471313 - DNA, 15 bp, Homo sapiens
ttggagccagaggat

SEQ ID NO: 471314 - DNA, 15 bp, Homo sapiens
tggagccagaggatc

SEQ ID NO: 471315 - DNA, 15 bp, Homo sapiens
ggagccagaggatca

SEQ ID NO: 471316 - DNA, 15 bp, Homo sapiens
gagccagaggatcat

SEQ ID NO: 471317 - DNA, 15 bp, Homo sapiens
agccagaggatcatg

SEQ ID NO: 471318 - DNA, 15 bp, Homo sapiens
gccagaggatcatgg

SEQ ID NO: 471319 - DNA, 15 bp, Homo sapiens
ccagaggatcatggg

SEQ ID NO: 471320 - DNA, 15 bp, Homo sapiens
cagaggatcatgggc

SEQ ID NO: 471321 - DNA, 15 bp, Homo sapiens
agaggatcatgggct

SEQ ID NO: 471322 - DNA, 15 bp, Homo sapiens
gaggatcatgggctt

SEQ ID NO: 471323 - DNA, 15 bp, Homo sapiens
aggatcatgggcttc

SEQ ID NO: 471324 - DNA, 15 bp, Homo sapiens
ggatcatgggcttca

SEQ ID NO: 471325 - DNA, 15 bp, Homo sapiens
gatcatgggcttcat

SEQ ID NO: 471326 - DNA, 15 bp, Homo sapiens
atcatgggcttcatt

SEQ ID NO: 471327 - DNA, 15 bp, Homo sapiens
tcatgggcttcatta

SEQ ID NO: 471328 - DNA, 15 bp, Homo sapiens
catgggcttcattaa

SEQ ID NO: 471329 - DNA, 15 bp, Homo sapiens
atgggcttcattaag

SEQ ID NO: 471330 - DNA, 15 bp, Homo sapiens
tgggcttcattaagt

SEQ ID NO: 471331 - DNA, 15 bp, Homo sapiens
gggcttcattaagtt

SEQ ID NO: 471332 - DNA, 15 bp, Homo sapiens
ggcttcattaagttc

SEQ ID NO: 471333 - DNA, 15 bp, Homo sapiens
gcttcattaagttct

SEQ ID NO: 471334 - DNA, 15 bp, Homo sapiens
cttcattaagttctg

SEQ ID NO: 471335 - DNA, 15 bp, Homo sapiens
ttcattaagttctgt

SEQ ID NO: 471336 - DNA, 15 bp, Homo sapiens
tcattaagttctgtg

SEQ ID NO: 471337 - DNA, 15 bp, Homo sapiens
cattaagttctgtgc

SEQ ID NO: 471338 - DNA, 15 bp, Homo sapiens
attaagttctgtgca

SEQ ID NO: 471339 - DNA, 15 bp, Homo sapiens
ttaagttctgtgcag

SEQ ID NO: 471340 - DNA, 15 bp, Homo sapiens
taagttctgtgcagg

SEQ ID NO: 471341 - DNA, 15 bp, Homo sapiens
aagttctgtgcaggt

SEQ ID NO: 471342 - DNA, 15 bp, Homo sapiens
agttctgtgcaggta

SEQ ID NO: 471343 - DNA, 15 bp, Homo sapiens
gttctgtgcaggtaa

SEQ ID NO: 471344 - DNA, 15 bp, Homo sapiens
ttctgtgcaggtaat

SEQ ID NO: 471345 - DNA, 15 bp, Homo sapiens
tctgtgcaggtaatg

SEQ ID NO: 471346 - DNA, 15 bp, Homo sapiens
ctgtgcaggtaatgt

SEQ ID NO: 471347 - DNA, 15 bp, Homo sapiens
tgtgcaggtaatgta

SEQ ID NO: 471348 - DNA, 15 bp, Homo sapiens
gtgcaggtaatgtaa

SEQ ID NO: 471349 - DNA, 15 bp, Homo sapiens
tgcaggtaatgtaaa

SEQ ID NO: 471350 - DNA, 15 bp, Homo sapiens
gcaggtaatgtaaat

SEQ ID NO: 471351 - DNA, 15 bp, Homo sapiens
caggtaatgtaaata

SEQ ID NO: 471352 - DNA, 15 bp, Homo sapiens
aggtaatgtaaatat

SEQ ID NO: 471353 - DNA, 15 bp, Homo sapiens
ggtaatgtaaatatt

SEQ ID NO: 471354 - DNA, 15 bp, Homo sapiens
gtaatgtaaatattt

SEQ ID NO: 471355 - DNA, 15 bp, Homo sapiens
taatgtaaatatttt

SEQ ID NO: 471356 - DNA, 15 bp, Homo sapiens
aatgtaaatatttta

SEQ ID NO: 471357 - DNA, 15 bp, Homo sapiens
atgtaaatattttaa

SEQ ID NO: 471358 - DNA, 15 bp, Homo sapiens
tgtaaatattttaaa

SEQ ID NO: 471359 - DNA, 15 bp, Homo sapiens
gtaaatattttaaat

SEQ ID NO: 471360 - DNA, 15 bp, Homo sapiens
taaatattttaaatg

SEQ ID NO: 471361 - DNA, 15 bp, Homo sapiens
aaatattttaaatgc

SEQ ID NO: 471362 - DNA, 15 bp, Homo sapiens
aatattttaaatgca

SEQ ID NO: 471363 - DNA, 15 bp, Homo sapiens
atattttaaatgcat

SEQ ID NO: 471364 - DNA, 15 bp, Homo sapiens
tattttaaatgcatc

SEQ ID NO: 471365 - DNA, 15 bp, Homo sapiens
attttaaatgcatct

SEQ ID NO: 471366 - DNA, 15 bp, Homo sapiens
ttttaaatgcatctt

SEQ ID NO: 471367 - DNA, 15 bp, Homo sapiens
tttaaatgcatcttc

SEQ ID NO: 471368 - DNA, 15 bp, Homo sapiens
ttaaatgcatcttcg

SEQ ID NO: 471369 - DNA, 15 bp, Homo sapiens
taaatgcatcttcgg

SEQ ID NO: 471370 - DNA, 15 bp, Homo sapiens
aaatgcatcttcgga

SEQ ID NO: 471371 - DNA, 15 bp, Homo sapiens
aatgcatcttcggaa

SEQ ID NO: 471372 - DNA, 15 bp, Homo sapiens
atgcatcttcggaag

SEQ ID NO: 471373 - DNA, 15 bp, Homo sapiens
tgcatcttcggaagg

SEQ ID NO: 471374 - DNA, 15 bp, Homo sapiens
gcatcttcggaagga

SEQ ID NO: 471375 - DNA, 15 bp, Homo sapiens
catcttcggaaggat

SEQ ID NO: 471376 - DNA, 15 bp, Homo sapiens
atcttcggaaggatc

SEQ ID NO: 471377 - DNA, 15 bp, Homo sapiens
tcttcggaaggatca

SEQ ID NO: 471378 - DNA, 15 bp, Homo sapiens
cttcggaaggatcac

SEQ ID NO: 471379 - DNA, 15 bp, Homo sapiens
ttcggaaggatcaca

SEQ ID NO: 471380 - DNA, 15 bp, Homo sapiens
tcggaaggatcacag

SEQ ID NO: 471381 - DNA, 15 bp, Homo sapiens
cggaaggatcacagt

SEQ ID NO: 471382 - DNA, 15 bp, Homo sapiens
ggaaggatcacagtt

SEQ ID NO: 471383 - DNA, 15 bp, Homo sapiens
gaaggatcacagttg

SEQ ID NO: 471384 - DNA, 15 bp, Homo sapiens
aaggatcacagttga

SEQ ID NO: 471385 - DNA, 15 bp, Homo sapiens
aggatcacagttgat

SEQ ID NO: 471386 - DNA, 15 bp, Homo sapiens
ggatcacagttgata

SEQ ID NO: 471387 - DNA, 15 bp, Homo sapiens
gatcacagttgatat

SEQ ID NO: 471388 - DNA, 15 bp, Homo sapiens
atcacagttgatatc

SEQ ID NO: 471389 - DNA, 15 bp, Homo sapiens
tcacagttgatatct

SEQ ID NO: 471390 - DNA, 15 bp, Homo sapiens
cacagttgatatctg

SEQ ID NO: 471391 - DNA, 15 bp, Homo sapiens
acagttgatatctgt

SEQ ID NO: 471392 - DNA, 15 bp, Homo sapiens
cagttgatatctgta

SEQ ID NO: 471393 - DNA, 15 bp, Homo sapiens
agttgatatctgtat

SEQ ID NO: 471394 - DNA, 15 bp, Homo sapiens
gttgatatctgtatt

SEQ ID NO: 471395 - DNA, 15 bp, Homo sapiens
ttgatatctgtattg

SEQ ID NO: 471396 - DNA, 15 bp, Homo sapiens
tgatatctgtattgt

SEQ ID NO: 471397 - DNA, 15 bp, Homo sapiens
gatatctgtattgta

SEQ ID NO: 471398 - DNA, 15 bp, Homo sapiens
atatctgtattgtaa

SEQ ID NO: 471399 - DNA, 15 bp, Homo sapiens
tatctgtattgtaaa

SEQ ID NO: 471400 - DNA, 15 bp, Homo sapiens
atctgtattgtaaat

SEQ ID NO: 471401 - DNA, 15 bp, Homo sapiens
tctgtattgtaaata

SEQ ID NO: 471402 - DNA, 15 bp, Homo sapiens
ctgtattgtaaatag

SEQ ID NO: 471403 - DNA, 15 bp, Homo sapiens
tgtattgtaaataga

SEQ ID NO: 471404 - DNA, 15 bp, Homo sapiens
gtattgtaaatagaa

SEQ ID NO: 471405 - DNA, 15 bp, Homo sapiens
tattgtaaatagaaa

SEQ ID NO: 471406 - DNA, 15 bp, Homo sapiens
attgtaaatagaaac

SEQ ID NO: 471407 - DNA, 15 bp, Homo sapiens
ttgtaaatagaaact

SEQ ID NO: 471408 - DNA, 15 bp, Homo sapiens
tgtaaatagaaacta

SEQ ID NO: 471409 - DNA, 15 bp, Homo sapiens
gtaaatagaaactag

SEQ ID NO: 471410 - DNA, 15 bp, Homo sapiens
taaatagaaactaga

SEQ ID NO: 471411 - DNA, 15 bp, Homo sapiens
aaatagaaactagaa

SEQ ID NO: 471412 - DNA, 15 bp, Homo sapiens
aatagaaactagaat

SEQ ID NO: 471413 - DNA, 15 bp, Homo sapiens
atagaaactagaatt

SEQ ID NO: 471414 - DNA, 15 bp, Homo sapiens
tagaaactagaattg

SEQ ID NO: 471415 - DNA, 15 bp, Homo sapiens
agaaactagaattgt

SEQ ID NO: 471416 - DNA, 15 bp, Homo sapiens
gaaactagaattgtg

SEQ ID NO: 471417 - DNA, 15 bp, Homo sapiens
aaactagaattgtga

SEQ ID NO: 471418 - DNA, 15 bp, Homo sapiens
aactagaattgtgat

SEQ ID NO: 471419 - DNA, 15 bp, Homo sapiens
actagaattgtgata

SEQ ID NO: 471420 - DNA, 15 bp, Homo sapiens
ctagaattgtgatat

SEQ ID NO: 471421 - DNA, 15 bp, Homo sapiens
tagaattgtgatata

SEQ ID NO: 471422 - DNA, 15 bp, Homo sapiens
agaattgtgatatac

SEQ ID NO: 471423 - DNA, 15 bp, Homo sapiens
gaattgtgatataca

SEQ ID NO: 471424 - DNA, 15 bp, Homo sapiens
aattgtgatatacag

SEQ ID NO: 471425 - DNA, 15 bp, Homo sapiens
attgtgatatacagt

SEQ ID NO: 471426 - DNA, 15 bp, Homo sapiens
ttgtgatatacagta

SEQ ID NO: 471427 - DNA, 15 bp, Homo sapiens
tgtgatatacagtag

SEQ ID NO: 471428 - DNA, 15 bp, Homo sapiens
gtgatatacagtaga

SEQ ID NO: 471429 - DNA, 15 bp, Homo sapiens
tgatatacagtagaa

SEQ ID NO: 471430 - DNA, 15 bp, Homo sapiens
gatatacagtagaaa

SEQ ID NO: 471431 - DNA, 15 bp, Homo sapiens
atatacagtagaaaa

SEQ ID NO: 471432 - DNA, 15 bp, Homo sapiens
tatacagtagaaaac

SEQ ID NO: 471433 - DNA, 15 bp, Homo sapiens
atacagtagaaaact

SEQ ID NO: 471434 - DNA, 15 bp, Homo sapiens
tacagtagaaaactg

SEQ ID NO: 471435 - DNA, 15 bp, Homo sapiens
acagtagaaaactgg

SEQ ID NO: 471436 - DNA, 15 bp, Homo sapiens
cagtagaaaactggg

SEQ ID NO: 471437 - DNA, 15 bp, Homo sapiens
agtagaaaactgggg

SEQ ID NO: 471438 - DNA, 15 bp, Homo sapiens
gtagaaaactggggc

SEQ ID NO: 471439 - DNA, 15 bp, Homo sapiens
tagaaaactggggct

SEQ ID NO: 471440 - DNA, 15 bp, Homo sapiens
agaaaactggggctt

SEQ ID NO: 471441 - DNA, 15 bp, Homo sapiens
gaaaactggggcttg

SEQ ID NO: 471442 - DNA, 15 bp, Homo sapiens
aaaactggggcttgg

SEQ ID NO: 471443 - DNA, 15 bp, Homo sapiens
aaactggggcttgga

SEQ ID NO: 471444 - DNA, 15 bp, Homo sapiens
aactggggcttggag

SEQ ID NO: 471445 - DNA, 15 bp, Homo sapiens
actggggcttggaga

SEQ ID NO: 471446 - DNA, 15 bp, Homo sapiens
ctggggcttggagaa

SEQ ID NO: 471447 - DNA, 15 bp, Homo sapiens
tggggcttggagaac

SEQ ID NO: 471448 - DNA, 15 bp, Homo sapiens
ggggcttggagaaca

SEQ ID NO: 471449 - DNA, 15 bp, Homo sapiens
gggcttggagaacaa

SEQ ID NO: 471450 - DNA, 15 bp, Homo sapiens
ggcttggagaacaat

SEQ ID NO: 471451 - DNA, 15 bp, Homo sapiens
gcttggagaacaata

SEQ ID NO: 471452 - DNA, 15 bp, Homo sapiens
cttggagaacaatag

SEQ ID NO: 471453 - DNA, 15 bp, Homo sapiens
ttggagaacaatagt

SEQ ID NO: 471454 - DNA, 15 bp, Homo sapiens
tggagaacaatagtt

SEQ ID NO: 471455 - DNA, 15 bp, Homo sapiens
ggagaacaatagttc

SEQ ID NO: 471456 - DNA, 15 bp, Homo sapiens
gagaacaatagttca

SEQ ID NO: 471457 - DNA, 15 bp, Homo sapiens
agaacaatagttcat

SEQ ID NO: 471458 - DNA, 15 bp, Homo sapiens
gaacaatagttcatg

SEQ ID NO: 471459 - DNA, 15 bp, Homo sapiens
aacaatagttcatgg

SEQ ID NO: 471460 - DNA, 15 bp, Homo sapiens
acaatagttcatggg

SEQ ID NO: 471461 - DNA, 15 bp, Homo sapiens
caatagttcatggga

SEQ ID NO: 471462 - DNA, 15 bp, Homo sapiens
aatagttcatgggat

SEQ ID NO: 471463 - DNA, 15 bp, Homo sapiens
atagttcatgggata

SEQ ID NO: 471464 - DNA, 15 bp, Homo sapiens
tagttcatgggatag

SEQ ID NO: 471465 - DNA, 15 bp, Homo sapiens
agttcatgggatagg

SEQ ID NO: 471466 - DNA, 15 bp, Homo sapiens
gttcatgggatagga

SEQ ID NO: 471467 - DNA, 15 bp, Homo sapiens
ttcatgggataggat

SEQ ID NO: 471468 - DNA, 15 bp, Homo sapiens
tcatgggataggatg

SEQ ID NO: 471469 - DNA, 15 bp, Homo sapiens
catgggataggatga

SEQ ID NO: 471470 - DNA, 15 bp, Homo sapiens
atgggataggatgat

SEQ ID NO: 471471 - DNA, 15 bp, Homo sapiens
tgggataggatgatg

SEQ ID NO: 471472 - DNA, 15 bp, Homo sapiens
gggataggatgatgg

SEQ ID NO: 471473 - DNA, 15 bp, Homo sapiens
ggataggatgatggg

SEQ ID NO: 471474 - DNA, 15 bp, Homo sapiens
gataggatgatgggg

SEQ ID NO: 471475 - DNA, 15 bp, Homo sapiens
ataggatgatggggt

SEQ ID NO: 471476 - DNA, 15 bp, Homo sapiens
taggatgatggggtg

SEQ ID NO: 471477 - DNA, 15 bp, Homo sapiens
aggatgatggggtgg

SEQ ID NO: 471478 - DNA, 15 bp, Homo sapiens
ggatgatggggtggg

SEQ ID NO: 471479 - DNA, 15 bp, Homo sapiens
gatgatggggtgggt

SEQ ID NO: 471480 - DNA, 15 bp, Homo sapiens
atgatggggtgggtg

SEQ ID NO: 471481 - DNA, 15 bp, Homo sapiens
tgatggggtgggtgg

SEQ ID NO: 471482 - DNA, 15 bp, Homo sapiens
gatggggtgggtggg

SEQ ID NO: 471483 - DNA, 15 bp, Homo sapiens
atggggtgggtgggg

SEQ ID NO: 471484 - DNA, 15 bp, Homo sapiens
tggggtgggtggggt

SEQ ID NO: 471485 - DNA, 15 bp, Homo sapiens
ggggtgggtggggtt

SEQ ID NO: 471486 - DNA, 15 bp, Homo sapiens
gggtgggtggggttg

SEQ ID NO: 471487 - DNA, 15 bp, Homo sapiens
ggtgggtggggttgg

SEQ ID NO: 471488 - DNA, 15 bp, Homo sapiens
gtgggtggggttggg

SEQ ID NO: 471489 - DNA, 15 bp, Homo sapiens
tgggtggggttggga

SEQ ID NO: 471490 - DNA, 15 bp, Homo sapiens
gggtggggttgggat

SEQ ID NO: 471491 - DNA, 15 bp, Homo sapiens
ggtggggttgggata

SEQ ID NO: 471492 - DNA, 15 bp, Homo sapiens
gtggggttgggatag

SEQ ID NO: 471493 - DNA, 15 bp, Homo sapiens
tggggttgggatagt

SEQ ID NO: 471494 - DNA, 15 bp, Homo sapiens
ggggttgggatagtg

SEQ ID NO: 471495 - DNA, 15 bp, Homo sapiens
gggttgggatagtgt

SEQ ID NO: 471496 - DNA, 15 bp, Homo sapiens
ggttgggatagtgtt

SEQ ID NO: 471497 - DNA, 15 bp, Homo sapiens
gttgggatagtgtta

SEQ ID NO: 471498 - DNA, 15 bp, Homo sapiens
ttgggatagtgttag

SEQ ID NO: 471499 - DNA, 15 bp, Homo sapiens
tgggatagtgttagt

SEQ ID NO: 471500 - DNA, 15 bp, Homo sapiens
gggatagtgttagtc

SEQ ID NO: 471501 - DNA, 15 bp, Homo sapiens
ggatagtgttagtcc

SEQ ID NO: 471502 - DNA, 15 bp, Homo sapiens
gatagtgttagtcca

SEQ ID NO: 471503 - DNA, 15 bp, Homo sapiens
atagtgttagtccat

SEQ ID NO: 471504 - DNA, 15 bp, Homo sapiens
tagtgttagtccata

SEQ ID NO: 471505 - DNA, 15 bp, Homo sapiens
agtgttagtccatat

SEQ ID NO: 471506 - DNA, 15 bp, Homo sapiens
gtgttagtccatatc

SEQ ID NO: 471507 - DNA, 15 bp, Homo sapiens
tgttagtccatatca

SEQ ID NO: 471508 - DNA, 15 bp, Homo sapiens
gttagtccatatcac

SEQ ID NO: 471509 - DNA, 15 bp, Homo sapiens
ttagtccatatcacc

SEQ ID NO: 471510 - DNA, 15 bp, Homo sapiens
tagtccatatcaccc

SEQ ID NO: 471511 - DNA, 15 bp, Homo sapiens
agtccatatcaccct

SEQ ID NO: 471512 - DNA, 15 bp, Homo sapiens
gtccatatcacccta

SEQ ID NO: 471513 - DNA, 15 bp, Homo sapiens
tccatatcaccctaa

SEQ ID NO: 471514 - DNA, 15 bp, Homo sapiens
ccatatcaccctaaa

SEQ ID NO: 471515 - DNA, 15 bp, Homo sapiens
catatcaccctaaat

SEQ ID NO: 471516 - DNA, 15 bp, Homo sapiens
atatcaccctaaatg

SEQ ID NO: 471517 - DNA, 15 bp, Homo sapiens
tatcaccctaaatga

SEQ ID NO: 471518 - DNA, 15 bp, Homo sapiens
atcaccctaaatgat

SEQ ID NO: 471519 - DNA, 15 bp, Homo sapiens
tcaccctaaatgatt

SEQ ID NO: 471520 - DNA, 15 bp, Homo sapiens
caccctaaatgatta

SEQ ID NO: 471521 - DNA, 15 bp, Homo sapiens
accctaaatgattat

SEQ ID NO: 471522 - DNA, 15 bp, Homo sapiens
ccctaaatgattatc

SEQ ID NO: 471523 - DNA, 15 bp, Homo sapiens
cctaaatgattatca

SEQ ID NO: 471524 - DNA, 15 bp, Homo sapiens
ctaaatgattatcaa

SEQ ID NO: 471525 - DNA, 15 bp, Homo sapiens
taaatgattatcaaa

SEQ ID NO: 471526 - DNA, 15 bp, Homo sapiens
aaatgattatcaaac

SEQ ID NO: 471527 - DNA, 15 bp, Homo sapiens
aatgattatcaaact

SEQ ID NO: 471528 - DNA, 15 bp, Homo sapiens
atgattatcaaacta

SEQ ID NO: 471529 - DNA, 15 bp, Homo sapiens
tgattatcaaactaa

SEQ ID NO: 471530 - DNA, 15 bp, Homo sapiens
gattatcaaactaat

SEQ ID NO: 471531 - DNA, 15 bp, Homo sapiens
attatcaaactaatc

SEQ ID NO: 471532 - DNA, 15 bp, Homo sapiens
ttatcaaactaatca

SEQ ID NO: 471533 - DNA, 15 bp, Homo sapiens
tatcaaactaatcat

SEQ ID NO: 471534 - DNA, 15 bp, Homo sapiens
atcaaactaatcatt

SEQ ID NO: 471535 - DNA, 15 bp, Homo sapiens
tcaaactaatcattt

SEQ ID NO: 471536 - DNA, 15 bp, Homo sapiens
caaactaatcattta

SEQ ID NO: 471537 - DNA, 15 bp, Homo sapiens
aaactaatcatttag

SEQ ID NO: 471538 - DNA, 15 bp, Homo sapiens
aactaatcatttaga

SEQ ID NO: 471539 - DNA, 15 bp, Homo sapiens
actaatcatttagaa

SEQ ID NO: 471540 - DNA, 15 bp, Homo sapiens
ctaatcatttagaaa

SEQ ID NO: 471541 - DNA, 15 bp, Homo sapiens
taatcatttagaaat

SEQ ID NO: 471542 - DNA, 15 bp, Homo sapiens
aatcatttagaaata

SEQ ID NO: 471543 - DNA, 15 bp, Homo sapiens
atcatttagaaatac

SEQ ID NO: 471544 - DNA, 15 bp, Homo sapiens
tcatttagaaatacc

SEQ ID NO: 471545 - DNA, 15 bp, Homo sapiens
catttagaaatacct

SEQ ID NO: 471546 - DNA, 15 bp, Homo sapiens
atttagaaataccta

SEQ ID NO: 471547 - DNA, 15 bp, Homo sapiens
tttagaaatacctaa

SEQ ID NO: 471548 - DNA, 15 bp, Homo sapiens
ttagaaatacctaag

SEQ ID NO: 471549 - DNA, 15 bp, Homo sapiens
tagaaatacctaagg

SEQ ID NO: 471550 - DNA, 15 bp, Homo sapiens
agaaatacctaaggg

SEQ ID NO: 471551 - DNA, 15 bp, Homo sapiens
gaaatacctaaggga

SEQ ID NO: 471552 - DNA, 15 bp, Homo sapiens
aaatacctaagggaa

SEQ ID NO: 471553 - DNA, 15 bp, Homo sapiens
aatacctaagggaac

SEQ ID NO: 471554 - DNA, 15 bp, Homo sapiens
atacctaagggaaca

SEQ ID NO: 471555 - DNA, 15 bp, Homo sapiens
tacctaagggaacag

SEQ ID NO: 471556 - DNA, 15 bp, Homo sapiens
acctaagggaacagt

SEQ ID NO: 471557 - DNA, 15 bp, Homo sapiens
cctaagggaacagtg

SEQ ID NO: 471558 - DNA, 15 bp, Homo sapiens
ctaagggaacagtga

SEQ ID NO: 471559 - DNA, 15 bp, Homo sapiens
taagggaacagtgac

SEQ ID NO: 471560 - DNA, 15 bp, Homo sapiens
aagggaacagtgaca

SEQ ID NO: 471561 - DNA, 15 bp, Homo sapiens
agggaacagtgacat

SEQ ID NO: 471562 - DNA, 15 bp, Homo sapiens
gggaacagtgacatt

SEQ ID NO: 471563 - DNA, 15 bp, Homo sapiens
ggaacagtgacattt

SEQ ID NO: 471564 - DNA, 15 bp, Homo sapiens
gaacagtgacatttt

SEQ ID NO: 471565 - DNA, 15 bp, Homo sapiens
aacagtgacatttta

SEQ ID NO: 471566 - DNA, 15 bp, Homo sapiens
acagtgacattttat

SEQ ID NO: 471567 - DNA, 15 bp, Homo sapiens
cagtgacattttata

SEQ ID NO: 471568 - DNA, 15 bp, Homo sapiens
agtgacattttatac

SEQ ID NO: 471569 - DNA, 15 bp, Homo sapiens
gtgacattttatacc

SEQ ID NO: 471570 - DNA, 15 bp, Homo sapiens
tgacattttatacca

SEQ ID NO: 471571 - DNA, 15 bp, Homo sapiens
gacattttataccac

SEQ ID NO: 471572 - DNA, 15 bp, Homo sapiens
acattttataccact

SEQ ID NO: 471573 - DNA, 15 bp, Homo sapiens
cattttataccacta

SEQ ID NO: 471574 - DNA, 15 bp, Homo sapiens
attttataccactat

SEQ ID NO: 471575 - DNA, 15 bp, Homo sapiens
ttttataccactatt

SEQ ID NO: 471576 - DNA, 15 bp, Homo sapiens
tttataccactatta

SEQ ID NO: 471577 - DNA, 15 bp, Homo sapiens
ttataccactattaa

SEQ ID NO: 471578 - DNA, 15 bp, Homo sapiens
tataccactattaaa

SEQ ID NO: 471579 - DNA, 15 bp, Homo sapiens
ataccactattaaaa

SEQ ID NO: 471580 - DNA, 15 bp, Homo sapiens
taccactattaaaaa

SEQ ID NO: 471581 - DNA, 15 bp, Homo sapiens
accactattaaaaat

SEQ ID NO: 471582 - DNA, 15 bp, Homo sapiens
ccactattaaaaatg

SEQ ID NO: 471583 - DNA, 15 bp, Homo sapiens
cactattaaaaatgt

SEQ ID NO: 471584 - DNA, 15 bp, Homo sapiens
actattaaaaatgta

SEQ ID NO: 471585 - DNA, 15 bp, Homo sapiens
ctattaaaaatgtag

SEQ ID NO: 471586 - DNA, 15 bp, Homo sapiens
tattaaaaatgtagt

SEQ ID NO: 471587 - DNA, 15 bp, Homo sapiens
ttaaaaatgtagttc

SEQ ID NO: 471588 - DNA, 15 bp, Homo sapiens
taaaaatgtagttca

SEQ ID NO: 471589 - DNA, 15 bp, Homo sapiens
aaaaatgtagttcag

SEQ ID NO: 471590 - DNA, 15 bp, Homo sapiens
aaaatgtagttcagg

SEQ ID NO: 471591 - DNA, 15 bp, Homo sapiens
aaatgtagttcaggt

SEQ ID NO: 471592 - DNA, 15 bp, Homo sapiens
aatgtagttcaggta

SEQ ID NO: 471593 - DNA, 15 bp, Homo sapiens
atgtagttcaggtaa

SEQ ID NO: 471594 - DNA, 15 bp, Homo sapiens
tgtagttcaggtaaa

SEQ ID NO: 471595 - DNA, 15 bp, Homo sapiens
gtagttcaggtaaaa

SEQ ID NO: 471596 - DNA, 15 bp, Homo sapiens
tagttcaggtaaaat

SEQ ID NO: 471597 - DNA, 15 bp, Homo sapiens
agttcaggtaaaata

SEQ ID NO: 471598 - DNA, 15 bp, Homo sapiens
gttcaggtaaaataa

SEQ ID NO: 471599 - DNA, 15 bp, Homo sapiens
ttcaggtaaaataat

SEQ ID NO: 471600 - DNA, 15 bp, Homo sapiens
tcaggtaaaataatt

SEQ ID NO: 471601 - DNA, 15 bp, Homo sapiens
caggtaaaataatta

SEQ ID NO: 471602 - DNA, 15 bp, Homo sapiens
gtaaaataattatat

SEQ ID NO: 471603 - DNA, 15 bp, Homo sapiens
taaaataattatatg

SEQ ID NO: 471604 - DNA, 15 bp, Homo sapiens
aaaataattatatgt

SEQ ID NO: 471605 - DNA, 15 bp, Homo sapiens
aaataattatatgtc

SEQ ID NO: 471606 - DNA, 15 bp, Homo sapiens
aataattatatgtct

SEQ ID NO: 471607 - DNA, 15 bp, Homo sapiens
ataattatatgtctg

SEQ ID NO: 471608 - DNA, 15 bp, Homo sapiens
taattatatgtctgc

SEQ ID NO: 471609 - DNA, 15 bp, Homo sapiens
aattatatgtctgca

SEQ ID NO: 471610 - DNA, 15 bp, Homo sapiens
attatatgtctgcat

SEQ ID NO: 471611 - DNA, 15 bp, Homo sapiens
ttatatgtctgcata

SEQ ID NO: 471612 - DNA, 15 bp, Homo sapiens
tatatgtctgcatag

SEQ ID NO: 471613 - DNA, 15 bp, Homo sapiens
atatgtctgcatagt

SEQ ID NO: 471614 - DNA, 15 bp, Homo sapiens
tatgtctgcatagtt

SEQ ID NO: 471615 - DNA, 15 bp, Homo sapiens
atgtctgcatagttg

SEQ ID NO: 471616 - DNA, 15 bp, Homo sapiens
tgtctgcatagttgg

SEQ ID NO: 471617 - DNA, 15 bp, Homo sapiens
gtctgcatagttggg

SEQ ID NO: 471618 - DNA, 15 bp, Homo sapiens
tctgcatagttggga

SEQ ID NO: 471619 - DNA, 15 bp, Homo sapiens
ctgcatagttgggaa

SEQ ID NO: 471620 - DNA, 15 bp, Homo sapiens
tgcatagttgggaaa

SEQ ID NO: 471621 - DNA, 15 bp, Homo sapiens
gcatagttgggaaag

SEQ ID NO: 471622 - DNA, 15 bp, Homo sapiens
catagttgggaaagg

SEQ ID NO: 471623 - DNA, 15 bp, Homo sapiens
atagttgggaaagga

SEQ ID NO: 471624 - DNA, 15 bp, Homo sapiens
tagttgggaaaggac

SEQ ID NO: 471625 - DNA, 15 bp, Homo sapiens
agttgggaaaggaca

SEQ ID NO: 471626 - DNA, 15 bp, Homo sapiens
gttgggaaaggacaa

SEQ ID NO: 471627 - DNA, 15 bp, Homo sapiens
ttgggaaaggacaaa

SEQ ID NO: 471628 - DNA, 15 bp, Homo sapiens
tgggaaaggacaaag

SEQ ID NO: 471629 - DNA, 15 bp, Homo sapiens
gggaaaggacaaaga

SEQ ID NO: 471630 - DNA, 15 bp, Homo sapiens
ggaaaggacaaagaa

SEQ ID NO: 471631 - DNA, 15 bp, Homo sapiens
gaaaggacaaagaaa

SEQ ID NO: 471632 - DNA, 15 bp, Homo sapiens
aaaggacaaagaaat

SEQ ID NO: 471633 - DNA, 15 bp, Homo sapiens
aaggacaaagaaatt

SEQ ID NO: 471634 - DNA, 15 bp, Homo sapiens
aggacaaagaaattg

SEQ ID NO: 471635 - DNA, 15 bp, Homo sapiens
ggacaaagaaattga

SEQ ID NO: 471636 - DNA, 15 bp, Homo sapiens
gacaaagaaattgac

SEQ ID NO: 471637 - DNA, 15 bp, Homo sapiens
acaaagaaattgaca

SEQ ID NO: 471638 - DNA, 15 bp, Homo sapiens
caaagaaattgacag

SEQ ID NO: 471639 - DNA, 15 bp, Homo sapiens
aaagaaattgacagt

SEQ ID NO: 471640 - DNA, 15 bp, Homo sapiens
aagaaattgacagta

SEQ ID NO: 471641 - DNA, 15 bp, Homo sapiens
agaaattgacagtat

SEQ ID NO: 471642 - DNA, 15 bp, Homo sapiens
gaaattgacagtatt

SEQ ID NO: 471643 - DNA, 15 bp, Homo sapiens
aaattgacagtattc

SEQ ID NO: 471644 - DNA, 15 bp, Homo sapiens
aattgacagtattcc

SEQ ID NO: 471645 - DNA, 15 bp, Homo sapiens
attgacagtattcct

SEQ ID NO: 471646 - DNA, 15 bp, Homo sapiens
ttgacagtattcctt

SEQ ID NO: 471647 - DNA, 15 bp, Homo sapiens
tgacagtattccttc

SEQ ID NO: 471648 - DNA, 15 bp, Homo sapiens
gacagtattccttcc

SEQ ID NO: 471649 - DNA, 15 bp, Homo sapiens
acagtattccttccc

SEQ ID NO: 471650 - DNA, 15 bp, Homo sapiens
cagtattccttccca

SEQ ID NO: 471651 - DNA, 15 bp, Homo sapiens
agtattccttcccaa

SEQ ID NO: 471652 - DNA, 15 bp, Homo sapiens
gtattccttcccaaa

SEQ ID NO: 471653 - DNA, 15 bp, Homo sapiens
tattccttcccaaac

SEQ ID NO: 471654 - DNA, 15 bp, Homo sapiens
attccttcccaaaca

SEQ ID NO: 471655 - DNA, 15 bp, Homo sapiens
ttccttcccaaacag

SEQ ID NO: 471656 - DNA, 15 bp, Homo sapiens
tccttcccaaacaga

SEQ ID NO: 471657 - DNA, 15 bp, Homo sapiens
ccttcccaaacagag

SEQ ID NO: 471658 - DNA, 15 bp, Homo sapiens
cttcccaaacagagc

SEQ ID NO: 471659 - DNA, 15 bp, Homo sapiens
ttcccaaacagagca

SEQ ID NO: 471660 - DNA, 15 bp, Homo sapiens
tcccaaacagagcac

SEQ ID NO: 471661 - DNA, 15 bp, Homo sapiens
cccaaacagagcacc

SEQ ID NO: 471662 - DNA, 15 bp, Homo sapiens
ccaaacagagcacca

SEQ ID NO: 471663 - DNA, 15 bp, Homo sapiens
caaacagagcaccaa

SEQ ID NO: 471664 - DNA, 15 bp, Homo sapiens
aaacagagcaccaat

SEQ ID NO: 471665 - DNA, 15 bp, Homo sapiens
aacagagcaccaatg

SEQ ID NO: 471666 - DNA, 15 bp, Homo sapiens
acagagcaccaatgt

SEQ ID NO: 471667 - DNA, 15 bp, Homo sapiens
cagagcaccaatgtg

SEQ ID NO: 471668 - DNA, 15 bp, Homo sapiens
agagcaccaatgtgg

SEQ ID NO: 471669 - DNA, 15 bp, Homo sapiens
gagcaccaatgtggc

SEQ ID NO: 471670 - DNA, 15 bp, Homo sapiens
agcaccaatgtggcc

SEQ ID NO: 471671 - DNA, 15 bp, Homo sapiens
gcaccaatgtggccc

SEQ ID NO: 471672 - DNA, 15 bp, Homo sapiens
caccaatgtggccct

SEQ ID NO: 471673 - DNA, 15 bp, Homo sapiens
accaatgtggccctg

SEQ ID NO: 471674 - DNA, 15 bp, Homo sapiens
ccaatgtggccctgc

SEQ ID NO: 471675 - DNA, 15 bp, Homo sapiens
caatgtggccctgct

SEQ ID NO: 471676 - DNA, 15 bp, Homo sapiens
aatgtggccctgctc

SEQ ID NO: 471677 - DNA, 15 bp, Homo sapiens
atgtggccctgctct

SEQ ID NO: 471678 - DNA, 15 bp, Homo sapiens
tgtggccctgctctt

SEQ ID NO: 471679 - DNA, 15 bp, Homo sapiens
gtggccctgctcttt

SEQ ID NO: 471680 - DNA, 15 bp, Homo sapiens
tggccctgctctttc

SEQ ID NO: 471681 - DNA, 15 bp, Homo sapiens
ggccctgctctttct

SEQ ID NO: 471682 - DNA, 15 bp, Homo sapiens
gccctgctctttctc

SEQ ID NO: 471683 - DNA, 15 bp, Homo sapiens
ccctgctctttctct

SEQ ID NO: 471684 - DNA, 15 bp, Homo sapiens
cctgctctttctctc

SEQ ID NO: 471685 - DNA, 15 bp, Homo sapiens
ctgctctttctctct

SEQ ID NO: 471686 - DNA, 15 bp, Homo sapiens
tgctctttctctctt

SEQ ID NO: 471687 - DNA, 15 bp, Homo sapiens
gctctttctctctta

SEQ ID NO: 471688 - DNA, 15 bp, Homo sapiens
ctctttctctcttat

SEQ ID NO: 471689 - DNA, 15 bp, Homo sapiens
tctttctctcttatt

SEQ ID NO: 471690 - DNA, 15 bp, Homo sapiens
ctttctctcttattt

SEQ ID NO: 471691 - DNA, 15 bp, Homo sapiens
tttctctcttattta

SEQ ID NO: 471692 - DNA, 15 bp, Homo sapiens
ttctctcttatttat

SEQ ID NO: 471693 - DNA, 15 bp, Homo sapiens
tctctcttatttatt

SEQ ID NO: 471694 - DNA, 15 bp, Homo sapiens
ctctcttatttattg

SEQ ID NO: 471695 - DNA, 15 bp, Homo sapiens
tctcttatttattgt

SEQ ID NO: 471696 - DNA, 15 bp, Homo sapiens
ctcttatttattgtc

SEQ ID NO: 471697 - DNA, 15 bp, Homo sapiens
tcttatttattgtct

SEQ ID NO: 471698 - DNA, 15 bp, Homo sapiens
cttatttattgtctt

SEQ ID NO: 471699 - DNA, 15 bp, Homo sapiens
ttatttattgtctta

SEQ ID NO: 471700 - DNA, 15 bp, Homo sapiens
tatttattgtcttac

SEQ ID NO: 471701 - DNA, 15 bp, Homo sapiens
atttattgtcttacc

SEQ ID NO: 471702 - DNA, 15 bp, Homo sapiens
tttattgtcttacct

SEQ ID NO: 471703 - DNA, 15 bp, Homo sapiens
ttattgtcttacctt

SEQ ID NO: 471704 - DNA, 15 bp, Homo sapiens
tattgtcttaccttt

SEQ ID NO: 471705 - DNA, 15 bp, Homo sapiens
attgtcttacctttt

SEQ ID NO: 471706 - DNA, 15 bp, Homo sapiens
ttgtcttaccttttt

SEQ ID NO: 471707 - DNA, 15 bp, Homo sapiens
tgtcttacctttttc

SEQ ID NO: 471708 - DNA, 15 bp, Homo sapiens
gtcttacctttttcc

SEQ ID NO: 471709 - DNA, 15 bp, Homo sapiens
tcttacctttttccc

SEQ ID NO: 471710 - DNA, 15 bp, Homo sapiens
cttacctttttcccc

SEQ ID NO: 471711 - DNA, 15 bp, Homo sapiens
ttacctttttcccca

SEQ ID NO: 471712 - DNA, 15 bp, Homo sapiens
tacctttttccccac

SEQ ID NO: 471713 - DNA, 15 bp, Homo sapiens
acctttttccccact

SEQ ID NO: 471714 - DNA, 15 bp, Homo sapiens
cctttttccccacta

SEQ ID NO: 471715 - DNA, 15 bp, Homo sapiens
ctttttccccactag

SEQ ID NO: 471716 - DNA, 15 bp, Homo sapiens
tttttccccactaga

SEQ ID NO: 471717 - DNA, 15 bp, Homo sapiens
ttttccccactagaa

SEQ ID NO: 471718 - DNA, 15 bp, Homo sapiens
tttccccactagaat

SEQ ID NO: 471719 - DNA, 15 bp, Homo sapiens
ttccccactagaata

SEQ ID NO: 471720 - DNA, 15 bp, Homo sapiens
tccccactagaatat

SEQ ID NO: 471721 - DNA, 15 bp, Homo sapiens
ccccactagaatata

SEQ ID NO: 471722 - DNA, 15 bp, Homo sapiens
cccactagaatatat

SEQ ID NO: 471723 - DNA, 15 bp, Homo sapiens
ccactagaatatatg

SEQ ID NO: 471724 - DNA, 15 bp, Homo sapiens
cactagaatatatgc

SEQ ID NO: 471725 - DNA, 15 bp, Homo sapiens
actagaatatatgct

SEQ ID NO: 471726 - DNA, 15 bp, Homo sapiens
ctagaatatatgctg

SEQ ID NO: 471727 - DNA, 15 bp, Homo sapiens
tagaatatatgctgg

SEQ ID NO: 471728 - DNA, 15 bp, Homo sapiens
agaatatatgctggc

SEQ ID NO: 471729 - DNA, 15 bp, Homo sapiens
gaatatatgctggct

SEQ ID NO: 471730 - DNA, 15 bp, Homo sapiens
aatatatgctggctt

SEQ ID NO: 471731 - DNA, 15 bp, Homo sapiens
atatatgctggcttg

SEQ ID NO: 471732 - DNA, 15 bp, Homo sapiens
tatatgctggcttgt

SEQ ID NO: 471733 - DNA, 15 bp, Homo sapiens
atatgctggcttgtg

SEQ ID NO: 471734 - DNA, 15 bp, Homo sapiens
tatgctggcttgtgt

SEQ ID NO: 471735 - DNA, 15 bp, Homo sapiens
atgctggcttgtgtg

SEQ ID NO: 471736 - DNA, 15 bp, Homo sapiens
tgctggcttgtgtgt

SEQ ID NO: 471737 - DNA, 15 bp, Homo sapiens
gctggcttgtgtgta

SEQ ID NO: 471738 - DNA, 15 bp, Homo sapiens
ctggcttgtgtgtag

SEQ ID NO: 471739 - DNA, 15 bp, Homo sapiens
tggcttgtgtgtagc

SEQ ID NO: 471740 - DNA, 15 bp, Homo sapiens
ggcttgtgtgtagcc

SEQ ID NO: 471741 - DNA, 15 bp, Homo sapiens
gcttgtgtgtagcca

SEQ ID NO: 471742 - DNA, 15 bp, Homo sapiens
cttgtgtgtagccag

SEQ ID NO: 471743 - DNA, 15 bp, Homo sapiens
ttgtgtgtagccagc

SEQ ID NO: 471744 - DNA, 15 bp, Homo sapiens
tgtgtgtagccagca

SEQ ID NO: 471745 - DNA, 15 bp, Homo sapiens
gtgtgtagccagcat

SEQ ID NO: 471746 - DNA, 15 bp, Homo sapiens
tgtgtagccagcatc

SEQ ID NO: 471747 - DNA, 15 bp, Homo sapiens
gtgtagccagcatcg

SEQ ID NO: 471748 - DNA, 15 bp, Homo sapiens
tgtagccagcatcgg

SEQ ID NO: 471749 - DNA, 15 bp, Homo sapiens
gtagccagcatcggc

SEQ ID NO: 471750 - DNA, 15 bp, Homo sapiens
tagccagcatcggct

SEQ ID NO: 471751 - DNA, 15 bp, Homo sapiens
agccagcatcggctc

SEQ ID NO: 471752 - DNA, 15 bp, Homo sapiens
gccagcatcggctct

SEQ ID NO: 471753 - DNA, 15 bp, Homo sapiens
ccagcatcggctcta

SEQ ID NO: 471754 - DNA, 15 bp, Homo sapiens
cagcatcggctctat

SEQ ID NO: 471755 - DNA, 15 bp, Homo sapiens
agcatcggctctatg

SEQ ID NO: 471756 - DNA, 15 bp, Homo sapiens
gcatcggctctatga

SEQ ID NO: 471757 - DNA, 15 bp, Homo sapiens
catcggctctatgac

SEQ ID NO: 471758 - DNA, 15 bp, Homo sapiens
atcggctctatgact

SEQ ID NO: 471759 - DNA, 15 bp, Homo sapiens
tcggctctatgacta

SEQ ID NO: 471760 - DNA, 15 bp, Homo sapiens
cggctctatgactaa

SEQ ID NO: 471761 - DNA, 15 bp, Homo sapiens
ggctctatgactaat

SEQ ID NO: 471762 - DNA, 15 bp, Homo sapiens
gctctatgactaatt

SEQ ID NO: 471763 - DNA, 15 bp, Homo sapiens
ctctatgactaattt

SEQ ID NO: 471764 - DNA, 15 bp, Homo sapiens
tctatgactaatttc

SEQ ID NO: 471765 - DNA, 15 bp, Homo sapiens
ctatgactaatttcc

SEQ ID NO: 471766 - DNA, 15 bp, Homo sapiens
tatgactaatttcca

SEQ ID NO: 471767 - DNA, 15 bp, Homo sapiens
atgactaatttccat

SEQ ID NO: 471768 - DNA, 15 bp, Homo sapiens
tgactaatttccatt

SEQ ID NO: 471769 - DNA, 15 bp, Homo sapiens
gactaatttccatta

SEQ ID NO: 471770 - DNA, 15 bp, Homo sapiens
actaatttccattaa

SEQ ID NO: 471771 - DNA, 15 bp, Homo sapiens
ctaatttccattaac

SEQ ID NO: 471772 - DNA, 15 bp, Homo sapiens
taatttccattaaca

SEQ ID NO: 471773 - DNA, 15 bp, Homo sapiens
aatttccattaacac

SEQ ID NO: 471774 - DNA, 15 bp, Homo sapiens
atttccattaacaca

SEQ ID NO: 471775 - DNA, 15 bp, Homo sapiens
tttccattaacacag

SEQ ID NO: 471776 - DNA, 15 bp, Homo sapiens
ttccattaacacagc

SEQ ID NO: 471777 - DNA, 15 bp, Homo sapiens
tccattaacacagct

SEQ ID NO: 471778 - DNA, 15 bp, Homo sapiens
ccattaacacagctt

SEQ ID NO: 471779 - DNA, 15 bp, Homo sapiens
cattaacacagcttg

SEQ ID NO: 471780 - DNA, 15 bp, Homo sapiens
attaacacagcttgg

SEQ ID NO: 471781 - DNA, 15 bp, Homo sapiens
ttaacacagcttggt

SEQ ID NO: 471782 - DNA, 15 bp, Homo sapiens
taacacagcttggtt

SEQ ID NO: 471783 - DNA, 15 bp, Homo sapiens
aacacagcttggtta

SEQ ID NO: 471784 - DNA, 15 bp, Homo sapiens
acacagcttggttaa

SEQ ID NO: 471785 - DNA, 15 bp, Homo sapiens
cacagcttggttaaa

SEQ ID NO: 471786 - DNA, 15 bp, Homo sapiens
acagcttggttaaaa

SEQ ID NO: 471787 - DNA, 15 bp, Homo sapiens
cagcttggttaaaac

SEQ ID NO: 471788 - DNA, 15 bp, Homo sapiens
agcttggttaaaacc

SEQ ID NO: 471789 - DNA, 15 bp, Homo sapiens
gcttggttaaaacca

SEQ ID NO: 471790 - DNA, 15 bp, Homo sapiens
cttggttaaaaccat

SEQ ID NO: 471791 - DNA, 15 bp, Homo sapiens
ttggttaaaaccatt

SEQ ID NO: 471792 - DNA, 15 bp, Homo sapiens
tggttaaaaccattg

SEQ ID NO: 471793 - DNA, 15 bp, Homo sapiens
ggttaaaaccattgt

SEQ ID NO: 471794 - DNA, 15 bp, Homo sapiens
gttaaaaccattgtg

SEQ ID NO: 471795 - DNA, 15 bp, Homo sapiens
ttaaaaccattgtgg

SEQ ID NO: 471796 - DNA, 15 bp, Homo sapiens
taaaaccattgtggt

SEQ ID NO: 471797 - DNA, 15 bp, Homo sapiens
aaaaccattgtggtt

SEQ ID NO: 471798 - DNA, 15 bp, Homo sapiens
aaaccattgtggtta

SEQ ID NO: 471799 - DNA, 15 bp, Homo sapiens
aaccattgtggttaa

SEQ ID NO: 471800 - DNA, 15 bp, Homo sapiens
accattgtggttaaa

SEQ ID NO: 471801 - DNA, 15 bp, Homo sapiens
ccattgtggttaaaa

SEQ ID NO: 471802 - DNA, 15 bp, Homo sapiens
cattgtggttaaaac

SEQ ID NO: 471803 - DNA, 15 bp, Homo sapiens
attgtggttaaaacc

SEQ ID NO: 471804 - DNA, 15 bp, Homo sapiens
ttgtggttaaaacca

SEQ ID NO: 471805 - DNA, 15 bp, Homo sapiens
gtggttaaaaccaca

SEQ ID NO: 471806 - DNA, 15 bp, Homo sapiens
tggttaaaaccacaa

SEQ ID NO: 471807 - DNA, 15 bp, Homo sapiens
ggttaaaaccacaat

SEQ ID NO: 471808 - DNA, 15 bp, Homo sapiens
gttaaaaccacaata

SEQ ID NO: 471809 - DNA, 15 bp, Homo sapiens
ttaaaaccacaatac

SEQ ID NO: 471810 - DNA, 15 bp, Homo sapiens
taaaaccacaatact

SEQ ID NO: 471811 - DNA, 15 bp, Homo sapiens
aaaaccacaatactc

SEQ ID NO: 471812 - DNA, 15 bp, Homo sapiens
aaaccacaatactct

SEQ ID NO: 471813 - DNA, 15 bp, Homo sapiens
aaccacaatactctg

SEQ ID NO: 471814 - DNA, 15 bp, Homo sapiens
accacaatactctgt

SEQ ID NO: 471815 - DNA, 15 bp, Homo sapiens
ccacaatactctgtc

SEQ ID NO: 471816 - DNA, 15 bp, Homo sapiens
cacaatactctgtca

SEQ ID NO: 471817 - DNA, 15 bp, Homo sapiens
acaatactctgtcat

SEQ ID NO: 471818 - DNA, 15 bp, Homo sapiens
caatactctgtcatc

SEQ ID NO: 471819 - DNA, 15 bp, Homo sapiens
aatactctgtcatca

SEQ ID NO: 471820 - DNA, 15 bp, Homo sapiens
atactctgtcatcac

SEQ ID NO: 471821 - DNA, 15 bp, Homo sapiens
tactctgtcatcact

SEQ ID NO: 471822 - DNA, 15 bp, Homo sapiens
actctgtcatcacta

SEQ ID NO: 471823 - DNA, 15 bp, Homo sapiens
ctctgtcatcactat

SEQ ID NO: 471824 - DNA, 15 bp, Homo sapiens
tctgtcatcactata

SEQ ID NO: 471825 - DNA, 15 bp, Homo sapiens
ctgtcatcactatat

SEQ ID NO: 471826 - DNA, 15 bp, Homo sapiens
tgtcatcactatatt

SEQ ID NO: 471827 - DNA, 15 bp, Homo sapiens
gtcatcactatatta

SEQ ID NO: 471828 - DNA, 15 bp, Homo sapiens
tcatcactatattaa

SEQ ID NO: 471829 - DNA, 15 bp, Homo sapiens
catcactatattaat

SEQ ID NO: 471830 - DNA, 15 bp, Homo sapiens
atcactatattaata

SEQ ID NO: 471831 - DNA, 15 bp, Homo sapiens
tcactatattaatag

SEQ ID NO: 471832 - DNA, 15 bp, Homo sapiens
cactatattaatagc

SEQ ID NO: 471833 - DNA, 15 bp, Homo sapiens
actatattaatagca

SEQ ID NO: 471834 - DNA, 15 bp, Homo sapiens
ctatattaatagcaa

SEQ ID NO: 471835 - DNA, 15 bp, Homo sapiens
tatattaatagcaaa

SEQ ID NO: 471836 - DNA, 15 bp, Homo sapiens
atattaatagcaaat

SEQ ID NO: 471837 - DNA, 15 bp, Homo sapiens
tattaatagcaaatt

SEQ ID NO: 471838 - DNA, 15 bp, Homo sapiens
attaatagcaaattg

SEQ ID NO: 471839 - DNA, 15 bp, Homo sapiens
ttaatagcaaattga

SEQ ID NO: 471840 - DNA, 15 bp, Homo sapiens
taatagcaaattgaa

SEQ ID NO: 471841 - DNA, 15 bp, Homo sapiens
aatagcaaattgaaa

SEQ ID NO: 471842 - DNA, 15 bp, Homo sapiens
atagcaaattgaaaa

SEQ ID NO: 471843 - DNA, 15 bp, Homo sapiens
tagcaaattgaaaat

SEQ ID NO: 471844 - DNA, 15 bp, Homo sapiens
agcaaattgaaaatt

SEQ ID NO: 471845 - DNA, 15 bp, Homo sapiens
gcaaattgaaaattt

SEQ ID NO: 471846 - DNA, 15 bp, Homo sapiens
caaattgaaaatttt

SEQ ID NO: 471847 - DNA, 15 bp, Homo sapiens
aaattgaaaattttt

SEQ ID NO: 471848 - DNA, 15 bp, Homo sapiens
aattgaaaatttttt

SEQ ID NO: 471849 - DNA, 15 bp, Homo sapiens
attgaaaattttttt

SEQ ID NO: 471850 - DNA, 15 bp, Homo sapiens
ttgaaaattttttta

SEQ ID NO: 471851 - DNA, 15 bp, Homo sapiens
tgaaaatttttttag

SEQ ID NO: 471852 - DNA, 15 bp, Homo sapiens
gaaaatttttttagt

SEQ ID NO: 471853 - DNA, 15 bp, Homo sapiens
aaaatttttttagtg

SEQ ID NO: 471854 - DNA, 15 bp, Homo sapiens
aaatttttttagtga

SEQ ID NO: 471855 - DNA, 15 bp, Homo sapiens
aatttttttagtgat

SEQ ID NO: 471856 - DNA, 15 bp, Homo sapiens
atttttttagtgata

SEQ ID NO: 471857 - DNA, 15 bp, Homo sapiens
tttttttagtgataa

SEQ ID NO: 471858 - DNA, 15 bp, Homo sapiens
ttttttagtgataag

SEQ ID NO: 471859 - DNA, 15 bp, Homo sapiens
tttttagtgataaga

SEQ ID NO: 471860 - DNA, 15 bp, Homo sapiens
ttttagtgataagaa

SEQ ID NO: 471861 - DNA, 15 bp, Homo sapiens
tttagtgataagaac

SEQ ID NO: 471862 - DNA, 15 bp, Homo sapiens
ttagtgataagaacc

SEQ ID NO: 471863 - DNA, 15 bp, Homo sapiens
tagtgataagaacca

SEQ ID NO: 471864 - DNA, 15 bp, Homo sapiens
agtgataagaaccag

SEQ ID NO: 471865 - DNA, 15 bp, Homo sapiens
gtgataagaaccagc

SEQ ID NO: 471866 - DNA, 15 bp, Homo sapiens
tgataagaaccagcc

SEQ ID NO: 471867 - DNA, 15 bp, Homo sapiens
gataagaaccagcca

SEQ ID NO: 471868 - DNA, 15 bp, Homo sapiens
ataagaaccagccaa

SEQ ID NO: 471869 - DNA, 15 bp, Homo sapiens
taagaaccagccaat

SEQ ID NO: 471870 - DNA, 15 bp, Homo sapiens
aagaaccagccaata

SEQ ID NO: 471871 - DNA, 15 bp, Homo sapiens
agaaccagccaatag

SEQ ID NO: 471872 - DNA, 15 bp, Homo sapiens
gaaccagccaatagt

SEQ ID NO: 471873 - DNA, 15 bp, Homo sapiens
aaccagccaatagtt

SEQ ID NO: 471874 - DNA, 15 bp, Homo sapiens
accagccaatagttt

SEQ ID NO: 471875 - DNA, 15 bp, Homo sapiens
ccagccaatagtttg

SEQ ID NO: 471876 - DNA, 15 bp, Homo sapiens
cagccaatagtttgg

SEQ ID NO: 471877 - DNA, 15 bp, Homo sapiens
agccaatagtttgga

SEQ ID NO: 471878 - DNA, 15 bp, Homo sapiens
gccaatagtttggaa

SEQ ID NO: 471879 - DNA, 15 bp, Homo sapiens
ccaatagtttggaaa

SEQ ID NO: 471880 - DNA, 15 bp, Homo sapiens
caatagtttggaaaa

SEQ ID NO: 471881 - DNA, 15 bp, Homo sapiens
aatagtttggaaaaa

SEQ ID NO: 471882 - DNA, 15 bp, Homo sapiens
atagtttggaaaaat

SEQ ID NO: 471883 - DNA, 15 bp, Homo sapiens
tagtttggaaaaatt

SEQ ID NO: 471884 - DNA, 15 bp, Homo sapiens
agtttggaaaaatta

SEQ ID NO: 471885 - DNA, 15 bp, Homo sapiens
gtttggaaaaattag

SEQ ID NO: 471886 - DNA, 15 bp, Homo sapiens
tttggaaaaattagt

SEQ ID NO: 471887 - DNA, 15 bp, Homo sapiens
ttggaaaaattagtt

SEQ ID NO: 471888 - DNA, 15 bp, Homo sapiens
tggaaaaattagttt

SEQ ID NO: 471889 - DNA, 15 bp, Homo sapiens
ggaaaaattagtttg

SEQ ID NO: 471890 - DNA, 15 bp, Homo sapiens
gaaaaattagtttgg

SEQ ID NO: 471891 - DNA, 15 bp, Homo sapiens
aaaaattagtttgga

SEQ ID NO: 471892 - DNA, 15 bp, Homo sapiens
aaaattagtttggaa

SEQ ID NO: 471893 - DNA, 15 bp, Homo sapiens
aaattagtttggaaa

SEQ ID NO: 471894 - DNA, 15 bp, Homo sapiens
aattagtttggaaaa

SEQ ID NO: 471895 - DNA, 15 bp, Homo sapiens
attagtttggaaaaa

SEQ ID NO: 471896 - DNA, 15 bp, Homo sapiens
ttagtttggaaaaat

SEQ ID NO: 471897 - DNA, 15 bp, Homo sapiens
agtttggaaaaattt

SEQ ID NO: 471898 - DNA, 15 bp, Homo sapiens
gtttggaaaaatttc

SEQ ID NO: 471899 - DNA, 15 bp, Homo sapiens
tttggaaaaatttca

SEQ ID NO: 471900 - DNA, 15 bp, Homo sapiens
ttggaaaaatttcaa

SEQ ID NO: 471901 - DNA, 15 bp, Homo sapiens
tggaaaaatttcaaa

SEQ ID NO: 471902 - DNA, 15 bp, Homo sapiens
ggaaaaatttcaaaa

SEQ ID NO: 471903 - DNA, 15 bp, Homo sapiens
gaaaaatttcaaaac

SEQ ID NO: 471904 - DNA, 15 bp, Homo sapiens
aaaaatttcaaaact

SEQ ID NO: 471905 - DNA, 15 bp, Homo sapiens
aaaatttcaaaacta

SEQ ID NO: 471906 - DNA, 15 bp, Homo sapiens
tttcaaaactaatta

SEQ ID NO: 471907 - DNA, 15 bp, Homo sapiens
ttcaaaactaattat

SEQ ID NO: 471908 - DNA, 15 bp, Homo sapiens
tcaaaactaattata

SEQ ID NO: 471909 - DNA, 15 bp, Homo sapiens
caaaactaattatac

SEQ ID NO: 471910 - DNA, 15 bp, Homo sapiens
aaaactaattatact

SEQ ID NO: 471911 - DNA, 15 bp, Homo sapiens
aaactaattatactt

SEQ ID NO: 471912 - DNA, 15 bp, Homo sapiens
aactaattatacttt

SEQ ID NO: 471913 - DNA, 15 bp, Homo sapiens
actaattatactttt

SEQ ID NO: 471914 - DNA, 15 bp, Homo sapiens
ctaattatacttttt

SEQ ID NO: 471915 - DNA, 15 bp, Homo sapiens
taattatactttttg

SEQ ID NO: 471916 - DNA, 15 bp, Homo sapiens
aattatactttttgg

SEQ ID NO: 471917 - DNA, 15 bp, Homo sapiens
attatactttttggc

SEQ ID NO: 471918 - DNA, 15 bp, Homo sapiens
ttatactttttggcc

SEQ ID NO: 471919 - DNA, 15 bp, Homo sapiens
tatactttttggccc

SEQ ID NO: 471920 - DNA, 15 bp, Homo sapiens
atactttttggccca

SEQ ID NO: 471921 - DNA, 15 bp, Homo sapiens
tactttttggcccaa

SEQ ID NO: 471922 - DNA, 15 bp, Homo sapiens
actttttggcccaag

SEQ ID NO: 471923 - DNA, 15 bp, Homo sapiens
ctttttggcccaagt

SEQ ID NO: 471924 - DNA, 15 bp, Homo sapiens
tttttggcccaagtt

SEQ ID NO: 471925 - DNA, 15 bp, Homo sapiens
ttttggcccaagttt

SEQ ID NO: 471926 - DNA, 15 bp, Homo sapiens
tttggcccaagtttt

SEQ ID NO: 471927 - DNA, 15 bp, Homo sapiens
ttggcccaagtttta

SEQ ID NO: 471928 - DNA, 15 bp, Homo sapiens
tggcccaagttttaa

SEQ ID NO: 471929 - DNA, 15 bp, Homo sapiens
ggcccaagttttaaa

SEQ ID NO: 471930 - DNA, 15 bp, Homo sapiens
gcccaagttttaaaa

SEQ ID NO: 471931 - DNA, 15 bp, Homo sapiens
cccaagttttaaaat

SEQ ID NO: 471932 - DNA, 15 bp, Homo sapiens
ccaagttttaaaata

SEQ ID NO: 471933 - DNA, 15 bp, Homo sapiens
caagttttaaaatat

SEQ ID NO: 471934 - DNA, 15 bp, Homo sapiens
aagttttaaaatatt

SEQ ID NO: 471935 - DNA, 15 bp, Homo sapiens
agttttaaaatattg

SEQ ID NO: 471936 - DNA, 15 bp, Homo sapiens
gttttaaaatattgg

SEQ ID NO: 471937 - DNA, 15 bp, Homo sapiens
ttttaaaatattggg

SEQ ID NO: 471938 - DNA, 15 bp, Homo sapiens
tttaaaatattgggg

SEQ ID NO: 471939 - DNA, 15 bp, Homo sapiens
ttaaaatattgggga

SEQ ID NO: 471940 - DNA, 15 bp, Homo sapiens
taaaatattggggaa

SEQ ID NO: 471941 - DNA, 15 bp, Homo sapiens
aaaatattggggaaa

SEQ ID NO: 471942 - DNA, 15 bp, Homo sapiens
aaatattggggaaat

SEQ ID NO: 471943 - DNA, 15 bp, Homo sapiens
aatattggggaaatg

SEQ ID NO: 471944 - DNA, 15 bp, Homo sapiens
atattggggaaatga

SEQ ID NO: 471945 - DNA, 15 bp, Homo sapiens
tattggggaaatgaa

SEQ ID NO: 471946 - DNA, 15 bp, Homo sapiens
attggggaaatgaac

SEQ ID NO: 471947 - DNA, 15 bp, Homo sapiens
ttggggaaatgaact

SEQ ID NO: 471948 - DNA, 15 bp, Homo sapiens
tggggaaatgaacta

SEQ ID NO: 471949 - DNA, 15 bp, Homo sapiens
ggggaaatgaactag

SEQ ID NO: 471950 - DNA, 15 bp, Homo sapiens
gggaaatgaactagg

SEQ ID NO: 471951 - DNA, 15 bp, Homo sapiens
ggaaatgaactaggt

SEQ ID NO: 471952 - DNA, 15 bp, Homo sapiens
gaaatgaactaggta

SEQ ID NO: 471953 - DNA, 15 bp, Homo sapiens
aaatgaactaggtat

SEQ ID NO: 471954 - DNA, 15 bp, Homo sapiens
aatgaactaggtatg

SEQ ID NO: 471955 - DNA, 15 bp, Homo sapiens
atgaactaggtatgg

SEQ ID NO: 471956 - DNA, 15 bp, Homo sapiens
tgaactaggtatggt

SEQ ID NO: 471957 - DNA, 15 bp, Homo sapiens
gaactaggtatggtt

SEQ ID NO: 471958 - DNA, 15 bp, Homo sapiens
aactaggtatggttt

SEQ ID NO: 471959 - DNA, 15 bp, Homo sapiens
actaggtatggttta

SEQ ID NO: 471960 - DNA, 15 bp, Homo sapiens
ctaggtatggtttat

SEQ ID NO: 471961 - DNA, 15 bp, Homo sapiens
taggtatggtttatt

SEQ ID NO: 471962 - DNA, 15 bp, Homo sapiens
aggtatggtttattt

SEQ ID NO: 471963 - DNA, 15 bp, Homo sapiens
ggtatggtttatttt

SEQ ID NO: 471964 - DNA, 15 bp, Homo sapiens
gtatggtttattttc

SEQ ID NO: 471965 - DNA, 15 bp, Homo sapiens
tatggtttattttca

SEQ ID NO: 471966 - DNA, 15 bp, Homo sapiens
atggtttattttcaa

SEQ ID NO: 471967 - DNA, 15 bp, Homo sapiens
tggtttattttcaac

SEQ ID NO: 471968 - DNA, 15 bp, Homo sapiens
ggtttattttcaaca

SEQ ID NO: 471969 - DNA, 15 bp, Homo sapiens
gtttattttcaacag

SEQ ID NO: 471970 - DNA, 15 bp, Homo sapiens
tttattttcaacaga

SEQ ID NO: 471971 - DNA, 15 bp, Homo sapiens
ttattttcaacagag

SEQ ID NO: 471972 - DNA, 15 bp, Homo sapiens
tattttcaacagaga

SEQ ID NO: 471973 - DNA, 15 bp, Homo sapiens
attttcaacagagaa

SEQ ID NO: 471974 - DNA, 15 bp, Homo sapiens
ttttcaacagagaat

SEQ ID NO: 471975 - DNA, 15 bp, Homo sapiens
tttcaacagagaatg

SEQ ID NO: 471976 - DNA, 15 bp, Homo sapiens
ttcaacagagaatga

SEQ ID NO: 471977 - DNA, 15 bp, Homo sapiens
tcaacagagaatgaa

SEQ ID NO: 471978 - DNA, 15 bp, Homo sapiens
caacagagaatgaaa

SEQ ID NO: 471979 - DNA, 15 bp, Homo sapiens
aacagagaatgaaaa

SEQ ID NO: 471980 - DNA, 15 bp, Homo sapiens
acagagaatgaaaaa

SEQ ID NO: 471981 - DNA, 15 bp, Homo sapiens
cagagaatgaaaaag

SEQ ID NO: 471982 - DNA, 15 bp, Homo sapiens
agagaatgaaaaagt

SEQ ID NO: 471983 - DNA, 15 bp, Homo sapiens
gagaatgaaaaagta

SEQ ID NO: 471984 - DNA, 15 bp, Homo sapiens
agaatgaaaaagtat

SEQ ID NO: 471985 - DNA, 15 bp, Homo sapiens
gaatgaaaaagtata

SEQ ID NO: 471986 - DNA, 15 bp, Homo sapiens
aatgaaaaagtataa

SEQ ID NO: 471987 - DNA, 15 bp, Homo sapiens
atgaaaaagtataaa

SEQ ID NO: 471988 - DNA, 15 bp, Homo sapiens
tgaaaaagtataaac

SEQ ID NO: 471989 - DNA, 15 bp, Homo sapiens
gaaaaagtataaaca

SEQ ID NO: 471990 - DNA, 15 bp, Homo sapiens
aaaaagtataaacat

SEQ ID NO: 471991 - DNA, 15 bp, Homo sapiens
aaaagtataaacata

SEQ ID NO: 471992 - DNA, 15 bp, Homo sapiens
aaagtataaacatat

SEQ ID NO: 471993 - DNA, 15 bp, Homo sapiens
aagtataaacatatc

SEQ ID NO: 471994 - DNA, 15 bp, Homo sapiens
agtataaacatatca

SEQ ID NO: 471995 - DNA, 15 bp, Homo sapiens
gtataaacatatcac

SEQ ID NO: 471996 - DNA, 15 bp, Homo sapiens
tataaacatatcact

SEQ ID NO: 471997 - DNA, 15 bp, Homo sapiens
ataaacatatcactg

SEQ ID NO: 471998 - DNA, 15 bp, Homo sapiens
taaacatatcactgg

SEQ ID NO: 471999 - DNA, 15 bp, Homo sapiens
aaacatatcactgga

SEQ ID NO: 472000 - DNA, 15 bp, Homo sapiens
aacatatcactggat

SEQ ID NO: 472001 - DNA, 15 bp, Homo sapiens
acatatcactggata

SEQ ID NO: 472002 - DNA, 15 bp, Homo sapiens
catatcactggatat

SEQ ID NO: 472003 - DNA, 15 bp, Homo sapiens
atatcactggatata

SEQ ID NO: 472004 - DNA, 15 bp, Homo sapiens
tatcactggatatat

SEQ ID NO: 472005 - DNA, 15 bp, Homo sapiens
atcactggatatatt

SEQ ID NO: 472006 - DNA, 15 bp, Homo sapiens
tcactggatatattt

SEQ ID NO: 472007 - DNA, 15 bp, Homo sapiens
cactggatatattta

SEQ ID NO: 472008 - DNA, 15 bp, Homo sapiens
actggatatatttag

SEQ ID NO: 472009 - DNA, 15 bp, Homo sapiens
ctggatatatttagt

SEQ ID NO: 472010 - DNA, 15 bp, Homo sapiens
tggatatatttagtg

SEQ ID NO: 472011 - DNA, 15 bp, Homo sapiens
ggatatatttagtga

SEQ ID NO: 472012 - DNA, 15 bp, Homo sapiens
gatatatttagtgat

SEQ ID NO: 472013 - DNA, 15 bp, Homo sapiens
atatatttagtgatg

SEQ ID NO: 472014 - DNA, 15 bp, Homo sapiens
tatatttagtgatga

SEQ ID NO: 472015 - DNA, 15 bp, Homo sapiens
atatttagtgatgag

SEQ ID NO: 472016 - DNA, 15 bp, Homo sapiens
tatttagtgatgagt

SEQ ID NO: 472017 - DNA, 15 bp, Homo sapiens
atttagtgatgagtt

SEQ ID NO: 472018 - DNA, 15 bp, Homo sapiens
tttagtgatgagttc

SEQ ID NO: 472019 - DNA, 15 bp, Homo sapiens
ttagtgatgagttct

SEQ ID NO: 472020 - DNA, 15 bp, Homo sapiens
tagtgatgagttctt

SEQ ID NO: 472021 - DNA, 15 bp, Homo sapiens
agtgatgagttctta

SEQ ID NO: 472022 - DNA, 15 bp, Homo sapiens
gtgatgagttcttat

SEQ ID NO: 472023 - DNA, 15 bp, Homo sapiens
tgatgagttcttatt

SEQ ID NO: 472024 - DNA, 15 bp, Homo sapiens
gatgagttcttattg

SEQ ID NO: 472025 - DNA, 15 bp, Homo sapiens
atgagttcttattgc

SEQ ID NO: 472026 - DNA, 15 bp, Homo sapiens
tgagttcttattgcc

SEQ ID NO: 472027 - DNA, 15 bp, Homo sapiens
gagttcttattgcca

SEQ ID NO: 472028 - DNA, 15 bp, Homo sapiens
agttcttattgccaa

SEQ ID NO: 472029 - DNA, 15 bp, Homo sapiens
gttcttattgccaag

SEQ ID NO: 472030 - DNA, 15 bp, Homo sapiens
ttcttattgccaagt

SEQ ID NO: 472031 - DNA, 15 bp, Homo sapiens
tcttattgccaagtg

SEQ ID NO: 472032 - DNA, 15 bp, Homo sapiens
cttattgccaagtgt

SEQ ID NO: 472033 - DNA, 15 bp, Homo sapiens
ttattgccaagtgtt

SEQ ID NO: 472034 - DNA, 15 bp, Homo sapiens
tattgccaagtgttt

SEQ ID NO: 472035 - DNA, 15 bp, Homo sapiens
attgccaagtgtttt

SEQ ID NO: 472036 - DNA, 15 bp, Homo sapiens
ttgccaagtgttttc

SEQ ID NO: 472037 - DNA, 15 bp, Homo sapiens
tgccaagtgttttca

SEQ ID NO: 472038 - DNA, 15 bp, Homo sapiens
gccaagtgttttcat

SEQ ID NO: 472039 - DNA, 15 bp, Homo sapiens
ccaagtgttttcatg

SEQ ID NO: 472040 - DNA, 15 bp, Homo sapiens
caagtgttttcatga

SEQ ID NO: 472041 - DNA, 15 bp, Homo sapiens
aagtgttttcatgag

SEQ ID NO: 472042 - DNA, 15 bp, Homo sapiens
agtgttttcatgaga

SEQ ID NO: 472043 - DNA, 15 bp, Homo sapiens
gtgttttcatgagac

SEQ ID NO: 472044 - DNA, 15 bp, Homo sapiens
tgttttcatgagact

SEQ ID NO: 472045 - DNA, 15 bp, Homo sapiens
gttttcatgagactg

SEQ ID NO: 472046 - DNA, 15 bp, Homo sapiens
ttttcatgagactgc

SEQ ID NO: 472047 - DNA, 15 bp, Homo sapiens
tttcatgagactgct

SEQ ID NO: 472048 - DNA, 15 bp, Homo sapiens
ttcatgagactgctt

SEQ ID NO: 472049 - DNA, 15 bp, Homo sapiens
tcatgagactgcttt

SEQ ID NO: 472050 - DNA, 15 bp, Homo sapiens
catgagactgcttta

SEQ ID NO: 472051 - DNA, 15 bp, Homo sapiens
atgagactgctttat

SEQ ID NO: 472052 - DNA, 15 bp, Homo sapiens
tgagactgctttatt

SEQ ID NO: 472053 - DNA, 15 bp, Homo sapiens
gagactgctttattt

SEQ ID NO: 472054 - DNA, 15 bp, Homo sapiens
agactgctttatttc

SEQ ID NO: 472055 - DNA, 15 bp, Homo sapiens
gactgctttatttca

SEQ ID NO: 472056 - DNA, 15 bp, Homo sapiens
actgctttatttcaa

SEQ ID NO: 472057 - DNA, 15 bp, Homo sapiens
ctgctttatttcaaa

SEQ ID NO: 472058 - DNA, 15 bp, Homo sapiens
tgctttatttcaaaa

SEQ ID NO: 472059 - DNA, 15 bp, Homo sapiens
gctttatttcaaaaa

SEQ ID NO: 472060 - DNA, 15 bp, Homo sapiens
ctttatttcaaaaat

SEQ ID NO: 472061 - DNA, 15 bp, Homo sapiens
tttatttcaaaaatg

SEQ ID NO: 472062 - DNA, 15 bp, Homo sapiens
ttatttcaaaaatgc

SEQ ID NO: 472063 - DNA, 15 bp, Homo sapiens
tatttcaaaaatgca

SEQ ID NO: 472064 - DNA, 15 bp, Homo sapiens
atttcaaaaatgcat

SEQ ID NO: 472065 - DNA, 15 bp, Homo sapiens
tttcaaaaatgcata

SEQ ID NO: 472066 - DNA, 15 bp, Homo sapiens
ttcaaaaatgcataa

SEQ ID NO: 472067 - DNA, 15 bp, Homo sapiens
tcaaaaatgcataaa

SEQ ID NO: 472068 - DNA, 15 bp, Homo sapiens
caaaaatgcataaaa

SEQ ID NO: 472069 - DNA, 15 bp, Homo sapiens
aaaaatgcataaaac

SEQ ID NO: 472070 - DNA, 15 bp, Homo sapiens
aaaatgcataaaact

SEQ ID NO: 472071 - DNA, 15 bp, Homo sapiens
aaatgcataaaacta

SEQ ID NO: 472072 - DNA, 15 bp, Homo sapiens
aatgcataaaactac

SEQ ID NO: 472073 - DNA, 15 bp, Homo sapiens
atgcataaaactacc

SEQ ID NO: 472074 - DNA, 15 bp, Homo sapiens
tgcataaaactacca

SEQ ID NO: 472075 - DNA, 15 bp, Homo sapiens
gcataaaactaccaa

SEQ ID NO: 472076 - DNA, 15 bp, Homo sapiens
cataaaactaccaaa

SEQ ID NO: 472077 - DNA, 15 bp, Homo sapiens
ataaaactaccaaaa

SEQ ID NO: 472078 - DNA, 15 bp, Homo sapiens
taaaactaccaaaac

SEQ ID NO: 472079 - DNA, 15 bp, Homo sapiens
aaaactaccaaaact

SEQ ID NO: 472080 - DNA, 15 bp, Homo sapiens
aaactaccaaaactg

SEQ ID NO: 472081 - DNA, 15 bp, Homo sapiens
aactaccaaaactgt

SEQ ID NO: 472082 - DNA, 15 bp, Homo sapiens
actaccaaaactgtt

SEQ ID NO: 472083 - DNA, 15 bp, Homo sapiens
ctaccaaaactgttg

SEQ ID NO: 472084 - DNA, 15 bp, Homo sapiens
taccaaaactgttga

SEQ ID NO: 472085 - DNA, 15 bp, Homo sapiens
accaaaactgttgac

SEQ ID NO: 472086 - DNA, 15 bp, Homo sapiens
ccaaaactgttgaca

SEQ ID NO: 472087 - DNA, 15 bp, Homo sapiens
caaaactgttgacat

SEQ ID NO: 472088 - DNA, 15 bp, Homo sapiens
aaaactgttgacatt

SEQ ID NO: 472089 - DNA, 15 bp, Homo sapiens
aaactgttgacattt

SEQ ID NO: 472090 - DNA, 15 bp, Homo sapiens
aactgttgacattta

SEQ ID NO: 472091 - DNA, 15 bp, Homo sapiens
actgttgacatttaa

SEQ ID NO: 472092 - DNA, 15 bp, Homo sapiens
ctgttgacatttaat

SEQ ID NO: 472093 - DNA, 15 bp, Homo sapiens
tgttgacatttaatt

SEQ ID NO: 472094 - DNA, 15 bp, Homo sapiens
gttgacatttaattg

SEQ ID NO: 472095 - DNA, 15 bp, Homo sapiens
ttgacatttaattgc

SEQ ID NO: 472096 - DNA, 15 bp, Homo sapiens
tgacatttaattgca

SEQ ID NO: 472097 - DNA, 15 bp, Homo sapiens
gacatttaattgcat

SEQ ID NO: 472098 - DNA, 15 bp, Homo sapiens
acatttaattgcatc

SEQ ID NO: 472099 - DNA, 15 bp, Homo sapiens
catttaattgcatca

SEQ ID NO: 472100 - DNA, 15 bp, Homo sapiens
atttaattgcatcaa

SEQ ID NO: 472101 - DNA, 15 bp, Homo sapiens
tttaattgcatcaat

SEQ ID NO: 472102 - DNA, 15 bp, Homo sapiens
ttaattgcatcaatt

SEQ ID NO: 472103 - DNA, 15 bp, Homo sapiens
taattgcatcaattt

SEQ ID NO: 472104 - DNA, 15 bp, Homo sapiens
aattgcatcaattta

SEQ ID NO: 472105 - DNA, 15 bp, Homo sapiens
attgcatcaatttac

SEQ ID NO: 472106 - DNA, 15 bp, Homo sapiens
ttgcatcaatttaca

SEQ ID NO: 472107 - DNA, 15 bp, Homo sapiens
tgcatcaatttacat

SEQ ID NO: 472108 - DNA, 15 bp, Homo sapiens
gcatcaatttacatc

SEQ ID NO: 472109 - DNA, 15 bp, Homo sapiens
catcaatttacatcg

SEQ ID NO: 472110 - DNA, 15 bp, Homo sapiens
atcaatttacatcgg

SEQ ID NO: 472111 - DNA, 15 bp, Homo sapiens
tcaatttacatcggc

SEQ ID NO: 472112 - DNA, 15 bp, Homo sapiens
caatttacatcggct

SEQ ID NO: 472113 - DNA, 15 bp, Homo sapiens
aatttacatcggctc

SEQ ID NO: 472114 - DNA, 15 bp, Homo sapiens
atttacatcggctct

SEQ ID NO: 472115 - DNA, 15 bp, Homo sapiens
tttacatcggctctg

SEQ ID NO: 472116 - DNA, 15 bp, Homo sapiens
ttacatcggctctga

SEQ ID NO: 472117 - DNA, 15 bp, Homo sapiens
tacatcggctctgat

SEQ ID NO: 472118 - DNA, 15 bp, Homo sapiens
acatcggctctgatt

SEQ ID NO: 472119 - DNA, 15 bp, Homo sapiens
catcggctctgattt

SEQ ID NO: 472120 - DNA, 15 bp, Homo sapiens
atcggctctgatttt

SEQ ID NO: 472121 - DNA, 15 bp, Homo sapiens
tcggctctgattttg

SEQ ID NO: 472122 - DNA, 15 bp, Homo sapiens
cggctctgattttgt

SEQ ID NO: 472123 - DNA, 15 bp, Homo sapiens
ggctctgattttgtt

SEQ ID NO: 472124 - DNA, 15 bp, Homo sapiens
gctctgattttgtta

SEQ ID NO: 472125 - DNA, 15 bp, Homo sapiens
ctctgattttgttat

SEQ ID NO: 472126 - DNA, 15 bp, Homo sapiens
tctgattttgttata

SEQ ID NO: 472127 - DNA, 15 bp, Homo sapiens
ctgattttgttatag

SEQ ID NO: 472128 - DNA, 15 bp, Homo sapiens
tgattttgttataga

SEQ ID NO: 472129 - DNA, 15 bp, Homo sapiens
gattttgttatagat

SEQ ID NO: 472130 - DNA, 15 bp, Homo sapiens
ttttgttatagatag

SEQ ID NO: 472131 - DNA, 15 bp, Homo sapiens
tttgttatagatagt

SEQ ID NO: 472132 - DNA, 15 bp, Homo sapiens
ttgttatagatagtt

SEQ ID NO: 472133 - DNA, 15 bp, Homo sapiens
tgttatagatagtta

SEQ ID NO: 472134 - DNA, 15 bp, Homo sapiens
gttatagatagttat

SEQ ID NO: 472135 - DNA, 15 bp, Homo sapiens
ttatagatagttatt

SEQ ID NO: 472136 - DNA, 15 bp, Homo sapiens
tatagatagttattg

SEQ ID NO: 472137 - DNA, 15 bp, Homo sapiens
atagatagttattgc

SEQ ID NO: 472138 - DNA, 15 bp, Homo sapiens
tagatagttattgcc

SEQ ID NO: 472139 - DNA, 15 bp, Homo sapiens
agatagttattgcct

SEQ ID NO: 472140 - DNA, 15 bp, Homo sapiens
gatagttattgcctt

SEQ ID NO: 472141 - DNA, 15 bp, Homo sapiens
atagttattgccttc

SEQ ID NO: 472142 - DNA, 15 bp, Homo sapiens
tagttattgccttcc

SEQ ID NO: 472143 - DNA, 15 bp, Homo sapiens
agttattgccttcca

SEQ ID NO: 472144 - DNA, 15 bp, Homo sapiens
gttattgccttccat

SEQ ID NO: 472145 - DNA, 15 bp, Homo sapiens
ttattgccttccatt

SEQ ID NO: 472146 - DNA, 15 bp, Homo sapiens
tattgccttccattt

SEQ ID NO: 472147 - DNA, 15 bp, Homo sapiens
attgccttccatttt

SEQ ID NO: 472148 - DNA, 15 bp, Homo sapiens
ttgccttccatttta

SEQ ID NO: 472149 - DNA, 15 bp, Homo sapiens
tgccttccattttac

SEQ ID NO: 472150 - DNA, 15 bp, Homo sapiens
gccttccattttact

SEQ ID NO: 472151 - DNA, 15 bp, Homo sapiens
ccttccattttactg

SEQ ID NO: 472152 - DNA, 15 bp, Homo sapiens
cttccattttactga

SEQ ID NO: 472153 - DNA, 15 bp, Homo sapiens
ttccattttactgag

SEQ ID NO: 472154 - DNA, 15 bp, Homo sapiens
tccattttactgaga

SEQ ID NO: 472155 - DNA, 15 bp, Homo sapiens
ccattttactgagag

SEQ ID NO: 472156 - DNA, 15 bp, Homo sapiens
cattttactgagaga

SEQ ID NO: 472157 - DNA, 15 bp, Homo sapiens
attttactgagagaa

SEQ ID NO: 472158 - DNA, 15 bp, Homo sapiens
ttttactgagagaag

SEQ ID NO: 472159 - DNA, 15 bp, Homo sapiens
tttactgagagaagt

SEQ ID NO: 472160 - DNA, 15 bp, Homo sapiens
ttactgagagaagtg

SEQ ID NO: 472161 - DNA, 15 bp, Homo sapiens
tactgagagaagtgt

SEQ ID NO: 472162 - DNA, 15 bp, Homo sapiens
actgagagaagtgta

SEQ ID NO: 472163 - DNA, 15 bp, Homo sapiens
ctgagagaagtgtaa

SEQ ID NO: 472164 - DNA, 15 bp, Homo sapiens
tgagagaagtgtaat

SEQ ID NO: 472165 - DNA, 15 bp, Homo sapiens
gagagaagtgtaatt

SEQ ID NO: 472166 - DNA, 15 bp, Homo sapiens
agagaagtgtaattg

SEQ ID NO: 472167 - DNA, 15 bp, Homo sapiens
gagaagtgtaattgt

SEQ ID NO: 472168 - DNA, 15 bp, Homo sapiens
agaagtgtaattgtt

SEQ ID NO: 472169 - DNA, 15 bp, Homo sapiens
gaagtgtaattgttt

SEQ ID NO: 472170 - DNA, 15 bp, Homo sapiens
aagtgtaattgtttt

SEQ ID NO: 472171 - DNA, 15 bp, Homo sapiens
agtgtaattgttttc

SEQ ID NO: 472172 - DNA, 15 bp, Homo sapiens
gtgtaattgttttca

SEQ ID NO: 472173 - DNA, 15 bp, Homo sapiens
tgtaattgttttcaa

SEQ ID NO: 472174 - DNA, 15 bp, Homo sapiens
gtaattgttttcaac

SEQ ID NO: 472175 - DNA, 15 bp, Homo sapiens
taattgttttcaacc

SEQ ID NO: 472176 - DNA, 15 bp, Homo sapiens
attgttttcaacctt

SEQ ID NO: 472177 - DNA, 15 bp, Homo sapiens
ttgttttcaacctta

SEQ ID NO: 472178 - DNA, 15 bp, Homo sapiens
tgttttcaaccttat

SEQ ID NO: 472179 - DNA, 15 bp, Homo sapiens
gttttcaaccttata

SEQ ID NO: 472180 - DNA, 15 bp, Homo sapiens
ttttcaaccttatag

SEQ ID NO: 472181 - DNA, 15 bp, Homo sapiens
tttcaaccttataga

SEQ ID NO: 472182 - DNA, 15 bp, Homo sapiens
ttcaaccttatagac

SEQ ID NO: 472183 - DNA, 15 bp, Homo sapiens
tcaaccttatagaca

SEQ ID NO: 472184 - DNA, 15 bp, Homo sapiens
caaccttatagacaa

SEQ ID NO: 472185 - DNA, 15 bp, Homo sapiens
aaccttatagacaac

SEQ ID NO: 472186 - DNA, 15 bp, Homo sapiens
accttatagacaaca

SEQ ID NO: 472187 - DNA, 15 bp, Homo sapiens
ccttatagacaacat

SEQ ID NO: 472188 - DNA, 15 bp, Homo sapiens
cttatagacaacatc

SEQ ID NO: 472189 - DNA, 15 bp, Homo sapiens
ttatagacaacatct

SEQ ID NO: 472190 - DNA, 15 bp, Homo sapiens
tatagacaacatctg

SEQ ID NO: 472191 - DNA, 15 bp, Homo sapiens
atagacaacatctgg

SEQ ID NO: 472192 - DNA, 15 bp, Homo sapiens
tagacaacatctggg

SEQ ID NO: 472193 - DNA, 15 bp, Homo sapiens
agacaacatctgggg

SEQ ID NO: 472194 - DNA, 15 bp, Homo sapiens
gacaacatctgggga

SEQ ID NO: 472195 - DNA, 15 bp, Homo sapiens
acaacatctggggaa

SEQ ID NO: 472196 - DNA, 15 bp, Homo sapiens
caacatctggggaag

SEQ ID NO: 472197 - DNA, 15 bp, Homo sapiens
aacatctggggaaga

SEQ ID NO: 472198 - DNA, 15 bp, Homo sapiens
acatctggggaagat

SEQ ID NO: 472199 - DNA, 15 bp, Homo sapiens
atctggggaagatgt

SEQ ID NO: 472200 - DNA, 15 bp, Homo sapiens
tctggggaagatgta

SEQ ID NO: 472201 - DNA, 15 bp, Homo sapiens
ctggggaagatgtac

SEQ ID NO: 472202 - DNA, 15 bp, Homo sapiens
tggggaagatgtacg

SEQ ID NO: 472203 - DNA, 15 bp, Homo sapiens
ggggaagatgtacga

SEQ ID NO: 472204 - DNA, 15 bp, Homo sapiens
gggaagatgtacgag

SEQ ID NO: 472205 - DNA, 15 bp, Homo sapiens
ggaagatgtacgaga

SEQ ID NO: 472206 - DNA, 15 bp, Homo sapiens
gaagatgtacgagac

SEQ ID NO: 472207 - DNA, 15 bp, Homo sapiens
aagatgtacgagact

SEQ ID NO: 472208 - DNA, 15 bp, Homo sapiens
agatgtacgagactt

SEQ ID NO: 472209 - DNA, 15 bp, Homo sapiens
gatgtacgagacttc

SEQ ID NO: 472210 - DNA, 15 bp, Homo sapiens
atgtacgagacttca

SEQ ID NO: 472211 - DNA, 15 bp, Homo sapiens
tgtacgagacttcac

SEQ ID NO: 472212 - DNA, 15 bp, Homo sapiens
gtacgagacttcaca

SEQ ID NO: 472213 - DNA, 15 bp, Homo sapiens
tacgagacttcacaa

SEQ ID NO: 472214 - DNA, 15 bp, Homo sapiens
acgagacttcacaaa

SEQ ID NO: 472215 - DNA, 15 bp, Homo sapiens
cgagacttcacaaag

SEQ ID NO: 472216 - DNA, 15 bp, Homo sapiens
gagacttcacaaagg

SEQ ID NO: 472217 - DNA, 15 bp, Homo sapiens
agacttcacaaaggt

SEQ ID NO: 472218 - DNA, 15 bp, Homo sapiens
gacttcacaaaggta

SEQ ID NO: 472219 - DNA, 15 bp, Homo sapiens
acttcacaaaggtac

SEQ ID NO: 472220 - DNA, 15 bp, Homo sapiens
cttcacaaaggtact

SEQ ID NO: 472221 - DNA, 15 bp, Homo sapiens
ttcacaaaggtactt

SEQ ID NO: 472222 - DNA, 15 bp, Homo sapiens
tcacaaaggtactta

SEQ ID NO: 472223 - DNA, 15 bp, Homo sapiens
cacaaaggtacttaa

SEQ ID NO: 472224 - DNA, 15 bp, Homo sapiens
acaaaggtacttaag

SEQ ID NO: 472225 - DNA, 15 bp, Homo sapiens
caaaggtacttaaga

SEQ ID NO: 472226 - DNA, 15 bp, Homo sapiens
aaaggtacttaagaa

SEQ ID NO: 472227 - DNA, 15 bp, Homo sapiens
aaggtacttaagaac

SEQ ID NO: 472228 - DNA, 15 bp, Homo sapiens
aggtacttaagaaca

SEQ ID NO: 472229 - DNA, 15 bp, Homo sapiens
ggtacttaagaacaa

SEQ ID NO: 472230 - DNA, 15 bp, Homo sapiens
gtacttaagaacaag

SEQ ID NO: 472231 - DNA, 15 bp, Homo sapiens
tacttaagaacaagt

SEQ ID NO: 472232 - DNA, 15 bp, Homo sapiens
acttaagaacaagtt

SEQ ID NO: 472233 - DNA, 15 bp, Homo sapiens
cttaagaacaagttc

SEQ ID NO: 472234 - DNA, 15 bp, Homo sapiens
ttaagaacaagttca

SEQ ID NO: 472235 - DNA, 15 bp, Homo sapiens
taagaacaagttcag

SEQ ID NO: 472236 - DNA, 15 bp, Homo sapiens
aagaacaagttcagg

SEQ ID NO: 472237 - DNA, 15 bp, Homo sapiens
agaacaagttcaggt

SEQ ID NO: 472238 - DNA, 15 bp, Homo sapiens
gaacaagttcaggtc

SEQ ID NO: 472239 - DNA, 15 bp, Homo sapiens
aacaagttcaggtcg

SEQ ID NO: 472240 - DNA, 15 bp, Homo sapiens
acaagttcaggtcga

SEQ ID NO: 472241 - DNA, 15 bp, Homo sapiens
caagttcaggtcgaa

SEQ ID NO: 472242 - DNA, 15 bp, Homo sapiens
aagttcaggtcgaag

SEQ ID NO: 472243 - DNA, 15 bp, Homo sapiens
agttcaggtcgaaga

SEQ ID NO: 472244 - DNA, 15 bp, Homo sapiens
gttcaggtcgaagaa

SEQ ID NO: 472245 - DNA, 15 bp, Homo sapiens
ttcaggtcgaagaag

SEQ ID NO: 472246 - DNA, 15 bp, Homo sapiens
tcaggtcgaagaagt

SEQ ID NO: 472247 - DNA, 15 bp, Homo sapiens
caggtcgaagaagta

SEQ ID NO: 472248 - DNA, 15 bp, Homo sapiens
aggtcgaagaagtac

SEQ ID NO: 472249 - DNA, 15 bp, Homo sapiens
ggtcgaagaagtact

SEQ ID NO: 472250 - DNA, 15 bp, Homo sapiens
gtcgaagaagtactt

SEQ ID NO: 472251 - DNA, 15 bp, Homo sapiens
tcgaagaagtacttt

SEQ ID NO: 472252 - DNA, 15 bp, Homo sapiens
cgaagaagtactttg

SEQ ID NO: 472253 - DNA, 15 bp, Homo sapiens
gaagaagtactttgc

SEQ ID NO: 472254 - DNA, 15 bp, Homo sapiens
aagaagtactttgcc

SEQ ID NO: 472255 - DNA, 15 bp, Homo sapiens
agaagtactttgcca

SEQ ID NO: 472256 - DNA, 15 bp, Homo sapiens
gaagtactttgccaa

SEQ ID NO: 472257 - DNA, 15 bp, Homo sapiens
aagtactttgccaaa

SEQ ID NO: 472258 - DNA, 15 bp, Homo sapiens
agtactttgccaaac

SEQ ID NO: 472259 - DNA, 15 bp, Homo sapiens
gtactttgccaaaca

SEQ ID NO: 472260 - DNA, 15 bp, Homo sapiens
tactttgccaaacac

SEQ ID NO: 472261 - DNA, 15 bp, Homo sapiens
actttgccaaacacc

SEQ ID NO: 472262 - DNA, 15 bp, Homo sapiens
ctttgccaaacaccc

SEQ ID NO: 472263 - DNA, 15 bp, Homo sapiens
tttgccaaacaccct

SEQ ID NO: 472264 - DNA, 15 bp, Homo sapiens
ttgccaaacaccctc

SEQ ID NO: 472265 - DNA, 15 bp, Homo sapiens
tgccaaacaccctcg

SEQ ID NO: 472266 - DNA, 15 bp, Homo sapiens
gccaaacaccctcga

SEQ ID NO: 472267 - DNA, 15 bp, Homo sapiens
ccaaacaccctcgac

SEQ ID NO: 472268 - DNA, 15 bp, Homo sapiens
caaacaccctcgact

SEQ ID NO: 472269 - DNA, 15 bp, Homo sapiens
aaacaccctcgactt

SEQ ID NO: 472270 - DNA, 15 bp, Homo sapiens
aacaccctcgacttg

SEQ ID NO: 472271 - DNA, 15 bp, Homo sapiens
acaccctcgacttgg

SEQ ID NO: 472272 - DNA, 15 bp, Homo sapiens
caccctcgacttggt

SEQ ID NO: 472273 - DNA, 15 bp, Homo sapiens
accctcgacttggtt

SEQ ID NO: 472274 - DNA, 15 bp, Homo sapiens
ccctcgacttggtta

SEQ ID NO: 472275 - DNA, 15 bp, Homo sapiens
cctcgacttggttac

SEQ ID NO: 472276 - DNA, 15 bp, Homo sapiens
ctcgacttggttacc

SEQ ID NO: 472277 - DNA, 15 bp, Homo sapiens
tcgacttggttacct

SEQ ID NO: 472278 - DNA, 15 bp, Homo sapiens
cgacttggttacctg

SEQ ID NO: 472279 - DNA, 15 bp, Homo sapiens
gacttggttacctgc

SEQ ID NO: 472280 - DNA, 15 bp, Homo sapiens
acttggttacctgcc

SEQ ID NO: 472281 - DNA, 15 bp, Homo sapiens
cttggttacctgcct

SEQ ID NO: 472282 - DNA, 15 bp, Homo sapiens
ttggttacctgcctg

SEQ ID NO: 472283 - DNA, 15 bp, Homo sapiens
tggttacctgcctgt

SEQ ID NO: 472284 - DNA, 15 bp, Homo sapiens
ggttacctgcctgtc

SEQ ID NO: 472285 - DNA, 15 bp, Homo sapiens
gttacctgcctgtcc

SEQ ID NO: 472286 - DNA, 15 bp, Homo sapiens
ttacctgcctgtcca

SEQ ID NO: 472287 - DNA, 15 bp, Homo sapiens
tacctgcctgtccag

SEQ ID NO: 472288 - DNA, 15 bp, Homo sapiens
acctgcctgtccaga

SEQ ID NO: 472289 - DNA, 15 bp, Homo sapiens
cctgcctgtccagac

SEQ ID NO: 472290 - DNA, 15 bp, Homo sapiens
ctgcctgtccagaca

SEQ ID NO: 472291 - DNA, 15 bp, Homo sapiens
tgcctgtccagacag

SEQ ID NO: 472292 - DNA, 15 bp, Homo sapiens
gcctgtccagacagt

SEQ ID NO: 472293 - DNA, 15 bp, Homo sapiens
cctgtccagacagtt

SEQ ID NO: 472294 - DNA, 15 bp, Homo sapiens
ctgtccagacagttc

SEQ ID NO: 472295 - DNA, 15 bp, Homo sapiens
tgtccagacagttct

SEQ ID NO: 472296 - DNA, 15 bp, Homo sapiens
gtccagacagttctt

SEQ ID NO: 472297 - DNA, 15 bp, Homo sapiens
tccagacagttcttg

SEQ ID NO: 472298 - DNA, 15 bp, Homo sapiens
ccagacagttcttga

SEQ ID NO: 472299 - DNA, 15 bp, Homo sapiens
cagacagttcttgaa

SEQ ID NO: 472300 - DNA, 15 bp, Homo sapiens
agacagttcttgaag

SEQ ID NO: 472301 - DNA, 15 bp, Homo sapiens
gacagttcttgaagg

SEQ ID NO: 472302 - DNA, 15 bp, Homo sapiens
acagttcttgaaggt

SEQ ID NO: 472303 - DNA, 15 bp, Homo sapiens
cagttcttgaaggtg

SEQ ID NO: 472304 - DNA, 15 bp, Homo sapiens
agttcttgaaggtga

SEQ ID NO: 472305 - DNA, 15 bp, Homo sapiens
gttcttgaaggtgac

SEQ ID NO: 472306 - DNA, 15 bp, Homo sapiens
ttcttgaaggtgaca

SEQ ID NO: 472307 - DNA, 15 bp, Homo sapiens
tcttgaaggtgacaa

SEQ ID NO: 472308 - DNA, 15 bp, Homo sapiens
cttgaaggtgacaac

SEQ ID NO: 472309 - DNA, 15 bp, Homo sapiens
ttgaaggtgacaact

SEQ ID NO: 472310 - DNA, 15 bp, Homo sapiens
tgaaggtgacaactt

SEQ ID NO: 472311 - DNA, 15 bp, Homo sapiens
gaaggtgacaactta

SEQ ID NO: 472312 - DNA, 15 bp, Homo sapiens
aaggtgacaacttag

SEQ ID NO: 472313 - DNA, 15 bp, Homo sapiens
aggtgacaacttaga

SEQ ID NO: 472314 - DNA, 15 bp, Homo sapiens
ggtgacaacttagag

SEQ ID NO: 472315 - DNA, 15 bp, Homo sapiens
gtgacaacttagaga

SEQ ID NO: 472316 - DNA, 15 bp, Homo sapiens
tgacaacttagagac

SEQ ID NO: 472317 - DNA, 15 bp, Homo sapiens
gacaacttagagacg

SEQ ID NO: 472318 - DNA, 15 bp, Homo sapiens
acaacttagagacgt

SEQ ID NO: 472319 - DNA, 15 bp, Homo sapiens
caacttagagacgta

SEQ ID NO: 472320 - DNA, 15 bp, Homo sapiens
aacttagagacgtaa

SEQ ID NO: 472321 - DNA, 15 bp, Homo sapiens
acttagagacgtaag

SEQ ID NO: 472322 - DNA, 15 bp, Homo sapiens
cttagagacgtaagt

SEQ ID NO: 472323 - DNA, 15 bp, Homo sapiens
ttagagacgtaagtt

SEQ ID NO: 472324 - DNA, 15 bp, Homo sapiens
tagagacgtaagttt

SEQ ID NO: 472325 - DNA, 15 bp, Homo sapiens
agagacgtaagtttg

SEQ ID NO: 472326 - DNA, 15 bp, Homo sapiens
gagacgtaagtttga

SEQ ID NO: 472327 - DNA, 15 bp, Homo sapiens
agacgtaagtttgat

SEQ ID NO: 472328 - DNA, 15 bp, Homo sapiens
gacgtaagtttgatt

SEQ ID NO: 472329 - DNA, 15 bp, Homo sapiens
acgtaagtttgattt

SEQ ID NO: 472330 - DNA, 15 bp, Homo sapiens
cgtaagtttgatttt

SEQ ID NO: 472331 - DNA, 15 bp, Homo sapiens
gtaagtttgatttta

SEQ ID NO: 472332 - DNA, 15 bp, Homo sapiens
taagtttgattttaa

SEQ ID NO: 472333 - DNA, 15 bp, Homo sapiens
aagtttgattttaat

SEQ ID NO: 472334 - DNA, 15 bp, Homo sapiens
agtttgattttaata

SEQ ID NO: 472335 - DNA, 15 bp, Homo sapiens
gtttgattttaatat

SEQ ID NO: 472336 - DNA, 15 bp, Homo sapiens
tttgattttaatatt

SEQ ID NO: 472337 - DNA, 15 bp, Homo sapiens
ttgattttaatatta

SEQ ID NO: 472338 - DNA, 15 bp, Homo sapiens
tgattttaatattaa

SEQ ID NO: 472339 - DNA, 15 bp, Homo sapiens
gattttaatattaaa

SEQ ID NO: 472340 - DNA, 15 bp, Homo sapiens
attttaatattaaat

SEQ ID NO: 472341 - DNA, 15 bp, Homo sapiens
ttttaatattaaatc

SEQ ID NO: 472342 - DNA, 15 bp, Homo sapiens
tttaatattaaatct

SEQ ID NO: 472343 - DNA, 15 bp, Homo sapiens
ttaatattaaatcta

SEQ ID NO: 472344 - DNA, 15 bp, Homo sapiens
taatattaaatctag

SEQ ID NO: 472345 - DNA, 15 bp, Homo sapiens
aatattaaatctagt

SEQ ID NO: 472346 - DNA, 15 bp, Homo sapiens
atattaaatctagtg

SEQ ID NO: 472347 - DNA, 15 bp, Homo sapiens
tattaaatctagtgt

SEQ ID NO: 472348 - DNA, 15 bp, Homo sapiens
attaaatctagtgtg

SEQ ID NO: 472349 - DNA, 15 bp, Homo sapiens
ttaaatctagtgtga

SEQ ID NO: 472350 - DNA, 15 bp, Homo sapiens
taaatctagtgtgaa

SEQ ID NO: 472351 - DNA, 15 bp, Homo sapiens
aaatctagtgtgaac

SEQ ID NO: 472352 - DNA, 15 bp, Homo sapiens
aatctagtgtgaaca

SEQ ID NO: 472353 - DNA, 15 bp, Homo sapiens
atctagtgtgaacat

SEQ ID NO: 472354 - DNA, 15 bp, Homo sapiens
tctagtgtgaacatt

SEQ ID NO: 472355 - DNA, 15 bp, Homo sapiens
ctagtgtgaacattt

SEQ ID NO: 472356 - DNA, 15 bp, Homo sapiens
tagtgtgaacattta

SEQ ID NO: 472357 - DNA, 15 bp, Homo sapiens
agtgtgaacatttat

SEQ ID NO: 472358 - DNA, 15 bp, Homo sapiens
gtgtgaacatttata

SEQ ID NO: 472359 - DNA, 15 bp, Homo sapiens
tgtgaacatttatat

SEQ ID NO: 472360 - DNA, 15 bp, Homo sapiens
gtgaacatttatatc

SEQ ID NO: 472361 - DNA, 15 bp, Homo sapiens
tgaacatttatatct

SEQ ID NO: 472362 - DNA, 15 bp, Homo sapiens
gaacatttatatctg

SEQ ID NO: 472363 - DNA, 15 bp, Homo sapiens
aacatttatatctga

SEQ ID NO: 472364 - DNA, 15 bp, Homo sapiens
acatttatatctgat

SEQ ID NO: 472365 - DNA, 15 bp, Homo sapiens
catttatatctgatg

SEQ ID NO: 472366 - DNA, 15 bp, Homo sapiens
atttatatctgatgt

SEQ ID NO: 472367 - DNA, 15 bp, Homo sapiens
tttatatctgatgtt

SEQ ID NO: 472368 - DNA, 15 bp, Homo sapiens
ttatatctgatgttg

SEQ ID NO: 472369 - DNA, 15 bp, Homo sapiens
tatatctgatgttgt

SEQ ID NO: 472370 - DNA, 15 bp, Homo sapiens
atatctgatgttgtc

SEQ ID NO: 472371 - DNA, 15 bp, Homo sapiens
tatctgatgttgtct

SEQ ID NO: 472372 - DNA, 15 bp, Homo sapiens
atctgatgttgtctt

SEQ ID NO: 472373 - DNA, 15 bp, Homo sapiens
tctgatgttgtcttt

SEQ ID NO: 472374 - DNA, 15 bp, Homo sapiens
ctgatgttgtctttt

SEQ ID NO: 472375 - DNA, 15 bp, Homo sapiens
tgatgttgtcttttt

SEQ ID NO: 472376 - DNA, 15 bp, Homo sapiens
gatgttgtctttttt

SEQ ID NO: 472377 - DNA, 15 bp, Homo sapiens
atgttgtctttttta

SEQ ID NO: 472378 - DNA, 15 bp, Homo sapiens
tgttgtcttttttat

SEQ ID NO: 472379 - DNA, 15 bp, Homo sapiens
gttgtcttttttatg

SEQ ID NO: 472380 - DNA, 15 bp, Homo sapiens
ttgtcttttttatgt

SEQ ID NO: 472381 - DNA, 15 bp, Homo sapiens
tgtcttttttatgtt

SEQ ID NO: 472382 - DNA, 15 bp, Homo sapiens
gtcttttttatgtta

SEQ ID NO: 472383 - DNA, 15 bp, Homo sapiens
tcttttttatgttag

SEQ ID NO: 472384 - DNA, 15 bp, Homo sapiens
cttttttatgttagt

SEQ ID NO: 472385 - DNA, 15 bp, Homo sapiens
ttttttatgttagta

SEQ ID NO: 472386 - DNA, 15 bp, Homo sapiens
tttttatgttagtaa

SEQ ID NO: 472387 - DNA, 15 bp, Homo sapiens
ttttatgttagtaac

SEQ ID NO: 472388 - DNA, 15 bp, Homo sapiens
tttatgttagtaaca

SEQ ID NO: 472389 - DNA, 15 bp, Homo sapiens
ttatgttagtaacac

SEQ ID NO: 472390 - DNA, 15 bp, Homo sapiens
tatgttagtaacaca

SEQ ID NO: 472391 - DNA, 15 bp, Homo sapiens
atgttagtaacacaa

SEQ ID NO: 472392 - DNA, 15 bp, Homo sapiens
tgttagtaacacaag

SEQ ID NO: 472393 - DNA, 15 bp, Homo sapiens
gttagtaacacaaga

SEQ ID NO: 472394 - DNA, 15 bp, Homo sapiens
ttagtaacacaagag

SEQ ID NO: 472395 - DNA, 15 bp, Homo sapiens
tagtaacacaagaga

SEQ ID NO: 472396 - DNA, 15 bp, Homo sapiens
agtaacacaagagaa

SEQ ID NO: 472397 - DNA, 15 bp, Homo sapiens
gtaacacaagagaaa

SEQ ID NO: 472398 - DNA, 15 bp, Homo sapiens
taacacaagagaaat

SEQ ID NO: 472399 - DNA, 15 bp, Homo sapiens
aacacaagagaaatt

SEQ ID NO: 472400 - DNA, 15 bp, Homo sapiens
acacaagagaaattg

SEQ ID NO: 472401 - DNA, 15 bp, Homo sapiens
cacaagagaaattgt

SEQ ID NO: 472402 - DNA, 15 bp, Homo sapiens
acaagagaaattgtt

SEQ ID NO: 472403 - DNA, 15 bp, Homo sapiens
caagagaaattgttt

SEQ ID NO: 472404 - DNA, 15 bp, Homo sapiens
aagagaaattgttta

SEQ ID NO: 472405 - DNA, 15 bp, Homo sapiens
agagaaattgtttaa

SEQ ID NO: 472406 - DNA, 15 bp, Homo sapiens
gagaaattgtttaat

SEQ ID NO: 472407 - DNA, 15 bp, Homo sapiens
agaaattgtttaata

SEQ ID NO: 472408 - DNA, 15 bp, Homo sapiens
gaaattgtttaatac

SEQ ID NO: 472409 - DNA, 15 bp, Homo sapiens
aaattgtttaatacc

SEQ ID NO: 472410 - DNA, 15 bp, Homo sapiens
aattgtttaatacca

SEQ ID NO: 472411 - DNA, 15 bp, Homo sapiens
attgtttaataccaa

SEQ ID NO: 472412 - DNA, 15 bp, Homo sapiens
ttgtttaataccaac

SEQ ID NO: 472413 - DNA, 15 bp, Homo sapiens
tgtttaataccaact

SEQ ID NO: 472414 - DNA, 15 bp, Homo sapiens
gtttaataccaactg

SEQ ID NO: 472415 - DNA, 15 bp, Homo sapiens
tttaataccaactgc

SEQ ID NO: 472416 - DNA, 15 bp, Homo sapiens
ttaataccaactgca

SEQ ID NO: 472417 - DNA, 15 bp, Homo sapiens
taataccaactgcat

SEQ ID NO: 472418 - DNA, 15 bp, Homo sapiens
aataccaactgcatt

SEQ ID NO: 472419 - DNA, 15 bp, Homo sapiens
ataccaactgcattt

SEQ ID NO: 472420 - DNA, 15 bp, Homo sapiens
taccaactgcatttt

SEQ ID NO: 472421 - DNA, 15 bp, Homo sapiens
accaactgcatttta

SEQ ID NO: 472422 - DNA, 15 bp, Homo sapiens
ccaactgcattttag

SEQ ID NO: 472423 - DNA, 15 bp, Homo sapiens
caactgcattttaga

SEQ ID NO: 472424 - DNA, 15 bp, Homo sapiens
aactgcattttagag

SEQ ID NO: 472425 - DNA, 15 bp, Homo sapiens
actgcattttagagg

SEQ ID NO: 472426 - DNA, 15 bp, Homo sapiens
gcattttagaggagg

SEQ ID NO: 472427 - DNA, 15 bp, Homo sapiens
cattttagaggaggt

SEQ ID NO: 472428 - DNA, 15 bp, Homo sapiens
attttagaggaggta

SEQ ID NO: 472429 - DNA, 15 bp, Homo sapiens
ttttagaggaggtaa

SEQ ID NO: 472430 - DNA, 15 bp, Homo sapiens
tttagaggaggtaaa

SEQ ID NO: 472431 - DNA, 15 bp, Homo sapiens
ttagaggaggtaaat

SEQ ID NO: 472432 - DNA, 15 bp, Homo sapiens
tagaggaggtaaatt

SEQ ID NO: 472433 - DNA, 15 bp, Homo sapiens
agaggaggtaaatta

SEQ ID NO: 472434 - DNA, 15 bp, Homo sapiens
gaggaggtaaattaa

SEQ ID NO: 472435 - DNA, 15 bp, Homo sapiens
aggaggtaaattaaa

SEQ ID NO: 472436 - DNA, 15 bp, Homo sapiens
ggaggtaaattaaac

SEQ ID NO: 472437 - DNA, 15 bp, Homo sapiens
gaggtaaattaaact

SEQ ID NO: 472438 - DNA, 15 bp, Homo sapiens
aggtaaattaaactt

SEQ ID NO: 472439 - DNA, 15 bp, Homo sapiens
ggtaaattaaacttg

SEQ ID NO: 472440 - DNA, 15 bp, Homo sapiens
gtaaattaaacttgg

SEQ ID NO: 472441 - DNA, 15 bp, Homo sapiens
taaattaaacttgga

SEQ ID NO: 472442 - DNA, 15 bp, Homo sapiens
aaattaaacttggaa

SEQ ID NO: 472443 - DNA, 15 bp, Homo sapiens
aattaaacttggaat

SEQ ID NO: 472444 - DNA, 15 bp, Homo sapiens
attaaacttggaatc

SEQ ID NO: 472445 - DNA, 15 bp, Homo sapiens
ttaaacttggaatca

SEQ ID NO: 472446 - DNA, 15 bp, Homo sapiens
taaacttggaatcag

SEQ ID NO: 472447 - DNA, 15 bp, Homo sapiens
aaacttggaatcagt

SEQ ID NO: 472448 - DNA, 15 bp, Homo sapiens
aacttggaatcagtc

SEQ ID NO: 472449 - DNA, 15 bp, Homo sapiens
acttggaatcagtct

SEQ ID NO: 472450 - DNA, 15 bp, Homo sapiens
cttggaatcagtctt

SEQ ID NO: 472451 - DNA, 15 bp, Homo sapiens
ttggaatcagtcttc

SEQ ID NO: 472452 - DNA, 15 bp, Homo sapiens
tggaatcagtcttca

SEQ ID NO: 472453 - DNA, 15 bp, Homo sapiens
ggaatcagtcttcac

SEQ ID NO: 472454 - DNA, 15 bp, Homo sapiens
gaatcagtcttcaca

SEQ ID NO: 472455 - DNA, 15 bp, Homo sapiens
aatcagtcttcacaa

SEQ ID NO: 472456 - DNA, 15 bp, Homo sapiens
atcagtcttcacaac

SEQ ID NO: 472457 - DNA, 15 bp, Homo sapiens
tcagtcttcacaaca

SEQ ID NO: 472458 - DNA, 15 bp, Homo sapiens
cagtcttcacaacat

SEQ ID NO: 472459 - DNA, 15 bp, Homo sapiens
agtcttcacaacatg

SEQ ID NO: 472460 - DNA, 15 bp, Homo sapiens
gtcttcacaacatga

SEQ ID NO: 472461 - DNA, 15 bp, Homo sapiens
tcttcacaacatgaa

SEQ ID NO: 472462 - DNA, 15 bp, Homo sapiens
cttcacaacatgaat

SEQ ID NO: 472463 - DNA, 15 bp, Homo sapiens
ttcacaacatgaatt

SEQ ID NO: 472464 - DNA, 15 bp, Homo sapiens
tcacaacatgaattt

SEQ ID NO: 472465 - DNA, 15 bp, Homo sapiens
cacaacatgaatttt

SEQ ID NO: 472466 - DNA, 15 bp, Homo sapiens
acaacatgaattttt

SEQ ID NO: 472467 - DNA, 15 bp, Homo sapiens
caacatgaattttta

SEQ ID NO: 472468 - DNA, 15 bp, Homo sapiens
aacatgaatttttac

SEQ ID NO: 472469 - DNA, 15 bp, Homo sapiens
acatgaatttttaca

SEQ ID NO: 472470 - DNA, 15 bp, Homo sapiens
catgaatttttacaa

SEQ ID NO: 472471 - DNA, 15 bp, Homo sapiens
atgaatttttacaat

SEQ ID NO: 472472 - DNA, 15 bp, Homo sapiens
tgaatttttacaatt

SEQ ID NO: 472473 - DNA, 15 bp, Homo sapiens
gaatttttacaattc

SEQ ID NO: 472474 - DNA, 15 bp, Homo sapiens
aatttttacaattca

SEQ ID NO: 472475 - DNA, 15 bp, Homo sapiens
atttttacaattcac

SEQ ID NO: 472476 - DNA, 15 bp, Homo sapiens
tttttacaattcact

SEQ ID NO: 472477 - DNA, 15 bp, Homo sapiens
ttttacaattcactt

SEQ ID NO: 472478 - DNA, 15 bp, Homo sapiens
tttacaattcacttt

SEQ ID NO: 472479 - DNA, 15 bp, Homo sapiens
ttacaattcactttt

SEQ ID NO: 472480 - DNA, 15 bp, Homo sapiens
tacaattcacttttg

SEQ ID NO: 472481 - DNA, 15 bp, Homo sapiens
acaattcacttttga

SEQ ID NO: 472482 - DNA, 15 bp, Homo sapiens
caattcacttttgac

SEQ ID NO: 472483 - DNA, 15 bp, Homo sapiens
aattcacttttgaca

SEQ ID NO: 472484 - DNA, 15 bp, Homo sapiens
attcacttttgacaa

SEQ ID NO: 472485 - DNA, 15 bp, Homo sapiens
ttcacttttgacaat

SEQ ID NO: 472486 - DNA, 15 bp, Homo sapiens
tcacttttgacaatg

SEQ ID NO: 472487 - DNA, 15 bp, Homo sapiens
cacttttgacaatgt

SEQ ID NO: 472488 - DNA, 15 bp, Homo sapiens
acttttgacaatgtc

SEQ ID NO: 472489 - DNA, 15 bp, Homo sapiens
cttttgacaatgtca

SEQ ID NO: 472490 - DNA, 15 bp, Homo sapiens
ttttgacaatgtcac

SEQ ID NO: 472491 - DNA, 15 bp, Homo sapiens
tttgacaatgtcaca

SEQ ID NO: 472492 - DNA, 15 bp, Homo sapiens
ttgacaatgtcacag

SEQ ID NO: 472493 - DNA, 15 bp, Homo sapiens
tgacaatgtcacagc

SEQ ID NO: 472494 - DNA, 15 bp, Homo sapiens
gacaatgtcacagcc

SEQ ID NO: 472495 - DNA, 15 bp, Homo sapiens
acaatgtcacagcca

SEQ ID NO: 472496 - DNA, 15 bp, Homo sapiens
caatgtcacagccaa

SEQ ID NO: 472497 - DNA, 15 bp, Homo sapiens
aatgtcacagccaaa

SEQ ID NO: 472498 - DNA, 15 bp, Homo sapiens
atgtcacagccaaaa

SEQ ID NO: 472499 - DNA, 15 bp, Homo sapiens
tgtcacagccaaaat

SEQ ID NO: 472500 - DNA, 15 bp, Homo sapiens
gtcacagccaaaatt

SEQ ID NO: 472501 - DNA, 15 bp, Homo sapiens
tcacagccaaaattt

SEQ ID NO: 472502 - DNA, 15 bp, Homo sapiens
cacagccaaaatttc

SEQ ID NO: 472503 - DNA, 15 bp, Homo sapiens
acagccaaaatttca

SEQ ID NO: 472504 - DNA, 15 bp, Homo sapiens
cagccaaaatttcaa

SEQ ID NO: 472505 - DNA, 15 bp, Homo sapiens
agccaaaatttcaat

SEQ ID NO: 472506 - DNA, 15 bp, Homo sapiens
gccaaaatttcaatt

SEQ ID NO: 472507 - DNA, 15 bp, Homo sapiens
ccaaaatttcaattt

SEQ ID NO: 472508 - DNA, 15 bp, Homo sapiens
caaaatttcaatttt

SEQ ID NO: 472509 - DNA, 15 bp, Homo sapiens
aaaatttcaatttta

SEQ ID NO: 472510 - DNA, 15 bp, Homo sapiens
aaatttcaattttaa

SEQ ID NO: 472511 - DNA, 15 bp, Homo sapiens
aatttcaattttaac

SEQ ID NO: 472512 - DNA, 15 bp, Homo sapiens
atttcaattttaacc

SEQ ID NO: 472513 - DNA, 15 bp, Homo sapiens
tttcaattttaacct

SEQ ID NO: 472514 - DNA, 15 bp, Homo sapiens
ttcaattttaacctt

SEQ ID NO: 472515 - DNA, 15 bp, Homo sapiens
tcaattttaaccttg

SEQ ID NO: 472516 - DNA, 15 bp, Homo sapiens
caattttaaccttgc

SEQ ID NO: 472517 - DNA, 15 bp, Homo sapiens
aattttaaccttgca

SEQ ID NO: 472518 - DNA, 15 bp, Homo sapiens
attttaaccttgcac

SEQ ID NO: 472519 - DNA, 15 bp, Homo sapiens
ttttaaccttgcaca

SEQ ID NO: 472520 - DNA, 15 bp, Homo sapiens
tttaaccttgcacat

SEQ ID NO: 472521 - DNA, 15 bp, Homo sapiens
ttaaccttgcacatg

SEQ ID NO: 472522 - DNA, 15 bp, Homo sapiens
taaccttgcacatgt

SEQ ID NO: 472523 - DNA, 15 bp, Homo sapiens
aaccttgcacatgtc

SEQ ID NO: 472524 - DNA, 15 bp, Homo sapiens
accttgcacatgtcc

SEQ ID NO: 472525 - DNA, 15 bp, Homo sapiens
ccttgcacatgtcct

SEQ ID NO: 472526 - DNA, 15 bp, Homo sapiens
cttgcacatgtcctt

SEQ ID NO: 472527 - DNA, 15 bp, Homo sapiens
ttgcacatgtcctta

SEQ ID NO: 472528 - DNA, 15 bp, Homo sapiens
tgcacatgtccttaa

SEQ ID NO: 472529 - DNA, 15 bp, Homo sapiens
gcacatgtccttaaa

SEQ ID NO: 472530 - DNA, 15 bp, Homo sapiens
cacatgtccttaaat

SEQ ID NO: 472531 - DNA, 15 bp, Homo sapiens
acatgtccttaaatt

SEQ ID NO: 472532 - DNA, 15 bp, Homo sapiens
catgtccttaaattt

SEQ ID NO: 472533 - DNA, 15 bp, Homo sapiens
atgtccttaaatttt

SEQ ID NO: 472534 - DNA, 15 bp, Homo sapiens
tgtccttaaatttta

SEQ ID NO: 472535 - DNA, 15 bp, Homo sapiens
gtccttaaattttaa

SEQ ID NO: 472536 - DNA, 15 bp, Homo sapiens
tccttaaattttaaa

SEQ ID NO: 472537 - DNA, 15 bp, Homo sapiens
ccttaaattttaaaa

SEQ ID NO: 472538 - DNA, 15 bp, Homo sapiens
cttaaattttaaaaa

SEQ ID NO: 472539 - DNA, 15 bp, Homo sapiens
taaattttaaaaata

SEQ ID NO: 472540 - DNA, 15 bp, Homo sapiens
aaattttaaaaatat

SEQ ID NO: 472541 - DNA, 15 bp, Homo sapiens
aattttaaaaatatg

SEQ ID NO: 472542 - DNA, 15 bp, Homo sapiens
attttaaaaatatgt

SEQ ID NO: 472543 - DNA, 15 bp, Homo sapiens
ttttaaaaatatgta

SEQ ID NO: 472544 - DNA, 15 bp, Homo sapiens
tttaaaaatatgtat

SEQ ID NO: 472545 - DNA, 15 bp, Homo sapiens
ttaaaaatatgtatt

SEQ ID NO: 472546 - DNA, 15 bp, Homo sapiens
taaaaatatgtatta

SEQ ID NO: 472547 - DNA, 15 bp, Homo sapiens
aaaaatatgtattaa

SEQ ID NO: 472548 - DNA, 15 bp, Homo sapiens
aaaatatgtattaat

SEQ ID NO: 472549 - DNA, 15 bp, Homo sapiens
aaatatgtattaata

SEQ ID NO: 472550 - DNA, 15 bp, Homo sapiens
aatatgtattaatat

SEQ ID NO: 472551 - DNA, 15 bp, Homo sapiens
atatgtattaatatg

SEQ ID NO: 472552 - DNA, 15 bp, Homo sapiens
tatgtattaatatgt

SEQ ID NO: 472553 - DNA, 15 bp, Homo sapiens
atgtattaatatgtc

SEQ ID NO: 472554 - DNA, 15 bp, Homo sapiens
tgtattaatatgtca

SEQ ID NO: 472555 - DNA, 15 bp, Homo sapiens
gtattaatatgtcaa

SEQ ID NO: 472556 - DNA, 15 bp, Homo sapiens
tattaatatgtcaac

SEQ ID NO: 472557 - DNA, 15 bp, Homo sapiens
attaatatgtcaacc

SEQ ID NO: 472558 - DNA, 15 bp, Homo sapiens
ttaatatgtcaacct

SEQ ID NO: 472559 - DNA, 15 bp, Homo sapiens
taatatgtcaacctt

SEQ ID NO: 472560 - DNA, 15 bp, Homo sapiens
aatatgtcaacctta

SEQ ID NO: 472561 - DNA, 15 bp, Homo sapiens
atatgtcaaccttaa

SEQ ID NO: 472562 - DNA, 15 bp, Homo sapiens
tatgtcaaccttaat

SEQ ID NO: 472563 - DNA, 15 bp, Homo sapiens
atgtcaaccttaata

SEQ ID NO: 472564 - DNA, 15 bp, Homo sapiens
tgtcaaccttaatac

SEQ ID NO: 472565 - DNA, 15 bp, Homo sapiens
gtcaaccttaataca

SEQ ID NO: 472566 - DNA, 15 bp, Homo sapiens
tcaaccttaatacac

SEQ ID NO: 472567 - DNA, 15 bp, Homo sapiens
caaccttaatacaca

SEQ ID NO: 472568 - DNA, 15 bp, Homo sapiens
aaccttaatacacac

SEQ ID NO: 472569 - DNA, 15 bp, Homo sapiens
accttaatacacact

SEQ ID NO: 472570 - DNA, 15 bp, Homo sapiens
ccttaatacacactg

SEQ ID NO: 472571 - DNA, 15 bp, Homo sapiens
cttaatacacactgg

SEQ ID NO: 472572 - DNA, 15 bp, Homo sapiens
ttaatacacactggt

SEQ ID NO: 472573 - DNA, 15 bp, Homo sapiens
taatacacactggtc

SEQ ID NO: 472574 - DNA, 15 bp, Homo sapiens
aatacacactggtca

SEQ ID NO: 472575 - DNA, 15 bp, Homo sapiens
atacacactggtcat

SEQ ID NO: 472576 - DNA, 15 bp, Homo sapiens
tacacactggtcatc

SEQ ID NO: 472577 - DNA, 15 bp, Homo sapiens
acacactggtcatct

SEQ ID NO: 472578 - DNA, 15 bp, Homo sapiens
cacactggtcatctc

SEQ ID NO: 472579 - DNA, 15 bp, Homo sapiens
acactggtcatctct

SEQ ID NO: 472580 - DNA, 15 bp, Homo sapiens
cactggtcatctctt

SEQ ID NO: 472581 - DNA, 15 bp, Homo sapiens
actggtcatctcttt

SEQ ID NO: 472582 - DNA, 15 bp, Homo sapiens
ctggtcatctctttt

SEQ ID NO: 472583 - DNA, 15 bp, Homo sapiens
tggtcatctcttttg

SEQ ID NO: 472584 - DNA, 15 bp, Homo sapiens
ggtcatctcttttgt

SEQ ID NO: 472585 - DNA, 15 bp, Homo sapiens
gtcatctcttttgtt

SEQ ID NO: 472586 - DNA, 15 bp, Homo sapiens
tcatctcttttgttg

SEQ ID NO: 472587 - DNA, 15 bp, Homo sapiens
catctcttttgttgg

SEQ ID NO: 472588 - DNA, 15 bp, Homo sapiens
atctcttttgttggt

SEQ ID NO: 472589 - DNA, 15 bp, Homo sapiens
tctcttttgttggtc

SEQ ID NO: 472590 - DNA, 15 bp, Homo sapiens
ctcttttgttggtca

SEQ ID NO: 472591 - DNA, 15 bp, Homo sapiens
tcttttgttggtcat

SEQ ID NO: 472592 - DNA, 15 bp, Homo sapiens
cttttgttggtcatc

SEQ ID NO: 472593 - DNA, 15 bp, Homo sapiens
ttttgttggtcatct

SEQ ID NO: 472594 - DNA, 15 bp, Homo sapiens
tttgttggtcatctc

SEQ ID NO: 472595 - DNA, 15 bp, Homo sapiens
ttgttggtcatctct

SEQ ID NO: 472596 - DNA, 15 bp, Homo sapiens
tgttggtcatctctt

SEQ ID NO: 472597 - DNA, 15 bp, Homo sapiens
gttggtcatctcttt

SEQ ID NO: 472598 - DNA, 15 bp, Homo sapiens
ttggtcatctctttt

SEQ ID NO: 472599 - DNA, 15 bp, Homo sapiens
tggtcatctcttttc

SEQ ID NO: 472600 - DNA, 15 bp, Homo sapiens
ggtcatctcttttct

SEQ ID NO: 472601 - DNA, 15 bp, Homo sapiens
gtcatctcttttctt

SEQ ID NO: 472602 - DNA, 15 bp, Homo sapiens
tcatctcttttcttt

SEQ ID NO: 472603 - DNA, 15 bp, Homo sapiens
catctcttttctttt

SEQ ID NO: 472604 - DNA, 15 bp, Homo sapiens
atctcttttcttttt

SEQ ID NO: 472605 - DNA, 15 bp, Homo sapiens
tctcttttcttttta

SEQ ID NO: 472606 - DNA, 15 bp, Homo sapiens
ctcttttctttttaa

SEQ ID NO: 472607 - DNA, 15 bp, Homo sapiens
tttctttttaaaaac

SEQ ID NO: 472608 - DNA, 15 bp, Homo sapiens
ttctttttaaaaaca

SEQ ID NO: 472609 - DNA, 15 bp, Homo sapiens
tctttttaaaaacac

SEQ ID NO: 472610 - DNA, 15 bp, Homo sapiens
ctttttaaaaacact

SEQ ID NO: 472611 - DNA, 15 bp, Homo sapiens
tttttaaaaacactt

SEQ ID NO: 472612 - DNA, 15 bp, Homo sapiens
ttttaaaaacactta

SEQ ID NO: 472613 - DNA, 15 bp, Homo sapiens
tttaaaaacacttaa

SEQ ID NO: 472614 - DNA, 15 bp, Homo sapiens
ttaaaaacacttaaa

SEQ ID NO: 472615 - DNA, 15 bp, Homo sapiens
taaaaacacttaaag

SEQ ID NO: 472616 - DNA, 15 bp, Homo sapiens
aaaaacacttaaagt

SEQ ID NO: 472617 - DNA, 15 bp, Homo sapiens
aaaacacttaaagtg

SEQ ID NO: 472618 - DNA, 15 bp, Homo sapiens
aaacacttaaagtgt

SEQ ID NO: 472619 - DNA, 15 bp, Homo sapiens
aacacttaaagtgtg

SEQ ID NO: 472620 - DNA, 15 bp, Homo sapiens
acacttaaagtgtgg

SEQ ID NO: 472621 - DNA, 15 bp, Homo sapiens
cacttaaagtgtggc

SEQ ID NO: 472622 - DNA, 15 bp, Homo sapiens
acttaaagtgtggca

SEQ ID NO: 472623 - DNA, 15 bp, Homo sapiens
cttaaagtgtggcat

SEQ ID NO: 472624 - DNA, 15 bp, Homo sapiens
ttaaagtgtggcatt

SEQ ID NO: 472625 - DNA, 15 bp, Homo sapiens
taaagtgtggcatta

SEQ ID NO: 472626 - DNA, 15 bp, Homo sapiens
aaagtgtggcattat

SEQ ID NO: 472627 - DNA, 15 bp, Homo sapiens
aagtgtggcattata

SEQ ID NO: 472628 - DNA, 15 bp, Homo sapiens
agtgtggcattatat

SEQ ID NO: 472629 - DNA, 15 bp, Homo sapiens
gtgtggcattatata

SEQ ID NO: 472630 - DNA, 15 bp, Homo sapiens
tgtggcattatatag

SEQ ID NO: 472631 - DNA, 15 bp, Homo sapiens
gtggcattatatagt

SEQ ID NO: 472632 - DNA, 15 bp, Homo sapiens
tggcattatatagtc

SEQ ID NO: 472633 - DNA, 15 bp, Homo sapiens
ggcattatatagtct

SEQ ID NO: 472634 - DNA, 15 bp, Homo sapiens
gcattatatagtctt

SEQ ID NO: 472635 - DNA, 15 bp, Homo sapiens
cattatatagtcttt

SEQ ID NO: 472636 - DNA, 15 bp, Homo sapiens
attatatagtctttc

SEQ ID NO: 472637 - DNA, 15 bp, Homo sapiens
ttatatagtctttca

SEQ ID NO: 472638 - DNA, 15 bp, Homo sapiens
tatatagtctttcat

SEQ ID NO: 472639 - DNA, 15 bp, Homo sapiens
atatagtctttcatt

SEQ ID NO: 472640 - DNA, 15 bp, Homo sapiens
tatagtctttcatta

SEQ ID NO: 472641 - DNA, 15 bp, Homo sapiens
atagtctttcattat

SEQ ID NO: 472642 - DNA, 15 bp, Homo sapiens
tagtctttcattatt

SEQ ID NO: 472643 - DNA, 15 bp, Homo sapiens
agtctttcattattt

SEQ ID NO: 472644 - DNA, 15 bp, Homo sapiens
gtctttcattattta

SEQ ID NO: 472645 - DNA, 15 bp, Homo sapiens
tctttcattatttat

SEQ ID NO: 472646 - DNA, 15 bp, Homo sapiens
ctttcattatttatt

SEQ ID NO: 472647 - DNA, 15 bp, Homo sapiens
tttcattatttattt

SEQ ID NO: 472648 - DNA, 15 bp, Homo sapiens
ttcattatttatttt

SEQ ID NO: 472649 - DNA, 15 bp, Homo sapiens
tcattatttattttc

SEQ ID NO: 472650 - DNA, 15 bp, Homo sapiens
cattatttattttcc

SEQ ID NO: 472651 - DNA, 15 bp, Homo sapiens
attatttattttcct

SEQ ID NO: 472652 - DNA, 15 bp, Homo sapiens
ttatttattttcctt

SEQ ID NO: 472653 - DNA, 15 bp, Homo sapiens
tatttattttccttt

SEQ ID NO: 472654 - DNA, 15 bp, Homo sapiens
atttattttcctttt

SEQ ID NO: 472655 - DNA, 15 bp, Homo sapiens
tttattttccttttt

SEQ ID NO: 472656 - DNA, 15 bp, Homo sapiens
ttattttcctttttt

SEQ ID NO: 472657 - DNA, 15 bp, Homo sapiens
tattttccttttttt

SEQ ID NO: 472658 - DNA, 15 bp, Homo sapiens
attttcctttttttc

SEQ ID NO: 472659 - DNA, 15 bp, Homo sapiens
ttttcctttttttcc

SEQ ID NO: 472660 - DNA, 15 bp, Homo sapiens
tttcctttttttccc

SEQ ID NO: 472661 - DNA, 15 bp, Homo sapiens
ttcctttttttcccc

SEQ ID NO: 472662 - DNA, 15 bp, Homo sapiens
tcctttttttcccct

SEQ ID NO: 472663 - DNA, 15 bp, Homo sapiens
cctttttttcccctt

SEQ ID NO: 472664 - DNA, 15 bp, Homo sapiens
ctttttttcccctta

SEQ ID NO: 472665 - DNA, 15 bp, Homo sapiens
tttttttccccttat

SEQ ID NO: 472666 - DNA, 15 bp, Homo sapiens
ttttttccccttatg

SEQ ID NO: 472667 - DNA, 15 bp, Homo sapiens
tttttccccttatgg

SEQ ID NO: 472668 - DNA, 15 bp, Homo sapiens
ttttccccttatggg

SEQ ID NO: 472669 - DNA, 15 bp, Homo sapiens
tttccccttatgggg

SEQ ID NO: 472670 - DNA, 15 bp, Homo sapiens
ttccccttatggggg

SEQ ID NO: 472671 - DNA, 15 bp, Homo sapiens
tccccttatgggggg

SEQ ID NO: 472672 - DNA, 15 bp, Homo sapiens
ccccttatggggggt

SEQ ID NO: 472673 - DNA, 15 bp, Homo sapiens
cccttatggggggtg

SEQ ID NO: 472674 - DNA, 15 bp, Homo sapiens
ccttatggggggtgt

SEQ ID NO: 472675 - DNA, 15 bp, Homo sapiens
cttatggggggtgtt

SEQ ID NO: 472676 - DNA, 15 bp, Homo sapiens
ttatggggggtgttt

SEQ ID NO: 472677 - DNA, 15 bp, Homo sapiens
tatggggggtgtttt

SEQ ID NO: 472678 - DNA, 15 bp, Homo sapiens
atggggggtgtttta

SEQ ID NO: 472679 - DNA, 15 bp, Homo sapiens
tggggggtgttttac

SEQ ID NO: 472680 - DNA, 15 bp, Homo sapiens
ggggggtgttttact

SEQ ID NO: 472681 - DNA, 15 bp, Homo sapiens
gggggtgttttacta

SEQ ID NO: 472682 - DNA, 15 bp, Homo sapiens
ggggtgttttactat

SEQ ID NO: 472683 - DNA, 15 bp, Homo sapiens
gggtgttttactatt

SEQ ID NO: 472684 - DNA, 15 bp, Homo sapiens
ggtgttttactattt

SEQ ID NO: 472685 - DNA, 15 bp, Homo sapiens
gtgttttactatttc

SEQ ID NO: 472686 - DNA, 15 bp, Homo sapiens
tgttttactatttct

SEQ ID NO: 472687 - DNA, 15 bp, Homo sapiens
gttttactatttctc

SEQ ID NO: 472688 - DNA, 15 bp, Homo sapiens
ttttactatttctca

SEQ ID NO: 472689 - DNA, 15 bp, Homo sapiens
tttactatttctcag

SEQ ID NO: 472690 - DNA, 15 bp, Homo sapiens
ttactatttctcaga

SEQ ID NO: 472691 - DNA, 15 bp, Homo sapiens
tactatttctcagag

SEQ ID NO: 472692 - DNA, 15 bp, Homo sapiens
actatttctcagagt

SEQ ID NO: 472693 - DNA, 15 bp, Homo sapiens
ctatttctcagagta

SEQ ID NO: 472694 - DNA, 15 bp, Homo sapiens
tatttctcagagtat

SEQ ID NO: 472695 - DNA, 15 bp, Homo sapiens
atttctcagagtatg

SEQ ID NO: 472696 - DNA, 15 bp, Homo sapiens
tttctcagagtatgt

SEQ ID NO: 472697 - DNA, 15 bp, Homo sapiens
ttctcagagtatgtt

SEQ ID NO: 472698 - DNA, 15 bp, Homo sapiens
tctcagagtatgttt

SEQ ID NO: 472699 - DNA, 15 bp, Homo sapiens
ctcagagtatgtttt

SEQ ID NO: 472700 - DNA, 15 bp, Homo sapiens
tcagagtatgtttta

SEQ ID NO: 472701 - DNA, 15 bp, Homo sapiens
cagagtatgttttat

SEQ ID NO: 472702 - DNA, 15 bp, Homo sapiens
agagtatgttttata

SEQ ID NO: 472703 - DNA, 15 bp, Homo sapiens
gagtatgttttatac

SEQ ID NO: 472704 - DNA, 15 bp, Homo sapiens
agtatgttttatact

SEQ ID NO: 472705 - DNA, 15 bp, Homo sapiens
gtatgttttatactc

SEQ ID NO: 472706 - DNA, 15 bp, Homo sapiens
tatgttttatactct

SEQ ID NO: 472707 - DNA, 15 bp, Homo sapiens
atgttttatactctt

SEQ ID NO: 472708 - DNA, 15 bp, Homo sapiens
tgttttatactcttt

SEQ ID NO: 472709 - DNA, 15 bp, Homo sapiens
gttttatactctttt

SEQ ID NO: 472710 - DNA, 15 bp, Homo sapiens
ttttatactcttttt

SEQ ID NO: 472711 - DNA, 15 bp, Homo sapiens
tttatactctttttg

SEQ ID NO: 472712 - DNA, 15 bp, Homo sapiens
ttatactctttttgc

SEQ ID NO: 472713 - DNA, 15 bp, Homo sapiens
tatactctttttgca

SEQ ID NO: 472714 - DNA, 15 bp, Homo sapiens
atactctttttgcat

SEQ ID NO: 472715 - DNA, 15 bp, Homo sapiens
tactctttttgcatc

SEQ ID NO: 472716 - DNA, 15 bp, Homo sapiens
actctttttgcatct

SEQ ID NO: 472717 - DNA, 15 bp, Homo sapiens
ctctttttgcatctc

SEQ ID NO: 472718 - DNA, 15 bp, Homo sapiens
tctttttgcatctct

SEQ ID NO: 472719 - DNA, 15 bp, Homo sapiens
ctttttgcatctctt

SEQ ID NO: 472720 - DNA, 15 bp, Homo sapiens
tttttgcatctcttt

SEQ ID NO: 472721 - DNA, 15 bp, Homo sapiens
ttttgcatctcttta

SEQ ID NO: 472722 - DNA, 15 bp, Homo sapiens
tttgcatctctttaa

SEQ ID NO: 472723 - DNA, 15 bp, Homo sapiens
ttgcatctctttaat

SEQ ID NO: 472724 - DNA, 15 bp, Homo sapiens
tgcatctctttaata

SEQ ID NO: 472725 - DNA, 15 bp, Homo sapiens
gcatctctttaatat

SEQ ID NO: 472726 - DNA, 15 bp, Homo sapiens
catctctttaatata

SEQ ID NO: 472727 - DNA, 15 bp, Homo sapiens
atctctttaatataa

SEQ ID NO: 472728 - DNA, 15 bp, Homo sapiens
tctctttaatataaa

SEQ ID NO: 472729 - DNA, 15 bp, Homo sapiens
ctctttaatataaat

SEQ ID NO: 472730 - DNA, 15 bp, Homo sapiens
tctttaatataaatt

SEQ ID NO: 472731 - DNA, 15 bp, Homo sapiens
ctttaatataaattt

SEQ ID NO: 472732 - DNA, 15 bp, Homo sapiens
tttaatataaattta

SEQ ID NO: 472733 - DNA, 15 bp, Homo sapiens
ttaatataaatttat

SEQ ID NO: 472734 - DNA, 15 bp, Homo sapiens
taatataaatttatt

SEQ ID NO: 472735 - DNA, 15 bp, Homo sapiens
aatataaatttatta

SEQ ID NO: 472736 - DNA, 15 bp, Homo sapiens
atataaatttattaa

SEQ ID NO: 472737 - DNA, 15 bp, Homo sapiens
tataaatttattaat

SEQ ID NO: 472738 - DNA, 15 bp, Homo sapiens
ataaatttattaata

SEQ ID NO: 472739 - DNA, 15 bp, Homo sapiens
taaatttattaataa

SEQ ID NO: 472740 - DNA, 15 bp, Homo sapiens
aaatttattaataat

SEQ ID NO: 472741 - DNA, 15 bp, Homo sapiens
aatttattaataata

SEQ ID NO: 472742 - DNA, 15 bp, Homo sapiens
atttattaataatac

SEQ ID NO: 472743 - DNA, 15 bp, Homo sapiens
tttattaataatact

SEQ ID NO: 472744 - DNA, 15 bp, Homo sapiens
ttattaataatactt

SEQ ID NO: 472745 - DNA, 15 bp, Homo sapiens
tattaataatactta

SEQ ID NO: 472746 - DNA, 15 bp, Homo sapiens
attaataatacttaa

SEQ ID NO: 472747 - DNA, 15 bp, Homo sapiens
ttaataatacttaat

SEQ ID NO: 472748 - DNA, 15 bp, Homo sapiens
taataatacttaatc

SEQ ID NO: 472749 - DNA, 15 bp, Homo sapiens
aataatacttaatct

SEQ ID NO: 472750 - DNA, 15 bp, Homo sapiens
ataatacttaatctg

SEQ ID NO: 472751 - DNA, 15 bp, Homo sapiens
taatacttaatctgt

SEQ ID NO: 472752 - DNA, 15 bp, Homo sapiens
aatacttaatctgtt

SEQ ID NO: 472753 - DNA, 15 bp, Homo sapiens
atacttaatctgttg

SEQ ID NO: 472754 - DNA, 15 bp, Homo sapiens
tacttaatctgttga

SEQ ID NO: 472755 - DNA, 15 bp, Homo sapiens
acttaatctgttgat

SEQ ID NO: 472756 - DNA, 15 bp, Homo sapiens
cttaatctgttgatt

SEQ ID NO: 472757 - DNA, 15 bp, Homo sapiens
ttaatctgttgattc

SEQ ID NO: 472758 - DNA, 15 bp, Homo sapiens
taatctgttgattca

SEQ ID NO: 472759 - DNA, 15 bp, Homo sapiens
aatctgttgattcag

SEQ ID NO: 472760 - DNA, 15 bp, Homo sapiens
atctgttgattcaga

SEQ ID NO: 472761 - DNA, 15 bp, Homo sapiens
tctgttgattcagat

SEQ ID NO: 472762 - DNA, 15 bp, Homo sapiens
ctgttgattcagata

SEQ ID NO: 472763 - DNA, 15 bp, Homo sapiens
tgttgattcagatat

SEQ ID NO: 472764 - DNA, 15 bp, Homo sapiens
gttgattcagatatt

SEQ ID NO: 472765 - DNA, 15 bp, Homo sapiens
ttgattcagatattt

SEQ ID NO: 472766 - DNA, 15 bp, Homo sapiens
tgattcagatattta

SEQ ID NO: 472767 - DNA, 15 bp, Homo sapiens
gattcagatatttat

SEQ ID NO: 472768 - DNA, 15 bp, Homo sapiens
attcagatatttatg

SEQ ID NO: 472769 - DNA, 15 bp, Homo sapiens
ttcagatatttatgc

SEQ ID NO: 472770 - DNA, 15 bp, Homo sapiens
tcagatatttatgct

SEQ ID NO: 472771 - DNA, 15 bp, Homo sapiens
cagatatttatgcta

SEQ ID NO: 472772 - DNA, 15 bp, Homo sapiens
agatatttatgctaa

SEQ ID NO: 472773 - DNA, 15 bp, Homo sapiens
gatatttatgctaaa

SEQ ID NO: 472774 - DNA, 15 bp, Homo sapiens
atatttatgctaaaa

SEQ ID NO: 472775 - DNA, 15 bp, Homo sapiens
tatttatgctaaaat

SEQ ID NO: 472776 - DNA, 15 bp, Homo sapiens
atttatgctaaaatt

SEQ ID NO: 472777 - DNA, 15 bp, Homo sapiens
tttatgctaaaattc

SEQ ID NO: 472778 - DNA, 15 bp, Homo sapiens
ttatgctaaaattct

SEQ ID NO: 472779 - DNA, 15 bp, Homo sapiens
tatgctaaaattcta

SEQ ID NO: 472780 - DNA, 15 bp, Homo sapiens
atgctaaaattctaa

SEQ ID NO: 472781 - DNA, 15 bp, Homo sapiens
tgctaaaattctaaa

SEQ ID NO: 472782 - DNA, 15 bp, Homo sapiens
gctaaaattctaaag

SEQ ID NO: 472783 - DNA, 15 bp, Homo sapiens
ctaaaattctaaagt

SEQ ID NO: 472784 - DNA, 15 bp, Homo sapiens
taaaattctaaagta

SEQ ID NO: 472785 - DNA, 15 bp, Homo sapiens
aaaattctaaagtat

SEQ ID NO: 472786 - DNA, 15 bp, Homo sapiens
aaattctaaagtatc

SEQ ID NO: 472787 - DNA, 15 bp, Homo sapiens
aattctaaagtatca

SEQ ID NO: 472788 - DNA, 15 bp, Homo sapiens
attctaaagtatcac

SEQ ID NO: 472789 - DNA, 15 bp, Homo sapiens
ttctaaagtatcaca

SEQ ID NO: 472790 - DNA, 15 bp, Homo sapiens
tctaaagtatcacat

SEQ ID NO: 472791 - DNA, 15 bp, Homo sapiens
ctaaagtatcacatt

SEQ ID NO: 472792 - DNA, 15 bp, Homo sapiens
taaagtatcacatta

SEQ ID NO: 472793 - DNA, 15 bp, Homo sapiens
aaagtatcacattat

SEQ ID NO: 472794 - DNA, 15 bp, Homo sapiens
aagtatcacattatg

SEQ ID NO: 472795 - DNA, 15 bp, Homo sapiens
agtatcacattatga

SEQ ID NO: 472796 - DNA, 15 bp, Homo sapiens
gtatcacattatgat

SEQ ID NO: 472797 - DNA, 15 bp, Homo sapiens
tatcacattatgatt

SEQ ID NO: 472798 - DNA, 15 bp, Homo sapiens
atcacattatgattc

SEQ ID NO: 472799 - DNA, 15 bp, Homo sapiens
tcacattatgattct

SEQ ID NO: 472800 - DNA, 15 bp, Homo sapiens
cacattatgattcta

SEQ ID NO: 472801 - DNA, 15 bp, Homo sapiens
acattatgattctaa

SEQ ID NO: 472802 - DNA, 15 bp, Homo sapiens
cattatgattctaat

SEQ ID NO: 472803 - DNA, 15 bp, Homo sapiens
attatgattctaatc

SEQ ID NO: 472804 - DNA, 15 bp, Homo sapiens
ttatgattctaatct

SEQ ID NO: 472805 - DNA, 15 bp, Homo sapiens
tatgattctaatcta

SEQ ID NO: 472806 - DNA, 15 bp, Homo sapiens
atgattctaatctat

SEQ ID NO: 472807 - DNA, 15 bp, Homo sapiens
tgattctaatctatt

SEQ ID NO: 472808 - DNA, 15 bp, Homo sapiens
gattctaatctattt

SEQ ID NO: 472809 - DNA, 15 bp, Homo sapiens
attctaatctatttt

SEQ ID NO: 472810 - DNA, 15 bp, Homo sapiens
ttctaatctattttt

SEQ ID NO: 472811 - DNA, 15 bp, Homo sapiens
tctaatctatttttt

SEQ ID NO: 472812 - DNA, 15 bp, Homo sapiens
ctaatctatttttta

SEQ ID NO: 472813 - DNA, 15 bp, Homo sapiens
taatctattttttat

SEQ ID NO: 472814 - DNA, 15 bp, Homo sapiens
aatctattttttatt

SEQ ID NO: 472815 - DNA, 15 bp, Homo sapiens
atctattttttattg

SEQ ID NO: 472816 - DNA, 15 bp, Homo sapiens
tctattttttattga

SEQ ID NO: 472817 - DNA, 15 bp, Homo sapiens
ctattttttattgaa

SEQ ID NO: 472818 - DNA, 15 bp, Homo sapiens
tattttttattgaaa

SEQ ID NO: 472819 - DNA, 15 bp, Homo sapiens
attttttattgaaaa

SEQ ID NO: 472820 - DNA, 15 bp, Homo sapiens
ttttttattgaaaat

SEQ ID NO: 472821 - DNA, 15 bp, Homo sapiens
tttttattgaaaatg

SEQ ID NO: 472822 - DNA, 15 bp, Homo sapiens
ttttattgaaaatga

SEQ ID NO: 472823 - DNA, 15 bp, Homo sapiens
tttattgaaaatgaa

SEQ ID NO: 472824 - DNA, 15 bp, Homo sapiens
ttattgaaaatgaag

SEQ ID NO: 472825 - DNA, 15 bp, Homo sapiens
tattgaaaatgaaga

SEQ ID NO: 472826 - DNA, 15 bp, Homo sapiens
attgaaaatgaagac

SEQ ID NO: 472827 - DNA, 15 bp, Homo sapiens
ttgaaaatgaagaca

SEQ ID NO: 472828 - DNA, 15 bp, Homo sapiens
tgaaaatgaagacag

SEQ ID NO: 472829 - DNA, 15 bp, Homo sapiens
gaaaatgaagacagc

SEQ ID NO: 472830 - DNA, 15 bp, Homo sapiens
aaaatgaagacagca

SEQ ID NO: 472831 - DNA, 15 bp, Homo sapiens
aaatgaagacagcaa

SEQ ID NO: 472832 - DNA, 15 bp, Homo sapiens
aatgaagacagcaaa

SEQ ID NO: 472833 - DNA, 15 bp, Homo sapiens
atgaagacagcaaac

SEQ ID NO: 472834 - DNA, 15 bp, Homo sapiens
tgaagacagcaaact

SEQ ID NO: 472835 - DNA, 15 bp, Homo sapiens
gaagacagcaaactg

SEQ ID NO: 472836 - DNA, 15 bp, Homo sapiens
aagacagcaaactga

SEQ ID NO: 472837 - DNA, 15 bp, Homo sapiens
agacagcaaactgag

SEQ ID NO: 472838 - DNA, 15 bp, Homo sapiens
gacagcaaactgaga

SEQ ID NO: 472839 - DNA, 15 bp, Homo sapiens
acagcaaactgagat

SEQ ID NO: 472840 - DNA, 15 bp, Homo sapiens
cagcaaactgagata

SEQ ID NO: 472841 - DNA, 15 bp, Homo sapiens
agcaaactgagatag

SEQ ID NO: 472842 - DNA, 15 bp, Homo sapiens
gcaaactgagatagc

SEQ ID NO: 472843 - DNA, 15 bp, Homo sapiens
caaactgagatagct

SEQ ID NO: 472844 - DNA, 15 bp, Homo sapiens
aaactgagatagctt

SEQ ID NO: 472845 - DNA, 15 bp, Homo sapiens
aactgagatagcttt

SEQ ID NO: 472846 - DNA, 15 bp, Homo sapiens
actgagatagcttta

SEQ ID NO: 472847 - DNA, 15 bp, Homo sapiens
ctgagatagctttat

SEQ ID NO: 472848 - DNA, 15 bp, Homo sapiens
tgagatagctttata

SEQ ID NO: 472849 - DNA, 15 bp, Homo sapiens
gagatagctttatat

SEQ ID NO: 472850 - DNA, 15 bp, Homo sapiens
agatagctttatata

SEQ ID NO: 472851 - DNA, 15 bp, Homo sapiens
gatagctttatatat

SEQ ID NO: 472852 - DNA, 15 bp, Homo sapiens
atagctttatatatt

SEQ ID NO: 472853 - DNA, 15 bp, Homo sapiens
tagctttatatatta

SEQ ID NO: 472854 - DNA, 15 bp, Homo sapiens
agctttatatattac

SEQ ID NO: 472855 - DNA, 15 bp, Homo sapiens
gctttatatattaca

SEQ ID NO: 472856 - DNA, 15 bp, Homo sapiens
ctttatatattacat

SEQ ID NO: 472857 - DNA, 15 bp, Homo sapiens
tttatatattacata

SEQ ID NO: 472858 - DNA, 15 bp, Homo sapiens
ttatatattacataa

SEQ ID NO: 472859 - DNA, 15 bp, Homo sapiens
tatatattacataaa

SEQ ID NO: 472860 - DNA, 15 bp, Homo sapiens
atatattacataaaa

SEQ ID NO: 472861 - DNA, 15 bp, Homo sapiens
tatattacataaaat

SEQ ID NO: 472862 - DNA, 15 bp, Homo sapiens
atattacataaaata

SEQ ID NO: 472863 - DNA, 15 bp, Homo sapiens
tattacataaaatag

SEQ ID NO: 472864 - DNA, 15 bp, Homo sapiens
attacataaaataga

SEQ ID NO: 472865 - DNA, 15 bp, Homo sapiens
ttacataaaatagaa

SEQ ID NO: 472866 - DNA, 15 bp, Homo sapiens
tacataaaatagaaa

SEQ ID NO: 472867 - DNA, 15 bp, Homo sapiens
acataaaatagaaaa

SEQ ID NO: 472868 - DNA, 15 bp, Homo sapiens
cataaaatagaaaaa

SEQ ID NO: 472869 - DNA, 15 bp, Homo sapiens
ataaaatagaaaaaa

SEQ ID NO: 472870 - DNA, 15 bp, Homo sapiens
taaaatagaaaaaat

SEQ ID NO: 472871 - DNA, 15 bp, Homo sapiens
aaaatagaaaaaatt

SEQ ID NO: 472872 - DNA, 15 bp, Homo sapiens
aaatagaaaaaattt

SEQ ID NO: 472873 - DNA, 15 bp, Homo sapiens
aatagaaaaaattta

SEQ ID NO: 472874 - DNA, 15 bp, Homo sapiens
atagaaaaaatttat

SEQ ID NO: 472875 - DNA, 15 bp, Homo sapiens
tagaaaaaatttatt

SEQ ID NO: 472876 - DNA, 15 bp, Homo sapiens
agaaaaaatttattc

SEQ ID NO: 472877 - DNA, 15 bp, Homo sapiens
gaaaaaatttattca

SEQ ID NO: 472878 - DNA, 15 bp, Homo sapiens
aaaaaatttattcaa

SEQ ID NO: 472879 - DNA, 15 bp, Homo sapiens
aaaaatttattcaaa

SEQ ID NO: 472880 - DNA, 15 bp, Homo sapiens
aaaatttattcaaag

SEQ ID NO: 472881 - DNA, 15 bp, Homo sapiens
aaatttattcaaagt

SEQ ID NO: 472882 - DNA, 15 bp, Homo sapiens
aatttattcaaagtg

SEQ ID NO: 472883 - DNA, 15 bp, Homo sapiens
atttattcaaagtgt

SEQ ID NO: 472884 - DNA, 15 bp, Homo sapiens
tttattcaaagtgta

SEQ ID NO: 472885 - DNA, 15 bp, Homo sapiens
ttattcaaagtgtat

SEQ ID NO: 472886 - DNA, 15 bp, Homo sapiens
tattcaaagtgtata

SEQ ID NO: 472887 - DNA, 15 bp, Homo sapiens
attcaaagtgtataa

SEQ ID NO: 472888 - DNA, 15 bp, Homo sapiens
ttcaaagtgtataat

SEQ ID NO: 472889 - DNA, 15 bp, Homo sapiens
tcaaagtgtataatt

SEQ ID NO: 472890 - DNA, 15 bp, Homo sapiens
caaagtgtataattt

SEQ ID NO: 472891 - DNA, 15 bp, Homo sapiens
aaagtgtataatttg

SEQ ID NO: 472892 - DNA, 15 bp, Homo sapiens
aagtgtataatttga

SEQ ID NO: 472893 - DNA, 15 bp, Homo sapiens
agtgtataatttgag

SEQ ID NO: 472894 - DNA, 15 bp, Homo sapiens
gtgtataatttgagt

SEQ ID NO: 472895 - DNA, 15 bp, Homo sapiens
tgtataatttgagtt

SEQ ID NO: 472896 - DNA, 15 bp, Homo sapiens
gtataatttgagttg

SEQ ID NO: 472897 - DNA, 15 bp, Homo sapiens
tataatttgagttgg

SEQ ID NO: 472898 - DNA, 15 bp, Homo sapiens
ataatttgagttggt

SEQ ID NO: 472899 - DNA, 15 bp, Homo sapiens
taatttgagttggtt

SEQ ID NO: 472900 - DNA, 15 bp, Homo sapiens
aatttgagttggtta

SEQ ID NO: 472901 - DNA, 15 bp, Homo sapiens
atttgagttggttag

SEQ ID NO: 472902 - DNA, 15 bp, Homo sapiens
tttgagttggttagc

SEQ ID NO: 472903 - DNA, 15 bp, Homo sapiens
ttgagttggttagca

SEQ ID NO: 472904 - DNA, 15 bp, Homo sapiens
tgagttggttagcat

SEQ ID NO: 472905 - DNA, 15 bp, Homo sapiens
gagttggttagcata

SEQ ID NO: 472906 - DNA, 15 bp, Homo sapiens
agttggttagcatac

SEQ ID NO: 472907 - DNA, 15 bp, Homo sapiens
gttggttagcataca

SEQ ID NO: 472908 - DNA, 15 bp, Homo sapiens
ttggttagcatacat

SEQ ID NO: 472909 - DNA, 15 bp, Homo sapiens
tggttagcatacatg

SEQ ID NO: 472910 - DNA, 15 bp, Homo sapiens
ggttagcatacatga

SEQ ID NO: 472911 - DNA, 15 bp, Homo sapiens
gttagcatacatgaa

SEQ ID NO: 472912 - DNA, 15 bp, Homo sapiens
ttagcatacatgaaa

SEQ ID NO: 472913 - DNA, 15 bp, Homo sapiens
tagcatacatgaaag

SEQ ID NO: 472914 - DNA, 15 bp, Homo sapiens
agcatacatgaaagt

SEQ ID NO: 472915 - DNA, 15 bp, Homo sapiens
gcatacatgaaagtt

SEQ ID NO: 472916 - DNA, 15 bp, Homo sapiens
catacatgaaagttt

SEQ ID NO: 472917 - DNA, 15 bp, Homo sapiens
atacatgaaagtttc

SEQ ID NO: 472918 - DNA, 15 bp, Homo sapiens
tacatgaaagtttca

SEQ ID NO: 472919 - DNA, 15 bp, Homo sapiens
acatgaaagtttcaa

SEQ ID NO: 472920 - DNA, 15 bp, Homo sapiens
catgaaagtttcaag

SEQ ID NO: 472921 - DNA, 15 bp, Homo sapiens
atgaaagtttcaaga

SEQ ID NO: 472922 - DNA, 15 bp, Homo sapiens
tgaaagtttcaagat

SEQ ID NO: 472923 - DNA, 15 bp, Homo sapiens
gaaagtttcaagatg

SEQ ID NO: 472924 - DNA, 15 bp, Homo sapiens
aaagtttcaagatgg

SEQ ID NO: 472925 - DNA, 15 bp, Homo sapiens
aagtttcaagatggt

SEQ ID NO: 472926 - DNA, 15 bp, Homo sapiens
agtttcaagatggtg

SEQ ID NO: 472927 - DNA, 15 bp, Homo sapiens
gtttcaagatggtga

SEQ ID NO: 472928 - DNA, 15 bp, Homo sapiens
tttcaagatggtgaa

SEQ ID NO: 472929 - DNA, 15 bp, Homo sapiens
ttcaagatggtgaaa

SEQ ID NO: 472930 - DNA, 15 bp, Homo sapiens
tcaagatggtgaaat

SEQ ID NO: 472931 - DNA, 15 bp, Homo sapiens
caagatggtgaaatt

SEQ ID NO: 472932 - DNA, 15 bp, Homo sapiens
aagatggtgaaatta

SEQ ID NO: 472933 - DNA, 15 bp, Homo sapiens
agatggtgaaattac

SEQ ID NO: 472934 - DNA, 15 bp, Homo sapiens
gatggtgaaattacc

SEQ ID NO: 472935 - DNA, 15 bp, Homo sapiens
atggtgaaattacca

SEQ ID NO: 472936 - DNA, 15 bp, Homo sapiens
tggtgaaattaccat

SEQ ID NO: 472937 - DNA, 15 bp, Homo sapiens
ggtgaaattaccatg

SEQ ID NO: 472938 - DNA, 15 bp, Homo sapiens
gtgaaattaccatgt

SEQ ID NO: 472939 - DNA, 15 bp, Homo sapiens
tgaaattaccatgtg

SEQ ID NO: 472940 - DNA, 15 bp, Homo sapiens
gaaattaccatgtga

SEQ ID NO: 472941 - DNA, 15 bp, Homo sapiens
aaattaccatgtgat

SEQ ID NO: 472942 - DNA, 15 bp, Homo sapiens
aattaccatgtgatt

SEQ ID NO: 472943 - DNA, 15 bp, Homo sapiens
attaccatgtgatta

SEQ ID NO: 472944 - DNA, 15 bp, Homo sapiens
ttaccatgtgattat

SEQ ID NO: 472945 - DNA, 15 bp, Homo sapiens
taccatgtgattata

SEQ ID NO: 472946 - DNA, 15 bp, Homo sapiens
accatgtgattataa

SEQ ID NO: 472947 - DNA, 15 bp, Homo sapiens
ccatgtgattataaa

SEQ ID NO: 472948 - DNA, 15 bp, Homo sapiens
catgtgattataaag

SEQ ID NO: 472949 - DNA, 15 bp, Homo sapiens
atgtgattataaagc

SEQ ID NO: 472950 - DNA, 15 bp, Homo sapiens
tgtgattataaagca

SEQ ID NO: 472951 - DNA, 15 bp, Homo sapiens
gtgattataaagcaa

SEQ ID NO: 472952 - DNA, 15 bp, Homo sapiens
tgattataaagcaaa

SEQ ID NO: 472953 - DNA, 15 bp, Homo sapiens
gattataaagcaaag

SEQ ID NO: 472954 - DNA, 15 bp, Homo sapiens
attataaagcaaagg

SEQ ID NO: 472955 - DNA, 15 bp, Homo sapiens
ttataaagcaaaggg

SEQ ID NO: 472956 - DNA, 15 bp, Homo sapiens
tataaagcaaaggga

SEQ ID NO: 472957 - DNA, 15 bp, Homo sapiens
ataaagcaaagggaa

SEQ ID NO: 472958 - DNA, 15 bp, Homo sapiens
taaagcaaagggaat

SEQ ID NO: 472959 - DNA, 15 bp, Homo sapiens
aaagcaaagggaata

SEQ ID NO: 472960 - DNA, 15 bp, Homo sapiens
aagcaaagggaataa

SEQ ID NO: 472961 - DNA, 15 bp, Homo sapiens
agcaaagggaataag

SEQ ID NO: 472962 - DNA, 15 bp, Homo sapiens
gcaaagggaataaga

SEQ ID NO: 472963 - DNA, 15 bp, Homo sapiens
caaagggaataagaa

SEQ ID NO: 472964 - DNA, 15 bp, Homo sapiens
aaagggaataagaat

SEQ ID NO: 472965 - DNA, 15 bp, Homo sapiens
aagggaataagaatt

SEQ ID NO: 472966 - DNA, 15 bp, Homo sapiens
agggaataagaattt

SEQ ID NO: 472967 - DNA, 15 bp, Homo sapiens
gggaataagaattta

SEQ ID NO: 472968 - DNA, 15 bp, Homo sapiens
ggaataagaatttat

SEQ ID NO: 472969 - DNA, 15 bp, Homo sapiens
gaataagaatttatg

SEQ ID NO: 472970 - DNA, 15 bp, Homo sapiens
aataagaatttatgg

SEQ ID NO: 472971 - DNA, 15 bp, Homo sapiens
ataagaatttatggc

SEQ ID NO: 472972 - DNA, 15 bp, Homo sapiens
taagaatttatggcc

SEQ ID NO: 472973 - DNA, 15 bp, Homo sapiens
aagaatttatggcct

SEQ ID NO: 472974 - DNA, 15 bp, Homo sapiens
agaatttatggcctg

SEQ ID NO: 472975 - DNA, 15 bp, Homo sapiens
gaatttatggcctga

SEQ ID NO: 472976 - DNA, 15 bp, Homo sapiens
aatttatggcctgaa

SEQ ID NO: 472977 - DNA, 15 bp, Homo sapiens
atttatggcctgaag

SEQ ID NO: 472978 - DNA, 15 bp, Homo sapiens
tttatggcctgaagt

SEQ ID NO: 472979 - DNA, 15 bp, Homo sapiens
ttatggcctgaagtg

SEQ ID NO: 472980 - DNA, 15 bp, Homo sapiens
tatggcctgaagtga

SEQ ID NO: 472981 - DNA, 15 bp, Homo sapiens
atggcctgaagtgaa

SEQ ID NO: 472982 - DNA, 15 bp, Homo sapiens
tggcctgaagtgaaa

SEQ ID NO: 472983 - DNA, 15 bp, Homo sapiens
ggcctgaagtgaaaa

SEQ ID NO: 472984 - DNA, 15 bp, Homo sapiens
gcctgaagtgaaaag

SEQ ID NO: 472985 - DNA, 15 bp, Homo sapiens
cctgaagtgaaaaga

SEQ ID NO: 472986 - DNA, 15 bp, Homo sapiens
ctgaagtgaaaagaa

SEQ ID NO: 472987 - DNA, 15 bp, Homo sapiens
tgaagtgaaaagaaa

SEQ ID NO: 472988 - DNA, 15 bp, Homo sapiens
gaagtgaaaagaaaa

SEQ ID NO: 472989 - DNA, 15 bp, Homo sapiens
aagtgaaaagaaaaa

SEQ ID NO: 472990 - DNA, 15 bp, Homo sapiens
agtgaaaagaaaaaa

SEQ ID NO: 472991 - DNA, 15 bp, Homo sapiens
gtgaaaagaaaaaaa

SEQ ID NO: 472992 - DNA, 15 bp, Homo sapiens
tgaaaagaaaaaaaa

SEQ ID NO: 472993 - DNA, 15 bp, Homo sapiens
gaaaagaaaaaaaat

SEQ ID NO: 472994 - DNA, 15 bp, Homo sapiens
aaaagaaaaaaaatg

SEQ ID NO: 472995 - DNA, 15 bp, Homo sapiens
aaagaaaaaaaatgt

SEQ ID NO: 472996 - DNA, 15 bp, Homo sapiens
aagaaaaaaaatgtt

SEQ ID NO: 472997 - DNA, 15 bp, Homo sapiens
agaaaaaaaatgttt

SEQ ID NO: 472998 - DNA, 15 bp, Homo sapiens
gaaaaaaaatgtttt

SEQ ID NO: 472999 - DNA, 15 bp, Homo sapiens
aaaaaaaatgttttt

SEQ ID NO: 473000 - DNA, 15 bp, Homo sapiens
aaaaaaatgtttttc

SEQ ID NO: 473001 - DNA, 15 bp, Homo sapiens
aaaaaatgtttttca

SEQ ID NO: 473002 - DNA, 15 bp, Homo sapiens
aaaaatgtttttcaa

SEQ ID NO: 473003 - DNA, 15 bp, Homo sapiens
aaaatgtttttcaat

SEQ ID NO: 473004 - DNA, 15 bp, Homo sapiens
aaatgtttttcaatg

SEQ ID NO: 473005 - DNA, 15 bp, Homo sapiens
aatgtttttcaatga

SEQ ID NO: 473006 - DNA, 15 bp, Homo sapiens
atgtttttcaatgac

SEQ ID NO: 473007 - DNA, 15 bp, Homo sapiens
tgtttttcaatgacc

SEQ ID NO: 473008 - DNA, 15 bp, Homo sapiens
gtttttcaatgaccc

SEQ ID NO: 473009 - DNA, 15 bp, Homo sapiens
tttttcaatgaccca

SEQ ID NO: 473010 - DNA, 15 bp, Homo sapiens
ttttcaatgacccag

SEQ ID NO: 473011 - DNA, 15 bp, Homo sapiens
tttcaatgacccaga

SEQ ID NO: 473012 - DNA, 15 bp, Homo sapiens
ttcaatgacccagaa

SEQ ID NO: 473013 - DNA, 15 bp, Homo sapiens
tcaatgacccagaaa

SEQ ID NO: 473014 - DNA, 15 bp, Homo sapiens
caatgacccagaaaa

SEQ ID NO: 473015 - DNA, 15 bp, Homo sapiens
aatgacccagaaaaa

SEQ ID NO: 473016 - DNA, 15 bp, Homo sapiens
atgacccagaaaaaa

SEQ ID NO: 473017 - DNA, 15 bp, Homo sapiens
tgacccagaaaaaat

SEQ ID NO: 473018 - DNA, 15 bp, Homo sapiens
gacccagaaaaaatg

SEQ ID NO: 473019 - DNA, 15 bp, Homo sapiens
acccagaaaaaatgc

SEQ ID NO: 473020 - DNA, 15 bp, Homo sapiens
cccagaaaaaatgca

SEQ ID NO: 473021 - DNA, 15 bp, Homo sapiens
ccagaaaaaatgcaa

SEQ ID NO: 473022 - DNA, 15 bp, Homo sapiens
cagaaaaaatgcaaa

SEQ ID NO: 473023 - DNA, 15 bp, Homo sapiens
agaaaaaatgcaaag

SEQ ID NO: 473024 - DNA, 15 bp, Homo sapiens
gaaaaaatgcaaaga

SEQ ID NO: 473025 - DNA, 15 bp, Homo sapiens
aaaaaatgcaaagaa

SEQ ID NO: 473026 - DNA, 15 bp, Homo sapiens
aaaaatgcaaagaag

SEQ ID NO: 473027 - DNA, 15 bp, Homo sapiens
aaaatgcaaagaagt

SEQ ID NO: 473028 - DNA, 15 bp, Homo sapiens
aaatgcaaagaagta

SEQ ID NO: 473029 - DNA, 15 bp, Homo sapiens
aatgcaaagaagtaa

SEQ ID NO: 473030 - DNA, 15 bp, Homo sapiens
atgcaaagaagtaat

SEQ ID NO: 473031 - DNA, 15 bp, Homo sapiens
tgcaaagaagtaatt

SEQ ID NO: 473032 - DNA, 15 bp, Homo sapiens
gcaaagaagtaattt

SEQ ID NO: 473033 - DNA, 15 bp, Homo sapiens
caaagaagtaatttt

SEQ ID NO: 473034 - DNA, 15 bp, Homo sapiens
aaagaagtaatttta

SEQ ID NO: 473035 - DNA, 15 bp, Homo sapiens
aagaagtaattttaa

SEQ ID NO: 473036 - DNA, 15 bp, Homo sapiens
agaagtaattttaag

SEQ ID NO: 473037 - DNA, 15 bp, Homo sapiens
gaagtaattttaaga

SEQ ID NO: 473038 - DNA, 15 bp, Homo sapiens
aagtaattttaagat

SEQ ID NO: 473039 - DNA, 15 bp, Homo sapiens
agtaattttaagata

SEQ ID NO: 473040 - DNA, 15 bp, Homo sapiens
gtaattttaagatac

SEQ ID NO: 473041 - DNA, 15 bp, Homo sapiens
taattttaagatact

SEQ ID NO: 473042 - DNA, 15 bp, Homo sapiens
aattttaagatacta

SEQ ID NO: 473043 - DNA, 15 bp, Homo sapiens
attttaagatactaa

SEQ ID NO: 473044 - DNA, 15 bp, Homo sapiens
ttttaagatactaaa

SEQ ID NO: 473045 - DNA, 15 bp, Homo sapiens
tttaagatactaaac

SEQ ID NO: 473046 - DNA, 15 bp, Homo sapiens
ttaagatactaaaca

SEQ ID NO: 473047 - DNA, 15 bp, Homo sapiens
taagatactaaacaa

SEQ ID NO: 473048 - DNA, 15 bp, Homo sapiens
aagatactaaacaat

SEQ ID NO: 473049 - DNA, 15 bp, Homo sapiens
agatactaaacaatt

SEQ ID NO: 473050 - DNA, 15 bp, Homo sapiens
gatactaaacaatta

SEQ ID NO: 473051 - DNA, 15 bp, Homo sapiens
atactaaacaattat

SEQ ID NO: 473052 - DNA, 15 bp, Homo sapiens
tactaaacaattatg

SEQ ID NO: 473053 - DNA, 15 bp, Homo sapiens
actaaacaattatgt

SEQ ID NO: 473054 - DNA, 15 bp, Homo sapiens
ctaaacaattatgtg

SEQ ID NO: 473055 - DNA, 15 bp, Homo sapiens
taaacaattatgtgt

SEQ ID NO: 473056 - DNA, 15 bp, Homo sapiens
aaacaattatgtgtt

SEQ ID NO: 473057 - DNA, 15 bp, Homo sapiens
aacaattatgtgtta

SEQ ID NO: 473058 - DNA, 15 bp, Homo sapiens
acaattatgtgttaa

SEQ ID NO: 473059 - DNA, 15 bp, Homo sapiens
caattatgtgttaag

SEQ ID NO: 473060 - DNA, 15 bp, Homo sapiens
aattatgtgttaaga

SEQ ID NO: 473061 - DNA, 15 bp, Homo sapiens
attatgtgttaagat

SEQ ID NO: 473062 - DNA, 15 bp, Homo sapiens
ttatgtgttaagatc

SEQ ID NO: 473063 - DNA, 15 bp, Homo sapiens
tatgtgttaagatcc

SEQ ID NO: 473064 - DNA, 15 bp, Homo sapiens
atgtgttaagatcca

SEQ ID NO: 473065 - DNA, 15 bp, Homo sapiens
tgtgttaagatccaa

SEQ ID NO: 473066 - DNA, 15 bp, Homo sapiens
gtgttaagatccaaa

SEQ ID NO: 473067 - DNA, 15 bp, Homo sapiens
tgttaagatccaaat

SEQ ID NO: 473068 - DNA, 15 bp, Homo sapiens
gttaagatccaaata

SEQ ID NO: 473069 - DNA, 15 bp, Homo sapiens
ttaagatccaaatag

SEQ ID NO: 473070 - DNA, 15 bp, Homo sapiens
taagatccaaataga

SEQ ID NO: 473071 - DNA, 15 bp, Homo sapiens
aagatccaaatagat

SEQ ID NO: 473072 - DNA, 15 bp, Homo sapiens
agatccaaatagata

SEQ ID NO: 473073 - DNA, 15 bp, Homo sapiens
gatccaaatagatag

SEQ ID NO: 473074 - DNA, 15 bp, Homo sapiens
atccaaatagataga

SEQ ID NO: 473075 - DNA, 15 bp, Homo sapiens
tccaaatagatagat

SEQ ID NO: 473076 - DNA, 15 bp, Homo sapiens
ccaaatagatagatt

SEQ ID NO: 473077 - DNA, 15 bp, Homo sapiens
caaatagatagattt

SEQ ID NO: 473078 - DNA, 15 bp, Homo sapiens
aaatagatagatttt

SEQ ID NO: 473079 - DNA, 15 bp, Homo sapiens
aatagatagatttta

SEQ ID NO: 473080 - DNA, 15 bp, Homo sapiens
atagatagattttaa

SEQ ID NO: 473081 - DNA, 15 bp, Homo sapiens
tagatagattttaaa

SEQ ID NO: 473082 - DNA, 15 bp, Homo sapiens
agatagattttaaat

SEQ ID NO: 473083 - DNA, 15 bp, Homo sapiens
gatagattttaaatc

SEQ ID NO: 473084 - DNA, 15 bp, Homo sapiens
atagattttaaatct

SEQ ID NO: 473085 - DNA, 15 bp, Homo sapiens
tagattttaaatctt

SEQ ID NO: 473086 - DNA, 15 bp, Homo sapiens
agattttaaatcttt

SEQ ID NO: 473087 - DNA, 15 bp, Homo sapiens
gattttaaatctttg

SEQ ID NO: 473088 - DNA, 15 bp, Homo sapiens
attttaaatctttga

SEQ ID NO: 473089 - DNA, 15 bp, Homo sapiens
ttttaaatctttgaa

SEQ ID NO: 473090 - DNA, 15 bp, Homo sapiens
tttaaatctttgaat

SEQ ID NO: 473091 - DNA, 15 bp, Homo sapiens
ttaaatctttgaatt

SEQ ID NO: 473092 - DNA, 15 bp, Homo sapiens
taaatctttgaattg

SEQ ID NO: 473093 - DNA, 15 bp, Homo sapiens
aaatctttgaattgc

SEQ ID NO: 473094 - DNA, 15 bp, Homo sapiens
aatctttgaattgct

SEQ ID NO: 473095 - DNA, 15 bp, Homo sapiens
atctttgaattgctt

SEQ ID NO: 473096 - DNA, 15 bp, Homo sapiens
tctttgaattgcttt

SEQ ID NO: 473097 - DNA, 15 bp, Homo sapiens
ctttgaattgctttt

SEQ ID NO: 473098 - DNA, 15 bp, Homo sapiens
tttgaattgcttttt

SEQ ID NO: 473099 - DNA, 15 bp, Homo sapiens
ttgaattgctttttc

SEQ ID NO: 473100 - DNA, 15 bp, Homo sapiens
tgaattgctttttca

SEQ ID NO: 473101 - DNA, 15 bp, Homo sapiens
gaattgctttttcat

SEQ ID NO: 473102 - DNA, 15 bp, Homo sapiens
aattgctttttcata

SEQ ID NO: 473103 - DNA, 15 bp, Homo sapiens
attgctttttcatat

SEQ ID NO: 473104 - DNA, 15 bp, Homo sapiens
ttgctttttcatatg

SEQ ID NO: 473105 - DNA, 15 bp, Homo sapiens
tgctttttcatatgt

SEQ ID NO: 473106 - DNA, 15 bp, Homo sapiens
gctttttcatatgtc

SEQ ID NO: 473107 - DNA, 15 bp, Homo sapiens
ctttttcatatgtca

SEQ ID NO: 473108 - DNA, 15 bp, Homo sapiens
tttttcatatgtcag

SEQ ID NO: 473109 - DNA, 15 bp, Homo sapiens
ttttcatatgtcagg

SEQ ID NO: 473110 - DNA, 15 bp, Homo sapiens
tttcatatgtcagga

SEQ ID NO: 473111 - DNA, 15 bp, Homo sapiens
ttcatatgtcaggat

SEQ ID NO: 473112 - DNA, 15 bp, Homo sapiens
tcatatgtcaggata

SEQ ID NO: 473113 - DNA, 15 bp, Homo sapiens
catatgtcaggataa

SEQ ID NO: 473114 - DNA, 15 bp, Homo sapiens
atatgtcaggataaa

SEQ ID NO: 473115 - DNA, 15 bp, Homo sapiens
tatgtcaggataaat

SEQ ID NO: 473116 - DNA, 15 bp, Homo sapiens
atgtcaggataaata

SEQ ID NO: 473117 - DNA, 15 bp, Homo sapiens
tgtcaggataaatat

SEQ ID NO: 473118 - DNA, 15 bp, Homo sapiens
tcaggataaatattc

SEQ ID NO: 473119 - DNA, 15 bp, Homo sapiens
caggataaatattcc

SEQ ID NO: 473120 - DNA, 15 bp, Homo sapiens
aggataaatattcct

SEQ ID NO: 473121 - DNA, 15 bp, Homo sapiens
ggataaatattcctg

SEQ ID NO: 473122 - DNA, 15 bp, Homo sapiens
gataaatattcctgc

SEQ ID NO: 473123 - DNA, 15 bp, Homo sapiens
ataaatattcctgct

SEQ ID NO: 473124 - DNA, 15 bp, Homo sapiens
taaatattcctgcta

SEQ ID NO: 473125 - DNA, 15 bp, Homo sapiens
aaatattcctgctaa

SEQ ID NO: 473126 - DNA, 15 bp, Homo sapiens
aatattcctgctaag

SEQ ID NO: 473127 - DNA, 15 bp, Homo sapiens
atattcctgctaagg

SEQ ID NO: 473128 - DNA, 15 bp, Homo sapiens
tattcctgctaaggc

SEQ ID NO: 473129 - DNA, 15 bp, Homo sapiens
attcctgctaaggcc

SEQ ID NO: 473130 - DNA, 15 bp, Homo sapiens
ttcctgctaaggcca

SEQ ID NO: 473131 - DNA, 15 bp, Homo sapiens
tcctgctaaggccat

SEQ ID NO: 473132 - DNA, 15 bp, Homo sapiens
cctgctaaggccatt

SEQ ID NO: 473133 - DNA, 15 bp, Homo sapiens
ctgctaaggccattt

SEQ ID NO: 473134 - DNA, 15 bp, Homo sapiens
tgctaaggccatttt

SEQ ID NO: 473135 - DNA, 15 bp, Homo sapiens
gctaaggccattttc

SEQ ID NO: 473136 - DNA, 15 bp, Homo sapiens
ctaaggccattttct

SEQ ID NO: 473137 - DNA, 15 bp, Homo sapiens
taaggccattttctt

SEQ ID NO: 473138 - DNA, 15 bp, Homo sapiens
aaggccattttcttg

SEQ ID NO: 473139 - DNA, 15 bp, Homo sapiens
aggccattttcttgt

SEQ ID NO: 473140 - DNA, 15 bp, Homo sapiens
ggccattttcttgtg

SEQ ID NO: 473141 - DNA, 15 bp, Homo sapiens
gccattttcttgtgg

SEQ ID NO: 473142 - DNA, 15 bp, Homo sapiens
ccattttcttgtggt

SEQ ID NO: 473143 - DNA, 15 bp, Homo sapiens
cattttcttgtggtt

SEQ ID NO: 473144 - DNA, 15 bp, Homo sapiens
attttcttgtggttg

SEQ ID NO: 473145 - DNA, 15 bp, Homo sapiens
ttttcttgtggttga

SEQ ID NO: 473146 - DNA, 15 bp, Homo sapiens
tttcttgtggttgaa

SEQ ID NO: 473147 - DNA, 15 bp, Homo sapiens
ttcttgtggttgaat

SEQ ID NO: 473148 - DNA, 15 bp, Homo sapiens
tcttgtggttgaatc

SEQ ID NO: 473149 - DNA, 15 bp, Homo sapiens
cttgtggttgaatct

SEQ ID NO: 473150 - DNA, 15 bp, Homo sapiens
ttgtggttgaatctt

SEQ ID NO: 473151 - DNA, 15 bp, Homo sapiens
tgtggttgaatcttg

SEQ ID NO: 473152 - DNA, 15 bp, Homo sapiens
gtggttgaatcttgg

SEQ ID NO: 473153 - DNA, 15 bp, Homo sapiens
tggttgaatcttggg

SEQ ID NO: 473154 - DNA, 15 bp, Homo sapiens
ggttgaatcttgggg

SEQ ID NO: 473155 - DNA, 15 bp, Homo sapiens
gttgaatcttgggga

SEQ ID NO: 473156 - DNA, 15 bp, Homo sapiens
ttgaatcttggggaa

SEQ ID NO: 473157 - DNA, 15 bp, Homo sapiens
tgaatcttggggaaa

SEQ ID NO: 473158 - DNA, 15 bp, Homo sapiens
gaatcttggggaaaa

SEQ ID NO: 473159 - DNA, 15 bp, Homo sapiens
aatcttggggaaaat

SEQ ID NO: 473160 - DNA, 15 bp, Homo sapiens
atcttggggaaaatg

SEQ ID NO: 473161 - DNA, 15 bp, Homo sapiens
tcttggggaaaatga

SEQ ID NO: 473162 - DNA, 15 bp, Homo sapiens
cttggggaaaatgaa

SEQ ID NO: 473163 - DNA, 15 bp, Homo sapiens
ttggggaaaatgaac

SEQ ID NO: 473164 - DNA, 15 bp, Homo sapiens
tggggaaaatgaact

SEQ ID NO: 473165 - DNA, 15 bp, Homo sapiens
ggggaaaatgaactt

SEQ ID NO: 473166 - DNA, 15 bp, Homo sapiens
gggaaaatgaacttt

SEQ ID NO: 473167 - DNA, 15 bp, Homo sapiens
ggaaaatgaactttt

SEQ ID NO: 473168 - DNA, 15 bp, Homo sapiens
gaaaatgaactttta

SEQ ID NO: 473169 - DNA, 15 bp, Homo sapiens
aaaatgaacttttat

SEQ ID NO: 473170 - DNA, 15 bp, Homo sapiens
aaatgaacttttatt

SEQ ID NO: 473171 - DNA, 15 bp, Homo sapiens
aatgaacttttatta

SEQ ID NO: 473172 - DNA, 15 bp, Homo sapiens
atgaacttttattac

SEQ ID NO: 473173 - DNA, 15 bp, Homo sapiens
tgaacttttattact

SEQ ID NO: 473174 - DNA, 15 bp, Homo sapiens
gaacttttattacta

SEQ ID NO: 473175 - DNA, 15 bp, Homo sapiens
aacttttattactaa

SEQ ID NO: 473176 - DNA, 15 bp, Homo sapiens
acttttattactaat

SEQ ID NO: 473177 - DNA, 15 bp, Homo sapiens
cttttattactaatc

SEQ ID NO: 473178 - DNA, 15 bp, Homo sapiens
ttttattactaatca

SEQ ID NO: 473179 - DNA, 15 bp, Homo sapiens
tttattactaatcat

SEQ ID NO: 473180 - DNA, 15 bp, Homo sapiens
ttattactaatcatc

SEQ ID NO: 473181 - DNA, 15 bp, Homo sapiens
tattactaatcatca

SEQ ID NO: 473182 - DNA, 15 bp, Homo sapiens
attactaatcatcaa

SEQ ID NO: 473183 - DNA, 15 bp, Homo sapiens
ttactaatcatcaac

SEQ ID NO: 473184 - DNA, 15 bp, Homo sapiens
tactaatcatcaaca

SEQ ID NO: 473185 - DNA, 15 bp, Homo sapiens
actaatcatcaacag

SEQ ID NO: 473186 - DNA, 15 bp, Homo sapiens
ctaatcatcaacaga

SEQ ID NO: 473187 - DNA, 15 bp, Homo sapiens
taatcatcaacagag

SEQ ID NO: 473188 - DNA, 15 bp, Homo sapiens
aatcatcaacagagt

SEQ ID NO: 473189 - DNA, 15 bp, Homo sapiens
atcatcaacagagtg

SEQ ID NO: 473190 - DNA, 15 bp, Homo sapiens
tcatcaacagagtgc

SEQ ID NO: 473191 - DNA, 15 bp, Homo sapiens
catcaacagagtgcc

SEQ ID NO: 473192 - DNA, 15 bp, Homo sapiens
atcaacagagtgccc

SEQ ID NO: 473193 - DNA, 15 bp, Homo sapiens
tcaacagagtgccca

SEQ ID NO: 473194 - DNA, 15 bp, Homo sapiens
caacagagtgcccag

SEQ ID NO: 473195 - DNA, 15 bp, Homo sapiens
aacagagtgcccagt

SEQ ID NO: 473196 - DNA, 15 bp, Homo sapiens
acagagtgcccagtt

SEQ ID NO: 473197 - DNA, 15 bp, Homo sapiens
cagagtgcccagttg

SEQ ID NO: 473198 - DNA, 15 bp, Homo sapiens
agagtgcccagttgt

SEQ ID NO: 473199 - DNA, 15 bp, Homo sapiens
gagtgcccagttgta

SEQ ID NO: 473200 - DNA, 15 bp, Homo sapiens
agtgcccagttgtat

SEQ ID NO: 473201 - DNA, 15 bp, Homo sapiens
gtgcccagttgtata

SEQ ID NO: 473202 - DNA, 15 bp, Homo sapiens
tgcccagttgtatag

SEQ ID NO: 473203 - DNA, 15 bp, Homo sapiens
gcccagttgtatagc

SEQ ID NO: 473204 - DNA, 15 bp, Homo sapiens
cccagttgtatagca

SEQ ID NO: 473205 - DNA, 15 bp, Homo sapiens
ccagttgtatagcat

SEQ ID NO: 473206 - DNA, 15 bp, Homo sapiens
cagttgtatagcata

SEQ ID NO: 473207 - DNA, 15 bp, Homo sapiens
agttgtatagcataa

SEQ ID NO: 473208 - DNA, 15 bp, Homo sapiens
gttgtatagcataat

SEQ ID NO: 473209 - DNA, 15 bp, Homo sapiens
ttgtatagcataatg

SEQ ID NO: 473210 - DNA, 15 bp, Homo sapiens
tgtatagcataatga

SEQ ID NO: 473211 - DNA, 15 bp, Homo sapiens
gtatagcataatgaa

SEQ ID NO: 473212 - DNA, 15 bp, Homo sapiens
tatagcataatgaag

SEQ ID NO: 473213 - DNA, 15 bp, Homo sapiens
atagcataatgaagt

SEQ ID NO: 473214 - DNA, 15 bp, Homo sapiens
tagcataatgaagtt

SEQ ID NO: 473215 - DNA, 15 bp, Homo sapiens
agcataatgaagttc

SEQ ID NO: 473216 - DNA, 15 bp, Homo sapiens
gcataatgaagttct

SEQ ID NO: 473217 - DNA, 15 bp, Homo sapiens
cataatgaagttcta

SEQ ID NO: 473218 - DNA, 15 bp, Homo sapiens
ataatgaagttctag

SEQ ID NO: 473219 - DNA, 15 bp, Homo sapiens
taatgaagttctagt

SEQ ID NO: 473220 - DNA, 15 bp, Homo sapiens
aatgaagttctagtc

SEQ ID NO: 473221 - DNA, 15 bp, Homo sapiens
atgaagttctagtca

SEQ ID NO: 473222 - DNA, 15 bp, Homo sapiens
tgaagttctagtcag

SEQ ID NO: 473223 - DNA, 15 bp, Homo sapiens
gaagttctagtcaga

SEQ ID NO: 473224 - DNA, 15 bp, Homo sapiens
aagttctagtcagag

SEQ ID NO: 473225 - DNA, 15 bp, Homo sapiens
agttctagtcagaga

SEQ ID NO: 473226 - DNA, 15 bp, Homo sapiens
gttctagtcagagaa

SEQ ID NO: 473227 - DNA, 15 bp, Homo sapiens
ttctagtcagagaaa

SEQ ID NO: 473228 - DNA, 15 bp, Homo sapiens
tctagtcagagaaag

SEQ ID NO: 473229 - DNA, 15 bp, Homo sapiens
ctagtcagagaaaga

SEQ ID NO: 473230 - DNA, 15 bp, Homo sapiens
tagtcagagaaagac

SEQ ID NO: 473231 - DNA, 15 bp, Homo sapiens
agtcagagaaagaca

SEQ ID NO: 473232 - DNA, 15 bp, Homo sapiens
gtcagagaaagacac

SEQ ID NO: 473233 - DNA, 15 bp, Homo sapiens
tcagagaaagacacc

SEQ ID NO: 473234 - DNA, 15 bp, Homo sapiens
cagagaaagacaccg

SEQ ID NO: 473235 - DNA, 15 bp, Homo sapiens
agagaaagacaccgt

SEQ ID NO: 473236 - DNA, 15 bp, Homo sapiens
gagaaagacaccgtc

SEQ ID NO: 473237 - DNA, 15 bp, Homo sapiens
agaaagacaccgtct

SEQ ID NO: 473238 - DNA, 15 bp, Homo sapiens
gaaagacaccgtctc

SEQ ID NO: 473239 - DNA, 15 bp, Homo sapiens
aaagacaccgtctca

SEQ ID NO: 473240 - DNA, 15 bp, Homo sapiens
aagacaccgtctcag

SEQ ID NO: 473241 - DNA, 15 bp, Homo sapiens
agacaccgtctcaga

SEQ ID NO: 473242 - DNA, 15 bp, Homo sapiens
gacaccgtctcagat

SEQ ID NO: 473243 - DNA, 15 bp, Homo sapiens
acaccgtctcagatg

SEQ ID NO: 473244 - DNA, 15 bp, Homo sapiens
caccgtctcagatga

SEQ ID NO: 473245 - DNA, 15 bp, Homo sapiens
accgtctcagatgac

SEQ ID NO: 473246 - DNA, 15 bp, Homo sapiens
ccgtctcagatgact

SEQ ID NO: 473247 - DNA, 15 bp, Homo sapiens
cgtctcagatgacta

SEQ ID NO: 473248 - DNA, 15 bp, Homo sapiens
gtctcagatgactag

SEQ ID NO: 473249 - DNA, 15 bp, Homo sapiens
tctcagatgactaga

SEQ ID NO: 473250 - DNA, 15 bp, Homo sapiens
ctcagatgactagag

SEQ ID NO: 473251 - DNA, 15 bp, Homo sapiens
tcagatgactagaga

SEQ ID NO: 473252 - DNA, 15 bp, Homo sapiens
cagatgactagagaa

SEQ ID NO: 473253 - DNA, 15 bp, Homo sapiens
agatgactagagaag

SEQ ID NO: 473254 - DNA, 15 bp, Homo sapiens
gatgactagagaaga

SEQ ID NO: 473255 - DNA, 15 bp, Homo sapiens
atgactagagaagag

SEQ ID NO: 473256 - DNA, 15 bp, Homo sapiens
tgactagagaagaga

SEQ ID NO: 473257 - DNA, 15 bp, Homo sapiens
gactagagaagagaa

SEQ ID NO: 473258 - DNA, 15 bp, Homo sapiens
actagagaagagaaa

SEQ ID NO: 473259 - DNA, 15 bp, Homo sapiens
ctagagaagagaaac

SEQ ID NO: 473260 - DNA, 15 bp, Homo sapiens
tagagaagagaaact

SEQ ID NO: 473261 - DNA, 15 bp, Homo sapiens
agagaagagaaactc

SEQ ID NO: 473262 - DNA, 15 bp, Homo sapiens
gagaagagaaactca

SEQ ID NO: 473263 - DNA, 15 bp, Homo sapiens
agaagagaaactcaa

SEQ ID NO: 473264 - DNA, 15 bp, Homo sapiens
gaagagaaactcaaa

SEQ ID NO: 473265 - DNA, 15 bp, Homo sapiens
aagagaaactcaaaa

SEQ ID NO: 473266 - DNA, 15 bp, Homo sapiens
agagaaactcaaaag

SEQ ID NO: 473267 - DNA, 15 bp, Homo sapiens
gagaaactcaaaagt

SEQ ID NO: 473268 - DNA, 15 bp, Homo sapiens
agaaactcaaaagtg

SEQ ID NO: 473269 - DNA, 15 bp, Homo sapiens
gaaactcaaaagtgt

SEQ ID NO: 473270 - DNA, 15 bp, Homo sapiens
aaactcaaaagtgtg

SEQ ID NO: 473271 - DNA, 15 bp, Homo sapiens
aactcaaaagtgtga

SEQ ID NO: 473272 - DNA, 15 bp, Homo sapiens
actcaaaagtgtgaa

SEQ ID NO: 473273 - DNA, 15 bp, Homo sapiens
ctcaaaagtgtgaag

SEQ ID NO: 473274 - DNA, 15 bp, Homo sapiens
tcaaaagtgtgaagt

SEQ ID NO: 473275 - DNA, 15 bp, Homo sapiens
caaaagtgtgaagtt

SEQ ID NO: 473276 - DNA, 15 bp, Homo sapiens
aaaagtgtgaagttt

SEQ ID NO: 473277 - DNA, 15 bp, Homo sapiens
aaagtgtgaagtttt

SEQ ID NO: 473278 - DNA, 15 bp, Homo sapiens
aagtgtgaagttttc

SEQ ID NO: 473279 - DNA, 15 bp, Homo sapiens
agtgtgaagttttct

SEQ ID NO: 473280 - DNA, 15 bp, Homo sapiens
gtgtgaagttttcta

SEQ ID NO: 473281 - DNA, 15 bp, Homo sapiens
tgtgaagttttctac

SEQ ID NO: 473282 - DNA, 15 bp, Homo sapiens
gtgaagttttctact

SEQ ID NO: 473283 - DNA, 15 bp, Homo sapiens
tgaagttttctactt

SEQ ID NO: 473284 - DNA, 15 bp, Homo sapiens
gaagttttctacttt

SEQ ID NO: 473285 - DNA, 15 bp, Homo sapiens
aagttttctacttta

SEQ ID NO: 473286 - DNA, 15 bp, Homo sapiens
agttttctactttat

SEQ ID NO: 473287 - DNA, 15 bp, Homo sapiens
gttttctactttata

SEQ ID NO: 473288 - DNA, 15 bp, Homo sapiens
ttttctactttataa

SEQ ID NO: 473289 - DNA, 15 bp, Homo sapiens
tttctactttataaa

SEQ ID NO: 473290 - DNA, 15 bp, Homo sapiens
ttctactttataaaa

SEQ ID NO: 473291 - DNA, 15 bp, Homo sapiens
tctactttataaaaa

SEQ ID NO: 473292 - DNA, 15 bp, Homo sapiens
ctactttataaaaaa

SEQ ID NO: 473293 - DNA, 15 bp, Homo sapiens
tactttataaaaaat

SEQ ID NO: 473294 - DNA, 15 bp, Homo sapiens
actttataaaaaata

SEQ ID NO: 473295 - DNA, 15 bp, Homo sapiens
ctttataaaaaatag

SEQ ID NO: 473296 - DNA, 15 bp, Homo sapiens
tttataaaaaataga

SEQ ID NO: 473297 - DNA, 15 bp, Homo sapiens
ttataaaaaatagag

SEQ ID NO: 473298 - DNA, 15 bp, Homo sapiens
tataaaaaatagaga

SEQ ID NO: 473299 - DNA, 15 bp, Homo sapiens
ataaaaaatagagaa

SEQ ID NO: 473300 - DNA, 15 bp, Homo sapiens
taaaaaatagagaaa

SEQ ID NO: 473301 - DNA, 15 bp, Homo sapiens
aaaaaatagagaaaa

SEQ ID NO: 473302 - DNA, 15 bp, Homo sapiens
aaaaatagagaaaat

SEQ ID NO: 473303 - DNA, 15 bp, Homo sapiens
aaaatagagaaaatt

SEQ ID NO: 473304 - DNA, 15 bp, Homo sapiens
aaatagagaaaattg

SEQ ID NO: 473305 - DNA, 15 bp, Homo sapiens
aatagagaaaattgt

SEQ ID NO: 473306 - DNA, 15 bp, Homo sapiens
atagagaaaattgta

SEQ ID NO: 473307 - DNA, 15 bp, Homo sapiens
tagagaaaattgtag

SEQ ID NO: 473308 - DNA, 15 bp, Homo sapiens
agagaaaattgtagt

SEQ ID NO: 473309 - DNA, 15 bp, Homo sapiens
gagaaaattgtagta

SEQ ID NO: 473310 - DNA, 15 bp, Homo sapiens
agaaaattgtagtaa

SEQ ID NO: 473311 - DNA, 15 bp, Homo sapiens
gaaaattgtagtaag

SEQ ID NO: 473312 - DNA, 15 bp, Homo sapiens
aaaattgtagtaaga

SEQ ID NO: 473313 - DNA, 15 bp, Homo sapiens
aaattgtagtaagaa

SEQ ID NO: 473314 - DNA, 15 bp, Homo sapiens
aattgtagtaagaag

SEQ ID NO: 473315 - DNA, 15 bp, Homo sapiens
attgtagtaagaagt

SEQ ID NO: 473316 - DNA, 15 bp, Homo sapiens
ttgtagtaagaagta

SEQ ID NO: 473317 - DNA, 15 bp, Homo sapiens
tgtagtaagaagtat

SEQ ID NO: 473318 - DNA, 15 bp, Homo sapiens
gtagtaagaagtata

SEQ ID NO: 473319 - DNA, 15 bp, Homo sapiens
tagtaagaagtataa

SEQ ID NO: 473320 - DNA, 15 bp, Homo sapiens
agtaagaagtataaa

SEQ ID NO: 473321 - DNA, 15 bp, Homo sapiens
gtaagaagtataaaa

SEQ ID NO: 473322 - DNA, 15 bp, Homo sapiens
taagaagtataaaaa

SEQ ID NO: 473323 - DNA, 15 bp, Homo sapiens
aagaagtataaaaaa

SEQ ID NO: 473324 - DNA, 15 bp, Homo sapiens
agaagtataaaaaat

SEQ ID NO: 473325 - DNA, 15 bp, Homo sapiens
gaagtataaaaaatg

SEQ ID NO: 473326 - DNA, 15 bp, Homo sapiens
aagtataaaaaatgt

SEQ ID NO: 473327 - DNA, 15 bp, Homo sapiens
agtataaaaaatgtc

SEQ ID NO: 473328 - DNA, 15 bp, Homo sapiens
gtataaaaaatgtca

SEQ ID NO: 473329 - DNA, 15 bp, Homo sapiens
tataaaaaatgtcaa

SEQ ID NO: 473330 - DNA, 15 bp, Homo sapiens
ataaaaaatgtcaag

SEQ ID NO: 473331 - DNA, 15 bp, Homo sapiens
taaaaaatgtcaagt

SEQ ID NO: 473332 - DNA, 15 bp, Homo sapiens
aaaaaatgtcaagtg

SEQ ID NO: 473333 - DNA, 15 bp, Homo sapiens
aaaaatgtcaagtgc

SEQ ID NO: 473334 - DNA, 15 bp, Homo sapiens
aaaatgtcaagtgca

SEQ ID NO: 473335 - DNA, 15 bp, Homo sapiens
aaatgtcaagtgcaa

SEQ ID NO: 473336 - DNA, 15 bp, Homo sapiens
aatgtcaagtgcaat

SEQ ID NO: 473337 - DNA, 15 bp, Homo sapiens
atgtcaagtgcaatt

SEQ ID NO: 473338 - DNA, 15 bp, Homo sapiens
tgtcaagtgcaattt

SEQ ID NO: 473339 - DNA, 15 bp, Homo sapiens
gtcaagtgcaatttt

SEQ ID NO: 473340 - DNA, 15 bp, Homo sapiens
tcaagtgcaattttt

SEQ ID NO: 473341 - DNA, 15 bp, Homo sapiens
caagtgcaatttttg

SEQ ID NO: 473342 - DNA, 15 bp, Homo sapiens
aagtgcaatttttgt

SEQ ID NO: 473343 - DNA, 15 bp, Homo sapiens
agtgcaatttttgtg

SEQ ID NO: 473344 - DNA, 15 bp, Homo sapiens
gtgcaatttttgtga

SEQ ID NO: 473345 - DNA, 15 bp, Homo sapiens
tgcaatttttgtgaa

SEQ ID NO: 473346 - DNA, 15 bp, Homo sapiens
gcaatttttgtgaaa

SEQ ID NO: 473347 - DNA, 15 bp, Homo sapiens
caatttttgtgaaat

SEQ ID NO: 473348 - DNA, 15 bp, Homo sapiens
aatttttgtgaaatg

SEQ ID NO: 473349 - DNA, 15 bp, Homo sapiens
atttttgtgaaatga

SEQ ID NO: 473350 - DNA, 15 bp, Homo sapiens
tttttgtgaaatgaa

SEQ ID NO: 473351 - DNA, 15 bp, Homo sapiens
ttttgtgaaatgaaa

SEQ ID NO: 473352 - DNA, 15 bp, Homo sapiens
tttgtgaaatgaaac

SEQ ID NO: 473353 - DNA, 15 bp, Homo sapiens
ttgtgaaatgaaact

SEQ ID NO: 473354 - DNA, 15 bp, Homo sapiens
tgtgaaatgaaactt

SEQ ID NO: 473355 - DNA, 15 bp, Homo sapiens
gtgaaatgaaacttt

SEQ ID NO: 473356 - DNA, 15 bp, Homo sapiens
tgaaatgaaacttta

SEQ ID NO: 473357 - DNA, 15 bp, Homo sapiens
gaaatgaaactttag

SEQ ID NO: 473358 - DNA, 15 bp, Homo sapiens
aaatgaaactttagc

SEQ ID NO: 473359 - DNA, 15 bp, Homo sapiens
aatgaaactttagcc

SEQ ID NO: 473360 - DNA, 15 bp, Homo sapiens
atgaaactttagcct

SEQ ID NO: 473361 - DNA, 15 bp, Homo sapiens
tgaaactttagcctt

SEQ ID NO: 473362 - DNA, 15 bp, Homo sapiens
gaaactttagccttc

SEQ ID NO: 473363 - DNA, 15 bp, Homo sapiens
aaactttagccttca

SEQ ID NO: 473364 - DNA, 15 bp, Homo sapiens
aactttagccttcag

SEQ ID NO: 473365 - DNA, 15 bp, Homo sapiens
actttagccttcaga

SEQ ID NO: 473366 - DNA, 15 bp, Homo sapiens
ctttagccttcagat

SEQ ID NO: 473367 - DNA, 15 bp, Homo sapiens
tttagccttcagatt

SEQ ID NO: 473368 - DNA, 15 bp, Homo sapiens
ttagccttcagattc

SEQ ID NO: 473369 - DNA, 15 bp, Homo sapiens
tagccttcagattca

SEQ ID NO: 473370 - DNA, 15 bp, Homo sapiens
agccttcagattcat

SEQ ID NO: 473371 - DNA, 15 bp, Homo sapiens
gccttcagattcata

SEQ ID NO: 473372 - DNA, 15 bp, Homo sapiens
ccttcagattcatag

SEQ ID NO: 473373 - DNA, 15 bp, Homo sapiens
cttcagattcatagt

SEQ ID NO: 473374 - DNA, 15 bp, Homo sapiens
ttcagattcatagtt

SEQ ID NO: 473375 - DNA, 15 bp, Homo sapiens
tcagattcatagttc

SEQ ID NO: 473376 - DNA, 15 bp, Homo sapiens
cagattcatagttca

SEQ ID NO: 473377 - DNA, 15 bp, Homo sapiens
agattcatagttcat

SEQ ID NO: 473378 - DNA, 15 bp, Homo sapiens
gattcatagttcatt

SEQ ID NO: 473379 - DNA, 15 bp, Homo sapiens
attcatagttcattt

SEQ ID NO: 473380 - DNA, 15 bp, Homo sapiens
ttcatagttcatttt

SEQ ID NO: 473381 - DNA, 15 bp, Homo sapiens
tcatagttcatttta

SEQ ID NO: 473382 - DNA, 15 bp, Homo sapiens
catagttcattttat

SEQ ID NO: 473383 - DNA, 15 bp, Homo sapiens
atagttcattttatt

SEQ ID NO: 473384 - DNA, 15 bp, Homo sapiens
tagttcattttattt

SEQ ID NO: 473385 - DNA, 15 bp, Homo sapiens
agttcattttatttt

SEQ ID NO: 473386 - DNA, 15 bp, Homo sapiens
gttcattttattttg

SEQ ID NO: 473387 - DNA, 15 bp, Homo sapiens
ttcattttattttgt

SEQ ID NO: 473388 - DNA, 15 bp, Homo sapiens
tcattttattttgta

SEQ ID NO: 473389 - DNA, 15 bp, Homo sapiens
cattttattttgtac

SEQ ID NO: 473390 - DNA, 15 bp, Homo sapiens
attttattttgtaca

SEQ ID NO: 473391 - DNA, 15 bp, Homo sapiens
ttttattttgtacat

SEQ ID NO: 473392 - DNA, 15 bp, Homo sapiens
tttattttgtacatg

SEQ ID NO: 473393 - DNA, 15 bp, Homo sapiens
ttattttgtacatga

SEQ ID NO: 473394 - DNA, 15 bp, Homo sapiens
tattttgtacatgat

SEQ ID NO: 473395 - DNA, 15 bp, Homo sapiens
attttgtacatgata

SEQ ID NO: 473396 - DNA, 15 bp, Homo sapiens
ttttgtacatgatag

SEQ ID NO: 473397 - DNA, 15 bp, Homo sapiens
tttgtacatgataga

SEQ ID NO: 473398 - DNA, 15 bp, Homo sapiens
ttgtacatgatagaa

SEQ ID NO: 473399 - DNA, 15 bp, Homo sapiens
tgtacatgatagaaa

SEQ ID NO: 473400 - DNA, 15 bp, Homo sapiens
gtacatgatagaaaa

SEQ ID NO: 473401 - DNA, 15 bp, Homo sapiens
tacatgatagaaaat

SEQ ID NO: 473402 - DNA, 15 bp, Homo sapiens
acatgatagaaaatc

SEQ ID NO: 473403 - DNA, 15 bp, Homo sapiens
catgatagaaaatca

SEQ ID NO: 473404 - DNA, 15 bp, Homo sapiens
atgatagaaaatcag

SEQ ID NO: 473405 - DNA, 15 bp, Homo sapiens
tgatagaaaatcagg

SEQ ID NO: 473406 - DNA, 15 bp, Homo sapiens
gatagaaaatcagga

SEQ ID NO: 473407 - DNA, 15 bp, Homo sapiens
atagaaaatcaggaa

SEQ ID NO: 473408 - DNA, 15 bp, Homo sapiens
tagaaaatcaggaag

SEQ ID NO: 473409 - DNA, 15 bp, Homo sapiens
agaaaatcaggaagt

SEQ ID NO: 473410 - DNA, 15 bp, Homo sapiens
gaaaatcaggaagta

SEQ ID NO: 473411 - DNA, 15 bp, Homo sapiens
aaaatcaggaagtag

SEQ ID NO: 473412 - DNA, 15 bp, Homo sapiens
aaatcaggaagtagt

SEQ ID NO: 473413 - DNA, 15 bp, Homo sapiens
aatcaggaagtagta

SEQ ID NO: 473414 - DNA, 15 bp, Homo sapiens
atcaggaagtagtaa

SEQ ID NO: 473415 - DNA, 15 bp, Homo sapiens
tcaggaagtagtaat

SEQ ID NO: 473416 - DNA, 15 bp, Homo sapiens
caggaagtagtaata

SEQ ID NO: 473417 - DNA, 15 bp, Homo sapiens
aggaagtagtaatat

SEQ ID NO: 473418 - DNA, 15 bp, Homo sapiens
ggaagtagtaatatt

SEQ ID NO: 473419 - DNA, 15 bp, Homo sapiens
gaagtagtaatattt

SEQ ID NO: 473420 - DNA, 15 bp, Homo sapiens
aagtagtaatatttt

SEQ ID NO: 473421 - DNA, 15 bp, Homo sapiens
agtagtaatatttta

SEQ ID NO: 473422 - DNA, 15 bp, Homo sapiens
gtagtaatattttag

SEQ ID NO: 473423 - DNA, 15 bp, Homo sapiens
tagtaatattttagt

SEQ ID NO: 473424 - DNA, 15 bp, Homo sapiens
agtaatattttagtg

SEQ ID NO: 473425 - DNA, 15 bp, Homo sapiens
gtaatattttagtgc

SEQ ID NO: 473426 - DNA, 15 bp, Homo sapiens
taatattttagtgct

SEQ ID NO: 473427 - DNA, 15 bp, Homo sapiens
aatattttagtgctt

SEQ ID NO: 473428 - DNA, 15 bp, Homo sapiens
atattttagtgcttt

SEQ ID NO: 473429 - DNA, 15 bp, Homo sapiens
tattttagtgctttg

SEQ ID NO: 473430 - DNA, 15 bp, Homo sapiens
attttagtgctttgt

SEQ ID NO: 473431 - DNA, 15 bp, Homo sapiens
ttttagtgctttgtg

SEQ ID NO: 473432 - DNA, 15 bp, Homo sapiens
tttagtgctttgtga

SEQ ID NO: 473433 - DNA, 15 bp, Homo sapiens
ttagtgctttgtgat

SEQ ID NO: 473434 - DNA, 15 bp, Homo sapiens
tagtgctttgtgata

SEQ ID NO: 473435 - DNA, 15 bp, Homo sapiens
agtgctttgtgatag

SEQ ID NO: 473436 - DNA, 15 bp, Homo sapiens
gtgctttgtgatagt

SEQ ID NO: 473437 - DNA, 15 bp, Homo sapiens
tgctttgtgatagtc

SEQ ID NO: 473438 - DNA, 15 bp, Homo sapiens
gctttgtgatagtca

SEQ ID NO: 473439 - DNA, 15 bp, Homo sapiens
ctttgtgatagtcaa

SEQ ID NO: 473440 - DNA, 15 bp, Homo sapiens
tttgtgatagtcaat

SEQ ID NO: 473441 - DNA, 15 bp, Homo sapiens
ttgtgatagtcaatg

SEQ ID NO: 473442 - DNA, 15 bp, Homo sapiens
tgtgatagtcaatgt

SEQ ID NO: 473443 - DNA, 15 bp, Homo sapiens
gtgatagtcaatgtc

SEQ ID NO: 473444 - DNA, 15 bp, Homo sapiens
tgatagtcaatgtct

SEQ ID NO: 473445 - DNA, 15 bp, Homo sapiens
gatagtcaatgtctc

SEQ ID NO: 473446 - DNA, 15 bp, Homo sapiens
atagtcaatgtctca

SEQ ID NO: 473447 - DNA, 15 bp, Homo sapiens
tagtcaatgtctcaa

SEQ ID NO: 473448 - DNA, 15 bp, Homo sapiens
agtcaatgtctcaaa

SEQ ID NO: 473449 - DNA, 15 bp, Homo sapiens
gtcaatgtctcaaac

SEQ ID NO: 473450 - DNA, 15 bp, Homo sapiens
tcaatgtctcaaaca

SEQ ID NO: 473451 - DNA, 15 bp, Homo sapiens
caatgtctcaaacat

SEQ ID NO: 473452 - DNA, 15 bp, Homo sapiens
aatgtctcaaacatg

SEQ ID NO: 473453 - DNA, 15 bp, Homo sapiens
atgtctcaaacatgt

SEQ ID NO: 473454 - DNA, 15 bp, Homo sapiens
tgtctcaaacatgtc

SEQ ID NO: 473455 - DNA, 15 bp, Homo sapiens
gtctcaaacatgtca

SEQ ID NO: 473456 - DNA, 15 bp, Homo sapiens
tctcaaacatgtcaa

SEQ ID NO: 473457 - DNA, 15 bp, Homo sapiens
ctcaaacatgtcaaa

SEQ ID NO: 473458 - DNA, 15 bp, Homo sapiens
tcaaacatgtcaaaa

SEQ ID NO: 473459 - DNA, 15 bp, Homo sapiens
caaacatgtcaaaat

SEQ ID NO: 473460 - DNA, 15 bp, Homo sapiens
aaacatgtcaaaata

SEQ ID NO: 473461 - DNA, 15 bp, Homo sapiens
aacatgtcaaaatag

SEQ ID NO: 473462 - DNA, 15 bp, Homo sapiens
acatgtcaaaataga

SEQ ID NO: 473463 - DNA, 15 bp, Homo sapiens
catgtcaaaatagaa

SEQ ID NO: 473464 - DNA, 15 bp, Homo sapiens
atgtcaaaatagaag

SEQ ID NO: 473465 - DNA, 15 bp, Homo sapiens
tgtcaaaatagaaga

SEQ ID NO: 473466 - DNA, 15 bp, Homo sapiens
gtcaaaatagaagaa

SEQ ID NO: 473467 - DNA, 15 bp, Homo sapiens
tcaaaatagaagaat

SEQ ID NO: 473468 - DNA, 15 bp, Homo sapiens
caaaatagaagaata

SEQ ID NO: 473469 - DNA, 15 bp, Homo sapiens
aaaatagaagaatac

SEQ ID NO: 473470 - DNA, 15 bp, Homo sapiens
aaatagaagaataca

SEQ ID NO: 473471 - DNA, 15 bp, Homo sapiens
aatagaagaatacag

SEQ ID NO: 473472 - DNA, 15 bp, Homo sapiens
atagaagaatacagt

SEQ ID NO: 473473 - DNA, 15 bp, Homo sapiens
tagaagaatacagta

SEQ ID NO: 473474 - DNA, 15 bp, Homo sapiens
agaagaatacagtat

SEQ ID NO: 473475 - DNA, 15 bp, Homo sapiens
gaagaatacagtatt

SEQ ID NO: 473476 - DNA, 15 bp, Homo sapiens
aagaatacagtattt

SEQ ID NO: 473477 - DNA, 15 bp, Homo sapiens
agaatacagtatttg

SEQ ID NO: 473478 - DNA, 15 bp, Homo sapiens
gaatacagtatttgg

SEQ ID NO: 473479 - DNA, 15 bp, Homo sapiens
aatacagtatttggt

SEQ ID NO: 473480 - DNA, 15 bp, Homo sapiens
atacagtatttggtc

SEQ ID NO: 473481 - DNA, 15 bp, Homo sapiens
tacagtatttggtct

SEQ ID NO: 473482 - DNA, 15 bp, Homo sapiens
acagtatttggtctg

SEQ ID NO: 473483 - DNA, 15 bp, Homo sapiens
cagtatttggtctgc

SEQ ID NO: 473484 - DNA, 15 bp, Homo sapiens
agtatttggtctgca

SEQ ID NO: 473485 - DNA, 15 bp, Homo sapiens
gtatttggtctgcag

SEQ ID NO: 473486 - DNA, 15 bp, Homo sapiens
tatttggtctgcaga

SEQ ID NO: 473487 - DNA, 15 bp, Homo sapiens
atttggtctgcagac

SEQ ID NO: 473488 - DNA, 15 bp, Homo sapiens
gtctgcagaccaaaa

SEQ ID NO: 473489 - DNA, 15 bp, Homo sapiens
tctgcagaccaaaat

SEQ ID NO: 473490 - DNA, 15 bp, Homo sapiens
ctgcagaccaaaata

SEQ ID NO: 473491 - DNA, 15 bp, Homo sapiens
tgcagaccaaaatag

SEQ ID NO: 473492 - DNA, 15 bp, Homo sapiens
gcagaccaaaataga

SEQ ID NO: 473493 - DNA, 15 bp, Homo sapiens
cagaccaaaatagat

SEQ ID NO: 473494 - DNA, 15 bp, Homo sapiens
agaccaaaatagatt

SEQ ID NO: 473495 - DNA, 15 bp, Homo sapiens
gaccaaaatagattt

SEQ ID NO: 473496 - DNA, 15 bp, Homo sapiens
accaaaatagatttt

SEQ ID NO: 473497 - DNA, 15 bp, Homo sapiens
ccaaaatagattttt

SEQ ID NO: 473498 - DNA, 15 bp, Homo sapiens
caaaatagatttttt

SEQ ID NO: 473499 - DNA, 15 bp, Homo sapiens
aaaatagattttttt

SEQ ID NO: 473500 - DNA, 15 bp, Homo sapiens
aaatagattttttta

SEQ ID NO: 473501 - DNA, 15 bp, Homo sapiens
aatagatttttttaa

SEQ ID NO: 473502 - DNA, 15 bp, Homo sapiens
atagatttttttaaa

SEQ ID NO: 473503 - DNA, 15 bp, Homo sapiens
tagatttttttaaat

SEQ ID NO: 473504 - DNA, 15 bp, Homo sapiens
agatttttttaaatc

SEQ ID NO: 473505 - DNA, 15 bp, Homo sapiens
gatttttttaaatcc

SEQ ID NO: 473506 - DNA, 15 bp, Homo sapiens
atttttttaaatccc

SEQ ID NO: 473507 - DNA, 15 bp, Homo sapiens
tttttttaaatccct

SEQ ID NO: 473508 - DNA, 15 bp, Homo sapiens
ttttttaaatccctg

SEQ ID NO: 473509 - DNA, 15 bp, Homo sapiens
tttttaaatccctgt

SEQ ID NO: 473510 - DNA, 15 bp, Homo sapiens
ttttaaatccctgta

SEQ ID NO: 473511 - DNA, 15 bp, Homo sapiens
tttaaatccctgtag

SEQ ID NO: 473512 - DNA, 15 bp, Homo sapiens
ttaaatccctgtaga

SEQ ID NO: 473513 - DNA, 15 bp, Homo sapiens
taaatccctgtagac

SEQ ID NO: 473514 - DNA, 15 bp, Homo sapiens
aaatccctgtagacc

SEQ ID NO: 473515 - DNA, 15 bp, Homo sapiens
aatccctgtagacct

SEQ ID NO: 473516 - DNA, 15 bp, Homo sapiens
atccctgtagacctc

SEQ ID NO: 473517 - DNA, 15 bp, Homo sapiens
tccctgtagacctca

SEQ ID NO: 473518 - DNA, 15 bp, Homo sapiens
ccctgtagacctcaa

SEQ ID NO: 473519 - DNA, 15 bp, Homo sapiens
cctgtagacctcaaa

SEQ ID NO: 473520 - DNA, 15 bp, Homo sapiens
ctgtagacctcaaac

SEQ ID NO: 473521 - DNA, 15 bp, Homo sapiens
tgtagacctcaaact

SEQ ID NO: 473522 - DNA, 15 bp, Homo sapiens
gtagacctcaaactt

SEQ ID NO: 473523 - DNA, 15 bp, Homo sapiens
tagacctcaaacttt

SEQ ID NO: 473524 - DNA, 15 bp, Homo sapiens
agacctcaaactttg

SEQ ID NO: 473525 - DNA, 15 bp, Homo sapiens
gacctcaaactttgc

SEQ ID NO: 473526 - DNA, 15 bp, Homo sapiens
acctcaaactttgct

SEQ ID NO: 473527 - DNA, 15 bp, Homo sapiens
cctcaaactttgcta

SEQ ID NO: 473528 - DNA, 15 bp, Homo sapiens
ctcaaactttgctaa

SEQ ID NO: 473529 - DNA, 15 bp, Homo sapiens
tcaaactttgctaaa

SEQ ID NO: 473530 - DNA, 15 bp, Homo sapiens
caaactttgctaaat

SEQ ID NO: 473531 - DNA, 15 bp, Homo sapiens
aaactttgctaaatt

SEQ ID NO: 473532 - DNA, 15 bp, Homo sapiens
aactttgctaaattt

SEQ ID NO: 473533 - DNA, 15 bp, Homo sapiens
actttgctaaattta

SEQ ID NO: 473534 - DNA, 15 bp, Homo sapiens
ctttgctaaatttat

SEQ ID NO: 473535 - DNA, 15 bp, Homo sapiens
tttgctaaatttatg

SEQ ID NO: 473536 - DNA, 15 bp, Homo sapiens
ttgctaaatttatgt

SEQ ID NO: 473537 - DNA, 15 bp, Homo sapiens
tgctaaatttatgta

SEQ ID NO: 473538 - DNA, 15 bp, Homo sapiens
gctaaatttatgtac

SEQ ID NO: 473539 - DNA, 15 bp, Homo sapiens
ctaaatttatgtacc

SEQ ID NO: 473540 - DNA, 15 bp, Homo sapiens
taaatttatgtacca

SEQ ID NO: 473541 - DNA, 15 bp, Homo sapiens
aaatttatgtaccag

SEQ ID NO: 473542 - DNA, 15 bp, Homo sapiens
aatttatgtaccagt

SEQ ID NO: 473543 - DNA, 15 bp, Homo sapiens
atttatgtaccagtt

SEQ ID NO: 473544 - DNA, 15 bp, Homo sapiens
tttatgtaccagttt

SEQ ID NO: 473545 - DNA, 15 bp, Homo sapiens
ttatgtaccagttta

SEQ ID NO: 473546 - DNA, 15 bp, Homo sapiens
tatgtaccagtttat

SEQ ID NO: 473547 - DNA, 15 bp, Homo sapiens
atgtaccagtttatc

SEQ ID NO: 473548 - DNA, 15 bp, Homo sapiens
tgtaccagtttatct

SEQ ID NO: 473549 - DNA, 15 bp, Homo sapiens
gtaccagtttatctc

SEQ ID NO: 473550 - DNA, 15 bp, Homo sapiens
taccagtttatctct

SEQ ID NO: 473551 - DNA, 15 bp, Homo sapiens
accagtttatctctt

SEQ ID NO: 473552 - DNA, 15 bp, Homo sapiens
ccagtttatctcttt

SEQ ID NO: 473553 - DNA, 15 bp, Homo sapiens
cagtttatctctttt

SEQ ID NO: 473554 - DNA, 15 bp, Homo sapiens
agtttatctctttta

SEQ ID NO: 473555 - DNA, 15 bp, Homo sapiens
gtttatctcttttat

SEQ ID NO: 473556 - DNA, 15 bp, Homo sapiens
tttatctcttttatt

SEQ ID NO: 473557 - DNA, 15 bp, Homo sapiens
ttatctcttttattt

SEQ ID NO: 473558 - DNA, 15 bp, Homo sapiens
tatctcttttatttg

SEQ ID NO: 473559 - DNA, 15 bp, Homo sapiens
atctcttttatttgt

SEQ ID NO: 473560 - DNA, 15 bp, Homo sapiens
tctcttttatttgtg

SEQ ID NO: 473561 - DNA, 15 bp, Homo sapiens
ctcttttatttgtgg

SEQ ID NO: 473562 - DNA, 15 bp, Homo sapiens
tcttttatttgtgga

SEQ ID NO: 473563 - DNA, 15 bp, Homo sapiens
cttttatttgtggaa

SEQ ID NO: 473564 - DNA, 15 bp, Homo sapiens
ttttatttgtggaat

SEQ ID NO: 473565 - DNA, 15 bp, Homo sapiens
tttatttgtggaatg

SEQ ID NO: 473566 - DNA, 15 bp, Homo sapiens
ttatttgtggaatgg

SEQ ID NO: 473567 - DNA, 15 bp, Homo sapiens
tatttgtggaatggc

SEQ ID NO: 473568 - DNA, 15 bp, Homo sapiens
atttgtggaatggct

SEQ ID NO: 473569 - DNA, 15 bp, Homo sapiens
tttgtggaatggcta

SEQ ID NO: 473570 - DNA, 15 bp, Homo sapiens
ttgtggaatggctaa

SEQ ID NO: 473571 - DNA, 15 bp, Homo sapiens
tgtggaatggctaag

SEQ ID NO: 473572 - DNA, 15 bp, Homo sapiens
gtggaatggctaaga

SEQ ID NO: 473573 - DNA, 15 bp, Homo sapiens
tggaatggctaagaa

SEQ ID NO: 473574 - DNA, 15 bp, Homo sapiens
ggaatggctaagaaa

SEQ ID NO: 473575 - DNA, 15 bp, Homo sapiens
gaatggctaagaaat

SEQ ID NO: 473576 - DNA, 15 bp, Homo sapiens
aatggctaagaaata

SEQ ID NO: 473577 - DNA, 15 bp, Homo sapiens
atggctaagaaatag

SEQ ID NO: 473578 - DNA, 15 bp, Homo sapiens
tggctaagaaataga

SEQ ID NO: 473579 - DNA, 15 bp, Homo sapiens
ggctaagaaatagaa

SEQ ID NO: 473580 - DNA, 15 bp, Homo sapiens
gctaagaaatagaag

SEQ ID NO: 473581 - DNA, 15 bp, Homo sapiens
ctaagaaatagaaga

SEQ ID NO: 473582 - DNA, 15 bp, Homo sapiens
taagaaatagaagaa

SEQ ID NO: 473583 - DNA, 15 bp, Homo sapiens
aagaaatagaagaaa

SEQ ID NO: 473584 - DNA, 15 bp, Homo sapiens
agaaatagaagaaag

SEQ ID NO: 473585 - DNA, 15 bp, Homo sapiens
gaaatagaagaaaga

SEQ ID NO: 473586 - DNA, 15 bp, Homo sapiens
aaatagaagaaagaa

SEQ ID NO: 473587 - DNA, 15 bp, Homo sapiens
aatagaagaaagaac

SEQ ID NO: 473588 - DNA, 15 bp, Homo sapiens
atagaagaaagaaca

SEQ ID NO: 473589 - DNA, 15 bp, Homo sapiens
tagaagaaagaacac

SEQ ID NO: 473590 - DNA, 15 bp, Homo sapiens
agaagaaagaacaca

SEQ ID NO: 473591 - DNA, 15 bp, Homo sapiens
gaagaaagaacacag

SEQ ID NO: 473592 - DNA, 15 bp, Homo sapiens
aagaaagaacacagc

SEQ ID NO: 473593 - DNA, 15 bp, Homo sapiens
agaaagaacacagcc

SEQ ID NO: 473594 - DNA, 15 bp, Homo sapiens
gaaagaacacagcca

SEQ ID NO: 473595 - DNA, 15 bp, Homo sapiens
aaagaacacagccaa

SEQ ID NO: 473596 - DNA, 15 bp, Homo sapiens
aagaacacagccaaa

SEQ ID NO: 473597 - DNA, 15 bp, Homo sapiens
agaacacagccaaag

SEQ ID NO: 473598 - DNA, 15 bp, Homo sapiens
gaacacagccaaagc

SEQ ID NO: 473599 - DNA, 15 bp, Homo sapiens
aacacagccaaagca

SEQ ID NO: 473600 - DNA, 15 bp, Homo sapiens
acacagccaaagcat

SEQ ID NO: 473601 - DNA, 15 bp, Homo sapiens
cacagccaaagcata

SEQ ID NO: 473602 - DNA, 15 bp, Homo sapiens
acagccaaagcatag

SEQ ID NO: 473603 - DNA, 15 bp, Homo sapiens
cagccaaagcatagg

SEQ ID NO: 473604 - DNA, 15 bp, Homo sapiens
agccaaagcatagga

SEQ ID NO: 473605 - DNA, 15 bp, Homo sapiens
gccaaagcataggag

SEQ ID NO: 473606 - DNA, 15 bp, Homo sapiens
ccaaagcataggaga

SEQ ID NO: 473607 - DNA, 15 bp, Homo sapiens
caaagcataggagat

SEQ ID NO: 473608 - DNA, 15 bp, Homo sapiens
aaagcataggagata

SEQ ID NO: 473609 - DNA, 15 bp, Homo sapiens
aagcataggagatac

SEQ ID NO: 473610 - DNA, 15 bp, Homo sapiens
agcataggagatacc

SEQ ID NO: 473611 - DNA, 15 bp, Homo sapiens
gcataggagatacct

SEQ ID NO: 473612 - DNA, 15 bp, Homo sapiens
cataggagatacctt

SEQ ID NO: 473613 - DNA, 15 bp, Homo sapiens
ataggagataccttt

SEQ ID NO: 473614 - DNA, 15 bp, Homo sapiens
taggagatacctttt

SEQ ID NO: 473615 - DNA, 15 bp, Homo sapiens
aggagataccttttt

SEQ ID NO: 473616 - DNA, 15 bp, Homo sapiens
ggagatacctttttc

SEQ ID NO: 473617 - DNA, 15 bp, Homo sapiens
gagatacctttttcc

SEQ ID NO: 473618 - DNA, 15 bp, Homo sapiens
agatacctttttccc

SEQ ID NO: 473619 - DNA, 15 bp, Homo sapiens
gatacctttttccct

SEQ ID NO: 473620 - DNA, 15 bp, Homo sapiens
atacctttttccctc

SEQ ID NO: 473621 - DNA, 15 bp, Homo sapiens
tacctttttccctct

SEQ ID NO: 473622 - DNA, 15 bp, Homo sapiens
acctttttccctcta

SEQ ID NO: 473623 - DNA, 15 bp, Homo sapiens
cctttttccctctat

SEQ ID NO: 473624 - DNA, 15 bp, Homo sapiens
ctttttccctctata

SEQ ID NO: 473625 - DNA, 15 bp, Homo sapiens
tttttccctctatag

SEQ ID NO: 473626 - DNA, 15 bp, Homo sapiens
ttttccctctatagg

SEQ ID NO: 473627 - DNA, 15 bp, Homo sapiens
tttccctctataggt

SEQ ID NO: 473628 - DNA, 15 bp, Homo sapiens
ttccctctataggta

SEQ ID NO: 473629 - DNA, 15 bp, Homo sapiens
tccctctataggtaa

SEQ ID NO: 473630 - DNA, 15 bp, Homo sapiens
ccctctataggtaat

SEQ ID NO: 473631 - DNA, 15 bp, Homo sapiens
cctctataggtaatg

SEQ ID NO: 473632 - DNA, 15 bp, Homo sapiens
ctctataggtaatgt

SEQ ID NO: 473633 - DNA, 15 bp, Homo sapiens
tctataggtaatgtc

SEQ ID NO: 473634 - DNA, 15 bp, Homo sapiens
ctataggtaatgtcg

SEQ ID NO: 473635 - DNA, 15 bp, Homo sapiens
tataggtaatgtcgt

SEQ ID NO: 473636 - DNA, 15 bp, Homo sapiens
ataggtaatgtcgtg

SEQ ID NO: 473637 - DNA, 15 bp, Homo sapiens
taggtaatgtcgtgt

SEQ ID NO: 473638 - DNA, 15 bp, Homo sapiens
aggtaatgtcgtgtg

SEQ ID NO: 473639 - DNA, 15 bp, Homo sapiens
ggtaatgtcgtgtgt

SEQ ID NO: 473640 - DNA, 15 bp, Homo sapiens
gtaatgtcgtgtgtg

SEQ ID NO: 473641 - DNA, 15 bp, Homo sapiens
taatgtcgtgtgtgt

SEQ ID NO: 473642 - DNA, 15 bp, Homo sapiens
aatgtcgtgtgtgtg

SEQ ID NO: 473643 - DNA, 15 bp, Homo sapiens
atgtcgtgtgtgtgt

SEQ ID NO: 473644 - DNA, 15 bp, Homo sapiens
tgtcgtgtgtgtgta

SEQ ID NO: 473645 - DNA, 15 bp, Homo sapiens
gtcgtgtgtgtgtaa

SEQ ID NO: 473646 - DNA, 15 bp, Homo sapiens
tcgtgtgtgtgtaaa

SEQ ID NO: 473647 - DNA, 15 bp, Homo sapiens
cgtgtgtgtgtaaac

SEQ ID NO: 473648 - DNA, 15 bp, Homo sapiens
gtgtgtgtgtaaaca

SEQ ID NO: 473649 - DNA, 15 bp, Homo sapiens
tgtgtgtgtaaacag

SEQ ID NO: 473650 - DNA, 15 bp, Homo sapiens
gtgtgtgtaaacaga

SEQ ID NO: 473651 - DNA, 15 bp, Homo sapiens
tgtgtgtaaacagaa

SEQ ID NO: 473652 - DNA, 15 bp, Homo sapiens
gtgtgtaaacagaaa

SEQ ID NO: 473653 - DNA, 15 bp, Homo sapiens
tgtgtaaacagaaag

SEQ ID NO: 473654 - DNA, 15 bp, Homo sapiens
gtgtaaacagaaaga

SEQ ID NO: 473655 - DNA, 15 bp, Homo sapiens
tgtaaacagaaagaa

SEQ ID NO: 473656 - DNA, 15 bp, Homo sapiens
gtaaacagaaagaaa

SEQ ID NO: 473657 - DNA, 15 bp, Homo sapiens
taaacagaaagaaat

SEQ ID NO: 473658 - DNA, 15 bp, Homo sapiens
aaacagaaagaaata

SEQ ID NO: 473659 - DNA, 15 bp, Homo sapiens
aacagaaagaaatac

SEQ ID NO: 473660 - DNA, 15 bp, Homo sapiens
acagaaagaaataca

SEQ ID NO: 473661 - DNA, 15 bp, Homo sapiens
cagaaagaaatacaa

SEQ ID NO: 473662 - DNA, 15 bp, Homo sapiens
agaaagaaatacaat

SEQ ID NO: 473663 - DNA, 15 bp, Homo sapiens
gaaagaaatacaatg

SEQ ID NO: 473664 - DNA, 15 bp, Homo sapiens
aaagaaatacaatgc

SEQ ID NO: 473665 - DNA, 15 bp, Homo sapiens
aagaaatacaatgca

SEQ ID NO: 473666 - DNA, 15 bp, Homo sapiens
agaaatacaatgcaa

SEQ ID NO: 473667 - DNA, 15 bp, Homo sapiens
gaaatacaatgcaaa

SEQ ID NO: 473668 - DNA, 15 bp, Homo sapiens
aaatacaatgcaaat

SEQ ID NO: 473669 - DNA, 15 bp, Homo sapiens
aatacaatgcaaatg

SEQ ID NO: 473670 - DNA, 15 bp, Homo sapiens
atacaatgcaaatgc

SEQ ID NO: 473671 - DNA, 15 bp, Homo sapiens
tacaatgcaaatgca

SEQ ID NO: 473672 - DNA, 15 bp, Homo sapiens
acaatgcaaatgcat

SEQ ID NO: 473673 - DNA, 15 bp, Homo sapiens
caatgcaaatgcata

SEQ ID NO: 473674 - DNA, 15 bp, Homo sapiens
aatgcaaatgcatat

SEQ ID NO: 473675 - DNA, 15 bp, Homo sapiens
atgcaaatgcatatt

SEQ ID NO: 473676 - DNA, 15 bp, Homo sapiens
tgcaaatgcatattt

SEQ ID NO: 473677 - DNA, 15 bp, Homo sapiens
gcaaatgcatattta

SEQ ID NO: 473678 - DNA, 15 bp, Homo sapiens
caaatgcatatttag

SEQ ID NO: 473679 - DNA, 15 bp, Homo sapiens
aaatgcatatttaga

SEQ ID NO: 473680 - DNA, 15 bp, Homo sapiens
aatgcatatttagat

SEQ ID NO: 473681 - DNA, 15 bp, Homo sapiens
atgcatatttagata

SEQ ID NO: 473682 - DNA, 15 bp, Homo sapiens
tgcatatttagatag

SEQ ID NO: 473683 - DNA, 15 bp, Homo sapiens
gcatatttagatagg

SEQ ID NO: 473684 - DNA, 15 bp, Homo sapiens
catatttagataggt

SEQ ID NO: 473685 - DNA, 15 bp, Homo sapiens
atatttagataggtc

SEQ ID NO: 473686 - DNA, 15 bp, Homo sapiens
tatttagataggtcc

SEQ ID NO: 473687 - DNA, 15 bp, Homo sapiens
atttagataggtcca

SEQ ID NO: 473688 - DNA, 15 bp, Homo sapiens
tttagataggtccat

SEQ ID NO: 473689 - DNA, 15 bp, Homo sapiens
ttagataggtccatg

SEQ ID NO: 473690 - DNA, 15 bp, Homo sapiens
tagataggtccatgt

SEQ ID NO: 473691 - DNA, 15 bp, Homo sapiens
agataggtccatgta

SEQ ID NO: 473692 - DNA, 15 bp, Homo sapiens
gataggtccatgtat

SEQ ID NO: 473693 - DNA, 15 bp, Homo sapiens
ataggtccatgtata

SEQ ID NO: 473694 - DNA, 15 bp, Homo sapiens
taggtccatgtataa

SEQ ID NO: 473695 - DNA, 15 bp, Homo sapiens
aggtccatgtataac

SEQ ID NO: 473696 - DNA, 15 bp, Homo sapiens
ggtccatgtataaca

SEQ ID NO: 473697 - DNA, 15 bp, Homo sapiens
gtccatgtataacac

SEQ ID NO: 473698 - DNA, 15 bp, Homo sapiens
tccatgtataacaca

SEQ ID NO: 473699 - DNA, 15 bp, Homo sapiens
ccatgtataacacat

SEQ ID NO: 473700 - DNA, 15 bp, Homo sapiens
catgtataacacata

SEQ ID NO: 473701 - DNA, 15 bp, Homo sapiens
atgtataacacatac

SEQ ID NO: 473702 - DNA, 15 bp, Homo sapiens
tgtataacacataca

SEQ ID NO: 473703 - DNA, 15 bp, Homo sapiens
gtataacacatacac

SEQ ID NO: 473704 - DNA, 15 bp, Homo sapiens
tataacacatacaca

SEQ ID NO: 473705 - DNA, 15 bp, Homo sapiens
ataacacatacacat

SEQ ID NO: 473706 - DNA, 15 bp, Homo sapiens
taacacatacacata

SEQ ID NO: 473707 - DNA, 15 bp, Homo sapiens
aacacatacacatac

SEQ ID NO: 473708 - DNA, 15 bp, Homo sapiens
acacatacacataca

SEQ ID NO: 473709 - DNA, 15 bp, Homo sapiens
cacatacacatacaa

SEQ ID NO: 473710 - DNA, 15 bp, Homo sapiens
acatacacatacaaa

SEQ ID NO: 473711 - DNA, 15 bp, Homo sapiens
catacacatacaaaa

SEQ ID NO: 473712 - DNA, 15 bp, Homo sapiens
atacacatacaaaag

SEQ ID NO: 473713 - DNA, 15 bp, Homo sapiens
tacacatacaaaagg

SEQ ID NO: 473714 - DNA, 15 bp, Homo sapiens
acacatacaaaaggt

SEQ ID NO: 473715 - DNA, 15 bp, Homo sapiens
cacatacaaaaggta

SEQ ID NO: 473716 - DNA, 15 bp, Homo sapiens
acatacaaaaggtaa

SEQ ID NO: 473717 - DNA, 15 bp, Homo sapiens
catacaaaaggtaag

SEQ ID NO: 473718 - DNA, 15 bp, Homo sapiens
atacaaaaggtaaga

SEQ ID NO: 473719 - DNA, 15 bp, Homo sapiens
tacaaaaggtaagaa

SEQ ID NO: 473720 - DNA, 15 bp, Homo sapiens
acaaaaggtaagaaa

SEQ ID NO: 473721 - DNA, 15 bp, Homo sapiens
caaaaggtaagaaaa

SEQ ID NO: 473722 - DNA, 15 bp, Homo sapiens
aaaaggtaagaaaaa

SEQ ID NO: 473723 - DNA, 15 bp, Homo sapiens
aaaggtaagaaaaaa

SEQ ID NO: 473724 - DNA, 15 bp, Homo sapiens
aaggtaagaaaaaat

SEQ ID NO: 473725 - DNA, 15 bp, Homo sapiens
aggtaagaaaaaatt

SEQ ID NO: 473726 - DNA, 15 bp, Homo sapiens
ggtaagaaaaaattt

SEQ ID NO: 473727 - DNA, 15 bp, Homo sapiens
gtaagaaaaaatttc

SEQ ID NO: 473728 - DNA, 15 bp, Homo sapiens
taagaaaaaatttca

SEQ ID NO: 473729 - DNA, 15 bp, Homo sapiens
aagaaaaaatttcaa

SEQ ID NO: 473730 - DNA, 15 bp, Homo sapiens
agaaaaaatttcaac

SEQ ID NO: 473731 - DNA, 15 bp, Homo sapiens
gaaaaaatttcaact

SEQ ID NO: 473732 - DNA, 15 bp, Homo sapiens
aaaaaatttcaactg

SEQ ID NO: 473733 - DNA, 15 bp, Homo sapiens
aaaaatttcaactgt

SEQ ID NO: 473734 - DNA, 15 bp, Homo sapiens
aaaatttcaactgtg

SEQ ID NO: 473735 - DNA, 15 bp, Homo sapiens
aaatttcaactgtgt

SEQ ID NO: 473736 - DNA, 15 bp, Homo sapiens
aatttcaactgtgtg

SEQ ID NO: 473737 - DNA, 15 bp, Homo sapiens
atttcaactgtgtga

SEQ ID NO: 473738 - DNA, 15 bp, Homo sapiens
tttcaactgtgtgat

SEQ ID NO: 473739 - DNA, 15 bp, Homo sapiens
ttcaactgtgtgatt

SEQ ID NO: 473740 - DNA, 15 bp, Homo sapiens
tcaactgtgtgatta

SEQ ID NO: 473741 - DNA, 15 bp, Homo sapiens
caactgtgtgattac

SEQ ID NO: 473742 - DNA, 15 bp, Homo sapiens
aactgtgtgattact

SEQ ID NO: 473743 - DNA, 15 bp, Homo sapiens
actgtgtgattactg

SEQ ID NO: 473744 - DNA, 15 bp, Homo sapiens
ctgtgtgattactgt

SEQ ID NO: 473745 - DNA, 15 bp, Homo sapiens
tgtgtgattactgtg

SEQ ID NO: 473746 - DNA, 15 bp, Homo sapiens
gtgtgattactgtgc

SEQ ID NO: 473747 - DNA, 15 bp, Homo sapiens
tgtgattactgtgct

SEQ ID NO: 473748 - DNA, 15 bp, Homo sapiens
gtgattactgtgctt

SEQ ID NO: 473749 - DNA, 15 bp, Homo sapiens
tgattactgtgcttg

SEQ ID NO: 473750 - DNA, 15 bp, Homo sapiens
gattactgtgcttga

SEQ ID NO: 473751 - DNA, 15 bp, Homo sapiens
attactgtgcttgat

SEQ ID NO: 473752 - DNA, 15 bp, Homo sapiens
ttactgtgcttgata

SEQ ID NO: 473753 - DNA, 15 bp, Homo sapiens
tactgtgcttgatat

SEQ ID NO: 473754 - DNA, 15 bp, Homo sapiens
actgtgcttgatatc

SEQ ID NO: 473755 - DNA, 15 bp, Homo sapiens
ctgtgcttgatatca

SEQ ID NO: 473756 - DNA, 15 bp, Homo sapiens
tgtgcttgatatcaa

SEQ ID NO: 473757 - DNA, 15 bp, Homo sapiens
gtgcttgatatcaaa

SEQ ID NO: 473758 - DNA, 15 bp, Homo sapiens
tgcttgatatcaaac

SEQ ID NO: 473759 - DNA, 15 bp, Homo sapiens
gcttgatatcaaact

SEQ ID NO: 473760 - DNA, 15 bp, Homo sapiens
cttgatatcaaactg

SEQ ID NO: 473761 - DNA, 15 bp, Homo sapiens
ttgatatcaaactgt

SEQ ID NO: 473762 - DNA, 15 bp, Homo sapiens
tgatatcaaactgtg

SEQ ID NO: 473763 - DNA, 15 bp, Homo sapiens
gatatcaaactgtgt

SEQ ID NO: 473764 - DNA, 15 bp, Homo sapiens
atatcaaactgtgta

SEQ ID NO: 473765 - DNA, 15 bp, Homo sapiens
tatcaaactgtgtac

SEQ ID NO: 473766 - DNA, 15 bp, Homo sapiens
atcaaactgtgtaca

SEQ ID NO: 473767 - DNA, 15 bp, Homo sapiens
tcaaactgtgtacac

SEQ ID NO: 473768 - DNA, 15 bp, Homo sapiens
caaactgtgtacact

SEQ ID NO: 473769 - DNA, 15 bp, Homo sapiens
aaactgtgtacactt

SEQ ID NO: 473770 - DNA, 15 bp, Homo sapiens
aactgtgtacactta

SEQ ID NO: 473771 - DNA, 15 bp, Homo sapiens
actgtgtacacttaa

SEQ ID NO: 473772 - DNA, 15 bp, Homo sapiens
ctgtgtacacttaag

SEQ ID NO: 473773 - DNA, 15 bp, Homo sapiens
tgtgtacacttaaga

SEQ ID NO: 473774 - DNA, 15 bp, Homo sapiens
gtgtacacttaagat

SEQ ID NO: 473775 - DNA, 15 bp, Homo sapiens
tgtacacttaagata

SEQ ID NO: 473776 - DNA, 15 bp, Homo sapiens
gtacacttaagatat

SEQ ID NO: 473777 - DNA, 15 bp, Homo sapiens
tacacttaagatata

SEQ ID NO: 473778 - DNA, 15 bp, Homo sapiens
acacttaagatatat

SEQ ID NO: 473779 - DNA, 15 bp, Homo sapiens
cacttaagatatatt

SEQ ID NO: 473780 - DNA, 15 bp, Homo sapiens
acttaagatatattc

SEQ ID NO: 473781 - DNA, 15 bp, Homo sapiens
cttaagatatattct

SEQ ID NO: 473782 - DNA, 15 bp, Homo sapiens
ttaagatatattctt

SEQ ID NO: 473783 - DNA, 15 bp, Homo sapiens
taagatatattcttt

SEQ ID NO: 473784 - DNA, 15 bp, Homo sapiens
aagatatattctttc

SEQ ID NO: 473785 - DNA, 15 bp, Homo sapiens
agatatattctttcc

SEQ ID NO: 473786 - DNA, 15 bp, Homo sapiens
gatatattctttcca

SEQ ID NO: 473787 - DNA, 15 bp, Homo sapiens
atatattctttccac

SEQ ID NO: 473788 - DNA, 15 bp, Homo sapiens
tatattctttccact

SEQ ID NO: 473789 - DNA, 15 bp, Homo sapiens
atattctttccactt

SEQ ID NO: 473790 - DNA, 15 bp, Homo sapiens
tattctttccacttg

SEQ ID NO: 473791 - DNA, 15 bp, Homo sapiens
attctttccacttga

SEQ ID NO: 473792 - DNA, 15 bp, Homo sapiens
ttctttccacttgat

SEQ ID NO: 473793 - DNA, 15 bp, Homo sapiens
tctttccacttgata

SEQ ID NO: 473794 - DNA, 15 bp, Homo sapiens
ctttccacttgatat

SEQ ID NO: 473795 - DNA, 15 bp, Homo sapiens
tttccacttgatatc

SEQ ID NO: 473796 - DNA, 15 bp, Homo sapiens
ttccacttgatatca

SEQ ID NO: 473797 - DNA, 15 bp, Homo sapiens
tccacttgatatcaa

SEQ ID NO: 473798 - DNA, 15 bp, Homo sapiens
ccacttgatatcaaa

SEQ ID NO: 473799 - DNA, 15 bp, Homo sapiens
cacttgatatcaaac

SEQ ID NO: 473800 - DNA, 15 bp, Homo sapiens
acttgatatcaaact

SEQ ID NO: 473801 - DNA, 15 bp, Homo sapiens
tcaaactgtgtacaa

SEQ ID NO: 473802 - DNA, 15 bp, Homo sapiens
caaactgtgtacaat

SEQ ID NO: 473803 - DNA, 15 bp, Homo sapiens
aaactgtgtacaatt

SEQ ID NO: 473804 - DNA, 15 bp, Homo sapiens
aactgtgtacaatta

SEQ ID NO: 473805 - DNA, 15 bp, Homo sapiens
actgtgtacaattaa

SEQ ID NO: 473806 - DNA, 15 bp, Homo sapiens
ctgtgtacaattaag

SEQ ID NO: 473807 - DNA, 15 bp, Homo sapiens
tgtgtacaattaaga

SEQ ID NO: 473808 - DNA, 15 bp, Homo sapiens
gtgtacaattaagat

SEQ ID NO: 473809 - DNA, 15 bp, Homo sapiens
tgtacaattaagatc

SEQ ID NO: 473810 - DNA, 15 bp, Homo sapiens
gtacaattaagatct

SEQ ID NO: 473811 - DNA, 15 bp, Homo sapiens
tacaattaagatctg

SEQ ID NO: 473812 - DNA, 15 bp, Homo sapiens
acaattaagatctgt

SEQ ID NO: 473813 - DNA, 15 bp, Homo sapiens
caattaagatctgtg

SEQ ID NO: 473814 - DNA, 15 bp, Homo sapiens
aattaagatctgtgt

SEQ ID NO: 473815 - DNA, 15 bp, Homo sapiens
attaagatctgtgtc

SEQ ID NO: 473816 - DNA, 15 bp, Homo sapiens
ttaagatctgtgtct

SEQ ID NO: 473817 - DNA, 15 bp, Homo sapiens
taagatctgtgtctt

SEQ ID NO: 473818 - DNA, 15 bp, Homo sapiens
aagatctgtgtcttt

SEQ ID NO: 473819 - DNA, 15 bp, Homo sapiens
agatctgtgtctttc

SEQ ID NO: 473820 - DNA, 15 bp, Homo sapiens
gatctgtgtctttct

SEQ ID NO: 473821 - DNA, 15 bp, Homo sapiens
atctgtgtctttcta

SEQ ID NO: 473822 - DNA, 15 bp, Homo sapiens
tctgtgtctttctaa

SEQ ID NO: 473823 - DNA, 15 bp, Homo sapiens
ctgtgtctttctaaa

SEQ ID NO: 473824 - DNA, 15 bp, Homo sapiens
tgtgtctttctaaac

SEQ ID NO: 473825 - DNA, 15 bp, Homo sapiens
gtgtctttctaaaca

SEQ ID NO: 473826 - DNA, 15 bp, Homo sapiens
tgtctttctaaacat

SEQ ID NO: 473827 - DNA, 15 bp, Homo sapiens
gtctttctaaacatt

SEQ ID NO: 473828 - DNA, 15 bp, Homo sapiens
tctttctaaacattc

SEQ ID NO: 473829 - DNA, 15 bp, Homo sapiens
ctttctaaacattct

SEQ ID NO: 473830 - DNA, 15 bp, Homo sapiens
tttctaaacattctt

SEQ ID NO: 473831 - DNA, 15 bp, Homo sapiens
ttctaaacattcttt

SEQ ID NO: 473832 - DNA, 15 bp, Homo sapiens
tctaaacattctttt

SEQ ID NO: 473833 - DNA, 15 bp, Homo sapiens
ctaaacattcttttg

SEQ ID NO: 473834 - DNA, 15 bp, Homo sapiens
taaacattcttttgc

SEQ ID NO: 473835 - DNA, 15 bp, Homo sapiens
aaacattcttttgca

SEQ ID NO: 473836 - DNA, 15 bp, Homo sapiens
aacattcttttgcat

SEQ ID NO: 473837 - DNA, 15 bp, Homo sapiens
acattcttttgcata

SEQ ID NO: 473838 - DNA, 15 bp, Homo sapiens
cattcttttgcatag

SEQ ID NO: 473839 - DNA, 15 bp, Homo sapiens
attcttttgcatagt

SEQ ID NO: 473840 - DNA, 15 bp, Homo sapiens
ttcttttgcatagta

SEQ ID NO: 473841 - DNA, 15 bp, Homo sapiens
tcttttgcatagtac

SEQ ID NO: 473842 - DNA, 15 bp, Homo sapiens
cttttgcatagtaca

SEQ ID NO: 473843 - DNA, 15 bp, Homo sapiens
ttttgcatagtacaa

SEQ ID NO: 473844 - DNA, 15 bp, Homo sapiens
tttgcatagtacaat

SEQ ID NO: 473845 - DNA, 15 bp, Homo sapiens
ttgcatagtacaatt

SEQ ID NO: 473846 - DNA, 15 bp, Homo sapiens
tgcatagtacaattt

SEQ ID NO: 473847 - DNA, 15 bp, Homo sapiens
gcatagtacaattta

SEQ ID NO: 473848 - DNA, 15 bp, Homo sapiens
catagtacaatttag

SEQ ID NO: 473849 - DNA, 15 bp, Homo sapiens
atagtacaatttaga

SEQ ID NO: 473850 - DNA, 15 bp, Homo sapiens
tagtacaatttagaa

SEQ ID NO: 473851 - DNA, 15 bp, Homo sapiens
agtacaatttagaaa

SEQ ID NO: 473852 - DNA, 15 bp, Homo sapiens
gtacaatttagaaaa

SEQ ID NO: 473853 - DNA, 15 bp, Homo sapiens
tacaatttagaaaaa

SEQ ID NO: 473854 - DNA, 15 bp, Homo sapiens
acaatttagaaaaag

SEQ ID NO: 473855 - DNA, 15 bp, Homo sapiens
caatttagaaaaagt

SEQ ID NO: 473856 - DNA, 15 bp, Homo sapiens
aatttagaaaaagtt

SEQ ID NO: 473857 - DNA, 15 bp, Homo sapiens
atttagaaaaagttt

SEQ ID NO: 473858 - DNA, 15 bp, Homo sapiens
tttagaaaaagtttt

SEQ ID NO: 473859 - DNA, 15 bp, Homo sapiens
ttagaaaaagtttta

SEQ ID NO: 473860 - DNA, 15 bp, Homo sapiens
tagaaaaagttttaa

SEQ ID NO: 473861 - DNA, 15 bp, Homo sapiens
agaaaaagttttaat

SEQ ID NO: 473862 - DNA, 15 bp, Homo sapiens
gaaaaagttttaata

SEQ ID NO: 473863 - DNA, 15 bp, Homo sapiens
aaaaagttttaataa

SEQ ID NO: 473864 - DNA, 15 bp, Homo sapiens
aaaagttttaataaa

SEQ ID NO: 473865 - DNA, 15 bp, Homo sapiens
aaagttttaataaag

SEQ ID NO: 473866 - DNA, 15 bp, Homo sapiens
aagttttaataaagc

SEQ ID NO: 473867 - DNA, 15 bp, Homo sapiens
agttttaataaagca

SEQ ID NO: 473868 - DNA, 15 bp, Homo sapiens
gttttaataaagcaa

SEQ ID NO: 473869 - DNA, 15 bp, Homo sapiens
ttttaataaagcaat

SEQ ID NO: 473870 - DNA, 15 bp, Homo sapiens
tttaataaagcaatt

SEQ ID NO: 473871 - DNA, 15 bp, Homo sapiens
ttaataaagcaattt

SEQ ID NO: 473872 - DNA, 15 bp, Homo sapiens
taataaagcaatttc

SEQ ID NO: 473873 - DNA, 15 bp, Homo sapiens
aataaagcaatttca

SEQ ID NO: 473874 - DNA, 15 bp, Homo sapiens
ataaagcaatttcaa

SEQ ID NO: 473875 - DNA, 15 bp, Homo sapiens
taaagcaatttcaat

SEQ ID NO: 473876 - DNA, 15 bp, Homo sapiens
aaagcaatttcaatt

SEQ ID NO: 473877 - DNA, 15 bp, Homo sapiens
aagcaatttcaattg

SEQ ID NO: 473878 - DNA, 15 bp, Homo sapiens
agcaatttcaattga

SEQ ID NO: 473879 - DNA, 15 bp, Homo sapiens
gcaatttcaattgaa

SEQ ID NO: 473880 - DNA, 15 bp, Homo sapiens
caatttcaattgaaa

SEQ ID NO: 473881 - DNA, 15 bp, Homo sapiens
aatttcaattgaaag

SEQ ID NO: 473882 - DNA, 15 bp, Homo sapiens
atttcaattgaaaga

SEQ ID NO: 473883 - DNA, 15 bp, Homo sapiens
tttcaattgaaagag

SEQ ID NO: 473884 - DNA, 15 bp, Homo sapiens
ttcaattgaaagaga

SEQ ID NO: 473885 - DNA, 15 bp, Homo sapiens
tcaattgaaagagag

SEQ ID NO: 473886 - DNA, 15 bp, Homo sapiens
caattgaaagagagc

SEQ ID NO: 473887 - DNA, 15 bp, Homo sapiens
aattgaaagagagct

SEQ ID NO: 473888 - DNA, 15 bp, Homo sapiens
attgaaagagagctg

SEQ ID NO: 473889 - DNA, 15 bp, Homo sapiens
ttgaaagagagctgt

SEQ ID NO: 473890 - DNA, 15 bp, Homo sapiens
tgaaagagagctgtt

SEQ ID NO: 473891 - DNA, 15 bp, Homo sapiens
gaaagagagctgttc

SEQ ID NO: 473892 - DNA, 15 bp, Homo sapiens
aaagagagctgttcg

SEQ ID NO: 473893 - DNA, 15 bp, Homo sapiens
aagagagctgttcga

SEQ ID NO: 473894 - DNA, 15 bp, Homo sapiens
agagagctgttcgaa

SEQ ID NO: 473895 - DNA, 15 bp, Homo sapiens
gagagctgttcgaat

SEQ ID NO: 473896 - DNA, 15 bp, Homo sapiens
agagctgttcgaata

SEQ ID NO: 473897 - DNA, 15 bp, Homo sapiens
gagctgttcgaatac

SEQ ID NO: 473898 - DNA, 15 bp, Homo sapiens
agctgttcgaataca

SEQ ID NO: 473899 - DNA, 15 bp, Homo sapiens
gctgttcgaatacat

SEQ ID NO: 473900 - DNA, 15 bp, Homo sapiens
ctgttcgaatacatt

SEQ ID NO: 473901 - DNA, 15 bp, Homo sapiens
tgttcgaatacattc

SEQ ID NO: 473902 - DNA, 15 bp, Homo sapiens
gttcgaatacattca

SEQ ID NO: 473903 - DNA, 15 bp, Homo sapiens
ttcgaatacattcag

SEQ ID NO: 473904 - DNA, 15 bp, Homo sapiens
tcgaatacattcagg

SEQ ID NO: 473905 - DNA, 15 bp, Homo sapiens
cgaatacattcagga

SEQ ID NO: 473906 - DNA, 15 bp, Homo sapiens
gaatacattcaggaa

SEQ ID NO: 473907 - DNA, 15 bp, Homo sapiens
aatacattcaggaac

SEQ ID NO: 473908 - DNA, 15 bp, Homo sapiens
atacattcaggaaca

SEQ ID NO: 473909 - DNA, 15 bp, Homo sapiens
tacattcaggaacag

SEQ ID NO: 473910 - DNA, 15 bp, Homo sapiens
acattcaggaacagt

SEQ ID NO: 473911 - DNA, 15 bp, Homo sapiens
cattcaggaacagta

SEQ ID NO: 473912 - DNA, 15 bp, Homo sapiens
attcaggaacagtag

SEQ ID NO: 473913 - DNA, 15 bp, Homo sapiens
ttcaggaacagtaga

SEQ ID NO: 473914 - DNA, 15 bp, Homo sapiens
tcaggaacagtagac

SEQ ID NO: 473915 - DNA, 15 bp, Homo sapiens
caggaacagtagact

SEQ ID NO: 473916 - DNA, 15 bp, Homo sapiens
aggaacagtagactt

SEQ ID NO: 473917 - DNA, 15 bp, Homo sapiens
ggaacagtagacttt

SEQ ID NO: 473918 - DNA, 15 bp, Homo sapiens
gaacagtagactttt

SEQ ID NO: 473919 - DNA, 15 bp, Homo sapiens
aacagtagacttttg

SEQ ID NO: 473920 - DNA, 15 bp, Homo sapiens
acagtagacttttgg

SEQ ID NO: 473921 - DNA, 15 bp, Homo sapiens
cagtagacttttggt

SEQ ID NO: 473922 - DNA, 15 bp, Homo sapiens
agtagacttttggtc

SEQ ID NO: 473923 - DNA, 15 bp, Homo sapiens
gtagacttttggtcc

SEQ ID NO: 473924 - DNA, 15 bp, Homo sapiens
tagacttttggtcct

SEQ ID NO: 473925 - DNA, 15 bp, Homo sapiens
agacttttggtcctc

SEQ ID NO: 473926 - DNA, 15 bp, Homo sapiens
gacttttggtcctct

SEQ ID NO: 473927 - DNA, 15 bp, Homo sapiens
acttttggtcctctt

SEQ ID NO: 473928 - DNA, 15 bp, Homo sapiens
cttttggtcctcttt

SEQ ID NO: 473929 - DNA, 15 bp, Homo sapiens
ttttggtcctctttt

SEQ ID NO: 473930 - DNA, 15 bp, Homo sapiens
tttggtcctcttttt

SEQ ID NO: 473931 - DNA, 15 bp, Homo sapiens
ttggtcctctttttg

SEQ ID NO: 473932 - DNA, 15 bp, Homo sapiens
tggtcctctttttga

SEQ ID NO: 473933 - DNA, 15 bp, Homo sapiens
ggtcctctttttgat

SEQ ID NO: 473934 - DNA, 15 bp, Homo sapiens
gtcctctttttgatt

SEQ ID NO: 473935 - DNA, 15 bp, Homo sapiens
tcctctttttgattt

SEQ ID NO: 473936 - DNA, 15 bp, Homo sapiens
cctctttttgatttg

SEQ ID NO: 473937 - DNA, 15 bp, Homo sapiens
ctctttttgatttgt

SEQ ID NO: 473938 - DNA, 15 bp, Homo sapiens
tctttttgatttgtg

SEQ ID NO: 473939 - DNA, 15 bp, Homo sapiens
ctttttgatttgtgg

SEQ ID NO: 473940 - DNA, 15 bp, Homo sapiens
tttttgatttgtggg

SEQ ID NO: 473941 - DNA, 15 bp, Homo sapiens
ttttgatttgtgggt

SEQ ID NO: 473942 - DNA, 15 bp, Homo sapiens
tttgatttgtgggta

SEQ ID NO: 473943 - DNA, 15 bp, Homo sapiens
ttgatttgtgggtat

SEQ ID NO: 473944 - DNA, 15 bp, Homo sapiens
tgatttgtgggtatg

SEQ ID NO: 473945 - DNA, 15 bp, Homo sapiens
gatttgtgggtatgc

SEQ ID NO: 473946 - DNA, 15 bp, Homo sapiens
atttgtgggtatgct

SEQ ID NO: 473947 - DNA, 15 bp, Homo sapiens
tttgtgggtatgctt

SEQ ID NO: 473948 - DNA, 15 bp, Homo sapiens
ttgtgggtatgcttt

SEQ ID NO: 473949 - DNA, 15 bp, Homo sapiens
tgtgggtatgctttt

SEQ ID NO: 473950 - DNA, 15 bp, Homo sapiens
gtgggtatgcttttg

SEQ ID NO: 473951 - DNA, 15 bp, Homo sapiens
tgggtatgcttttgt

SEQ ID NO: 473952 - DNA, 15 bp, Homo sapiens
gggtatgcttttgtc

SEQ ID NO: 473953 - DNA, 15 bp, Homo sapiens
ggtatgcttttgtcc

SEQ ID NO: 473954 - DNA, 15 bp, Homo sapiens
gtatgcttttgtcct

SEQ ID NO: 473955 - DNA, 15 bp, Homo sapiens
tatgcttttgtcctt

SEQ ID NO: 473956 - DNA, 15 bp, Homo sapiens
atgcttttgtccttt

SEQ ID NO: 473957 - DNA, 15 bp, Homo sapiens
tgcttttgtcctttc

SEQ ID NO: 473958 - DNA, 15 bp, Homo sapiens
gcttttgtcctttcc

SEQ ID NO: 473959 - DNA, 15 bp, Homo sapiens
cttttgtcctttcct

SEQ ID NO: 473960 - DNA, 15 bp, Homo sapiens
ttttgtcctttcctt

SEQ ID NO: 473961 - DNA, 15 bp, Homo sapiens
tttgtcctttccttc

SEQ ID NO: 473962 - DNA, 15 bp, Homo sapiens
ttgtcctttccttca

SEQ ID NO: 473963 - DNA, 15 bp, Homo sapiens
tgtcctttccttcaa

SEQ ID NO: 473964 - DNA, 15 bp, Homo sapiens
gtcctttccttcaaa

SEQ ID NO: 473965 - DNA, 15 bp, Homo sapiens
tcctttccttcaaaa

SEQ ID NO: 473966 - DNA, 15 bp, Homo sapiens
cctttccttcaaaag

SEQ ID NO: 473967 - DNA, 15 bp, Homo sapiens
ctttccttcaaaagg

SEQ ID NO: 473968 - DNA, 15 bp, Homo sapiens
tttccttcaaaaggt

SEQ ID NO: 473969 - DNA, 15 bp, Homo sapiens
ttccttcaaaaggtt

SEQ ID NO: 473970 - DNA, 15 bp, Homo sapiens
tccttcaaaaggttg

SEQ ID NO: 473971 - DNA, 15 bp, Homo sapiens
ccttcaaaaggttgt

SEQ ID NO: 473972 - DNA, 15 bp, Homo sapiens
cttcaaaaggttgtg

SEQ ID NO: 473973 - DNA, 15 bp, Homo sapiens
ttcaaaaggttgtgt

SEQ ID NO: 473974 - DNA, 15 bp, Homo sapiens
tcaaaaggttgtgtg

SEQ ID NO: 473975 - DNA, 15 bp, Homo sapiens
caaaaggttgtgtga

SEQ ID NO: 473976 - DNA, 15 bp, Homo sapiens
aaaaggttgtgtgat

SEQ ID NO: 473977 - DNA, 15 bp, Homo sapiens
aaaggttgtgtgata

SEQ ID NO: 473978 - DNA, 15 bp, Homo sapiens
aaggttgtgtgataa

SEQ ID NO: 473979 - DNA, 15 bp, Homo sapiens
aggttgtgtgataat

SEQ ID NO: 473980 - DNA, 15 bp, Homo sapiens
ggttgtgtgataata

SEQ ID NO: 473981 - DNA, 15 bp, Homo sapiens
gttgtgtgataatag

SEQ ID NO: 473982 - DNA, 15 bp, Homo sapiens
ttgtgtgataataga

SEQ ID NO: 473983 - DNA, 15 bp, Homo sapiens
tgtgtgataatagat

SEQ ID NO: 473984 - DNA, 15 bp, Homo sapiens
gtgtgataatagatt

SEQ ID NO: 473985 - DNA, 15 bp, Homo sapiens
tgtgataatagattc

SEQ ID NO: 473986 - DNA, 15 bp, Homo sapiens
gtgataatagattct

SEQ ID NO: 473987 - DNA, 15 bp, Homo sapiens
tgataatagattctt

SEQ ID NO: 473988 - DNA, 15 bp, Homo sapiens
gataatagattctta

SEQ ID NO: 473989 - DNA, 15 bp, Homo sapiens
ataatagattcttat

SEQ ID NO: 473990 - DNA, 15 bp, Homo sapiens
taatagattcttatt

SEQ ID NO: 473991 - DNA, 15 bp, Homo sapiens
aatagattcttattt

SEQ ID NO: 473992 - DNA, 15 bp, Homo sapiens
atagattcttatttg

SEQ ID NO: 473993 - DNA, 15 bp, Homo sapiens
tagattcttatttgt

SEQ ID NO: 473994 - DNA, 15 bp, Homo sapiens
agattcttatttgtc

SEQ ID NO: 473995 - DNA, 15 bp, Homo sapiens
gattcttatttgtct

SEQ ID NO: 473996 - DNA, 15 bp, Homo sapiens
attcttatttgtctt

SEQ ID NO: 473997 - DNA, 15 bp, Homo sapiens
ttcttatttgtctta

SEQ ID NO: 473998 - DNA, 15 bp, Homo sapiens
tcttatttgtcttag

SEQ ID NO: 473999 - DNA, 15 bp, Homo sapiens
cttatttgtcttagt

SEQ ID NO: 474000 - DNA, 15 bp, Homo sapiens
ttatttgtcttagta

SEQ ID NO: 474001 - DNA, 15 bp, Homo sapiens
tatttgtcttagtat

SEQ ID NO: 474002 - DNA, 15 bp, Homo sapiens
atttgtcttagtatc

SEQ ID NO: 474003 - DNA, 15 bp, Homo sapiens
tttgtcttagtatct

SEQ ID NO: 474004 - DNA, 15 bp, Homo sapiens
ttgtcttagtatcta

SEQ ID NO: 474005 - DNA, 15 bp, Homo sapiens
tgtcttagtatctaa

SEQ ID NO: 474006 - DNA, 15 bp, Homo sapiens
gtcttagtatctaat

SEQ ID NO: 474007 - DNA, 15 bp, Homo sapiens
tcttagtatctaata

SEQ ID NO: 474008 - DNA, 15 bp, Homo sapiens
cttagtatctaatat

SEQ ID NO: 474009 - DNA, 15 bp, Homo sapiens
ttagtatctaatata

SEQ ID NO: 474010 - DNA, 15 bp, Homo sapiens
tagtatctaatatat

SEQ ID NO: 474011 - DNA, 15 bp, Homo sapiens
agtatctaatatatg

SEQ ID NO: 474012 - DNA, 15 bp, Homo sapiens
gtatctaatatatgt

SEQ ID NO: 474013 - DNA, 15 bp, Homo sapiens
tatctaatatatgtt

SEQ ID NO: 474014 - DNA, 15 bp, Homo sapiens
atctaatatatgttt

SEQ ID NO: 474015 - DNA, 15 bp, Homo sapiens
tctaatatatgttta

SEQ ID NO: 474016 - DNA, 15 bp, Homo sapiens
ctaatatatgtttaa

SEQ ID NO: 474017 - DNA, 15 bp, Homo sapiens
taatatatgtttaac

SEQ ID NO: 474018 - DNA, 15 bp, Homo sapiens
aatatatgtttaact

SEQ ID NO: 474019 - DNA, 15 bp, Homo sapiens
atatatgtttaactg

SEQ ID NO: 474020 - DNA, 15 bp, Homo sapiens
tatatgtttaactgt

SEQ ID NO: 474021 - DNA, 15 bp, Homo sapiens
atatgtttaactgtg

SEQ ID NO: 474022 - DNA, 15 bp, Homo sapiens
tatgtttaactgtgc

SEQ ID NO: 474023 - DNA, 15 bp, Homo sapiens
atgtttaactgtgct

SEQ ID NO: 474024 - DNA, 15 bp, Homo sapiens
tgtttaactgtgctg

SEQ ID NO: 474025 - DNA, 15 bp, Homo sapiens
gtttaactgtgctga

SEQ ID NO: 474026 - DNA, 15 bp, Homo sapiens
tttaactgtgctgat

SEQ ID NO: 474027 - DNA, 15 bp, Homo sapiens
ttaactgtgctgatg

SEQ ID NO: 474028 - DNA, 15 bp, Homo sapiens
taactgtgctgatgc

SEQ ID NO: 474029 - DNA, 15 bp, Homo sapiens
aactgtgctgatgcc

SEQ ID NO: 474030 - DNA, 15 bp, Homo sapiens
actgtgctgatgcct

SEQ ID NO: 474031 - DNA, 15 bp, Homo sapiens
ctgtgctgatgcctt

SEQ ID NO: 474032 - DNA, 15 bp, Homo sapiens
tgtgctgatgcctta

SEQ ID NO: 474033 - DNA, 15 bp, Homo sapiens
gtgctgatgccttag

SEQ ID NO: 474034 - DNA, 15 bp, Homo sapiens
tgctgatgccttagg

SEQ ID NO: 474035 - DNA, 15 bp, Homo sapiens
gctgatgccttagga

SEQ ID NO: 474036 - DNA, 15 bp, Homo sapiens
ctgatgccttaggat

SEQ ID NO: 474037 - DNA, 15 bp, Homo sapiens
tgatgccttaggata

SEQ ID NO: 474038 - DNA, 15 bp, Homo sapiens
gatgccttaggataa

SEQ ID NO: 474039 - DNA, 15 bp, Homo sapiens
atgccttaggataaa

SEQ ID NO: 474040 - DNA, 15 bp, Homo sapiens
tgccttaggataaag

SEQ ID NO: 474041 - DNA, 15 bp, Homo sapiens
gccttaggataaaga

SEQ ID NO: 474042 - DNA, 15 bp, Homo sapiens
ccttaggataaagac

SEQ ID NO: 474043 - DNA, 15 bp, Homo sapiens
cttaggataaagaca

SEQ ID NO: 474044 - DNA, 15 bp, Homo sapiens
ttaggataaagacaa

SEQ ID NO: 474045 - DNA, 15 bp, Homo sapiens
taggataaagacaaa

SEQ ID NO: 474046 - DNA, 15 bp, Homo sapiens
aggataaagacaaaa

SEQ ID NO: 474047 - DNA, 15 bp, Homo sapiens
ggataaagacaaaat

SEQ ID NO: 474048 - DNA, 15 bp, Homo sapiens
gataaagacaaaatt

SEQ ID NO: 474049 - DNA, 15 bp, Homo sapiens
ataaagacaaaattg

SEQ ID NO: 474050 - DNA, 15 bp, Homo sapiens
taaagacaaaattgt

SEQ ID NO: 474051 - DNA, 15 bp, Homo sapiens
aaagacaaaattgta

SEQ ID NO: 474052 - DNA, 15 bp, Homo sapiens
aagacaaaattgtac

SEQ ID NO: 474053 - DNA, 15 bp, Homo sapiens
agacaaaattgtact

SEQ ID NO: 474054 - DNA, 15 bp, Homo sapiens
gacaaaattgtactt

SEQ ID NO: 474055 - DNA, 15 bp, Homo sapiens
acaaaattgtacttt

SEQ ID NO: 474056 - DNA, 15 bp, Homo sapiens
caaaattgtactttt

SEQ ID NO: 474057 - DNA, 15 bp, Homo sapiens
aaaattgtacttttt

SEQ ID NO: 474058 - DNA, 15 bp, Homo sapiens
aaattgtactttttt

SEQ ID NO: 474059 - DNA, 15 bp, Homo sapiens
aattgtacttttttt

SEQ ID NO: 474060 - DNA, 15 bp, Homo sapiens
attgtactttttttg

SEQ ID NO: 474061 - DNA, 15 bp, Homo sapiens
ttgtactttttttgt

SEQ ID NO: 474062 - DNA, 15 bp, Homo sapiens
tgtactttttttgta

SEQ ID NO: 474063 - DNA, 15 bp, Homo sapiens
gtactttttttgtat

SEQ ID NO: 474064 - DNA, 15 bp, Homo sapiens
tactttttttgtatc

SEQ ID NO: 474065 - DNA, 15 bp, Homo sapiens
actttttttgtatcc

SEQ ID NO: 474066 - DNA, 15 bp, Homo sapiens
ctttttttgtatccc

SEQ ID NO: 474067 - DNA, 15 bp, Homo sapiens
tttttttgtatccca

SEQ ID NO: 474068 - DNA, 15 bp, Homo sapiens
ttttttgtatcccat

SEQ ID NO: 474069 - DNA, 15 bp, Homo sapiens
tttttgtatcccatc

SEQ ID NO: 474070 - DNA, 15 bp, Homo sapiens
ttttgtatcccatcc

SEQ ID NO: 474071 - DNA, 15 bp, Homo sapiens
tttgtatcccatcca

SEQ ID NO: 474072 - DNA, 15 bp, Homo sapiens
ttgtatcccatccag

SEQ ID NO: 474073 - DNA, 15 bp, Homo sapiens
tgtatcccatccagt

SEQ ID NO: 474074 - DNA, 15 bp, Homo sapiens
gtatcccatccagtt

SEQ ID NO: 474075 - DNA, 15 bp, Homo sapiens
atcccatccagttaa

SEQ ID NO: 474076 - DNA, 15 bp, Homo sapiens
tcccatccagttaac

SEQ ID NO: 474077 - DNA, 15 bp, Homo sapiens
cccatccagttaacc

SEQ ID NO: 474078 - DNA, 15 bp, Homo sapiens
ccatccagttaacct

SEQ ID NO: 474079 - DNA, 15 bp, Homo sapiens
catccagttaacctt

SEQ ID NO: 474080 - DNA, 15 bp, Homo sapiens
atccagttaaccttt

SEQ ID NO: 474081 - DNA, 15 bp, Homo sapiens
tccagttaacctttg

SEQ ID NO: 474082 - DNA, 15 bp, Homo sapiens
ccagttaacctttgg

SEQ ID NO: 474083 - DNA, 15 bp, Homo sapiens
cagttaacctttgga

SEQ ID NO: 474084 - DNA, 15 bp, Homo sapiens
agttaacctttggaa

SEQ ID NO: 474085 - DNA, 15 bp, Homo sapiens
gttaacctttggaat

SEQ ID NO: 474086 - DNA, 15 bp, Homo sapiens
ttaacctttggaatg

SEQ ID NO: 474087 - DNA, 15 bp, Homo sapiens
taacctttggaatgg

SEQ ID NO: 474088 - DNA, 15 bp, Homo sapiens
aacctttggaatgga

SEQ ID NO: 474089 - DNA, 15 bp, Homo sapiens
acctttggaatggat

SEQ ID NO: 474090 - DNA, 15 bp, Homo sapiens
cctttggaatggata

SEQ ID NO: 474091 - DNA, 15 bp, Homo sapiens
ctttggaatggataa

SEQ ID NO: 474092 - DNA, 15 bp, Homo sapiens
tttggaatggataat

SEQ ID NO: 474093 - DNA, 15 bp, Homo sapiens
ttggaatggataatt

SEQ ID NO: 474094 - DNA, 15 bp, Homo sapiens
tggaatggataattc

SEQ ID NO: 474095 - DNA, 15 bp, Homo sapiens
ggaatggataattct

SEQ ID NO: 474096 - DNA, 15 bp, Homo sapiens
gaatggataattctg

SEQ ID NO: 474097 - DNA, 15 bp, Homo sapiens
aatggataattctga

SEQ ID NO: 474098 - DNA, 15 bp, Homo sapiens
atggataattctgag

SEQ ID NO: 474099 - DNA, 15 bp, Homo sapiens
tggataattctgagg

SEQ ID NO: 474100 - DNA, 15 bp, Homo sapiens
ggataattctgaggc

SEQ ID NO: 474101 - DNA, 15 bp, Homo sapiens
gataattctgaggca

SEQ ID NO: 474102 - DNA, 15 bp, Homo sapiens
ataattctgaggcac

SEQ ID NO: 474103 - DNA, 15 bp, Homo sapiens
attctgaggcacaga

SEQ ID NO: 474104 - DNA, 15 bp, Homo sapiens
ttctgaggcacagaa

SEQ ID NO: 474105 - DNA, 15 bp, Homo sapiens
tctgaggcacagaat

SEQ ID NO: 474106 - DNA, 15 bp, Homo sapiens
ctgaggcacagaatt

SEQ ID NO: 474107 - DNA, 15 bp, Homo sapiens
tgaggcacagaatta

SEQ ID NO: 474108 - DNA, 15 bp, Homo sapiens
gaggcacagaattat

SEQ ID NO: 474109 - DNA, 15 bp, Homo sapiens
aggcacagaattatt

SEQ ID NO: 474110 - DNA, 15 bp, Homo sapiens
ggcacagaattatta

SEQ ID NO: 474111 - DNA, 15 bp, Homo sapiens
gcacagaattattac

SEQ ID NO: 474112 - DNA, 15 bp, Homo sapiens
cacagaattattact

SEQ ID NO: 474113 - DNA, 15 bp, Homo sapiens
acagaattattactt

SEQ ID NO: 474114 - DNA, 15 bp, Homo sapiens
cagaattattacttg

SEQ ID NO: 474115 - DNA, 15 bp, Homo sapiens
agaattattacttgg

SEQ ID NO: 474116 - DNA, 15 bp, Homo sapiens
gaattattacttggt

SEQ ID NO: 474117 - DNA, 15 bp, Homo sapiens
aattattacttggtg

SEQ ID NO: 474118 - DNA, 15 bp, Homo sapiens
attattacttggtgc

SEQ ID NO: 474119 - DNA, 15 bp, Homo sapiens
ttattacttggtgct

SEQ ID NO: 474120 - DNA, 15 bp, Homo sapiens
tattacttggtgctt

SEQ ID NO: 474121 - DNA, 15 bp, Homo sapiens
attacttggtgcttt

SEQ ID NO: 474122 - DNA, 15 bp, Homo sapiens
ttacttggtgcttta

SEQ ID NO: 474123 - DNA, 15 bp, Homo sapiens
tacttggtgctttaa

SEQ ID NO: 474124 - DNA, 15 bp, Homo sapiens
acttggtgctttaat

SEQ ID NO: 474125 - DNA, 15 bp, Homo sapiens
cttggtgctttaatt

SEQ ID NO: 474126 - DNA, 15 bp, Homo sapiens
ttggtgctttaattt

SEQ ID NO: 474127 - DNA, 15 bp, Homo sapiens
tggtgctttaattta

SEQ ID NO: 474128 - DNA, 15 bp, Homo sapiens
ggtgctttaatttac

SEQ ID NO: 474129 - DNA, 15 bp, Homo sapiens
gtgctttaatttacg

SEQ ID NO: 474130 - DNA, 15 bp, Homo sapiens
tgctttaatttacgg

SEQ ID NO: 474131 - DNA, 15 bp, Homo sapiens
gctttaatttacggg

SEQ ID NO: 474132 - DNA, 15 bp, Homo sapiens
ctttaatttacggga

SEQ ID NO: 474133 - DNA, 15 bp, Homo sapiens
tttaatttacgggat

SEQ ID NO: 474134 - DNA, 15 bp, Homo sapiens
ttaatttacgggata

SEQ ID NO: 474135 - DNA, 15 bp, Homo sapiens
taatttacgggataa

SEQ ID NO: 474136 - DNA, 15 bp, Homo sapiens
aatttacgggataat

SEQ ID NO: 474137 - DNA, 15 bp, Homo sapiens
atttacgggataatt

SEQ ID NO: 474138 - DNA, 15 bp, Homo sapiens
tttacgggataattt

SEQ ID NO: 474139 - DNA, 15 bp, Homo sapiens
ttacgggataatttg

SEQ ID NO: 474140 - DNA, 15 bp, Homo sapiens
tacgggataatttga

SEQ ID NO: 474141 - DNA, 15 bp, Homo sapiens
acgggataatttgat

SEQ ID NO: 474142 - DNA, 15 bp, Homo sapiens
cgggataatttgata

SEQ ID NO: 474143 - DNA, 15 bp, Homo sapiens
gggataatttgatag

SEQ ID NO: 474144 - DNA, 15 bp, Homo sapiens
ggataatttgatagg

SEQ ID NO: 474145 - DNA, 15 bp, Homo sapiens
gataatttgataggt

SEQ ID NO: 474146 - DNA, 15 bp, Homo sapiens
ataatttgataggtt

SEQ ID NO: 474147 - DNA, 15 bp, Homo sapiens
taatttgataggttt

SEQ ID NO: 474148 - DNA, 15 bp, Homo sapiens
aatttgataggtttg

SEQ ID NO: 474149 - DNA, 15 bp, Homo sapiens
atttgataggtttga

SEQ ID NO: 474150 - DNA, 15 bp, Homo sapiens
tttgataggtttgaa

SEQ ID NO: 474151 - DNA, 15 bp, Homo sapiens
ttgataggtttgaac

SEQ ID NO: 474152 - DNA, 15 bp, Homo sapiens
tgataggtttgaact

SEQ ID NO: 474153 - DNA, 15 bp, Homo sapiens
gataggtttgaacta

SEQ ID NO: 474154 - DNA, 15 bp, Homo sapiens
ataggtttgaactaa

SEQ ID NO: 474155 - DNA, 15 bp, Homo sapiens
taggtttgaactaag

SEQ ID NO: 474156 - DNA, 15 bp, Homo sapiens
aggtttgaactaagc

SEQ ID NO: 474157 - DNA, 15 bp, Homo sapiens
ggtttgaactaagcg

SEQ ID NO: 474158 - DNA, 15 bp, Homo sapiens
gtttgaactaagcga

SEQ ID NO: 474159 - DNA, 15 bp, Homo sapiens
tttgaactaagcgat

SEQ ID NO: 474160 - DNA, 15 bp, Homo sapiens
ttgaactaagcgatg

SEQ ID NO: 474161 - DNA, 15 bp, Homo sapiens
tgaactaagcgatgt

SEQ ID NO: 474162 - DNA, 15 bp, Homo sapiens
gaactaagcgatgtg

SEQ ID NO: 474163 - DNA, 15 bp, Homo sapiens
aactaagcgatgtgc

SEQ ID NO: 474164 - DNA, 15 bp, Homo sapiens
actaagcgatgtgcc

SEQ ID NO: 474165 - DNA, 15 bp, Homo sapiens
ctaagcgatgtgcct

SEQ ID NO: 474166 - DNA, 15 bp, Homo sapiens
taagcgatgtgcctt

SEQ ID NO: 474167 - DNA, 15 bp, Homo sapiens
aagcgatgtgccttt

SEQ ID NO: 474168 - DNA, 15 bp, Homo sapiens
agcgatgtgcctttt

SEQ ID NO: 474169 - DNA, 15 bp, Homo sapiens
gcgatgtgcctttta

SEQ ID NO: 474170 - DNA, 15 bp, Homo sapiens
cgatgtgccttttaa

SEQ ID NO: 474171 - DNA, 15 bp, Homo sapiens
gatgtgccttttaat

SEQ ID NO: 474172 - DNA, 15 bp, Homo sapiens
atgtgccttttaatc

SEQ ID NO: 474173 - DNA, 15 bp, Homo sapiens
tgtgccttttaatct

SEQ ID NO: 474174 - DNA, 15 bp, Homo sapiens
gtgccttttaatctt

SEQ ID NO: 474175 - DNA, 15 bp, Homo sapiens
tgccttttaatcttt

SEQ ID NO: 474176 - DNA, 15 bp, Homo sapiens
gccttttaatctttt

SEQ ID NO: 474177 - DNA, 15 bp, Homo sapiens
ccttttaatcttttg

SEQ ID NO: 474178 - DNA, 15 bp, Homo sapiens
cttttaatcttttgc

SEQ ID NO: 474179 - DNA, 15 bp, Homo sapiens
ttttaatcttttgct

SEQ ID NO: 474180 - DNA, 15 bp, Homo sapiens
tttaatcttttgcta

SEQ ID NO: 474181 - DNA, 15 bp, Homo sapiens
ttaatcttttgctaa

SEQ ID NO: 474182 - DNA, 15 bp, Homo sapiens
taatcttttgctaaa

SEQ ID NO: 474183 - DNA, 15 bp, Homo sapiens
aatcttttgctaaac

SEQ ID NO: 474184 - DNA, 15 bp, Homo sapiens
atcttttgctaaacc

SEQ ID NO: 474185 - DNA, 15 bp, Homo sapiens
tcttttgctaaacca

SEQ ID NO: 474186 - DNA, 15 bp, Homo sapiens
cttttgctaaaccat

SEQ ID NO: 474187 - DNA, 15 bp, Homo sapiens
ttttgctaaaccatt

SEQ ID NO: 474188 - DNA, 15 bp, Homo sapiens
tttgctaaaccattg

SEQ ID NO: 474189 - DNA, 15 bp, Homo sapiens
ttgctaaaccattgg

SEQ ID NO: 474190 - DNA, 15 bp, Homo sapiens
tgctaaaccattggc

SEQ ID NO: 474191 - DNA, 15 bp, Homo sapiens
gctaaaccattggca

SEQ ID NO: 474192 - DNA, 15 bp, Homo sapiens
ctaaaccattggcat

SEQ ID NO: 474193 - DNA, 15 bp, Homo sapiens
taaaccattggcatt

SEQ ID NO: 474194 - DNA, 15 bp, Homo sapiens
aaaccattggcattt

SEQ ID NO: 474195 - DNA, 15 bp, Homo sapiens
aaccattggcatttt

SEQ ID NO: 474196 - DNA, 15 bp, Homo sapiens
accattggcattttg

SEQ ID NO: 474197 - DNA, 15 bp, Homo sapiens
ccattggcattttgc

SEQ ID NO: 474198 - DNA, 15 bp, Homo sapiens
cattggcattttgca

SEQ ID NO: 474199 - DNA, 15 bp, Homo sapiens
attggcattttgcat

SEQ ID NO: 474200 - DNA, 15 bp, Homo sapiens
ttggcattttgcatc

SEQ ID NO: 474201 - DNA, 15 bp, Homo sapiens
tggcattttgcatca

SEQ ID NO: 474202 - DNA, 15 bp, Homo sapiens
ggcattttgcatcac

SEQ ID NO: 474203 - DNA, 15 bp, Homo sapiens
gcattttgcatcaca

SEQ ID NO: 474204 - DNA, 15 bp, Homo sapiens
cattttgcatcacaa

SEQ ID NO: 474205 - DNA, 15 bp, Homo sapiens
attttgcatcacaaa

SEQ ID NO: 474206 - DNA, 15 bp, Homo sapiens
ttttgcatcacaaat

SEQ ID NO: 474207 - DNA, 15 bp, Homo sapiens
tttgcatcacaaata

SEQ ID NO: 474208 - DNA, 15 bp, Homo sapiens
ttgcatcacaaatat

SEQ ID NO: 474209 - DNA, 15 bp, Homo sapiens
tgcatcacaaatatc

SEQ ID NO: 474210 - DNA, 15 bp, Homo sapiens
gcatcacaaatatct

SEQ ID NO: 474211 - DNA, 15 bp, Homo sapiens
catcacaaatatcta

SEQ ID NO: 474212 - DNA, 15 bp, Homo sapiens
atcacaaatatctac

SEQ ID NO: 474213 - DNA, 15 bp, Homo sapiens
tcacaaatatctaca

SEQ ID NO: 474214 - DNA, 15 bp, Homo sapiens
cacaaatatctacac

SEQ ID NO: 474215 - DNA, 15 bp, Homo sapiens
acaaatatctacacg

SEQ ID NO: 474216 - DNA, 15 bp, Homo sapiens
caaatatctacacgc

SEQ ID NO: 474217 - DNA, 15 bp, Homo sapiens
aaatatctacacgct

SEQ ID NO: 474218 - DNA, 15 bp, Homo sapiens
aatatctacacgctt

SEQ ID NO: 474219 - DNA, 15 bp, Homo sapiens
atatctacacgcttt

SEQ ID NO: 474220 - DNA, 15 bp, Homo sapiens
tatctacacgcttta

SEQ ID NO: 474221 - DNA, 15 bp, Homo sapiens
atctacacgctttac

SEQ ID NO: 474222 - DNA, 15 bp, Homo sapiens
tctacacgctttaca

SEQ ID NO: 474223 - DNA, 15 bp, Homo sapiens
ctacacgctttacag

SEQ ID NO: 474224 - DNA, 15 bp, Homo sapiens
tacacgctttacagg

SEQ ID NO: 474225 - DNA, 15 bp, Homo sapiens
acacgctttacagga

SEQ ID NO: 474226 - DNA, 15 bp, Homo sapiens
cacgctttacaggaa

SEQ ID NO: 474227 - DNA, 15 bp, Homo sapiens
acgctttacaggaat

SEQ ID NO: 474228 - DNA, 15 bp, Homo sapiens
cgctttacaggaatc

SEQ ID NO: 474229 - DNA, 15 bp, Homo sapiens
gctttacaggaatca

SEQ ID NO: 474230 - DNA, 15 bp, Homo sapiens
ctttacaggaatcat

SEQ ID NO: 474231 - DNA, 15 bp, Homo sapiens
tttacaggaatcatg

SEQ ID NO: 474232 - DNA, 15 bp, Homo sapiens
ttacaggaatcatgc

SEQ ID NO: 474233 - DNA, 15 bp, Homo sapiens
tacaggaatcatgca

SEQ ID NO: 474234 - DNA, 15 bp, Homo sapiens
acaggaatcatgcag

SEQ ID NO: 474235 - DNA, 15 bp, Homo sapiens
caggaatcatgcaga

SEQ ID NO: 474236 - DNA, 15 bp, Homo sapiens
aggaatcatgcagat

SEQ ID NO: 474237 - DNA, 15 bp, Homo sapiens
ggaatcatgcagata

SEQ ID NO: 474238 - DNA, 15 bp, Homo sapiens
gaatcatgcagatag

SEQ ID NO: 474239 - DNA, 15 bp, Homo sapiens
aatcatgcagataga

SEQ ID NO: 474240 - DNA, 15 bp, Homo sapiens
atcatgcagatagat

SEQ ID NO: 474241 - DNA, 15 bp, Homo sapiens
tcatgcagatagatg

SEQ ID NO: 474242 - DNA, 15 bp, Homo sapiens
catgcagatagatgc

SEQ ID NO: 474243 - DNA, 15 bp, Homo sapiens
atgcagatagatgca

SEQ ID NO: 474244 - DNA, 15 bp, Homo sapiens
tgcagatagatgcat

SEQ ID NO: 474245 - DNA, 15 bp, Homo sapiens
gcagatagatgcata

SEQ ID NO: 474246 - DNA, 15 bp, Homo sapiens
cagatagatgcatat

SEQ ID NO: 474247 - DNA, 15 bp, Homo sapiens
agatagatgcatatt

SEQ ID NO: 474248 - DNA, 15 bp, Homo sapiens
gatagatgcatattt

SEQ ID NO: 474249 - DNA, 15 bp, Homo sapiens
atagatgcatatttt

SEQ ID NO: 474250 - DNA, 15 bp, Homo sapiens
tagatgcatatttta

SEQ ID NO: 474251 - DNA, 15 bp, Homo sapiens
agatgcatattttat

SEQ ID NO: 474252 - DNA, 15 bp, Homo sapiens
gatgcatattttata

SEQ ID NO: 474253 - DNA, 15 bp, Homo sapiens
atgcatattttatac

SEQ ID NO: 474254 - DNA, 15 bp, Homo sapiens
tgcatattttatact

SEQ ID NO: 474255 - DNA, 15 bp, Homo sapiens
gcatattttatactc

SEQ ID NO: 474256 - DNA, 15 bp, Homo sapiens
catattttatactcc

SEQ ID NO: 474257 - DNA, 15 bp, Homo sapiens
atattttatactcct

SEQ ID NO: 474258 - DNA, 15 bp, Homo sapiens
tattttatactcctt

SEQ ID NO: 474259 - DNA, 15 bp, Homo sapiens
attttatactccttt

SEQ ID NO: 474260 - DNA, 15 bp, Homo sapiens
ttttatactccttta

SEQ ID NO: 474261 - DNA, 15 bp, Homo sapiens
tttatactcctttaa

SEQ ID NO: 474262 - DNA, 15 bp, Homo sapiens
ttatactcctttaaa

SEQ ID NO: 474263 - DNA, 15 bp, Homo sapiens
tatactcctttaaaa

SEQ ID NO: 474264 - DNA, 15 bp, Homo sapiens
atactcctttaaaac

SEQ ID NO: 474265 - DNA, 15 bp, Homo sapiens
tactcctttaaaaca

SEQ ID NO: 474266 - DNA, 15 bp, Homo sapiens
actcctttaaaacat

SEQ ID NO: 474267 - DNA, 15 bp, Homo sapiens
ctcctttaaaacatt

SEQ ID NO: 474268 - DNA, 15 bp, Homo sapiens
tcctttaaaacattt

SEQ ID NO: 474269 - DNA, 15 bp, Homo sapiens
cctttaaaacatttt

SEQ ID NO: 474270 - DNA, 15 bp, Homo sapiens
ctttaaaacattttt

SEQ ID NO: 474271 - DNA, 15 bp, Homo sapiens
tttaaaacattttta

SEQ ID NO: 474272 - DNA, 15 bp, Homo sapiens
ttaaaacatttttaa

SEQ ID NO: 474273 - DNA, 15 bp, Homo sapiens
taaaacatttttaat

SEQ ID NO: 474274 - DNA, 15 bp, Homo sapiens
aaaacatttttaatt

SEQ ID NO: 474275 - DNA, 15 bp, Homo sapiens
aaacatttttaattt

SEQ ID NO: 474276 - DNA, 15 bp, Homo sapiens
aacatttttaatttg

SEQ ID NO: 474277 - DNA, 15 bp, Homo sapiens
acatttttaatttgc

SEQ ID NO: 474278 - DNA, 15 bp, Homo sapiens
catttttaatttgcc

SEQ ID NO: 474279 - DNA, 15 bp, Homo sapiens
atttttaatttgcct

SEQ ID NO: 474280 - DNA, 15 bp, Homo sapiens
tttttaatttgcctt

SEQ ID NO: 474281 - DNA, 15 bp, Homo sapiens
ttttaatttgccttt

SEQ ID NO: 474282 - DNA, 15 bp, Homo sapiens
tttaatttgcctttc

SEQ ID NO: 474283 - DNA, 15 bp, Homo sapiens
ttaatttgcctttca

SEQ ID NO: 474284 - DNA, 15 bp, Homo sapiens
taatttgcctttcaa

SEQ ID NO: 474285 - DNA, 15 bp, Homo sapiens
aatttgcctttcaat

SEQ ID NO: 474286 - DNA, 15 bp, Homo sapiens
atttgcctttcaatg

SEQ ID NO: 474287 - DNA, 15 bp, Homo sapiens
tttgcctttcaatgt

SEQ ID NO: 474288 - DNA, 15 bp, Homo sapiens
ttgcctttcaatgtc

SEQ ID NO: 474289 - DNA, 15 bp, Homo sapiens
tgcctttcaatgtca

SEQ ID NO: 474290 - DNA, 15 bp, Homo sapiens
gcctttcaatgtcaa

SEQ ID NO: 474291 - DNA, 15 bp, Homo sapiens
cctttcaatgtcaaa

SEQ ID NO: 474292 - DNA, 15 bp, Homo sapiens
ctttcaatgtcaaaa

SEQ ID NO: 474293 - DNA, 15 bp, Homo sapiens
tttcaatgtcaaaat

SEQ ID NO: 474294 - DNA, 15 bp, Homo sapiens
ttcaatgtcaaaata

SEQ ID NO: 474295 - DNA, 15 bp, Homo sapiens
tcaatgtcaaaataa

SEQ ID NO: 474296 - DNA, 15 bp, Homo sapiens
caatgtcaaaataat

SEQ ID NO: 474297 - DNA, 15 bp, Homo sapiens
aatgtcaaaataatc

SEQ ID NO: 474298 - DNA, 15 bp, Homo sapiens
atgtcaaaataatca

SEQ ID NO: 474299 - DNA, 15 bp, Homo sapiens
tgtcaaaataatcat

SEQ ID NO: 474300 - DNA, 15 bp, Homo sapiens
gtcaaaataatcatt

SEQ ID NO: 474301 - DNA, 15 bp, Homo sapiens
tcaaaataatcattg

SEQ ID NO: 474302 - DNA, 15 bp, Homo sapiens
caaaataatcattgg

SEQ ID NO: 474303 - DNA, 15 bp, Homo sapiens
aaaataatcattggt

SEQ ID NO: 474304 - DNA, 15 bp, Homo sapiens
aaataatcattggtg

SEQ ID NO: 474305 - DNA, 15 bp, Homo sapiens
aataatcattggtgt

SEQ ID NO: 474306 - DNA, 15 bp, Homo sapiens
ataatcattggtgtc

SEQ ID NO: 474307 - DNA, 15 bp, Homo sapiens
taatcattggtgtca

SEQ ID NO: 474308 - DNA, 15 bp, Homo sapiens
taggggtggtatcta

SEQ ID NO: 474309 - DNA, 15 bp, Homo sapiens
aggggtggtatctag

SEQ ID NO: 474310 - DNA, 15 bp, Homo sapiens
ggggtggtatctagg

SEQ ID NO: 474311 - DNA, 15 bp, Homo sapiens
gggtggtatctaggt

SEQ ID NO: 474312 - DNA, 15 bp, Homo sapiens
ggtggtatctaggtt

SEQ ID NO: 474313 - DNA, 15 bp, Homo sapiens
gtggtatctaggttg

SEQ ID NO: 474314 - DNA, 15 bp, Homo sapiens
tggtatctaggttgc

SEQ ID NO: 474315 - DNA, 15 bp, Homo sapiens
ggtatctaggttgca

SEQ ID NO: 474316 - DNA, 15 bp, Homo sapiens
gtatctaggttgcat

SEQ ID NO: 474317 - DNA, 15 bp, Homo sapiens
tatctaggttgcatg

SEQ ID NO: 474318 - DNA, 15 bp, Homo sapiens
atctaggttgcatgt

SEQ ID NO: 474319 - DNA, 15 bp, Homo sapiens
tctaggttgcatgtt

SEQ ID NO: 474320 - DNA, 15 bp, Homo sapiens
ctaggttgcatgttt

SEQ ID NO: 474321 - DNA, 15 bp, Homo sapiens
taggttgcatgtttg

SEQ ID NO: 474322 - DNA, 15 bp, Homo sapiens
aggttgcatgtttgt

SEQ ID NO: 474323 - DNA, 15 bp, Homo sapiens
ggttgcatgtttgtt

SEQ ID NO: 474324 - DNA, 15 bp, Homo sapiens
gttgcatgtttgttc

SEQ ID NO: 474325 - DNA, 15 bp, Homo sapiens
ttgcatgtttgttca

SEQ ID NO: 474326 - DNA, 15 bp, Homo sapiens
tgcatgtttgttcaa

SEQ ID NO: 474327 - DNA, 15 bp, Homo sapiens
gcatgtttgttcaat

SEQ ID NO: 474328 - DNA, 15 bp, Homo sapiens
catgtttgttcaatg

SEQ ID NO: 474329 - DNA, 15 bp, Homo sapiens
atgtttgttcaatgt

SEQ ID NO: 474330 - DNA, 15 bp, Homo sapiens
tgtttgttcaatgtg

SEQ ID NO: 474331 - DNA, 15 bp, Homo sapiens
gtttgttcaatgtgt

SEQ ID NO: 474332 - DNA, 15 bp, Homo sapiens
tttgttcaatgtgtg

SEQ ID NO: 474333 - DNA, 15 bp, Homo sapiens
ttgttcaatgtgtgt

SEQ ID NO: 474334 - DNA, 15 bp, Homo sapiens
tgttcaatgtgtgtg

SEQ ID NO: 474335 - DNA, 15 bp, Homo sapiens
gttcaatgtgtgtgt

SEQ ID NO: 474336 - DNA, 15 bp, Homo sapiens
ttcaatgtgtgtgtg

SEQ ID NO: 474337 - DNA, 15 bp, Homo sapiens
tcaatgtgtgtgtga

SEQ ID NO: 474338 - DNA, 15 bp, Homo sapiens
caatgtgtgtgtgag

SEQ ID NO: 474339 - DNA, 15 bp, Homo sapiens
aatgtgtgtgtgagg

SEQ ID NO: 474340 - DNA, 15 bp, Homo sapiens
atgtgtgtgtgaggt

SEQ ID NO: 474341 - DNA, 15 bp, Homo sapiens
tgtgtgtgtgaggtt

SEQ ID NO: 474342 - DNA, 15 bp, Homo sapiens
gtgtgtgtgaggttg

SEQ ID NO: 474343 - DNA, 15 bp, Homo sapiens
tgtgtgtgaggttga

SEQ ID NO: 474344 - DNA, 15 bp, Homo sapiens
gtgtgtgaggttgag

SEQ ID NO: 474345 - DNA, 15 bp, Homo sapiens
tgtgtgaggttgagg

SEQ ID NO: 474346 - DNA, 15 bp, Homo sapiens
gtgtgaggttgaggt

SEQ ID NO: 474347 - DNA, 15 bp, Homo sapiens
tgtgaggttgaggta

SEQ ID NO: 474348 - DNA, 15 bp, Homo sapiens
gtgaggttgaggtat

SEQ ID NO: 474349 - DNA, 15 bp, Homo sapiens
tgaggttgaggtatt

SEQ ID NO: 474350 - DNA, 15 bp, Homo sapiens
gaggttgaggtattt

SEQ ID NO: 474351 - DNA, 15 bp, Homo sapiens
aggttgaggtatttt

SEQ ID NO: 474352 - DNA, 15 bp, Homo sapiens
ggttgaggtattttg

SEQ ID NO: 474353 - DNA, 15 bp, Homo sapiens
gttgaggtattttgg

SEQ ID NO: 474354 - DNA, 15 bp, Homo sapiens
ttgaggtattttggg

SEQ ID NO: 474355 - DNA, 15 bp, Homo sapiens
tgaggtattttgggt

SEQ ID NO: 474356 - DNA, 15 bp, Homo sapiens
gaggtattttgggta

SEQ ID NO: 474357 - DNA, 15 bp, Homo sapiens
aggtattttgggtac

SEQ ID NO: 474358 - DNA, 15 bp, Homo sapiens
ggtattttgggtaca

SEQ ID NO: 474359 - DNA, 15 bp, Homo sapiens
gtattttgggtacat

SEQ ID NO: 474360 - DNA, 15 bp, Homo sapiens
tattttgggtacatc

SEQ ID NO: 474361 - DNA, 15 bp, Homo sapiens
attttgggtacatct

SEQ ID NO: 474362 - DNA, 15 bp, Homo sapiens
ttttgggtacatctg

SEQ ID NO: 474363 - DNA, 15 bp, Homo sapiens
tttgggtacatctgg

SEQ ID NO: 474364 - DNA, 15 bp, Homo sapiens
ttgggtacatctggg

SEQ ID NO: 474365 - DNA, 15 bp, Homo sapiens
tgggtacatctgggt

SEQ ID NO: 474366 - DNA, 15 bp, Homo sapiens
gggtacatctgggtt

SEQ ID NO: 474367 - DNA, 15 bp, Homo sapiens
ggtacatctgggttt

SEQ ID NO: 474368 - DNA, 15 bp, Homo sapiens
gtacatctgggtttg

SEQ ID NO: 474369 - DNA, 15 bp, Homo sapiens
tacatctgggtttgg

SEQ ID NO: 474370 - DNA, 15 bp, Homo sapiens
acatctgggtttgga

SEQ ID NO: 474371 - DNA, 15 bp, Homo sapiens
catctgggtttggat

SEQ ID NO: 474372 - DNA, 15 bp, Homo sapiens
atctgggtttggatg

SEQ ID NO: 474373 - DNA, 15 bp, Homo sapiens
tctgggtttggatgt

SEQ ID NO: 474374 - DNA, 15 bp, Homo sapiens
ctgggtttggatgtt

SEQ ID NO: 474375 - DNA, 15 bp, Homo sapiens
tgggtttggatgttt

SEQ ID NO: 474376 - DNA, 15 bp, Homo sapiens
gggtttggatgttta

SEQ ID NO: 474377 - DNA, 15 bp, Homo sapiens
ggtttggatgtttac

SEQ ID NO: 474378 - DNA, 15 bp, Homo sapiens
gtttggatgtttaca

SEQ ID NO: 474379 - DNA, 15 bp, Homo sapiens
tttggatgtttacat

SEQ ID NO: 474380 - DNA, 15 bp, Homo sapiens
ttggatgtttacatt

SEQ ID NO: 474381 - DNA, 15 bp, Homo sapiens
tggatgtttacattt

SEQ ID NO: 474382 - DNA, 15 bp, Homo sapiens
ggatgtttacattta

SEQ ID NO: 474383 - DNA, 15 bp, Homo sapiens
gatgtttacatttaa

SEQ ID NO: 474384 - DNA, 15 bp, Homo sapiens
atgtttacatttaaa

SEQ ID NO: 474385 - DNA, 15 bp, Homo sapiens
tgtttacatttaaaa

SEQ ID NO: 474386 - DNA, 15 bp, Homo sapiens
gtttacatttaaaat

SEQ ID NO: 474387 - DNA, 15 bp, Homo sapiens
tttacatttaaaatt

SEQ ID NO: 474388 - DNA, 15 bp, Homo sapiens
ttacatttaaaatta

SEQ ID NO: 474389 - DNA, 15 bp, Homo sapiens
tacatttaaaattac

SEQ ID NO: 474390 - DNA, 15 bp, Homo sapiens
acatttaaaattaca

SEQ ID NO: 474391 - DNA, 15 bp, Homo sapiens
catttaaaattacat

SEQ ID NO: 474392 - DNA, 15 bp, Homo sapiens
atttaaaattacatg

SEQ ID NO: 474393 - DNA, 15 bp, Homo sapiens
tttaaaattacatga

SEQ ID NO: 474394 - DNA, 15 bp, Homo sapiens
ttaaaattacatgaa

SEQ ID NO: 474395 - DNA, 15 bp, Homo sapiens
taaaattacatgaag

SEQ ID NO: 474396 - DNA, 15 bp, Homo sapiens
aaaattacatgaaga

SEQ ID NO: 474397 - DNA, 15 bp, Homo sapiens
aaattacatgaagaa

SEQ ID NO: 474398 - DNA, 15 bp, Homo sapiens
aattacatgaagaac

SEQ ID NO: 474399 - DNA, 15 bp, Homo sapiens
attacatgaagaaca

SEQ ID NO: 474400 - DNA, 15 bp, Homo sapiens
ttacatgaagaacag

SEQ ID NO: 474401 - DNA, 15 bp, Homo sapiens
tacatgaagaacaga

SEQ ID NO: 474402 - DNA, 15 bp, Homo sapiens
acatgaagaacagaa

SEQ ID NO: 474403 - DNA, 15 bp, Homo sapiens
catgaagaacagaaa

SEQ ID NO: 474404 - DNA, 15 bp, Homo sapiens
atgaagaacagaaaa

SEQ ID NO: 474405 - DNA, 15 bp, Homo sapiens
tgaagaacagaaaag

SEQ ID NO: 474406 - DNA, 15 bp, Homo sapiens
gaagaacagaaaagt

SEQ ID NO: 474407 - DNA, 15 bp, Homo sapiens
aagaacagaaaagtc

SEQ ID NO: 474408 - DNA, 15 bp, Homo sapiens
agaacagaaaagtct

SEQ ID NO: 474409 - DNA, 15 bp, Homo sapiens
gaacagaaaagtcta

SEQ ID NO: 474410 - DNA, 15 bp, Homo sapiens
aacagaaaagtctaa

SEQ ID NO: 474411 - DNA, 15 bp, Homo sapiens
acagaaaagtctaat

SEQ ID NO: 474412 - DNA, 15 bp, Homo sapiens
cagaaaagtctaatt

SEQ ID NO: 474413 - DNA, 15 bp, Homo sapiens
agaaaagtctaattt

SEQ ID NO: 474414 - DNA, 15 bp, Homo sapiens
gaaaagtctaatttt

SEQ ID NO: 474415 - DNA, 15 bp, Homo sapiens
aaaagtctaatttta

SEQ ID NO: 474416 - DNA, 15 bp, Homo sapiens
aaagtctaattttat

SEQ ID NO: 474417 - DNA, 15 bp, Homo sapiens
aagtctaattttatt

SEQ ID NO: 474418 - DNA, 15 bp, Homo sapiens
agtctaattttattg

SEQ ID NO: 474419 - DNA, 15 bp, Homo sapiens
gtctaattttattgc

SEQ ID NO: 474420 - DNA, 15 bp, Homo sapiens
tctaattttattgca

SEQ ID NO: 474421 - DNA, 15 bp, Homo sapiens
ctaattttattgcac

SEQ ID NO: 474422 - DNA, 15 bp, Homo sapiens
taattttattgcacc

SEQ ID NO: 474423 - DNA, 15 bp, Homo sapiens
aattttattgcacct

SEQ ID NO: 474424 - DNA, 15 bp, Homo sapiens
attttattgcacctc

SEQ ID NO: 474425 - DNA, 15 bp, Homo sapiens
ttttattgcacctct

SEQ ID NO: 474426 - DNA, 15 bp, Homo sapiens
tttattgcacctctg

SEQ ID NO: 474427 - DNA, 15 bp, Homo sapiens
ttattgcacctctgc

SEQ ID NO: 474428 - DNA, 15 bp, Homo sapiens
tattgcacctctgcc

SEQ ID NO: 474429 - DNA, 15 bp, Homo sapiens
attgcacctctgcca

SEQ ID NO: 474430 - DNA, 15 bp, Homo sapiens
ttgcacctctgccat

SEQ ID NO: 474431 - DNA, 15 bp, Homo sapiens
tgcacctctgccatc

SEQ ID NO: 474432 - DNA, 15 bp, Homo sapiens
gcacctctgccatca

SEQ ID NO: 474433 - DNA, 15 bp, Homo sapiens
cacctctgccatcaa

SEQ ID NO: 474434 - DNA, 15 bp, Homo sapiens
acctctgccatcaac

SEQ ID NO: 474435 - DNA, 15 bp, Homo sapiens
cctctgccatcaaca

SEQ ID NO: 474436 - DNA, 15 bp, Homo sapiens
ctctgccatcaacat

SEQ ID NO: 474437 - DNA, 15 bp, Homo sapiens
tctgccatcaacata

SEQ ID NO: 474438 - DNA, 15 bp, Homo sapiens
ctgccatcaacatat

SEQ ID NO: 474439 - DNA, 15 bp, Homo sapiens
tgccatcaacatata

SEQ ID NO: 474440 - DNA, 15 bp, Homo sapiens
gccatcaacatataa

SEQ ID NO: 474441 - DNA, 15 bp, Homo sapiens
ccatcaacatataat

SEQ ID NO: 474442 - DNA, 15 bp, Homo sapiens
catcaacatataatg

SEQ ID NO: 474443 - DNA, 15 bp, Homo sapiens
atcaacatataatgt

SEQ ID NO: 474444 - DNA, 15 bp, Homo sapiens
tcaacatataatgta

SEQ ID NO: 474445 - DNA, 15 bp, Homo sapiens
caacatataatgtag

SEQ ID NO: 474446 - DNA, 15 bp, Homo sapiens
aacatataatgtagt

SEQ ID NO: 474447 - DNA, 15 bp, Homo sapiens
acatataatgtagtg

SEQ ID NO: 474448 - DNA, 15 bp, Homo sapiens
catataatgtagtgt

SEQ ID NO: 474449 - DNA, 15 bp, Homo sapiens
atataatgtagtgtt

SEQ ID NO: 474450 - DNA, 15 bp, Homo sapiens
tataatgtagtgttt

SEQ ID NO: 474451 - DNA, 15 bp, Homo sapiens
ataatgtagtgtttc

SEQ ID NO: 474452 - DNA, 15 bp, Homo sapiens
taatgtagtgtttca

SEQ ID NO: 474453 - DNA, 15 bp, Homo sapiens
aatgtagtgtttcat

SEQ ID NO: 474454 - DNA, 15 bp, Homo sapiens
atgtagtgtttcatt

SEQ ID NO: 474455 - DNA, 15 bp, Homo sapiens
tgtagtgtttcattt

SEQ ID NO: 474456 - DNA, 15 bp, Homo sapiens
gtagtgtttcatttt

SEQ ID NO: 474457 - DNA, 15 bp, Homo sapiens
tagtgtttcattttt

SEQ ID NO: 474458 - DNA, 15 bp, Homo sapiens
agtgtttcattttta

SEQ ID NO: 474459 - DNA, 15 bp, Homo sapiens
gtgtttcatttttaa

SEQ ID NO: 474460 - DNA, 15 bp, Homo sapiens
tgtttcatttttaac

SEQ ID NO: 474461 - DNA, 15 bp, Homo sapiens
gtttcatttttaact

SEQ ID NO: 474462 - DNA, 15 bp, Homo sapiens
tttcatttttaactt

SEQ ID NO: 474463 - DNA, 15 bp, Homo sapiens
ttcatttttaacttc

SEQ ID NO: 474464 - DNA, 15 bp, Homo sapiens
tcatttttaacttca

SEQ ID NO: 474465 - DNA, 15 bp, Homo sapiens
catttttaacttcat

SEQ ID NO: 474466 - DNA, 15 bp, Homo sapiens
atttttaacttcatc

SEQ ID NO: 474467 - DNA, 15 bp, Homo sapiens
tttttaacttcatct

SEQ ID NO: 474468 - DNA, 15 bp, Homo sapiens
ttttaacttcatctt

SEQ ID NO: 474469 - DNA, 15 bp, Homo sapiens
tttaacttcatcttt

SEQ ID NO: 474470 - DNA, 15 bp, Homo sapiens
ttaacttcatctttc

SEQ ID NO: 474471 - DNA, 15 bp, Homo sapiens
taacttcatctttct

SEQ ID NO: 474472 - DNA, 15 bp, Homo sapiens
aacttcatctttcta

SEQ ID NO: 474473 - DNA, 15 bp, Homo sapiens
acttcatctttctaa

SEQ ID NO: 474474 - DNA, 15 bp, Homo sapiens
cttcatctttctaac

SEQ ID NO: 474475 - DNA, 15 bp, Homo sapiens
ttcatctttctaacc

SEQ ID NO: 474476 - DNA, 15 bp, Homo sapiens
tcatctttctaacca

SEQ ID NO: 474477 - DNA, 15 bp, Homo sapiens
catctttctaaccaa

SEQ ID NO: 474478 - DNA, 15 bp, Homo sapiens
atctttctaaccaag

SEQ ID NO: 474479 - DNA, 15 bp, Homo sapiens
tctttctaaccaagt

SEQ ID NO: 474480 - DNA, 15 bp, Homo sapiens
ctttctaaccaagtt

SEQ ID NO: 474481 - DNA, 15 bp, Homo sapiens
tttctaaccaagttt

SEQ ID NO: 474482 - DNA, 15 bp, Homo sapiens
ttctaaccaagtttc

SEQ ID NO: 474483 - DNA, 15 bp, Homo sapiens
tctaaccaagtttct

SEQ ID NO: 474484 - DNA, 15 bp, Homo sapiens
ctaaccaagtttctt

SEQ ID NO: 474485 - DNA, 15 bp, Homo sapiens
taaccaagtttcttc

SEQ ID NO: 474486 - DNA, 15 bp, Homo sapiens
aaccaagtttcttct

SEQ ID NO: 474487 - DNA, 15 bp, Homo sapiens
accaagtttcttctc

SEQ ID NO: 474488 - DNA, 15 bp, Homo sapiens
ccaagtttcttctct

SEQ ID NO: 474489 - DNA, 15 bp, Homo sapiens
caagtttcttctcta

SEQ ID NO: 474490 - DNA, 15 bp, Homo sapiens
aagtttcttctctag

SEQ ID NO: 474491 - DNA, 15 bp, Homo sapiens
agtttcttctctagg

SEQ ID NO: 474492 - DNA, 15 bp, Homo sapiens
ttcttctctaggaaa

SEQ ID NO: 474493 - DNA, 15 bp, Homo sapiens
tcttctctaggaaaa

SEQ ID NO: 474494 - DNA, 15 bp, Homo sapiens
cttctctaggaaaaa

SEQ ID NO: 474495 - DNA, 15 bp, Homo sapiens
ttctctaggaaaaac

SEQ ID NO: 474496 - DNA, 15 bp, Homo sapiens
tctctaggaaaaaca

SEQ ID NO: 474497 - DNA, 15 bp, Homo sapiens
ctctaggaaaaacaa

SEQ ID NO: 474498 - DNA, 15 bp, Homo sapiens
tctaggaaaaacaaa

SEQ ID NO: 474499 - DNA, 15 bp, Homo sapiens
ctaggaaaaacaaaa

SEQ ID NO: 474500 - DNA, 15 bp, Homo sapiens
taggaaaaacaaaaa

SEQ ID NO: 474501 - DNA, 15 bp, Homo sapiens
aggaaaaacaaaaat

SEQ ID NO: 474502 - DNA, 15 bp, Homo sapiens
ggaaaaacaaaaata

SEQ ID NO: 474503 - DNA, 15 bp, Homo sapiens
gaaaaacaaaaatat

SEQ ID NO: 474504 - DNA, 15 bp, Homo sapiens
aaaaacaaaaatatg

SEQ ID NO: 474505 - DNA, 15 bp, Homo sapiens
aaaacaaaaatatga

SEQ ID NO: 474506 - DNA, 15 bp, Homo sapiens
aaacaaaaatatgat

SEQ ID NO: 474507 - DNA, 15 bp, Homo sapiens
aacaaaaatatgatt

SEQ ID NO: 474508 - DNA, 15 bp, Homo sapiens
acaaaaatatgattg

SEQ ID NO: 474509 - DNA, 15 bp, Homo sapiens
caaaaatatgattgc

SEQ ID NO: 474510 - DNA, 15 bp, Homo sapiens
aaaaatatgattgca

SEQ ID NO: 474511 - DNA, 15 bp, Homo sapiens
aaaatatgattgcat

SEQ ID NO: 474512 - DNA, 15 bp, Homo sapiens
aaatatgattgcatc

SEQ ID NO: 474513 - DNA, 15 bp, Homo sapiens
aatatgattgcatcc

SEQ ID NO: 474514 - DNA, 15 bp, Homo sapiens
atatgattgcatccc

SEQ ID NO: 474515 - DNA, 15 bp, Homo sapiens
tatgattgcatcccc

SEQ ID NO: 474516 - DNA, 15 bp, Homo sapiens
atgattgcatccccc

SEQ ID NO: 474517 - DNA, 15 bp, Homo sapiens
tgattgcatccccct

SEQ ID NO: 474518 - DNA, 15 bp, Homo sapiens
gattgcatccccctt

SEQ ID NO: 474519 - DNA, 15 bp, Homo sapiens
attgcatcccccttg

SEQ ID NO: 474520 - DNA, 15 bp, Homo sapiens
ttgcatcccccttgg

SEQ ID NO: 474521 - DNA, 15 bp, Homo sapiens
tgcatcccccttggt

SEQ ID NO: 474522 - DNA, 15 bp, Homo sapiens
gcatcccccttggta

SEQ ID NO: 474523 - DNA, 15 bp, Homo sapiens
catcccccttggtat

SEQ ID NO: 474524 - DNA, 15 bp, Homo sapiens
atcccccttggtata

SEQ ID NO: 474525 - DNA, 15 bp, Homo sapiens
tcccccttggtatat

SEQ ID NO: 474526 - DNA, 15 bp, Homo sapiens
cccccttggtatatt

SEQ ID NO: 474527 - DNA, 15 bp, Homo sapiens
ccccttggtatatta

SEQ ID NO: 474528 - DNA, 15 bp, Homo sapiens
cccttggtatattat

SEQ ID NO: 474529 - DNA, 15 bp, Homo sapiens
ccttggtatattata

SEQ ID NO: 474530 - DNA, 15 bp, Homo sapiens
cttggtatattatag

SEQ ID NO: 474531 - DNA, 15 bp, Homo sapiens
ttggtatattataga

SEQ ID NO: 474532 - DNA, 15 bp, Homo sapiens
tggtatattatagaa

SEQ ID NO: 474533 - DNA, 15 bp, Homo sapiens
ggtatattatagaat

SEQ ID NO: 474534 - DNA, 15 bp, Homo sapiens
gtatattatagaatg

SEQ ID NO: 474535 - DNA, 15 bp, Homo sapiens
tatattatagaatgg

SEQ ID NO: 474536 - DNA, 15 bp, Homo sapiens
atattatagaatggt

SEQ ID NO: 474537 - DNA, 15 bp, Homo sapiens
tattatagaatggta

SEQ ID NO: 474538 - DNA, 15 bp, Homo sapiens
attatagaatggtat

SEQ ID NO: 474539 - DNA, 15 bp, Homo sapiens
ttatagaatggtatc

SEQ ID NO: 474540 - DNA, 15 bp, Homo sapiens
tatagaatggtatct

SEQ ID NO: 474541 - DNA, 15 bp, Homo sapiens
atagaatggtatctt

SEQ ID NO: 474542 - DNA, 15 bp, Homo sapiens
tagaatggtatcttt

SEQ ID NO: 474543 - DNA, 15 bp, Homo sapiens
agaatggtatcttta

SEQ ID NO: 474544 - DNA, 15 bp, Homo sapiens
gaatggtatctttac

SEQ ID NO: 474545 - DNA, 15 bp, Homo sapiens
aatggtatctttaca

SEQ ID NO: 474546 - DNA, 15 bp, Homo sapiens
atggtatctttacat

SEQ ID NO: 474547 - DNA, 15 bp, Homo sapiens
tggtatctttacatt

SEQ ID NO: 474548 - DNA, 15 bp, Homo sapiens
ggtatctttacatta

SEQ ID NO: 474549 - DNA, 15 bp, Homo sapiens
gtatctttacattat

SEQ ID NO: 474550 - DNA, 15 bp, Homo sapiens
tatctttacattatt

SEQ ID NO: 474551 - DNA, 15 bp, Homo sapiens
atctttacattattc

SEQ ID NO: 474552 - DNA, 15 bp, Homo sapiens
tctttacattattct

SEQ ID NO: 474553 - DNA, 15 bp, Homo sapiens
ctttacattattcta

SEQ ID NO: 474554 - DNA, 15 bp, Homo sapiens
tttacattattctat

SEQ ID NO: 474555 - DNA, 15 bp, Homo sapiens
ttacattattctata

SEQ ID NO: 474556 - DNA, 15 bp, Homo sapiens
tacattattctataa

SEQ ID NO: 474557 - DNA, 15 bp, Homo sapiens
acattattctataat

SEQ ID NO: 474558 - DNA, 15 bp, Homo sapiens
cattattctataatt

SEQ ID NO: 474559 - DNA, 15 bp, Homo sapiens
attattctataattt

SEQ ID NO: 474560 - DNA, 15 bp, Homo sapiens
ttattctataatttt

SEQ ID NO: 474561 - DNA, 15 bp, Homo sapiens
tattctataattttg

SEQ ID NO: 474562 - DNA, 15 bp, Homo sapiens
attctataattttga

SEQ ID NO: 474563 - DNA, 15 bp, Homo sapiens
ttctataattttgag

SEQ ID NO: 474564 - DNA, 15 bp, Homo sapiens
tctataattttgagt

SEQ ID NO: 474565 - DNA, 15 bp, Homo sapiens
ctataattttgagtt

SEQ ID NO: 474566 - DNA, 15 bp, Homo sapiens
tataattttgagtta

SEQ ID NO: 474567 - DNA, 15 bp, Homo sapiens
ataattttgagttat

SEQ ID NO: 474568 - DNA, 15 bp, Homo sapiens
taattttgagttatt

SEQ ID NO: 474569 - DNA, 15 bp, Homo sapiens
aattttgagttattt

SEQ ID NO: 474570 - DNA, 15 bp, Homo sapiens
attttgagttatttt

SEQ ID NO: 474571 - DNA, 15 bp, Homo sapiens
ttttgagttattttt

SEQ ID NO: 474572 - DNA, 15 bp, Homo sapiens
tttgagttatttttg

SEQ ID NO: 474573 - DNA, 15 bp, Homo sapiens
ttgagttatttttga

SEQ ID NO: 474574 - DNA, 15 bp, Homo sapiens
tgagttatttttgag

SEQ ID NO: 474575 - DNA, 15 bp, Homo sapiens
gagttatttttgagc

SEQ ID NO: 474576 - DNA, 15 bp, Homo sapiens
agttatttttgagca

SEQ ID NO: 474577 - DNA, 15 bp, Homo sapiens
gttatttttgagcat

SEQ ID NO: 474578 - DNA, 15 bp, Homo sapiens
ttatttttgagcatt

SEQ ID NO: 474579 - DNA, 15 bp, Homo sapiens
tatttttgagcattc

SEQ ID NO: 474580 - DNA, 15 bp, Homo sapiens
atttttgagcattct

SEQ ID NO: 474581 - DNA, 15 bp, Homo sapiens
tttttgagcattctg

SEQ ID NO: 474582 - DNA, 15 bp, Homo sapiens
ttttgagcattctgg

SEQ ID NO: 474583 - DNA, 15 bp, Homo sapiens
tttgagcattctggt

SEQ ID NO: 474584 - DNA, 15 bp, Homo sapiens
ttgagcattctggtt

SEQ ID NO: 474585 - DNA, 15 bp, Homo sapiens
tgagcattctggttt

SEQ ID NO: 474586 - DNA, 15 bp, Homo sapiens
gagcattctggtttt

SEQ ID NO: 474587 - DNA, 15 bp, Homo sapiens
agcattctggttttt

SEQ ID NO: 474588 - DNA, 15 bp, Homo sapiens
gcattctggtttttt

SEQ ID NO: 474589 - DNA, 15 bp, Homo sapiens
cattctggttttttc

SEQ ID NO: 474590 - DNA, 15 bp, Homo sapiens
attctggttttttcc

SEQ ID NO: 474591 - DNA, 15 bp, Homo sapiens
ttctggttttttccc

SEQ ID NO: 474592 - DNA, 15 bp, Homo sapiens
tctggttttttcccc

SEQ ID NO: 474593 - DNA, 15 bp, Homo sapiens
ctggttttttcccca

SEQ ID NO: 474594 - DNA, 15 bp, Homo sapiens
tggttttttccccag

SEQ ID NO: 474595 - DNA, 15 bp, Homo sapiens
ggttttttccccagt

SEQ ID NO: 474596 - DNA, 15 bp, Homo sapiens
gttttttccccagta

SEQ ID NO: 474597 - DNA, 15 bp, Homo sapiens
ttttttccccagtat

SEQ ID NO: 474598 - DNA, 15 bp, Homo sapiens
tttttccccagtatg

SEQ ID NO: 474599 - DNA, 15 bp, Homo sapiens
ttttccccagtatga

SEQ ID NO: 474600 - DNA, 15 bp, Homo sapiens
tttccccagtatgac

SEQ ID NO: 474601 - DNA, 15 bp, Homo sapiens
ttccccagtatgact

SEQ ID NO: 474602 - DNA, 15 bp, Homo sapiens
tccccagtatgactg

SEQ ID NO: 474603 - DNA, 15 bp, Homo sapiens
ccccagtatgactgt

SEQ ID NO: 474604 - DNA, 15 bp, Homo sapiens
cccagtatgactgtt

SEQ ID NO: 474605 - DNA, 15 bp, Homo sapiens
ccagtatgactgttt

SEQ ID NO: 474606 - DNA, 15 bp, Homo sapiens
cagtatgactgttta

SEQ ID NO: 474607 - DNA, 15 bp, Homo sapiens
agtatgactgtttaa

SEQ ID NO: 474608 - DNA, 15 bp, Homo sapiens
gtatgactgtttaaa

SEQ ID NO: 474609 - DNA, 15 bp, Homo sapiens
tatgactgtttaaag

SEQ ID NO: 474610 - DNA, 15 bp, Homo sapiens
atgactgtttaaaga

SEQ ID NO: 474611 - DNA, 15 bp, Homo sapiens
tgactgtttaaagat

SEQ ID NO: 474612 - DNA, 15 bp, Homo sapiens
gactgtttaaagatg

SEQ ID NO: 474613 - DNA, 15 bp, Homo sapiens
actgtttaaagatgt

SEQ ID NO: 474614 - DNA, 15 bp, Homo sapiens
ctgtttaaagatgtg

SEQ ID NO: 474615 - DNA, 15 bp, Homo sapiens
tgtttaaagatgtgt

SEQ ID NO: 474616 - DNA, 15 bp, Homo sapiens
gtttaaagatgtgtt

SEQ ID NO: 474617 - DNA, 15 bp, Homo sapiens
tttaaagatgtgttt

SEQ ID NO: 474618 - DNA, 15 bp, Homo sapiens
ttaaagatgtgtttg

SEQ ID NO: 474619 - DNA, 15 bp, Homo sapiens
taaagatgtgtttgc

SEQ ID NO: 474620 - DNA, 15 bp, Homo sapiens
aaagatgtgtttgct

SEQ ID NO: 474621 - DNA, 15 bp, Homo sapiens
aagatgtgtttgcta

SEQ ID NO: 474622 - DNA, 15 bp, Homo sapiens
agatgtgtttgctat

SEQ ID NO: 474623 - DNA, 15 bp, Homo sapiens
gatgtgtttgctatc

SEQ ID NO: 474624 - DNA, 15 bp, Homo sapiens
atgtgtttgctatcc

SEQ ID NO: 474625 - DNA, 15 bp, Homo sapiens
tgtgtttgctatcct

SEQ ID NO: 474626 - DNA, 15 bp, Homo sapiens
gtgtttgctatcctt

SEQ ID NO: 474627 - DNA, 15 bp, Homo sapiens
tgtttgctatccttg

SEQ ID NO: 474628 - DNA, 15 bp, Homo sapiens
gtttgctatccttga

SEQ ID NO: 474629 - DNA, 15 bp, Homo sapiens
tttgctatccttgaa

SEQ ID NO: 474630 - DNA, 15 bp, Homo sapiens
ttgctatccttgaac

SEQ ID NO: 474631 - DNA, 15 bp, Homo sapiens
tgctatccttgaaca

SEQ ID NO: 474632 - DNA, 15 bp, Homo sapiens
gctatccttgaacaa

SEQ ID NO: 474633 - DNA, 15 bp, Homo sapiens
ctatccttgaacaaa

SEQ ID NO: 474634 - DNA, 15 bp, Homo sapiens
tatccttgaacaaat

SEQ ID NO: 474635 - DNA, 15 bp, Homo sapiens
atccttgaacaaata

SEQ ID NO: 474636 - DNA, 15 bp, Homo sapiens
tccttgaacaaatat

SEQ ID NO: 474637 - DNA, 15 bp, Homo sapiens
ccttgaacaaatatc

SEQ ID NO: 474638 - DNA, 15 bp, Homo sapiens
cttgaacaaatatcc

SEQ ID NO: 474639 - DNA, 15 bp, Homo sapiens
ttgaacaaatatcct

SEQ ID NO: 474640 - DNA, 15 bp, Homo sapiens
tgaacaaatatcctg

SEQ ID NO: 474641 - DNA, 15 bp, Homo sapiens
gaacaaatatcctgt

SEQ ID NO: 474642 - DNA, 15 bp, Homo sapiens
aacaaatatcctgta

SEQ ID NO: 474643 - DNA, 15 bp, Homo sapiens
acaaatatcctgtaa

SEQ ID NO: 474644 - DNA, 15 bp, Homo sapiens
caaatatcctgtaat

SEQ ID NO: 474645 - DNA, 15 bp, Homo sapiens
aaatatcctgtaata

SEQ ID NO: 474646 - DNA, 15 bp, Homo sapiens
aatatcctgtaatat

SEQ ID NO: 474647 - DNA, 15 bp, Homo sapiens
atatcctgtaatatc

SEQ ID NO: 474648 - DNA, 15 bp, Homo sapiens
tatcctgtaatatct

SEQ ID NO: 474649 - DNA, 15 bp, Homo sapiens
atcctgtaatatctg

SEQ ID NO: 474650 - DNA, 15 bp, Homo sapiens
tcctgtaatatctgt

SEQ ID NO: 474651 - DNA, 15 bp, Homo sapiens
cctgtaatatctgtg

SEQ ID NO: 474652 - DNA, 15 bp, Homo sapiens
ctgtaatatctgtga

SEQ ID NO: 474653 - DNA, 15 bp, Homo sapiens
tgtaatatctgtgaa

SEQ ID NO: 474654 - DNA, 15 bp, Homo sapiens
gtaatatctgtgaaa

SEQ ID NO: 474655 - DNA, 15 bp, Homo sapiens
taatatctgtgaaaa

SEQ ID NO: 474656 - DNA, 15 bp, Homo sapiens
aatatctgtgaaaag

SEQ ID NO: 474657 - DNA, 15 bp, Homo sapiens
atatctgtgaaaagg

SEQ ID NO: 474658 - DNA, 15 bp, Homo sapiens
tatctgtgaaaaggc

SEQ ID NO: 474659 - DNA, 15 bp, Homo sapiens
atctgtgaaaaggcc

SEQ ID NO: 474660 - DNA, 15 bp, Homo sapiens
tctgtgaaaaggccc

SEQ ID NO: 474661 - DNA, 15 bp, Homo sapiens
ctgtgaaaaggcccc

SEQ ID NO: 474662 - DNA, 15 bp, Homo sapiens
tgtgaaaaggcccct

SEQ ID NO: 474663 - DNA, 15 bp, Homo sapiens
gtgaaaaggcccctg

SEQ ID NO: 474664 - DNA, 15 bp, Homo sapiens
tgaaaaggcccctgc

SEQ ID NO: 474665 - DNA, 15 bp, Homo sapiens
gaaaaggcccctgca

SEQ ID NO: 474666 - DNA, 15 bp, Homo sapiens
aaaaggcccctgcag

SEQ ID NO: 474667 - DNA, 15 bp, Homo sapiens
aaaggcccctgcaga

SEQ ID NO: 474668 - DNA, 15 bp, Homo sapiens
aaggcccctgcagac

SEQ ID NO: 474669 - DNA, 15 bp, Homo sapiens
aggcccctgcagact

SEQ ID NO: 474670 - DNA, 15 bp, Homo sapiens
ggcccctgcagactc

SEQ ID NO: 474671 - DNA, 15 bp, Homo sapiens
gcccctgcagactct

SEQ ID NO: 474672 - DNA, 15 bp, Homo sapiens
cccctgcagactctt

SEQ ID NO: 474673 - DNA, 15 bp, Homo sapiens
ccctgcagactcttg

SEQ ID NO: 474674 - DNA, 15 bp, Homo sapiens
cctgcagactcttga

SEQ ID NO: 474675 - DNA, 15 bp, Homo sapiens
ctgcagactcttgaa

SEQ ID NO: 474676 - DNA, 15 bp, Homo sapiens
tgcagactcttgaat

SEQ ID NO: 474677 - DNA, 15 bp, Homo sapiens
gcagactcttgaata

SEQ ID NO: 474678 - DNA, 15 bp, Homo sapiens
cagactcttgaatac

SEQ ID NO: 474679 - DNA, 15 bp, Homo sapiens
agactcttgaataca

SEQ ID NO: 474680 - DNA, 15 bp, Homo sapiens
gactcttgaatacac

SEQ ID NO: 474681 - DNA, 15 bp, Homo sapiens
actcttgaatacacg

SEQ ID NO: 474682 - DNA, 15 bp, Homo sapiens
ctcttgaatacacgg

SEQ ID NO: 474683 - DNA, 15 bp, Homo sapiens
tcttgaatacacggc

SEQ ID NO: 474684 - DNA, 15 bp, Homo sapiens
cttgaatacacggcg

SEQ ID NO: 474685 - DNA, 15 bp, Homo sapiens
ttgaatacacggcga

SEQ ID NO: 474686 - DNA, 15 bp, Homo sapiens
tgaatacacggcgac

SEQ ID NO: 474687 - DNA, 15 bp, Homo sapiens
gaatacacggcgact

SEQ ID NO: 474688 - DNA, 15 bp, Homo sapiens
aatacacggcgactt

SEQ ID NO: 474689 - DNA, 15 bp, Homo sapiens
atacacggcgacttc

SEQ ID NO: 474690 - DNA, 15 bp, Homo sapiens
tacacggcgacttct

SEQ ID NO: 474691 - DNA, 15 bp, Homo sapiens
acacggcgacttctc

SEQ ID NO: 474692 - DNA, 15 bp, Homo sapiens
cacggcgacttctct

SEQ ID NO: 474693 - DNA, 15 bp, Homo sapiens
acggcgacttctcta

SEQ ID NO: 474694 - DNA, 15 bp, Homo sapiens
cggcgacttctctag

SEQ ID NO: 474695 - DNA, 15 bp, Homo sapiens
ggcgacttctctaga

SEQ ID NO: 474696 - DNA, 15 bp, Homo sapiens
gcgacttctctagaa

SEQ ID NO: 474697 - DNA, 15 bp, Homo sapiens
cgacttctctagaat

SEQ ID NO: 474698 - DNA, 15 bp, Homo sapiens
gacttctctagaata

SEQ ID NO: 474699 - DNA, 15 bp, Homo sapiens
acttctctagaatac

SEQ ID NO: 474700 - DNA, 15 bp, Homo sapiens
cttctctagaataca

SEQ ID NO: 474701 - DNA, 15 bp, Homo sapiens
ttctctagaatacac

SEQ ID NO: 474702 - DNA, 15 bp, Homo sapiens
tctctagaatacact

SEQ ID NO: 474703 - DNA, 15 bp, Homo sapiens
ctctagaatacactg

SEQ ID NO: 474704 - DNA, 15 bp, Homo sapiens
tctagaatacactgt

SEQ ID NO: 474705 - DNA, 15 bp, Homo sapiens
ctagaatacactgtg

SEQ ID NO: 474706 - DNA, 15 bp, Homo sapiens
tagaatacactgtga

SEQ ID NO: 474707 - DNA, 15 bp, Homo sapiens
agaatacactgtgac

SEQ ID NO: 474708 - DNA, 15 bp, Homo sapiens
gaatacactgtgact

SEQ ID NO: 474709 - DNA, 15 bp, Homo sapiens
aatacactgtgactt

SEQ ID NO: 474710 - DNA, 15 bp, Homo sapiens
atacactgtgacttc

SEQ ID NO: 474711 - DNA, 15 bp, Homo sapiens
tacactgtgacttct

SEQ ID NO: 474712 - DNA, 15 bp, Homo sapiens
acactgtgacttctg

SEQ ID NO: 474713 - DNA, 15 bp, Homo sapiens
cactgtgacttctgt

SEQ ID NO: 474714 - DNA, 15 bp, Homo sapiens
actgtgacttctgtt

SEQ ID NO: 474715 - DNA, 15 bp, Homo sapiens
ctgtgacttctgtta

SEQ ID NO: 474716 - DNA, 15 bp, Homo sapiens
tgtgacttctgttac

SEQ ID NO: 474717 - DNA, 15 bp, Homo sapiens
gtgacttctgttact

SEQ ID NO: 474718 - DNA, 15 bp, Homo sapiens
tgacttctgttactt

SEQ ID NO: 474719 - DNA, 15 bp, Homo sapiens
gacttctgttacttt

SEQ ID NO: 474720 - DNA, 15 bp, Homo sapiens
acttctgttactttt

SEQ ID NO: 474721 - DNA, 15 bp, Homo sapiens
cttctgttacttttg

SEQ ID NO: 474722 - DNA, 15 bp, Homo sapiens
ttctgttacttttga

SEQ ID NO: 474723 - DNA, 15 bp, Homo sapiens
tctgttacttttgat

SEQ ID NO: 474724 - DNA, 15 bp, Homo sapiens
ctgttacttttgatt

SEQ ID NO: 474725 - DNA, 15 bp, Homo sapiens
tgttacttttgattt

SEQ ID NO: 474726 - DNA, 15 bp, Homo sapiens
gttacttttgatttc

SEQ ID NO: 474727 - DNA, 15 bp, Homo sapiens
ttacttttgatttcc

SEQ ID NO: 474728 - DNA, 15 bp, Homo sapiens
tacttttgatttccc

SEQ ID NO: 474729 - DNA, 15 bp, Homo sapiens
acttttgatttcccc

SEQ ID NO: 474730 - DNA, 15 bp, Homo sapiens
cttttgatttcccca

SEQ ID NO: 474731 - DNA, 15 bp, Homo sapiens
ttttgatttccccat

SEQ ID NO: 474732 - DNA, 15 bp, Homo sapiens
tttgatttccccatg

SEQ ID NO: 474733 - DNA, 15 bp, Homo sapiens
ttgatttccccatgg

SEQ ID NO: 474734 - DNA, 15 bp, Homo sapiens
tgatttccccatggt

SEQ ID NO: 474735 - DNA, 15 bp, Homo sapiens
gatttccccatggtg

SEQ ID NO: 474736 - DNA, 15 bp, Homo sapiens
atttccccatggtgg

SEQ ID NO: 474737 - DNA, 15 bp, Homo sapiens
tttccccatggtggc

SEQ ID NO: 474738 - DNA, 15 bp, Homo sapiens
ttccccatggtggct

SEQ ID NO: 474739 - DNA, 15 bp, Homo sapiens
tccccatggtggctc

SEQ ID NO: 474740 - DNA, 15 bp, Homo sapiens
ccccatggtggctct

SEQ ID NO: 474741 - DNA, 15 bp, Homo sapiens
cccatggtggctctc

SEQ ID NO: 474742 - DNA, 15 bp, Homo sapiens
ccatggtggctctca

SEQ ID NO: 474743 - DNA, 15 bp, Homo sapiens
catggtggctctcag

SEQ ID NO: 474744 - DNA, 15 bp, Homo sapiens
atggtggctctcagg

SEQ ID NO: 474745 - DNA, 15 bp, Homo sapiens
tggtggctctcaggg

SEQ ID NO: 474746 - DNA, 15 bp, Homo sapiens
ggtggctctcagggc

SEQ ID NO: 474747 - DNA, 15 bp, Homo sapiens
gtggctctcagggca

SEQ ID NO: 474748 - DNA, 15 bp, Homo sapiens
tggctctcagggcaa

SEQ ID NO: 474749 - DNA, 15 bp, Homo sapiens
ggctctcagggcaac

SEQ ID NO: 474750 - DNA, 15 bp, Homo sapiens
gctctcagggcaacc

SEQ ID NO: 474751 - DNA, 15 bp, Homo sapiens
ctctcagggcaacca

SEQ ID NO: 474752 - DNA, 15 bp, Homo sapiens
tctcagggcaaccac

SEQ ID NO: 474753 - DNA, 15 bp, Homo sapiens
ctcagggcaaccaca

SEQ ID NO: 474754 - DNA, 15 bp, Homo sapiens
tcagggcaaccacat

SEQ ID NO: 474755 - DNA, 15 bp, Homo sapiens
cagggcaaccacata

SEQ ID NO: 474756 - DNA, 15 bp, Homo sapiens
agggcaaccacatat

SEQ ID NO: 474757 - DNA, 15 bp, Homo sapiens
gggcaaccacatata

SEQ ID NO: 474758 - DNA, 15 bp, Homo sapiens
ggcaaccacatatat

SEQ ID NO: 474759 - DNA, 15 bp, Homo sapiens
gcaaccacatatatg

SEQ ID NO: 474760 - DNA, 15 bp, Homo sapiens
caaccacatatatga

SEQ ID NO: 474761 - DNA, 15 bp, Homo sapiens
aaccacatatatgag

SEQ ID NO: 474762 - DNA, 15 bp, Homo sapiens
accacatatatgagc

SEQ ID NO: 474763 - DNA, 15 bp, Homo sapiens
ccacatatatgagcg

SEQ ID NO: 474764 - DNA, 15 bp, Homo sapiens
cacatatatgagcgg

SEQ ID NO: 474765 - DNA, 15 bp, Homo sapiens
acatatatgagcgga

SEQ ID NO: 474766 - DNA, 15 bp, Homo sapiens
catatatgagcggaa

SEQ ID NO: 474767 - DNA, 15 bp, Homo sapiens
atatatgagcggaag

SEQ ID NO: 474768 - DNA, 15 bp, Homo sapiens
tatatgagcggaaga

SEQ ID NO: 474769 - DNA, 15 bp, Homo sapiens
atatgagcggaagat

SEQ ID NO: 474770 - DNA, 15 bp, Homo sapiens
tatgagcggaagata

SEQ ID NO: 474771 - DNA, 15 bp, Homo sapiens
atgagcggaagataa

SEQ ID NO: 474772 - DNA, 15 bp, Homo sapiens
tgagcggaagataat

SEQ ID NO: 474773 - DNA, 15 bp, Homo sapiens
gagcggaagataatt

SEQ ID NO: 474774 - DNA, 15 bp, Homo sapiens
agcggaagataattg

SEQ ID NO: 474775 - DNA, 15 bp, Homo sapiens
gcggaagataattga

SEQ ID NO: 474776 - DNA, 15 bp, Homo sapiens
cggaagataattgag

SEQ ID NO: 474777 - DNA, 15 bp, Homo sapiens
ggaagataattgaga

SEQ ID NO: 474778 - DNA, 15 bp, Homo sapiens
gaagataattgagaa

SEQ ID NO: 474779 - DNA, 15 bp, Homo sapiens
aagataattgagaat

SEQ ID NO: 474780 - DNA, 15 bp, Homo sapiens
agataattgagaatc

SEQ ID NO: 474781 - DNA, 15 bp, Homo sapiens
gataattgagaatct

SEQ ID NO: 474782 - DNA, 15 bp, Homo sapiens
ataattgagaatctc

SEQ ID NO: 474783 - DNA, 15 bp, Homo sapiens
taattgagaatctcc

SEQ ID NO: 474784 - DNA, 15 bp, Homo sapiens
aattgagaatctccc

SEQ ID NO: 474785 - DNA, 15 bp, Homo sapiens
attgagaatctcccc

SEQ ID NO: 474786 - DNA, 15 bp, Homo sapiens
ttgagaatctcccca

SEQ ID NO: 474787 - DNA, 15 bp, Homo sapiens
tgagaatctccccac

SEQ ID NO: 474788 - DNA, 15 bp, Homo sapiens
gagaatctccccaca

SEQ ID NO: 474789 - DNA, 15 bp, Homo sapiens
agaatctccccacac

SEQ ID NO: 474790 - DNA, 15 bp, Homo sapiens
gaatctccccacacc

SEQ ID NO: 474791 - DNA, 15 bp, Homo sapiens
aatctccccacaccc

SEQ ID NO: 474792 - DNA, 15 bp, Homo sapiens
atctccccacacccc

SEQ ID NO: 474793 - DNA, 15 bp, Homo sapiens
tctccccacaccccc

SEQ ID NO: 474794 - DNA, 15 bp, Homo sapiens
ctccccacaccccca

SEQ ID NO: 474795 - DNA, 15 bp, Homo sapiens
tccccacacccccac

SEQ ID NO: 474796 - DNA, 15 bp, Homo sapiens
ccacacccccactgc

SEQ ID NO: 474797 - DNA, 15 bp, Homo sapiens
cacacccccactgct

SEQ ID NO: 474798 - DNA, 15 bp, Homo sapiens
acacccccactgctt

SEQ ID NO: 474799 - DNA, 15 bp, Homo sapiens
cacccccactgcttt

SEQ ID NO: 474800 - DNA, 15 bp, Homo sapiens
acccccactgctttt

SEQ ID NO: 474801 - DNA, 15 bp, Homo sapiens
cccccactgcttttg

SEQ ID NO: 474802 - DNA, 15 bp, Homo sapiens
ccccactgcttttgt

SEQ ID NO: 474803 - DNA, 15 bp, Homo sapiens
cccactgcttttgtc

SEQ ID NO: 474804 - DNA, 15 bp, Homo sapiens
ccactgcttttgtct

SEQ ID NO: 474805 - DNA, 15 bp, Homo sapiens
cactgcttttgtctt

SEQ ID NO: 474806 - DNA, 15 bp, Homo sapiens
actgcttttgtctta

SEQ ID NO: 474807 - DNA, 15 bp, Homo sapiens
ctgcttttgtcttaa

SEQ ID NO: 474808 - DNA, 15 bp, Homo sapiens
tgcttttgtcttaaa

SEQ ID NO: 474809 - DNA, 15 bp, Homo sapiens
gcttttgtcttaaat

SEQ ID NO: 474810 - DNA, 15 bp, Homo sapiens
cttttgtcttaaatt

SEQ ID NO: 474811 - DNA, 15 bp, Homo sapiens
ttttgtcttaaattg

SEQ ID NO: 474812 - DNA, 15 bp, Homo sapiens
tttgtcttaaattgc

SEQ ID NO: 474813 - DNA, 15 bp, Homo sapiens
ttgtcttaaattgct

SEQ ID NO: 474814 - DNA, 15 bp, Homo sapiens
tgtcttaaattgctc

SEQ ID NO: 474815 - DNA, 15 bp, Homo sapiens
gtcttaaattgctct

SEQ ID NO: 474816 - DNA, 15 bp, Homo sapiens
tcttaaattgctcta

SEQ ID NO: 474817 - DNA, 15 bp, Homo sapiens
cttaaattgctctaa

SEQ ID NO: 474818 - DNA, 15 bp, Homo sapiens
ttaaattgctctaaa

SEQ ID NO: 474819 - DNA, 15 bp, Homo sapiens
taaattgctctaaag

SEQ ID NO: 474820 - DNA, 15 bp, Homo sapiens
aaattgctctaaagt

SEQ ID NO: 474821 - DNA, 15 bp, Homo sapiens
aattgctctaaagtg

SEQ ID NO: 474822 - DNA, 15 bp, Homo sapiens
attgctctaaagtgt

SEQ ID NO: 474823 - DNA, 15 bp, Homo sapiens
ttgctctaaagtgtt

SEQ ID NO: 474824 - DNA, 15 bp, Homo sapiens
tgctctaaagtgttt

SEQ ID NO: 474825 - DNA, 15 bp, Homo sapiens
gctctaaagtgtttg

SEQ ID NO: 474826 - DNA, 15 bp, Homo sapiens
ctctaaagtgtttgt

SEQ ID NO: 474827 - DNA, 15 bp, Homo sapiens
tctaaagtgtttgtt

SEQ ID NO: 474828 - DNA, 15 bp, Homo sapiens
ctaaagtgtttgttc

SEQ ID NO: 474829 - DNA, 15 bp, Homo sapiens
taaagtgtttgttct

SEQ ID NO: 474830 - DNA, 15 bp, Homo sapiens
aaagtgtttgttctg

SEQ ID NO: 474831 - DNA, 15 bp, Homo sapiens
aagtgtttgttctgt

SEQ ID NO: 474832 - DNA, 15 bp, Homo sapiens
agtgtttgttctgtg

SEQ ID NO: 474833 - DNA, 15 bp, Homo sapiens
gtgtttgttctgtga

SEQ ID NO: 474834 - DNA, 15 bp, Homo sapiens
tgtttgttctgtgac

SEQ ID NO: 474835 - DNA, 15 bp, Homo sapiens
gtttgttctgtgact

SEQ ID NO: 474836 - DNA, 15 bp, Homo sapiens
tttgttctgtgactt

SEQ ID NO: 474837 - DNA, 15 bp, Homo sapiens
ttgttctgtgacttt

SEQ ID NO: 474838 - DNA, 15 bp, Homo sapiens
tgttctgtgactttt

SEQ ID NO: 474839 - DNA, 15 bp, Homo sapiens
gttctgtgacttttg

SEQ ID NO: 474840 - DNA, 15 bp, Homo sapiens
ttctgtgacttttgt

SEQ ID NO: 474841 - DNA, 15 bp, Homo sapiens
tctgtgacttttgtc

SEQ ID NO: 474842 - DNA, 15 bp, Homo sapiens
ctgtgacttttgtct

SEQ ID NO: 474843 - DNA, 15 bp, Homo sapiens
tgtgacttttgtctc

SEQ ID NO: 474844 - DNA, 15 bp, Homo sapiens
gtgacttttgtctcc

SEQ ID NO: 474845 - DNA, 15 bp, Homo sapiens
tgacttttgtctccc

SEQ ID NO: 474846 - DNA, 15 bp, Homo sapiens
gacttttgtctccct

SEQ ID NO: 474847 - DNA, 15 bp, Homo sapiens
acttttgtctccctc

SEQ ID NO: 474848 - DNA, 15 bp, Homo sapiens
cttttgtctccctct

SEQ ID NO: 474849 - DNA, 15 bp, Homo sapiens
ttttgtctccctctc

SEQ ID NO: 474850 - DNA, 15 bp, Homo sapiens
tttgtctccctctcc

SEQ ID NO: 474851 - DNA, 15 bp, Homo sapiens
ttgtctccctctccc

SEQ ID NO: 474852 - DNA, 15 bp, Homo sapiens
tgtctccctctcccc

SEQ ID NO: 474853 - DNA, 15 bp, Homo sapiens
gtctccctctcccct

SEQ ID NO: 474854 - DNA, 15 bp, Homo sapiens
tctccctctcccctc

SEQ ID NO: 474855 - DNA, 15 bp, Homo sapiens
ctccctctcccctct

SEQ ID NO: 474856 - DNA, 15 bp, Homo sapiens
cctctcccctctttg

SEQ ID NO: 474857 - DNA, 15 bp, Homo sapiens
ctctcccctctttgc

SEQ ID NO: 474858 - DNA, 15 bp, Homo sapiens
tctcccctctttgca

SEQ ID NO: 474859 - DNA, 15 bp, Homo sapiens
ctcccctctttgcag

SEQ ID NO: 474860 - DNA, 15 bp, Homo sapiens
tcccctctttgcagt

SEQ ID NO: 474861 - DNA, 15 bp, Homo sapiens
cccctctttgcagtc

SEQ ID NO: 474862 - DNA, 15 bp, Homo sapiens
ccctctttgcagtcc

SEQ ID NO: 474863 - DNA, 15 bp, Homo sapiens
cctctttgcagtcct

SEQ ID NO: 474864 - DNA, 15 bp, Homo sapiens
ctctttgcagtccta

SEQ ID NO: 474865 - DNA, 15 bp, Homo sapiens
tctttgcagtcctat

SEQ ID NO: 474866 - DNA, 15 bp, Homo sapiens
ctttgcagtcctatc

SEQ ID NO: 474867 - DNA, 15 bp, Homo sapiens
tttgcagtcctatca

SEQ ID NO: 474868 - DNA, 15 bp, Homo sapiens
ttgcagtcctatcac

SEQ ID NO: 474869 - DNA, 15 bp, Homo sapiens
tgcagtcctatcaca

SEQ ID NO: 474870 - DNA, 15 bp, Homo sapiens
gcagtcctatcacac

SEQ ID NO: 474871 - DNA, 15 bp, Homo sapiens
cagtcctatcacact

SEQ ID NO: 474872 - DNA, 15 bp, Homo sapiens
agtcctatcacactc

SEQ ID NO: 474873 - DNA, 15 bp, Homo sapiens
gtcctatcacactca

SEQ ID NO: 474874 - DNA, 15 bp, Homo sapiens
tcctatcacactcat

SEQ ID NO: 474875 - DNA, 15 bp, Homo sapiens
cctatcacactcatc

SEQ ID NO: 474876 - DNA, 15 bp, Homo sapiens
ctatcacactcatca

SEQ ID NO: 474877 - DNA, 15 bp, Homo sapiens
tatcacactcatcag

SEQ ID NO: 474878 - DNA, 15 bp, Homo sapiens
atcacactcatcagt

SEQ ID NO: 474879 - DNA, 15 bp, Homo sapiens
tcacactcatcagta

SEQ ID NO: 474880 - DNA, 15 bp, Homo sapiens
cacactcatcagtat

SEQ ID NO: 474881 - DNA, 15 bp, Homo sapiens
acactcatcagtatg

SEQ ID NO: 474882 - DNA, 15 bp, Homo sapiens
cactcatcagtatgt

SEQ ID NO: 474883 - DNA, 15 bp, Homo sapiens
actcatcagtatgtg

SEQ ID NO: 474884 - DNA, 15 bp, Homo sapiens
ctcatcagtatgtgg

SEQ ID NO: 474885 - DNA, 15 bp, Homo sapiens
tcatcagtatgtggc

SEQ ID NO: 474886 - DNA, 15 bp, Homo sapiens
catcagtatgtggcc

SEQ ID NO: 474887 - DNA, 15 bp, Homo sapiens
atcagtatgtggcca

SEQ ID NO: 474888 - DNA, 15 bp, Homo sapiens
tcagtatgtggccag

SEQ ID NO: 474889 - DNA, 15 bp, Homo sapiens
cagtatgtggccaga

SEQ ID NO: 474890 - DNA, 15 bp, Homo sapiens
agtatgtggccagag

SEQ ID NO: 474891 - DNA, 15 bp, Homo sapiens
gtatgtggccagagc

SEQ ID NO: 474892 - DNA, 15 bp, Homo sapiens
tatgtggccagagca

SEQ ID NO: 474893 - DNA, 15 bp, Homo sapiens
atgtggccagagcac

SEQ ID NO: 474894 - DNA, 15 bp, Homo sapiens
tgtggccagagcact

SEQ ID NO: 474895 - DNA, 15 bp, Homo sapiens
gtggccagagcacta

SEQ ID NO: 474896 - DNA, 15 bp, Homo sapiens
tggccagagcactat

SEQ ID NO: 474897 - DNA, 15 bp, Homo sapiens
ggccagagcactatg

SEQ ID NO: 474898 - DNA, 15 bp, Homo sapiens
gccagagcactatga

SEQ ID NO: 474899 - DNA, 15 bp, Homo sapiens
ccagagcactatgag

SEQ ID NO: 474900 - DNA, 15 bp, Homo sapiens
cagagcactatgagt

SEQ ID NO: 474901 - DNA, 15 bp, Homo sapiens
agagcactatgagtg

SEQ ID NO: 474902 - DNA, 15 bp, Homo sapiens
gagcactatgagtga

SEQ ID NO: 474903 - DNA, 15 bp, Homo sapiens
agcactatgagtgag

SEQ ID NO: 474904 - DNA, 15 bp, Homo sapiens
gcactatgagtgagt

SEQ ID NO: 474905 - DNA, 15 bp, Homo sapiens
cactatgagtgagta

SEQ ID NO: 474906 - DNA, 15 bp, Homo sapiens
actatgagtgagtat

SEQ ID NO: 474907 - DNA, 15 bp, Homo sapiens
ctatgagtgagtatt

SEQ ID NO: 474908 - DNA, 15 bp, Homo sapiens
tatgagtgagtattc

SEQ ID NO: 474909 - DNA, 15 bp, Homo sapiens
atgagtgagtattca

SEQ ID NO: 474910 - DNA, 15 bp, Homo sapiens
tgagtgagtattcat

SEQ ID NO: 474911 - DNA, 15 bp, Homo sapiens
gagtgagtattcata

SEQ ID NO: 474912 - DNA, 15 bp, Homo sapiens
agtgagtattcatag

SEQ ID NO: 474913 - DNA, 15 bp, Homo sapiens
gtgagtattcatagc

SEQ ID NO: 474914 - DNA, 15 bp, Homo sapiens
tgagtattcatagcc

SEQ ID NO: 474915 - DNA, 15 bp, Homo sapiens
gagtattcatagccc

SEQ ID NO: 474916 - DNA, 15 bp, Homo sapiens
agtattcatagccca

SEQ ID NO: 474917 - DNA, 15 bp, Homo sapiens
gtattcatagcccac

SEQ ID NO: 474918 - DNA, 15 bp, Homo sapiens
tattcatagcccacg

SEQ ID NO: 474919 - DNA, 15 bp, Homo sapiens
attcatagcccacgt

SEQ ID NO: 474920 - DNA, 15 bp, Homo sapiens
ttcatagcccacgtg

SEQ ID NO: 474921 - DNA, 15 bp, Homo sapiens
tcatagcccacgtgc

SEQ ID NO: 474922 - DNA, 15 bp, Homo sapiens
catagcccacgtgca

SEQ ID NO: 474923 - DNA, 15 bp, Homo sapiens
atagcccacgtgcag

SEQ ID NO: 474924 - DNA, 15 bp, Homo sapiens
tagcccacgtgcagg

SEQ ID NO: 474925 - DNA, 15 bp, Homo sapiens
agcccacgtgcagga

SEQ ID NO: 474926 - DNA, 15 bp, Homo sapiens
gcccacgtgcaggag

SEQ ID NO: 474927 - DNA, 15 bp, Homo sapiens
cccacgtgcaggaga

SEQ ID NO: 474928 - DNA, 15 bp, Homo sapiens
ccacgtgcaggagag

SEQ ID NO: 474929 - DNA, 15 bp, Homo sapiens
cacgtgcaggagagg

SEQ ID NO: 474930 - DNA, 15 bp, Homo sapiens
acgtgcaggagaggt

SEQ ID NO: 474931 - DNA, 15 bp, Homo sapiens
cgtgcaggagaggtg

SEQ ID NO: 474932 - DNA, 15 bp, Homo sapiens
gtgcaggagaggtgt

SEQ ID NO: 474933 - DNA, 15 bp, Homo sapiens
tgcaggagaggtgtt

SEQ ID NO: 474934 - DNA, 15 bp, Homo sapiens
gcaggagaggtgttc

SEQ ID NO: 474935 - DNA, 15 bp, Homo sapiens
caggagaggtgttct

SEQ ID NO: 474936 - DNA, 15 bp, Homo sapiens
aggagaggtgttctg

SEQ ID NO: 474937 - DNA, 15 bp, Homo sapiens
ggagaggtgttctga

SEQ ID NO: 474938 - DNA, 15 bp, Homo sapiens
gagaggtgttctgat

SEQ ID NO: 474939 - DNA, 15 bp, Homo sapiens
agaggtgttctgatc

SEQ ID NO: 474940 - DNA, 15 bp, Homo sapiens
gaggtgttctgatca

SEQ ID NO: 474941 - DNA, 15 bp, Homo sapiens
aggtgttctgatcag

SEQ ID NO: 474942 - DNA, 15 bp, Homo sapiens
ggtgttctgatcagt

SEQ ID NO: 474943 - DNA, 15 bp, Homo sapiens
gtgttctgatcagtg

SEQ ID NO: 474944 - DNA, 15 bp, Homo sapiens
tgttctgatcagtgg

SEQ ID NO: 474945 - DNA, 15 bp, Homo sapiens
gttctgatcagtggt

SEQ ID NO: 474946 - DNA, 15 bp, Homo sapiens
ttctgatcagtggta

SEQ ID NO: 474947 - DNA, 15 bp, Homo sapiens
tctgatcagtggtac

SEQ ID NO: 474948 - DNA, 15 bp, Homo sapiens
ctgatcagtggtact

SEQ ID NO: 474949 - DNA, 15 bp, Homo sapiens
tgatcagtggtacta

SEQ ID NO: 474950 - DNA, 15 bp, Homo sapiens
gatcagtggtactag

SEQ ID NO: 474951 - DNA, 15 bp, Homo sapiens
atcagtggtactagc

SEQ ID NO: 474952 - DNA, 15 bp, Homo sapiens
tcagtggtactagca

SEQ ID NO: 474953 - DNA, 15 bp, Homo sapiens
cagtggtactagcat

SEQ ID NO: 474954 - DNA, 15 bp, Homo sapiens
agtggtactagcatg

SEQ ID NO: 474955 - DNA, 15 bp, Homo sapiens
gtggtactagcatgg

SEQ ID NO: 474956 - DNA, 15 bp, Homo sapiens
tggtactagcatggg

SEQ ID NO: 474957 - DNA, 15 bp, Homo sapiens
ggtactagcatgggg

SEQ ID NO: 474958 - DNA, 15 bp, Homo sapiens
gtactagcatggggg

SEQ ID NO: 474959 - DNA, 15 bp, Homo sapiens
tactagcatgggggt

SEQ ID NO: 474960 - DNA, 15 bp, Homo sapiens
actagcatgggggtc

SEQ ID NO: 474961 - DNA, 15 bp, Homo sapiens
ctagcatgggggtct

SEQ ID NO: 474962 - DNA, 15 bp, Homo sapiens
tagcatgggggtctt

SEQ ID NO: 474963 - DNA, 15 bp, Homo sapiens
agcatgggggtctta

SEQ ID NO: 474964 - DNA, 15 bp, Homo sapiens
gcatgggggtcttac

SEQ ID NO: 474965 - DNA, 15 bp, Homo sapiens
catgggggtcttact

SEQ ID NO: 474966 - DNA, 15 bp, Homo sapiens
atgggggtcttacta

SEQ ID NO: 474967 - DNA, 15 bp, Homo sapiens
tgggggtcttactaa

SEQ ID NO: 474968 - DNA, 15 bp, Homo sapiens
gggggtcttactaaa

SEQ ID NO: 474969 - DNA, 15 bp, Homo sapiens
ggggtcttactaaac

SEQ ID NO: 474970 - DNA, 15 bp, Homo sapiens
gggtcttactaaact

SEQ ID NO: 474971 - DNA, 15 bp, Homo sapiens
ggtcttactaaactc

SEQ ID NO: 474972 - DNA, 15 bp, Homo sapiens
gtcttactaaactct

SEQ ID NO: 474973 - DNA, 15 bp, Homo sapiens
tcttactaaactctt

SEQ ID NO: 474974 - DNA, 15 bp, Homo sapiens
cttactaaactcttg

SEQ ID NO: 474975 - DNA, 15 bp, Homo sapiens
ttactaaactcttgg

SEQ ID NO: 474976 - DNA, 15 bp, Homo sapiens
tactaaactcttggt

SEQ ID NO: 474977 - DNA, 15 bp, Homo sapiens
actaaactcttggtc

SEQ ID NO: 474978 - DNA, 15 bp, Homo sapiens
ctaaactcttggtct

SEQ ID NO: 474979 - DNA, 15 bp, Homo sapiens
taaactcttggtcta

SEQ ID NO: 474980 - DNA, 15 bp, Homo sapiens
aaactcttggtctaa

SEQ ID NO: 474981 - DNA, 15 bp, Homo sapiens
aactcttggtctaaa

SEQ ID NO: 474982 - DNA, 15 bp, Homo sapiens
actcttggtctaaaa

SEQ ID NO: 474983 - DNA, 15 bp, Homo sapiens
ctcttggtctaaaat

SEQ ID NO: 474984 - DNA, 15 bp, Homo sapiens
tcttggtctaaaata

SEQ ID NO: 474985 - DNA, 15 bp, Homo sapiens
cttggtctaaaataa

SEQ ID NO: 474986 - DNA, 15 bp, Homo sapiens
ttggtctaaaataat

SEQ ID NO: 474987 - DNA, 15 bp, Homo sapiens
tggtctaaaataata

SEQ ID NO: 474988 - DNA, 15 bp, Homo sapiens
ggtctaaaataatac

SEQ ID NO: 474989 - DNA, 15 bp, Homo sapiens
gtctaaaataatact

SEQ ID NO: 474990 - DNA, 15 bp, Homo sapiens
tctaaaataatactt

SEQ ID NO: 474991 - DNA, 15 bp, Homo sapiens
ctaaaataatacttc

SEQ ID NO: 474992 - DNA, 15 bp, Homo sapiens
taaaataatacttct

SEQ ID NO: 474993 - DNA, 15 bp, Homo sapiens
aaaataatacttctg

SEQ ID NO: 474994 - DNA, 15 bp, Homo sapiens
aaataatacttctgt

SEQ ID NO: 474995 - DNA, 15 bp, Homo sapiens
aataatacttctgtg

SEQ ID NO: 474996 - DNA, 15 bp, Homo sapiens
ataatacttctgtgt

SEQ ID NO: 474997 - DNA, 15 bp, Homo sapiens
taatacttctgtgtt

SEQ ID NO: 474998 - DNA, 15 bp, Homo sapiens
aatacttctgtgttc

SEQ ID NO: 474999 - DNA, 15 bp, Homo sapiens
atacttctgtgttcc

SEQ ID NO: 475000 - DNA, 15 bp, Homo sapiens
tacttctgtgttccg

SEQ ID NO: 475001 - DNA, 15 bp, Homo sapiens
acttctgtgttccgg

SEQ ID NO: 475002 - DNA, 15 bp, Homo sapiens
cttctgtgttccggg

SEQ ID NO: 475003 - DNA, 15 bp, Homo sapiens
ttctgtgttccgggt

SEQ ID NO: 475004 - DNA, 15 bp, Homo sapiens
tctgtgttccgggta

SEQ ID NO: 475005 - DNA, 15 bp, Homo sapiens
ctgtgttccgggtaa

SEQ ID NO: 475006 - DNA, 15 bp, Homo sapiens
tgtgttccgggtaac

SEQ ID NO: 475007 - DNA, 15 bp, Homo sapiens
gtgttccgggtaaca

SEQ ID NO: 475008 - DNA, 15 bp, Homo sapiens
tgttccgggtaacaa

SEQ ID NO: 475009 - DNA, 15 bp, Homo sapiens
gttccgggtaacaat

SEQ ID NO: 475010 - DNA, 15 bp, Homo sapiens
ttccgggtaacaatc

SEQ ID NO: 475011 - DNA, 15 bp, Homo sapiens
tccgggtaacaatcc

SEQ ID NO: 475012 - DNA, 15 bp, Homo sapiens
ccgggtaacaatcct

SEQ ID NO: 475013 - DNA, 15 bp, Homo sapiens
cgggtaacaatccta

SEQ ID NO: 475014 - DNA, 15 bp, Homo sapiens
gggtaacaatcctag

SEQ ID NO: 475015 - DNA, 15 bp, Homo sapiens
ggtaacaatcctagt

SEQ ID NO: 475016 - DNA, 15 bp, Homo sapiens
gtaacaatcctagtg

SEQ ID NO: 475017 - DNA, 15 bp, Homo sapiens
taacaatcctagtgg

SEQ ID NO: 475018 - DNA, 15 bp, Homo sapiens
aacaatcctagtggt

SEQ ID NO: 475019 - DNA, 15 bp, Homo sapiens
acaatcctagtggtc

SEQ ID NO: 475020 - DNA, 15 bp, Homo sapiens
caatcctagtggtct

SEQ ID NO: 475021 - DNA, 15 bp, Homo sapiens
aatcctagtggtctg

SEQ ID NO: 475022 - DNA, 15 bp, Homo sapiens
atcctagtggtctgt

SEQ ID NO: 475023 - DNA, 15 bp, Homo sapiens
tcctagtggtctgtt

SEQ ID NO: 475024 - DNA, 15 bp, Homo sapiens
cctagtggtctgttt

SEQ ID NO: 475025 - DNA, 15 bp, Homo sapiens
ctagtggtctgtttg

SEQ ID NO: 475026 - DNA, 15 bp, Homo sapiens
tagtggtctgtttgc

SEQ ID NO: 475027 - DNA, 15 bp, Homo sapiens
agtggtctgtttgca

SEQ ID NO: 475028 - DNA, 15 bp, Homo sapiens
gtggtctgtttgcat

SEQ ID NO: 475029 - DNA, 15 bp, Homo sapiens
tggtctgtttgcatg

SEQ ID NO: 475030 - DNA, 15 bp, Homo sapiens
ggtctgtttgcatgg

SEQ ID NO: 475031 - DNA, 15 bp, Homo sapiens
gtctgtttgcatggc

SEQ ID NO: 475032 - DNA, 15 bp, Homo sapiens
tctgtttgcatggca

SEQ ID NO: 475033 - DNA, 15 bp, Homo sapiens
ctgtttgcatggcag

SEQ ID NO: 475034 - DNA, 15 bp, Homo sapiens
tgtttgcatggcaga

SEQ ID NO: 475035 - DNA, 15 bp, Homo sapiens
gtttgcatggcagat

SEQ ID NO: 475036 - DNA, 15 bp, Homo sapiens
tttgcatggcagatt

SEQ ID NO: 475037 - DNA, 15 bp, Homo sapiens
ttgcatggcagattc

SEQ ID NO: 475038 - DNA, 15 bp, Homo sapiens
tgcatggcagattca

SEQ ID NO: 475039 - DNA, 15 bp, Homo sapiens
gcatggcagattcat

SEQ ID NO: 475040 - DNA, 15 bp, Homo sapiens
catggcagattcatt

SEQ ID NO: 475041 - DNA, 15 bp, Homo sapiens
atggcagattcatta

SEQ ID NO: 475042 - DNA, 15 bp, Homo sapiens
tggcagattcattac

SEQ ID NO: 475043 - DNA, 15 bp, Homo sapiens
ggcagattcattact

SEQ ID NO: 475044 - DNA, 15 bp, Homo sapiens
gcagattcattactt

SEQ ID NO: 475045 - DNA, 15 bp, Homo sapiens
cagattcattactta

SEQ ID NO: 475046 - DNA, 15 bp, Homo sapiens
agattcattacttaa

SEQ ID NO: 475047 - DNA, 15 bp, Homo sapiens
gattcattacttaag

SEQ ID NO: 475048 - DNA, 15 bp, Homo sapiens
attcattacttaagt

SEQ ID NO: 475049 - DNA, 15 bp, Homo sapiens
ttcattacttaagta

SEQ ID NO: 475050 - DNA, 15 bp, Homo sapiens
tcattacttaagtaa

SEQ ID NO: 475051 - DNA, 15 bp, Homo sapiens
cattacttaagtaac

SEQ ID NO: 475052 - DNA, 15 bp, Homo sapiens
attacttaagtaacc

SEQ ID NO: 475053 - DNA, 15 bp, Homo sapiens
ttacttaagtaacct

SEQ ID NO: 475054 - DNA, 15 bp, Homo sapiens
tacttaagtaaccta

SEQ ID NO: 475055 - DNA, 15 bp, Homo sapiens
acttaagtaacctaa

SEQ ID NO: 475056 - DNA, 15 bp, Homo sapiens
cttaagtaacctaac

SEQ ID NO: 475057 - DNA, 15 bp, Homo sapiens
ttaagtaacctaaca

SEQ ID NO: 475058 - DNA, 15 bp, Homo sapiens
taagtaacctaacat

SEQ ID NO: 475059 - DNA, 15 bp, Homo sapiens
aagtaacctaacatt

SEQ ID NO: 475060 - DNA, 15 bp, Homo sapiens
agtaacctaacattt

SEQ ID NO: 475061 - DNA, 15 bp, Homo sapiens
gtaacctaacatttc

SEQ ID NO: 475062 - DNA, 15 bp, Homo sapiens
taacctaacatttct

SEQ ID NO: 475063 - DNA, 15 bp, Homo sapiens
aacctaacatttcta

SEQ ID NO: 475064 - DNA, 15 bp, Homo sapiens
acctaacatttctaa

SEQ ID NO: 475065 - DNA, 15 bp, Homo sapiens
cctaacatttctaat

SEQ ID NO: 475066 - DNA, 15 bp, Homo sapiens
ctaacatttctaata

SEQ ID NO: 475067 - DNA, 15 bp, Homo sapiens
taacatttctaatag

SEQ ID NO: 475068 - DNA, 15 bp, Homo sapiens
aacatttctaatagt

SEQ ID NO: 475069 - DNA, 15 bp, Homo sapiens
acatttctaatagta

SEQ ID NO: 475070 - DNA, 15 bp, Homo sapiens
catttctaatagtaa

SEQ ID NO: 475071 - DNA, 15 bp, Homo sapiens
atttctaatagtaac

SEQ ID NO: 475072 - DNA, 15 bp, Homo sapiens
tttctaatagtaaca

SEQ ID NO: 475073 - DNA, 15 bp, Homo sapiens
ttctaatagtaacac

SEQ ID NO: 475074 - DNA, 15 bp, Homo sapiens
tctaatagtaacacc

SEQ ID NO: 475075 - DNA, 15 bp, Homo sapiens
ctaatagtaacacct

SEQ ID NO: 475076 - DNA, 15 bp, Homo sapiens
taatagtaacaccta

SEQ ID NO: 475077 - DNA, 15 bp, Homo sapiens
aatagtaacacctat

SEQ ID NO: 475078 - DNA, 15 bp, Homo sapiens
atagtaacacctatc

SEQ ID NO: 475079 - DNA, 15 bp, Homo sapiens
tagtaacacctatca

SEQ ID NO: 475080 - DNA, 15 bp, Homo sapiens
agtaacacctatcaa

SEQ ID NO: 475081 - DNA, 15 bp, Homo sapiens
gtaacacctatcaat

SEQ ID NO: 475082 - DNA, 15 bp, Homo sapiens
taacacctatcaata

SEQ ID NO: 475083 - DNA, 15 bp, Homo sapiens
aacacctatcaatat

SEQ ID NO: 475084 - DNA, 15 bp, Homo sapiens
acacctatcaatatt

SEQ ID NO: 475085 - DNA, 15 bp, Homo sapiens
cacctatcaatattt

SEQ ID NO: 475086 - DNA, 15 bp, Homo sapiens
acctatcaatatttg

SEQ ID NO: 475087 - DNA, 15 bp, Homo sapiens
cctatcaatatttgg

SEQ ID NO: 475088 - DNA, 15 bp, Homo sapiens
ctatcaatatttggg

SEQ ID NO: 475089 - DNA, 15 bp, Homo sapiens
tatcaatatttgggc

SEQ ID NO: 475090 - DNA, 15 bp, Homo sapiens
atcaatatttgggca

SEQ ID NO: 475091 - DNA, 15 bp, Homo sapiens
tcaatatttgggcat

SEQ ID NO: 475092 - DNA, 15 bp, Homo sapiens
caatatttgggcata

SEQ ID NO: 475093 - DNA, 15 bp, Homo sapiens
aatatttgggcataa

SEQ ID NO: 475094 - DNA, 15 bp, Homo sapiens
atatttgggcataaa

SEQ ID NO: 475095 - DNA, 15 bp, Homo sapiens
tatttgggcataaaa

SEQ ID NO: 475096 - DNA, 15 bp, Homo sapiens
atttgggcataaaat

SEQ ID NO: 475097 - DNA, 15 bp, Homo sapiens
tttgggcataaaatt

SEQ ID NO: 475098 - DNA, 15 bp, Homo sapiens
ttgggcataaaatta

SEQ ID NO: 475099 - DNA, 15 bp, Homo sapiens
tgggcataaaattat

SEQ ID NO: 475100 - DNA, 15 bp, Homo sapiens
gggcataaaattatt

SEQ ID NO: 475101 - DNA, 15 bp, Homo sapiens
ggcataaaattattg

SEQ ID NO: 475102 - DNA, 15 bp, Homo sapiens
gcataaaattattgc

SEQ ID NO: 475103 - DNA, 15 bp, Homo sapiens
cataaaattattgct

SEQ ID NO: 475104 - DNA, 15 bp, Homo sapiens
ataaaattattgctt

SEQ ID NO: 475105 - DNA, 15 bp, Homo sapiens
taaaattattgcttt

SEQ ID NO: 475106 - DNA, 15 bp, Homo sapiens
aaaattattgctttg

SEQ ID NO: 475107 - DNA, 15 bp, Homo sapiens
aaattattgctttgt

SEQ ID NO: 475108 - DNA, 15 bp, Homo sapiens
aattattgctttgtt

SEQ ID NO: 475109 - DNA, 15 bp, Homo sapiens
attattgctttgttt

SEQ ID NO: 475110 - DNA, 15 bp, Homo sapiens
ttattgctttgtttt

SEQ ID NO: 475111 - DNA, 15 bp, Homo sapiens
tattgctttgttttt

SEQ ID NO: 475112 - DNA, 15 bp, Homo sapiens
attgctttgtttttt

SEQ ID NO: 475113 - DNA, 15 bp, Homo sapiens
ctttgtttttttctt

SEQ ID NO: 475114 - DNA, 15 bp, Homo sapiens
tttgtttttttcttt

SEQ ID NO: 475115 - DNA, 15 bp, Homo sapiens
ttgtttttttctttt

SEQ ID NO: 475116 - DNA, 15 bp, Homo sapiens
tgtttttttctttta

SEQ ID NO: 475117 - DNA, 15 bp, Homo sapiens
gtttttttcttttaa

SEQ ID NO: 475118 - DNA, 15 bp, Homo sapiens
tttttttcttttaaa

SEQ ID NO: 475119 - DNA, 15 bp, Homo sapiens
tttttcttttaaagc

SEQ ID NO: 475120 - DNA, 15 bp, Homo sapiens
ttttcttttaaagcc

SEQ ID NO: 475121 - DNA, 15 bp, Homo sapiens
tttcttttaaagccc

SEQ ID NO: 475122 - DNA, 15 bp, Homo sapiens
ttcttttaaagcccc

SEQ ID NO: 475123 - DNA, 15 bp, Homo sapiens
tcttttaaagcccct

SEQ ID NO: 475124 - DNA, 15 bp, Homo sapiens
cttttaaagcccctc

SEQ ID NO: 475125 - DNA, 15 bp, Homo sapiens
ttttaaagcccctca

SEQ ID NO: 475126 - DNA, 15 bp, Homo sapiens
tttaaagcccctcac

SEQ ID NO: 475127 - DNA, 15 bp, Homo sapiens
ttaaagcccctcaca

SEQ ID NO: 475128 - DNA, 15 bp, Homo sapiens
taaagcccctcacaa

SEQ ID NO: 475129 - DNA, 15 bp, Homo sapiens
aaagcccctcacaat

SEQ ID NO: 475130 - DNA, 15 bp, Homo sapiens
aagcccctcacaatc

SEQ ID NO: 475131 - DNA, 15 bp, Homo sapiens
agcccctcacaatct

SEQ ID NO: 475132 - DNA, 15 bp, Homo sapiens
gcccctcacaatctc

SEQ ID NO: 475133 - DNA, 15 bp, Homo sapiens
cccctcacaatctcc

SEQ ID NO: 475134 - DNA, 15 bp, Homo sapiens
ccctcacaatctcct

SEQ ID NO: 475135 - DNA, 15 bp, Homo sapiens
cctcacaatctcctc

SEQ ID NO: 475136 - DNA, 15 bp, Homo sapiens
ctcacaatctcctca

SEQ ID NO: 475137 - DNA, 15 bp, Homo sapiens
tcacaatctcctcaa

SEQ ID NO: 475138 - DNA, 15 bp, Homo sapiens
cacaatctcctcaac

SEQ ID NO: 475139 - DNA, 15 bp, Homo sapiens
acaatctcctcaact

SEQ ID NO: 475140 - DNA, 15 bp, Homo sapiens
caatctcctcaactg

SEQ ID NO: 475141 - DNA, 15 bp, Homo sapiens
aatctcctcaactgt

SEQ ID NO: 475142 - DNA, 15 bp, Homo sapiens
atctcctcaactgtt

SEQ ID NO: 475143 - DNA, 15 bp, Homo sapiens
tctcctcaactgttt

SEQ ID NO: 475144 - DNA, 15 bp, Homo sapiens
ctcctcaactgtttc

SEQ ID NO: 475145 - DNA, 15 bp, Homo sapiens
tcctcaactgtttca

SEQ ID NO: 475146 - DNA, 15 bp, Homo sapiens
cctcaactgtttcat

SEQ ID NO: 475147 - DNA, 15 bp, Homo sapiens
ctcaactgtttcatg

SEQ ID NO: 475148 - DNA, 15 bp, Homo sapiens
tcaactgtttcatga

SEQ ID NO: 475149 - DNA, 15 bp, Homo sapiens
caactgtttcatgat

SEQ ID NO: 475150 - DNA, 15 bp, Homo sapiens
aactgtttcatgatg

SEQ ID NO: 475151 - DNA, 15 bp, Homo sapiens
actgtttcatgatga

SEQ ID NO: 475152 - DNA, 15 bp, Homo sapiens
ctgtttcatgatgac

SEQ ID NO: 475153 - DNA, 15 bp, Homo sapiens
tgtttcatgatgaca

SEQ ID NO: 475154 - DNA, 15 bp, Homo sapiens
gtttcatgatgacac

SEQ ID NO: 475155 - DNA, 15 bp, Homo sapiens
tttcatgatgacacc

SEQ ID NO: 475156 - DNA, 15 bp, Homo sapiens
ttcatgatgacaccc

SEQ ID NO: 475157 - DNA, 15 bp, Homo sapiens
tcatgatgacaccca

SEQ ID NO: 475158 - DNA, 15 bp, Homo sapiens
catgatgacacccat

SEQ ID NO: 475159 - DNA, 15 bp, Homo sapiens
atgatgacacccatt

SEQ ID NO: 475160 - DNA, 15 bp, Homo sapiens
tgatgacacccattc

SEQ ID NO: 475161 - DNA, 15 bp, Homo sapiens
gatgacacccattca

SEQ ID NO: 475162 - DNA, 15 bp, Homo sapiens
atgacacccattcaa

SEQ ID NO: 475163 - DNA, 15 bp, Homo sapiens
tgacacccattcaag

SEQ ID NO: 475164 - DNA, 15 bp, Homo sapiens
gacacccattcaaga

SEQ ID NO: 475165 - DNA, 15 bp, Homo sapiens
acacccattcaagaa

SEQ ID NO: 475166 - DNA, 15 bp, Homo sapiens
cacccattcaagaat

SEQ ID NO: 475167 - DNA, 15 bp, Homo sapiens
acccattcaagaata

SEQ ID NO: 475168 - DNA, 15 bp, Homo sapiens
cccattcaagaatag

SEQ ID NO: 475169 - DNA, 15 bp, Homo sapiens
ccattcaagaataga

SEQ ID NO: 475170 - DNA, 15 bp, Homo sapiens
cattcaagaatagaa

SEQ ID NO: 475171 - DNA, 15 bp, Homo sapiens
attcaagaatagaac

SEQ ID NO: 475172 - DNA, 15 bp, Homo sapiens
ttcaagaatagaaca

SEQ ID NO: 475173 - DNA, 15 bp, Homo sapiens
tcaagaatagaacaa

SEQ ID NO: 475174 - DNA, 15 bp, Homo sapiens
caagaatagaacaat

SEQ ID NO: 475175 - DNA, 15 bp, Homo sapiens
aagaatagaacaata

SEQ ID NO: 475176 - DNA, 15 bp, Homo sapiens
agaatagaacaatat

SEQ ID NO: 475177 - DNA, 15 bp, Homo sapiens
gaatagaacaatatg

SEQ ID NO: 475178 - DNA, 15 bp, Homo sapiens
aatagaacaatatgc

SEQ ID NO: 475179 - DNA, 15 bp, Homo sapiens
atagaacaatatgcc

SEQ ID NO: 475180 - DNA, 15 bp, Homo sapiens
tagaacaatatgcca

SEQ ID NO: 475181 - DNA, 15 bp, Homo sapiens
agaacaatatgccac

SEQ ID NO: 475182 - DNA, 15 bp, Homo sapiens
gaacaatatgccaca

SEQ ID NO: 475183 - DNA, 15 bp, Homo sapiens
aacaatatgccacac

SEQ ID NO: 475184 - DNA, 15 bp, Homo sapiens
acaatatgccacacg

SEQ ID NO: 475185 - DNA, 15 bp, Homo sapiens
caatatgccacacgg

SEQ ID NO: 475186 - DNA, 15 bp, Homo sapiens
aatatgccacacggt

SEQ ID NO: 475187 - DNA, 15 bp, Homo sapiens
atatgccacacggta

SEQ ID NO: 475188 - DNA, 15 bp, Homo sapiens
tatgccacacggtaa

SEQ ID NO: 475189 - DNA, 15 bp, Homo sapiens
atgccacacggtaag

SEQ ID NO: 475190 - DNA, 15 bp, Homo sapiens
tgccacacggtaaga

SEQ ID NO: 475191 - DNA, 15 bp, Homo sapiens
gccacacggtaagaa

SEQ ID NO: 475192 - DNA, 15 bp, Homo sapiens
ccacacggtaagaaa

SEQ ID NO: 475193 - DNA, 15 bp, Homo sapiens
cacacggtaagaaac

SEQ ID NO: 475194 - DNA, 15 bp, Homo sapiens
acacggtaagaaact

SEQ ID NO: 475195 - DNA, 15 bp, Homo sapiens
cacggtaagaaactt

SEQ ID NO: 475196 - DNA, 15 bp, Homo sapiens
acggtaagaaacttt

SEQ ID NO: 475197 - DNA, 15 bp, Homo sapiens
cggtaagaaactttg

SEQ ID NO: 475198 - DNA, 15 bp, Homo sapiens
ggtaagaaactttga

SEQ ID NO: 475199 - DNA, 15 bp, Homo sapiens
gtaagaaactttgat

SEQ ID NO: 475200 - DNA, 15 bp, Homo sapiens
taagaaactttgatc

SEQ ID NO: 475201 - DNA, 15 bp, Homo sapiens
aagaaactttgatca

SEQ ID NO: 475202 - DNA, 15 bp, Homo sapiens
agaaactttgatcag

SEQ ID NO: 475203 - DNA, 15 bp, Homo sapiens
gaaactttgatcaga

SEQ ID NO: 475204 - DNA, 15 bp, Homo sapiens
aaactttgatcagag

SEQ ID NO: 475205 - DNA, 15 bp, Homo sapiens
aactttgatcagagc

SEQ ID NO: 475206 - DNA, 15 bp, Homo sapiens
actttgatcagagcc

SEQ ID NO: 475207 - DNA, 15 bp, Homo sapiens
ctttgatcagagccc

SEQ ID NO: 475208 - DNA, 15 bp, Homo sapiens
tttgatcagagccct

SEQ ID NO: 475209 - DNA, 15 bp, Homo sapiens
ttgatcagagccctc

SEQ ID NO: 475210 - DNA, 15 bp, Homo sapiens
tgatcagagccctcc

SEQ ID NO: 475211 - DNA, 15 bp, Homo sapiens
gatcagagccctcca

SEQ ID NO: 475212 - DNA, 15 bp, Homo sapiens
atcagagccctccac

SEQ ID NO: 475213 - DNA, 15 bp, Homo sapiens
tcagagccctccact

SEQ ID NO: 475214 - DNA, 15 bp, Homo sapiens
cagagccctccactg

SEQ ID NO: 475215 - DNA, 15 bp, Homo sapiens
agagccctccactgc

SEQ ID NO: 475216 - DNA, 15 bp, Homo sapiens
gagccctccactgca

SEQ ID NO: 475217 - DNA, 15 bp, Homo sapiens
agccctccactgcac

SEQ ID NO: 475218 - DNA, 15 bp, Homo sapiens
gccctccactgcact

SEQ ID NO: 475219 - DNA, 15 bp, Homo sapiens
ccctccactgcactg

SEQ ID NO: 475220 - DNA, 15 bp, Homo sapiens
cctccactgcactgc

SEQ ID NO: 475221 - DNA, 15 bp, Homo sapiens
ctccactgcactgcc

SEQ ID NO: 475222 - DNA, 15 bp, Homo sapiens
tccactgcactgcca

SEQ ID NO: 475223 - DNA, 15 bp, Homo sapiens
ccactgcactgccac

SEQ ID NO: 475224 - DNA, 15 bp, Homo sapiens
cactgcactgccacc

SEQ ID NO: 475225 - DNA, 15 bp, Homo sapiens
actgcactgccaccc

SEQ ID NO: 475226 - DNA, 15 bp, Homo sapiens
ctgcactgccaccca

SEQ ID NO: 475227 - DNA, 15 bp, Homo sapiens
tgcactgccacccag

SEQ ID NO: 475228 - DNA, 15 bp, Homo sapiens
gcactgccacccaga

SEQ ID NO: 475229 - DNA, 15 bp, Homo sapiens
cactgccacccagaa

SEQ ID NO: 475230 - DNA, 15 bp, Homo sapiens
actgccacccagaat

SEQ ID NO: 475231 - DNA, 15 bp, Homo sapiens
ctgccacccagaatg

SEQ ID NO: 475232 - DNA, 15 bp, Homo sapiens
tgccacccagaatgt

SEQ ID NO: 475233 - DNA, 15 bp, Homo sapiens
gccacccagaatgta

SEQ ID NO: 475234 - DNA, 15 bp, Homo sapiens
ccacccagaatgtat

SEQ ID NO: 475235 - DNA, 15 bp, Homo sapiens
cacccagaatgtatc

SEQ ID NO: 475236 - DNA, 15 bp, Homo sapiens
acccagaatgtatct

SEQ ID NO: 475237 - DNA, 15 bp, Homo sapiens
cccagaatgtatcta

SEQ ID NO: 475238 - DNA, 15 bp, Homo sapiens
ccagaatgtatctat

SEQ ID NO: 475239 - DNA, 15 bp, Homo sapiens
cagaatgtatctatg

SEQ ID NO: 475240 - DNA, 15 bp, Homo sapiens
agaatgtatctatgt

SEQ ID NO: 475241 - DNA, 15 bp, Homo sapiens
gaatgtatctatgtc

SEQ ID NO: 475242 - DNA, 15 bp, Homo sapiens
aatgtatctatgtct

SEQ ID NO: 475243 - DNA, 15 bp, Homo sapiens
atgtatctatgtcta

SEQ ID NO: 475244 - DNA, 15 bp, Homo sapiens
tgtatctatgtctaa

SEQ ID NO: 475245 - DNA, 15 bp, Homo sapiens
gtatctatgtctaat

SEQ ID NO: 475246 - DNA, 15 bp, Homo sapiens
tatctatgtctaatt

SEQ ID NO: 475247 - DNA, 15 bp, Homo sapiens
atctatgtctaatta

SEQ ID NO: 475248 - DNA, 15 bp, Homo sapiens
tctatgtctaattaa

SEQ ID NO: 475249 - DNA, 15 bp, Homo sapiens
ctatgtctaattaat

SEQ ID NO: 475250 - DNA, 15 bp, Homo sapiens
tatgtctaattaatc

SEQ ID NO: 475251 - DNA, 15 bp, Homo sapiens
atgtctaattaatct

SEQ ID NO: 475252 - DNA, 15 bp, Homo sapiens
tgtctaattaatcta

SEQ ID NO: 475253 - DNA, 15 bp, Homo sapiens
gtctaattaatctaa

SEQ ID NO: 475254 - DNA, 15 bp, Homo sapiens
tctaattaatctaat

SEQ ID NO: 475255 - DNA, 15 bp, Homo sapiens
ctaattaatctaata

SEQ ID NO: 475256 - DNA, 15 bp, Homo sapiens
taattaatctaatat

SEQ ID NO: 475257 - DNA, 15 bp, Homo sapiens
aattaatctaatatc

SEQ ID NO: 475258 - DNA, 15 bp, Homo sapiens
attaatctaatatca

SEQ ID NO: 475259 - DNA, 15 bp, Homo sapiens
ttaatctaatatcat

SEQ ID NO: 475260 - DNA, 15 bp, Homo sapiens
taatctaatatcatt

SEQ ID NO: 475261 - DNA, 15 bp, Homo sapiens
aatctaatatcatta

SEQ ID NO: 475262 - DNA, 15 bp, Homo sapiens
atctaatatcattaa

SEQ ID NO: 475263 - DNA, 15 bp, Homo sapiens
tctaatatcattaat

SEQ ID NO: 475264 - DNA, 15 bp, Homo sapiens
ctaatatcattaata

SEQ ID NO: 475265 - DNA, 15 bp, Homo sapiens
taatatcattaatat

SEQ ID NO: 475266 - DNA, 15 bp, Homo sapiens
aatatcattaatata

SEQ ID NO: 475267 - DNA, 15 bp, Homo sapiens
atatcattaatatac

SEQ ID NO: 475268 - DNA, 15 bp, Homo sapiens
tatcattaatatacc

SEQ ID NO: 475269 - DNA, 15 bp, Homo sapiens
atcattaatatacct

SEQ ID NO: 475270 - DNA, 15 bp, Homo sapiens
tcattaatatacctt

SEQ ID NO: 475271 - DNA, 15 bp, Homo sapiens
cattaatataccttg

SEQ ID NO: 475272 - DNA, 15 bp, Homo sapiens
attaatataccttga

SEQ ID NO: 475273 - DNA, 15 bp, Homo sapiens
ttaatataccttgat

SEQ ID NO: 475274 - DNA, 15 bp, Homo sapiens
taatataccttgatt

SEQ ID NO: 475275 - DNA, 15 bp, Homo sapiens
aatataccttgattt

SEQ ID NO: 475276 - DNA, 15 bp, Homo sapiens
atataccttgattta

SEQ ID NO: 475277 - DNA, 15 bp, Homo sapiens
tataccttgatttaa

SEQ ID NO: 475278 - DNA, 15 bp, Homo sapiens
ataccttgatttaag

SEQ ID NO: 475279 - DNA, 15 bp, Homo sapiens
taccttgatttaaga

SEQ ID NO: 475280 - DNA, 15 bp, Homo sapiens
accttgatttaagaa

SEQ ID NO: 475281 - DNA, 15 bp, Homo sapiens
ccttgatttaagaaa

SEQ ID NO: 475282 - DNA, 15 bp, Homo sapiens
cttgatttaagaaat

SEQ ID NO: 475283 - DNA, 15 bp, Homo sapiens
ttgatttaagaaatg

SEQ ID NO: 475284 - DNA, 15 bp, Homo sapiens
tgatttaagaaatgc

SEQ ID NO: 475285 - DNA, 15 bp, Homo sapiens
gatttaagaaatgca

SEQ ID NO: 475286 - DNA, 15 bp, Homo sapiens
atttaagaaatgcag

SEQ ID NO: 475287 - DNA, 15 bp, Homo sapiens
tttaagaaatgcagt

SEQ ID NO: 475288 - DNA, 15 bp, Homo sapiens
ttaagaaatgcagtt

SEQ ID NO: 475289 - DNA, 15 bp, Homo sapiens
taagaaatgcagttt

SEQ ID NO: 475290 - DNA, 15 bp, Homo sapiens
aagaaatgcagtttt

SEQ ID NO: 475291 - DNA, 15 bp, Homo sapiens
agaaatgcagttttg

SEQ ID NO: 475292 - DNA, 15 bp, Homo sapiens
gaaatgcagttttgc

SEQ ID NO: 475293 - DNA, 15 bp, Homo sapiens
aaatgcagttttgca

SEQ ID NO: 475294 - DNA, 15 bp, Homo sapiens
aatgcagttttgcag

SEQ ID NO: 475295 - DNA, 15 bp, Homo sapiens
atgcagttttgcagg

SEQ ID NO: 475296 - DNA, 15 bp, Homo sapiens
tgcagttttgcagga

SEQ ID NO: 475297 - DNA, 15 bp, Homo sapiens
gcagttttgcaggag

SEQ ID NO: 475298 - DNA, 15 bp, Homo sapiens
cagttttgcaggagt

SEQ ID NO: 475299 - DNA, 15 bp, Homo sapiens
agttttgcaggagtt

SEQ ID NO: 475300 - DNA, 15 bp, Homo sapiens
gttttgcaggagtta

SEQ ID NO: 475301 - DNA, 15 bp, Homo sapiens
ttttgcaggagttat

SEQ ID NO: 475302 - DNA, 15 bp, Homo sapiens
tttgcaggagttatg

SEQ ID NO: 475303 - DNA, 15 bp, Homo sapiens
ttgcaggagttatga

SEQ ID NO: 475304 - DNA, 15 bp, Homo sapiens
tgcaggagttatgat

SEQ ID NO: 475305 - DNA, 15 bp, Homo sapiens
gcaggagttatgatt

SEQ ID NO: 475306 - DNA, 15 bp, Homo sapiens
caggagttatgattc

SEQ ID NO: 475307 - DNA, 15 bp, Homo sapiens
aggagttatgattcc

SEQ ID NO: 475308 - DNA, 15 bp, Homo sapiens
ggagttatgattcca

SEQ ID NO: 475309 - DNA, 15 bp, Homo sapiens
gagttatgattccat

SEQ ID NO: 475310 - DNA, 15 bp, Homo sapiens
agttatgattccatt

SEQ ID NO: 475311 - DNA, 15 bp, Homo sapiens
gttatgattccatta

SEQ ID NO: 475312 - DNA, 15 bp, Homo sapiens
tatgattccattata

SEQ ID NO: 475313 - DNA, 15 bp, Homo sapiens
atgattccattatat

SEQ ID NO: 475314 - DNA, 15 bp, Homo sapiens
tgattccattatatt

SEQ ID NO: 475315 - DNA, 15 bp, Homo sapiens
gattccattatattt

SEQ ID NO: 475316 - DNA, 15 bp, Homo sapiens
attccattatatttg

SEQ ID NO: 475317 - DNA, 15 bp, Homo sapiens
ttccattatatttgg

SEQ ID NO: 475318 - DNA, 15 bp, Homo sapiens
tccattatatttgga

SEQ ID NO: 475319 - DNA, 15 bp, Homo sapiens
ccattatatttggaa

SEQ ID NO: 475320 - DNA, 15 bp, Homo sapiens
cattatatttggaat

SEQ ID NO: 475321 - DNA, 15 bp, Homo sapiens
attatatttggaatt

SEQ ID NO: 475322 - DNA, 15 bp, Homo sapiens
ttatatttggaattt

SEQ ID NO: 475323 - DNA, 15 bp, Homo sapiens
tatatttggaatttg

SEQ ID NO: 475324 - DNA, 15 bp, Homo sapiens
atatttggaatttgg

SEQ ID NO: 475325 - DNA, 15 bp, Homo sapiens
tatttggaatttggg

SEQ ID NO: 475326 - DNA, 15 bp, Homo sapiens
atttggaatttgggc

SEQ ID NO: 475327 - DNA, 15 bp, Homo sapiens
tttggaatttgggct

SEQ ID NO: 475328 - DNA, 15 bp, Homo sapiens
ttggaatttgggctc

SEQ ID NO: 475329 - DNA, 15 bp, Homo sapiens
tggaatttgggctct

SEQ ID NO: 475330 - DNA, 15 bp, Homo sapiens
ggaatttgggctctc

SEQ ID NO: 475331 - DNA, 15 bp, Homo sapiens
gaatttgggctctca

SEQ ID NO: 475332 - DNA, 15 bp, Homo sapiens
aatttgggctctcat

SEQ ID NO: 475333 - DNA, 15 bp, Homo sapiens
atttgggctctcata

SEQ ID NO: 475334 - DNA, 15 bp, Homo sapiens
tttgggctctcatat

SEQ ID NO: 475335 - DNA, 15 bp, Homo sapiens
ttgggctctcatatt

SEQ ID NO: 475336 - DNA, 15 bp, Homo sapiens
tgggctctcatattt

SEQ ID NO: 475337 - DNA, 15 bp, Homo sapiens
gggctctcatatttt

SEQ ID NO: 475338 - DNA, 15 bp, Homo sapiens
ggctctcatattttc

SEQ ID NO: 475339 - DNA, 15 bp, Homo sapiens
gctctcatattttca

SEQ ID NO: 475340 - DNA, 15 bp, Homo sapiens
ctctcatattttcat

SEQ ID NO: 475341 - DNA, 15 bp, Homo sapiens
tctcatattttcatg

SEQ ID NO: 475342 - DNA, 15 bp, Homo sapiens
ctcatattttcatga

SEQ ID NO: 475343 - DNA, 15 bp, Homo sapiens
tcatattttcatgac

SEQ ID NO: 475344 - DNA, 15 bp, Homo sapiens
catattttcatgaca

SEQ ID NO: 475345 - DNA, 15 bp, Homo sapiens
atattttcatgacac

SEQ ID NO: 475346 - DNA, 15 bp, Homo sapiens
tattttcatgacaca

SEQ ID NO: 475347 - DNA, 15 bp, Homo sapiens
attttcatgacacag

SEQ ID NO: 475348 - DNA, 15 bp, Homo sapiens
ttttcatgacacagt

SEQ ID NO: 475349 - DNA, 15 bp, Homo sapiens
tttcatgacacagtt

SEQ ID NO: 475350 - DNA, 15 bp, Homo sapiens
ttcatgacacagttt

SEQ ID NO: 475351 - DNA, 15 bp, Homo sapiens
tcatgacacagtttg

SEQ ID NO: 475352 - DNA, 15 bp, Homo sapiens
catgacacagtttgc

SEQ ID NO: 475353 - DNA, 15 bp, Homo sapiens
atgacacagtttgca

SEQ ID NO: 475354 - DNA, 15 bp, Homo sapiens
tgacacagtttgcac

SEQ ID NO: 475355 - DNA, 15 bp, Homo sapiens
gacacagtttgcact

SEQ ID NO: 475356 - DNA, 15 bp, Homo sapiens
acacagtttgcactt

SEQ ID NO: 475357 - DNA, 15 bp, Homo sapiens
cacagtttgcacttt

SEQ ID NO: 475358 - DNA, 15 bp, Homo sapiens
acagtttgcacttta

SEQ ID NO: 475359 - DNA, 15 bp, Homo sapiens
cagtttgcactttac

SEQ ID NO: 475360 - DNA, 15 bp, Homo sapiens
agtttgcactttacc

SEQ ID NO: 475361 - DNA, 15 bp, Homo sapiens
gtttgcactttacca

SEQ ID NO: 475362 - DNA, 15 bp, Homo sapiens
tttgcactttaccaa

SEQ ID NO: 475363 - DNA, 15 bp, Homo sapiens
ttgcactttaccaaa

SEQ ID NO: 475364 - DNA, 15 bp, Homo sapiens
tgcactttaccaaac

SEQ ID NO: 475365 - DNA, 15 bp, Homo sapiens
gcactttaccaaaca

SEQ ID NO: 475366 - DNA, 15 bp, Homo sapiens
cactttaccaaacac

SEQ ID NO: 475367 - DNA, 15 bp, Homo sapiens
actttaccaaacacc

SEQ ID NO: 475368 - DNA, 15 bp, Homo sapiens
ctttaccaaacacct

SEQ ID NO: 475369 - DNA, 15 bp, Homo sapiens
tttaccaaacacctg

SEQ ID NO: 475370 - DNA, 15 bp, Homo sapiens
ttaccaaacacctgc

SEQ ID NO: 475371 - DNA, 15 bp, Homo sapiens
taccaaacacctgct

SEQ ID NO: 475372 - DNA, 15 bp, Homo sapiens
accaaacacctgcta

SEQ ID NO: 475373 - DNA, 15 bp, Homo sapiens
ccaaacacctgctat

SEQ ID NO: 475374 - DNA, 15 bp, Homo sapiens
caaacacctgctata

SEQ ID NO: 475375 - DNA, 15 bp, Homo sapiens
aaacacctgctatat

SEQ ID NO: 475376 - DNA, 15 bp, Homo sapiens
aacacctgctatata

SEQ ID NO: 475377 - DNA, 15 bp, Homo sapiens
acacctgctatatat

SEQ ID NO: 475378 - DNA, 15 bp, Homo sapiens
cacctgctatatatt

SEQ ID NO: 475379 - DNA, 15 bp, Homo sapiens
acctgctatatattc

SEQ ID NO: 475380 - DNA, 15 bp, Homo sapiens
cctgctatatattct

SEQ ID NO: 475381 - DNA, 15 bp, Homo sapiens
ctgctatatattcta

SEQ ID NO: 475382 - DNA, 15 bp, Homo sapiens
tgctatatattctat

SEQ ID NO: 475383 - DNA, 15 bp, Homo sapiens
gctatatattctatg

SEQ ID NO: 475384 - DNA, 15 bp, Homo sapiens
ctatatattctatga

SEQ ID NO: 475385 - DNA, 15 bp, Homo sapiens
tatatattctatgaa

SEQ ID NO: 475386 - DNA, 15 bp, Homo sapiens
atatattctatgaaa

SEQ ID NO: 475387 - DNA, 15 bp, Homo sapiens
tatattctatgaaaa

SEQ ID NO: 475388 - DNA, 15 bp, Homo sapiens
attctatgaaaagta

SEQ ID NO: 475389 - DNA, 15 bp, Homo sapiens
ttctatgaaaagtaa

SEQ ID NO: 475390 - DNA, 15 bp, Homo sapiens
tctatgaaaagtaaa

SEQ ID NO: 475391 - DNA, 15 bp, Homo sapiens
ctatgaaaagtaaac

SEQ ID NO: 475392 - DNA, 15 bp, Homo sapiens
tatgaaaagtaaacc

SEQ ID NO: 475393 - DNA, 15 bp, Homo sapiens
atgaaaagtaaacct

SEQ ID NO: 475394 - DNA, 15 bp, Homo sapiens
tgaaaagtaaaccta

SEQ ID NO: 475395 - DNA, 15 bp, Homo sapiens
gaaaagtaaacctaa

SEQ ID NO: 475396 - DNA, 15 bp, Homo sapiens
aaaagtaaacctaac

SEQ ID NO: 475397 - DNA, 15 bp, Homo sapiens
aaagtaaacctaacc

SEQ ID NO: 475398 - DNA, 15 bp, Homo sapiens
aagtaaacctaacca

SEQ ID NO: 475399 - DNA, 15 bp, Homo sapiens
agtaaacctaaccag

SEQ ID NO: 475400 - DNA, 15 bp, Homo sapiens
gtaaacctaaccagg

SEQ ID NO: 475401 - DNA, 15 bp, Homo sapiens
taaacctaaccagga

SEQ ID NO: 475402 - DNA, 15 bp, Homo sapiens
aaacctaaccaggat

SEQ ID NO: 475403 - DNA, 15 bp, Homo sapiens
aacctaaccaggatg

SEQ ID NO: 475404 - DNA, 15 bp, Homo sapiens
acctaaccaggatgt

SEQ ID NO: 475405 - DNA, 15 bp, Homo sapiens
cctaaccaggatgtg

SEQ ID NO: 475406 - DNA, 15 bp, Homo sapiens
ctaaccaggatgtga

SEQ ID NO: 475407 - DNA, 15 bp, Homo sapiens
taaccaggatgtgat

SEQ ID NO: 475408 - DNA, 15 bp, Homo sapiens
aaccaggatgtgatt

SEQ ID NO: 475409 - DNA, 15 bp, Homo sapiens
accaggatgtgattc

SEQ ID NO: 475410 - DNA, 15 bp, Homo sapiens
ccaggatgtgattct

SEQ ID NO: 475411 - DNA, 15 bp, Homo sapiens
caggatgtgattctc

SEQ ID NO: 475412 - DNA, 15 bp, Homo sapiens
aggatgtgattctcc

SEQ ID NO: 475413 - DNA, 15 bp, Homo sapiens
ggatgtgattctcca

SEQ ID NO: 475414 - DNA, 15 bp, Homo sapiens
gatgtgattctccag

SEQ ID NO: 475415 - DNA, 15 bp, Homo sapiens
atgtgattctccagc

SEQ ID NO: 475416 - DNA, 15 bp, Homo sapiens
tgtgattctccagct

SEQ ID NO: 475417 - DNA, 15 bp, Homo sapiens
gtgattctccagcta

SEQ ID NO: 475418 - DNA, 15 bp, Homo sapiens
tgattctccagctaa

SEQ ID NO: 475419 - DNA, 15 bp, Homo sapiens
gattctccagctaat

SEQ ID NO: 475420 - DNA, 15 bp, Homo sapiens
attctccagctaatg

SEQ ID NO: 475421 - DNA, 15 bp, Homo sapiens
ttctccagctaatga

SEQ ID NO: 475422 - DNA, 15 bp, Homo sapiens
tctccagctaatgag

SEQ ID NO: 475423 - DNA, 15 bp, Homo sapiens
ctccagctaatgaga

SEQ ID NO: 475424 - DNA, 15 bp, Homo sapiens
tccagctaatgagaa

SEQ ID NO: 475425 - DNA, 15 bp, Homo sapiens
ccagctaatgagaat

SEQ ID NO: 475426 - DNA, 15 bp, Homo sapiens
cagctaatgagaatc

SEQ ID NO: 475427 - DNA, 15 bp, Homo sapiens
agctaatgagaatcc

SEQ ID NO: 475428 - DNA, 15 bp, Homo sapiens
gctaatgagaatcca

SEQ ID NO: 475429 - DNA, 15 bp, Homo sapiens
ctaatgagaatccaa

SEQ ID NO: 475430 - DNA, 15 bp, Homo sapiens
taatgagaatccaaa

SEQ ID NO: 475431 - DNA, 15 bp, Homo sapiens
aatgagaatccaaac

SEQ ID NO: 475432 - DNA, 15 bp, Homo sapiens
atgagaatccaaaca

SEQ ID NO: 475433 - DNA, 15 bp, Homo sapiens
tgagaatccaaacac

SEQ ID NO: 475434 - DNA, 15 bp, Homo sapiens
gagaatccaaacact

SEQ ID NO: 475435 - DNA, 15 bp, Homo sapiens
agaatccaaacactg

SEQ ID NO: 475436 - DNA, 15 bp, Homo sapiens
gaatccaaacactgt

SEQ ID NO: 475437 - DNA, 15 bp, Homo sapiens
aatccaaacactgta

SEQ ID NO: 475438 - DNA, 15 bp, Homo sapiens
atccaaacactgtac

SEQ ID NO: 475439 - DNA, 15 bp, Homo sapiens
tccaaacactgtaca

SEQ ID NO: 475440 - DNA, 15 bp, Homo sapiens
ccaaacactgtacaa

SEQ ID NO: 475441 - DNA, 15 bp, Homo sapiens
caaacactgtacaag

SEQ ID NO: 475442 - DNA, 15 bp, Homo sapiens
aaacactgtacaagc

SEQ ID NO: 475443 - DNA, 15 bp, Homo sapiens
aacactgtacaagca

SEQ ID NO: 475444 - DNA, 15 bp, Homo sapiens
acactgtacaagcag

SEQ ID NO: 475445 - DNA, 15 bp, Homo sapiens
cactgtacaagcagg

SEQ ID NO: 475446 - DNA, 15 bp, Homo sapiens
actgtacaagcagga

SEQ ID NO: 475447 - DNA, 15 bp, Homo sapiens
ctgtacaagcaggat

SEQ ID NO: 475448 - DNA, 15 bp, Homo sapiens
tgtacaagcaggatt

SEQ ID NO: 475449 - DNA, 15 bp, Homo sapiens
gtacaagcaggattt

SEQ ID NO: 475450 - DNA, 15 bp, Homo sapiens
tacaagcaggattta

SEQ ID NO: 475451 - DNA, 15 bp, Homo sapiens
acaagcaggatttag

SEQ ID NO: 475452 - DNA, 15 bp, Homo sapiens
caagcaggatttaga

SEQ ID NO: 475453 - DNA, 15 bp, Homo sapiens
aagcaggatttagat

SEQ ID NO: 475454 - DNA, 15 bp, Homo sapiens
agcaggatttagatg

SEQ ID NO: 475455 - DNA, 15 bp, Homo sapiens
gcaggatttagatgg

SEQ ID NO: 475456 - DNA, 15 bp, Homo sapiens
caggatttagatggt

SEQ ID NO: 475457 - DNA, 15 bp, Homo sapiens
aggatttagatggtg

SEQ ID NO: 475458 - DNA, 15 bp, Homo sapiens
ggatttagatggtgt

SEQ ID NO: 475459 - DNA, 15 bp, Homo sapiens
gatttagatggtgta

SEQ ID NO: 475460 - DNA, 15 bp, Homo sapiens
atttagatggtgtaa

SEQ ID NO: 475461 - DNA, 15 bp, Homo sapiens
tttagatggtgtaac

SEQ ID NO: 475462 - DNA, 15 bp, Homo sapiens
ttagatggtgtaacc

SEQ ID NO: 475463 - DNA, 15 bp, Homo sapiens
tagatggtgtaacca

SEQ ID NO: 475464 - DNA, 15 bp, Homo sapiens
agatggtgtaaccaa

SEQ ID NO: 475465 - DNA, 15 bp, Homo sapiens
gatggtgtaaccaag

SEQ ID NO: 475466 - DNA, 15 bp, Homo sapiens
atggtgtaaccaagt

SEQ ID NO: 475467 - DNA, 15 bp, Homo sapiens
tggtgtaaccaagtt

SEQ ID NO: 475468 - DNA, 15 bp, Homo sapiens
ggtgtaaccaagttt

SEQ ID NO: 475469 - DNA, 15 bp, Homo sapiens
gtgtaaccaagtttc

SEQ ID NO: 475470 - DNA, 15 bp, Homo sapiens
tgtaaccaagtttca

SEQ ID NO: 475471 - DNA, 15 bp, Homo sapiens
gtaaccaagtttcag

SEQ ID NO: 475472 - DNA, 15 bp, Homo sapiens
taaccaagtttcagt

SEQ ID NO: 475473 - DNA, 15 bp, Homo sapiens
aaccaagtttcagta

SEQ ID NO: 475474 - DNA, 15 bp, Homo sapiens
accaagtttcagtaa

SEQ ID NO: 475475 - DNA, 15 bp, Homo sapiens
ccaagtttcagtaaa

SEQ ID NO: 475476 - DNA, 15 bp, Homo sapiens
caagtttcagtaaat

SEQ ID NO: 475477 - DNA, 15 bp, Homo sapiens
aagtttcagtaaatg

SEQ ID NO: 475478 - DNA, 15 bp, Homo sapiens
agtttcagtaaatga

SEQ ID NO: 475479 - DNA, 15 bp, Homo sapiens
gtttcagtaaatgaa

SEQ ID NO: 475480 - DNA, 15 bp, Homo sapiens
tttcagtaaatgaaa

SEQ ID NO: 475481 - DNA, 15 bp, Homo sapiens
ttcagtaaatgaaag

SEQ ID NO: 475482 - DNA, 15 bp, Homo sapiens
tcagtaaatgaaagt

SEQ ID NO: 475483 - DNA, 15 bp, Homo sapiens
cagtaaatgaaagtg

SEQ ID NO: 475484 - DNA, 15 bp, Homo sapiens
agtaaatgaaagtgg

SEQ ID NO: 475485 - DNA, 15 bp, Homo sapiens
gtaaatgaaagtggg

SEQ ID NO: 475486 - DNA, 15 bp, Homo sapiens
taaatgaaagtggga

SEQ ID NO: 475487 - DNA, 15 bp, Homo sapiens
aaatgaaagtgggat

SEQ ID NO: 475488 - DNA, 15 bp, Homo sapiens
aatgaaagtgggatt

SEQ ID NO: 475489 - DNA, 15 bp, Homo sapiens
atgaaagtgggattg

SEQ ID NO: 475490 - DNA, 15 bp, Homo sapiens
tgaaagtgggattgc

SEQ ID NO: 475491 - DNA, 15 bp, Homo sapiens
gaaagtgggattgca

SEQ ID NO: 475492 - DNA, 15 bp, Homo sapiens
aaagtgggattgcag

SEQ ID NO: 475493 - DNA, 15 bp, Homo sapiens
aagtgggattgcagg

SEQ ID NO: 475494 - DNA, 15 bp, Homo sapiens
agtgggattgcaggt

SEQ ID NO: 475495 - DNA, 15 bp, Homo sapiens
gtgggattgcaggta

SEQ ID NO: 475496 - DNA, 15 bp, Homo sapiens
tgggattgcaggtat

SEQ ID NO: 475497 - DNA, 15 bp, Homo sapiens
gggattgcaggtatt

SEQ ID NO: 475498 - DNA, 15 bp, Homo sapiens
ggattgcaggtattc

SEQ ID NO: 475499 - DNA, 15 bp, Homo sapiens
gattgcaggtattct

SEQ ID NO: 475500 - DNA, 15 bp, Homo sapiens
attgcaggtattctc

SEQ ID NO: 475501 - DNA, 15 bp, Homo sapiens
ttgcaggtattctca

SEQ ID NO: 475502 - DNA, 15 bp, Homo sapiens
tgcaggtattctcag

SEQ ID NO: 475503 - DNA, 15 bp, Homo sapiens
gcaggtattctcagg

SEQ ID NO: 475504 - DNA, 15 bp, Homo sapiens
caggtattctcagga

SEQ ID NO: 475505 - DNA, 15 bp, Homo sapiens
aggtattctcaggag

SEQ ID NO: 475506 - DNA, 15 bp, Homo sapiens
ggtattctcaggaga

SEQ ID NO: 475507 - DNA, 15 bp, Homo sapiens
gtattctcaggagat

SEQ ID NO: 475508 - DNA, 15 bp, Homo sapiens
tattctcaggagatg

SEQ ID NO: 475509 - DNA, 15 bp, Homo sapiens
attctcaggagatgg

SEQ ID NO: 475510 - DNA, 15 bp, Homo sapiens
ttctcaggagatggt

SEQ ID NO: 475511 - DNA, 15 bp, Homo sapiens
tctcaggagatggtg

SEQ ID NO: 475512 - DNA, 15 bp, Homo sapiens
ctcaggagatggtgc

SEQ ID NO: 475513 - DNA, 15 bp, Homo sapiens
tcaggagatggtgca

SEQ ID NO: 475514 - DNA, 15 bp, Homo sapiens
caggagatggtgcac

SEQ ID NO: 475515 - DNA, 15 bp, Homo sapiens
aggagatggtgcaca

SEQ ID NO: 475516 - DNA, 15 bp, Homo sapiens
ggagatggtgcacat

SEQ ID NO: 475517 - DNA, 15 bp, Homo sapiens
gagatggtgcacatg

SEQ ID NO: 475518 - DNA, 15 bp, Homo sapiens
agatggtgcacatgt

SEQ ID NO: 475519 - DNA, 15 bp, Homo sapiens
gatggtgcacatgtg

SEQ ID NO: 475520 - DNA, 15 bp, Homo sapiens
atggtgcacatgtga

SEQ ID NO: 475521 - DNA, 15 bp, Homo sapiens
tggtgcacatgtgaa

SEQ ID NO: 475522 - DNA, 15 bp, Homo sapiens
ggtgcacatgtgaat

SEQ ID NO: 475523 - DNA, 15 bp, Homo sapiens
gtgcacatgtgaatt

SEQ ID NO: 475524 - DNA, 15 bp, Homo sapiens
tgcacatgtgaatta

SEQ ID NO: 475525 - DNA, 15 bp, Homo sapiens
gcacatgtgaattac

SEQ ID NO: 475526 - DNA, 15 bp, Homo sapiens
cacatgtgaattaca

SEQ ID NO: 475527 - DNA, 15 bp, Homo sapiens
acatgtgaattacaa

SEQ ID NO: 475528 - DNA, 15 bp, Homo sapiens
catgtgaattacaat

SEQ ID NO: 475529 - DNA, 15 bp, Homo sapiens
atgtgaattacaata

SEQ ID NO: 475530 - DNA, 15 bp, Homo sapiens
tgtgaattacaatat

SEQ ID NO: 475531 - DNA, 15 bp, Homo sapiens
gtgaattacaatatg

SEQ ID NO: 475532 - DNA, 15 bp, Homo sapiens
tgaattacaatatgt

SEQ ID NO: 475533 - DNA, 15 bp, Homo sapiens
gaattacaatatgta

SEQ ID NO: 475534 - DNA, 15 bp, Homo sapiens
aattacaatatgtaa

SEQ ID NO: 475535 - DNA, 15 bp, Homo sapiens
attacaatatgtaat

SEQ ID NO: 475536 - DNA, 15 bp, Homo sapiens
ttacaatatgtaatt

SEQ ID NO: 475537 - DNA, 15 bp, Homo sapiens
tacaatatgtaatta

SEQ ID NO: 475538 - DNA, 15 bp, Homo sapiens
acaatatgtaattaa

SEQ ID NO: 475539 - DNA, 15 bp, Homo sapiens
caatatgtaattaaa

SEQ ID NO: 475540 - DNA, 15 bp, Homo sapiens
aatatgtaattaaat

SEQ ID NO: 475541 - DNA, 15 bp, Homo sapiens
atatgtaattaaatt

SEQ ID NO: 475542 - DNA, 15 bp, Homo sapiens
tatgtaattaaattt

SEQ ID NO: 475543 - DNA, 15 bp, Homo sapiens
atgtaattaaattta

SEQ ID NO: 475544 - DNA, 15 bp, Homo sapiens
tgtaattaaatttat

SEQ ID NO: 475545 - DNA, 15 bp, Homo sapiens
gtaattaaatttatg

SEQ ID NO: 475546 - DNA, 15 bp, Homo sapiens
taattaaatttatgc

SEQ ID NO: 475547 - DNA, 15 bp, Homo sapiens
aattaaatttatgct

SEQ ID NO: 475548 - DNA, 15 bp, Homo sapiens
attaaatttatgcta

SEQ ID NO: 475549 - DNA, 15 bp, Homo sapiens
ttaaatttatgctaa

SEQ ID NO: 475550 - DNA, 15 bp, Homo sapiens
taaatttatgctaat

SEQ ID NO: 475551 - DNA, 15 bp, Homo sapiens
aaatttatgctaatg

SEQ ID NO: 475552 - DNA, 15 bp, Homo sapiens
aatttatgctaatgc

SEQ ID NO: 475553 - DNA, 15 bp, Homo sapiens
atttatgctaatgct

SEQ ID NO: 475554 - DNA, 15 bp, Homo sapiens
tttatgctaatgctt

SEQ ID NO: 475555 - DNA, 15 bp, Homo sapiens
ttatgctaatgcttt

SEQ ID NO: 475556 - DNA, 15 bp, Homo sapiens
tatgctaatgcttta

SEQ ID NO: 475557 - DNA, 15 bp, Homo sapiens
atgctaatgctttag

SEQ ID NO: 475558 - DNA, 15 bp, Homo sapiens
tgctaatgctttagg

SEQ ID NO: 475559 - DNA, 15 bp, Homo sapiens
gctaatgctttagga

SEQ ID NO: 475560 - DNA, 15 bp, Homo sapiens
ctaatgctttaggat

SEQ ID NO: 475561 - DNA, 15 bp, Homo sapiens
taatgctttaggata

SEQ ID NO: 475562 - DNA, 15 bp, Homo sapiens
aatgctttaggatag

SEQ ID NO: 475563 - DNA, 15 bp, Homo sapiens
atgctttaggatagg

SEQ ID NO: 475564 - DNA, 15 bp, Homo sapiens
tgctttaggataggg

SEQ ID NO: 475565 - DNA, 15 bp, Homo sapiens
gctttaggatagggg

SEQ ID NO: 475566 - DNA, 15 bp, Homo sapiens
ctttaggataggggt

SEQ ID NO: 475567 - DNA, 15 bp, Homo sapiens
tttaggataggggtt

SEQ ID NO: 475568 - DNA, 15 bp, Homo sapiens
ttaggataggggttt

SEQ ID NO: 475569 - DNA, 15 bp, Homo sapiens
taggataggggttta

SEQ ID NO: 475570 - DNA, 15 bp, Homo sapiens
aggataggggtttat

SEQ ID NO: 475571 - DNA, 15 bp, Homo sapiens
ggataggggtttatt

SEQ ID NO: 475572 - DNA, 15 bp, Homo sapiens
gataggggtttattt

SEQ ID NO: 475573 - DNA, 15 bp, Homo sapiens
ataggggtttatttt

SEQ ID NO: 475574 - DNA, 15 bp, Homo sapiens
taggggtttatttta

SEQ ID NO: 475575 - DNA, 15 bp, Homo sapiens
aggggtttattttag

SEQ ID NO: 475576 - DNA, 15 bp, Homo sapiens
ggggtttattttaga

SEQ ID NO: 475577 - DNA, 15 bp, Homo sapiens
gggtttattttagag

SEQ ID NO: 475578 - DNA, 15 bp, Homo sapiens
ggtttattttagagt

SEQ ID NO: 475579 - DNA, 15 bp, Homo sapiens
gtttattttagagtc

SEQ ID NO: 475580 - DNA, 15 bp, Homo sapiens
tttattttagagtct

SEQ ID NO: 475581 - DNA, 15 bp, Homo sapiens
ttattttagagtctc

SEQ ID NO: 475582 - DNA, 15 bp, Homo sapiens
tattttagagtctct

SEQ ID NO: 475583 - DNA, 15 bp, Homo sapiens
attttagagtctcta

SEQ ID NO: 475584 - DNA, 15 bp, Homo sapiens
ttttagagtctctaa

SEQ ID NO: 475585 - DNA, 15 bp, Homo sapiens
tttagagtctctaaa

SEQ ID NO: 475586 - DNA, 15 bp, Homo sapiens
ttagagtctctaaat

SEQ ID NO: 475587 - DNA, 15 bp, Homo sapiens
tagagtctctaaata

SEQ ID NO: 475588 - DNA, 15 bp, Homo sapiens
agagtctctaaataa

SEQ ID NO: 475589 - DNA, 15 bp, Homo sapiens
gagtctctaaataat

SEQ ID NO: 475590 - DNA, 15 bp, Homo sapiens
agtctctaaataata

SEQ ID NO: 475591 - DNA, 15 bp, Homo sapiens
gtctctaaataatat

SEQ ID NO: 475592 - DNA, 15 bp, Homo sapiens
tctctaaataatata

SEQ ID NO: 475593 - DNA, 15 bp, Homo sapiens
ctctaaataatatat

SEQ ID NO: 475594 - DNA, 15 bp, Homo sapiens
tctaaataatatata

SEQ ID NO: 475595 - DNA, 15 bp, Homo sapiens
ctaaataatatatag

SEQ ID NO: 475596 - DNA, 15 bp, Homo sapiens
taaataatatatagg

SEQ ID NO: 475597 - DNA, 15 bp, Homo sapiens
aaataatatataggc

SEQ ID NO: 475598 - DNA, 15 bp, Homo sapiens
aataatatataggct

SEQ ID NO: 475599 - DNA, 15 bp, Homo sapiens
ataatatataggctg

SEQ ID NO: 475600 - DNA, 15 bp, Homo sapiens
taatatataggctgg

SEQ ID NO: 475601 - DNA, 15 bp, Homo sapiens
aatatataggctggt

SEQ ID NO: 475602 - DNA, 15 bp, Homo sapiens
atatataggctggtc

SEQ ID NO: 475603 - DNA, 15 bp, Homo sapiens
tatataggctggtct

SEQ ID NO: 475604 - DNA, 15 bp, Homo sapiens
atataggctggtctt

SEQ ID NO: 475605 - DNA, 15 bp, Homo sapiens
tataggctggtcttg

SEQ ID NO: 475606 - DNA, 15 bp, Homo sapiens
ataggctggtcttga

SEQ ID NO: 475607 - DNA, 15 bp, Homo sapiens
taggctggtcttgat

SEQ ID NO: 475608 - DNA, 15 bp, Homo sapiens
aggctggtcttgatg

SEQ ID NO: 475609 - DNA, 15 bp, Homo sapiens
ggctggtcttgatgg

SEQ ID NO: 475610 - DNA, 15 bp, Homo sapiens
gctggtcttgatggt

SEQ ID NO: 475611 - DNA, 15 bp, Homo sapiens
ctggtcttgatggtg

SEQ ID NO: 475612 - DNA, 15 bp, Homo sapiens
tggtcttgatggtgt

SEQ ID NO: 475613 - DNA, 15 bp, Homo sapiens
ggtcttgatggtgtg

SEQ ID NO: 475614 - DNA, 15 bp, Homo sapiens
gtcttgatggtgtgc

SEQ ID NO: 475615 - DNA, 15 bp, Homo sapiens
tcttgatggtgtgca

SEQ ID NO: 475616 - DNA, 15 bp, Homo sapiens
cttgatggtgtgcac

SEQ ID NO: 475617 - DNA, 15 bp, Homo sapiens
ttgatggtgtgcaca

SEQ ID NO: 475618 - DNA, 15 bp, Homo sapiens
tgatggtgtgcacag

SEQ ID NO: 475619 - DNA, 15 bp, Homo sapiens
gatggtgtgcacaga

SEQ ID NO: 475620 - DNA, 15 bp, Homo sapiens
atggtgtgcacagac

SEQ ID NO: 475621 - DNA, 15 bp, Homo sapiens
tggtgtgcacagact

SEQ ID NO: 475622 - DNA, 15 bp, Homo sapiens
ggtgtgcacagactt

SEQ ID NO: 475623 - DNA, 15 bp, Homo sapiens
gtgtgcacagacttt

SEQ ID NO: 475624 - DNA, 15 bp, Homo sapiens
tgtgcacagactttc

SEQ ID NO: 475625 - DNA, 15 bp, Homo sapiens
gtgcacagactttca

SEQ ID NO: 475626 - DNA, 15 bp, Homo sapiens
tgcacagactttcag

SEQ ID NO: 475627 - DNA, 15 bp, Homo sapiens
gcacagactttcaga

SEQ ID NO: 475628 - DNA, 15 bp, Homo sapiens
cacagactttcagaa

SEQ ID NO: 475629 - DNA, 15 bp, Homo sapiens
acagactttcagaaa

SEQ ID NO: 475630 - DNA, 15 bp, Homo sapiens
cagactttcagaaaa

SEQ ID NO: 475631 - DNA, 15 bp, Homo sapiens
agactttcagaaaag

SEQ ID NO: 475632 - DNA, 15 bp, Homo sapiens
gactttcagaaaagt

SEQ ID NO: 475633 - DNA, 15 bp, Homo sapiens
actttcagaaaagtg

SEQ ID NO: 475634 - DNA, 15 bp, Homo sapiens
ctttcagaaaagtgg

SEQ ID NO: 475635 - DNA, 15 bp, Homo sapiens
tttcagaaaagtggt

SEQ ID NO: 475636 - DNA, 15 bp, Homo sapiens
ttcagaaaagtggta

SEQ ID NO: 475637 - DNA, 15 bp, Homo sapiens
tcagaaaagtggtat

SEQ ID NO: 475638 - DNA, 15 bp, Homo sapiens
cagaaaagtggtata

SEQ ID NO: 475639 - DNA, 15 bp, Homo sapiens
agaaaagtggtatat

SEQ ID NO: 475640 - DNA, 15 bp, Homo sapiens
gaaaagtggtatata

SEQ ID NO: 475641 - DNA, 15 bp, Homo sapiens
aaaagtggtatatac

SEQ ID NO: 475642 - DNA, 15 bp, Homo sapiens
aaagtggtatatact

SEQ ID NO: 475643 - DNA, 15 bp, Homo sapiens
aagtggtatatacta

SEQ ID NO: 475644 - DNA, 15 bp, Homo sapiens
agtggtatatactag

SEQ ID NO: 475645 - DNA, 15 bp, Homo sapiens
gtggtatatactagg

SEQ ID NO: 475646 - DNA, 15 bp, Homo sapiens
tggtatatactaggt

SEQ ID NO: 475647 - DNA, 15 bp, Homo sapiens
ggtatatactaggtg

SEQ ID NO: 475648 - DNA, 15 bp, Homo sapiens
gtatatactaggtgt

SEQ ID NO: 475649 - DNA, 15 bp, Homo sapiens
tatatactaggtgtc

SEQ ID NO: 475650 - DNA, 15 bp, Homo sapiens
atatactaggtgtct

SEQ ID NO: 475651 - DNA, 15 bp, Homo sapiens
tatactaggtgtctg

SEQ ID NO: 475652 - DNA, 15 bp, Homo sapiens
atactaggtgtctgt

SEQ ID NO: 475653 - DNA, 15 bp, Homo sapiens
tactaggtgtctgtg

SEQ ID NO: 475654 - DNA, 15 bp, Homo sapiens
actaggtgtctgtga

SEQ ID NO: 475655 - DNA, 15 bp, Homo sapiens
ctaggtgtctgtgat

SEQ ID NO: 475656 - DNA, 15 bp, Homo sapiens
taggtgtctgtgatt

SEQ ID NO: 475657 - DNA, 15 bp, Homo sapiens
aggtgtctgtgattc

SEQ ID NO: 475658 - DNA, 15 bp, Homo sapiens
ggtgtctgtgattct

SEQ ID NO: 475659 - DNA, 15 bp, Homo sapiens
gtgtctgtgattcta

SEQ ID NO: 475660 - DNA, 15 bp, Homo sapiens
tgtctgtgattctag

SEQ ID NO: 475661 - DNA, 15 bp, Homo sapiens
gtctgtgattctagt

SEQ ID NO: 475662 - DNA, 15 bp, Homo sapiens
tctgtgattctagta

SEQ ID NO: 475663 - DNA, 15 bp, Homo sapiens
ctgtgattctagtaa

SEQ ID NO: 475664 - DNA, 15 bp, Homo sapiens
tgtgattctagtaag

SEQ ID NO: 475665 - DNA, 15 bp, Homo sapiens
gtgattctagtaagt

SEQ ID NO: 475666 - DNA, 15 bp, Homo sapiens
tgattctagtaagta

SEQ ID NO: 475667 - DNA, 15 bp, Homo sapiens
gattctagtaagtag

SEQ ID NO: 475668 - DNA, 15 bp, Homo sapiens
attctagtaagtagc

SEQ ID NO: 475669 - DNA, 15 bp, Homo sapiens
ttctagtaagtagct

SEQ ID NO: 475670 - DNA, 15 bp, Homo sapiens
tctagtaagtagctt

SEQ ID NO: 475671 - DNA, 15 bp, Homo sapiens
ctagtaagtagcttt

SEQ ID NO: 475672 - DNA, 15 bp, Homo sapiens
tagtaagtagctttg

SEQ ID NO: 475673 - DNA, 15 bp, Homo sapiens
agtaagtagctttgc

SEQ ID NO: 475674 - DNA, 15 bp, Homo sapiens
gtaagtagctttgcc

SEQ ID NO: 475675 - DNA, 15 bp, Homo sapiens
taagtagctttgcct

SEQ ID NO: 475676 - DNA, 15 bp, Homo sapiens
aagtagctttgccta

SEQ ID NO: 475677 - DNA, 15 bp, Homo sapiens
agtagctttgcctag

SEQ ID NO: 475678 - DNA, 15 bp, Homo sapiens
gtagctttgcctaga

SEQ ID NO: 475679 - DNA, 15 bp, Homo sapiens
tagctttgcctagaa

SEQ ID NO: 475680 - DNA, 15 bp, Homo sapiens
agctttgcctagaaa

SEQ ID NO: 475681 - DNA, 15 bp, Homo sapiens
gctttgcctagaaag

SEQ ID NO: 475682 - DNA, 15 bp, Homo sapiens
ctttgcctagaaagg

SEQ ID NO: 475683 - DNA, 15 bp, Homo sapiens
tttgcctagaaaggt

SEQ ID NO: 475684 - DNA, 15 bp, Homo sapiens
ttgcctagaaaggtt

SEQ ID NO: 475685 - DNA, 15 bp, Homo sapiens
tgcctagaaaggtta

SEQ ID NO: 475686 - DNA, 15 bp, Homo sapiens
gcctagaaaggttaa

SEQ ID NO: 475687 - DNA, 15 bp, Homo sapiens
cctagaaaggttaat

SEQ ID NO: 475688 - DNA, 15 bp, Homo sapiens
ctagaaaggttaatt

SEQ ID NO: 475689 - DNA, 15 bp, Homo sapiens
tagaaaggttaattc

SEQ ID NO: 475690 - DNA, 15 bp, Homo sapiens
agaaaggttaattca

SEQ ID NO: 475691 - DNA, 15 bp, Homo sapiens
gaaaggttaattcaa

SEQ ID NO: 475692 - DNA, 15 bp, Homo sapiens
aaaggttaattcaag

SEQ ID NO: 475693 - DNA, 15 bp, Homo sapiens
aaggttaattcaagc

SEQ ID NO: 475694 - DNA, 15 bp, Homo sapiens
aggttaattcaagca

SEQ ID NO: 475695 - DNA, 15 bp, Homo sapiens
ggttaattcaagcat

SEQ ID NO: 475696 - DNA, 15 bp, Homo sapiens
gttaattcaagcatc

SEQ ID NO: 475697 - DNA, 15 bp, Homo sapiens
ttaattcaagcatca

SEQ ID NO: 475698 - DNA, 15 bp, Homo sapiens
taattcaagcatcat

SEQ ID NO: 475699 - DNA, 15 bp, Homo sapiens
aattcaagcatcata

SEQ ID NO: 475700 - DNA, 15 bp, Homo sapiens
attcaagcatcataa

SEQ ID NO: 475701 - DNA, 15 bp, Homo sapiens
ttcaagcatcataaa

SEQ ID NO: 475702 - DNA, 15 bp, Homo sapiens
tcaagcatcataaaa

SEQ ID NO: 475703 - DNA, 15 bp, Homo sapiens
caagcatcataaaaa

SEQ ID NO: 475704 - DNA, 15 bp, Homo sapiens
aagcatcataaaaat

SEQ ID NO: 475705 - DNA, 15 bp, Homo sapiens
agcatcataaaaatg

SEQ ID NO: 475706 - DNA, 15 bp, Homo sapiens
gcatcataaaaatgg

SEQ ID NO: 475707 - DNA, 15 bp, Homo sapiens
catcataaaaatggt

SEQ ID NO: 475708 - DNA, 15 bp, Homo sapiens
atcataaaaatggta

SEQ ID NO: 475709 - DNA, 15 bp, Homo sapiens
tcataaaaatggtaa

SEQ ID NO: 475710 - DNA, 15 bp, Homo sapiens
cataaaaatggtaac

SEQ ID NO: 475711 - DNA, 15 bp, Homo sapiens
ataaaaatggtaaca

SEQ ID NO: 475712 - DNA, 15 bp, Homo sapiens
taaaaatggtaacat

SEQ ID NO: 475713 - DNA, 15 bp, Homo sapiens
aaaatggtaacattt

SEQ ID NO: 475714 - DNA, 15 bp, Homo sapiens
aaatggtaacatttg

SEQ ID NO: 475715 - DNA, 15 bp, Homo sapiens
aatggtaacatttga

SEQ ID NO: 475716 - DNA, 15 bp, Homo sapiens
atggtaacatttgaa

SEQ ID NO: 475717 - DNA, 15 bp, Homo sapiens
tggtaacatttgaac

SEQ ID NO: 475718 - DNA, 15 bp, Homo sapiens
ggtaacatttgaact

SEQ ID NO: 475719 - DNA, 15 bp, Homo sapiens
gtaacatttgaactg

SEQ ID NO: 475720 - DNA, 15 bp, Homo sapiens
taacatttgaactgg

SEQ ID NO: 475721 - DNA, 15 bp, Homo sapiens
aacatttgaactggg

SEQ ID NO: 475722 - DNA, 15 bp, Homo sapiens
acatttgaactgggt

SEQ ID NO: 475723 - DNA, 15 bp, Homo sapiens
catttgaactgggtc

SEQ ID NO: 475724 - DNA, 15 bp, Homo sapiens
atttgaactgggtct

SEQ ID NO: 475725 - DNA, 15 bp, Homo sapiens
tttgaactgggtcta

SEQ ID NO: 475726 - DNA, 15 bp, Homo sapiens
ttgaactgggtctag

SEQ ID NO: 475727 - DNA, 15 bp, Homo sapiens
tgaactgggtctagg

SEQ ID NO: 475728 - DNA, 15 bp, Homo sapiens
gaactgggtctaggc

SEQ ID NO: 475729 - DNA, 15 bp, Homo sapiens
aactgggtctaggcc

SEQ ID NO: 475730 - DNA, 15 bp, Homo sapiens
actgggtctaggcca

SEQ ID NO: 475731 - DNA, 15 bp, Homo sapiens
ctgggtctaggccaa

SEQ ID NO: 475732 - DNA, 15 bp, Homo sapiens
tgggtctaggccaac

SEQ ID NO: 475733 - DNA, 15 bp, Homo sapiens
gggtctaggccaact

SEQ ID NO: 475734 - DNA, 15 bp, Homo sapiens
ggtctaggccaacta

SEQ ID NO: 475735 - DNA, 15 bp, Homo sapiens
gtctaggccaactag

SEQ ID NO: 475736 - DNA, 15 bp, Homo sapiens
tctaggccaactaga

SEQ ID NO: 475737 - DNA, 15 bp, Homo sapiens
ctaggccaactagaa

SEQ ID NO: 475738 - DNA, 15 bp, Homo sapiens
taggccaactagaat

SEQ ID NO: 475739 - DNA, 15 bp, Homo sapiens
aggccaactagaatt

SEQ ID NO: 475740 - DNA, 15 bp, Homo sapiens
ggccaactagaattt

SEQ ID NO: 475741 - DNA, 15 bp, Homo sapiens
gccaactagaatttc

SEQ ID NO: 475742 - DNA, 15 bp, Homo sapiens
ccaactagaatttct

SEQ ID NO: 475743 - DNA, 15 bp, Homo sapiens
caactagaatttcta

SEQ ID NO: 475744 - DNA, 15 bp, Homo sapiens
aactagaatttctag

SEQ ID NO: 475745 - DNA, 15 bp, Homo sapiens
actagaatttctagg

SEQ ID NO: 475746 - DNA, 15 bp, Homo sapiens
ctagaatttctaggg

SEQ ID NO: 475747 - DNA, 15 bp, Homo sapiens
tagaatttctagggg

SEQ ID NO: 475748 - DNA, 15 bp, Homo sapiens
agaatttctagggga

SEQ ID NO: 475749 - DNA, 15 bp, Homo sapiens
gaatttctaggggaa

SEQ ID NO: 475750 - DNA, 15 bp, Homo sapiens
aatttctaggggaaa

SEQ ID NO: 475751 - DNA, 15 bp, Homo sapiens
atttctaggggaaag

SEQ ID NO: 475752 - DNA, 15 bp, Homo sapiens
tttctaggggaaagt

SEQ ID NO: 475753 - DNA, 15 bp, Homo sapiens
ttctaggggaaagtc

SEQ ID NO: 475754 - DNA, 15 bp, Homo sapiens
tctaggggaaagtct

SEQ ID NO: 475755 - DNA, 15 bp, Homo sapiens
ctaggggaaagtctt

SEQ ID NO: 475756 - DNA, 15 bp, Homo sapiens
taggggaaagtcttg

SEQ ID NO: 475757 - DNA, 15 bp, Homo sapiens
aggggaaagtcttgg

SEQ ID NO: 475758 - DNA, 15 bp, Homo sapiens
ggggaaagtcttgga

SEQ ID NO: 475759 - DNA, 15 bp, Homo sapiens
gggaaagtcttggac

SEQ ID NO: 475760 - DNA, 15 bp, Homo sapiens
ggaaagtcttggact

SEQ ID NO: 475761 - DNA, 15 bp, Homo sapiens
gaaagtcttggacta

SEQ ID NO: 475762 - DNA, 15 bp, Homo sapiens
aaagtcttggactaa

SEQ ID NO: 475763 - DNA, 15 bp, Homo sapiens
aagtcttggactaat

SEQ ID NO: 475764 - DNA, 15 bp, Homo sapiens
agtcttggactaatg

SEQ ID NO: 475765 - DNA, 15 bp, Homo sapiens
gtcttggactaatgg

SEQ ID NO: 475766 - DNA, 15 bp, Homo sapiens
tcttggactaatgga

SEQ ID NO: 475767 - DNA, 15 bp, Homo sapiens
cttggactaatggaa

SEQ ID NO: 475768 - DNA, 15 bp, Homo sapiens
ttggactaatggaat

SEQ ID NO: 475769 - DNA, 15 bp, Homo sapiens
tggactaatggaata

SEQ ID NO: 475770 - DNA, 15 bp, Homo sapiens
ggactaatggaataa

SEQ ID NO: 475771 - DNA, 15 bp, Homo sapiens
gactaatggaataat

SEQ ID NO: 475772 - DNA, 15 bp, Homo sapiens
actaatggaataata

SEQ ID NO: 475773 - DNA, 15 bp, Homo sapiens
ctaatggaataatat

SEQ ID NO: 475774 - DNA, 15 bp, Homo sapiens
taatggaataatata

SEQ ID NO: 475775 - DNA, 15 bp, Homo sapiens
aatggaataatatac

SEQ ID NO: 475776 - DNA, 15 bp, Homo sapiens
atggaataatatact

SEQ ID NO: 475777 - DNA, 15 bp, Homo sapiens
tggaataatatactc

SEQ ID NO: 475778 - DNA, 15 bp, Homo sapiens
ggaataatatactca

SEQ ID NO: 475779 - DNA, 15 bp, Homo sapiens
gaataatatactcaa

SEQ ID NO: 475780 - DNA, 15 bp, Homo sapiens
aataatatactcaaa

SEQ ID NO: 475781 - DNA, 15 bp, Homo sapiens
ataatatactcaaaa

SEQ ID NO: 475782 - DNA, 15 bp, Homo sapiens
taatatactcaaaag

SEQ ID NO: 475783 - DNA, 15 bp, Homo sapiens
aatatactcaaaagc

SEQ ID NO: 475784 - DNA, 15 bp, Homo sapiens
atatactcaaaagca

SEQ ID NO: 475785 - DNA, 15 bp, Homo sapiens
tatactcaaaagcat

SEQ ID NO: 475786 - DNA, 15 bp, Homo sapiens
atactcaaaagcatt

SEQ ID NO: 475787 - DNA, 15 bp, Homo sapiens
tactcaaaagcattg

SEQ ID NO: 475788 - DNA, 15 bp, Homo sapiens
actcaaaagcattga

SEQ ID NO: 475789 - DNA, 15 bp, Homo sapiens
ctcaaaagcattgag

SEQ ID NO: 475790 - DNA, 15 bp, Homo sapiens
tcaaaagcattgagc

SEQ ID NO: 475791 - DNA, 15 bp, Homo sapiens
caaaagcattgagct

SEQ ID NO: 475792 - DNA, 15 bp, Homo sapiens
aaaagcattgagctg

SEQ ID NO: 475793 - DNA, 15 bp, Homo sapiens
aaagcattgagctgg

SEQ ID NO: 475794 - DNA, 15 bp, Homo sapiens
aagcattgagctggg

SEQ ID NO: 475795 - DNA, 15 bp, Homo sapiens
agcattgagctggga

SEQ ID NO: 475796 - DNA, 15 bp, Homo sapiens
gcattgagctgggaa

SEQ ID NO: 475797 - DNA, 15 bp, Homo sapiens
cattgagctgggaaa

SEQ ID NO: 475798 - DNA, 15 bp, Homo sapiens
attgagctgggaaag

SEQ ID NO: 475799 - DNA, 15 bp, Homo sapiens
ttgagctgggaaagg

SEQ ID NO: 475800 - DNA, 15 bp, Homo sapiens
tgagctgggaaaggg

SEQ ID NO: 475801 - DNA, 15 bp, Homo sapiens
gagctgggaaagggc

SEQ ID NO: 475802 - DNA, 15 bp, Homo sapiens
agctgggaaagggca

SEQ ID NO: 475803 - DNA, 15 bp, Homo sapiens
gctgggaaagggcat

SEQ ID NO: 475804 - DNA, 15 bp, Homo sapiens
ctgggaaagggcatg

SEQ ID NO: 475805 - DNA, 15 bp, Homo sapiens
tgggaaagggcatgg

SEQ ID NO: 475806 - DNA, 15 bp, Homo sapiens
gggaaagggcatggt

SEQ ID NO: 475807 - DNA, 15 bp, Homo sapiens
ggaaagggcatggtt

SEQ ID NO: 475808 - DNA, 15 bp, Homo sapiens
gaaagggcatggttt

SEQ ID NO: 475809 - DNA, 15 bp, Homo sapiens
aaagggcatggtttg

SEQ ID NO: 475810 - DNA, 15 bp, Homo sapiens
aagggcatggtttgt

SEQ ID NO: 475811 - DNA, 15 bp, Homo sapiens
agggcatggtttgtt

SEQ ID NO: 475812 - DNA, 15 bp, Homo sapiens
gggcatggtttgttt

SEQ ID NO: 475813 - DNA, 15 bp, Homo sapiens
ggcatggtttgttta

SEQ ID NO: 475814 - DNA, 15 bp, Homo sapiens
gcatggtttgtttac

SEQ ID NO: 475815 - DNA, 15 bp, Homo sapiens
catggtttgtttact

SEQ ID NO: 475816 - DNA, 15 bp, Homo sapiens
atggtttgtttactg

SEQ ID NO: 475817 - DNA, 15 bp, Homo sapiens
tggtttgtttactga

SEQ ID NO: 475818 - DNA, 15 bp, Homo sapiens
ggtttgtttactgaa

SEQ ID NO: 475819 - DNA, 15 bp, Homo sapiens
gtttgtttactgaac

SEQ ID NO: 475820 - DNA, 15 bp, Homo sapiens
tttgtttactgaact

SEQ ID NO: 475821 - DNA, 15 bp, Homo sapiens
ttgtttactgaactg

SEQ ID NO: 475822 - DNA, 15 bp, Homo sapiens
tgtttactgaactgc

SEQ ID NO: 475823 - DNA, 15 bp, Homo sapiens
gtttactgaactgca

SEQ ID NO: 475824 - DNA, 15 bp, Homo sapiens
tttactgaactgcag

SEQ ID NO: 475825 - DNA, 15 bp, Homo sapiens
ttactgaactgcagg

SEQ ID NO: 475826 - DNA, 15 bp, Homo sapiens
tactgaactgcaggt

SEQ ID NO: 475827 - DNA, 15 bp, Homo sapiens
actgaactgcaggta

SEQ ID NO: 475828 - DNA, 15 bp, Homo sapiens
ctgaactgcaggtag

SEQ ID NO: 475829 - DNA, 15 bp, Homo sapiens
tgaactgcaggtagg

SEQ ID NO: 475830 - DNA, 15 bp, Homo sapiens
gaactgcaggtaggg

SEQ ID NO: 475831 - DNA, 15 bp, Homo sapiens
aactgcaggtagggg

SEQ ID NO: 475832 - DNA, 15 bp, Homo sapiens
actgcaggtagggga

SEQ ID NO: 475833 - DNA, 15 bp, Homo sapiens
ctgcaggtaggggaa

SEQ ID NO: 475834 - DNA, 15 bp, Homo sapiens
tgcaggtaggggaaa

SEQ ID NO: 475835 - DNA, 15 bp, Homo sapiens
gcaggtaggggaaag

SEQ ID NO: 475836 - DNA, 15 bp, Homo sapiens
caggtaggggaaaga

SEQ ID NO: 475837 - DNA, 15 bp, Homo sapiens
aggtaggggaaagag

SEQ ID NO: 475838 - DNA, 15 bp, Homo sapiens
ggtaggggaaagaga

SEQ ID NO: 475839 - DNA, 15 bp, Homo sapiens
gtaggggaaagagaa

SEQ ID NO: 475840 - DNA, 15 bp, Homo sapiens
taggggaaagagaaa

SEQ ID NO: 475841 - DNA, 15 bp, Homo sapiens
aggggaaagagaaat

SEQ ID NO: 475842 - DNA, 15 bp, Homo sapiens
ggggaaagagaaata

SEQ ID NO: 475843 - DNA, 15 bp, Homo sapiens
gggaaagagaaatag

SEQ ID NO: 475844 - DNA, 15 bp, Homo sapiens
ggaaagagaaataga

SEQ ID NO: 475845 - DNA, 15 bp, Homo sapiens
gaaagagaaatagat

SEQ ID NO: 475846 - DNA, 15 bp, Homo sapiens
aaagagaaatagatg

SEQ ID NO: 475847 - DNA, 15 bp, Homo sapiens
aagagaaatagatga

SEQ ID NO: 475848 - DNA, 15 bp, Homo sapiens
agagaaatagatgag

SEQ ID NO: 475849 - DNA, 15 bp, Homo sapiens
gagaaatagatgaga

SEQ ID NO: 475850 - DNA, 15 bp, Homo sapiens
agaaatagatgagaa

SEQ ID NO: 475851 - DNA, 15 bp, Homo sapiens
gaaatagatgagaaa

SEQ ID NO: 475852 - DNA, 15 bp, Homo sapiens
aaatagatgagaaag

SEQ ID NO: 475853 - DNA, 15 bp, Homo sapiens
aatagatgagaaagt

SEQ ID NO: 475854 - DNA, 15 bp, Homo sapiens
atagatgagaaagtg

SEQ ID NO: 475855 - DNA, 15 bp, Homo sapiens
tagatgagaaagtga

SEQ ID NO: 475856 - DNA, 15 bp, Homo sapiens
agatgagaaagtgaa

SEQ ID NO: 475857 - DNA, 15 bp, Homo sapiens
gatgagaaagtgaag

SEQ ID NO: 475858 - DNA, 15 bp, Homo sapiens
atgagaaagtgaagg

SEQ ID NO: 475859 - DNA, 15 bp, Homo sapiens
tgagaaagtgaagga

SEQ ID NO: 475860 - DNA, 15 bp, Homo sapiens
gagaaagtgaaggac

SEQ ID NO: 475861 - DNA, 15 bp, Homo sapiens
agaaagtgaaggaca

SEQ ID NO: 475862 - DNA, 15 bp, Homo sapiens
gaaagtgaaggacac

SEQ ID NO: 475863 - DNA, 15 bp, Homo sapiens
aaagtgaaggacaca

SEQ ID NO: 475864 - DNA, 15 bp, Homo sapiens
aagtgaaggacacag

SEQ ID NO: 475865 - DNA, 15 bp, Homo sapiens
agtgaaggacacaga

SEQ ID NO: 475866 - DNA, 15 bp, Homo sapiens
gtgaaggacacagaa

SEQ ID NO: 475867 - DNA, 15 bp, Homo sapiens
tgaaggacacagaag

SEQ ID NO: 475868 - DNA, 15 bp, Homo sapiens
gaaggacacagaagt

SEQ ID NO: 475869 - DNA, 15 bp, Homo sapiens
aaggacacagaagtt

SEQ ID NO: 475870 - DNA, 15 bp, Homo sapiens
aggacacagaagttg

SEQ ID NO: 475871 - DNA, 15 bp, Homo sapiens
ggacacagaagttga

SEQ ID NO: 475872 - DNA, 15 bp, Homo sapiens
gacacagaagttgag

SEQ ID NO: 475873 - DNA, 15 bp, Homo sapiens
acacagaagttgagg

SEQ ID NO: 475874 - DNA, 15 bp, Homo sapiens
cacagaagttgaggt

SEQ ID NO: 475875 - DNA, 15 bp, Homo sapiens
acagaagttgaggtc

SEQ ID NO: 475876 - DNA, 15 bp, Homo sapiens
cagaagttgaggtct

SEQ ID NO: 475877 - DNA, 15 bp, Homo sapiens
agaagttgaggtctg

SEQ ID NO: 475878 - DNA, 15 bp, Homo sapiens
gaagttgaggtctga

SEQ ID NO: 475879 - DNA, 15 bp, Homo sapiens
aagttgaggtctgat

SEQ ID NO: 475880 - DNA, 15 bp, Homo sapiens
agttgaggtctgata

SEQ ID NO: 475881 - DNA, 15 bp, Homo sapiens
gttgaggtctgataa

SEQ ID NO: 475882 - DNA, 15 bp, Homo sapiens
ttgaggtctgataat

SEQ ID NO: 475883 - DNA, 15 bp, Homo sapiens
tgaggtctgataatg

SEQ ID NO: 475884 - DNA, 15 bp, Homo sapiens
gaggtctgataatga

SEQ ID NO: 475885 - DNA, 15 bp, Homo sapiens
aggtctgataatgaa

SEQ ID NO: 475886 - DNA, 15 bp, Homo sapiens
ggtctgataatgaaa

SEQ ID NO: 475887 - DNA, 15 bp, Homo sapiens
gtctgataatgaaaa

SEQ ID NO: 475888 - DNA, 15 bp, Homo sapiens
tctgataatgaaaaa

SEQ ID NO: 475889 - DNA, 15 bp, Homo sapiens
ctgataatgaaaaac

SEQ ID NO: 475890 - DNA, 15 bp, Homo sapiens
tgataatgaaaaacc

SEQ ID NO: 475891 - DNA, 15 bp, Homo sapiens
gataatgaaaaaccc

SEQ ID NO: 475892 - DNA, 15 bp, Homo sapiens
ataatgaaaaaccca

SEQ ID NO: 475893 - DNA, 15 bp, Homo sapiens
taatgaaaaacccag

SEQ ID NO: 475894 - DNA, 15 bp, Homo sapiens
aatgaaaaacccagc

SEQ ID NO: 475895 - DNA, 15 bp, Homo sapiens
atgaaaaacccagcc

SEQ ID NO: 475896 - DNA, 15 bp, Homo sapiens
tgaaaaacccagcca

SEQ ID NO: 475897 - DNA, 15 bp, Homo sapiens
gaaaaacccagccac

SEQ ID NO: 475898 - DNA, 15 bp, Homo sapiens
aaaaacccagccact

SEQ ID NO: 475899 - DNA, 15 bp, Homo sapiens
aaaacccagccactg

SEQ ID NO: 475900 - DNA, 15 bp, Homo sapiens
aaacccagccactga

SEQ ID NO: 475901 - DNA, 15 bp, Homo sapiens
aacccagccactgaa

SEQ ID NO: 475902 - DNA, 15 bp, Homo sapiens
acccagccactgaag

SEQ ID NO: 475903 - DNA, 15 bp, Homo sapiens
cccagccactgaaga

SEQ ID NO: 475904 - DNA, 15 bp, Homo sapiens
ccagccactgaagag

SEQ ID NO: 475905 - DNA, 15 bp, Homo sapiens
cagccactgaagagt

SEQ ID NO: 475906 - DNA, 15 bp, Homo sapiens
agccactgaagagtt

SEQ ID NO: 475907 - DNA, 15 bp, Homo sapiens
gccactgaagagttg

SEQ ID NO: 475908 - DNA, 15 bp, Homo sapiens
ccactgaagagttgg

SEQ ID NO: 475909 - DNA, 15 bp, Homo sapiens
cactgaagagttgga

SEQ ID NO: 475910 - DNA, 15 bp, Homo sapiens
actgaagagttggat

SEQ ID NO: 475911 - DNA, 15 bp, Homo sapiens
ctgaagagttggatc

SEQ ID NO: 475912 - DNA, 15 bp, Homo sapiens
tgaagagttggatca

SEQ ID NO: 475913 - DNA, 15 bp, Homo sapiens
gaagagttggatcat

SEQ ID NO: 475914 - DNA, 15 bp, Homo sapiens
aagagttggatcatg

SEQ ID NO: 475915 - DNA, 15 bp, Homo sapiens
agagttggatcatgt

SEQ ID NO: 475916 - DNA, 15 bp, Homo sapiens
gagttggatcatgtc

SEQ ID NO: 475917 - DNA, 15 bp, Homo sapiens
agttggatcatgtcc

SEQ ID NO: 475918 - DNA, 15 bp, Homo sapiens
gttggatcatgtcct

SEQ ID NO: 475919 - DNA, 15 bp, Homo sapiens
ttggatcatgtcctt

SEQ ID NO: 475920 - DNA, 15 bp, Homo sapiens
tggatcatgtcctta

SEQ ID NO: 475921 - DNA, 15 bp, Homo sapiens
ggatcatgtccttag

SEQ ID NO: 475922 - DNA, 15 bp, Homo sapiens
gatcatgtccttagt

SEQ ID NO: 475923 - DNA, 15 bp, Homo sapiens
atcatgtccttagtt

SEQ ID NO: 475924 - DNA, 15 bp, Homo sapiens
tcatgtccttagttg

SEQ ID NO: 475925 - DNA, 15 bp, Homo sapiens
catgtccttagttga

SEQ ID NO: 475926 - DNA, 15 bp, Homo sapiens
atgtccttagttgaa

SEQ ID NO: 475927 - DNA, 15 bp, Homo sapiens
tgtccttagttgaag

SEQ ID NO: 475928 - DNA, 15 bp, Homo sapiens
gtccttagttgaagg

SEQ ID NO: 475929 - DNA, 15 bp, Homo sapiens
tccttagttgaaggg

SEQ ID NO: 475930 - DNA, 15 bp, Homo sapiens
ccttagttgaaggga

SEQ ID NO: 475931 - DNA, 15 bp, Homo sapiens
cttagttgaagggaa

SEQ ID NO: 475932 - DNA, 15 bp, Homo sapiens
ttagttgaagggaag

SEQ ID NO: 475933 - DNA, 15 bp, Homo sapiens
tagttgaagggaagt

SEQ ID NO: 475934 - DNA, 15 bp, Homo sapiens
agttgaagggaagtc

SEQ ID NO: 475935 - DNA, 15 bp, Homo sapiens
gttgaagggaagtca

SEQ ID NO: 475936 - DNA, 15 bp, Homo sapiens
ttgaagggaagtcat

SEQ ID NO: 475937 - DNA, 15 bp, Homo sapiens
tgaagggaagtcatg

SEQ ID NO: 475938 - DNA, 15 bp, Homo sapiens
gaagggaagtcatgg

SEQ ID NO: 475939 - DNA, 15 bp, Homo sapiens
aagggaagtcatgga

SEQ ID NO: 475940 - DNA, 15 bp, Homo sapiens
agggaagtcatggag

SEQ ID NO: 475941 - DNA, 15 bp, Homo sapiens
gggaagtcatggaga

SEQ ID NO: 475942 - DNA, 15 bp, Homo sapiens
ggaagtcatggagag

SEQ ID NO: 475943 - DNA, 15 bp, Homo sapiens
gaagtcatggagagt

SEQ ID NO: 475944 - DNA, 15 bp, Homo sapiens
aagtcatggagagtt

SEQ ID NO: 475945 - DNA, 15 bp, Homo sapiens
agtcatggagagttt

SEQ ID NO: 475946 - DNA, 15 bp, Homo sapiens
gtcatggagagtttt

SEQ ID NO: 475947 - DNA, 15 bp, Homo sapiens
tcatggagagttttt

SEQ ID NO: 475948 - DNA, 15 bp, Homo sapiens
catggagagtttttg

SEQ ID NO: 475949 - DNA, 15 bp, Homo sapiens
atggagagtttttgt

SEQ ID NO: 475950 - DNA, 15 bp, Homo sapiens
tggagagtttttgtt

SEQ ID NO: 475951 - DNA, 15 bp, Homo sapiens
ggagagtttttgtta

SEQ ID NO: 475952 - DNA, 15 bp, Homo sapiens
gagagtttttgttat

SEQ ID NO: 475953 - DNA, 15 bp, Homo sapiens
agagtttttgttatg

SEQ ID NO: 475954 - DNA, 15 bp, Homo sapiens
gagtttttgttatga

SEQ ID NO: 475955 - DNA, 15 bp, Homo sapiens
agtttttgttatgag

SEQ ID NO: 475956 - DNA, 15 bp, Homo sapiens
gtttttgttatgaga

SEQ ID NO: 475957 - DNA, 15 bp, Homo sapiens
tttttgttatgagag

SEQ ID NO: 475958 - DNA, 15 bp, Homo sapiens
ttttgttatgagagg

SEQ ID NO: 475959 - DNA, 15 bp, Homo sapiens
tttgttatgagagga

SEQ ID NO: 475960 - DNA, 15 bp, Homo sapiens
ttgttatgagaggaa

SEQ ID NO: 475961 - DNA, 15 bp, Homo sapiens
tgttatgagaggaac

SEQ ID NO: 475962 - DNA, 15 bp, Homo sapiens
gttatgagaggaaca

SEQ ID NO: 475963 - DNA, 15 bp, Homo sapiens
ttatgagaggaacat

SEQ ID NO: 475964 - DNA, 15 bp, Homo sapiens
tatgagaggaacatc

SEQ ID NO: 475965 - DNA, 15 bp, Homo sapiens
atgagaggaacatca

SEQ ID NO: 475966 - DNA, 15 bp, Homo sapiens
tgagaggaacatcat

SEQ ID NO: 475967 - DNA, 15 bp, Homo sapiens
gagaggaacatcatt

SEQ ID NO: 475968 - DNA, 15 bp, Homo sapiens
agaggaacatcattt

SEQ ID NO: 475969 - DNA, 15 bp, Homo sapiens
gaggaacatcatttt

SEQ ID NO: 475970 - DNA, 15 bp, Homo sapiens
aggaacatcatttta

SEQ ID NO: 475971 - DNA, 15 bp, Homo sapiens
ggaacatcattttat

SEQ ID NO: 475972 - DNA, 15 bp, Homo sapiens
gaacatcattttatt

SEQ ID NO: 475973 - DNA, 15 bp, Homo sapiens
aacatcattttattt

SEQ ID NO: 475974 - DNA, 15 bp, Homo sapiens
acatcattttatttg

SEQ ID NO: 475975 - DNA, 15 bp, Homo sapiens
catcattttatttgt

SEQ ID NO: 475976 - DNA, 15 bp, Homo sapiens
atcattttatttgtt

SEQ ID NO: 475977 - DNA, 15 bp, Homo sapiens
tcattttatttgttt

SEQ ID NO: 475978 - DNA, 15 bp, Homo sapiens
cattttatttgtttg

SEQ ID NO: 475979 - DNA, 15 bp, Homo sapiens
attttatttgtttga

SEQ ID NO: 475980 - DNA, 15 bp, Homo sapiens
ttttatttgtttgag

SEQ ID NO: 475981 - DNA, 15 bp, Homo sapiens
tttatttgtttgaga

SEQ ID NO: 475982 - DNA, 15 bp, Homo sapiens
ttatttgtttgagaa

SEQ ID NO: 475983 - DNA, 15 bp, Homo sapiens
tatttgtttgagaat

SEQ ID NO: 475984 - DNA, 15 bp, Homo sapiens
atttgtttgagaatg

SEQ ID NO: 475985 - DNA, 15 bp, Homo sapiens
tttgtttgagaatgt

SEQ ID NO: 475986 - DNA, 15 bp, Homo sapiens
ttgtttgagaatgtc

SEQ ID NO: 475987 - DNA, 15 bp, Homo sapiens
tgtttgagaatgtca

SEQ ID NO: 475988 - DNA, 15 bp, Homo sapiens
gtttgagaatgtcac

SEQ ID NO: 475989 - DNA, 15 bp, Homo sapiens
tttgagaatgtcacg

SEQ ID NO: 475990 - DNA, 15 bp, Homo sapiens
ttgagaatgtcacgc

SEQ ID NO: 475991 - DNA, 15 bp, Homo sapiens
tgagaatgtcacgct

SEQ ID NO: 475992 - DNA, 15 bp, Homo sapiens
gagaatgtcacgctc

SEQ ID NO: 475993 - DNA, 15 bp, Homo sapiens
agaatgtcacgctca

SEQ ID NO: 475994 - DNA, 15 bp, Homo sapiens
gaatgtcacgctcac

SEQ ID NO: 475995 - DNA, 15 bp, Homo sapiens
aatgtcacgctcact

SEQ ID NO: 475996 - DNA, 15 bp, Homo sapiens
atgtcacgctcactt

SEQ ID NO: 475997 - DNA, 15 bp, Homo sapiens
tgtcacgctcactta

SEQ ID NO: 475998 - DNA, 15 bp, Homo sapiens
gtcacgctcacttag

SEQ ID NO: 475999 - DNA, 15 bp, Homo sapiens
tcacgctcacttaga

SEQ ID NO: 476000 - DNA, 15 bp, Homo sapiens
cacgctcacttagat

SEQ ID NO: 476001 - DNA, 15 bp, Homo sapiens
acgctcacttagatg

SEQ ID NO: 476002 - DNA, 15 bp, Homo sapiens
cgctcacttagatgt

SEQ ID NO: 476003 - DNA, 15 bp, Homo sapiens
gctcacttagatgta

SEQ ID NO: 476004 - DNA, 15 bp, Homo sapiens
ctcacttagatgtag

SEQ ID NO: 476005 - DNA, 15 bp, Homo sapiens
tcacttagatgtaga

SEQ ID NO: 476006 - DNA, 15 bp, Homo sapiens
cacttagatgtagac

SEQ ID NO: 476007 - DNA, 15 bp, Homo sapiens
acttagatgtagacc

SEQ ID NO: 476008 - DNA, 15 bp, Homo sapiens
cttagatgtagacca

SEQ ID NO: 476009 - DNA, 15 bp, Homo sapiens
ttagatgtagaccaa

SEQ ID NO: 476010 - DNA, 15 bp, Homo sapiens
tagatgtagaccaac

SEQ ID NO: 476011 - DNA, 15 bp, Homo sapiens
agatgtagaccaact

SEQ ID NO: 476012 - DNA, 15 bp, Homo sapiens
gatgtagaccaacta

SEQ ID NO: 476013 - DNA, 15 bp, Homo sapiens
atgtagaccaactag

SEQ ID NO: 476014 - DNA, 15 bp, Homo sapiens
tgtagaccaactaga

SEQ ID NO: 476015 - DNA, 15 bp, Homo sapiens
gtagaccaactagag

SEQ ID NO: 476016 - DNA, 15 bp, Homo sapiens
tagaccaactagagg

SEQ ID NO: 476017 - DNA, 15 bp, Homo sapiens
agaccaactagaggg

SEQ ID NO: 476018 - DNA, 15 bp, Homo sapiens
gaccaactagagggt

SEQ ID NO: 476019 - DNA, 15 bp, Homo sapiens
accaactagagggtt

SEQ ID NO: 476020 - DNA, 15 bp, Homo sapiens
ccaactagagggtta

SEQ ID NO: 476021 - DNA, 15 bp, Homo sapiens
caactagagggttaa

SEQ ID NO: 476022 - DNA, 15 bp, Homo sapiens
aactagagggttaag

SEQ ID NO: 476023 - DNA, 15 bp, Homo sapiens
actagagggttaagg

SEQ ID NO: 476024 - DNA, 15 bp, Homo sapiens
ctagagggttaagga

SEQ ID NO: 476025 - DNA, 15 bp, Homo sapiens
tagagggttaaggaa

SEQ ID NO: 476026 - DNA, 15 bp, Homo sapiens
agagggttaaggaaa

SEQ ID NO: 476027 - DNA, 15 bp, Homo sapiens
gagggttaaggaaag

SEQ ID NO: 476028 - DNA, 15 bp, Homo sapiens
agggttaaggaaagc

SEQ ID NO: 476029 - DNA, 15 bp, Homo sapiens
gggttaaggaaagcc

SEQ ID NO: 476030 - DNA, 15 bp, Homo sapiens
ggttaaggaaagcct

SEQ ID NO: 476031 - DNA, 15 bp, Homo sapiens
gttaaggaaagccta

SEQ ID NO: 476032 - DNA, 15 bp, Homo sapiens
ttaaggaaagcctag

SEQ ID NO: 476033 - DNA, 15 bp, Homo sapiens
taaggaaagcctagg

SEQ ID NO: 476034 - DNA, 15 bp, Homo sapiens
aaggaaagcctaggt

SEQ ID NO: 476035 - DNA, 15 bp, Homo sapiens
aggaaagcctaggtc

SEQ ID NO: 476036 - DNA, 15 bp, Homo sapiens
ggaaagcctaggtct

SEQ ID NO: 476037 - DNA, 15 bp, Homo sapiens
gaaagcctaggtctg

SEQ ID NO: 476038 - DNA, 15 bp, Homo sapiens
aaagcctaggtctgg

SEQ ID NO: 476039 - DNA, 15 bp, Homo sapiens
aagcctaggtctggg

SEQ ID NO: 476040 - DNA, 15 bp, Homo sapiens
agcctaggtctggga

SEQ ID NO: 476041 - DNA, 15 bp, Homo sapiens
gcctaggtctgggag

SEQ ID NO: 476042 - DNA, 15 bp, Homo sapiens
cctaggtctgggagc

SEQ ID NO: 476043 - DNA, 15 bp, Homo sapiens
ctaggtctgggagct

SEQ ID NO: 476044 - DNA, 15 bp, Homo sapiens
taggtctgggagctc

SEQ ID NO: 476045 - DNA, 15 bp, Homo sapiens
aggtctgggagctca

SEQ ID NO: 476046 - DNA, 15 bp, Homo sapiens
ggtctgggagctcaa

SEQ ID NO: 476047 - DNA, 15 bp, Homo sapiens
gtctgggagctcaat

SEQ ID NO: 476048 - DNA, 15 bp, Homo sapiens
tctgggagctcaatt

SEQ ID NO: 476049 - DNA, 15 bp, Homo sapiens
ctgggagctcaatta

SEQ ID NO: 476050 - DNA, 15 bp, Homo sapiens
tgggagctcaattag

SEQ ID NO: 476051 - DNA, 15 bp, Homo sapiens
gggagctcaattaga

SEQ ID NO: 476052 - DNA, 15 bp, Homo sapiens
ggagctcaattagaa

SEQ ID NO: 476053 - DNA, 15 bp, Homo sapiens
gagctcaattagaag

SEQ ID NO: 476054 - DNA, 15 bp, Homo sapiens
agctcaattagaaga

SEQ ID NO: 476055 - DNA, 15 bp, Homo sapiens
gctcaattagaagat

SEQ ID NO: 476056 - DNA, 15 bp, Homo sapiens
ctcaattagaagatt

SEQ ID NO: 476057 - DNA, 15 bp, Homo sapiens
tcaattagaagatta

SEQ ID NO: 476058 - DNA, 15 bp, Homo sapiens
caattagaagattag

SEQ ID NO: 476059 - DNA, 15 bp, Homo sapiens
aattagaagattagg

SEQ ID NO: 476060 - DNA, 15 bp, Homo sapiens
attagaagattaggt

SEQ ID NO: 476061 - DNA, 15 bp, Homo sapiens
ttagaagattaggtc

SEQ ID NO: 476062 - DNA, 15 bp, Homo sapiens
tagaagattaggtca

SEQ ID NO: 476063 - DNA, 15 bp, Homo sapiens
agaagattaggtcag

SEQ ID NO: 476064 - DNA, 15 bp, Homo sapiens
gaagattaggtcagt

SEQ ID NO: 476065 - DNA, 15 bp, Homo sapiens
aagattaggtcagtt

SEQ ID NO: 476066 - DNA, 15 bp, Homo sapiens
agattaggtcagtta

SEQ ID NO: 476067 - DNA, 15 bp, Homo sapiens
gattaggtcagttag

SEQ ID NO: 476068 - DNA, 15 bp, Homo sapiens
attaggtcagttagg

SEQ ID NO: 476069 - DNA, 15 bp, Homo sapiens
ttaggtcagttagga

SEQ ID NO: 476070 - DNA, 15 bp, Homo sapiens
taggtcagttaggag

SEQ ID NO: 476071 - DNA, 15 bp, Homo sapiens
aggtcagttaggaga

SEQ ID NO: 476072 - DNA, 15 bp, Homo sapiens
ggtcagttaggagac

SEQ ID NO: 476073 - DNA, 15 bp, Homo sapiens
gtcagttaggagact

SEQ ID NO: 476074 - DNA, 15 bp, Homo sapiens
tcagttaggagactt

SEQ ID NO: 476075 - DNA, 15 bp, Homo sapiens
cagttaggagacttt

SEQ ID NO: 476076 - DNA, 15 bp, Homo sapiens
agttaggagacttta

SEQ ID NO: 476077 - DNA, 15 bp, Homo sapiens
gttaggagactttac

SEQ ID NO: 476078 - DNA, 15 bp, Homo sapiens
ttaggagactttaca

SEQ ID NO: 476079 - DNA, 15 bp, Homo sapiens
taggagactttacaa

SEQ ID NO: 476080 - DNA, 15 bp, Homo sapiens
aggagactttacaac

SEQ ID NO: 476081 - DNA, 15 bp, Homo sapiens
ggagactttacaaca

SEQ ID NO: 476082 - DNA, 15 bp, Homo sapiens
gagactttacaacat

SEQ ID NO: 476083 - DNA, 15 bp, Homo sapiens
agactttacaacatg

SEQ ID NO: 476084 - DNA, 15 bp, Homo sapiens
gactttacaacatgg

SEQ ID NO: 476085 - DNA, 15 bp, Homo sapiens
actttacaacatggc

SEQ ID NO: 476086 - DNA, 15 bp, Homo sapiens
ctttacaacatggcg

SEQ ID NO: 476087 - DNA, 15 bp, Homo sapiens
tttacaacatggcgt

SEQ ID NO: 476088 - DNA, 15 bp, Homo sapiens
ttacaacatggcgta

SEQ ID NO: 476089 - DNA, 15 bp, Homo sapiens
tacaacatggcgtaa

SEQ ID NO: 476090 - DNA, 15 bp, Homo sapiens
acaacatggcgtaag

SEQ ID NO: 476091 - DNA, 15 bp, Homo sapiens
caacatggcgtaaga

SEQ ID NO: 476092 - DNA, 15 bp, Homo sapiens
aacatggcgtaagat

SEQ ID NO: 476093 - DNA, 15 bp, Homo sapiens
acatggcgtaagata

SEQ ID NO: 476094 - DNA, 15 bp, Homo sapiens
catggcgtaagataa

SEQ ID NO: 476095 - DNA, 15 bp, Homo sapiens
atggcgtaagataaa

SEQ ID NO: 476096 - DNA, 15 bp, Homo sapiens
tggcgtaagataaag

SEQ ID NO: 476097 - DNA, 15 bp, Homo sapiens
ggcgtaagataaagg

SEQ ID NO: 476098 - DNA, 15 bp, Homo sapiens
gcgtaagataaaggc

SEQ ID NO: 476099 - DNA, 15 bp, Homo sapiens
cgtaagataaaggcc

SEQ ID NO: 476100 - DNA, 15 bp, Homo sapiens
gtaagataaaggcct

SEQ ID NO: 476101 - DNA, 15 bp, Homo sapiens
taagataaaggccta

SEQ ID NO: 476102 - DNA, 15 bp, Homo sapiens
aagataaaggcctac

SEQ ID NO: 476103 - DNA, 15 bp, Homo sapiens
agataaaggcctaca

SEQ ID NO: 476104 - DNA, 15 bp, Homo sapiens
gataaaggcctacag

SEQ ID NO: 476105 - DNA, 15 bp, Homo sapiens
ataaaggcctacagg

SEQ ID NO: 476106 - DNA, 15 bp, Homo sapiens
taaaggcctacaggc

SEQ ID NO: 476107 - DNA, 15 bp, Homo sapiens
aaaggcctacaggca

SEQ ID NO: 476108 - DNA, 15 bp, Homo sapiens
aaggcctacaggcat

SEQ ID NO: 476109 - DNA, 15 bp, Homo sapiens
aggcctacaggcatt

SEQ ID NO: 476110 - DNA, 15 bp, Homo sapiens
ggcctacaggcatta

SEQ ID NO: 476111 - DNA, 15 bp, Homo sapiens
gcctacaggcattaa

SEQ ID NO: 476112 - DNA, 15 bp, Homo sapiens
cctacaggcattaag

SEQ ID NO: 476113 - DNA, 15 bp, Homo sapiens
ctacaggcattaagg

SEQ ID NO: 476114 - DNA, 15 bp, Homo sapiens
tacaggcattaaggc

SEQ ID NO: 476115 - DNA, 15 bp, Homo sapiens
acaggcattaaggca

SEQ ID NO: 476116 - DNA, 15 bp, Homo sapiens
caggcattaaggcag

SEQ ID NO: 476117 - DNA, 15 bp, Homo sapiens
aggcattaaggcagt

SEQ ID NO: 476118 - DNA, 15 bp, Homo sapiens
ggcattaaggcagtg

SEQ ID NO: 476119 - DNA, 15 bp, Homo sapiens
gcattaaggcagtgg

SEQ ID NO: 476120 - DNA, 15 bp, Homo sapiens
cattaaggcagtggt

SEQ ID NO: 476121 - DNA, 15 bp, Homo sapiens
attaaggcagtggtg

SEQ ID NO: 476122 - DNA, 15 bp, Homo sapiens
ttaaggcagtggtga

SEQ ID NO: 476123 - DNA, 15 bp, Homo sapiens
taaggcagtggtgat

SEQ ID NO: 476124 - DNA, 15 bp, Homo sapiens
aaggcagtggtgata

SEQ ID NO: 476125 - DNA, 15 bp, Homo sapiens
aggcagtggtgatag

SEQ ID NO: 476126 - DNA, 15 bp, Homo sapiens
ggcagtggtgataga

SEQ ID NO: 476127 - DNA, 15 bp, Homo sapiens
gcagtggtgatagaa

SEQ ID NO: 476128 - DNA, 15 bp, Homo sapiens
cagtggtgatagaaa

SEQ ID NO: 476129 - DNA, 15 bp, Homo sapiens
agtggtgatagaaag

SEQ ID NO: 476130 - DNA, 15 bp, Homo sapiens
gtggtgatagaaagg

SEQ ID NO: 476131 - DNA, 15 bp, Homo sapiens
tggtgatagaaaggt

SEQ ID NO: 476132 - DNA, 15 bp, Homo sapiens
ggtgatagaaaggta

SEQ ID NO: 476133 - DNA, 15 bp, Homo sapiens
gtgatagaaaggtag

SEQ ID NO: 476134 - DNA, 15 bp, Homo sapiens
tgatagaaaggtagc

SEQ ID NO: 476135 - DNA, 15 bp, Homo sapiens
gatagaaaggtagct

SEQ ID NO: 476136 - DNA, 15 bp, Homo sapiens
atagaaaggtagctc

SEQ ID NO: 476137 - DNA, 15 bp, Homo sapiens
tagaaaggtagctca

SEQ ID NO: 476138 - DNA, 15 bp, Homo sapiens
agaaaggtagctcaa

SEQ ID NO: 476139 - DNA, 15 bp, Homo sapiens
gaaaggtagctcaac

SEQ ID NO: 476140 - DNA, 15 bp, Homo sapiens
aaaggtagctcaaca

SEQ ID NO: 476141 - DNA, 15 bp, Homo sapiens
aaggtagctcaacat

SEQ ID NO: 476142 - DNA, 15 bp, Homo sapiens
aggtagctcaacatg

SEQ ID NO: 476143 - DNA, 15 bp, Homo sapiens
ggtagctcaacatga

SEQ ID NO: 476144 - DNA, 15 bp, Homo sapiens
gtagctcaacatgaa

SEQ ID NO: 476145 - DNA, 15 bp, Homo sapiens
tagctcaacatgaaa

SEQ ID NO: 476146 - DNA, 15 bp, Homo sapiens
agctcaacatgaaac

SEQ ID NO: 476147 - DNA, 15 bp, Homo sapiens
gctcaacatgaaacg

SEQ ID NO: 476148 - DNA, 15 bp, Homo sapiens
ctcaacatgaaacgt

SEQ ID NO: 476149 - DNA, 15 bp, Homo sapiens
tcaacatgaaacgtt

SEQ ID NO: 476150 - DNA, 15 bp, Homo sapiens
caacatgaaacgttt

SEQ ID NO: 476151 - DNA, 15 bp, Homo sapiens
aacatgaaacgtttt

SEQ ID NO: 476152 - DNA, 15 bp, Homo sapiens
acatgaaacgtttta

SEQ ID NO: 476153 - DNA, 15 bp, Homo sapiens
catgaaacgttttag

SEQ ID NO: 476154 - DNA, 15 bp, Homo sapiens
atgaaacgttttagt

SEQ ID NO: 476155 - DNA, 15 bp, Homo sapiens
tgaaacgttttagtt

SEQ ID NO: 476156 - DNA, 15 bp, Homo sapiens
gaaacgttttagttt

SEQ ID NO: 476157 - DNA, 15 bp, Homo sapiens
aaacgttttagtttt

SEQ ID NO: 476158 - DNA, 15 bp, Homo sapiens
aacgttttagtttta

SEQ ID NO: 476159 - DNA, 15 bp, Homo sapiens
acgttttagttttac

SEQ ID NO: 476160 - DNA, 15 bp, Homo sapiens
cgttttagttttaca

SEQ ID NO: 476161 - DNA, 15 bp, Homo sapiens
gttttagttttacag

SEQ ID NO: 476162 - DNA, 15 bp, Homo sapiens
ttttagttttacagt

SEQ ID NO: 476163 - DNA, 15 bp, Homo sapiens
tttagttttacagtc

SEQ ID NO: 476164 - DNA, 15 bp, Homo sapiens
ttagttttacagtcg

SEQ ID NO: 476165 - DNA, 15 bp, Homo sapiens
tagttttacagtcgt

SEQ ID NO: 476166 - DNA, 15 bp, Homo sapiens
agttttacagtcgtg

SEQ ID NO: 476167 - DNA, 15 bp, Homo sapiens
gttttacagtcgtgt

SEQ ID NO: 476168 - DNA, 15 bp, Homo sapiens
ttttacagtcgtgtt

SEQ ID NO: 476169 - DNA, 15 bp, Homo sapiens
tttacagtcgtgtta

SEQ ID NO: 476170 - DNA, 15 bp, Homo sapiens
ttacagtcgtgttag

SEQ ID NO: 476171 - DNA, 15 bp, Homo sapiens
tacagtcgtgttagg

SEQ ID NO: 476172 - DNA, 15 bp, Homo sapiens
acagtcgtgttagga

SEQ ID NO: 476173 - DNA, 15 bp, Homo sapiens
cagtcgtgttaggag

SEQ ID NO: 476174 - DNA, 15 bp, Homo sapiens
agtcgtgttaggaga

SEQ ID NO: 476175 - DNA, 15 bp, Homo sapiens
gtcgtgttaggagat

SEQ ID NO: 476176 - DNA, 15 bp, Homo sapiens
tcgtgttaggagatt

SEQ ID NO: 476177 - DNA, 15 bp, Homo sapiens
cgtgttaggagattt

SEQ ID NO: 476178 - DNA, 15 bp, Homo sapiens
gtgttaggagatttg

SEQ ID NO: 476179 - DNA, 15 bp, Homo sapiens
tgttaggagatttgg

SEQ ID NO: 476180 - DNA, 15 bp, Homo sapiens
gttaggagatttgga

SEQ ID NO: 476181 - DNA, 15 bp, Homo sapiens
ttaggagatttggat

SEQ ID NO: 476182 - DNA, 15 bp, Homo sapiens
taggagatttggatc

SEQ ID NO: 476183 - DNA, 15 bp, Homo sapiens
aggagatttggatct

SEQ ID NO: 476184 - DNA, 15 bp, Homo sapiens
ggagatttggatctt

SEQ ID NO: 476185 - DNA, 15 bp, Homo sapiens
gagatttggatcttt

SEQ ID NO: 476186 - DNA, 15 bp, Homo sapiens
agatttggatctttc

SEQ ID NO: 476187 - DNA, 15 bp, Homo sapiens
gatttggatctttct

SEQ ID NO: 476188 - DNA, 15 bp, Homo sapiens
atttggatctttcta

SEQ ID NO: 476189 - DNA, 15 bp, Homo sapiens
tttggatctttctat

SEQ ID NO: 476190 - DNA, 15 bp, Homo sapiens
ttggatctttctatg

SEQ ID NO: 476191 - DNA, 15 bp, Homo sapiens
tggatctttctatgt

SEQ ID NO: 476192 - DNA, 15 bp, Homo sapiens
ggatctttctatgtt

SEQ ID NO: 476193 - DNA, 15 bp, Homo sapiens
gatctttctatgttt

SEQ ID NO: 476194 - DNA, 15 bp, Homo sapiens
atctttctatgtttt

SEQ ID NO: 476195 - DNA, 15 bp, Homo sapiens
tctttctatgttttg

SEQ ID NO: 476196 - DNA, 15 bp, Homo sapiens
ctttctatgttttgt

SEQ ID NO: 476197 - DNA, 15 bp, Homo sapiens
tttctatgttttgtc

SEQ ID NO: 476198 - DNA, 15 bp, Homo sapiens
ttctatgttttgtca

SEQ ID NO: 476199 - DNA, 15 bp, Homo sapiens
tctatgttttgtcag

SEQ ID NO: 476200 - DNA, 15 bp, Homo sapiens
ctatgttttgtcaga

SEQ ID NO: 476201 - DNA, 15 bp, Homo sapiens
tatgttttgtcagaa

SEQ ID NO: 476202 - DNA, 15 bp, Homo sapiens
atgttttgtcagaat

SEQ ID NO: 476203 - DNA, 15 bp, Homo sapiens
tgttttgtcagaatt

SEQ ID NO: 476204 - DNA, 15 bp, Homo sapiens
gttttgtcagaattt

SEQ ID NO: 476205 - DNA, 15 bp, Homo sapiens
ttttgtcagaatttt

SEQ ID NO: 476206 - DNA, 15 bp, Homo sapiens
tttgtcagaattttg

SEQ ID NO: 476207 - DNA, 15 bp, Homo sapiens
ttgtcagaattttga

SEQ ID NO: 476208 - DNA, 15 bp, Homo sapiens
tgtcagaattttgac

SEQ ID NO: 476209 - DNA, 15 bp, Homo sapiens
gtcagaattttgaca

SEQ ID NO: 476210 - DNA, 15 bp, Homo sapiens
tcagaattttgacaa

SEQ ID NO: 476211 - DNA, 15 bp, Homo sapiens
cagaattttgacaat

SEQ ID NO: 476212 - DNA, 15 bp, Homo sapiens
agaattttgacaatt

SEQ ID NO: 476213 - DNA, 15 bp, Homo sapiens
gaattttgacaattt

SEQ ID NO: 476214 - DNA, 15 bp, Homo sapiens
aattttgacaattta

SEQ ID NO: 476215 - DNA, 15 bp, Homo sapiens
attttgacaatttaa

SEQ ID NO: 476216 - DNA, 15 bp, Homo sapiens
ttttgacaatttaaa

SEQ ID NO: 476217 - DNA, 15 bp, Homo sapiens
tttgacaatttaaaa

SEQ ID NO: 476218 - DNA, 15 bp, Homo sapiens
ttgacaatttaaaaa

SEQ ID NO: 476219 - DNA, 15 bp, Homo sapiens
tgacaatttaaaaat

SEQ ID NO: 476220 - DNA, 15 bp, Homo sapiens
gacaatttaaaaatg

SEQ ID NO: 476221 - DNA, 15 bp, Homo sapiens
acaatttaaaaatga

SEQ ID NO: 476222 - DNA, 15 bp, Homo sapiens
caatttaaaaatgat

SEQ ID NO: 476223 - DNA, 15 bp, Homo sapiens
aatttaaaaatgatt

SEQ ID NO: 476224 - DNA, 15 bp, Homo sapiens
atttaaaaatgatta

SEQ ID NO: 476225 - DNA, 15 bp, Homo sapiens
tttaaaaatgattaa

SEQ ID NO: 476226 - DNA, 15 bp, Homo sapiens
ttaaaaatgattaag

SEQ ID NO: 476227 - DNA, 15 bp, Homo sapiens
taaaaatgattaagg

SEQ ID NO: 476228 - DNA, 15 bp, Homo sapiens
aaaaatgattaagga

SEQ ID NO: 476229 - DNA, 15 bp, Homo sapiens
aaaatgattaaggat

SEQ ID NO: 476230 - DNA, 15 bp, Homo sapiens
aaatgattaaggatg

SEQ ID NO: 476231 - DNA, 15 bp, Homo sapiens
aatgattaaggatgt

SEQ ID NO: 476232 - DNA, 15 bp, Homo sapiens
atgattaaggatgta

SEQ ID NO: 476233 - DNA, 15 bp, Homo sapiens
tgattaaggatgtac

SEQ ID NO: 476234 - DNA, 15 bp, Homo sapiens
gattaaggatgtacg

SEQ ID NO: 476235 - DNA, 15 bp, Homo sapiens
attaaggatgtacgt

SEQ ID NO: 476236 - DNA, 15 bp, Homo sapiens
ttaaggatgtacgtc

SEQ ID NO: 476237 - DNA, 15 bp, Homo sapiens
taaggatgtacgtcc

SEQ ID NO: 476238 - DNA, 15 bp, Homo sapiens
aaggatgtacgtcca

SEQ ID NO: 476239 - DNA, 15 bp, Homo sapiens
aggatgtacgtccaa

SEQ ID NO: 476240 - DNA, 15 bp, Homo sapiens
ggatgtacgtccaat

SEQ ID NO: 476241 - DNA, 15 bp, Homo sapiens
gatgtacgtccaatt

SEQ ID NO: 476242 - DNA, 15 bp, Homo sapiens
atgtacgtccaattg

SEQ ID NO: 476243 - DNA, 15 bp, Homo sapiens
tgtacgtccaattga

SEQ ID NO: 476244 - DNA, 15 bp, Homo sapiens
gtacgtccaattgac

SEQ ID NO: 476245 - DNA, 15 bp, Homo sapiens
tacgtccaattgacc

SEQ ID NO: 476246 - DNA, 15 bp, Homo sapiens
acgtccaattgacca

SEQ ID NO: 476247 - DNA, 15 bp, Homo sapiens
cgtccaattgaccat

SEQ ID NO: 476248 - DNA, 15 bp, Homo sapiens
gtccaattgaccatg

SEQ ID NO: 476249 - DNA, 15 bp, Homo sapiens
tccaattgaccatgt

SEQ ID NO: 476250 - DNA, 15 bp, Homo sapiens
ccaattgaccatgtc

SEQ ID NO: 476251 - DNA, 15 bp, Homo sapiens
caattgaccatgtcc

SEQ ID NO: 476252 - DNA, 15 bp, Homo sapiens
aattgaccatgtcct

SEQ ID NO: 476253 - DNA, 15 bp, Homo sapiens
attgaccatgtccta

SEQ ID NO: 476254 - DNA, 15 bp, Homo sapiens
ttgaccatgtcctat

SEQ ID NO: 476255 - DNA, 15 bp, Homo sapiens
tgaccatgtcctata

SEQ ID NO: 476256 - DNA, 15 bp, Homo sapiens
gaccatgtcctatat

SEQ ID NO: 476257 - DNA, 15 bp, Homo sapiens
accatgtcctatatg

SEQ ID NO: 476258 - DNA, 15 bp, Homo sapiens
ccatgtcctatatgg

SEQ ID NO: 476259 - DNA, 15 bp, Homo sapiens
catgtcctatatggc

SEQ ID NO: 476260 - DNA, 15 bp, Homo sapiens
atgtcctatatggcc

SEQ ID NO: 476261 - DNA, 15 bp, Homo sapiens
tgtcctatatggcca

SEQ ID NO: 476262 - DNA, 15 bp, Homo sapiens
gtcctatatggccat

SEQ ID NO: 476263 - DNA, 15 bp, Homo sapiens
tcctatatggccatg

SEQ ID NO: 476264 - DNA, 15 bp, Homo sapiens
cctatatggccatgt

SEQ ID NO: 476265 - DNA, 15 bp, Homo sapiens
ctatatggccatgtt

SEQ ID NO: 476266 - DNA, 15 bp, Homo sapiens
tatatggccatgttg

SEQ ID NO: 476267 - DNA, 15 bp, Homo sapiens
atatggccatgttgt

SEQ ID NO: 476268 - DNA, 15 bp, Homo sapiens
tatggccatgttgtc

SEQ ID NO: 476269 - DNA, 15 bp, Homo sapiens
atggccatgttgtct

SEQ ID NO: 476270 - DNA, 15 bp, Homo sapiens
tggccatgttgtcta

SEQ ID NO: 476271 - DNA, 15 bp, Homo sapiens
ggccatgttgtctaa

SEQ ID NO: 476272 - DNA, 15 bp, Homo sapiens
gccatgttgtctaac

SEQ ID NO: 476273 - DNA, 15 bp, Homo sapiens
ccatgttgtctaacc

SEQ ID NO: 476274 - DNA, 15 bp, Homo sapiens
catgttgtctaacct

SEQ ID NO: 476275 - DNA, 15 bp, Homo sapiens
atgttgtctaacctc

SEQ ID NO: 476276 - DNA, 15 bp, Homo sapiens
tgttgtctaacctcc

SEQ ID NO: 476277 - DNA, 15 bp, Homo sapiens
gttgtctaacctcct

SEQ ID NO: 476278 - DNA, 15 bp, Homo sapiens
ttgtctaacctcctt

SEQ ID NO: 476279 - DNA, 15 bp, Homo sapiens
tgtctaacctcctta

SEQ ID NO: 476280 - DNA, 15 bp, Homo sapiens
gtctaacctccttat

SEQ ID NO: 476281 - DNA, 15 bp, Homo sapiens
tctaacctccttatt

SEQ ID NO: 476282 - DNA, 15 bp, Homo sapiens
ctaacctccttattt

SEQ ID NO: 476283 - DNA, 15 bp, Homo sapiens
taacctccttatttt

SEQ ID NO: 476284 - DNA, 15 bp, Homo sapiens
aacctccttattttt

SEQ ID NO: 476285 - DNA, 15 bp, Homo sapiens
acctccttattttta

SEQ ID NO: 476286 - DNA, 15 bp, Homo sapiens
cctccttatttttat

SEQ ID NO: 476287 - DNA, 15 bp, Homo sapiens
ctccttatttttatt

SEQ ID NO: 476288 - DNA, 15 bp, Homo sapiens
tccttatttttattt

SEQ ID NO: 476289 - DNA, 15 bp, Homo sapiens
ccttatttttatttt

SEQ ID NO: 476290 - DNA, 15 bp, Homo sapiens
cttatttttattttg

SEQ ID NO: 476291 - DNA, 15 bp, Homo sapiens
ttatttttattttgc

SEQ ID NO: 476292 - DNA, 15 bp, Homo sapiens
tatttttattttgca

SEQ ID NO: 476293 - DNA, 15 bp, Homo sapiens
atttttattttgcag

SEQ ID NO: 476294 - DNA, 15 bp, Homo sapiens
tttttattttgcaga

SEQ ID NO: 476295 - DNA, 15 bp, Homo sapiens
ttttattttgcagac

SEQ ID NO: 476296 - DNA, 15 bp, Homo sapiens
tttattttgcagact

SEQ ID NO: 476297 - DNA, 15 bp, Homo sapiens
ttattttgcagactg

SEQ ID NO: 476298 - DNA, 15 bp, Homo sapiens
tattttgcagactgg

SEQ ID NO: 476299 - DNA, 15 bp, Homo sapiens
attttgcagactggc

SEQ ID NO: 476300 - DNA, 15 bp, Homo sapiens
ttttgcagactggcc

SEQ ID NO: 476301 - DNA, 15 bp, Homo sapiens
tttgcagactggccc

SEQ ID NO: 476302 - DNA, 15 bp, Homo sapiens
ttgcagactggccca

SEQ ID NO: 476303 - DNA, 15 bp, Homo sapiens
tgcagactggcccag

SEQ ID NO: 476304 - DNA, 15 bp, Homo sapiens
gcagactggcccaga

SEQ ID NO: 476305 - DNA, 15 bp, Homo sapiens
cagactggcccagat

SEQ ID NO: 476306 - DNA, 15 bp, Homo sapiens
agactggcccagatg

SEQ ID NO: 476307 - DNA, 15 bp, Homo sapiens
gactggcccagatgg
